United States Patent 12,043,843 (MATERIALS AND METHODS FOR TREATMENT OF HEMOGLOBINOPATHIES) - sequence listing, part 2

SEQ ID NO: 32273 - DNA, 20 bp, Artificial Sequence
  chemically synthesized
tttcctgaagtatgatcata

SEQ ID NO: 32274 - DNA, 20 bp, Artificial Sequence
  chemically synthesized
cttctgtctgctcattgaac

SEQ ID NO: 32275 - DNA, 20 bp, Artificial Sequence
  chemically synthesized
tctgtctgctcattgaacca

SEQ ID NO: 32276 - DNA, 20 bp, Artificial Sequence
  chemically synthesized
tgctcattgaaccagagctc

SEQ ID NO: 32277 - DNA, 20 bp, Artificial Sequence
  chemically synthesized
gctcattgaaccagagctcc

SEQ ID NO: 32278 - DNA, 20 bp, Artificial Sequence
  chemically synthesized
ctccaggaccaataccacta

SEQ ID NO: 32279 - DNA, 20 bp, Artificial Sequence
  chemically synthesized
tcttttgcctctacaactct

SEQ ID NO: 32280 - DNA, 20 bp, Artificial Sequence
  chemically synthesized
cttttgcctctacaactctc

SEQ ID NO: 32281 - DNA, 20 bp, Artificial Sequence
  chemically synthesized
cctctacaactctcaggtca

SEQ ID NO: 32282 - DNA, 20 bp, Artificial Sequence
  chemically synthesized
gctgaaatattacctcctct

SEQ ID NO: 32283 - DNA, 20 bp, Artificial Sequence
  chemically synthesized
agaacccgcatttgtcacac

SEQ ID NO: 32284 - DNA, 20 bp, Artificial Sequence
  chemically synthesized
caaattttttctttctttca

SEQ ID NO: 32285 - DNA, 20 bp, Artificial Sequence
  chemically synthesized
attttttctttctttcatag

SEQ ID NO: 32286 - DNA, 20 bp, Artificial Sequence
  chemically synthesized
ttctttcatagcagctatat

SEQ ID NO: 32287 - DNA, 20 bp, Artificial Sequence
  chemically synthesized
tctttcatagcagctatatg

SEQ ID NO: 32288 - DNA, 20 bp, Artificial Sequence
  chemically synthesized
tttcctttccgttaaaatac

SEQ ID NO: 32289 - DNA, 20 bp, Artificial Sequence
  chemically synthesized
ccgttaaaatacaagcttca

SEQ ID NO: 32290 - DNA, 20 bp, Artificial Sequence
  chemically synthesized
cgttaaaatacaagcttcat

SEQ ID NO: 32291 - DNA, 20 bp, Artificial Sequence
  chemically synthesized
aaatacaagcttcataggaa

SEQ ID NO: 32292 - DNA, 20 bp, Artificial Sequence
  chemically synthesized
atacaagcttcataggaaca

SEQ ID NO: 32293 - DNA, 20 bp, Artificial Sequence
  chemically synthesized
caccaatgtatttttgtacc

SEQ ID NO: 32294 - DNA, 20 bp, Artificial Sequence
  chemically synthesized
caatgtatttttgtacccag

SEQ ID NO: 32295 - DNA, 20 bp, Artificial Sequence
  chemically synthesized
gtacccagtagttgctaaaa

SEQ ID NO: 32296 - DNA, 20 bp, Artificial Sequence
  chemically synthesized
acccagtagttgctaaaata

SEQ ID NO: 32297 - DNA, 20 bp, Artificial Sequence
  chemically synthesized
cagtagttgctaaaatagag

SEQ ID NO: 32298 - DNA, 20 bp, Artificial Sequence
  chemically synthesized
aaaatagagaagcctctcat

SEQ ID NO: 32299 - DNA, 20 bp, Artificial Sequence
  chemically synthesized
gcttgttaaataaatgtatt

SEQ ID NO: 32300 - DNA, 20 bp, Artificial Sequence
  chemically synthesized
ctattattcatttctaaaca

SEQ ID NO: 32301 - DNA, 20 bp, Artificial Sequence
  chemically synthesized
tattcatttctaaacacaga

SEQ ID NO: 32302 - DNA, 20 bp, Artificial Sequence
  chemically synthesized
ttcatttctaaacacagaaa

SEQ ID NO: 32303 - DNA, 20 bp, Artificial Sequence
  chemically synthesized
tttctaaacacagaaagagt

SEQ ID NO: 32304 - DNA, 20 bp, Artificial Sequence
  chemically synthesized
taaacacagaaagagtgaga

SEQ ID NO: 32305 - DNA, 20 bp, Artificial Sequence
  chemically synthesized
aaacacagaaagagtgagaa

SEQ ID NO: 32306 - DNA, 20 bp, Artificial Sequence
  chemically synthesized
aacacagaaagagtgagaaa

SEQ ID NO: 32307 - DNA, 20 bp, Artificial Sequence
  chemically synthesized
cacagaaagagtgagaaagg

SEQ ID NO: 32308 - DNA, 20 bp, Artificial Sequence
  chemically synthesized
gaaagagtgagaaagggaga

SEQ ID NO: 32309 - DNA, 20 bp, Artificial Sequence
  chemically synthesized
gagtgagaaagggagaaaga

SEQ ID NO: 32310 - DNA, 20 bp, Artificial Sequence
  chemically synthesized
gagaaagggagaaagacaga

SEQ ID NO: 32311 - DNA, 20 bp, Artificial Sequence
  chemically synthesized
aagggagaaagacagaaagt

SEQ ID NO: 32312 - DNA, 20 bp, Artificial Sequence
  chemically synthesized
aagacagaaagtaagaatga

SEQ ID NO: 32313 - DNA, 20 bp, Artificial Sequence
  chemically synthesized
cagaaagtaagaatgaaaga

SEQ ID NO: 32314 - DNA, 20 bp, Artificial Sequence
  chemically synthesized
gaaagtaagaatgaaagaaa

SEQ ID NO: 32315 - DNA, 20 bp, Artificial Sequence
  chemically synthesized
aagtaagaatgaaagaaaga

SEQ ID NO: 32316 - DNA, 20 bp, Artificial Sequence
  chemically synthesized
aagaatgaaagaaagagagt

SEQ ID NO: 32317 - DNA, 20 bp, Artificial Sequence
  chemically synthesized
gaaagaaagagagtgagata

SEQ ID NO: 32318 - DNA, 20 bp, Artificial Sequence
  chemically synthesized
aaagagagtgagataaagaa

SEQ ID NO: 32319 - DNA, 20 bp, Artificial Sequence
  chemically synthesized
gataaagaatagatattttc

SEQ ID NO: 32320 - DNA, 20 bp, Artificial Sequence
  chemically synthesized
ttaaattattgccctcaaat

SEQ ID NO: 32321 - DNA, 20 bp, Artificial Sequence
  chemically synthesized
attattgccctcaaattgga

SEQ ID NO: 32322 - DNA, 20 bp, Artificial Sequence
  chemically synthesized
tattgccctcaaattggaca

SEQ ID NO: 32323 - DNA, 20 bp, Artificial Sequence
  chemically synthesized
taccaacaaatgatcctctg

SEQ ID NO: 32324 - DNA, 20 bp, Artificial Sequence
  chemically synthesized
attgctctgacctgacaacc

SEQ ID NO: 32325 - DNA, 20 bp, Artificial Sequence
  chemically synthesized
acctgacaacccagctattt

SEQ ID NO: 32326 - DNA, 20 bp, Artificial Sequence
  chemically synthesized
acaacccagctattttagtt

SEQ ID NO: 32327 - DNA, 20 bp, Artificial Sequence
  chemically synthesized
ctattttagtttagtctttg

SEQ ID NO: 32328 - DNA, 20 bp, Artificial Sequence
  chemically synthesized
atgcctatctcactttgctg

SEQ ID NO: 32329 - DNA, 20 bp, Artificial Sequence
  chemically synthesized
tgctgtagcatttccaatcc

SEQ ID NO: 32330 - DNA, 20 bp, Artificial Sequence
  chemically synthesized
gtagcatttccaatcctgga

SEQ ID NO: 32331 - DNA, 20 bp, Artificial Sequence
  chemically synthesized
catttccaatcctggacagt

SEQ ID NO: 32332 - DNA, 20 bp, Artificial Sequence
  chemically synthesized
atcctggacagtcagcataa

SEQ ID NO: 32333 - DNA, 20 bp, Artificial Sequence
  chemically synthesized
gtcacttatttaatatttca

SEQ ID NO: 32334 - DNA, 20 bp, Artificial Sequence
  chemically synthesized
aacattcaaaccttcaactt

SEQ ID NO: 32335 - DNA, 20 bp, Artificial Sequence
  chemically synthesized
acattcaaaccttcaacttt

SEQ ID NO: 32336 - DNA, 20 bp, Artificial Sequence
  chemically synthesized
aactttaggatttactataa

SEQ ID NO: 32337 - DNA, 20 bp, Artificial Sequence
  chemically synthesized
ataaatacattgatgattat

SEQ ID NO: 32338 - DNA, 20 bp, Artificial Sequence
  chemically synthesized
attatttttaaattacaact

SEQ ID NO: 32339 - DNA, 20 bp, Artificial Sequence
  chemically synthesized
atttttaaattacaacttgg

SEQ ID NO: 32340 - DNA, 20 bp, Artificial Sequence
  chemically synthesized
aattacaacttggtagcctc

SEQ ID NO: 32341 - DNA, 20 bp, Artificial Sequence
  chemically synthesized
attttctatatgcatttcta

SEQ ID NO: 32342 - DNA, 20 bp, Artificial Sequence
  chemically synthesized
ttctatatgcatttctatag

SEQ ID NO: 32343 - DNA, 20 bp, Artificial Sequence
  chemically synthesized
tatatgcatttctatagaag

SEQ ID NO: 32344 - DNA, 20 bp, Artificial Sequence
  chemically synthesized
gcacatgctgtacaaaccat

SEQ ID NO: 32345 - DNA, 20 bp, Artificial Sequence
  chemically synthesized
atgctgtacaaaccataaga

SEQ ID NO: 32346 - DNA, 20 bp, Artificial Sequence
  chemically synthesized
ctgtacaaaccataagatgg

SEQ ID NO: 32347 - DNA, 20 bp, Artificial Sequence
  chemically synthesized
tgtacaaaccataagatggc

SEQ ID NO: 32348 - DNA, 20 bp, Artificial Sequence
  chemically synthesized
tacaaaccataagatggcag

SEQ ID NO: 32349 - DNA, 20 bp, Artificial Sequence
  chemically synthesized
caaaccataagatggcagga

SEQ ID NO: 32350 - DNA, 20 bp, Artificial Sequence
  chemically synthesized
aaaccataagatggcaggag

SEQ ID NO: 32351 - DNA, 20 bp, Artificial Sequence
  chemically synthesized
aagatggcaggagaggtttg

SEQ ID NO: 32352 - DNA, 20 bp, Artificial Sequence
  chemically synthesized
ttgtggaacactgactctcc

SEQ ID NO: 32353 - DNA, 20 bp, Artificial Sequence
  chemically synthesized
tgtggaacactgactctcct

SEQ ID NO: 32354 - DNA, 20 bp, Artificial Sequence
  chemically synthesized
gtggaacactgactctcctg

SEQ ID NO: 32355 - DNA, 20 bp, Artificial Sequence
  chemically synthesized
ctgactctcctggggccatg

SEQ ID NO: 32356 - DNA, 20 bp, Artificial Sequence
  chemically synthesized
gactctcctggggccatgca

SEQ ID NO: 32357 - DNA, 20 bp, Artificial Sequence
  chemically synthesized
actctcctggggccatgcag

SEQ ID NO: 32358 - DNA, 20 bp, Artificial Sequence
  chemically synthesized
ctctcctggggccatgcaga

SEQ ID NO: 32359 - DNA, 20 bp, Artificial Sequence
  chemically synthesized
ctcctggggccatgcagagg

SEQ ID NO: 32360 - DNA, 20 bp, Artificial Sequence
  chemically synthesized
tcctggggccatgcagaggg

SEQ ID NO: 32361 - DNA, 20 bp, Artificial Sequence
  chemically synthesized
gccatgcagagggaggtttg

SEQ ID NO: 32362 - DNA, 20 bp, Artificial Sequence
  chemically synthesized
gtttgaagatcttgttgata

SEQ ID NO: 32363 - DNA, 20 bp, Artificial Sequence
  chemically synthesized
cttgttgatacagattgaca

SEQ ID NO: 32364 - DNA, 20 bp, Artificial Sequence
  chemically synthesized
cagattgacacagaatacca

SEQ ID NO: 32365 - DNA, 20 bp, Artificial Sequence
  chemically synthesized
tttccccactgcctttcctt

SEQ ID NO: 32366 - DNA, 20 bp, Artificial Sequence
  chemically synthesized
tttccttgagtaaaaatcct

SEQ ID NO: 32367 - DNA, 20 bp, Artificial Sequence
  chemically synthesized
tccctttctttctatgttga

SEQ ID NO: 32368 - DNA, 20 bp, Artificial Sequence
  chemically synthesized
atgttgatagcaaaaccaat

SEQ ID NO: 32369 - DNA, 20 bp, Artificial Sequence
  chemically synthesized
tgttgatagcaaaaccaatg

SEQ ID NO: 32370 - DNA, 20 bp, Artificial Sequence
  chemically synthesized
taacaactgttgacttattt

SEQ ID NO: 32371 - DNA, 20 bp, Artificial Sequence
  chemically synthesized
tgttgacttattttggattt

SEQ ID NO: 32372 - DNA, 20 bp, Artificial Sequence
  chemically synthesized
ttcactgtaacacaaaaatg

SEQ ID NO: 32373 - DNA, 20 bp, Artificial Sequence
  chemically synthesized
tgtaacacaaaaatgcagac

SEQ ID NO: 32374 - DNA, 20 bp, Artificial Sequence
  chemically synthesized
aacacaaaaatgcagacaag

SEQ ID NO: 32375 - DNA, 20 bp, Artificial Sequence
  chemically synthesized
cagacaagcagcactgattt

SEQ ID NO: 32376 - DNA, 20 bp, Artificial Sequence
  chemically synthesized
aagcagcactgattttagtg

SEQ ID NO: 32377 - DNA, 20 bp, Artificial Sequence
  chemically synthesized
ctgattttagtgtggcatca

SEQ ID NO: 32378 - DNA, 20 bp, Artificial Sequence
  chemically synthesized
gtgtggcatcatggaaataa

SEQ ID NO: 32379 - DNA, 20 bp, Artificial Sequence
  chemically synthesized
ggaaataacagtgctacaca

SEQ ID NO: 32380 - DNA, 20 bp, Artificial Sequence
  chemically synthesized
ctacacatagcccttgctac

SEQ ID NO: 32381 - DNA, 20 bp, Artificial Sequence
  chemically synthesized
tagcccttgctaccagccaa

SEQ ID NO: 32382 - DNA, 20 bp, Artificial Sequence
  chemically synthesized
agcccttgctaccagccaat

SEQ ID NO: 32383 - DNA, 20 bp, Artificial Sequence
  chemically synthesized
gccaataggactatttattt

SEQ ID NO: 32384 - DNA, 20 bp, Artificial Sequence
  chemically synthesized
tatatgtatatataaatgtg

SEQ ID NO: 32385 - DNA, 20 bp, Artificial Sequence
  chemically synthesized
gtatatataaatgtgtagaa

SEQ ID NO: 32386 - DNA, 20 bp, Artificial Sequence
  chemically synthesized
ataaatgtgtagaaaagttg

SEQ ID NO: 32387 - DNA, 20 bp, Artificial Sequence
  chemically synthesized
aaatgtgtagaaaagttgca

SEQ ID NO: 32388 - DNA, 20 bp, Artificial Sequence
  chemically synthesized
aaaagttgcagagaaatgta

SEQ ID NO: 32389 - DNA, 20 bp, Artificial Sequence
  chemically synthesized
agttgcagagaaatgtatgg

SEQ ID NO: 32390 - DNA, 20 bp, Artificial Sequence
  chemically synthesized
gaaatgtatggcagattata

SEQ ID NO: 32391 - DNA, 20 bp, Artificial Sequence
  chemically synthesized
aaatgtatggcagattataa

SEQ ID NO: 32392 - DNA, 20 bp, Artificial Sequence
  chemically synthesized
aatgtatggcagattataaa

SEQ ID NO: 32393 - DNA, 20 bp, Artificial Sequence
  chemically synthesized
ttataaagggaaattatctc

SEQ ID NO: 32394 - DNA, 20 bp, Artificial Sequence
  chemically synthesized
tataaagggaaattatctcc

SEQ ID NO: 32395 - DNA, 20 bp, Artificial Sequence
  chemically synthesized
ataaagggaaattatctcca

SEQ ID NO: 32396 - DNA, 20 bp, Artificial Sequence
  chemically synthesized
aaagggaaattatctccagg

SEQ ID NO: 32397 - DNA, 20 bp, Artificial Sequence
  chemically synthesized
aagggaaattatctccaggg

SEQ ID NO: 32398 - DNA, 20 bp, Artificial Sequence
  chemically synthesized
gaaattatctccagggagga

SEQ ID NO: 32399 - DNA, 20 bp, Artificial Sequence
  chemically synthesized
ttatctccagggaggataga

SEQ ID NO: 32400 - DNA, 20 bp, Artificial Sequence
  chemically synthesized
tatctccagggaggatagaa

SEQ ID NO: 32401 - DNA, 20 bp, Artificial Sequence
  chemically synthesized
tccagggaggatagaaaggt

SEQ ID NO: 32402 - DNA, 20 bp, Artificial Sequence
  chemically synthesized
ccagggaggatagaaaggta

SEQ ID NO: 32403 - DNA, 20 bp, Artificial Sequence
  chemically synthesized
ggatagaaaggtaaggataa

SEQ ID NO: 32404 - DNA, 20 bp, Artificial Sequence
  chemically synthesized
gatagaaaggtaaggataaa

SEQ ID NO: 32405 - DNA, 20 bp, Artificial Sequence
  chemically synthesized
tactttatatttaatataca

SEQ ID NO: 32406 - DNA, 20 bp, Artificial Sequence
  chemically synthesized
ctttatatttaatatacatg

SEQ ID NO: 32407 - DNA, 20 bp, Artificial Sequence
  chemically synthesized
taattttttaaattatatca

SEQ ID NO: 32408 - DNA, 20 bp, Artificial Sequence
  chemically synthesized
aattatatcatagacatatt

SEQ ID NO: 32409 - DNA, 20 bp, Artificial Sequence
  chemically synthesized
attatatcatagacatattt

SEQ ID NO: 32410 - DNA, 20 bp, Artificial Sequence
  chemically synthesized
tatcatagacatatttagga

SEQ ID NO: 32411 - DNA, 20 bp, Artificial Sequence
  chemically synthesized
gacatatttaggatagtgaa

SEQ ID NO: 32412 - DNA, 20 bp, Artificial Sequence
  chemically synthesized
ttaaaaatacaactacttac

SEQ ID NO: 32413 - DNA, 20 bp, Artificial Sequence
  chemically synthesized
ttttaaatgtctcaaattat

SEQ ID NO: 32414 - DNA, 20 bp, Artificial Sequence
  chemically synthesized
atcagattttattttttatc

SEQ ID NO: 32415 - DNA, 20 bp, Artificial Sequence
  chemically synthesized
atccagaaaaaatatataaa

SEQ ID NO: 32416 - DNA, 20 bp, Artificial Sequence
  chemically synthesized
tatataaaaagtctgtttca

SEQ ID NO: 32417 - DNA, 20 bp, Artificial Sequence
  chemically synthesized
tataaaaagtctgtttcata

SEQ ID NO: 32418 - DNA, 20 bp, Artificial Sequence
  chemically synthesized
ctgtttcatagagttttact

SEQ ID NO: 32419 - DNA, 20 bp, Artificial Sequence
  chemically synthesized
tgtttcatagagttttactg

SEQ ID NO: 32420 - DNA, 20 bp, Artificial Sequence
  chemically synthesized
agagttttactgaggtataa

SEQ ID NO: 32421 - DNA, 20 bp, Artificial Sequence
  chemically synthesized
aatagatgtaattctcctaa

SEQ ID NO: 32422 - DNA, 20 bp, Artificial Sequence
  chemically synthesized
aaagtgttatattttgcaaa

SEQ ID NO: 32423 - DNA, 20 bp, Artificial Sequence
  chemically synthesized
gtgttatattttgcaaatag

SEQ ID NO: 32424 - DNA, 20 bp, Artificial Sequence
  chemically synthesized
tgctaaaatattattgttaa

SEQ ID NO: 32425 - DNA, 20 bp, Artificial Sequence
  chemically synthesized
gttaatagtattccactaac

SEQ ID NO: 32426 - DNA, 20 bp, Artificial Sequence
  chemically synthesized
aactttaattaatatttgtt

SEQ ID NO: 32427 - DNA, 20 bp, Artificial Sequence
  chemically synthesized
tttctactaccccacacaca

SEQ ID NO: 32428 - DNA, 20 bp, Artificial Sequence
  chemically synthesized
ttctactaccccacacacat

SEQ ID NO: 32429 - DNA, 20 bp, Artificial Sequence
  chemically synthesized
catatcttcttctatcatgt

SEQ ID NO: 32430 - DNA, 20 bp, Artificial Sequence
  chemically synthesized
tctatcatgttggcctcatt

SEQ ID NO: 32431 - DNA, 20 bp, Artificial Sequence
  chemically synthesized
catgttggcctcattcagta

SEQ ID NO: 32432 - DNA, 20 bp, Artificial Sequence
  chemically synthesized
ggcctcattcagtacagtac

SEQ ID NO: 32433 - DNA, 20 bp, Artificial Sequence
  chemically synthesized
tcagtacagtactagaaaat

SEQ ID NO: 32434 - DNA, 20 bp, Artificial Sequence
  chemically synthesized
gtacagtactagaaaatcag

SEQ ID NO: 32435 - DNA, 20 bp, Artificial Sequence
  chemically synthesized
tacagtactagaaaatcagt

SEQ ID NO: 32436 - DNA, 20 bp, Artificial Sequence
  chemically synthesized
acagtactagaaaatcagta

SEQ ID NO: 32437 - DNA, 20 bp, Artificial Sequence
  chemically synthesized
ctagaaaatcagtagggact

SEQ ID NO: 32438 - DNA, 20 bp, Artificial Sequence
  chemically synthesized
tagaaaatcagtagggactc

SEQ ID NO: 32439 - DNA, 20 bp, Artificial Sequence
  chemically synthesized
actcaggttatatgtgtgaa

SEQ ID NO: 32440 - DNA, 20 bp, Artificial Sequence
  chemically synthesized
tgaatgaatgcctattttta

SEQ ID NO: 32441 - DNA, 20 bp, Artificial Sequence
  chemically synthesized
cctttctgtatgtctaacct

SEQ ID NO: 32442 - DNA, 20 bp, Artificial Sequence
  chemically synthesized
gtatgtctaaccttagattc

SEQ ID NO: 32443 - DNA, 20 bp, Artificial Sequence
  chemically synthesized
ctaaccttagattctagtca

SEQ ID NO: 32444 - DNA, 20 bp, Artificial Sequence
  chemically synthesized
tagtcatggccatatgtctc

SEQ ID NO: 32445 - DNA, 20 bp, Artificial Sequence
  chemically synthesized
agtcatggccatatgtctct

SEQ ID NO: 32446 - DNA, 20 bp, Artificial Sequence
  chemically synthesized
catggccatatgtctctagg

SEQ ID NO: 32447 - DNA, 20 bp, Artificial Sequence
  chemically synthesized
gtggcccaaccaccctatca

SEQ ID NO: 32448 - DNA, 20 bp, Artificial Sequence
  chemically synthesized
ctatcacagattctgcttca

SEQ ID NO: 32449 - DNA, 20 bp, Artificial Sequence
  chemically synthesized
tatcacagattctgcttcaa

SEQ ID NO: 32450 - DNA, 20 bp, Artificial Sequence
  chemically synthesized
tgcttcaaaggcactcatct

SEQ ID NO: 32451 - DNA, 20 bp, Artificial Sequence
  chemically synthesized
catcttggtgaatgaatatc

SEQ ID NO: 32452 - DNA, 20 bp, Artificial Sequence
  chemically synthesized
ggtgaatgaatatctagtcc

SEQ ID NO: 32453 - DNA, 20 bp, Artificial Sequence
  chemically synthesized
gaatgaatatctagtcccag

SEQ ID NO: 32454 - DNA, 20 bp, Artificial Sequence
  chemically synthesized
aatgaatatctagtcccaga

SEQ ID NO: 32455 - DNA, 20 bp, Artificial Sequence
  chemically synthesized
tgaatatctagtcccagaag

SEQ ID NO: 32456 - DNA, 20 bp, Artificial Sequence
  chemically synthesized
gaatatctagtcccagaagg

SEQ ID NO: 32457 - DNA, 20 bp, Artificial Sequence
  chemically synthesized
aaaactatcttgtccacatc

SEQ ID NO: 32458 - DNA, 20 bp, Artificial Sequence
  chemically synthesized
ctatcttgtccacatctagt

SEQ ID NO: 32459 - DNA, 20 bp, Artificial Sequence
  chemically synthesized
tagttggctgacacacaatt

SEQ ID NO: 32460 - DNA, 20 bp, Artificial Sequence
  chemically synthesized
agttggctgacacacaattt

SEQ ID NO: 32461 - DNA, 20 bp, Artificial Sequence
  chemically synthesized
gacacacaatttaggcttct

SEQ ID NO: 32462 - DNA, 20 bp, Artificial Sequence
  chemically synthesized
acacacaatttaggcttctt

SEQ ID NO: 32463 - DNA, 20 bp, Artificial Sequence
  chemically synthesized
ttaggcttcttgggtgtaat

SEQ ID NO: 32464 - DNA, 20 bp, Artificial Sequence
  chemically synthesized
ttgggtgtaatcagatctgt

SEQ ID NO: 32465 - DNA, 20 bp, Artificial Sequence
  chemically synthesized
tcagatctgtaagcatgatc

SEQ ID NO: 32466 - DNA, 20 bp, Artificial Sequence
  chemically synthesized
atctgtaagcatgatccgga

SEQ ID NO: 32467 - DNA, 20 bp, Artificial Sequence
  chemically synthesized
aagcatgatccggaaagaaa

SEQ ID NO: 32468 - DNA, 20 bp, Artificial Sequence
  chemically synthesized
ggaaagaaaaagttcctgaa

SEQ ID NO: 32469 - DNA, 20 bp, Artificial Sequence
  chemically synthesized
aaagaaaaagttcctgaaca

SEQ ID NO: 32470 - DNA, 20 bp, Artificial Sequence
  chemically synthesized
aagaaaaagttcctgaacag

SEQ ID NO: 32471 - DNA, 20 bp, Artificial Sequence
  chemically synthesized
acagaggcttccaacatcct

SEQ ID NO: 32472 - DNA, 20 bp, Artificial Sequence
  chemically synthesized
gaggcttccaacatcctcag

SEQ ID NO: 32473 - DNA, 20 bp, Artificial Sequence
  chemically synthesized
aggcttccaacatcctcaga

SEQ ID NO: 32474 - DNA, 20 bp, Artificial Sequence
  chemically synthesized
aaacctctcttaatccacat

SEQ ID NO: 32475 - DNA, 20 bp, Artificial Sequence
  chemically synthesized
tctcttaatccacataagaa

SEQ ID NO: 32476 - DNA, 20 bp, Artificial Sequence
  chemically synthesized
aattccaacatcttgctcct

SEQ ID NO: 32477 - DNA, 20 bp, Artificial Sequence
  chemically synthesized
ctcctaagaacactttgccc

SEQ ID NO: 32478 - DNA, 20 bp, Artificial Sequence
  chemically synthesized
tcctaagaacactttgccct

SEQ ID NO: 32479 - DNA, 20 bp, Artificial Sequence
  chemically synthesized
cctaagaacactttgccctg

SEQ ID NO: 32480 - DNA, 20 bp, Artificial Sequence
  chemically synthesized
ctaagaacactttgccctgg

SEQ ID NO: 32481 - DNA, 20 bp, Artificial Sequence
  chemically synthesized
actttgccctgggggaaaaa

SEQ ID NO: 32482 - DNA, 20 bp, Artificial Sequence
  chemically synthesized
gccctgggggaaaaaaagaa

SEQ ID NO: 32483 - DNA, 20 bp, Artificial Sequence
  chemically synthesized
aaaaaaagaaaagccatcgt

SEQ ID NO: 32484 - DNA, 20 bp, Artificial Sequence
  chemically synthesized
gaaaagccatcgtaagcttt

SEQ ID NO: 32485 - DNA, 20 bp, Artificial Sequence
  chemically synthesized
aagccatcgtaagctttcag

SEQ ID NO: 32486 - DNA, 20 bp, Artificial Sequence
  chemically synthesized
agccatcgtaagctttcaga

SEQ ID NO: 32487 - DNA, 20 bp, Artificial Sequence
  chemically synthesized
gctttcagaaggcctatgct

SEQ ID NO: 32488 - DNA, 20 bp, Artificial Sequence
  chemically synthesized
ctttcagaaggcctatgctg

SEQ ID NO: 32489 - DNA, 20 bp, Artificial Sequence
  chemically synthesized
tgctgaggttttgcttcctt

SEQ ID NO: 32490 - DNA, 20 bp, Artificial Sequence
  chemically synthesized
ttttgcttccttcagtttta

SEQ ID NO: 32491 - DNA, 20 bp, Artificial Sequence
  chemically synthesized
gttttaaagcataatatttt

SEQ ID NO: 32492 - DNA, 20 bp, Artificial Sequence
  chemically synthesized
attttgagtaactcaatgtt

SEQ ID NO: 32493 - DNA, 20 bp, Artificial Sequence
  chemically synthesized
acctcaaattttgctcttga

SEQ ID NO: 32494 - DNA, 20 bp, Artificial Sequence
  chemically synthesized
tactatgctctgctttctca

SEQ ID NO: 32495 - DNA, 20 bp, Artificial Sequence
  chemically synthesized
actatgctctgctttctcac

SEQ ID NO: 32496 - DNA, 20 bp, Artificial Sequence
  chemically synthesized
ctttctcacaggatgcatgt

SEQ ID NO: 32497 - DNA, 20 bp, Artificial Sequence
  chemically synthesized
gcatgtgagaataaaacaca

SEQ ID NO: 32498 - DNA, 20 bp, Artificial Sequence
  chemically synthesized
aaaacacaaagtctttatgt

SEQ ID NO: 32499 - DNA, 20 bp, Artificial Sequence
  chemically synthesized
agaatatcttgtgtaacttc

SEQ ID NO: 32500 - DNA, 20 bp, Artificial Sequence
  chemically synthesized
acttcaagtattacgattgt

SEQ ID NO: 32501 - DNA, 20 bp, Artificial Sequence
  chemically synthesized
ttcaagtattacgattgtga

SEQ ID NO: 32502 - DNA, 20 bp, Artificial Sequence
  chemically synthesized
caagtattacgattgtgaga

SEQ ID NO: 32503 - DNA, 20 bp, Artificial Sequence
  chemically synthesized
gattgtgagagagcttttta

SEQ ID NO: 32504 - DNA, 20 bp, Artificial Sequence
  chemically synthesized
attgtgagagagctttttaa

SEQ ID NO: 32505 - DNA, 20 bp, Artificial Sequence
  chemically synthesized
aaggtttttattttctttgt

SEQ ID NO: 32506 - DNA, 20 bp, Artificial Sequence
  chemically synthesized
ggtttttattttctttgtca

SEQ ID NO: 32507 - DNA, 20 bp, Artificial Sequence
  chemically synthesized
tttattttctttgtcagagc

SEQ ID NO: 32508 - DNA, 20 bp, Artificial Sequence
  chemically synthesized
ttttctttgtcagagctaga

SEQ ID NO: 32509 - DNA, 20 bp, Artificial Sequence
  chemically synthesized
ttctttgtcagagctagaca

SEQ ID NO: 32510 - DNA, 20 bp, Artificial Sequence
  chemically synthesized
agctagacagagtatcttct

SEQ ID NO: 32511 - DNA, 20 bp, Artificial Sequence
  chemically synthesized
cagagtatcttctcagccca

SEQ ID NO: 32512 - DNA, 20 bp, Artificial Sequence
  chemically synthesized
agagtatcttctcagcccaa

SEQ ID NO: 32513 - DNA, 20 bp, Artificial Sequence
  chemically synthesized
aaaattttcaatgatgatta

SEQ ID NO: 32514 - DNA, 20 bp, Artificial Sequence
  chemically synthesized
aatgatgattatagtaataa

SEQ ID NO: 32515 - DNA, 20 bp, Artificial Sequence
  chemically synthesized
gatttctataatacttacaa

SEQ ID NO: 32516 - DNA, 20 bp, Artificial Sequence
  chemically synthesized
ctataatacttacaatggac

SEQ ID NO: 32517 - DNA, 20 bp, Artificial Sequence
  chemically synthesized
tataatacttacaatggacc

SEQ ID NO: 32518 - DNA, 20 bp, Artificial Sequence
  chemically synthesized
ccaggcactattgaacacgt

SEQ ID NO: 32519 - DNA, 20 bp, Artificial Sequence
  chemically synthesized
attaaaataattcaaccatg

SEQ ID NO: 32520 - DNA, 20 bp, Artificial Sequence
  chemically synthesized
ttaaaataattcaaccatgt

SEQ ID NO: 32521 - DNA, 20 bp, Artificial Sequence
  chemically synthesized
ttcaaccatgtgggtactat

SEQ ID NO: 32522 - DNA, 20 bp, Artificial Sequence
  chemically synthesized
actattggtatccccactta

SEQ ID NO: 32523 - DNA, 20 bp, Artificial Sequence
  chemically synthesized
tggtatccccacttaaagat

SEQ ID NO: 32524 - DNA, 20 bp, Artificial Sequence
  chemically synthesized
tatccccacttaaagatgag

SEQ ID NO: 32525 - DNA, 20 bp, Artificial Sequence
  chemically synthesized
aagatgagtggaccaaaaca

SEQ ID NO: 32526 - DNA, 20 bp, Artificial Sequence
  chemically synthesized
tgagtggaccaaaacacaga

SEQ ID NO: 32527 - DNA, 20 bp, Artificial Sequence
  chemically synthesized
aaagataaattgctttgcta

SEQ ID NO: 32528 - DNA, 20 bp, Artificial Sequence
  chemically synthesized
aagataaattgctttgctat

SEQ ID NO: 32529 - DNA, 20 bp, Artificial Sequence
  chemically synthesized
agataaattgctttgctata

SEQ ID NO: 32530 - DNA, 20 bp, Artificial Sequence
  chemically synthesized
ttgctttgctatagggtacg

SEQ ID NO: 32531 - DNA, 20 bp, Artificial Sequence
  chemically synthesized
ctatagggtacgcagccaat

SEQ ID NO: 32532 - DNA, 20 bp, Artificial Sequence
  chemically synthesized
tagggtacgcagccaataag

SEQ ID NO: 32533 - DNA, 20 bp, Artificial Sequence
  chemically synthesized
ggtacgcagccaataagtgg

SEQ ID NO: 32534 - DNA, 20 bp, Artificial Sequence
  chemically synthesized
gtacgcagccaataagtgga

SEQ ID NO: 32535 - DNA, 20 bp, Artificial Sequence
  chemically synthesized
cgcagccaataagtggaagg

SEQ ID NO: 32536 - DNA, 20 bp, Artificial Sequence
  chemically synthesized
gcagccaataagtggaaggt

SEQ ID NO: 32537 - DNA, 20 bp, Artificial Sequence
  chemically synthesized
aattcccaaaactactgcat

SEQ ID NO: 32538 - DNA, 20 bp, Artificial Sequence
  chemically synthesized
ctactgcataagactgtatg

SEQ ID NO: 32539 - DNA, 20 bp, Artificial Sequence
  chemically synthesized
ctgcataagactgtatgaag

SEQ ID NO: 32540 - DNA, 20 bp, Artificial Sequence
  chemically synthesized
tatgaagaagcatgaaacaa

SEQ ID NO: 32541 - DNA, 20 bp, Artificial Sequence
  chemically synthesized
atgaagaagcatgaaacaat

SEQ ID NO: 32542 - DNA, 20 bp, Artificial Sequence
  chemically synthesized
agcatgaaacaataggtttc

SEQ ID NO: 32543 - DNA, 20 bp, Artificial Sequence
  chemically synthesized
atgaaacaataggtttcaag

SEQ ID NO: 32544 - DNA, 20 bp, Artificial Sequence
  chemically synthesized
aataggtttcaagaagccta

SEQ ID NO: 32545 - DNA, 20 bp, Artificial Sequence
  chemically synthesized
gaagcctacagaacacttaa

SEQ ID NO: 32546 - DNA, 20 bp, Artificial Sequence
  chemically synthesized
aagcctacagaacacttaac

SEQ ID NO: 32547 - DNA, 20 bp, Artificial Sequence
  chemically synthesized
cttaacaggatttttcatgc

SEQ ID NO: 32548 - DNA, 20 bp, Artificial Sequence
  chemically synthesized
ggatttttcatgctggttca

SEQ ID NO: 32549 - DNA, 20 bp, Artificial Sequence
  chemically synthesized
tttcatgctggttcatagtt

SEQ ID NO: 32550 - DNA, 20 bp, Artificial Sequence
  chemically synthesized
ctggttcatagttaagttat

SEQ ID NO: 32551 - DNA, 20 bp, Artificial Sequence
  chemically synthesized
catagttaagttattggttg

SEQ ID NO: 32552 - DNA, 20 bp, Artificial Sequence
  chemically synthesized
gaagatgcaacaaatctgaa

SEQ ID NO: 32553 - DNA, 20 bp, Artificial Sequence
  chemically synthesized
gatgcaacaaatctgaatgg

SEQ ID NO: 32554 - DNA, 20 bp, Artificial Sequence
  chemically synthesized
tgcaacaaatctgaatggca

SEQ ID NO: 32555 - DNA, 20 bp, Artificial Sequence
  chemically synthesized
gcaacaaatctgaatggcag

SEQ ID NO: 32556 - DNA, 20 bp, Artificial Sequence
  chemically synthesized
gaatggcagaggaaaaaaca

SEQ ID NO: 32557 - DNA, 20 bp, Artificial Sequence
  chemically synthesized
ggcagaggaaaaaacaaaga

SEQ ID NO: 32558 - DNA, 20 bp, Artificial Sequence
  chemically synthesized
cagaggaaaaaacaaagaaa

SEQ ID NO: 32559 - DNA, 20 bp, Artificial Sequence
  chemically synthesized
gaggaaaaaacaaagaaaga

SEQ ID NO: 32560 - DNA, 20 bp, Artificial Sequence
  chemically synthesized
aaacaaagaaagagagttct

SEQ ID NO: 32561 - DNA, 20 bp, Artificial Sequence
  chemically synthesized
aaagaaagagagttctgagt

SEQ ID NO: 32562 - DNA, 20 bp, Artificial Sequence
  chemically synthesized
aagagagttctgagtgagcc

SEQ ID NO: 32563 - DNA, 20 bp, Artificial Sequence
  chemically synthesized
agagagttctgagtgagcct

SEQ ID NO: 32564 - DNA, 20 bp, Artificial Sequence
  chemically synthesized
tgagtgagcctgggtctcca

SEQ ID NO: 32565 - DNA, 20 bp, Artificial Sequence
  chemically synthesized
gagtgagcctgggtctccat

SEQ ID NO: 32566 - DNA, 20 bp, Artificial Sequence
  chemically synthesized
gtgagcctgggtctccatag

SEQ ID NO: 32567 - DNA, 20 bp, Artificial Sequence
  chemically synthesized
cctgggtctccataggagca

SEQ ID NO: 32568 - DNA, 20 bp, Artificial Sequence
  chemically synthesized
ctccataggagcaaagaacc

SEQ ID NO: 32569 - DNA, 20 bp, Artificial Sequence
  chemically synthesized
taggagcaaagaaccaagtg

SEQ ID NO: 32570 - DNA, 20 bp, Artificial Sequence
  chemically synthesized
gcaaagaaccaagtgaagct

SEQ ID NO: 32571 - DNA, 20 bp, Artificial Sequence
  chemically synthesized
caaagaaccaagtgaagctt

SEQ ID NO: 32572 - DNA, 20 bp, Artificial Sequence
  chemically synthesized
gaaccaagtgaagcttgggt

SEQ ID NO: 32573 - DNA, 20 bp, Artificial Sequence
  chemically synthesized
agtgaagcttgggttagttg

SEQ ID NO: 32574 - DNA, 20 bp, Artificial Sequence
  chemically synthesized
gtgaagcttgggttagttgt

SEQ ID NO: 32575 - DNA, 20 bp, Artificial Sequence
  chemically synthesized
tgaagcttgggttagttgtg

SEQ ID NO: 32576 - DNA, 20 bp, Artificial Sequence
  chemically synthesized
ttgggttagttgtggggtgt

SEQ ID NO: 32577 - DNA, 20 bp, Artificial Sequence
  chemically synthesized
tgtggggtgtaagatataat

SEQ ID NO: 32578 - DNA, 20 bp, Artificial Sequence
  chemically synthesized
ggggtgtaagatataattag

SEQ ID NO: 32579 - DNA, 20 bp, Artificial Sequence
  chemically synthesized
ggtgtaagatataattagaa

SEQ ID NO: 32580 - DNA, 20 bp, Artificial Sequence
  chemically synthesized
gtaagatataattagaagag

SEQ ID NO: 32581 - DNA, 20 bp, Artificial Sequence
  chemically synthesized
agatataattagaagagaag

SEQ ID NO: 32582 - DNA, 20 bp, Artificial Sequence
  chemically synthesized
gaagagaagtagctctactc

SEQ ID NO: 32583 - DNA, 20 bp, Artificial Sequence
  chemically synthesized
gagaagtagctctactctgg

SEQ ID NO: 32584 - DNA, 20 bp, Artificial Sequence
  chemically synthesized
aagtagctctactctggtag

SEQ ID NO: 32585 - DNA, 20 bp, Artificial Sequence
  chemically synthesized
ctggtagaagtgaaactttg

SEQ ID NO: 32586 - DNA, 20 bp, Artificial Sequence
  chemically synthesized
ctgattcctcacaaactgct

SEQ ID NO: 32587 - DNA, 20 bp, Artificial Sequence
  chemically synthesized
ttcctcacaaactgctgagt

SEQ ID NO: 32588 - DNA, 20 bp, Artificial Sequence
  chemically synthesized
tcctcacaaactgctgagta

SEQ ID NO: 32589 - DNA, 20 bp, Artificial Sequence
  chemically synthesized
cacaaactgctgagtaagga

SEQ ID NO: 32590 - DNA, 20 bp, Artificial Sequence
  chemically synthesized
acaaactgctgagtaaggat

SEQ ID NO: 32591 - DNA, 20 bp, Artificial Sequence
  chemically synthesized
agtaaggataggaaaatgca

SEQ ID NO: 32592 - DNA, 20 bp, Artificial Sequence
  chemically synthesized
gataggaaaatgcatagcct

SEQ ID NO: 32593 - DNA, 20 bp, Artificial Sequence
  chemically synthesized
gaaaatgcatagccttggtc

SEQ ID NO: 32594 - DNA, 20 bp, Artificial Sequence
  chemically synthesized
catagccttggtcaagattt

SEQ ID NO: 32595 - DNA, 20 bp, Artificial Sequence
  chemically synthesized
cttggtcaagatttaagcat

SEQ ID NO: 32596 - DNA, 20 bp, Artificial Sequence
  chemically synthesized
ttggtcaagatttaagcatg

SEQ ID NO: 32597 - DNA, 20 bp, Artificial Sequence
  chemically synthesized
taagcatgaggacataaaaa

SEQ ID NO: 32598 - DNA, 20 bp, Artificial Sequence
  chemically synthesized
tgaggacataaaaatagata

SEQ ID NO: 32599 - DNA, 20 bp, Artificial Sequence
  chemically synthesized
gaggacataaaaatagatat

SEQ ID NO: 32600 - DNA, 20 bp, Artificial Sequence
  chemically synthesized
gacataaaaatagatatagg

SEQ ID NO: 32601 - DNA, 20 bp, Artificial Sequence
  chemically synthesized
taaaaatagatataggcaga

SEQ ID NO: 32602 - DNA, 20 bp, Artificial Sequence
  chemically synthesized
tagatataggcagaaagcac

SEQ ID NO: 32603 - DNA, 20 bp, Artificial Sequence
  chemically synthesized
tttgaatgcatatattgtgc

SEQ ID NO: 32604 - DNA, 20 bp, Artificial Sequence
  chemically synthesized
ttgtgcaagtgcctctattc

SEQ ID NO: 32605 - DNA, 20 bp, Artificial Sequence
  chemically synthesized
tgtgcaagtgcctctattct

SEQ ID NO: 32606 - DNA, 20 bp, Artificial Sequence
  chemically synthesized
agtgcctctattctgggtgc

SEQ ID NO: 32607 - DNA, 20 bp, Artificial Sequence
  chemically synthesized
tattctgggtgctagcatac

SEQ ID NO: 32608 - DNA, 20 bp, Artificial Sequence
  chemically synthesized
aacatttttgttccttttgt

SEQ ID NO: 32609 - DNA, 20 bp, Artificial Sequence
  chemically synthesized
catttttgttccttttgtca

SEQ ID NO: 32610 - DNA, 20 bp, Artificial Sequence
  chemically synthesized
atttttgttccttttgtcag

SEQ ID NO: 32611 - DNA, 20 bp, Artificial Sequence
  chemically synthesized
tttgtcagaggcatttgaac

SEQ ID NO: 32612 - DNA, 20 bp, Artificial Sequence
  chemically synthesized
tgtcagaggcatttgaacca

SEQ ID NO: 32613 - DNA, 20 bp, Artificial Sequence
  chemically synthesized
cagagcaactccatcttaaa

SEQ ID NO: 32614 - DNA, 20 bp, Artificial Sequence
  chemically synthesized
agagcaactccatcttaaat

SEQ ID NO: 32615 - DNA, 20 bp, Artificial Sequence
  chemically synthesized
agcaactccatcttaaatag

SEQ ID NO: 32616 - DNA, 20 bp, Artificial Sequence
  chemically synthesized
actccatcttaaataggagc

SEQ ID NO: 32617 - DNA, 20 bp, Artificial Sequence
  chemically synthesized
ctccatcttaaataggagct

SEQ ID NO: 32618 - DNA, 20 bp, Artificial Sequence
  chemically synthesized
aaataggagctgggtacaat

SEQ ID NO: 32619 - DNA, 20 bp, Artificial Sequence
  chemically synthesized
aataggagctgggtacaata

SEQ ID NO: 32620 - DNA, 20 bp, Artificial Sequence
  chemically synthesized
gagctgggtacaataaggct

SEQ ID NO: 32621 - DNA, 20 bp, Artificial Sequence
  chemically synthesized
acaataaggctgagacctac

SEQ ID NO: 32622 - DNA, 20 bp, Artificial Sequence
  chemically synthesized
caataaggctgagacctact

SEQ ID NO: 32623 - DNA, 20 bp, Artificial Sequence
  chemically synthesized
gacctactgggctgtattcc

SEQ ID NO: 32624 - DNA, 20 bp, Artificial Sequence
  chemically synthesized
tactgggctgtattcccaga

SEQ ID NO: 32625 - DNA, 20 bp, Artificial Sequence
  chemically synthesized
gggctgtattcccagaaagt

SEQ ID NO: 32626 - DNA, 20 bp, Artificial Sequence
  chemically synthesized
ggctgtattcccagaaagtt

SEQ ID NO: 32627 - DNA, 20 bp, Artificial Sequence
  chemically synthesized
cccagaaagttaggcattct

SEQ ID NO: 32628 - DNA, 20 bp, Artificial Sequence
  chemically synthesized
aagttaggcattctcagtca

SEQ ID NO: 32629 - DNA, 20 bp, Artificial Sequence
  chemically synthesized
agttaggcattctcagtcac

SEQ ID NO: 32630 - DNA, 20 bp, Artificial Sequence
  chemically synthesized
ggcattctcagtcacaggat

SEQ ID NO: 32631 - DNA, 20 bp, Artificial Sequence
  chemically synthesized
tctcagtcacaggatgagat

SEQ ID NO: 32632 - DNA, 20 bp, Artificial Sequence
  chemically synthesized
tcagtcacaggatgagataa

SEQ ID NO: 32633 - DNA, 20 bp, Artificial Sequence
  chemically synthesized
cagtcacaggatgagataag

SEQ ID NO: 32634 - DNA, 20 bp, Artificial Sequence
  chemically synthesized
cacaggatgagataagaggt

SEQ ID NO: 32635 - DNA, 20 bp, Artificial Sequence
  chemically synthesized
atgagataagaggttggcac

SEQ ID NO: 32636 - DNA, 20 bp, Artificial Sequence
  chemically synthesized
taagaggttggcacaagata

SEQ ID NO: 32637 - DNA, 20 bp, Artificial Sequence
  chemically synthesized
aagaggttggcacaagatac

SEQ ID NO: 32638 - DNA, 20 bp, Artificial Sequence
  chemically synthesized
ggcacaagatacaggtcata

SEQ ID NO: 32639 - DNA, 20 bp, Artificial Sequence
  chemically synthesized
taaagaccttgctgaaaaaa

SEQ ID NO: 32640 - DNA, 20 bp, Artificial Sequence
  chemically synthesized
cttgctgaaaaaacagtttg

SEQ ID NO: 32641 - DNA, 20 bp, Artificial Sequence
  chemically synthesized
tgaaaaaacagtttgcagta

SEQ ID NO: 32642 - DNA, 20 bp, Artificial Sequence
  chemically synthesized
aaaaacagtttgcagtaaag

SEQ ID NO: 32643 - DNA, 20 bp, Artificial Sequence
  chemically synthesized
acagtttgcagtaaagaagc

SEQ ID NO: 32644 - DNA, 20 bp, Artificial Sequence
  chemically synthesized
tggctgaaacccaccaaacc

SEQ ID NO: 32645 - DNA, 20 bp, Artificial Sequence
  chemically synthesized
caccaaaccaagattgtgat

SEQ ID NO: 32646 - DNA, 20 bp, Artificial Sequence
  chemically synthesized
ccaaaccaagattgtgatga

SEQ ID NO: 32647 - DNA, 20 bp, Artificial Sequence
  chemically synthesized
attgtgatgagagtgacctc

SEQ ID NO: 32648 - DNA, 20 bp, Artificial Sequence
  chemically synthesized
gtgatgagagtgacctctgg

SEQ ID NO: 32649 - DNA, 20 bp, Artificial Sequence
  chemically synthesized
cctcactgctactctcccac

SEQ ID NO: 32650 - DNA, 20 bp, Artificial Sequence
  chemically synthesized
ccaccagcactatgactgtt

SEQ ID NO: 32651 - DNA, 20 bp, Artificial Sequence
  chemically synthesized
atgactgtttagaaatgcca

SEQ ID NO: 32652 - DNA, 20 bp, Artificial Sequence
  chemically synthesized
tagaaatgccatggcaacat

SEQ ID NO: 32653 - DNA, 20 bp, Artificial Sequence
  chemically synthesized
agaaatgccatggcaacatc

SEQ ID NO: 32654 - DNA, 20 bp, Artificial Sequence
  chemically synthesized
aatgccatggcaacatcagg

SEQ ID NO: 32655 - DNA, 20 bp, Artificial Sequence
  chemically synthesized
caacatcaggaagttacgct

SEQ ID NO: 32656 - DNA, 20 bp, Artificial Sequence
  chemically synthesized
catcaggaagttacgctaag

SEQ ID NO: 32657 - DNA, 20 bp, Artificial Sequence
  chemically synthesized
gttacgctaagcggtctgaa

SEQ ID NO: 32658 - DNA, 20 bp, Artificial Sequence
  chemically synthesized
ttacgctaagcggtctgaaa

SEQ ID NO: 32659 - DNA, 20 bp, Artificial Sequence
  chemically synthesized
tacgctaagcggtctgaaaa

SEQ ID NO: 32660 - DNA, 20 bp, Artificial Sequence
  chemically synthesized
acgctaagcggtctgaaaag

SEQ ID NO: 32661 - DNA, 20 bp, Artificial Sequence
  chemically synthesized
gctaagcggtctgaaaaggg

SEQ ID NO: 32662 - DNA, 20 bp, Artificial Sequence
  chemically synthesized
ctaagcggtctgaaaagggg

SEQ ID NO: 32663 - DNA, 20 bp, Artificial Sequence
  chemically synthesized
tgaataatccaccccttgtt

SEQ ID NO: 32664 - DNA, 20 bp, Artificial Sequence
  chemically synthesized
tcaataaataaccataaaaa

SEQ ID NO: 32665 - DNA, 20 bp, Artificial Sequence
  chemically synthesized
caataaataaccataaaaat

SEQ ID NO: 32666 - DNA, 20 bp, Artificial Sequence
  chemically synthesized
taaccataaaaatgggcaac

SEQ ID NO: 32667 - DNA, 20 bp, Artificial Sequence
  chemically synthesized
ccataaaaatgggcaaccag

SEQ ID NO: 32668 - DNA, 20 bp, Artificial Sequence
  chemically synthesized
aatgggcaaccagcagtcct

SEQ ID NO: 32669 - DNA, 20 bp, Artificial Sequence
  chemically synthesized
atgggcaaccagcagtcctc

SEQ ID NO: 32670 - DNA, 20 bp, Artificial Sequence
  chemically synthesized
cctcaggactgttctgccta

SEQ ID NO: 32671 - DNA, 20 bp, Artificial Sequence
  chemically synthesized
ctcaggactgttctgcctat

SEQ ID NO: 32672 - DNA, 20 bp, Artificial Sequence
  chemically synthesized
tcaggactgttctgcctata

SEQ ID NO: 32673 - DNA, 20 bp, Artificial Sequence
  chemically synthesized
ggactgttctgcctataggg

SEQ ID NO: 32674 - DNA, 20 bp, Artificial Sequence
  chemically synthesized
cttgctttcacttttctgta

SEQ ID NO: 32675 - DNA, 20 bp, Artificial Sequence
  chemically synthesized
atttgccccaaattctttct

SEQ ID NO: 32676 - DNA, 20 bp, Artificial Sequence
  chemically synthesized
tttgccccaaattctttctt

SEQ ID NO: 32677 - DNA, 20 bp, Artificial Sequence
  chemically synthesized
ctttcttgggcacgaaatcc

SEQ ID NO: 32678 - DNA, 20 bp, Artificial Sequence
  chemically synthesized
gaaatccaagaaccctctct

SEQ ID NO: 32679 - DNA, 20 bp, Artificial Sequence
  chemically synthesized
aaatccaagaaccctctctt

SEQ ID NO: 32680 - DNA, 20 bp, Artificial Sequence
  chemically synthesized
aatccaagaaccctctctta

SEQ ID NO: 32681 - DNA, 20 bp, Artificial Sequence
  chemically synthesized
aagaaccctctcttagggtc

SEQ ID NO: 32682 - DNA, 20 bp, Artificial Sequence
  chemically synthesized
tctggattgtgactcctttc

SEQ ID NO: 32683 - DNA, 20 bp, Artificial Sequence
  chemically synthesized
ctttcaaaatgattttattc

SEQ ID NO: 32684 - DNA, 20 bp, Artificial Sequence
  chemically synthesized
aactaaaactctgtgtcact

SEQ ID NO: 32685 - DNA, 20 bp, Artificial Sequence
  chemically synthesized
taaaactctgtgtcactaag

SEQ ID NO: 32686 - DNA, 20 bp, Artificial Sequence
  chemically synthesized
gtgtcactaagtggctttgc

SEQ ID NO: 32687 - DNA, 20 bp, Artificial Sequence
  chemically synthesized
tgtcactaagtggctttgca

SEQ ID NO: 32688 - DNA, 20 bp, Artificial Sequence
  chemically synthesized
cactaagtggctttgcaagg

SEQ ID NO: 32689 - DNA, 20 bp, Artificial Sequence
  chemically synthesized
caaggtggcatgtgtatgtg

SEQ ID NO: 32690 - DNA, 20 bp, Artificial Sequence
  chemically synthesized
ggtggcatgtgtatgtgtgg

SEQ ID NO: 32691 - DNA, 20 bp, Artificial Sequence
  chemically synthesized
tggcatgtgtatgtgtggca

SEQ ID NO: 32692 - DNA, 20 bp, Artificial Sequence
  chemically synthesized
tggcagagcttctcttcctt

SEQ ID NO: 32693 - DNA, 20 bp, Artificial Sequence
  chemically synthesized
tccttcagaaccacattcct

SEQ ID NO: 32694 - DNA, 20 bp, Artificial Sequence
  chemically synthesized
gaaccacattcctgagactt

SEQ ID NO: 32695 - DNA, 20 bp, Artificial Sequence
  chemically synthesized
accacattcctgagacttga

SEQ ID NO: 32696 - DNA, 20 bp, Artificial Sequence
  chemically synthesized
gagacttgagagaatgtctt

SEQ ID NO: 32697 - DNA, 20 bp, Artificial Sequence
  chemically synthesized
atgtctttggtctctgctgc

SEQ ID NO: 32698 - DNA, 20 bp, Artificial Sequence
  chemically synthesized
gtctttggtctctgctgcta

SEQ ID NO: 32699 - DNA, 20 bp, Artificial Sequence
  chemically synthesized
gctgctagagaattttatcc

SEQ ID NO: 32700 - DNA, 20 bp, Artificial Sequence
  chemically synthesized
gagaattttatcctggttca

SEQ ID NO: 32701 - DNA, 20 bp, Artificial Sequence
  chemically synthesized
ttatcctggttcatggactg

SEQ ID NO: 32702 - DNA, 20 bp, Artificial Sequence
  chemically synthesized
tcctggttcatggactgcag

SEQ ID NO: 32703 - DNA, 20 bp, Artificial Sequence
  chemically synthesized
cctggttcatggactgcagc

SEQ ID NO: 32704 - DNA, 20 bp, Artificial Sequence
  chemically synthesized
tggttcatggactgcagcgg

SEQ ID NO: 32705 - DNA, 20 bp, Artificial Sequence
  chemically synthesized
ggttcatggactgcagcggg

SEQ ID NO: 32706 - DNA, 20 bp, Artificial Sequence
  chemically synthesized
tcatggactgcagcgggagg

SEQ ID NO: 32707 - DNA, 20 bp, Artificial Sequence
  chemically synthesized
tggactgcagcgggaggtgg

SEQ ID NO: 32708 - DNA, 20 bp, Artificial Sequence
  chemically synthesized
gtggaagcattttcaaactt

SEQ ID NO: 32709 - DNA, 20 bp, Artificial Sequence
  chemically synthesized
tggaagcattttcaaacttt

SEQ ID NO: 32710 - DNA, 20 bp, Artificial Sequence
  chemically synthesized
gaagcattttcaaactttgg

SEQ ID NO: 32711 - DNA, 20 bp, Artificial Sequence
  chemically synthesized
aagcattttcaaactttggg

SEQ ID NO: 32712 - DNA, 20 bp, Artificial Sequence
  chemically synthesized
agcattttcaaactttggga

SEQ ID NO: 32713 - DNA, 20 bp, Artificial Sequence
  chemically synthesized
gcattttcaaactttgggag

SEQ ID NO: 32714 - DNA, 20 bp, Artificial Sequence
  chemically synthesized
aaactttgggaggggaatgt

SEQ ID NO: 32715 - DNA, 20 bp, Artificial Sequence
  chemically synthesized
aactttgggaggggaatgtt

SEQ ID NO: 32716 - DNA, 20 bp, Artificial Sequence
  chemically synthesized
ctttgggaggggaatgttag

SEQ ID NO: 32717 - DNA, 20 bp, Artificial Sequence
  chemically synthesized
ggggaatgttaggagaccat

SEQ ID NO: 32718 - DNA, 20 bp, Artificial Sequence
  chemically synthesized
gggaatgttaggagaccatt

SEQ ID NO: 32719 - DNA, 20 bp, Artificial Sequence
  chemically synthesized
agaccattaggcatgtgctc

SEQ ID NO: 32720 - DNA, 20 bp, Artificial Sequence
  chemically synthesized
accattaggcatgtgctcaa

SEQ ID NO: 32721 - DNA, 20 bp, Artificial Sequence
  chemically synthesized
tgtgctcaagagatgacacc

SEQ ID NO: 32722 - DNA, 20 bp, Artificial Sequence
  chemically synthesized
tcaagagatgacaccaagtc

SEQ ID NO: 32723 - DNA, 20 bp, Artificial Sequence
  chemically synthesized
caagagatgacaccaagtcc

SEQ ID NO: 32724 - DNA, 20 bp, Artificial Sequence
  chemically synthesized
gagatgacaccaagtccagg

SEQ ID NO: 32725 - DNA, 20 bp, Artificial Sequence
  chemically synthesized
agatgacaccaagtccaggc

SEQ ID NO: 32726 - DNA, 20 bp, Artificial Sequence
  chemically synthesized
gatgacaccaagtccaggca

SEQ ID NO: 32727 - DNA, 20 bp, Artificial Sequence
  chemically synthesized
gtgcctgttgtctcatgaat

SEQ ID NO: 32728 - DNA, 20 bp, Artificial Sequence
  chemically synthesized
ctgttgtctcatgaatcaga

SEQ ID NO: 32729 - DNA, 20 bp, Artificial Sequence
  chemically synthesized
cacccctgcctaaaccttcc

SEQ ID NO: 32730 - DNA, 20 bp, Artificial Sequence
  chemically synthesized
cttcccagtcctgcattgca

SEQ ID NO: 32731 - DNA, 20 bp, Artificial Sequence
  chemically synthesized
tcccagtcctgcattgcaca

SEQ ID NO: 32732 - DNA, 20 bp, Artificial Sequence
  chemically synthesized
attgcacagagacccgtgct

SEQ ID NO: 32733 - DNA, 20 bp, Artificial Sequence
  chemically synthesized
ttgcacagagacccgtgctt

SEQ ID NO: 32734 - DNA, 20 bp, Artificial Sequence
  chemically synthesized
cagagacccgtgcttgggat

SEQ ID NO: 32735 - DNA, 20 bp, Artificial Sequence
  chemically synthesized
cccgtgcttgggattggaat

SEQ ID NO: 32736 - DNA, 20 bp, Artificial Sequence
  chemically synthesized
aaattttaatttttattcta

SEQ ID NO: 32737 - DNA, 20 bp, Artificial Sequence
  chemically synthesized
ttctaaagactttgaatctc

SEQ ID NO: 32738 - DNA, 20 bp, Artificial Sequence
  chemically synthesized
ctcatcttgcttttgccttc

SEQ ID NO: 32739 - DNA, 20 bp, Artificial Sequence
  chemically synthesized
tcatcttgcttttgccttcc

SEQ ID NO: 32740 - DNA, 20 bp, Artificial Sequence
  chemically synthesized
gcttttgccttccaggctgc

SEQ ID NO: 32741 - DNA, 20 bp, Artificial Sequence
  chemically synthesized
ttttgccttccaggctgctg

SEQ ID NO: 32742 - DNA, 20 bp, Artificial Sequence
  chemically synthesized
tccaggctgctggagtgcaa

SEQ ID NO: 32743 - DNA, 20 bp, Artificial Sequence
  chemically synthesized
ggagtgcaatggcgcgatct

SEQ ID NO: 32744 - DNA, 20 bp, Artificial Sequence
  chemically synthesized
tcactgcaacctccgcctcc

SEQ ID NO: 32745 - DNA, 20 bp, Artificial Sequence
  chemically synthesized
cactgcaacctccgcctccc

SEQ ID NO: 32746 - DNA, 20 bp, Artificial Sequence
  chemically synthesized
aacctccgcctcccaggttc

SEQ ID NO: 32747 - DNA, 20 bp, Artificial Sequence
  chemically synthesized
ttcaagcgattctcctacct

SEQ ID NO: 32748 - DNA, 20 bp, Artificial Sequence
  chemically synthesized
tcctacctcagcctcctgtg

SEQ ID NO: 32749 - DNA, 20 bp, Artificial Sequence
  chemically synthesized
ctcctgtgtagctgcaatta

SEQ ID NO: 32750 - DNA, 20 bp, Artificial Sequence
  chemically synthesized
tcctgtgtagctgcaattac

SEQ ID NO: 32751 - DNA, 20 bp, Artificial Sequence
  chemically synthesized
caattacaggcatctgccac

SEQ ID NO: 32752 - DNA, 20 bp, Artificial Sequence
  chemically synthesized
aattacaggcatctgccacc

SEQ ID NO: 32753 - DNA, 20 bp, Artificial Sequence
  chemically synthesized
taatttttttgtatttttat

SEQ ID NO: 32754 - DNA, 20 bp, Artificial Sequence
  chemically synthesized
atttttttgtatttttatta

SEQ ID NO: 32755 - DNA, 20 bp, Artificial Sequence
  chemically synthesized
ttttgtatttttattagaga

SEQ ID NO: 32756 - DNA, 20 bp, Artificial Sequence
  chemically synthesized
tttgtatttttattagagac

SEQ ID NO: 32757 - DNA, 20 bp, Artificial Sequence
  chemically synthesized
ttgtatttttattagagaca

SEQ ID NO: 32758 - DNA, 20 bp, Artificial Sequence
  chemically synthesized
gagacagggtttcaccatgt

SEQ ID NO: 32759 - DNA, 20 bp, Artificial Sequence
  chemically synthesized
cagggtttcaccatgttggt

SEQ ID NO: 32760 - DNA, 20 bp, Artificial Sequence
  chemically synthesized
agggtttcaccatgttggtc

SEQ ID NO: 32761 - DNA, 20 bp, Artificial Sequence
  chemically synthesized
tttcaccatgttggtcaggc

SEQ ID NO: 32762 - DNA, 20 bp, Artificial Sequence
  chemically synthesized
tggtctcgaactcttgccct

SEQ ID NO: 32763 - DNA, 20 bp, Artificial Sequence
  chemically synthesized
ggtctcgaactcttgccctc

SEQ ID NO: 32764 - DNA, 20 bp, Artificial Sequence
  chemically synthesized
ctcaggtgatcctcctgcct

SEQ ID NO: 32765 - DNA, 20 bp, Artificial Sequence
  chemically synthesized
cctcctgcctcagccaccca

SEQ ID NO: 32766 - DNA, 20 bp, Artificial Sequence
  chemically synthesized
gcctcagccacccaaagtgc

SEQ ID NO: 32767 - DNA, 20 bp, Artificial Sequence
  chemically synthesized
cctcagccacccaaagtgct

SEQ ID NO: 32768 - DNA, 20 bp, Artificial Sequence
  chemically synthesized
cacccaaagtgctgggatta

SEQ ID NO: 32769 - DNA, 20 bp, Artificial Sequence
  chemically synthesized
acccaaagtgctgggattac

SEQ ID NO: 32770 - DNA, 20 bp, Artificial Sequence
  chemically synthesized
agtgctgggattacaggcat

SEQ ID NO: 32771 - DNA, 20 bp, Artificial Sequence
  chemically synthesized
acaggcatgagtctgtaatg

SEQ ID NO: 32772 - DNA, 20 bp, Artificial Sequence
  chemically synthesized
taatgtagccttttctttaa

SEQ ID NO: 32773 - DNA, 20 bp, Artificial Sequence
  chemically synthesized
aatgtagccttttctttaac

SEQ ID NO: 32774 - DNA, 20 bp, Artificial Sequence
  chemically synthesized
tttctttaacaggctaccca

SEQ ID NO: 32775 - DNA, 20 bp, Artificial Sequence
  chemically synthesized
tctttaacaggctacccaca

SEQ ID NO: 32776 - DNA, 20 bp, Artificial Sequence
  chemically synthesized
ctttaacaggctacccacag

SEQ ID NO: 32777 - DNA, 20 bp, Artificial Sequence
  chemically synthesized
ccacagaggaaccttccctt

SEQ ID NO: 32778 - DNA, 20 bp, Artificial Sequence
  chemically synthesized
ccttcccttgagctcctttt

SEQ ID NO: 32779 - DNA, 20 bp, Artificial Sequence
  chemically synthesized
gattcttccttctgtttctc

SEQ ID NO: 32780 - DNA, 20 bp, Artificial Sequence
  chemically synthesized
tcatccttaacttcctactt

SEQ ID NO: 32781 - DNA, 20 bp, Artificial Sequence
  chemically synthesized
catccttaacttcctactta

SEQ ID NO: 32782 - DNA, 20 bp, Artificial Sequence
  chemically synthesized
ctgtttcttattttgcccac

SEQ ID NO: 32783 - DNA, 20 bp, Artificial Sequence
  chemically synthesized
tgtttcttattttgcccact

SEQ ID NO: 32784 - DNA, 20 bp, Artificial Sequence
  chemically synthesized
tgcccactgggttcacctct

SEQ ID NO: 32785 - DNA, 20 bp, Artificial Sequence
  chemically synthesized
acctctaagtcacacacaac

SEQ ID NO: 32786 - DNA, 20 bp, Artificial Sequence
  chemically synthesized
taagtcacacacaactggac

SEQ ID NO: 32787 - DNA, 20 bp, Artificial Sequence
  chemically synthesized
tcacacacaactggacaagt

SEQ ID NO: 32788 - DNA, 20 bp, Artificial Sequence
  chemically synthesized
ggacaagtaagcatacccct

SEQ ID NO: 32789 - DNA, 20 bp, Artificial Sequence
  chemically synthesized
ctcagcaactcttccattaa

SEQ ID NO: 32790 - DNA, 20 bp, Artificial Sequence
  chemically synthesized
ccccaaacatgctgattacc

SEQ ID NO: 32791 - DNA, 20 bp, Artificial Sequence
  chemically synthesized
ctgattacctggctgctcca

SEQ ID NO: 32792 - DNA, 20 bp, Artificial Sequence
  chemically synthesized
tgattacctggctgctccat

SEQ ID NO: 32793 - DNA, 20 bp, Artificial Sequence
  chemically synthesized
gattacctggctgctccata

SEQ ID NO: 32794 - DNA, 20 bp, Artificial Sequence
  chemically synthesized
tacctggctgctccataggg

SEQ ID NO: 32795 - DNA, 20 bp, Artificial Sequence
  chemically synthesized
tggctgctccatagggtggt

SEQ ID NO: 32796 - DNA, 20 bp, Artificial Sequence
  chemically synthesized
tgctccatagggtggttggt

SEQ ID NO: 32797 - DNA, 20 bp, Artificial Sequence
  chemically synthesized
tagggtggttggttggtctt

SEQ ID NO: 32798 - DNA, 20 bp, Artificial Sequence
  chemically synthesized
gttggtcttaagtctcccac

SEQ ID NO: 32799 - DNA, 20 bp, Artificial Sequence
  chemically synthesized
gtcttaagtctcccactagc

SEQ ID NO: 32800 - DNA, 20 bp, Artificial Sequence
  chemically synthesized
gtctcccactagccagcacc

SEQ ID NO: 32801 - DNA, 20 bp, Artificial Sequence
  chemically synthesized
tcccactagccagcacctag

SEQ ID NO: 32802 - DNA, 20 bp, Artificial Sequence
  chemically synthesized
gccagcacctagcagttctt

SEQ ID NO: 32803 - DNA, 20 bp, Artificial Sequence
  chemically synthesized
tagcagttcttcagtttgtg

SEQ ID NO: 32804 - DNA, 20 bp, Artificial Sequence
  chemically synthesized
tcttcagtttgtgtggttct

SEQ ID NO: 32805 - DNA, 20 bp, Artificial Sequence
  chemically synthesized
gtttgtgtggttctcagtgc

SEQ ID NO: 32806 - DNA, 20 bp, Artificial Sequence
  chemically synthesized
tcagtgctggtgatcatgct

SEQ ID NO: 32807 - DNA, 20 bp, Artificial Sequence
  chemically synthesized
ctgcccccttcatgcctctc

SEQ ID NO: 32808 - DNA, 20 bp, Artificial Sequence
  chemically synthesized
ccccttcatgcctctctggt

SEQ ID NO: 32809 - DNA, 20 bp, Artificial Sequence
  chemically synthesized
ttcatgcctctctggtcagt

SEQ ID NO: 32810 - DNA, 20 bp, Artificial Sequence
  chemically synthesized
ctctggtcagtcagaccctt

SEQ ID NO: 32811 - DNA, 20 bp, Artificial Sequence
  chemically synthesized
agtcagacccttcagaaccc

SEQ ID NO: 32812 - DNA, 20 bp, Artificial Sequence
  chemically synthesized
tcagacccttcagaacccaa

SEQ ID NO: 32813 - DNA, 20 bp, Artificial Sequence
  chemically synthesized
cagacccttcagaacccaag

SEQ ID NO: 32814 - DNA, 20 bp, Artificial Sequence
  chemically synthesized
cccttcagaacccaagaggt

SEQ ID NO: 32815 - DNA, 20 bp, Artificial Sequence
  chemically synthesized
ttcagaacccaagaggtaag

SEQ ID NO: 32816 - DNA, 20 bp, Artificial Sequence
  chemically synthesized
cagaacccaagaggtaagca

SEQ ID NO: 32817 - DNA, 20 bp, Artificial Sequence
  chemically synthesized
gaggtaagcagagttcctct

SEQ ID NO: 32818 - DNA, 20 bp, Artificial Sequence
  chemically synthesized
aagcagagttcctctaagaa

SEQ ID NO: 32819 - DNA, 20 bp, Artificial Sequence
  chemically synthesized
agagttcctctaagaatggt

SEQ ID NO: 32820 - DNA, 20 bp, Artificial Sequence
  chemically synthesized
ttaaacttcatcctgtcatc

SEQ ID NO: 32821 - DNA, 20 bp, Artificial Sequence
  chemically synthesized
acttcatcctgtcatcaagc

SEQ ID NO: 32822 - DNA, 20 bp, Artificial Sequence
  chemically synthesized
tcatcaagccagcacatact

SEQ ID NO: 32823 - DNA, 20 bp, Artificial Sequence
  chemically synthesized
actaagcatctataatgtgc

SEQ ID NO: 32824 - DNA, 20 bp, Artificial Sequence
  chemically synthesized
ctataatgtgctagacaatg

SEQ ID NO: 32825 - DNA, 20 bp, Artificial Sequence
  chemically synthesized
tataatgtgctagacaatgt

SEQ ID NO: 32826 - DNA, 20 bp, Artificial Sequence
  chemically synthesized
gtgctagacaatgtgggtaa

SEQ ID NO: 32827 - DNA, 20 bp, Artificial Sequence
  chemically synthesized
gctagacaatgtgggtaatg

SEQ ID NO: 32828 - DNA, 20 bp, Artificial Sequence
  chemically synthesized
ctagacaatgtgggtaatgg

SEQ ID NO: 32829 - DNA, 20 bp, Artificial Sequence
  chemically synthesized
tgggtaatggaggtgatgcc

SEQ ID NO: 32830 - DNA, 20 bp, Artificial Sequence
  chemically synthesized
attataatatctgccctcaa

SEQ ID NO: 32831 - DNA, 20 bp, Artificial Sequence
  chemically synthesized
atctattttttaaataatta

SEQ ID NO: 32832 - DNA, 20 bp, Artificial Sequence
  chemically synthesized
tctattttttaaataattac

SEQ ID NO: 32833 - DNA, 20 bp, Artificial Sequence
  chemically synthesized
acaggacaatttaaatgtat

SEQ ID NO: 32834 - DNA, 20 bp, Artificial Sequence
  chemically synthesized
acaatttaaatgtatcagtt

SEQ ID NO: 32835 - DNA, 20 bp, Artificial Sequence
  chemically synthesized
caatttaaatgtatcagttt

SEQ ID NO: 32836 - DNA, 20 bp, Artificial Sequence
  chemically synthesized
cagtttgggttgaataaaat

SEQ ID NO: 32837 - DNA, 20 bp, Artificial Sequence
  chemically synthesized
agtttgggttgaataaaatc

SEQ ID NO: 32838 - DNA, 20 bp, Artificial Sequence
  chemically synthesized
gtttgggttgaataaaatca

SEQ ID NO: 32839 - DNA, 20 bp, Artificial Sequence
  chemically synthesized
aaatcagggatgtttctcat

SEQ ID NO: 32840 - DNA, 20 bp, Artificial Sequence
  chemically synthesized
aatcagggatgtttctcatt

SEQ ID NO: 32841 - DNA, 20 bp, Artificial Sequence
  chemically synthesized
atcagggatgtttctcatta

SEQ ID NO: 32842 - DNA, 20 bp, Artificial Sequence
  chemically synthesized
cattagggcctcaacacatt

SEQ ID NO: 32843 - DNA, 20 bp, Artificial Sequence
  chemically synthesized
ttagggcctcaacacatttg

SEQ ID NO: 32844 - DNA, 20 bp, Artificial Sequence
  chemically synthesized
tagggcctcaacacatttgg

SEQ ID NO: 32845 - DNA, 20 bp, Artificial Sequence
  chemically synthesized
aacacatttggaggtgtgtt

SEQ ID NO: 32846 - DNA, 20 bp, Artificial Sequence
  chemically synthesized
catttggaggtgtgttaaga

SEQ ID NO: 32847 - DNA, 20 bp, Artificial Sequence
  chemically synthesized
ttggaggtgtgttaagacag

SEQ ID NO: 32848 - DNA, 20 bp, Artificial Sequence
  chemically synthesized
aggtgtgttaagacagtagt

SEQ ID NO: 32849 - DNA, 20 bp, Artificial Sequence
  chemically synthesized
acagtagtcagattcacacc

SEQ ID NO: 32850 - DNA, 20 bp, Artificial Sequence
  chemically synthesized
agtagtcagattcacaccaa

SEQ ID NO: 32851 - DNA, 20 bp, Artificial Sequence
  chemically synthesized
tcacaccaagagccctgtca

SEQ ID NO: 32852 - DNA, 20 bp, Artificial Sequence
  chemically synthesized
atgctttgtgaaaaaacttc

SEQ ID NO: 32853 - DNA, 20 bp, Artificial Sequence
  chemically synthesized
tgctttgtgaaaaaacttcg

SEQ ID NO: 32854 - DNA, 20 bp, Artificial Sequence
  chemically synthesized
tttgtgaaaaaacttcgagg

SEQ ID NO: 32855 - DNA, 20 bp, Artificial Sequence
  chemically synthesized
gaaaaaacttcgaggtagta

SEQ ID NO: 32856 - DNA, 20 bp, Artificial Sequence
  chemically synthesized
gccatatcctatcctgtgca

SEQ ID NO: 32857 - DNA, 20 bp, Artificial Sequence
  chemically synthesized
tatcctatcctgtgcataga

SEQ ID NO: 32858 - DNA, 20 bp, Artificial Sequence
  chemically synthesized
atcctatcctgtgcatagac

SEQ ID NO: 32859 - DNA, 20 bp, Artificial Sequence
  chemically synthesized
cctgtgcatagacaggaaaa

SEQ ID NO: 32860 - DNA, 20 bp, Artificial Sequence
  chemically synthesized
acaggaaaatggttgctgac

SEQ ID NO: 32861 - DNA, 20 bp, Artificial Sequence
  chemically synthesized
ggaaaatggttgctgactgg

SEQ ID NO: 32862 - DNA, 20 bp, Artificial Sequence
  chemically synthesized
atggttgctgactggcagac

SEQ ID NO: 32863 - DNA, 20 bp, Artificial Sequence
  chemically synthesized
gctgactggcagaccagaat

SEQ ID NO: 32864 - DNA, 20 bp, Artificial Sequence
  chemically synthesized
ctgactggcagaccagaatt

SEQ ID NO: 32865 - DNA, 20 bp, Artificial Sequence
  chemically synthesized
catctaaatgcatctctcca

SEQ ID NO: 32866 - DNA, 20 bp, Artificial Sequence
  chemically synthesized
tctctccacagcgatttcta

SEQ ID NO: 32867 - DNA, 20 bp, Artificial Sequence
  chemically synthesized
cttgtctctcatcccatatt

SEQ ID NO: 32868 - DNA, 20 bp, Artificial Sequence
  chemically synthesized
ttggttacttgttgccatgc

SEQ ID NO: 32869 - DNA, 20 bp, Artificial Sequence
  chemically synthesized
tggttacttgttgccatgcc

SEQ ID NO: 32870 - DNA, 20 bp, Artificial Sequence
  chemically synthesized
acttgttgccatgccgggac

SEQ ID NO: 32871 - DNA, 20 bp, Artificial Sequence
  chemically synthesized
tgccgggaccagccatgcat

SEQ ID NO: 32872 - DNA, 20 bp, Artificial Sequence
  chemically synthesized
gccatgcattggtttgcctt

SEQ ID NO: 32873 - DNA, 20 bp, Artificial Sequence
  chemically synthesized
cattggtttgcctttggcat

SEQ ID NO: 32874 - DNA, 20 bp, Artificial Sequence
  chemically synthesized
ctctatacccatgttttcca

SEQ ID NO: 32875 - DNA, 20 bp, Artificial Sequence
  chemically synthesized
atacccatgttttccacagc

SEQ ID NO: 32876 - DNA, 20 bp, Artificial Sequence
  chemically synthesized
tttccacagctggcaaacac

SEQ ID NO: 32877 - DNA, 20 bp, Artificial Sequence
  chemically synthesized
ccacagctggcaaacaccag

SEQ ID NO: 32878 - DNA, 20 bp, Artificial Sequence
  chemically synthesized
aataacactgttctcaccac

SEQ ID NO: 32879 - DNA, 20 bp, Artificial Sequence
  chemically synthesized
gttctcaccaccagcccttc

SEQ ID NO: 32880 - DNA, 20 bp, Artificial Sequence
  chemically synthesized
caccagcccttctggttcac

SEQ ID NO: 32881 - DNA, 20 bp, Artificial Sequence
  chemically synthesized
tggttcactagatgtttcca

SEQ ID NO: 32882 - DNA, 20 bp, Artificial Sequence
  chemically synthesized
gttcactagatgtttccatg

SEQ ID NO: 32883 - DNA, 20 bp, Artificial Sequence
  chemically synthesized
tccatggagtcctgatataa

SEQ ID NO: 32884 - DNA, 20 bp, Artificial Sequence
  chemically synthesized
tagacaacttattttaaaca

SEQ ID NO: 32885 - DNA, 20 bp, Artificial Sequence
  chemically synthesized
cttattttaaacacagttgc

SEQ ID NO: 32886 - DNA, 20 bp, Artificial Sequence
  chemically synthesized
ccctacactctaaatgtcta

SEQ ID NO: 32887 - DNA, 20 bp, Artificial Sequence
  chemically synthesized
taaatgtctacagaactcac

SEQ ID NO: 32888 - DNA, 20 bp, Artificial Sequence
  chemically synthesized
tctacagaactcaccagaca

SEQ ID NO: 32889 - DNA, 20 bp, Artificial Sequence
  chemically synthesized
acagaactcaccagacaaag

SEQ ID NO: 32890 - DNA, 20 bp, Artificial Sequence
  chemically synthesized
actcaccagacaaagaagaa

SEQ ID NO: 32891 - DNA, 20 bp, Artificial Sequence
  chemically synthesized
gacaaagaagaaaagttatt

SEQ ID NO: 32892 - DNA, 20 bp, Artificial Sequence
  chemically synthesized
aaagaagaaaagttatttag

SEQ ID NO: 32893 - DNA, 20 bp, Artificial Sequence
  chemically synthesized
agttatttagcagttgtgat

SEQ ID NO: 32894 - DNA, 20 bp, Artificial Sequence
  chemically synthesized
ataagctaccacttgaattc

SEQ ID NO: 32895 - DNA, 20 bp, Artificial Sequence
  chemically synthesized
taagctaccacttgaattca

SEQ ID NO: 32896 - DNA, 20 bp, Artificial Sequence
  chemically synthesized
cttgaattcaaggttattac

SEQ ID NO: 32897 - DNA, 20 bp, Artificial Sequence
  chemically synthesized
agcatgattattgacacatt

SEQ ID NO: 32898 - DNA, 20 bp, Artificial Sequence
  chemically synthesized
ttgacacatttggttttatt

SEQ ID NO: 32899 - DNA, 20 bp, Artificial Sequence
  chemically synthesized
tgagtgtcccttatttgccc

SEQ ID NO: 32900 - DNA, 20 bp, Artificial Sequence
  chemically synthesized
ccaagattcattgctgtgac

SEQ ID NO: 32901 - DNA, 20 bp, Artificial Sequence
  chemically synthesized
attgctgtgacaagaatgac

SEQ ID NO: 32902 - DNA, 20 bp, Artificial Sequence
  chemically synthesized
gctgtgacaagaatgacaag

SEQ ID NO: 32903 - DNA, 20 bp, Artificial Sequence
  chemically synthesized
gtgacaagaatgacaagaag

SEQ ID NO: 32904 - DNA, 20 bp, Artificial Sequence
  chemically synthesized
acaagaatgacaagaagaag

SEQ ID NO: 32905 - DNA, 20 bp, Artificial Sequence
  chemically synthesized
acaagaagaagcagttactt

SEQ ID NO: 32906 - DNA, 20 bp, Artificial Sequence
  chemically synthesized
ttacttgagaaatccccttg

SEQ ID NO: 32907 - DNA, 20 bp, Artificial Sequence
  chemically synthesized
ttctccttgtgtatccacca

SEQ ID NO: 32908 - DNA, 20 bp, Artificial Sequence
  chemically synthesized
tccttgtgtatccaccatag

SEQ ID NO: 32909 - DNA, 20 bp, Artificial Sequence
  chemically synthesized
tttaataaaactatattaaa

SEQ ID NO: 32910 - DNA, 20 bp, Artificial Sequence
  chemically synthesized
attaaatggaaattcaccaa

SEQ ID NO: 32911 - DNA, 20 bp, Artificial Sequence
  chemically synthesized
gaaattcaccaatagaaact

SEQ ID NO: 32912 - DNA, 20 bp, Artificial Sequence
  chemically synthesized
aaattcaccaatagaaactt

SEQ ID NO: 32913 - DNA, 20 bp, Artificial Sequence
  chemically synthesized
tcaccaatagaaacttagga

SEQ ID NO: 32914 - DNA, 20 bp, Artificial Sequence
  chemically synthesized
caccaatagaaacttaggaa

SEQ ID NO: 32915 - DNA, 20 bp, Artificial Sequence
  chemically synthesized
gaaacttaggaaaggtaaca

SEQ ID NO: 32916 - DNA, 20 bp, Artificial Sequence
  chemically synthesized
gaaaggtaacaaagtcctgt

SEQ ID NO: 32917 - DNA, 20 bp, Artificial Sequence
  chemically synthesized
aaaggtaacaaagtcctgtg

SEQ ID NO: 32918 - DNA, 20 bp, Artificial Sequence
  chemically synthesized
gtaacaaagtcctgtgaggt

SEQ ID NO: 32919 - DNA, 20 bp, Artificial Sequence
  chemically synthesized
aagtcctgtgaggttggctt

SEQ ID NO: 32920 - DNA, 20 bp, Artificial Sequence
  chemically synthesized
gaggttggcttcagcatatc

SEQ ID NO: 32921 - DNA, 20 bp, Artificial Sequence
  chemically synthesized
gcatatccagaacacatgct

SEQ ID NO: 32922 - DNA, 20 bp, Artificial Sequence
  chemically synthesized
catatccagaacacatgctc

SEQ ID NO: 32923 - DNA, 20 bp, Artificial Sequence
  chemically synthesized
atccagaacacatgctcagg

SEQ ID NO: 32924 - DNA, 20 bp, Artificial Sequence
  chemically synthesized
tccagaacacatgctcagga

SEQ ID NO: 32925 - DNA, 20 bp, Artificial Sequence
  chemically synthesized
agaacacatgctcaggaagg

SEQ ID NO: 32926 - DNA, 20 bp, Artificial Sequence
  chemically synthesized
aacacatgctcaggaaggaa

SEQ ID NO: 32927 - DNA, 20 bp, Artificial Sequence
  chemically synthesized
acacatgctcaggaaggaag

SEQ ID NO: 32928 - DNA, 20 bp, Artificial Sequence
  chemically synthesized
cacatgctcaggaaggaaga

SEQ ID NO: 32929 - DNA, 20 bp, Artificial Sequence
  chemically synthesized
atgctcaggaaggaagaggg

SEQ ID NO: 32930 - DNA, 20 bp, Artificial Sequence
  chemically synthesized
tgctcaggaaggaagagggt

SEQ ID NO: 32931 - DNA, 20 bp, Artificial Sequence
  chemically synthesized
gctcaggaaggaagagggtg

SEQ ID NO: 32932 - DNA, 20 bp, Artificial Sequence
  chemically synthesized
ctcaggaaggaagagggtgg

SEQ ID NO: 32933 - DNA, 20 bp, Artificial Sequence
  chemically synthesized
tcaggaaggaagagggtggg

SEQ ID NO: 32934 - DNA, 20 bp, Artificial Sequence
  chemically synthesized
ggtggggggaccctgtaaac

SEQ ID NO: 32935 - DNA, 20 bp, Artificial Sequence
  chemically synthesized
gtggggggaccctgtaaaca

SEQ ID NO: 32936 - DNA, 20 bp, Artificial Sequence
  chemically synthesized
tggggggaccctgtaaacaa

SEQ ID NO: 32937 - DNA, 20 bp, Artificial Sequence
  chemically synthesized
gactttgatcattcactttg

SEQ ID NO: 32938 - DNA, 20 bp, Artificial Sequence
  chemically synthesized
ctttgatcattcactttgaa

SEQ ID NO: 32939 - DNA, 20 bp, Artificial Sequence
  chemically synthesized
aagagtcttctgtcatatgc

SEQ ID NO: 32940 - DNA, 20 bp, Artificial Sequence
  chemically synthesized
gtcttctgtcatatgctgga

SEQ ID NO: 32941 - DNA, 20 bp, Artificial Sequence
  chemically synthesized
tcttctgtcatatgctggat

SEQ ID NO: 32942 - DNA, 20 bp, Artificial Sequence
  chemically synthesized
tcatatgctggatgggcaaa

SEQ ID NO: 32943 - DNA, 20 bp, Artificial Sequence
  chemically synthesized
tgctggatgggcaaacagct

SEQ ID NO: 32944 - DNA, 20 bp, Artificial Sequence
  chemically synthesized
ctggatgggcaaacagctta

SEQ ID NO: 32945 - DNA, 20 bp, Artificial Sequence
  chemically synthesized
tggatgggcaaacagcttag

SEQ ID NO: 32946 - DNA, 20 bp, Artificial Sequence
  chemically synthesized
ggatgggcaaacagcttaga

SEQ ID NO: 32947 - DNA, 20 bp, Artificial Sequence
  chemically synthesized
aacagcttagagggctgcct

SEQ ID NO: 32948 - DNA, 20 bp, Artificial Sequence
  chemically synthesized
cagcttagagggctgcctta

SEQ ID NO: 32949 - DNA, 20 bp, Artificial Sequence
  chemically synthesized
tgccttagagtgcacaaaat

SEQ ID NO: 32950 - DNA, 20 bp, Artificial Sequence
  chemically synthesized
ccttagagtgcacaaaatca

SEQ ID NO: 32951 - DNA, 20 bp, Artificial Sequence
  chemically synthesized
tgcacaaaatcagagatatt

SEQ ID NO: 32952 - DNA, 20 bp, Artificial Sequence
  chemically synthesized
cacaaaatcagagatattca

SEQ ID NO: 32953 - DNA, 20 bp, Artificial Sequence
  chemically synthesized
agatattcagagatgcacat

SEQ ID NO: 32954 - DNA, 20 bp, Artificial Sequence
  chemically synthesized
gatattcagagatgcacatg

SEQ ID NO: 32955 - DNA, 20 bp, Artificial Sequence
  chemically synthesized
ttcagagatgcacatgagga

SEQ ID NO: 32956 - DNA, 20 bp, Artificial Sequence
  chemically synthesized
cagagatgcacatgaggatg

SEQ ID NO: 32957 - DNA, 20 bp, Artificial Sequence
  chemically synthesized
gatgcacatgaggatggagt

SEQ ID NO: 32958 - DNA, 20 bp, Artificial Sequence
  chemically synthesized
gcacatgaggatggagtgag

SEQ ID NO: 32959 - DNA, 20 bp, Artificial Sequence
  chemically synthesized
acatgaggatggagtgagaa

SEQ ID NO: 32960 - DNA, 20 bp, Artificial Sequence
  chemically synthesized
catgaggatggagtgagaag

SEQ ID NO: 32961 - DNA, 20 bp, Artificial Sequence
  chemically synthesized
gaggatggagtgagaagagg

SEQ ID NO: 32962 - DNA, 20 bp, Artificial Sequence
  chemically synthesized
ggatggagtgagaagaggaa

SEQ ID NO: 32963 - DNA, 20 bp, Artificial Sequence
  chemically synthesized
atggagtgagaagaggaaga

SEQ ID NO: 32964 - DNA, 20 bp, Artificial Sequence
  chemically synthesized
ggagtgagaagaggaagaga

SEQ ID NO: 32965 - DNA, 20 bp, Artificial Sequence
  chemically synthesized
acataaatacctctcacgct

SEQ ID NO: 32966 - DNA, 20 bp, Artificial Sequence
  chemically synthesized
gtttattttttcatttaata

SEQ ID NO: 32967 - DNA, 20 bp, Artificial Sequence
  chemically synthesized
tttaatacagaatatttttt

SEQ ID NO: 32968 - DNA, 20 bp, Artificial Sequence
  chemically synthesized
ttaagctcctactctcttca

SEQ ID NO: 32969 - DNA, 20 bp, Artificial Sequence
  chemically synthesized
tcttcaaagcactgtgctta

SEQ ID NO: 32970 - DNA, 20 bp, Artificial Sequence
  chemically synthesized
caaagcactgtgcttaaagc

SEQ ID NO: 32971 - DNA, 20 bp, Artificial Sequence
  chemically synthesized
ctgtgcttaaagctggcatg

SEQ ID NO: 32972 - DNA, 20 bp, Artificial Sequence
  chemically synthesized
ctggcatgtagttgaattta

SEQ ID NO: 32973 - DNA, 20 bp, Artificial Sequence
  chemically synthesized
atgtagttgaatttatagtc

SEQ ID NO: 32974 - DNA, 20 bp, Artificial Sequence
  chemically synthesized
agttgaatttatagtccagc

SEQ ID NO: 32975 - DNA, 20 bp, Artificial Sequence
  chemically synthesized
gttgaatttatagtccagca

SEQ ID NO: 32976 - DNA, 20 bp, Artificial Sequence
  chemically synthesized
tgaatttatagtccagcaag

SEQ ID NO: 32977 - DNA, 20 bp, Artificial Sequence
  chemically synthesized
cagcaaggagactgaccatt

SEQ ID NO: 32978 - DNA, 20 bp, Artificial Sequence
  chemically synthesized
accattgagaattacaaata

SEQ ID NO: 32979 - DNA, 20 bp, Artificial Sequence
  chemically synthesized
attgagaattacaaatatgg

SEQ ID NO: 32980 - DNA, 20 bp, Artificial Sequence
  chemically synthesized
ttgagaattacaaatatggc

SEQ ID NO: 32981 - DNA, 20 bp, Artificial Sequence
  chemically synthesized
atatggcaggaatttctaaa

SEQ ID NO: 32982 - DNA, 20 bp, Artificial Sequence
  chemically synthesized
ggcaggaatttctaaacaga

SEQ ID NO: 32983 - DNA, 20 bp, Artificial Sequence
  chemically synthesized
tttctaaacagaaagatgtg

SEQ ID NO: 32984 - DNA, 20 bp, Artificial Sequence
  chemically synthesized
gcagctctcatatcctgtca

SEQ ID NO: 32985 - DNA, 20 bp, Artificial Sequence
  chemically synthesized
cacagaaatgacacatcaca

SEQ ID NO: 32986 - DNA, 20 bp, Artificial Sequence
  chemically synthesized
atagctcctaaactgcatca

SEQ ID NO: 32987 - DNA, 20 bp, Artificial Sequence
  chemically synthesized
tgacctcctgtttctgcatt

SEQ ID NO: 32988 - DNA, 20 bp, Artificial Sequence
  chemically synthesized
catatcaccccaaattccaa

SEQ ID NO: 32989 - DNA, 20 bp, Artificial Sequence
  chemically synthesized
caaattccaatggttttgtg

SEQ ID NO: 32990 - DNA, 20 bp, Artificial Sequence
  chemically synthesized
tccaatggttttgtgaagtc

SEQ ID NO: 32991 - DNA, 20 bp, Artificial Sequence
  chemically synthesized
tggttttgtgaagtcaagat

SEQ ID NO: 32992 - DNA, 20 bp, Artificial Sequence
  chemically synthesized
ttttgtgaagtcaagattgg

SEQ ID NO: 32993 - DNA, 20 bp, Artificial Sequence
  chemically synthesized
tgaagtcaagattggtggtc

SEQ ID NO: 32994 - DNA, 20 bp, Artificial Sequence
  chemically synthesized
gaagtcaagattggtggtca

SEQ ID NO: 32995 - DNA, 20 bp, Artificial Sequence
  chemically synthesized
caagattggtggtcaaggtc

SEQ ID NO: 32996 - DNA, 20 bp, Artificial Sequence
  chemically synthesized
aagattggtggtcaaggtcg

SEQ ID NO: 32997 - DNA, 20 bp, Artificial Sequence
  chemically synthesized
agattggtggtcaaggtcga

SEQ ID NO: 32998 - DNA, 20 bp, Artificial Sequence
  chemically synthesized
tggtggtcaaggtcgaggga

SEQ ID NO: 32999 - DNA, 20 bp, Artificial Sequence
  chemically synthesized
caaggtcgagggaaagtgca

SEQ ID NO: 33000 - DNA, 20 bp, Artificial Sequence
  chemically synthesized
agggaaagtgcacagatcaa

SEQ ID NO: 33001 - DNA, 20 bp, Artificial Sequence
  chemically synthesized
aactatgtcaaactttgtca

SEQ ID NO: 33002 - DNA, 20 bp, Artificial Sequence
  chemically synthesized
atgtcaaactttgtcatagc

SEQ ID NO: 33003 - DNA, 20 bp, Artificial Sequence
  chemically synthesized
aaactttgtcatagctagat

SEQ ID NO: 33004 - DNA, 20 bp, Artificial Sequence
  chemically synthesized
agatgagctttttgaactta

SEQ ID NO: 33005 - DNA, 20 bp, Artificial Sequence
  chemically synthesized
acttaaagtttgtcaaaatt

SEQ ID NO: 33006 - DNA, 20 bp, Artificial Sequence
  chemically synthesized
cttaaagtttgtcaaaattt

SEQ ID NO: 33007 - DNA, 20 bp, Artificial Sequence
  chemically synthesized
ttaggaaaatattttgccct

SEQ ID NO: 33008 - DNA, 20 bp, Artificial Sequence
  chemically synthesized
taggaaaatattttgccctt

SEQ ID NO: 33009 - DNA, 20 bp, Artificial Sequence
  chemically synthesized
gaaaatattttgcccttagg

SEQ ID NO: 33010 - DNA, 20 bp, Artificial Sequence
  chemically synthesized
tgaaaattttactctttctt

SEQ ID NO: 33011 - DNA, 20 bp, Artificial Sequence
  chemically synthesized
tttactctttctttagtgtt

SEQ ID NO: 33012 - DNA, 20 bp, Artificial Sequence
  chemically synthesized
aatcgaccttattgcaacca

SEQ ID NO: 33013 - DNA, 20 bp, Artificial Sequence
  chemically synthesized
tcgaccttattgcaaccatg

SEQ ID NO: 33014 - DNA, 20 bp, Artificial Sequence
  chemically synthesized
ttattgcaaccatggagaat

SEQ ID NO: 33015 - DNA, 20 bp, Artificial Sequence
  chemically synthesized
tgcaaccatggagaatgaga

SEQ ID NO: 33016 - DNA, 20 bp, Artificial Sequence
  chemically synthesized
atggagaatgagatagtacc

SEQ ID NO: 33017 - DNA, 20 bp, Artificial Sequence
  chemically synthesized
gaatgagatagtacctggct

SEQ ID NO: 33018 - DNA, 20 bp, Artificial Sequence
  chemically synthesized
atgagatagtacctggctca

SEQ ID NO: 33019 - DNA, 20 bp, Artificial Sequence
  chemically synthesized
tgagatagtacctggctcag

SEQ ID NO: 33020 - DNA, 20 bp, Artificial Sequence
  chemically synthesized
ggtccacatcacataatatg

SEQ ID NO: 33021 - DNA, 20 bp, Artificial Sequence
  chemically synthesized
gtccacatcacataatatgt

SEQ ID NO: 33022 - DNA, 20 bp, Artificial Sequence
  chemically synthesized
tctatcactacactgttgtg

SEQ ID NO: 33023 - DNA, 20 bp, Artificial Sequence
  chemically synthesized
tgttgtgaagccctgttctc

SEQ ID NO: 33024 - DNA, 20 bp, Artificial Sequence
  chemically synthesized
tgaagccctgttctccagcc

SEQ ID NO: 33025 - DNA, 20 bp, Artificial Sequence
  chemically synthesized
gaagccctgttctccagccc

SEQ ID NO: 33026 - DNA, 20 bp, Artificial Sequence
  chemically synthesized
cattcttccattcctaacac

SEQ ID NO: 33027 - DNA, 20 bp, Artificial Sequence
  chemically synthesized
cacaagcttctcctccttta

SEQ ID NO: 33028 - DNA, 20 bp, Artificial Sequence
  chemically synthesized
cttctcctcctttacagaaa

SEQ ID NO: 33029 - DNA, 20 bp, Artificial Sequence
  chemically synthesized
ttctcctcctttacagaaat

SEQ ID NO: 33030 - DNA, 20 bp, Artificial Sequence
  chemically synthesized
tcctttacagaaatgggtct

SEQ ID NO: 33031 - DNA, 20 bp, Artificial Sequence
  chemically synthesized
tatacctgccatgtcatgct

SEQ ID NO: 33032 - DNA, 20 bp, Artificial Sequence
  chemically synthesized
acctgccatgtcatgctgag

SEQ ID NO: 33033 - DNA, 20 bp, Artificial Sequence
  chemically synthesized
cctgccatgtcatgctgagt

SEQ ID NO: 33034 - DNA, 20 bp, Artificial Sequence
  chemically synthesized
ctgccatgtcatgctgagtg

SEQ ID NO: 33035 - DNA, 20 bp, Artificial Sequence
  chemically synthesized
tgccatgtcatgctgagtgg

SEQ ID NO: 33036 - DNA, 20 bp, Artificial Sequence
  chemically synthesized
atgtcatgctgagtgggggc

SEQ ID NO: 33037 - DNA, 20 bp, Artificial Sequence
  chemically synthesized
tgtcatgctgagtgggggct

SEQ ID NO: 33038 - DNA, 20 bp, Artificial Sequence
  chemically synthesized
gtcatgctgagtgggggctg

SEQ ID NO: 33039 - DNA, 20 bp, Artificial Sequence
  chemically synthesized
agtgggggctggggtttgca

SEQ ID NO: 33040 - DNA, 20 bp, Artificial Sequence
  chemically synthesized
tgggggctggggtttgcaaa

SEQ ID NO: 33041 - DNA, 20 bp, Artificial Sequence
  chemically synthesized
ggggctggggtttgcaaaga

SEQ ID NO: 33042 - DNA, 20 bp, Artificial Sequence
  chemically synthesized
gctggggtttgcaaagagag

SEQ ID NO: 33043 - DNA, 20 bp, Artificial Sequence
  chemically synthesized
gggtttgcaaagagagaaga

SEQ ID NO: 33044 - DNA, 20 bp, Artificial Sequence
  chemically synthesized
ttgcaaagagagaagacagc

SEQ ID NO: 33045 - DNA, 20 bp, Artificial Sequence
  chemically synthesized
tgcaaagagagaagacagct

SEQ ID NO: 33046 - DNA, 20 bp, Artificial Sequence
  chemically synthesized
gcaaagagagaagacagcta

SEQ ID NO: 33047 - DNA, 20 bp, Artificial Sequence
  chemically synthesized
gctagggaacataattgcta

SEQ ID NO: 33048 - DNA, 20 bp, Artificial Sequence
  chemically synthesized
tttctattgtacactaaata

SEQ ID NO: 33049 - DNA, 20 bp, Artificial Sequence
  chemically synthesized
attgtacactaaatatagtc

SEQ ID NO: 33050 - DNA, 20 bp, Artificial Sequence
  chemically synthesized
tagtctggatgtattgcata

SEQ ID NO: 33051 - DNA, 20 bp, Artificial Sequence
  chemically synthesized
gatgtattgcatatggtccc

SEQ ID NO: 33052 - DNA, 20 bp, Artificial Sequence
  chemically synthesized
atatggtccctagtttttaa

SEQ ID NO: 33053 - DNA, 20 bp, Artificial Sequence
  chemically synthesized
actttcccgctttccaataa

SEQ ID NO: 33054 - DNA, 20 bp, Artificial Sequence
  chemically synthesized
gctttccaataacagaatga

SEQ ID NO: 33055 - DNA, 20 bp, Artificial Sequence
  chemically synthesized
tccaataacagaatgatgga

SEQ ID NO: 33056 - DNA, 20 bp, Artificial Sequence
  chemically synthesized
aatgatggaaagaccttcac

SEQ ID NO: 33057 - DNA, 20 bp, Artificial Sequence
  chemically synthesized
accttcacaagtccaaacac

SEQ ID NO: 33058 - DNA, 20 bp, Artificial Sequence
  chemically synthesized
caagtccaaacacaagcaaa

SEQ ID NO: 33059 - DNA, 20 bp, Artificial Sequence
  chemically synthesized
aacacaagcaaatggccaaa

SEQ ID NO: 33060 - DNA, 20 bp, Artificial Sequence
  chemically synthesized
acaagcaaatggccaaatgg

SEQ ID NO: 33061 - DNA, 20 bp, Artificial Sequence
  chemically synthesized
aagcaaatggccaaatggca

SEQ ID NO: 33062 - DNA, 20 bp, Artificial Sequence
  chemically synthesized
gttctttttctgtgtcacat

SEQ ID NO: 33063 - DNA, 20 bp, Artificial Sequence
  chemically synthesized
ttctgtgtcacataagattc

SEQ ID NO: 33064 - DNA, 20 bp, Artificial Sequence
  chemically synthesized
gattccagacaatataatct

SEQ ID NO: 33065 - DNA, 20 bp, Artificial Sequence
  chemically synthesized
tccagacaatataatcttag

SEQ ID NO: 33066 - DNA, 20 bp, Artificial Sequence
  chemically synthesized
ataatcttagtagtatctat

SEQ ID NO: 33067 - DNA, 20 bp, Artificial Sequence
  chemically synthesized
tgcattcacactcaaaaact

SEQ ID NO: 33068 - DNA, 20 bp, Artificial Sequence
  chemically synthesized
aaaaacttggtatctgtgct

SEQ ID NO: 33069 - DNA, 20 bp, Artificial Sequence
  chemically synthesized
atctgtgcttggtttaataa

SEQ ID NO: 33070 - DNA, 20 bp, Artificial Sequence
  chemically synthesized
tgtgcttggtttaataaaag

SEQ ID NO: 33071 - DNA, 20 bp, Artificial Sequence
  chemically synthesized
cttggtttaataaaagtagt

SEQ ID NO: 33072 - DNA, 20 bp, Artificial Sequence
  chemically synthesized
aaagtagtgagtgtacctca

SEQ ID NO: 33073 - DNA, 20 bp, Artificial Sequence
  chemically synthesized
agtagtgagtgtacctcatg

SEQ ID NO: 33074 - DNA, 20 bp, Artificial Sequence
  chemically synthesized
tgagtgtacctcatggagct

SEQ ID NO: 33075 - DNA, 20 bp, Artificial Sequence
  chemically synthesized
gtgtacctcatggagctgag

SEQ ID NO: 33076 - DNA, 20 bp, Artificial Sequence
  chemically synthesized
tacctcatggagctgagtgg

SEQ ID NO: 33077 - DNA, 20 bp, Artificial Sequence
  chemically synthesized
tgtgtttatgattgtgtgtg

SEQ ID NO: 33078 - DNA, 20 bp, Artificial Sequence
  chemically synthesized
tgtgtgtggcgcttttgtgt

SEQ ID NO: 33079 - DNA, 20 bp, Artificial Sequence
  chemically synthesized
tgtgtggcgcttttgtgtga

SEQ ID NO: 33080 - DNA, 20 bp, Artificial Sequence
  chemically synthesized
tgtggcgcttttgtgtgaga

SEQ ID NO: 33081 - DNA, 20 bp, Artificial Sequence
  chemically synthesized
tggcgcttttgtgtgagaga

SEQ ID NO: 33082 - DNA, 20 bp, Artificial Sequence
  chemically synthesized
gcgcttttgtgtgagagaga

SEQ ID NO: 33083 - DNA, 20 bp, Artificial Sequence
  chemically synthesized
agtgtgtgtgtatgtgtgtc

SEQ ID NO: 33084 - DNA, 20 bp, Artificial Sequence
  chemically synthesized
tgtgtgtgtatgtgtgtcaa

SEQ ID NO: 33085 - DNA, 20 bp, Artificial Sequence
  chemically synthesized
gtgtgtgtatgtgtgtcaag

SEQ ID NO: 33086 - DNA, 20 bp, Artificial Sequence
  chemically synthesized
tgtatgtgtgtcaagaggtt

SEQ ID NO: 33087 - DNA, 20 bp, Artificial Sequence
  chemically synthesized
gtatgtgtgtcaagaggtta

SEQ ID NO: 33088 - DNA, 20 bp, Artificial Sequence
  chemically synthesized
tatgtgtgtcaagaggttaa

SEQ ID NO: 33089 - DNA, 20 bp, Artificial Sequence
  chemically synthesized
gtcaagaggttaagggctta

SEQ ID NO: 33090 - DNA, 20 bp, Artificial Sequence
  chemically synthesized
tcaagaggttaagggcttaa

SEQ ID NO: 33091 - DNA, 20 bp, Artificial Sequence
  chemically synthesized
ggcttaaaggaacaattaat

SEQ ID NO: 33092 - DNA, 20 bp, Artificial Sequence
  chemically synthesized
aggaacaattaattggtgat

SEQ ID NO: 33093 - DNA, 20 bp, Artificial Sequence
  chemically synthesized
ggaacaattaattggtgatt

SEQ ID NO: 33094 - DNA, 20 bp, Artificial Sequence
  chemically synthesized
ggatcatgtactcaacacca

SEQ ID NO: 33095 - DNA, 20 bp, Artificial Sequence
  chemically synthesized
gtactcaacaccatagcttg

SEQ ID NO: 33096 - DNA, 20 bp, Artificial Sequence
  chemically synthesized
aacgatgtctgtccactcac

SEQ ID NO: 33097 - DNA, 20 bp, Artificial Sequence
  chemically synthesized
gtgtgtgtgtgtgtgtgtgt

SEQ ID NO: 33098 - DNA, 20 bp, Artificial Sequence
  chemically synthesized
tgtgtgtgtgtgtgtgtgtg

SEQ ID NO: 33099 - DNA, 20 bp, Artificial Sequence
  chemically synthesized
gtgtgtgtgtgtgtgtgtga

SEQ ID NO: 33100 - DNA, 20 bp, Artificial Sequence
  chemically synthesized
tgtgtgtgtgtgtgtgtgag

SEQ ID NO: 33101 - DNA, 20 bp, Artificial Sequence
  chemically synthesized
tgtgtgtgtgtgtgaggggt

SEQ ID NO: 33102 - DNA, 20 bp, Artificial Sequence
  chemically synthesized
gtgtgtgtgtgtgaggggtt

SEQ ID NO: 33103 - DNA, 20 bp, Artificial Sequence
  chemically synthesized
gtgaggggttgggttcgttg

SEQ ID NO: 33104 - DNA, 20 bp, Artificial Sequence
  chemically synthesized
tgaggggttgggttcgttgt

SEQ ID NO: 33105 - DNA, 20 bp, Artificial Sequence
  chemically synthesized
gaggggttgggttcgttgtg

SEQ ID NO: 33106 - DNA, 20 bp, Artificial Sequence
  chemically synthesized
ttcgttgtggggaaacactt

SEQ ID NO: 33107 - DNA, 20 bp, Artificial Sequence
  chemically synthesized
ttgatgaaaaatgatttctc

SEQ ID NO: 33108 - DNA, 20 bp, Artificial Sequence
  chemically synthesized
cattctgttcgtaaaacttt

SEQ ID NO: 33109 - DNA, 20 bp, Artificial Sequence
  chemically synthesized
tcgtaaaactttgagttttg

SEQ ID NO: 33110 - DNA, 20 bp, Artificial Sequence
  chemically synthesized
ctttgagttttgaagacact

SEQ ID NO: 33111 - DNA, 20 bp, Artificial Sequence
  chemically synthesized
tttgagttttgaagacactc

SEQ ID NO: 33112 - DNA, 20 bp, Artificial Sequence
  chemically synthesized
ttgagttttgaagacactca

SEQ ID NO: 33113 - DNA, 20 bp, Artificial Sequence
  chemically synthesized
cagggtctctttcttccctt

SEQ ID NO: 33114 - DNA, 20 bp, Artificial Sequence
  chemically synthesized
ttcccttaagctttctctca

SEQ ID NO: 33115 - DNA, 20 bp, Artificial Sequence
  chemically synthesized
cccttaagctttctctcatg

SEQ ID NO: 33116 - DNA, 20 bp, Artificial Sequence
  chemically synthesized
ccttaagctttctctcatgg

SEQ ID NO: 33117 - DNA, 20 bp, Artificial Sequence
  chemically synthesized
tctcatggaggaatgccact

SEQ ID NO: 33118 - DNA, 20 bp, Artificial Sequence
  chemically synthesized
atgccactcagacatctact

SEQ ID NO: 33119 - DNA, 20 bp, Artificial Sequence
  chemically synthesized
ttacaacacttgcatttcct

SEQ ID NO: 33120 - DNA, 20 bp, Artificial Sequence
  chemically synthesized
tacaacacttgcatttcctt

SEQ ID NO: 33121 - DNA, 20 bp, Artificial Sequence
  chemically synthesized
catacatctgcatttattat

SEQ ID NO: 33122 - DNA, 20 bp, Artificial Sequence
  chemically synthesized
tctgcatttattataagcaa

SEQ ID NO: 33123 - DNA, 20 bp, Artificial Sequence
  chemically synthesized
ctgcatttattataagcaac

SEQ ID NO: 33124 - DNA, 20 bp, Artificial Sequence
  chemically synthesized
catttattataagcaacagg

SEQ ID NO: 33125 - DNA, 20 bp, Artificial Sequence
  chemically synthesized
atttattataagcaacaggc

SEQ ID NO: 33126 - DNA, 20 bp, Artificial Sequence
  chemically synthesized
agcaacaggcgggacacttc

SEQ ID NO: 33127 - DNA, 20 bp, Artificial Sequence
  chemically synthesized
aggcgggacacttccagcaa

SEQ ID NO: 33128 - DNA, 20 bp, Artificial Sequence
  chemically synthesized
gggacacttccagcaataga

SEQ ID NO: 33129 - DNA, 20 bp, Artificial Sequence
  chemically synthesized
aaagaaaacttaatttacaa

SEQ ID NO: 33130 - DNA, 20 bp, Artificial Sequence
  chemically synthesized
gaaaacttaatttacaaaag

SEQ ID NO: 33131 - DNA, 20 bp, Artificial Sequence
  chemically synthesized
aaaacttaatttacaaaagc

SEQ ID NO: 33132 - DNA, 20 bp, Artificial Sequence
  chemically synthesized
aaacttaatttacaaaagca

SEQ ID NO: 33133 - DNA, 20 bp, Artificial Sequence
  chemically synthesized
aatttacaaaagcagggatt

SEQ ID NO: 33134 - DNA, 20 bp, Artificial Sequence
  chemically synthesized
acaaaagcagggattcagtg

SEQ ID NO: 33135 - DNA, 20 bp, Artificial Sequence
  chemically synthesized
agggattcagtgaagccacc

SEQ ID NO: 33136 - DNA, 20 bp, Artificial Sequence
  chemically synthesized
agccacctggttgttactct

SEQ ID NO: 33137 - DNA, 20 bp, Artificial Sequence
  chemically synthesized
gccacctggttgttactctt

SEQ ID NO: 33138 - DNA, 20 bp, Artificial Sequence
  chemically synthesized
tactcttgggcactcacatg

SEQ ID NO: 33139 - DNA, 20 bp, Artificial Sequence
  chemically synthesized
ctcacatgtagatgccaacc

SEQ ID NO: 33140 - DNA, 20 bp, Artificial Sequence
  chemically synthesized
cacatgtagatgccaaccca

SEQ ID NO: 33141 - DNA, 20 bp, Artificial Sequence
  chemically synthesized
tagatgccaacccagagcat

SEQ ID NO: 33142 - DNA, 20 bp, Artificial Sequence
  chemically synthesized
agatgccaacccagagcatc

SEQ ID NO: 33143 - DNA, 20 bp, Artificial Sequence
  chemically synthesized
tgccaacccagagcatcagg

SEQ ID NO: 33144 - DNA, 20 bp, Artificial Sequence
  chemically synthesized
ccaacccagagcatcaggaa

SEQ ID NO: 33145 - DNA, 20 bp, Artificial Sequence
  chemically synthesized
caacccagagcatcaggaag

SEQ ID NO: 33146 - DNA, 20 bp, Artificial Sequence
  chemically synthesized
gcatcaggaagaggacttca

SEQ ID NO: 33147 - DNA, 20 bp, Artificial Sequence
  chemically synthesized
agaggacttcaaagcccatg

SEQ ID NO: 33148 - DNA, 20 bp, Artificial Sequence
  chemically synthesized
aggacttcaaagcccatgaa

SEQ ID NO: 33149 - DNA, 20 bp, Artificial Sequence
  chemically synthesized
cttcaaagcccatgaagagt

SEQ ID NO: 33150 - DNA, 20 bp, Artificial Sequence
  chemically synthesized
ttcaaagcccatgaagagtg

SEQ ID NO: 33151 - DNA, 20 bp, Artificial Sequence
  chemically synthesized
ccatgaagagtgaggccacc

SEQ ID NO: 33152 - DNA, 20 bp, Artificial Sequence
  chemically synthesized
catgaagagtgaggccacca

SEQ ID NO: 33153 - DNA, 20 bp, Artificial Sequence
  chemically synthesized
tgaagagtgaggccaccaag

SEQ ID NO: 33154 - DNA, 20 bp, Artificial Sequence
  chemically synthesized
caccaaggagatactcttta

SEQ ID NO: 33155 - DNA, 20 bp, Artificial Sequence
  chemically synthesized
atactctttatagatatcac

SEQ ID NO: 33156 - DNA, 20 bp, Artificial Sequence
  chemically synthesized
atagatatcacaagtgtact

SEQ ID NO: 33157 - DNA, 20 bp, Artificial Sequence
  chemically synthesized
gatatcacaagtgtacttgg

SEQ ID NO: 33158 - DNA, 20 bp, Artificial Sequence
  chemically synthesized
tatcacaagtgtacttggta

SEQ ID NO: 33159 - DNA, 20 bp, Artificial Sequence
  chemically synthesized
atcacaagtgtacttggtag

SEQ ID NO: 33160 - DNA, 20 bp, Artificial Sequence
  chemically synthesized
tagaggtgacctcgtaaaca

SEQ ID NO: 33161 - DNA, 20 bp, Artificial Sequence
  chemically synthesized
tgacctcgtaaacaaagaac

SEQ ID NO: 33162 - DNA, 20 bp, Artificial Sequence
  chemically synthesized
gacctcgtaaacaaagaacc

SEQ ID NO: 33163 - DNA, 20 bp, Artificial Sequence
  chemically synthesized
ctcgtaaacaaagaaccagg

SEQ ID NO: 33164 - DNA, 20 bp, Artificial Sequence
  chemically synthesized
aaacaaagaaccaggtggtg

SEQ ID NO: 33165 - DNA, 20 bp, Artificial Sequence
  chemically synthesized
ggtggtgaagaacatgtcga

SEQ ID NO: 33166 - DNA, 20 bp, Artificial Sequence
  chemically synthesized
aagaacatgtcgatggccaa

SEQ ID NO: 33167 - DNA, 20 bp, Artificial Sequence
  chemically synthesized
atggccaaaagctctacaat

SEQ ID NO: 33168 - DNA, 20 bp, Artificial Sequence
  chemically synthesized
ccaaaagctctacaatcaga

SEQ ID NO: 33169 - DNA, 20 bp, Artificial Sequence
  chemically synthesized
caaaagctctacaatcagat

SEQ ID NO: 33170 - DNA, 20 bp, Artificial Sequence
  chemically synthesized
aaaagctctacaatcagatg

SEQ ID NO: 33171 - DNA, 20 bp, Artificial Sequence
  chemically synthesized
aaagctctacaatcagatgg

SEQ ID NO: 33172 - DNA, 20 bp, Artificial Sequence
  chemically synthesized
gctctacaatcagatggggg

SEQ ID NO: 33173 - DNA, 20 bp, Artificial Sequence
  chemically synthesized
tacaatcagatgggggaaga

SEQ ID NO: 33174 - DNA, 20 bp, Artificial Sequence
  chemically synthesized
atcagatgggggaagacagc

SEQ ID NO: 33175 - DNA, 20 bp, Artificial Sequence
  chemically synthesized
tcagatgggggaagacagct

SEQ ID NO: 33176 - DNA, 20 bp, Artificial Sequence
  chemically synthesized
gggaagacagctgggttgac

SEQ ID NO: 33177 - DNA, 20 bp, Artificial Sequence
  chemically synthesized
ggaagacagctgggttgacc

SEQ ID NO: 33178 - DNA, 20 bp, Artificial Sequence
  chemically synthesized
cgggctgttgtatctgctca

SEQ ID NO: 33179 - DNA, 20 bp, Artificial Sequence
  chemically synthesized
ttgtatctgctcatggcctt

SEQ ID NO: 33180 - DNA, 20 bp, Artificial Sequence
  chemically synthesized
ccttgagctccattttgccc

SEQ ID NO: 33181 - DNA, 20 bp, Artificial Sequence
  chemically synthesized
tgagctccattttgccccag

SEQ ID NO: 33182 - DNA, 20 bp, Artificial Sequence
  chemically synthesized
gagctccattttgccccagc

SEQ ID NO: 33183 - DNA, 20 bp, Artificial Sequence
  chemically synthesized
ccattttgccccagcaggct

SEQ ID NO: 33184 - DNA, 20 bp, Artificial Sequence
  chemically synthesized
ctaagccaccactctgccac

SEQ ID NO: 33185 - DNA, 20 bp, Artificial Sequence
  chemically synthesized
agccaccactctgccaccag

SEQ ID NO: 33186 - DNA, 20 bp, Artificial Sequence
  chemically synthesized
cttcatctctgctctctgac

SEQ ID NO: 33187 - DNA, 20 bp, Artificial Sequence
  chemically synthesized
ttcatctctgctctctgact

SEQ ID NO: 33188 - DNA, 20 bp, Artificial Sequence
  chemically synthesized
atgttatctattctgattca

SEQ ID NO: 33189 - DNA, 20 bp, Artificial Sequence
  chemically synthesized
ctattctgattcatagtatc

SEQ ID NO: 33190 - DNA, 20 bp, Artificial Sequence
  chemically synthesized
ttctgattcatagtatccag

SEQ ID NO: 33191 - DNA, 20 bp, Artificial Sequence
  chemically synthesized
aatcatcacattctcattat

SEQ ID NO: 33192 - DNA, 20 bp, Artificial Sequence
  chemically synthesized
atcatcacattctcattata

SEQ ID NO: 33193 - DNA, 20 bp, Artificial Sequence
  chemically synthesized
ctaatgttcacaattttcca

SEQ ID NO: 33194 - DNA, 20 bp, Artificial Sequence
  chemically synthesized
ttcacaattttccaaagcca

SEQ ID NO: 33195 - DNA, 20 bp, Artificial Sequence
  chemically synthesized
taaattcctgaccatcttcg

SEQ ID NO: 33196 - DNA, 20 bp, Artificial Sequence
  chemically synthesized
accatcttcgtagttgatta

SEQ ID NO: 33197 - DNA, 20 bp, Artificial Sequence
  chemically synthesized
tagttgattatggctctgaa

SEQ ID NO: 33198 - DNA, 20 bp, Artificial Sequence
  chemically synthesized
tctgaatggctttttgccca

SEQ ID NO: 33199 - DNA, 20 bp, Artificial Sequence
  chemically synthesized
ggctttttgcccaaagcatc

SEQ ID NO: 33200 - DNA, 20 bp, Artificial Sequence
  chemically synthesized
catccagcaccattttcatc

SEQ ID NO: 33201 - DNA, 20 bp, Artificial Sequence
  chemically synthesized
atccagcaccattttcatct

SEQ ID NO: 33202 - DNA, 20 bp, Artificial Sequence
  chemically synthesized
cagcaccattttcatctggg

SEQ ID NO: 33203 - DNA, 20 bp, Artificial Sequence
  chemically synthesized
atctgggtagtttcccctgc

SEQ ID NO: 33204 - DNA, 20 bp, Artificial Sequence
  chemically synthesized
gtttcccctgctggtaaaaa

SEQ ID NO: 33205 - DNA, 20 bp, Artificial Sequence
  chemically synthesized
tatctactcccatcccccga

SEQ ID NO: 33206 - DNA, 20 bp, Artificial Sequence
  chemically synthesized
cccatcccccgacagaaaca

SEQ ID NO: 33207 - DNA, 20 bp, Artificial Sequence
  chemically synthesized
ccatcccccgacagaaacac

SEQ ID NO: 33208 - DNA, 20 bp, Artificial Sequence
  chemically synthesized
atccactatcactctctatc

SEQ ID NO: 33209 - DNA, 20 bp, Artificial Sequence
  chemically synthesized
tccactatcactctctatct

SEQ ID NO: 33210 - DNA, 20 bp, Artificial Sequence
  chemically synthesized
tatcactctctatctgggtg

SEQ ID NO: 33211 - DNA, 20 bp, Artificial Sequence
  chemically synthesized
ctctctatctgggtgtggtt

SEQ ID NO: 33212 - DNA, 20 bp, Artificial Sequence
  chemically synthesized
gttgagatcttcaaaatctg

SEQ ID NO: 33213 - DNA, 20 bp, Artificial Sequence
  chemically synthesized
ttcaaaatctgcagtgctga

SEQ ID NO: 33214 - DNA, 20 bp, Artificial Sequence
  chemically synthesized
aatctgcagtgctgatagct

SEQ ID NO: 33215 - DNA, 20 bp, Artificial Sequence
  chemically synthesized
gcagtgctgatagctcagca

SEQ ID NO: 33216 - DNA, 20 bp, Artificial Sequence
  chemically synthesized
tgatagctcagcatggaatg

SEQ ID NO: 33217 - DNA, 20 bp, Artificial Sequence
  chemically synthesized
atggaatgaagtgaaccaac

SEQ ID NO: 33218 - DNA, 20 bp, Artificial Sequence
  chemically synthesized
caacaagctctctctgactt

SEQ ID NO: 33219 - DNA, 20 bp, Artificial Sequence
  chemically synthesized
tctctctgactttggtttat

SEQ ID NO: 33220 - DNA, 20 bp, Artificial Sequence
  chemically synthesized
ctctctgactttggtttata

SEQ ID NO: 33221 - DNA, 20 bp, Artificial Sequence
  chemically synthesized
gatttgcatacattttctga

SEQ ID NO: 33222 - DNA, 20 bp, Artificial Sequence
  chemically synthesized
atacattttctgatggatac

SEQ ID NO: 33223 - DNA, 20 bp, Artificial Sequence
  chemically synthesized
tacattttctgatggatact

SEQ ID NO: 33224 - DNA, 20 bp, Artificial Sequence
  chemically synthesized
atggatactaggctcatttc

SEQ ID NO: 33225 - DNA, 20 bp, Artificial Sequence
  chemically synthesized
tggatactaggctcatttct

SEQ ID NO: 33226 - DNA, 20 bp, Artificial Sequence
  chemically synthesized
ggctcatttctgggaatatg

SEQ ID NO: 33227 - DNA, 20 bp, Artificial Sequence
  chemically synthesized
tgggaatatgcagcaattta

SEQ ID NO: 33228 - DNA, 20 bp, Artificial Sequence
  chemically synthesized
aagcattgtgcctcatgtca

SEQ ID NO: 33229 - DNA, 20 bp, Artificial Sequence
  chemically synthesized
caatctgacactaatctatt

SEQ ID NO: 33230 - DNA, 20 bp, Artificial Sequence
  chemically synthesized
ctgacactaatctatttggt

SEQ ID NO: 33231 - DNA, 20 bp, Artificial Sequence
  chemically synthesized
tggtaagtttttctttctgt

SEQ ID NO: 33232 - DNA, 20 bp, Artificial Sequence
  chemically synthesized
agtctatacccttgtcatta

SEQ ID NO: 33233 - DNA, 20 bp, Artificial Sequence
  chemically synthesized
cactctaacttcatcttttt

SEQ ID NO: 33234 - DNA, 20 bp, Artificial Sequence
  chemically synthesized
actctaacttcatctttttt

SEQ ID NO: 33235 - DNA, 20 bp, Artificial Sequence
  chemically synthesized
tctaacttcatcttttttgg

SEQ ID NO: 33236 - DNA, 20 bp, Artificial Sequence
  chemically synthesized
acttcatcttttttgggagt

SEQ ID NO: 33237 - DNA, 20 bp, Artificial Sequence
  chemically synthesized
cttttttgggagtaagtact

SEQ ID NO: 33238 - DNA, 20 bp, Artificial Sequence
  chemically synthesized
ttttgggagtaagtacttgg

SEQ ID NO: 33239 - DNA, 20 bp, Artificial Sequence
  chemically synthesized
taagtacttggtagaacaca

SEQ ID NO: 33240 - DNA, 20 bp, Artificial Sequence
  chemically synthesized
agtacttggtagaacacata

SEQ ID NO: 33241 - DNA, 20 bp, Artificial Sequence
  chemically synthesized
gtacttggtagaacacatag

SEQ ID NO: 33242 - DNA, 20 bp, Artificial Sequence
  chemically synthesized
tggtagaacacatagaggca

SEQ ID NO: 33243 - DNA, 20 bp, Artificial Sequence
  chemically synthesized
gtagaacacatagaggcaaa

SEQ ID NO: 33244 - DNA, 20 bp, Artificial Sequence
  chemically synthesized
tagaacacatagaggcaaag

SEQ ID NO: 33245 - DNA, 20 bp, Artificial Sequence
  chemically synthesized
aacacatagaggcaaagagg

SEQ ID NO: 33246 - DNA, 20 bp, Artificial Sequence
  chemically synthesized
catagaggcaaagaggaagc

SEQ ID NO: 33247 - DNA, 20 bp, Artificial Sequence
  chemically synthesized
aaagaggaagctggtttatg

SEQ ID NO: 33248 - DNA, 20 bp, Artificial Sequence
  chemically synthesized
aagctggtttatgcagcccg

SEQ ID NO: 33249 - DNA, 20 bp, Artificial Sequence
  chemically synthesized
gctggtttatgcagcccgaa

SEQ ID NO: 33250 - DNA, 20 bp, Artificial Sequence
  chemically synthesized
tggtttatgcagcccgaaga

SEQ ID NO: 33251 - DNA, 20 bp, Artificial Sequence
  chemically synthesized
gcagcccgaagagagcaaca

SEQ ID NO: 33252 - DNA, 20 bp, Artificial Sequence
  chemically synthesized
cagcccgaagagagcaacaa

SEQ ID NO: 33253 - DNA, 20 bp, Artificial Sequence
  chemically synthesized
gaagagagcaacaaaggaaa

SEQ ID NO: 33254 - DNA, 20 bp, Artificial Sequence
  chemically synthesized
aggaaatagataatccaaac

SEQ ID NO: 33255 - DNA, 20 bp, Artificial Sequence
  chemically synthesized
gaaatagataatccaaacca

SEQ ID NO: 33256 - DNA, 20 bp, Artificial Sequence
  chemically synthesized
agataatccaaaccagagtc

SEQ ID NO: 33257 - DNA, 20 bp, Artificial Sequence
  chemically synthesized
accagagtctggaactacac

SEQ ID NO: 33258 - DNA, 20 bp, Artificial Sequence
  chemically synthesized
cagagtctggaactacacca

SEQ ID NO: 33259 - DNA, 20 bp, Artificial Sequence
  chemically synthesized
gatatcattctgtattcccg

SEQ ID NO: 33260 - DNA, 20 bp, Artificial Sequence
  chemically synthesized
caacttgattttttcctaac

SEQ ID NO: 33261 - DNA, 20 bp, Artificial Sequence
  chemically synthesized
tcctaactagatcactctgc

SEQ ID NO: 33262 - DNA, 20 bp, Artificial Sequence
  chemically synthesized
cctaactagatcactctgct

SEQ ID NO: 33263 - DNA, 20 bp, Artificial Sequence
  chemically synthesized
ctaactagatcactctgcta

SEQ ID NO: 33264 - DNA, 20 bp, Artificial Sequence
  chemically synthesized
cactctgctagggaatgaaa

SEQ ID NO: 33265 - DNA, 20 bp, Artificial Sequence
  chemically synthesized
actctgctagggaatgaaaa

SEQ ID NO: 33266 - DNA, 20 bp, Artificial Sequence
  chemically synthesized
tctgctagggaatgaaaaag

SEQ ID NO: 33267 - DNA, 20 bp, Artificial Sequence
  chemically synthesized
agggaatgaaaaaggagatc

SEQ ID NO: 33268 - DNA, 20 bp, Artificial Sequence
  chemically synthesized
gggaatgaaaaaggagatct

SEQ ID NO: 33269 - DNA, 20 bp, Artificial Sequence
  chemically synthesized
atctaggattttccctcttc

SEQ ID NO: 33270 - DNA, 20 bp, Artificial Sequence
  chemically synthesized
tctaggattttccctcttct

SEQ ID NO: 33271 - DNA, 20 bp, Artificial Sequence
  chemically synthesized
cctcttctaggaatttgcaa

SEQ ID NO: 33272 - DNA, 20 bp, Artificial Sequence
  chemically synthesized
tcttctaggaatttgcaaaa

SEQ ID NO: 33273 - DNA, 20 bp, Artificial Sequence
  chemically synthesized
aatttgcaaaagagattatt

SEQ ID NO: 33274 - DNA, 20 bp, Artificial Sequence
  chemically synthesized
ttgcaaaagagattattcag

SEQ ID NO: 33275 - DNA, 20 bp, Artificial Sequence
  chemically synthesized
aaagagattattcagaagcc

SEQ ID NO: 33276 - DNA, 20 bp, Artificial Sequence
  chemically synthesized
tattcagaagccaagttcta

SEQ ID NO: 33277 - DNA, 20 bp, Artificial Sequence
  chemically synthesized
aagccaagttctaaagattt

SEQ ID NO: 33278 - DNA, 20 bp, Artificial Sequence
  chemically synthesized
agccaagttctaaagatttt

SEQ ID NO: 33279 - DNA, 20 bp, Artificial Sequence
  chemically synthesized
gccaagttctaaagatttta

SEQ ID NO: 33280 - DNA, 20 bp, Artificial Sequence
  chemically synthesized
caagttctaaagattttagg

SEQ ID NO: 33281 - DNA, 20 bp, Artificial Sequence
  chemically synthesized
taaagattttagggagtctt

SEQ ID NO: 33282 - DNA, 20 bp, Artificial Sequence
  chemically synthesized
aaagattttagggagtcttt

SEQ ID NO: 33283 - DNA, 20 bp, Artificial Sequence
  chemically synthesized
ttagggagtctttgggatga

SEQ ID NO: 33284 - DNA, 20 bp, Artificial Sequence
  chemically synthesized
ccctctctgcaatctctgat

SEQ ID NO: 33285 - DNA, 20 bp, Artificial Sequence
  chemically synthesized
gtctactgctcattcctatg

SEQ ID NO: 33286 - DNA, 20 bp, Artificial Sequence
  chemically synthesized
ctactgctcattcctatgcg

SEQ ID NO: 33287 - DNA, 20 bp, Artificial Sequence
  chemically synthesized
tcattcctatgcggagcctc

SEQ ID NO: 33288 - DNA, 20 bp, Artificial Sequence
  chemically synthesized
cattcctatgcggagcctct

SEQ ID NO: 33289 - DNA, 20 bp, Artificial Sequence
  chemically synthesized
ctatgcggagcctctaggcc

SEQ ID NO: 33290 - DNA, 20 bp, Artificial Sequence
  chemically synthesized
gcctctaggccaagacacac

SEQ ID NO: 33291 - DNA, 20 bp, Artificial Sequence
  chemically synthesized
ctctaggccaagacacactg

SEQ ID NO: 33292 - DNA, 20 bp, Artificial Sequence
  chemically synthesized
ttctttaccgacctgttcat

SEQ ID NO: 33293 - DNA, 20 bp, Artificial Sequence
  chemically synthesized
aagtctgttcattgttgcca

SEQ ID NO: 33294 - DNA, 20 bp, Artificial Sequence
  chemically synthesized
agatgtgactatgaacccct

SEQ ID NO: 33295 - DNA, 20 bp, Artificial Sequence
  chemically synthesized
tgactatgaacccctaagcc

SEQ ID NO: 33296 - DNA, 20 bp, Artificial Sequence
  chemically synthesized
atgaacccctaagcctggtc

SEQ ID NO: 33297 - DNA, 20 bp, Artificial Sequence
  chemically synthesized
cctaagcctggtcaagatat

SEQ ID NO: 33298 - DNA, 20 bp, Artificial Sequence
  chemically synthesized
tggatccaacaccaactttt

SEQ ID NO: 33299 - DNA, 20 bp, Artificial Sequence
  chemically synthesized
ccaactttttagactatact

SEQ ID NO: 33300 - DNA, 20 bp, Artificial Sequence
  chemically synthesized
actttttagactatactcag

SEQ ID NO: 33301 - DNA, 20 bp, Artificial Sequence
  chemically synthesized
ttagactatactcagaagcc

SEQ ID NO: 33302 - DNA, 20 bp, Artificial Sequence
  chemically synthesized
tactcagaagccaagctgca

SEQ ID NO: 33303 - DNA, 20 bp, Artificial Sequence
  chemically synthesized
agccaagctgcaaagaaaat

SEQ ID NO: 33304 - DNA, 20 bp, Artificial Sequence
  chemically synthesized
gctgcaaagaaaattagttt

SEQ ID NO: 33305 - DNA, 20 bp, Artificial Sequence
  chemically synthesized
gtttcagaaactcctcccta

SEQ ID NO: 33306 - DNA, 20 bp, Artificial Sequence
  chemically synthesized
tccctccttctttattctcc

SEQ ID NO: 33307 - DNA, 20 bp, Artificial Sequence
  chemically synthesized
cttctttattctcccagcct

SEQ ID NO: 33308 - DNA, 20 bp, Artificial Sequence
  chemically synthesized
ttctttattctcccagcctg

SEQ ID NO: 33309 - DNA, 20 bp, Artificial Sequence
  chemically synthesized
tctttattctcccagcctga

SEQ ID NO: 33310 - DNA, 20 bp, Artificial Sequence
  chemically synthesized
ttctcccagcctgagggatt

SEQ ID NO: 33311 - DNA, 20 bp, Artificial Sequence
  chemically synthesized
gcctgagggatttagaactt

SEQ ID NO: 33312 - DNA, 20 bp, Artificial Sequence
  chemically synthesized
agggatttagaactttggaa

SEQ ID NO: 33313 - DNA, 20 bp, Artificial Sequence
  chemically synthesized
gggatttagaactttggaac

SEQ ID NO: 33314 - DNA, 20 bp, Artificial Sequence
  chemically synthesized
gatttagaactttggaacag

SEQ ID NO: 33315 - DNA, 20 bp, Artificial Sequence
  chemically synthesized
actttggaacaggagtcgct

SEQ ID NO: 33316 - DNA, 20 bp, Artificial Sequence
  chemically synthesized
ctttggaacaggagtcgcta

SEQ ID NO: 33317 - DNA, 20 bp, Artificial Sequence
  chemically synthesized
ctaaggtttcttcctgcatc

SEQ ID NO: 33318 - DNA, 20 bp, Artificial Sequence
  chemically synthesized
taaggtttcttcctgcatct

SEQ ID NO: 33319 - DNA, 20 bp, Artificial Sequence
  chemically synthesized
gtttcttcctgcatctaggt

SEQ ID NO: 33320 - DNA, 20 bp, Artificial Sequence
  chemically synthesized
tttcttcctgcatctaggtt

SEQ ID NO: 33321 - DNA, 20 bp, Artificial Sequence
  chemically synthesized
ttcttcctgcatctaggtta

SEQ ID NO: 33322 - DNA, 20 bp, Artificial Sequence
  chemically synthesized
ctgcatctaggttagggaat

SEQ ID NO: 33323 - DNA, 20 bp, Artificial Sequence
  chemically synthesized
tagggaattagccacatctc

SEQ ID NO: 33324 - DNA, 20 bp, Artificial Sequence
  chemically synthesized
ttagccacatctccagaaat

SEQ ID NO: 33325 - DNA, 20 bp, Artificial Sequence
  chemically synthesized
ccagaaataagatttatttt

SEQ ID NO: 33326 - DNA, 20 bp, Artificial Sequence
  chemically synthesized
gatttattttaagcatcaca

SEQ ID NO: 33327 - DNA, 20 bp, Artificial Sequence
  chemically synthesized
atttattttaagcatcacat

SEQ ID NO: 33328 - DNA, 20 bp, Artificial Sequence
  chemically synthesized
tttattttaagcatcacata

SEQ ID NO: 33329 - DNA, 20 bp, Artificial Sequence
  chemically synthesized
ttattttaagcatcacatag

SEQ ID NO: 33330 - DNA, 20 bp, Artificial Sequence
  chemically synthesized
ttttaagcatcacatagggg

SEQ ID NO: 33331 - DNA, 20 bp, Artificial Sequence
  chemically synthesized
agcatcacataggggtagaa

SEQ ID NO: 33332 - DNA, 20 bp, Artificial Sequence
  chemically synthesized
taggggtagaaaagaaaatg

SEQ ID NO: 33333 - DNA, 20 bp, Artificial Sequence
  chemically synthesized
aggggtagaaaagaaaatgt

SEQ ID NO: 33334 - DNA, 20 bp, Artificial Sequence
  chemically synthesized
ggggtagaaaagaaaatgta

SEQ ID NO: 33335 - DNA, 20 bp, Artificial Sequence
  chemically synthesized
ggtagaaaagaaaatgtagg

SEQ ID NO: 33336 - DNA, 20 bp, Artificial Sequence
  chemically synthesized
gtagaaaagaaaatgtaggg

SEQ ID NO: 33337 - DNA, 20 bp, Artificial Sequence
  chemically synthesized
aaaagaaaatgtagggagga

SEQ ID NO: 33338 - DNA, 20 bp, Artificial Sequence
  chemically synthesized
tagggaggatggcctttttg

SEQ ID NO: 33339 - DNA, 20 bp, Artificial Sequence
  chemically synthesized
ggaggatggcctttttgcag

SEQ ID NO: 33340 - DNA, 20 bp, Artificial Sequence
  chemically synthesized
ttcttttattattatacttt

SEQ ID NO: 33341 - DNA, 20 bp, Artificial Sequence
  chemically synthesized
tattattatactttaagttt

SEQ ID NO: 33342 - DNA, 20 bp, Artificial Sequence
  chemically synthesized
attattatactttaagtttt

SEQ ID NO: 33343 - DNA, 20 bp, Artificial Sequence
  chemically synthesized
ttattatactttaagtttta

SEQ ID NO: 33344 - DNA, 20 bp, Artificial Sequence
  chemically synthesized
gggtacatttgcacaacgtg

SEQ ID NO: 33345 - DNA, 20 bp, Artificial Sequence
  chemically synthesized
ggtacatttgcacaacgtgc

SEQ ID NO: 33346 - DNA, 20 bp, Artificial Sequence
  chemically synthesized
tatgtatacatgtgccatgt

SEQ ID NO: 33347 - DNA, 20 bp, Artificial Sequence
  chemically synthesized
gcacccattaactcgtcact

SEQ ID NO: 33348 - DNA, 20 bp, Artificial Sequence
  chemically synthesized
attaactcgtcacttagcat

SEQ ID NO: 33349 - DNA, 20 bp, Artificial Sequence
  chemically synthesized
ttaactcgtcacttagcatt

SEQ ID NO: 33350 - DNA, 20 bp, Artificial Sequence
  chemically synthesized
ccccgacccccaccccactg

SEQ ID NO: 33351 - DNA, 20 bp, Artificial Sequence
  chemically synthesized
cccgacccccaccccactgc

SEQ ID NO: 33352 - DNA, 20 bp, Artificial Sequence
  chemically synthesized
ccccaccccactgcaggccc

SEQ ID NO: 33353 - DNA, 20 bp, Artificial Sequence
  chemically synthesized
attgttcaattcccacctat

SEQ ID NO: 33354 - DNA, 20 bp, Artificial Sequence
  chemically synthesized
ttcaattcccacctatgagt

SEQ ID NO: 33355 - DNA, 20 bp, Artificial Sequence
  chemically synthesized
cacctatgagtgagaacatg

SEQ ID NO: 33356 - DNA, 20 bp, Artificial Sequence
  chemically synthesized
gagtgagaacatgcagtgtt

SEQ ID NO: 33357 - DNA, 20 bp, Artificial Sequence
  chemically synthesized
tttggtttttgtccttgcga

SEQ ID NO: 33358 - DNA, 20 bp, Artificial Sequence
  chemically synthesized
tgtccttgcgatagtttgct

SEQ ID NO: 33359 - DNA, 20 bp, Artificial Sequence
  chemically synthesized
cgatagtttgctgagaatga

SEQ ID NO: 33360 - DNA, 20 bp, Artificial Sequence
  chemically synthesized
ttgctgagaatgatggtttc

SEQ ID NO: 33361 - DNA, 20 bp, Artificial Sequence
  chemically synthesized
gcttcatccatgtccctaca

SEQ ID NO: 33362 - DNA, 20 bp, Artificial Sequence
  chemically synthesized
cttcatccatgtccctacaa

SEQ ID NO: 33363 - DNA, 20 bp, Artificial Sequence
  chemically synthesized
catgaactcttcatttttta

SEQ ID NO: 33364 - DNA, 20 bp, Artificial Sequence
  chemically synthesized
cttcattttttatggctgca

SEQ ID NO: 33365 - DNA, 20 bp, Artificial Sequence
  chemically synthesized
tatggctgcatagtattcca

SEQ ID NO: 33366 - DNA, 20 bp, Artificial Sequence
  chemically synthesized
tgtgccacgttttcttaatc

SEQ ID NO: 33367 - DNA, 20 bp, Artificial Sequence
  chemically synthesized
ttaatccagtctatcattgt

SEQ ID NO: 33368 - DNA, 20 bp, Artificial Sequence
  chemically synthesized
gtctatcattgttggacatt

SEQ ID NO: 33369 - DNA, 20 bp, Artificial Sequence
  chemically synthesized
tctatcattgttggacattt

SEQ ID NO: 33370 - DNA, 20 bp, Artificial Sequence
  chemically synthesized
tcattgttggacatttgggt

SEQ ID NO: 33371 - DNA, 20 bp, Artificial Sequence
  chemically synthesized
tggacatttgggttggttcc

SEQ ID NO: 33372 - DNA, 20 bp, Artificial Sequence
  chemically synthesized
caagtctttgctattgtgaa

SEQ ID NO: 33373 - DNA, 20 bp, Artificial Sequence
  chemically synthesized
tacatgtgcatgtgtcttta

SEQ ID NO: 33374 - DNA, 20 bp, Artificial Sequence
  chemically synthesized
atgtgcatgtgtctttatag

SEQ ID NO: 33375 - DNA, 20 bp, Artificial Sequence
  chemically synthesized
agcatgatttataatccttt

SEQ ID NO: 33376 - DNA, 20 bp, Artificial Sequence
  chemically synthesized
taatcctttgagtatgtacc

SEQ ID NO: 33377 - DNA, 20 bp, Artificial Sequence
  chemically synthesized
tttgagtatgtacccagtaa

SEQ ID NO: 33378 - DNA, 20 bp, Artificial Sequence
  chemically synthesized
ttgagtatgtacccagtaat

SEQ ID NO: 33379 - DNA, 20 bp, Artificial Sequence
  chemically synthesized
gtatgtacccagtaatggga

SEQ ID NO: 33380 - DNA, 20 bp, Artificial Sequence
  chemically synthesized
gtacccagtaatgggatggc

SEQ ID NO: 33381 - DNA, 20 bp, Artificial Sequence
  chemically synthesized
tacccagtaatgggatggct

SEQ ID NO: 33382 - DNA, 20 bp, Artificial Sequence
  chemically synthesized
aatgggatggctgggtcaaa

SEQ ID NO: 33383 - DNA, 20 bp, Artificial Sequence
  chemically synthesized
gctgggtcaaatggtatttc

SEQ ID NO: 33384 - DNA, 20 bp, Artificial Sequence
  chemically synthesized
tcaaatggtatttctagttc

SEQ ID NO: 33385 - DNA, 20 bp, Artificial Sequence
  chemically synthesized
atttctagttctagatccct

SEQ ID NO: 33386 - DNA, 20 bp, Artificial Sequence
  chemically synthesized
tttctagttctagatccctg

SEQ ID NO: 33387 - DNA, 20 bp, Artificial Sequence
  chemically synthesized
cgccacactgacttccacaa

SEQ ID NO: 33388 - DNA, 20 bp, Artificial Sequence
  chemically synthesized
gacttccacaatggttgaac

SEQ ID NO: 33389 - DNA, 20 bp, Artificial Sequence
  chemically synthesized
acaatggttgaactagttta

SEQ ID NO: 33390 - DNA, 20 bp, Artificial Sequence
  chemically synthesized
ctagtttacagtctcaccaa

SEQ ID NO: 33391 - DNA, 20 bp, Artificial Sequence
  chemically synthesized
cagtctcaccaacagtgtaa

SEQ ID NO: 33392 - DNA, 20 bp, Artificial Sequence
  chemically synthesized
ctacttcttcacatcctctc

SEQ ID NO: 33393 - DNA, 20 bp, Artificial Sequence
  chemically synthesized
ttaatgatcgccattctaac

SEQ ID NO: 33394 - DNA, 20 bp, Artificial Sequence
  chemically synthesized
atcgccattctaactggtgt

SEQ ID NO: 33395 - DNA, 20 bp, Artificial Sequence
  chemically synthesized
ccattctaactggtgtgaga

SEQ ID NO: 33396 - DNA, 20 bp, Artificial Sequence
  chemically synthesized
tgtgagatggtatctcactg

SEQ ID NO: 33397 - DNA, 20 bp, Artificial Sequence
  chemically synthesized
tttgatttgtatttctctga

SEQ ID NO: 33398 - DNA, 20 bp, Artificial Sequence
  chemically synthesized
atttgtatttctctgatggc

SEQ ID NO: 33399 - DNA, 20 bp, Artificial Sequence
  chemically synthesized
ctctgatggccagtgatgat

SEQ ID NO: 33400 - DNA, 20 bp, Artificial Sequence
  chemically synthesized
ctgcataaatgtcttctttt

SEQ ID NO: 33401 - DNA, 20 bp, Artificial Sequence
  chemically synthesized
cataaatgtcttcttttgag

SEQ ID NO: 33402 - DNA, 20 bp, Artificial Sequence
  chemically synthesized
atcctttgcccactttttga

SEQ ID NO: 33403 - DNA, 20 bp, Artificial Sequence
  chemically synthesized
tcctttgcccactttttgat

SEQ ID NO: 33404 - DNA, 20 bp, Artificial Sequence
  chemically synthesized
cctttgcccactttttgatg

SEQ ID NO: 33405 - DNA, 20 bp, Artificial Sequence
  chemically synthesized
tttttcttgtaaatttgttt

SEQ ID NO: 33406 - DNA, 20 bp, Artificial Sequence
  chemically synthesized
aaatttgtttgagttcatca

SEQ ID NO: 33407 - DNA, 20 bp, Artificial Sequence
  chemically synthesized
tttgagttcatcatagattc

SEQ ID NO: 33408 - DNA, 20 bp, Artificial Sequence
  chemically synthesized
tcatcatagattctggatat

SEQ ID NO: 33409 - DNA, 20 bp, Artificial Sequence
  chemically synthesized
tctggatattagccctttgt

SEQ ID NO: 33410 - DNA, 20 bp, Artificial Sequence
  chemically synthesized
atattagccctttgtcggat

SEQ ID NO: 33411 - DNA, 20 bp, Artificial Sequence
  chemically synthesized
ttagccctttgtcggatgag

SEQ ID NO: 33412 - DNA, 20 bp, Artificial Sequence
  chemically synthesized
atgttgcctgttcactctga

SEQ ID NO: 33413 - DNA, 20 bp, Artificial Sequence
  chemically synthesized
ttgcctgttcactctgatgg

SEQ ID NO: 33414 - DNA, 20 bp, Artificial Sequence
  chemically synthesized
tggtagtttcttttgctgtg

SEQ ID NO: 33415 - DNA, 20 bp, Artificial Sequence
  chemically synthesized
tagtttcttttgctgtgcag

SEQ ID NO: 33416 - DNA, 20 bp, Artificial Sequence
  chemically synthesized
tttgctgtgcagaagctctt

SEQ ID NO: 33417 - DNA, 20 bp, Artificial Sequence
  chemically synthesized
cagaagctctttagtttaat

SEQ ID NO: 33418 - DNA, 20 bp, Artificial Sequence
  chemically synthesized
tagatcccatttgtccattt

SEQ ID NO: 33419 - DNA, 20 bp, Artificial Sequence
  chemically synthesized
gcttttgttgccattgcttt

SEQ ID NO: 33420 - DNA, 20 bp, Artificial Sequence
  chemically synthesized
tgccattgcttttggtgttt

SEQ ID NO: 33421 - DNA, 20 bp, Artificial Sequence
  chemically synthesized
cttttggtgttttagacatg

SEQ ID NO: 33422 - DNA, 20 bp, Artificial Sequence
  chemically synthesized
gcccatgcctatgtcctgaa

SEQ ID NO: 33423 - DNA, 20 bp, Artificial Sequence
  chemically synthesized
atgtcctgaatggtattgcc

SEQ ID NO: 33424 - DNA, 20 bp, Artificial Sequence
  chemically synthesized
tgtcctgaatggtattgcct

SEQ ID NO: 33425 - DNA, 20 bp, Artificial Sequence
  chemically synthesized
gtattgcctaggttttcttc

SEQ ID NO: 33426 - DNA, 20 bp, Artificial Sequence
  chemically synthesized
attgcctaggttttcttcca

SEQ ID NO: 33427 - DNA, 20 bp, Artificial Sequence
  chemically synthesized
gttttcttccagagttttta

SEQ ID NO: 33428 - DNA, 20 bp, Artificial Sequence
  chemically synthesized
tccagagtttttatggtttt

SEQ ID NO: 33429 - DNA, 20 bp, Artificial Sequence
  chemically synthesized
tggttttcagtctaacattt

SEQ ID NO: 33430 - DNA, 20 bp, Artificial Sequence
  chemically synthesized
tcttgaattaatttttgtat

SEQ ID NO: 33431 - DNA, 20 bp, Artificial Sequence
  chemically synthesized
cttgaattaatttttgtata

SEQ ID NO: 33432 - DNA, 20 bp, Artificial Sequence
  chemically synthesized
ttaatttttgtataaggtgt

SEQ ID NO: 33433 - DNA, 20 bp, Artificial Sequence
  chemically synthesized
tttttgtataaggtgtaaga

SEQ ID NO: 33434 - DNA, 20 bp, Artificial Sequence
  chemically synthesized
ttttgtataaggtgtaagaa

SEQ ID NO: 33435 - DNA, 20 bp, Artificial Sequence
  chemically synthesized
tttgtataaggtgtaagaaa

SEQ ID NO: 33436 - DNA, 20 bp, Artificial Sequence
  chemically synthesized
taaggtgtaagaaagggatc

SEQ ID NO: 33437 - DNA, 20 bp, Artificial Sequence
  chemically synthesized
gtaagaaagggatccagttt

SEQ ID NO: 33438 - DNA, 20 bp, Artificial Sequence
  chemically synthesized
cagtttcagctttctgcgta

SEQ ID NO: 33439 - DNA, 20 bp, Artificial Sequence
  chemically synthesized
ttcagctttctgcgtatggt

SEQ ID NO: 33440 - DNA, 20 bp, Artificial Sequence
  chemically synthesized
gctttctgcgtatggttagc

SEQ ID NO: 33441 - DNA, 20 bp, Artificial Sequence
  chemically synthesized
gtatggttagccagttttcc

SEQ ID NO: 33442 - DNA, 20 bp, Artificial Sequence
  chemically synthesized
tcccagcaccatttattaaa

SEQ ID NO: 33443 - DNA, 20 bp, Artificial Sequence
  chemically synthesized
cccagcaccatttattaaat

SEQ ID NO: 33444 - DNA, 20 bp, Artificial Sequence
  chemically synthesized
ccagcaccatttattaaata

SEQ ID NO: 33445 - DNA, 20 bp, Artificial Sequence
  chemically synthesized
tccccatttgttttttttgt

SEQ ID NO: 33446 - DNA, 20 bp, Artificial Sequence
  chemically synthesized
ccccatttgttttttttgtc

SEQ ID NO: 33447 - DNA, 20 bp, Artificial Sequence
  chemically synthesized
tttttttgtcaggtttgtca

SEQ ID NO: 33448 - DNA, 20 bp, Artificial Sequence
  chemically synthesized
ttgtcaggtttgtcaaagat

SEQ ID NO: 33449 - DNA, 20 bp, Artificial Sequence
  chemically synthesized
caggtttgtcaaagatcaga

SEQ ID NO: 33450 - DNA, 20 bp, Artificial Sequence
  chemically synthesized
tgtcaaagatcagatggttg

SEQ ID NO: 33451 - DNA, 20 bp, Artificial Sequence
  chemically synthesized
atcagatggttgtagacatg

SEQ ID NO: 33452 - DNA, 20 bp, Artificial Sequence
  chemically synthesized
agacatgcggcattatttct

SEQ ID NO: 33453 - DNA, 20 bp, Artificial Sequence
  chemically synthesized
gacatgcggcattatttctg

SEQ ID NO: 33454 - DNA, 20 bp, Artificial Sequence
  chemically synthesized
aggcctctgttctgttccat

SEQ ID NO: 33455 - DNA, 20 bp, Artificial Sequence
  chemically synthesized
attggtctatatctctgttt

SEQ ID NO: 33456 - DNA, 20 bp, Artificial Sequence
  chemically synthesized
ctatatctctgttttggtac

SEQ ID NO: 33457 - DNA, 20 bp, Artificial Sequence
  chemically synthesized
gtaccagtaccatgctgttt

SEQ ID NO: 33458 - DNA, 20 bp, Artificial Sequence
  chemically synthesized
ccatgctgttttggttactg

SEQ ID NO: 33459 - DNA, 20 bp, Artificial Sequence
  chemically synthesized
ttttggttactgtagccttg

SEQ ID NO: 33460 - DNA, 20 bp, Artificial Sequence
  chemically synthesized
gttactgtagccttgtagta

SEQ ID NO: 33461 - DNA, 20 bp, Artificial Sequence
  chemically synthesized
tagccttgtagtatagtttg

SEQ ID NO: 33462 - DNA, 20 bp, Artificial Sequence
  chemically synthesized
cttgtagtatagtttgaagt

SEQ ID NO: 33463 - DNA, 20 bp, Artificial Sequence
  chemically synthesized
ttgtagtatagtttgaagtc

SEQ ID NO: 33464 - DNA, 20 bp, Artificial Sequence
  chemically synthesized
tagtatagtttgaagtcagg

SEQ ID NO: 33465 - DNA, 20 bp, Artificial Sequence
  chemically synthesized
gtcaggtagcgtgatgcctc

SEQ ID NO: 33466 - DNA, 20 bp, Artificial Sequence
  chemically synthesized
tgcctccagctttgttcttt

SEQ ID NO: 33467 - DNA, 20 bp, Artificial Sequence
  chemically synthesized
ccagctttgttcttttggct

SEQ ID NO: 33468 - DNA, 20 bp, Artificial Sequence
  chemically synthesized
cagctttgttcttttggctt

SEQ ID NO: 33469 - DNA, 20 bp, Artificial Sequence
  chemically synthesized
ttgttcttttggcttaggat

SEQ ID NO: 33470 - DNA, 20 bp, Artificial Sequence
  chemically synthesized
ttaggattggcatgtcaatg

SEQ ID NO: 33471 - DNA, 20 bp, Artificial Sequence
  chemically synthesized
taggattggcatgtcaatgt

SEQ ID NO: 33472 - DNA, 20 bp, Artificial Sequence
  chemically synthesized
tgtcaatgtgggctcttttt

SEQ ID NO: 33473 - DNA, 20 bp, Artificial Sequence
  chemically synthesized
ttggttccatatgaacttta

SEQ ID NO: 33474 - DNA, 20 bp, Artificial Sequence
  chemically synthesized
gttccatatgaactttaaag

SEQ ID NO: 33475 - DNA, 20 bp, Artificial Sequence
  chemically synthesized
tagttttttccaattctgtg

SEQ ID NO: 33476 - DNA, 20 bp, Artificial Sequence
  chemically synthesized
tttttccaattctgtgaaga

SEQ ID NO: 33477 - DNA, 20 bp, Artificial Sequence
  chemically synthesized
aattctgtgaagaaagtcat

SEQ ID NO: 33478 - DNA, 20 bp, Artificial Sequence
  chemically synthesized
tctgtgaagaaagtcattgg

SEQ ID NO: 33479 - DNA, 20 bp, Artificial Sequence
  chemically synthesized
gaaagtcattggtagcttga

SEQ ID NO: 33480 - DNA, 20 bp, Artificial Sequence
  chemically synthesized
aaagtcattggtagcttgat

SEQ ID NO: 33481 - DNA, 20 bp, Artificial Sequence
  chemically synthesized
aagtcattggtagcttgatg

SEQ ID NO: 33482 - DNA, 20 bp, Artificial Sequence
  chemically synthesized
cattggtagcttgatgggga

SEQ ID NO: 33483 - DNA, 20 bp, Artificial Sequence
  chemically synthesized
attgaatctataaattacct

SEQ ID NO: 33484 - DNA, 20 bp, Artificial Sequence
  chemically synthesized
ttgaatctataaattacctt

SEQ ID NO: 33485 - DNA, 20 bp, Artificial Sequence
  chemically synthesized
ataaattaccttgggctgta

SEQ ID NO: 33486 - DNA, 20 bp, Artificial Sequence
  chemically synthesized
tattgattcttcctacccat

SEQ ID NO: 33487 - DNA, 20 bp, Artificial Sequence
  chemically synthesized
attcttcctacccatgagca

SEQ ID NO: 33488 - DNA, 20 bp, Artificial Sequence
  chemically synthesized
gtatcttcttttatttcatt

SEQ ID NO: 33489 - DNA, 20 bp, Artificial Sequence
  chemically synthesized
tcttcttttatttcattcag

SEQ ID NO: 33490 - DNA, 20 bp, Artificial Sequence
  chemically synthesized
tcttttatttcattcagcag

SEQ ID NO: 33491 - DNA, 20 bp, Artificial Sequence
  chemically synthesized
tttcattcagcagtggtttg

SEQ ID NO: 33492 - DNA, 20 bp, Artificial Sequence
  chemically synthesized
gtggtttgtagttctccttg

SEQ ID NO: 33493 - DNA, 20 bp, Artificial Sequence
  chemically synthesized
ggtttgtagttctccttgaa

SEQ ID NO: 33494 - DNA, 20 bp, Artificial Sequence
  chemically synthesized
gtttgtagttctccttgaag

SEQ ID NO: 33495 - DNA, 20 bp, Artificial Sequence
  chemically synthesized
aggtccttcacctctcttgt

SEQ ID NO: 33496 - DNA, 20 bp, Artificial Sequence
  chemically synthesized
ccttcacctctcttgtaagt

SEQ ID NO: 33497 - DNA, 20 bp, Artificial Sequence
  chemically synthesized
tctcttgtaagttggattcc

SEQ ID NO: 33498 - DNA, 20 bp, Artificial Sequence
  chemically synthesized
ctcttgtaagttggattcct

SEQ ID NO: 33499 - DNA, 20 bp, Artificial Sequence
  chemically synthesized
taggtattttattctctttg

SEQ ID NO: 33500 - DNA, 20 bp, Artificial Sequence
  chemically synthesized
ctctttgaagcaattgtgaa

SEQ ID NO: 33501 - DNA, 20 bp, Artificial Sequence
  chemically synthesized
tctttgaagcaattgtgaat

SEQ ID NO: 33502 - DNA, 20 bp, Artificial Sequence
  chemically synthesized
tttgaagcaattgtgaatgg

SEQ ID NO: 33503 - DNA, 20 bp, Artificial Sequence
  chemically synthesized
atgggagttccctcatgatt

SEQ ID NO: 33504 - DNA, 20 bp, Artificial Sequence
  chemically synthesized
gctctctgtttgtctgttat

SEQ ID NO: 33505 - DNA, 20 bp, Artificial Sequence
  chemically synthesized
tttgtctgttattggtgtat

SEQ ID NO: 33506 - DNA, 20 bp, Artificial Sequence
  chemically synthesized
gcacattgattttgtatcct

SEQ ID NO: 33507 - DNA, 20 bp, Artificial Sequence
  chemically synthesized
tgtatcctgagactttgctg

SEQ ID NO: 33508 - DNA, 20 bp, Artificial Sequence
  chemically synthesized
actttgctgaagttgcctat

SEQ ID NO: 33509 - DNA, 20 bp, Artificial Sequence
  chemically synthesized
ctgaagttgcctatcagttt

SEQ ID NO: 33510 - DNA, 20 bp, Artificial Sequence
  chemically synthesized
tgaagttgcctatcagttta

SEQ ID NO: 33511 - DNA, 20 bp, Artificial Sequence
  chemically synthesized
ctatcagtttaaggacattt

SEQ ID NO: 33512 - DNA, 20 bp, Artificial Sequence
  chemically synthesized
tatcagtttaaggacatttt

SEQ ID NO: 33513 - DNA, 20 bp, Artificial Sequence
  chemically synthesized
gtttaaggacattttgggct

SEQ ID NO: 33514 - DNA, 20 bp, Artificial Sequence
  chemically synthesized
aaggacattttgggctgaga

SEQ ID NO: 33515 - DNA, 20 bp, Artificial Sequence
  chemically synthesized
gacattttgggctgagacag

SEQ ID NO: 33516 - DNA, 20 bp, Artificial Sequence
  chemically synthesized
acattttgggctgagacagt

SEQ ID NO: 33517 - DNA, 20 bp, Artificial Sequence
  chemically synthesized
cattttgggctgagacagtg

SEQ ID NO: 33518 - DNA, 20 bp, Artificial Sequence
  chemically synthesized
gctgagacagtggggttttc

SEQ ID NO: 33519 - DNA, 20 bp, Artificial Sequence
  chemically synthesized
acaatcgtgtcatctgcaaa

SEQ ID NO: 33520 - DNA, 20 bp, Artificial Sequence
  chemically synthesized
caatcgtgtcatctgcaaac

SEQ ID NO: 33521 - DNA, 20 bp, Artificial Sequence
  chemically synthesized
aatcgtgtcatctgcaaaca

SEQ ID NO: 33522 - DNA, 20 bp, Artificial Sequence
  chemically synthesized
cttctcctgcctaattgccc

SEQ ID NO: 33523 - DNA, 20 bp, Artificial Sequence
  chemically synthesized
tcctgcctaattgccctggc

SEQ ID NO: 33524 - DNA, 20 bp, Artificial Sequence
  chemically synthesized
aattccaacactatgttgaa

SEQ ID NO: 33525 - DNA, 20 bp, Artificial Sequence
  chemically synthesized
attccaacactatgttgaat

SEQ ID NO: 33526 - DNA, 20 bp, Artificial Sequence
  chemically synthesized
tccaacactatgttgaatag

SEQ ID NO: 33527 - DNA, 20 bp, Artificial Sequence
  chemically synthesized
aacactatgttgaataggag

SEQ ID NO: 33528 - DNA, 20 bp, Artificial Sequence
  chemically synthesized
ctatgttgaataggagtagt

SEQ ID NO: 33529 - DNA, 20 bp, Artificial Sequence
  chemically synthesized
atgttgaataggagtagtga

SEQ ID NO: 33530 - DNA, 20 bp, Artificial Sequence
  chemically synthesized
gttgaataggagtagtgaga

SEQ ID NO: 33531 - DNA, 20 bp, Artificial Sequence
  chemically synthesized
ttgaataggagtagtgagag

SEQ ID NO: 33532 - DNA, 20 bp, Artificial Sequence
  chemically synthesized
tgaataggagtagtgagaga

SEQ ID NO: 33533 - DNA, 20 bp, Artificial Sequence
  chemically synthesized
agggcatccctgtcttgtgc

SEQ ID NO: 33534 - DNA, 20 bp, Artificial Sequence
  chemically synthesized
ctgtcttgtgccagttttca

SEQ ID NO: 33535 - DNA, 20 bp, Artificial Sequence
  chemically synthesized
tgtcttgtgccagttttcaa

SEQ ID NO: 33536 - DNA, 20 bp, Artificial Sequence
  chemically synthesized
gtcttgtgccagttttcaaa

SEQ ID NO: 33537 - DNA, 20 bp, Artificial Sequence
  chemically synthesized
gttttcaaagggaatgcttc

SEQ ID NO: 33538 - DNA, 20 bp, Artificial Sequence
  chemically synthesized
gcttccagtttttgtccatt

SEQ ID NO: 33539 - DNA, 20 bp, Artificial Sequence
  chemically synthesized
ttgtccattcagtatgatat

SEQ ID NO: 33540 - DNA, 20 bp, Artificial Sequence
  chemically synthesized
attcagtatgatattggctg

SEQ ID NO: 33541 - DNA, 20 bp, Artificial Sequence
  chemically synthesized
ttcagtatgatattggctgt

SEQ ID NO: 33542 - DNA, 20 bp, Artificial Sequence
  chemically synthesized
tattggctgtgggtttgtca

SEQ ID NO: 33543 - DNA, 20 bp, Artificial Sequence
  chemically synthesized
ggctgtgggtttgtcataga

SEQ ID NO: 33544 - DNA, 20 bp, Artificial Sequence
  chemically synthesized
tagatggctcttattatttt

SEQ ID NO: 33545 - DNA, 20 bp, Artificial Sequence
  chemically synthesized
ccatcaatacctaatttatt

SEQ ID NO: 33546 - DNA, 20 bp, Artificial Sequence
  chemically synthesized
atcaatacctaatttattga

SEQ ID NO: 33547 - DNA, 20 bp, Artificial Sequence
  chemically synthesized
cctaatttattgagagtttt

SEQ ID NO: 33548 - DNA, 20 bp, Artificial Sequence
  chemically synthesized
tattgagagtttttagcatg

SEQ ID NO: 33549 - DNA, 20 bp, Artificial Sequence
  chemically synthesized
attgagagtttttagcatga

SEQ ID NO: 33550 - DNA, 20 bp, Artificial Sequence
  chemically synthesized
ttgagagtttttagcatgaa

SEQ ID NO: 33551 - DNA, 20 bp, Artificial Sequence
  chemically synthesized
agggttgttgaattttgtca

SEQ ID NO: 33552 - DNA, 20 bp, Artificial Sequence
  chemically synthesized
gggttgttgaattttgtcaa

SEQ ID NO: 33553 - DNA, 20 bp, Artificial Sequence
  chemically synthesized
aggccttttctgcatctatt

SEQ ID NO: 33554 - DNA, 20 bp, Artificial Sequence
  chemically synthesized
catctattgagataatcatg

SEQ ID NO: 33555 - DNA, 20 bp, Artificial Sequence
  chemically synthesized
aatcatgtggtttttgtctt

SEQ ID NO: 33556 - DNA, 20 bp, Artificial Sequence
  chemically synthesized
ctttggttctgtttatatgc

SEQ ID NO: 33557 - DNA, 20 bp, Artificial Sequence
  chemically synthesized
ttgatttgcatatgttgaac

SEQ ID NO: 33558 - DNA, 20 bp, Artificial Sequence
  chemically synthesized
gttgaaccagccttgcatcc

SEQ ID NO: 33559 - DNA, 20 bp, Artificial Sequence
  chemically synthesized
ttgaaccagccttgcatccc

SEQ ID NO: 33560 - DNA, 20 bp, Artificial Sequence
  chemically synthesized
tgaaccagccttgcatccca

SEQ ID NO: 33561 - DNA, 20 bp, Artificial Sequence
  chemically synthesized
agccttgcatcccagggatg

SEQ ID NO: 33562 - DNA, 20 bp, Artificial Sequence
  chemically synthesized
ggatgaagcccacttgatca

SEQ ID NO: 33563 - DNA, 20 bp, Artificial Sequence
  chemically synthesized
tgaagcccacttgatcatgg

SEQ ID NO: 33564 - DNA, 20 bp, Artificial Sequence
  chemically synthesized
cccacttgatcatggtggat

SEQ ID NO: 33565 - DNA, 20 bp, Artificial Sequence
  chemically synthesized
gatcatggtggataagcttt

SEQ ID NO: 33566 - DNA, 20 bp, Artificial Sequence
  chemically synthesized
taagcttttggatgtgctgc

SEQ ID NO: 33567 - DNA, 20 bp, Artificial Sequence
  chemically synthesized
tgctgctggatttgctttgc

SEQ ID NO: 33568 - DNA, 20 bp, Artificial Sequence
  chemically synthesized
tgctttgccagtattttatt

SEQ ID NO: 33569 - DNA, 20 bp, Artificial Sequence
  chemically synthesized
gctttgccagtattttattg

SEQ ID NO: 33570 - DNA, 20 bp, Artificial Sequence
  chemically synthesized
ttttttgcatcgatgtccat

SEQ ID NO: 33571 - DNA, 20 bp, Artificial Sequence
  chemically synthesized
tttttgcatcgatgtccatc

SEQ ID NO: 33572 - DNA, 20 bp, Artificial Sequence
  chemically synthesized
ttttgcatcgatgtccatca

SEQ ID NO: 33573 - DNA, 20 bp, Artificial Sequence
  chemically synthesized
tcgatgtccatcagggatat

SEQ ID NO: 33574 - DNA, 20 bp, Artificial Sequence
  chemically synthesized
ttttttgttgtgtctctgcc

SEQ ID NO: 33575 - DNA, 20 bp, Artificial Sequence
  chemically synthesized
gttgtgtctctgcccggctt

SEQ ID NO: 33576 - DNA, 20 bp, Artificial Sequence
  chemically synthesized
tctctgcccggctttggtat

SEQ ID NO: 33577 - DNA, 20 bp, Artificial Sequence
  chemically synthesized
ctctgcccggctttggtatc

SEQ ID NO: 33578 - DNA, 20 bp, Artificial Sequence
  chemically synthesized
ctttggtatcaggatgatgc

SEQ ID NO: 33579 - DNA, 20 bp, Artificial Sequence
  chemically synthesized
tgatgctggcctcataaaat

SEQ ID NO: 33580 - DNA, 20 bp, Artificial Sequence
  chemically synthesized
gctggcctcataaaatgagt

SEQ ID NO: 33581 - DNA, 20 bp, Artificial Sequence
  chemically synthesized
ctggcctcataaaatgagtt

SEQ ID NO: 33582 - DNA, 20 bp, Artificial Sequence
  chemically synthesized
tggcctcataaaatgagtta

SEQ ID NO: 33583 - DNA, 20 bp, Artificial Sequence
  chemically synthesized
gcctcataaaatgagttagg

SEQ ID NO: 33584 - DNA, 20 bp, Artificial Sequence
  chemically synthesized
cctcataaaatgagttaggg

SEQ ID NO: 33585 - DNA, 20 bp, Artificial Sequence
  chemically synthesized
tcttttactattgattcgaa

SEQ ID NO: 33586 - DNA, 20 bp, Artificial Sequence
  chemically synthesized
actattgattcgaatagttt

SEQ ID NO: 33587 - DNA, 20 bp, Artificial Sequence
  chemically synthesized
tattgattcgaatagtttca

SEQ ID NO: 33588 - DNA, 20 bp, Artificial Sequence
  chemically synthesized
attgattcgaatagtttcag

SEQ ID NO: 33589 - DNA, 20 bp, Artificial Sequence
  chemically synthesized
ttgattcgaatagtttcaga

SEQ ID NO: 33590 - DNA, 20 bp, Artificial Sequence
  chemically synthesized
tcgaatagtttcagagggaa

SEQ ID NO: 33591 - DNA, 20 bp, Artificial Sequence
  chemically synthesized
agtttcagagggaatggtac

SEQ ID NO: 33592 - DNA, 20 bp, Artificial Sequence
  chemically synthesized
ccagctcctccttgtacctc

SEQ ID NO: 33593 - DNA, 20 bp, Artificial Sequence
  chemically synthesized
gctcctccttgtacctctgg

SEQ ID NO: 33594 - DNA, 20 bp, Artificial Sequence
  chemically synthesized
cttgtacctctggtagaatt

SEQ ID NO: 33595 - DNA, 20 bp, Artificial Sequence
  chemically synthesized
aatttggctgtgactccatc

SEQ ID NO: 33596 - DNA, 20 bp, Artificial Sequence
  chemically synthesized
gctgtgactccatctggtcc

SEQ ID NO: 33597 - DNA, 20 bp, Artificial Sequence
  chemically synthesized
atctggtcctggactgtttt

SEQ ID NO: 33598 - DNA, 20 bp, Artificial Sequence
  chemically synthesized
ggtcctggactgtttttggt

SEQ ID NO: 33599 - DNA, 20 bp, Artificial Sequence
  chemically synthesized
ctggactgtttttggttggt

SEQ ID NO: 33600 - DNA, 20 bp, Artificial Sequence
  chemically synthesized
attaattattgcctcaattt

SEQ ID NO: 33601 - DNA, 20 bp, Artificial Sequence
  chemically synthesized
tcaatttcagatcctgttat

SEQ ID NO: 33602 - DNA, 20 bp, Artificial Sequence
  chemically synthesized
gatcctgttattggtctatt

SEQ ID NO: 33603 - DNA, 20 bp, Artificial Sequence
  chemically synthesized
tcctgttattggtctattca

SEQ ID NO: 33604 - DNA, 20 bp, Artificial Sequence
  chemically synthesized
tcagagattcaacttcttcc

SEQ ID NO: 33605 - DNA, 20 bp, Artificial Sequence
  chemically synthesized
gattcaacttcttcctggtt

SEQ ID NO: 33606 - DNA, 20 bp, Artificial Sequence
  chemically synthesized
acttcttcctggtttagtct

SEQ ID NO: 33607 - DNA, 20 bp, Artificial Sequence
  chemically synthesized
cttcttcctggtttagtctt

SEQ ID NO: 33608 - DNA, 20 bp, Artificial Sequence
  chemically synthesized
tcttcctggtttagtcttgg

SEQ ID NO: 33609 - DNA, 20 bp, Artificial Sequence
  chemically synthesized
cttcctggtttagtcttggg

SEQ ID NO: 33610 - DNA, 20 bp, Artificial Sequence
  chemically synthesized
ttcctggtttagtcttggga

SEQ ID NO: 33611 - DNA, 20 bp, Artificial Sequence
  chemically synthesized
cttgggagggtgtatgtgtc

SEQ ID NO: 33612 - DNA, 20 bp, Artificial Sequence
  chemically synthesized
ttgggagggtgtatgtgtca

SEQ ID NO: 33613 - DNA, 20 bp, Artificial Sequence
  chemically synthesized
aggaatttatccatttcttc

SEQ ID NO: 33614 - DNA, 20 bp, Artificial Sequence
  chemically synthesized
tccatttcttctagattttc

SEQ ID NO: 33615 - DNA, 20 bp, Artificial Sequence
  chemically synthesized
gattttctagtttatttgtg

SEQ ID NO: 33616 - DNA, 20 bp, Artificial Sequence
  chemically synthesized
ttttctagtttatttgtgta

SEQ ID NO: 33617 - DNA, 20 bp, Artificial Sequence
  chemically synthesized
tttctagtttatttgtgtag

SEQ ID NO: 33618 - DNA, 20 bp, Artificial Sequence
  chemically synthesized
tatttgtgtagaggtgttta

SEQ ID NO: 33619 - DNA, 20 bp, Artificial Sequence
  chemically synthesized
gtgtttatagtattctctga

SEQ ID NO: 33620 - DNA, 20 bp, Artificial Sequence
  chemically synthesized
tttatagtattctctgatgg

SEQ ID NO: 33621 - DNA, 20 bp, Artificial Sequence
  chemically synthesized
gatggtggtttgtatttctg

SEQ ID NO: 33622 - DNA, 20 bp, Artificial Sequence
  chemically synthesized
atggtggtttgtatttctgt

SEQ ID NO: 33623 - DNA, 20 bp, Artificial Sequence
  chemically synthesized
ggtttgtatttctgtgggat

SEQ ID NO: 33624 - DNA, 20 bp, Artificial Sequence
  chemically synthesized
ttgtatttctgtgggatcgg

SEQ ID NO: 33625 - DNA, 20 bp, Artificial Sequence
  chemically synthesized
ttctctcttttcttctttat

SEQ ID NO: 33626 - DNA, 20 bp, Artificial Sequence
  chemically synthesized
ttcttctttattagtcttgc

SEQ ID NO: 33627 - DNA, 20 bp, Artificial Sequence
  chemically synthesized
ttctttattagtcttgctag

SEQ ID NO: 33628 - DNA, 20 bp, Artificial Sequence
  chemically synthesized
tgttgatctttttgaaaaac

SEQ ID NO: 33629 - DNA, 20 bp, Artificial Sequence
  chemically synthesized
ctttttgaaaaaccagcttc

SEQ ID NO: 33630 - DNA, 20 bp, Artificial Sequence
  chemically synthesized
ctggattcattgattttttg

SEQ ID NO: 33631 - DNA, 20 bp, Artificial Sequence
  chemically synthesized
tggattcattgattttttga

SEQ ID NO: 33632 - DNA, 20 bp, Artificial Sequence
  chemically synthesized
ggattcattgattttttgaa

SEQ ID NO: 33633 - DNA, 20 bp, Artificial Sequence
  chemically synthesized
ttttgtgtctctatttcctt

SEQ ID NO: 33634 - DNA, 20 bp, Artificial Sequence
  chemically synthesized
cttcagttctgctctgattt

SEQ ID NO: 33635 - DNA, 20 bp, Artificial Sequence
  chemically synthesized
agttatttcttgccttctgc

SEQ ID NO: 33636 - DNA, 20 bp, Artificial Sequence
  chemically synthesized
tgtgtttgctcttgcttctc

SEQ ID NO: 33637 - DNA, 20 bp, Artificial Sequence
  chemically synthesized
agttcttttaattgtgatgt

SEQ ID NO: 33638 - DNA, 20 bp, Artificial Sequence
  chemically synthesized
gttcttttaattgtgatgtt

SEQ ID NO: 33639 - DNA, 20 bp, Artificial Sequence
  chemically synthesized
ttcttttaattgtgatgtta

SEQ ID NO: 33640 - DNA, 20 bp, Artificial Sequence
  chemically synthesized
tgatgttagggtgtcaattt

SEQ ID NO: 33641 - DNA, 20 bp, Artificial Sequence
  chemically synthesized
atctttcctgctttctcttc

SEQ ID NO: 33642 - DNA, 20 bp, Artificial Sequence
  chemically synthesized
tctttcctgctttctcttct

SEQ ID NO: 33643 - DNA, 20 bp, Artificial Sequence
  chemically synthesized
tgctttctcttctgggcgtt

SEQ ID NO: 33644 - DNA, 20 bp, Artificial Sequence
  chemically synthesized
acactgctttgaatgtgtcc

SEQ ID NO: 33645 - DNA, 20 bp, Artificial Sequence
  chemically synthesized
actgctttgaatgtgtccca

SEQ ID NO: 33646 - DNA, 20 bp, Artificial Sequence
  chemically synthesized
tgaatgtgtcccagagattc

SEQ ID NO: 33647 - DNA, 20 bp, Artificial Sequence
  chemically synthesized
tgttgtgtctttgttctctt

SEQ ID NO: 33648 - DNA, 20 bp, Artificial Sequence
  chemically synthesized
ctttgttctctttggttcca

SEQ ID NO: 33649 - DNA, 20 bp, Artificial Sequence
  chemically synthesized
ccttcattttgttatgaacc

SEQ ID NO: 33650 - DNA, 20 bp, Artificial Sequence
  chemically synthesized
tcattttgttatgaacccag

SEQ ID NO: 33651 - DNA, 20 bp, Artificial Sequence
  chemically synthesized
ttatgaacccagtagtcatt

SEQ ID NO: 33652 - DNA, 20 bp, Artificial Sequence
  chemically synthesized
tatgaacccagtagtcattc

SEQ ID NO: 33653 - DNA, 20 bp, Artificial Sequence
  chemically synthesized
tgaacccagtagtcattcag

SEQ ID NO: 33654 - DNA, 20 bp, Artificial Sequence
  chemically synthesized
tcattcaggagcaatttgtt

SEQ ID NO: 33655 - DNA, 20 bp, Artificial Sequence
  chemically synthesized
caatttgttcggtttccatg

SEQ ID NO: 33656 - DNA, 20 bp, Artificial Sequence
  chemically synthesized
tgttcggtttccatgtagtt

SEQ ID NO: 33657 - DNA, 20 bp, Artificial Sequence
  chemically synthesized
tcggtttccatgtagttgag

SEQ ID NO: 33658 - DNA, 20 bp, Artificial Sequence
  chemically synthesized
ccatgtagttgagcggtttt

SEQ ID NO: 33659 - DNA, 20 bp, Artificial Sequence
  chemically synthesized
gtagttgagcggttttgagt

SEQ ID NO: 33660 - DNA, 20 bp, Artificial Sequence
  chemically synthesized
tgagtgagtttcttaatcct

SEQ ID NO: 33661 - DNA, 20 bp, Artificial Sequence
  chemically synthesized
agtttcttaatcctgagttc

SEQ ID NO: 33662 - DNA, 20 bp, Artificial Sequence
  chemically synthesized
gttctagtttgattgcactg

SEQ ID NO: 33663 - DNA, 20 bp, Artificial Sequence
  chemically synthesized
gtttgattgcactgtggtct

SEQ ID NO: 33664 - DNA, 20 bp, Artificial Sequence
  chemically synthesized
ttgattgcactgtggtctga

SEQ ID NO: 33665 - DNA, 20 bp, Artificial Sequence
  chemically synthesized
ttgcactgtggtctgagaga

SEQ ID NO: 33666 - DNA, 20 bp, Artificial Sequence
  chemically synthesized
tctgttcttttacatttgct

SEQ ID NO: 33667 - DNA, 20 bp, Artificial Sequence
  chemically synthesized
ctgttcttttacatttgctg

SEQ ID NO: 33668 - DNA, 20 bp, Artificial Sequence
  chemically synthesized
gttcttttacatttgctgag

SEQ ID NO: 33669 - DNA, 20 bp, Artificial Sequence
  chemically synthesized
gtgctttacttccaactatg

SEQ ID NO: 33670 - DNA, 20 bp, Artificial Sequence
  chemically synthesized
tccaactatgtggtcaattt

SEQ ID NO: 33671 - DNA, 20 bp, Artificial Sequence
  chemically synthesized
ctatgtggtcaattttggaa

SEQ ID NO: 33672 - DNA, 20 bp, Artificial Sequence
  chemically synthesized
tatgtggtcaattttggaat

SEQ ID NO: 33673 - DNA, 20 bp, Artificial Sequence
  chemically synthesized
ggtcaattttggaataggtg

SEQ ID NO: 33674 - DNA, 20 bp, Artificial Sequence
  chemically synthesized
attttggaataggtgtggtg

SEQ ID NO: 33675 - DNA, 20 bp, Artificial Sequence
  chemically synthesized
aggtgtggtgtggtgctgaa

SEQ ID NO: 33676 - DNA, 20 bp, Artificial Sequence
  chemically synthesized
gaatgtatattctgttgatt

SEQ ID NO: 33677 - DNA, 20 bp, Artificial Sequence
  chemically synthesized
aatgtatattctgttgattt

SEQ ID NO: 33678 - DNA, 20 bp, Artificial Sequence
  chemically synthesized
atgtatattctgttgatttg

SEQ ID NO: 33679 - DNA, 20 bp, Artificial Sequence
  chemically synthesized
tatattctgttgatttgggg

SEQ ID NO: 33680 - DNA, 20 bp, Artificial Sequence
  chemically synthesized
tattctgttgatttggggtg

SEQ ID NO: 33681 - DNA, 20 bp, Artificial Sequence
  chemically synthesized
ttctgttgatttggggtgga

SEQ ID NO: 33682 - DNA, 20 bp, Artificial Sequence
  chemically synthesized
atttggggtggagagttctg

SEQ ID NO: 33683 - DNA, 20 bp, Artificial Sequence
  chemically synthesized
agagttctgtagatgtctat

SEQ ID NO: 33684 - DNA, 20 bp, Artificial Sequence
  chemically synthesized
gagttctgtagatgtctatt

SEQ ID NO: 33685 - DNA, 20 bp, Artificial Sequence
  chemically synthesized
agatgtctattaggtccgct

SEQ ID NO: 33686 - DNA, 20 bp, Artificial Sequence
  chemically synthesized
tctattaggtccgcttggtg

SEQ ID NO: 33687 - DNA, 20 bp, Artificial Sequence
  chemically synthesized
tattaggtccgcttggtgca

SEQ ID NO: 33688 - DNA, 20 bp, Artificial Sequence
  chemically synthesized
ggtccgcttggtgcagagct

SEQ ID NO: 33689 - DNA, 20 bp, Artificial Sequence
  chemically synthesized
gcagagctgagttcaattcc

SEQ ID NO: 33690 - DNA, 20 bp, Artificial Sequence
  chemically synthesized
gttgatctgtctaatgttga

SEQ ID NO: 33691 - DNA, 20 bp, Artificial Sequence
  chemically synthesized
gatctgtctaatgttgacag

SEQ ID NO: 33692 - DNA, 20 bp, Artificial Sequence
  chemically synthesized
atctgtctaatgttgacagt

SEQ ID NO: 33693 - DNA, 20 bp, Artificial Sequence
  chemically synthesized
tctgtctaatgttgacagtg

SEQ ID NO: 33694 - DNA, 20 bp, Artificial Sequence
  chemically synthesized
atgttgacagtggggtgtta

SEQ ID NO: 33695 - DNA, 20 bp, Artificial Sequence
  chemically synthesized
gtctcccattgttattgtgt

SEQ ID NO: 33696 - DNA, 20 bp, Artificial Sequence
  chemically synthesized
ctcccattgttattgtgtga

SEQ ID NO: 33697 - DNA, 20 bp, Artificial Sequence
  chemically synthesized
ttgttattgtgtgagagtct

SEQ ID NO: 33698 - DNA, 20 bp, Artificial Sequence
  chemically synthesized
tgagagtctaagtctctttg

SEQ ID NO: 33699 - DNA, 20 bp, Artificial Sequence
  chemically synthesized
gagagtctaagtctctttgt

SEQ ID NO: 33700 - DNA, 20 bp, Artificial Sequence
  chemically synthesized
aagtctctttgtaggtctct

SEQ ID NO: 33701 - DNA, 20 bp, Artificial Sequence
  chemically synthesized
agtctctttgtaggtctcta

SEQ ID NO: 33702 - DNA, 20 bp, Artificial Sequence
  chemically synthesized
aaggacttgctttatgaacc

SEQ ID NO: 33703 - DNA, 20 bp, Artificial Sequence
  chemically synthesized
aggacttgctttatgaacct

SEQ ID NO: 33704 - DNA, 20 bp, Artificial Sequence
  chemically synthesized
gaacctgggtgttcctgtat

SEQ ID NO: 33705 - DNA, 20 bp, Artificial Sequence
  chemically synthesized
aacctgggtgttcctgtatt

SEQ ID NO: 33706 - DNA, 20 bp, Artificial Sequence
  chemically synthesized
gtattgggtgcatatatgtt

SEQ ID NO: 33707 - DNA, 20 bp, Artificial Sequence
  chemically synthesized
tattgggtgcatatatgttt

SEQ ID NO: 33708 - DNA, 20 bp, Artificial Sequence
  chemically synthesized
gggtgcatatatgtttagga

SEQ ID NO: 33709 - DNA, 20 bp, Artificial Sequence
  chemically synthesized
gcatatatgtttaggatagt

SEQ ID NO: 33710 - DNA, 20 bp, Artificial Sequence
  chemically synthesized
atccctttaccattatgtaa

SEQ ID NO: 33711 - DNA, 20 bp, Artificial Sequence
  chemically synthesized
ttgtctcttttgatctttgt

SEQ ID NO: 33712 - DNA, 20 bp, Artificial Sequence
  chemically synthesized
ttttgatctttgttggttta

SEQ ID NO: 33713 - DNA, 20 bp, Artificial Sequence
  chemically synthesized
tggtttaaagcctgttttat

SEQ ID NO: 33714 - DNA, 20 bp, Artificial Sequence
  chemically synthesized
gtttaaagcctgttttatca

SEQ ID NO: 33715 - DNA, 20 bp, Artificial Sequence
  chemically synthesized
aagcctgttttatcagagat

SEQ ID NO: 33716 - DNA, 20 bp, Artificial Sequence
  chemically synthesized
agcctgttttatcagagatg

SEQ ID NO: 33717 - DNA, 20 bp, Artificial Sequence
  chemically synthesized
ttttttgttttccattttct

SEQ ID NO: 33718 - DNA, 20 bp, Artificial Sequence
  chemically synthesized
tttgttttccattttcttgg

SEQ ID NO: 33719 - DNA, 20 bp, Artificial Sequence
  chemically synthesized
ttcctccatccctttatttt

SEQ ID NO: 33720 - DNA, 20 bp, Artificial Sequence
  chemically synthesized
ctatgtgtgtgtgtgcacat

SEQ ID NO: 33721 - DNA, 20 bp, Artificial Sequence
  chemically synthesized
gtgtgtgtgtgcacatgaga

SEQ ID NO: 33722 - DNA, 20 bp, Artificial Sequence
  chemically synthesized
tgtgtgtgtgcacatgagat

SEQ ID NO: 33723 - DNA, 20 bp, Artificial Sequence
  chemically synthesized
tgagatgggtttcctgaata

SEQ ID NO: 33724 - DNA, 20 bp, Artificial Sequence
  chemically synthesized
tcctgaatacagcacactga

SEQ ID NO: 33725 - DNA, 20 bp, Artificial Sequence
  chemically synthesized
cctgaatacagcacactgat

SEQ ID NO: 33726 - DNA, 20 bp, Artificial Sequence
  chemically synthesized
gcccgtctgtgtctttttac

SEQ ID NO: 33727 - DNA, 20 bp, Artificial Sequence
  chemically synthesized
ccgtctgtgtctttttactg

SEQ ID NO: 33728 - DNA, 20 bp, Artificial Sequence
  chemically synthesized
tgtctttttactggagcatt

SEQ ID NO: 33729 - DNA, 20 bp, Artificial Sequence
  chemically synthesized
gcatttagcccatttacatt

SEQ ID NO: 33730 - DNA, 20 bp, Artificial Sequence
  chemically synthesized
catttagcccatttacatta

SEQ ID NO: 33731 - DNA, 20 bp, Artificial Sequence
  chemically synthesized
tgatcctgtcattatgatgt

SEQ ID NO: 33732 - DNA, 20 bp, Artificial Sequence
  chemically synthesized
cctgtcattatgatgttagc

SEQ ID NO: 33733 - DNA, 20 bp, Artificial Sequence
  chemically synthesized
tagctggttattttgctcat

SEQ ID NO: 33734 - DNA, 20 bp, Artificial Sequence
  chemically synthesized
attttgctcattagttgatg

SEQ ID NO: 33735 - DNA, 20 bp, Artificial Sequence
  chemically synthesized
tagttgatgcagtttcttcc

SEQ ID NO: 33736 - DNA, 20 bp, Artificial Sequence
  chemically synthesized
cagtttcttcctagcctcaa

SEQ ID NO: 33737 - DNA, 20 bp, Artificial Sequence
  chemically synthesized
cctcaatggtctttacaatt

SEQ ID NO: 33738 - DNA, 20 bp, Artificial Sequence
  chemically synthesized
tacaatttggcatgtttttg

SEQ ID NO: 33739 - DNA, 20 bp, Artificial Sequence
  chemically synthesized
aatttggcatgtttttgcag

SEQ ID NO: 33740 - DNA, 20 bp, Artificial Sequence
  chemically synthesized
tggcatgtttttgcagtggc

SEQ ID NO: 33741 - DNA, 20 bp, Artificial Sequence
  chemically synthesized
gtttttgcagtggctggtac

SEQ ID NO: 33742 - DNA, 20 bp, Artificial Sequence
  chemically synthesized
cggttgtgcctttccatatt

SEQ ID NO: 33743 - DNA, 20 bp, Artificial Sequence
  chemically synthesized
tccatatttagtgcttcctt

SEQ ID NO: 33744 - DNA, 20 bp, Artificial Sequence
  chemically synthesized
ccatatttagtgcttccttc

SEQ ID NO: 33745 - DNA, 20 bp, Artificial Sequence
  chemically synthesized
atatttagtgcttccttcag

SEQ ID NO: 33746 - DNA, 20 bp, Artificial Sequence
  chemically synthesized
gcttccttcaggagctcttt

SEQ ID NO: 33747 - DNA, 20 bp, Artificial Sequence
  chemically synthesized
cttccttcaggagctctttt

SEQ ID NO: 33748 - DNA, 20 bp, Artificial Sequence
  chemically synthesized
cttcaggagctcttttaggt

SEQ ID NO: 33749 - DNA, 20 bp, Artificial Sequence
  chemically synthesized
ttcaggagctcttttaggtc

SEQ ID NO: 33750 - DNA, 20 bp, Artificial Sequence
  chemically synthesized
gagctcttttaggtcaggcc

SEQ ID NO: 33751 - DNA, 20 bp, Artificial Sequence
  chemically synthesized
ctggtgatgacaaaatctct

SEQ ID NO: 33752 - DNA, 20 bp, Artificial Sequence
  chemically synthesized
tcagcatttgcttgtctgta

SEQ ID NO: 33753 - DNA, 20 bp, Artificial Sequence
  chemically synthesized
ttatttctccttcacttatg

SEQ ID NO: 33754 - DNA, 20 bp, Artificial Sequence
  chemically synthesized
tctccttcacttatgaagct

SEQ ID NO: 33755 - DNA, 20 bp, Artificial Sequence
  chemically synthesized
ttcacttatgaagcttagtt

SEQ ID NO: 33756 - DNA, 20 bp, Artificial Sequence
  chemically synthesized
cttatgaagcttagtttggc

SEQ ID NO: 33757 - DNA, 20 bp, Artificial Sequence
  chemically synthesized
tgttgaaaattctttccttt

SEQ ID NO: 33758 - DNA, 20 bp, Artificial Sequence
  chemically synthesized
gttgaaaattctttccttta

SEQ ID NO: 33759 - DNA, 20 bp, Artificial Sequence
  chemically synthesized
cctttaaggatgttgaatat

SEQ ID NO: 33760 - DNA, 20 bp, Artificial Sequence
  chemically synthesized
tattggcccccactctcttc

SEQ ID NO: 33761 - DNA, 20 bp, Artificial Sequence
  chemically synthesized
ccccactctcttctggcttg

SEQ ID NO: 33762 - DNA, 20 bp, Artificial Sequence
  chemically synthesized
ccactctcttctggcttgta

SEQ ID NO: 33763 - DNA, 20 bp, Artificial Sequence
  chemically synthesized
tggcttgtagagtttctgct

SEQ ID NO: 33764 - DNA, 20 bp, Artificial Sequence
  chemically synthesized
gcttgtagagtttctgctga

SEQ ID NO: 33765 - DNA, 20 bp, Artificial Sequence
  chemically synthesized
gagatctgctgttattctga

SEQ ID NO: 33766 - DNA, 20 bp, Artificial Sequence
  chemically synthesized
agatctgctgttattctgat

SEQ ID NO: 33767 - DNA, 20 bp, Artificial Sequence
  chemically synthesized
ttctgatgggcttccctttg

SEQ ID NO: 33768 - DNA, 20 bp, Artificial Sequence
  chemically synthesized
tctgatgggcttccctttgt

SEQ ID NO: 33769 - DNA, 20 bp, Artificial Sequence
  chemically synthesized
ggtaacccgacctttctctc

SEQ ID NO: 33770 - DNA, 20 bp, Artificial Sequence
  chemically synthesized
ttttcccttcatttcaactt

SEQ ID NO: 33771 - DNA, 20 bp, Artificial Sequence
  chemically synthesized
tctgacaattatgtgccttg

SEQ ID NO: 33772 - DNA, 20 bp, Artificial Sequence
  chemically synthesized
gccttgtagttgctcttctc

SEQ ID NO: 33773 - DNA, 20 bp, Artificial Sequence
  chemically synthesized
ccttgtagttgctcttctca

SEQ ID NO: 33774 - DNA, 20 bp, Artificial Sequence
  chemically synthesized
ttgtagttgctcttctcaag

SEQ ID NO: 33775 - DNA, 20 bp, Artificial Sequence
  chemically synthesized
cttctcaaggagtatctttg

SEQ ID NO: 33776 - DNA, 20 bp, Artificial Sequence
  chemically synthesized
tgaatgttgacctgccttgc

SEQ ID NO: 33777 - DNA, 20 bp, Artificial Sequence
  chemically synthesized
gttgacctgccttgctagat

SEQ ID NO: 33778 - DNA, 20 bp, Artificial Sequence
  chemically synthesized
ttgacctgccttgctagatt

SEQ ID NO: 33779 - DNA, 20 bp, Artificial Sequence
  chemically synthesized
tgacctgccttgctagattg

SEQ ID NO: 33780 - DNA, 20 bp, Artificial Sequence
  chemically synthesized
cctgccttgctagattgggg

SEQ ID NO: 33781 - DNA, 20 bp, Artificial Sequence
  chemically synthesized
ctagattggggaagttctcc

SEQ ID NO: 33782 - DNA, 20 bp, Artificial Sequence
  chemically synthesized
ttctcctggataatatcctg

SEQ ID NO: 33783 - DNA, 20 bp, Artificial Sequence
  chemically synthesized
ctcctggataatatcctgca

SEQ ID NO: 33784 - DNA, 20 bp, Artificial Sequence
  chemically synthesized
ctgcagagtgttttccaact

SEQ ID NO: 33785 - DNA, 20 bp, Artificial Sequence
  chemically synthesized
tccattctgcccgtcacttt

SEQ ID NO: 33786 - DNA, 20 bp, Artificial Sequence
  chemically synthesized
ccattctgcccgtcactttc

SEQ ID NO: 33787 - DNA, 20 bp, Artificial Sequence
  chemically synthesized
tcactttcaggtacaccaat

SEQ ID NO: 33788 - DNA, 20 bp, Artificial Sequence
  chemically synthesized
tcaggtacaccaatcagata

SEQ ID NO: 33789 - DNA, 20 bp, Artificial Sequence
  chemically synthesized
acaccaatcagatatagatt

SEQ ID NO: 33790 - DNA, 20 bp, Artificial Sequence
  chemically synthesized
atagatttggtcttttcaca

SEQ ID NO: 33791 - DNA, 20 bp, Artificial Sequence
  chemically synthesized
tcacatagtcccatatttct

SEQ ID NO: 33792 - DNA, 20 bp, Artificial Sequence
  chemically synthesized
acatagtcccatatttcttg

SEQ ID NO: 33793 - DNA, 20 bp, Artificial Sequence
  chemically synthesized
catagtcccatatttcttgg

SEQ ID NO: 33794 - DNA, 20 bp, Artificial Sequence
  chemically synthesized
atcactgataccctttcttc

SEQ ID NO: 33795 - DNA, 20 bp, Artificial Sequence
  chemically synthesized
tttcttccagttgatcgaat

SEQ ID NO: 33796 - DNA, 20 bp, Artificial Sequence
  chemically synthesized
agttgatcgaatcagctact

SEQ ID NO: 33797 - DNA, 20 bp, Artificial Sequence
  chemically synthesized
agtcttgtgcattcatcatg

SEQ ID NO: 33798 - DNA, 20 bp, Artificial Sequence
  chemically synthesized
atcatgtagttctcatgcct

SEQ ID NO: 33799 - DNA, 20 bp, Artificial Sequence
  chemically synthesized
agttctcatgccttggtttt

SEQ ID NO: 33800 - DNA, 20 bp, Artificial Sequence
  chemically synthesized
gccttggttttcagctccat

SEQ ID NO: 33801 - DNA, 20 bp, Artificial Sequence
  chemically synthesized
ccttggttttcagctccatc

SEQ ID NO: 33802 - DNA, 20 bp, Artificial Sequence
  chemically synthesized
tcagctccatcaggtccttt

SEQ ID NO: 33803 - DNA, 20 bp, Artificial Sequence
  chemically synthesized
cagctccatcaggtccttta

SEQ ID NO: 33804 - DNA, 20 bp, Artificial Sequence
  chemically synthesized
ctttaaggacttctctgtat

SEQ ID NO: 33805 - DNA, 20 bp, Artificial Sequence
  chemically synthesized
cttctctgtattggttattc

SEQ ID NO: 33806 - DNA, 20 bp, Artificial Sequence
  chemically synthesized
tctgtattggttattctagt

SEQ ID NO: 33807 - DNA, 20 bp, Artificial Sequence
  chemically synthesized
tggttattctagttagccat

SEQ ID NO: 33808 - DNA, 20 bp, Artificial Sequence
  chemically synthesized
cattagtctaatttattttc

SEQ ID NO: 33809 - DNA, 20 bp, Artificial Sequence
  chemically synthesized
attagtctaatttattttca

SEQ ID NO: 33810 - DNA, 20 bp, Artificial Sequence
  chemically synthesized
ggtttttaacttttttgcca

SEQ ID NO: 33811 - DNA, 20 bp, Artificial Sequence
  chemically synthesized
gtttttaacttttttgccat

SEQ ID NO: 33812 - DNA, 20 bp, Artificial Sequence
  chemically synthesized
aacttttttgccatgggttc

SEQ ID NO: 33813 - DNA, 20 bp, Artificial Sequence
  chemically synthesized
tgggttcgagcttcctcctt

SEQ ID NO: 33814 - DNA, 20 bp, Artificial Sequence
  chemically synthesized
tcgagcttcctcctttagct

SEQ ID NO: 33815 - DNA, 20 bp, Artificial Sequence
  chemically synthesized
gagcttcctcctttagctcg

SEQ ID NO: 33816 - DNA, 20 bp, Artificial Sequence
  chemically synthesized
cttcctcctttagctcggag

SEQ ID NO: 33817 - DNA, 20 bp, Artificial Sequence
  chemically synthesized
cggagtagtttgatcgtctg

SEQ ID NO: 33818 - DNA, 20 bp, Artificial Sequence
  chemically synthesized
cttcttctctcaacttgtca

SEQ ID NO: 33819 - DNA, 20 bp, Artificial Sequence
  chemically synthesized
tgtcaaagtcattctctgtc

SEQ ID NO: 33820 - DNA, 20 bp, Artificial Sequence
  chemically synthesized
gtccagctttgtaccgttgc

SEQ ID NO: 33821 - DNA, 20 bp, Artificial Sequence
  chemically synthesized
agctttgtaccgttgctggt

SEQ ID NO: 33822 - DNA, 20 bp, Artificial Sequence
  chemically synthesized
gctttgtaccgttgctggtg

SEQ ID NO: 33823 - DNA, 20 bp, Artificial Sequence
  chemically synthesized
tttgtaccgttgctggtgag

SEQ ID NO: 33824 - DNA, 20 bp, Artificial Sequence
  chemically synthesized
ggtgaggagctgcattcctt

SEQ ID NO: 33825 - DNA, 20 bp, Artificial Sequence
  chemically synthesized
tgaggagctgcattcctttg

SEQ ID NO: 33826 - DNA, 20 bp, Artificial Sequence
  chemically synthesized
gaggagctgcattcctttgg

SEQ ID NO: 33827 - DNA, 20 bp, Artificial Sequence
  chemically synthesized
ggagctgcattcctttggag

SEQ ID NO: 33828 - DNA, 20 bp, Artificial Sequence
  chemically synthesized
gagctgcattcctttggagg

SEQ ID NO: 33829 - DNA, 20 bp, Artificial Sequence
  chemically synthesized
gctgcattcctttggaggag

SEQ ID NO: 33830 - DNA, 20 bp, Artificial Sequence
  chemically synthesized
tgcattcctttggaggagga

SEQ ID NO: 33831 - DNA, 20 bp, Artificial Sequence
  chemically synthesized
gcattcctttggaggaggag

SEQ ID NO: 33832 - DNA, 20 bp, Artificial Sequence
  chemically synthesized
aggagaggcactctgatttt

SEQ ID NO: 33833 - DNA, 20 bp, Artificial Sequence
  chemically synthesized
gagaggcactctgattttta

SEQ ID NO: 33834 - DNA, 20 bp, Artificial Sequence
  chemically synthesized
actctgatttttagagtttc

SEQ ID NO: 33835 - DNA, 20 bp, Artificial Sequence
  chemically synthesized
tctgtttttccccatctttg

SEQ ID NO: 33836 - DNA, 20 bp, Artificial Sequence
  chemically synthesized
tttgtggttttatctacctt

SEQ ID NO: 33837 - DNA, 20 bp, Artificial Sequence
  chemically synthesized
ctacctttggtctttgatga

SEQ ID NO: 33838 - DNA, 20 bp, Artificial Sequence
  chemically synthesized
tctttgatgatggtgacgta

SEQ ID NO: 33839 - DNA, 20 bp, Artificial Sequence
  chemically synthesized
tgatgatggtgacgtacaga

SEQ ID NO: 33840 - DNA, 20 bp, Artificial Sequence
  chemically synthesized
gatgatggtgacgtacagat

SEQ ID NO: 33841 - DNA, 20 bp, Artificial Sequence
  chemically synthesized
gtgacgtacagatgggtttt

SEQ ID NO: 33842 - DNA, 20 bp, Artificial Sequence
  chemically synthesized
gtacagatgggtttttggtg

SEQ ID NO: 33843 - DNA, 20 bp, Artificial Sequence
  chemically synthesized
tggatgtcctttctgtttgt

SEQ ID NO: 33844 - DNA, 20 bp, Artificial Sequence
  chemically synthesized
tttgttagttttccttctaa

SEQ ID NO: 33845 - DNA, 20 bp, Artificial Sequence
  chemically synthesized
ttgttagttttccttctaac

SEQ ID NO: 33846 - DNA, 20 bp, Artificial Sequence
  chemically synthesized
tttccttctaacaggaccct

SEQ ID NO: 33847 - DNA, 20 bp, Artificial Sequence
  chemically synthesized
ctaacaggaccctcagcttg

SEQ ID NO: 33848 - DNA, 20 bp, Artificial Sequence
  chemically synthesized
acaggaccctcagcttgcag

SEQ ID NO: 33849 - DNA, 20 bp, Artificial Sequence
  chemically synthesized
agcttgcagcagatttttaa

SEQ ID NO: 33850 - DNA, 20 bp, Artificial Sequence
  chemically synthesized
cagatttttaaaagaacttc

SEQ ID NO: 33851 - DNA, 20 bp, Artificial Sequence
  chemically synthesized
agatttttaaaagaacttcc

SEQ ID NO: 33852 - DNA, 20 bp, Artificial Sequence
  chemically synthesized
tattgacgcctatgtcacta

SEQ ID NO: 33853 - DNA, 20 bp, Artificial Sequence
  chemically synthesized
attgacgcctatgtcactac

SEQ ID NO: 33854 - DNA, 20 bp, Artificial Sequence
  chemically synthesized
gcctatgtcactacaggaat

SEQ ID NO: 33855 - DNA, 20 bp, Artificial Sequence
  chemically synthesized
ctatgtcactacaggaatca

SEQ ID NO: 33856 - DNA, 20 bp, Artificial Sequence
  chemically synthesized
tgtcactacaggaatcagag

SEQ ID NO: 33857 - DNA, 20 bp, Artificial Sequence
  chemically synthesized
gtcactacaggaatcagagc

SEQ ID NO: 33858 - DNA, 20 bp, Artificial Sequence
  chemically synthesized
tcactacaggaatcagagca

SEQ ID NO: 33859 - DNA, 20 bp, Artificial Sequence
  chemically synthesized
gggcattacattgatccttt

SEQ ID NO: 33860 - DNA, 20 bp, Artificial Sequence
  chemically synthesized
ttttttttttttaattttta

SEQ ID NO: 33861 - DNA, 20 bp, Artificial Sequence
  chemically synthesized
tttttttttttaatttttaa

SEQ ID NO: 33862 - DNA, 20 bp, Artificial Sequence
  chemically synthesized
taatttttaaaggtaattgt

SEQ ID NO: 33863 - DNA, 20 bp, Artificial Sequence
  chemically synthesized
gtaattgttagaaatttccc

SEQ ID NO: 33864 - DNA, 20 bp, Artificial Sequence
  chemically synthesized
taattgttagaaatttccca

SEQ ID NO: 33865 - DNA, 20 bp, Artificial Sequence
  chemically synthesized
cactgaaaacataactttta

SEQ ID NO: 33866 - DNA, 20 bp, Artificial Sequence
  chemically synthesized
taacttttacagatgatttg

SEQ ID NO: 33867 - DNA, 20 bp, Artificial Sequence
  chemically synthesized
ttacagatgatttgtggata

SEQ ID NO: 33868 - DNA, 20 bp, Artificial Sequence
  chemically synthesized
acacatcacctatcttactt

SEQ ID NO: 33869 - DNA, 20 bp, Artificial Sequence
  chemically synthesized
cacatcacctatcttacttt

SEQ ID NO: 33870 - DNA, 20 bp, Artificial Sequence
  chemically synthesized
tcacctatcttactttagga

SEQ ID NO: 33871 - DNA, 20 bp, Artificial Sequence
  chemically synthesized
ttactttaggacagtctgtg

SEQ ID NO: 33872 - DNA, 20 bp, Artificial Sequence
  chemically synthesized
agatgatatttttcctgctg

SEQ ID NO: 33873 - DNA, 20 bp, Artificial Sequence
  chemically synthesized
cctgctgcagttcctttgtc

SEQ ID NO: 33874 - DNA, 20 bp, Artificial Sequence
  chemically synthesized
gttcctttgtcaagtgactt

SEQ ID NO: 33875 - DNA, 20 bp, Artificial Sequence
  chemically synthesized
ctttgtcaagtgactttaga

SEQ ID NO: 33876 - DNA, 20 bp, Artificial Sequence
  chemically synthesized
caagtgactttagacagata

SEQ ID NO: 33877 - DNA, 20 bp, Artificial Sequence
  chemically synthesized
aagtgactttagacagatac

SEQ ID NO: 33878 - DNA, 20 bp, Artificial Sequence
  chemically synthesized
ttagacagatacaggactgc

SEQ ID NO: 33879 - DNA, 20 bp, Artificial Sequence
  chemically synthesized
agacagatacaggactgcaa

SEQ ID NO: 33880 - DNA, 20 bp, Artificial Sequence
  chemically synthesized
acaggactgcaagagtgact

SEQ ID NO: 33881 - DNA, 20 bp, Artificial Sequence
  chemically synthesized
caggactgcaagagtgactc

SEQ ID NO: 33882 - DNA, 20 bp, Artificial Sequence
  chemically synthesized
aagagtgactcaggtcatgc

SEQ ID NO: 33883 - DNA, 20 bp, Artificial Sequence
  chemically synthesized
tgactcaggtcatgctggca

SEQ ID NO: 33884 - DNA, 20 bp, Artificial Sequence
  chemically synthesized
gactcaggtcatgctggcat

SEQ ID NO: 33885 - DNA, 20 bp, Artificial Sequence
  chemically synthesized
ctcaggtcatgctggcatag

SEQ ID NO: 33886 - DNA, 20 bp, Artificial Sequence
  chemically synthesized
aggtcatgctggcataggag

SEQ ID NO: 33887 - DNA, 20 bp, Artificial Sequence
  chemically synthesized
tcatgctggcataggagaag

SEQ ID NO: 33888 - DNA, 20 bp, Artificial Sequence
  chemically synthesized
catgctggcataggagaagc

SEQ ID NO: 33889 - DNA, 20 bp, Artificial Sequence
  chemically synthesized
ggcataggagaagcaggtgc

SEQ ID NO: 33890 - DNA, 20 bp, Artificial Sequence
  chemically synthesized
tgctagtgtttcacttgaac

SEQ ID NO: 33891 - DNA, 20 bp, Artificial Sequence
  chemically synthesized
gtttcacttgaactagttgt

SEQ ID NO: 33892 - DNA, 20 bp, Artificial Sequence
  chemically synthesized
tttcacttgaactagttgtt

SEQ ID NO: 33893 - DNA, 20 bp, Artificial Sequence
  chemically synthesized
acttgaactagttgttgggc

SEQ ID NO: 33894 - DNA, 20 bp, Artificial Sequence
  chemically synthesized
cttgaactagttgttgggct

SEQ ID NO: 33895 - DNA, 20 bp, Artificial Sequence
  chemically synthesized
ttgaactagttgttgggctg

SEQ ID NO: 33896 - DNA, 20 bp, Artificial Sequence
  chemically synthesized
aactagttgttgggctgggg

SEQ ID NO: 33897 - DNA, 20 bp, Artificial Sequence
  chemically synthesized
gttgggctggggtggaatga

SEQ ID NO: 33898 - DNA, 20 bp, Artificial Sequence
  chemically synthesized
ggggtggaatgaaagctccc

SEQ ID NO: 33899 - DNA, 20 bp, Artificial Sequence
  chemically synthesized
gggtggaatgaaagctccct

SEQ ID NO: 33900 - DNA, 20 bp, Artificial Sequence
  chemically synthesized
atgaaagctccctaggccat

SEQ ID NO: 33901 - DNA, 20 bp, Artificial Sequence
  chemically synthesized
tgaaagctccctaggccatg

SEQ ID NO: 33902 - DNA, 20 bp, Artificial Sequence
  chemically synthesized
atgaggacatctttgcaatg

SEQ ID NO: 33903 - DNA, 20 bp, Artificial Sequence
  chemically synthesized
gaggacatctttgcaatgtg

SEQ ID NO: 33904 - DNA, 20 bp, Artificial Sequence
  chemically synthesized
ggacatctttgcaatgtgga

SEQ ID NO: 33905 - DNA, 20 bp, Artificial Sequence
  chemically synthesized
gacatctttgcaatgtggag

SEQ ID NO: 33906 - DNA, 20 bp, Artificial Sequence
  chemically synthesized
aatgtggagaggacccaaat

SEQ ID NO: 33907 - DNA, 20 bp, Artificial Sequence
  chemically synthesized
gtggagaggacccaaatcag

SEQ ID NO: 33908 - DNA, 20 bp, Artificial Sequence
  chemically synthesized
tggagaggacccaaatcagt

SEQ ID NO: 33909 - DNA, 20 bp, Artificial Sequence
  chemically synthesized
gtgttgctctttgaatgttg

SEQ ID NO: 33910 - DNA, 20 bp, Artificial Sequence
  chemically synthesized
tgttgctctttgaatgttga

SEQ ID NO: 33911 - DNA, 20 bp, Artificial Sequence
  chemically synthesized
ttgaatgttgaaggccttgt

SEQ ID NO: 33912 - DNA, 20 bp, Artificial Sequence
  chemically synthesized
tgaaggccttgtcagcatac

SEQ ID NO: 33913 - DNA, 20 bp, Artificial Sequence
  chemically synthesized
ttgtcagcatactggtcacc

SEQ ID NO: 33914 - DNA, 20 bp, Artificial Sequence
  chemically synthesized
acttcatactgtttgtacca

SEQ ID NO: 33915 - DNA, 20 bp, Artificial Sequence
  chemically synthesized
ctgtttgtaccaaagcacca

SEQ ID NO: 33916 - DNA, 20 bp, Artificial Sequence
  chemically synthesized
cacagtttccttatgaaact

SEQ ID NO: 33917 - DNA, 20 bp, Artificial Sequence
  chemically synthesized
tccttatgaaacttagcttc

SEQ ID NO: 33918 - DNA, 20 bp, Artificial Sequence
  chemically synthesized
ccttatgaaacttagcttca

SEQ ID NO: 33919 - DNA, 20 bp, Artificial Sequence
  chemically synthesized
atgaaacttagcttcaaggc

SEQ ID NO: 33920 - DNA, 20 bp, Artificial Sequence
  chemically synthesized
gaaacttagcttcaaggctg

SEQ ID NO: 33921 - DNA, 20 bp, Artificial Sequence
  chemically synthesized
aaggctggagatgtttttga

SEQ ID NO: 33922 - DNA, 20 bp, Artificial Sequence
  chemically synthesized
attcgtcttgactataataa

SEQ ID NO: 33923 - DNA, 20 bp, Artificial Sequence
  chemically synthesized
ataatggtaacttttcttgt

SEQ ID NO: 33924 - DNA, 20 bp, Artificial Sequence
  chemically synthesized
ctgaaattctacttctgcct

SEQ ID NO: 33925 - DNA, 20 bp, Artificial Sequence
  chemically synthesized
aattctacttctgccttaga

SEQ ID NO: 33926 - DNA, 20 bp, Artificial Sequence
  chemically synthesized
ttctacttctgccttagaca

SEQ ID NO: 33927 - DNA, 20 bp, Artificial Sequence
  chemically synthesized
tctacttctgccttagacag

SEQ ID NO: 33928 - DNA, 20 bp, Artificial Sequence
  chemically synthesized
ggctcctatccttcctcctg

SEQ ID NO: 33929 - DNA, 20 bp, Artificial Sequence
  chemically synthesized
cttcctcctgaagctctgtt

SEQ ID NO: 33930 - DNA, 20 bp, Artificial Sequence
  chemically synthesized
tgaagctctgttgagcccga

SEQ ID NO: 33931 - DNA, 20 bp, Artificial Sequence
  chemically synthesized
aagctctgttgagcccgatg

SEQ ID NO: 33932 - DNA, 20 bp, Artificial Sequence
  chemically synthesized
agctctgttgagcccgatgg

SEQ ID NO: 33933 - DNA, 20 bp, Artificial Sequence
  chemically synthesized
tctgttgagcccgatggagg

SEQ ID NO: 33934 - DNA, 20 bp, Artificial Sequence
  chemically synthesized
ctgttgagcccgatggaggt

SEQ ID NO: 33935 - DNA, 20 bp, Artificial Sequence
  chemically synthesized
ttgagcccgatggaggtggg

SEQ ID NO: 33936 - DNA, 20 bp, Artificial Sequence
  chemically synthesized
tgagcccgatggaggtgggc

SEQ ID NO: 33937 - DNA, 20 bp, Artificial Sequence
  chemically synthesized
gaggtgggcaggcactgtca

SEQ ID NO: 33938 - DNA, 20 bp, Artificial Sequence
  chemically synthesized
caggcactgtcatagtccgt

SEQ ID NO: 33939 - DNA, 20 bp, Artificial Sequence
  chemically synthesized
cgtaagcttcctgctgcact

SEQ ID NO: 33940 - DNA, 20 bp, Artificial Sequence
  chemically synthesized
acttggtgatgtgattcttc

SEQ ID NO: 33941 - DNA, 20 bp, Artificial Sequence
  chemically synthesized
ggtgatgtgattcttcaagt

SEQ ID NO: 33942 - DNA, 20 bp, Artificial Sequence
  chemically synthesized
gtgatgtgattcttcaagtc

SEQ ID NO: 33943 - DNA, 20 bp, Artificial Sequence
  chemically synthesized
gattcttcaagtcaggaaat

SEQ ID NO: 33944 - DNA, 20 bp, Artificial Sequence
  chemically synthesized
ttcaagtcaggaaattggtc

SEQ ID NO: 33945 - DNA, 20 bp, Artificial Sequence
  chemically synthesized
tcaagtcaggaaattggtcc

SEQ ID NO: 33946 - DNA, 20 bp, Artificial Sequence
  chemically synthesized
agtcaggaaattggtccagg

SEQ ID NO: 33947 - DNA, 20 bp, Artificial Sequence
  chemically synthesized
aattggtccaggtagttttc

SEQ ID NO: 33948 - DNA, 20 bp, Artificial Sequence
  chemically synthesized
tccaggtagttttccagtgt

SEQ ID NO: 33949 - DNA, 20 bp, Artificial Sequence
  chemically synthesized
ggtagttttccagtgttagc

SEQ ID NO: 33950 - DNA, 20 bp, Artificial Sequence
  chemically synthesized
gtagttttccagtgttagca

SEQ ID NO: 33951 - DNA, 20 bp, Artificial Sequence
  chemically synthesized
gttagcaaggatgcatccat

SEQ ID NO: 33952 - DNA, 20 bp, Artificial Sequence
  chemically synthesized
atgcatccatgagttttttg

SEQ ID NO: 33953 - DNA, 20 bp, Artificial Sequence
  chemically synthesized
gttttttgtggatatcctcc

SEQ ID NO: 33954 - DNA, 20 bp, Artificial Sequence
  chemically synthesized
tttttgtggatatcctccca

SEQ ID NO: 33955 - DNA, 20 bp, Artificial Sequence
  chemically synthesized
cattttcacaccttcctgcc

SEQ ID NO: 33956 - DNA, 20 bp, Artificial Sequence
  chemically synthesized
ccttcctgcccagaccaatc

SEQ ID NO: 33957 - DNA, 20 bp, Artificial Sequence
  chemically synthesized
gcccagaccaatccagcgca

SEQ ID NO: 33958 - DNA, 20 bp, Artificial Sequence
  chemically synthesized
tccagcgcacagacttcaca

SEQ ID NO: 33959 - DNA, 20 bp, Artificial Sequence
  chemically synthesized
acagacttcacacagtgact

SEQ ID NO: 33960 - DNA, 20 bp, Artificial Sequence
  chemically synthesized
cacagtgactcagcttcgtc

SEQ ID NO: 33961 - DNA, 20 bp, Artificial Sequence
  chemically synthesized
acagtgactcagcttcgtca

SEQ ID NO: 33962 - DNA, 20 bp, Artificial Sequence
  chemically synthesized
tgattgcttctaaacatcct

SEQ ID NO: 33963 - DNA, 20 bp, Artificial Sequence
  chemically synthesized
attgcttctaaacatcctca

SEQ ID NO: 33964 - DNA, 20 bp, Artificial Sequence
  chemically synthesized
aaacatcctcagagttctct

SEQ ID NO: 33965 - DNA, 20 bp, Artificial Sequence
  chemically synthesized
aacatcctcagagttctctc

SEQ ID NO: 33966 - DNA, 20 bp, Artificial Sequence
  chemically synthesized
cctcagagttctctcaggtc

SEQ ID NO: 33967 - DNA, 20 bp, Artificial Sequence
  chemically synthesized
ctggtaccctctgcttcttg

SEQ ID NO: 33968 - DNA, 20 bp, Artificial Sequence
  chemically synthesized
cctctgcttcttgtggcttg

SEQ ID NO: 33969 - DNA, 20 bp, Artificial Sequence
  chemically synthesized
cttcttgtggcttgaagttc

SEQ ID NO: 33970 - DNA, 20 bp, Artificial Sequence
  chemically synthesized
aaactgtttgtcttttgtct

SEQ ID NO: 33971 - DNA, 20 bp, Artificial Sequence
  chemically synthesized
ctgtttgtcttttgtctcag

SEQ ID NO: 33972 - DNA, 20 bp, Artificial Sequence
  chemically synthesized
tttgtctcagcagctttccc

SEQ ID NO: 33973 - DNA, 20 bp, Artificial Sequence
  chemically synthesized
cagcagctttccctggcttc

SEQ ID NO: 33974 - DNA, 20 bp, Artificial Sequence
  chemically synthesized
gcagctttccctggcttctg

SEQ ID NO: 33975 - DNA, 20 bp, Artificial Sequence
  chemically synthesized
cagctttccctggcttctgg

SEQ ID NO: 33976 - DNA, 20 bp, Artificial Sequence
  chemically synthesized
tctggaggacgttttcctgt

SEQ ID NO: 33977 - DNA, 20 bp, Artificial Sequence
  chemically synthesized
ggaggacgttttcctgtgag

SEQ ID NO: 33978 - DNA, 20 bp, Artificial Sequence
  chemically synthesized
acgttttcctgtgagtggct

SEQ ID NO: 33979 - DNA, 20 bp, Artificial Sequence
  chemically synthesized
gtgagtggctgagtctcttc

SEQ ID NO: 33980 - DNA, 20 bp, Artificial Sequence
  chemically synthesized
tgagtggctgagtctcttcc

SEQ ID NO: 33981 - DNA, 20 bp, Artificial Sequence
  chemically synthesized
gagtctcttccaggcattct

SEQ ID NO: 33982 - DNA, 20 bp, Artificial Sequence
  chemically synthesized
tcttccaggcattcttggca

SEQ ID NO: 33983 - DNA, 20 bp, Artificial Sequence
  chemically synthesized
caaagatgccctcttgatgt

SEQ ID NO: 33984 - DNA, 20 bp, Artificial Sequence
  chemically synthesized
gatgccctcttgatgttggc

SEQ ID NO: 33985 - DNA, 20 bp, Artificial Sequence
  chemically synthesized
atgccctcttgatgttggcc

SEQ ID NO: 33986 - DNA, 20 bp, Artificial Sequence
  chemically synthesized
tgccctcttgatgttggcca

SEQ ID NO: 33987 - DNA, 20 bp, Artificial Sequence
  chemically synthesized
cttgatgttggccagggctg

SEQ ID NO: 33988 - DNA, 20 bp, Artificial Sequence
  chemically synthesized
ttgatgttggccagggctgc

SEQ ID NO: 33989 - DNA, 20 bp, Artificial Sequence
  chemically synthesized
gttggccagggctgcaggtc

SEQ ID NO: 33990 - DNA, 20 bp, Artificial Sequence
  chemically synthesized
ttggccagggctgcaggtcc

SEQ ID NO: 33991 - DNA, 20 bp, Artificial Sequence
  chemically synthesized
agggctgcaggtccaggacc

SEQ ID NO: 33992 - DNA, 20 bp, Artificial Sequence
  chemically synthesized
gggctgcaggtccaggacct

SEQ ID NO: 33993 - DNA, 20 bp, Artificial Sequence
  chemically synthesized
gctgcaggtccaggacctgg

SEQ ID NO: 33994 - DNA, 20 bp, Artificial Sequence
  chemically synthesized
ctgcaggtccaggacctggg

SEQ ID NO: 33995 - DNA, 20 bp, Artificial Sequence
  chemically synthesized
gcaggtccaggacctgggag

SEQ ID NO: 33996 - DNA, 20 bp, Artificial Sequence
  chemically synthesized
tccaggacctgggaggagct

SEQ ID NO: 33997 - DNA, 20 bp, Artificial Sequence
  chemically synthesized
cctgggaggagctgagcgct

SEQ ID NO: 33998 - DNA, 20 bp, Artificial Sequence
  chemically synthesized
gaggagctgagcgctcagtg

SEQ ID NO: 33999 - DNA, 20 bp, Artificial Sequence
  chemically synthesized
agctgagcgctcagtgtggc

SEQ ID NO: 34000 - DNA, 20 bp, Artificial Sequence
  chemically synthesized
tgagcgctcagtgtggctgg

SEQ ID NO: 34001 - DNA, 20 bp, Artificial Sequence
  chemically synthesized
gctcagtgtggctggtggcg

SEQ ID NO: 34002 - DNA, 20 bp, Artificial Sequence
  chemically synthesized
tcagtgtggctggtggcgtg

SEQ ID NO: 34003 - DNA, 20 bp, Artificial Sequence
  chemically synthesized
cagtgtggctggtggcgtgg

SEQ ID NO: 34004 - DNA, 20 bp, Artificial Sequence
  chemically synthesized
agtgtggctggtggcgtgga

SEQ ID NO: 34005 - DNA, 20 bp, Artificial Sequence
  chemically synthesized
gtgtggctggtggcgtggag

SEQ ID NO: 34006 - DNA, 20 bp, Artificial Sequence
  chemically synthesized
tggctggtggcgtggagggg

SEQ ID NO: 34007 - DNA, 20 bp, Artificial Sequence
  chemically synthesized
ggctggtggcgtggaggggc

SEQ ID NO: 34008 - DNA, 20 bp, Artificial Sequence
  chemically synthesized
ctggtggcgtggaggggcgg

SEQ ID NO: 34009 - DNA, 20 bp, Artificial Sequence
  chemically synthesized
tggtggcgtggaggggcggg

SEQ ID NO: 34010 - DNA, 20 bp, Artificial Sequence
  chemically synthesized
tggcgtggaggggcgggagg

SEQ ID NO: 34011 - DNA, 20 bp, Artificial Sequence
  chemically synthesized
cgtggaggggcgggaggaag

SEQ ID NO: 34012 - DNA, 20 bp, Artificial Sequence
  chemically synthesized
gtggaggggcgggaggaagt

SEQ ID NO: 34013 - DNA, 20 bp, Artificial Sequence
  chemically synthesized
tggaggggcgggaggaagtg

SEQ ID NO: 34014 - DNA, 20 bp, Artificial Sequence
  chemically synthesized
gaggggcgggaggaagtggg

SEQ ID NO: 34015 - DNA, 20 bp, Artificial Sequence
  chemically synthesized
aggggcgggaggaagtgggg

SEQ ID NO: 34016 - DNA, 20 bp, Artificial Sequence
  chemically synthesized
gaggaagtggggaggatcat

SEQ ID NO: 34017 - DNA, 20 bp, Artificial Sequence
  chemically synthesized
aggaagtggggaggatcatg

SEQ ID NO: 34018 - DNA, 20 bp, Artificial Sequence
  chemically synthesized
gaagtggggaggatcatgag

SEQ ID NO: 34019 - DNA, 20 bp, Artificial Sequence
  chemically synthesized
aagtggggaggatcatgagg

SEQ ID NO: 34020 - DNA, 20 bp, Artificial Sequence
  chemically synthesized
agtggggaggatcatgagga

SEQ ID NO: 34021 - DNA, 20 bp, Artificial Sequence
  chemically synthesized
gtggggaggatcatgaggag

SEQ ID NO: 34022 - DNA, 20 bp, Artificial Sequence
  chemically synthesized
ggaggatcatgaggaggggt

SEQ ID NO: 34023 - DNA, 20 bp, Artificial Sequence
  chemically synthesized
gaggatcatgaggaggggtg

SEQ ID NO: 34024 - DNA, 20 bp, Artificial Sequence
  chemically synthesized
cctactgttgatatgttgtt

SEQ ID NO: 34025 - DNA, 20 bp, Artificial Sequence
  chemically synthesized
ctactgttgatatgttgttc

SEQ ID NO: 34026 - DNA, 20 bp, Artificial Sequence
  chemically synthesized
tactgttgatatgttgttca

SEQ ID NO: 34027 - DNA, 20 bp, Artificial Sequence
  chemically synthesized
atatgttgttcagggaccat

SEQ ID NO: 34028 - DNA, 20 bp, Artificial Sequence
  chemically synthesized
tatgttgttcagggaccatc

SEQ ID NO: 34029 - DNA, 20 bp, Artificial Sequence
  chemically synthesized
tgttgttcagggaccatcgg

SEQ ID NO: 34030 - DNA, 20 bp, Artificial Sequence
  chemically synthesized
ttcagggaccatcgggagcc

SEQ ID NO: 34031 - DNA, 20 bp, Artificial Sequence
  chemically synthesized
cagggaccatcgggagccca

SEQ ID NO: 34032 - DNA, 20 bp, Artificial Sequence
  chemically synthesized
cagagctctgctctgtttca

SEQ ID NO: 34033 - DNA, 20 bp, Artificial Sequence
  chemically synthesized
agagctctgctctgtttcac

SEQ ID NO: 34034 - DNA, 20 bp, Artificial Sequence
  chemically synthesized
ctgtttcacgggactccaca

SEQ ID NO: 34035 - DNA, 20 bp, Artificial Sequence
  chemically synthesized
gtttcacgggactccacaaa

SEQ ID NO: 34036 - DNA, 20 bp, Artificial Sequence
  chemically synthesized
gactccacaaagagaactgc

SEQ ID NO: 34037 - DNA, 20 bp, Artificial Sequence
  chemically synthesized
acaaagagaactgcaagtcc

SEQ ID NO: 34038 - DNA, 20 bp, Artificial Sequence
  chemically synthesized
tcccagtctttcacctctct

SEQ ID NO: 34039 - DNA, 20 bp, Artificial Sequence
  chemically synthesized
gtctcttcatcacatctctt

SEQ ID NO: 34040 - DNA, 20 bp, Artificial Sequence
  chemically synthesized
tcatcacatctcttcagtat

SEQ ID NO: 34041 - DNA, 20 bp, Artificial Sequence
  chemically synthesized
catcacatctcttcagtata

SEQ ID NO: 34042 - DNA, 20 bp, Artificial Sequence
  chemically synthesized
cacatctcttcagtataagg

SEQ ID NO: 34043 - DNA, 20 bp, Artificial Sequence
  chemically synthesized
ctcttcagtataaggaagaa

SEQ ID NO: 34044 - DNA, 20 bp, Artificial Sequence
  chemically synthesized
tcagtataaggaagaacaga

SEQ ID NO: 34045 - DNA, 20 bp, Artificial Sequence
  chemically synthesized
cagtataaggaagaacagaa

SEQ ID NO: 34046 - DNA, 20 bp, Artificial Sequence
  chemically synthesized
agtataaggaagaacagaaa

SEQ ID NO: 34047 - DNA, 20 bp, Artificial Sequence
  chemically synthesized
tataaggaagaacagaaagg

SEQ ID NO: 34048 - DNA, 20 bp, Artificial Sequence
  chemically synthesized
ataaggaagaacagaaaggg

SEQ ID NO: 34049 - DNA, 20 bp, Artificial Sequence
  chemically synthesized
aaggaagaacagaaagggag

SEQ ID NO: 34050 - DNA, 20 bp, Artificial Sequence
  chemically synthesized
ggaagaacagaaagggagga

SEQ ID NO: 34051 - DNA, 20 bp, Artificial Sequence
  chemically synthesized
agaaagggaggagagaaact

SEQ ID NO: 34052 - DNA, 20 bp, Artificial Sequence
  chemically synthesized
gaaagggaggagagaaactc

SEQ ID NO: 34053 - DNA, 20 bp, Artificial Sequence
  chemically synthesized
aaagggaggagagaaactca

SEQ ID NO: 34054 - DNA, 20 bp, Artificial Sequence
  chemically synthesized
ggagagaaactcagggttgt

SEQ ID NO: 34055 - DNA, 20 bp, Artificial Sequence
  chemically synthesized
cagtcaaatgtgtccattta

SEQ ID NO: 34056 - DNA, 20 bp, Artificial Sequence
  chemically synthesized
tataaaatgtattgttatcc

SEQ ID NO: 34057 - DNA, 20 bp, Artificial Sequence
  chemically synthesized
tatcctagttatctttatac

SEQ ID NO: 34058 - DNA, 20 bp, Artificial Sequence
  chemically synthesized
atctttatactagcctgcta

SEQ ID NO: 34059 - DNA, 20 bp, Artificial Sequence
  chemically synthesized
tttatactagcctgctatgg

SEQ ID NO: 34060 - DNA, 20 bp, Artificial Sequence
  chemically synthesized
ttatactagcctgctatggc

SEQ ID NO: 34061 - DNA, 20 bp, Artificial Sequence
  chemically synthesized
tagcctgctatggcaggttt

SEQ ID NO: 34062 - DNA, 20 bp, Artificial Sequence
  chemically synthesized
agcctgctatggcaggtttc

SEQ ID NO: 34063 - DNA, 20 bp, Artificial Sequence
  chemically synthesized
atggcaggtttcaggatcac

SEQ ID NO: 34064 - DNA, 20 bp, Artificial Sequence
  chemically synthesized
ggtttcaggatcactggacc

SEQ ID NO: 34065 - DNA, 20 bp, Artificial Sequence
  chemically synthesized
tttcaggatcactggaccta

SEQ ID NO: 34066 - DNA, 20 bp, Artificial Sequence
  chemically synthesized
ttcaggatcactggacctag

SEQ ID NO: 34067 - DNA, 20 bp, Artificial Sequence
  chemically synthesized
tcaggatcactggacctaga

SEQ ID NO: 34068 - DNA, 20 bp, Artificial Sequence
  chemically synthesized
gatcactggacctagagggt

SEQ ID NO: 34069 - DNA, 20 bp, Artificial Sequence
  chemically synthesized
ctggacctagagggtgagtc

SEQ ID NO: 34070 - DNA, 20 bp, Artificial Sequence
  chemically synthesized
acctagagggtgagtcaaga

SEQ ID NO: 34071 - DNA, 20 bp, Artificial Sequence
  chemically synthesized
aagaaagattttctttgatg

SEQ ID NO: 34072 - DNA, 20 bp, Artificial Sequence
  chemically synthesized
agattttctttgatgtggct

SEQ ID NO: 34073 - DNA, 20 bp, Artificial Sequence
  chemically synthesized
ccccctgaattcattcccaa

SEQ ID NO: 34074 - DNA, 20 bp, Artificial Sequence
  chemically synthesized
gaattcattcccaaaagccc

SEQ ID NO: 34075 - DNA, 20 bp, Artificial Sequence
  chemically synthesized
aattcattcccaaaagccca

SEQ ID NO: 34076 - DNA, 20 bp, Artificial Sequence
  chemically synthesized
attcattcccaaaagcccaa

SEQ ID NO: 34077 - DNA, 20 bp, Artificial Sequence
  chemically synthesized
cattcccaaaagcccaaggg

SEQ ID NO: 34078 - DNA, 20 bp, Artificial Sequence
  chemically synthesized
cccaaaagcccaagggaaga

SEQ ID NO: 34079 - DNA, 20 bp, Artificial Sequence
  chemically synthesized
aagcccaagggaagaaagaa

SEQ ID NO: 34080 - DNA, 20 bp, Artificial Sequence
  chemically synthesized
agcccaagggaagaaagaac

SEQ ID NO: 34081 - DNA, 20 bp, Artificial Sequence
  chemically synthesized
agggaagaaagaacaggatt

SEQ ID NO: 34082 - DNA, 20 bp, Artificial Sequence
  chemically synthesized
agtatacattgcccatatct

SEQ ID NO: 34083 - DNA, 20 bp, Artificial Sequence
  chemically synthesized
atacattgcccatatcttgg

SEQ ID NO: 34084 - DNA, 20 bp, Artificial Sequence
  chemically synthesized
ccatatcttggaagacaata

SEQ ID NO: 34085 - DNA, 20 bp, Artificial Sequence
  chemically synthesized
atatcttggaagacaataca

SEQ ID NO: 34086 - DNA, 20 bp, Artificial Sequence
  chemically synthesized
atcttggaagacaatacaga

SEQ ID NO: 34087 - DNA, 20 bp, Artificial Sequence
  chemically synthesized
ttggaagacaatacagagag

SEQ ID NO: 34088 - DNA, 20 bp, Artificial Sequence
  chemically synthesized
gacaatacagagagcagtaa

SEQ ID NO: 34089 - DNA, 20 bp, Artificial Sequence
  chemically synthesized
atacagagagcagtaacaga

SEQ ID NO: 34090 - DNA, 20 bp, Artificial Sequence
  chemically synthesized
cagagagcagtaacagacag

SEQ ID NO: 34091 - DNA, 20 bp, Artificial Sequence
  chemically synthesized
gcagtaacagacagaagaac

SEQ ID NO: 34092 - DNA, 20 bp, Artificial Sequence
  chemically synthesized
gtaacagacagaagaactag

SEQ ID NO: 34093 - DNA, 20 bp, Artificial Sequence
  chemically synthesized
cagaagaactagcagacaca

SEQ ID NO: 34094 - DNA, 20 bp, Artificial Sequence
  chemically synthesized
agaactagcagacacacaga

SEQ ID NO: 34095 - DNA, 20 bp, Artificial Sequence
  chemically synthesized
agcagacacacagaaagaca

SEQ ID NO: 34096 - DNA, 20 bp, Artificial Sequence
  chemically synthesized
gcagacacacagaaagacat

SEQ ID NO: 34097 - DNA, 20 bp, Artificial Sequence
  chemically synthesized
aaattatattttgttaaaaa

SEQ ID NO: 34098 - DNA, 20 bp, Artificial Sequence
  chemically synthesized
ttgttaaaaatggtctatgt

SEQ ID NO: 34099 - DNA, 20 bp, Artificial Sequence
  chemically synthesized
ttaaaaatggtctatgtgag

SEQ ID NO: 34100 - DNA, 20 bp, Artificial Sequence
  chemically synthesized
atgtgagaagttctgtaata

SEQ ID NO: 34101 - DNA, 20 bp, Artificial Sequence
  chemically synthesized
tgagaagttctgtaatacag

SEQ ID NO: 34102 - DNA, 20 bp, Artificial Sequence
  chemically synthesized
gagaagttctgtaatacagt

SEQ ID NO: 34103 - DNA, 20 bp, Artificial Sequence
  chemically synthesized
agaagttctgtaatacagta

SEQ ID NO: 34104 - DNA, 20 bp, Artificial Sequence
  chemically synthesized
tctgtaatacagtagggaat

SEQ ID NO: 34105 - DNA, 20 bp, Artificial Sequence
  chemically synthesized
atgttatatttaccatcctc

SEQ ID NO: 34106 - DNA, 20 bp, Artificial Sequence
  chemically synthesized
atttaccatcctcgagcaca

SEQ ID NO: 34107 - DNA, 20 bp, Artificial Sequence
  chemically synthesized
ccatcctcgagcacacagtc

SEQ ID NO: 34108 - DNA, 20 bp, Artificial Sequence
  chemically synthesized
tcctcgagcacacagtcaag

SEQ ID NO: 34109 - DNA, 20 bp, Artificial Sequence
  chemically synthesized
acacagtcaagaagctacaa

SEQ ID NO: 34110 - DNA, 20 bp, Artificial Sequence
  chemically synthesized
acagtcaagaagctacaaaa

SEQ ID NO: 34111 - DNA, 20 bp, Artificial Sequence
  chemically synthesized
tcaagaagctacaaaagaga

SEQ ID NO: 34112 - DNA, 20 bp, Artificial Sequence
  chemically synthesized
caagaagctacaaaagagaa

SEQ ID NO: 34113 - DNA, 20 bp, Artificial Sequence
  chemically synthesized
agaaaggcaaatttcacaca

SEQ ID NO: 34114 - DNA, 20 bp, Artificial Sequence
  chemically synthesized
ggcaaatttcacacacagcc

SEQ ID NO: 34115 - DNA, 20 bp, Artificial Sequence
  chemically synthesized
atttcacacacagccaagtt

SEQ ID NO: 34116 - DNA, 20 bp, Artificial Sequence
  chemically synthesized
gtaaaacaaacaaaatcttt

SEQ ID NO: 34117 - DNA, 20 bp, Artificial Sequence
  chemically synthesized
acaaaatcttttggtctaat

SEQ ID NO: 34118 - DNA, 20 bp, Artificial Sequence
  chemically synthesized
tcttttggtctaatcagata

SEQ ID NO: 34119 - DNA, 20 bp, Artificial Sequence
  chemically synthesized
atcagataaagatcatttac

SEQ ID NO: 34120 - DNA, 20 bp, Artificial Sequence
  chemically synthesized
ataaagatcatttactagcc

SEQ ID NO: 34121 - DNA, 20 bp, Artificial Sequence
  chemically synthesized
ctagcctggaaactattgtg

SEQ ID NO: 34122 - DNA, 20 bp, Artificial Sequence
  chemically synthesized
tagcctggaaactattgtga

SEQ ID NO: 34123 - DNA, 20 bp, Artificial Sequence
  chemically synthesized
ctgtgttatttatacatccc

SEQ ID NO: 34124 - DNA, 20 bp, Artificial Sequence
  chemically synthesized
atccccacctttctgtgatg

SEQ ID NO: 34125 - DNA, 20 bp, Artificial Sequence
  chemically synthesized
ccccacctttctgtgatgaa

SEQ ID NO: 34126 - DNA, 20 bp, Artificial Sequence
  chemically synthesized
cacctttctgtgatgaagag

SEQ ID NO: 34127 - DNA, 20 bp, Artificial Sequence
  chemically synthesized
acctttctgtgatgaagagt

SEQ ID NO: 34128 - DNA, 20 bp, Artificial Sequence
  chemically synthesized
tttctgtgatgaagagtagg

SEQ ID NO: 34129 - DNA, 20 bp, Artificial Sequence
  chemically synthesized
ttctgtgatgaagagtaggt

SEQ ID NO: 34130 - DNA, 20 bp, Artificial Sequence
  chemically synthesized
tgtgatgaagagtaggtggg

SEQ ID NO: 34131 - DNA, 20 bp, Artificial Sequence
  chemically synthesized
gaagagtaggtgggcagcca

SEQ ID NO: 34132 - DNA, 20 bp, Artificial Sequence
  chemically synthesized
gtgggcagccatagatcact

SEQ ID NO: 34133 - DNA, 20 bp, Artificial Sequence
  chemically synthesized
agccatagatcactgagtgt

SEQ ID NO: 34134 - DNA, 20 bp, Artificial Sequence
  chemically synthesized
atcactgagtgtcagtatga

SEQ ID NO: 34135 - DNA, 20 bp, Artificial Sequence
  chemically synthesized
cactgagtgtcagtatgaca

SEQ ID NO: 34136 - DNA, 20 bp, Artificial Sequence
  chemically synthesized
actgagtgtcagtatgacag

SEQ ID NO: 34137 - DNA, 20 bp, Artificial Sequence
  chemically synthesized
agtgtcagtatgacagaggc

SEQ ID NO: 34138 - DNA, 20 bp, Artificial Sequence
  chemically synthesized
tgtcagtatgacagaggcca

SEQ ID NO: 34139 - DNA, 20 bp, Artificial Sequence
  chemically synthesized
gtatgacagaggccagagat

SEQ ID NO: 34140 - DNA, 20 bp, Artificial Sequence
  chemically synthesized
tatgacagaggccagagatg

SEQ ID NO: 34141 - DNA, 20 bp, Artificial Sequence
  chemically synthesized
atgacagaggccagagatga

SEQ ID NO: 34142 - DNA, 20 bp, Artificial Sequence
  chemically synthesized
tgacagaggccagagatgag

SEQ ID NO: 34143 - DNA, 20 bp, Artificial Sequence
  chemically synthesized
ggccagagatgaggggcatc

SEQ ID NO: 34144 - DNA, 20 bp, Artificial Sequence
  chemically synthesized
atgaggggcatccagctgac

SEQ ID NO: 34145 - DNA, 20 bp, Artificial Sequence
  chemically synthesized
gcatccagctgactggtcac

SEQ ID NO: 34146 - DNA, 20 bp, Artificial Sequence
  chemically synthesized
catccagctgactggtcact

SEQ ID NO: 34147 - DNA, 20 bp, Artificial Sequence
  chemically synthesized
ccagctgactggtcactggg

SEQ ID NO: 34148 - DNA, 20 bp, Artificial Sequence
  chemically synthesized
tcactgggtggccccttgtg

SEQ ID NO: 34149 - DNA, 20 bp, Artificial Sequence
  chemically synthesized
ggtggccccttgtgtagtcc

SEQ ID NO: 34150 - DNA, 20 bp, Artificial Sequence
  chemically synthesized
gcacatcataccctgtattt

SEQ ID NO: 34151 - DNA, 20 bp, Artificial Sequence
  chemically synthesized
ataccctgtattttggtcaa

SEQ ID NO: 34152 - DNA, 20 bp, Artificial Sequence
  chemically synthesized
taatttaaaacttatcattt

SEQ ID NO: 34153 - DNA, 20 bp, Artificial Sequence
  chemically synthesized
aaaacttatcatttgagtca

SEQ ID NO: 34154 - DNA, 20 bp, Artificial Sequence
  chemically synthesized
atcatttgagtcatggatac

SEQ ID NO: 34155 - DNA, 20 bp, Artificial Sequence
  chemically synthesized
atggatactggctcttcacc

SEQ ID NO: 34156 - DNA, 20 bp, Artificial Sequence
  chemically synthesized
actggctcttcacctggcca

SEQ ID NO: 34157 - DNA, 20 bp, Artificial Sequence
  chemically synthesized
ctggctcttcacctggccat

SEQ ID NO: 34158 - DNA, 20 bp, Artificial Sequence
  chemically synthesized
aaaccccctcttctcatgcc

SEQ ID NO: 34159 - DNA, 20 bp, Artificial Sequence
  chemically synthesized
tctcatgcctagactctgaa

SEQ ID NO: 34160 - DNA, 20 bp, Artificial Sequence
  chemically synthesized
tagactctgaaaagaatcaa

SEQ ID NO: 34161 - DNA, 20 bp, Artificial Sequence
  chemically synthesized
tgaaaagaatcaaaagtatt

SEQ ID NO: 34162 - DNA, 20 bp, Artificial Sequence
  chemically synthesized
aaaagaatcaaaagtatttg

SEQ ID NO: 34163 - DNA, 20 bp, Artificial Sequence
  chemically synthesized
gaatcaaaagtatttggagc

SEQ ID NO: 34164 - DNA, 20 bp, Artificial Sequence
  chemically synthesized
aaaagtatttggagccagaa

SEQ ID NO: 34165 - DNA, 20 bp, Artificial Sequence
  chemically synthesized
aaagtatttggagccagaaa

SEQ ID NO: 34166 - DNA, 20 bp, Artificial Sequence
  chemically synthesized
gaaaaggccattttatcttc

SEQ ID NO: 34167 - DNA, 20 bp, Artificial Sequence
  chemically synthesized
ccattttatcttctagttat

SEQ ID NO: 34168 - DNA, 20 bp, Artificial Sequence
  chemically synthesized
ctctgctattttgcacatgc

SEQ ID NO: 34169 - DNA, 20 bp, Artificial Sequence
  chemically synthesized
acatgccagacacccctatc

SEQ ID NO: 34170 - DNA, 20 bp, Artificial Sequence
  chemically synthesized
tctctgatgttcccctaaac

SEQ ID NO: 34171 - DNA, 20 bp, Artificial Sequence
  chemically synthesized
tgaaaatgcatctctctgtt

SEQ ID NO: 34172 - DNA, 20 bp, Artificial Sequence
  chemically synthesized
aaatgcatctctctgttcag

SEQ ID NO: 34173 - DNA, 20 bp, Artificial Sequence
  chemically synthesized
tctctctgttcagtagtaac

SEQ ID NO: 34174 - DNA, 20 bp, Artificial Sequence
  chemically synthesized
agtaactggaattaactatc

SEQ ID NO: 34175 - DNA, 20 bp, Artificial Sequence
  chemically synthesized
ggaattaactatcaagacaa

SEQ ID NO: 34176 - DNA, 20 bp, Artificial Sequence
  chemically synthesized
aagacaatggtcatctgaat

SEQ ID NO: 34177 - DNA, 20 bp, Artificial Sequence
  chemically synthesized
tatttgataaatgttaacca

SEQ ID NO: 34178 - DNA, 20 bp, Artificial Sequence
  chemically synthesized
ttaactgaacacatttctca

SEQ ID NO: 34179 - DNA, 20 bp, Artificial Sequence
  chemically synthesized
aactgaacacatttctcata

SEQ ID NO: 34180 - DNA, 20 bp, Artificial Sequence
  chemically synthesized
tctcatagagatactttccc

SEQ ID NO: 34181 - DNA, 20 bp, Artificial Sequence
  chemically synthesized
tagactcatcattttgaatt

SEQ ID NO: 34182 - DNA, 20 bp, Artificial Sequence
  chemically synthesized
agactcatcattttgaattg

SEQ ID NO: 34183 - DNA, 20 bp, Artificial Sequence
  chemically synthesized
gactcatcattttgaattga

SEQ ID NO: 34184 - DNA, 20 bp, Artificial Sequence
  chemically synthesized
tcattttgaattgagggaaa

SEQ ID NO: 34185 - DNA, 20 bp, Artificial Sequence
  chemically synthesized
gaaatggtttaccctcattg

SEQ ID NO: 34186 - DNA, 20 bp, Artificial Sequence
  chemically synthesized
tggtttaccctcattgaaga

SEQ ID NO: 34187 - DNA, 20 bp, Artificial Sequence
  chemically synthesized
cctcattgaagaaagtaatt

SEQ ID NO: 34188 - DNA, 20 bp, Artificial Sequence
  chemically synthesized
ctcattgaagaaagtaattg

SEQ ID NO: 34189 - DNA, 20 bp, Artificial Sequence
  chemically synthesized
tcattgaagaaagtaattga

SEQ ID NO: 34190 - DNA, 20 bp, Artificial Sequence
  chemically synthesized
aagaaagtaattgagggaaa

SEQ ID NO: 34191 - DNA, 20 bp, Artificial Sequence
  chemically synthesized
gaaatggcttactctcattg

SEQ ID NO: 34192 - DNA, 20 bp, Artificial Sequence
  chemically synthesized
tggcttactctcattgaaga

SEQ ID NO: 34193 - DNA, 20 bp, Artificial Sequence
  chemically synthesized
tttcttcacgtgcaattttc

SEQ ID NO: 34194 - DNA, 20 bp, Artificial Sequence
  chemically synthesized
cacgtgcaattttctagaaa

SEQ ID NO: 34195 - DNA, 20 bp, Artificial Sequence
  chemically synthesized
gtgcaattttctagaaacag

SEQ ID NO: 34196 - DNA, 20 bp, Artificial Sequence
  chemically synthesized
aattttctagaaacagcagc

SEQ ID NO: 34197 - DNA, 20 bp, Artificial Sequence
  chemically synthesized
gcagccagctccatatatgc

SEQ ID NO: 34198 - DNA, 20 bp, Artificial Sequence
  chemically synthesized
agccagctccatatatgcaa

SEQ ID NO: 34199 - DNA, 20 bp, Artificial Sequence
  chemically synthesized
ctccatatatgcaagagaac

SEQ ID NO: 34200 - DNA, 20 bp, Artificial Sequence
  chemically synthesized
gagaactggatgtatgtctg

SEQ ID NO: 34201 - DNA, 20 bp, Artificial Sequence
  chemically synthesized
tgccttattcctatgtataa

SEQ ID NO: 34202 - DNA, 20 bp, Artificial Sequence
  chemically synthesized
gccttattcctatgtataac

SEQ ID NO: 34203 - DNA, 20 bp, Artificial Sequence
  chemically synthesized
ataacaggactaatatatgc

SEQ ID NO: 34204 - DNA, 20 bp, Artificial Sequence
  chemically synthesized
actaatatatgcaagccata

SEQ ID NO: 34205 - DNA, 20 bp, Artificial Sequence
  chemically synthesized
taatatatgcaagccatatg

SEQ ID NO: 34206 - DNA, 20 bp, Artificial Sequence
  chemically synthesized
atatatgcaagccatatgga

SEQ ID NO: 34207 - DNA, 20 bp, Artificial Sequence
  chemically synthesized
gcaagccatatggagagcaa

SEQ ID NO: 34208 - DNA, 20 bp, Artificial Sequence
  chemically synthesized
caagccatatggagagcaat

SEQ ID NO: 34209 - DNA, 20 bp, Artificial Sequence
  chemically synthesized
atgggcattgactgaaatgc

SEQ ID NO: 34210 - DNA, 20 bp, Artificial Sequence
  chemically synthesized
aatgccggtgacccaaatca

SEQ ID NO: 34211 - DNA, 20 bp, Artificial Sequence
  chemically synthesized
gtgacccaaatcatagaccc

SEQ ID NO: 34212 - DNA, 20 bp, Artificial Sequence
  chemically synthesized
ccaagaattatatatataat

SEQ ID NO: 34213 - DNA, 20 bp, Artificial Sequence
  chemically synthesized
ataatatatataaacacaca

SEQ ID NO: 34214 - DNA, 20 bp, Artificial Sequence
  chemically synthesized
tacacacactattatatatt

SEQ ID NO: 34215 - DNA, 20 bp, Artificial Sequence
  chemically synthesized
tatatattaagtatatataa

SEQ ID NO: 34216 - DNA, 20 bp, Artificial Sequence
  chemically synthesized
tatatattaaatatatataa

SEQ ID NO: 34217 - DNA, 20 bp, Artificial Sequence
  chemically synthesized
taaatatatataatagtgta

SEQ ID NO: 34218 - DNA, 20 bp, Artificial Sequence
  chemically synthesized
aaatatatataatagtgtat

SEQ ID NO: 34219 - DNA, 20 bp, Artificial Sequence
  chemically synthesized
gtgtgtatatgtatgtgtgt

SEQ ID NO: 34220 - DNA, 20 bp, Artificial Sequence
  chemically synthesized
taagtatgtatgtatgtgta

SEQ ID NO: 34221 - DNA, 20 bp, Artificial Sequence
  chemically synthesized
tgtatgtatgtgtatggtgc

SEQ ID NO: 34222 - DNA, 20 bp, Artificial Sequence
  chemically synthesized
atgtgtatggtgccagccat

SEQ ID NO: 34223 - DNA, 20 bp, Artificial Sequence
  chemically synthesized
ataagctaatcaaacaatgt

SEQ ID NO: 34224 - DNA, 20 bp, Artificial Sequence
  chemically synthesized
caatgtgagttaaattacct

SEQ ID NO: 34225 - DNA, 20 bp, Artificial Sequence
  chemically synthesized
attacctgagaaaacaatat

SEQ ID NO: 34226 - DNA, 20 bp, Artificial Sequence
  chemically synthesized
ctgagaaaacaatatcagtt

SEQ ID NO: 34227 - DNA, 20 bp, Artificial Sequence
  chemically synthesized
aacaatatcagttgagcact

SEQ ID NO: 34228 - DNA, 20 bp, Artificial Sequence
  chemically synthesized
tgagcactgagatatgtact

SEQ ID NO: 34229 - DNA, 20 bp, Artificial Sequence
  chemically synthesized
tacatatatcttatacaaat

SEQ ID NO: 34230 - DNA, 20 bp, Artificial Sequence
  chemically synthesized
tatcttatacaaatcagcaa

SEQ ID NO: 34231 - DNA, 20 bp, Artificial Sequence
  chemically synthesized
ttatacaaatcagcaataga

SEQ ID NO: 34232 - DNA, 20 bp, Artificial Sequence
  chemically synthesized
tatacaaatcagcaatagac

SEQ ID NO: 34233 - DNA, 20 bp, Artificial Sequence
  chemically synthesized
acaaatcagcaatagacagg

SEQ ID NO: 34234 - DNA, 20 bp, Artificial Sequence
  chemically synthesized
caaatcagcaatagacaggc

SEQ ID NO: 34235 - DNA, 20 bp, Artificial Sequence
  chemically synthesized
aaatcagcaatagacaggca

SEQ ID NO: 34236 - DNA, 20 bp, Artificial Sequence
  chemically synthesized
gcagggtaaaataatgttct

SEQ ID NO: 34237 - DNA, 20 bp, Artificial Sequence
  chemically synthesized
gggtaaaataatgttctaag

SEQ ID NO: 34238 - DNA, 20 bp, Artificial Sequence
  chemically synthesized
taaaataatgttctaagtag

SEQ ID NO: 34239 - DNA, 20 bp, Artificial Sequence
  chemically synthesized
aaataatgttctaagtagca

SEQ ID NO: 34240 - DNA, 20 bp, Artificial Sequence
  chemically synthesized
aataatgttctaagtagcag

SEQ ID NO: 34241 - DNA, 20 bp, Artificial Sequence
  chemically synthesized
ataatgttctaagtagcaga

SEQ ID NO: 34242 - DNA, 20 bp, Artificial Sequence
  chemically synthesized
ctgatttccactgaaatgct

SEQ ID NO: 34243 - DNA, 20 bp, Artificial Sequence
  chemically synthesized
tgatttccactgaaatgctc

SEQ ID NO: 34244 - DNA, 20 bp, Artificial Sequence
  chemically synthesized
gatttccactgaaatgctca

SEQ ID NO: 34245 - DNA, 20 bp, Artificial Sequence
  chemically synthesized
tgaaatgctcagggattgat

SEQ ID NO: 34246 - DNA, 20 bp, Artificial Sequence
  chemically synthesized
ctcattgaaatgactttccc

SEQ ID NO: 34247 - DNA, 20 bp, Artificial Sequence
  chemically synthesized
ctttccctagttacttatgc

SEQ ID NO: 34248 - DNA, 20 bp, Artificial Sequence
  chemically synthesized
ggcaacattgtcatcctgtc

SEQ ID NO: 34249 - DNA, 20 bp, Artificial Sequence
  chemically synthesized
gcaacattgtcatcctgtcc

SEQ ID NO: 34250 - DNA, 20 bp, Artificial Sequence
  chemically synthesized
aggtcccctgaattattcct

SEQ ID NO: 34251 - DNA, 20 bp, Artificial Sequence
  chemically synthesized
gtcccctgaattattcctca

SEQ ID NO: 34252 - DNA, 20 bp, Artificial Sequence
  chemically synthesized
ctgaattattcctcagagac

SEQ ID NO: 34253 - DNA, 20 bp, Artificial Sequence
  chemically synthesized
agtgaaacaatgtcatgctc

SEQ ID NO: 34254 - DNA, 20 bp, Artificial Sequence
  chemically synthesized
tgaaacaatgtcatgctcta

SEQ ID NO: 34255 - DNA, 20 bp, Artificial Sequence
  chemically synthesized
acaatgtcatgctctagagt

SEQ ID NO: 34256 - DNA, 20 bp, Artificial Sequence
  chemically synthesized
caatgtcatgctctagagtg

SEQ ID NO: 34257 - DNA, 20 bp, Artificial Sequence
  chemically synthesized
tgtcatgctctagagtgagg

SEQ ID NO: 34258 - DNA, 20 bp, Artificial Sequence
  chemically synthesized
tcatgctctagagtgaggca

SEQ ID NO: 34259 - DNA, 20 bp, Artificial Sequence
  chemically synthesized
atgctctagagtgaggcaga

SEQ ID NO: 34260 - DNA, 20 bp, Artificial Sequence
  chemically synthesized
tgaggcagagagaataaacg

SEQ ID NO: 34261 - DNA, 20 bp, Artificial Sequence
  chemically synthesized
tatgccactctgaatctgct

SEQ ID NO: 34262 - DNA, 20 bp, Artificial Sequence
  chemically synthesized
tctgcttagttttaatgcta

SEQ ID NO: 34263 - DNA, 20 bp, Artificial Sequence
  chemically synthesized
gttttaatgctatagataaa

SEQ ID NO: 34264 - DNA, 20 bp, Artificial Sequence
  chemically synthesized
ttttaatgctatagataaat

SEQ ID NO: 34265 - DNA, 20 bp, Artificial Sequence
  chemically synthesized
atagataaatgggttcataa

SEQ ID NO: 34266 - DNA, 20 bp, Artificial Sequence
  chemically synthesized
tagataaatgggttcataaa

SEQ ID NO: 34267 - DNA, 20 bp, Artificial Sequence
  chemically synthesized
ataaatgggttcataaaagg

SEQ ID NO: 34268 - DNA, 20 bp, Artificial Sequence
  chemically synthesized
taaatgggttcataaaaggt

SEQ ID NO: 34269 - DNA, 20 bp, Artificial Sequence
  chemically synthesized
gggttcataaaaggtgggaa

SEQ ID NO: 34270 - DNA, 20 bp, Artificial Sequence
  chemically synthesized
ggttcataaaaggtgggaaa

SEQ ID NO: 34271 - DNA, 20 bp, Artificial Sequence
  chemically synthesized
tcataaaaggtgggaaaagg

SEQ ID NO: 34272 - DNA, 20 bp, Artificial Sequence
  chemically synthesized
taaaaggtgggaaaaggaag

SEQ ID NO: 34273 - DNA, 20 bp, Artificial Sequence
  chemically synthesized
gtgggaaaaggaagtggatg

SEQ ID NO: 34274 - DNA, 20 bp, Artificial Sequence
  chemically synthesized
cattgtgatgtgaacgacat

SEQ ID NO: 34275 - DNA, 20 bp, Artificial Sequence
  chemically synthesized
attgtgatgtgaacgacatg

SEQ ID NO: 34276 - DNA, 20 bp, Artificial Sequence
  chemically synthesized
ccaaacctatgaataaatgt

SEQ ID NO: 34277 - DNA, 20 bp, Artificial Sequence
  chemically synthesized
aataaatgtcagacaaacta

SEQ ID NO: 34278 - DNA, 20 bp, Artificial Sequence
  chemically synthesized
tcagacaaactacagtgaca

SEQ ID NO: 34279 - DNA, 20 bp, Artificial Sequence
  chemically synthesized
gacaaactacagtgacatag

SEQ ID NO: 34280 - DNA, 20 bp, Artificial Sequence
  chemically synthesized
actacagtgacatagaagac

SEQ ID NO: 34281 - DNA, 20 bp, Artificial Sequence
  chemically synthesized
ctacagtgacatagaagacc

SEQ ID NO: 34282 - DNA, 20 bp, Artificial Sequence
  chemically synthesized
tgacatagaagaccaggatg

SEQ ID NO: 34283 - DNA, 20 bp, Artificial Sequence
  chemically synthesized
catagaagaccaggatgcag

SEQ ID NO: 34284 - DNA, 20 bp, Artificial Sequence
  chemically synthesized
gaccaggatgcagcagatat

SEQ ID NO: 34285 - DNA, 20 bp, Artificial Sequence
  chemically synthesized
ccaggatgcagcagatatga

SEQ ID NO: 34286 - DNA, 20 bp, Artificial Sequence
  chemically synthesized
atatgagagacacatgtgtt

SEQ ID NO: 34287 - DNA, 20 bp, Artificial Sequence
  chemically synthesized
tatgagagacacatgtgttg

SEQ ID NO: 34288 - DNA, 20 bp, Artificial Sequence
  chemically synthesized
atgagagacacatgtgttga

SEQ ID NO: 34289 - DNA, 20 bp, Artificial Sequence
  chemically synthesized
gacacatgtgttgagggcct

SEQ ID NO: 34290 - DNA, 20 bp, Artificial Sequence
  chemically synthesized
ggccttggccctttctcctc

SEQ ID NO: 34291 - DNA, 20 bp, Artificial Sequence
  chemically synthesized
tccagaaccaatgcccatga

SEQ ID NO: 34292 - DNA, 20 bp, Artificial Sequence
  chemically synthesized
ccaatgcccatgacagtctt

SEQ ID NO: 34293 - DNA, 20 bp, Artificial Sequence
  chemically synthesized
cagtcttgagaatcaaaatg

SEQ ID NO: 34294 - DNA, 20 bp, Artificial Sequence
  chemically synthesized
agtcttgagaatcaaaatgt

SEQ ID NO: 34295 - DNA, 20 bp, Artificial Sequence
  chemically synthesized
tcttgagaatcaaaatgtag

SEQ ID NO: 34296 - DNA, 20 bp, Artificial Sequence
  chemically synthesized
gaatcaaaatgtaggagaaa

SEQ ID NO: 34297 - DNA, 20 bp, Artificial Sequence
  chemically synthesized
atgtaggagaaaaagatgat

SEQ ID NO: 34298 - DNA, 20 bp, Artificial Sequence
  chemically synthesized
aggagaaaaagatgatgaga

SEQ ID NO: 34299 - DNA, 20 bp, Artificial Sequence
  chemically synthesized
agatgatgagaaagtccaac

SEQ ID NO: 34300 - DNA, 20 bp, Artificial Sequence
  chemically synthesized
attgcaaataaaactacaac

SEQ ID NO: 34301 - DNA, 20 bp, Artificial Sequence
  chemically synthesized
caaataaaactacaactgga

SEQ ID NO: 34302 - DNA, 20 bp, Artificial Sequence
  chemically synthesized
aataaaactacaactggata

SEQ ID NO: 34303 - DNA, 20 bp, Artificial Sequence
  chemically synthesized
aaactacaactggatagaga

SEQ ID NO: 34304 - DNA, 20 bp, Artificial Sequence
  chemically synthesized
caactggatagagacggttg

SEQ ID NO: 34305 - DNA, 20 bp, Artificial Sequence
  chemically synthesized
aactggatagagacggttga

SEQ ID NO: 34306 - DNA, 20 bp, Artificial Sequence
  chemically synthesized
gagacggttgaaggtgatgt

SEQ ID NO: 34307 - DNA, 20 bp, Artificial Sequence
  chemically synthesized
ggttgaaggtgatgtcagca

SEQ ID NO: 34308 - DNA, 20 bp, Artificial Sequence
  chemically synthesized
gttgaaggtgatgtcagcac

SEQ ID NO: 34309 - DNA, 20 bp, Artificial Sequence
  chemically synthesized
aaggtgatgtcagcacaggc

SEQ ID NO: 34310 - DNA, 20 bp, Artificial Sequence
  chemically synthesized
aggctagcttgatgacatct

SEQ ID NO: 34311 - DNA, 20 bp, Artificial Sequence
  chemically synthesized
agcttgatgacatcttggtg

SEQ ID NO: 34312 - DNA, 20 bp, Artificial Sequence
  chemically synthesized
tgatgacatcttggtgtaga

SEQ ID NO: 34313 - DNA, 20 bp, Artificial Sequence
  chemically synthesized
gacatcttggtgtagacaga

SEQ ID NO: 34314 - DNA, 20 bp, Artificial Sequence
  chemically synthesized
cttggtgtagacagaaagca

SEQ ID NO: 34315 - DNA, 20 bp, Artificial Sequence
  chemically synthesized
ttggtgtagacagaaagcat

SEQ ID NO: 34316 - DNA, 20 bp, Artificial Sequence
  chemically synthesized
ggtgtagacagaaagcatgg

SEQ ID NO: 34317 - DNA, 20 bp, Artificial Sequence
  chemically synthesized
tgtagacagaaagcatggga

SEQ ID NO: 34318 - DNA, 20 bp, Artificial Sequence
  chemically synthesized
agaaagcatgggagagtaca

SEQ ID NO: 34319 - DNA, 20 bp, Artificial Sequence
  chemically synthesized
gaaagcatgggagagtacat

SEQ ID NO: 34320 - DNA, 20 bp, Artificial Sequence
  chemically synthesized
gggagagtacatgggatcga

SEQ ID NO: 34321 - DNA, 20 bp, Artificial Sequence
  chemically synthesized
agagtacatgggatcgacag

SEQ ID NO: 34322 - DNA, 20 bp, Artificial Sequence
  chemically synthesized
gagtacatgggatcgacagt

SEQ ID NO: 34323 - DNA, 20 bp, Artificial Sequence
  chemically synthesized
agtacatgggatcgacagta

SEQ ID NO: 34324 - DNA, 20 bp, Artificial Sequence
  chemically synthesized
gggatcgacagtagggaaac

SEQ ID NO: 34325 - DNA, 20 bp, Artificial Sequence
  chemically synthesized
cgacagtagggaaaccagtg

SEQ ID NO: 34326 - DNA, 20 bp, Artificial Sequence
  chemically synthesized
gacagtagggaaaccagtgt

SEQ ID NO: 34327 - DNA, 20 bp, Artificial Sequence
  chemically synthesized
cagtgtaggcgaacaactat

SEQ ID NO: 34328 - DNA, 20 bp, Artificial Sequence
  chemically synthesized
gcgaacaactattggcataa

SEQ ID NO: 34329 - DNA, 20 bp, Artificial Sequence
  chemically synthesized
acaactattggcataatgga

SEQ ID NO: 34330 - DNA, 20 bp, Artificial Sequence
  chemically synthesized
tattggcataatggacagac

SEQ ID NO: 34331 - DNA, 20 bp, Artificial Sequence
  chemically synthesized
gcacaccaatcttcattacc

SEQ ID NO: 34332 - DNA, 20 bp, Artificial Sequence
  chemically synthesized
cacaccaatcttcattacct

SEQ ID NO: 34333 - DNA, 20 bp, Artificial Sequence
  chemically synthesized
aatcttcattacctgggtgt

SEQ ID NO: 34334 - DNA, 20 bp, Artificial Sequence
  chemically synthesized
ttcattacctgggtgttggt

SEQ ID NO: 34335 - DNA, 20 bp, Artificial Sequence
  chemically synthesized
tcattacctgggtgttggtc

SEQ ID NO: 34336 - DNA, 20 bp, Artificial Sequence
  chemically synthesized
tacctgggtgttggtcagga

SEQ ID NO: 34337 - DNA, 20 bp, Artificial Sequence
  chemically synthesized
cctgggtgttggtcaggata

SEQ ID NO: 34338 - DNA, 20 bp, Artificial Sequence
  chemically synthesized
ctgggtgttggtcaggatag

SEQ ID NO: 34339 - DNA, 20 bp, Artificial Sequence
  chemically synthesized
tcaggatagaggtatatctt

SEQ ID NO: 34340 - DNA, 20 bp, Artificial Sequence
  chemically synthesized
caggatagaggtatatctta

SEQ ID NO: 34341 - DNA, 20 bp, Artificial Sequence
  chemically synthesized
aggatagaggtatatcttaa

SEQ ID NO: 34342 - DNA, 20 bp, Artificial Sequence
  chemically synthesized
ggatagaggtatatcttaag

SEQ ID NO: 34343 - DNA, 20 bp, Artificial Sequence
  chemically synthesized
aggtatatcttaaggggctg

SEQ ID NO: 34344 - DNA, 20 bp, Artificial Sequence
  chemically synthesized
atatcttaaggggctgcgga

SEQ ID NO: 34345 - DNA, 20 bp, Artificial Sequence
  chemically synthesized
ggctgcggatggtaatgaaa

SEQ ID NO: 34346 - DNA, 20 bp, Artificial Sequence
  chemically synthesized
gatggtaatgaaacagtcat

SEQ ID NO: 34347 - DNA, 20 bp, Artificial Sequence
  chemically synthesized
aatgaaacagtcataagcca

SEQ ID NO: 34348 - DNA, 20 bp, Artificial Sequence
  chemically synthesized
aaacagtcataagccatggc

SEQ ID NO: 34349 - DNA, 20 bp, Artificial Sequence
  chemically synthesized
agtcataagccatggcaagc

SEQ ID NO: 34350 - DNA, 20 bp, Artificial Sequence
  chemically synthesized
caagacacctgactccatga

SEQ ID NO: 34351 - DNA, 20 bp, Artificial Sequence
  chemically synthesized
acacctgactccatgacaga

SEQ ID NO: 34352 - DNA, 20 bp, Artificial Sequence
  chemically synthesized
acctgactccatgacagaaa

SEQ ID NO: 34353 - DNA, 20 bp, Artificial Sequence
  chemically synthesized
actccatgacagaaagagta

SEQ ID NO: 34354 - DNA, 20 bp, Artificial Sequence
  chemically synthesized
cagaaagagtatggataaaa

SEQ ID NO: 34355 - DNA, 20 bp, Artificial Sequence
  chemically synthesized
agaaagagtatggataaaat

SEQ ID NO: 34356 - DNA, 20 bp, Artificial Sequence
  chemically synthesized
agtatggataaaataggcct

SEQ ID NO: 34357 - DNA, 20 bp, Artificial Sequence
  chemically synthesized
tatggataaaataggcctga

SEQ ID NO: 34358 - DNA, 20 bp, Artificial Sequence
  chemically synthesized
ggataaaataggcctgagag

SEQ ID NO: 34359 - DNA, 20 bp, Artificial Sequence
  chemically synthesized
taaaataggcctgagagaag

SEQ ID NO: 34360 - DNA, 20 bp, Artificial Sequence
  chemically synthesized
aaaataggcctgagagaagc

SEQ ID NO: 34361 - DNA, 20 bp, Artificial Sequence
  chemically synthesized
cctgagagaagcaggctcca

SEQ ID NO: 34362 - DNA, 20 bp, Artificial Sequence
  chemically synthesized
atctccctgtgatctaacca

SEQ ID NO: 34363 - DNA, 20 bp, Artificial Sequence
  chemically synthesized
tgatctaaccacagaacacc

SEQ ID NO: 34364 - DNA, 20 bp, Artificial Sequence
  chemically synthesized
ccacagaacacctagcactg

SEQ ID NO: 34365 - DNA, 20 bp, Artificial Sequence
  chemically synthesized
cacagaacacctagcactgt

SEQ ID NO: 34366 - DNA, 20 bp, Artificial Sequence
  chemically synthesized
acctagcactgtgggcattg

SEQ ID NO: 34367 - DNA, 20 bp, Artificial Sequence
  chemically synthesized
attgtggtcaatgtcactcc

SEQ ID NO: 34368 - DNA, 20 bp, Artificial Sequence
  chemically synthesized
ttgtggtcaatgtcactccg

SEQ ID NO: 34369 - DNA, 20 bp, Artificial Sequence
  chemically synthesized
caatgtcactccgaggtctg

SEQ ID NO: 34370 - DNA, 20 bp, Artificial Sequence
  chemically synthesized
gaggtctgtagctgccaaca

SEQ ID NO: 34371 - DNA, 20 bp, Artificial Sequence
  chemically synthesized
ctgtagctgccaacatagct

SEQ ID NO: 34372 - DNA, 20 bp, Artificial Sequence
  chemically synthesized
ctgccaacatagctaagaaa

SEQ ID NO: 34373 - DNA, 20 bp, Artificial Sequence
  chemically synthesized
catagctaagaaatagtaca

SEQ ID NO: 34374 - DNA, 20 bp, Artificial Sequence
  chemically synthesized
atagctaagaaatagtacat

SEQ ID NO: 34375 - DNA, 20 bp, Artificial Sequence
  chemically synthesized
agaaatagtacatgggctca

SEQ ID NO: 34376 - DNA, 20 bp, Artificial Sequence
  chemically synthesized
aaatagtacatgggctcatg

SEQ ID NO: 34377 - DNA, 20 bp, Artificial Sequence
  chemically synthesized
aatagtacatgggctcatgg

SEQ ID NO: 34378 - DNA, 20 bp, Artificial Sequence
  chemically synthesized
aggttatgatcattcctgat

SEQ ID NO: 34379 - DNA, 20 bp, Artificial Sequence
  chemically synthesized
tatgatcattcctgatgaga

SEQ ID NO: 34380 - DNA, 20 bp, Artificial Sequence
  chemically synthesized
tgatcattcctgatgagaaa

SEQ ID NO: 34381 - DNA, 20 bp, Artificial Sequence
  chemically synthesized
tcattcctgatgagaaagag

SEQ ID NO: 34382 - DNA, 20 bp, Artificial Sequence
  chemically synthesized
attcctgatgagaaagagaa

SEQ ID NO: 34383 - DNA, 20 bp, Artificial Sequence
  chemically synthesized
aagagaagagtgccattgcc

SEQ ID NO: 34384 - DNA, 20 bp, Artificial Sequence
  chemically synthesized
agaagagtgccattgccaag

SEQ ID NO: 34385 - DNA, 20 bp, Artificial Sequence
  chemically synthesized
agtgccattgccaagaagta

SEQ ID NO: 34386 - DNA, 20 bp, Artificial Sequence
  chemically synthesized
tgccattgccaagaagtatg

SEQ ID NO: 34387 - DNA, 20 bp, Artificial Sequence
  chemically synthesized
tgccaagaagtatggagatg

SEQ ID NO: 34388 - DNA, 20 bp, Artificial Sequence
  chemically synthesized
gccaagaagtatggagatgt

SEQ ID NO: 34389 - DNA, 20 bp, Artificial Sequence
  chemically synthesized
gagatgtaggctgccaataa

SEQ ID NO: 34390 - DNA, 20 bp, Artificial Sequence
  chemically synthesized
agatgtaggctgccaataat

SEQ ID NO: 34391 - DNA, 20 bp, Artificial Sequence
  chemically synthesized
ccaataatgggatgaatatc

SEQ ID NO: 34392 - DNA, 20 bp, Artificial Sequence
  chemically synthesized
tgatgtgccttctccatgcc

SEQ ID NO: 34393 - DNA, 20 bp, Artificial Sequence
  chemically synthesized
gatgtgccttctccatgcct

SEQ ID NO: 34394 - DNA, 20 bp, Artificial Sequence
  chemically synthesized
gtgccttctccatgcctggg

SEQ ID NO: 34395 - DNA, 20 bp, Artificial Sequence
  chemically synthesized
cttctccatgcctgggaagc

SEQ ID NO: 34396 - DNA, 20 bp, Artificial Sequence
  chemically synthesized
tccatgcctgggaagccagt

SEQ ID NO: 34397 - DNA, 20 bp, Artificial Sequence
  chemically synthesized
tgcctgggaagccagtaagc

SEQ ID NO: 34398 - DNA, 20 bp, Artificial Sequence
  chemically synthesized
ctgggaagccagtaagctgg

SEQ ID NO: 34399 - DNA, 20 bp, Artificial Sequence
  chemically synthesized
tgggaagccagtaagctgga

SEQ ID NO: 34400 - DNA, 20 bp, Artificial Sequence
  chemically synthesized
gaagccagtaagctggaagg

SEQ ID NO: 34401 - DNA, 20 bp, Artificial Sequence
  chemically synthesized
gccagtaagctggaaggtgg

SEQ ID NO: 34402 - DNA, 20 bp, Artificial Sequence
  chemically synthesized
agtaagctggaaggtggaag

SEQ ID NO: 34403 - DNA, 20 bp, Artificial Sequence
  chemically synthesized
aaggtggaagcagacttatt

SEQ ID NO: 34404 - DNA, 20 bp, Artificial Sequence
  chemically synthesized
gacttattgagccccattgc

SEQ ID NO: 34405 - DNA, 20 bp, Artificial Sequence
  chemically synthesized
gccccattgccagctttgca

SEQ ID NO: 34406 - DNA, 20 bp, Artificial Sequence
  chemically synthesized
cccattgccagctttgcaaa

SEQ ID NO: 34407 - DNA, 20 bp, Artificial Sequence
  chemically synthesized
ccattgccagctttgcaaag

SEQ ID NO: 34408 - DNA, 20 bp, Artificial Sequence
  chemically synthesized
aaagaggcaaatatttactc

SEQ ID NO: 34409 - DNA, 20 bp, Artificial Sequence
  chemically synthesized
aagaggcaaatatttactcc

SEQ ID NO: 34410 - DNA, 20 bp, Artificial Sequence
  chemically synthesized
gcaaatatttactccaggta

SEQ ID NO: 34411 - DNA, 20 bp, Artificial Sequence
  chemically synthesized
atttactccaggtaaagcaa

SEQ ID NO: 34412 - DNA, 20 bp, Artificial Sequence
  chemically synthesized
ccaggtaaagcaatagtaat

SEQ ID NO: 34413 - DNA, 20 bp, Artificial Sequence
  chemically synthesized
aatagtaatcagttgtataa

SEQ ID NO: 34414 - DNA, 20 bp, Artificial Sequence
  chemically synthesized
ttgtataaaagttgctcctt

SEQ ID NO: 34415 - DNA, 20 bp, Artificial Sequence
  chemically synthesized
tgagaattctacctgttcat

SEQ ID NO: 34416 - DNA, 20 bp, Artificial Sequence
  chemically synthesized
cctgttcataagatgttcac

SEQ ID NO: 34417 - DNA, 20 bp, Artificial Sequence
  chemically synthesized
tgttcaccagtcctgacttt

SEQ ID NO: 34418 - DNA, 20 bp, Artificial Sequence
  chemically synthesized
ccagtcctgactttcagtga

SEQ ID NO: 34419 - DNA, 20 bp, Artificial Sequence
  chemically synthesized
tcctgactttcagtgacagc

SEQ ID NO: 34420 - DNA, 20 bp, Artificial Sequence
  chemically synthesized
cctgactttcagtgacagca

SEQ ID NO: 34421 - DNA, 20 bp, Artificial Sequence
  chemically synthesized
tgacagcaaggatgataatt

SEQ ID NO: 34422 - DNA, 20 bp, Artificial Sequence
  chemically synthesized
gatgataatttagtcattcc

SEQ ID NO: 34423 - DNA, 20 bp, Artificial Sequence
  chemically synthesized
atgataatttagtcattcct

SEQ ID NO: 34424 - DNA, 20 bp, Artificial Sequence
  chemically synthesized
gataatttagtcattcctgg

SEQ ID NO: 34425 - DNA, 20 bp, Artificial Sequence
  chemically synthesized
tagtcattcctgggagatcc

SEQ ID NO: 34426 - DNA, 20 bp, Artificial Sequence
  chemically synthesized
agtcattcctgggagatcct

SEQ ID NO: 34427 - DNA, 20 bp, Artificial Sequence
  chemically synthesized
ttcctgggagatcctaggta

SEQ ID NO: 34428 - DNA, 20 bp, Artificial Sequence
  chemically synthesized
tcctgggagatcctaggtat

SEQ ID NO: 34429 - DNA, 20 bp, Artificial Sequence
  chemically synthesized
agatcctaggtatgggaaaa

SEQ ID NO: 34430 - DNA, 20 bp, Artificial Sequence
  chemically synthesized
atgggaaaatagaatgtata

SEQ ID NO: 34431 - DNA, 20 bp, Artificial Sequence
  chemically synthesized
ggaaaatagaatgtataaag

SEQ ID NO: 34432 - DNA, 20 bp, Artificial Sequence
  chemically synthesized
tgtataaagaagatattatt

SEQ ID NO: 34433 - DNA, 20 bp, Artificial Sequence
  chemically synthesized
gtataaagaagatattattt

SEQ ID NO: 34434 - DNA, 20 bp, Artificial Sequence
  chemically synthesized
tataaagaagatattattta

SEQ ID NO: 34435 - DNA, 20 bp, Artificial Sequence
  chemically synthesized
atttagggtttactctatgt

SEQ ID NO: 34436 - DNA, 20 bp, Artificial Sequence
  chemically synthesized
tttactctatgtaagattat

SEQ ID NO: 34437 - DNA, 20 bp, Artificial Sequence
  chemically synthesized
aagattattggatactacgt

SEQ ID NO: 34438 - DNA, 20 bp, Artificial Sequence
  chemically synthesized
agattattggatactacgtt

SEQ ID NO: 34439 - DNA, 20 bp, Artificial Sequence
  chemically synthesized
gattattggatactacgttg

SEQ ID NO: 34440 - DNA, 20 bp, Artificial Sequence
  chemically synthesized
tggatactacgttggggata

SEQ ID NO: 34441 - DNA, 20 bp, Artificial Sequence
  chemically synthesized
tggggatacagctattcatg

SEQ ID NO: 34442 - DNA, 20 bp, Artificial Sequence
  chemically synthesized
tcattgtaaatcatataacc

SEQ ID NO: 34443 - DNA, 20 bp, Artificial Sequence
  chemically synthesized
agaaaataaaaacaaaatga

SEQ ID NO: 34444 - DNA, 20 bp, Artificial Sequence
  chemically synthesized
aaataaaaacaaaatgaaag

SEQ ID NO: 34445 - DNA, 20 bp, Artificial Sequence
  chemically synthesized
aagaaatcactatatttgaa

SEQ ID NO: 34446 - DNA, 20 bp, Artificial Sequence
  chemically synthesized
atatttgaatagtgctgtaa

SEQ ID NO: 34447 - DNA, 20 bp, Artificial Sequence
  chemically synthesized
ctgtaatggcctgaaactta

SEQ ID NO: 34448 - DNA, 20 bp, Artificial Sequence
  chemically synthesized
tgtaatggcctgaaacttat

SEQ ID NO: 34449 - DNA, 20 bp, Artificial Sequence
  chemically synthesized
aacttataggtcacttttca

SEQ ID NO: 34450 - DNA, 20 bp, Artificial Sequence
  chemically synthesized
atggtgctcttcatcctgac

SEQ ID NO: 34451 - DNA, 20 bp, Artificial Sequence
  chemically synthesized
gtgctcttcatcctgactgg

SEQ ID NO: 34452 - DNA, 20 bp, Artificial Sequence
  chemically synthesized
catcctgactggtggtatta

SEQ ID NO: 34453 - DNA, 20 bp, Artificial Sequence
  chemically synthesized
atcctgactggtggtattat

SEQ ID NO: 34454 - DNA, 20 bp, Artificial Sequence
  chemically synthesized
tcctgactggtggtattata

SEQ ID NO: 34455 - DNA, 20 bp, Artificial Sequence
  chemically synthesized
tgactggtggtattataggg

SEQ ID NO: 34456 - DNA, 20 bp, Artificial Sequence
  chemically synthesized
ggtattatagggtggatgta

SEQ ID NO: 34457 - DNA, 20 bp, Artificial Sequence
  chemically synthesized
gtattatagggtggatgtaa

SEQ ID NO: 34458 - DNA, 20 bp, Artificial Sequence
  chemically synthesized
gggtggatgtaaaggtttcc

SEQ ID NO: 34459 - DNA, 20 bp, Artificial Sequence
  chemically synthesized
ggtggatgtaaaggtttccc

SEQ ID NO: 34460 - DNA, 20 bp, Artificial Sequence
  chemically synthesized
aaaggtttcccaggctatgt

SEQ ID NO: 34461 - DNA, 20 bp, Artificial Sequence
  chemically synthesized
ccaggctatgtgagacctaa

SEQ ID NO: 34462 - DNA, 20 bp, Artificial Sequence
  chemically synthesized
ctatgtgagacctaaaagat

SEQ ID NO: 34463 - DNA, 20 bp, Artificial Sequence
  chemically synthesized
tgtgagacctaaaagatcag

SEQ ID NO: 34464 - DNA, 20 bp, Artificial Sequence
  chemically synthesized
ctaaaagatcagtagaaaaa

SEQ ID NO: 34465 - DNA, 20 bp, Artificial Sequence
  chemically synthesized
atcagtagaaaaatggttct

SEQ ID NO: 34466 - DNA, 20 bp, Artificial Sequence
  chemically synthesized
aaaatggttctaagcactat

SEQ ID NO: 34467 - DNA, 20 bp, Artificial Sequence
  chemically synthesized
ggttctaagcactattggaa

SEQ ID NO: 34468 - DNA, 20 bp, Artificial Sequence
  chemically synthesized
tctaagcactattggaaaag

SEQ ID NO: 34469 - DNA, 20 bp, Artificial Sequence
  chemically synthesized
ctattggaaaagcagatata

SEQ ID NO: 34470 - DNA, 20 bp, Artificial Sequence
  chemically synthesized
aagcagatataaagattata

SEQ ID NO: 34471 - DNA, 20 bp, Artificial Sequence
  chemically synthesized
atatggaaaaacaaatacac

SEQ ID NO: 34472 - DNA, 20 bp, Artificial Sequence
  chemically synthesized
ggaaaaacaaatacacaagt

SEQ ID NO: 34473 - DNA, 20 bp, Artificial Sequence
  chemically synthesized
tacacaagtaagaaatatat

SEQ ID NO: 34474 - DNA, 20 bp, Artificial Sequence
  chemically synthesized
tatgagcaaatacaataaaa

SEQ ID NO: 34475 - DNA, 20 bp, Artificial Sequence
  chemically synthesized
tacaataaaatagtaaattt

SEQ ID NO: 34476 - DNA, 20 bp, Artificial Sequence
  chemically synthesized
caataaaatagtaaatttca

SEQ ID NO: 34477 - DNA, 20 bp, Artificial Sequence
  chemically synthesized
tgacttttcttcaatattcc

SEQ ID NO: 34478 - DNA, 20 bp, Artificial Sequence
  chemically synthesized
acttttcttcaatattcctg

SEQ ID NO: 34479 - DNA, 20 bp, Artificial Sequence
  chemically synthesized
cttttcttcaatattcctgg

SEQ ID NO: 34480 - DNA, 20 bp, Artificial Sequence
  chemically synthesized
ttttcttcaatattcctgga

SEQ ID NO: 34481 - DNA, 20 bp, Artificial Sequence
  chemically synthesized
gagggaaaattcaattgatg

SEQ ID NO: 34482 - DNA, 20 bp, Artificial Sequence
  chemically synthesized
aaattcaattgatgaagctc

SEQ ID NO: 34483 - DNA, 20 bp, Artificial Sequence
  chemically synthesized
attcaattgatgaagctcca

SEQ ID NO: 34484 - DNA, 20 bp, Artificial Sequence
  chemically synthesized
gatgaagctccagagacttt

SEQ ID NO: 34485 - DNA, 20 bp, Artificial Sequence
  chemically synthesized
atgaagctccagagactttt

SEQ ID NO: 34486 - DNA, 20 bp, Artificial Sequence
  chemically synthesized
aagctccagagacttttggg

SEQ ID NO: 34487 - DNA, 20 bp, Artificial Sequence
  chemically synthesized
tccagagacttttgggtagt

SEQ ID NO: 34488 - DNA, 20 bp, Artificial Sequence
  chemically synthesized
gggtagttagaaaatgacgt

SEQ ID NO: 34489 - DNA, 20 bp, Artificial Sequence
  chemically synthesized
gtagttagaaaatgacgtaa

SEQ ID NO: 34490 - DNA, 20 bp, Artificial Sequence
  chemically synthesized
cttacctgtgtgtgtttcca

SEQ ID NO: 34491 - DNA, 20 bp, Artificial Sequence
  chemically synthesized
gtgtgtgtttccaaagcaca

SEQ ID NO: 34492 - DNA, 20 bp, Artificial Sequence
  chemically synthesized
tccaaagcacatagaactct

SEQ ID NO: 34493 - DNA, 20 bp, Artificial Sequence
  chemically synthesized
acatagaactctaagttgcc

SEQ ID NO: 34494 - DNA, 20 bp, Artificial Sequence
  chemically synthesized
gttgcccagctttataaccc

SEQ ID NO: 34495 - DNA, 20 bp, Artificial Sequence
  chemically synthesized
gttattgatacactgcttca

SEQ ID NO: 34496 - DNA, 20 bp, Artificial Sequence
  chemically synthesized
aattttcataatataaattg

SEQ ID NO: 34497 - DNA, 20 bp, Artificial Sequence
  chemically synthesized
aatataaattgaagaataaa

SEQ ID NO: 34498 - DNA, 20 bp, Artificial Sequence
  chemically synthesized
gaagaataaacagtaaaatg

SEQ ID NO: 34499 - DNA, 20 bp, Artificial Sequence
  chemically synthesized
taaaatgtggatttgatgat

SEQ ID NO: 34500 - DNA, 20 bp, Artificial Sequence
  chemically synthesized
gatttgatgataagcttttg

SEQ ID NO: 34501 - DNA, 20 bp, Artificial Sequence
  chemically synthesized
atttgatgataagcttttga

SEQ ID NO: 34502 - DNA, 20 bp, Artificial Sequence
  chemically synthesized
ttgaaggcactaattgataa

SEQ ID NO: 34503 - DNA, 20 bp, Artificial Sequence
  chemically synthesized
actgttgcatatcacctact

SEQ ID NO: 34504 - DNA, 20 bp, Artificial Sequence
  chemically synthesized
ggtgatgcaaaaataaaaat

SEQ ID NO: 34505 - DNA, 20 bp, Artificial Sequence
  chemically synthesized
aaaaataaaaattggtaatt

SEQ ID NO: 34506 - DNA, 20 bp, Artificial Sequence
  chemically synthesized
aaaataaaaattggtaattt

SEQ ID NO: 34507 - DNA, 20 bp, Artificial Sequence
  chemically synthesized
taaaaattggtaatttaggc

SEQ ID NO: 34508 - DNA, 20 bp, Artificial Sequence
  chemically synthesized
ttggtaatttaggcaagatc

SEQ ID NO: 34509 - DNA, 20 bp, Artificial Sequence
  chemically synthesized
tggtaatttaggcaagatca

SEQ ID NO: 34510 - DNA, 20 bp, Artificial Sequence
  chemically synthesized
gtaatttaggcaagatcaag

SEQ ID NO: 34511 - DNA, 20 bp, Artificial Sequence
  chemically synthesized
gaattttttttttaaaacta

SEQ ID NO: 34512 - DNA, 20 bp, Artificial Sequence
  chemically synthesized
tttaaaactatggaatctga

SEQ ID NO: 34513 - DNA, 20 bp, Artificial Sequence
  chemically synthesized
ttaaaactatggaatctgat

SEQ ID NO: 34514 - DNA, 20 bp, Artificial Sequence
  chemically synthesized
aatctgatgggatttgacaa

SEQ ID NO: 34515 - DNA, 20 bp, Artificial Sequence
  chemically synthesized
tgatgggatttgacaaaagt

SEQ ID NO: 34516 - DNA, 20 bp, Artificial Sequence
  chemically synthesized
tgggatttgacaaaagtgag

SEQ ID NO: 34517 - DNA, 20 bp, Artificial Sequence
  chemically synthesized
gggatttgacaaaagtgaga

SEQ ID NO: 34518 - DNA, 20 bp, Artificial Sequence
  chemically synthesized
gagaaggctctgtgactcat

SEQ ID NO: 34519 - DNA, 20 bp, Artificial Sequence
  chemically synthesized
ctgtgactcattagaattct

SEQ ID NO: 34520 - DNA, 20 bp, Artificial Sequence
  chemically synthesized
tcattagaattctaagattt

SEQ ID NO: 34521 - DNA, 20 bp, Artificial Sequence
  chemically synthesized
tagaattctaagatttcagc

SEQ ID NO: 34522 - DNA, 20 bp, Artificial Sequence
  chemically synthesized
ttctaagatttcagctggtg

SEQ ID NO: 34523 - DNA, 20 bp, Artificial Sequence
  chemically synthesized
tctaagatttcagctggtgc

SEQ ID NO: 34524 - DNA, 20 bp, Artificial Sequence
  chemically synthesized
aagatttcagctggtgcagg

SEQ ID NO: 34525 - DNA, 20 bp, Artificial Sequence
  chemically synthesized
ggtgcaggcagccaacctct

SEQ ID NO: 34526 - DNA, 20 bp, Artificial Sequence
  chemically synthesized
agaatacataaattgtgtgt

SEQ ID NO: 34527 - DNA, 20 bp, Artificial Sequence
  chemically synthesized
atacataaattgtgtgttgg

SEQ ID NO: 34528 - DNA, 20 bp, Artificial Sequence
  chemically synthesized
aaattgtgtgttggtggcat

SEQ ID NO: 34529 - DNA, 20 bp, Artificial Sequence
  chemically synthesized
tgtgtgttggtggcatgagc

SEQ ID NO: 34530 - DNA, 20 bp, Artificial Sequence
  chemically synthesized
tgtgttggtggcatgagcca

SEQ ID NO: 34531 - DNA, 20 bp, Artificial Sequence
  chemically synthesized
gtggcatgagccagagaaaa

SEQ ID NO: 34532 - DNA, 20 bp, Artificial Sequence
  chemically synthesized
tggcatgagccagagaaaat

SEQ ID NO: 34533 - DNA, 20 bp, Artificial Sequence
  chemically synthesized
aataggcccaccttctctta

SEQ ID NO: 34534 - DNA, 20 bp, Artificial Sequence
  chemically synthesized
ggcccaccttctcttatggt

SEQ ID NO: 34535 - DNA, 20 bp, Artificial Sequence
  chemically synthesized
accttctcttatggttggtt

SEQ ID NO: 34536 - DNA, 20 bp, Artificial Sequence
  chemically synthesized
tacatctcatatactattga

SEQ ID NO: 34537 - DNA, 20 bp, Artificial Sequence
  chemically synthesized
catctcatatactattgaaa

SEQ ID NO: 34538 - DNA, 20 bp, Artificial Sequence
  chemically synthesized
taaatttatgcacgatttac

SEQ ID NO: 34539 - DNA, 20 bp, Artificial Sequence
  chemically synthesized
gacctctttctgtccatgaa

SEQ ID NO: 34540 - DNA, 20 bp, Artificial Sequence
  chemically synthesized
tccatgaaaagaatgcatcc

SEQ ID NO: 34541 - DNA, 20 bp, Artificial Sequence
  chemically synthesized
aagaatgcatccaagattac

SEQ ID NO: 34542 - DNA, 20 bp, Artificial Sequence
  chemically synthesized
gattactggactttcatttt

SEQ ID NO: 34543 - DNA, 20 bp, Artificial Sequence
  chemically synthesized
tactggactttcattttcag

SEQ ID NO: 34544 - DNA, 20 bp, Artificial Sequence
  chemically synthesized
attttcagaagaatttgttg

SEQ ID NO: 34545 - DNA, 20 bp, Artificial Sequence
  chemically synthesized
agaagaatttgttgaagttt

SEQ ID NO: 34546 - DNA, 20 bp, Artificial Sequence
  chemically synthesized
ctttctaacaataatgatct

SEQ ID NO: 34547 - DNA, 20 bp, Artificial Sequence
  chemically synthesized
tttctaacaataatgatctt

SEQ ID NO: 34548 - DNA, 20 bp, Artificial Sequence
  chemically synthesized
taacaataatgatcttggga

SEQ ID NO: 34549 - DNA, 20 bp, Artificial Sequence
  chemically synthesized
tgggaaagtaatttaatctt

SEQ ID NO: 34550 - DNA, 20 bp, Artificial Sequence
  chemically synthesized
agtaatttaatcttgagatt

SEQ ID NO: 34551 - DNA, 20 bp, Artificial Sequence
  chemically synthesized
atttggttacataacctgta

SEQ ID NO: 34552 - DNA, 20 bp, Artificial Sequence
  chemically synthesized
acataacctgtaaagactac

SEQ ID NO: 34553 - DNA, 20 bp, Artificial Sequence
  chemically synthesized
actagtgatttctgtcttct

SEQ ID NO: 34554 - DNA, 20 bp, Artificial Sequence
  chemically synthesized
tcagtcattctcttgacaca

SEQ ID NO: 34555 - DNA, 20 bp, Artificial Sequence
  chemically synthesized
tcattctcttgacacaaagt

SEQ ID NO: 34556 - DNA, 20 bp, Artificial Sequence
  chemically synthesized
cattctcttgacacaaagta

SEQ ID NO: 34557 - DNA, 20 bp, Artificial Sequence
  chemically synthesized
attctcttgacacaaagtaa

SEQ ID NO: 34558 - DNA, 20 bp, Artificial Sequence
  chemically synthesized
ttctcttgacacaaagtaag

SEQ ID NO: 34559 - DNA, 20 bp, Artificial Sequence
  chemically synthesized
gtaaggggaaatgttttgta

SEQ ID NO: 34560 - DNA, 20 bp, Artificial Sequence
  chemically synthesized
aaggggaaatgttttgtaaa

SEQ ID NO: 34561 - DNA, 20 bp, Artificial Sequence
  chemically synthesized
gggaaatgttttgtaaagag

SEQ ID NO: 34562 - DNA, 20 bp, Artificial Sequence
  chemically synthesized
ttgtgtttttgttattgttt

SEQ ID NO: 34563 - DNA, 20 bp, Artificial Sequence
  chemically synthesized
gtgtttttgttattgtttca

SEQ ID NO: 34564 - DNA, 20 bp, Artificial Sequence
  chemically synthesized
tttttgttattgtttcagag

SEQ ID NO: 34565 - DNA, 20 bp, Artificial Sequence
  chemically synthesized
gtacctcctttctctttctc

SEQ ID NO: 34566 - DNA, 20 bp, Artificial Sequence
  chemically synthesized
ctcctttctctttctctagt

SEQ ID NO: 34567 - DNA, 20 bp, Artificial Sequence
  chemically synthesized
tttctctagtgagtacatgt

SEQ ID NO: 34568 - DNA, 20 bp, Artificial Sequence
  chemically synthesized
ttctctagtgagtacatgtc

SEQ ID NO: 34569 - DNA, 20 bp, Artificial Sequence
  chemically synthesized
acatgtcaggattattcacc

SEQ ID NO: 34570 - DNA, 20 bp, Artificial Sequence
  chemically synthesized
atgtcaggattattcaccca

SEQ ID NO: 34571 - DNA, 20 bp, Artificial Sequence
  chemically synthesized
tgtcaggattattcacccag

SEQ ID NO: 34572 - DNA, 20 bp, Artificial Sequence
  chemically synthesized
aatgatttcctttttttctg

SEQ ID NO: 34573 - DNA, 20 bp, Artificial Sequence
  chemically synthesized
gatttcctttttttctgtgg

SEQ ID NO: 34574 - DNA, 20 bp, Artificial Sequence
  chemically synthesized
ctttttttctgtggaagcct

SEQ ID NO: 34575 - DNA, 20 bp, Artificial Sequence
  chemically synthesized
tttttttctgtggaagcctt

SEQ ID NO: 34576 - DNA, 20 bp, Artificial Sequence
  chemically synthesized
ttctgtggaagccttgggaa

SEQ ID NO: 34577 - DNA, 20 bp, Artificial Sequence
  chemically synthesized
gaagccttgggaacagatat

SEQ ID NO: 34578 - DNA, 20 bp, Artificial Sequence
  chemically synthesized
gaacagatataagatgatga

SEQ ID NO: 34579 - DNA, 20 bp, Artificial Sequence
  chemically synthesized
aacagatataagatgatgat

SEQ ID NO: 34580 - DNA, 20 bp, Artificial Sequence
  chemically synthesized
acagatataagatgatgatg

SEQ ID NO: 34581 - DNA, 20 bp, Artificial Sequence
  chemically synthesized
taagatgatgatggggtttt

SEQ ID NO: 34582 - DNA, 20 bp, Artificial Sequence
  chemically synthesized
aagatgatgatggggttttt

SEQ ID NO: 34583 - DNA, 20 bp, Artificial Sequence
  chemically synthesized
gatgatgatggggtttttag

SEQ ID NO: 34584 - DNA, 20 bp, Artificial Sequence
  chemically synthesized
cctgtgtttgactttaaata

SEQ ID NO: 34585 - DNA, 20 bp, Artificial Sequence
  chemically synthesized
taaataaagatattaaacta

SEQ ID NO: 34586 - DNA, 20 bp, Artificial Sequence
  chemically synthesized
taaactatagtttctctaat

SEQ ID NO: 34587 - DNA, 20 bp, Artificial Sequence
  chemically synthesized
actatagtttctctaatcag

SEQ ID NO: 34588 - DNA, 20 bp, Artificial Sequence
  chemically synthesized
cagataaaatgtgatatgtc

SEQ ID NO: 34589 - DNA, 20 bp, Artificial Sequence
  chemically synthesized
agataaaatgtgatatgtct

SEQ ID NO: 34590 - DNA, 20 bp, Artificial Sequence
  chemically synthesized
taaaatgtgatatgtctggg

SEQ ID NO: 34591 - DNA, 20 bp, Artificial Sequence
  chemically synthesized
aaaatgtgatatgtctgggt

SEQ ID NO: 34592 - DNA, 20 bp, Artificial Sequence
  chemically synthesized
tgtgatatgtctgggtggga

SEQ ID NO: 34593 - DNA, 20 bp, Artificial Sequence
  chemically synthesized
gtgatatgtctgggtgggaa

SEQ ID NO: 34594 - DNA, 20 bp, Artificial Sequence
  chemically synthesized
tgatatgtctgggtgggaaa

SEQ ID NO: 34595 - DNA, 20 bp, Artificial Sequence
  chemically synthesized
atgtctgggtgggaaaggga

SEQ ID NO: 34596 - DNA, 20 bp, Artificial Sequence
  chemically synthesized
tgtctgggtgggaaagggaa

SEQ ID NO: 34597 - DNA, 20 bp, Artificial Sequence
  chemically synthesized
tctgggtgggaaagggaaag

SEQ ID NO: 34598 - DNA, 20 bp, Artificial Sequence
  chemically synthesized
gtgggaaagggaaaggagaa

SEQ ID NO: 34599 - DNA, 20 bp, Artificial Sequence
  chemically synthesized
ggaaaggagaaaagattgat

SEQ ID NO: 34600 - DNA, 20 bp, Artificial Sequence
  chemically synthesized
aaaagattgatgagccaatg

SEQ ID NO: 34601 - DNA, 20 bp, Artificial Sequence
  chemically synthesized
aaagattgatgagccaatgt

SEQ ID NO: 34602 - DNA, 20 bp, Artificial Sequence
  chemically synthesized
caatgtgggaacttctgaca

SEQ ID NO: 34603 - DNA, 20 bp, Artificial Sequence
  chemically synthesized
ggaacttctgacatagctaa

SEQ ID NO: 34604 - DNA, 20 bp, Artificial Sequence
  chemically synthesized
acatagctaaaagtaacgtt

SEQ ID NO: 34605 - DNA, 20 bp, Artificial Sequence
  chemically synthesized
gctaaaagtaacgttgagcc

SEQ ID NO: 34606 - DNA, 20 bp, Artificial Sequence
  chemically synthesized
ctaaaagtaacgttgagcct

SEQ ID NO: 34607 - DNA, 20 bp, Artificial Sequence
  chemically synthesized
taaaagtaacgttgagcctg

SEQ ID NO: 34608 - DNA, 20 bp, Artificial Sequence
  chemically synthesized
taacgttgagcctggggcat

SEQ ID NO: 34609 - DNA, 20 bp, Artificial Sequence
  chemically synthesized
aacgttgagcctggggcatt

SEQ ID NO: 34610 - DNA, 20 bp, Artificial Sequence
  chemically synthesized
gagcctggggcattgggact

SEQ ID NO: 34611 - DNA, 20 bp, Artificial Sequence
  chemically synthesized
agcctggggcattgggactg

SEQ ID NO: 34612 - DNA, 20 bp, Artificial Sequence
  chemically synthesized
gcctggggcattgggactga

SEQ ID NO: 34613 - DNA, 20 bp, Artificial Sequence
  chemically synthesized
tggggcattgggactgaggg

SEQ ID NO: 34614 - DNA, 20 bp, Artificial Sequence
  chemically synthesized
ggcattgggactgagggaag

SEQ ID NO: 34615 - DNA, 20 bp, Artificial Sequence
  chemically synthesized
cattgggactgagggaagta

SEQ ID NO: 34616 - DNA, 20 bp, Artificial Sequence
  chemically synthesized
attgggactgagggaagtag

SEQ ID NO: 34617 - DNA, 20 bp, Artificial Sequence
  chemically synthesized
ttgggactgagggaagtaga

SEQ ID NO: 34618 - DNA, 20 bp, Artificial Sequence
  chemically synthesized
tgggactgagggaagtagag

SEQ ID NO: 34619 - DNA, 20 bp, Artificial Sequence
  chemically synthesized
actgagggaagtagagggga

SEQ ID NO: 34620 - DNA, 20 bp, Artificial Sequence
  chemically synthesized
aaagcaactctgtcctcaaa

SEQ ID NO: 34621 - DNA, 20 bp, Artificial Sequence
  chemically synthesized
caactctgtcctcaaaaagt

SEQ ID NO: 34622 - DNA, 20 bp, Artificial Sequence
  chemically synthesized
ctgtcctcaaaaagtgagaa

SEQ ID NO: 34623 - DNA, 20 bp, Artificial Sequence
  chemically synthesized
tgtcctcaaaaagtgagaaa

SEQ ID NO: 34624 - DNA, 20 bp, Artificial Sequence
  chemically synthesized
tcctcaaaaagtgagaaaag

SEQ ID NO: 34625 - DNA, 20 bp, Artificial Sequence
  chemically synthesized
cctcaaaaagtgagaaaagg

SEQ ID NO: 34626 - DNA, 20 bp, Artificial Sequence
  chemically synthesized
ttattgctcaatctgcctgc

SEQ ID NO: 34627 - DNA, 20 bp, Artificial Sequence
  chemically synthesized
tgctcaatctgcctgccagt

SEQ ID NO: 34628 - DNA, 20 bp, Artificial Sequence
  chemically synthesized
ctcaatctgcctgccagtga

SEQ ID NO: 34629 - DNA, 20 bp, Artificial Sequence
  chemically synthesized
tcaatctgcctgccagtgag

SEQ ID NO: 34630 - DNA, 20 bp, Artificial Sequence
  chemically synthesized
ctgcctgccagtgagaggtt

SEQ ID NO: 34631 - DNA, 20 bp, Artificial Sequence
  chemically synthesized
tgagaggttcagacaatact

SEQ ID NO: 34632 - DNA, 20 bp, Artificial Sequence
  chemically synthesized
cagacaatactcagcttatg

SEQ ID NO: 34633 - DNA, 20 bp, Artificial Sequence
  chemically synthesized
agacaatactcagcttatgc

SEQ ID NO: 34634 - DNA, 20 bp, Artificial Sequence
  chemically synthesized
actcagcttatgcaggatta

SEQ ID NO: 34635 - DNA, 20 bp, Artificial Sequence
  chemically synthesized
cagcttatgcaggattaaag

SEQ ID NO: 34636 - DNA, 20 bp, Artificial Sequence
  chemically synthesized
cttatgcaggattaaagaag

SEQ ID NO: 34637 - DNA, 20 bp, Artificial Sequence
  chemically synthesized
gcaggattaaagaagcagta

SEQ ID NO: 34638 - DNA, 20 bp, Artificial Sequence
  chemically synthesized
tggcaaataaaaattgtaca

SEQ ID NO: 34639 - DNA, 20 bp, Artificial Sequence
  chemically synthesized
ggcaaataaaaattgtacat

SEQ ID NO: 34640 - DNA, 20 bp, Artificial Sequence
  chemically synthesized
tataacttattgttttatta

SEQ ID NO: 34641 - DNA, 20 bp, Artificial Sequence
  chemically synthesized
ataacttattgttttattat

SEQ ID NO: 34642 - DNA, 20 bp, Artificial Sequence
  chemically synthesized
cataataactttaatttttt

SEQ ID NO: 34643 - DNA, 20 bp, Artificial Sequence
  chemically synthesized
aataactttaatttttttgg

SEQ ID NO: 34644 - DNA, 20 bp, Artificial Sequence
  chemically synthesized
ttttggtagtaaaaatatgt

SEQ ID NO: 34645 - DNA, 20 bp, Artificial Sequence
  chemically synthesized
tttggtagtaaaaatatgtg

SEQ ID NO: 34646 - DNA, 20 bp, Artificial Sequence
  chemically synthesized
atatgtgaggtctgctttct

SEQ ID NO: 34647 - DNA, 20 bp, Artificial Sequence
  chemically synthesized
attttaaatatacctaaata

SEQ ID NO: 34648 - DNA, 20 bp, Artificial Sequence
  chemically synthesized
taaatatacctaaataaagc

SEQ ID NO: 34649 - DNA, 20 bp, Artificial Sequence
  chemically synthesized
aaatatacctaaataaagct

SEQ ID NO: 34650 - DNA, 20 bp, Artificial Sequence
  chemically synthesized
atatacctaaataaagctgg

SEQ ID NO: 34651 - DNA, 20 bp, Artificial Sequence
  chemically synthesized
tatacctaaataaagctggg

SEQ ID NO: 34652 - DNA, 20 bp, Artificial Sequence
  chemically synthesized
atacctaaataaagctggga

SEQ ID NO: 34653 - DNA, 20 bp, Artificial Sequence
  chemically synthesized
taaataaagctgggagggaa

SEQ ID NO: 34654 - DNA, 20 bp, Artificial Sequence
  chemically synthesized
ctgggagggaaaagataata

SEQ ID NO: 34655 - DNA, 20 bp, Artificial Sequence
  chemically synthesized
gataatacagaacattaatc

SEQ ID NO: 34656 - DNA, 20 bp, Artificial Sequence
  chemically synthesized
attgataaattaaaaaaaaa

SEQ ID NO: 34657 - DNA, 20 bp, Artificial Sequence
  chemically synthesized
ttgataaattaaaaaaaaac

SEQ ID NO: 34658 - DNA, 20 bp, Artificial Sequence
  chemically synthesized
gataaattaaaaaaaaacag

SEQ ID NO: 34659 - DNA, 20 bp, Artificial Sequence
  chemically synthesized
aaattaaaaaaaaacaggag

SEQ ID NO: 34660 - DNA, 20 bp, Artificial Sequence
  chemically synthesized
aattaaaaaaaaacaggagt

SEQ ID NO: 34661 - DNA, 20 bp, Artificial Sequence
  chemically synthesized
aaaaacaggagtaggaatac

SEQ ID NO: 34662 - DNA, 20 bp, Artificial Sequence
  chemically synthesized
acaggagtaggaataccaga

SEQ ID NO: 34663 - DNA, 20 bp, Artificial Sequence
  chemically synthesized
caggagtaggaataccagat

SEQ ID NO: 34664 - DNA, 20 bp, Artificial Sequence
  chemically synthesized
aggagtaggaataccagata

SEQ ID NO: 34665 - DNA, 20 bp, Artificial Sequence
  chemically synthesized
aataccagatagggaaaata

SEQ ID NO: 34666 - DNA, 20 bp, Artificial Sequence
  chemically synthesized
cagatagggaaaataaagct

SEQ ID NO: 34667 - DNA, 20 bp, Artificial Sequence
  chemically synthesized
aaagctgagaaacaaatgta

SEQ ID NO: 34668 - DNA, 20 bp, Artificial Sequence
  chemically synthesized
ttgaatttctaccgtgtgtc

SEQ ID NO: 34669 - DNA, 20 bp, Artificial Sequence
  chemically synthesized
ttctaccgtgtgtcaagtat

SEQ ID NO: 34670 - DNA, 20 bp, Artificial Sequence
  chemically synthesized
ccgtgtgtcaagtattggac

SEQ ID NO: 34671 - DNA, 20 bp, Artificial Sequence
  chemically synthesized
cgtgtgtcaagtattggact

SEQ ID NO: 34672 - DNA, 20 bp, Artificial Sequence
  chemically synthesized
gtgtgtcaagtattggactg

SEQ ID NO: 34673 - DNA, 20 bp, Artificial Sequence
  chemically synthesized
attatatacacctcattttt

SEQ ID NO: 34674 - DNA, 20 bp, Artificial Sequence
  chemically synthesized
ttatatacacctcatttttt

SEQ ID NO: 34675 - DNA, 20 bp, Artificial Sequence
  chemically synthesized
tatacacctcattttttggg

SEQ ID NO: 34676 - DNA, 20 bp, Artificial Sequence
  chemically synthesized
tttgggaagaatccttaaaa

SEQ ID NO: 34677 - DNA, 20 bp, Artificial Sequence
  chemically synthesized
ctgttttcatattgaaaact

SEQ ID NO: 34678 - DNA, 20 bp, Artificial Sequence
  chemically synthesized
gtgctttcacttgattcact

SEQ ID NO: 34679 - DNA, 20 bp, Artificial Sequence
  chemically synthesized
gattcactcagttgcttttg

SEQ ID NO: 34680 - DNA, 20 bp, Artificial Sequence
  chemically synthesized
cagttgcttttgtggtatat

SEQ ID NO: 34681 - DNA, 20 bp, Artificial Sequence
  chemically synthesized
tggtatatgagatgatctgt

SEQ ID NO: 34682 - DNA, 20 bp, Artificial Sequence
  chemically synthesized
atgagatgatctgtgagttt

SEQ ID NO: 34683 - DNA, 20 bp, Artificial Sequence
  chemically synthesized
gagatgatctgtgagtttca

SEQ ID NO: 34684 - DNA, 20 bp, Artificial Sequence
  chemically synthesized
agatgatctgtgagtttcag

SEQ ID NO: 34685 - DNA, 20 bp, Artificial Sequence
  chemically synthesized
gatgatctgtgagtttcaga

SEQ ID NO: 34686 - DNA, 20 bp, Artificial Sequence
  chemically synthesized
atgatctgtgagtttcagag

SEQ ID NO: 34687 - DNA, 20 bp, Artificial Sequence
  chemically synthesized
aaacctttgcctcatccctg

SEQ ID NO: 34688 - DNA, 20 bp, Artificial Sequence
  chemically synthesized
tgcagccattcaccctcttc

SEQ ID NO: 34689 - DNA, 20 bp, Artificial Sequence
  chemically synthesized
gcagccattcaccctcttcc

SEQ ID NO: 34690 - DNA, 20 bp, Artificial Sequence
  chemically synthesized
cagccattcaccctcttcca

SEQ ID NO: 34691 - DNA, 20 bp, Artificial Sequence
  chemically synthesized
ctcttccagggtctctgtca

SEQ ID NO: 34692 - DNA, 20 bp, Artificial Sequence
  chemically synthesized
ccagggtctctgtcatagaa

SEQ ID NO: 34693 - DNA, 20 bp, Artificial Sequence
  chemically synthesized
ctctgtcatagaatagactt

SEQ ID NO: 34694 - DNA, 20 bp, Artificial Sequence
  chemically synthesized
agacttgagtttttattaat

SEQ ID NO: 34695 - DNA, 20 bp, Artificial Sequence
  chemically synthesized
taatgagaaactaattctca

SEQ ID NO: 34696 - DNA, 20 bp, Artificial Sequence
  chemically synthesized
aactctgccgcataaactga

SEQ ID NO: 34697 - DNA, 20 bp, Artificial Sequence
  chemically synthesized
cataaactgatggctctatg

SEQ ID NO: 34698 - DNA, 20 bp, Artificial Sequence
  chemically synthesized
atggctctatgcagacacct

SEQ ID NO: 34699 - DNA, 20 bp, Artificial Sequence
  chemically synthesized
gctctatgcagacacctcag

SEQ ID NO: 34700 - DNA, 20 bp, Artificial Sequence
  chemically synthesized
ctctatgcagacacctcagc

SEQ ID NO: 34701 - DNA, 20 bp, Artificial Sequence
  chemically synthesized
ctatgcagacacctcagcag

SEQ ID NO: 34702 - DNA, 20 bp, Artificial Sequence
  chemically synthesized
cacctcagcaggagcccatt

SEQ ID NO: 34703 - DNA, 20 bp, Artificial Sequence
  chemically synthesized
atattctctcaccttccctt

SEQ ID NO: 34704 - DNA, 20 bp, Artificial Sequence
  chemically synthesized
ctgacactcttttctgtctc

SEQ ID NO: 34705 - DNA, 20 bp, Artificial Sequence
  chemically synthesized
tcttttctgtctcaagcact

SEQ ID NO: 34706 - DNA, 20 bp, Artificial Sequence
  chemically synthesized
tttttttacccccttacctt

SEQ ID NO: 34707 - DNA, 20 bp, Artificial Sequence
  chemically synthesized
ggctattatcctttctgtga

SEQ ID NO: 34708 - DNA, 20 bp, Artificial Sequence
  chemically synthesized
tttctgtgatggttaatatt

SEQ ID NO: 34709 - DNA, 20 bp, Artificial Sequence
  chemically synthesized
atattgagtgcaaacttgat

SEQ ID NO: 34710 - DNA, 20 bp, Artificial Sequence
  chemically synthesized
gtgcaaacttgattggattg

SEQ ID NO: 34711 - DNA, 20 bp, Artificial Sequence
  chemically synthesized
tgcaaacttgattggattga

SEQ ID NO: 34712 - DNA, 20 bp, Artificial Sequence
  chemically synthesized
tgattggattgaaggatgca

SEQ ID NO: 34713 - DNA, 20 bp, Artificial Sequence
  chemically synthesized
aggatgcaaagtattgttcc

SEQ ID NO: 34714 - DNA, 20 bp, Artificial Sequence
  chemically synthesized
ggatgcaaagtattgttcct

SEQ ID NO: 34715 - DNA, 20 bp, Artificial Sequence
  chemically synthesized
attgttcctgggtgtgctgt

SEQ ID NO: 34716 - DNA, 20 bp, Artificial Sequence
  chemically synthesized
ttgttcctgggtgtgctgta

SEQ ID NO: 34717 - DNA, 20 bp, Artificial Sequence
  chemically synthesized
tgttcctgggtgtgctgtaa

SEQ ID NO: 34718 - DNA, 20 bp, Artificial Sequence
  chemically synthesized
gtgctgtaagggtgttgcca

SEQ ID NO: 34719 - DNA, 20 bp, Artificial Sequence
  chemically synthesized
tgctgtaagggtgttgccaa

SEQ ID NO: 34720 - DNA, 20 bp, Artificial Sequence
  chemically synthesized
ctgtaagggtgttgccaaag

SEQ ID NO: 34721 - DNA, 20 bp, Artificial Sequence
  chemically synthesized
gccaaaggagattaacattt

SEQ ID NO: 34722 - DNA, 20 bp, Artificial Sequence
  chemically synthesized
aaggagattaacatttgagt

SEQ ID NO: 34723 - DNA, 20 bp, Artificial Sequence
  chemically synthesized
gagattaacatttgagtcag

SEQ ID NO: 34724 - DNA, 20 bp, Artificial Sequence
  chemically synthesized
taacatttgagtcagtagac

SEQ ID NO: 34725 - DNA, 20 bp, Artificial Sequence
  chemically synthesized
aacatttgagtcagtagact

SEQ ID NO: 34726 - DNA, 20 bp, Artificial Sequence
  chemically synthesized
catttgagtcagtagactgg

SEQ ID NO: 34727 - DNA, 20 bp, Artificial Sequence
  chemically synthesized
tttgagtcagtagactggga

SEQ ID NO: 34728 - DNA, 20 bp, Artificial Sequence
  chemically synthesized
ttgagtcagtagactgggag

SEQ ID NO: 34729 - DNA, 20 bp, Artificial Sequence
  chemically synthesized
agtcagtagactgggagagg

SEQ ID NO: 34730 - DNA, 20 bp, Artificial Sequence
  chemically synthesized
agacccacccaccctccgtc

SEQ ID NO: 34731 - DNA, 20 bp, Artificial Sequence
  chemically synthesized
gacccacccaccctccgtct

SEQ ID NO: 34732 - DNA, 20 bp, Artificial Sequence
  chemically synthesized
ccacccaccctccgtctggg

SEQ ID NO: 34733 - DNA, 20 bp, Artificial Sequence
  chemically synthesized
cacccaccctccgtctgggt

SEQ ID NO: 34734 - DNA, 20 bp, Artificial Sequence
  chemically synthesized
ctgggtgggtactatctaat

SEQ ID NO: 34735 - DNA, 20 bp, Artificial Sequence
  chemically synthesized
ggtactatctaatcagctgc

SEQ ID NO: 34736 - DNA, 20 bp, Artificial Sequence
  chemically synthesized
gtactatctaatcagctgcc

SEQ ID NO: 34737 - DNA, 20 bp, Artificial Sequence
  chemically synthesized
tactatctaatcagctgcca

SEQ ID NO: 34738 - DNA, 20 bp, Artificial Sequence
  chemically synthesized
tatctaatcagctgccaggg

SEQ ID NO: 34739 - DNA, 20 bp, Artificial Sequence
  chemically synthesized
taatcagctgccagggcggc

SEQ ID NO: 34740 - DNA, 20 bp, Artificial Sequence
  chemically synthesized
tcagctgccagggcggctag

SEQ ID NO: 34741 - DNA, 20 bp, Artificial Sequence
  chemically synthesized
ctgccagggcggctagaaga

SEQ ID NO: 34742 - DNA, 20 bp, Artificial Sequence
  chemically synthesized
ccagggcggctagaagaaag

SEQ ID NO: 34743 - DNA, 20 bp, Artificial Sequence
  chemically synthesized
cagggcggctagaagaaagc

SEQ ID NO: 34744 - DNA, 20 bp, Artificial Sequence
  chemically synthesized
ggctagaagaaagcaggcaa

SEQ ID NO: 34745 - DNA, 20 bp, Artificial Sequence
  chemically synthesized
tagaagaaagcaggcaaaag

SEQ ID NO: 34746 - DNA, 20 bp, Artificial Sequence
  chemically synthesized
agaaagcaggcaaaagaaga

SEQ ID NO: 34747 - DNA, 20 bp, Artificial Sequence
  chemically synthesized
aagcaggcaaaagaagatgg

SEQ ID NO: 34748 - DNA, 20 bp, Artificial Sequence
  chemically synthesized
gcaggcaaaagaagatggaa

SEQ ID NO: 34749 - DNA, 20 bp, Artificial Sequence
  chemically synthesized
ggcaaaagaagatggaagag

SEQ ID NO: 34750 - DNA, 20 bp, Artificial Sequence
  chemically synthesized
aaaagaagatggaagagtag

SEQ ID NO: 34751 - DNA, 20 bp, Artificial Sequence
  chemically synthesized
ttacacaatataaacctttc

SEQ ID NO: 34752 - DNA, 20 bp, Artificial Sequence
  chemically synthesized
tacacaatataaacctttcc

SEQ ID NO: 34753 - DNA, 20 bp, Artificial Sequence
  chemically synthesized
ataaacctttccaggtgcta

SEQ ID NO: 34754 - DNA, 20 bp, Artificial Sequence
  chemically synthesized
ttccaggtgctaaagtcaca

SEQ ID NO: 34755 - DNA, 20 bp, Artificial Sequence
  chemically synthesized
tccaggtgctaaagtcacac

SEQ ID NO: 34756 - DNA, 20 bp, Artificial Sequence
  chemically synthesized
gtgaatctgtacccctgatc

SEQ ID NO: 34757 - DNA, 20 bp, Artificial Sequence
  chemically synthesized
gaatctgtacccctgatcca

SEQ ID NO: 34758 - DNA, 20 bp, Artificial Sequence
  chemically synthesized
aatctgtacccctgatccag

SEQ ID NO: 34759 - DNA, 20 bp, Artificial Sequence
  chemically synthesized
tccagaggcacacataaccc

SEQ ID NO: 34760 - DNA, 20 bp, Artificial Sequence
  chemically synthesized
acataacccaagctccgtcc

SEQ ID NO: 34761 - DNA, 20 bp, Artificial Sequence
  chemically synthesized
gtccaagcttaattttgaat

SEQ ID NO: 34762 - DNA, 20 bp, Artificial Sequence
  chemically synthesized
ttaattttgaattggtttat

SEQ ID NO: 34763 - DNA, 20 bp, Artificial Sequence
  chemically synthesized
gaattggtttattagtcata

SEQ ID NO: 34764 - DNA, 20 bp, Artificial Sequence
  chemically synthesized
tggtttattagtcatatggt

SEQ ID NO: 34765 - DNA, 20 bp, Artificial Sequence
  chemically synthesized
ttattagtcatatggtcaga

SEQ ID NO: 34766 - DNA, 20 bp, Artificial Sequence
  chemically synthesized
tcagatagtgactttttttc

SEQ ID NO: 34767 - DNA, 20 bp, Artificial Sequence
  chemically synthesized
atagtgactttttttctaga

SEQ ID NO: 34768 - DNA, 20 bp, Artificial Sequence
  chemically synthesized
atttgaacctctgatgatta

SEQ ID NO: 34769 - DNA, 20 bp, Artificial Sequence
  chemically synthesized
ttgaacctctgatgattaca

SEQ ID NO: 34770 - DNA, 20 bp, Artificial Sequence
  chemically synthesized
tgaacctctgatgattacag

SEQ ID NO: 34771 - DNA, 20 bp, Artificial Sequence
  chemically synthesized
ttacagaggtatacctcctc

SEQ ID NO: 34772 - DNA, 20 bp, Artificial Sequence
  chemically synthesized
ggtatacctcctcaagaatt

SEQ ID NO: 34773 - DNA, 20 bp, Artificial Sequence
  chemically synthesized
atacctcctcaagaatttgg

SEQ ID NO: 34774 - DNA, 20 bp, Artificial Sequence
  chemically synthesized
acctcctcaagaatttggaa

SEQ ID NO: 34775 - DNA, 20 bp, Artificial Sequence
  chemically synthesized
ggaagagttgattctatatt

SEQ ID NO: 34776 - DNA, 20 bp, Artificial Sequence
  chemically synthesized
ttctatatttggcacttatc

SEQ ID NO: 34777 - DNA, 20 bp, Artificial Sequence
  chemically synthesized
tggcacttatctggacttct

SEQ ID NO: 34778 - DNA, 20 bp, Artificial Sequence
  chemically synthesized
ggcacttatctggacttcta

SEQ ID NO: 34779 - DNA, 20 bp, Artificial Sequence
  chemically synthesized
tatctggacttctaaggtaa

SEQ ID NO: 34780 - DNA, 20 bp, Artificial Sequence
  chemically synthesized
gacttctaaggtaaaagaca

SEQ ID NO: 34781 - DNA, 20 bp, Artificial Sequence
  chemically synthesized
acttctaaggtaaaagacat

SEQ ID NO: 34782 - DNA, 20 bp, Artificial Sequence
  chemically synthesized
cttctaaggtaaaagacatg

SEQ ID NO: 34783 - DNA, 20 bp, Artificial Sequence
  chemically synthesized
taaggtaaaagacatggggt

SEQ ID NO: 34784 - DNA, 20 bp, Artificial Sequence
  chemically synthesized
aaggtaaaagacatggggtt

SEQ ID NO: 34785 - DNA, 20 bp, Artificial Sequence
  chemically synthesized
aggtaaaagacatggggttg

SEQ ID NO: 34786 - DNA, 20 bp, Artificial Sequence
  chemically synthesized
ggtaaaagacatggggttgg

SEQ ID NO: 34787 - DNA, 20 bp, Artificial Sequence
  chemically synthesized
aaaagacatggggttggggg

SEQ ID NO: 34788 - DNA, 20 bp, Artificial Sequence
  chemically synthesized
aaagacatggggttgggggc

SEQ ID NO: 34789 - DNA, 20 bp, Artificial Sequence
  chemically synthesized
aagacatggggttgggggca

SEQ ID NO: 34790 - DNA, 20 bp, Artificial Sequence
  chemically synthesized
agacatggggttgggggcag

SEQ ID NO: 34791 - DNA, 20 bp, Artificial Sequence
  chemically synthesized
gacatggggttgggggcagg

SEQ ID NO: 34792 - DNA, 20 bp, Artificial Sequence
  chemically synthesized
gttgggggcagggggactct

SEQ ID NO: 34793 - DNA, 20 bp, Artificial Sequence
  chemically synthesized
ttgggggcagggggactctc

SEQ ID NO: 34794 - DNA, 20 bp, Artificial Sequence
  chemically synthesized
tgggggcagggggactctca

SEQ ID NO: 34795 - DNA, 20 bp, Artificial Sequence
  chemically synthesized
ggcagggggactctcagggt

SEQ ID NO: 34796 - DNA, 20 bp, Artificial Sequence
  chemically synthesized
ggggactctcagggttagaa

SEQ ID NO: 34797 - DNA, 20 bp, Artificial Sequence
  chemically synthesized
gactctcagggttagaatgg

SEQ ID NO: 34798 - DNA, 20 bp, Artificial Sequence
  chemically synthesized
ctcagggttagaatggaagc

SEQ ID NO: 34799 - DNA, 20 bp, Artificial Sequence
  chemically synthesized
cagggttagaatggaagcca

SEQ ID NO: 34800 - DNA, 20 bp, Artificial Sequence
  chemically synthesized
gggttagaatggaagccaga

SEQ ID NO: 34801 - DNA, 20 bp, Artificial Sequence
  chemically synthesized
aatggaagccagagagatta

SEQ ID NO: 34802 - DNA, 20 bp, Artificial Sequence
  chemically synthesized
agccagagagattaaagaat

SEQ ID NO: 34803 - DNA, 20 bp, Artificial Sequence
  chemically synthesized
agagagattaaagaatcagt

SEQ ID NO: 34804 - DNA, 20 bp, Artificial Sequence
  chemically synthesized
gagagattaaagaatcagtc

SEQ ID NO: 34805 - DNA, 20 bp, Artificial Sequence
  chemically synthesized
agattaaagaatcagtcagg

SEQ ID NO: 34806 - DNA, 20 bp, Artificial Sequence
  chemically synthesized
attaaagaatcagtcaggtg

SEQ ID NO: 34807 - DNA, 20 bp, Artificial Sequence
  chemically synthesized
taaagaatcagtcaggtgga

SEQ ID NO: 34808 - DNA, 20 bp, Artificial Sequence
  chemically synthesized
caaccccataattcatgcct

SEQ ID NO: 34809 - DNA, 20 bp, Artificial Sequence
  chemically synthesized
ctgagtcaacacccatgctc

SEQ ID NO: 34810 - DNA, 20 bp, Artificial Sequence
  chemically synthesized
cccatgctctggtttgttcg

SEQ ID NO: 34811 - DNA, 20 bp, Artificial Sequence
  chemically synthesized
attgtttgccttatgtgttc

SEQ ID NO: 34812 - DNA, 20 bp, Artificial Sequence
  chemically synthesized
ccttcacttttttatatttg

SEQ ID NO: 34813 - DNA, 20 bp, Artificial Sequence
  chemically synthesized
ttcacttttttatatttgaa

SEQ ID NO: 34814 - DNA, 20 bp, Artificial Sequence
  chemically synthesized
tcacttttttatatttgaag

SEQ ID NO: 34815 - DNA, 20 bp, Artificial Sequence
  chemically synthesized
atttgaagaggtaactctca

SEQ ID NO: 34816 - DNA, 20 bp, Artificial Sequence
  chemically synthesized
aggtaactctcaaagaaacc

SEQ ID NO: 34817 - DNA, 20 bp, Artificial Sequence
  chemically synthesized
ctctcaaagaaaccaagttt

SEQ ID NO: 34818 - DNA, 20 bp, Artificial Sequence
  chemically synthesized
ctcaaagaaaccaagtttta

SEQ ID NO: 34819 - DNA, 20 bp, Artificial Sequence
  chemically synthesized
aaaccaagttttagagatgt

SEQ ID NO: 34820 - DNA, 20 bp, Artificial Sequence
  chemically synthesized
aaccaagttttagagatgtc

SEQ ID NO: 34821 - DNA, 20 bp, Artificial Sequence
  chemically synthesized
accaagttttagagatgtca

SEQ ID NO: 34822 - DNA, 20 bp, Artificial Sequence
  chemically synthesized
caagttttagagatgtcagg

SEQ ID NO: 34823 - DNA, 20 bp, Artificial Sequence
  chemically synthesized
tagagatgtcagggagtctt

SEQ ID NO: 34824 - DNA, 20 bp, Artificial Sequence
  chemically synthesized
agagatgtcagggagtcttt

SEQ ID NO: 34825 - DNA, 20 bp, Artificial Sequence
  chemically synthesized
ctactacatatatctactct

SEQ ID NO: 34826 - DNA, 20 bp, Artificial Sequence
  chemically synthesized
ctacatatatctactcttag

SEQ ID NO: 34827 - DNA, 20 bp, Artificial Sequence
  chemically synthesized
actattacttttctcttgct

SEQ ID NO: 34828 - DNA, 20 bp, Artificial Sequence
  chemically synthesized
cttttctcttgctaagaaat

SEQ ID NO: 34829 - DNA, 20 bp, Artificial Sequence
  chemically synthesized
tctctgttttttttttgcct

SEQ ID NO: 34830 - DNA, 20 bp, Artificial Sequence
  chemically synthesized
tttgccttggttcctgcaat

SEQ ID NO: 34831 - DNA, 20 bp, Artificial Sequence
  chemically synthesized
gttcctgcaatgagatctta

SEQ ID NO: 34832 - DNA, 20 bp, Artificial Sequence
  chemically synthesized
tcctgcaatgagatcttaca

SEQ ID NO: 34833 - DNA, 20 bp, Artificial Sequence
  chemically synthesized
cctgcaatgagatcttacag

SEQ ID NO: 34834 - DNA, 20 bp, Artificial Sequence
  chemically synthesized
tgcaatgagatcttacagag

SEQ ID NO: 34835 - DNA, 20 bp, Artificial Sequence
  chemically synthesized
ctttgttcccttccattctt

SEQ ID NO: 34836 - DNA, 20 bp, Artificial Sequence
  chemically synthesized
ccttccattcttcagttcca

SEQ ID NO: 34837 - DNA, 20 bp, Artificial Sequence
  chemically synthesized
agtcatgtatctcacatctt

SEQ ID NO: 34838 - DNA, 20 bp, Artificial Sequence
  chemically synthesized
tcacatctttagccgtatga

SEQ ID NO: 34839 - DNA, 20 bp, Artificial Sequence
  chemically synthesized
ctttagccgtatgaaagatt

SEQ ID NO: 34840 - DNA, 20 bp, Artificial Sequence
  chemically synthesized
tttagccgtatgaaagattt

SEQ ID NO: 34841 - DNA, 20 bp, Artificial Sequence
  chemically synthesized
agatttgggcatcatctttt

SEQ ID NO: 34842 - DNA, 20 bp, Artificial Sequence
  chemically synthesized
tcttttcagaatctgcacat

SEQ ID NO: 34843 - DNA, 20 bp, Artificial Sequence
  chemically synthesized
tcagaatctgcacatgagcc

SEQ ID NO: 34844 - DNA, 20 bp, Artificial Sequence
  chemically synthesized
aatctgcacatgagcctggc

SEQ ID NO: 34845 - DNA, 20 bp, Artificial Sequence
  chemically synthesized
ctgcacatgagcctggctgg

SEQ ID NO: 34846 - DNA, 20 bp, Artificial Sequence
  chemically synthesized
tgcacatgagcctggctggt

SEQ ID NO: 34847 - DNA, 20 bp, Artificial Sequence
  chemically synthesized
gctggtaggaacatttattt

SEQ ID NO: 34848 - DNA, 20 bp, Artificial Sequence
  chemically synthesized
ggtaggaacatttattttag

SEQ ID NO: 34849 - DNA, 20 bp, Artificial Sequence
  chemically synthesized
ttattttagaagctcctccc

SEQ ID NO: 34850 - DNA, 20 bp, Artificial Sequence
  chemically synthesized
attttagaagctcctcccca

SEQ ID NO: 34851 - DNA, 20 bp, Artificial Sequence
  chemically synthesized
cccagagaccattcctgatt

SEQ ID NO: 34852 - DNA, 20 bp, Artificial Sequence
  chemically synthesized
ttctctattatttgtgccct

SEQ ID NO: 34853 - DNA, 20 bp, Artificial Sequence
  chemically synthesized
tatttgtgccctcagccttg

SEQ ID NO: 34854 - DNA, 20 bp, Artificial Sequence
  chemically synthesized
atttgtgccctcagccttgt

SEQ ID NO: 34855 - DNA, 20 bp, Artificial Sequence
  chemically synthesized
gccctcagccttgtgggtat

SEQ ID NO: 34856 - DNA, 20 bp, Artificial Sequence
  chemically synthesized
ccctcagccttgtgggtatt

SEQ ID NO: 34857 - DNA, 20 bp, Artificial Sequence
  chemically synthesized
tgtgggtattgggctttgaa

SEQ ID NO: 34858 - DNA, 20 bp, Artificial Sequence
  chemically synthesized
ggctttgaacagcacaactc

SEQ ID NO: 34859 - DNA, 20 bp, Artificial Sequence
  chemically synthesized
caagatctctgtctctgtcc

SEQ ID NO: 34860 - DNA, 20 bp, Artificial Sequence
  chemically synthesized
gtctctgtcctggcttttac

SEQ ID NO: 34861 - DNA, 20 bp, Artificial Sequence
  chemically synthesized
ctctgtcctggcttttactg

SEQ ID NO: 34862 - DNA, 20 bp, Artificial Sequence
  chemically synthesized
tctgtcctggcttttactgg

SEQ ID NO: 34863 - DNA, 20 bp, Artificial Sequence
  chemically synthesized
tactggaggttttcctctgt

SEQ ID NO: 34864 - DNA, 20 bp, Artificial Sequence
  chemically synthesized
ctggaggttttcctctgttg

SEQ ID NO: 34865 - DNA, 20 bp, Artificial Sequence
  chemically synthesized
tggaggttttcctctgttgg

SEQ ID NO: 34866 - DNA, 20 bp, Artificial Sequence
  chemically synthesized
tgaatattttgtctacattg

SEQ ID NO: 34867 - DNA, 20 bp, Artificial Sequence
  chemically synthesized
ttttgtctacattgtggctt

SEQ ID NO: 34868 - DNA, 20 bp, Artificial Sequence
  chemically synthesized
tggctcttgctgtgctactt

SEQ ID NO: 34869 - DNA, 20 bp, Artificial Sequence
  chemically synthesized
ttttatctcattgcatttca

SEQ ID NO: 34870 - DNA, 20 bp, Artificial Sequence
  chemically synthesized
atataataattgccatcaca

SEQ ID NO: 34871 - DNA, 20 bp, Artificial Sequence
  chemically synthesized
attgccatcacaaagtgatg

SEQ ID NO: 34872 - DNA, 20 bp, Artificial Sequence
  chemically synthesized
acaaagtgatgtggtgtgct

SEQ ID NO: 34873 - DNA, 20 bp, Artificial Sequence
  chemically synthesized
tgatgtggtgtgcttggctg

SEQ ID NO: 34874 - DNA, 20 bp, Artificial Sequence
  chemically synthesized
tggctgaagcaccatgtgat

SEQ ID NO: 34875 - DNA, 20 bp, Artificial Sequence
  chemically synthesized
agtatgcctgctgcatcccc

SEQ ID NO: 34876 - DNA, 20 bp, Artificial Sequence
  chemically synthesized
gcctgctgcatcccctggaa

SEQ ID NO: 34877 - DNA, 20 bp, Artificial Sequence
  chemically synthesized
ctgctgcatcccctggaaaa

SEQ ID NO: 34878 - DNA, 20 bp, Artificial Sequence
  chemically synthesized
cctggaaaagagaaaacttc

SEQ ID NO: 34879 - DNA, 20 bp, Artificial Sequence
  chemically synthesized
ggaaaagagaaaacttctgg

SEQ ID NO: 34880 - DNA, 20 bp, Artificial Sequence
  chemically synthesized
gaaaagagaaaacttctggt

SEQ ID NO: 34881 - DNA, 20 bp, Artificial Sequence
  chemically synthesized
acttctggtaggctaaactc

SEQ ID NO: 34882 - DNA, 20 bp, Artificial Sequence
  chemically synthesized
tctggtaggctaaactcaag

SEQ ID NO: 34883 - DNA, 20 bp, Artificial Sequence
  chemically synthesized
ctggtaggctaaactcaaga

SEQ ID NO: 34884 - DNA, 20 bp, Artificial Sequence
  chemically synthesized
tggtaggctaaactcaagaa

SEQ ID NO: 34885 - DNA, 20 bp, Artificial Sequence
  chemically synthesized
ggctaaactcaagaagggaa

SEQ ID NO: 34886 - DNA, 20 bp, Artificial Sequence
  chemically synthesized
aaactcaagaagggaatagt

SEQ ID NO: 34887 - DNA, 20 bp, Artificial Sequence
  chemically synthesized
ggaatagttagtgataactg

SEQ ID NO: 34888 - DNA, 20 bp, Artificial Sequence
  chemically synthesized
tgcagaatgtgcgttcacgt

SEQ ID NO: 34889 - DNA, 20 bp, Artificial Sequence
  chemically synthesized
gcagaatgtgcgttcacgtt

SEQ ID NO: 34890 - DNA, 20 bp, Artificial Sequence
  chemically synthesized
tgtgcgttcacgttgggtac

SEQ ID NO: 34891 - DNA, 20 bp, Artificial Sequence
  chemically synthesized
tgcgttcacgttgggtacta

SEQ ID NO: 34892 - DNA, 20 bp, Artificial Sequence
  chemically synthesized
gttcacgttgggtactagag

SEQ ID NO: 34893 - DNA, 20 bp, Artificial Sequence
  chemically synthesized
ttcacgttgggtactagaga

SEQ ID NO: 34894 - DNA, 20 bp, Artificial Sequence
  chemically synthesized
gaattttattatattgactc

SEQ ID NO: 34895 - DNA, 20 bp, Artificial Sequence
  chemically synthesized
tatattgactctagtctatc

SEQ ID NO: 34896 - DNA, 20 bp, Artificial Sequence
  chemically synthesized
ctatctagctctctgctttc

SEQ ID NO: 34897 - DNA, 20 bp, Artificial Sequence
  chemically synthesized
agctttctctgatctaaacc

SEQ ID NO: 34898 - DNA, 20 bp, Artificial Sequence
  chemically synthesized
tttctctgatctaaaccaag

SEQ ID NO: 34899 - DNA, 20 bp, Artificial Sequence
  chemically synthesized
ttctctgatctaaaccaagc

SEQ ID NO: 34900 - DNA, 20 bp, Artificial Sequence
  chemically synthesized
tctaaaccaagcaggaaata

SEQ ID NO: 34901 - DNA, 20 bp, Artificial Sequence
  chemically synthesized
aaaccaagcaggaaatatag

SEQ ID NO: 34902 - DNA, 20 bp, Artificial Sequence
  chemically synthesized
caggaaatatagtagaaatt

SEQ ID NO: 34903 - DNA, 20 bp, Artificial Sequence
  chemically synthesized
aggaaatatagtagaaattc

SEQ ID NO: 34904 - DNA, 20 bp, Artificial Sequence
  chemically synthesized
tagtagaaattcaggttaca

SEQ ID NO: 34905 - DNA, 20 bp, Artificial Sequence
  chemically synthesized
agtagaaattcaggttacat

SEQ ID NO: 34906 - DNA, 20 bp, Artificial Sequence
  chemically synthesized
aaattcaggttacataggcc

SEQ ID NO: 34907 - DNA, 20 bp, Artificial Sequence
  chemically synthesized
ttcaggttacataggccaag

SEQ ID NO: 34908 - DNA, 20 bp, Artificial Sequence
  chemically synthesized
acataggccaagaagatata

SEQ ID NO: 34909 - DNA, 20 bp, Artificial Sequence
  chemically synthesized
cataggccaagaagatatat

SEQ ID NO: 34910 - DNA, 20 bp, Artificial Sequence
  chemically synthesized
agatatataggctttctctt

SEQ ID NO: 34911 - DNA, 20 bp, Artificial Sequence
  chemically synthesized
ggctttctcttgagataaac

SEQ ID NO: 34912 - DNA, 20 bp, Artificial Sequence
  chemically synthesized
gctttctcttgagataaact

SEQ ID NO: 34913 - DNA, 20 bp, Artificial Sequence
  chemically synthesized
tctcttgagataaactggga

SEQ ID NO: 34914 - DNA, 20 bp, Artificial Sequence
  chemically synthesized
tgggaaagatttgactgttg

SEQ ID NO: 34915 - DNA, 20 bp, Artificial Sequence
  chemically synthesized
tttgactgttgaagtaaatg

SEQ ID NO: 34916 - DNA, 20 bp, Artificial Sequence
  chemically synthesized
ttgactgttgaagtaaatgt

SEQ ID NO: 34917 - DNA, 20 bp, Artificial Sequence
  chemically synthesized
tgactgttgaagtaaatgta

SEQ ID NO: 34918 - DNA, 20 bp, Artificial Sequence
  chemically synthesized
gtagggaataaattacctcc

SEQ ID NO: 34919 - DNA, 20 bp, Artificial Sequence
  chemically synthesized
agggaataaattacctccca

SEQ ID NO: 34920 - DNA, 20 bp, Artificial Sequence
  chemically synthesized
gggaataaattacctcccag

SEQ ID NO: 34921 - DNA, 20 bp, Artificial Sequence
  chemically synthesized
ttacctcccagaggtgatac

SEQ ID NO: 34922 - DNA, 20 bp, Artificial Sequence
  chemically synthesized
acctcccagaggtgatacca

SEQ ID NO: 34923 - DNA, 20 bp, Artificial Sequence
  chemically synthesized
gaggtgataccagagtctgc

SEQ ID NO: 34924 - DNA, 20 bp, Artificial Sequence
  chemically synthesized
aggtgataccagagtctgct

SEQ ID NO: 34925 - DNA, 20 bp, Artificial Sequence
  chemically synthesized
ggtgataccagagtctgctg

SEQ ID NO: 34926 - DNA, 20 bp, Artificial Sequence
  chemically synthesized
cagagtctgctggggctatg

SEQ ID NO: 34927 - DNA, 20 bp, Artificial Sequence
  chemically synthesized
gtctgctggggctatgaaga

SEQ ID NO: 34928 - DNA, 20 bp, Artificial Sequence
  chemically synthesized
tctgctggggctatgaagac

SEQ ID NO: 34929 - DNA, 20 bp, Artificial Sequence
  chemically synthesized
tgtctgattccccacacata

SEQ ID NO: 34930 - DNA, 20 bp, Artificial Sequence
  chemically synthesized
gtctgattccccacacataa

SEQ ID NO: 34931 - DNA, 20 bp, Artificial Sequence
  chemically synthesized
cccacacataaaggtcctac

SEQ ID NO: 34932 - DNA, 20 bp, Artificial Sequence
  chemically synthesized
acacataaaggtcctaccag

SEQ ID NO: 34933 - DNA, 20 bp, Artificial Sequence
  chemically synthesized
gtcctaccagtggcttgatt

SEQ ID NO: 34934 - DNA, 20 bp, Artificial Sequence
  chemically synthesized
taccagtggcttgattcagc

SEQ ID NO: 34935 - DNA, 20 bp, Artificial Sequence
  chemically synthesized
gccagtaacttatttgaaaa

SEQ ID NO: 34936 - DNA, 20 bp, Artificial Sequence
  chemically synthesized
gtaacttatttgaaaaaaga

SEQ ID NO: 34937 - DNA, 20 bp, Artificial Sequence
  chemically synthesized
aaaaaagaaagattatttaa

SEQ ID NO: 34938 - DNA, 20 bp, Artificial Sequence
  chemically synthesized
agaaagattatttaaaagct

SEQ ID NO: 34939 - DNA, 20 bp, Artificial Sequence
  chemically synthesized
gaaagattatttaaaagctt

SEQ ID NO: 34940 - DNA, 20 bp, Artificial Sequence
  chemically synthesized
aaagattatttaaaagcttg

SEQ ID NO: 34941 - DNA, 20 bp, Artificial Sequence
  chemically synthesized
aagattatttaaaagcttgg

SEQ ID NO: 34942 - DNA, 20 bp, Artificial Sequence
  chemically synthesized
agattatttaaaagcttggg

SEQ ID NO: 34943 - DNA, 20 bp, Artificial Sequence
  chemically synthesized
aaagcttggggggactaatt

SEQ ID NO: 34944 - DNA, 20 bp, Artificial Sequence
  chemically synthesized
gggggactaattaagtgttc

SEQ ID NO: 34945 - DNA, 20 bp, Artificial Sequence
  chemically synthesized
taagtgttccagctccctct

SEQ ID NO: 34946 - DNA, 20 bp, Artificial Sequence
  chemically synthesized
aagtgttccagctccctcta

SEQ ID NO: 34947 - DNA, 20 bp, Artificial Sequence
  chemically synthesized
gtgttccagctccctctaag

SEQ ID NO: 34948 - DNA, 20 bp, Artificial Sequence
  chemically synthesized
tgttccagctccctctaagg

SEQ ID NO: 34949 - DNA, 20 bp, Artificial Sequence
  chemically synthesized
ttccagctccctctaaggag

SEQ ID NO: 34950 - DNA, 20 bp, Artificial Sequence
  chemically synthesized
cctctaaggaggagttaata

SEQ ID NO: 34951 - DNA, 20 bp, Artificial Sequence
  chemically synthesized
tctaaggaggagttaataca

SEQ ID NO: 34952 - DNA, 20 bp, Artificial Sequence
  chemically synthesized
atacagagtaaatatttctt

SEQ ID NO: 34953 - DNA, 20 bp, Artificial Sequence
  chemically synthesized
gtaaatatttcttaagatcc

SEQ ID NO: 34954 - DNA, 20 bp, Artificial Sequence
  chemically synthesized
atatttcttaagatccaagt

SEQ ID NO: 34955 - DNA, 20 bp, Artificial Sequence
  chemically synthesized
aagatccaagttggctataa

SEQ ID NO: 34956 - DNA, 20 bp, Artificial Sequence
  chemically synthesized
agatccaagttggctataaa

SEQ ID NO: 34957 - DNA, 20 bp, Artificial Sequence
  chemically synthesized
gatccaagttggctataaaa

SEQ ID NO: 34958 - DNA, 20 bp, Artificial Sequence
  chemically synthesized
tccaagttggctataaaagg

SEQ ID NO: 34959 - DNA, 20 bp, Artificial Sequence
  chemically synthesized
ggctataaaagggagacatc

SEQ ID NO: 34960 - DNA, 20 bp, Artificial Sequence
  chemically synthesized
gctataaaagggagacatct

SEQ ID NO: 34961 - DNA, 20 bp, Artificial Sequence
  chemically synthesized
ataaaagggagacatctggg

SEQ ID NO: 34962 - DNA, 20 bp, Artificial Sequence
  chemically synthesized
taaaagggagacatctggga

SEQ ID NO: 34963 - DNA, 20 bp, Artificial Sequence
  chemically synthesized
gctatctttattaataacca

SEQ ID NO: 34964 - DNA, 20 bp, Artificial Sequence
  chemically synthesized
acagtgactgcttctcttca

SEQ ID NO: 34965 - DNA, 20 bp, Artificial Sequence
  chemically synthesized
tgcttctcttcacagatgtt

SEQ ID NO: 34966 - DNA, 20 bp, Artificial Sequence
  chemically synthesized
ttctcttcacagatgttgag

SEQ ID NO: 34967 - DNA, 20 bp, Artificial Sequence
  chemically synthesized
tctcttcacagatgttgaga

SEQ ID NO: 34968 - DNA, 20 bp, Artificial Sequence
  chemically synthesized
gagaaggaacaacatgatct

SEQ ID NO: 34969 - DNA, 20 bp, Artificial Sequence
  chemically synthesized
aacaacatgatctaagtctt

SEQ ID NO: 34970 - DNA, 20 bp, Artificial Sequence
  chemically synthesized
acaacatgatctaagtcttt

SEQ ID NO: 34971 - DNA, 20 bp, Artificial Sequence
  chemically synthesized
catgatctaagtctttaggt

SEQ ID NO: 34972 - DNA, 20 bp, Artificial Sequence
  chemically synthesized
taagtctttaggtaagacac

SEQ ID NO: 34973 - DNA, 20 bp, Artificial Sequence
  chemically synthesized
gctcttcctcaccatcaaac

SEQ ID NO: 34974 - DNA, 20 bp, Artificial Sequence
  chemically synthesized
cctcaccatcaaacaagtta

SEQ ID NO: 34975 - DNA, 20 bp, Artificial Sequence
  chemically synthesized
atcaaacaagttatggtacc

SEQ ID NO: 34976 - DNA, 20 bp, Artificial Sequence
  chemically synthesized
tcaaacaagttatggtacct

SEQ ID NO: 34977 - DNA, 20 bp, Artificial Sequence
  chemically synthesized
aaacaagttatggtacctgg

SEQ ID NO: 34978 - DNA, 20 bp, Artificial Sequence
  chemically synthesized
agttatggtacctgggagta

SEQ ID NO: 34979 - DNA, 20 bp, Artificial Sequence
  chemically synthesized
ggagtatggtgaaatactcc

SEQ ID NO: 34980 - DNA, 20 bp, Artificial Sequence
  chemically synthesized
gaaatactcctagatatata

SEQ ID NO: 34981 - DNA, 20 bp, Artificial Sequence
  chemically synthesized
aatactcctagatatataaa

SEQ ID NO: 34982 - DNA, 20 bp, Artificial Sequence
  chemically synthesized
tagatatataaagagtgtac

SEQ ID NO: 34983 - DNA, 20 bp, Artificial Sequence
  chemically synthesized
agatatataaagagtgtact

SEQ ID NO: 34984 - DNA, 20 bp, Artificial Sequence
  chemically synthesized
atatataaagagtgtactag

SEQ ID NO: 34985 - DNA, 20 bp, Artificial Sequence
  chemically synthesized
gtactaggagactcctctat

SEQ ID NO: 34986 - DNA, 20 bp, Artificial Sequence
  chemically synthesized
agactcctctataagctctc

SEQ ID NO: 34987 - DNA, 20 bp, Artificial Sequence
  chemically synthesized
actcctctataagctctcca

SEQ ID NO: 34988 - DNA, 20 bp, Artificial Sequence
  chemically synthesized
ctctataagctctccagaga

SEQ ID NO: 34989 - DNA, 20 bp, Artificial Sequence
  chemically synthesized
aagctctccagagaaagata

SEQ ID NO: 34990 - DNA, 20 bp, Artificial Sequence
  chemically synthesized
gctctccagagaaagatacg

SEQ ID NO: 34991 - DNA, 20 bp, Artificial Sequence
  chemically synthesized
ctccagagaaagatacggag

SEQ ID NO: 34992 - DNA, 20 bp, Artificial Sequence
  chemically synthesized
cagagaaagatacggagaag

SEQ ID NO: 34993 - DNA, 20 bp, Artificial Sequence
  chemically synthesized
aaagatacggagaagaagtg

SEQ ID NO: 34994 - DNA, 20 bp, Artificial Sequence
  chemically synthesized
aagatacggagaagaagtga

SEQ ID NO: 34995 - DNA, 20 bp, Artificial Sequence
  chemically synthesized
gaagaagtgaaggatctcaa

SEQ ID NO: 34996 - DNA, 20 bp, Artificial Sequence
  chemically synthesized
tgaaggatctcaatagtcca

SEQ ID NO: 34997 - DNA, 20 bp, Artificial Sequence
  chemically synthesized
atctcaatagtccacagctt

SEQ ID NO: 34998 - DNA, 20 bp, Artificial Sequence
  chemically synthesized
cacagctttggatgtgtgca

SEQ ID NO: 34999 - DNA, 20 bp, Artificial Sequence
  chemically synthesized
ttggatgtgtgcacagattt

SEQ ID NO: 35000 - DNA, 20 bp, Artificial Sequence
  chemically synthesized
tgtgcacagatttcagtctg

SEQ ID NO: 35001 - DNA, 20 bp, Artificial Sequence
  chemically synthesized
agatttcagtctgaagttga

SEQ ID NO: 35002 - DNA, 20 bp, Artificial Sequence
  chemically synthesized
tgaagttgatagaacttcaa

SEQ ID NO: 35003 - DNA, 20 bp, Artificial Sequence
  chemically synthesized
agaacttcaaaagcaattcc

SEQ ID NO: 35004 - DNA, 20 bp, Artificial Sequence
  chemically synthesized
gtgctaccaaccaactacct

SEQ ID NO: 35005 - DNA, 20 bp, Artificial Sequence
  chemically synthesized
tacctaagaccttctgtact

SEQ ID NO: 35006 - DNA, 20 bp, Artificial Sequence
  chemically synthesized
atgtcttctttcctttctaa

SEQ ID NO: 35007 - DNA, 20 bp, Artificial Sequence
  chemically synthesized
tttcctttctaaaagatgaa

SEQ ID NO: 35008 - DNA, 20 bp, Artificial Sequence
  chemically synthesized
ttcctttctaaaagatgaac

SEQ ID NO: 35009 - DNA, 20 bp, Artificial Sequence
  chemically synthesized
ctttctaaaagatgaacagg

SEQ ID NO: 35010 - DNA, 20 bp, Artificial Sequence
  chemically synthesized
tttctaaaagatgaacagga

SEQ ID NO: 35011 - DNA, 20 bp, Artificial Sequence
  chemically synthesized
tacattttactttttaaaca

SEQ ID NO: 35012 - DNA, 20 bp, Artificial Sequence
  chemically synthesized
attttactttttaaacaaag

SEQ ID NO: 35013 - DNA, 20 bp, Artificial Sequence
  chemically synthesized
tttactttttaaacaaagca

SEQ ID NO: 35014 - DNA, 20 bp, Artificial Sequence
  chemically synthesized
aacaaagcagagaaaaatta

SEQ ID NO: 35015 - DNA, 20 bp, Artificial Sequence
  chemically synthesized
aaaattatggctgtaaatgt

SEQ ID NO: 35016 - DNA, 20 bp, Artificial Sequence
  chemically synthesized
attatggctgtaaatgttag

SEQ ID NO: 35017 - DNA, 20 bp, Artificial Sequence
  chemically synthesized
tagaagtttatctgattttc

SEQ ID NO: 35018 - DNA, 20 bp, Artificial Sequence
  chemically synthesized
agaagtttatctgattttct

SEQ ID NO: 35019 - DNA, 20 bp, Artificial Sequence
  chemically synthesized
attttctaggtgttccatta

SEQ ID NO: 35020 - DNA, 20 bp, Artificial Sequence
  chemically synthesized
aatcttcttgcttctatcct

SEQ ID NO: 35021 - DNA, 20 bp, Artificial Sequence
  chemically synthesized
ttccctatattttttttcct

SEQ ID NO: 35022 - DNA, 20 bp, Artificial Sequence
  chemically synthesized
tctctcattgtctttcttct

SEQ ID NO: 35023 - DNA, 20 bp, Artificial Sequence
  chemically synthesized
tgtctttcttctcagaaacc

SEQ ID NO: 35024 - DNA, 20 bp, Artificial Sequence
  chemically synthesized
tctttcttctcagaaaccaa

SEQ ID NO: 35025 - DNA, 20 bp, Artificial Sequence
  chemically synthesized
cagaaaccaagagccacgac

SEQ ID NO: 35026 - DNA, 20 bp, Artificial Sequence
  chemically synthesized
accaagagccacgactagct

SEQ ID NO: 35027 - DNA, 20 bp, Artificial Sequence
  chemically synthesized
ccaagagccacgactagctg

SEQ ID NO: 35028 - DNA, 20 bp, Artificial Sequence
  chemically synthesized
ccacgactagctgaggacac

SEQ ID NO: 35029 - DNA, 20 bp, Artificial Sequence
  chemically synthesized
acaagaattttcacaaaaca

SEQ ID NO: 35030 - DNA, 20 bp, Artificial Sequence
  chemically synthesized
agaattttcacaaaacaaag

SEQ ID NO: 35031 - DNA, 20 bp, Artificial Sequence
  chemically synthesized
aattttcacaaaacaaagta

SEQ ID NO: 35032 - DNA, 20 bp, Artificial Sequence
  chemically synthesized
aacaaagtagagtgattcca

SEQ ID NO: 35033 - DNA, 20 bp, Artificial Sequence
  chemically synthesized
gattccatagatcactatta

SEQ ID NO: 35034 - DNA, 20 bp, Artificial Sequence
  chemically synthesized
cactattatagctgcattac

SEQ ID NO: 35035 - DNA, 20 bp, Artificial Sequence
  chemically synthesized
actattatagctgcattacc

SEQ ID NO: 35036 - DNA, 20 bp, Artificial Sequence
  chemically synthesized
cattaccaggtatgtctgca

SEQ ID NO: 35037 - DNA, 20 bp, Artificial Sequence
  chemically synthesized
gtatgtctgcatggaattct

SEQ ID NO: 35038 - DNA, 20 bp, Artificial Sequence
  chemically synthesized
tatgtctgcatggaattctt

SEQ ID NO: 35039 - DNA, 20 bp, Artificial Sequence
  chemically synthesized
ctgcatggaattcttgggaa

SEQ ID NO: 35040 - DNA, 20 bp, Artificial Sequence
  chemically synthesized
gcatggaattcttgggaatg

SEQ ID NO: 35041 - DNA, 20 bp, Artificial Sequence
  chemically synthesized
tggaattcttgggaatggag

SEQ ID NO: 35042 - DNA, 20 bp, Artificial Sequence
  chemically synthesized
ggaattcttgggaatggaga

SEQ ID NO: 35043 - DNA, 20 bp, Artificial Sequence
  chemically synthesized
aattcttgggaatggagaag

SEQ ID NO: 35044 - DNA, 20 bp, Artificial Sequence
  chemically synthesized
attcttgggaatggagaagg

SEQ ID NO: 35045 - DNA, 20 bp, Artificial Sequence
  chemically synthesized
atggagaaggaggaaacttt

SEQ ID NO: 35046 - DNA, 20 bp, Artificial Sequence
  chemically synthesized
aaggaggaaactttaagttg

SEQ ID NO: 35047 - DNA, 20 bp, Artificial Sequence
  chemically synthesized
aggaggaaactttaagttgc

SEQ ID NO: 35048 - DNA, 20 bp, Artificial Sequence
  chemically synthesized
tttaagttgcaggttattat

SEQ ID NO: 35049 - DNA, 20 bp, Artificial Sequence
  chemically synthesized
aaaatacaatcattgcctta

SEQ ID NO: 35050 - DNA, 20 bp, Artificial Sequence
  chemically synthesized
acaatcattgccttacagtt

SEQ ID NO: 35051 - DNA, 20 bp, Artificial Sequence
  chemically synthesized
tcattgccttacagtttggt

SEQ ID NO: 35052 - DNA, 20 bp, Artificial Sequence
  chemically synthesized
agtttggttagctttccctg

SEQ ID NO: 35053 - DNA, 20 bp, Artificial Sequence
  chemically synthesized
tgtgctgcatattctctgat

SEQ ID NO: 35054 - DNA, 20 bp, Artificial Sequence
  chemically synthesized
gctgcatattctctgataag

SEQ ID NO: 35055 - DNA, 20 bp, Artificial Sequence
  chemically synthesized
ctgcatattctctgataaga

SEQ ID NO: 35056 - DNA, 20 bp, Artificial Sequence
  chemically synthesized
ataagaaggaatttttcaca

SEQ ID NO: 35057 - DNA, 20 bp, Artificial Sequence
  chemically synthesized
aaggaatttttcacaaagtt

SEQ ID NO: 35058 - DNA, 20 bp, Artificial Sequence
  chemically synthesized
tttttcacaaagttgagata

SEQ ID NO: 35059 - DNA, 20 bp, Artificial Sequence
  chemically synthesized
acaaagttgagatacagtga

SEQ ID NO: 35060 - DNA, 20 bp, Artificial Sequence
  chemically synthesized
gttgagatacagtgaaagat

SEQ ID NO: 35061 - DNA, 20 bp, Artificial Sequence
  chemically synthesized
ttgagatacagtgaaagatt

SEQ ID NO: 35062 - DNA, 20 bp, Artificial Sequence
  chemically synthesized
tacagtgaaagattaggtta

SEQ ID NO: 35063 - DNA, 20 bp, Artificial Sequence
  chemically synthesized
acagtgaaagattaggttaa

SEQ ID NO: 35064 - DNA, 20 bp, Artificial Sequence
  chemically synthesized
agtgaaagattaggttaaag

SEQ ID NO: 35065 - DNA, 20 bp, Artificial Sequence
  chemically synthesized
ggagattattgctgaaacgt

SEQ ID NO: 35066 - DNA, 20 bp, Artificial Sequence
  chemically synthesized
agattattgctgaaacgtca

SEQ ID NO: 35067 - DNA, 20 bp, Artificial Sequence
  chemically synthesized
ttattgctgaaacgtcagag

SEQ ID NO: 35068 - DNA, 20 bp, Artificial Sequence
  chemically synthesized
tgctgaaacgtcagagaagt

SEQ ID NO: 35069 - DNA, 20 bp, Artificial Sequence
  chemically synthesized
ctgaaacgtcagagaagtaa

SEQ ID NO: 35070 - DNA, 20 bp, Artificial Sequence
  chemically synthesized
cagagaagtaagagtgttga

SEQ ID NO: 35071 - DNA, 20 bp, Artificial Sequence
  chemically synthesized
gagaagtaagagtgttgaca

SEQ ID NO: 35072 - DNA, 20 bp, Artificial Sequence
  chemically synthesized
agagtgttgacagagaaatg

SEQ ID NO: 35073 - DNA, 20 bp, Artificial Sequence
  chemically synthesized
tgacagagaaatgaagtaca

SEQ ID NO: 35074 - DNA, 20 bp, Artificial Sequence
  chemically synthesized
gaaatgaagtacatagaaca

SEQ ID NO: 35075 - DNA, 20 bp, Artificial Sequence
  chemically synthesized
atgaagtacatagaacacag

SEQ ID NO: 35076 - DNA, 20 bp, Artificial Sequence
  chemically synthesized
tgaagtacatagaacacaga

SEQ ID NO: 35077 - DNA, 20 bp, Artificial Sequence
  chemically synthesized
gaagtacatagaacacagaa

SEQ ID NO: 35078 - DNA, 20 bp, Artificial Sequence
  chemically synthesized
aagtacatagaacacagaag

SEQ ID NO: 35079 - DNA, 20 bp, Artificial Sequence
  chemically synthesized
gtacatagaacacagaaggg

SEQ ID NO: 35080 - DNA, 20 bp, Artificial Sequence
  chemically synthesized
tacatagaacacagaagggg

SEQ ID NO: 35081 - DNA, 20 bp, Artificial Sequence
  chemically synthesized
catagaacacagaaggggag

SEQ ID NO: 35082 - DNA, 20 bp, Artificial Sequence
  chemically synthesized
aacacagaaggggaggagct

SEQ ID NO: 35083 - DNA, 20 bp, Artificial Sequence
  chemically synthesized
cagaaggggaggagctaagc

SEQ ID NO: 35084 - DNA, 20 bp, Artificial Sequence
  chemically synthesized
agctggattatctttgcgtc

SEQ ID NO: 35085 - DNA, 20 bp, Artificial Sequence
  chemically synthesized
atctttgcgtctagtaactg

SEQ ID NO: 35086 - DNA, 20 bp, Artificial Sequence
  chemically synthesized
tacatcactcattgtatgtt

SEQ ID NO: 35087 - DNA, 20 bp, Artificial Sequence
  chemically synthesized
atcactcattgtatgttcag

SEQ ID NO: 35088 - DNA, 20 bp, Artificial Sequence
  chemically synthesized
tcactcattgtatgttcagt

SEQ ID NO: 35089 - DNA, 20 bp, Artificial Sequence
  chemically synthesized
gttcagtaggcactgaattc

SEQ ID NO: 35090 - DNA, 20 bp, Artificial Sequence
  chemically synthesized
gaattctggtttatgtctct

SEQ ID NO: 35091 - DNA, 20 bp, Artificial Sequence
  chemically synthesized
tggtttatgtctctcagtcc

SEQ ID NO: 35092 - DNA, 20 bp, Artificial Sequence
  chemically synthesized
ggtttatgtctctcagtcct

SEQ ID NO: 35093 - DNA, 20 bp, Artificial Sequence
  chemically synthesized
tatgtctctcagtcctagga

SEQ ID NO: 35094 - DNA, 20 bp, Artificial Sequence
  chemically synthesized
ctcagtcctaggacagaata

SEQ ID NO: 35095 - DNA, 20 bp, Artificial Sequence
  chemically synthesized
gctgaaaaatgattctttca

SEQ ID NO: 35096 - DNA, 20 bp, Artificial Sequence
  chemically synthesized
aatgattctttcaaagtgct

SEQ ID NO: 35097 - DNA, 20 bp, Artificial Sequence
  chemically synthesized
ctgagttgttgcctcacgcc

SEQ ID NO: 35098 - DNA, 20 bp, Artificial Sequence
  chemically synthesized
ttgcctcacgcccagttgtc

SEQ ID NO: 35099 - DNA, 20 bp, Artificial Sequence
  chemically synthesized
tctcttcactgaaactatta

SEQ ID NO: 35100 - DNA, 20 bp, Artificial Sequence
  chemically synthesized
ttcactgaaactattacagt

SEQ ID NO: 35101 - DNA, 20 bp, Artificial Sequence
  chemically synthesized
acagttagatctcatctcta

SEQ ID NO: 35102 - DNA, 20 bp, Artificial Sequence
  chemically synthesized
cagttagatctcatctctat

SEQ ID NO: 35103 - DNA, 20 bp, Artificial Sequence
  chemically synthesized
ttagatctcatctctatggg

SEQ ID NO: 35104 - DNA, 20 bp, Artificial Sequence
  chemically synthesized
gatctcatctctatgggtgg

SEQ ID NO: 35105 - DNA, 20 bp, Artificial Sequence
  chemically synthesized
atctcatctctatgggtgga

SEQ ID NO: 35106 - DNA, 20 bp, Artificial Sequence
  chemically synthesized
catctctatgggtggaaggt

SEQ ID NO: 35107 - DNA, 20 bp, Artificial Sequence
  chemically synthesized
tctctatgggtggaaggtaa

SEQ ID NO: 35108 - DNA, 20 bp, Artificial Sequence
  chemically synthesized
ctctatgggtggaaggtaag

SEQ ID NO: 35109 - DNA, 20 bp, Artificial Sequence
  chemically synthesized
ggtaagaggatcgtttcctt

SEQ ID NO: 35110 - DNA, 20 bp, Artificial Sequence
  chemically synthesized
aagaggatcgtttcctttgg

SEQ ID NO: 35111 - DNA, 20 bp, Artificial Sequence
  chemically synthesized
gtttcctttggtggcatctt

SEQ ID NO: 35112 - DNA, 20 bp, Artificial Sequence
  chemically synthesized
tttcctttggtggcatcttt

SEQ ID NO: 35113 - DNA, 20 bp, Artificial Sequence
  chemically synthesized
ttcctttggtggcatcttta

SEQ ID NO: 35114 - DNA, 20 bp, Artificial Sequence
  chemically synthesized
ctttggtggcatctttaggg

SEQ ID NO: 35115 - DNA, 20 bp, Artificial Sequence
  chemically synthesized
ggtagtgccttacactgaca

SEQ ID NO: 35116 - DNA, 20 bp, Artificial Sequence
  chemically synthesized
acactgacaaagtaactctg

SEQ ID NO: 35117 - DNA, 20 bp, Artificial Sequence
  chemically synthesized
cactgacaaagtaactctga

SEQ ID NO: 35118 - DNA, 20 bp, Artificial Sequence
  chemically synthesized
actgacaaagtaactctgaa

SEQ ID NO: 35119 - DNA, 20 bp, Artificial Sequence
  chemically synthesized
ctgacaaagtaactctgaag

SEQ ID NO: 35120 - DNA, 20 bp, Artificial Sequence
  chemically synthesized
taactctgaaggggtatatt

SEQ ID NO: 35121 - DNA, 20 bp, Artificial Sequence
  chemically synthesized
atacgaccatctttttaact

SEQ ID NO: 35122 - DNA, 20 bp, Artificial Sequence
  chemically synthesized
tacgaccatctttttaactt

SEQ ID NO: 35123 - DNA, 20 bp, Artificial Sequence
  chemically synthesized
cttaggataaaaacaacttc

SEQ ID NO: 35124 - DNA, 20 bp, Artificial Sequence
  chemically synthesized
aggataaaaacaacttcaag

SEQ ID NO: 35125 - DNA, 20 bp, Artificial Sequence
  chemically synthesized
acaacttcaagaagttgttc

SEQ ID NO: 35126 - DNA, 20 bp, Artificial Sequence
  chemically synthesized
aagttgttctggcatgtgac

SEQ ID NO: 35127 - DNA, 20 bp, Artificial Sequence
  chemically synthesized
tggcatgtgacaagaaaaaa

SEQ ID NO: 35128 - DNA, 20 bp, Artificial Sequence
  chemically synthesized
atgtgacaagaaaaaaaagc

SEQ ID NO: 35129 - DNA, 20 bp, Artificial Sequence
  chemically synthesized
tgtgacaagaaaaaaaagca

SEQ ID NO: 35130 - DNA, 20 bp, Artificial Sequence
  chemically synthesized
gtgacaagaaaaaaaagcaa

SEQ ID NO: 35131 - DNA, 20 bp, Artificial Sequence
  chemically synthesized
gggatgcatttgctctaatt

SEQ ID NO: 35132 - DNA, 20 bp, Artificial Sequence
  chemically synthesized
atgactcttgatttcctcac

SEQ ID NO: 35133 - DNA, 20 bp, Artificial Sequence
  chemically synthesized
aagtgaatatgtatccccct

SEQ ID NO: 35134 - DNA, 20 bp, Artificial Sequence
  chemically synthesized
ccccctcagacttccatttt

SEQ ID NO: 35135 - DNA, 20 bp, Artificial Sequence
  chemically synthesized
agacttccattttgagtaaa

SEQ ID NO: 35136 - DNA, 20 bp, Artificial Sequence
  chemically synthesized
cattctttcatttgttcaaa

SEQ ID NO: 35137 - DNA, 20 bp, Artificial Sequence
  chemically synthesized
catttgttcaaacagaaatc

SEQ ID NO: 35138 - DNA, 20 bp, Artificial Sequence
  chemically synthesized
atttgttcaaacagaaatct

SEQ ID NO: 35139 - DNA, 20 bp, Artificial Sequence
  chemically synthesized
tttgttcaaacagaaatcta

SEQ ID NO: 35140 - DNA, 20 bp, Artificial Sequence
  chemically synthesized
ttgttcaaacagaaatctag

SEQ ID NO: 35141 - DNA, 20 bp, Artificial Sequence
  chemically synthesized
cactcccatttttaatatat

SEQ ID NO: 35142 - DNA, 20 bp, Artificial Sequence
  chemically synthesized
tttaatatatcagcaaatct

SEQ ID NO: 35143 - DNA, 20 bp, Artificial Sequence
  chemically synthesized
aaatgcatctgtctctgttt

SEQ ID NO: 35144 - DNA, 20 bp, Artificial Sequence
  chemically synthesized
catttcccctgcttctctcc

SEQ ID NO: 35145 - DNA, 20 bp, Artificial Sequence
  chemically synthesized
cccctgcttctctcctagtc

SEQ ID NO: 35146 - DNA, 20 bp, Artificial Sequence
  chemically synthesized
ccctgcttctctcctagtca

SEQ ID NO: 35147 - DNA, 20 bp, Artificial Sequence
  chemically synthesized
ggtcaccatgactcttcata

SEQ ID NO: 35148 - DNA, 20 bp, Artificial Sequence
  chemically synthesized
cttcatatggatttttaaaa

SEQ ID NO: 35149 - DNA, 20 bp, Artificial Sequence
  chemically synthesized
ctcttttcttgtctcttgct

SEQ ID NO: 35150 - DNA, 20 bp, Artificial Sequence
  chemically synthesized
cttgcttagtcttcttcaca

SEQ ID NO: 35151 - DNA, 20 bp, Artificial Sequence
  chemically synthesized
gcttagtcttcttcacatag

SEQ ID NO: 35152 - DNA, 20 bp, Artificial Sequence
  chemically synthesized
tcttcttcacatagcagtct

SEQ ID NO: 35153 - DNA, 20 bp, Artificial Sequence
  chemically synthesized
cttcacatagcagtctaagt

SEQ ID NO: 35154 - DNA, 20 bp, Artificial Sequence
  chemically synthesized
agtaatttaaaaatacaaat

SEQ ID NO: 35155 - DNA, 20 bp, Artificial Sequence
  chemically synthesized
attttccattgtgattttca

SEQ ID NO: 35156 - DNA, 20 bp, Artificial Sequence
  chemically synthesized
taatgtctttactacattta

SEQ ID NO: 35157 - DNA, 20 bp, Artificial Sequence
  chemically synthesized
gtctttactacatttatagt

SEQ ID NO: 35158 - DNA, 20 bp, Artificial Sequence
  chemically synthesized
tttactacatttatagtaag

SEQ ID NO: 35159 - DNA, 20 bp, Artificial Sequence
  chemically synthesized
aaaacaaaacaaaaattccg

SEQ ID NO: 35160 - DNA, 20 bp, Artificial Sequence
  chemically synthesized
acaaaacaaaaattccgtgg

SEQ ID NO: 35161 - DNA, 20 bp, Artificial Sequence
  chemically synthesized
aaaattccgtggtggtctgt

SEQ ID NO: 35162 - DNA, 20 bp, Artificial Sequence
  chemically synthesized
aaattccgtggtggtctgta

SEQ ID NO: 35163 - DNA, 20 bp, Artificial Sequence
  chemically synthesized
cctgttttcttatcaaatgc

SEQ ID NO: 35164 - DNA, 20 bp, Artificial Sequence
  chemically synthesized
agtcatgctgattttccctc

SEQ ID NO: 35165 - DNA, 20 bp, Artificial Sequence
  chemically synthesized
tgctgattttccctctggaa

SEQ ID NO: 35166 - DNA, 20 bp, Artificial Sequence
  chemically synthesized
cctctggaacagttttcctc

SEQ ID NO: 35167 - DNA, 20 bp, Artificial Sequence
  chemically synthesized
ctctggaacagttttcctct

SEQ ID NO: 35168 - DNA, 20 bp, Artificial Sequence
  chemically synthesized
ttttcctctaggtctgtata

SEQ ID NO: 35169 - DNA, 20 bp, Artificial Sequence
  chemically synthesized
cctctaggtctgtatacggt

SEQ ID NO: 35170 - DNA, 20 bp, Artificial Sequence
  chemically synthesized
ctctaggtctgtatacggtc

SEQ ID NO: 35171 - DNA, 20 bp, Artificial Sequence
  chemically synthesized
gtcaggttttcttttgtatt

SEQ ID NO: 35172 - DNA, 20 bp, Artificial Sequence
  chemically synthesized
tcaggttttcttttgtattg

SEQ ID NO: 35173 - DNA, 20 bp, Artificial Sequence
  chemically synthesized
tttcttttgtattgaggtct

SEQ ID NO: 35174 - DNA, 20 bp, Artificial Sequence
  chemically synthesized
tattgaggtctcagttcaaa

SEQ ID NO: 35175 - DNA, 20 bp, Artificial Sequence
  chemically synthesized
attgaggtctcagttcaaat

SEQ ID NO: 35176 - DNA, 20 bp, Artificial Sequence
  chemically synthesized
gttcaaatgggacctcctca

SEQ ID NO: 35177 - DNA, 20 bp, Artificial Sequence
  chemically synthesized
ttcaaatgggacctcctcat

SEQ ID NO: 35178 - DNA, 20 bp, Artificial Sequence
  chemically synthesized
atgggacctcctcataggtg

SEQ ID NO: 35179 - DNA, 20 bp, Artificial Sequence
  chemically synthesized
cctcctcataggtgcagttc

SEQ ID NO: 35180 - DNA, 20 bp, Artificial Sequence
  chemically synthesized
ctcctcataggtgcagttct

SEQ ID NO: 35181 - DNA, 20 bp, Artificial Sequence
  chemically synthesized
ccatccaattaatctacatc

SEQ ID NO: 35182 - DNA, 20 bp, Artificial Sequence
  chemically synthesized
tccaattaatctacatcaag

SEQ ID NO: 35183 - DNA, 20 bp, Artificial Sequence
  chemically synthesized
ttatttttcaacttaattta

SEQ ID NO: 35184 - DNA, 20 bp, Artificial Sequence
  chemically synthesized
caacttaatttatggtttat

SEQ ID NO: 35185 - DNA, 20 bp, Artificial Sequence
  chemically synthesized
taatttatggtttataagat

SEQ ID NO: 35186 - DNA, 20 bp, Artificial Sequence
  chemically synthesized
aatttatggtttataagatt

SEQ ID NO: 35187 - DNA, 20 bp, Artificial Sequence
  chemically synthesized
atttatggtttataagatta

SEQ ID NO: 35188 - DNA, 20 bp, Artificial Sequence
  chemically synthesized
gtcttattaccatttaattc

SEQ ID NO: 35189 - DNA, 20 bp, Artificial Sequence
  chemically synthesized
cttattaccatttaattcca

SEQ ID NO: 35190 - DNA, 20 bp, Artificial Sequence
  chemically synthesized
tattaccatttaattccaga

SEQ ID NO: 35191 - DNA, 20 bp, Artificial Sequence
  chemically synthesized
ccagagagctttaaatatca

SEQ ID NO: 35192 - DNA, 20 bp, Artificial Sequence
  chemically synthesized
tgatgcgtgttcacaaatat

SEQ ID NO: 35193 - DNA, 20 bp, Artificial Sequence
  chemically synthesized
gatgcgtgttcacaaatatt

SEQ ID NO: 35194 - DNA, 20 bp, Artificial Sequence
  chemically synthesized
tcacaaatattaggtgaact

SEQ ID NO: 35195 - DNA, 20 bp, Artificial Sequence
  chemically synthesized
gtgaactaagaaatgtttat

SEQ ID NO: 35196 - DNA, 20 bp, Artificial Sequence
  chemically synthesized
aatgtttatcagtcacatgt

SEQ ID NO: 35197 - DNA, 20 bp, Artificial Sequence
  chemically synthesized
tcacatgttagatactttgc

SEQ ID NO: 35198 - DNA, 20 bp, Artificial Sequence
  chemically synthesized
cacatgttagatactttgca

SEQ ID NO: 35199 - DNA, 20 bp, Artificial Sequence
  chemically synthesized
tagatactttgcaaggtgtt

SEQ ID NO: 35200 - DNA, 20 bp, Artificial Sequence
  chemically synthesized
actttgcaaggtgttgagca

SEQ ID NO: 35201 - DNA, 20 bp, Artificial Sequence
  chemically synthesized
taaacaccatgtctatatgc

SEQ ID NO: 35202 - DNA, 20 bp, Artificial Sequence
  chemically synthesized
acaccatgtctatatgcaag

SEQ ID NO: 35203 - DNA, 20 bp, Artificial Sequence
  chemically synthesized
gtctatatgcaagaagcccc

SEQ ID NO: 35204 - DNA, 20 bp, Artificial Sequence
  chemically synthesized
tatgcaagaagcccctagtc

SEQ ID NO: 35205 - DNA, 20 bp, Artificial Sequence
  chemically synthesized
gcaagaagcccctagtctag

SEQ ID NO: 35206 - DNA, 20 bp, Artificial Sequence
  chemically synthesized
agaagcccctagtctagtgg

SEQ ID NO: 35207 - DNA, 20 bp, Artificial Sequence
  chemically synthesized
agcccctagtctagtggcag

SEQ ID NO: 35208 - DNA, 20 bp, Artificial Sequence
  chemically synthesized
gcccctagtctagtggcaga

SEQ ID NO: 35209 - DNA, 20 bp, Artificial Sequence
  chemically synthesized
ggaatattaaaaccttctca

SEQ ID NO: 35210 - DNA, 20 bp, Artificial Sequence
  chemically synthesized
gaatattaaaaccttctcaa

SEQ ID NO: 35211 - DNA, 20 bp, Artificial Sequence
  chemically synthesized
aaggactaatctcttctctt

SEQ ID NO: 35212 - DNA, 20 bp, Artificial Sequence
  chemically synthesized
taatctcttctcttcagtaa

SEQ ID NO: 35213 - DNA, 20 bp, Artificial Sequence
  chemically synthesized
ctcttctcttcagtaaaaga

SEQ ID NO: 35214 - DNA, 20 bp, Artificial Sequence
  chemically synthesized
taaaagacagcaccacgttt

SEQ ID NO: 35215 - DNA, 20 bp, Artificial Sequence
  chemically synthesized
aagacagcaccacgtttaag

SEQ ID NO: 35216 - DNA, 20 bp, Artificial Sequence
  chemically synthesized
agacagcaccacgtttaagc

SEQ ID NO: 35217 - DNA, 20 bp, Artificial Sequence
  chemically synthesized
gacagcaccacgtttaagca

SEQ ID NO: 35218 - DNA, 20 bp, Artificial Sequence
  chemically synthesized
accacgtttaagcagggaaa

SEQ ID NO: 35219 - DNA, 20 bp, Artificial Sequence
  chemically synthesized
gcagggaaatagctctcact

SEQ ID NO: 35220 - DNA, 20 bp, Artificial Sequence
  chemically synthesized
aaatagctctcactcagtat

SEQ ID NO: 35221 - DNA, 20 bp, Artificial Sequence
  chemically synthesized
aatagctctcactcagtatt

SEQ ID NO: 35222 - DNA, 20 bp, Artificial Sequence
  chemically synthesized
atagctctcactcagtattg

SEQ ID NO: 35223 - DNA, 20 bp, Artificial Sequence
  chemically synthesized
agctctcactcagtattggg

SEQ ID NO: 35224 - DNA, 20 bp, Artificial Sequence
  chemically synthesized
tcactcagtattggggagaa

SEQ ID NO: 35225 - DNA, 20 bp, Artificial Sequence
  chemically synthesized
agtattggggagaacagatt

SEQ ID NO: 35226 - DNA, 20 bp, Artificial Sequence
  chemically synthesized
attggggagaacagattcag

SEQ ID NO: 35227 - DNA, 20 bp, Artificial Sequence
  chemically synthesized
agaacagattcagaagccta

SEQ ID NO: 35228 - DNA, 20 bp, Artificial Sequence
  chemically synthesized
cagattcagaagcctatggc

SEQ ID NO: 35229 - DNA, 20 bp, Artificial Sequence
  chemically synthesized
agattcagaagcctatggct

SEQ ID NO: 35230 - DNA, 20 bp, Artificial Sequence
  chemically synthesized
gattcagaagcctatggctg

SEQ ID NO: 35231 - DNA, 20 bp, Artificial Sequence
  chemically synthesized
gaagcctatggctggggata

SEQ ID NO: 35232 - DNA, 20 bp, Artificial Sequence
  chemically synthesized
aagcctatggctggggataa

SEQ ID NO: 35233 - DNA, 20 bp, Artificial Sequence
  chemically synthesized
agcctatggctggggataaa

SEQ ID NO: 35234 - DNA, 20 bp, Artificial Sequence
  chemically synthesized
ctatggctggggataaaggg

SEQ ID NO: 35235 - DNA, 20 bp, Artificial Sequence
  chemically synthesized
tatggctggggataaaggga

SEQ ID NO: 35236 - DNA, 20 bp, Artificial Sequence
  chemically synthesized
ggggataaagggaaggaaac

SEQ ID NO: 35237 - DNA, 20 bp, Artificial Sequence
  chemically synthesized
gggataaagggaaggaaacc

SEQ ID NO: 35238 - DNA, 20 bp, Artificial Sequence
  chemically synthesized
ataaagggaaggaaaccagg

SEQ ID NO: 35239 - DNA, 20 bp, Artificial Sequence
  chemically synthesized
agggaaggaaaccaggaaga

SEQ ID NO: 35240 - DNA, 20 bp, Artificial Sequence
  chemically synthesized
gatggatgtttaaatataaa

SEQ ID NO: 35241 - DNA, 20 bp, Artificial Sequence
  chemically synthesized
tggatgtttaaatataaatg

SEQ ID NO: 35242 - DNA, 20 bp, Artificial Sequence
  chemically synthesized
ataaatggagaacttgaaat

SEQ ID NO: 35243 - DNA, 20 bp, Artificial Sequence
  chemically synthesized
aaatggagaacttgaaatga

SEQ ID NO: 35244 - DNA, 20 bp, Artificial Sequence
  chemically synthesized
atggagaacttgaaatgaga

SEQ ID NO: 35245 - DNA, 20 bp, Artificial Sequence
  chemically synthesized
tggagaacttgaaatgagag

SEQ ID NO: 35246 - DNA, 20 bp, Artificial Sequence
  chemically synthesized
gaacttgaaatgagagaggt

SEQ ID NO: 35247 - DNA, 20 bp, Artificial Sequence
  chemically synthesized
aaatgagagaggtcagattc

SEQ ID NO: 35248 - DNA, 20 bp, Artificial Sequence
  chemically synthesized
aatgagagaggtcagattct

SEQ ID NO: 35249 - DNA, 20 bp, Artificial Sequence
  chemically synthesized
atgagagaggtcagattcta

SEQ ID NO: 35250 - DNA, 20 bp, Artificial Sequence
  chemically synthesized
cagattctagggaattactt

SEQ ID NO: 35251 - DNA, 20 bp, Artificial Sequence
  chemically synthesized
attctagggaattacttcag

SEQ ID NO: 35252 - DNA, 20 bp, Artificial Sequence
  chemically synthesized
ttctagggaattacttcagt

SEQ ID NO: 35253 - DNA, 20 bp, Artificial Sequence
  chemically synthesized
gaattacttcagtaggccta

SEQ ID NO: 35254 - DNA, 20 bp, Artificial Sequence
  chemically synthesized
ctatagaaaaataatttaaa

SEQ ID NO: 35255 - DNA, 20 bp, Artificial Sequence
  chemically synthesized
aaaaataatttaaaaagaaa

SEQ ID NO: 35256 - DNA, 20 bp, Artificial Sequence
  chemically synthesized
aaaagacactacttgtaaat

SEQ ID NO: 35257 - DNA, 20 bp, Artificial Sequence
  chemically synthesized
cactacttgtaaataagaaa

SEQ ID NO: 35258 - DNA, 20 bp, Artificial Sequence
  chemically synthesized
acttgtaaataagaaacagt

SEQ ID NO: 35259 - DNA, 20 bp, Artificial Sequence
  chemically synthesized
acagtaagatgtttaaactg

SEQ ID NO: 35260 - DNA, 20 bp, Artificial Sequence
  chemically synthesized
cagtaagatgtttaaactga

SEQ ID NO: 35261 - DNA, 20 bp, Artificial Sequence
  chemically synthesized
gtaagatgtttaaactgaag

SEQ ID NO: 35262 - DNA, 20 bp, Artificial Sequence
  chemically synthesized
tgaaggagatacactattat

SEQ ID NO: 35263 - DNA, 20 bp, Artificial Sequence
  chemically synthesized
actattataagtgatgtctt

SEQ ID NO: 35264 - DNA, 20 bp, Artificial Sequence
  chemically synthesized
ttataagtgatgtctttggc

SEQ ID NO: 35265 - DNA, 20 bp, Artificial Sequence
  chemically synthesized
gctggcctaatcatttattc

SEQ ID NO: 35266 - DNA, 20 bp, Artificial Sequence
  chemically synthesized
aatcatttattccagcccca

SEQ ID NO: 35267 - DNA, 20 bp, Artificial Sequence
  chemically synthesized
cccaaagtctaacttataat

SEQ ID NO: 35268 - DNA, 20 bp, Artificial Sequence
  chemically synthesized
gtctaacttataattagact

SEQ ID NO: 35269 - DNA, 20 bp, Artificial Sequence
  chemically synthesized
ttagactgagctattgtcac

SEQ ID NO: 35270 - DNA, 20 bp, Artificial Sequence
  chemically synthesized
gactgagctattgtcacaag

SEQ ID NO: 35271 - DNA, 20 bp, Artificial Sequence
  chemically synthesized
gagctattgtcacaagtagt

SEQ ID NO: 35272 - DNA, 20 bp, Artificial Sequence
  chemically synthesized
ctattgtcacaagtagtgag

SEQ ID NO: 35273 - DNA, 20 bp, Artificial Sequence
  chemically synthesized
acaagtagtgagtagtactg

SEQ ID NO: 35274 - DNA, 20 bp, Artificial Sequence
  chemically synthesized
caagtagtgagtagtactga

SEQ ID NO: 35275 - DNA, 20 bp, Artificial Sequence
  chemically synthesized
gtagtactgaaggattctac

SEQ ID NO: 35276 - DNA, 20 bp, Artificial Sequence
  chemically synthesized
agtactgaaggattctacaa

SEQ ID NO: 35277 - DNA, 20 bp, Artificial Sequence
  chemically synthesized
gtactgaaggattctacaag

SEQ ID NO: 35278 - DNA, 20 bp, Artificial Sequence
  chemically synthesized
tactgaaggattctacaaga

SEQ ID NO: 35279 - DNA, 20 bp, Artificial Sequence
  chemically synthesized
gaatgtctgttccccatcac

SEQ ID NO: 35280 - DNA, 20 bp, Artificial Sequence
  chemically synthesized
catcactagtccatgaaatc

SEQ ID NO: 35281 - DNA, 20 bp, Artificial Sequence
  chemically synthesized
tcactagtccatgaaatctg

SEQ ID NO: 35282 - DNA, 20 bp, Artificial Sequence
  chemically synthesized
cactagtccatgaaatctgg

SEQ ID NO: 35283 - DNA, 20 bp, Artificial Sequence
  chemically synthesized
gtccatgaaatctggaggcc

SEQ ID NO: 35284 - DNA, 20 bp, Artificial Sequence
  chemically synthesized
ttctcaatctgactgctcct

SEQ ID NO: 35285 - DNA, 20 bp, Artificial Sequence
  chemically synthesized
atctgactgctccttagcta

SEQ ID NO: 35286 - DNA, 20 bp, Artificial Sequence
  chemically synthesized
tgactgctccttagctacag

SEQ ID NO: 35287 - DNA, 20 bp, Artificial Sequence
  chemically synthesized
ctgctccttagctacagtgg

SEQ ID NO: 35288 - DNA, 20 bp, Artificial Sequence
  chemically synthesized
ctccttagctacagtggtag

SEQ ID NO: 35289 - DNA, 20 bp, Artificial Sequence
  chemically synthesized
cttagctacagtggtagtgg

SEQ ID NO: 35290 - DNA, 20 bp, Artificial Sequence
  chemically synthesized
tagctacagtggtagtggca

SEQ ID NO: 35291 - DNA, 20 bp, Artificial Sequence
  chemically synthesized
cttcccacacttttctttct

SEQ ID NO: 35292 - DNA, 20 bp, Artificial Sequence
  chemically synthesized
ttcccacacttttctttctt

SEQ ID NO: 35293 - DNA, 20 bp, Artificial Sequence
  chemically synthesized
cttttctttcttaggctgtt

SEQ ID NO: 35294 - DNA, 20 bp, Artificial Sequence
  chemically synthesized
ttcttaggctgttgagactt

SEQ ID NO: 35295 - DNA, 20 bp, Artificial Sequence
  chemically synthesized
tgagactttagctgataatt

SEQ ID NO: 35296 - DNA, 20 bp, Artificial Sequence
  chemically synthesized
gagactttagctgataattc

SEQ ID NO: 35297 - DNA, 20 bp, Artificial Sequence
  chemically synthesized
ctttagctgataattcaggt

SEQ ID NO: 35298 - DNA, 20 bp, Artificial Sequence
  chemically synthesized
ttcaggtaagtctttacatg

SEQ ID NO: 35299 - DNA, 20 bp, Artificial Sequence
  chemically synthesized
tcaggtaagtctttacatgc

SEQ ID NO: 35300 - DNA, 20 bp, Artificial Sequence
  chemically synthesized
tctttacatgcaggaaaatg

SEQ ID NO: 35301 - DNA, 20 bp, Artificial Sequence
  chemically synthesized
acatgcaggaaaatgtggat

SEQ ID NO: 35302 - DNA, 20 bp, Artificial Sequence
  chemically synthesized
catgcaggaaaatgtggatt

SEQ ID NO: 35303 - DNA, 20 bp, Artificial Sequence
  chemically synthesized
atgcaggaaaatgtggatta

SEQ ID NO: 35304 - DNA, 20 bp, Artificial Sequence
  chemically synthesized
gattagggatcactactgtg

SEQ ID NO: 35305 - DNA, 20 bp, Artificial Sequence
  chemically synthesized
attagggatcactactgtga

SEQ ID NO: 35306 - DNA, 20 bp, Artificial Sequence
  chemically synthesized
cactactgtgaaggcaatta

SEQ ID NO: 35307 - DNA, 20 bp, Artificial Sequence
  chemically synthesized
actactgtgaaggcaattac

SEQ ID NO: 35308 - DNA, 20 bp, Artificial Sequence
  chemically synthesized
tgtgaaggcaattacaggtt

SEQ ID NO: 35309 - DNA, 20 bp, Artificial Sequence
  chemically synthesized
gtgaaggcaattacaggttt

SEQ ID NO: 35310 - DNA, 20 bp, Artificial Sequence
  chemically synthesized
aaggcaattacaggtttagg

SEQ ID NO: 35311 - DNA, 20 bp, Artificial Sequence
  chemically synthesized
gcaattacaggtttaggtgg

SEQ ID NO: 35312 - DNA, 20 bp, Artificial Sequence
  chemically synthesized
tacaggtttaggtggtagac

SEQ ID NO: 35313 - DNA, 20 bp, Artificial Sequence
  chemically synthesized
gtggtagaccagaaaaaaat

SEQ ID NO: 35314 - DNA, 20 bp, Artificial Sequence
  chemically synthesized
gaccagaaaaaaattagtgt

SEQ ID NO: 35315 - DNA, 20 bp, Artificial Sequence
  chemically synthesized
aaaaattagtgttagctttc

SEQ ID NO: 35316 - DNA, 20 bp, Artificial Sequence
  chemically synthesized
aaatccccttgaatgcccca

SEQ ID NO: 35317 - DNA, 20 bp, Artificial Sequence
  chemically synthesized
cgaattctttaaaatctgca

SEQ ID NO: 35318 - DNA, 20 bp, Artificial Sequence
  chemically synthesized
tctttaaaatctgcatagtt

SEQ ID NO: 35319 - DNA, 20 bp, Artificial Sequence
  chemically synthesized
ctttaaaatctgcatagtta

SEQ ID NO: 35320 - DNA, 20 bp, Artificial Sequence
  chemically synthesized
tttaaaatctgcatagttaa

SEQ ID NO: 35321 - DNA, 20 bp, Artificial Sequence
  chemically synthesized
atctgcatagttaagggtaa

SEQ ID NO: 35322 - DNA, 20 bp, Artificial Sequence
  chemically synthesized
catagttaagggtaacagtt

SEQ ID NO: 35323 - DNA, 20 bp, Artificial Sequence
  chemically synthesized
agttaagggtaacagtttag

SEQ ID NO: 35324 - DNA, 20 bp, Artificial Sequence
  chemically synthesized
gggtaacagtttagaagttg

SEQ ID NO: 35325 - DNA, 20 bp, Artificial Sequence
  chemically synthesized
tttacataattttttttctg

SEQ ID NO: 35326 - DNA, 20 bp, Artificial Sequence
  chemically synthesized
tacataattttttttctgaa

SEQ ID NO: 35327 - DNA, 20 bp, Artificial Sequence
  chemically synthesized
aatgcttaaatgcatataaa

SEQ ID NO: 35328 - DNA, 20 bp, Artificial Sequence
  chemically synthesized
atataaacagttgaaactcc

SEQ ID NO: 35329 - DNA, 20 bp, Artificial Sequence
  chemically synthesized
actccaagaatttgattacg

SEQ ID NO: 35330 - DNA, 20 bp, Artificial Sequence
  chemically synthesized
ctccaagaatttgattacgt

SEQ ID NO: 35331 - DNA, 20 bp, Artificial Sequence
  chemically synthesized
caagaatttgattacgtagg

SEQ ID NO: 35332 - DNA, 20 bp, Artificial Sequence
  chemically synthesized
aagaatttgattacgtaggt

SEQ ID NO: 35333 - DNA, 20 bp, Artificial Sequence
  chemically synthesized
gaatttgattacgtaggtag

SEQ ID NO: 35334 - DNA, 20 bp, Artificial Sequence
  chemically synthesized
ttgattacgtaggtaggaga

SEQ ID NO: 35335 - DNA, 20 bp, Artificial Sequence
  chemically synthesized
cgtaggtaggagatagatcc

SEQ ID NO: 35336 - DNA, 20 bp, Artificial Sequence
  chemically synthesized
gagatagatcctggaatgtg

SEQ ID NO: 35337 - DNA, 20 bp, Artificial Sequence
  chemically synthesized
agatcctggaatgtgcagtt

SEQ ID NO: 35338 - DNA, 20 bp, Artificial Sequence
  chemically synthesized
tgtgcagttaagaatacaaa

SEQ ID NO: 35339 - DNA, 20 bp, Artificial Sequence
  chemically synthesized
gttaagaatacaaatagtat

SEQ ID NO: 35340 - DNA, 20 bp, Artificial Sequence
  chemically synthesized
caaatagtatgagtaaccct

SEQ ID NO: 35341 - DNA, 20 bp, Artificial Sequence
  chemically synthesized
taaccctgagaatgtatttt

SEQ ID NO: 35342 - DNA, 20 bp, Artificial Sequence
  chemically synthesized
attgatgtcattattatctt

SEQ ID NO: 35343 - DNA, 20 bp, Artificial Sequence
  chemically synthesized
ttgatgtcattattatcttt

SEQ ID NO: 35344 - DNA, 20 bp, Artificial Sequence
  chemically synthesized
tatctttaggaaaaaattct

SEQ ID NO: 35345 - DNA, 20 bp, Artificial Sequence
  chemically synthesized
aaaaaattctgagaatgata

SEQ ID NO: 35346 - DNA, 20 bp, Artificial Sequence
  chemically synthesized
ttctgagaatgatatagtcg

SEQ ID NO: 35347 - DNA, 20 bp, Artificial Sequence
  chemically synthesized
atagtcgaagtgataccttg

SEQ ID NO: 35348 - DNA, 20 bp, Artificial Sequence
  chemically synthesized
tagtcgaagtgataccttga

SEQ ID NO: 35349 - DNA, 20 bp, Artificial Sequence
  chemically synthesized
tcgaagtgataccttgaagg

SEQ ID NO: 35350 - DNA, 20 bp, Artificial Sequence
  chemically synthesized
gaaggtagaactgtgcactg

SEQ ID NO: 35351 - DNA, 20 bp, Artificial Sequence
  chemically synthesized
actgtgcactgtggtaataa

SEQ ID NO: 35352 - DNA, 20 bp, Artificial Sequence
  chemically synthesized
cactgtggtaataacagaaa

SEQ ID NO: 35353 - DNA, 20 bp, Artificial Sequence
  chemically synthesized
gtggtaataacagaaacaga

SEQ ID NO: 35354 - DNA, 20 bp, Artificial Sequence
  chemically synthesized
acatttcttctatataaacc

SEQ ID NO: 35355 - DNA, 20 bp, Artificial Sequence
  chemically synthesized
catttcttctatataaaccc

SEQ ID NO: 35356 - DNA, 20 bp, Artificial Sequence
  chemically synthesized
tataaacccaggatgtcgtc

SEQ ID NO: 35357 - DNA, 20 bp, Artificial Sequence
  chemically synthesized
aaacccaggatgtcgtccag

SEQ ID NO: 35358 - DNA, 20 bp, Artificial Sequence
  chemically synthesized
cccaggatgtcgtccagcgg

SEQ ID NO: 35359 - DNA, 20 bp, Artificial Sequence
  chemically synthesized
tcccatcccttcctattgac

SEQ ID NO: 35360 - DNA, 20 bp, Artificial Sequence
  chemically synthesized
cttcctattgactggttttc

SEQ ID NO: 35361 - DNA, 20 bp, Artificial Sequence
  chemically synthesized
ttcctattgactggttttcc

SEQ ID NO: 35362 - DNA, 20 bp, Artificial Sequence
  chemically synthesized
attgactggttttccaggct

SEQ ID NO: 35363 - DNA, 20 bp, Artificial Sequence
  chemically synthesized
tgactggttttccaggcttg

SEQ ID NO: 35364 - DNA, 20 bp, Artificial Sequence
  chemically synthesized
gactggttttccaggcttgg

SEQ ID NO: 35365 - DNA, 20 bp, Artificial Sequence
  chemically synthesized
tggttttccaggcttggagg

SEQ ID NO: 35366 - DNA, 20 bp, Artificial Sequence
  chemically synthesized
gcttggaggaagctcatcac

SEQ ID NO: 35367 - DNA, 20 bp, Artificial Sequence
  chemically synthesized
atgtatatatccatcctttt

SEQ ID NO: 35368 - DNA, 20 bp, Artificial Sequence
  chemically synthesized
atatccatcctttttggcaa

SEQ ID NO: 35369 - DNA, 20 bp, Artificial Sequence
  chemically synthesized
gcaccctccttcttctcatt

SEQ ID NO: 35370 - DNA, 20 bp, Artificial Sequence
  chemically synthesized
caccctccttcttctcatta

SEQ ID NO: 35371 - DNA, 20 bp, Artificial Sequence
  chemically synthesized
cctccttcttctcattaagg

SEQ ID NO: 35372 - DNA, 20 bp, Artificial Sequence
  chemically synthesized
aggaagatcacaatcttcat

SEQ ID NO: 35373 - DNA, 20 bp, Artificial Sequence
  chemically synthesized
tgagcccatgtacttctttc

SEQ ID NO: 35374 - DNA, 20 bp, Artificial Sequence
  chemically synthesized
gtacttctttctggccatgc

SEQ ID NO: 35375 - DNA, 20 bp, Artificial Sequence
  chemically synthesized
tctggccatgctggctgcca

SEQ ID NO: 35376 - DNA, 20 bp, Artificial Sequence
  chemically synthesized
catgctggctgccacagacc

SEQ ID NO: 35377 - DNA, 20 bp, Artificial Sequence
  chemically synthesized
atgctggctgccacagacct

SEQ ID NO: 35378 - DNA, 20 bp, Artificial Sequence
  chemically synthesized
tgctggctgccacagacctg

SEQ ID NO: 35379 - DNA, 20 bp, Artificial Sequence
  chemically synthesized
ggctgccacagacctggggc

SEQ ID NO: 35380 - DNA, 20 bp, Artificial Sequence
  chemically synthesized
ggccctgaccacaatgccca

SEQ ID NO: 35381 - DNA, 20 bp, Artificial Sequence
  chemically synthesized
gaccacaatgcccacggtgc

SEQ ID NO: 35382 - DNA, 20 bp, Artificial Sequence
  chemically synthesized
accacaatgcccacggtgct

SEQ ID NO: 35383 - DNA, 20 bp, Artificial Sequence
  chemically synthesized
cacaatgcccacggtgctgg

SEQ ID NO: 35384 - DNA, 20 bp, Artificial Sequence
  chemically synthesized
ccacggtgctgggagtcctc

SEQ ID NO: 35385 - DNA, 20 bp, Artificial Sequence
  chemically synthesized
ggtgctgggagtcctctggc

SEQ ID NO: 35386 - DNA, 20 bp, Artificial Sequence
  chemically synthesized
ggagtcctctggctggatca

SEQ ID NO: 35387 - DNA, 20 bp, Artificial Sequence
  chemically synthesized
gagtcctctggctggatcac

SEQ ID NO: 35388 - DNA, 20 bp, Artificial Sequence
  chemically synthesized
agtcctctggctggatcaca

SEQ ID NO: 35389 - DNA, 20 bp, Artificial Sequence
  chemically synthesized
tcctctggctggatcacagg

SEQ ID NO: 35390 - DNA, 20 bp, Artificial Sequence
  chemically synthesized
tggctggatcacagggagat

SEQ ID NO: 35391 - DNA, 20 bp, Artificial Sequence
  chemically synthesized
ctggatcacagggagattgg

SEQ ID NO: 35392 - DNA, 20 bp, Artificial Sequence
  chemically synthesized
tcacagggagattggaagtg

SEQ ID NO: 35393 - DNA, 20 bp, Artificial Sequence
  chemically synthesized
gaagtgcggcctgcttttcc

SEQ ID NO: 35394 - DNA, 20 bp, Artificial Sequence
  chemically synthesized
aagtgcggcctgcttttccc

SEQ ID NO: 35395 - DNA, 20 bp, Artificial Sequence
  chemically synthesized
tacactcactttcctttctc

SEQ ID NO: 35396 - DNA, 20 bp, Artificial Sequence
  chemically synthesized
tcactttcctttctcgagtc

SEQ ID NO: 35397 - DNA, 20 bp, Artificial Sequence
  chemically synthesized
gtctggcattctgcttgcca

SEQ ID NO: 35398 - DNA, 20 bp, Artificial Sequence
  chemically synthesized
attgccatctgcaaccctct

SEQ ID NO: 35399 - DNA, 20 bp, Artificial Sequence
  chemically synthesized
ctctgtacttactaatactc

SEQ ID NO: 35400 - DNA, 20 bp, Artificial Sequence
  chemically synthesized
tgtacttactaatactcgag

SEQ ID NO: 35401 - DNA, 20 bp, Artificial Sequence
  chemically synthesized
ttactaatactcgagtagtg

SEQ ID NO: 35402 - DNA, 20 bp, Artificial Sequence
  chemically synthesized
aatactcgagtagtgaagat

SEQ ID NO: 35403 - DNA, 20 bp, Artificial Sequence
  chemically synthesized
atactcgagtagtgaagatt

SEQ ID NO: 35404 - DNA, 20 bp, Artificial Sequence
  chemically synthesized
tcgagtagtgaagattgggc

SEQ ID NO: 35405 - DNA, 20 bp, Artificial Sequence
  chemically synthesized
cgagtagtgaagattgggct

SEQ ID NO: 35406 - DNA, 20 bp, Artificial Sequence
  chemically synthesized
agtagtgaagattgggctgg

SEQ ID NO: 35407 - DNA, 20 bp, Artificial Sequence
  chemically synthesized
attgggctgggagttctgat

SEQ ID NO: 35408 - DNA, 20 bp, Artificial Sequence
  chemically synthesized
ttgggctgggagttctgatg

SEQ ID NO: 35409 - DNA, 20 bp, Artificial Sequence
  chemically synthesized
tgggctgggagttctgatga

SEQ ID NO: 35410 - DNA, 20 bp, Artificial Sequence
  chemically synthesized
gggctgggagttctgatgag

SEQ ID NO: 35411 - DNA, 20 bp, Artificial Sequence
  chemically synthesized
gtatccgttgttcccccaat

SEQ ID NO: 35412 - DNA, 20 bp, Artificial Sequence
  chemically synthesized
tatccgttgttcccccaatc

SEQ ID NO: 35413 - DNA, 20 bp, Artificial Sequence
  chemically synthesized
cacatgcattctgccttcac

SEQ ID NO: 35414 - DNA, 20 bp, Artificial Sequence
  chemically synthesized
acatgcattctgccttcacc

SEQ ID NO: 35415 - DNA, 20 bp, Artificial Sequence
  chemically synthesized
caccttcaaccgactgtacc

SEQ ID NO: 35416 - DNA, 20 bp, Artificial Sequence
  chemically synthesized
actgtacccagctgtgcttg

SEQ ID NO: 35417 - DNA, 20 bp, Artificial Sequence
  chemically synthesized
tgtagtctttatatttgtgc

SEQ ID NO: 35418 - DNA, 20 bp, Artificial Sequence
  chemically synthesized
tctcctatgtgttgatactc

SEQ ID NO: 35419 - DNA, 20 bp, Artificial Sequence
  chemically synthesized
ttgatactcaagactgtcct

SEQ ID NO: 35420 - DNA, 20 bp, Artificial Sequence
  chemically synthesized
actgtcctgagcattgcctc

SEQ ID NO: 35421 - DNA, 20 bp, Artificial Sequence
  chemically synthesized
tgtcctgagcattgcctcca

SEQ ID NO: 35422 - DNA, 20 bp, Artificial Sequence
  chemically synthesized
tcctgagcattgcctccaga

SEQ ID NO: 35423 - DNA, 20 bp, Artificial Sequence
  chemically synthesized
cctgagcattgcctccagag

SEQ ID NO: 35424 - DNA, 20 bp, Artificial Sequence
  chemically synthesized
tgagcattgcctccagagag

SEQ ID NO: 35425 - DNA, 20 bp, Artificial Sequence
  chemically synthesized
agcattgcctccagagagga

SEQ ID NO: 35426 - DNA, 20 bp, Artificial Sequence
  chemically synthesized
gcattgcctccagagaggag

SEQ ID NO: 35427 - DNA, 20 bp, Artificial Sequence
  chemically synthesized
cattgcctccagagaggaga

SEQ ID NO: 35428 - DNA, 20 bp, Artificial Sequence
  chemically synthesized
cctccagagaggagagggcc

SEQ ID NO: 35429 - DNA, 20 bp, Artificial Sequence
  chemically synthesized
ctccagagaggagagggcca

SEQ ID NO: 35430 - DNA, 20 bp, Artificial Sequence
  chemically synthesized
ctcccatatctgctgtgtcc

SEQ ID NO: 35431 - DNA, 20 bp, Artificial Sequence
  chemically synthesized
tgtcctggttttttatgtca

SEQ ID NO: 35432 - DNA, 20 bp, Artificial Sequence
  chemically synthesized
gttttttatgtcacagtgat

SEQ ID NO: 35433 - DNA, 20 bp, Artificial Sequence
  chemically synthesized
ttgtctctgattcatcgttt

SEQ ID NO: 35434 - DNA, 20 bp, Artificial Sequence
  chemically synthesized
ctctgattcatcgttttgga

SEQ ID NO: 35435 - DNA, 20 bp, Artificial Sequence
  chemically synthesized
tgattcatcgttttggaaag

SEQ ID NO: 35436 - DNA, 20 bp, Artificial Sequence
  chemically synthesized
gattcatcgttttggaaagc

SEQ ID NO: 35437 - DNA, 20 bp, Artificial Sequence
  chemically synthesized
catattgttcacctcattat

SEQ ID NO: 35438 - DNA, 20 bp, Artificial Sequence
  chemically synthesized
ctaatgaatcctataacata

SEQ ID NO: 35439 - DNA, 20 bp, Artificial Sequence
  chemically synthesized
atcctataacatatagtgtc

SEQ ID NO: 35440 - DNA, 20 bp, Artificial Sequence
  chemically synthesized
taacatatagtgtcaagacc

SEQ ID NO: 35441 - DNA, 20 bp, Artificial Sequence
  chemically synthesized
catatagtgtcaagaccaag

SEQ ID NO: 35442 - DNA, 20 bp, Artificial Sequence
  chemically synthesized
gtgtcaagaccaagcagatt

SEQ ID NO: 35443 - DNA, 20 bp, Artificial Sequence
  chemically synthesized
cttcacctttttactaccca

SEQ ID NO: 35444 - DNA, 20 bp, Artificial Sequence
  chemically synthesized
ctttttactacccatagaat

SEQ ID NO: 35445 - DNA, 20 bp, Artificial Sequence
  chemically synthesized
aacctgatctccaatcatca

SEQ ID NO: 35446 - DNA, 20 bp, Artificial Sequence
  chemically synthesized
aatcatcacagtcactctca

SEQ ID NO: 35447 - DNA, 20 bp, Artificial Sequence
  chemically synthesized
aatgtaaaaactctaatatt

SEQ ID NO: 35448 - DNA, 20 bp, Artificial Sequence
  chemically synthesized
gtaaaaactctaatatttag

SEQ ID NO: 35449 - DNA, 20 bp, Artificial Sequence
  chemically synthesized
taaaaactctaatatttagc

SEQ ID NO: 35450 - DNA, 20 bp, Artificial Sequence
  chemically synthesized
aaaactctaatatttagcag

SEQ ID NO: 35451 - DNA, 20 bp, Artificial Sequence
  chemically synthesized
aactctaatatttagcagga

SEQ ID NO: 35452 - DNA, 20 bp, Artificial Sequence
  chemically synthesized
taatatttagcaggagagca

SEQ ID NO: 35453 - DNA, 20 bp, Artificial Sequence
  chemically synthesized
tatttagcaggagagcaaag

SEQ ID NO: 35454 - DNA, 20 bp, Artificial Sequence
  chemically synthesized
gagcaaagaagtctcatatc

SEQ ID NO: 35455 - DNA, 20 bp, Artificial Sequence
  chemically synthesized
gcatgcatgctcatatgact

SEQ ID NO: 35456 - DNA, 20 bp, Artificial Sequence
  chemically synthesized
gctcatatgacttggtaaaa

SEQ ID NO: 35457 - DNA, 20 bp, Artificial Sequence
  chemically synthesized
ctcatatgacttggtaaaat

SEQ ID NO: 35458 - DNA, 20 bp, Artificial Sequence
  chemically synthesized
gtaaaataggtgttaaaata

SEQ ID NO: 35459 - DNA, 20 bp, Artificial Sequence
  chemically synthesized
aggtgttaaaatacagcttc

SEQ ID NO: 35460 - DNA, 20 bp, Artificial Sequence
  chemically synthesized
atacagcttcaagtttccct

SEQ ID NO: 35461 - DNA, 20 bp, Artificial Sequence
  chemically synthesized
tacagcttcaagtttcccta

SEQ ID NO: 35462 - DNA, 20 bp, Artificial Sequence
  chemically synthesized
tttccctaaggtatctcttt

SEQ ID NO: 35463 - DNA, 20 bp, Artificial Sequence
  chemically synthesized
tctctttaagcccaactctt

SEQ ID NO: 35464 - DNA, 20 bp, Artificial Sequence
  chemically synthesized
cccaactctttagctaaatg

SEQ ID NO: 35465 - DNA, 20 bp, Artificial Sequence
  chemically synthesized
ttttgttgcattcctgtaaa

SEQ ID NO: 35466 - DNA, 20 bp, Artificial Sequence
  chemically synthesized
tgtaaacggaatatttctct

SEQ ID NO: 35467 - DNA, 20 bp, Artificial Sequence
  chemically synthesized
ttattgtgataacaatacct

SEQ ID NO: 35468 - DNA, 20 bp, Artificial Sequence
  chemically synthesized
tattgtgataacaatacctt

SEQ ID NO: 35469 - DNA, 20 bp, Artificial Sequence
  chemically synthesized
acaataccttaggcatctat

SEQ ID NO: 35470 - DNA, 20 bp, Artificial Sequence
  chemically synthesized
actaacatatgtttatttca

SEQ ID NO: 35471 - DNA, 20 bp, Artificial Sequence
  chemically synthesized
tatgtttatttcatggtata

SEQ ID NO: 35472 - DNA, 20 bp, Artificial Sequence
  chemically synthesized
tttatttcatggtataaagt

SEQ ID NO: 35473 - DNA, 20 bp, Artificial Sequence
  chemically synthesized
atttcatggtataaagttag

SEQ ID NO: 35474 - DNA, 20 bp, Artificial Sequence
  chemically synthesized
catggtataaagttagcaga

SEQ ID NO: 35475 - DNA, 20 bp, Artificial Sequence
  chemically synthesized
atggtataaagttagcagat

SEQ ID NO: 35476 - DNA, 20 bp, Artificial Sequence
  chemically synthesized
ataaagttagcagataggaa

SEQ ID NO: 35477 - DNA, 20 bp, Artificial Sequence
  chemically synthesized
tcataaaaatataaaattat

SEQ ID NO: 35478 - DNA, 20 bp, Artificial Sequence
  chemically synthesized
aaaaatataaaattattagt

SEQ ID NO: 35479 - DNA, 20 bp, Artificial Sequence
  chemically synthesized
ataaaattattagttggttc

SEQ ID NO: 35480 - DNA, 20 bp, Artificial Sequence
  chemically synthesized
attagttggttcgagtgaaa

SEQ ID NO: 35481 - DNA, 20 bp, Artificial Sequence
  chemically synthesized
ttggttcgagtgaaatggaa

SEQ ID NO: 35482 - DNA, 20 bp, Artificial Sequence
  chemically synthesized
ggttcgagtgaaatggaata

SEQ ID NO: 35483 - DNA, 20 bp, Artificial Sequence
  chemically synthesized
gagtgaaatggaatagagtt

SEQ ID NO: 35484 - DNA, 20 bp, Artificial Sequence
  chemically synthesized
aactcttatgaatttctctg

SEQ ID NO: 35485 - DNA, 20 bp, Artificial Sequence
  chemically synthesized
actcttatgaatttctctgc

SEQ ID NO: 35486 - DNA, 20 bp, Artificial Sequence
  chemically synthesized
gcaggtgtccatacaaacaa

SEQ ID NO: 35487 - DNA, 20 bp, Artificial Sequence
  chemically synthesized
caggtgtccatacaaacaat

SEQ ID NO: 35488 - DNA, 20 bp, Artificial Sequence
  chemically synthesized
acaatgggaacctataaatt

SEQ ID NO: 35489 - DNA, 20 bp, Artificial Sequence
  chemically synthesized
acctataaatttggtcactg

SEQ ID NO: 35490 - DNA, 20 bp, Artificial Sequence
  chemically synthesized
taaatttggtcactgaagtc

SEQ ID NO: 35491 - DNA, 20 bp, Artificial Sequence
  chemically synthesized
aaatttggtcactgaagtcc

SEQ ID NO: 35492 - DNA, 20 bp, Artificial Sequence
  chemically synthesized
ccaggaattttcctgcaaaa

SEQ ID NO: 35493 - DNA, 20 bp, Artificial Sequence
  chemically synthesized
agaatataatcttctttgat

SEQ ID NO: 35494 - DNA, 20 bp, Artificial Sequence
  chemically synthesized
ctaattacttatcatctcaa

SEQ ID NO: 35495 - DNA, 20 bp, Artificial Sequence
  chemically synthesized
tacttatcatctcaacagtc

SEQ ID NO: 35496 - DNA, 20 bp, Artificial Sequence
  chemically synthesized
tatcatctcaacagtctagt

SEQ ID NO: 35497 - DNA, 20 bp, Artificial Sequence
  chemically synthesized
taaactcatatttattcccc

SEQ ID NO: 35498 - DNA, 20 bp, Artificial Sequence
  chemically synthesized
aaactcatatttattcccca

SEQ ID NO: 35499 - DNA, 20 bp, Artificial Sequence
  chemically synthesized
ctcatatttattccccaagg

SEQ ID NO: 35500 - DNA, 20 bp, Artificial Sequence
  chemically synthesized
aacttgtaacaaaaaaatgt

SEQ ID NO: 35501 - DNA, 20 bp, Artificial Sequence
  chemically synthesized
ttgtaacaaaaaaatgtgag

SEQ ID NO: 35502 - DNA, 20 bp, Artificial Sequence
  chemically synthesized
gtaacaaaaaaatgtgagaa

SEQ ID NO: 35503 - DNA, 20 bp, Artificial Sequence
  chemically synthesized
taacaaaaaaatgtgagaag

SEQ ID NO: 35504 - DNA, 20 bp, Artificial Sequence
  chemically synthesized
aaatgtgagaagaggaatca

SEQ ID NO: 35505 - DNA, 20 bp, Artificial Sequence
  chemically synthesized
aagaggaatcacggataaat

SEQ ID NO: 35506 - DNA, 20 bp, Artificial Sequence
  chemically synthesized
gaggaatcacggataaatga

SEQ ID NO: 35507 - DNA, 20 bp, Artificial Sequence
  chemically synthesized
aggaatcacggataaatgag

SEQ ID NO: 35508 - DNA, 20 bp, Artificial Sequence
  chemically synthesized
cacggataaatgagaggacg

SEQ ID NO: 35509 - DNA, 20 bp, Artificial Sequence
  chemically synthesized
taaatgagaggacgtagaca

SEQ ID NO: 35510 - DNA, 20 bp, Artificial Sequence
  chemically synthesized
tgagaggacgtagacacagt

SEQ ID NO: 35511 - DNA, 20 bp, Artificial Sequence
  chemically synthesized
tcattcttattctactaccc

SEQ ID NO: 35512 - DNA, 20 bp, Artificial Sequence
  chemically synthesized
tattctactaccctagttgc

SEQ ID NO: 35513 - DNA, 20 bp, Artificial Sequence
  chemically synthesized
tagttgctagctccaatgtt

SEQ ID NO: 35514 - DNA, 20 bp, Artificial Sequence
  chemically synthesized
agttgctagctccaatgttg

SEQ ID NO: 35515 - DNA, 20 bp, Artificial Sequence
  chemically synthesized
tccaatgttgaggccatcct

SEQ ID NO: 35516 - DNA, 20 bp, Artificial Sequence
  chemically synthesized
ccatcctcagatatctacgc

SEQ ID NO: 35517 - DNA, 20 bp, Artificial Sequence
  chemically synthesized
agatatctacgctggctgac

SEQ ID NO: 35518 - DNA, 20 bp, Artificial Sequence
  chemically synthesized
gctggctgactagtccaaat

SEQ ID NO: 35519 - DNA, 20 bp, Artificial Sequence
  chemically synthesized
ggctgactagtccaaattag

SEQ ID NO: 35520 - DNA, 20 bp, Artificial Sequence
  chemically synthesized
tgactagtccaaattagtgg

SEQ ID NO: 35521 - DNA, 20 bp, Artificial Sequence
  chemically synthesized
actagtccaaattagtggaa

SEQ ID NO: 35522 - DNA, 20 bp, Artificial Sequence
  chemically synthesized
gtccaaattagtggaagaga

SEQ ID NO: 35523 - DNA, 20 bp, Artificial Sequence
  chemically synthesized
accctccttttgctatgaaa

SEQ ID NO: 35524 - DNA, 20 bp, Artificial Sequence
  chemically synthesized
ccctccttttgctatgaaaa

SEQ ID NO: 35525 - DNA, 20 bp, Artificial Sequence
  chemically synthesized
tttgctatgaaaaaggtctg

SEQ ID NO: 35526 - DNA, 20 bp, Artificial Sequence
  chemically synthesized
ttgctatgaaaaaggtctga

SEQ ID NO: 35527 - DNA, 20 bp, Artificial Sequence
  chemically synthesized
tctgaaggaacaaaaaaaaa

SEQ ID NO: 35528 - DNA, 20 bp, Artificial Sequence
  chemically synthesized
ctgaaggaacaaaaaaaaat

SEQ ID NO: 35529 - DNA, 20 bp, Artificial Sequence
  chemically synthesized
taggtttctgcatttttttg

SEQ ID NO: 35530 - DNA, 20 bp, Artificial Sequence
  chemically synthesized
acattctgattccatgtaat

SEQ ID NO: 35531 - DNA, 20 bp, Artificial Sequence
  chemically synthesized
taataagtgtaaatttccca

SEQ ID NO: 35532 - DNA, 20 bp, Artificial Sequence
  chemically synthesized
tttgattaaaattgtctgat

SEQ ID NO: 35533 - DNA, 20 bp, Artificial Sequence
  chemically synthesized
attaaaattgtctgatgagt

SEQ ID NO: 35534 - DNA, 20 bp, Artificial Sequence
  chemically synthesized
ttaaaattgtctgatgagtt

SEQ ID NO: 35535 - DNA, 20 bp, Artificial Sequence
  chemically synthesized
aaattgtctgatgagttagg

SEQ ID NO: 35536 - DNA, 20 bp, Artificial Sequence
  chemically synthesized
aattgtctgatgagttagga

SEQ ID NO: 35537 - DNA, 20 bp, Artificial Sequence
  chemically synthesized
attgtctgatgagttaggaa

SEQ ID NO: 35538 - DNA, 20 bp, Artificial Sequence
  chemically synthesized
tcaatttaaaatatcctaaa

SEQ ID NO: 35539 - DNA, 20 bp, Artificial Sequence
  chemically synthesized
aatttaaaatatcctaaaaa

SEQ ID NO: 35540 - DNA, 20 bp, Artificial Sequence
  chemically synthesized
atttaaaatatcctaaaaag

SEQ ID NO: 35541 - DNA, 20 bp, Artificial Sequence
  chemically synthesized
tttaaaatatcctaaaaaga

SEQ ID NO: 35542 - DNA, 20 bp, Artificial Sequence
  chemically synthesized
taaaatatcctaaaaagagg

SEQ ID NO: 35543 - DNA, 20 bp, Artificial Sequence
  chemically synthesized
aaaatatcctaaaaagaggg

SEQ ID NO: 35544 - DNA, 20 bp, Artificial Sequence
  chemically synthesized
tgtcttaattatactttaat

SEQ ID NO: 35545 - DNA, 20 bp, Artificial Sequence
  chemically synthesized
tcttaattatactttaatca

SEQ ID NO: 35546 - DNA, 20 bp, Artificial Sequence
  chemically synthesized
tcagagcaaaaataatactt

SEQ ID NO: 35547 - DNA, 20 bp, Artificial Sequence
  chemically synthesized
agcaaaaataatacttcagt

SEQ ID NO: 35548 - DNA, 20 bp, Artificial Sequence
  chemically synthesized
aaataatacttcagtgagac

SEQ ID NO: 35549 - DNA, 20 bp, Artificial Sequence
  chemically synthesized
ataatacttcagtgagacaa

SEQ ID NO: 35550 - DNA, 20 bp, Artificial Sequence
  chemically synthesized
aatacttcagtgagacaaga

SEQ ID NO: 35551 - DNA, 20 bp, Artificial Sequence
  chemically synthesized
atacttcagtgagacaagag

SEQ ID NO: 35552 - DNA, 20 bp, Artificial Sequence
  chemically synthesized
tacttcagtgagacaagaga

SEQ ID NO: 35553 - DNA, 20 bp, Artificial Sequence
  chemically synthesized
acttcagtgagacaagagag

SEQ ID NO: 35554 - DNA, 20 bp, Artificial Sequence
  chemically synthesized
agacaagagaggggactata

SEQ ID NO: 35555 - DNA, 20 bp, Artificial Sequence
  chemically synthesized
caagagaggggactatatag

SEQ ID NO: 35556 - DNA, 20 bp, Artificial Sequence
  chemically synthesized
gaagatattgtttatgtctt

SEQ ID NO: 35557 - DNA, 20 bp, Artificial Sequence
  chemically synthesized
gttttaccccgatcatttta

SEQ ID NO: 35558 - DNA, 20 bp, Artificial Sequence
  chemically synthesized
aattgtgcacctgtgaatgt

SEQ ID NO: 35559 - DNA, 20 bp, Artificial Sequence
  chemically synthesized
gttcatgtttctgctttctg

SEQ ID NO: 35560 - DNA, 20 bp, Artificial Sequence
  chemically synthesized
ttcatgtttctgctttctgc

SEQ ID NO: 35561 - DNA, 20 bp, Artificial Sequence
  chemically synthesized
gcaggttgttgttctcaact

SEQ ID NO: 35562 - DNA, 20 bp, Artificial Sequence
  chemically synthesized
ggttgttgttctcaactcag

SEQ ID NO: 35563 - DNA, 20 bp, Artificial Sequence
  chemically synthesized
gttgttgttctcaactcagc

SEQ ID NO: 35564 - DNA, 20 bp, Artificial Sequence
  chemically synthesized
tcagcaggaaatgtcttatg

SEQ ID NO: 35565 - DNA, 20 bp, Artificial Sequence
  chemically synthesized
gaaatgtcttatgaagaaaa

SEQ ID NO: 35566 - DNA, 20 bp, Artificial Sequence
  chemically synthesized
agaaaatggcccctgctcct

SEQ ID NO: 35567 - DNA, 20 bp, Artificial Sequence
  chemically synthesized
gaaaatggcccctgctcctt

SEQ ID NO: 35568 - DNA, 20 bp, Artificial Sequence
  chemically synthesized
aatggcccctgctccttagg

SEQ ID NO: 35569 - DNA, 20 bp, Artificial Sequence
  chemically synthesized
ggcccctgctccttaggtag

SEQ ID NO: 35570 - DNA, 20 bp, Artificial Sequence
  chemically synthesized
gcccctgctccttaggtagc

SEQ ID NO: 35571 - DNA, 20 bp, Artificial Sequence
  chemically synthesized
gctccttaggtagcaggcca

SEQ ID NO: 35572 - DNA, 20 bp, Artificial Sequence
  chemically synthesized
ctccttaggtagcaggccat

SEQ ID NO: 35573 - DNA, 20 bp, Artificial Sequence
  chemically synthesized
actgaccctcttgccttctg

SEQ ID NO: 35574 - DNA, 20 bp, Artificial Sequence
  chemically synthesized
ccctcttgccttctgaagct

SEQ ID NO: 35575 - DNA, 20 bp, Artificial Sequence
  chemically synthesized
tgccttctgaagctaagctc

SEQ ID NO: 35576 - DNA, 20 bp, Artificial Sequence
  chemically synthesized
ctgaagctaagctccagctt

SEQ ID NO: 35577 - DNA, 20 bp, Artificial Sequence
  chemically synthesized
ttacttgctccctgtctcct

SEQ ID NO: 35578 - DNA, 20 bp, Artificial Sequence
  chemically synthesized
acttgctccctgtctcctga

SEQ ID NO: 35579 - DNA, 20 bp, Artificial Sequence
  chemically synthesized
acacatttgaatccctatct

SEQ ID NO: 35580 - DNA, 20 bp, Artificial Sequence
  chemically synthesized
cacatttgaatccctatctc

SEQ ID NO: 35581 - DNA, 20 bp, Artificial Sequence
  chemically synthesized
cctatctcaggtattgctca

SEQ ID NO: 35582 - DNA, 20 bp, Artificial Sequence
  chemically synthesized
tatctcaggtattgctcata

SEQ ID NO: 35583 - DNA, 20 bp, Artificial Sequence
  chemically synthesized
tctcaggtattgctcataga

SEQ ID NO: 35584 - DNA, 20 bp, Artificial Sequence
  chemically synthesized
gctcatagagagtccaactt

SEQ ID NO: 35585 - DNA, 20 bp, Artificial Sequence
  chemically synthesized
tatttatattctgtttcatt

SEQ ID NO: 35586 - DNA, 20 bp, Artificial Sequence
  chemically synthesized
tttatattctgtttcattaa

SEQ ID NO: 35587 - DNA, 20 bp, Artificial Sequence
  chemically synthesized
attaagagatgtaattgtga

SEQ ID NO: 35588 - DNA, 20 bp, Artificial Sequence
  chemically synthesized
aactgaacatataaaaaaat

SEQ ID NO: 35589 - DNA, 20 bp, Artificial Sequence
  chemically synthesized
cttgtcacgccatgtcacct

SEQ ID NO: 35590 - DNA, 20 bp, Artificial Sequence
  chemically synthesized
gccatgtcacctgagcaaca

SEQ ID NO: 35591 - DNA, 20 bp, Artificial Sequence
  chemically synthesized
cagtctgaatactaaattgt

SEQ ID NO: 35592 - DNA, 20 bp, Artificial Sequence
  chemically synthesized
gaatactaaattgtgagtgt

SEQ ID NO: 35593 - DNA, 20 bp, Artificial Sequence
  chemically synthesized
gtgtgagtgcatatatgtga

SEQ ID NO: 35594 - DNA, 20 bp, Artificial Sequence
  chemically synthesized
tgagtgcatatatgtgatgg

SEQ ID NO: 35595 - DNA, 20 bp, Artificial Sequence
  chemically synthesized
gagtgcatatatgtgatggt

SEQ ID NO: 35596 - DNA, 20 bp, Artificial Sequence
  chemically synthesized
ttttattcataaaaatattg

SEQ ID NO: 35597 - DNA, 20 bp, Artificial Sequence
  chemically synthesized
tttattcataaaaatattgt

SEQ ID NO: 35598 - DNA, 20 bp, Artificial Sequence
  chemically synthesized
ttattcataaaaatattgtg

SEQ ID NO: 35599 - DNA, 20 bp, Artificial Sequence
  chemically synthesized
ttcataaaaatattgtgggg

SEQ ID NO: 35600 - DNA, 20 bp, Artificial Sequence
  chemically synthesized
tattatcactgttttcttga

SEQ ID NO: 35601 - DNA, 20 bp, Artificial Sequence
  chemically synthesized
attatcactgttttcttgat

SEQ ID NO: 35602 - DNA, 20 bp, Artificial Sequence
  chemically synthesized
ttatcactgttttcttgatg

SEQ ID NO: 35603 - DNA, 20 bp, Artificial Sequence
  chemically synthesized
tggggaaatttaatataaaa

SEQ ID NO: 35604 - DNA, 20 bp, Artificial Sequence
  chemically synthesized
aaaagttaaatattccctcc

SEQ ID NO: 35605 - DNA, 20 bp, Artificial Sequence
  chemically synthesized
aaagttaaatattccctcca

SEQ ID NO: 35606 - DNA, 20 bp, Artificial Sequence
  chemically synthesized
aagttaaatattccctccaa

SEQ ID NO: 35607 - DNA, 20 bp, Artificial Sequence
  chemically synthesized
aagggcataacatttttaat

SEQ ID NO: 35608 - DNA, 20 bp, Artificial Sequence
  chemically synthesized
cataacatttttaattggta

SEQ ID NO: 35609 - DNA, 20 bp, Artificial Sequence
  chemically synthesized
aatttatatcttctaactat

SEQ ID NO: 35610 - DNA, 20 bp, Artificial Sequence
  chemically synthesized
atttatatcttctaactata

SEQ ID NO: 35611 - DNA, 20 bp, Artificial Sequence
  chemically synthesized
atatcttctaactataaggc

SEQ ID NO: 35612 - DNA, 20 bp, Artificial Sequence
  chemically synthesized
aactataaggccagtgtgaa

SEQ ID NO: 35613 - DNA, 20 bp, Artificial Sequence
  chemically synthesized
gtgtgaatggtactccacta

SEQ ID NO: 35614 - DNA, 20 bp, Artificial Sequence
  chemically synthesized
tgaatggtactccactacag

SEQ ID NO: 35615 - DNA, 20 bp, Artificial Sequence
  chemically synthesized
ccactacagtagactatcct

SEQ ID NO: 35616 - DNA, 20 bp, Artificial Sequence
  chemically synthesized
ctacagtagactatccttag

SEQ ID NO: 35617 - DNA, 20 bp, Artificial Sequence
  chemically synthesized
cttgtattccgtcatgcttg

SEQ ID NO: 35618 - DNA, 20 bp, Artificial Sequence
  chemically synthesized
tatctccaaactcctaaccg

SEQ ID NO: 35619 - DNA, 20 bp, Artificial Sequence
  chemically synthesized
ctccaaactcctaaccgcag

SEQ ID NO: 35620 - DNA, 20 bp, Artificial Sequence
  chemically synthesized
caaactcctaaccgcagtag

SEQ ID NO: 35621 - DNA, 20 bp, Artificial Sequence
  chemically synthesized
agtagaagaacttttttaaa

SEQ ID NO: 35622 - DNA, 20 bp, Artificial Sequence
  chemically synthesized
tatgacattgcaaaaaaaaa

SEQ ID NO: 35623 - DNA, 20 bp, Artificial Sequence
  chemically synthesized
tgacattgcaaaaaaaaaaa

SEQ ID NO: 35624 - DNA, 20 bp, Artificial Sequence
  chemically synthesized
aaagagtaatgcttttgttg

SEQ ID NO: 35625 - DNA, 20 bp, Artificial Sequence
  chemically synthesized
aattactaaaatgcaatgct

SEQ ID NO: 35626 - DNA, 20 bp, Artificial Sequence
  chemically synthesized
ttaatgacaatgtttttcat

SEQ ID NO: 35627 - DNA, 20 bp, Artificial Sequence
  chemically synthesized
taatgacaatgtttttcatc

SEQ ID NO: 35628 - DNA, 20 bp, Artificial Sequence
  chemically synthesized
gacaatgtttttcatcaggc

SEQ ID NO: 35629 - DNA, 20 bp, Artificial Sequence
  chemically synthesized
ttcaaactataataaatatt

SEQ ID NO: 35630 - DNA, 20 bp, Artificial Sequence
  chemically synthesized
caaactataataaatattta

SEQ ID NO: 35631 - DNA, 20 bp, Artificial Sequence
  chemically synthesized
taaatatttagagtaaatta

SEQ ID NO: 35632 - DNA, 20 bp, Artificial Sequence
  chemically synthesized
tttagagtaaattatagata

SEQ ID NO: 35633 - DNA, 20 bp, Artificial Sequence
  chemically synthesized
aagaaatgataataaataaa

SEQ ID NO: 35634 - DNA, 20 bp, Artificial Sequence
  chemically synthesized
ctctgattccatgttttcct

SEQ ID NO: 35635 - DNA, 20 bp, Artificial Sequence
  chemically synthesized
ttccatgttttcctgagact

SEQ ID NO: 35636 - DNA, 20 bp, Artificial Sequence
  chemically synthesized
ttttcctgagactcagtgac

SEQ ID NO: 35637 - DNA, 20 bp, Artificial Sequence
  chemically synthesized
tttcctgagactcagtgaca

SEQ ID NO: 35638 - DNA, 20 bp, Artificial Sequence
  chemically synthesized
tcctgagactcagtgacaag

SEQ ID NO: 35639 - DNA, 20 bp, Artificial Sequence
  chemically synthesized
cctgagactcagtgacaagg

SEQ ID NO: 35640 - DNA, 20 bp, Artificial Sequence
  chemically synthesized
agactcagtgacaaggagga

SEQ ID NO: 35641 - DNA, 20 bp, Artificial Sequence
  chemically synthesized
gaatcttttttttgattcca

SEQ ID NO: 35642 - DNA, 20 bp, Artificial Sequence
  chemically synthesized
ttcttgtaatttgttttgtt

SEQ ID NO: 35643 - DNA, 20 bp, Artificial Sequence
  chemically synthesized
gtaatttgttttgttcagcc

SEQ ID NO: 35644 - DNA, 20 bp, Artificial Sequence
  chemically synthesized
tgttttgttcagcctagttt

SEQ ID NO: 35645 - DNA, 20 bp, Artificial Sequence
  chemically synthesized
tgttcagcctagtttcagtt

SEQ ID NO: 35646 - DNA, 20 bp, Artificial Sequence
  chemically synthesized
ttgagtttcacttataacca

SEQ ID NO: 35647 - DNA, 20 bp, Artificial Sequence
  chemically synthesized
tgagtttcacttataaccaa

SEQ ID NO: 35648 - DNA, 20 bp, Artificial Sequence
  chemically synthesized
tattaataattatatcatct

SEQ ID NO: 35649 - DNA, 20 bp, Artificial Sequence
  chemically synthesized
taattatatcatctcagtta

SEQ ID NO: 35650 - DNA, 20 bp, Artificial Sequence
  chemically synthesized
ctctaactaatatttaaaac

SEQ ID NO: 35651 - DNA, 20 bp, Artificial Sequence
  chemically synthesized
ttaaaactggaaaatactgt

SEQ ID NO: 35652 - DNA, 20 bp, Artificial Sequence
  chemically synthesized
taaaactggaaaatactgtt

SEQ ID NO: 35653 - DNA, 20 bp, Artificial Sequence
  chemically synthesized
aactggaaaatactgttagg

SEQ ID NO: 35654 - DNA, 20 bp, Artificial Sequence
  chemically synthesized
tggaaaatactgttaggtag

SEQ ID NO: 35655 - DNA, 20 bp, Artificial Sequence
  chemically synthesized
gaaaatactgttaggtagaa

SEQ ID NO: 35656 - DNA, 20 bp, Artificial Sequence
  chemically synthesized
ctgcctctttttctaaaata

SEQ ID NO: 35657 - DNA, 20 bp, Artificial Sequence
  chemically synthesized
tgcctctttttctaaaatac

SEQ ID NO: 35658 - DNA, 20 bp, Artificial Sequence
  chemically synthesized
tttttctaaaatacaggaaa

SEQ ID NO: 35659 - DNA, 20 bp, Artificial Sequence
  chemically synthesized
caggaaatggaacctaaaaa

SEQ ID NO: 35660 - DNA, 20 bp, Artificial Sequence
  chemically synthesized
gaaatggaacctaaaaatgg

SEQ ID NO: 35661 - DNA, 20 bp, Artificial Sequence
  chemically synthesized
aaatggaacctaaaaatggc

SEQ ID NO: 35662 - DNA, 20 bp, Artificial Sequence
  chemically synthesized
ggaacctaaaaatggcagga

SEQ ID NO: 35663 - DNA, 20 bp, Artificial Sequence
  chemically synthesized
tggcaggaaagttgaccatt

SEQ ID NO: 35664 - DNA, 20 bp, Artificial Sequence
  chemically synthesized
catttggtgaatgatttatg

SEQ ID NO: 35665 - DNA, 20 bp, Artificial Sequence
  chemically synthesized
tgaagttatttcccttgttt

SEQ ID NO: 35666 - DNA, 20 bp, Artificial Sequence
  chemically synthesized
agttatttcccttgtttaag

SEQ ID NO: 35667 - DNA, 20 bp, Artificial Sequence
  chemically synthesized
gaagttcatttctgacttga

SEQ ID NO: 35668 - DNA, 20 bp, Artificial Sequence
  chemically synthesized
ttcatttctgacttgaaagt

SEQ ID NO: 35669 - DNA, 20 bp, Artificial Sequence
  chemically synthesized
agtgtgaaactaaattcact

SEQ ID NO: 35670 - DNA, 20 bp, Artificial Sequence
  chemically synthesized
gtgaaactaaattcactgag

SEQ ID NO: 35671 - DNA, 20 bp, Artificial Sequence
  chemically synthesized
aattcactgagaagatgctg

SEQ ID NO: 35672 - DNA, 20 bp, Artificial Sequence
  chemically synthesized
attcactgagaagatgctgt

SEQ ID NO: 35673 - DNA, 20 bp, Artificial Sequence
  chemically synthesized
aagatgctgtaggatgaata

SEQ ID NO: 35674 - DNA, 20 bp, Artificial Sequence
  chemically synthesized
ctgtaggatgaatacagaca

SEQ ID NO: 35675 - DNA, 20 bp, Artificial Sequence
  chemically synthesized
tgtaggatgaatacagacac

SEQ ID NO: 35676 - DNA, 20 bp, Artificial Sequence
  chemically synthesized
tgaatacagacacaggacat

SEQ ID NO: 35677 - DNA, 20 bp, Artificial Sequence
  chemically synthesized
aatacagacacaggacatcg

SEQ ID NO: 35678 - DNA, 20 bp, Artificial Sequence
  chemically synthesized
atacagacacaggacatcgg

SEQ ID NO: 35679 - DNA, 20 bp, Artificial Sequence
  chemically synthesized
cagacacaggacatcggagg

SEQ ID NO: 35680 - DNA, 20 bp, Artificial Sequence
  chemically synthesized
agacacaggacatcggaggt

SEQ ID NO: 35681 - DNA, 20 bp, Artificial Sequence
  chemically synthesized
gacacaggacatcggaggtg

SEQ ID NO: 35682 - DNA, 20 bp, Artificial Sequence
  chemically synthesized
acacaggacatcggaggtgg

SEQ ID NO: 35683 - DNA, 20 bp, Artificial Sequence
  chemically synthesized
cacaggacatcggaggtggg

SEQ ID NO: 35684 - DNA, 20 bp, Artificial Sequence
  chemically synthesized
aggacatcggaggtgggggg

SEQ ID NO: 35685 - DNA, 20 bp, Artificial Sequence
  chemically synthesized
ctaaataattatctcaaact

SEQ ID NO: 35686 - DNA, 20 bp, Artificial Sequence
  chemically synthesized
ttatctcaaacttagttata

SEQ ID NO: 35687 - DNA, 20 bp, Artificial Sequence
  chemically synthesized
tctcaaacttagttatacag

SEQ ID NO: 35688 - DNA, 20 bp, Artificial Sequence
  chemically synthesized
ctcaaacttagttatacaga

SEQ ID NO: 35689 - DNA, 20 bp, Artificial Sequence
  chemically synthesized
tagttatacagaaggctaca

SEQ ID NO: 35690 - DNA, 20 bp, Artificial Sequence
  chemically synthesized
ttatacagaaggctacatgg

SEQ ID NO: 35691 - DNA, 20 bp, Artificial Sequence
  chemically synthesized
ctacatggtggaaatccact

SEQ ID NO: 35692 - DNA, 20 bp, Artificial Sequence
  chemically synthesized
tgtaacaatcaacataaaca

SEQ ID NO: 35693 - DNA, 20 bp, Artificial Sequence
  chemically synthesized
tcaacataaacacagtatgt

SEQ ID NO: 35694 - DNA, 20 bp, Artificial Sequence
  chemically synthesized
gttagtattatcataaaatt

SEQ ID NO: 35695 - DNA, 20 bp, Artificial Sequence
  chemically synthesized
aactttctgtgatctcctac

SEQ ID NO: 35696 - DNA, 20 bp, Artificial Sequence
  chemically synthesized
atctcctacaagtcttcctg

SEQ ID NO: 35697 - DNA, 20 bp, Artificial Sequence
  chemically synthesized
ggtaaaatgctatgtactat

SEQ ID NO: 35698 - DNA, 20 bp, Artificial Sequence
  chemically synthesized
aaaatgctatgtactattag

SEQ ID NO: 35699 - DNA, 20 bp, Artificial Sequence
  chemically synthesized
ctatgtactattagaagcct

SEQ ID NO: 35700 - DNA, 20 bp, Artificial Sequence
  chemically synthesized
gaagccttagcaaattaata

SEQ ID NO: 35701 - DNA, 20 bp, Artificial Sequence
  chemically synthesized
aagccttagcaaattaatac

SEQ ID NO: 35702 - DNA, 20 bp, Artificial Sequence
  chemically synthesized
ttagcaaattaatacaggaa

SEQ ID NO: 35703 - DNA, 20 bp, Artificial Sequence
  chemically synthesized
taccacgtgttctcacttat

SEQ ID NO: 35704 - DNA, 20 bp, Artificial Sequence
  chemically synthesized
cacgtgttctcacttatgag

SEQ ID NO: 35705 - DNA, 20 bp, Artificial Sequence
  chemically synthesized
acgtgttctcacttatgagt

SEQ ID NO: 35706 - DNA, 20 bp, Artificial Sequence
  chemically synthesized
gtgttctcacttatgagtgg

SEQ ID NO: 35707 - DNA, 20 bp, Artificial Sequence
  chemically synthesized
atgagtgggagctaaatgat

SEQ ID NO: 35708 - DNA, 20 bp, Artificial Sequence
  chemically synthesized
agctaaatgatgagaacaca

SEQ ID NO: 35709 - DNA, 20 bp, Artificial Sequence
  chemically synthesized
gatgagaacacatggacaca

SEQ ID NO: 35710 - DNA, 20 bp, Artificial Sequence
  chemically synthesized
tgagaacacatggacacatg

SEQ ID NO: 35711 - DNA, 20 bp, Artificial Sequence
  chemically synthesized
gagaacacatggacacatgg

SEQ ID NO: 35712 - DNA, 20 bp, Artificial Sequence
  chemically synthesized
agaacacatggacacatgga

SEQ ID NO: 35713 - DNA, 20 bp, Artificial Sequence
  chemically synthesized
gaacacatggacacatggag

SEQ ID NO: 35714 - DNA, 20 bp, Artificial Sequence
  chemically synthesized
tggaggggaacatcacacac

SEQ ID NO: 35715 - DNA, 20 bp, Artificial Sequence
  chemically synthesized
ggaggggaacatcacacact

SEQ ID NO: 35716 - DNA, 20 bp, Artificial Sequence
  chemically synthesized
gaggggaacatcacacactg

SEQ ID NO: 35717 - DNA, 20 bp, Artificial Sequence
  chemically synthesized
catcacacactggggcctat

SEQ ID NO: 35718 - DNA, 20 bp, Artificial Sequence
  chemically synthesized
tcacacactggggcctattg

SEQ ID NO: 35719 - DNA, 20 bp, Artificial Sequence
  chemically synthesized
cacacactggggcctattgg

SEQ ID NO: 35720 - DNA, 20 bp, Artificial Sequence
  chemically synthesized
cactggggcctattggagga

SEQ ID NO: 35721 - DNA, 20 bp, Artificial Sequence
  chemically synthesized
ctggggcctattggaggatg

SEQ ID NO: 35722 - DNA, 20 bp, Artificial Sequence
  chemically synthesized
tggggcctattggaggatgg

SEQ ID NO: 35723 - DNA, 20 bp, Artificial Sequence
  chemically synthesized
ggggcctattggaggatgga

SEQ ID NO: 35724 - DNA, 20 bp, Artificial Sequence
  chemically synthesized
tattggaggatggagggtga

SEQ ID NO: 35725 - DNA, 20 bp, Artificial Sequence
  chemically synthesized
attggaggatggagggtgaa

SEQ ID NO: 35726 - DNA, 20 bp, Artificial Sequence
  chemically synthesized
tggaggatggagggtgaaag

SEQ ID NO: 35727 - DNA, 20 bp, Artificial Sequence
  chemically synthesized
ggaggatggagggtgaaagg

SEQ ID NO: 35728 - DNA, 20 bp, Artificial Sequence
  chemically synthesized
gaggatggagggtgaaagga

SEQ ID NO: 35729 - DNA, 20 bp, Artificial Sequence
  chemically synthesized
ggatggagggtgaaaggagg

SEQ ID NO: 35730 - DNA, 20 bp, Artificial Sequence
  chemically synthesized
atggagggtgaaaggaggga

SEQ ID NO: 35731 - DNA, 20 bp, Artificial Sequence
  chemically synthesized
tggagggtgaaaggagggag

SEQ ID NO: 35732 - DNA, 20 bp, Artificial Sequence
  chemically synthesized
ggtgaaaggagggagaggat

SEQ ID NO: 35733 - DNA, 20 bp, Artificial Sequence
  chemically synthesized
gtgaaaggagggagaggatc

SEQ ID NO: 35734 - DNA, 20 bp, Artificial Sequence
  chemically synthesized
aggagggagaggatcaggaa

SEQ ID NO: 35735 - DNA, 20 bp, Artificial Sequence
  chemically synthesized
aggatcaggaaaagtaacaa

SEQ ID NO: 35736 - DNA, 20 bp, Artificial Sequence
  chemically synthesized
ggatcaggaaaagtaacaaa

SEQ ID NO: 35737 - DNA, 20 bp, Artificial Sequence
  chemically synthesized
gatcaggaaaagtaacaaaa

SEQ ID NO: 35738 - DNA, 20 bp, Artificial Sequence
  chemically synthesized
gaaaagtaacaaaagggtac

SEQ ID NO: 35739 - DNA, 20 bp, Artificial Sequence
  chemically synthesized
aaaagtaacaaaagggtact

SEQ ID NO: 35740 - DNA, 20 bp, Artificial Sequence
  chemically synthesized
gggtactaggcttaatacct

SEQ ID NO: 35741 - DNA, 20 bp, Artificial Sequence
  chemically synthesized
actaggcttaatacctgagt

SEQ ID NO: 35742 - DNA, 20 bp, Artificial Sequence
  chemically synthesized
acaacaaaccctcgtgacac

SEQ ID NO: 35743 - DNA, 20 bp, Artificial Sequence
  chemically synthesized
acacaagtttaaatatgtaa

SEQ ID NO: 35744 - DNA, 20 bp, Artificial Sequence
  chemically synthesized
tactcctgaacctaaaataa

SEQ ID NO: 35745 - DNA, 20 bp, Artificial Sequence
  chemically synthesized
cctgaacctaaaataaaagt

SEQ ID NO: 35746 - DNA, 20 bp, Artificial Sequence
  chemically synthesized
aacctaaaataaaagttagt

SEQ ID NO: 35747 - DNA, 20 bp, Artificial Sequence
  chemically synthesized
acctaaaataaaagttagtt

SEQ ID NO: 35748 - DNA, 20 bp, Artificial Sequence
  chemically synthesized
aaataaaagttagttaggaa

SEQ ID NO: 35749 - DNA, 20 bp, Artificial Sequence
  chemically synthesized
taaaagttagttaggaaaag

SEQ ID NO: 35750 - DNA, 20 bp, Artificial Sequence
  chemically synthesized
ctatttataacactatctcc

SEQ ID NO: 35751 - DNA, 20 bp, Artificial Sequence
  chemically synthesized
tatttataacactatctcct

SEQ ID NO: 35752 - DNA, 20 bp, Artificial Sequence
  chemically synthesized
gcacatgaatttgtattcat

SEQ ID NO: 35753 - DNA, 20 bp, Artificial Sequence
  chemically synthesized
catgaatttgtattcataag

SEQ ID NO: 35754 - DNA, 20 bp, Artificial Sequence
  chemically synthesized
tgaatttgtattcataagaa

SEQ ID NO: 35755 - DNA, 20 bp, Artificial Sequence
  chemically synthesized
atttgtattcataagaagag

SEQ ID NO: 35756 - DNA, 20 bp, Artificial Sequence
  chemically synthesized
ttcataagaagagtagaatt

SEQ ID NO: 35757 - DNA, 20 bp, Artificial Sequence
  chemically synthesized
cataagaagagtagaattca

SEQ ID NO: 35758 - DNA, 20 bp, Artificial Sequence
  chemically synthesized
aagaagagtagaattcagag

SEQ ID NO: 35759 - DNA, 20 bp, Artificial Sequence
  chemically synthesized
gagtagaattcagagtggtc

SEQ ID NO: 35760 - DNA, 20 bp, Artificial Sequence
  chemically synthesized
tagaattcagagtggtccag

SEQ ID NO: 35761 - DNA, 20 bp, Artificial Sequence
  chemically synthesized
ggtccagtggactaacaaac

SEQ ID NO: 35762 - DNA, 20 bp, Artificial Sequence
  chemically synthesized
actggtgaaccaccttctta

SEQ ID NO: 35763 - DNA, 20 bp, Artificial Sequence
  chemically synthesized
ggtgaaccaccttcttacag

SEQ ID NO: 35764 - DNA, 20 bp, Artificial Sequence
  chemically synthesized
gtgaaccaccttcttacagc

SEQ ID NO: 35765 - DNA, 20 bp, Artificial Sequence
  chemically synthesized
ccaccttcttacagcaggtg

SEQ ID NO: 35766 - DNA, 20 bp, Artificial Sequence
  chemically synthesized
agcaggtgaagcctgtaatt

SEQ ID NO: 35767 - DNA, 20 bp, Artificial Sequence
  chemically synthesized
aattcagcttttcatcattc

SEQ ID NO: 35768 - DNA, 20 bp, Artificial Sequence
  chemically synthesized
ttttcatcattcaagactga

SEQ ID NO: 35769 - DNA, 20 bp, Artificial Sequence
  chemically synthesized
tcatcattcaagactgaaag

SEQ ID NO: 35770 - DNA, 20 bp, Artificial Sequence
  chemically synthesized
aaagaagaatataacttata

SEQ ID NO: 35771 - DNA, 20 bp, Artificial Sequence
  chemically synthesized
agaagaatataacttatata

SEQ ID NO: 35772 - DNA, 20 bp, Artificial Sequence
  chemically synthesized
agaatataacttatatagag

SEQ ID NO: 35773 - DNA, 20 bp, Artificial Sequence
  chemically synthesized
gaatataacttatatagaga

SEQ ID NO: 35774 - DNA, 20 bp, Artificial Sequence
  chemically synthesized
tatatagagaaggacctcat

SEQ ID NO: 35775 - DNA, 20 bp, Artificial Sequence
  chemically synthesized
atatagagaaggacctcatg

SEQ ID NO: 35776 - DNA, 20 bp, Artificial Sequence
  chemically synthesized
ctcatgaggaataaatttca

SEQ ID NO: 35777 - DNA, 20 bp, Artificial Sequence
  chemically synthesized
taaatttcatggtgcctatt

SEQ ID NO: 35778 - DNA, 20 bp, Artificial Sequence
  chemically synthesized
tggtgcctattaagataaat

SEQ ID NO: 35779 - DNA, 20 bp, Artificial Sequence
  chemically synthesized
taagataaataagtaccatg

SEQ ID NO: 35780 - DNA, 20 bp, Artificial Sequence
  chemically synthesized
aaataagtaccatgtagtta

SEQ ID NO: 35781 - DNA, 20 bp, Artificial Sequence
  chemically synthesized
aataagtaccatgtagttat

SEQ ID NO: 35782 - DNA, 20 bp, Artificial Sequence
  chemically synthesized
catgtagttatgggaaatct

SEQ ID NO: 35783 - DNA, 20 bp, Artificial Sequence
  chemically synthesized
atgtagttatgggaaatcta

SEQ ID NO: 35784 - DNA, 20 bp, Artificial Sequence
  chemically synthesized
atgggaaatctaaggtgtaa

SEQ ID NO: 35785 - DNA, 20 bp, Artificial Sequence
  chemically synthesized
aaaagaatatacattaaaaa

SEQ ID NO: 35786 - DNA, 20 bp, Artificial Sequence
  chemically synthesized
caaataataatatacttgtg

SEQ ID NO: 35787 - DNA, 20 bp, Artificial Sequence
  chemically synthesized
aataatatacttgtgtagta

SEQ ID NO: 35788 - DNA, 20 bp, Artificial Sequence
  chemically synthesized
ataatatacttgtgtagtat

SEQ ID NO: 35789 - DNA, 20 bp, Artificial Sequence
  chemically synthesized
acttgtgtagtatgggcttg

SEQ ID NO: 35790 - DNA, 20 bp, Artificial Sequence
  chemically synthesized
cttgtgtagtatgggcttga

SEQ ID NO: 35791 - DNA, 20 bp, Artificial Sequence
  chemically synthesized
ttgtgtagtatgggcttgaa

SEQ ID NO: 35792 - DNA, 20 bp, Artificial Sequence
  chemically synthesized
ttgaagggataacataccat

SEQ ID NO: 35793 - DNA, 20 bp, Artificial Sequence
  chemically synthesized
accataagaatatttaattt

SEQ ID NO: 35794 - DNA, 20 bp, Artificial Sequence
  chemically synthesized
taagaatatttaatttgagt

SEQ ID NO: 35795 - DNA, 20 bp, Artificial Sequence
  chemically synthesized
aagaatatttaatttgagtc

SEQ ID NO: 35796 - DNA, 20 bp, Artificial Sequence
  chemically synthesized
taatttgagtcaggaaatga

SEQ ID NO: 35797 - DNA, 20 bp, Artificial Sequence
  chemically synthesized
aatttgagtcaggaaatgaa

SEQ ID NO: 35798 - DNA, 20 bp, Artificial Sequence
  chemically synthesized
gagtcaggaaatgaaaggct

SEQ ID NO: 35799 - DNA, 20 bp, Artificial Sequence
  chemically synthesized
aggctaagtgtgcatttctg

SEQ ID NO: 35800 - DNA, 20 bp, Artificial Sequence
  chemically synthesized
agtgtgcatttctgtagact

SEQ ID NO: 35801 - DNA, 20 bp, Artificial Sequence
  chemically synthesized
tctgtagactaagccaatct

SEQ ID NO: 35802 - DNA, 20 bp, Artificial Sequence
  chemically synthesized
agccaatcttagaaatgatt

SEQ ID NO: 35803 - DNA, 20 bp, Artificial Sequence
  chemically synthesized
caatcttagaaatgattaag

SEQ ID NO: 35804 - DNA, 20 bp, Artificial Sequence
  chemically synthesized
tagaaatgattaagaagacg

SEQ ID NO: 35805 - DNA, 20 bp, Artificial Sequence
  chemically synthesized
aaatgattaagaagacgtgg

SEQ ID NO: 35806 - DNA, 20 bp, Artificial Sequence
  chemically synthesized
aagaagacgtggaagaatct

SEQ ID NO: 35807 - DNA, 20 bp, Artificial Sequence
  chemically synthesized
gaagacgtggaagaatctta

SEQ ID NO: 35808 - DNA, 20 bp, Artificial Sequence
  chemically synthesized
acacactgaaaaaatatgta

SEQ ID NO: 35809 - DNA, 20 bp, Artificial Sequence
  chemically synthesized
aaaaatatgtatggtctaat

SEQ ID NO: 35810 - DNA, 20 bp, Artificial Sequence
  chemically synthesized
tgtatggtctaatgagttta

SEQ ID NO: 35811 - DNA, 20 bp, Artificial Sequence
  chemically synthesized
catataaaatgaatttatac

SEQ ID NO: 35812 - DNA, 20 bp, Artificial Sequence
  chemically synthesized
aaaatgaatttatactagat

SEQ ID NO: 35813 - DNA, 20 bp, Artificial Sequence
  chemically synthesized
aaatgaatttatactagata

SEQ ID NO: 35814 - DNA, 20 bp, Artificial Sequence
  chemically synthesized
aatgaatttatactagataa

SEQ ID NO: 35815 - DNA, 20 bp, Artificial Sequence
  chemically synthesized
atgaatttatactagataag

SEQ ID NO: 35816 - DNA, 20 bp, Artificial Sequence
  chemically synthesized
aatttatactagataagggg

SEQ ID NO: 35817 - DNA, 20 bp, Artificial Sequence
  chemically synthesized
tctcattaacaaataattgc

SEQ ID NO: 35818 - DNA, 20 bp, Artificial Sequence
  chemically synthesized
ctcattaacaaataattgct

SEQ ID NO: 35819 - DNA, 20 bp, Artificial Sequence
  chemically synthesized
taattgctgggttccttcac

SEQ ID NO: 35820 - DNA, 20 bp, Artificial Sequence
  chemically synthesized
attgctgggttccttcacca

SEQ ID NO: 35821 - DNA, 20 bp, Artificial Sequence
  chemically synthesized
gggttccttcaccagagatg

SEQ ID NO: 35822 - DNA, 20 bp, Artificial Sequence
  chemically synthesized
accagagatgcagattttta

SEQ ID NO: 35823 - DNA, 20 bp, Artificial Sequence
  chemically synthesized
ccagagatgcagatttttat

SEQ ID NO: 35824 - DNA, 20 bp, Artificial Sequence
  chemically synthesized
cagagatgcagatttttata

SEQ ID NO: 35825 - DNA, 20 bp, Artificial Sequence
  chemically synthesized
gatttttatagggtaaatga

SEQ ID NO: 35826 - DNA, 20 bp, Artificial Sequence
  chemically synthesized
atttttatagggtaaatgaa

SEQ ID NO: 35827 - DNA, 20 bp, Artificial Sequence
  chemically synthesized
aatgaaaggtgatatattta

SEQ ID NO: 35828 - DNA, 20 bp, Artificial Sequence
  chemically synthesized
atatatttaaagatacttac

SEQ ID NO: 35829 - DNA, 20 bp, Artificial Sequence
  chemically synthesized
agatacttactagattatat

SEQ ID NO: 35830 - DNA, 20 bp, Artificial Sequence
  chemically synthesized
agattatatgagtattaaat

SEQ ID NO: 35831 - DNA, 20 bp, Artificial Sequence
  chemically synthesized
gattatatgagtattaaatt

SEQ ID NO: 35832 - DNA, 20 bp, Artificial Sequence
  chemically synthesized
tatatgagtattaaattggg

SEQ ID NO: 35833 - DNA, 20 bp, Artificial Sequence
  chemically synthesized
tgagtattaaattgggcagc

SEQ ID NO: 35834 - DNA, 20 bp, Artificial Sequence
  chemically synthesized
gagtattaaattgggcagca

SEQ ID NO: 35835 - DNA, 20 bp, Artificial Sequence
  chemically synthesized
aattgggcagcaaggatgat

SEQ ID NO: 35836 - DNA, 20 bp, Artificial Sequence
  chemically synthesized
aaggatgattagaaatgatt

SEQ ID NO: 35837 - DNA, 20 bp, Artificial Sequence
  chemically synthesized
aggatgattagaaatgatta

SEQ ID NO: 35838 - DNA, 20 bp, Artificial Sequence
  chemically synthesized
attagaaatgattaaggacc

SEQ ID NO: 35839 - DNA, 20 bp, Artificial Sequence
  chemically synthesized
tagaaatgattaaggaccca

SEQ ID NO: 35840 - DNA, 20 bp, Artificial Sequence
  chemically synthesized
agaaatgattaaggacccag

SEQ ID NO: 35841 - DNA, 20 bp, Artificial Sequence
  chemically synthesized
gaggtctccatgtccaatta

SEQ ID NO: 35842 - DNA, 20 bp, Artificial Sequence
  chemically synthesized
taaatctgtttttgatttta

SEQ ID NO: 35843 - DNA, 20 bp, Artificial Sequence
  chemically synthesized
gattttatagcctaaatcct

SEQ ID NO: 35844 - DNA, 20 bp, Artificial Sequence
  chemically synthesized
atagcctaaatccttagaca

SEQ ID NO: 35845 - DNA, 20 bp, Artificial Sequence
  chemically synthesized
cattgttattaataaactca

SEQ ID NO: 35846 - DNA, 20 bp, Artificial Sequence
  chemically synthesized
catagacaaaatttatttta

SEQ ID NO: 35847 - DNA, 20 bp, Artificial Sequence
  chemically synthesized
atagacaaaatttattttat

SEQ ID NO: 35848 - DNA, 20 bp, Artificial Sequence
  chemically synthesized
aatttattttatgggaaatt

SEQ ID NO: 35849 - DNA, 20 bp, Artificial Sequence
  chemically synthesized
atttattttatgggaaattt

SEQ ID NO: 35850 - DNA, 20 bp, Artificial Sequence
  chemically synthesized
ttattttatgggaaatttag

SEQ ID NO: 35851 - DNA, 20 bp, Artificial Sequence
  chemically synthesized
aatttaggagtttatgtccc

SEQ ID NO: 35852 - DNA, 20 bp, Artificial Sequence
  chemically synthesized
agtttatgtccctagatttc

SEQ ID NO: 35853 - DNA, 20 bp, Artificial Sequence
  chemically synthesized
agtacatgccaccaaactga

SEQ ID NO: 35854 - DNA, 20 bp, Artificial Sequence
  chemically synthesized
gccaccaaactgacagatga

SEQ ID NO: 35855 - DNA, 20 bp, Artificial Sequence
  chemically synthesized
aactgacagatgacagtgat

SEQ ID NO: 35856 - DNA, 20 bp, Artificial Sequence
  chemically synthesized
gatgacagtgattagtcaca

SEQ ID NO: 35857 - DNA, 20 bp, Artificial Sequence
  chemically synthesized
gtcacaaagtgcctcaaaaa

SEQ ID NO: 35858 - DNA, 20 bp, Artificial Sequence
  chemically synthesized
caaagtgcctcaaaaataga

SEQ ID NO: 35859 - DNA, 20 bp, Artificial Sequence
  chemically synthesized
aaaaatagatggccctatgt

SEQ ID NO: 35860 - DNA, 20 bp, Artificial Sequence
  chemically synthesized
agatggccctatgttagtca

SEQ ID NO: 35861 - DNA, 20 bp, Artificial Sequence
  chemically synthesized
ctatgttagtcatggttctc

SEQ ID NO: 35862 - DNA, 20 bp, Artificial Sequence
  chemically synthesized
gtcatggttctccagaaaaa

SEQ ID NO: 35863 - DNA, 20 bp, Artificial Sequence
  chemically synthesized
ctccagaaaaatagaatcaa

SEQ ID NO: 35864 - DNA, 20 bp, Artificial Sequence
  chemically synthesized
tccagaaaaatagaatcaac

SEQ ID NO: 35865 - DNA, 20 bp, Artificial Sequence
  chemically synthesized
ccaacttcaaattatactac

SEQ ID NO: 35866 - DNA, 20 bp, Artificial Sequence
  chemically synthesized
caacttcaaattatactaca

SEQ ID NO: 35867 - DNA, 20 bp, Artificial Sequence
  chemically synthesized
caaattatactacaaggtga

SEQ ID NO: 35868 - DNA, 20 bp, Artificial Sequence
  chemically synthesized
gtgacagtaactaactgaaa

SEQ ID NO: 35869 - DNA, 20 bp, Artificial Sequence
  chemically synthesized
agtaactaactgaaacagca

SEQ ID NO: 35870 - DNA, 20 bp, Artificial Sequence
  chemically synthesized
agcatggtactgataccaaa

SEQ ID NO: 35871 - DNA, 20 bp, Artificial Sequence
  chemically synthesized
caaacagacacactgactaa

SEQ ID NO: 35872 - DNA, 20 bp, Artificial Sequence
  chemically synthesized
agacacactgactaatggaa

SEQ ID NO: 35873 - DNA, 20 bp, Artificial Sequence
  chemically synthesized
cactgactaatggaacagaa

SEQ ID NO: 35874 - DNA, 20 bp, Artificial Sequence
  chemically synthesized
ctgactaatggaacagaatg

SEQ ID NO: 35875 - DNA, 20 bp, Artificial Sequence
  chemically synthesized
atggaacagaatggagaact

SEQ ID NO: 35876 - DNA, 20 bp, Artificial Sequence
  chemically synthesized
gaacagaatggagaactcag

SEQ ID NO: 35877 - DNA, 20 bp, Artificial Sequence
  chemically synthesized
agaatggagaactcagaagt

SEQ ID NO: 35878 - DNA, 20 bp, Artificial Sequence
  chemically synthesized
aatctgatcttcaacaaacc

SEQ ID NO: 35879 - DNA, 20 bp, Artificial Sequence
  chemically synthesized
tcaacaaacctggtaaaaac

SEQ ID NO: 35880 - DNA, 20 bp, Artificial Sequence
  chemically synthesized
aacctggtaaaaacaagtaa

SEQ ID NO: 35881 - DNA, 20 bp, Artificial Sequence
  chemically synthesized
acctggtaaaaacaagtaat

SEQ ID NO: 35882 - DNA, 20 bp, Artificial Sequence
  chemically synthesized
cctggtaaaaacaagtaatg

SEQ ID NO: 35883 - DNA, 20 bp, Artificial Sequence
  chemically synthesized
ggtaaaaacaagtaatgggg

SEQ ID NO: 35884 - DNA, 20 bp, Artificial Sequence
  chemically synthesized
gtaaaaacaagtaatgggga

SEQ ID NO: 35885 - DNA, 20 bp, Artificial Sequence
  chemically synthesized
taaaaacaagtaatggggaa

SEQ ID NO: 35886 - DNA, 20 bp, Artificial Sequence
  chemically synthesized
ccctattttataaattgtgc

SEQ ID NO: 35887 - DNA, 20 bp, Artificial Sequence
  chemically synthesized
cctattttataaattgtgct

SEQ ID NO: 35888 - DNA, 20 bp, Artificial Sequence
  chemically synthesized
tattttataaattgtgctgg

SEQ ID NO: 35889 - DNA, 20 bp, Artificial Sequence
  chemically synthesized
ataaattgtgctgggagaac

SEQ ID NO: 35890 - DNA, 20 bp, Artificial Sequence
  chemically synthesized
attgtgctgggagaactggc

SEQ ID NO: 35891 - DNA, 20 bp, Artificial Sequence
  chemically synthesized
gagaactggctagccatatg

SEQ ID NO: 35892 - DNA, 20 bp, Artificial Sequence
  chemically synthesized
catatgcagaaaattgaaac

SEQ ID NO: 35893 - DNA, 20 bp, Artificial Sequence
  chemically synthesized
tcttatacataaattaactc

SEQ ID NO: 35894 - DNA, 20 bp, Artificial Sequence
  chemically synthesized
aattaactcaagatgcatta

SEQ ID NO: 35895 - DNA, 20 bp, Artificial Sequence
  chemically synthesized
tcaagatgcattaaagactt

SEQ ID NO: 35896 - DNA, 20 bp, Artificial Sequence
  chemically synthesized
acccaaaactataaaaactt

SEQ ID NO: 35897 - DNA, 20 bp, Artificial Sequence
  chemically synthesized
caaaactataaaaactttag

SEQ ID NO: 35898 - DNA, 20 bp, Artificial Sequence
  chemically synthesized
aaaaactttagaagaaaacc

SEQ ID NO: 35899 - DNA, 20 bp, Artificial Sequence
  chemically synthesized
aaaactttagaagaaaacct

SEQ ID NO: 35900 - DNA, 20 bp, Artificial Sequence
  chemically synthesized
aaacctaggcaataccattc

SEQ ID NO: 35901 - DNA, 20 bp, Artificial Sequence
  chemically synthesized
aggcaataccattccggaca

SEQ ID NO: 35902 - DNA, 20 bp, Artificial Sequence
  chemically synthesized
taccattccggacatagaca

SEQ ID NO: 35903 - DNA, 20 bp, Artificial Sequence
  chemically synthesized
accattccggacatagacac

SEQ ID NO: 35904 - DNA, 20 bp, Artificial Sequence
  chemically synthesized
tccggacatagacacaggca

SEQ ID NO: 35905 - DNA, 20 bp, Artificial Sequence
  chemically synthesized
gtcaaaaacaattgcaacaa

SEQ ID NO: 35906 - DNA, 20 bp, Artificial Sequence
  chemically synthesized
aaaagcaaacactgtcaaat

SEQ ID NO: 35907 - DNA, 20 bp, Artificial Sequence
  chemically synthesized
aatgagatctaattaaacta

SEQ ID NO: 35908 - DNA, 20 bp, Artificial Sequence
  chemically synthesized
tgagatctaattaaactaaa

SEQ ID NO: 35909 - DNA, 20 bp, Artificial Sequence
  chemically synthesized
tctaattaaactaaagagat

SEQ ID NO: 35910 - DNA, 20 bp, Artificial Sequence
  chemically synthesized
ctaattaaactaaagagatc

SEQ ID NO: 35911 - DNA, 20 bp, Artificial Sequence
  chemically synthesized
taaactaaagagatcgggca

SEQ ID NO: 35912 - DNA, 20 bp, Artificial Sequence
  chemically synthesized
actaaagagatcgggcatgg

SEQ ID NO: 35913 - DNA, 20 bp, Artificial Sequence
  chemically synthesized
gtggctcacgcctgtaatcc

SEQ ID NO: 35914 - DNA, 20 bp, Artificial Sequence
  chemically synthesized
cgcctgtaatcccagcactt

SEQ ID NO: 35915 - DNA, 20 bp, Artificial Sequence
  chemically synthesized
gcctgtaatcccagcacttt

SEQ ID NO: 35916 - DNA, 20 bp, Artificial Sequence
  chemically synthesized
ctgtaatcccagcactttgg

SEQ ID NO: 35917 - DNA, 20 bp, Artificial Sequence
  chemically synthesized
tgtaatcccagcactttggg

SEQ ID NO: 35918 - DNA, 20 bp, Artificial Sequence
  chemically synthesized
tcccagcactttgggaggcc

SEQ ID NO: 35919 - DNA, 20 bp, Artificial Sequence
  chemically synthesized
cccagcactttgggaggcca

SEQ ID NO: 35920 - DNA, 20 bp, Artificial Sequence
  chemically synthesized
agcactttgggaggccaagg

SEQ ID NO: 35921 - DNA, 20 bp, Artificial Sequence
  chemically synthesized
gcactttgggaggccaaggt

SEQ ID NO: 35922 - DNA, 20 bp, Artificial Sequence
  chemically synthesized
ctttgggaggccaaggtggg

SEQ ID NO: 35923 - DNA, 20 bp, Artificial Sequence
  chemically synthesized
ccaaggtgggtggatcactt

SEQ ID NO: 35924 - DNA, 20 bp, Artificial Sequence
  chemically synthesized
caaggtgggtggatcacttg

SEQ ID NO: 35925 - DNA, 20 bp, Artificial Sequence
  chemically synthesized
ggtgggtggatcacttgagg

SEQ ID NO: 35926 - DNA, 20 bp, Artificial Sequence
  chemically synthesized
gtgggtggatcacttgaggt

SEQ ID NO: 35927 - DNA, 20 bp, Artificial Sequence
  chemically synthesized
tgggtggatcacttgaggtg

SEQ ID NO: 35928 - DNA, 20 bp, Artificial Sequence
  chemically synthesized
ggtggatcacttgaggtggg

SEQ ID NO: 35929 - DNA, 20 bp, Artificial Sequence
  chemically synthesized
tcacttgaggtggggagtat

SEQ ID NO: 35930 - DNA, 20 bp, Artificial Sequence
  chemically synthesized
acttgaggtggggagtataa

SEQ ID NO: 35931 - DNA, 20 bp, Artificial Sequence
  chemically synthesized
tgaggtggggagtataagag

SEQ ID NO: 35932 - DNA, 20 bp, Artificial Sequence
  chemically synthesized
tggggagtataagagcagcc

SEQ ID NO: 35933 - DNA, 20 bp, Artificial Sequence
  chemically synthesized
taagagcagcctggccaaca

SEQ ID NO: 35934 - DNA, 20 bp, Artificial Sequence
  chemically synthesized
taaaaatacaaaaaatgtgc

SEQ ID NO: 35935 - DNA, 20 bp, Artificial Sequence
  chemically synthesized
aaaaatacaaaaaatgtgct

SEQ ID NO: 35936 - DNA, 20 bp, Artificial Sequence
  chemically synthesized
tacaaaaaatgtgctgggta

SEQ ID NO: 35937 - DNA, 20 bp, Artificial Sequence
  chemically synthesized
aaaaaatgtgctgggtatgg

SEQ ID NO: 35938 - DNA, 20 bp, Artificial Sequence
  chemically synthesized
gtggtgcgtacctgtaatct

SEQ ID NO: 35939 - DNA, 20 bp, Artificial Sequence
  chemically synthesized
tacctgtaatctcagctact

SEQ ID NO: 35940 - DNA, 20 bp, Artificial Sequence
  chemically synthesized
acctgtaatctcagctactc

SEQ ID NO: 35941 - DNA, 20 bp, Artificial Sequence
  chemically synthesized
ctgtaatctcagctactcag

SEQ ID NO: 35942 - DNA, 20 bp, Artificial Sequence
  chemically synthesized
tgtaatctcagctactcagg

SEQ ID NO: 35943 - DNA, 20 bp, Artificial Sequence
  chemically synthesized
tctcagctactcaggaggct

SEQ ID NO: 35944 - DNA, 20 bp, Artificial Sequence
  chemically synthesized
ctcagctactcaggaggctg

SEQ ID NO: 35945 - DNA, 20 bp, Artificial Sequence
  chemically synthesized
agctactcaggaggctgagg

SEQ ID NO: 35946 - DNA, 20 bp, Artificial Sequence
  chemically synthesized
gctactcaggaggctgaggc

SEQ ID NO: 35947 - DNA, 20 bp, Artificial Sequence
  chemically synthesized
tactcaggaggctgaggcag

SEQ ID NO: 35948 - DNA, 20 bp, Artificial Sequence
  chemically synthesized
gcaggagaattgcttgaacc

SEQ ID NO: 35949 - DNA, 20 bp, Artificial Sequence
  chemically synthesized
caggagaattgcttgaaccc

SEQ ID NO: 35950 - DNA, 20 bp, Artificial Sequence
  chemically synthesized
ggagaattgcttgaacccag

SEQ ID NO: 35951 - DNA, 20 bp, Artificial Sequence
  chemically synthesized
gagaattgcttgaacccagg

SEQ ID NO: 35952 - DNA, 20 bp, Artificial Sequence
  chemically synthesized
aattgcttgaacccaggagg

SEQ ID NO: 35953 - DNA, 20 bp, Artificial Sequence
  chemically synthesized
ttgcttgaacccaggaggca

SEQ ID NO: 35954 - DNA, 20 bp, Artificial Sequence
  chemically synthesized
tgcttgaacccaggaggcag

SEQ ID NO: 35955 - DNA, 20 bp, Artificial Sequence
  chemically synthesized
aacccaggaggcagaggttg

SEQ ID NO: 35956 - DNA, 20 bp, Artificial Sequence
  chemically synthesized
caggaggcagaggttgcagt

SEQ ID NO: 35957 - DNA, 20 bp, Artificial Sequence
  chemically synthesized
ggcagaggttgcagtgagct

SEQ ID NO: 35958 - DNA, 20 bp, Artificial Sequence
  chemically synthesized
gagatcgcaccactgcactc

SEQ ID NO: 35959 - DNA, 20 bp, Artificial Sequence
  chemically synthesized
cgcaccactgcactctagca

SEQ ID NO: 35960 - DNA, 20 bp, Artificial Sequence
  chemically synthesized
gcaccactgcactctagcat

SEQ ID NO: 35961 - DNA, 20 bp, Artificial Sequence
  chemically synthesized
ctgcactctagcatgggtga

SEQ ID NO: 35962 - DNA, 20 bp, Artificial Sequence
  chemically synthesized
gcactctagcatgggtgaaa

SEQ ID NO: 35963 - DNA, 20 bp, Artificial Sequence
  chemically synthesized
tctagcatgggtgaaagagt

SEQ ID NO: 35964 - DNA, 20 bp, Artificial Sequence
  chemically synthesized
tgagacttcatctcaaaata

SEQ ID NO: 35965 - DNA, 20 bp, Artificial Sequence
  chemically synthesized
aagaaaaatacaattaaata

SEQ ID NO: 35966 - DNA, 20 bp, Artificial Sequence
  chemically synthesized
gaaaaatacaattaaataca

SEQ ID NO: 35967 - DNA, 20 bp, Artificial Sequence
  chemically synthesized
ttaaatacagagcttctaaa

SEQ ID NO: 35968 - DNA, 20 bp, Artificial Sequence
  chemically synthesized
acagcaaaataaactatcat

SEQ ID NO: 35969 - DNA, 20 bp, Artificial Sequence
  chemically synthesized
agcaaaataaactatcatca

SEQ ID NO: 35970 - DNA, 20 bp, Artificial Sequence
  chemically synthesized
taaactatcatcagagcgaa

SEQ ID NO: 35971 - DNA, 20 bp, Artificial Sequence
  chemically synthesized
aaactatcatcagagcgaac

SEQ ID NO: 35972 - DNA, 20 bp, Artificial Sequence
  chemically synthesized
cagagcgaacaggcaaccta

SEQ ID NO: 35973 - DNA, 20 bp, Artificial Sequence
  chemically synthesized
cgaacaggcaacctacagaa

SEQ ID NO: 35974 - DNA, 20 bp, Artificial Sequence
  chemically synthesized
gaacaggcaacctacagaat

SEQ ID NO: 35975 - DNA, 20 bp, Artificial Sequence
  chemically synthesized
acaggcaacctacagaatgg

SEQ ID NO: 35976 - DNA, 20 bp, Artificial Sequence
  chemically synthesized
tgcaatctacccatctgaca

SEQ ID NO: 35977 - DNA, 20 bp, Artificial Sequence
  chemically synthesized
gcaatctacccatctgacaa

SEQ ID NO: 35978 - DNA, 20 bp, Artificial Sequence
  chemically synthesized
tctgacaaaggtctaatatc

SEQ ID NO: 35979 - DNA, 20 bp, Artificial Sequence
  chemically synthesized
gtctaatatccagaatctat

SEQ ID NO: 35980 - DNA, 20 bp, Artificial Sequence
  chemically synthesized
tctaatatccagaatctatg

SEQ ID NO: 35981 - DNA, 20 bp, Artificial Sequence
  chemically synthesized
tccagaatctatgaggaact

SEQ ID NO: 35982 - DNA, 20 bp, Artificial Sequence
  chemically synthesized
gaacttagacatatttacaa

SEQ ID NO: 35983 - DNA, 20 bp, Artificial Sequence
  chemically synthesized
acacaaacaaccccattaaa

SEQ ID NO: 35984 - DNA, 20 bp, Artificial Sequence
  chemically synthesized
caaacaaccccattaaaaag

SEQ ID NO: 35985 - DNA, 20 bp, Artificial Sequence
  chemically synthesized
aaacaaccccattaaaaagt

SEQ ID NO: 35986 - DNA, 20 bp, Artificial Sequence
  chemically synthesized
accccattaaaaagtgggca

SEQ ID NO: 35987 - DNA, 20 bp, Artificial Sequence
  chemically synthesized
ccccattaaaaagtgggcaa

SEQ ID NO: 35988 - DNA, 20 bp, Artificial Sequence
  chemically synthesized
aagtgggcaaaggacatgaa

SEQ ID NO: 35989 - DNA, 20 bp, Artificial Sequence
  chemically synthesized
catgaacagacacttctcaa

SEQ ID NO: 35990 - DNA, 20 bp, Artificial Sequence
  chemically synthesized
gaacagacacttctcaaaag

SEQ ID NO: 35991 - DNA, 20 bp, Artificial Sequence
  chemically synthesized
ctcaaaagaagacatttatg

SEQ ID NO: 35992 - DNA, 20 bp, Artificial Sequence
  chemically synthesized
aagaagacatttatgtggct

SEQ ID NO: 35993 - DNA, 20 bp, Artificial Sequence
  chemically synthesized
ggctaagaaacatacgaaaa

SEQ ID NO: 35994 - DNA, 20 bp, Artificial Sequence
  chemically synthesized
gtctcaatgtcactgatcat

SEQ ID NO: 35995 - DNA, 20 bp, Artificial Sequence
  chemically synthesized
ctcaatgtcactgatcatta

SEQ ID NO: 35996 - DNA, 20 bp, Artificial Sequence
  chemically synthesized
aatgaaataccatctgacac

SEQ ID NO: 35997 - DNA, 20 bp, Artificial Sequence
  chemically synthesized
aaataccatctgacaccagt

SEQ ID NO: 35998 - DNA, 20 bp, Artificial Sequence
  chemically synthesized
ccatctgacaccagtcagaa

SEQ ID NO: 35999 - DNA, 20 bp, Artificial Sequence
  chemically synthesized
tctgacaccagtcagaatgg

SEQ ID NO: 36000 - DNA, 20 bp, Artificial Sequence
  chemically synthesized
agtcagaatggtggttttta

SEQ ID NO: 36001 - DNA, 20 bp, Artificial Sequence
  chemically synthesized
gaatggtggtttttaaagtc

SEQ ID NO: 36002 - DNA, 20 bp, Artificial Sequence
  chemically synthesized
tttttaaagtcaagaaacaa

SEQ ID NO: 36003 - DNA, 20 bp, Artificial Sequence
  chemically synthesized
agtcaagaaacaacagatgc

SEQ ID NO: 36004 - DNA, 20 bp, Artificial Sequence
  chemically synthesized
aagaaacaacagatgctagc

SEQ ID NO: 36005 - DNA, 20 bp, Artificial Sequence
  chemically synthesized
agaaacaacagatgctagca

SEQ ID NO: 36006 - DNA, 20 bp, Artificial Sequence
  chemically synthesized
aacagatgctagcaaggttg

SEQ ID NO: 36007 - DNA, 20 bp, Artificial Sequence
  chemically synthesized
cagatgctagcaaggttgca

SEQ ID NO: 36008 - DNA, 20 bp, Artificial Sequence
  chemically synthesized
ctagcaaggttgcagagaaa

SEQ ID NO: 36009 - DNA, 20 bp, Artificial Sequence
  chemically synthesized
tagcaaggttgcagagaaat

SEQ ID NO: 36010 - DNA, 20 bp, Artificial Sequence
  chemically synthesized
taggaacacttttacactgt

SEQ ID NO: 36011 - DNA, 20 bp, Artificial Sequence
  chemically synthesized
gaacacttttacactgttgg

SEQ ID NO: 36012 - DNA, 20 bp, Artificial Sequence
  chemically synthesized
aacacttttacactgttggt

SEQ ID NO: 36013 - DNA, 20 bp, Artificial Sequence
  chemically synthesized
gtaaactaattcaaccattg

SEQ ID NO: 36014 - DNA, 20 bp, Artificial Sequence
  chemically synthesized
aactaattcaaccattgtgg

SEQ ID NO: 36015 - DNA, 20 bp, Artificial Sequence
  chemically synthesized
aattcaaccattgtggaaga

SEQ ID NO: 36016 - DNA, 20 bp, Artificial Sequence
  chemically synthesized
aaccattgtggaagacagtg

SEQ ID NO: 36017 - DNA, 20 bp, Artificial Sequence
  chemically synthesized
gacagtgtggcaattcctca

SEQ ID NO: 36018 - DNA, 20 bp, Artificial Sequence
  chemically synthesized
gtggcaattcctcaaagatt

SEQ ID NO: 36019 - DNA, 20 bp, Artificial Sequence
  chemically synthesized
attcctcaaagatttagaac

SEQ ID NO: 36020 - DNA, 20 bp, Artificial Sequence
  chemically synthesized
tgacctcacaatcccattac

SEQ ID NO: 36021 - DNA, 20 bp, Artificial Sequence
  chemically synthesized
gacctcacaatcccattact

SEQ ID NO: 36022 - DNA, 20 bp, Artificial Sequence
  chemically synthesized
cattactgggtatataccta

SEQ ID NO: 36023 - DNA, 20 bp, Artificial Sequence
  chemically synthesized
attactgggtatatacctaa

SEQ ID NO: 36024 - DNA, 20 bp, Artificial Sequence
  chemically synthesized
tactgggtatatacctaaag

SEQ ID NO: 36025 - DNA, 20 bp, Artificial Sequence
  chemically synthesized
gtataaatcattctattact

SEQ ID NO: 36026 - DNA, 20 bp, Artificial Sequence
  chemically synthesized
atgcacatgtatgttcattg

SEQ ID NO: 36027 - DNA, 20 bp, Artificial Sequence
  chemically synthesized
cattgtagcactattcacaa

SEQ ID NO: 36028 - DNA, 20 bp, Artificial Sequence
  chemically synthesized
tagcactattcacaatagca

SEQ ID NO: 36029 - DNA, 20 bp, Artificial Sequence
  chemically synthesized
tattcacaatagcaaagaca

SEQ ID NO: 36030 - DNA, 20 bp, Artificial Sequence
  chemically synthesized
agacatagaatcaacccaaa

SEQ ID NO: 36031 - DNA, 20 bp, Artificial Sequence
  chemically synthesized
acccaaatggccatcaatga

SEQ ID NO: 36032 - DNA, 20 bp, Artificial Sequence
  chemically synthesized
gatagacaatttaaaaaatg

SEQ ID NO: 36033 - DNA, 20 bp, Artificial Sequence
  chemically synthesized
aaatactatctaaccataaa

SEQ ID NO: 36034 - DNA, 20 bp, Artificial Sequence
  chemically synthesized
aatactatctaaccataaaa

SEQ ID NO: 36035 - DNA, 20 bp, Artificial Sequence
  chemically synthesized
atactatctaaccataaaaa

SEQ ID NO: 36036 - DNA, 20 bp, Artificial Sequence
  chemically synthesized
atctaaccataaaaagggat

SEQ ID NO: 36037 - DNA, 20 bp, Artificial Sequence
  chemically synthesized
gatgagatcatgccctttgc

SEQ ID NO: 36038 - DNA, 20 bp, Artificial Sequence
  chemically synthesized
atgagatcatgccctttgct

SEQ ID NO: 36039 - DNA, 20 bp, Artificial Sequence
  chemically synthesized
tcatgccctttgctgggaca

SEQ ID NO: 36040 - DNA, 20 bp, Artificial Sequence
  chemically synthesized
gccctttgctgggacatgga

SEQ ID NO: 36041 - DNA, 20 bp, Artificial Sequence
  chemically synthesized
cctttgctgggacatggatg

SEQ ID NO: 36042 - DNA, 20 bp, Artificial Sequence
  chemically synthesized
tgggacatggatggagccga

SEQ ID NO: 36043 - DNA, 20 bp, Artificial Sequence
  chemically synthesized
gagccgaaagccattatctt

SEQ ID NO: 36044 - DNA, 20 bp, Artificial Sequence
  chemically synthesized
ttatcttcagtaaactaatg

SEQ ID NO: 36045 - DNA, 20 bp, Artificial Sequence
  chemically synthesized
tatcttcagtaaactaatgc

SEQ ID NO: 36046 - DNA, 20 bp, Artificial Sequence
  chemically synthesized
tcagtaaactaatgcaggaa

SEQ ID NO: 36047 - DNA, 20 bp, Artificial Sequence
  chemically synthesized
aaacaccacatgttctcact

SEQ ID NO: 36048 - DNA, 20 bp, Artificial Sequence
  chemically synthesized
caccacatgttctcacttag

SEQ ID NO: 36049 - DNA, 20 bp, Artificial Sequence
  chemically synthesized
cacatgttctcacttagaag

SEQ ID NO: 36050 - DNA, 20 bp, Artificial Sequence
  chemically synthesized
acatgttctcacttagaagt

SEQ ID NO: 36051 - DNA, 20 bp, Artificial Sequence
  chemically synthesized
atgttctcacttagaagtgg

SEQ ID NO: 36052 - DNA, 20 bp, Artificial Sequence
  chemically synthesized
agaagtgggagctgaacaat

SEQ ID NO: 36053 - DNA, 20 bp, Artificial Sequence
  chemically synthesized
gggagctgaacaatgagaat

SEQ ID NO: 36054 - DNA, 20 bp, Artificial Sequence
  chemically synthesized
acaatgagaatgagaacaca

SEQ ID NO: 36055 - DNA, 20 bp, Artificial Sequence
  chemically synthesized
agaatgagaacacatggaaa

SEQ ID NO: 36056 - DNA, 20 bp, Artificial Sequence
  chemically synthesized
tgagaacacatggaaacagt

SEQ ID NO: 36057 - DNA, 20 bp, Artificial Sequence
  chemically synthesized
gagaacacatggaaacagtg

SEQ ID NO: 36058 - DNA, 20 bp, Artificial Sequence
  chemically synthesized
agaacacatggaaacagtga

SEQ ID NO: 36059 - DNA, 20 bp, Artificial Sequence
  chemically synthesized
gaacacatggaaacagtgag

SEQ ID NO: 36060 - DNA, 20 bp, Artificial Sequence
  chemically synthesized
cacatggaaacagtgagggg

SEQ ID NO: 36061 - DNA, 20 bp, Artificial Sequence
  chemically synthesized
gtgaggggaagaacacacac

SEQ ID NO: 36062 - DNA, 20 bp, Artificial Sequence
  chemically synthesized
gaggggaagaacacacactg

SEQ ID NO: 36063 - DNA, 20 bp, Artificial Sequence
  chemically synthesized
gaacacacactggagcctgt

SEQ ID NO: 36064 - DNA, 20 bp, Artificial Sequence
  chemically synthesized
aacacacactggagcctgtc

SEQ ID NO: 36065 - DNA, 20 bp, Artificial Sequence
  chemically synthesized
acacacactggagcctgtca

SEQ ID NO: 36066 - DNA, 20 bp, Artificial Sequence
  chemically synthesized
cactggagcctgtcagggca

SEQ ID NO: 36067 - DNA, 20 bp, Artificial Sequence
  chemically synthesized
actggagcctgtcagggcat

SEQ ID NO: 36068 - DNA, 20 bp, Artificial Sequence
  chemically synthesized
ctggagcctgtcagggcatg

SEQ ID NO: 36069 - DNA, 20 bp, Artificial Sequence
  chemically synthesized
gcctgtcagggcatggggtg

SEQ ID NO: 36070 - DNA, 20 bp, Artificial Sequence
  chemically synthesized
tcagggcatggggtgtggtg

SEQ ID NO: 36071 - DNA, 20 bp, Artificial Sequence
  chemically synthesized
cagggcatggggtgtggtga

SEQ ID NO: 36072 - DNA, 20 bp, Artificial Sequence
  chemically synthesized
agggcatggggtgtggtgaa

SEQ ID NO: 36073 - DNA, 20 bp, Artificial Sequence
  chemically synthesized
gggcatggggtgtggtgaag

SEQ ID NO: 36074 - DNA, 20 bp, Artificial Sequence
  chemically synthesized
gcatggggtgtggtgaaggg

SEQ ID NO: 36075 - DNA, 20 bp, Artificial Sequence
  chemically synthesized
ggtgtggtgaaggggagcat

SEQ ID NO: 36076 - DNA, 20 bp, Artificial Sequence
  chemically synthesized
aaggggagcattagaaaaaa

SEQ ID NO: 36077 - DNA, 20 bp, Artificial Sequence
  chemically synthesized
aaaaaatagctaatgcatgc

SEQ ID NO: 36078 - DNA, 20 bp, Artificial Sequence
  chemically synthesized
aaaaatagctaatgcatgct

SEQ ID NO: 36079 - DNA, 20 bp, Artificial Sequence
  chemically synthesized
tgcatgctgggcttaacacc

SEQ ID NO: 36080 - DNA, 20 bp, Artificial Sequence
  chemically synthesized
gcatgctgggcttaacacct

SEQ ID NO: 36081 - DNA, 20 bp, Artificial Sequence
  chemically synthesized
tgggcttaacacctaggtga

SEQ ID NO: 36082 - DNA, 20 bp, Artificial Sequence
  chemically synthesized
gggcttaacacctaggtgat

SEQ ID NO: 36083 - DNA, 20 bp, Artificial Sequence
  chemically synthesized
acacctaggtgatgggttga

SEQ ID NO: 36084 - DNA, 20 bp, Artificial Sequence
  chemically synthesized
cacctaggtgatgggttgat

SEQ ID NO: 36085 - DNA, 20 bp, Artificial Sequence
  chemically synthesized
aggtgatgggttgataggta

SEQ ID NO: 36086 - DNA, 20 bp, Artificial Sequence
  chemically synthesized
cacatcctgcacatgtacct

SEQ ID NO: 36087 - DNA, 20 bp, Artificial Sequence
  chemically synthesized
attgaatgtacataaaaata

SEQ ID NO: 36088 - DNA, 20 bp, Artificial Sequence
  chemically synthesized
actgcattaaaaaaaaataa

SEQ ID NO: 36089 - DNA, 20 bp, Artificial Sequence
  chemically synthesized
ctgttgcaccaacctaatat

SEQ ID NO: 36090 - DNA, 20 bp, Artificial Sequence
  chemically synthesized
tgttgcaccaacctaatata

SEQ ID NO: 36091 - DNA, 20 bp, Artificial Sequence
  chemically synthesized
accaacctaatataaggaaa

SEQ ID NO: 36092 - DNA, 20 bp, Artificial Sequence
  chemically synthesized
aacctaatataaggaaatag

SEQ ID NO: 36093 - DNA, 20 bp, Artificial Sequence
  chemically synthesized
ggaaatagcagatgtgatta

SEQ ID NO: 36094 - DNA, 20 bp, Artificial Sequence
  chemically synthesized
aaatagcagatgtgattatg

SEQ ID NO: 36095 - DNA, 20 bp, Artificial Sequence
  chemically synthesized
aatagcagatgtgattatgg

SEQ ID NO: 36096 - DNA, 20 bp, Artificial Sequence
  chemically synthesized
agcagatgtgattatggagg

SEQ ID NO: 36097 - DNA, 20 bp, Artificial Sequence
  chemically synthesized
gcagatgtgattatggagga

SEQ ID NO: 36098 - DNA, 20 bp, Artificial Sequence
  chemically synthesized
atgtgattatggaggaaggc

SEQ ID NO: 36099 - DNA, 20 bp, Artificial Sequence
  chemically synthesized
tatggaggaaggcaagtccc

SEQ ID NO: 36100 - DNA, 20 bp, Artificial Sequence
  chemically synthesized
aaggcaagtcccaagatatg

SEQ ID NO: 36101 - DNA, 20 bp, Artificial Sequence
  chemically synthesized
ggcaagtcccaagatatgca

SEQ ID NO: 36102 - DNA, 20 bp, Artificial Sequence
  chemically synthesized
agtcccaagatatgcagagt

SEQ ID NO: 36103 - DNA, 20 bp, Artificial Sequence
  chemically synthesized
gatatgcagagtgagtcatc

SEQ ID NO: 36104 - DNA, 20 bp, Artificial Sequence
  chemically synthesized
agtcatcaagttgaaaactc

SEQ ID NO: 36105 - DNA, 20 bp, Artificial Sequence
  chemically synthesized
tcatcaagttgaaaactcaa

SEQ ID NO: 36106 - DNA, 20 bp, Artificial Sequence
  chemically synthesized
atcaagttgaaaactcaaga

SEQ ID NO: 36107 - DNA, 20 bp, Artificial Sequence
  chemically synthesized
gttgaaaactcaagagagcc

SEQ ID NO: 36108 - DNA, 20 bp, Artificial Sequence
  chemically synthesized
gaaaactcaagagagcctgg

SEQ ID NO: 36109 - DNA, 20 bp, Artificial Sequence
  chemically synthesized
ctcaagagagcctggtagtt

SEQ ID NO: 36110 - DNA, 20 bp, Artificial Sequence
  chemically synthesized
agagcctggtagtttagtcc

SEQ ID NO: 36111 - DNA, 20 bp, Artificial Sequence
  chemically synthesized
tggtagtttagtcccagtcc

SEQ ID NO: 36112 - DNA, 20 bp, Artificial Sequence
  chemically synthesized
ttagtcccagtccaagtctg

SEQ ID NO: 36113 - DNA, 20 bp, Artificial Sequence
  chemically synthesized
tagtcccagtccaagtctga

SEQ ID NO: 36114 - DNA, 20 bp, Artificial Sequence
  chemically synthesized
ccagtccaagtctgaaggcc

SEQ ID NO: 36115 - DNA, 20 bp, Artificial Sequence
  chemically synthesized
cagtccaagtctgaaggcct

SEQ ID NO: 36116 - DNA, 20 bp, Artificial Sequence
  chemically synthesized
aagtctgaaggcctgggaaa

SEQ ID NO: 36117 - DNA, 20 bp, Artificial Sequence
  chemically synthesized
agtctgaaggcctgggaaac

SEQ ID NO: 36118 - DNA, 20 bp, Artificial Sequence
  chemically synthesized
tctgaaggcctgggaaacag

SEQ ID NO: 36119 - DNA, 20 bp, Artificial Sequence
  chemically synthesized
ctgaaggcctgggaaacagg

SEQ ID NO: 36120 - DNA, 20 bp, Artificial Sequence
  chemically synthesized
ctgggaaacaggaggattga

SEQ ID NO: 36121 - DNA, 20 bp, Artificial Sequence
  chemically synthesized
atggtgtacttgcaacccaa

SEQ ID NO: 36122 - DNA, 20 bp, Artificial Sequence
  chemically synthesized
acttgcaacccaaaagccat

SEQ ID NO: 36123 - DNA, 20 bp, Artificial Sequence
  chemically synthesized
cttgcaacccaaaagccatc

SEQ ID NO: 36124 - DNA, 20 bp, Artificial Sequence
  chemically synthesized
acccaaaagccatcaggctt

SEQ ID NO: 36125 - DNA, 20 bp, Artificial Sequence
  chemically synthesized
aagccatcaggcttcagacc

SEQ ID NO: 36126 - DNA, 20 bp, Artificial Sequence
  chemically synthesized
agccatcaggcttcagaccc

SEQ ID NO: 36127 - DNA, 20 bp, Artificial Sequence
  chemically synthesized
catcaggcttcagacccagg

SEQ ID NO: 36128 - DNA, 20 bp, Artificial Sequence
  chemically synthesized
cccaggaagttttgatgttt

SEQ ID NO: 36129 - DNA, 20 bp, Artificial Sequence
  chemically synthesized
tgatgtttcagttcaatcta

SEQ ID NO: 36130 - DNA, 20 bp, Artificial Sequence
  chemically synthesized
gatgtttcagttcaatctaa

SEQ ID NO: 36131 - DNA, 20 bp, Artificial Sequence
  chemically synthesized
gtttcagttcaatctaaagg

SEQ ID NO: 36132 - DNA, 20 bp, Artificial Sequence
  chemically synthesized
tcaatctaaaggcagaaaaa

SEQ ID NO: 36133 - DNA, 20 bp, Artificial Sequence
  chemically synthesized
caatctaaaggcagaaaaaa

SEQ ID NO: 36134 - DNA, 20 bp, Artificial Sequence
  chemically synthesized
taaaggcagaaaaaaaggtc

SEQ ID NO: 36135 - DNA, 20 bp, Artificial Sequence
  chemically synthesized
agaaaaaaaggtctagattc

SEQ ID NO: 36136 - DNA, 20 bp, Artificial Sequence
  chemically synthesized
aaggtctagattccagtttg

SEQ ID NO: 36137 - DNA, 20 bp, Artificial Sequence
  chemically synthesized
aggtctagattccagtttga

SEQ ID NO: 36138 - DNA, 20 bp, Artificial Sequence
  chemically synthesized
ccagtttgaaggccatcaat

SEQ ID NO: 36139 - DNA, 20 bp, Artificial Sequence
  chemically synthesized
cagtttgaaggccatcaata

SEQ ID NO: 36140 - DNA, 20 bp, Artificial Sequence
  chemically synthesized
aggaataattctctctgatt

SEQ ID NO: 36141 - DNA, 20 bp, Artificial Sequence
  chemically synthesized
ggaataattctctctgattt

SEQ ID NO: 36142 - DNA, 20 bp, Artificial Sequence
  chemically synthesized
gaataattctctctgatttg

SEQ ID NO: 36143 - DNA, 20 bp, Artificial Sequence
  chemically synthesized
taattctctctgatttgggg

SEQ ID NO: 36144 - DNA, 20 bp, Artificial Sequence
  chemically synthesized
aattctctctgatttgggga

SEQ ID NO: 36145 - DNA, 20 bp, Artificial Sequence
  chemically synthesized
attctctctgatttggggaa

SEQ ID NO: 36146 - DNA, 20 bp, Artificial Sequence
  chemically synthesized
tctctgatttggggaagggt

SEQ ID NO: 36147 - DNA, 20 bp, Artificial Sequence
  chemically synthesized
gtcagactttttgttctatt

SEQ ID NO: 36148 - DNA, 20 bp, Artificial Sequence
  chemically synthesized
tcagactttttgttctattc

SEQ ID NO: 36149 - DNA, 20 bp, Artificial Sequence
  chemically synthesized
tattcaggttttcaactgat

SEQ ID NO: 36150 - DNA, 20 bp, Artificial Sequence
  chemically synthesized
ttcaggttttcaactgattg

SEQ ID NO: 36151 - DNA, 20 bp, Artificial Sequence
  chemically synthesized
tcaggttttcaactgattgg

SEQ ID NO: 36152 - DNA, 20 bp, Artificial Sequence
  chemically synthesized
ggttttcaactgattggagg

SEQ ID NO: 36153 - DNA, 20 bp, Artificial Sequence
  chemically synthesized
ttggaggaagccgcctgcaa

SEQ ID NO: 36154 - DNA, 20 bp, Artificial Sequence
  chemically synthesized
tggaggaagccgcctgcaat

SEQ ID NO: 36155 - DNA, 20 bp, Artificial Sequence
  chemically synthesized
aggaagccgcctgcaatagg

SEQ ID NO: 36156 - DNA, 20 bp, Artificial Sequence
  chemically synthesized
ggaagccgcctgcaatagga

SEQ ID NO: 36157 - DNA, 20 bp, Artificial Sequence
  chemically synthesized
gaaggaccatctgctctact

SEQ ID NO: 36158 - DNA, 20 bp, Artificial Sequence
  chemically synthesized
aacaccctcacaaaaacatc

SEQ ID NO: 36159 - DNA, 20 bp, Artificial Sequence
  chemically synthesized
aataatgtttgacaaatatt

SEQ ID NO: 36160 - DNA, 20 bp, Artificial Sequence
  chemically synthesized
ataatgtttgacaaatattt

SEQ ID NO: 36161 - DNA, 20 bp, Artificial Sequence
  chemically synthesized
acaaatatttgggcacccca

SEQ ID NO: 36162 - DNA, 20 bp, Artificial Sequence
  chemically synthesized
tatttgggcaccccatggcc

SEQ ID NO: 36163 - DNA, 20 bp, Artificial Sequence
  chemically synthesized
accccatggcccagtcaaat

SEQ ID NO: 36164 - DNA, 20 bp, Artificial Sequence
  chemically synthesized
tggcatataaaattaaccat

SEQ ID NO: 36165 - DNA, 20 bp, Artificial Sequence
  chemically synthesized
gcatataaaattaaccatca

SEQ ID NO: 36166 - DNA, 20 bp, Artificial Sequence
  chemically synthesized
aaattaaccatcagagcctg

SEQ ID NO: 36167 - DNA, 20 bp, Artificial Sequence
  chemically synthesized
attaaccatcagagcctgta

SEQ ID NO: 36168 - DNA, 20 bp, Artificial Sequence
  chemically synthesized
ttaaccatcagagcctgtag

SEQ ID NO: 36169 - DNA, 20 bp, Artificial Sequence
  chemically synthesized
catcagagcctgtagaggat

SEQ ID NO: 36170 - DNA, 20 bp, Artificial Sequence
  chemically synthesized
agcctgtagaggatgagtta

SEQ ID NO: 36171 - DNA, 20 bp, Artificial Sequence
  chemically synthesized
gcctgtagaggatgagttaa

SEQ ID NO: 36172 - DNA, 20 bp, Artificial Sequence
  chemically synthesized
gtagaggatgagttaaagga

SEQ ID NO: 36173 - DNA, 20 bp, Artificial Sequence
  chemically synthesized
gagttaaaggatggaatctt

SEQ ID NO: 36174 - DNA, 20 bp, Artificial Sequence
  chemically synthesized
gttaaaggatggaatcttcg

SEQ ID NO: 36175 - DNA, 20 bp, Artificial Sequence
  chemically synthesized
ggaatcttcggagataattg

SEQ ID NO: 36176 - DNA, 20 bp, Artificial Sequence
  chemically synthesized
tcggagataattgtggaatc

SEQ ID NO: 36177 - DNA, 20 bp, Artificial Sequence
  chemically synthesized
gagataattgtggaatccag

SEQ ID NO: 36178 - DNA, 20 bp, Artificial Sequence
  chemically synthesized
agataattgtggaatccaga

SEQ ID NO: 36179 - DNA, 20 bp, Artificial Sequence
  chemically synthesized
tgtggaatccagaaggctga

SEQ ID NO: 36180 - DNA, 20 bp, Artificial Sequence
  chemically synthesized
tccagaaggctgacagataa

SEQ ID NO: 36181 - DNA, 20 bp, Artificial Sequence
  chemically synthesized
gataatagaatcaaactaca

SEQ ID NO: 36182 - DNA, 20 bp, Artificial Sequence
  chemically synthesized
ctacacagaaaaaaaaaaaa

SEQ ID NO: 36183 - DNA, 20 bp, Artificial Sequence
  chemically synthesized
cacagaaaaaaaaaaaaaag

SEQ ID NO: 36184 - DNA, 20 bp, Artificial Sequence
  chemically synthesized
gaaaaaaaaaaaaaagaagc

SEQ ID NO: 36185 - DNA, 20 bp, Artificial Sequence
  chemically synthesized
aaaaaagaagctggtattgt

SEQ ID NO: 36186 - DNA, 20 bp, Artificial Sequence
  chemically synthesized
agaagctggtattgtcagca

SEQ ID NO: 36187 - DNA, 20 bp, Artificial Sequence
  chemically synthesized
gcacagacttactcaacaaa

SEQ ID NO: 36188 - DNA, 20 bp, Artificial Sequence
  chemically synthesized
tcaacaaacagcaaaaatcc

SEQ ID NO: 36189 - DNA, 20 bp, Artificial Sequence
  chemically synthesized
caacaaacagcaaaaatcct

SEQ ID NO: 36190 - DNA, 20 bp, Artificial Sequence
  chemically synthesized
aaacagcaaaaatcctagga

SEQ ID NO: 36191 - DNA, 20 bp, Artificial Sequence
  chemically synthesized
acagcaaaaatcctaggata

SEQ ID NO: 36192 - DNA, 20 bp, Artificial Sequence
  chemically synthesized
tagagaccttcctgaatcgt

SEQ ID NO: 36193 - DNA, 20 bp, Artificial Sequence
  chemically synthesized
tcctgaatcgttagcgatat

SEQ ID NO: 36194 - DNA, 20 bp, Artificial Sequence
  chemically synthesized
ctatatgccatatgtaatat

SEQ ID NO: 36195 - DNA, 20 bp, Artificial Sequence
  chemically synthesized
tatatgccatatgtaatata

SEQ ID NO: 36196 - DNA, 20 bp, Artificial Sequence
  chemically synthesized
atgccatatgtaatataagg

SEQ ID NO: 36197 - DNA, 20 bp, Artificial Sequence
  chemically synthesized
ccatatgtaatataaggcag

SEQ ID NO: 36198 - DNA, 20 bp, Artificial Sequence
  chemically synthesized
atgtaatataaggcagcagt

SEQ ID NO: 36199 - DNA, 20 bp, Artificial Sequence
  chemically synthesized
tataaggcagcagttagata

SEQ ID NO: 36200 - DNA, 20 bp, Artificial Sequence
  chemically synthesized
ttagatatagactgtgatgc

SEQ ID NO: 36201 - DNA, 20 bp, Artificial Sequence
  chemically synthesized
agatatagactgtgatgcca

SEQ ID NO: 36202 - DNA, 20 bp, Artificial Sequence
  chemically synthesized
tagactgtgatgccagagct

SEQ ID NO: 36203 - DNA, 20 bp, Artificial Sequence
  chemically synthesized
gtgatgccagagctcagacc

SEQ ID NO: 36204 - DNA, 20 bp, Artificial Sequence
  chemically synthesized
gatgccagagctcagaccaa

SEQ ID NO: 36205 - DNA, 20 bp, Artificial Sequence
  chemically synthesized
cagagctcagaccaagagcc

SEQ ID NO: 36206 - DNA, 20 bp, Artificial Sequence
  chemically synthesized
agagctcagaccaagagcca

SEQ ID NO: 36207 - DNA, 20 bp, Artificial Sequence
  chemically synthesized
tcagaccaagagccaaggaa

SEQ ID NO: 36208 - DNA, 20 bp, Artificial Sequence
  chemically synthesized
cagaccaagagccaaggaat

SEQ ID NO: 36209 - DNA, 20 bp, Artificial Sequence
  chemically synthesized
accaagagccaaggaatagg

SEQ ID NO: 36210 - DNA, 20 bp, Artificial Sequence
  chemically synthesized
gagccaaggaataggaagac

SEQ ID NO: 36211 - DNA, 20 bp, Artificial Sequence
  chemically synthesized
aaaaatattttcattttaaa

SEQ ID NO: 36212 - DNA, 20 bp, Artificial Sequence
  chemically synthesized
atattttcattttaaaaagt

SEQ ID NO: 36213 - DNA, 20 bp, Artificial Sequence
  chemically synthesized
tattttcattttaaaaagtt

SEQ ID NO: 36214 - DNA, 20 bp, Artificial Sequence
  chemically synthesized
ttaggtaatttctaataatg

SEQ ID NO: 36215 - DNA, 20 bp, Artificial Sequence
  chemically synthesized
ttctaataatgtggctgcct

SEQ ID NO: 36216 - DNA, 20 bp, Artificial Sequence
  chemically synthesized
tgtggctgcctgagtatttt

SEQ ID NO: 36217 - DNA, 20 bp, Artificial Sequence
  chemically synthesized
ctgcctgagtattttcagca

SEQ ID NO: 36218 - DNA, 20 bp, Artificial Sequence
  chemically synthesized
aaatattgtgttatgtgatt

SEQ ID NO: 36219 - DNA, 20 bp, Artificial Sequence
  chemically synthesized
attgtgttatgtgatttaga

SEQ ID NO: 36220 - DNA, 20 bp, Artificial Sequence
  chemically synthesized
tgtgttatgtgatttagaaa

SEQ ID NO: 36221 - DNA, 20 bp, Artificial Sequence
  chemically synthesized
ttatgtgatttagaaagaga

SEQ ID NO: 36222 - DNA, 20 bp, Artificial Sequence
  chemically synthesized
tatgtgatttagaaagagac

SEQ ID NO: 36223 - DNA, 20 bp, Artificial Sequence
  chemically synthesized
tttagaaagagacaggcact

SEQ ID NO: 36224 - DNA, 20 bp, Artificial Sequence
  chemically synthesized
agaaagagacaggcactcag

SEQ ID NO: 36225 - DNA, 20 bp, Artificial Sequence
  chemically synthesized
actcagcggatgacccttgt

SEQ ID NO: 36226 - DNA, 20 bp, Artificial Sequence
  chemically synthesized
ctcagcggatgacccttgtc

SEQ ID NO: 36227 - DNA, 20 bp, Artificial Sequence
  chemically synthesized
tgtcaggaaacactgcatca

SEQ ID NO: 36228 - DNA, 20 bp, Artificial Sequence
  chemically synthesized
caggaaacactgcatcaaag

SEQ ID NO: 36229 - DNA, 20 bp, Artificial Sequence
  chemically synthesized
aggaaacactgcatcaaaga

SEQ ID NO: 36230 - DNA, 20 bp, Artificial Sequence
  chemically synthesized
atcaaagaaggcttttatta

SEQ ID NO: 36231 - DNA, 20 bp, Artificial Sequence
  chemically synthesized
tcaaagaaggcttttattac

SEQ ID NO: 36232 - DNA, 20 bp, Artificial Sequence
  chemically synthesized
aaagaaggcttttattacag

SEQ ID NO: 36233 - DNA, 20 bp, Artificial Sequence
  chemically synthesized
aaggcttttattacaggaga

SEQ ID NO: 36234 - DNA, 20 bp, Artificial Sequence
  chemically synthesized
ggcttttattacaggagatg

SEQ ID NO: 36235 - DNA, 20 bp, Artificial Sequence
  chemically synthesized
gcttttattacaggagatgg

SEQ ID NO: 36236 - DNA, 20 bp, Artificial Sequence
  chemically synthesized
atggaggtccttcccaatct

SEQ ID NO: 36237 - DNA, 20 bp, Artificial Sequence
  chemically synthesized
tgacatgatactttacttca

SEQ ID NO: 36238 - DNA, 20 bp, Artificial Sequence
  chemically synthesized
gacatgatactttacttcac

SEQ ID NO: 36239 - DNA, 20 bp, Artificial Sequence
  chemically synthesized
actttacttcacaggcaata

SEQ ID NO: 36240 - DNA, 20 bp, Artificial Sequence
  chemically synthesized
ttacttcacaggcaatacag

SEQ ID NO: 36241 - DNA, 20 bp, Artificial Sequence
  chemically synthesized
tacttcacaggcaatacagc

SEQ ID NO: 36242 - DNA, 20 bp, Artificial Sequence
  chemically synthesized
aatacagcaggaaatatgaa

SEQ ID NO: 36243 - DNA, 20 bp, Artificial Sequence
  chemically synthesized
gaaatatgaaaagaatgaac

SEQ ID NO: 36244 - DNA, 20 bp, Artificial Sequence
  chemically synthesized
aaatatgaaaagaatgaaca

SEQ ID NO: 36245 - DNA, 20 bp, Artificial Sequence
  chemically synthesized
gaaaagaatgaacaaggtct

SEQ ID NO: 36246 - DNA, 20 bp, Artificial Sequence
  chemically synthesized
gtcttagaaaatacatgaat

SEQ ID NO: 36247 - DNA, 20 bp, Artificial Sequence
  chemically synthesized
cttagaaaatacatgaatga

SEQ ID NO: 36248 - DNA, 20 bp, Artificial Sequence
  chemically synthesized
atgaatgagagacacatcaa

SEQ ID NO: 36249 - DNA, 20 bp, Artificial Sequence
  chemically synthesized
agacacatcaatggctattt

SEQ ID NO: 36250 - DNA, 20 bp, Artificial Sequence
  chemically synthesized
gacacatcaatggctattta

SEQ ID NO: 36251 - DNA, 20 bp, Artificial Sequence
  chemically synthesized
tcaatggctatttaaggaaa

SEQ ID NO: 36252 - DNA, 20 bp, Artificial Sequence
  chemically synthesized
atggctatttaaggaaatag

SEQ ID NO: 36253 - DNA, 20 bp, Artificial Sequence
  chemically synthesized
taaggaaatagaagatattt

SEQ ID NO: 36254 - DNA, 20 bp, Artificial Sequence
  chemically synthesized
aaggaaatagaagatatttt

SEQ ID NO: 36255 - DNA, 20 bp, Artificial Sequence
  chemically synthesized
gtgccctgcctacttcctcc

SEQ ID NO: 36256 - DNA, 20 bp, Artificial Sequence
  chemically synthesized
tacttcctcccagtgcccct

SEQ ID NO: 36257 - DNA, 20 bp, Artificial Sequence
  chemically synthesized
cctcccagtgcccctaagct

SEQ ID NO: 36258 - DNA, 20 bp, Artificial Sequence
  chemically synthesized
cccctaagcttggtgacttt

SEQ ID NO: 36259 - DNA, 20 bp, Artificial Sequence
  chemically synthesized
agcttggtgactttgagtgt

SEQ ID NO: 36260 - DNA, 20 bp, Artificial Sequence
  chemically synthesized
ctttgagtgttggctgataa

SEQ ID NO: 36261 - DNA, 20 bp, Artificial Sequence
  chemically synthesized
taatagttgttcccattctc

SEQ ID NO: 36262 - DNA, 20 bp, Artificial Sequence
  chemically synthesized
atagttgttcccattctctg

SEQ ID NO: 36263 - DNA, 20 bp, Artificial Sequence
  chemically synthesized
tagttgttcccattctctgg

SEQ ID NO: 36264 - DNA, 20 bp, Artificial Sequence
  chemically synthesized
ggaggcttatcctccaccaa

SEQ ID NO: 36265 - DNA, 20 bp, Artificial Sequence
  chemically synthesized
ccaacagtgtcacttcacat

SEQ ID NO: 36266 - DNA, 20 bp, Artificial Sequence
  chemically synthesized
atgagattttatcccaactc

SEQ ID NO: 36267 - DNA, 20 bp, Artificial Sequence
  chemically synthesized
tgagattttatcccaactct

SEQ ID NO: 36268 - DNA, 20 bp, Artificial Sequence
  chemically synthesized
gagattttatcccaactctg

SEQ ID NO: 36269 - DNA, 20 bp, Artificial Sequence
  chemically synthesized
attttatcccaactctgggg

SEQ ID NO: 36270 - DNA, 20 bp, Artificial Sequence
  chemically synthesized
cccaactctggggcagtctg

SEQ ID NO: 36271 - DNA, 20 bp, Artificial Sequence
  chemically synthesized
ccaactctggggcagtctgc

SEQ ID NO: 36272 - DNA, 20 bp, Artificial Sequence
  chemically synthesized
aattactttatatctgttct

SEQ ID NO: 36273 - DNA, 20 bp, Artificial Sequence
  chemically synthesized
ctttatatctgttctaagat

SEQ ID NO: 36274 - DNA, 20 bp, Artificial Sequence
  chemically synthesized
tctaagataagtgatgtttc

SEQ ID NO: 36275 - DNA, 20 bp, Artificial Sequence
  chemically synthesized
ctaagataagtgatgtttcc

SEQ ID NO: 36276 - DNA, 20 bp, Artificial Sequence
  chemically synthesized
ataagtgatgtttccaggaa

SEQ ID NO: 36277 - DNA, 20 bp, Artificial Sequence
  chemically synthesized
aagtgatgtttccaggaata

SEQ ID NO: 36278 - DNA, 20 bp, Artificial Sequence
  chemically synthesized
caggaatagagtcatattta

SEQ ID NO: 36279 - DNA, 20 bp, Artificial Sequence
  chemically synthesized
aggaatagagtcatatttat

SEQ ID NO: 36280 - DNA, 20 bp, Artificial Sequence
  chemically synthesized
ggaatagagtcatatttatg

SEQ ID NO: 36281 - DNA, 20 bp, Artificial Sequence
  chemically synthesized
atagagtcatatttatgggg

SEQ ID NO: 36282 - DNA, 20 bp, Artificial Sequence
  chemically synthesized
gagtcatatttatggggcag

SEQ ID NO: 36283 - DNA, 20 bp, Artificial Sequence
  chemically synthesized
gcagaagattcgtgtactgc

SEQ ID NO: 36284 - DNA, 20 bp, Artificial Sequence
  chemically synthesized
aagattcgtgtactgccagt

SEQ ID NO: 36285 - DNA, 20 bp, Artificial Sequence
  chemically synthesized
gattcgtgtactgccagtga

SEQ ID NO: 36286 - DNA, 20 bp, Artificial Sequence
  chemically synthesized
attcgtgtactgccagtgag

SEQ ID NO: 36287 - DNA, 20 bp, Artificial Sequence
  chemically synthesized
ttcgtgtactgccagtgaga

SEQ ID NO: 36288 - DNA, 20 bp, Artificial Sequence
  chemically synthesized
caatatacctactaatgaaa

SEQ ID NO: 36289 - DNA, 20 bp, Artificial Sequence
  chemically synthesized
aatatacctactaatgaaat

SEQ ID NO: 36290 - DNA, 20 bp, Artificial Sequence
  chemically synthesized
tatacctactaatgaaatgg

SEQ ID NO: 36291 - DNA, 20 bp, Artificial Sequence
  chemically synthesized
atacctactaatgaaatggg

SEQ ID NO: 36292 - DNA, 20 bp, Artificial Sequence
  chemically synthesized
tacctactaatgaaatggga

SEQ ID NO: 36293 - DNA, 20 bp, Artificial Sequence
  chemically synthesized
ctactaatgaaatgggaggg

SEQ ID NO: 36294 - DNA, 20 bp, Artificial Sequence
  chemically synthesized
agggcagcctgaaattaaat

SEQ ID NO: 36295 - DNA, 20 bp, Artificial Sequence
  chemically synthesized
tgaaattaaatcagttatct

SEQ ID NO: 36296 - DNA, 20 bp, Artificial Sequence
  chemically synthesized
gaaattaaatcagttatctc

SEQ ID NO: 36297 - DNA, 20 bp, Artificial Sequence
  chemically synthesized
aaattaaatcagttatctca

SEQ ID NO: 36298 - DNA, 20 bp, Artificial Sequence
  chemically synthesized
ttactacctcacctcatttt

SEQ ID NO: 36299 - DNA, 20 bp, Artificial Sequence
  chemically synthesized
ctcacctcattttaagttca

SEQ ID NO: 36300 - DNA, 20 bp, Artificial Sequence
  chemically synthesized
ctcattttaagttcaaagca

SEQ ID NO: 36301 - DNA, 20 bp, Artificial Sequence
  chemically synthesized
atggctcccctaaatcaatc

SEQ ID NO: 36302 - DNA, 20 bp, Artificial Sequence
  chemically synthesized
tccagacctaaattttaact

SEQ ID NO: 36303 - DNA, 20 bp, Artificial Sequence
  chemically synthesized
ctaaattttaacttagtaca

SEQ ID NO: 36304 - DNA, 20 bp, Artificial Sequence
  chemically synthesized
aaattttaacttagtacaaa

SEQ ID NO: 36305 - DNA, 20 bp, Artificial Sequence
  chemically synthesized
aattttaacttagtacaaag

SEQ ID NO: 36306 - DNA, 20 bp, Artificial Sequence
  chemically synthesized
aaagaggacacacaaatttt

SEQ ID NO: 36307 - DNA, 20 bp, Artificial Sequence
  chemically synthesized
acacacaaattttcagactt

SEQ ID NO: 36308 - DNA, 20 bp, Artificial Sequence
  chemically synthesized
tttcagacttaagccatttc

SEQ ID NO: 36309 - DNA, 20 bp, Artificial Sequence
  chemically synthesized
tcagacttaagccatttcca

SEQ ID NO: 36310 - DNA, 20 bp, Artificial Sequence
  chemically synthesized
actactattctgcttacatt

SEQ ID NO: 36311 - DNA, 20 bp, Artificial Sequence
  chemically synthesized
ctactattctgcttacattt

SEQ ID NO: 36312 - DNA, 20 bp, Artificial Sequence
  chemically synthesized
ctattctgcttacatttagg

SEQ ID NO: 36313 - DNA, 20 bp, Artificial Sequence
  chemically synthesized
ttacatttaggaagacctat

SEQ ID NO: 36314 - DNA, 20 bp, Artificial Sequence
  chemically synthesized
catttaggaagacctatgag

SEQ ID NO: 36315 - DNA, 20 bp, Artificial Sequence
  chemically synthesized
gaagacctatgagcagaatg

SEQ ID NO: 36316 - DNA, 20 bp, Artificial Sequence
  chemically synthesized
cctatgagcagaatgcagtt

SEQ ID NO: 36317 - DNA, 20 bp, Artificial Sequence
  chemically synthesized
ctatgagcagaatgcagttc

SEQ ID NO: 36318 - DNA, 20 bp, Artificial Sequence
  chemically synthesized
atgagcagaatgcagttcag

SEQ ID NO: 36319 - DNA, 20 bp, Artificial Sequence
  chemically synthesized
tgagcagaatgcagttcagg

SEQ ID NO: 36320 - DNA, 20 bp, Artificial Sequence
  chemically synthesized
acttaactgatgtgaaatgt

SEQ ID NO: 36321 - DNA, 20 bp, Artificial Sequence
  chemically synthesized
cttaactgatgtgaaatgtc

SEQ ID NO: 36322 - DNA, 20 bp, Artificial Sequence
  chemically synthesized
gcaccaaaatgtgaccctca

SEQ ID NO: 36323 - DNA, 20 bp, Artificial Sequence
  chemically synthesized
atactcattttaaaatctca

SEQ ID NO: 36324 - DNA, 20 bp, Artificial Sequence
  chemically synthesized
tcattttaaaatctcatagt

SEQ ID NO: 36325 - DNA, 20 bp, Artificial Sequence
  chemically synthesized
cattttaaaatctcatagtt

SEQ ID NO: 36326 - DNA, 20 bp, Artificial Sequence
  chemically synthesized
taaaatctcatagttgggct

SEQ ID NO: 36327 - DNA, 20 bp, Artificial Sequence
  chemically synthesized
ctcatagttgggctaagttc

SEQ ID NO: 36328 - DNA, 20 bp, Artificial Sequence
  chemically synthesized
tcatagttgggctaagttcc

SEQ ID NO: 36329 - DNA, 20 bp, Artificial Sequence
  chemically synthesized
gctaagttccaggataaatt

SEQ ID NO: 36330 - DNA, 20 bp, Artificial Sequence
  chemically synthesized
ctaagttccaggataaattt

SEQ ID NO: 36331 - DNA, 20 bp, Artificial Sequence
  chemically synthesized
ccaggataaatttaggattt

SEQ ID NO: 36332 - DNA, 20 bp, Artificial Sequence
  chemically synthesized
atttaggatttaagactgat

SEQ ID NO: 36333 - DNA, 20 bp, Artificial Sequence
  chemically synthesized
atttaagactgatgagacaa

SEQ ID NO: 36334 - DNA, 20 bp, Artificial Sequence
  chemically synthesized
gatgagacaatagaaattct

SEQ ID NO: 36335 - DNA, 20 bp, Artificial Sequence
  chemically synthesized
tcagatccttatttctctga

SEQ ID NO: 36336 - DNA, 20 bp, Artificial Sequence
  chemically synthesized
ttatttctctgacagactat

SEQ ID NO: 36337 - DNA, 20 bp, Artificial Sequence
  chemically synthesized
actatgagatgattgtattc

SEQ ID NO: 36338 - DNA, 20 bp, Artificial Sequence
  chemically synthesized
tgtattcaagtacaaattgt

SEQ ID NO: 36339 - DNA, 20 bp, Artificial Sequence
  chemically synthesized
caagtacaaattgtcagaca

SEQ ID NO: 36340 - DNA, 20 bp, Artificial Sequence
  chemically synthesized
tacaaattgtcagacaaagc

SEQ ID NO: 36341 - DNA, 20 bp, Artificial Sequence
  chemically synthesized
acaaattgtcagacaaagcc

SEQ ID NO: 36342 - DNA, 20 bp, Artificial Sequence
  chemically synthesized
caaattgtcagacaaagcca

SEQ ID NO: 36343 - DNA, 20 bp, Artificial Sequence
  chemically synthesized
tcagacaaagccagggatta

SEQ ID NO: 36344 - DNA, 20 bp, Artificial Sequence
  chemically synthesized
tcccctttttaacattacta

SEQ ID NO: 36345 - DNA, 20 bp, Artificial Sequence
  chemically synthesized
cccctttttaacattactac

SEQ ID NO: 36346 - DNA, 20 bp, Artificial Sequence
  chemically synthesized
aaacttgatttatattgctc

SEQ ID NO: 36347 - DNA, 20 bp, Artificial Sequence
  chemically synthesized
cttgatttatattgctccag

SEQ ID NO: 36348 - DNA, 20 bp, Artificial Sequence
  chemically synthesized
gatttatattgctccagaag

SEQ ID NO: 36349 - DNA, 20 bp, Artificial Sequence
  chemically synthesized
gaagcagtaactctgattct

SEQ ID NO: 36350 - DNA, 20 bp, Artificial Sequence
  chemically synthesized
aagcagtaactctgattctt

SEQ ID NO: 36351 - DNA, 20 bp, Artificial Sequence
  chemically synthesized
agtaactctgattcttgggc

SEQ ID NO: 36352 - DNA, 20 bp, Artificial Sequence
  chemically synthesized
attcttgggcaagacttacc

SEQ ID NO: 36353 - DNA, 20 bp, Artificial Sequence
  chemically synthesized
tcttgggcaagacttaccaa

SEQ ID NO: 36354 - DNA, 20 bp, Artificial Sequence
  chemically synthesized
gggcaagacttaccaagaga

SEQ ID NO: 36355 - DNA, 20 bp, Artificial Sequence
  chemically synthesized
cttaccaagagacagaaaac

SEQ ID NO: 36356 - DNA, 20 bp, Artificial Sequence
  chemically synthesized
aaaacaagcttactgtttga

SEQ ID NO: 36357 - DNA, 20 bp, Artificial Sequence
  chemically synthesized
tactgtttgaaagaacttat

SEQ ID NO: 36358 - DNA, 20 bp, Artificial Sequence
  chemically synthesized
tgtttgaaagaacttatcag

SEQ ID NO: 36359 - DNA, 20 bp, Artificial Sequence
  chemically synthesized
tatcagcagcactcatttgt

SEQ ID NO: 36360 - DNA, 20 bp, Artificial Sequence
  chemically synthesized
aaacaatcttatttgaaacc

SEQ ID NO: 36361 - DNA, 20 bp, Artificial Sequence
  chemically synthesized
atcttatttgaaaccaagaa

SEQ ID NO: 36362 - DNA, 20 bp, Artificial Sequence
  chemically synthesized
tttgaaaccaagaaaagatt

SEQ ID NO: 36363 - DNA, 20 bp, Artificial Sequence
  chemically synthesized
accaagaaaagattaagtgt

SEQ ID NO: 36364 - DNA, 20 bp, Artificial Sequence
  chemically synthesized
ccaagaaaagattaagtgtg

SEQ ID NO: 36365 - DNA, 20 bp, Artificial Sequence
  chemically synthesized
caagaaaagattaagtgtga

SEQ ID NO: 36366 - DNA, 20 bp, Artificial Sequence
  chemically synthesized
attaagtgtgagggattatt

SEQ ID NO: 36367 - DNA, 20 bp, Artificial Sequence
  chemically synthesized
gggattattaagctttgtct

SEQ ID NO: 36368 - DNA, 20 bp, Artificial Sequence
  chemically synthesized
tattaagctttgtctaagtt

SEQ ID NO: 36369 - DNA, 20 bp, Artificial Sequence
  chemically synthesized
aagctttgtctaagttgagt

SEQ ID NO: 36370 - DNA, 20 bp, Artificial Sequence
  chemically synthesized
tctaagttgagtgagcttat

SEQ ID NO: 36371 - DNA, 20 bp, Artificial Sequence
  chemically synthesized
ttgagtgagcttattggcta

SEQ ID NO: 36372 - DNA, 20 bp, Artificial Sequence
  chemically synthesized
tgagtgagcttattggctac

SEQ ID NO: 36373 - DNA, 20 bp, Artificial Sequence
  chemically synthesized
gagtgagcttattggctaca

SEQ ID NO: 36374 - DNA, 20 bp, Artificial Sequence
  chemically synthesized
agcttattggctacagggtt

SEQ ID NO: 36375 - DNA, 20 bp, Artificial Sequence
  chemically synthesized
gcttattggctacagggtta

SEQ ID NO: 36376 - DNA, 20 bp, Artificial Sequence
  chemically synthesized
acagggttaaggaataacaa

SEQ ID NO: 36377 - DNA, 20 bp, Artificial Sequence
  chemically synthesized
gggttaaggaataacaaaag

SEQ ID NO: 36378 - DNA, 20 bp, Artificial Sequence
  chemically synthesized
ggttaaggaataacaaaagt

SEQ ID NO: 36379 - DNA, 20 bp, Artificial Sequence
  chemically synthesized
aataacaaaagtaggcttca

SEQ ID NO: 36380 - DNA, 20 bp, Artificial Sequence
  chemically synthesized
cttcacggtatcttcttttt

SEQ ID NO: 36381 - DNA, 20 bp, Artificial Sequence
  chemically synthesized
ttcacggtatcttctttttg

SEQ ID NO: 36382 - DNA, 20 bp, Artificial Sequence
  chemically synthesized
acggtatcttctttttgagg

SEQ ID NO: 36383 - DNA, 20 bp, Artificial Sequence
  chemically synthesized
cggtatcttctttttgaggt

SEQ ID NO: 36384 - DNA, 20 bp, Artificial Sequence
  chemically synthesized
ggtatcttctttttgaggtg

SEQ ID NO: 36385 - DNA, 20 bp, Artificial Sequence
  chemically synthesized
tttgaggtggggaatcatac

SEQ ID NO: 36386 - DNA, 20 bp, Artificial Sequence
  chemically synthesized
ttgaggtggggaatcataca

SEQ ID NO: 36387 - DNA, 20 bp, Artificial Sequence
  chemically synthesized
gtggggaatcatacaaggca

SEQ ID NO: 36388 - DNA, 20 bp, Artificial Sequence
  chemically synthesized
tggggaatcatacaaggcaa

SEQ ID NO: 36389 - DNA, 20 bp, Artificial Sequence
  chemically synthesized
ggaatcatacaaggcaaagg

SEQ ID NO: 36390 - DNA, 20 bp, Artificial Sequence
  chemically synthesized
tcatacaaggcaaaggtagt

SEQ ID NO: 36391 - DNA, 20 bp, Artificial Sequence
  chemically synthesized
acaaggcaaaggtagttaga

SEQ ID NO: 36392 - DNA, 20 bp, Artificial Sequence
  chemically synthesized
atagcatgacttccatgtgc

SEQ ID NO: 36393 - DNA, 20 bp, Artificial Sequence
  chemically synthesized
tgacttccatgtgctggatg

SEQ ID NO: 36394 - DNA, 20 bp, Artificial Sequence
  chemically synthesized
aattctgttttctttttgca

SEQ ID NO: 36395 - DNA, 20 bp, Artificial Sequence
  chemically synthesized
ttctttttgcaaagaaaata

SEQ ID NO: 36396 - DNA, 20 bp, Artificial Sequence
  chemically synthesized
tctttttgcaaagaaaatat

SEQ ID NO: 36397 - DNA, 20 bp, Artificial Sequence
  chemically synthesized
ctttttgcaaagaaaatatg

SEQ ID NO: 36398 - DNA, 20 bp, Artificial Sequence
  chemically synthesized
caaagaaaatatggggcttt

SEQ ID NO: 36399 - DNA, 20 bp, Artificial Sequence
  chemically synthesized
aatatggggctttaagaaca

SEQ ID NO: 36400 - DNA, 20 bp, Artificial Sequence
  chemically synthesized
gggctttaagaacacagttc

SEQ ID NO: 36401 - DNA, 20 bp, Artificial Sequence
  chemically synthesized
gctttaagaacacagttctg

SEQ ID NO: 36402 - DNA, 20 bp, Artificial Sequence
  chemically synthesized
ggagcccacttccttctcca

SEQ ID NO: 36403 - DNA, 20 bp, Artificial Sequence
  chemically synthesized
gagcccacttccttctccaa

SEQ ID NO: 36404 - DNA, 20 bp, Artificial Sequence
  chemically synthesized
gcccacttccttctccaaag

SEQ ID NO: 36405 - DNA, 20 bp, Artificial Sequence
  chemically synthesized
cccacttccttctccaaagg

SEQ ID NO: 36406 - DNA, 20 bp, Artificial Sequence
  chemically synthesized
aggcttgaaaaaaaatatcc

SEQ ID NO: 36407 - DNA, 20 bp, Artificial Sequence
  chemically synthesized
cttgaaaaaaaatatcccag

SEQ ID NO: 36408 - DNA, 20 bp, Artificial Sequence
  chemically synthesized
atcccagtagcctaattatc

SEQ ID NO: 36409 - DNA, 20 bp, Artificial Sequence
  chemically synthesized
tagcctaattatccagcatc

SEQ ID NO: 36410 - DNA, 20 bp, Artificial Sequence
  chemically synthesized
ctaattatccagcatcaaga

SEQ ID NO: 36411 - DNA, 20 bp, Artificial Sequence
  chemically synthesized
tccagcatcaagacagatac

SEQ ID NO: 36412 - DNA, 20 bp, Artificial Sequence
  chemically synthesized
ccagcatcaagacagatact

SEQ ID NO: 36413 - DNA, 20 bp, Artificial Sequence
  chemically synthesized
cagcatcaagacagatactg

SEQ ID NO: 36414 - DNA, 20 bp, Artificial Sequence
  chemically synthesized
acctcacaaattaaccctgt

SEQ ID NO: 36415 - DNA, 20 bp, Artificial Sequence
  chemically synthesized
tcacaaattaaccctgttag

SEQ ID NO: 36416 - DNA, 20 bp, Artificial Sequence
  chemically synthesized
ttaaccctgttagcagtctt

SEQ ID NO: 36417 - DNA, 20 bp, Artificial Sequence
  chemically synthesized
aaccctgttagcagtcttca

SEQ ID NO: 36418 - DNA, 20 bp, Artificial Sequence
  chemically synthesized
atttaaaccaatttctacac

SEQ ID NO: 36419 - DNA, 20 bp, Artificial Sequence
  chemically synthesized
tttaaaccaatttctacacc

SEQ ID NO: 36420 - DNA, 20 bp, Artificial Sequence
  chemically synthesized
ccaatttctacaccaggact

SEQ ID NO: 36421 - DNA, 20 bp, Artificial Sequence
  chemically synthesized
ccccttaatttctgataccc

SEQ ID NO: 36422 - DNA, 20 bp, Artificial Sequence
  chemically synthesized
cccttaatttctgatacccc

SEQ ID NO: 36423 - DNA, 20 bp, Artificial Sequence
  chemically synthesized
taatttctgataccccaggt

SEQ ID NO: 36424 - DNA, 20 bp, Artificial Sequence
  chemically synthesized
aatttctgataccccaggtc

SEQ ID NO: 36425 - DNA, 20 bp, Artificial Sequence
  chemically synthesized
tgataccccaggtcaggctc

SEQ ID NO: 36426 - DNA, 20 bp, Artificial Sequence
  chemically synthesized
aggtcaggctctagtgacta

SEQ ID NO: 36427 - DNA, 20 bp, Artificial Sequence
  chemically synthesized
ggtcaggctctagtgactat

SEQ ID NO: 36428 - DNA, 20 bp, Artificial Sequence
  chemically synthesized
tcaggctctagtgactatgg

SEQ ID NO: 36429 - DNA, 20 bp, Artificial Sequence
  chemically synthesized
ctctagtgactatgggagaa

SEQ ID NO: 36430 - DNA, 20 bp, Artificial Sequence
  chemically synthesized
gactatgggagaatggaatg

SEQ ID NO: 36431 - DNA, 20 bp, Artificial Sequence
  chemically synthesized
actatgggagaatggaatga

SEQ ID NO: 36432 - DNA, 20 bp, Artificial Sequence
  chemically synthesized
agaatggaatgaaggtaatt

SEQ ID NO: 36433 - DNA, 20 bp, Artificial Sequence
  chemically synthesized
aatggaatgaaggtaattga

SEQ ID NO: 36434 - DNA, 20 bp, Artificial Sequence
  chemically synthesized
atggaatgaaggtaattgag

SEQ ID NO: 36435 - DNA, 20 bp, Artificial Sequence
  chemically synthesized
aggtaattgagaggaaaata

SEQ ID NO: 36436 - DNA, 20 bp, Artificial Sequence
  chemically synthesized
aaaataaagactaatcttct

SEQ ID NO: 36437 - DNA, 20 bp, Artificial Sequence
  chemically synthesized
ttggattctcttccaccaca

SEQ ID NO: 36438 - DNA, 20 bp, Artificial Sequence
  chemically synthesized
ttccaccacatagttgttgc

SEQ ID NO: 36439 - DNA, 20 bp, Artificial Sequence
  chemically synthesized
ccaccacatagttgttgcaa

SEQ ID NO: 36440 - DNA, 20 bp, Artificial Sequence
  chemically synthesized
caccacatagttgttgcaag

SEQ ID NO: 36441 - DNA, 20 bp, Artificial Sequence
  chemically synthesized
accacatagttgttgcaaga

SEQ ID NO: 36442 - DNA, 20 bp, Artificial Sequence
  chemically synthesized
agttgttgcaagagggtaaa

SEQ ID NO: 36443 - DNA, 20 bp, Artificial Sequence
  chemically synthesized
ttgttgcaagagggtaaata

SEQ ID NO: 36444 - DNA, 20 bp, Artificial Sequence
  chemically synthesized
gcaagagggtaaatagagaa

SEQ ID NO: 36445 - DNA, 20 bp, Artificial Sequence
  chemically synthesized
aagagggtaaatagagaaaa

SEQ ID NO: 36446 - DNA, 20 bp, Artificial Sequence
  chemically synthesized
agagggtaaatagagaaaag

SEQ ID NO: 36447 - DNA, 20 bp, Artificial Sequence
  chemically synthesized
ggtaaatagagaaaagaggc

SEQ ID NO: 36448 - DNA, 20 bp, Artificial Sequence
  chemically synthesized
aggcaagatatctgtatcta

SEQ ID NO: 36449 - DNA, 20 bp, Artificial Sequence
  chemically synthesized
tctgtatctacagattctgc

SEQ ID NO: 36450 - DNA, 20 bp, Artificial Sequence
  chemically synthesized
ctgtatctacagattctgcc

SEQ ID NO: 36451 - DNA, 20 bp, Artificial Sequence
  chemically synthesized
tgtatcaacctccaacataa

SEQ ID NO: 36452 - DNA, 20 bp, Artificial Sequence
  chemically synthesized
aacataaaagttcaacttcc

SEQ ID NO: 36453 - DNA, 20 bp, Artificial Sequence
  chemically synthesized
tgttaactctgaaataaaaa

SEQ ID NO: 36454 - DNA, 20 bp, Artificial Sequence
  chemically synthesized
taactctgaaataaaaacag

SEQ ID NO: 36455 - DNA, 20 bp, Artificial Sequence
  chemically synthesized
aaaacagtagttttatgtga

SEQ ID NO: 36456 - DNA, 20 bp, Artificial Sequence
  chemically synthesized
aaacagtagttttatgtgat

SEQ ID NO: 36457 - DNA, 20 bp, Artificial Sequence
  chemically synthesized
gggtgcttacatgaataatt

SEQ ID NO: 36458 - DNA, 20 bp, Artificial Sequence
  chemically synthesized
gtgcttacatgaataattaa

SEQ ID NO: 36459 - DNA, 20 bp, Artificial Sequence
  chemically synthesized
catgaataattaagagttct

SEQ ID NO: 36460 - DNA, 20 bp, Artificial Sequence
  chemically synthesized
aagagttctgagttgatatc

SEQ ID NO: 36461 - DNA, 20 bp, Artificial Sequence
  chemically synthesized
agttctgagttgatatctag

SEQ ID NO: 36462 - DNA, 20 bp, Artificial Sequence
  chemically synthesized
tgatatctagaagttcttgt

SEQ ID NO: 36463 - DNA, 20 bp, Artificial Sequence
  chemically synthesized
tctagaagttcttgttagct

SEQ ID NO: 36464 - DNA, 20 bp, Artificial Sequence
  chemically synthesized
cttgttagctcagcgctatt

SEQ ID NO: 36465 - DNA, 20 bp, Artificial Sequence
  chemically synthesized
taagaacacttttcctacaa

SEQ ID NO: 36466 - DNA, 20 bp, Artificial Sequence
  chemically synthesized
cctacaatagaaattttctt

SEQ ID NO: 36467 - DNA, 20 bp, Artificial Sequence
  chemically synthesized
acaatagaaattttctttgg

SEQ ID NO: 36468 - DNA, 20 bp, Artificial Sequence
  chemically synthesized
aatagaaattttctttggaa

SEQ ID NO: 36469 - DNA, 20 bp, Artificial Sequence
  chemically synthesized
atagaaattttctttggaag

SEQ ID NO: 36470 - DNA, 20 bp, Artificial Sequence
  chemically synthesized
gaaattttctttggaagagg

SEQ ID NO: 36471 - DNA, 20 bp, Artificial Sequence
  chemically synthesized
aaattttctttggaagaggc

SEQ ID NO: 36472 - DNA, 20 bp, Artificial Sequence
  chemically synthesized
attttctttggaagaggcag

SEQ ID NO: 36473 - DNA, 20 bp, Artificial Sequence
  chemically synthesized
tttctttggaagaggcagga

SEQ ID NO: 36474 - DNA, 20 bp, Artificial Sequence
  chemically synthesized
ttctttggaagaggcaggag

SEQ ID NO: 36475 - DNA, 20 bp, Artificial Sequence
  chemically synthesized
ttggaagaggcaggagagga

SEQ ID NO: 36476 - DNA, 20 bp, Artificial Sequence
  chemically synthesized
ggaagaggcaggagaggaaa

SEQ ID NO: 36477 - DNA, 20 bp, Artificial Sequence
  chemically synthesized
gagaggaaagagactgactc

SEQ ID NO: 36478 - DNA, 20 bp, Artificial Sequence
  chemically synthesized
agaggaaagagactgactct

SEQ ID NO: 36479 - DNA, 20 bp, Artificial Sequence
  chemically synthesized
aggaaagagactgactctgg

SEQ ID NO: 36480 - DNA, 20 bp, Artificial Sequence
  chemically synthesized
tgactctgggagtgaatgtg

SEQ ID NO: 36481 - DNA, 20 bp, Artificial Sequence
  chemically synthesized
gactctgggagtgaatgtgc

SEQ ID NO: 36482 - DNA, 20 bp, Artificial Sequence
  chemically synthesized
actctgggagtgaatgtgca

SEQ ID NO: 36483 - DNA, 20 bp, Artificial Sequence
  chemically synthesized
ctgggagtgaatgtgcaggg

SEQ ID NO: 36484 - DNA, 20 bp, Artificial Sequence
  chemically synthesized
tgggagtgaatgtgcagggt

SEQ ID NO: 36485 - DNA, 20 bp, Artificial Sequence
  chemically synthesized
gggagtgaatgtgcagggtg

SEQ ID NO: 36486 - DNA, 20 bp, Artificial Sequence
  chemically synthesized
tggggtcaccatgacacctg

SEQ ID NO: 36487 - DNA, 20 bp, Artificial Sequence
  chemically synthesized
ggggtcaccatgacacctgt

SEQ ID NO: 36488 - DNA, 20 bp, Artificial Sequence
  chemically synthesized
ctctcctcctcctcttgatg

SEQ ID NO: 36489 - DNA, 20 bp, Artificial Sequence
  chemically synthesized
ctcctcttgatgcagttctc

SEQ ID NO: 36490 - DNA, 20 bp, Artificial Sequence
  chemically synthesized
tcctcttgatgcagttctct

SEQ ID NO: 36491 - DNA, 20 bp, Artificial Sequence
  chemically synthesized
ttgatgcagttctctaggct

SEQ ID NO: 36492 - DNA, 20 bp, Artificial Sequence
  chemically synthesized
cttcttcctcctctactttg

SEQ ID NO: 36493 - DNA, 20 bp, Artificial Sequence
  chemically synthesized
ctttgtagctcccacatttt

SEQ ID NO: 36494 - DNA, 20 bp, Artificial Sequence
  chemically synthesized
cacattttcagcttatatat

SEQ ID NO: 36495 - DNA, 20 bp, Artificial Sequence
  chemically synthesized
cagcttatatattagccaat

SEQ ID NO: 36496 - DNA, 20 bp, Artificial Sequence
  chemically synthesized
atattagccaattagtatat

SEQ ID NO: 36497 - DNA, 20 bp, Artificial Sequence
  chemically synthesized
agtatattagtaatattttg

SEQ ID NO: 36498 - DNA, 20 bp, Artificial Sequence
  chemically synthesized
tgaagtcactgttcttacct

SEQ ID NO: 36499 - DNA, 20 bp, Artificial Sequence
  chemically synthesized
gtcactgttcttacctaagt

SEQ ID NO: 36500 - DNA, 20 bp, Artificial Sequence
  chemically synthesized
acctaagtcagtttaacaat

SEQ ID NO: 36501 - DNA, 20 bp, Artificial Sequence
  chemically synthesized
cagtttaacaatcagcatac

SEQ ID NO: 36502 - DNA, 20 bp, Artificial Sequence
  chemically synthesized
ttaacaatcagcataccagt

SEQ ID NO: 36503 - DNA, 20 bp, Artificial Sequence
  chemically synthesized
caatcagcataccagtcagt

SEQ ID NO: 36504 - DNA, 20 bp, Artificial Sequence
  chemically synthesized
tgatcaatgtgttaatcata

SEQ ID NO: 36505 - DNA, 20 bp, Artificial Sequence
  chemically synthesized
tcaaactctgtcattgcttc

SEQ ID NO: 36506 - DNA, 20 bp, Artificial Sequence
  chemically synthesized
caaactctgtcattgcttcc

SEQ ID NO: 36507 - DNA, 20 bp, Artificial Sequence
  chemically synthesized
aaactctgtcattgcttcca

SEQ ID NO: 36508 - DNA, 20 bp, Artificial Sequence
  chemically synthesized
gtcattgcttccagggccat

SEQ ID NO: 36509 - DNA, 20 bp, Artificial Sequence
  chemically synthesized
tggtgtgttaatacaacact

SEQ ID NO: 36510 - DNA, 20 bp, Artificial Sequence
  chemically synthesized
tgttaatacaacacttagta

SEQ ID NO: 36511 - DNA, 20 bp, Artificial Sequence
  chemically synthesized
aatacaacacttagtaaagt

SEQ ID NO: 36512 - DNA, 20 bp, Artificial Sequence
  chemically synthesized
cttagtaaagtaagcaatgt

SEQ ID NO: 36513 - DNA, 20 bp, Artificial Sequence
  chemically synthesized
aaagtaagcaatgttagtgt

SEQ ID NO: 36514 - DNA, 20 bp, Artificial Sequence
  chemically synthesized
agtaagcaatgttagtgttg

SEQ ID NO: 36515 - DNA, 20 bp, Artificial Sequence
  chemically synthesized
aagcaatgttagtgttggag

SEQ ID NO: 36516 - DNA, 20 bp, Artificial Sequence
  chemically synthesized
agcaatgttagtgttggagt

SEQ ID NO: 36517 - DNA, 20 bp, Artificial Sequence
  chemically synthesized
caatgttagtgttggagtgg

SEQ ID NO: 36518 - DNA, 20 bp, Artificial Sequence
  chemically synthesized
tgttagtgttggagtgggag

SEQ ID NO: 36519 - DNA, 20 bp, Artificial Sequence
  chemically synthesized
accgtgttttttactacaat

SEQ ID NO: 36520 - DNA, 20 bp, Artificial Sequence
  chemically synthesized
tgttttttactacaatgagt

SEQ ID NO: 36521 - DNA, 20 bp, Artificial Sequence
  chemically synthesized
ttttttactacaatgagtta

SEQ ID NO: 36522 - DNA, 20 bp, Artificial Sequence
  chemically synthesized
ctacaatgagttagagccac

SEQ ID NO: 36523 - DNA, 20 bp, Artificial Sequence
  chemically synthesized
tacaatgagttagagccact

SEQ ID NO: 36524 - DNA, 20 bp, Artificial Sequence
  chemically synthesized
gagttagagccactaggtct

SEQ ID NO: 36525 - DNA, 20 bp, Artificial Sequence
  chemically synthesized
gttagagccactaggtctga

SEQ ID NO: 36526 - DNA, 20 bp, Artificial Sequence
  chemically synthesized
agccactaggtctgagagac

SEQ ID NO: 36527 - DNA, 20 bp, Artificial Sequence
  chemically synthesized
taggtctgagagactagtaa

SEQ ID NO: 36528 - DNA, 20 bp, Artificial Sequence
  chemically synthesized
gactagtaaaagaatgtaaa

SEQ ID NO: 36529 - DNA, 20 bp, Artificial Sequence
  chemically synthesized
aacagtaaaaattttgtgct

SEQ ID NO: 36530 - DNA, 20 bp, Artificial Sequence
  chemically synthesized
ttgtgctaagttttatgcta

SEQ ID NO: 36531 - DNA, 20 bp, Artificial Sequence
  chemically synthesized
ctaagttttatgctaaagtc

SEQ ID NO: 36532 - DNA, 20 bp, Artificial Sequence
  chemically synthesized
taagttttatgctaaagtct

SEQ ID NO: 36533 - DNA, 20 bp, Artificial Sequence
  chemically synthesized
ctaaagtctgggtgatgcaa

SEQ ID NO: 36534 - DNA, 20 bp, Artificial Sequence
  chemically synthesized
aaagtctgggtgatgcaaaa

SEQ ID NO: 36535 - DNA, 20 bp, Artificial Sequence
  chemically synthesized
ggtgatgcaaaagagacatc

SEQ ID NO: 36536 - DNA, 20 bp, Artificial Sequence
  chemically synthesized
gtgatgcaaaagagacatct

SEQ ID NO: 36537 - DNA, 20 bp, Artificial Sequence
  chemically synthesized
tgatgcaaaagagacatctg

SEQ ID NO: 36538 - DNA, 20 bp, Artificial Sequence
  chemically synthesized
caaaagagacatctggggtt

SEQ ID NO: 36539 - DNA, 20 bp, Artificial Sequence
  chemically synthesized
agagacatctggggtttagt

SEQ ID NO: 36540 - DNA, 20 bp, Artificial Sequence
  chemically synthesized
agacatctggggtttagtta

SEQ ID NO: 36541 - DNA, 20 bp, Artificial Sequence
  chemically synthesized
acatctggggtttagttaga

SEQ ID NO: 36542 - DNA, 20 bp, Artificial Sequence
  chemically synthesized
catctggggtttagttagag

SEQ ID NO: 36543 - DNA, 20 bp, Artificial Sequence
  chemically synthesized
atctggggtttagttagaga

SEQ ID NO: 36544 - DNA, 20 bp, Artificial Sequence
  chemically synthesized
ttagttagagagggcaaaat

SEQ ID NO: 36545 - DNA, 20 bp, Artificial Sequence
  chemically synthesized
agttagagagggcaaaataa

SEQ ID NO: 36546 - DNA, 20 bp, Artificial Sequence
  chemically synthesized
gggcaaaataagagacaata

SEQ ID NO: 36547 - DNA, 20 bp, Artificial Sequence
  chemically synthesized
aataagagacaatatagaaa

SEQ ID NO: 36548 - DNA, 20 bp, Artificial Sequence
  chemically synthesized
tatagaaatagatacaacaa

SEQ ID NO: 36549 - DNA, 20 bp, Artificial Sequence
  chemically synthesized
atagaaatagatacaacaaa

SEQ ID NO: 36550 - DNA, 20 bp, Artificial Sequence
  chemically synthesized
tagaaatagatacaacaaaa

SEQ ID NO: 36551 - DNA, 20 bp, Artificial Sequence
  chemically synthesized
tagatacaacaaaagggtga

SEQ ID NO: 36552 - DNA, 20 bp, Artificial Sequence
  chemically synthesized
caacaaaagggtgatggata

SEQ ID NO: 36553 - DNA, 20 bp, Artificial Sequence
  chemically synthesized
aacaaaagggtgatggatat

SEQ ID NO: 36554 - DNA, 20 bp, Artificial Sequence
  chemically synthesized
aaaagggtgatggatatagg

SEQ ID NO: 36555 - DNA, 20 bp, Artificial Sequence
  chemically synthesized
tggatataggaagaacgaca

SEQ ID NO: 36556 - DNA, 20 bp, Artificial Sequence
  chemically synthesized
ggatataggaagaacgacac

SEQ ID NO: 36557 - DNA, 20 bp, Artificial Sequence
  chemically synthesized
agaacgacacaggaaaacaa

SEQ ID NO: 36558 - DNA, 20 bp, Artificial Sequence
  chemically synthesized
gaacgacacaggaaaacaat

SEQ ID NO: 36559 - DNA, 20 bp, Artificial Sequence
  chemically synthesized
gacacaggaaaacaatagga

SEQ ID NO: 36560 - DNA, 20 bp, Artificial Sequence
  chemically synthesized
acacaggaaaacaataggat

SEQ ID NO: 36561 - DNA, 20 bp, Artificial Sequence
  chemically synthesized
cacaggaaaacaataggata

SEQ ID NO: 36562 - DNA, 20 bp, Artificial Sequence
  chemically synthesized
aataggatagggatgacgta

SEQ ID NO: 36563 - DNA, 20 bp, Artificial Sequence
  chemically synthesized
cagctgcaccctatgtacct

SEQ ID NO: 36564 - DNA, 20 bp, Artificial Sequence
  chemically synthesized
ctgcaccctatgtacctgag

SEQ ID NO: 36565 - DNA, 20 bp, Artificial Sequence
  chemically synthesized
accctatgtacctgagcaga

SEQ ID NO: 36566 - DNA, 20 bp, Artificial Sequence
  chemically synthesized
atgtacctgagcagatggtg

SEQ ID NO: 36567 - DNA, 20 bp, Artificial Sequence
  chemically synthesized
gcagatggtgcagaaatgat

SEQ ID NO: 36568 - DNA, 20 bp, Artificial Sequence
  chemically synthesized
cagaaatgatcagtgctgcc

SEQ ID NO: 36569 - DNA, 20 bp, Artificial Sequence
  chemically synthesized
atgatcagtgctgcccagcc

SEQ ID NO: 36570 - DNA, 20 bp, Artificial Sequence
  chemically synthesized
cagtgctgcccagccaagcc

SEQ ID NO: 36571 - DNA, 20 bp, Artificial Sequence
  chemically synthesized
cagccaagcccagcctaaat

SEQ ID NO: 36572 - DNA, 20 bp, Artificial Sequence
  chemically synthesized
aaataagttgaaccatgcat

SEQ ID NO: 36573 - DNA, 20 bp, Artificial Sequence
  chemically synthesized
ataagttgaaccatgcatta

SEQ ID NO: 36574 - DNA, 20 bp, Artificial Sequence
  chemically synthesized
aaataaatgtttaatgttgt

SEQ ID NO: 36575 - DNA, 20 bp, Artificial Sequence
  chemically synthesized
tgtcagccactgatgctata

SEQ ID NO: 36576 - DNA, 20 bp, Artificial Sequence
  chemically synthesized
gtcagccactgatgctatac

SEQ ID NO: 36577 - DNA, 20 bp, Artificial Sequence
  chemically synthesized
tcagccactgatgctataca

SEQ ID NO: 36578 - DNA, 20 bp, Artificial Sequence
  chemically synthesized
atgtgacaattctgtgataa

SEQ ID NO: 36579 - DNA, 20 bp, Artificial Sequence
  chemically synthesized
tacataaaccctgtaaatat

SEQ ID NO: 36580 - DNA, 20 bp, Artificial Sequence
  chemically synthesized
ctgtaaatattagtttatta

SEQ ID NO: 36581 - DNA, 20 bp, Artificial Sequence
  chemically synthesized
tataaactcttaataaaata

SEQ ID NO: 36582 - DNA, 20 bp, Artificial Sequence
  chemically synthesized
tcttaataaaatatggataa

SEQ ID NO: 36583 - DNA, 20 bp, Artificial Sequence
  chemically synthesized
ataatagtaatactttgcat

SEQ ID NO: 36584 - DNA, 20 bp, Artificial Sequence
  chemically synthesized
tacataaattactgcaactt

SEQ ID NO: 36585 - DNA, 20 bp, Artificial Sequence
  chemically synthesized
tgagctgcttcaaacattat

SEQ ID NO: 36586 - DNA, 20 bp, Artificial Sequence
  chemically synthesized
tttattatatcacatttcta

SEQ ID NO: 36587 - DNA, 20 bp, Artificial Sequence
  chemically synthesized
ttattatatcacatttctat

SEQ ID NO: 36588 - DNA, 20 bp, Artificial Sequence
  chemically synthesized
tctataggtctgcactctca

SEQ ID NO: 36589 - DNA, 20 bp, Artificial Sequence
  chemically synthesized
ctataggtctgcactctcat

SEQ ID NO: 36590 - DNA, 20 bp, Artificial Sequence
  chemically synthesized
gcactctcataggcttaact

SEQ ID NO: 36591 - DNA, 20 bp, Artificial Sequence
  chemically synthesized
gcttaactgagttctctgct

SEQ ID NO: 36592 - DNA, 20 bp, Artificial Sequence
  chemically synthesized
cttaactgagttctctgctt

SEQ ID NO: 36593 - DNA, 20 bp, Artificial Sequence
  chemically synthesized
ttaactgagttctctgctta

SEQ ID NO: 36594 - DNA, 20 bp, Artificial Sequence
  chemically synthesized
ttctctgcttagggtatcat

SEQ ID NO: 36595 - DNA, 20 bp, Artificial Sequence
  chemically synthesized
tctctgcttagggtatcata

SEQ ID NO: 36596 - DNA, 20 bp, Artificial Sequence
  chemically synthesized
taaggtcaaattcaaaatat

SEQ ID NO: 36597 - DNA, 20 bp, Artificial Sequence
  chemically synthesized
aaggtcaaattcaaaatatc

SEQ ID NO: 36598 - DNA, 20 bp, Artificial Sequence
  chemically synthesized
ggtcaaattcaaaatatcgg

SEQ ID NO: 36599 - DNA, 20 bp, Artificial Sequence
  chemically synthesized
gtcaaattcaaaatatcggg

SEQ ID NO: 36600 - DNA, 20 bp, Artificial Sequence
  chemically synthesized
tcaaattcaaaatatcggga

SEQ ID NO: 36601 - DNA, 20 bp, Artificial Sequence
  chemically synthesized
attcaaaatatcgggagggc

SEQ ID NO: 36602 - DNA, 20 bp, Artificial Sequence
  chemically synthesized
ttcaaaatatcgggagggct

SEQ ID NO: 36603 - DNA, 20 bp, Artificial Sequence
  chemically synthesized
gagggctgggctcttatcca

SEQ ID NO: 36604 - DNA, 20 bp, Artificial Sequence
  chemically synthesized
agggctgggctcttatccaa

SEQ ID NO: 36605 - DNA, 20 bp, Artificial Sequence
  chemically synthesized
gggctcttatccaaaggctc

SEQ ID NO: 36606 - DNA, 20 bp, Artificial Sequence
  chemically synthesized
ggctcttatccaaaggctct

SEQ ID NO: 36607 - DNA, 20 bp, Artificial Sequence
  chemically synthesized
gctcttatccaaaggctctg

SEQ ID NO: 36608 - DNA, 20 bp, Artificial Sequence
  chemically synthesized
cttatccaaaggctctgggg

SEQ ID NO: 36609 - DNA, 20 bp, Artificial Sequence
  chemically synthesized
aattcgcttccacgttcatt

SEQ ID NO: 36610 - DNA, 20 bp, Artificial Sequence
  chemically synthesized
ttccacgttcattcagattg

SEQ ID NO: 36611 - DNA, 20 bp, Artificial Sequence
  chemically synthesized
acgttcattcagattgtagt

SEQ ID NO: 36612 - DNA, 20 bp, Artificial Sequence
  chemically synthesized
gttcattcagattgtagtca

SEQ ID NO: 36613 - DNA, 20 bp, Artificial Sequence
  chemically synthesized
ttcagattgtagtcagagct

SEQ ID NO: 36614 - DNA, 20 bp, Artificial Sequence
  chemically synthesized
tttttttttttttttttttt

SEQ ID NO: 36615 - DNA, 20 bp, Artificial Sequence
  chemically synthesized
ttttttttttttttttgaga

SEQ ID NO: 36616 - DNA, 20 bp, Artificial Sequence
  chemically synthesized
ttttttttttttttgagatg

SEQ ID NO: 36617 - DNA, 20 bp, Artificial Sequence
  chemically synthesized
tggagtctcgctctgtcacc

SEQ ID NO: 36618 - DNA, 20 bp, Artificial Sequence
  chemically synthesized
tctcgctctgtcacccagcc

SEQ ID NO: 36619 - DNA, 20 bp, Artificial Sequence
  chemically synthesized
tcgctctgtcacccagcctg

SEQ ID NO: 36620 - DNA, 20 bp, Artificial Sequence
  chemically synthesized
ctgtcacccagcctggagtg

SEQ ID NO: 36621 - DNA, 20 bp, Artificial Sequence
  chemically synthesized
tcacccagcctggagtgcag

SEQ ID NO: 36622 - DNA, 20 bp, Artificial Sequence
  chemically synthesized
tccctgcaacctgtgcctcc

SEQ ID NO: 36623 - DNA, 20 bp, Artificial Sequence
  chemically synthesized
ccctgcaacctgtgcctccc

SEQ ID NO: 36624 - DNA, 20 bp, Artificial Sequence
  chemically synthesized
aacctgtgcctcccgggttc

SEQ ID NO: 36625 - DNA, 20 bp, Artificial Sequence
  chemically synthesized
ttcaagcaattctcctgcct

SEQ ID NO: 36626 - DNA, 20 bp, Artificial Sequence
  chemically synthesized
ttctcctgcctcagtttccc

SEQ ID NO: 36627 - DNA, 20 bp, Artificial Sequence
  chemically synthesized
tcctgcctcagtttcccaag

SEQ ID NO: 36628 - DNA, 20 bp, Artificial Sequence
  chemically synthesized
gcctcagtttcccaagtagc

SEQ ID NO: 36629 - DNA, 20 bp, Artificial Sequence
  chemically synthesized
ttcccaagtagctggaacta

SEQ ID NO: 36630 - DNA, 20 bp, Artificial Sequence
  chemically synthesized
tcccaagtagctggaactac

SEQ ID NO: 36631 - DNA, 20 bp, Artificial Sequence
  chemically synthesized
caggcaactgcaaccacacc

SEQ ID NO: 36632 - DNA, 20 bp, Artificial Sequence
  chemically synthesized
tggctaatttttatattttt

SEQ ID NO: 36633 - DNA, 20 bp, Artificial Sequence
  chemically synthesized
ctaatttttatattttttgg

SEQ ID NO: 36634 - DNA, 20 bp, Artificial Sequence
  chemically synthesized
taatttttatattttttggt

SEQ ID NO: 36635 - DNA, 20 bp, Artificial Sequence
  chemically synthesized
aatttttatattttttggta

SEQ ID NO: 36636 - DNA, 20 bp, Artificial Sequence
  chemically synthesized
tttatattttttggtaggga

SEQ ID NO: 36637 - DNA, 20 bp, Artificial Sequence
  chemically synthesized
gggatggaatttcaccatgt

SEQ ID NO: 36638 - DNA, 20 bp, Artificial Sequence
  chemically synthesized
tggaatttcaccatgttggc

SEQ ID NO: 36639 - DNA, 20 bp, Artificial Sequence
  chemically synthesized
ggaatttcaccatgttggcc

SEQ ID NO: 36640 - DNA, 20 bp, Artificial Sequence
  chemically synthesized
tttcaccatgttggccaggc

SEQ ID NO: 36641 - DNA, 20 bp, Artificial Sequence
  chemically synthesized
ccatgttggccaggctggtc

SEQ ID NO: 36642 - DNA, 20 bp, Artificial Sequence
  chemically synthesized
tggtctggaactcctgacct

SEQ ID NO: 36643 - DNA, 20 bp, Artificial Sequence
  chemically synthesized
ggtctggaactcctgacctc

SEQ ID NO: 36644 - DNA, 20 bp, Artificial Sequence
  chemically synthesized
ctcaggtgatccgcccgcct

SEQ ID NO: 36645 - DNA, 20 bp, Artificial Sequence
  chemically synthesized
ccgcccgccttggcctccca

SEQ ID NO: 36646 - DNA, 20 bp, Artificial Sequence
  chemically synthesized
gccttggcctcccaaagtgc

SEQ ID NO: 36647 - DNA, 20 bp, Artificial Sequence
  chemically synthesized
ccttggcctcccaaagtgct

SEQ ID NO: 36648 - DNA, 20 bp, Artificial Sequence
  chemically synthesized
ctcccaaagtgctgggatta

SEQ ID NO: 36649 - DNA, 20 bp, Artificial Sequence
  chemically synthesized
tcccaaagtgctgggattac

SEQ ID NO: 36650 - DNA, 20 bp, Artificial Sequence
  chemically synthesized
ctgggattacaggcttgaat

SEQ ID NO: 36651 - DNA, 20 bp, Artificial Sequence
  chemically synthesized
cttgaatgagccattgcacc

SEQ ID NO: 36652 - DNA, 20 bp, Artificial Sequence
  chemically synthesized
gagccattgcacccggctgt

SEQ ID NO: 36653 - DNA, 20 bp, Artificial Sequence
  chemically synthesized
gccattgcacccggctgtca

SEQ ID NO: 36654 - DNA, 20 bp, Artificial Sequence
  chemically synthesized
tgcacccggctgtcagagtt

SEQ ID NO: 36655 - DNA, 20 bp, Artificial Sequence
  chemically synthesized
tttcctactgctgaactctg

SEQ ID NO: 36656 - DNA, 20 bp, Artificial Sequence
  chemically synthesized
gttttttgtttgtttgtttg

SEQ ID NO: 36657 - DNA, 20 bp, Artificial Sequence
  chemically synthesized
ttttttgtttgtttgtttgc

SEQ ID NO: 36658 - DNA, 20 bp, Artificial Sequence
  chemically synthesized
tttgtttgtttgcaggctgt

SEQ ID NO: 36659 - DNA, 20 bp, Artificial Sequence
  chemically synthesized
tttgtttgcaggctgttagc

SEQ ID NO: 36660 - DNA, 20 bp, Artificial Sequence
  chemically synthesized
ttgtttgcaggctgttagct

SEQ ID NO: 36661 - DNA, 20 bp, Artificial Sequence
  chemically synthesized
taggatgcccgttctgtacc

SEQ ID NO: 36662 - DNA, 20 bp, Artificial Sequence
  chemically synthesized
aggatgcccgttctgtacct

SEQ ID NO: 36663 - DNA, 20 bp, Artificial Sequence
  chemically synthesized
ggatgcccgttctgtaccta

SEQ ID NO: 36664 - DNA, 20 bp, Artificial Sequence
  chemically synthesized
gatgcccgttctgtacctag

SEQ ID NO: 36665 - DNA, 20 bp, Artificial Sequence
  chemically synthesized
gacctccttatatttcaaac

SEQ ID NO: 36666 - DNA, 20 bp, Artificial Sequence
  chemically synthesized
tctcaaattttgaatatgtc

SEQ ID NO: 36667 - DNA, 20 bp, Artificial Sequence
  chemically synthesized
cttcctattctcctactact

SEQ ID NO: 36668 - DNA, 20 bp, Artificial Sequence
  chemically synthesized
cttggtgaaaactctgcttt

SEQ ID NO: 36669 - DNA, 20 bp, Artificial Sequence
  chemically synthesized
ttggtgaaaactctgctttt

SEQ ID NO: 36670 - DNA, 20 bp, Artificial Sequence
  chemically synthesized
tggtgaaaactctgctttta

SEQ ID NO: 36671 - DNA, 20 bp, Artificial Sequence
  chemically synthesized
ggtgaaaactctgcttttag

SEQ ID NO: 36672 - DNA, 20 bp, Artificial Sequence
  chemically synthesized
actctgcttttaggggctca

SEQ ID NO: 36673 - DNA, 20 bp, Artificial Sequence
  chemically synthesized
cttttaggggctcatggaat

SEQ ID NO: 36674 - DNA, 20 bp, Artificial Sequence
  chemically synthesized
aggggctcatggaattagac

SEQ ID NO: 36675 - DNA, 20 bp, Artificial Sequence
  chemically synthesized
ggggctcatggaattagact

SEQ ID NO: 36676 - DNA, 20 bp, Artificial Sequence
  chemically synthesized
gaattagactaggttcccct

SEQ ID NO: 36677 - DNA, 20 bp, Artificial Sequence
  chemically synthesized
tttccttttcaattaactca

SEQ ID NO: 36678 - DNA, 20 bp, Artificial Sequence
  chemically synthesized
ttcaattaactcaaagtcaa

SEQ ID NO: 36679 - DNA, 20 bp, Artificial Sequence
  chemically synthesized
ttaactcaaagtcaatagat

SEQ ID NO: 36680 - DNA, 20 bp, Artificial Sequence
  chemically synthesized
aattacatctgtataacccc

SEQ ID NO: 36681 - DNA, 20 bp, Artificial Sequence
  chemically synthesized
atgatattgtatcatattca

SEQ ID NO: 36682 - DNA, 20 bp, Artificial Sequence
  chemically synthesized
ttgtatcatattcacagtcc

SEQ ID NO: 36683 - DNA, 20 bp, Artificial Sequence
  chemically synthesized
atattcacagtcctagaaat

SEQ ID NO: 36684 - DNA, 20 bp, Artificial Sequence
  chemically synthesized
tattcacagtcctagaaatt

SEQ ID NO: 36685 - DNA, 20 bp, Artificial Sequence
  chemically synthesized
cacagtcctagaaattagga

SEQ ID NO: 36686 - DNA, 20 bp, Artificial Sequence
  chemically synthesized
acagtcctagaaattaggat

SEQ ID NO: 36687 - DNA, 20 bp, Artificial Sequence
  chemically synthesized
aattaggataggaaatcttg

SEQ ID NO: 36688 - DNA, 20 bp, Artificial Sequence
  chemically synthesized
taggataggaaatcttgtgg

SEQ ID NO: 36689 - DNA, 20 bp, Artificial Sequence
  chemically synthesized
ataggaaatcttgtggtaga

SEQ ID NO: 36690 - DNA, 20 bp, Artificial Sequence
  chemically synthesized
taggaaatcttgtggtagaa

SEQ ID NO: 36691 - DNA, 20 bp, Artificial Sequence
  chemically synthesized
ctatcacaccatttaaaaaa

SEQ ID NO: 36692 - DNA, 20 bp, Artificial Sequence
  chemically synthesized
cacaccatttaaaaaatagc

SEQ ID NO: 36693 - DNA, 20 bp, Artificial Sequence
  chemically synthesized
ccatttaaaaaatagctagt

SEQ ID NO: 36694 - DNA, 20 bp, Artificial Sequence
  chemically synthesized
atttaaaaaatagctagtga

SEQ ID NO: 36695 - DNA, 20 bp, Artificial Sequence
  chemically synthesized
ttaaaaaatagctagtgaga

SEQ ID NO: 36696 - DNA, 20 bp, Artificial Sequence
  chemically synthesized
taaaaaatagctagtgagag

SEQ ID NO: 36697 - DNA, 20 bp, Artificial Sequence
  chemically synthesized
aaaaatagctagtgagagag

SEQ ID NO: 36698 - DNA, 20 bp, Artificial Sequence
  chemically synthesized
ttcttttccaatatatgtgt

SEQ ID NO: 36699 - DNA, 20 bp, Artificial Sequence
  chemically synthesized
caatatatgtgttagtttta

SEQ ID NO: 36700 - DNA, 20 bp, Artificial Sequence
  chemically synthesized
ttcttaacatttttttgatg

SEQ ID NO: 36701 - DNA, 20 bp, Artificial Sequence
  chemically synthesized
tgatgaagcacaatgtctga

SEQ ID NO: 36702 - DNA, 20 bp, Artificial Sequence
  chemically synthesized
gatgaagcacaatgtctgaa

SEQ ID NO: 36703 - DNA, 20 bp, Artificial Sequence
  chemically synthesized
atgaagcacaatgtctgaaa

SEQ ID NO: 36704 - DNA, 20 bp, Artificial Sequence
  chemically synthesized
aagcacaatgtctgaaaggg

SEQ ID NO: 36705 - DNA, 20 bp, Artificial Sequence
  chemically synthesized
cacaatgtctgaaagggtgg

SEQ ID NO: 36706 - DNA, 20 bp, Artificial Sequence
  chemically synthesized
atgtctgaaagggtggtaga

SEQ ID NO: 36707 - DNA, 20 bp, Artificial Sequence
  chemically synthesized
tctgaaagggtggtagaaag

SEQ ID NO: 36708 - DNA, 20 bp, Artificial Sequence
  chemically synthesized
aaagggtggtagaaagcagc

SEQ ID NO: 36709 - DNA, 20 bp, Artificial Sequence
  chemically synthesized
agggtggtagaaagcagctg

SEQ ID NO: 36710 - DNA, 20 bp, Artificial Sequence
  chemically synthesized
aagcagctggagtcgaaact

SEQ ID NO: 36711 - DNA, 20 bp, Artificial Sequence
  chemically synthesized
agcagctggagtcgaaactg

SEQ ID NO: 36712 - DNA, 20 bp, Artificial Sequence
  chemically synthesized
tggagtcgaaactgaggatg

SEQ ID NO: 36713 - DNA, 20 bp, Artificial Sequence
  chemically synthesized
aaactgaggatgaagtcgta

SEQ ID NO: 36714 - DNA, 20 bp, Artificial Sequence
  chemically synthesized
gaggatgaagtcgtatagtc

SEQ ID NO: 36715 - DNA, 20 bp, Artificial Sequence
  chemically synthesized
ggatgaagtcgtatagtcta

SEQ ID NO: 36716 - DNA, 20 bp, Artificial Sequence
  chemically synthesized
tagagctgtgctgtccaaaa

SEQ ID NO: 36717 - DNA, 20 bp, Artificial Sequence
  chemically synthesized
agctgtgctgtccaaaacag

SEQ ID NO: 36718 - DNA, 20 bp, Artificial Sequence
  chemically synthesized
ctgtccaaaacagtagcatc

SEQ ID NO: 36719 - DNA, 20 bp, Artificial Sequence
  chemically synthesized
ccaaaacagtagcatctggt

SEQ ID NO: 36720 - DNA, 20 bp, Artificial Sequence
  chemically synthesized
cagtagcatctggttagctt

SEQ ID NO: 36721 - DNA, 20 bp, Artificial Sequence
  chemically synthesized
agcatctggttagcttgagt

SEQ ID NO: 36722 - DNA, 20 bp, Artificial Sequence
  chemically synthesized
cttgagtcagaattttctgt

SEQ ID NO: 36723 - DNA, 20 bp, Artificial Sequence
  chemically synthesized
agtgtaaacactcgattttg

SEQ ID NO: 36724 - DNA, 20 bp, Artificial Sequence
  chemically synthesized
tttgtaccaaaaaaaaatcg

SEQ ID NO: 36725 - DNA, 20 bp, Artificial Sequence
  chemically synthesized
ttgtaccaaaaaaaaatcgt

SEQ ID NO: 36726 - DNA, 20 bp, Artificial Sequence
  chemically synthesized
aaatgataatatttttgata

SEQ ID NO: 36727 - DNA, 20 bp, Artificial Sequence
  chemically synthesized
tgataatatttttgatatag

SEQ ID NO: 36728 - DNA, 20 bp, Artificial Sequence
  chemically synthesized
tttgatatagtagcttaaat

SEQ ID NO: 36729 - DNA, 20 bp, Artificial Sequence
  chemically synthesized
actccttttaatgtgactac

SEQ ID NO: 36730 - DNA, 20 bp, Artificial Sequence
  chemically synthesized
aacatttaacatcacatatt

SEQ ID NO: 36731 - DNA, 20 bp, Artificial Sequence
  chemically synthesized
ctaattatatttccaccaca

SEQ ID NO: 36732 - DNA, 20 bp, Artificial Sequence
  chemically synthesized
atatttccaccacatagtgc

SEQ ID NO: 36733 - DNA, 20 bp, Artificial Sequence
  chemically synthesized
tccaccacatagtgctggtc

SEQ ID NO: 36734 - DNA, 20 bp, Artificial Sequence
  chemically synthesized
caccacatagtgctggtcta

SEQ ID NO: 36735 - DNA, 20 bp, Artificial Sequence
  chemically synthesized
ccacatagtgctggtctaga

SEQ ID NO: 36736 - DNA, 20 bp, Artificial Sequence
  chemically synthesized
tttgtttgtttgtttctcct

SEQ ID NO: 36737 - DNA, 20 bp, Artificial Sequence
  chemically synthesized
ttgtttgtttgtttctcctc

SEQ ID NO: 36738 - DNA, 20 bp, Artificial Sequence
  chemically synthesized
gctgccccttttctcctcac

SEQ ID NO: 36739 - DNA, 20 bp, Artificial Sequence
  chemically synthesized
ttttctcctcactggctttc

SEQ ID NO: 36740 - DNA, 20 bp, Artificial Sequence
  chemically synthesized
tttctcctcactggctttcc

SEQ ID NO: 36741 - DNA, 20 bp, Artificial Sequence
  chemically synthesized
cctcactggctttccaggtc

SEQ ID NO: 36742 - DNA, 20 bp, Artificial Sequence
  chemically synthesized
tcactggctttccaggtctg

SEQ ID NO: 36743 - DNA, 20 bp, Artificial Sequence
  chemically synthesized
actggctttccaggtctgga

SEQ ID NO: 36744 - DNA, 20 bp, Artificial Sequence
  chemically synthesized
gtctggagagatttcatcct

SEQ ID NO: 36745 - DNA, 20 bp, Artificial Sequence
  chemically synthesized
ctggagagatttcatccttg

SEQ ID NO: 36746 - DNA, 20 bp, Artificial Sequence
  chemically synthesized
ctttatcatctatgtctcta

SEQ ID NO: 36747 - DNA, 20 bp, Artificial Sequence
  chemically synthesized
atctatgtctctacagtcct

SEQ ID NO: 36748 - DNA, 20 bp, Artificial Sequence
  chemically synthesized
gtctctacagtccttggcaa

SEQ ID NO: 36749 - DNA, 20 bp, Artificial Sequence
  chemically synthesized
tctacagtccttggcaatgg

SEQ ID NO: 36750 - DNA, 20 bp, Artificial Sequence
  chemically synthesized
ggcagcctcctcctctttat

SEQ ID NO: 36751 - DNA, 20 bp, Artificial Sequence
  chemically synthesized
cagcctcctcctctttatca

SEQ ID NO: 36752 - DNA, 20 bp, Artificial Sequence
  chemically synthesized
cctcctcctctttatcagag

SEQ ID NO: 36753 - DNA, 20 bp, Artificial Sequence
  chemically synthesized
gagaagactgcactcttcat

SEQ ID NO: 36754 - DNA, 20 bp, Artificial Sequence
  chemically synthesized
gtactactctctgactatac

SEQ ID NO: 36755 - DNA, 20 bp, Artificial Sequence
  chemically synthesized
ctactctctgactatactgg

SEQ ID NO: 36756 - DNA, 20 bp, Artificial Sequence
  chemically synthesized
tctgactatactggcagcca

SEQ ID NO: 36757 - DNA, 20 bp, Artificial Sequence
  chemically synthesized
atactggcagccatagacct

SEQ ID NO: 36758 - DNA, 20 bp, Artificial Sequence
  chemically synthesized
acaacaatgtccactgtcct

SEQ ID NO: 36759 - DNA, 20 bp, Artificial Sequence
  chemically synthesized
ccactgtccttggtgttctc

SEQ ID NO: 36760 - DNA, 20 bp, Artificial Sequence
  chemically synthesized
tgtccttggtgttctctggc

SEQ ID NO: 36761 - DNA, 20 bp, Artificial Sequence
  chemically synthesized
ggtgttctctggctagatca

SEQ ID NO: 36762 - DNA, 20 bp, Artificial Sequence
  chemically synthesized
gtgttctctggctagatcac

SEQ ID NO: 36763 - DNA, 20 bp, Artificial Sequence
  chemically synthesized
tggctagatcacaggaaaat

SEQ ID NO: 36764 - DNA, 20 bp, Artificial Sequence
  chemically synthesized
gatcacaggaaaatgagcca

SEQ ID NO: 36765 - DNA, 20 bp, Artificial Sequence
  chemically synthesized
tcacaggaaaatgagccatg

SEQ ID NO: 36766 - DNA, 20 bp, Artificial Sequence
  chemically synthesized
gccatggagcctgcttcctc

SEQ ID NO: 36767 - DNA, 20 bp, Artificial Sequence
  chemically synthesized
ccatggagcctgcttcctcc

SEQ ID NO: 36768 - DNA, 20 bp, Artificial Sequence
  chemically synthesized
aatccactccctctctatcg

SEQ ID NO: 36769 - DNA, 20 bp, Artificial Sequence
  chemically synthesized
tccactccctctctatcgtg

SEQ ID NO: 36770 - DNA, 20 bp, Artificial Sequence
  chemically synthesized
tccctctctatcgtggagtc

SEQ ID NO: 36771 - DNA, 20 bp, Artificial Sequence
  chemically synthesized
cctctctatcgtggagtcca

SEQ ID NO: 36772 - DNA, 20 bp, Artificial Sequence
  chemically synthesized
gtccagagtgttgctcatca

SEQ ID NO: 36773 - DNA, 20 bp, Artificial Sequence
  chemically synthesized
atggcccatgactgttttat

SEQ ID NO: 36774 - DNA, 20 bp, Artificial Sequence
  chemically synthesized
attggcatccataatcccct

SEQ ID NO: 36775 - DNA, 20 bp, Artificial Sequence
  chemically synthesized
cctccattctcaccaatgct

SEQ ID NO: 36776 - DNA, 20 bp, Artificial Sequence
  chemically synthesized
ctccattctcaccaatgcta

SEQ ID NO: 36777 - DNA, 20 bp, Artificial Sequence
  chemically synthesized
cattctcaccaatgctaagg

SEQ ID NO: 36778 - DNA, 20 bp, Artificial Sequence
  chemically synthesized
tcaccaatgctaaggtggtg

SEQ ID NO: 36779 - DNA, 20 bp, Artificial Sequence
  chemically synthesized
caatgctaaggtggtgaaga

SEQ ID NO: 36780 - DNA, 20 bp, Artificial Sequence
  chemically synthesized
taaggtggtgaagatagatc

SEQ ID NO: 36781 - DNA, 20 bp, Artificial Sequence
  chemically synthesized
aaggtggtgaagatagatct

SEQ ID NO: 36782 - DNA, 20 bp, Artificial Sequence
  chemically synthesized
aggtggtgaagatagatctg

SEQ ID NO: 36783 - DNA, 20 bp, Artificial Sequence
  chemically synthesized
ggtggtgaagatagatctgg

SEQ ID NO: 36784 - DNA, 20 bp, Artificial Sequence
  chemically synthesized
atagatctgggggttcaaat

SEQ ID NO: 36785 - DNA, 20 bp, Artificial Sequence
  chemically synthesized
tagatctgggggttcaaatg

SEQ ID NO: 36786 - DNA, 20 bp, Artificial Sequence
  chemically synthesized
agatctgggggttcaaatga

SEQ ID NO: 36787 - DNA, 20 bp, Artificial Sequence
  chemically synthesized
gatctgggggttcaaatgag

SEQ ID NO: 36788 - DNA, 20 bp, Artificial Sequence
  chemically synthesized
cccataatcatcaccctctc

SEQ ID NO: 36789 - DNA, 20 bp, Artificial Sequence
  chemically synthesized
cccatgctttctgcctgcac

SEQ ID NO: 36790 - DNA, 20 bp, Artificial Sequence
  chemically synthesized
tgcaccagatgtgatcaaac

SEQ ID NO: 36791 - DNA, 20 bp, Artificial Sequence
  chemically synthesized
tgtgatcaaactggcctgtg

SEQ ID NO: 36792 - DNA, 20 bp, Artificial Sequence
  chemically synthesized
tgtgcagacatcacctttaa

SEQ ID NO: 36793 - DNA, 20 bp, Artificial Sequence
  chemically synthesized
ctttaatagactttatccta

SEQ ID NO: 36794 - DNA, 20 bp, Artificial Sequence
  chemically synthesized
tagactttatcctatagtcc

SEQ ID NO: 36795 - DNA, 20 bp, Artificial Sequence
  chemically synthesized
atagtcctggtctcatcaac

SEQ ID NO: 36796 - DNA, 20 bp, Artificial Sequence
  chemically synthesized
ggtctcatcaactggtttct

SEQ ID NO: 36797 - DNA, 20 bp, Artificial Sequence
  chemically synthesized
tctcttacattctgatcctt

SEQ ID NO: 36798 - DNA, 20 bp, Artificial Sequence
  chemically synthesized
cttacattctgatccttaag

SEQ ID NO: 36799 - DNA, 20 bp, Artificial Sequence
  chemically synthesized
ttacattctgatccttaaga

SEQ ID NO: 36800 - DNA, 20 bp, Artificial Sequence
  chemically synthesized
tctgatccttaagaaggtca

SEQ ID NO: 36801 - DNA, 20 bp, Artificial Sequence
  chemically synthesized
ctgatccttaagaaggtcat

SEQ ID NO: 36802 - DNA, 20 bp, Artificial Sequence
  chemically synthesized
gaaggtcatgggaattgcct

SEQ ID NO: 36803 - DNA, 20 bp, Artificial Sequence
  chemically synthesized
tcatgggaattgcctcagac

SEQ ID NO: 36804 - DNA, 20 bp, Artificial Sequence
  chemically synthesized
catgggaattgcctcagaca

SEQ ID NO: 36805 - DNA, 20 bp, Artificial Sequence
  chemically synthesized
tgggaattgcctcagacaag

SEQ ID NO: 36806 - DNA, 20 bp, Artificial Sequence
  chemically synthesized
gaattgcctcagacaaggag

SEQ ID NO: 36807 - DNA, 20 bp, Artificial Sequence
  chemically synthesized
cctcagacaaggagcagact

SEQ ID NO: 36808 - DNA, 20 bp, Artificial Sequence
  chemically synthesized
ctcagacaaggagcagacta

SEQ ID NO: 36809 - DNA, 20 bp, Artificial Sequence
  chemically synthesized
aatacttgtatttctcacat

SEQ ID NO: 36810 - DNA, 20 bp, Artificial Sequence
  chemically synthesized
ttctcacattagctgtgttc

SEQ ID NO: 36811 - DNA, 20 bp, Artificial Sequence
  chemically synthesized
ggtttttaatgtcacttgat

SEQ ID NO: 36812 - DNA, 20 bp, Artificial Sequence
  chemically synthesized
gtttttaatgtcacttgatt

SEQ ID NO: 36813 - DNA, 20 bp, Artificial Sequence
  chemically synthesized
tgattgggctaccacccttt

SEQ ID NO: 36814 - DNA, 20 bp, Artificial Sequence
  chemically synthesized
tgcttcatcaaaaaaatgtt

SEQ ID NO: 36815 - DNA, 20 bp, Artificial Sequence
  chemically synthesized
caatgcaaatcaaaaccaca

SEQ ID NO: 36816 - DNA, 20 bp, Artificial Sequence
  chemically synthesized
atgcaaatcaaaaccacaaa

SEQ ID NO: 36817 - DNA, 20 bp, Artificial Sequence
  chemically synthesized
aaagagataccatctcacac

SEQ ID NO: 36818 - DNA, 20 bp, Artificial Sequence
  chemically synthesized
agataccatctcacaccagt

SEQ ID NO: 36819 - DNA, 20 bp, Artificial Sequence
  chemically synthesized
ccatctcacaccagttagaa

SEQ ID NO: 36820 - DNA, 20 bp, Artificial Sequence
  chemically synthesized
ttagaatggcaatcattaaa

SEQ ID NO: 36821 - DNA, 20 bp, Artificial Sequence
  chemically synthesized
aatggcaatcattaaaaagt

SEQ ID NO: 36822 - DNA, 20 bp, Artificial Sequence
  chemically synthesized
atggcaatcattaaaaagtc

SEQ ID NO: 36823 - DNA, 20 bp, Artificial Sequence
  chemically synthesized
tggcaatcattaaaaagtca

SEQ ID NO: 36824 - DNA, 20 bp, Artificial Sequence
  chemically synthesized
attaaaaagtcagggaacaa

SEQ ID NO: 36825 - DNA, 20 bp, Artificial Sequence
  chemically synthesized
ttaaaaagtcagggaacaac

SEQ ID NO: 36826 - DNA, 20 bp, Artificial Sequence
  chemically synthesized
agtcagggaacaacaggtgc

SEQ ID NO: 36827 - DNA, 20 bp, Artificial Sequence
  chemically synthesized
tcagggaacaacaggtgctg

SEQ ID NO: 36828 - DNA, 20 bp, Artificial Sequence
  chemically synthesized
agggaacaacaggtgctgga

SEQ ID NO: 36829 - DNA, 20 bp, Artificial Sequence
  chemically synthesized
gggaacaacaggtgctggag

SEQ ID NO: 36830 - DNA, 20 bp, Artificial Sequence
  chemically synthesized
aacaggtgctggagaggatg

SEQ ID NO: 36831 - DNA, 20 bp, Artificial Sequence
  chemically synthesized
caggtgctggagaggatgtg

SEQ ID NO: 36832 - DNA, 20 bp, Artificial Sequence
  chemically synthesized
ctggagaggatgtggagaaa

SEQ ID NO: 36833 - DNA, 20 bp, Artificial Sequence
  chemically synthesized
tggagaggatgtggagaaat

SEQ ID NO: 36834 - DNA, 20 bp, Artificial Sequence
  chemically synthesized
taggaacacttttacactct

SEQ ID NO: 36835 - DNA, 20 bp, Artificial Sequence
  chemically synthesized
gaacacttttacactcttgg

SEQ ID NO: 36836 - DNA, 20 bp, Artificial Sequence
  chemically synthesized
aacacttttacactcttggt

SEQ ID NO: 36837 - DNA, 20 bp, Artificial Sequence
  chemically synthesized
ctcttggtgggactgtaaac

SEQ ID NO: 36838 - DNA, 20 bp, Artificial Sequence
  chemically synthesized
gtaaactagttcaaccattg

SEQ ID NO: 36839 - DNA, 20 bp, Artificial Sequence
  chemically synthesized
aactagttcaaccattgtgg

SEQ ID NO: 36840 - DNA, 20 bp, Artificial Sequence
  chemically synthesized
agttcaaccattgtggaagt

SEQ ID NO: 36841 - DNA, 20 bp, Artificial Sequence
  chemically synthesized
aaccattgtggaagtcagtg

SEQ ID NO: 36842 - DNA, 20 bp, Artificial Sequence
  chemically synthesized
aagtcagtgtggcgattcct

SEQ ID NO: 36843 - DNA, 20 bp, Artificial Sequence
  chemically synthesized
agtcagtgtggcgattcctc

SEQ ID NO: 36844 - DNA, 20 bp, Artificial Sequence
  chemically synthesized
gtcagtgtggcgattcctca

SEQ ID NO: 36845 - DNA, 20 bp, Artificial Sequence
  chemically synthesized
gtggcgattcctcagggatc

SEQ ID NO: 36846 - DNA, 20 bp, Artificial Sequence
  chemically synthesized
attcctcagggatctagaac

SEQ ID NO: 36847 - DNA, 20 bp, Artificial Sequence
  chemically synthesized
actagaaataccatttgacc

SEQ ID NO: 36848 - DNA, 20 bp, Artificial Sequence
  chemically synthesized
tgacccagccatcccattac

SEQ ID NO: 36849 - DNA, 20 bp, Artificial Sequence
  chemically synthesized
gacccagccatcccattact

SEQ ID NO: 36850 - DNA, 20 bp, Artificial Sequence
  chemically synthesized
attactgggtatatacccaa

SEQ ID NO: 36851 - DNA, 20 bp, Artificial Sequence
  chemically synthesized
ttataaatcatgctgctata

SEQ ID NO: 36852 - DNA, 20 bp, Artificial Sequence
  chemically synthesized
atgcacacgtatgtttactg

SEQ ID NO: 36853 - DNA, 20 bp, Artificial Sequence
  chemically synthesized
tactgtggcactattcacaa

SEQ ID NO: 36854 - DNA, 20 bp, Artificial Sequence
  chemically synthesized
tggcactattcacaatagca

SEQ ID NO: 36855 - DNA, 20 bp, Artificial Sequence
  chemically synthesized
tattcacaatagcaaagact

SEQ ID NO: 36856 - DNA, 20 bp, Artificial Sequence
  chemically synthesized
acccaaatgtccaacaatga

SEQ ID NO: 36857 - DNA, 20 bp, Artificial Sequence
  chemically synthesized
caacaatgatagactgaatt

SEQ ID NO: 36858 - DNA, 20 bp, Artificial Sequence
  chemically synthesized
tagactgaattaagaaaatg

SEQ ID NO: 36859 - DNA, 20 bp, Artificial Sequence
  chemically synthesized
aatgtggcacatatacacca

SEQ ID NO: 36860 - DNA, 20 bp, Artificial Sequence
  chemically synthesized
atacaccatggaatactatg

SEQ ID NO: 36861 - DNA, 20 bp, Artificial Sequence
  chemically synthesized
ctatgcagccataaaaaatg

SEQ ID NO: 36862 - DNA, 20 bp, Artificial Sequence
  chemically synthesized
atgcagccataaaaaatgaa

SEQ ID NO: 36863 - DNA, 20 bp, Artificial Sequence
  chemically synthesized
tgaagagttcatgtcatttg

SEQ ID NO: 36864 - DNA, 20 bp, Artificial Sequence
  chemically synthesized
gaagagttcatgtcatttgt

SEQ ID NO: 36865 - DNA, 20 bp, Artificial Sequence
  chemically synthesized
aagagttcatgtcatttgta

SEQ ID NO: 36866 - DNA, 20 bp, Artificial Sequence
  chemically synthesized
tcatgtcatttgtagggaca

SEQ ID NO: 36867 - DNA, 20 bp, Artificial Sequence
  chemically synthesized
tgtagggacatggatgaaac

SEQ ID NO: 36868 - DNA, 20 bp, Artificial Sequence
  chemically synthesized
aaactggaaaccatcattct

SEQ ID NO: 36869 - DNA, 20 bp, Artificial Sequence
  chemically synthesized
cattctcagcaaactatcgc

SEQ ID NO: 36870 - DNA, 20 bp, Artificial Sequence
  chemically synthesized
attctcagcaaactatcgca

SEQ ID NO: 36871 - DNA, 20 bp, Artificial Sequence
  chemically synthesized
tatcgcaaggacaaaaaacc

SEQ ID NO: 36872 - DNA, 20 bp, Artificial Sequence
  chemically synthesized
gcactgcatgttctcactca

SEQ ID NO: 36873 - DNA, 20 bp, Artificial Sequence
  chemically synthesized
cactgcatgttctcactcat

SEQ ID NO: 36874 - DNA, 20 bp, Artificial Sequence
  chemically synthesized
tgcatgttctcactcatagg

SEQ ID NO: 36875 - DNA, 20 bp, Artificial Sequence
  chemically synthesized
gcatgttctcactcataggt

SEQ ID NO: 36876 - DNA, 20 bp, Artificial Sequence
  chemically synthesized
ataggtgggaattgaacaat

SEQ ID NO: 36877 - DNA, 20 bp, Artificial Sequence
  chemically synthesized
aattgaacaatgagaacaca

SEQ ID NO: 36878 - DNA, 20 bp, Artificial Sequence
  chemically synthesized
acaatgagaacacatggaca

SEQ ID NO: 36879 - DNA, 20 bp, Artificial Sequence
  chemically synthesized
caatgagaacacatggacac

SEQ ID NO: 36880 - DNA, 20 bp, Artificial Sequence
  chemically synthesized
tgagaacacatggacacagg

SEQ ID NO: 36881 - DNA, 20 bp, Artificial Sequence
  chemically synthesized
gagaacacatggacacagga

SEQ ID NO: 36882 - DNA, 20 bp, Artificial Sequence
  chemically synthesized
agaacacatggacacaggaa

SEQ ID NO: 36883 - DNA, 20 bp, Artificial Sequence
  chemically synthesized
gaacacatggacacaggaag

SEQ ID NO: 36884 - DNA, 20 bp, Artificial Sequence
  chemically synthesized
ggaaggggaacaacacactc

SEQ ID NO: 36885 - DNA, 20 bp, Artificial Sequence
  chemically synthesized
gaaggggaacaacacactcc

SEQ ID NO: 36886 - DNA, 20 bp, Artificial Sequence
  chemically synthesized
aaggggaacaacacactccg

SEQ ID NO: 36887 - DNA, 20 bp, Artificial Sequence
  chemically synthesized
cacactccggggactgttgt

SEQ ID NO: 36888 - DNA, 20 bp, Artificial Sequence
  chemically synthesized
acactccggggactgttgtg

SEQ ID NO: 36889 - DNA, 20 bp, Artificial Sequence
  chemically synthesized
ctccggggactgttgtgagg

SEQ ID NO: 36890 - DNA, 20 bp, Artificial Sequence
  chemically synthesized
tccggggactgttgtgaggt

SEQ ID NO: 36891 - DNA, 20 bp, Artificial Sequence
  chemically synthesized
ccggggactgttgtgaggtg

SEQ ID NO: 36892 - DNA, 20 bp, Artificial Sequence
  chemically synthesized
cggggactgttgtgaggtgg

SEQ ID NO: 36893 - DNA, 20 bp, Artificial Sequence
  chemically synthesized
ggggactgttgtgaggtggg

SEQ ID NO: 36894 - DNA, 20 bp, Artificial Sequence
  chemically synthesized
gactgttgtgaggtgggggg

SEQ ID NO: 36895 - DNA, 20 bp, Artificial Sequence
  chemically synthesized
actgttgtgaggtgggggga

SEQ ID NO: 36896 - DNA, 20 bp, Artificial Sequence
  chemically synthesized
ctgttgtgaggtggggggaa

SEQ ID NO: 36897 - DNA, 20 bp, Artificial Sequence
  chemically synthesized
tgttgtgaggtggggggaag

SEQ ID NO: 36898 - DNA, 20 bp, Artificial Sequence
  chemically synthesized
gttgtgaggtggggggaagg

SEQ ID NO: 36899 - DNA, 20 bp, Artificial Sequence
  chemically synthesized
tgtgaggtggggggaagggg

SEQ ID NO: 36900 - DNA, 20 bp, Artificial Sequence
  chemically synthesized
tgaggtggggggaaggggga

SEQ ID NO: 36901 - DNA, 20 bp, Artificial Sequence
  chemically synthesized
aggtggggggaagggggaga

SEQ ID NO: 36902 - DNA, 20 bp, Artificial Sequence
  chemically synthesized
gtggggggaagggggagaga

SEQ ID NO: 36903 - DNA, 20 bp, Artificial Sequence
  chemically synthesized
ggaagggggagagagagcat

SEQ ID NO: 36904 - DNA, 20 bp, Artificial Sequence
  chemically synthesized
gaagggggagagagagcatt

SEQ ID NO: 36905 - DNA, 20 bp, Artificial Sequence
  chemically synthesized
agggggagagagagcattag

SEQ ID NO: 36906 - DNA, 20 bp, Artificial Sequence
  chemically synthesized
taggagatatacctaatgct

SEQ ID NO: 36907 - DNA, 20 bp, Artificial Sequence
  chemically synthesized
tatacctaatgctaagtgac

SEQ ID NO: 36908 - DNA, 20 bp, Artificial Sequence
  chemically synthesized
aatgctaagtgacaagttaa

SEQ ID NO: 36909 - DNA, 20 bp, Artificial Sequence
  chemically synthesized
atgctaagtgacaagttaat

SEQ ID NO: 36910 - DNA, 20 bp, Artificial Sequence
  chemically synthesized
aagtgacaagttaatgggtg

SEQ ID NO: 36911 - DNA, 20 bp, Artificial Sequence
  chemically synthesized
atgggtgcagcacaccaaca

SEQ ID NO: 36912 - DNA, 20 bp, Artificial Sequence
  chemically synthesized
cacatgtaccctaaaactta

SEQ ID NO: 36913 - DNA, 20 bp, Artificial Sequence
  chemically synthesized
ataataaaaatacattattt

SEQ ID NO: 36914 - DNA, 20 bp, Artificial Sequence
  chemically synthesized
tttggattaacaaaaaccaa

SEQ ID NO: 36915 - DNA, 20 bp, Artificial Sequence
  chemically synthesized
ttggattaacaaaaaccaac

SEQ ID NO: 36916 - DNA, 20 bp, Artificial Sequence
  chemically synthesized
caaaaaccaacaggctacca

SEQ ID NO: 36917 - DNA, 20 bp, Artificial Sequence
  chemically synthesized
tctcacatgttttgttattc

SEQ ID NO: 36918 - DNA, 20 bp, Artificial Sequence
  chemically synthesized
ttttgttattctggctctgc

SEQ ID NO: 36919 - DNA, 20 bp, Artificial Sequence
  chemically synthesized
tgctagaattctcttgattt

SEQ ID NO: 36920 - DNA, 20 bp, Artificial Sequence
  chemically synthesized
tcatattttctctttcccca

SEQ ID NO: 36921 - DNA, 20 bp, Artificial Sequence
  chemically synthesized
cttccttgtttttcaattat

SEQ ID NO: 36922 - DNA, 20 bp, Artificial Sequence
  chemically synthesized
gcttaaataatatttctttt

SEQ ID NO: 36923 - DNA, 20 bp, Artificial Sequence
  chemically synthesized
agaaattttcccctgcccca

SEQ ID NO: 36924 - DNA, 20 bp, Artificial Sequence
  chemically synthesized
tgccccaaagatgctttctg

SEQ ID NO: 36925 - DNA, 20 bp, Artificial Sequence
  chemically synthesized
gccccaaagatgctttctgt

SEQ ID NO: 36926 - DNA, 20 bp, Artificial Sequence
  chemically synthesized
tgctttctgtgggctccctt

SEQ ID NO: 36927 - DNA, 20 bp, Artificial Sequence
  chemically synthesized
ttagcatgctaccatctatg

SEQ ID NO: 36928 - DNA, 20 bp, Artificial Sequence
  chemically synthesized
taccatctatgcagtaatga

SEQ ID NO: 36929 - DNA, 20 bp, Artificial Sequence
  chemically synthesized
gatagtgctatgaaaatttg

SEQ ID NO: 36930 - DNA, 20 bp, Artificial Sequence
  chemically synthesized
ctatttacattctgtgaata

SEQ ID NO: 36931 - DNA, 20 bp, Artificial Sequence
  chemically synthesized
tatgctcctcattgtgtatc

SEQ ID NO: 36932 - DNA, 20 bp, Artificial Sequence
  chemically synthesized
atctggcaaaaaaaaaaaaa

SEQ ID NO: 36933 - DNA, 20 bp, Artificial Sequence
  chemically synthesized
tctggcaaaaaaaaaaaaaa

SEQ ID NO: 36934 - DNA, 20 bp, Artificial Sequence
  chemically synthesized
ctggcaaaaaaaaaaaaaaa

SEQ ID NO: 36935 - DNA, 20 bp, Artificial Sequence
  chemically synthesized
aaaaaaaaaaaaagggcaat

SEQ ID NO: 36936 - DNA, 20 bp, Artificial Sequence
  chemically synthesized
aaaaaagggcaatgagctac

SEQ ID NO: 36937 - DNA, 20 bp, Artificial Sequence
  chemically synthesized
gctacaagtaatataatttt

SEQ ID NO: 36938 - DNA, 20 bp, Artificial Sequence
  chemically synthesized
taatataattttaagataaa

SEQ ID NO: 36939 - DNA, 20 bp, Artificial Sequence
  chemically synthesized
taagataaaaagctgaatgt

SEQ ID NO: 36940 - DNA, 20 bp, Artificial Sequence
  chemically synthesized
ataaaaagctgaatgtcagc

SEQ ID NO: 36941 - DNA, 20 bp, Artificial Sequence
  chemically synthesized
taaaaagctgaatgtcagcc

SEQ ID NO: 36942 - DNA, 20 bp, Artificial Sequence
  chemically synthesized
agctgaatgtcagccgggcg

SEQ ID NO: 36943 - DNA, 20 bp, Artificial Sequence
  chemically synthesized
gtgactcacacctgcaatcc

SEQ ID NO: 36944 - DNA, 20 bp, Artificial Sequence
  chemically synthesized
cacctgcaatcccagcactt

SEQ ID NO: 36945 - DNA, 20 bp, Artificial Sequence
  chemically synthesized
acctgcaatcccagcacttt

SEQ ID NO: 36946 - DNA, 20 bp, Artificial Sequence
  chemically synthesized
ctgcaatcccagcactttgg

SEQ ID NO: 36947 - DNA, 20 bp, Artificial Sequence
  chemically synthesized
tgcaatcccagcactttggg

SEQ ID NO: 36948 - DNA, 20 bp, Artificial Sequence
  chemically synthesized
tcccagcactttgggaggcc

SEQ ID NO: 36949 - DNA, 20 bp, Artificial Sequence
  chemically synthesized
cccagcactttgggaggcca

SEQ ID NO: 36950 - DNA, 20 bp, Artificial Sequence
  chemically synthesized
cagcactttgggaggccaag

SEQ ID NO: 36951 - DNA, 20 bp, Artificial Sequence
  chemically synthesized
agcactttgggaggccaagg

SEQ ID NO: 36952 - DNA, 20 bp, Artificial Sequence
  chemically synthesized
gcactttgggaggccaagga

SEQ ID NO: 36953 - DNA, 20 bp, Artificial Sequence
  chemically synthesized
ctttgggaggccaaggaggg

SEQ ID NO: 36954 - DNA, 20 bp, Artificial Sequence
  chemically synthesized
ggccaaggagggtggatcac

SEQ ID NO: 36955 - DNA, 20 bp, Artificial Sequence
  chemically synthesized
gccaaggagggtggatcacg

SEQ ID NO: 36956 - DNA, 20 bp, Artificial Sequence
  chemically synthesized
ggagggtggatcacgaggtc

SEQ ID NO: 36957 - DNA, 20 bp, Artificial Sequence
  chemically synthesized
agggtggatcacgaggtcaa

SEQ ID NO: 36958 - DNA, 20 bp, Artificial Sequence
  chemically synthesized
gatcacgaggtcaagagatc

SEQ ID NO: 36959 - DNA, 20 bp, Artificial Sequence
  chemically synthesized
tcaagagatcgagaccatcc

SEQ ID NO: 36960 - DNA, 20 bp, Artificial Sequence
  chemically synthesized
cgagaccatcctggccaata

SEQ ID NO: 36961 - DNA, 20 bp, Artificial Sequence
  chemically synthesized
tctactaaaaatacaaaaat

SEQ ID NO: 36962 - DNA, 20 bp, Artificial Sequence
  chemically synthesized
ctaaaaatacaaaaattagc

SEQ ID NO: 36963 - DNA, 20 bp, Artificial Sequence
  chemically synthesized
taaaaatacaaaaattagct

SEQ ID NO: 36964 - DNA, 20 bp, Artificial Sequence
  chemically synthesized
atacaaaaattagctgggtg

SEQ ID NO: 36965 - DNA, 20 bp, Artificial Sequence
  chemically synthesized
ggtgtggtgacgcgctactg

SEQ ID NO: 36966 - DNA, 20 bp, Artificial Sequence
  chemically synthesized
gtgacgcgctactgtagtcc

SEQ ID NO: 36967 - DNA, 20 bp, Artificial Sequence
  chemically synthesized
ctactgtagtcccagcttct

SEQ ID NO: 36968 - DNA, 20 bp, Artificial Sequence
  chemically synthesized
tactgtagtcccagcttctc

SEQ ID NO: 36969 - DNA, 20 bp, Artificial Sequence
  chemically synthesized
ctgtagtcccagcttctcag

SEQ ID NO: 36970 - DNA, 20 bp, Artificial Sequence
  chemically synthesized
tgtagtcccagcttctcagg

SEQ ID NO: 36971 - DNA, 20 bp, Artificial Sequence
  chemically synthesized
cccagcttctcaggaggctg

SEQ ID NO: 36972 - DNA, 20 bp, Artificial Sequence
  chemically synthesized
agcttctcaggaggctgtgg

SEQ ID NO: 36973 - DNA, 20 bp, Artificial Sequence
  chemically synthesized
gcttctcaggaggctgtggc

SEQ ID NO: 36974 - DNA, 20 bp, Artificial Sequence
  chemically synthesized
ttctcaggaggctgtggcag

SEQ ID NO: 36975 - DNA, 20 bp, Artificial Sequence
  chemically synthesized
gcaggagaatcacttgaacc

SEQ ID NO: 36976 - DNA, 20 bp, Artificial Sequence
  chemically synthesized
caggagaatcacttgaacct

SEQ ID NO: 36977 - DNA, 20 bp, Artificial Sequence
  chemically synthesized
ggagaatcacttgaacctgg

SEQ ID NO: 36978 - DNA, 20 bp, Artificial Sequence
  chemically synthesized
gagaatcacttgaacctggg

SEQ ID NO: 36979 - DNA, 20 bp, Artificial Sequence
  chemically synthesized
aatcacttgaacctgggagg

SEQ ID NO: 36980 - DNA, 20 bp, Artificial Sequence
  chemically synthesized
tcacttgaacctgggaggtg

SEQ ID NO: 36981 - DNA, 20 bp, Artificial Sequence
  chemically synthesized
aacctgggaggtggagtttg

SEQ ID NO: 36982 - DNA, 20 bp, Artificial Sequence
  chemically synthesized
tgggaggtggagtttgcagt

SEQ ID NO: 36983 - DNA, 20 bp, Artificial Sequence
  chemically synthesized
ggtggagtttgcagtgagct

SEQ ID NO: 36984 - DNA, 20 bp, Artificial Sequence
  chemically synthesized
gagattgtgctactgcactc

SEQ ID NO: 36985 - DNA, 20 bp, Artificial Sequence
  chemically synthesized
tgtgctactgcactccagcc

SEQ ID NO: 36986 - DNA, 20 bp, Artificial Sequence
  chemically synthesized
actgcactccagcctggcga

SEQ ID NO: 36987 - DNA, 20 bp, Artificial Sequence
  chemically synthesized
tgcactccagcctggcgaca

SEQ ID NO: 36988 - DNA, 20 bp, Artificial Sequence
  chemically synthesized
ctccagcctggcgacagagt

SEQ ID NO: 36989 - DNA, 20 bp, Artificial Sequence
  chemically synthesized
aaaaaaaaaaaaaaaaaaaa

SEQ ID NO: 36990 - DNA, 20 bp, Artificial Sequence
  chemically synthesized
tgaatctgcatgactattaa

SEQ ID NO: 36991 - DNA, 20 bp, Artificial Sequence
  chemically synthesized
gactattaacagatccattg

SEQ ID NO: 36992 - DNA, 20 bp, Artificial Sequence
  chemically synthesized
taacagatccattgaagttc

SEQ ID NO: 36993 - DNA, 20 bp, Artificial Sequence
  chemically synthesized
cagatccattgaagttccag

SEQ ID NO: 36994 - DNA, 20 bp, Artificial Sequence
  chemically synthesized
ccattgaagttccagtagat

SEQ ID NO: 36995 - DNA, 20 bp, Artificial Sequence
  chemically synthesized
gataagaacaaattttacca

SEQ ID NO: 36996 - DNA, 20 bp, Artificial Sequence
  chemically synthesized
aacaaattttaccaaagtaa

SEQ ID NO: 36997 - DNA, 20 bp, Artificial Sequence
  chemically synthesized
acaaattttaccaaagtaac

SEQ ID NO: 36998 - DNA, 20 bp, Artificial Sequence
  chemically synthesized
attttaccaaagtaacagga

SEQ ID NO: 36999 - DNA, 20 bp, Artificial Sequence
  chemically synthesized
aggaaagacaaaaacgcaat

SEQ ID NO: 37000 - DNA, 20 bp, Artificial Sequence
  chemically synthesized
aaaacgcaattggaattcat

SEQ ID NO: 37001 - DNA, 20 bp, Artificial Sequence
  chemically synthesized
caattggaattcataagctc

SEQ ID NO: 37002 - DNA, 20 bp, Artificial Sequence
  chemically synthesized
aattggaattcataagctct

SEQ ID NO: 37003 - DNA, 20 bp, Artificial Sequence
  chemically synthesized
ttcataagctctaggacccg

SEQ ID NO: 37004 - DNA, 20 bp, Artificial Sequence
  chemically synthesized
cataagctctaggacccgta

SEQ ID NO: 37005 - DNA, 20 bp, Artificial Sequence
  chemically synthesized
ataagctctaggacccgtag

SEQ ID NO: 37006 - DNA, 20 bp, Artificial Sequence
  chemically synthesized
agaggtacatatgatccctg

SEQ ID NO: 37007 - DNA, 20 bp, Artificial Sequence
  chemically synthesized
ctaaccctttcaaataaact

SEQ ID NO: 37008 - DNA, 20 bp, Artificial Sequence
  chemically synthesized
ataaactaagttatgatgct

SEQ ID NO: 37009 - DNA, 20 bp, Artificial Sequence
  chemically synthesized
gttatgatgctgagcctcct

SEQ ID NO: 37010 - DNA, 20 bp, Artificial Sequence
  chemically synthesized
ttatgatgctgagcctcctt

SEQ ID NO: 37011 - DNA, 20 bp, Artificial Sequence
  chemically synthesized
cctccttgggtcacataacc

SEQ ID NO: 37012 - DNA, 20 bp, Artificial Sequence
  chemically synthesized
tgggtcacataaccaagccc

SEQ ID NO: 37013 - DNA, 20 bp, Artificial Sequence
  chemically synthesized
ctggtatccctatcttacat

SEQ ID NO: 37014 - DNA, 20 bp, Artificial Sequence
  chemically synthesized
tatccctatcttacatcagc

SEQ ID NO: 37015 - DNA, 20 bp, Artificial Sequence
  chemically synthesized
attttcctcaccccattctt

SEQ ID NO: 37016 - DNA, 20 bp, Artificial Sequence
  chemically synthesized
ttttcctcaccccattcttc

SEQ ID NO: 37017 - DNA, 20 bp, Artificial Sequence
  chemically synthesized
aggaaacacctgaaaatccc

SEQ ID NO: 37018 - DNA, 20 bp, Artificial Sequence
  chemically synthesized
ggaaacacctgaaaatcccg

SEQ ID NO: 37019 - DNA, 20 bp, Artificial Sequence
  chemically synthesized
cctgaaaatcccgaggacat

SEQ ID NO: 37020 - DNA, 20 bp, Artificial Sequence
  chemically synthesized
aatcccgaggacatcagttg

SEQ ID NO: 37021 - DNA, 20 bp, Artificial Sequence
  chemically synthesized
atcccgaggacatcagttgt

SEQ ID NO: 37022 - DNA, 20 bp, Artificial Sequence
  chemically synthesized
tcccgaggacatcagttgtg

SEQ ID NO: 37023 - DNA, 20 bp, Artificial Sequence
  chemically synthesized
ggggccctgttcctcccgaa

SEQ ID NO: 37024 - DNA, 20 bp, Artificial Sequence
  chemically synthesized
ggccctgttcctcccgaaca

SEQ ID NO: 37025 - DNA, 20 bp, Artificial Sequence
  chemically synthesized
cctgttcctcccgaacagag

SEQ ID NO: 37026 - DNA, 20 bp, Artificial Sequence
  chemically synthesized
tgttcctcccgaacagagaa

SEQ ID NO: 37027 - DNA, 20 bp, Artificial Sequence
  chemically synthesized
ttcctcccgaacagagaaga

SEQ ID NO: 37028 - DNA, 20 bp, Artificial Sequence
  chemically synthesized
tcctcccgaacagagaagag

SEQ ID NO: 37029 - DNA, 20 bp, Artificial Sequence
  chemically synthesized
cctcccgaacagagaagaga

SEQ ID NO: 37030 - DNA, 20 bp, Artificial Sequence
  chemically synthesized
cccgaacagagaagagaggg

SEQ ID NO: 37031 - DNA, 20 bp, Artificial Sequence
  chemically synthesized
ccgaacagagaagagaggga

SEQ ID NO: 37032 - DNA, 20 bp, Artificial Sequence
  chemically synthesized
cgaacagagaagagagggaa

SEQ ID NO: 37033 - DNA, 20 bp, Artificial Sequence
  chemically synthesized
aacagagaagagagggaagg

SEQ ID NO: 37034 - DNA, 20 bp, Artificial Sequence
  chemically synthesized
gaagagagggaagggagatc

SEQ ID NO: 37035 - DNA, 20 bp, Artificial Sequence
  chemically synthesized
aagagagggaagggagatca

SEQ ID NO: 37036 - DNA, 20 bp, Artificial Sequence
  chemically synthesized
agagagggaagggagatcaa

SEQ ID NO: 37037 - DNA, 20 bp, Artificial Sequence
  chemically synthesized
gagagggaagggagatcaag

SEQ ID NO: 37038 - DNA, 20 bp, Artificial Sequence
  chemically synthesized
gggagatcaaggggtctcct

SEQ ID NO: 37039 - DNA, 20 bp, Artificial Sequence
  chemically synthesized
caaggggtctcctgagatgc

SEQ ID NO: 37040 - DNA, 20 bp, Artificial Sequence
  chemically synthesized
gggtctcctgagatgctaga

SEQ ID NO: 37041 - DNA, 20 bp, Artificial Sequence
  chemically synthesized
gatgctagaaagatgaaact

SEQ ID NO: 37042 - DNA, 20 bp, Artificial Sequence
  chemically synthesized
atgctagaaagatgaaactc

SEQ ID NO: 37043 - DNA, 20 bp, Artificial Sequence
  chemically synthesized
tgctagaaagatgaaactca

SEQ ID NO: 37044 - DNA, 20 bp, Artificial Sequence
  chemically synthesized
gctagaaagatgaaactcag

SEQ ID NO: 37045 - DNA, 20 bp, Artificial Sequence
  chemically synthesized
tagaaagatgaaactcaggg

SEQ ID NO: 37046 - DNA, 20 bp, Artificial Sequence
  chemically synthesized
agaaagatgaaactcagggg

SEQ ID NO: 37047 - DNA, 20 bp, Artificial Sequence
  chemically synthesized
gaggtgatttccacatgcat

SEQ ID NO: 37048 - DNA, 20 bp, Artificial Sequence
  chemically synthesized
acatgcataagctttaaaat

SEQ ID NO: 37049 - DNA, 20 bp, Artificial Sequence
  chemically synthesized
catgcataagctttaaaatg

SEQ ID NO: 37050 - DNA, 20 bp, Artificial Sequence
  chemically synthesized
gctttaaaatgaggcctcat

SEQ ID NO: 37051 - DNA, 20 bp, Artificial Sequence
  chemically synthesized
tttaaaatgaggcctcatga

SEQ ID NO: 37052 - DNA, 20 bp, Artificial Sequence
  chemically synthesized
ttaaaatgaggcctcatgag

SEQ ID NO: 37053 - DNA, 20 bp, Artificial Sequence
  chemically synthesized
aggcctcatgagaggtctgt

SEQ ID NO: 37054 - DNA, 20 bp, Artificial Sequence
  chemically synthesized
gtgagtgaatgatctgaact

SEQ ID NO: 37055 - DNA, 20 bp, Artificial Sequence
  chemically synthesized
tgatctgaactgagtcctca

SEQ ID NO: 37056 - DNA, 20 bp, Artificial Sequence
  chemically synthesized
atctgaactgagtcctcaaa

SEQ ID NO: 37057 - DNA, 20 bp, Artificial Sequence
  chemically synthesized
tctgaactgagtcctcaaag

SEQ ID NO: 37058 - DNA, 20 bp, Artificial Sequence
  chemically synthesized
aactgagtcctcaaagagga

SEQ ID NO: 37059 - DNA, 20 bp, Artificial Sequence
  chemically synthesized
actgagtcctcaaagaggac

SEQ ID NO: 37060 - DNA, 20 bp, Artificial Sequence
  chemically synthesized
gtcctcaaagaggacaggaa

SEQ ID NO: 37061 - DNA, 20 bp, Artificial Sequence
  chemically synthesized
tcctcaaagaggacaggaat

SEQ ID NO: 37062 - DNA, 20 bp, Artificial Sequence
  chemically synthesized
acaggaataggttcctattt

SEQ ID NO: 37063 - DNA, 20 bp, Artificial Sequence
  chemically synthesized
tattttagccacaatactgt

SEQ ID NO: 37064 - DNA, 20 bp, Artificial Sequence
  chemically synthesized
tttagccacaatactgtgag

SEQ ID NO: 37065 - DNA, 20 bp, Artificial Sequence
  chemically synthesized
ttagccacaatactgtgagt

SEQ ID NO: 37066 - DNA, 20 bp, Artificial Sequence
  chemically synthesized
ccacaatactgtgagtgggt

SEQ ID NO: 37067 - DNA, 20 bp, Artificial Sequence
  chemically synthesized
tactgtgagtgggtgagtgc

SEQ ID NO: 37068 - DNA, 20 bp, Artificial Sequence
  chemically synthesized
actgtgagtgggtgagtgcc

SEQ ID NO: 37069 - DNA, 20 bp, Artificial Sequence
  chemically synthesized
gagtgccaggaacttgaata

SEQ ID NO: 37070 - DNA, 20 bp, Artificial Sequence
  chemically synthesized
attcctctctcttctgatgt

SEQ ID NO: 37071 - DNA, 20 bp, Artificial Sequence
  chemically synthesized
ttctgatgtgagatgcactc

SEQ ID NO: 37072 - DNA, 20 bp, Artificial Sequence
  chemically synthesized
tctgatgtgagatgcactca

SEQ ID NO: 37073 - DNA, 20 bp, Artificial Sequence
  chemically synthesized
atgtgagatgcactcaagga

SEQ ID NO: 37074 - DNA, 20 bp, Artificial Sequence
  chemically synthesized
tgcactcaaggaaagcatat

SEQ ID NO: 37075 - DNA, 20 bp, Artificial Sequence
  chemically synthesized
actcaaggaaagcatataag

SEQ ID NO: 37076 - DNA, 20 bp, Artificial Sequence
  chemically synthesized
ctcaaggaaagcatataaga

SEQ ID NO: 37077 - DNA, 20 bp, Artificial Sequence
  chemically synthesized
aagcatataagaaggttttc

SEQ ID NO: 37078 - DNA, 20 bp, Artificial Sequence
  chemically synthesized
gcatataagaaggttttcca

SEQ ID NO: 37079 - DNA, 20 bp, Artificial Sequence
  chemically synthesized
catataagaaggttttccag

SEQ ID NO: 37080 - DNA, 20 bp, Artificial Sequence
  chemically synthesized
aggttttccagaggtctgcc

SEQ ID NO: 37081 - DNA, 20 bp, Artificial Sequence
  chemically synthesized
gttttccagaggtctgccta

SEQ ID NO: 37082 - DNA, 20 bp, Artificial Sequence
  chemically synthesized
ttttccagaggtctgcctag

SEQ ID NO: 37083 - DNA, 20 bp, Artificial Sequence
  chemically synthesized
cagaggtctgcctagaggta

SEQ ID NO: 37084 - DNA, 20 bp, Artificial Sequence
  chemically synthesized
ctgcctagaggtaaagatca

SEQ ID NO: 37085 - DNA, 20 bp, Artificial Sequence
  chemically synthesized
tagaggtaaagatcacagct

SEQ ID NO: 37086 - DNA, 20 bp, Artificial Sequence
  chemically synthesized
agaggtaaagatcacagctg

SEQ ID NO: 37087 - DNA, 20 bp, Artificial Sequence
  chemically synthesized
ggtaaagatcacagctgagg

SEQ ID NO: 37088 - DNA, 20 bp, Artificial Sequence
  chemically synthesized
gtaaagatcacagctgaggt

SEQ ID NO: 37089 - DNA, 20 bp, Artificial Sequence
  chemically synthesized
agctgaggtgggatatccta

SEQ ID NO: 37090 - DNA, 20 bp, Artificial Sequence
  chemically synthesized
aggtgggatatcctacagca

SEQ ID NO: 37091 - DNA, 20 bp, Artificial Sequence
  chemically synthesized
tttttttttttcttttttga

SEQ ID NO: 37092 - DNA, 20 bp, Artificial Sequence
  chemically synthesized
tttttttttcttttttgaaa

SEQ ID NO: 37093 - DNA, 20 bp, Artificial Sequence
  chemically synthesized
tcttttttgaaagagtattt

SEQ ID NO: 37094 - DNA, 20 bp, Artificial Sequence
  chemically synthesized
cttttttgaaagagtattta

SEQ ID NO: 37095 - DNA, 20 bp, Artificial Sequence
  chemically synthesized
gagtatttaaggaactgtga

SEQ ID NO: 37096 - DNA, 20 bp, Artificial Sequence
  chemically synthesized
ttaaggaactgtgatagatt

SEQ ID NO: 37097 - DNA, 20 bp, Artificial Sequence
  chemically synthesized
taaggaactgtgatagattt

SEQ ID NO: 37098 - DNA, 20 bp, Artificial Sequence
  chemically synthesized
tagatttaggttttctaatc

SEQ ID NO: 37099 - DNA, 20 bp, Artificial Sequence
  chemically synthesized
agatttaggttttctaatct

SEQ ID NO: 37100 - DNA, 20 bp, Artificial Sequence
  chemically synthesized
gttttctaatctgggaccct

SEQ ID NO: 37101 - DNA, 20 bp, Artificial Sequence
  chemically synthesized
ctaatctgggacccttggat

SEQ ID NO: 37102 - DNA, 20 bp, Artificial Sequence
  chemically synthesized
tgggacccttggattggcat

SEQ ID NO: 37103 - DNA, 20 bp, Artificial Sequence
  chemically synthesized
taagtataattgttaatgct

SEQ ID NO: 37104 - DNA, 20 bp, Artificial Sequence
  chemically synthesized
ttcttactcatttttctatg

SEQ ID NO: 37105 - DNA, 20 bp, Artificial Sequence
  chemically synthesized
tttttctatgtagatgttta

SEQ ID NO: 37106 - DNA, 20 bp, Artificial Sequence
  chemically synthesized
gatgtttatagctttttttt

SEQ ID NO: 37107 - DNA, 20 bp, Artificial Sequence
  chemically synthesized
tgtttatagcttttttttca

SEQ ID NO: 37108 - DNA, 20 bp, Artificial Sequence
  chemically synthesized
aatatttcttcattccaaaa

SEQ ID NO: 37109 - DNA, 20 bp, Artificial Sequence
  chemically synthesized
tatcactcacctcctttgtt

SEQ ID NO: 37110 - DNA, 20 bp, Artificial Sequence
  chemically synthesized
cacctcctttgttcagttat

SEQ ID NO: 37111 - DNA, 20 bp, Artificial Sequence
  chemically synthesized
tattacatttatatttgtaa

SEQ ID NO: 37112 - DNA, 20 bp, Artificial Sequence
  chemically synthesized
atttatatttgtaatagttc

SEQ ID NO: 37113 - DNA, 20 bp, Artificial Sequence
  chemically synthesized
atacattcatttttgaaaat

SEQ ID NO: 37114 - DNA, 20 bp, Artificial Sequence
  chemically synthesized
cattcatttttgaaaataag

SEQ ID NO: 37115 - DNA, 20 bp, Artificial Sequence
  chemically synthesized
tcatttttgaaaataagaag

SEQ ID NO: 37116 - DNA, 20 bp, Artificial Sequence
  chemically synthesized
ttttgaaaataagaagcaga

SEQ ID NO: 37117 - DNA, 20 bp, Artificial Sequence
  chemically synthesized
tttgaaaataagaagcagaa

SEQ ID NO: 37118 - DNA, 20 bp, Artificial Sequence
  chemically synthesized
aatgacatgactatctttac

SEQ ID NO: 37119 - DNA, 20 bp, Artificial Sequence
  chemically synthesized
ggtgcttttgtcattttatg

SEQ ID NO: 37120 - DNA, 20 bp, Artificial Sequence
  chemically synthesized
tagattcaaatgatcatctt

SEQ ID NO: 37121 - DNA, 20 bp, Artificial Sequence
  chemically synthesized
aatgatcatctttggtcatt

SEQ ID NO: 37122 - DNA, 20 bp, Artificial Sequence
  chemically synthesized
ttggtcatttggtttcaact

SEQ ID NO: 37123 - DNA, 20 bp, Artificial Sequence
  chemically synthesized
caacttagttgaaatcaact

SEQ ID NO: 37124 - DNA, 20 bp, Artificial Sequence
  chemically synthesized
caactcagtttttgtttatc

SEQ ID NO: 37125 - DNA, 20 bp, Artificial Sequence
  chemically synthesized
tcagtttttgtttatccaga

SEQ ID NO: 37126 - DNA, 20 bp, Artificial Sequence
  chemically synthesized
cagtttttgtttatccagaa

SEQ ID NO: 37127 - DNA, 20 bp, Artificial Sequence
  chemically synthesized
agtttttgtttatccagaaa

SEQ ID NO: 37128 - DNA, 20 bp, Artificial Sequence
  chemically synthesized
ttattgataactttcctgtt

SEQ ID NO: 37129 - DNA, 20 bp, Artificial Sequence
  chemically synthesized
attgataactttcctgttca

SEQ ID NO: 37130 - DNA, 20 bp, Artificial Sequence
  chemically synthesized
ttgataactttcctgttcag

SEQ ID NO: 37131 - DNA, 20 bp, Artificial Sequence
  chemically synthesized
ttcagaggattttttgttga

SEQ ID NO: 37132 - DNA, 20 bp, Artificial Sequence
  chemically synthesized
ttgttgatagtttttctctg

SEQ ID NO: 37133 - DNA, 20 bp, Artificial Sequence
  chemically synthesized
gttgatagtttttctctgaa

SEQ ID NO: 37134 - DNA, 20 bp, Artificial Sequence
  chemically synthesized
gatagtttttctctgaagag

SEQ ID NO: 37135 - DNA, 20 bp, Artificial Sequence
  chemically synthesized
tagacaaaaaattctgaatc

SEQ ID NO: 37136 - DNA, 20 bp, Artificial Sequence
  chemically synthesized
aaaattctgaatcgagttga

SEQ ID NO: 37137 - DNA, 20 bp, Artificial Sequence
  chemically synthesized
aaattctgaatcgagttgaa

SEQ ID NO: 37138 - DNA, 20 bp, Artificial Sequence
  chemically synthesized
ctgaatcgagttgaaaggct

SEQ ID NO: 37139 - DNA, 20 bp, Artificial Sequence
  chemically synthesized
tcgagttgaaaggcttagaa

SEQ ID NO: 37140 - DNA, 20 bp, Artificial Sequence
  chemically synthesized
cgagttgaaaggcttagaaa

SEQ ID NO: 37141 - DNA, 20 bp, Artificial Sequence
  chemically synthesized
gagttgaaaggcttagaaaa

SEQ ID NO: 37142 - DNA, 20 bp, Artificial Sequence
  chemically synthesized
ttgaaaggcttagaaaaggg

SEQ ID NO: 37143 - DNA, 20 bp, Artificial Sequence
  chemically synthesized
tagaaaagggcagccaaatt

SEQ ID NO: 37144 - DNA, 20 bp, Artificial Sequence
  chemically synthesized
gggcagccaaattaagatct

SEQ ID NO: 37145 - DNA, 20 bp, Artificial Sequence
  chemically synthesized
agccaaattaagatctaaga

SEQ ID NO: 37146 - DNA, 20 bp, Artificial Sequence
  chemically synthesized
taagatctaagaaagcaaat

SEQ ID NO: 37147 - DNA, 20 bp, Artificial Sequence
  chemically synthesized
tgaaaatgaaatcatattga

SEQ ID NO: 37148 - DNA, 20 bp, Artificial Sequence
  chemically synthesized
aaatgaaatcatattgatgg

SEQ ID NO: 37149 - DNA, 20 bp, Artificial Sequence
  chemically synthesized
gatggcagatgataatatat

SEQ ID NO: 37150 - DNA, 20 bp, Artificial Sequence
  chemically synthesized
cagatgataatatattggac

SEQ ID NO: 37151 - DNA, 20 bp, Artificial Sequence
  chemically synthesized
agatgataatatattggact

SEQ ID NO: 37152 - DNA, 20 bp, Artificial Sequence
  chemically synthesized
gataatatattggactgggt

SEQ ID NO: 37153 - DNA, 20 bp, Artificial Sequence
  chemically synthesized
taatatattggactgggttg

SEQ ID NO: 37154 - DNA, 20 bp, Artificial Sequence
  chemically synthesized
tatattggactgggttggag

SEQ ID NO: 37155 - DNA, 20 bp, Artificial Sequence
  chemically synthesized
atattggactgggttggaga

SEQ ID NO: 37156 - DNA, 20 bp, Artificial Sequence
  chemically synthesized
ttggactgggttggagaagg

SEQ ID NO: 37157 - DNA, 20 bp, Artificial Sequence
  chemically synthesized
tggactgggttggagaaggc

SEQ ID NO: 37158 - DNA, 20 bp, Artificial Sequence
  chemically synthesized
gactgggttggagaaggcag

SEQ ID NO: 37159 - DNA, 20 bp, Artificial Sequence
  chemically synthesized
actgggttggagaaggcagg

SEQ ID NO: 37160 - DNA, 20 bp, Artificial Sequence
  chemically synthesized
ggcaggaggaatttaacttg

SEQ ID NO: 37161 - DNA, 20 bp, Artificial Sequence
  chemically synthesized
ggaatttaacttgtggacaa

SEQ ID NO: 37162 - DNA, 20 bp, Artificial Sequence
  chemically synthesized
cttgtggacaatagaaatct

SEQ ID NO: 37163 - DNA, 20 bp, Artificial Sequence
  chemically synthesized
tgtggacaatagaaatctga

SEQ ID NO: 37164 - DNA, 20 bp, Artificial Sequence
  chemically synthesized
gacaatagaaatctgagagt

SEQ ID NO: 37165 - DNA, 20 bp, Artificial Sequence
  chemically synthesized
acaatagaaatctgagagtt

SEQ ID NO: 37166 - DNA, 20 bp, Artificial Sequence
  chemically synthesized
atagaaatctgagagttggg

SEQ ID NO: 37167 - DNA, 20 bp, Artificial Sequence
  chemically synthesized
agttgggtagtcccaactgt

SEQ ID NO: 37168 - DNA, 20 bp, Artificial Sequence
  chemically synthesized
gttgggtagtcccaactgtc

SEQ ID NO: 37169 - DNA, 20 bp, Artificial Sequence
  chemically synthesized
agtcccaactgtcaggccct

SEQ ID NO: 37170 - DNA, 20 bp, Artificial Sequence
  chemically synthesized
gtcccaactgtcaggccctc

SEQ ID NO: 37171 - DNA, 20 bp, Artificial Sequence
  chemically synthesized
aactgtcaggccctcaggac

SEQ ID NO: 37172 - DNA, 20 bp, Artificial Sequence
  chemically synthesized
actgtcaggccctcaggact

SEQ ID NO: 37173 - DNA, 20 bp, Artificial Sequence
  chemically synthesized
ctgtcaggccctcaggactg

SEQ ID NO: 37174 - DNA, 20 bp, Artificial Sequence
  chemically synthesized
ccctcaggactggggccaaa

SEQ ID NO: 37175 - DNA, 20 bp, Artificial Sequence
  chemically synthesized
ctcaggactggggccaaatg

SEQ ID NO: 37176 - DNA, 20 bp, Artificial Sequence
  chemically synthesized
tcaggactggggccaaatgg

SEQ ID NO: 37177 - DNA, 20 bp, Artificial Sequence
  chemically synthesized
atggaggactcacttttttg

SEQ ID NO: 37178 - DNA, 20 bp, Artificial Sequence
  chemically synthesized
actcacttttttgaagatta

SEQ ID NO: 37179 - DNA, 20 bp, Artificial Sequence
  chemically synthesized
gaagattaaagacaatgcgt

SEQ ID NO: 37180 - DNA, 20 bp, Artificial Sequence
  chemically synthesized
agattaaagacaatgcgtga

SEQ ID NO: 37181 - DNA, 20 bp, Artificial Sequence
  chemically synthesized
aaagacaatgcgtgagagca

SEQ ID NO: 37182 - DNA, 20 bp, Artificial Sequence
  chemically synthesized
agacaatgcgtgagagcacg

SEQ ID NO: 37183 - DNA, 20 bp, Artificial Sequence
  chemically synthesized
cacggagttctgaacctaaa

SEQ ID NO: 37184 - DNA, 20 bp, Artificial Sequence
  chemically synthesized
acggagttctgaacctaaac

SEQ ID NO: 37185 - DNA, 20 bp, Artificial Sequence
  chemically synthesized
gttctgaacctaaacaggct

SEQ ID NO: 37186 - DNA, 20 bp, Artificial Sequence
  chemically synthesized
ctgagcttctgcactctgct

SEQ ID NO: 37187 - DNA, 20 bp, Artificial Sequence
  chemically synthesized
tgctaagatcctgaaattta

SEQ ID NO: 37188 - DNA, 20 bp, Artificial Sequence
  chemically synthesized
aagatcctgaaatttataga

SEQ ID NO: 37189 - DNA, 20 bp, Artificial Sequence
  chemically synthesized
cctgaaatttatagaaagaa

SEQ ID NO: 37190 - DNA, 20 bp, Artificial Sequence
  chemically synthesized
catataacaatttaatttat

SEQ ID NO: 37191 - DNA, 20 bp, Artificial Sequence
  chemically synthesized
tgtgtctgtgtgtttgtttg

SEQ ID NO: 37192 - DNA, 20 bp, Artificial Sequence
  chemically synthesized
tttgtttgaagaactgctct

SEQ ID NO: 37193 - DNA, 20 bp, Artificial Sequence
  chemically synthesized
tgtttgaagaactgctctaa

SEQ ID NO: 37194 - DNA, 20 bp, Artificial Sequence
  chemically synthesized
tgaagaactgctctaagaga

SEQ ID NO: 37195 - DNA, 20 bp, Artificial Sequence
  chemically synthesized
actgctctaagagatggcat

SEQ ID NO: 37196 - DNA, 20 bp, Artificial Sequence
  chemically synthesized
gctctaagagatggcatgag

SEQ ID NO: 37197 - DNA, 20 bp, Artificial Sequence
  chemically synthesized
taagagatggcatgagtagt

SEQ ID NO: 37198 - DNA, 20 bp, Artificial Sequence
  chemically synthesized
gagatggcatgagtagtcag

SEQ ID NO: 37199 - DNA, 20 bp, Artificial Sequence
  chemically synthesized
agatggcatgagtagtcagt

SEQ ID NO: 37200 - DNA, 20 bp, Artificial Sequence
  chemically synthesized
gagtagtcagtgggactcac

SEQ ID NO: 37201 - DNA, 20 bp, Artificial Sequence
  chemically synthesized
gggactcactagaaaaattc

SEQ ID NO: 37202 - DNA, 20 bp, Artificial Sequence
  chemically synthesized
gactcactagaaaaattcta

SEQ ID NO: 37203 - DNA, 20 bp, Artificial Sequence
  chemically synthesized
cactagaaaaattctagaga

SEQ ID NO: 37204 - DNA, 20 bp, Artificial Sequence
  chemically synthesized
actagaaaaattctagagac

SEQ ID NO: 37205 - DNA, 20 bp, Artificial Sequence
  chemically synthesized
ctagaaaaattctagagaca

SEQ ID NO: 37206 - DNA, 20 bp, Artificial Sequence
  chemically synthesized
agagacagggcccatctcct

SEQ ID NO: 37207 - DNA, 20 bp, Artificial Sequence
  chemically synthesized
gagacagggcccatctcctt

SEQ ID NO: 37208 - DNA, 20 bp, Artificial Sequence
  chemically synthesized
acagggcccatctccttagg

SEQ ID NO: 37209 - DNA, 20 bp, Artificial Sequence
  chemically synthesized
cagggcccatctccttagga

SEQ ID NO: 37210 - DNA, 20 bp, Artificial Sequence
  chemically synthesized
cccatctccttaggaaggtg

SEQ ID NO: 37211 - DNA, 20 bp, Artificial Sequence
  chemically synthesized
ccatctccttaggaaggtgc

SEQ ID NO: 37212 - DNA, 20 bp, Artificial Sequence
  chemically synthesized
catctccttaggaaggtgcg

SEQ ID NO: 37213 - DNA, 20 bp, Artificial Sequence
  chemically synthesized
gacacatcttccatccaact

SEQ ID NO: 37214 - DNA, 20 bp, Artificial Sequence
  chemically synthesized
acatcttccatccaactcag

SEQ ID NO: 37215 - DNA, 20 bp, Artificial Sequence
  chemically synthesized
catcttccatccaactcaga

SEQ ID NO: 37216 - DNA, 20 bp, Artificial Sequence
  chemically synthesized
tcttccatccaactcagaag

SEQ ID NO: 37217 - DNA, 20 bp, Artificial Sequence
  chemically synthesized
cttccatccaactcagaagg

SEQ ID NO: 37218 - DNA, 20 bp, Artificial Sequence
  chemically synthesized
ttccatccaactcagaagga

SEQ ID NO: 37219 - DNA, 20 bp, Artificial Sequence
  chemically synthesized
catccaactcagaaggaggg

SEQ ID NO: 37220 - DNA, 20 bp, Artificial Sequence
  chemically synthesized
tccaactcagaaggagggca

SEQ ID NO: 37221 - DNA, 20 bp, Artificial Sequence
  chemically synthesized
aactcagaaggagggcagag

SEQ ID NO: 37222 - DNA, 20 bp, Artificial Sequence
  chemically synthesized
actcagaaggagggcagagt

SEQ ID NO: 37223 - DNA, 20 bp, Artificial Sequence
  chemically synthesized
aggagggcagagtaggaaat

SEQ ID NO: 37224 - DNA, 20 bp, Artificial Sequence
  chemically synthesized
agggcagagtaggaaatgag

SEQ ID NO: 37225 - DNA, 20 bp, Artificial Sequence
  chemically synthesized
agagtaggaaatgagaagat

SEQ ID NO: 37226 - DNA, 20 bp, Artificial Sequence
  chemically synthesized
gagtaggaaatgagaagatg

SEQ ID NO: 37227 - DNA, 20 bp, Artificial Sequence
  chemically synthesized
agtaggaaatgagaagatga

SEQ ID NO: 37228 - DNA, 20 bp, Artificial Sequence
  chemically synthesized
ggaaatgagaagatgaggga

SEQ ID NO: 37229 - DNA, 20 bp, Artificial Sequence
  chemically synthesized
gaaatgagaagatgagggaa

SEQ ID NO: 37230 - DNA, 20 bp, Artificial Sequence
  chemically synthesized
aatgagaagatgagggaaag

SEQ ID NO: 37231 - DNA, 20 bp, Artificial Sequence
  chemically synthesized
atgagaagatgagggaaagg

SEQ ID NO: 37232 - DNA, 20 bp, Artificial Sequence
  chemically synthesized
tcctctttcacttgtttatg

SEQ ID NO: 37233 - DNA, 20 bp, Artificial Sequence
  chemically synthesized
tgtttatgtagactgtataa

SEQ ID NO: 37234 - DNA, 20 bp, Artificial Sequence
  chemically synthesized
actatttactacattttctt

SEQ ID NO: 37235 - DNA, 20 bp, Artificial Sequence
  chemically synthesized
ctatttactacattttcttg

SEQ ID NO: 37236 - DNA, 20 bp, Artificial Sequence
  chemically synthesized
ctacattttcttgaggctaa

SEQ ID NO: 37237 - DNA, 20 bp, Artificial Sequence
  chemically synthesized
tgttccttcttcatactaca

SEQ ID NO: 37238 - DNA, 20 bp, Artificial Sequence
  chemically synthesized
ctcctttactcccttgtatc

SEQ ID NO: 37239 - DNA, 20 bp, Artificial Sequence
  chemically synthesized
acattcaaattatgttctca

SEQ ID NO: 37240 - DNA, 20 bp, Artificial Sequence
  chemically synthesized
tcaaattatgttctcaaagt

SEQ ID NO: 37241 - DNA, 20 bp, Artificial Sequence
  chemically synthesized
agcatgacaacttttttcca

SEQ ID NO: 37242 - DNA, 20 bp, Artificial Sequence
  chemically synthesized
ctgtatgtatttatgcatct

SEQ ID NO: 37243 - DNA, 20 bp, Artificial Sequence
  chemically synthesized
atgtatttatgcatcttggt

SEQ ID NO: 37244 - DNA, 20 bp, Artificial Sequence
  chemically synthesized
gtatttatgcatcttggtga

SEQ ID NO: 37245 - DNA, 20 bp, Artificial Sequence
  chemically synthesized
cttggtgagagtgttgctac

SEQ ID NO: 37246 - DNA, 20 bp, Artificial Sequence
  chemically synthesized
tgagagtgttgctacaagta

SEQ ID NO: 37247 - DNA, 20 bp, Artificial Sequence
  chemically synthesized
gagagtgttgctacaagtat

SEQ ID NO: 37248 - DNA, 20 bp, Artificial Sequence
  chemically synthesized
gtataggaatcttattcatc

SEQ ID NO: 37249 - DNA, 20 bp, Artificial Sequence
  chemically synthesized
atatatcatcatgtgaaatt

SEQ ID NO: 37250 - DNA, 20 bp, Artificial Sequence
  chemically synthesized
tatatcatcatgtgaaattc

SEQ ID NO: 37251 - DNA, 20 bp, Artificial Sequence
  chemically synthesized
tcatgtgaaattcaggtcaa

SEQ ID NO: 37252 - DNA, 20 bp, Artificial Sequence
  chemically synthesized
attcaggtcaatagaacatc

SEQ ID NO: 37253 - DNA, 20 bp, Artificial Sequence
  chemically synthesized
tcaatagaacatctagaatg

SEQ ID NO: 37254 - DNA, 20 bp, Artificial Sequence
  chemically synthesized
tagaacatctagaatgaagc

SEQ ID NO: 37255 - DNA, 20 bp, Artificial Sequence
  chemically synthesized
tctagaatgaagctagaatg

SEQ ID NO: 37256 - DNA, 20 bp, Artificial Sequence
  chemically synthesized
agaatgaagctagaatgaag

SEQ ID NO: 37257 - DNA, 20 bp, Artificial Sequence
  chemically synthesized
gaatgaagctagaatgaagc

SEQ ID NO: 37258 - DNA, 20 bp, Artificial Sequence
  chemically synthesized
aatgaagctagaatgaagca

SEQ ID NO: 37259 - DNA, 20 bp, Artificial Sequence
  chemically synthesized
agctagaatgaagcagggct

SEQ ID NO: 37260 - DNA, 20 bp, Artificial Sequence
  chemically synthesized
ttagatctatgatttttctc

SEQ ID NO: 37261 - DNA, 20 bp, Artificial Sequence
  chemically synthesized
tatgatttttctcaagtttt

SEQ ID NO: 37262 - DNA, 20 bp, Artificial Sequence
  chemically synthesized
ttctcaagttttcagcatta

SEQ ID NO: 37263 - DNA, 20 bp, Artificial Sequence
  chemically synthesized
tcagcattatggatcctgtt

SEQ ID NO: 37264 - DNA, 20 bp, Artificial Sequence
  chemically synthesized
tggatcctgttgagacattc

SEQ ID NO: 37265 - DNA, 20 bp, Artificial Sequence
  chemically synthesized
ggatcctgttgagacattca

SEQ ID NO: 37266 - DNA, 20 bp, Artificial Sequence
  chemically synthesized
gatcctgttgagacattcaa

SEQ ID NO: 37267 - DNA, 20 bp, Artificial Sequence
  chemically synthesized
caatattctgcataaaattg

SEQ ID NO: 37268 - DNA, 20 bp, Artificial Sequence
  chemically synthesized
aatattctgcataaaattga

SEQ ID NO: 37269 - DNA, 20 bp, Artificial Sequence
  chemically synthesized
atattctgcataaaattgaa

SEQ ID NO: 37270 - DNA, 20 bp, Artificial Sequence
  chemically synthesized
attctgcataaaattgaagg

SEQ ID NO: 37271 - DNA, 20 bp, Artificial Sequence
  chemically synthesized
aaaattgaagggagaatatt

SEQ ID NO: 37272 - DNA, 20 bp, Artificial Sequence
  chemically synthesized
taagcactattataaactca

SEQ ID NO: 37273 - DNA, 20 bp, Artificial Sequence
  chemically synthesized
aagcactattataaactcat

SEQ ID NO: 37274 - DNA, 20 bp, Artificial Sequence
  chemically synthesized
ataaactcataggccatatt

SEQ ID NO: 37275 - DNA, 20 bp, Artificial Sequence
  chemically synthesized
aaactcataggccatattga

SEQ ID NO: 37276 - DNA, 20 bp, Artificial Sequence
  chemically synthesized
ggccatattgagagcttctt

SEQ ID NO: 37277 - DNA, 20 bp, Artificial Sequence
  chemically synthesized
ccatattgagagcttcttaa

SEQ ID NO: 37278 - DNA, 20 bp, Artificial Sequence
  chemically synthesized
tattgagagcttcttaagag

SEQ ID NO: 37279 - DNA, 20 bp, Artificial Sequence
  chemically synthesized
agcagactgtgcttattaca

SEQ ID NO: 37280 - DNA, 20 bp, Artificial Sequence
  chemically synthesized
gtgcttattacatggttatt

SEQ ID NO: 37281 - DNA, 20 bp, Artificial Sequence
  chemically synthesized
tggttatttagaactaaaca

SEQ ID NO: 37282 - DNA, 20 bp, Artificial Sequence
  chemically synthesized
atttagaactaaacacagtg

SEQ ID NO: 37283 - DNA, 20 bp, Artificial Sequence
  chemically synthesized
ctaaacacagtgcagttgtg

SEQ ID NO: 37284 - DNA, 20 bp, Artificial Sequence
  chemically synthesized
aattctgtgctgactcaaaa

SEQ ID NO: 37285 - DNA, 20 bp, Artificial Sequence
  chemically synthesized
agtcattttccaacttgtcc

SEQ ID NO: 37286 - DNA, 20 bp, Artificial Sequence
  chemically synthesized
attttccaacttgtcccaga

SEQ ID NO: 37287 - DNA, 20 bp, Artificial Sequence
  chemically synthesized
caacttgtcccagatggtat

SEQ ID NO: 37288 - DNA, 20 bp, Artificial Sequence
  chemically synthesized
tcccagatggtattggtgaa

SEQ ID NO: 37289 - DNA, 20 bp, Artificial Sequence
  chemically synthesized
ccagatggtattggtgaatg

SEQ ID NO: 37290 - DNA, 20 bp, Artificial Sequence
  chemically synthesized
attggtgaatggagctccta

SEQ ID NO: 37291 - DNA, 20 bp, Artificial Sequence
  chemically synthesized
ttggtgaatggagctcctac

SEQ ID NO: 37292 - DNA, 20 bp, Artificial Sequence
  chemically synthesized
tatcttcatatatgatatat

SEQ ID NO: 37293 - DNA, 20 bp, Artificial Sequence
  chemically synthesized
catatatgatatatcagttc

SEQ ID NO: 37294 - DNA, 20 bp, Artificial Sequence
  chemically synthesized
atatatgatatatcagttca

SEQ ID NO: 37295 - DNA, 20 bp, Artificial Sequence
  chemically synthesized
aggaaaaatcatcacacatc

SEQ ID NO: 37296 - DNA, 20 bp, Artificial Sequence
  chemically synthesized
aaaatcatcacacatcaagt

SEQ ID NO: 37297 - DNA, 20 bp, Artificial Sequence
  chemically synthesized
aaatcatcacacatcaagtc

SEQ ID NO: 37298 - DNA, 20 bp, Artificial Sequence
  chemically synthesized
cacacatcaagtcaggaccc

SEQ ID NO: 37299 - DNA, 20 bp, Artificial Sequence
  chemically synthesized
aagtcaggaccccagatcct

SEQ ID NO: 37300 - DNA, 20 bp, Artificial Sequence
  chemically synthesized
agtcaggaccccagatcctt

SEQ ID NO: 37301 - DNA, 20 bp, Artificial Sequence
  chemically synthesized
tcactaaacatttatgttct

SEQ ID NO: 37302 - DNA, 20 bp, Artificial Sequence
  chemically synthesized
aaacatttatgttctgagtt

SEQ ID NO: 37303 - DNA, 20 bp, Artificial Sequence
  chemically synthesized
acatttatgttctgagttga

SEQ ID NO: 37304 - DNA, 20 bp, Artificial Sequence
  chemically synthesized
agagctgcctatcaatttca

SEQ ID NO: 37305 - DNA, 20 bp, Artificial Sequence
  chemically synthesized
gcctatcaatttcacagcca

SEQ ID NO: 37306 - DNA, 20 bp, Artificial Sequence
  chemically synthesized
atagctgctccacctttatc

SEQ ID NO: 37307 - DNA, 20 bp, Artificial Sequence
  chemically synthesized
ccacctttatccagaaaaac

SEQ ID NO: 37308 - DNA, 20 bp, Artificial Sequence
  chemically synthesized
aaaactagttcttgtgcttc

SEQ ID NO: 37309 - DNA, 20 bp, Artificial Sequence
  chemically synthesized
attttcttaacacttgttaa

SEQ ID NO: 37310 - DNA, 20 bp, Artificial Sequence
  chemically synthesized
cttaacacttgttaatagct

SEQ ID NO: 37311 - DNA, 20 bp, Artificial Sequence
  chemically synthesized
taatagctaagccatctgaa

SEQ ID NO: 37312 - DNA, 20 bp, Artificial Sequence
  chemically synthesized
ctgaatggaattttgccaca

SEQ ID NO: 37313 - DNA, 20 bp, Artificial Sequence
  chemically synthesized
tggaattttgccacatagtg

SEQ ID NO: 37314 - DNA, 20 bp, Artificial Sequence
  chemically synthesized
tttgccacatagtgcagcct

SEQ ID NO: 37315 - DNA, 20 bp, Artificial Sequence
  chemically synthesized
ttgccacatagtgcagcctt

SEQ ID NO: 37316 - DNA, 20 bp, Artificial Sequence
  chemically synthesized
gccacatagtgcagccttgg

SEQ ID NO: 37317 - DNA, 20 bp, Artificial Sequence
  chemically synthesized
cagccttgggagcatgcata

SEQ ID NO: 37318 - DNA, 20 bp, Artificial Sequence
  chemically synthesized
ttgggagcatgcatacagta

SEQ ID NO: 37319 - DNA, 20 bp, Artificial Sequence
  chemically synthesized
atacagtatggcttcatctc

SEQ ID NO: 37320 - DNA, 20 bp, Artificial Sequence
  chemically synthesized
atctctggtgacactgctta

SEQ ID NO: 37321 - DNA, 20 bp, Artificial Sequence
  chemically synthesized
tctggtgacactgcttatag

SEQ ID NO: 37322 - DNA, 20 bp, Artificial Sequence
  chemically synthesized
ctggtgacactgcttatagt

SEQ ID NO: 37323 - DNA, 20 bp, Artificial Sequence
  chemically synthesized
acactgcttatagtgggcct

SEQ ID NO: 37324 - DNA, 20 bp, Artificial Sequence
  chemically synthesized
agtgggcctcagtttgatga

SEQ ID NO: 37325 - DNA, 20 bp, Artificial Sequence
  chemically synthesized
ctcagtttgatgacagtatc

SEQ ID NO: 37326 - DNA, 20 bp, Artificial Sequence
  chemically synthesized
atgacagtatctagctctcc

SEQ ID NO: 37327 - DNA, 20 bp, Artificial Sequence
  chemically synthesized
aatccccacacgcctgcctc

SEQ ID NO: 37328 - DNA, 20 bp, Artificial Sequence
  chemically synthesized
atccccacacgcctgcctct

SEQ ID NO: 37329 - DNA, 20 bp, Artificial Sequence
  chemically synthesized
tgcctctgggtaaatatcaa

SEQ ID NO: 37330 - DNA, 20 bp, Artificial Sequence
  chemically synthesized
ggtaaatatcaacggcttcc

SEQ ID NO: 37331 - DNA, 20 bp, Artificial Sequence
  chemically synthesized
tatcaacggcttcccagtgt

SEQ ID NO: 37332 - DNA, 20 bp, Artificial Sequence
  chemically synthesized
atcaacggcttcccagtgtt

SEQ ID NO: 37333 - DNA, 20 bp, Artificial Sequence
  chemically synthesized
aacggcttcccagtgttggg

SEQ ID NO: 37334 - DNA, 20 bp, Artificial Sequence
  chemically synthesized
acggcttcccagtgttgggc

SEQ ID NO: 37335 - DNA, 20 bp, Artificial Sequence
  chemically synthesized
tctttttattcccaaaatct

SEQ ID NO: 37336 - DNA, 20 bp, Artificial Sequence
  chemically synthesized
atttacctttcattttcttt

SEQ ID NO: 37337 - DNA, 20 bp, Artificial Sequence
  chemically synthesized
tttacctttcattttctttg

SEQ ID NO: 37338 - DNA, 20 bp, Artificial Sequence
  chemically synthesized
tgtcttacttttaatgaccc

SEQ ID NO: 37339 - DNA, 20 bp, Artificial Sequence
  chemically synthesized
tacttttaatgacccaagct

SEQ ID NO: 37340 - DNA, 20 bp, Artificial Sequence
  chemically synthesized
cttttaatgacccaagctta

SEQ ID NO: 37341 - DNA, 20 bp, Artificial Sequence
  chemically synthesized
taatgacccaagcttagaga

SEQ ID NO: 37342 - DNA, 20 bp, Artificial Sequence
  chemically synthesized
atgacccaagcttagagatg

SEQ ID NO: 37343 - DNA, 20 bp, Artificial Sequence
  chemically synthesized
tgacccaagcttagagatgg

SEQ ID NO: 37344 - DNA, 20 bp, Artificial Sequence
  chemically synthesized
gacccaagcttagagatgga

SEQ ID NO: 37345 - DNA, 20 bp, Artificial Sequence
  chemically synthesized
cccaagcttagagatggagg

SEQ ID NO: 37346 - DNA, 20 bp, Artificial Sequence
  chemically synthesized
taataaaaaactttcttttt

SEQ ID NO: 37347 - DNA, 20 bp, Artificial Sequence
  chemically synthesized
aaactttcttttttggtttc

SEQ ID NO: 37348 - DNA, 20 bp, Artificial Sequence
  chemically synthesized
ttttggtttcaagtgtttta

SEQ ID NO: 37349 - DNA, 20 bp, Artificial Sequence
  chemically synthesized
ttttatggccaatttctcta

SEQ ID NO: 37350 - DNA, 20 bp, Artificial Sequence
  chemically synthesized
taaagacgttattgtttttt

SEQ ID NO: 37351 - DNA, 20 bp, Artificial Sequence
  chemically synthesized
aaagacgttattgtttttta

SEQ ID NO: 37352 - DNA, 20 bp, Artificial Sequence
  chemically synthesized
cgttattgttttttaaggaa

SEQ ID NO: 37353 - DNA, 20 bp, Artificial Sequence
  chemically synthesized
aagctcacaaacattttaaa

SEQ ID NO: 37354 - DNA, 20 bp, Artificial Sequence
  chemically synthesized
tttaaaaagtacttgtgctc

SEQ ID NO: 37355 - DNA, 20 bp, Artificial Sequence
  chemically synthesized
gtacttgtgctctggaaatc

SEQ ID NO: 37356 - DNA, 20 bp, Artificial Sequence
  chemically synthesized
tccttacacaatttttttta

SEQ ID NO: 37357 - DNA, 20 bp, Artificial Sequence
  chemically synthesized
ccttacacaattttttttaa

SEQ ID NO: 37358 - DNA, 20 bp, Artificial Sequence
  chemically synthesized
aattttttttaaaggaatcc

SEQ ID NO: 37359 - DNA, 20 bp, Artificial Sequence
  chemically synthesized
taaaggaatcccagatttta

SEQ ID NO: 37360 - DNA, 20 bp, Artificial Sequence
  chemically synthesized
tttcttctatgtttaccctt

SEQ ID NO: 37361 - DNA, 20 bp, Artificial Sequence
  chemically synthesized
attcctcaatctgtgttttt

SEQ ID NO: 37362 - DNA, 20 bp, Artificial Sequence
  chemically synthesized
aatctgtgtttttaagcatg

SEQ ID NO: 37363 - DNA, 20 bp, Artificial Sequence
  chemically synthesized
atctgtgtttttaagcatga

SEQ ID NO: 37364 - DNA, 20 bp, Artificial Sequence
  chemically synthesized
taagcatgaaggatctttcg

SEQ ID NO: 37365 - DNA, 20 bp, Artificial Sequence
  chemically synthesized
aagcatgaaggatctttcga

SEQ ID NO: 37366 - DNA, 20 bp, Artificial Sequence
  chemically synthesized
catgaaggatctttcgaagg

SEQ ID NO: 37367 - DNA, 20 bp, Artificial Sequence
  chemically synthesized
tttgtgtaataattataatt

SEQ ID NO: 37368 - DNA, 20 bp, Artificial Sequence
  chemically synthesized
aattcaatgtgatttaattt

SEQ ID NO: 37369 - DNA, 20 bp, Artificial Sequence
  chemically synthesized
attcaatgtgatttaatttt

SEQ ID NO: 37370 - DNA, 20 bp, Artificial Sequence
  chemically synthesized
ttcaatgtgatttaatttta

SEQ ID NO: 37371 - DNA, 20 bp, Artificial Sequence
  chemically synthesized
atttaattttagggattccc

SEQ ID NO: 37372 - DNA, 20 bp, Artificial Sequence
  chemically synthesized
ttttagggattccctagtgt

SEQ ID NO: 37373 - DNA, 20 bp, Artificial Sequence
  chemically synthesized
agtgttggtgatttcaatct

SEQ ID NO: 37374 - DNA, 20 bp, Artificial Sequence
  chemically synthesized
ttggtgatttcaatctcagt

SEQ ID NO: 37375 - DNA, 20 bp, Artificial Sequence
  chemically synthesized
tgatttcaatctcagtaagt

SEQ ID NO: 37376 - DNA, 20 bp, Artificial Sequence
  chemically synthesized
aagttagtaatcctgactca

SEQ ID NO: 37377 - DNA, 20 bp, Artificial Sequence
  chemically synthesized
agttagtaatcctgactcac

SEQ ID NO: 37378 - DNA, 20 bp, Artificial Sequence
  chemically synthesized
ttagtaatcctgactcacag

SEQ ID NO: 37379 - DNA, 20 bp, Artificial Sequence
  chemically synthesized
ctgactcacaggagctgata

SEQ ID NO: 37380 - DNA, 20 bp, Artificial Sequence
  chemically synthesized
gactcacaggagctgataca

SEQ ID NO: 37381 - DNA, 20 bp, Artificial Sequence
  chemically synthesized
actcacaggagctgatacag

SEQ ID NO: 37382 - DNA, 20 bp, Artificial Sequence
  chemically synthesized
cacaggagctgatacagagg

SEQ ID NO: 37383 - DNA, 20 bp, Artificial Sequence
  chemically synthesized
agctgatacagaggtagcat

SEQ ID NO: 37384 - DNA, 20 bp, Artificial Sequence
  chemically synthesized
tctgatttatttttgatact

SEQ ID NO: 37385 - DNA, 20 bp, Artificial Sequence
  chemically synthesized
ctgatttatttttgatactg

SEQ ID NO: 37386 - DNA, 20 bp, Artificial Sequence
  chemically synthesized
gatactgaggccattttatg

SEQ ID NO: 37387 - DNA, 20 bp, Artificial Sequence
  chemically synthesized
cattttatgaagaaaactgc

SEQ ID NO: 37388 - DNA, 20 bp, Artificial Sequence
  chemically synthesized
attttatgaagaaaactgct

SEQ ID NO: 37389 - DNA, 20 bp, Artificial Sequence
  chemically synthesized
aagaaaactgctaggtgcta

SEQ ID NO: 37390 - DNA, 20 bp, Artificial Sequence
  chemically synthesized
aggtgctaaagacttgcctc

SEQ ID NO: 37391 - DNA, 20 bp, Artificial Sequence
  chemically synthesized
ggtgctaaagacttgcctcc

SEQ ID NO: 37392 - DNA, 20 bp, Artificial Sequence
  chemically synthesized
ttctgaatttctcgttaaat

SEQ ID NO: 37393 - DNA, 20 bp, Artificial Sequence
  chemically synthesized
tttctcgttaaataagactg

SEQ ID NO: 37394 - DNA, 20 bp, Artificial Sequence
  chemically synthesized
ctcgttaaataagactgcag

SEQ ID NO: 37395 - DNA, 20 bp, Artificial Sequence
  chemically synthesized
cgttaaataagactgcagca

SEQ ID NO: 37396 - DNA, 20 bp, Artificial Sequence
  chemically synthesized
aaataagactgcagcagagc

SEQ ID NO: 37397 - DNA, 20 bp, Artificial Sequence
  chemically synthesized
actgcagcagagctggtaat

SEQ ID NO: 37398 - DNA, 20 bp, Artificial Sequence
  chemically synthesized
tctttctcccatacccctct

SEQ ID NO: 37399 - DNA, 20 bp, Artificial Sequence
  chemically synthesized
cccatacccctcttggatcg

SEQ ID NO: 37400 - DNA, 20 bp, Artificial Sequence
  chemically synthesized
cctcttggatcgtggcaacc

SEQ ID NO: 37401 - DNA, 20 bp, Artificial Sequence
  chemically synthesized
gatcgtggcaaccaagaaaa

SEQ ID NO: 37402 - DNA, 20 bp, Artificial Sequence
  chemically synthesized
ggcaaccaagaaaacagaaa

SEQ ID NO: 37403 - DNA, 20 bp, Artificial Sequence
  chemically synthesized
aaccaagaaaacagaaacag

SEQ ID NO: 37404 - DNA, 20 bp, Artificial Sequence
  chemically synthesized
gaaaacagaaacagtagtga

SEQ ID NO: 37405 - DNA, 20 bp, Artificial Sequence
  chemically synthesized
acagaaacagtagtgatggc

SEQ ID NO: 37406 - DNA, 20 bp, Artificial Sequence
  chemically synthesized
gtagtgatggctggcatcct

SEQ ID NO: 37407 - DNA, 20 bp, Artificial Sequence
  chemically synthesized
tagtgatggctggcatcctt

SEQ ID NO: 37408 - DNA, 20 bp, Artificial Sequence
  chemically synthesized
tggctggcatccttaggctg

SEQ ID NO: 37409 - DNA, 20 bp, Artificial Sequence
  chemically synthesized
cattataattttacctgtta

SEQ ID NO: 37410 - DNA, 20 bp, Artificial Sequence
  chemically synthesized
tacctgttacagaactgcaa

SEQ ID NO: 37411 - DNA, 20 bp, Artificial Sequence
  chemically synthesized
acagaactgcaacagttcct

SEQ ID NO: 37412 - DNA, 20 bp, Artificial Sequence
  chemically synthesized
cagaactgcaacagttcctc

SEQ ID NO: 37413 - DNA, 20 bp, Artificial Sequence
  chemically synthesized
gaactgcaacagttcctcag

SEQ ID NO: 37414 - DNA, 20 bp, Artificial Sequence
  chemically synthesized
gcaacagttcctcaggagtt

SEQ ID NO: 37415 - DNA, 20 bp, Artificial Sequence
  chemically synthesized
aacagttcctcaggagtttg

SEQ ID NO: 37416 - DNA, 20 bp, Artificial Sequence
  chemically synthesized
cctcaggagtttggagttga

SEQ ID NO: 37417 - DNA, 20 bp, Artificial Sequence
  chemically synthesized
ggagtttggagttgatggaa

SEQ ID NO: 37418 - DNA, 20 bp, Artificial Sequence
  chemically synthesized
gtttggagttgatggaaaag

SEQ ID NO: 37419 - DNA, 20 bp, Artificial Sequence
  chemically synthesized
ttggagttgatggaaaagca

SEQ ID NO: 37420 - DNA, 20 bp, Artificial Sequence
  chemically synthesized
ggagttgatggaaaagcaga

SEQ ID NO: 37421 - DNA, 20 bp, Artificial Sequence
  chemically synthesized
agttgatggaaaagcagaga

SEQ ID NO: 37422 - DNA, 20 bp, Artificial Sequence
  chemically synthesized
gttgatggaaaagcagagag

SEQ ID NO: 37423 - DNA, 20 bp, Artificial Sequence
  chemically synthesized
atggaaaagcagagagaggt

SEQ ID NO: 37424 - DNA, 20 bp, Artificial Sequence
  chemically synthesized
gaaaagcagagagaggtaag

SEQ ID NO: 37425 - DNA, 20 bp, Artificial Sequence
  chemically synthesized
aaaagcagagagaggtaaga

SEQ ID NO: 37426 - DNA, 20 bp, Artificial Sequence
  chemically synthesized
gcagagagaggtaagaagga

SEQ ID NO: 37427 - DNA, 20 bp, Artificial Sequence
  chemically synthesized
aggtaagaaggacagaaaac

SEQ ID NO: 37428 - DNA, 20 bp, Artificial Sequence
  chemically synthesized
agaaggacagaaaaccagct

SEQ ID NO: 37429 - DNA, 20 bp, Artificial Sequence
  chemically synthesized
accagctaagtatttaatta

SEQ ID NO: 37430 - DNA, 20 bp, Artificial Sequence
  chemically synthesized
ccagctaagtatttaattat

SEQ ID NO: 37431 - DNA, 20 bp, Artificial Sequence
  chemically synthesized
ttaattatgggaaataatgt

SEQ ID NO: 37432 - DNA, 20 bp, Artificial Sequence
  chemically synthesized
ttatgggaaataatgttgga

SEQ ID NO: 37433 - DNA, 20 bp, Artificial Sequence
  chemically synthesized
tatgggaaataatgttggaa

SEQ ID NO: 37434 - DNA, 20 bp, Artificial Sequence
  chemically synthesized
atgggaaataatgttggaaa

SEQ ID NO: 37435 - DNA, 20 bp, Artificial Sequence
  chemically synthesized
gaaataatgttggaaagggc

SEQ ID NO: 37436 - DNA, 20 bp, Artificial Sequence
  chemically synthesized
ataatgttggaaagggcaag

SEQ ID NO: 37437 - DNA, 20 bp, Artificial Sequence
  chemically synthesized
atgttggaaagggcaagtgg

SEQ ID NO: 37438 - DNA, 20 bp, Artificial Sequence
  chemically synthesized
tggaaagggcaagtggcaga

SEQ ID NO: 37439 - DNA, 20 bp, Artificial Sequence
  chemically synthesized
aagggcaagtggcagaaaga

SEQ ID NO: 37440 - DNA, 20 bp, Artificial Sequence
  chemically synthesized
gcaagtggcagaaagaaagc

SEQ ID NO: 37441 - DNA, 20 bp, Artificial Sequence
  chemically synthesized
gcagaaagaaagccagtaaa

SEQ ID NO: 37442 - DNA, 20 bp, Artificial Sequence
  chemically synthesized
agaaagccagtaaatggtga

SEQ ID NO: 37443 - DNA, 20 bp, Artificial Sequence
  chemically synthesized
atggtgaaagaaacataaaa

SEQ ID NO: 37444 - DNA, 20 bp, Artificial Sequence
  chemically synthesized
ataaaaaagataattgtatg

SEQ ID NO: 37445 - DNA, 20 bp, Artificial Sequence
  chemically synthesized
gataattgtatgaagatatt

SEQ ID NO: 37446 - DNA, 20 bp, Artificial Sequence
  chemically synthesized
taattgtatgaagatatttg

SEQ ID NO: 37447 - DNA, 20 bp, Artificial Sequence
  chemically synthesized
tgaagatatttggagaaaat

SEQ ID NO: 37448 - DNA, 20 bp, Artificial Sequence
  chemically synthesized
gagaaaatgagaaaatcaac

SEQ ID NO: 37449 - DNA, 20 bp, Artificial Sequence
  chemically synthesized
aaatgagaaaatcaactgga

SEQ ID NO: 37450 - DNA, 20 bp, Artificial Sequence
  chemically synthesized
tgagaaaatcaactggatgg

SEQ ID NO: 37451 - DNA, 20 bp, Artificial Sequence
  chemically synthesized
caactggatggaagcattaa

SEQ ID NO: 37452 - DNA, 20 bp, Artificial Sequence
  chemically synthesized
aactggatggaagcattaaa

SEQ ID NO: 37453 - DNA, 20 bp, Artificial Sequence
  chemically synthesized
ttaaaaggtttctatctcga

SEQ ID NO: 37454 - DNA, 20 bp, Artificial Sequence
  chemically synthesized
aaggtttctatctcgaaaga

SEQ ID NO: 37455 - DNA, 20 bp, Artificial Sequence
  chemically synthesized
ttctatctcgaaagatggat

SEQ ID NO: 37456 - DNA, 20 bp, Artificial Sequence
  chemically synthesized
tctatctcgaaagatggatt

SEQ ID NO: 37457 - DNA, 20 bp, Artificial Sequence
  chemically synthesized
gattaggtatgaaatgctta

SEQ ID NO: 37458 - DNA, 20 bp, Artificial Sequence
  chemically synthesized
taggtatgaaatgcttatag

SEQ ID NO: 37459 - DNA, 20 bp, Artificial Sequence
  chemically synthesized
atgcttatagcagtgatgcc

SEQ ID NO: 37460 - DNA, 20 bp, Artificial Sequence
  chemically synthesized
gcccagacattgttttgcac

SEQ ID NO: 37461 - DNA, 20 bp, Artificial Sequence
  chemically synthesized
gttttgcactggaatcacct

SEQ ID NO: 37462 - DNA, 20 bp, Artificial Sequence
  chemically synthesized
ttttgcactggaatcacctg

SEQ ID NO: 37463 - DNA, 20 bp, Artificial Sequence
  chemically synthesized
atcacctgaggacctgaaaa

SEQ ID NO: 37464 - DNA, 20 bp, Artificial Sequence
  chemically synthesized
tgaaaaaagcgaatttgatt

SEQ ID NO: 37465 - DNA, 20 bp, Artificial Sequence
  chemically synthesized
gcgaatttgattcagaatgt

SEQ ID NO: 37466 - DNA, 20 bp, Artificial Sequence
  chemically synthesized
aatttgattcagaatgttgg

SEQ ID NO: 37467 - DNA, 20 bp, Artificial Sequence
  chemically synthesized
atttgattcagaatgttgga

SEQ ID NO: 37468 - DNA, 20 bp, Artificial Sequence
  chemically synthesized
tttgattcagaatgttggaa

SEQ ID NO: 37469 - DNA, 20 bp, Artificial Sequence
  chemically synthesized
ttgattcagaatgttggaag

SEQ ID NO: 37470 - DNA, 20 bp, Artificial Sequence
  chemically synthesized
attcagaatgttggaagggg

SEQ ID NO: 37471 - DNA, 20 bp, Artificial Sequence
  chemically synthesized
tgttggaaggggcagaatct

SEQ ID NO: 37472 - DNA, 20 bp, Artificial Sequence
  chemically synthesized
gttggaaggggcagaatctg

SEQ ID NO: 37473 - DNA, 20 bp, Artificial Sequence
  chemically synthesized
tctgaggctgcatgcctaac

SEQ ID NO: 37474 - DNA, 20 bp, Artificial Sequence
  chemically synthesized
ctaacaagcccgctgcttgt

SEQ ID NO: 37475 - DNA, 20 bp, Artificial Sequence
  chemically synthesized
cgctgcttgttagctgcgtc

SEQ ID NO: 37476 - DNA, 20 bp, Artificial Sequence
  chemically synthesized
tagtctgtgatccacaactc

SEQ ID NO: 37477 - DNA, 20 bp, Artificial Sequence
  chemically synthesized
tctgtgatccacaactctgg

SEQ ID NO: 37478 - DNA, 20 bp, Artificial Sequence
  chemically synthesized
gatccacaactctggtggcc

SEQ ID NO: 37479 - DNA, 20 bp, Artificial Sequence
  chemically synthesized
caactctggtggccaagctc

SEQ ID NO: 37480 - DNA, 20 bp, Artificial Sequence
  chemically synthesized
ggccaagctcaagtaactgt

SEQ ID NO: 37481 - DNA, 20 bp, Artificial Sequence
  chemically synthesized
ccaagctcaagtaactgtta

SEQ ID NO: 37482 - DNA, 20 bp, Artificial Sequence
  chemically synthesized
aagtaactgttagagtgaca

SEQ ID NO: 37483 - DNA, 20 bp, Artificial Sequence
  chemically synthesized
agagtgacaaagccgttcat

SEQ ID NO: 37484 - DNA, 20 bp, Artificial Sequence
  chemically synthesized
gtgacaaagccgttcattgg

SEQ ID NO: 37485 - DNA, 20 bp, Artificial Sequence
  chemically synthesized
aagccgttcattggtagtga

SEQ ID NO: 37486 - DNA, 20 bp, Artificial Sequence
  chemically synthesized
agtgatggtgatgcacgcta

SEQ ID NO: 37487 - DNA, 20 bp, Artificial Sequence
  chemically synthesized
attcaatttccaaaaaaaat

SEQ ID NO: 37488 - DNA, 20 bp, Artificial Sequence
  chemically synthesized
ttacaacaatcatttccaaa

SEQ ID NO: 37489 - DNA, 20 bp, Artificial Sequence
  chemically synthesized
aacaatcatttccaaatggt

SEQ ID NO: 37490 - DNA, 20 bp, Artificial Sequence
  chemically synthesized
ttccaaatggtcagtaatca

SEQ ID NO: 37491 - DNA, 20 bp, Artificial Sequence
  chemically synthesized
aaatggtcagtaatcacagc

SEQ ID NO: 37492 - DNA, 20 bp, Artificial Sequence
  chemically synthesized
tggtcagtaatcacagcaag

SEQ ID NO: 37493 - DNA, 20 bp, Artificial Sequence
  chemically synthesized
atcacagcaagaagacaact

SEQ ID NO: 37494 - DNA, 20 bp, Artificial Sequence
  chemically synthesized
cagcaagaagacaactaagc

SEQ ID NO: 37495 - DNA, 20 bp, Artificial Sequence
  chemically synthesized
ctgttgttgcaaatatttat

SEQ ID NO: 37496 - DNA, 20 bp, Artificial Sequence
  chemically synthesized
atttataagtaccctcaaaa

SEQ ID NO: 37497 - DNA, 20 bp, Artificial Sequence
  chemically synthesized
aagtaccctcaaaatagttg

SEQ ID NO: 37498 - DNA, 20 bp, Artificial Sequence
  chemically synthesized
aatgaaaaatttttgaattt

SEQ ID NO: 37499 - DNA, 20 bp, Artificial Sequence
  chemically synthesized
gaaaaatcgaaccattaact

SEQ ID NO: 37500 - DNA, 20 bp, Artificial Sequence
  chemically synthesized
aactcagtattttttctaat

SEQ ID NO: 37501 - DNA, 20 bp, Artificial Sequence
  chemically synthesized
actcagtattttttctaatt

SEQ ID NO: 37502 - DNA, 20 bp, Artificial Sequence
  chemically synthesized
ctcagtattttttctaatta

SEQ ID NO: 37503 - DNA, 20 bp, Artificial Sequence
  chemically synthesized
tctaattagggaaaaaacca

SEQ ID NO: 37504 - DNA, 20 bp, Artificial Sequence
  chemically synthesized
ctgtacatgctattcttctt

SEQ ID NO: 37505 - DNA, 20 bp, Artificial Sequence
  chemically synthesized
tgtacatgctattcttcttc

SEQ ID NO: 37506 - DNA, 20 bp, Artificial Sequence
  chemically synthesized
gctattcttcttcaggaaaa

SEQ ID NO: 37507 - DNA, 20 bp, Artificial Sequence
  chemically synthesized
cttcttcaggaaaatagttg

SEQ ID NO: 37508 - DNA, 20 bp, Artificial Sequence
  chemically synthesized
tcttcaggaaaatagttgca

SEQ ID NO: 37509 - DNA, 20 bp, Artificial Sequence
  chemically synthesized
cagagtcaaatttatcacac

SEQ ID NO: 37510 - DNA, 20 bp, Artificial Sequence
  chemically synthesized
cacaccagttaatcatctcc

SEQ ID NO: 37511 - DNA, 20 bp, Artificial Sequence
  chemically synthesized
accagttaatcatctccaag

SEQ ID NO: 37512 - DNA, 20 bp, Artificial Sequence
  chemically synthesized
ccagttaatcatctccaagc

SEQ ID NO: 37513 - DNA, 20 bp, Artificial Sequence
  chemically synthesized
gttaatcatctccaagcagg

SEQ ID NO: 37514 - DNA, 20 bp, Artificial Sequence
  chemically synthesized
tcatctccaagcaggaagat

SEQ ID NO: 37515 - DNA, 20 bp, Artificial Sequence
  chemically synthesized
atctccaagcaggaagattg

SEQ ID NO: 37516 - DNA, 20 bp, Artificial Sequence
  chemically synthesized
tctccaagcaggaagattgg

SEQ ID NO: 37517 - DNA, 20 bp, Artificial Sequence
  chemically synthesized
gcaggaagattggaggctcc

SEQ ID NO: 37518 - DNA, 20 bp, Artificial Sequence
  chemically synthesized
gattggaggctcctggtttc

SEQ ID NO: 37519 - DNA, 20 bp, Artificial Sequence
  chemically synthesized
attggaggctcctggtttca

SEQ ID NO: 37520 - DNA, 20 bp, Artificial Sequence
  chemically synthesized
gctcctggtttcaaggtttc

SEQ ID NO: 37521 - DNA, 20 bp, Artificial Sequence
  chemically synthesized
tcaagaaatctgatctttac

SEQ ID NO: 37522 - DNA, 20 bp, Artificial Sequence
  chemically synthesized
agaaatctgatctttaccgg

SEQ ID NO: 37523 - DNA, 20 bp, Artificial Sequence
  chemically synthesized
ttaccggtggatacactatg

SEQ ID NO: 37524 - DNA, 20 bp, Artificial Sequence
  chemically synthesized
tatgtggcccaatattactg

SEQ ID NO: 37525 - DNA, 20 bp, Artificial Sequence
  chemically synthesized
gcagccccttttttgctgac

SEQ ID NO: 37526 - DNA, 20 bp, Artificial Sequence
  chemically synthesized
ttttttgctgactggctttc

SEQ ID NO: 37527 - DNA, 20 bp, Artificial Sequence
  chemically synthesized
tttttgctgactggctttcc

SEQ ID NO: 37528 - DNA, 20 bp, Artificial Sequence
  chemically synthesized
ttttgctgactggctttcca

SEQ ID NO: 37529 - DNA, 20 bp, Artificial Sequence
  chemically synthesized
gctgactggctttccagggc

SEQ ID NO: 37530 - DNA, 20 bp, Artificial Sequence
  chemically synthesized
tgactggctttccagggctg

SEQ ID NO: 37531 - DNA, 20 bp, Artificial Sequence
  chemically synthesized
gactggctttccagggctgg

SEQ ID NO: 37532 - DNA, 20 bp, Artificial Sequence
  chemically synthesized
tggctttccagggctggagg

SEQ ID NO: 37533 - DNA, 20 bp, Artificial Sequence
  chemically synthesized
ggctggaggcagctcatcac

SEQ ID NO: 37534 - DNA, 20 bp, Artificial Sequence
  chemically synthesized
tgtttatgtgtgcatccttc

SEQ ID NO: 37535 - DNA, 20 bp, Artificial Sequence
  chemically synthesized
gtttatgtgtgcatccttct

SEQ ID NO: 37536 - DNA, 20 bp, Artificial Sequence
  chemically synthesized
gtgtgcatccttctgggcaa

SEQ ID NO: 37537 - DNA, 20 bp, Artificial Sequence
  chemically synthesized
gcatgctcctctacctcatc

SEQ ID NO: 37538 - DNA, 20 bp, Artificial Sequence
  chemically synthesized
tacctcatcaagcatgacca

SEQ ID NO: 37539 - DNA, 20 bp, Artificial Sequence
  chemically synthesized
agcatgaccacagtcttcat

SEQ ID NO: 37540 - DNA, 20 bp, Artificial Sequence
  chemically synthesized
gtactacttcctcaccatgc

SEQ ID NO: 37541 - DNA, 20 bp, Artificial Sequence
  chemically synthesized
ctacttcctcaccatgctgg

SEQ ID NO: 37542 - DNA, 20 bp, Artificial Sequence
  chemically synthesized
tacttcctcaccatgctggc

SEQ ID NO: 37543 - DNA, 20 bp, Artificial Sequence
  chemically synthesized
cctcaccatgctggcaggca

SEQ ID NO: 37544 - DNA, 20 bp, Artificial Sequence
  chemically synthesized
gctggcaggcacagacctca

SEQ ID NO: 37545 - DNA, 20 bp, Artificial Sequence
  chemically synthesized
gaccacgatgcctactgtaa

SEQ ID NO: 37546 - DNA, 20 bp, Artificial Sequence
  chemically synthesized
accacgatgcctactgtaat

SEQ ID NO: 37547 - DNA, 20 bp, Artificial Sequence
  chemically synthesized
ctactgtaatgggcatccta

SEQ ID NO: 37548 - DNA, 20 bp, Artificial Sequence
  chemically synthesized
tactgtaatgggcatcctat

SEQ ID NO: 37549 - DNA, 20 bp, Artificial Sequence
  chemically synthesized
ggcatcctatgggtgaatca

SEQ ID NO: 37550 - DNA, 20 bp, Artificial Sequence
  chemically synthesized
gcatcctatgggtgaatcac

SEQ ID NO: 37551 - DNA, 20 bp, Artificial Sequence
  chemically synthesized
catcctatgggtgaatcaca

SEQ ID NO: 37552 - DNA, 20 bp, Artificial Sequence
  chemically synthesized
tcctatgggtgaatcacagg

SEQ ID NO: 37553 - DNA, 20 bp, Artificial Sequence
  chemically synthesized
tgggtgaatcacagggagat

SEQ ID NO: 37554 - DNA, 20 bp, Artificial Sequence
  chemically synthesized
gtgaatcacagggagattag

SEQ ID NO: 37555 - DNA, 20 bp, Artificial Sequence
  chemically synthesized
tcacagggagattagcagtg

SEQ ID NO: 37556 - DNA, 20 bp, Artificial Sequence
  chemically synthesized
cacagggagattagcagtgt

SEQ ID NO: 37557 - DNA, 20 bp, Artificial Sequence
  chemically synthesized
gcagtgtgggctgcttccta

SEQ ID NO: 37558 - DNA, 20 bp, Artificial Sequence
  chemically synthesized
cagtgtgggctgcttcctac

SEQ ID NO: 37559 - DNA, 20 bp, Artificial Sequence
  chemically synthesized
tattcactccctttctgttg

SEQ ID NO: 37560 - DNA, 20 bp, Artificial Sequence
  chemically synthesized
ctccctttctgttgtggaat

SEQ ID NO: 37561 - DNA, 20 bp, Artificial Sequence
  chemically synthesized
tccctttctgttgtggaatc

SEQ ID NO: 37562 - DNA, 20 bp, Artificial Sequence
  chemically synthesized
tgtggaatcaggttccctcc

SEQ ID NO: 37563 - DNA, 20 bp, Artificial Sequence
  chemically synthesized
atcaggttccctcctggcaa

SEQ ID NO: 37564 - DNA, 20 bp, Artificial Sequence
  chemically synthesized
attgccatccgcaatccttt

SEQ ID NO: 37565 - DNA, 20 bp, Artificial Sequence
  chemically synthesized
gcttccattctcaccaatac

SEQ ID NO: 37566 - DNA, 20 bp, Artificial Sequence
  chemically synthesized
ttccattctcaccaatacta

SEQ ID NO: 37567 - DNA, 20 bp, Artificial Sequence
  chemically synthesized
tctcaccaatactagagtca

SEQ ID NO: 37568 - DNA, 20 bp, Artificial Sequence
  chemically synthesized
caatactagagtcatagcgt

SEQ ID NO: 37569 - DNA, 20 bp, Artificial Sequence
  chemically synthesized
aatactagagtcatagcgtt

SEQ ID NO: 37570 - DNA, 20 bp, Artificial Sequence
  chemically synthesized
tactagagtcatagcgttag

SEQ ID NO: 37571 - DNA, 20 bp, Artificial Sequence
  chemically synthesized
tagagtcatagcgttaggag

SEQ ID NO: 37572 - DNA, 20 bp, Artificial Sequence
  chemically synthesized
agagtcatagcgttaggagt

SEQ ID NO: 37573 - DNA, 20 bp, Artificial Sequence
  chemically synthesized
agtcatagcgttaggagtgg

SEQ ID NO: 37574 - DNA, 20 bp, Artificial Sequence
  chemically synthesized
ttaggagtgggagtgtttct

SEQ ID NO: 37575 - DNA, 20 bp, Artificial Sequence
  chemically synthesized
taggagtgggagtgtttcta

SEQ ID NO: 37576 - DNA, 20 bp, Artificial Sequence
  chemically synthesized
aggagtgggagtgtttctaa

SEQ ID NO: 37577 - DNA, 20 bp, Artificial Sequence
  chemically synthesized
ggagtgggagtgtttctaag

SEQ ID NO: 37578 - DNA, 20 bp, Artificial Sequence
  chemically synthesized
acgtgctttctgcctccacc

SEQ ID NO: 37579 - DNA, 20 bp, Artificial Sequence
  chemically synthesized
tgcctccaccaagaaatcat

SEQ ID NO: 37580 - DNA, 20 bp, Artificial Sequence
  chemically synthesized
ccaccaagaaatcatgagac

SEQ ID NO: 37581 - DNA, 20 bp, Artificial Sequence
  chemically synthesized
tgtgctgacataactttcaa

SEQ ID NO: 37582 - DNA, 20 bp, Artificial Sequence
  chemically synthesized
gatctctttaacaatcttcc

SEQ ID NO: 37583 - DNA, 20 bp, Artificial Sequence
  chemically synthesized
tctaattcttaatactgtca

SEQ ID NO: 37584 - DNA, 20 bp, Artificial Sequence
  chemically synthesized
ctaattcttaatactgtcat

SEQ ID NO: 37585 - DNA, 20 bp, Artificial Sequence
  chemically synthesized
actgtcataggcattgcttc

SEQ ID NO: 37586 - DNA, 20 bp, Artificial Sequence
  chemically synthesized
cataggcattgcttctggtg

SEQ ID NO: 37587 - DNA, 20 bp, Artificial Sequence
  chemically synthesized
taggcattgcttctggtgaa

SEQ ID NO: 37588 - DNA, 20 bp, Artificial Sequence
  chemically synthesized
ggcattgcttctggtgaaga

SEQ ID NO: 37589 - DNA, 20 bp, Artificial Sequence
  chemically synthesized
cattgcttctggtgaagaga

SEQ ID NO: 37590 - DNA, 20 bp, Artificial Sequence
  chemically synthesized
ttctggtgaagagagagcca

SEQ ID NO: 37591 - DNA, 20 bp, Artificial Sequence
  chemically synthesized
aatacctgtatctcccacat

SEQ ID NO: 37592 - DNA, 20 bp, Artificial Sequence
  chemically synthesized
tgttcttatcttctatgtta

SEQ ID NO: 37593 - DNA, 20 bp, Artificial Sequence
  chemically synthesized
tatcttctatgttacagtga

SEQ ID NO: 37594 - DNA, 20 bp, Artificial Sequence
  chemically synthesized
atcttctatgttacagtgat

SEQ ID NO: 37595 - DNA, 20 bp, Artificial Sequence
  chemically synthesized
atgggtttgacattcattta

SEQ ID NO: 37596 - DNA, 20 bp, Artificial Sequence
  chemically synthesized
ttgacattcatttacagatt

SEQ ID NO: 37597 - DNA, 20 bp, Artificial Sequence
  chemically synthesized
tgacattcatttacagattt

SEQ ID NO: 37598 - DNA, 20 bp, Artificial Sequence
  chemically synthesized
cattcatttacagatttggg

SEQ ID NO: 37599 - DNA, 20 bp, Artificial Sequence
  chemically synthesized
cagatttgggaagaatgtgc

SEQ ID NO: 37600 - DNA, 20 bp, Artificial Sequence
  chemically synthesized
gatttgggaagaatgtgcca

SEQ ID NO: 37601 - DNA, 20 bp, Artificial Sequence
  chemically synthesized
atttgggaagaatgtgccag

SEQ ID NO: 37602 - DNA, 20 bp, Artificial Sequence
  chemically synthesized
gaggttgtccacattatcat

SEQ ID NO: 37603 - DNA, 20 bp, Artificial Sequence
  chemically synthesized
ttaatgaaccctgtcatcta

SEQ ID NO: 37604 - DNA, 20 bp, Artificial Sequence
  chemically synthesized
tcatctacagcatcaaaacc

SEQ ID NO: 37605 - DNA, 20 bp, Artificial Sequence
  chemically synthesized
aaaaccaagcaaatacaata

SEQ ID NO: 37606 - DNA, 20 bp, Artificial Sequence
  chemically synthesized
atccgccttttatctaaaca

SEQ ID NO: 37607 - DNA, 20 bp, Artificial Sequence
  chemically synthesized
tccgccttttatctaaacat

SEQ ID NO: 37608 - DNA, 20 bp, Artificial Sequence
  chemically synthesized
cttttatctaaacataggtt

SEQ ID NO: 37609 - DNA, 20 bp, Artificial Sequence
  chemically synthesized
ttatctaaacataggtttag

SEQ ID NO: 37610 - DNA, 20 bp, Artificial Sequence
  chemically synthesized
ataggtttagtagttaaact

SEQ ID NO: 37611 - DNA, 20 bp, Artificial Sequence
  chemically synthesized
ttagtagttaaactcggatc

SEQ ID NO: 37612 - DNA, 20 bp, Artificial Sequence
  chemically synthesized
agtagttaaactcggatctg

SEQ ID NO: 37613 - DNA, 20 bp, Artificial Sequence
  chemically synthesized
taaactcggatctggagaat

SEQ ID NO: 37614 - DNA, 20 bp, Artificial Sequence
  chemically synthesized
cggatctggagaatcagaca

SEQ ID NO: 37615 - DNA, 20 bp, Artificial Sequence
  chemically synthesized
cagacacagacataaaaatg

SEQ ID NO: 37616 - DNA, 20 bp, Artificial Sequence
  chemically synthesized
cacagacataaaaatgaagc

SEQ ID NO: 37617 - DNA, 20 bp, Artificial Sequence
  chemically synthesized
gaagccagaatgaaaaatga

SEQ ID NO: 37618 - DNA, 20 bp, Artificial Sequence
  chemically synthesized
cagaatgaaaaatgaaagcc

SEQ ID NO: 37619 - DNA, 20 bp, Artificial Sequence
  chemically synthesized
gaatgaaaaatgaaagcctg

SEQ ID NO: 37620 - DNA, 20 bp, Artificial Sequence
  chemically synthesized
gaaagcctggagttctttct

SEQ ID NO: 37621 - DNA, 20 bp, Artificial Sequence
  chemically synthesized
cctggagttctttcttagca

SEQ ID NO: 37622 - DNA, 20 bp, Artificial Sequence
  chemically synthesized
tggagttctttcttagcaaa

SEQ ID NO: 37623 - DNA, 20 bp, Artificial Sequence
  chemically synthesized
gttctttcttagcaaagagc

SEQ ID NO: 37624 - DNA, 20 bp, Artificial Sequence
  chemically synthesized
ttctttcttagcaaagagca

SEQ ID NO: 37625 - DNA, 20 bp, Artificial Sequence
  chemically synthesized
tctttcttagcaaagagcaa

SEQ ID NO: 37626 - DNA, 20 bp, Artificial Sequence
  chemically synthesized
agcaaagagcaagggtatac

SEQ ID NO: 37627 - DNA, 20 bp, Artificial Sequence
  chemically synthesized
aaagagcaagggtatactgg

SEQ ID NO: 37628 - DNA, 20 bp, Artificial Sequence
  chemically synthesized
aagacaatgttgtcactcac

SEQ ID NO: 37629 - DNA, 20 bp, Artificial Sequence
  chemically synthesized
agacaatgttgtcactcaca

SEQ ID NO: 37630 - DNA, 20 bp, Artificial Sequence
  chemically synthesized
gttgtcactcacaaggactt

SEQ ID NO: 37631 - DNA, 20 bp, Artificial Sequence
  chemically synthesized
aggacttaagtactttacca

SEQ ID NO: 37632 - DNA, 20 bp, Artificial Sequence
  chemically synthesized
ggacttaagtactttaccat

SEQ ID NO: 37633 - DNA, 20 bp, Artificial Sequence
  chemically synthesized
gacttaagtactttaccata

SEQ ID NO: 37634 - DNA, 20 bp, Artificial Sequence
  chemically synthesized
taagtactttaccatagggt

SEQ ID NO: 37635 - DNA, 20 bp, Artificial Sequence
  chemically synthesized
aagtactttaccatagggtt

SEQ ID NO: 37636 - DNA, 20 bp, Artificial Sequence
  chemically synthesized
agtactttaccatagggttg

SEQ ID NO: 37637 - DNA, 20 bp, Artificial Sequence
  chemically synthesized
gtactttaccatagggttgg

SEQ ID NO: 37638 - DNA, 20 bp, Artificial Sequence
  chemically synthesized
atagggttgggggcatatct

SEQ ID NO: 37639 - DNA, 20 bp, Artificial Sequence
  chemically synthesized
tagggttgggggcatatctt

SEQ ID NO: 37640 - DNA, 20 bp, Artificial Sequence
  chemically synthesized
gggttgggggcatatcttag

SEQ ID NO: 37641 - DNA, 20 bp, Artificial Sequence
  chemically synthesized
ttgggggcatatcttaggag

SEQ ID NO: 37642 - DNA, 20 bp, Artificial Sequence
  chemically synthesized
ggcatatcttaggagaagtc

SEQ ID NO: 37643 - DNA, 20 bp, Artificial Sequence
  chemically synthesized
tcttaggagaagtctggtga

SEQ ID NO: 37644 - DNA, 20 bp, Artificial Sequence
  chemically synthesized
tctggtgacagaacactgaa

SEQ ID NO: 37645 - DNA, 20 bp, Artificial Sequence
  chemically synthesized
agaacactgaatagaccata

SEQ ID NO: 37646 - DNA, 20 bp, Artificial Sequence
  chemically synthesized
tagaccatatggaactgaaa

SEQ ID NO: 37647 - DNA, 20 bp, Artificial Sequence
  chemically synthesized
ctttcaaatgcacctgaaat

SEQ ID NO: 37648 - DNA, 20 bp, Artificial Sequence
  chemically synthesized
gcacctgaaattagccacct

SEQ ID NO: 37649 - DNA, 20 bp, Artificial Sequence
  chemically synthesized
tagccacctcagtgaaattt

SEQ ID NO: 37650 - DNA, 20 bp, Artificial Sequence
  chemically synthesized
agccacctcagtgaaatttg

SEQ ID NO: 37651 - DNA, 20 bp, Artificial Sequence
  chemically synthesized
cctcagtgaaatttgaggaa

SEQ ID NO: 37652 - DNA, 20 bp, Artificial Sequence
  chemically synthesized
ctcagtgaaatttgaggaaa

SEQ ID NO: 37653 - DNA, 20 bp, Artificial Sequence
  chemically synthesized
agtgaaatttgaggaaaagg

SEQ ID NO: 37654 - DNA, 20 bp, Artificial Sequence
  chemically synthesized
tctatgaaaaacttttgcct

SEQ ID NO: 37655 - DNA, 20 bp, Artificial Sequence
  chemically synthesized
tacatgtttatgtgtttgca

SEQ ID NO: 37656 - DNA, 20 bp, Artificial Sequence
  chemically synthesized
acatgtttatgtgtttgcat

SEQ ID NO: 37657 - DNA, 20 bp, Artificial Sequence
  chemically synthesized
ttgcataggctaatgcacac

SEQ ID NO: 37658 - DNA, 20 bp, Artificial Sequence
  chemically synthesized
gcacacaagtgtaaaaaaaa

SEQ ID NO: 37659 - DNA, 20 bp, Artificial Sequence
  chemically synthesized
aaaagttgatcatcattctc

SEQ ID NO: 37660 - DNA, 20 bp, Artificial Sequence
  chemically synthesized
taaaattttcattattctca

SEQ ID NO: 37661 - DNA, 20 bp, Artificial Sequence
  chemically synthesized
cattattctcatggcaaata

SEQ ID NO: 37662 - DNA, 20 bp, Artificial Sequence
  chemically synthesized
ctcatggcaaatatagtgat

SEQ ID NO: 37663 - DNA, 20 bp, Artificial Sequence
  chemically synthesized
ttttaaatttacttttaaat

SEQ ID NO: 37664 - DNA, 20 bp, Artificial Sequence
  chemically synthesized
aaatttacttttaaataagt

SEQ ID NO: 37665 - DNA, 20 bp, Artificial Sequence
  chemically synthesized
acttttaaataagtaagtgt

SEQ ID NO: 37666 - DNA, 20 bp, Artificial Sequence
  chemically synthesized
ttttaactgtcctctaccct

SEQ ID NO: 37667 - DNA, 20 bp, Artificial Sequence
  chemically synthesized
aactgtcctctaccctgagt

SEQ ID NO: 37668 - DNA, 20 bp, Artificial Sequence
  chemically synthesized
actgtcctctaccctgagtt

SEQ ID NO: 37669 - DNA, 20 bp, Artificial Sequence
  chemically synthesized
ctgtcctctaccctgagtta

SEQ ID NO: 37670 - DNA, 20 bp, Artificial Sequence
  chemically synthesized
ccctgagttagggtactctc

SEQ ID NO: 37671 - DNA, 20 bp, Artificial Sequence
  chemically synthesized
cctgagttagggtactctct

SEQ ID NO: 37672 - DNA, 20 bp, Artificial Sequence
  chemically synthesized
ctgagttagggtactctcta

SEQ ID NO: 37673 - DNA, 20 bp, Artificial Sequence
  chemically synthesized
catttaatattttctaaata

SEQ ID NO: 37674 - DNA, 20 bp, Artificial Sequence
  chemically synthesized
tattttctaaatacagtcgt

SEQ ID NO: 37675 - DNA, 20 bp, Artificial Sequence
  chemically synthesized
atacagtcgtaagtcactta

SEQ ID NO: 37676 - DNA, 20 bp, Artificial Sequence
  chemically synthesized
acagtcgtaagtcacttaca

SEQ ID NO: 37677 - DNA, 20 bp, Artificial Sequence
  chemically synthesized
cacttacagagtatttcaat

SEQ ID NO: 37678 - DNA, 20 bp, Artificial Sequence
  chemically synthesized
cttacagagtatttcaataa

SEQ ID NO: 37679 - DNA, 20 bp, Artificial Sequence
  chemically synthesized
aattttcaatacattccttg

SEQ ID NO: 37680 - DNA, 20 bp, Artificial Sequence
  chemically synthesized
attttcaatacattccttgc

SEQ ID NO: 37681 - DNA, 20 bp, Artificial Sequence
  chemically synthesized
tacattccttgcaggatgtc

SEQ ID NO: 37682 - DNA, 20 bp, Artificial Sequence
  chemically synthesized
aggatgtctggattttataa

SEQ ID NO: 37683 - DNA, 20 bp, Artificial Sequence
  chemically synthesized
tcttttgcccaaaaaaatct

SEQ ID NO: 37684 - DNA, 20 bp, Artificial Sequence
  chemically synthesized
tttgcccaaaaaaatcttag

SEQ ID NO: 37685 - DNA, 20 bp, Artificial Sequence
  chemically synthesized
ttgcccaaaaaaatcttaga

SEQ ID NO: 37686 - DNA, 20 bp, Artificial Sequence
  chemically synthesized
aaatcttagaaggaaaaacc

SEQ ID NO: 37687 - DNA, 20 bp, Artificial Sequence
  chemically synthesized
ttagaaggaaaaacctagac

SEQ ID NO: 37688 - DNA, 20 bp, Artificial Sequence
  chemically synthesized
aacctagacaagcttcttgt

SEQ ID NO: 37689 - DNA, 20 bp, Artificial Sequence
  chemically synthesized
cttcttgtcagctcgtaaaa

SEQ ID NO: 37690 - DNA, 20 bp, Artificial Sequence
  chemically synthesized
tcagctcgtaaaaaagtaaa

SEQ ID NO: 37691 - DNA, 20 bp, Artificial Sequence
  chemically synthesized
ctcgtaaaaaagtaaaaagt

SEQ ID NO: 37692 - DNA, 20 bp, Artificial Sequence
  chemically synthesized
aaagtaaaaagtgagttttt

SEQ ID NO: 37693 - DNA, 20 bp, Artificial Sequence
  chemically synthesized
agtaaaaagtgagtttttaa

SEQ ID NO: 37694 - DNA, 20 bp, Artificial Sequence
  chemically synthesized
ttaagagtatgtttgctctt

SEQ ID NO: 37695 - DNA, 20 bp, Artificial Sequence
  chemically synthesized
attttaacatacttttccct

SEQ ID NO: 37696 - DNA, 20 bp, Artificial Sequence
  chemically synthesized
cttttcccttggcctaataa

SEQ ID NO: 37697 - DNA, 20 bp, Artificial Sequence
  chemically synthesized
ttttcccttggcctaataat

SEQ ID NO: 37698 - DNA, 20 bp, Artificial Sequence
  chemically synthesized
tcccttggcctaataatagg

SEQ ID NO: 37699 - DNA, 20 bp, Artificial Sequence
  chemically synthesized
cccttggcctaataatagga

SEQ ID NO: 37700 - DNA, 20 bp, Artificial Sequence
  chemically synthesized
ccttggcctaataataggaa

SEQ ID NO: 37701 - DNA, 20 bp, Artificial Sequence
  chemically synthesized
gcctaataataggaagggtc

SEQ ID NO: 37702 - DNA, 20 bp, Artificial Sequence
  chemically synthesized
cctaataataggaagggtca

SEQ ID NO: 37703 - DNA, 20 bp, Artificial Sequence
  chemically synthesized
gtcaaggctctattcaaaaa

SEQ ID NO: 37704 - DNA, 20 bp, Artificial Sequence
  chemically synthesized
ctattcaaaaatagaaaata

SEQ ID NO: 37705 - DNA, 20 bp, Artificial Sequence
  chemically synthesized
aatagaaaatatagccattc

SEQ ID NO: 37706 - DNA, 20 bp, Artificial Sequence
  chemically synthesized
cattctagaatgaaaaatat

SEQ ID NO: 37707 - DNA, 20 bp, Artificial Sequence
  chemically synthesized
atgagacatcattacttcac

SEQ ID NO: 37708 - DNA, 20 bp, Artificial Sequence
  chemically synthesized
atatatactttatatatgtt

SEQ ID NO: 37709 - DNA, 20 bp, Artificial Sequence
  chemically synthesized
atatactttatatatgttca

SEQ ID NO: 37710 - DNA, 20 bp, Artificial Sequence
  chemically synthesized
tatactttatatatgttcag

SEQ ID NO: 37711 - DNA, 20 bp, Artificial Sequence
  chemically synthesized
atactttatatatgttcaga

SEQ ID NO: 37712 - DNA, 20 bp, Artificial Sequence
  chemically synthesized
atatgttcagagggaaaaat

SEQ ID NO: 37713 - DNA, 20 bp, Artificial Sequence
  chemically synthesized
tcagagggaaaaattagaaa

SEQ ID NO: 37714 - DNA, 20 bp, Artificial Sequence
  chemically synthesized
ctactgtaaactctctatat

SEQ ID NO: 37715 - DNA, 20 bp, Artificial Sequence
  chemically synthesized
tactgtaaactctctatatt

SEQ ID NO: 37716 - DNA, 20 bp, Artificial Sequence
  chemically synthesized
tgtaaactctctatattagg

SEQ ID NO: 37717 - DNA, 20 bp, Artificial Sequence
  chemically synthesized
ttaggaagaccaacaatgtt

SEQ ID NO: 37718 - DNA, 20 bp, Artificial Sequence
  chemically synthesized
aggaagaccaacaatgttga

SEQ ID NO: 37719 - DNA, 20 bp, Artificial Sequence
  chemically synthesized
accaacaatgttgagagaaa

SEQ ID NO: 37720 - DNA, 20 bp, Artificial Sequence
  chemically synthesized
atccaatgactaaaaaattg

SEQ ID NO: 37721 - DNA, 20 bp, Artificial Sequence
  chemically synthesized
caatgactaaaaaattgtgg

SEQ ID NO: 37722 - DNA, 20 bp, Artificial Sequence
  chemically synthesized
aatgactaaaaaattgtggt

SEQ ID NO: 37723 - DNA, 20 bp, Artificial Sequence
  chemically synthesized
tgactaaaaaattgtggtgg

SEQ ID NO: 37724 - DNA, 20 bp, Artificial Sequence
  chemically synthesized
gactaaaaaattgtggtggg

SEQ ID NO: 37725 - DNA, 20 bp, Artificial Sequence
  chemically synthesized
ctaaaaaattgtggtgggag

SEQ ID NO: 37726 - DNA, 20 bp, Artificial Sequence
  chemically synthesized
tttgtgtgactgtgtactaa

SEQ ID NO: 37727 - DNA, 20 bp, Artificial Sequence
  chemically synthesized
tgtgtactaaaagcttcttt

SEQ ID NO: 37728 - DNA, 20 bp, Artificial Sequence
  chemically synthesized
agactgatttaattgtgaaa

SEQ ID NO: 37729 - DNA, 20 bp, Artificial Sequence
  chemically synthesized
gactgatttaattgtgaaac

SEQ ID NO: 37730 - DNA, 20 bp, Artificial Sequence
  chemically synthesized
ttttcatccacaaatttcaa

SEQ ID NO: 37731 - DNA, 20 bp, Artificial Sequence
  chemically synthesized
tttcatccacaaatttcaaa

SEQ ID NO: 37732 - DNA, 20 bp, Artificial Sequence
  chemically synthesized
ttcatccacaaatttcaaaa

SEQ ID NO: 37733 - DNA, 20 bp, Artificial Sequence
  chemically synthesized
tcatccacaaatttcaaaag

SEQ ID NO: 37734 - DNA, 20 bp, Artificial Sequence
  chemically synthesized
caaaaggggaaaacctatct

SEQ ID NO: 37735 - DNA, 20 bp, Artificial Sequence
  chemically synthesized
aaaggggaaaacctatctca

SEQ ID NO: 37736 - DNA, 20 bp, Artificial Sequence
  chemically synthesized
tatctcagagtataatgttc

SEQ ID NO: 37737 - DNA, 20 bp, Artificial Sequence
  chemically synthesized
aatataaactcaaatcctaa

SEQ ID NO: 37738 - DNA, 20 bp, Artificial Sequence
  chemically synthesized
taaactcaaatcctaaaagt

SEQ ID NO: 37739 - DNA, 20 bp, Artificial Sequence
  chemically synthesized
taaaagtcagttatctacca

SEQ ID NO: 37740 - DNA, 20 bp, Artificial Sequence
  chemically synthesized
tgttccttatatgtgaccat

SEQ ID NO: 37741 - DNA, 20 bp, Artificial Sequence
  chemically synthesized
gttccttatatgtgaccatg

SEQ ID NO: 37742 - DNA, 20 bp, Artificial Sequence
  chemically synthesized
catgaggtctataatacatc

SEQ ID NO: 37743 - DNA, 20 bp, Artificial Sequence
  chemically synthesized
atgaggtctataatacatct

SEQ ID NO: 37744 - DNA, 20 bp, Artificial Sequence
  chemically synthesized
aatacatctaggcatcttaa

SEQ ID NO: 37745 - DNA, 20 bp, Artificial Sequence
  chemically synthesized
ttaatggaaaaatctcattt

SEQ ID NO: 37746 - DNA, 20 bp, Artificial Sequence
  chemically synthesized
cttgatttgctatcttgatg

SEQ ID NO: 37747 - DNA, 20 bp, Artificial Sequence
  chemically synthesized
tcttgatgcagaacctcttg

SEQ ID NO: 37748 - DNA, 20 bp, Artificial Sequence
  chemically synthesized
atgcagaacctcttgtagct

SEQ ID NO: 37749 - DNA, 20 bp, Artificial Sequence
  chemically synthesized
tgcagaacctcttgtagctg

SEQ ID NO: 37750 - DNA, 20 bp, Artificial Sequence
  chemically synthesized
gaacctcttgtagctgagga

SEQ ID NO: 37751 - DNA, 20 bp, Artificial Sequence
  chemically synthesized
gcctttgtttcccatctttg

SEQ ID NO: 37752 - DNA, 20 bp, Artificial Sequence
  chemically synthesized
tgtttcccatctttgtagaa

SEQ ID NO: 37753 - DNA, 20 bp, Artificial Sequence
  chemically synthesized
ttcccatctttgtagaacag

SEQ ID NO: 37754 - DNA, 20 bp, Artificial Sequence
  chemically synthesized
tctttgtagaacagaagctg

SEQ ID NO: 37755 - DNA, 20 bp, Artificial Sequence
  chemically synthesized
ctttgtagaacagaagctgt

SEQ ID NO: 37756 - DNA, 20 bp, Artificial Sequence
  chemically synthesized
cagaagctgtgggacatcac

SEQ ID NO: 37757 - DNA, 20 bp, Artificial Sequence
  chemically synthesized
tgggacatcacaagttgctg

SEQ ID NO: 37758 - DNA, 20 bp, Artificial Sequence
  chemically synthesized
caagttgctgtggtaatcac

SEQ ID NO: 37759 - DNA, 20 bp, Artificial Sequence
  chemically synthesized
ccatctgatatctaaatttt

SEQ ID NO: 37760 - DNA, 20 bp, Artificial Sequence
  chemically synthesized
catctgatatctaaattttg

SEQ ID NO: 37761 - DNA, 20 bp, Artificial Sequence
  chemically synthesized
tgatatctaaattttgagga

SEQ ID NO: 37762 - DNA, 20 bp, Artificial Sequence
  chemically synthesized
gatatctaaattttgaggat

SEQ ID NO: 37763 - DNA, 20 bp, Artificial Sequence
  chemically synthesized
aggataggctatctgtttta

SEQ ID NO: 37764 - DNA, 20 bp, Artificial Sequence
  chemically synthesized
ttttacagtgatacatttga

SEQ ID NO: 37765 - DNA, 20 bp, Artificial Sequence
  chemically synthesized
tacagtgatacatttgatgg

SEQ ID NO: 37766 - DNA, 20 bp, Artificial Sequence
  chemically synthesized
acagtgatacatttgatgga

SEQ ID NO: 37767 - DNA, 20 bp, Artificial Sequence
  chemically synthesized
acatttgatggaaggactct

SEQ ID NO: 37768 - DNA, 20 bp, Artificial Sequence
  chemically synthesized
ggaaggactcttagtttaac

SEQ ID NO: 37769 - DNA, 20 bp, Artificial Sequence
  chemically synthesized
gactcttagtttaactggcc

SEQ ID NO: 37770 - DNA, 20 bp, Artificial Sequence
  chemically synthesized
actcttagtttaactggcca

SEQ ID NO: 37771 - DNA, 20 bp, Artificial Sequence
  chemically synthesized
ttagtttaactggccaaggc

SEQ ID NO: 37772 - DNA, 20 bp, Artificial Sequence
  chemically synthesized
tagtttaactggccaaggcc

SEQ ID NO: 37773 - DNA, 20 bp, Artificial Sequence
  chemically synthesized
ctggccaaggccaggacttc

SEQ ID NO: 37774 - DNA, 20 bp, Artificial Sequence
  chemically synthesized
aaggccaggacttcaagcca

SEQ ID NO: 37775 - DNA, 20 bp, Artificial Sequence
  chemically synthesized
taattacctgccacatgtgt

SEQ ID NO: 37776 - DNA, 20 bp, Artificial Sequence
  chemically synthesized
ctgccacatgtgtgagaaat

SEQ ID NO: 37777 - DNA, 20 bp, Artificial Sequence
  chemically synthesized
tgccacatgtgtgagaaata

SEQ ID NO: 37778 - DNA, 20 bp, Artificial Sequence
  chemically synthesized
cacatgtgtgagaaataagg

SEQ ID NO: 37779 - DNA, 20 bp, Artificial Sequence
  chemically synthesized
aaggaagtttcaaaccatga

SEQ ID NO: 37780 - DNA, 20 bp, Artificial Sequence
  chemically synthesized
ggaagtttcaaaccatgatg

SEQ ID NO: 37781 - DNA, 20 bp, Artificial Sequence
  chemically synthesized
agtttcaaaccatgatggag

SEQ ID NO: 37782 - DNA, 20 bp, Artificial Sequence
  chemically synthesized
ccatgatggagcagcatcac

SEQ ID NO: 37783 - DNA, 20 bp, Artificial Sequence
  chemically synthesized
tggcatgccttttgtgtata

SEQ ID NO: 37784 - DNA, 20 bp, Artificial Sequence
  chemically synthesized
catgccttttgtgtatatgg

SEQ ID NO: 37785 - DNA, 20 bp, Artificial Sequence
  chemically synthesized
atgccttttgtgtatatggt

SEQ ID NO: 37786 - DNA, 20 bp, Artificial Sequence
  chemically synthesized
ttttgtgtatatggtgggtt

SEQ ID NO: 37787 - DNA, 20 bp, Artificial Sequence
  chemically synthesized
tttgtgtatatggtgggttg

SEQ ID NO: 37788 - DNA, 20 bp, Artificial Sequence
  chemically synthesized
tatatggtgggttgaggata

SEQ ID NO: 37789 - DNA, 20 bp, Artificial Sequence
  chemically synthesized
ttgaggatatggcaatattg

SEQ ID NO: 37790 - DNA, 20 bp, Artificial Sequence
  chemically synthesized
aatattgcagcctcactgaa

SEQ ID NO: 37791 - DNA, 20 bp, Artificial Sequence
  chemically synthesized
atattgcagcctcactgaat

SEQ ID NO: 37792 - DNA, 20 bp, Artificial Sequence
  chemically synthesized
cagcctcactgaataggtat

SEQ ID NO: 37793 - DNA, 20 bp, Artificial Sequence
  chemically synthesized
agcctcactgaataggtata

SEQ ID NO: 37794 - DNA, 20 bp, Artificial Sequence
  chemically synthesized
cctcactgaataggtataag

SEQ ID NO: 37795 - DNA, 20 bp, Artificial Sequence
  chemically synthesized
ctcactgaataggtataagg

SEQ ID NO: 37796 - DNA, 20 bp, Artificial Sequence
  chemically synthesized
gtataaggaggtgcttactt

SEQ ID NO: 37797 - DNA, 20 bp, Artificial Sequence
  chemically synthesized
aggaggtgcttactttggat

SEQ ID NO: 37798 - DNA, 20 bp, Artificial Sequence
  chemically synthesized
aggtgcttactttggataag

SEQ ID NO: 37799 - DNA, 20 bp, Artificial Sequence
  chemically synthesized
ggataagcagtgttgtttcc

SEQ ID NO: 37800 - DNA, 20 bp, Artificial Sequence
  chemically synthesized
cagtgttgtttccaagatga

SEQ ID NO: 37801 - DNA, 20 bp, Artificial Sequence
  chemically synthesized
tgttgtttccaagatgaaag

SEQ ID NO: 37802 - DNA, 20 bp, Artificial Sequence
  chemically synthesized
atgaaagaagcccaaattat

SEQ ID NO: 37803 - DNA, 20 bp, Artificial Sequence
  chemically synthesized
tgaaagaagcccaaattatt

SEQ ID NO: 37804 - DNA, 20 bp, Artificial Sequence
  chemically synthesized
taatgacgttgtccttaaac

SEQ ID NO: 37805 - DNA, 20 bp, Artificial Sequence
  chemically synthesized
acgttgtccttaaactggtt

SEQ ID NO: 37806 - DNA, 20 bp, Artificial Sequence
  chemically synthesized
gacgttgaattctctgttct

SEQ ID NO: 37807 - DNA, 20 bp, Artificial Sequence
  chemically synthesized
ctctgttcttggtgccttca

SEQ ID NO: 37808 - DNA, 20 bp, Artificial Sequence
  chemically synthesized
ggtgccttcatggttgttta

SEQ ID NO: 37809 - DNA, 20 bp, Artificial Sequence
  chemically synthesized
atatttttcaaattgattct

SEQ ID NO: 37810 - DNA, 20 bp, Artificial Sequence
  chemically synthesized
atttttcaaattgattctaa

SEQ ID NO: 37811 - DNA, 20 bp, Artificial Sequence
  chemically synthesized
tttttcaaattgattctaag

SEQ ID NO: 37812 - DNA, 20 bp, Artificial Sequence
  chemically synthesized
ttttcaaattgattctaaga

SEQ ID NO: 37813 - DNA, 20 bp, Artificial Sequence
  chemically synthesized
agagggtgatctgaatccac

SEQ ID NO: 37814 - DNA, 20 bp, Artificial Sequence
  chemically synthesized
cactagcattttatttcatt

SEQ ID NO: 37815 - DNA, 20 bp, Artificial Sequence
  chemically synthesized
gagacttttcatcttttaca

SEQ ID NO: 37816 - DNA, 20 bp, Artificial Sequence
  chemically synthesized
acttttcatcttttacatag

SEQ ID NO: 37817 - DNA, 20 bp, Artificial Sequence
  chemically synthesized
cttttcatcttttacataga

SEQ ID NO: 37818 - DNA, 20 bp, Artificial Sequence
  chemically synthesized
cttttacatagaaggaaact

SEQ ID NO: 37819 - DNA, 20 bp, Artificial Sequence
  chemically synthesized
atagaaggaaactaagttat

SEQ ID NO: 37820 - DNA, 20 bp, Artificial Sequence
  chemically synthesized
aatatcaactttcatgataa

SEQ ID NO: 37821 - DNA, 20 bp, Artificial Sequence
  chemically synthesized
ctttcatgataaaagataca

SEQ ID NO: 37822 - DNA, 20 bp, Artificial Sequence
  chemically synthesized
aaagatacacagtcccttct

SEQ ID NO: 37823 - DNA, 20 bp, Artificial Sequence
  chemically synthesized
aagatacacagtcccttctg

SEQ ID NO: 37824 - DNA, 20 bp, Artificial Sequence
  chemically synthesized
agatacacagtcccttctga

SEQ ID NO: 37825 - DNA, 20 bp, Artificial Sequence
  chemically synthesized
acagtcccttctgagggcac

SEQ ID NO: 37826 - DNA, 20 bp, Artificial Sequence
  chemically synthesized
aatacttcattaaaccaaac

SEQ ID NO: 37827 - DNA, 20 bp, Artificial Sequence
  chemically synthesized
tcttctgtcatatttttaat

SEQ ID NO: 37828 - DNA, 20 bp, Artificial Sequence
  chemically synthesized
cttctgtcatatttttaata

SEQ ID NO: 37829 - DNA, 20 bp, Artificial Sequence
  chemically synthesized
tctgtcatatttttaataag

SEQ ID NO: 37830 - DNA, 20 bp, Artificial Sequence
  chemically synthesized
ctgtcatatttttaataagg

SEQ ID NO: 37831 - DNA, 20 bp, Artificial Sequence
  chemically synthesized
catatttttaataaggagga

SEQ ID NO: 37832 - DNA, 20 bp, Artificial Sequence
  chemically synthesized
aacaaaataatatccttatt

SEQ ID NO: 37833 - DNA, 20 bp, Artificial Sequence
  chemically synthesized
ctatatgttaatgaaactgt

SEQ ID NO: 37834 - DNA, 20 bp, Artificial Sequence
  chemically synthesized
tgttaatgaaactgttagaa

SEQ ID NO: 37835 - DNA, 20 bp, Artificial Sequence
  chemically synthesized
gttagaaaagaaaatgatat

SEQ ID NO: 37836 - DNA, 20 bp, Artificial Sequence
  chemically synthesized
atgatatgagtaattttctc

SEQ ID NO: 37837 - DNA, 20 bp, Artificial Sequence
  chemically synthesized
tgatatgagtaattttctcc

SEQ ID NO: 37838 - DNA, 20 bp, Artificial Sequence
  chemically synthesized
gatatgagtaattttctcca

SEQ ID NO: 37839 - DNA, 20 bp, Artificial Sequence
  chemically synthesized
tccagggtatcctttgtgca

SEQ ID NO: 37840 - DNA, 20 bp, Artificial Sequence
  chemically synthesized
ttctcttcatcttttctaca

SEQ ID NO: 37841 - DNA, 20 bp, Artificial Sequence
  chemically synthesized
cttcatcttttctacaaagt

SEQ ID NO: 37842 - DNA, 20 bp, Artificial Sequence
  chemically synthesized
atcaataaataactgttgat

SEQ ID NO: 37843 - DNA, 20 bp, Artificial Sequence
  chemically synthesized
taactgttgattagtgaata

SEQ ID NO: 37844 - DNA, 20 bp, Artificial Sequence
  chemically synthesized
ttatcttcttgtgataacta

SEQ ID NO: 37845 - DNA, 20 bp, Artificial Sequence
  chemically synthesized
tcttcttgtgataactatgg

SEQ ID NO: 37846 - DNA, 20 bp, Artificial Sequence
  chemically synthesized
gtgataactatggaagtcaa

SEQ ID NO: 37847 - DNA, 20 bp, Artificial Sequence
  chemically synthesized
caatggaactactctccatt

SEQ ID NO: 37848 - DNA, 20 bp, Artificial Sequence
  chemically synthesized
actctccattcagcaaaact

SEQ ID NO: 37849 - DNA, 20 bp, Artificial Sequence
  chemically synthesized
ttcagcaaaactcagaaatt

SEQ ID NO: 37850 - DNA, 20 bp, Artificial Sequence
  chemically synthesized
tcagcaaaactcagaaattc

SEQ ID NO: 37851 - DNA, 20 bp, Artificial Sequence
  chemically synthesized
gcaaaactcagaaattcagg

SEQ ID NO: 37852 - DNA, 20 bp, Artificial Sequence
  chemically synthesized
atctactaccttcaatcact

SEQ ID NO: 37853 - DNA, 20 bp, Artificial Sequence
  chemically synthesized
caatcactcagttctattct

SEQ ID NO: 37854 - DNA, 20 bp, Artificial Sequence
  chemically synthesized
ctcagttctattctaagtca

SEQ ID NO: 37855 - DNA, 20 bp, Artificial Sequence
  chemically synthesized
atagaatctctcttctattc

SEQ ID NO: 37856 - DNA, 20 bp, Artificial Sequence
  chemically synthesized
ctaatgctactgataacaac

SEQ ID NO: 37857 - DNA, 20 bp, Artificial Sequence
  chemically synthesized
ccaacatgtttctcatactg

SEQ ID NO: 37858 - DNA, 20 bp, Artificial Sequence
  chemically synthesized
tgtttctcatactgtagcca

SEQ ID NO: 37859 - DNA, 20 bp, Artificial Sequence
  chemically synthesized
aacaataactacttgattat

SEQ ID NO: 37860 - DNA, 20 bp, Artificial Sequence
  chemically synthesized
gttttatattcattccctta

SEQ ID NO: 37861 - DNA, 20 bp, Artificial Sequence
  chemically synthesized
aaatgttttacatgatttgc

SEQ ID NO: 37862 - DNA, 20 bp, Artificial Sequence
  chemically synthesized
tttgcaagatatattgtgat

SEQ ID NO: 37863 - DNA, 20 bp, Artificial Sequence
  chemically synthesized
atcagaacctgctactacta

SEQ ID NO: 37864 - DNA, 20 bp, Artificial Sequence
  chemically synthesized
ctacagattcattttctctc

SEQ ID NO: 37865 - DNA, 20 bp, Artificial Sequence
  chemically synthesized
tttttcatgtattgttgttc

SEQ ID NO: 37866 - DNA, 20 bp, Artificial Sequence
  chemically synthesized
tttcatgtattgttgttcaa

SEQ ID NO: 37867 - DNA, 20 bp, Artificial Sequence
  chemically synthesized
attatttttatttgaattta

SEQ ID NO: 37868 - DNA, 20 bp, Artificial Sequence
  chemically synthesized
atactactacactactaata

SEQ ID NO: 37869 - DNA, 20 bp, Artificial Sequence
  chemically synthesized
ctactacactactaatatag

SEQ ID NO: 37870 - DNA, 20 bp, Artificial Sequence
  chemically synthesized
atatagtagcatttaattct

SEQ ID NO: 37871 - DNA, 20 bp, Artificial Sequence
  chemically synthesized
tagcatttaattctcagctt

SEQ ID NO: 37872 - DNA, 20 bp, Artificial Sequence
  chemically synthesized
catttaattctcagcttaag

SEQ ID NO: 37873 - DNA, 20 bp, Artificial Sequence
  chemically synthesized
agcttaagtagcatttcttc

SEQ ID NO: 37874 - DNA, 20 bp, Artificial Sequence
  chemically synthesized
tggaaaatgttccctgatcc

SEQ ID NO: 37875 - DNA, 20 bp, Artificial Sequence
  chemically synthesized
tttatttgatgtgtctctca

SEQ ID NO: 37876 - DNA, 20 bp, Artificial Sequence
  chemically synthesized
atagcacactaatattcacg

SEQ ID NO: 37877 - DNA, 20 bp, Artificial Sequence
  chemically synthesized
taatattcacgtagtaatga

SEQ ID NO: 37878 - DNA, 20 bp, Artificial Sequence
  chemically synthesized
gatagtgttgtatgaattca

SEQ ID NO: 37879 - DNA, 20 bp, Artificial Sequence
  chemically synthesized
catggtaaatattttctttc

SEQ ID NO: 37880 - DNA, 20 bp, Artificial Sequence
  chemically synthesized
ttttctttctagtgcctgct

SEQ ID NO: 37881 - DNA, 20 bp, Artificial Sequence
  chemically synthesized
tttctttctagtgcctgctt

SEQ ID NO: 37882 - DNA, 20 bp, Artificial Sequence
  chemically synthesized
gggttttaaatttcaataaa

SEQ ID NO: 37883 - DNA, 20 bp, Artificial Sequence
  chemically synthesized
taaatttcaataaaaagaac

SEQ ID NO: 37884 - DNA, 20 bp, Artificial Sequence
  chemically synthesized
tcaataaaaagaacaagtcc

SEQ ID NO: 37885 - DNA, 20 bp, Artificial Sequence
  chemically synthesized
caataaaaagaacaagtcct

SEQ ID NO: 37886 - DNA, 20 bp, Artificial Sequence
  chemically synthesized
taggtatttcattttctttg

SEQ ID NO: 37887 - DNA, 20 bp, Artificial Sequence
  chemically synthesized
ttctttgtggctgttcttaa

SEQ ID NO: 37888 - DNA, 20 bp, Artificial Sequence
  chemically synthesized
tctttgtggctgttcttaat

SEQ ID NO: 37889 - DNA, 20 bp, Artificial Sequence
  chemically synthesized
tgtgttctcgatttgactct

SEQ ID NO: 37890 - DNA, 20 bp, Artificial Sequence
  chemically synthesized
tctcgatttgactctcagcc

SEQ ID NO: 37891 - DNA, 20 bp, Artificial Sequence
  chemically synthesized
ctcgatttgactctcagcct

SEQ ID NO: 37892 - DNA, 20 bp, Artificial Sequence
  chemically synthesized
actctcagcctgggccttat

SEQ ID NO: 37893 - DNA, 20 bp, Artificial Sequence
  chemically synthesized
gcctgggccttattggtgta

SEQ ID NO: 37894 - DNA, 20 bp, Artificial Sequence
  chemically synthesized
accttgctaaaattgtttat

SEQ ID NO: 37895 - DNA, 20 bp, Artificial Sequence
  chemically synthesized
ctaaaattgtttatcagttc

SEQ ID NO: 37896 - DNA, 20 bp, Artificial Sequence
  chemically synthesized
aaattgtttatcagttctag

SEQ ID NO: 37897 - DNA, 20 bp, Artificial Sequence
  chemically synthesized
tatcagttctagcagccttt

SEQ ID NO: 37898 - DNA, 20 bp, Artificial Sequence
  chemically synthesized
cagttctagcagccttttgg

SEQ ID NO: 37899 - DNA, 20 bp, Artificial Sequence
  chemically synthesized
cagccttttggaagaatctg

SEQ ID NO: 37900 - DNA, 20 bp, Artificial Sequence
  chemically synthesized
agccttttggaagaatctgt

SEQ ID NO: 37901 - DNA, 20 bp, Artificial Sequence
  chemically synthesized
aagaatctgtaggattttct

SEQ ID NO: 37902 - DNA, 20 bp, Artificial Sequence
  chemically synthesized
tctgtaggattttctaagta

SEQ ID NO: 37903 - DNA, 20 bp, Artificial Sequence
  chemically synthesized
tgtaggattttctaagtata

SEQ ID NO: 37904 - DNA, 20 bp, Artificial Sequence
  chemically synthesized
taagtatagagtcatatcat

SEQ ID NO: 37905 - DNA, 20 bp, Artificial Sequence
  chemically synthesized
atagagtcatatcatcagca

SEQ ID NO: 37906 - DNA, 20 bp, Artificial Sequence
  chemically synthesized
agagtcatatcatcagcaaa

SEQ ID NO: 37907 - DNA, 20 bp, Artificial Sequence
  chemically synthesized
agtcatatcatcagcaaaga

SEQ ID NO: 37908 - DNA, 20 bp, Artificial Sequence
  chemically synthesized
atatcatcagcaaagagaga

SEQ ID NO: 37909 - DNA, 20 bp, Artificial Sequence
  chemically synthesized
atcagcaaagagagatagtt

SEQ ID NO: 37910 - DNA, 20 bp, Artificial Sequence
  chemically synthesized
tttctctcgcctgattgccc

SEQ ID NO: 37911 - DNA, 20 bp, Artificial Sequence
  chemically synthesized
tctcgcctgattgccctggt

SEQ ID NO: 37912 - DNA, 20 bp, Artificial Sequence
  chemically synthesized
ctcgcctgattgccctggtt

SEQ ID NO: 37913 - DNA, 20 bp, Artificial Sequence
  chemically synthesized
acttccaattttatgttcac

SEQ ID NO: 37914 - DNA, 20 bp, Artificial Sequence
  chemically synthesized
cttccaattttatgttcact

SEQ ID NO: 37915 - DNA, 20 bp, Artificial Sequence
  chemically synthesized
tccaattttatgttcactag

SEQ ID NO: 37916 - DNA, 20 bp, Artificial Sequence
  chemically synthesized
aattttatgttcactaggag

SEQ ID NO: 37917 - DNA, 20 bp, Artificial Sequence
  chemically synthesized
ttatgttcactaggagtggt

SEQ ID NO: 37918 - DNA, 20 bp, Artificial Sequence
  chemically synthesized
ttcactaggagtggtgagaa

SEQ ID NO: 37919 - DNA, 20 bp, Artificial Sequence
  chemically synthesized
tcactaggagtggtgagaat

SEQ ID NO: 37920 - DNA, 20 bp, Artificial Sequence
  chemically synthesized
tgggaatccttgtcttgttg

SEQ ID NO: 37921 - DNA, 20 bp, Artificial Sequence
  chemically synthesized
cttgtcttgttgcagttttc

SEQ ID NO: 37922 - DNA, 20 bp, Artificial Sequence
  chemically synthesized
ttgtcttgttgcagttttcg

SEQ ID NO: 37923 - DNA, 20 bp, Artificial Sequence
  chemically synthesized
gtcttgttgcagttttcgag

SEQ ID NO: 37924 - DNA, 20 bp, Artificial Sequence
  chemically synthesized
gttgcagttttcgaggagaa

SEQ ID NO: 37925 - DNA, 20 bp, Artificial Sequence
  chemically synthesized
gttttcgaggagaatagttc

SEQ ID NO: 37926 - DNA, 20 bp, Artificial Sequence
  chemically synthesized
agttccagcttttgcccatt

SEQ ID NO: 37927 - DNA, 20 bp, Artificial Sequence
  chemically synthesized
cagcttttgcccattcagta

SEQ ID NO: 37928 - DNA, 20 bp, Artificial Sequence
  chemically synthesized
ttgcccattcagtatggttt

SEQ ID NO: 37929 - DNA, 20 bp, Artificial Sequence
  chemically synthesized
attcagtatggttttggtta

SEQ ID NO: 37930 - DNA, 20 bp, Artificial Sequence
  chemically synthesized
ttcagtatggttttggttat

SEQ ID NO: 37931 - DNA, 20 bp, Artificial Sequence
  chemically synthesized
ggttatgggtttttcatacg

SEQ ID NO: 37932 - DNA, 20 bp, Artificial Sequence
  chemically synthesized
tacgtggcttttattctttt

SEQ ID NO: 37933 - DNA, 20 bp, Artificial Sequence
  chemically synthesized
acgtggcttttattcttttg

SEQ ID NO: 37934 - DNA, 20 bp, Artificial Sequence
  chemically synthesized
aggtatgttcctttgatgcc

SEQ ID NO: 37935 - DNA, 20 bp, Artificial Sequence
  chemically synthesized
tcctttgatgcctagtctgt

SEQ ID NO: 37936 - DNA, 20 bp, Artificial Sequence
  chemically synthesized
ctttgatgcctagtctgttg

SEQ ID NO: 37937 - DNA, 20 bp, Artificial Sequence
  chemically synthesized
tttgatgcctagtctgttgg

SEQ ID NO: 37938 - DNA, 20 bp, Artificial Sequence
  chemically synthesized
tgttggaggtttttatcatg

SEQ ID NO: 37939 - DNA, 20 bp, Artificial Sequence
  chemically synthesized
gttggaggtttttatcatga

SEQ ID NO: 37940 - DNA, 20 bp, Artificial Sequence
  chemically synthesized
ttggaggtttttatcatgaa

SEQ ID NO: 37941 - DNA, 20 bp, Artificial Sequence
  chemically synthesized
gggatgttgaattttattga

SEQ ID NO: 37942 - DNA, 20 bp, Artificial Sequence
  chemically synthesized
ggatgttgaattttattgaa

SEQ ID NO: 37943 - DNA, 20 bp, Artificial Sequence
  chemically synthesized
ttttattgaaaggtttttct

SEQ ID NO: 37944 - DNA, 20 bp, Artificial Sequence
  chemically synthesized
aaggtttttctcagtctatt

SEQ ID NO: 37945 - DNA, 20 bp, Artificial Sequence
  chemically synthesized
agtctattgagatgatcata

SEQ ID NO: 37946 - DNA, 20 bp, Artificial Sequence
  chemically synthesized
tgagatgatcatatggtttg

SEQ ID NO: 37947 - DNA, 20 bp, Artificial Sequence
  chemically synthesized
gagatgatcatatggtttgt

SEQ ID NO: 37948 - DNA, 20 bp, Artificial Sequence
  chemically synthesized
gatgatcatatggtttgtgg

SEQ ID NO: 37949 - DNA, 20 bp, Artificial Sequence
  chemically synthesized
atgatcatatggtttgtggg

SEQ ID NO: 37950 - DNA, 20 bp, Artificial Sequence
  chemically synthesized
atatggtttgtgggaggtga

SEQ ID NO: 37951 - DNA, 20 bp, Artificial Sequence
  chemically synthesized
gggaggtgaaagatctctac

SEQ ID NO: 37952 - DNA, 20 bp, Artificial Sequence
  chemically synthesized
ggaggtgaaagatctctaca

SEQ ID NO: 37953 - DNA, 20 bp, Artificial Sequence
  chemically synthesized
aggtgaaagatctctacaag

SEQ ID NO: 37954 - DNA, 20 bp, Artificial Sequence
  chemically synthesized
gaactacaaaacactgctga

SEQ ID NO: 37955 - DNA, 20 bp, Artificial Sequence
  chemically synthesized
aaaacactgctgaaagaaat

SEQ ID NO: 37956 - DNA, 20 bp, Artificial Sequence
  chemically synthesized
caacacaaataaataaataa

SEQ ID NO: 37957 - DNA, 20 bp, Artificial Sequence
  chemically synthesized
ataaataaataaaagctttc

SEQ ID NO: 37958 - DNA, 20 bp, Artificial Sequence
  chemically synthesized
taaataaataaaagctttcc

SEQ ID NO: 37959 - DNA, 20 bp, Artificial Sequence
  chemically synthesized
ataaaagctttccaggctca

SEQ ID NO: 37960 - DNA, 20 bp, Artificial Sequence
  chemically synthesized
agctttccaggctcatggat

SEQ ID NO: 37961 - DNA, 20 bp, Artificial Sequence
  chemically synthesized
tttccaggctcatggattgg

SEQ ID NO: 37962 - DNA, 20 bp, Artificial Sequence
  chemically synthesized
agaatcaatatgaatttaaa

SEQ ID NO: 37963 - DNA, 20 bp, Artificial Sequence
  chemically synthesized
ttaaatggccatactgctca

SEQ ID NO: 37964 - DNA, 20 bp, Artificial Sequence
  chemically synthesized
ccatactgctcaaagcaatt

SEQ ID NO: 37965 - DNA, 20 bp, Artificial Sequence
  chemically synthesized
attaccaatgtcattcttca

SEQ ID NO: 37966 - DNA, 20 bp, Artificial Sequence
  chemically synthesized
aatgtcattcttcacagtat

SEQ ID NO: 37967 - DNA, 20 bp, Artificial Sequence
  chemically synthesized
cttcacagtattagaaaaac

SEQ ID NO: 37968 - DNA, 20 bp, Artificial Sequence
  chemically synthesized
aaactagtttaaaattcata

SEQ ID NO: 37969 - DNA, 20 bp, Artificial Sequence
  chemically synthesized
aaaattcatatggaaccaaa

SEQ ID NO: 37970 - DNA, 20 bp, Artificial Sequence
  chemically synthesized
aattcatatggaaccaaaaa

SEQ ID NO: 37971 - DNA, 20 bp, Artificial Sequence
  chemically synthesized
ggaaccaaaaagagcctgaa

SEQ ID NO: 37972 - DNA, 20 bp, Artificial Sequence
  chemically synthesized
gaaccaaaaagagcctgaac

SEQ ID NO: 37973 - DNA, 20 bp, Artificial Sequence
  chemically synthesized
aaaaagagcctgaacaggca

SEQ ID NO: 37974 - DNA, 20 bp, Artificial Sequence
  chemically synthesized
tgaacaggcaaagcaatctt

SEQ ID NO: 37975 - DNA, 20 bp, Artificial Sequence
  chemically synthesized
acaggcaaagcaatcttaag

SEQ ID NO: 37976 - DNA, 20 bp, Artificial Sequence
  chemically synthesized
gcaaagcaatcttaagcaga

SEQ ID NO: 37977 - DNA, 20 bp, Artificial Sequence
  chemically synthesized
ttaagcagaaagaacaaaat

SEQ ID NO: 37978 - DNA, 20 bp, Artificial Sequence
  chemically synthesized
agcagaaagaacaaaattgg

SEQ ID NO: 37979 - DNA, 20 bp, Artificial Sequence
  chemically synthesized
caccacctgacttgaaacta

SEQ ID NO: 37980 - DNA, 20 bp, Artificial Sequence
  chemically synthesized
accacctgacttgaaactac

SEQ ID NO: 37981 - DNA, 20 bp, Artificial Sequence
  chemically synthesized
cctgacttgaaactacaggc

SEQ ID NO: 37982 - DNA, 20 bp, Artificial Sequence
  chemically synthesized
ctgacttgaaactacaggcc

SEQ ID NO: 37983 - DNA, 20 bp, Artificial Sequence
  chemically synthesized
ttgaaactacaggccaggca

SEQ ID NO: 37984 - DNA, 20 bp, Artificial Sequence
  chemically synthesized
aaactacaggccaggcacgg

SEQ ID NO: 37985 - DNA, 20 bp, Artificial Sequence
  chemically synthesized
gtggctcacgcctgtaactc

SEQ ID NO: 37986 - DNA, 20 bp, Artificial Sequence
  chemically synthesized
cgcctgtaactctagcactt

SEQ ID NO: 37987 - DNA, 20 bp, Artificial Sequence
  chemically synthesized
gcctgtaactctagcacttt

SEQ ID NO: 37988 - DNA, 20 bp, Artificial Sequence
  chemically synthesized
cctgtaactctagcacttta

SEQ ID NO: 37989 - DNA, 20 bp, Artificial Sequence
  chemically synthesized
ctgtaactctagcactttag

SEQ ID NO: 37990 - DNA, 20 bp, Artificial Sequence
  chemically synthesized
tgtaactctagcactttagg

SEQ ID NO: 37991 - DNA, 20 bp, Artificial Sequence
  chemically synthesized
ctctagcactttagggggct

SEQ ID NO: 37992 - DNA, 20 bp, Artificial Sequence
  chemically synthesized
tctagcactttagggggctg

SEQ ID NO: 37993 - DNA, 20 bp, Artificial Sequence
  chemically synthesized
agcactttagggggctgagg

SEQ ID NO: 37994 - DNA, 20 bp, Artificial Sequence
  chemically synthesized
gcactttagggggctgaggt

SEQ ID NO: 37995 - DNA, 20 bp, Artificial Sequence
  chemically synthesized
ctgaggtgggtgtatcacct

SEQ ID NO: 37996 - DNA, 20 bp, Artificial Sequence
  chemically synthesized
tgaggtgggtgtatcacctg

SEQ ID NO: 37997 - DNA, 20 bp, Artificial Sequence
  chemically synthesized
gtgggtgtatcacctgaggt

SEQ ID NO: 37998 - DNA, 20 bp, Artificial Sequence
  chemically synthesized
tgggtgtatcacctgaggtc

SEQ ID NO: 37999 - DNA, 20 bp, Artificial Sequence
  chemically synthesized
ggtgtatcacctgaggtcag

SEQ ID NO: 38000 - DNA, 20 bp, Artificial Sequence
  chemically synthesized
tcacctgaggtcaggagttc

SEQ ID NO: 38001 - DNA, 20 bp, Artificial Sequence
  chemically synthesized
tgaggtcaggagttcaagac

SEQ ID NO: 38002 - DNA, 20 bp, Artificial Sequence
  chemically synthesized
tcaggagttcaagaccagcc

SEQ ID NO: 38003 - DNA, 20 bp, Artificial Sequence
  chemically synthesized
caagaccagcctggtcaaca

SEQ ID NO: 38004 - DNA, 20 bp, Artificial Sequence
  chemically synthesized
ctctactaaaaatacaaaat

SEQ ID NO: 38005 - DNA, 20 bp, Artificial Sequence
  chemically synthesized
actaaaaatacaaaattagc

SEQ ID NO: 38006 - DNA, 20 bp, Artificial Sequence
  chemically synthesized
aatacaaaattagccggctg

SEQ ID NO: 38007 - DNA, 20 bp, Artificial Sequence
  chemically synthesized
acaaaattagccggctgtgg

SEQ ID NO: 38008 - DNA, 20 bp, Artificial Sequence
  chemically synthesized
aaattagccggctgtggtgg

SEQ ID NO: 38009 - DNA, 20 bp, Artificial Sequence
  chemically synthesized
aattagccggctgtggtggt

SEQ ID NO: 38010 - DNA, 20 bp, Artificial Sequence
  chemically synthesized
attagccggctgtggtggtg

SEQ ID NO: 38011 - DNA, 20 bp, Artificial Sequence
  chemically synthesized
ttagccggctgtggtggtgg

SEQ ID NO: 38012 - DNA, 20 bp, Artificial Sequence
  chemically synthesized
ggtggtgggggctgtaatcc

SEQ ID NO: 38013 - DNA, 20 bp, Artificial Sequence
  chemically synthesized
gggctgtaatcccagctact

SEQ ID NO: 38014 - DNA, 20 bp, Artificial Sequence
  chemically synthesized
ctgtaatcccagctactcgg

SEQ ID NO: 38015 - DNA, 20 bp, Artificial Sequence
  chemically synthesized
tgtaatcccagctactcgga

SEQ ID NO: 38016 - DNA, 20 bp, Artificial Sequence
  chemically synthesized
tcccagctactcggaaggct

SEQ ID NO: 38017 - DNA, 20 bp, Artificial Sequence
  chemically synthesized
cccagctactcggaaggctg

SEQ ID NO: 38018 - DNA, 20 bp, Artificial Sequence
  chemically synthesized
agctactcggaaggctgagg

SEQ ID NO: 38019 - DNA, 20 bp, Artificial Sequence
  chemically synthesized
gctactcggaaggctgaggc

SEQ ID NO: 38020 - DNA, 20 bp, Artificial Sequence
  chemically synthesized
tactcggaaggctgaggcag

SEQ ID NO: 38021 - DNA, 20 bp, Artificial Sequence
  chemically synthesized
caggagaattgcttgaactc

SEQ ID NO: 38022 - DNA, 20 bp, Artificial Sequence
  chemically synthesized
ggagaattgcttgaactctg

SEQ ID NO: 38023 - DNA, 20 bp, Artificial Sequence
  chemically synthesized
gagaattgcttgaactctgg

SEQ ID NO: 38024 - DNA, 20 bp, Artificial Sequence
  chemically synthesized
aattgcttgaactctggagg

SEQ ID NO: 38025 - DNA, 20 bp, Artificial Sequence
  chemically synthesized
gcttgaactctggaggcaga

SEQ ID NO: 38026 - DNA, 20 bp, Artificial Sequence
  chemically synthesized
aactctggaggcagacggtg

SEQ ID NO: 38027 - DNA, 20 bp, Artificial Sequence
  chemically synthesized
ctggaggcagacggtgcagt

SEQ ID NO: 38028 - DNA, 20 bp, Artificial Sequence
  chemically synthesized
ggcagacggtgcagtgagcc

SEQ ID NO: 38029 - DNA, 20 bp, Artificial Sequence
  chemically synthesized
aagatcgcaccactgcactc

SEQ ID NO: 38030 - DNA, 20 bp, Artificial Sequence
  chemically synthesized
cgcaccactgcactccagcc

SEQ ID NO: 38031 - DNA, 20 bp, Artificial Sequence
  chemically synthesized
gcaccactgcactccagcct

SEQ ID NO: 38032 - DNA, 20 bp, Artificial Sequence
  chemically synthesized
ctgcactccagcctgggtga

SEQ ID NO: 38033 - DNA, 20 bp, Artificial Sequence
  chemically synthesized
gcactccagcctgggtgaca

SEQ ID NO: 38034 - DNA, 20 bp, Artificial Sequence
  chemically synthesized
aaactctgaaaaaataaaaa

SEQ ID NO: 38035 - DNA, 20 bp, Artificial Sequence
  chemically synthesized
tctgaaaaaataaaaaaaga

SEQ ID NO: 38036 - DNA, 20 bp, Artificial Sequence
  chemically synthesized
aaaaataaaaaaagaaagaa

SEQ ID NO: 38037 - DNA, 20 bp, Artificial Sequence
  chemically synthesized
ataaaaaaagaaagaaaaga

SEQ ID NO: 38038 - DNA, 20 bp, Artificial Sequence
  chemically synthesized
aaaaagaaagaaaagaaaga

SEQ ID NO: 38039 - DNA, 20 bp, Artificial Sequence
  chemically synthesized
aaagaaagaaaagaaagaaa

SEQ ID NO: 38040 - DNA, 20 bp, Artificial Sequence
  chemically synthesized
agaaagaaaagaaagaaaga

SEQ ID NO: 38041 - DNA, 20 bp, Artificial Sequence
  chemically synthesized
gaaagaaaagaaagaaagag

SEQ ID NO: 38042 - DNA, 20 bp, Artificial Sequence
  chemically synthesized
aaagaaaagaaagaaagaga

SEQ ID NO: 38043 - DNA, 20 bp, Artificial Sequence
  chemically synthesized
gaaaagaaagaaagagaggg

SEQ ID NO: 38044 - DNA, 20 bp, Artificial Sequence
  chemically synthesized
agaaagaaagagagggaaga

SEQ ID NO: 38045 - DNA, 20 bp, Artificial Sequence
  chemically synthesized
gaaagaaagagagggaagaa

SEQ ID NO: 38046 - DNA, 20 bp, Artificial Sequence
  chemically synthesized
gaaagagagggaagaaagga

SEQ ID NO: 38047 - DNA, 20 bp, Artificial Sequence
  chemically synthesized
aaggaaagaaactacattat

SEQ ID NO: 38048 - DNA, 20 bp, Artificial Sequence
  chemically synthesized
aggaaagaaactacattata

SEQ ID NO: 38049 - DNA, 20 bp, Artificial Sequence
  chemically synthesized
gaaactacattataaggcca

SEQ ID NO: 38050 - DNA, 20 bp, Artificial Sequence
  chemically synthesized
taaggccacagtaccccaaa

SEQ ID NO: 38051 - DNA, 20 bp, Artificial Sequence
  chemically synthesized
gcatgatattgttacaaaaa

SEQ ID NO: 38052 - DNA, 20 bp, Artificial Sequence
  chemically synthesized
caaaaatagacacattgact

SEQ ID NO: 38053 - DNA, 20 bp, Artificial Sequence
  chemically synthesized
aaaaatagacacattgacta

SEQ ID NO: 38054 - DNA, 20 bp, Artificial Sequence
  chemically synthesized
cattgactaaggaaacacaa

SEQ ID NO: 38055 - DNA, 20 bp, Artificial Sequence
  chemically synthesized
caatagaaaactcaaaaata

SEQ ID NO: 38056 - DNA, 20 bp, Artificial Sequence
  chemically synthesized
aactcaaaaataaagctaca

SEQ ID NO: 38057 - DNA, 20 bp, Artificial Sequence
  chemically synthesized
tcaacaacactgacaaaaac

SEQ ID NO: 38058 - DNA, 20 bp, Artificial Sequence
  chemically synthesized
acaacactgacaaaaacaag

SEQ ID NO: 38059 - DNA, 20 bp, Artificial Sequence
  chemically synthesized
acactgacaaaaacaagcag

SEQ ID NO: 38060 - DNA, 20 bp, Artificial Sequence
  chemically synthesized
cactgacaaaaacaagcagc

SEQ ID NO: 38061 - DNA, 20 bp, Artificial Sequence
  chemically synthesized
acaaaaacaagcagcgggaa

SEQ ID NO: 38062 - DNA, 20 bp, Artificial Sequence
  chemically synthesized
caaaaacaagcagcgggaaa

SEQ ID NO: 38063 - DNA, 20 bp, Artificial Sequence
  chemically synthesized
acctatccaataaactgtgc

SEQ ID NO: 38064 - DNA, 20 bp, Artificial Sequence
  chemically synthesized
ataaactgtgctggaatacg

SEQ ID NO: 38065 - DNA, 20 bp, Artificial Sequence
  chemically synthesized
actgtgctggaatacgtggc

SEQ ID NO: 38066 - DNA, 20 bp, Artificial Sequence
  chemically synthesized
aatacgtggctagccatatg

SEQ ID NO: 38067 - DNA, 20 bp, Artificial Sequence
  chemically synthesized
acgtggctagccatatgcag

SEQ ID NO: 38068 - DNA, 20 bp, Artificial Sequence
  chemically synthesized
catatgcagaagaatgaaac

SEQ ID NO: 38069 - DNA, 20 bp, Artificial Sequence
  chemically synthesized
gacccttaccttacaccatt

SEQ ID NO: 38070 - DNA, 20 bp, Artificial Sequence
  chemically synthesized
cccttaccttacaccattta

SEQ ID NO: 38071 - DNA, 20 bp, Artificial Sequence
  chemically synthesized
tgaattcaaaacttaaatgt

SEQ ID NO: 38072 - DNA, 20 bp, Artificial Sequence
  chemically synthesized
atctcaaatcttacctgcac

SEQ ID NO: 38073 - DNA, 20 bp, Artificial Sequence
  chemically synthesized
tcaaatcttacctgcactgg

SEQ ID NO: 38074 - DNA, 20 bp, Artificial Sequence
  chemically synthesized
ctgcactggcagtgcatttt

SEQ ID NO: 38075 - DNA, 20 bp, Artificial Sequence
  chemically synthesized
ctggcagtgcatttttggct

SEQ ID NO: 38076 - DNA, 20 bp, Artificial Sequence
  chemically synthesized
atttttggctaagcccccaa

SEQ ID NO: 38077 - DNA, 20 bp, Artificial Sequence
  chemically synthesized
ccaaaagcaattgcaatgca

SEQ ID NO: 38078 - DNA, 20 bp, Artificial Sequence
  chemically synthesized
caatgcaaagaaaaattcac

SEQ ID NO: 38079 - DNA, 20 bp, Artificial Sequence
  chemically synthesized
tgcaaagaaaaattcacaag

SEQ ID NO: 38080 - DNA, 20 bp, Artificial Sequence
  chemically synthesized
agtggaacctaattaaacta

SEQ ID NO: 38081 - DNA, 20 bp, Artificial Sequence
  chemically synthesized
tggaacctaattaaactaaa

SEQ ID NO: 38082 - DNA, 20 bp, Artificial Sequence
  chemically synthesized
cttcactattcacaataaca

SEQ ID NO: 38083 - DNA, 20 bp, Artificial Sequence
  chemically synthesized
tattcacaataacaaagact

SEQ ID NO: 38084 - DNA, 20 bp, Artificial Sequence
  chemically synthesized
acccaaatgtccaacaatga

SEQ ID NO: 38085 - DNA, 20 bp, Artificial Sequence
  chemically synthesized
aatgtccaacaatgatagaa

SEQ ID NO: 38086 - DNA, 20 bp, Artificial Sequence
  chemically synthesized
caacaatgatagaatggatt

SEQ ID NO: 38087 - DNA, 20 bp, Artificial Sequence
  chemically synthesized
tagaatggattaagaaaatg

SEQ ID NO: 38088 - DNA, 20 bp, Artificial Sequence
  chemically synthesized
aatgtggcacatatacacca

SEQ ID NO: 38089 - DNA, 20 bp, Artificial Sequence
  chemically synthesized
atacaccatggaatactatg

SEQ ID NO: 38090 - DNA, 20 bp, Artificial Sequence
  chemically synthesized
atgcagccataaaaaatgat

SEQ ID NO: 38091 - DNA, 20 bp, Artificial Sequence
  chemically synthesized
tgatgagttcatgtcctttg

SEQ ID NO: 38092 - DNA, 20 bp, Artificial Sequence
  chemically synthesized
gatgagttcatgtcctttgt

SEQ ID NO: 38093 - DNA, 20 bp, Artificial Sequence
  chemically synthesized
atgagttcatgtcctttgta

SEQ ID NO: 38094 - DNA, 20 bp, Artificial Sequence
  chemically synthesized
tcatgtcctttgtagggaca

SEQ ID NO: 38095 - DNA, 20 bp, Artificial Sequence
  chemically synthesized
cctttgtagggacatggatg

SEQ ID NO: 38096 - DNA, 20 bp, Artificial Sequence
  chemically synthesized
tgtagggacatggatgaagc

SEQ ID NO: 38097 - DNA, 20 bp, Artificial Sequence
  chemically synthesized
aagctggaaaccatcattct

SEQ ID NO: 38098 - DNA, 20 bp, Artificial Sequence
  chemically synthesized
cattctcagcaaactatcac

SEQ ID NO: 38099 - DNA, 20 bp, Artificial Sequence
  chemically synthesized
attctcagcaaactatcaca

SEQ ID NO: 38100 - DNA, 20 bp, Artificial Sequence
  chemically synthesized
ataccacatgttctcactta

SEQ ID NO: 38101 - DNA, 20 bp, Artificial Sequence
  chemically synthesized
taccacatgttctcacttat

SEQ ID NO: 38102 - DNA, 20 bp, Artificial Sequence
  chemically synthesized
cacatgttctcacttatagg

SEQ ID NO: 38103 - DNA, 20 bp, Artificial Sequence
  chemically synthesized
acatgttctcacttataggt

SEQ ID NO: 38104 - DNA, 20 bp, Artificial Sequence
  chemically synthesized
ataggtgggaattgaacaat

SEQ ID NO: 38105 - DNA, 20 bp, Artificial Sequence
  chemically synthesized
aattgaacaatgagaacact

SEQ ID NO: 38106 - DNA, 20 bp, Artificial Sequence
  chemically synthesized
gaacaatgagaacacttgga

SEQ ID NO: 38107 - DNA, 20 bp, Artificial Sequence
  chemically synthesized
acaatgagaacacttggaca

SEQ ID NO: 38108 - DNA, 20 bp, Artificial Sequence
  chemically synthesized
caatgagaacacttggacag

SEQ ID NO: 38109 - DNA, 20 bp, Artificial Sequence
  chemically synthesized
tgagaacacttggacagagg

SEQ ID NO: 38110 - DNA, 20 bp, Artificial Sequence
  chemically synthesized
gagaacacttggacagagga

SEQ ID NO: 38111 - DNA, 20 bp, Artificial Sequence
  chemically synthesized
agaacacttggacagaggaa

SEQ ID NO: 38112 - DNA, 20 bp, Artificial Sequence
  chemically synthesized
gaacacttggacagaggaag

SEQ ID NO: 38113 - DNA, 20 bp, Artificial Sequence
  chemically synthesized
ggaaggggaacatcacacac

SEQ ID NO: 38114 - DNA, 20 bp, Artificial Sequence
  chemically synthesized
gaaggggaacatcacacacc

SEQ ID NO: 38115 - DNA, 20 bp, Artificial Sequence
  chemically synthesized
aaggggaacatcacacacca

SEQ ID NO: 38116 - DNA, 20 bp, Artificial Sequence
  chemically synthesized
tcacacaccagggcctgttg

SEQ ID NO: 38117 - DNA, 20 bp, Artificial Sequence
  chemically synthesized
cacacaccagggcctgttgt

SEQ ID NO: 38118 - DNA, 20 bp, Artificial Sequence
  chemically synthesized
acacaccagggcctgttgtg

SEQ ID NO: 38119 - DNA, 20 bp, Artificial Sequence
  chemically synthesized
caccagggcctgttgtgggg

SEQ ID NO: 38120 - DNA, 20 bp, Artificial Sequence
  chemically synthesized
accagggcctgttgtggggt

SEQ ID NO: 38121 - DNA, 20 bp, Artificial Sequence
  chemically synthesized
ccagggcctgttgtggggtg

SEQ ID NO: 38122 - DNA, 20 bp, Artificial Sequence
  chemically synthesized
cagggcctgttgtggggtgg

SEQ ID NO: 38123 - DNA, 20 bp, Artificial Sequence
  chemically synthesized
ggcctgttgtggggtggggg

SEQ ID NO: 38124 - DNA, 20 bp, Artificial Sequence
  chemically synthesized
gcctgttgtggggtgggggt

SEQ ID NO: 38125 - DNA, 20 bp, Artificial Sequence
  chemically synthesized
cctgttgtggggtgggggtg

SEQ ID NO: 38126 - DNA, 20 bp, Artificial Sequence
  chemically synthesized
ctgttgtggggtgggggtgg

SEQ ID NO: 38127 - DNA, 20 bp, Artificial Sequence
  chemically synthesized
tgttgtggggtgggggtggg

SEQ ID NO: 38128 - DNA, 20 bp, Artificial Sequence
  chemically synthesized
tgtggggtgggggtgggggg

SEQ ID NO: 38129 - DNA, 20 bp, Artificial Sequence
  chemically synthesized
tggggtgggggtggggggtg

SEQ ID NO: 38130 - DNA, 20 bp, Artificial Sequence
  chemically synthesized
gggtgggggtggggggtgga

SEQ ID NO: 38131 - DNA, 20 bp, Artificial Sequence
  chemically synthesized
ggtgggggtggggggtggag

SEQ ID NO: 38132 - DNA, 20 bp, Artificial Sequence
  chemically synthesized
gtgggggtggggggtggaga

SEQ ID NO: 38133 - DNA, 20 bp, Artificial Sequence
  chemically synthesized
gggtggggggtggagaggga

SEQ ID NO: 38134 - DNA, 20 bp, Artificial Sequence
  chemically synthesized
ggggtggagagggatagcat

SEQ ID NO: 38135 - DNA, 20 bp, Artificial Sequence
  chemically synthesized
gggtggagagggatagcatt

SEQ ID NO: 38136 - DNA, 20 bp, Artificial Sequence
  chemically synthesized
gtggagagggatagcattag

SEQ ID NO: 38137 - DNA, 20 bp, Artificial Sequence
  chemically synthesized
atatacctaatgtaaatgat

SEQ ID NO: 38138 - DNA, 20 bp, Artificial Sequence
  chemically synthesized
taatgtaaatgatgagttaa

SEQ ID NO: 38139 - DNA, 20 bp, Artificial Sequence
  chemically synthesized
aatgtaaatgatgagttaat

SEQ ID NO: 38140 - DNA, 20 bp, Artificial Sequence
  chemically synthesized
aaatgatgagttaatgggtg

SEQ ID NO: 38141 - DNA, 20 bp, Artificial Sequence
  chemically synthesized
atgggtgcagcacaccaaca

SEQ ID NO: 38142 - DNA, 20 bp, Artificial Sequence
  chemically synthesized
cacgttgcgcacatgtaccc

SEQ ID NO: 38143 - DNA, 20 bp, Artificial Sequence
  chemically synthesized
cacatgtaccctagaactta

SEQ ID NO: 38144 - DNA, 20 bp, Artificial Sequence
  chemically synthesized
agtataataataataataaa

SEQ ID NO: 38145 - DNA, 20 bp, Artificial Sequence
  chemically synthesized
tataataataataataaaaa

SEQ ID NO: 38146 - DNA, 20 bp, Artificial Sequence
  chemically synthesized
taataaaaagagcttctgtg

SEQ ID NO: 38147 - DNA, 20 bp, Artificial Sequence
  chemically synthesized
taaaaagagcttctgtgcag

SEQ ID NO: 38148 - DNA, 20 bp, Artificial Sequence
  chemically synthesized
aaagagcttctgtgcagcag

SEQ ID NO: 38149 - DNA, 20 bp, Artificial Sequence
  chemically synthesized
gcagcagaagaaactatcaa

SEQ ID NO: 38150 - DNA, 20 bp, Artificial Sequence
  chemically synthesized
agcagaagaaactatcaaca

SEQ ID NO: 38151 - DNA, 20 bp, Artificial Sequence
  chemically synthesized
cagagtaaactgacaatcta

SEQ ID NO: 38152 - DNA, 20 bp, Artificial Sequence
  chemically synthesized
agagtaaactgacaatctac

SEQ ID NO: 38153 - DNA, 20 bp, Artificial Sequence
  chemically synthesized
taaactgacaatctacagga

SEQ ID NO: 38154 - DNA, 20 bp, Artificial Sequence
  chemically synthesized
aaactgacaatctacaggat

SEQ ID NO: 38155 - DNA, 20 bp, Artificial Sequence
  chemically synthesized
actgacaatctacaggatag

SEQ ID NO: 38156 - DNA, 20 bp, Artificial Sequence
  chemically synthesized
ctattcacaaactgtgcatc

SEQ ID NO: 38157 - DNA, 20 bp, Artificial Sequence
  chemically synthesized
cacaaactgtgcatctggaa

SEQ ID NO: 38158 - DNA, 20 bp, Artificial Sequence
  chemically synthesized
acaaactgtgcatctggaaa

SEQ ID NO: 38159 - DNA, 20 bp, Artificial Sequence
  chemically synthesized
tctggaaaaggtctaatatt

SEQ ID NO: 38160 - DNA, 20 bp, Artificial Sequence
  chemically synthesized
gtctaatattcagaatctat

SEQ ID NO: 38161 - DNA, 20 bp, Artificial Sequence
  chemically synthesized
tctaatattcagaatctata

SEQ ID NO: 38162 - DNA, 20 bp, Artificial Sequence
  chemically synthesized
tataaggaattcgaacatat

SEQ ID NO: 38163 - DNA, 20 bp, Artificial Sequence
  chemically synthesized
aggaattcgaacatatcagc

SEQ ID NO: 38164 - DNA, 20 bp, Artificial Sequence
  chemically synthesized
cgaacatatcagcaagcaaa

SEQ ID NO: 38165 - DNA, 20 bp, Artificial Sequence
  chemically synthesized
caaacaattccatttaaaaa

SEQ ID NO: 38166 - DNA, 20 bp, Artificial Sequence
  chemically synthesized
aaacaattccatttaaaaat

SEQ ID NO: 38167 - DNA, 20 bp, Artificial Sequence
  chemically synthesized
aaatgggcaaaatccacgaa

SEQ ID NO: 38168 - DNA, 20 bp, Artificial Sequence
  chemically synthesized
tccacgaacagactcttctc

SEQ ID NO: 38169 - DNA, 20 bp, Artificial Sequence
  chemically synthesized
cacgaacagactcttctcaa

SEQ ID NO: 38170 - DNA, 20 bp, Artificial Sequence
  chemically synthesized
gaacagactcttctcaagag

SEQ ID NO: 38171 - DNA, 20 bp, Artificial Sequence
  chemically synthesized
tcttctcaagagaagacata

SEQ ID NO: 38172 - DNA, 20 bp, Artificial Sequence
  chemically synthesized
cttctcaagagaagacatac

SEQ ID NO: 38173 - DNA, 20 bp, Artificial Sequence
  chemically synthesized
ctcaagagaagacatacagg

SEQ ID NO: 38174 - DNA, 20 bp, Artificial Sequence
  chemically synthesized
aaatgatcatcatcactaat

SEQ ID NO: 38175 - DNA, 20 bp, Artificial Sequence
  chemically synthesized
atgatcatcatcactaatga

SEQ ID NO: 38176 - DNA, 20 bp, Artificial Sequence
  chemically synthesized
gaaatgcaaatcaaaaccac

SEQ ID NO: 38177 - DNA, 20 bp, Artificial Sequence
  chemically synthesized
aatgcaaatcaaaaccacaa

SEQ ID NO: 38178 - DNA, 20 bp, Artificial Sequence
  chemically synthesized
caagagatactatctcatac

SEQ ID NO: 38179 - DNA, 20 bp, Artificial Sequence
  chemically synthesized
agatactatctcataccagt

SEQ ID NO: 38180 - DNA, 20 bp, Artificial Sequence
  chemically synthesized
ctatctcataccagtcagaa

SEQ ID NO: 38181 - DNA, 20 bp, Artificial Sequence
  chemically synthesized
tcagaatagctatttttaaa

SEQ ID NO: 38182 - DNA, 20 bp, Artificial Sequence
  chemically synthesized
atttttaaaaagccaaaaaa

SEQ ID NO: 38183 - DNA, 20 bp, Artificial Sequence
  chemically synthesized
gccaaaaaacagattctcat

SEQ ID NO: 38184 - DNA, 20 bp, Artificial Sequence
  chemically synthesized
ccaaaaaacagattctcatg

SEQ ID NO: 38185 - DNA, 20 bp, Artificial Sequence
  chemically synthesized
aacagattctcatgaggcta

SEQ ID NO: 38186 - DNA, 20 bp, Artificial Sequence
  chemically synthesized
cagattctcatgaggctatg

SEQ ID NO: 38187 - DNA, 20 bp, Artificial Sequence
  chemically synthesized
tctcatgaggctatggagaa

SEQ ID NO: 38188 - DNA, 20 bp, Artificial Sequence
  chemically synthesized
ctcatgaggctatggagaaa

SEQ ID NO: 38189 - DNA, 20 bp, Artificial Sequence
  chemically synthesized
tcatgaggctatggagaaaa

SEQ ID NO: 38190 - DNA, 20 bp, Artificial Sequence
  chemically synthesized
gaacacttatacaatgatga

SEQ ID NO: 38191 - DNA, 20 bp, Artificial Sequence
  chemically synthesized
aacacttatacaatgatgat

SEQ ID NO: 38192 - DNA, 20 bp, Artificial Sequence
  chemically synthesized
acacttatacaatgatgatg

SEQ ID NO: 38193 - DNA, 20 bp, Artificial Sequence
  chemically synthesized
atgatgatggggatgtaaat

SEQ ID NO: 38194 - DNA, 20 bp, Artificial Sequence
  chemically synthesized
gtaaattagttcaaccactg

SEQ ID NO: 38195 - DNA, 20 bp, Artificial Sequence
  chemically synthesized
agttcaaccactgcagaaaa

SEQ ID NO: 38196 - DNA, 20 bp, Artificial Sequence
  chemically synthesized
aaccactgcagaaaacagtt

SEQ ID NO: 38197 - DNA, 20 bp, Artificial Sequence
  chemically synthesized
ccactgcagaaaacagtttg

SEQ ID NO: 38198 - DNA, 20 bp, Artificial Sequence
  chemically synthesized
actgcagaaaacagtttgga

SEQ ID NO: 38199 - DNA, 20 bp, Artificial Sequence
  chemically synthesized
aacagtttggagagtcttca

SEQ ID NO: 38200 - DNA, 20 bp, Artificial Sequence
  chemically synthesized
gagagtcttcaaagaacttt

SEQ ID NO: 38201 - DNA, 20 bp, Artificial Sequence
  chemically synthesized
agtcttcaaagaactttaag

SEQ ID NO: 38202 - DNA, 20 bp, Artificial Sequence
  chemically synthesized
tcttcaaagaactttaagca

SEQ ID NO: 38203 - DNA, 20 bp, Artificial Sequence
  chemically synthesized
agcagagctacaatttgaca

SEQ ID NO: 38204 - DNA, 20 bp, Artificial Sequence
  chemically synthesized
tgacacagcaatcccgctac

SEQ ID NO: 38205 - DNA, 20 bp, Artificial Sequence
  chemically synthesized
gacacagcaatcccgctact

SEQ ID NO: 38206 - DNA, 20 bp, Artificial Sequence
  chemically synthesized
cgctactgggtatatatcca

SEQ ID NO: 38207 - DNA, 20 bp, Artificial Sequence
  chemically synthesized
gctactgggtatatatccat

SEQ ID NO: 38208 - DNA, 20 bp, Artificial Sequence
  chemically synthesized
ggtatatatccataggaaaa

SEQ ID NO: 38209 - DNA, 20 bp, Artificial Sequence
  chemically synthesized
tatatatccataggaaaaca

SEQ ID NO: 38210 - DNA, 20 bp, Artificial Sequence
  chemically synthesized
tccataggaaaacagagcat

SEQ ID NO: 38211 - DNA, 20 bp, Artificial Sequence
  chemically synthesized
aaacagagcattagaccaac

SEQ ID NO: 38212 - DNA, 20 bp, Artificial Sequence
  chemically synthesized
atgttcactgtaatgctgtt

SEQ ID NO: 38213 - DNA, 20 bp, Artificial Sequence
  chemically synthesized
cactgtaatgctgtttagaa

SEQ ID NO: 38214 - DNA, 20 bp, Artificial Sequence
  chemically synthesized
gaatagcaaatacaaataac

SEQ ID NO: 38215 - DNA, 20 bp, Artificial Sequence
  chemically synthesized
gcaaatacaaataactggcc

SEQ ID NO: 38216 - DNA, 20 bp, Artificial Sequence
  chemically synthesized
caaatacaaataactggcct

SEQ ID NO: 38217 - DNA, 20 bp, Artificial Sequence
  chemically synthesized
actggcctaggtgtctatca

SEQ ID NO: 38218 - DNA, 20 bp, Artificial Sequence
  chemically synthesized
ctggcctaggtgtctatcaa

SEQ ID NO: 38219 - DNA, 20 bp, Artificial Sequence
  chemically synthesized
gcctaggtgtctatcaaagg

SEQ ID NO: 38220 - DNA, 20 bp, Artificial Sequence
  chemically synthesized
aggtgtctatcaaaggcgga

SEQ ID NO: 38221 - DNA, 20 bp, Artificial Sequence
  chemically synthesized
ggtgtctatcaaaggcggac

SEQ ID NO: 38222 - DNA, 20 bp, Artificial Sequence
  chemically synthesized
tatcaaaggcggacgggata

SEQ ID NO: 38223 - DNA, 20 bp, Artificial Sequence
  chemically synthesized
cggacgggataaagaaactg

SEQ ID NO: 38224 - DNA, 20 bp, Artificial Sequence
  chemically synthesized
acatatacaccaccactatg

SEQ ID NO: 38225 - DNA, 20 bp, Artificial Sequence
  chemically synthesized
caccaccactatgtggcaat

SEQ ID NO: 38226 - DNA, 20 bp, Artificial Sequence
  chemically synthesized
aaatgaaatcatgtcctttt

SEQ ID NO: 38227 - DNA, 20 bp, Artificial Sequence
  chemically synthesized
tcatgtccttttcagcaaca

SEQ ID NO: 38228 - DNA, 20 bp, Artificial Sequence
  chemically synthesized
catgtccttttcagcaacat

SEQ ID NO: 38229 - DNA, 20 bp, Artificial Sequence
  chemically synthesized
gtccttttcagcaacatggg

SEQ ID NO: 38230 - DNA, 20 bp, Artificial Sequence
  chemically synthesized
ccttttcagcaacatgggtg

SEQ ID NO: 38231 - DNA, 20 bp, Artificial Sequence
  chemically synthesized
ttcagcaacatgggtggagc

SEQ ID NO: 38232 - DNA, 20 bp, Artificial Sequence
  chemically synthesized
cagcaacatgggtggagctg

SEQ ID NO: 38233 - DNA, 20 bp, Artificial Sequence
  chemically synthesized
agcaacatgggtggagctgg

SEQ ID NO: 38234 - DNA, 20 bp, Artificial Sequence
  chemically synthesized
gagctggaggctataatcct

SEQ ID NO: 38235 - DNA, 20 bp, Artificial Sequence
  chemically synthesized
aatcctaagcaaattaacgc

SEQ ID NO: 38236 - DNA, 20 bp, Artificial Sequence
  chemically synthesized
aaattaacgcaagaacacaa

SEQ ID NO: 38237 - DNA, 20 bp, Artificial Sequence
  chemically synthesized
taccatatattctcatttat

SEQ ID NO: 38238 - DNA, 20 bp, Artificial Sequence
  chemically synthesized
catatattctcatttataag

SEQ ID NO: 38239 - DNA, 20 bp, Artificial Sequence
  chemically synthesized
atattctcatttataagtgg

SEQ ID NO: 38240 - DNA, 20 bp, Artificial Sequence
  chemically synthesized
ataagtggaagctaaacatt

SEQ ID NO: 38241 - DNA, 20 bp, Artificial Sequence
  chemically synthesized
agctaaacattgagtacacg

SEQ ID NO: 38242 - DNA, 20 bp, Artificial Sequence
  chemically synthesized
agtacacgtggatataaaca

SEQ ID NO: 38243 - DNA, 20 bp, Artificial Sequence
  chemically synthesized
gtacacgtggatataaacat

SEQ ID NO: 38244 - DNA, 20 bp, Artificial Sequence
  chemically synthesized
ggatataaacatgggaacaa

SEQ ID NO: 38245 - DNA, 20 bp, Artificial Sequence
  chemically synthesized
tagccacttgaaactactac

SEQ ID NO: 38246 - DNA, 20 bp, Artificial Sequence
  chemically synthesized
agccacttgaaactactaca

SEQ ID NO: 38247 - DNA, 20 bp, Artificial Sequence
  chemically synthesized
gccacttgaaactactacaa

SEQ ID NO: 38248 - DNA, 20 bp, Artificial Sequence
  chemically synthesized
ccacttgaaactactacaag

SEQ ID NO: 38249 - DNA, 20 bp, Artificial Sequence
  chemically synthesized
cttgaaactactacaagggg

SEQ ID NO: 38250 - DNA, 20 bp, Artificial Sequence
  chemically synthesized
ttgaaactactacaaggggc

SEQ ID NO: 38251 - DNA, 20 bp, Artificial Sequence
  chemically synthesized
tgaaactactacaaggggca

SEQ ID NO: 38252 - DNA, 20 bp, Artificial Sequence
  chemically synthesized
aaactactacaaggggcagg

SEQ ID NO: 38253 - DNA, 20 bp, Artificial Sequence
  chemically synthesized
actactacaaggggcaggga

SEQ ID NO: 38254 - DNA, 20 bp, Artificial Sequence
  chemically synthesized
acaaggggcagggagagatg

SEQ ID NO: 38255 - DNA, 20 bp, Artificial Sequence
  chemically synthesized
caaggggcagggagagatgc

SEQ ID NO: 38256 - DNA, 20 bp, Artificial Sequence
  chemically synthesized
aggggcagggagagatgcgg

SEQ ID NO: 38257 - DNA, 20 bp, Artificial Sequence
  chemically synthesized
gggcagggagagatgcggga

SEQ ID NO: 38258 - DNA, 20 bp, Artificial Sequence
  chemically synthesized
ggcagggagagatgcgggag

SEQ ID NO: 38259 - DNA, 20 bp, Artificial Sequence
  chemically synthesized
gcagggagagatgcgggaga

SEQ ID NO: 38260 - DNA, 20 bp, Artificial Sequence
  chemically synthesized
gagagggttaaaaaatctat

SEQ ID NO: 38261 - DNA, 20 bp, Artificial Sequence
  chemically synthesized
gggttaaaaaatctattgga

SEQ ID NO: 38262 - DNA, 20 bp, Artificial Sequence
  chemically synthesized
tccatgtaaaaaacctgcac

SEQ ID NO: 38263 - DNA, 20 bp, Artificial Sequence
  chemically synthesized
acaagtacccactgtatcta

SEQ ID NO: 38264 - DNA, 20 bp, Artificial Sequence
  chemically synthesized
agtaaatgttgaaaatttaa

SEQ ID NO: 38265 - DNA, 20 bp, Artificial Sequence
  chemically synthesized
aaaaacaaataaataaaaac

SEQ ID NO: 38266 - DNA, 20 bp, Artificial Sequence
  chemically synthesized
aaacaagtctatcctgaacc

SEQ ID NO: 38267 - DNA, 20 bp, Artificial Sequence
  chemically synthesized
atcctgaacctggtatgaaa

SEQ ID NO: 38268 - DNA, 20 bp, Artificial Sequence
  chemically synthesized
tcctgaacctggtatgaaat

SEQ ID NO: 38269 - DNA, 20 bp, Artificial Sequence
  chemically synthesized
tgaacctggtatgaaatggg

SEQ ID NO: 38270 - DNA, 20 bp, Artificial Sequence
  chemically synthesized
cagtgatttttatataaaca

SEQ ID NO: 38271 - DNA, 20 bp, Artificial Sequence
  chemically synthesized
tatataaacaaagttatttt

SEQ ID NO: 38272 - DNA, 20 bp, Artificial Sequence
  chemically synthesized
tattttaagacaaaatataa

SEQ ID NO: 38273 - DNA, 20 bp, Artificial Sequence
  chemically synthesized
attttaagacaaaatataat

SEQ ID NO: 38274 - DNA, 20 bp, Artificial Sequence
  chemically synthesized
taataggcccttcatttact

SEQ ID NO: 38275 - DNA, 20 bp, Artificial Sequence
  chemically synthesized
ttcatttacttggctattaa

SEQ ID NO: 38276 - DNA, 20 bp, Artificial Sequence
  chemically synthesized
tggctattaatagatccatt

SEQ ID NO: 38277 - DNA, 20 bp, Artificial Sequence
  chemically synthesized
ggctattaatagatccattg

SEQ ID NO: 38278 - DNA, 20 bp, Artificial Sequence
  chemically synthesized
tagatccattgaggttcctg

SEQ ID NO: 38279 - DNA, 20 bp, Artificial Sequence
  chemically synthesized
ccattgaggttcctgtggat

SEQ ID NO: 38280 - DNA, 20 bp, Artificial Sequence
  chemically synthesized
gatcagaactgattttccca

SEQ ID NO: 38281 - DNA, 20 bp, Artificial Sequence
  chemically synthesized
aactgattttcccaaagtat

SEQ ID NO: 38282 - DNA, 20 bp, Artificial Sequence
  chemically synthesized
attttcccaaagtatcagaa

SEQ ID NO: 38283 - DNA, 20 bp, Artificial Sequence
  chemically synthesized
caattgaaatgcataaactc

SEQ ID NO: 38284 - DNA, 20 bp, Artificial Sequence
  chemically synthesized
aattgaaatgcataaactcc

SEQ ID NO: 38285 - DNA, 20 bp, Artificial Sequence
  chemically synthesized
aatgcataaactccaggaca

SEQ ID NO: 38286 - DNA, 20 bp, Artificial Sequence
  chemically synthesized
catgtgaccctgcattcaac

SEQ ID NO: 38287 - DNA, 20 bp, Artificial Sequence
  chemically synthesized
tcaatactttgcattgtatt

SEQ ID NO: 38288 - DNA, 20 bp, Artificial Sequence
  chemically synthesized
tactttgcattgtattgaga

SEQ ID NO: 38289 - DNA, 20 bp, Artificial Sequence
  chemically synthesized
gtattgagacagacaatgca

SEQ ID NO: 38290 - DNA, 20 bp, Artificial Sequence
  chemically synthesized
gacaatgcaaagtacacaca

SEQ ID NO: 38291 - DNA, 20 bp, Artificial Sequence
  chemically synthesized
atatactgtgtactgatgct

SEQ ID NO: 38292 - DNA, 20 bp, Artificial Sequence
  chemically synthesized
tatactgtgtactgatgctt

SEQ ID NO: 38293 - DNA, 20 bp, Artificial Sequence
  chemically synthesized
atactgtgtactgatgctta

SEQ ID NO: 38294 - DNA, 20 bp, Artificial Sequence
  chemically synthesized
tactgatgcttagggtcctg

SEQ ID NO: 38295 - DNA, 20 bp, Artificial Sequence
  chemically synthesized
actgatgcttagggtcctga

SEQ ID NO: 38296 - DNA, 20 bp, Artificial Sequence
  chemically synthesized
ctgatgcttagggtcctgaa

SEQ ID NO: 38297 - DNA, 20 bp, Artificial Sequence
  chemically synthesized
tcctgaagggtcacataatt

SEQ ID NO: 38298 - DNA, 20 bp, Artificial Sequence
  chemically synthesized
agggtcacataattaagtcc

SEQ ID NO: 38299 - DNA, 20 bp, Artificial Sequence
  chemically synthesized
taagtcctggcatcccaatg

SEQ ID NO: 38300 - DNA, 20 bp, Artificial Sequence
  chemically synthesized
agtcctggcatcccaatgta

SEQ ID NO: 38301 - DNA, 20 bp, Artificial Sequence
  chemically synthesized
gtcctggcatcccaatgtag

SEQ ID NO: 38302 - DNA, 20 bp, Artificial Sequence
  chemically synthesized
ctggcatcccaatgtagagg

SEQ ID NO: 38303 - DNA, 20 bp, Artificial Sequence
  chemically synthesized
tcccaatgtagaggtggcat

SEQ ID NO: 38304 - DNA, 20 bp, Artificial Sequence
  chemically synthesized
ccaatgtagaggtggcattg

SEQ ID NO: 38305 - DNA, 20 bp, Artificial Sequence
  chemically synthesized
agaggtggcattggagtatg

SEQ ID NO: 38306 - DNA, 20 bp, Artificial Sequence
  chemically synthesized
cagcttttctcatccatcct

SEQ ID NO: 38307 - DNA, 20 bp, Artificial Sequence
  chemically synthesized
gcttttctcatccatccttg

SEQ ID NO: 38308 - DNA, 20 bp, Artificial Sequence
  chemically synthesized
atccttggagaaatacctga

SEQ ID NO: 38309 - DNA, 20 bp, Artificial Sequence
  chemically synthesized
gagaaatacctgaaagttcc

SEQ ID NO: 38310 - DNA, 20 bp, Artificial Sequence
  chemically synthesized
agaaatacctgaaagttccg

SEQ ID NO: 38311 - DNA, 20 bp, Artificial Sequence
  chemically synthesized
cctgaaagttccgaggacat

SEQ ID NO: 38312 - DNA, 20 bp, Artificial Sequence
  chemically synthesized
aagttccgaggacattggtt

SEQ ID NO: 38313 - DNA, 20 bp, Artificial Sequence
  chemically synthesized
ttgagcgtccctgcttctcc

SEQ ID NO: 38314 - DNA, 20 bp, Artificial Sequence
  chemically synthesized
gcgtccctgcttctcccaga

SEQ ID NO: 38315 - DNA, 20 bp, Artificial Sequence
  chemically synthesized
gtccctgcttctcccagaca

SEQ ID NO: 38316 - DNA, 20 bp, Artificial Sequence
  chemically synthesized
tccctgcttctcccagacag

SEQ ID NO: 38317 - DNA, 20 bp, Artificial Sequence
  chemically synthesized
cctgcttctcccagacagag

SEQ ID NO: 38318 - DNA, 20 bp, Artificial Sequence
  chemically synthesized
ctgcttctcccagacagagg

SEQ ID NO: 38319 - DNA, 20 bp, Artificial Sequence
  chemically synthesized
tgcttctcccagacagagga

SEQ ID NO: 38320 - DNA, 20 bp, Artificial Sequence
  chemically synthesized
cttctcccagacagaggagg

SEQ ID NO: 38321 - DNA, 20 bp, Artificial Sequence
  chemically synthesized
ttctcccagacagaggaggg

SEQ ID NO: 38322 - DNA, 20 bp, Artificial Sequence
  chemically synthesized
tctcccagacagaggaggga

SEQ ID NO: 38323 - DNA, 20 bp, Artificial Sequence
  chemically synthesized
ctcccagacagaggagggag

SEQ ID NO: 38324 - DNA, 20 bp, Artificial Sequence
  chemically synthesized
cccagacagaggagggaggg

SEQ ID NO: 38325 - DNA, 20 bp, Artificial Sequence
  chemically synthesized
cagaggagggaggggagatc

SEQ ID NO: 38326 - DNA, 20 bp, Artificial Sequence
  chemically synthesized
agaggagggaggggagatca

SEQ ID NO: 38327 - DNA, 20 bp, Artificial Sequence
  chemically synthesized
gaggagggaggggagatcaa

SEQ ID NO: 38328 - DNA, 20 bp, Artificial Sequence
  chemically synthesized
gggagatcaagggttcttct

SEQ ID NO: 38329 - DNA, 20 bp, Artificial Sequence
  chemically synthesized
caagggttcttctgagtatt

SEQ ID NO: 38330 - DNA, 20 bp, Artificial Sequence
  chemically synthesized
ggttcttctgagtatttgga

SEQ ID NO: 38331 - DNA, 20 bp, Artificial Sequence
  chemically synthesized
ttcttctgagtatttggaaa

SEQ ID NO: 38332 - DNA, 20 bp, Artificial Sequence
  chemically synthesized
tcttctgagtatttggaaag

SEQ ID NO: 38333 - DNA, 20 bp, Artificial Sequence
  chemically synthesized
tatttggaaagaggaaactc

SEQ ID NO: 38334 - DNA, 20 bp, Artificial Sequence
  chemically synthesized
atttggaaagaggaaactct

SEQ ID NO: 38335 - DNA, 20 bp, Artificial Sequence
  chemically synthesized
tttggaaagaggaaactctg

SEQ ID NO: 38336 - DNA, 20 bp, Artificial Sequence
  chemically synthesized
ggaaagaggaaactctgggg

SEQ ID NO: 38337 - DNA, 20 bp, Artificial Sequence
  chemically synthesized
catacataaactctctaatt

SEQ ID NO: 38338 - DNA, 20 bp, Artificial Sequence
  chemically synthesized
ctctaatttggcctcttgaa

SEQ ID NO: 38339 - DNA, 20 bp, Artificial Sequence
  chemically synthesized
tggcctcttgaatagtcttt

SEQ ID NO: 38340 - DNA, 20 bp, Artificial Sequence
  chemically synthesized
cctcttgaatagtctttgag

SEQ ID NO: 38341 - DNA, 20 bp, Artificial Sequence
  chemically synthesized
ttgaatagtctttgagaagt

SEQ ID NO: 38342 - DNA, 20 bp, Artificial Sequence
  chemically synthesized
gagaagtgagtgtctgaact

SEQ ID NO: 38343 - DNA, 20 bp, Artificial Sequence
  chemically synthesized
gtctgaactgagtcttcaaa

SEQ ID NO: 38344 - DNA, 20 bp, Artificial Sequence
  chemically synthesized
ctgaactgagtcttcaaata

SEQ ID NO: 38345 - DNA, 20 bp, Artificial Sequence
  chemically synthesized
aactgagtcttcaaatagag

SEQ ID NO: 38346 - DNA, 20 bp, Artificial Sequence
  chemically synthesized
actgagtcttcaaatagagc

SEQ ID NO: 38347 - DNA, 20 bp, Artificial Sequence
  chemically synthesized
gtcttcaaatagagcaggaa

SEQ ID NO: 38348 - DNA, 20 bp, Artificial Sequence
  chemically synthesized
tcttcaaatagagcaggaat

SEQ ID NO: 38349 - DNA, 20 bp, Artificial Sequence
  chemically synthesized
gcaggaatgggtccttattc

SEQ ID NO: 38350 - DNA, 20 bp, Artificial Sequence
  chemically synthesized
gaatgggtccttattccagc

SEQ ID NO: 38351 - DNA, 20 bp, Artificial Sequence
  chemically synthesized
ttattccagcaagaaaatga

SEQ ID NO: 38352 - DNA, 20 bp, Artificial Sequence
  chemically synthesized
ccagcaagaaaatgacagca

SEQ ID NO: 38353 - DNA, 20 bp, Artificial Sequence
  chemically synthesized
cagcaagaaaatgacagcat

SEQ ID NO: 38354 - DNA, 20 bp, Artificial Sequence
  chemically synthesized
aagaaaatgacagcataggt

SEQ ID NO: 38355 - DNA, 20 bp, Artificial Sequence
  chemically synthesized
atgacagcataggtgagtgc

SEQ ID NO: 38356 - DNA, 20 bp, Artificial Sequence
  chemically synthesized
tgacagcataggtgagtgcc

SEQ ID NO: 38357 - DNA, 20 bp, Artificial Sequence
  chemically synthesized
gcataggtgagtgccaggaa

SEQ ID NO: 38358 - DNA, 20 bp, Artificial Sequence
  chemically synthesized
cataggtgagtgccaggaac

SEQ ID NO: 38359 - DNA, 20 bp, Artificial Sequence
  chemically synthesized
tgagtgccaggaacaggaat

SEQ ID NO: 38360 - DNA, 20 bp, Artificial Sequence
  chemically synthesized
gagtgccaggaacaggaata

SEQ ID NO: 38361 - DNA, 20 bp, Artificial Sequence
  chemically synthesized
attcctcttccttcttatgt

SEQ ID NO: 38362 - DNA, 20 bp, Artificial Sequence
  chemically synthesized
cttccttcttatgttagatg

SEQ ID NO: 38363 - DNA, 20 bp, Artificial Sequence
  chemically synthesized
ttcttatgttagatgcagcg

SEQ ID NO: 38364 - DNA, 20 bp, Artificial Sequence
  chemically synthesized
cttatgttagatgcagcgaa

SEQ ID NO: 38365 - DNA, 20 bp, Artificial Sequence
  chemically synthesized
atgttagatgcagcgaagag

SEQ ID NO: 38366 - DNA, 20 bp, Artificial Sequence
  chemically synthesized
tagatgcagcgaagagaaga

SEQ ID NO: 38367 - DNA, 20 bp, Artificial Sequence
  chemically synthesized
agatgcagcgaagagaagat

SEQ ID NO: 38368 - DNA, 20 bp, Artificial Sequence
  chemically synthesized
tgcagcgaagagaagatagg

SEQ ID NO: 38369 - DNA, 20 bp, Artificial Sequence
  chemically synthesized
agagaagataggaagatttt

SEQ ID NO: 38370 - DNA, 20 bp, Artificial Sequence
  chemically synthesized
agaagataggaagattttca

SEQ ID NO: 38371 - DNA, 20 bp, Artificial Sequence
  chemically synthesized
gaagataggaagattttcag

SEQ ID NO: 38372 - DNA, 20 bp, Artificial Sequence
  chemically synthesized
aagattttcagaggtctgca

SEQ ID NO: 38373 - DNA, 20 bp, Artificial Sequence
  chemically synthesized
agattttcagaggtctgcat

SEQ ID NO: 38374 - DNA, 20 bp, Artificial Sequence
  chemically synthesized
attttcagaggtctgcatag

SEQ ID NO: 38375 - DNA, 20 bp, Artificial Sequence
  chemically synthesized
ataggagaacatactccatc

SEQ ID NO: 38376 - DNA, 20 bp, Artificial Sequence
  chemically synthesized
taggagaacatactccatct

SEQ ID NO: 38377 - DNA, 20 bp, Artificial Sequence
  chemically synthesized
tctgggatgaccaacaccta

SEQ ID NO: 38378 - DNA, 20 bp, Artificial Sequence
  chemically synthesized
gatgaccaacacctaaagca

SEQ ID NO: 38379 - DNA, 20 bp, Artificial Sequence
  chemically synthesized
ttcatctcaacacatgtttc

SEQ ID NO: 38380 - DNA, 20 bp, Artificial Sequence
  chemically synthesized
tcatctcaacacatgtttca

SEQ ID NO: 38381 - DNA, 20 bp, Artificial Sequence
  chemically synthesized
tctcaacacatgtttcaagg

SEQ ID NO: 38382 - DNA, 20 bp, Artificial Sequence
  chemically synthesized
ctcaacacatgtttcaaggc

SEQ ID NO: 38383 - DNA, 20 bp, Artificial Sequence
  chemically synthesized
catgtttcaaggcaggcttg

SEQ ID NO: 38384 - DNA, 20 bp, Artificial Sequence
  chemically synthesized
caggcttgaagtttcaaatg

SEQ ID NO: 38385 - DNA, 20 bp, Artificial Sequence
  chemically synthesized
agtttcaaatgtggtgctca

SEQ ID NO: 38386 - DNA, 20 bp, Artificial Sequence
  chemically synthesized
caaatgtggtgctcatggat

SEQ ID NO: 38387 - DNA, 20 bp, Artificial Sequence
  chemically synthesized
tggtgctcatggattagctt

SEQ ID NO: 38388 - DNA, 20 bp, Artificial Sequence
  chemically synthesized
ggtgctcatggattagcttc

SEQ ID NO: 38389 - DNA, 20 bp, Artificial Sequence
  chemically synthesized
ggaaaacgtgtgaatatttt

SEQ ID NO: 38390 - DNA, 20 bp, Artificial Sequence
  chemically synthesized
cttttgtccatttttctcca

SEQ ID NO: 38391 - DNA, 20 bp, Artificial Sequence
  chemically synthesized
tttgtccatttttctccaca

SEQ ID NO: 38392 - DNA, 20 bp, Artificial Sequence
  chemically synthesized
ttgtccatttttctccacag

SEQ ID NO: 38393 - DNA, 20 bp, Artificial Sequence
  chemically synthesized
tgtccatttttctccacaga

SEQ ID NO: 38394 - DNA, 20 bp, Artificial Sequence
  chemically synthesized
ttttctccacagagggctca

SEQ ID NO: 38395 - DNA, 20 bp, Artificial Sequence
  chemically synthesized
agagggctcatggcttttgt

SEQ ID NO: 38396 - DNA, 20 bp, Artificial Sequence
  chemically synthesized
ttctatttcaaaactaaaca

SEQ ID NO: 38397 - DNA, 20 bp, Artificial Sequence
  chemically synthesized
tttcaaaactaaacaaagaa

SEQ ID NO: 38398 - DNA, 20 bp, Artificial Sequence
  chemically synthesized
tgaaacataaaataaaaatc

SEQ ID NO: 38399 - DNA, 20 bp, Artificial Sequence
  chemically synthesized
atgtatccaaatatgcaatt

SEQ ID NO: 38400 - DNA, 20 bp, Artificial Sequence
  chemically synthesized
tccaaatatgcaattaagct

SEQ ID NO: 38401 - DNA, 20 bp, Artificial Sequence
  chemically synthesized
aaatatgcaattaagctaag

SEQ ID NO: 38402 - DNA, 20 bp, Artificial Sequence
  chemically synthesized
tatgcaattaagctaagcag

SEQ ID NO: 38403 - DNA, 20 bp, Artificial Sequence
  chemically synthesized
atgcaattaagctaagcagc

SEQ ID NO: 38404 - DNA, 20 bp, Artificial Sequence
  chemically synthesized
gccttcttttttgttactat

SEQ ID NO: 38405 - DNA, 20 bp, Artificial Sequence
  chemically synthesized
ctattggttcaaacattgtg

SEQ ID NO: 38406 - DNA, 20 bp, Artificial Sequence
  chemically synthesized
tggttcaaacattgtgcagc

SEQ ID NO: 38407 - DNA, 20 bp, Artificial Sequence
  chemically synthesized
attgtgcagcaagcacacca

SEQ ID NO: 38408 - DNA, 20 bp, Artificial Sequence
  chemically synthesized
tgtgcagcaagcacaccaca

SEQ ID NO: 38409 - DNA, 20 bp, Artificial Sequence
  chemically synthesized
gtgcagcaagcacaccacag

SEQ ID NO: 38410 - DNA, 20 bp, Artificial Sequence
  chemically synthesized
tgcagcaagcacaccacaga

SEQ ID NO: 38411 - DNA, 20 bp, Artificial Sequence
  chemically synthesized
gcagcaagcacaccacagag

SEQ ID NO: 38412 - DNA, 20 bp, Artificial Sequence
  chemically synthesized
attttttaaaatgtgttttt

SEQ ID NO: 38413 - DNA, 20 bp, Artificial Sequence
  chemically synthesized
taaaatgtgttttttagatt

SEQ ID NO: 38414 - DNA, 20 bp, Artificial Sequence
  chemically synthesized
tacttaattattcataactg

SEQ ID NO: 38415 - DNA, 20 bp, Artificial Sequence
  chemically synthesized
tgatcatcattccttatctc

SEQ ID NO: 38416 - DNA, 20 bp, Artificial Sequence
  chemically synthesized
atcattccttatctctagca

SEQ ID NO: 38417 - DNA, 20 bp, Artificial Sequence
  chemically synthesized
taaatgtattgctcttctat

SEQ ID NO: 38418 - DNA, 20 bp, Artificial Sequence
  chemically synthesized
ttattgctaaatatgaatat

SEQ ID NO: 38419 - DNA, 20 bp, Artificial Sequence
  chemically synthesized
tattgctaaatatgaatatt

SEQ ID NO: 38420 - DNA, 20 bp, Artificial Sequence
  chemically synthesized
taaatatgaatattaggatt

SEQ ID NO: 38421 - DNA, 20 bp, Artificial Sequence
  chemically synthesized
aaatatgaatattaggattg

SEQ ID NO: 38422 - DNA, 20 bp, Artificial Sequence
  chemically synthesized
gaatattaggattgaggctg

SEQ ID NO: 38423 - DNA, 20 bp, Artificial Sequence
  chemically synthesized
ggattgaggctgcagaaata

SEQ ID NO: 38424 - DNA, 20 bp, Artificial Sequence
  chemically synthesized
ctgcagaaatacagtttcac

SEQ ID NO: 38425 - DNA, 20 bp, Artificial Sequence
  chemically synthesized
cagaaatacagtttcacaag

SEQ ID NO: 38426 - DNA, 20 bp, Artificial Sequence
  chemically synthesized
agaaatacagtttcacaaga

SEQ ID NO: 38427 - DNA, 20 bp, Artificial Sequence
  chemically synthesized
aatacagtttcacaagaagg

SEQ ID NO: 38428 - DNA, 20 bp, Artificial Sequence
  chemically synthesized
agaaggtagtaaaaactgat

SEQ ID NO: 38429 - DNA, 20 bp, Artificial Sequence
  chemically synthesized
gaaggtagtaaaaactgata

SEQ ID NO: 38430 - DNA, 20 bp, Artificial Sequence
  chemically synthesized
ggtagtaaaaactgataagg

SEQ ID NO: 38431 - DNA, 20 bp, Artificial Sequence
  chemically synthesized
gtagtaaaaactgataaggc

SEQ ID NO: 38432 - DNA, 20 bp, Artificial Sequence
  chemically synthesized
tagtaaaaactgataaggca

SEQ ID NO: 38433 - DNA, 20 bp, Artificial Sequence
  chemically synthesized
aactgataaggcagggattt

SEQ ID NO: 38434 - DNA, 20 bp, Artificial Sequence
  chemically synthesized
aggcagggatttcagtgtaa

SEQ ID NO: 38435 - DNA, 20 bp, Artificial Sequence
  chemically synthesized
tcagtgtaatagtttctata

SEQ ID NO: 38436 - DNA, 20 bp, Artificial Sequence
  chemically synthesized
ccacttgtgaacacacaatg

SEQ ID NO: 38437 - DNA, 20 bp, Artificial Sequence
  chemically synthesized
gcggctccttttttgctgcc

SEQ ID NO: 38438 - DNA, 20 bp, Artificial Sequence
  chemically synthesized
ttttttgctgcctggctttt

SEQ ID NO: 38439 - DNA, 20 bp, Artificial Sequence
  chemically synthesized
gctgcctggcttttcagtac

SEQ ID NO: 38440 - DNA, 20 bp, Artificial Sequence
  chemically synthesized
tgcctggcttttcagtactg

SEQ ID NO: 38441 - DNA, 20 bp, Artificial Sequence
  chemically synthesized
gcctggcttttcagtactgg

SEQ ID NO: 38442 - DNA, 20 bp, Artificial Sequence
  chemically synthesized
gtttatgtgtgcgtccttct

SEQ ID NO: 38443 - DNA, 20 bp, Artificial Sequence
  chemically synthesized
gtgtgcgtccttcttggcaa

SEQ ID NO: 38444 - DNA, 20 bp, Artificial Sequence
  chemically synthesized
gcgtccttcttggcaatggc

SEQ ID NO: 38445 - DNA, 20 bp, Artificial Sequence
  chemically synthesized
gcaagctcctctacctcatc

SEQ ID NO: 38446 - DNA, 20 bp, Artificial Sequence
  chemically synthesized
tacctcatcaagcatgacca

SEQ ID NO: 38447 - DNA, 20 bp, Artificial Sequence
  chemically synthesized
tactgtttccttgccacact

SEQ ID NO: 38448 - DNA, 20 bp, Artificial Sequence
  chemically synthesized
actgtttccttgccacactg

SEQ ID NO: 38449 - DNA, 20 bp, Artificial Sequence
  chemically synthesized
tttccttgccacactgaggc

SEQ ID NO: 38450 - DNA, 20 bp, Artificial Sequence
  chemically synthesized
cacactgaggcaagacctca

SEQ ID NO: 38451 - DNA, 20 bp, Artificial Sequence
  chemically synthesized
gaccatgatgcccactgtaa

SEQ ID NO: 38452 - DNA, 20 bp, Artificial Sequence
  chemically synthesized
accatgatgcccactgtaat

SEQ ID NO: 38453 - DNA, 20 bp, Artificial Sequence
  chemically synthesized
ccactgtaatgggcgtcttg

SEQ ID NO: 38454 - DNA, 20 bp, Artificial Sequence
  chemically synthesized
cgtcttgtggatgaatcaca

SEQ ID NO: 38455 - DNA, 20 bp, Artificial Sequence
  chemically synthesized
tcttgtggatgaatcacaaa

SEQ ID NO: 38456 - DNA, 20 bp, Artificial Sequence
  chemically synthesized
cttgtggatgaatcacaaag

SEQ ID NO: 38457 - DNA, 20 bp, Artificial Sequence
  chemically synthesized
aatcacaaagaggttatcca

SEQ ID NO: 38458 - DNA, 20 bp, Artificial Sequence
  chemically synthesized
atcacaaagaggttatccat

SEQ ID NO: 38459 - DNA, 20 bp, Artificial Sequence
  chemically synthesized
tcacaaagaggttatccatg

SEQ ID NO: 38460 - DNA, 20 bp, Artificial Sequence
  chemically synthesized
tccatggggcctgcttcttg

SEQ ID NO: 38461 - DNA, 20 bp, Artificial Sequence
  chemically synthesized
ccatggggcctgcttcttgc

SEQ ID NO: 38462 - DNA, 20 bp, Artificial Sequence
  chemically synthesized
ccactcccattatccacttg

SEQ ID NO: 38463 - DNA, 20 bp, Artificial Sequence
  chemically synthesized
ccattatccacttgcagaat

SEQ ID NO: 38464 - DNA, 20 bp, Artificial Sequence
  chemically synthesized
cattatccacttgcagaatc

SEQ ID NO: 38465 - DNA, 20 bp, Artificial Sequence
  chemically synthesized
atcaggtattctcctgtcaa

SEQ ID NO: 38466 - DNA, 20 bp, Artificial Sequence
  chemically synthesized
attatcatccacatgcttct

SEQ ID NO: 38467 - DNA, 20 bp, Artificial Sequence
  chemically synthesized
ttatcatccacatgcttctc

SEQ ID NO: 38468 - DNA, 20 bp, Artificial Sequence
  chemically synthesized
taactatttctactaaatct

SEQ ID NO: 38469 - DNA, 20 bp, Artificial Sequence
  chemically synthesized
aactatttctactaaatctt

SEQ ID NO: 38470 - DNA, 20 bp, Artificial Sequence
  chemically synthesized
tttctactaaatcttgggtg

SEQ ID NO: 38471 - DNA, 20 bp, Artificial Sequence
  chemically synthesized
tactaaatcttgggtgaaga

SEQ ID NO: 38472 - DNA, 20 bp, Artificial Sequence
  chemically synthesized
cttgggtgaagatagaactg

SEQ ID NO: 38473 - DNA, 20 bp, Artificial Sequence
  chemically synthesized
atagaactgtggctatttat

SEQ ID NO: 38474 - DNA, 20 bp, Artificial Sequence
  chemically synthesized
tagaactgtggctatttatg

SEQ ID NO: 38475 - DNA, 20 bp, Artificial Sequence
  chemically synthesized
agaactgtggctatttatga

SEQ ID NO: 38476 - DNA, 20 bp, Artificial Sequence
  chemically synthesized
ccacaccttttttctccatc

SEQ ID NO: 38477 - DNA, 20 bp, Artificial Sequence
  chemically synthesized
tacattcaatcacttatacc

SEQ ID NO: 38478 - DNA, 20 bp, Artificial Sequence
  chemically synthesized
tcacttatacccagctattc

SEQ ID NO: 38479 - DNA, 20 bp, Artificial Sequence
  chemically synthesized
ggttgctttgattttcttcc

SEQ ID NO: 38480 - DNA, 20 bp, Artificial Sequence
  chemically synthesized
ttatatcctgatccttaaaa

SEQ ID NO: 38481 - DNA, 20 bp, Artificial Sequence
  chemically synthesized
cctgatccttaaaacagtta

SEQ ID NO: 38482 - DNA, 20 bp, Artificial Sequence
  chemically synthesized
ctgatccttaaaacagttaa

SEQ ID NO: 38483 - DNA, 20 bp, Artificial Sequence
  chemically synthesized
acagttaaaggtattgcctc

SEQ ID NO: 38484 - DNA, 20 bp, Artificial Sequence
  chemically synthesized
taaaggtattgcctccagaa

SEQ ID NO: 38485 - DNA, 20 bp, Artificial Sequence
  chemically synthesized
aaggtattgcctccagaaaa

SEQ ID NO: 38486 - DNA, 20 bp, Artificial Sequence
  chemically synthesized
tattgcctccagaaaagagc

SEQ ID NO: 38487 - DNA, 20 bp, Artificial Sequence
  chemically synthesized
ctccagaaaagagcaagcca

SEQ ID NO: 38488 - DNA, 20 bp, Artificial Sequence
  chemically synthesized
aacatgtgtgtctcccatat

SEQ ID NO: 38489 - DNA, 20 bp, Artificial Sequence
  chemically synthesized
ctcccatatcagctgtgtct

SEQ ID NO: 38490 - DNA, 20 bp, Artificial Sequence
  chemically synthesized
gtatttcacatcaccgtgat

SEQ ID NO: 38491 - DNA, 20 bp, Artificial Sequence
  chemically synthesized
ttcacatcaccgtgatcagt

SEQ ID NO: 38492 - DNA, 20 bp, Artificial Sequence
  chemically synthesized
atcagtgagactttcattca

SEQ ID NO: 38493 - DNA, 20 bp, Artificial Sequence
  chemically synthesized
tcagtgagactttcattcac

SEQ ID NO: 38494 - DNA, 20 bp, Artificial Sequence
  chemically synthesized
gagactttcattcacaggtt

SEQ ID NO: 38495 - DNA, 20 bp, Artificial Sequence
  chemically synthesized
agactttcattcacaggttt

SEQ ID NO: 38496 - DNA, 20 bp, Artificial Sequence
  chemically synthesized
tgggaaacatgcaccacatg

SEQ ID NO: 38497 - DNA, 20 bp, Artificial Sequence
  chemically synthesized
catgtggtgcacattaccgt

SEQ ID NO: 38498 - DNA, 20 bp, Artificial Sequence
  chemically synthesized
ttcatgaaccctattatata

SEQ ID NO: 38499 - DNA, 20 bp, Artificial Sequence
  chemically synthesized
attatatacagcatcaaacc

SEQ ID NO: 38500 - DNA, 20 bp, Artificial Sequence
  chemically synthesized
atatacagcatcaaaccaag

SEQ ID NO: 38501 - DNA, 20 bp, Artificial Sequence
  chemically synthesized
catcaaaccaagcagatcca

SEQ ID NO: 38502 - DNA, 20 bp, Artificial Sequence
  chemically synthesized
caaaccaagcagatccaaag

SEQ ID NO: 38503 - DNA, 20 bp, Artificial Sequence
  chemically synthesized
agcattgttcgcctattttc

SEQ ID NO: 38504 - DNA, 20 bp, Artificial Sequence
  chemically synthesized
gcattgttcgcctattttct

SEQ ID NO: 38505 - DNA, 20 bp, Artificial Sequence
  chemically synthesized
gttcgcctattttctgggca

SEQ ID NO: 38506 - DNA, 20 bp, Artificial Sequence
  chemically synthesized
cctattttctgggcacagaa

SEQ ID NO: 38507 - DNA, 20 bp, Artificial Sequence
  chemically synthesized
ttctgggcacagaatggctt

SEQ ID NO: 38508 - DNA, 20 bp, Artificial Sequence
  chemically synthesized
aatggcttgagccctttttt

SEQ ID NO: 38509 - DNA, 20 bp, Artificial Sequence
  chemically synthesized
tttgtgatcttcatgatttc

SEQ ID NO: 38510 - DNA, 20 bp, Artificial Sequence
  chemically synthesized
ttgtgatcttcatgatttct

SEQ ID NO: 38511 - DNA, 20 bp, Artificial Sequence
  chemically synthesized
tcatgatttctgggcctttt

SEQ ID NO: 38512 - DNA, 20 bp, Artificial Sequence
  chemically synthesized
ttctgggccttttgagtaat

SEQ ID NO: 38513 - DNA, 20 bp, Artificial Sequence
  chemically synthesized
gggccttttgagtaattgga

SEQ ID NO: 38514 - DNA, 20 bp, Artificial Sequence
  chemically synthesized
ggccttttgagtaattggaa

SEQ ID NO: 38515 - DNA, 20 bp, Artificial Sequence
  chemically synthesized
ccttttgagtaattggaaag

SEQ ID NO: 38516 - DNA, 20 bp, Artificial Sequence
  chemically synthesized
atacccaatatctcttgtat

SEQ ID NO: 38517 - DNA, 20 bp, Artificial Sequence
  chemically synthesized
aatatctcttgtatcagtgt

SEQ ID NO: 38518 - DNA, 20 bp, Artificial Sequence
  chemically synthesized
tctcttgtatcagtgttaga

SEQ ID NO: 38519 - DNA, 20 bp, Artificial Sequence
  chemically synthesized
ctcttgtatcagtgttagat

SEQ ID NO: 38520 - DNA, 20 bp, Artificial Sequence
  chemically synthesized
taggctttaactattatcta

SEQ ID NO: 38521 - DNA, 20 bp, Artificial Sequence
  chemically synthesized
taactattatctaaagtgaa

SEQ ID NO: 38522 - DNA, 20 bp, Artificial Sequence
  chemically synthesized
atctaaagtgaaaagctaca

SEQ ID NO: 38523 - DNA, 20 bp, Artificial Sequence
  chemically synthesized
tgtataaatgtattcatatg

SEQ ID NO: 38524 - DNA, 20 bp, Artificial Sequence
  chemically synthesized
tgtattcatatgtagatgta

SEQ ID NO: 38525 - DNA, 20 bp, Artificial Sequence
  chemically synthesized
tgtagatgtaaagctttatc

SEQ ID NO: 38526 - DNA, 20 bp, Artificial Sequence
  chemically synthesized
gtagatgtaaagctttatcg

SEQ ID NO: 38527 - DNA, 20 bp, Artificial Sequence
  chemically synthesized
tagatgtaaagctttatcga

SEQ ID NO: 38528 - DNA, 20 bp, Artificial Sequence
  chemically synthesized
gatgtaaagctttatcgagg

SEQ ID NO: 38529 - DNA, 20 bp, Artificial Sequence
  chemically synthesized
ctataatttacctatctatt

SEQ ID NO: 38530 - DNA, 20 bp, Artificial Sequence
  chemically synthesized
ataatttacctatctattga

SEQ ID NO: 38531 - DNA, 20 bp, Artificial Sequence
  chemically synthesized
acctatctattgagagatac

SEQ ID NO: 38532 - DNA, 20 bp, Artificial Sequence
  chemically synthesized
cctatctattgagagatact

SEQ ID NO: 38533 - DNA, 20 bp, Artificial Sequence
  chemically synthesized
tctattgagagatactagga

SEQ ID NO: 38534 - DNA, 20 bp, Artificial Sequence
  chemically synthesized
attgagagatactaggaaag

SEQ ID NO: 38535 - DNA, 20 bp, Artificial Sequence
  chemically synthesized
aagtggaatactattgaata

SEQ ID NO: 38536 - DNA, 20 bp, Artificial Sequence
  chemically synthesized
gtggaatactattgaatatg

SEQ ID NO: 38537 - DNA, 20 bp, Artificial Sequence
  chemically synthesized
gaatatggagataaaacatg

SEQ ID NO: 38538 - DNA, 20 bp, Artificial Sequence
  chemically synthesized
tagataaataccctaataat

SEQ ID NO: 38539 - DNA, 20 bp, Artificial Sequence
  chemically synthesized
agataaataccctaataatc

SEQ ID NO: 38540 - DNA, 20 bp, Artificial Sequence
  chemically synthesized
gataaataccctaataatca

SEQ ID NO: 38541 - DNA, 20 bp, Artificial Sequence
  chemically synthesized
cctaataatcagggaaaata

SEQ ID NO: 38542 - DNA, 20 bp, Artificial Sequence
  chemically synthesized
tattcataacctgtattcat

SEQ ID NO: 38543 - DNA, 20 bp, Artificial Sequence
  chemically synthesized
cctgtattcataagaactga

SEQ ID NO: 38544 - DNA, 20 bp, Artificial Sequence
  chemically synthesized
aagaactgaaagtaccattt

SEQ ID NO: 38545 - DNA, 20 bp, Artificial Sequence
  chemically synthesized
agaactgaaagtaccatttt

SEQ ID NO: 38546 - DNA, 20 bp, Artificial Sequence
  chemically synthesized
actgaaagtaccattttagg

SEQ ID NO: 38547 - DNA, 20 bp, Artificial Sequence
  chemically synthesized
tgaaagtaccattttaggaa

SEQ ID NO: 38548 - DNA, 20 bp, Artificial Sequence
  chemically synthesized
gtaccattttaggaagagtc

SEQ ID NO: 38549 - DNA, 20 bp, Artificial Sequence
  chemically synthesized
ccattttaggaagagtcaag

SEQ ID NO: 38550 - DNA, 20 bp, Artificial Sequence
  chemically synthesized
tttaggaagagtcaagtggc

SEQ ID NO: 38551 - DNA, 20 bp, Artificial Sequence
  chemically synthesized
gaagagtcaagtggccagtc

SEQ ID NO: 38552 - DNA, 20 bp, Artificial Sequence
  chemically synthesized
tggccagtctagttcaacca

SEQ ID NO: 38553 - DNA, 20 bp, Artificial Sequence
  chemically synthesized
tctagttcaaccaaagccta

SEQ ID NO: 38554 - DNA, 20 bp, Artificial Sequence
  chemically synthesized
agttcaaccaaagcctacag

SEQ ID NO: 38555 - DNA, 20 bp, Artificial Sequence
  chemically synthesized
gttcaaccaaagcctacaga

SEQ ID NO: 38556 - DNA, 20 bp, Artificial Sequence
  chemically synthesized
gaaggaaaaatgtgcaattg

SEQ ID NO: 38557 - DNA, 20 bp, Artificial Sequence
  chemically synthesized
aaaatgtgcaattgcagatc

SEQ ID NO: 38558 - DNA, 20 bp, Artificial Sequence
  chemically synthesized
tgcaattgcagatctagttt

SEQ ID NO: 38559 - DNA, 20 bp, Artificial Sequence
  chemically synthesized
gatctagttttggccatata

SEQ ID NO: 38560 - DNA, 20 bp, Artificial Sequence
  chemically synthesized
ggccatataaagatgaatta

SEQ ID NO: 38561 - DNA, 20 bp, Artificial Sequence
  chemically synthesized
tgaattatagcatgtgaatt

SEQ ID NO: 38562 - DNA, 20 bp, Artificial Sequence
  chemically synthesized
gaattatagcatgtgaattg

SEQ ID NO: 38563 - DNA, 20 bp, Artificial Sequence
  chemically synthesized
tagcatgtgaattgaggtca

SEQ ID NO: 38564 - DNA, 20 bp, Artificial Sequence
  chemically synthesized
atctcaaaactactctattt

SEQ ID NO: 38565 - DNA, 20 bp, Artificial Sequence
  chemically synthesized
tctcaaaactactctatttc

SEQ ID NO: 38566 - DNA, 20 bp, Artificial Sequence
  chemically synthesized
ctcaaaactactctatttca

SEQ ID NO: 38567 - DNA, 20 bp, Artificial Sequence
  chemically synthesized
aaaactactctatttcaggg

SEQ ID NO: 38568 - DNA, 20 bp, Artificial Sequence
  chemically synthesized
ttttttttttttttttaaaa

SEQ ID NO: 38569 - DNA, 20 bp, Artificial Sequence
  chemically synthesized
tttattttccttcaacttat

SEQ ID NO: 38570 - DNA, 20 bp, Artificial Sequence
  chemically synthesized
ttattttccttcaacttatt

SEQ ID NO: 38571 - DNA, 20 bp, Artificial Sequence
  chemically synthesized
ttttccttcaacttattagg

SEQ ID NO: 38572 - DNA, 20 bp, Artificial Sequence
  chemically synthesized
tttccttcaacttattaggt

SEQ ID NO: 38573 - DNA, 20 bp, Artificial Sequence
  chemically synthesized
caacttattaggtaggtgca

SEQ ID NO: 38574 - DNA, 20 bp, Artificial Sequence
  chemically synthesized
aacttattaggtaggtgcaa

SEQ ID NO: 38575 - DNA, 20 bp, Artificial Sequence
  chemically synthesized
ggtaggtgcaaaggtaattg

SEQ ID NO: 38576 - DNA, 20 bp, Artificial Sequence
  chemically synthesized
gcaaaggtaattgcagttca

SEQ ID NO: 38577 - DNA, 20 bp, Artificial Sequence
  chemically synthesized
gtaccaacataatatatttt

SEQ ID NO: 38578 - DNA, 20 bp, Artificial Sequence
  chemically synthesized
acataatatattttaagttc

SEQ ID NO: 38579 - DNA, 20 bp, Artificial Sequence
  chemically synthesized
cataatatattttaagttcc

SEQ ID NO: 38580 - DNA, 20 bp, Artificial Sequence
  chemically synthesized
ataatatattttaagttcca

SEQ ID NO: 38581 - DNA, 20 bp, Artificial Sequence
  chemically synthesized
taagttccagggcacatgtg

SEQ ID NO: 38582 - DNA, 20 bp, Artificial Sequence
  chemically synthesized
aagttccagggcacatgtgc

SEQ ID NO: 38583 - DNA, 20 bp, Artificial Sequence
  chemically synthesized
gggcacatgtgcaggatgtg

SEQ ID NO: 38584 - DNA, 20 bp, Artificial Sequence
  chemically synthesized
ggcacatgtgcaggatgtgc

SEQ ID NO: 38585 - DNA, 20 bp, Artificial Sequence
  chemically synthesized
ggatgtgcaggtttattaca

SEQ ID NO: 38586 - DNA, 20 bp, Artificial Sequence
  chemically synthesized
gatgtgcaggtttattacat

SEQ ID NO: 38587 - DNA, 20 bp, Artificial Sequence
  chemically synthesized
ataggtaaatgtgtgccatg

SEQ ID NO: 38588 - DNA, 20 bp, Artificial Sequence
  chemically synthesized
taggtaaatgtgtgccatgc

SEQ ID NO: 38589 - DNA, 20 bp, Artificial Sequence
  chemically synthesized
tgcaggtttgctgcattcgt

SEQ ID NO: 38590 - DNA, 20 bp, Artificial Sequence
  chemically synthesized
cattcgttagctattcttcc

SEQ ID NO: 38591 - DNA, 20 bp, Artificial Sequence
  chemically synthesized
ctctcctccccacccactac

SEQ ID NO: 38592 - DNA, 20 bp, Artificial Sequence
  chemically synthesized
cctccccacccactaccgga

SEQ ID NO: 38593 - DNA, 20 bp, Artificial Sequence
  chemically synthesized
ctccccacccactaccggac

SEQ ID NO: 38594 - DNA, 20 bp, Artificial Sequence
  chemically synthesized
ctgtgtgtgttgttccccac

SEQ ID NO: 38595 - DNA, 20 bp, Artificial Sequence
  chemically synthesized
gtccatgtgttctcactgtt

SEQ ID NO: 38596 - DNA, 20 bp, Artificial Sequence
  chemically synthesized
ttcagctcccatttctgtgt

SEQ ID NO: 38597 - DNA, 20 bp, Artificial Sequence
  chemically synthesized
tgtgtgagaacatgtgtgtt

SEQ ID NO: 38598 - DNA, 20 bp, Artificial Sequence
  chemically synthesized
ttggttttctgttcctgtgt

SEQ ID NO: 38599 - DNA, 20 bp, Artificial Sequence
  chemically synthesized
tgttcctgtgttagtttgat

SEQ ID NO: 38600 - DNA, 20 bp, Artificial Sequence
  chemically synthesized
gttcctgtgttagtttgatg

SEQ ID NO: 38601 - DNA, 20 bp, Artificial Sequence
  chemically synthesized
tgttagtttgatgaggataa

SEQ ID NO: 38602 - DNA, 20 bp, Artificial Sequence
  chemically synthesized
ttgatgaggataatggcttc

SEQ ID NO: 38603 - DNA, 20 bp, Artificial Sequence
  chemically synthesized
agctccattcatgtccctgc

SEQ ID NO: 38604 - DNA, 20 bp, Artificial Sequence
  chemically synthesized
gctccattcatgtccctgca

SEQ ID NO: 38605 - DNA, 20 bp, Artificial Sequence
  chemically synthesized
cacaatccttttccttttta

SEQ ID NO: 38606 - DNA, 20 bp, Artificial Sequence
  chemically synthesized
ttttcctttttatggctgta

SEQ ID NO: 38607 - DNA, 20 bp, Artificial Sequence
  chemically synthesized
tatggctgtatagtattcca

SEQ ID NO: 38608 - DNA, 20 bp, Artificial Sequence
  chemically synthesized
tttatccactctatcattga

SEQ ID NO: 38609 - DNA, 20 bp, Artificial Sequence
  chemically synthesized
ctctatcattgatggacatt

SEQ ID NO: 38610 - DNA, 20 bp, Artificial Sequence
  chemically synthesized
tctatcattgatggacattt

SEQ ID NO: 38611 - DNA, 20 bp, Artificial Sequence
  chemically synthesized
tttgggttgattccacatct

SEQ ID NO: 38612 - DNA, 20 bp, Artificial Sequence
  chemically synthesized
aataatgctgcaatgaacat

SEQ ID NO: 38613 - DNA, 20 bp, Artificial Sequence
  chemically synthesized
gcatgcctgtatttttataa

SEQ ID NO: 38614 - DNA, 20 bp, Artificial Sequence
  chemically synthesized
tagattgatttatattcctt

SEQ ID NO: 38615 - DNA, 20 bp, Artificial Sequence
  chemically synthesized
agattgatttatattccttt

SEQ ID NO: 38616 - DNA, 20 bp, Artificial Sequence
  chemically synthesized
tattcctttgggtatatacc

SEQ ID NO: 38617 - DNA, 20 bp, Artificial Sequence
  chemically synthesized
ttgggtatatacccagtaat

SEQ ID NO: 38618 - DNA, 20 bp, Artificial Sequence
  chemically synthesized
tacccagtaatgagattgct

SEQ ID NO: 38619 - DNA, 20 bp, Artificial Sequence
  chemically synthesized
agtaatgagattgctgagtc

SEQ ID NO: 38620 - DNA, 20 bp, Artificial Sequence
  chemically synthesized
aatgagattgctgagtcaag

SEQ ID NO: 38621 - DNA, 20 bp, Artificial Sequence
  chemically synthesized
atttctgcttctacatcttt

SEQ ID NO: 38622 - DNA, 20 bp, Artificial Sequence
  chemically synthesized
tttctgcttctacatctttg

SEQ ID NO: 38623 - DNA, 20 bp, Artificial Sequence
  chemically synthesized
tgcttctacatctttgagga

SEQ ID NO: 38624 - DNA, 20 bp, Artificial Sequence
  chemically synthesized
gcttctacatctttgaggaa

SEQ ID NO: 38625 - DNA, 20 bp, Artificial Sequence
  chemically synthesized
ctaatttactctcccgttaa

SEQ ID NO: 38626 - DNA, 20 bp, Artificial Sequence
  chemically synthesized
ctctcccgttaacagtgtaa

SEQ ID NO: 38627 - DNA, 20 bp, Artificial Sequence
  chemically synthesized
ctttctctctgcaaccttgc

SEQ ID NO: 38628 - DNA, 20 bp, Artificial Sequence
  chemically synthesized
ttaataattgccattctgac

SEQ ID NO: 38629 - DNA, 20 bp, Artificial Sequence
  chemically synthesized
attgccattctgactggtgt

SEQ ID NO: 38630 - DNA, 20 bp, Artificial Sequence
  chemically synthesized
ccattctgactggtgtgaga

SEQ ID NO: 38631 - DNA, 20 bp, Artificial Sequence
  chemically synthesized
tgtgagatggtatcccattg

SEQ ID NO: 38632 - DNA, 20 bp, Artificial Sequence
  chemically synthesized
atttgcatttttctaatgac

SEQ ID NO: 38633 - DNA, 20 bp, Artificial Sequence
  chemically synthesized
gcatttttctaatgaccagt

SEQ ID NO: 38634 - DNA, 20 bp, Artificial Sequence
  chemically synthesized
catttttctaatgaccagta

SEQ ID NO: 38635 - DNA, 20 bp, Artificial Sequence
  chemically synthesized
ttctaatgaccagtaaggtt

SEQ ID NO: 38636 - DNA, 20 bp, Artificial Sequence
  chemically synthesized
tttttttttcatatgtttat

SEQ ID NO: 38637 - DNA, 20 bp, Artificial Sequence
  chemically synthesized
ttttttcatatgtttattag

SEQ ID NO: 38638 - DNA, 20 bp, Artificial Sequence
  chemically synthesized
agaagcatgaatgtcttctt

SEQ ID NO: 38639 - DNA, 20 bp, Artificial Sequence
  chemically synthesized
aagcatgaatgtcttcttta

SEQ ID NO: 38640 - DNA, 20 bp, Artificial Sequence
  chemically synthesized
catgaatgtcttctttagag

SEQ ID NO: 38641 - DNA, 20 bp, Artificial Sequence
  chemically synthesized
tgtcattccccactttttaa

SEQ ID NO: 38642 - DNA, 20 bp, Artificial Sequence
  chemically synthesized
gtcattccccactttttaat

SEQ ID NO: 38643 - DNA, 20 bp, Artificial Sequence
  chemically synthesized
tcattccccactttttaatg

SEQ ID NO: 38644 - DNA, 20 bp, Artificial Sequence
  chemically synthesized
tttttcttgtaaatttgttt

SEQ ID NO: 38645 - DNA, 20 bp, Artificial Sequence
  chemically synthesized
aaatttgttttagttcctca

SEQ ID NO: 38646 - DNA, 20 bp, Artificial Sequence
  chemically synthesized
ttttagttcctcatagactc

SEQ ID NO: 38647 - DNA, 20 bp, Artificial Sequence
  chemically synthesized
tcctcatagactccagatat

SEQ ID NO: 38648 - DNA, 20 bp, Artificial Sequence
  chemically synthesized
tccagatattagacttttgt

SEQ ID NO: 38649 - DNA, 20 bp, Artificial Sequence
  chemically synthesized
gatattagacttttgtcaga

SEQ ID NO: 38650 - DNA, 20 bp, Artificial Sequence
  chemically synthesized
tattagacttttgtcagatg

SEQ ID NO: 38651 - DNA, 20 bp, Artificial Sequence
  chemically synthesized
aaaaattttcttctattctg

SEQ ID NO: 38652 - DNA, 20 bp, Artificial Sequence
  chemically synthesized
aaaattttcttctattctgt

SEQ ID NO: 38653 - DNA, 20 bp, Artificial Sequence
  chemically synthesized
ttgtctgttatctctgatga

SEQ ID NO: 38654 - DNA, 20 bp, Artificial Sequence
  chemically synthesized
tgatagtttcttttgctgtg

SEQ ID NO: 38655 - DNA, 20 bp, Artificial Sequence
  chemically synthesized
tagtttcttttgctgtgcag

SEQ ID NO: 38656 - DNA, 20 bp, Artificial Sequence
  chemically synthesized
cagaagctctttaatttaat

SEQ ID NO: 38657 - DNA, 20 bp, Artificial Sequence
  chemically synthesized
catttgtcaatttttttttg

SEQ ID NO: 38658 - DNA, 20 bp, Artificial Sequence
  chemically synthesized
tttttttttgcagttgcttt

SEQ ID NO: 38659 - DNA, 20 bp, Artificial Sequence
  chemically synthesized
gcagttgcttttggtgtctt

SEQ ID NO: 38660 - DNA, 20 bp, Artificial Sequence
  chemically synthesized
atgatacaatgtcatctata

SEQ ID NO: 38661 - DNA, 20 bp, Artificial Sequence
  chemically synthesized
atgtcatctataaagtttta

SEQ ID NO: 38662 - DNA, 20 bp, Artificial Sequence
  chemically synthesized
tcatctataaagttttacag

SEQ ID NO: 38663 - DNA, 20 bp, Artificial Sequence
  chemically synthesized
atctataaagttttacagta

SEQ ID NO: 38664 - DNA, 20 bp, Artificial Sequence
  chemically synthesized
ctctaaattcataaatttcc

SEQ ID NO: 38665 - DNA, 20 bp, Artificial Sequence
  chemically synthesized
ttcctagttgctcatttcat

SEQ ID NO: 38666 - DNA, 20 bp, Artificial Sequence
  chemically synthesized
cttgtgttctctctaaatgc

SEQ ID NO: 38667 - DNA, 20 bp, Artificial Sequence
  chemically synthesized
tgttctctctaaatgctgga

SEQ ID NO: 38668 - DNA, 20 bp, Artificial Sequence
  chemically synthesized
aacatttctgatatgtccaa

SEQ ID NO: 38669 - DNA, 20 bp, Artificial Sequence
  chemically synthesized
tttttattctaataaatcac

SEQ ID NO: 38670 - DNA, 20 bp, Artificial Sequence
  chemically synthesized
caagtgatctcaatttgttg

SEQ ID NO: 38671 - DNA, 20 bp, Artificial Sequence
  chemically synthesized
ctcaatttgttgcagcaact

SEQ ID NO: 38672 - DNA, 20 bp, Artificial Sequence
  chemically synthesized
cagcaacttggaaatctcac

SEQ ID NO: 38673 - DNA, 20 bp, Artificial Sequence
  chemically synthesized
agcaacttggaaatctcact

SEQ ID NO: 38674 - DNA, 20 bp, Artificial Sequence
  chemically synthesized
atccttttataattgatttt

SEQ ID NO: 38675 - DNA, 20 bp, Artificial Sequence
  chemically synthesized
cttttataattgattttaag

SEQ ID NO: 38676 - DNA, 20 bp, Artificial Sequence
  chemically synthesized
agtttattatgtattatctc

SEQ ID NO: 38677 - DNA, 20 bp, Artificial Sequence
  chemically synthesized
tatctctagtgttttatttt

SEQ ID NO: 38678 - DNA, 20 bp, Artificial Sequence
  chemically synthesized
ttttagtgtacgtattttcc

SEQ ID NO: 38679 - DNA, 20 bp, Artificial Sequence
  chemically synthesized
ttgctatatacacaatttaa

SEQ ID NO: 38680 - DNA, 20 bp, Artificial Sequence
  chemically synthesized
attatttactttatctactg

SEQ ID NO: 38681 - DNA, 20 bp, Artificial Sequence
  chemically synthesized
tactttatctactgaagtat

SEQ ID NO: 38682 - DNA, 20 bp, Artificial Sequence
  chemically synthesized
ctttatctactgaagtattg

SEQ ID NO: 38683 - DNA, 20 bp, Artificial Sequence
  chemically synthesized
gtattggagccatactatca

SEQ ID NO: 38684 - DNA, 20 bp, Artificial Sequence
  chemically synthesized
atcaaagcccttgctgactt

SEQ ID NO: 38685 - DNA, 20 bp, Artificial Sequence
  chemically synthesized
tcaaagcccttgctgacttc

SEQ ID NO: 38686 - DNA, 20 bp, Artificial Sequence
  chemically synthesized
tgtacatatcctatgtttaa

SEQ ID NO: 38687 - DNA, 20 bp, Artificial Sequence
  chemically synthesized
gtacatatcctatgtttaaa

SEQ ID NO: 38688 - DNA, 20 bp, Artificial Sequence
  chemically synthesized
tacatatcctatgtttaaaa

SEQ ID NO: 38689 - DNA, 20 bp, Artificial Sequence
  chemically synthesized
tgtttaaaagggtttgtgtt

SEQ ID NO: 38690 - DNA, 20 bp, Artificial Sequence
  chemically synthesized
tttaaaagggtttgtgtttg

SEQ ID NO: 38691 - DNA, 20 bp, Artificial Sequence
  chemically synthesized
ttaaaagggtttgtgtttgg

SEQ ID NO: 38692 - DNA, 20 bp, Artificial Sequence
  chemically synthesized
aaaagggtttgtgtttggag

SEQ ID NO: 38693 - DNA, 20 bp, Artificial Sequence
  chemically synthesized
aagggtttgtgtttggagga

SEQ ID NO: 38694 - DNA, 20 bp, Artificial Sequence
  chemically synthesized
ggtttgtgtttggaggagag

SEQ ID NO: 38695 - DNA, 20 bp, Artificial Sequence
  chemically synthesized
gtttgtgtttggaggagagt

SEQ ID NO: 38696 - DNA, 20 bp, Artificial Sequence
  chemically synthesized
tcctcatgtgcctattttcg

SEQ ID NO: 38697 - DNA, 20 bp, Artificial Sequence
  chemically synthesized
ctaatatttaatcattcctt

SEQ ID NO: 38698 - DNA, 20 bp, Artificial Sequence
  chemically synthesized
attcctttggttaatttttt

SEQ ID NO: 38699 - DNA, 20 bp, Artificial Sequence
  chemically synthesized
ttcctttggttaatttttta

SEQ ID NO: 38700 - DNA, 20 bp, Artificial Sequence
  chemically synthesized
tcctttggttaattttttaa

SEQ ID NO: 38701 - DNA, 20 bp, Artificial Sequence
  chemically synthesized
attttttaagggcactatta

SEQ ID NO: 38702 - DNA, 20 bp, Artificial Sequence
  chemically synthesized
ttttttaagggcactattat

SEQ ID NO: 38703 - DNA, 20 bp, Artificial Sequence
  chemically synthesized
ctattatgggtcaccttgct

SEQ ID NO: 38704 - DNA, 20 bp, Artificial Sequence
  chemically synthesized
ttgctaagcaaaaatgatat

SEQ ID NO: 38705 - DNA, 20 bp, Artificial Sequence
  chemically synthesized
gctaagcaaaaatgatataa

SEQ ID NO: 38706 - DNA, 20 bp, Artificial Sequence
  chemically synthesized
taagcaaaaatgatataaga

SEQ ID NO: 38707 - DNA, 20 bp, Artificial Sequence
  chemically synthesized
aaatgatataagagagcaaa

SEQ ID NO: 38708 - DNA, 20 bp, Artificial Sequence
  chemically synthesized
tagacaaacttttcttctta

SEQ ID NO: 38709 - DNA, 20 bp, Artificial Sequence
  chemically synthesized
tcttcttaaagtcttcaaat

SEQ ID NO: 38710 - DNA, 20 bp, Artificial Sequence
  chemically synthesized
tcttaaagtcttcaaataag

SEQ ID NO: 38711 - DNA, 20 bp, Artificial Sequence
  chemically synthesized
cttaaagtcttcaaataagt

SEQ ID NO: 38712 - DNA, 20 bp, Artificial Sequence
  chemically synthesized
ttaaagtcttcaaataagtg

SEQ ID NO: 38713 - DNA, 20 bp, Artificial Sequence
  chemically synthesized
ttcaaataagtggggactca

SEQ ID NO: 38714 - DNA, 20 bp, Artificial Sequence
  chemically synthesized
agtggggactcaaagaataa

SEQ ID NO: 38715 - DNA, 20 bp, Artificial Sequence
  chemically synthesized
aagaaatccaaatttaaaac

SEQ ID NO: 38716 - DNA, 20 bp, Artificial Sequence
  chemically synthesized
aagtgctgtgattaatcata

SEQ ID NO: 38717 - DNA, 20 bp, Artificial Sequence
  chemically synthesized
tgctgtgattaatcataaag

SEQ ID NO: 38718 - DNA, 20 bp, Artificial Sequence
  chemically synthesized
gtgattaatcataaagcaga

SEQ ID NO: 38719 - DNA, 20 bp, Artificial Sequence
  chemically synthesized
attaatcataaagcagaaag

SEQ ID NO: 38720 - DNA, 20 bp, Artificial Sequence
  chemically synthesized
agcagaaagaagacactgaa

SEQ ID NO: 38721 - DNA, 20 bp, Artificial Sequence
  chemically synthesized
cagaaagaagacactgaatg

SEQ ID NO: 38722 - DNA, 20 bp, Artificial Sequence
  chemically synthesized
gaaagaagacactgaatgga

SEQ ID NO: 38723 - DNA, 20 bp, Artificial Sequence
  chemically synthesized
aagacactgaatggagagtg

SEQ ID NO: 38724 - DNA, 20 bp, Artificial Sequence
  chemically synthesized
agacactgaatggagagtgt

SEQ ID NO: 38725 - DNA, 20 bp, Artificial Sequence
  chemically synthesized
ggagagtgtgggtctcaaaa

SEQ ID NO: 38726 - DNA, 20 bp, Artificial Sequence
  chemically synthesized
gagagtgtgggtctcaaaaa

SEQ ID NO: 38727 - DNA, 20 bp, Artificial Sequence
  chemically synthesized
gtgggtctcaaaaaaggctt

SEQ ID NO: 38728 - DNA, 20 bp, Artificial Sequence
  chemically synthesized
tgggtctcaaaaaaggcttg

SEQ ID NO: 38729 - DNA, 20 bp, Artificial Sequence
  chemically synthesized
tcaaaaaaggcttgaggtta

SEQ ID NO: 38730 - DNA, 20 bp, Artificial Sequence
  chemically synthesized
ttgaggttatggcttgaaat

SEQ ID NO: 38731 - DNA, 20 bp, Artificial Sequence
  chemically synthesized
tgaggttatggcttgaaata

SEQ ID NO: 38732 - DNA, 20 bp, Artificial Sequence
  chemically synthesized
gaggttatggcttgaaataa

SEQ ID NO: 38733 - DNA, 20 bp, Artificial Sequence
  chemically synthesized
ttatggcttgaaataagggt

SEQ ID NO: 38734 - DNA, 20 bp, Artificial Sequence
  chemically synthesized
aaataagggtaagattccct

SEQ ID NO: 38735 - DNA, 20 bp, Artificial Sequence
  chemically synthesized
aagggtaagattccctgaga

SEQ ID NO: 38736 - DNA, 20 bp, Artificial Sequence
  chemically synthesized
tccctgagaaagtgtccctt

SEQ ID NO: 38737 - DNA, 20 bp, Artificial Sequence
  chemically synthesized
gagaaagtgtcccttcagct

SEQ ID NO: 38738 - DNA, 20 bp, Artificial Sequence
  chemically synthesized
cttcagctgagacctgaaaa

SEQ ID NO: 38739 - DNA, 20 bp, Artificial Sequence
  chemically synthesized
gctgagacctgaaaatggat

SEQ ID NO: 38740 - DNA, 20 bp, Artificial Sequence
  chemically synthesized
aaaatggattagaaactaac

SEQ ID NO: 38741 - DNA, 20 bp, Artificial Sequence
  chemically synthesized
gaaactaactggtgaaaata

SEQ ID NO: 38742 - DNA, 20 bp, Artificial Sequence
  chemically synthesized
taactggtgaaaatacagac

SEQ ID NO: 38743 - DNA, 20 bp, Artificial Sequence
  chemically synthesized
aatacagacaagaatattct

SEQ ID NO: 38744 - DNA, 20 bp, Artificial Sequence
  chemically synthesized
acaagaatattctaagactg

SEQ ID NO: 38745 - DNA, 20 bp, Artificial Sequence
  chemically synthesized
caagaatattctaagactga

SEQ ID NO: 38746 - DNA, 20 bp, Artificial Sequence
  chemically synthesized
agaatattctaagactgaag

SEQ ID NO: 38747 - DNA, 20 bp, Artificial Sequence
  chemically synthesized
taagactgaaggagtgtgtg

SEQ ID NO: 38748 - DNA, 20 bp, Artificial Sequence
  chemically synthesized
agactgaaggagtgtgtgtg

SEQ ID NO: 38749 - DNA, 20 bp, Artificial Sequence
  chemically synthesized
aggagtgtgtgtggagacct

SEQ ID NO: 38750 - DNA, 20 bp, Artificial Sequence
  chemically synthesized
gtgtgtgtggagacctcagc

SEQ ID NO: 38751 - DNA, 20 bp, Artificial Sequence
  chemically synthesized
tgtgtgtggagacctcagct

SEQ ID NO: 38752 - DNA, 20 bp, Artificial Sequence
  chemically synthesized
tgtggagacctcagctaggt

SEQ ID NO: 38753 - DNA, 20 bp, Artificial Sequence
  chemically synthesized
tcagctaggttggtttatat

SEQ ID NO: 38754 - DNA, 20 bp, Artificial Sequence
  chemically synthesized
cagctaggttggtttatatt

SEQ ID NO: 38755 - DNA, 20 bp, Artificial Sequence
  chemically synthesized
agctaggttggtttatatta

SEQ ID NO: 38756 - DNA, 20 bp, Artificial Sequence
  chemically synthesized
taggttggtttatattaggg

SEQ ID NO: 38757 - DNA, 20 bp, Artificial Sequence
  chemically synthesized
aggttggtttatattaggga

SEQ ID NO: 38758 - DNA, 20 bp, Artificial Sequence
  chemically synthesized
ttggtttatattagggaagg

SEQ ID NO: 38759 - DNA, 20 bp, Artificial Sequence
  chemically synthesized
atattagggaaggtggctac

SEQ ID NO: 38760 - DNA, 20 bp, Artificial Sequence
  chemically synthesized
ttagggaaggtggctactgg

SEQ ID NO: 38761 - DNA, 20 bp, Artificial Sequence
  chemically synthesized
agggaaggtggctactggaa

SEQ ID NO: 38762 - DNA, 20 bp, Artificial Sequence
  chemically synthesized
gggaaggtggctactggaag

SEQ ID NO: 38763 - DNA, 20 bp, Artificial Sequence
  chemically synthesized
ggaaggtggctactggaaga

SEQ ID NO: 38764 - DNA, 20 bp, Artificial Sequence
  chemically synthesized
tggaagagggtgtttgcttt

SEQ ID NO: 38765 - DNA, 20 bp, Artificial Sequence
  chemically synthesized
aagagggtgtttgctttgag

SEQ ID NO: 38766 - DNA, 20 bp, Artificial Sequence
  chemically synthesized
gagggtgtttgctttgagaa

SEQ ID NO: 38767 - DNA, 20 bp, Artificial Sequence
  chemically synthesized
agggtgtttgctttgagaag

SEQ ID NO: 38768 - DNA, 20 bp, Artificial Sequence
  chemically synthesized
tttgctttgagaagaggctg

SEQ ID NO: 38769 - DNA, 20 bp, Artificial Sequence
  chemically synthesized
tgctttgagaagaggctgaa

SEQ ID NO: 38770 - DNA, 20 bp, Artificial Sequence
  chemically synthesized
gctttgagaagaggctgaag

SEQ ID NO: 38771 - DNA, 20 bp, Artificial Sequence
  chemically synthesized
ctttgagaagaggctgaaga

SEQ ID NO: 38772 - DNA, 20 bp, Artificial Sequence
  chemically synthesized
tgagaagaggctgaagaggg

SEQ ID NO: 38773 - DNA, 20 bp, Artificial Sequence
  chemically synthesized
gagaagaggctgaagaggga

SEQ ID NO: 38774 - DNA, 20 bp, Artificial Sequence
  chemically synthesized
gaggctgaagagggaaggaa

SEQ ID NO: 38775 - DNA, 20 bp, Artificial Sequence
  chemically synthesized
gagggaaggaatggccttat

SEQ ID NO: 38776 - DNA, 20 bp, Artificial Sequence
  chemically synthesized
atggccttattggtcatcat

SEQ ID NO: 38777 - DNA, 20 bp, Artificial Sequence
  chemically synthesized
ggccttattggtcatcataa

SEQ ID NO: 38778 - DNA, 20 bp, Artificial Sequence
  chemically synthesized
attggtcatcataagagttt

SEQ ID NO: 38779 - DNA, 20 bp, Artificial Sequence
  chemically synthesized
taagagtttgagtctctact

SEQ ID NO: 38780 - DNA, 20 bp, Artificial Sequence
  chemically synthesized
agagtttgagtctctactcg

SEQ ID NO: 38781 - DNA, 20 bp, Artificial Sequence
  chemically synthesized
tgagtctctactcggagtca

SEQ ID NO: 38782 - DNA, 20 bp, Artificial Sequence
  chemically synthesized
tctctactcggagtcatgga

SEQ ID NO: 38783 - DNA, 20 bp, Artificial Sequence
  chemically synthesized
gagtcatggaaagctactga

SEQ ID NO: 38784 - DNA, 20 bp, Artificial Sequence
  chemically synthesized
tcatggaaagctactgaaag

SEQ ID NO: 38785 - DNA, 20 bp, Artificial Sequence
  chemically synthesized
cttcaatattatttataaaa

SEQ ID NO: 38786 - DNA, 20 bp, Artificial Sequence
  chemically synthesized
attatttataaaatggaatt

SEQ ID NO: 38787 - DNA, 20 bp, Artificial Sequence
  chemically synthesized
ttatttataaaatggaattg

SEQ ID NO: 38788 - DNA, 20 bp, Artificial Sequence
  chemically synthesized
tatttataaaatggaattga

SEQ ID NO: 38789 - DNA, 20 bp, Artificial Sequence
  chemically synthesized
tttataaaatggaattgagg

SEQ ID NO: 38790 - DNA, 20 bp, Artificial Sequence
  chemically synthesized
ttataaaatggaattgaggg

SEQ ID NO: 38791 - DNA, 20 bp, Artificial Sequence
  chemically synthesized
taaaatggaattgagggagg

SEQ ID NO: 38792 - DNA, 20 bp, Artificial Sequence
  chemically synthesized
aaaatggaattgagggaggc

SEQ ID NO: 38793 - DNA, 20 bp, Artificial Sequence
  chemically synthesized
aaatggaattgagggaggca

SEQ ID NO: 38794 - DNA, 20 bp, Artificial Sequence
  chemically synthesized
ggaattgagggaggcaggga

SEQ ID NO: 38795 - DNA, 20 bp, Artificial Sequence
  chemically synthesized
gaattgagggaggcagggaa

SEQ ID NO: 38796 - DNA, 20 bp, Artificial Sequence
  chemically synthesized
aattgagggaggcagggaaa

SEQ ID NO: 38797 - DNA, 20 bp, Artificial Sequence
  chemically synthesized
tgagggaggcagggaaaggg

SEQ ID NO: 38798 - DNA, 20 bp, Artificial Sequence
  chemically synthesized
gcagggaaagggcagaatat

SEQ ID NO: 38799 - DNA, 20 bp, Artificial Sequence
  chemically synthesized
agggaaagggcagaatatta

SEQ ID NO: 38800 - DNA, 20 bp, Artificial Sequence
  chemically synthesized
cagaatattagagtaatttg

SEQ ID NO: 38801 - DNA, 20 bp, Artificial Sequence
  chemically synthesized
atattagagtaatttgaaga

SEQ ID NO: 38802 - DNA, 20 bp, Artificial Sequence
  chemically synthesized
agtaatttgaagaaagataa

SEQ ID NO: 38803 - DNA, 20 bp, Artificial Sequence
  chemically synthesized
aagataatagtaactcaatt

SEQ ID NO: 38804 - DNA, 20 bp, Artificial Sequence
  chemically synthesized
agataatagtaactcaattt

SEQ ID NO: 38805 - DNA, 20 bp, Artificial Sequence
  chemically synthesized
aatagtaactcaatttagga

SEQ ID NO: 38806 - DNA, 20 bp, Artificial Sequence
  chemically synthesized
agtaactcaatttaggaaag

SEQ ID NO: 38807 - DNA, 20 bp, Artificial Sequence
  chemically synthesized
tcaatttaggaaagtggaaa

SEQ ID NO: 38808 - DNA, 20 bp, Artificial Sequence
  chemically synthesized
taggaaagtggaaatggtaa

SEQ ID NO: 38809 - DNA, 20 bp, Artificial Sequence
  chemically synthesized
ggaaagtggaaatggtaatg

SEQ ID NO: 38810 - DNA, 20 bp, Artificial Sequence
  chemically synthesized
aaagtggaaatggtaatgga

SEQ ID NO: 38811 - DNA, 20 bp, Artificial Sequence
  chemically synthesized
gagagatatgacaaatattt

SEQ ID NO: 38812 - DNA, 20 bp, Artificial Sequence
  chemically synthesized
agagatatgacaaatattta

SEQ ID NO: 38813 - DNA, 20 bp, Artificial Sequence
  chemically synthesized
atttaaggtctaaatataat

SEQ ID NO: 38814 - DNA, 20 bp, Artificial Sequence
  chemically synthesized
tttaaggtctaaatataata

SEQ ID NO: 38815 - DNA, 20 bp, Artificial Sequence
  chemically synthesized
tctaaatataataaggttta

SEQ ID NO: 38816 - DNA, 20 bp, Artificial Sequence
  chemically synthesized
ctaaatataataaggtttac

SEQ ID NO: 38817 - DNA, 20 bp, Artificial Sequence
  chemically synthesized
aataaggtttacaggttatt

SEQ ID NO: 38818 - DNA, 20 bp, Artificial Sequence
  chemically synthesized
ggtttacaggttatttagaa

SEQ ID NO: 38819 - DNA, 20 bp, Artificial Sequence
  chemically synthesized
ttacaggttatttagaaaag

SEQ ID NO: 38820 - DNA, 20 bp, Artificial Sequence
  chemically synthesized
acaggttatttagaaaagca

SEQ ID NO: 38821 - DNA, 20 bp, Artificial Sequence
  chemically synthesized
caggttatttagaaaagcag

SEQ ID NO: 38822 - DNA, 20 bp, Artificial Sequence
  chemically synthesized
ttatttagaaaagcagagga

SEQ ID NO: 38823 - DNA, 20 bp, Artificial Sequence
  chemically synthesized
ttagaaaagcagaggaaaga

SEQ ID NO: 38824 - DNA, 20 bp, Artificial Sequence
  chemically synthesized
agaaaagcagaggaaagaaa

SEQ ID NO: 38825 - DNA, 20 bp, Artificial Sequence
  chemically synthesized
aagcagaggaaagaaagagt

SEQ ID NO: 38826 - DNA, 20 bp, Artificial Sequence
  chemically synthesized
agaggaaagaaagagttgga

SEQ ID NO: 38827 - DNA, 20 bp, Artificial Sequence
  chemically synthesized
gaggaaagaaagagttggaa

SEQ ID NO: 38828 - DNA, 20 bp, Artificial Sequence
  chemically synthesized
ggaaagaaagagttggaaag

SEQ ID NO: 38829 - DNA, 20 bp, Artificial Sequence
  chemically synthesized
atcaatttctgacatgttct

SEQ ID NO: 38830 - DNA, 20 bp, Artificial Sequence
  chemically synthesized
aatttctgacatgttcttgg

SEQ ID NO: 38831 - DNA, 20 bp, Artificial Sequence
  chemically synthesized
tctgacatgttcttggaaga

SEQ ID NO: 38832 - DNA, 20 bp, Artificial Sequence
  chemically synthesized
ctgacatgttcttggaagaa

SEQ ID NO: 38833 - DNA, 20 bp, Artificial Sequence
  chemically synthesized
acatgttcttggaagaaagg

SEQ ID NO: 38834 - DNA, 20 bp, Artificial Sequence
  chemically synthesized
tggaagaaaggcagtgccaa

SEQ ID NO: 38835 - DNA, 20 bp, Artificial Sequence
  chemically synthesized
agaaaggcagtgccaaaaga

SEQ ID NO: 38836 - DNA, 20 bp, Artificial Sequence
  chemically synthesized
gaaaggcagtgccaaaagaa

SEQ ID NO: 38837 - DNA, 20 bp, Artificial Sequence
  chemically synthesized
aggcagtgccaaaagaaagg

SEQ ID NO: 38838 - DNA, 20 bp, Artificial Sequence
  chemically synthesized
attatgtattgtctataaat

SEQ ID NO: 38839 - DNA, 20 bp, Artificial Sequence
  chemically synthesized
atgtattgtctataaataag

SEQ ID NO: 38840 - DNA, 20 bp, Artificial Sequence
  chemically synthesized
aagaatcattataattttta

SEQ ID NO: 38841 - DNA, 20 bp, Artificial Sequence
  chemically synthesized
cattataatttttaaagttg

SEQ ID NO: 38842 - DNA, 20 bp, Artificial Sequence
  chemically synthesized
attataatttttaaagttgt

SEQ ID NO: 38843 - DNA, 20 bp, Artificial Sequence
  chemically synthesized
ttttaaagttgtgggacact

SEQ ID NO: 38844 - DNA, 20 bp, Artificial Sequence
  chemically synthesized
agttgtgggacactgagaat

SEQ ID NO: 38845 - DNA, 20 bp, Artificial Sequence
  chemically synthesized
aaataataaacatgtgattt

SEQ ID NO: 38846 - DNA, 20 bp, Artificial Sequence
  chemically synthesized
aataaacatgtgatttaaga

SEQ ID NO: 38847 - DNA, 20 bp, Artificial Sequence
  chemically synthesized
gtgatttaagaaagcaattg

SEQ ID NO: 38848 - DNA, 20 bp, Artificial Sequence
  chemically synthesized
tgatttaagaaagcaattga

SEQ ID NO: 38849 - DNA, 20 bp, Artificial Sequence
  chemically synthesized
tttaagaaagcaattgaagg

SEQ ID NO: 38850 - DNA, 20 bp, Artificial Sequence
  chemically synthesized
gaaggaagtatttcaaactg

SEQ ID NO: 38851 - DNA, 20 bp, Artificial Sequence
  chemically synthesized
agtatttcaaactgtagaac

SEQ ID NO: 38852 - DNA, 20 bp, Artificial Sequence
  chemically synthesized
gacttttaaaaacaaaatat

SEQ ID NO: 38853 - DNA, 20 bp, Artificial Sequence
  chemically synthesized
atcattcattcaaatcattt

SEQ ID NO: 38854 - DNA, 20 bp, Artificial Sequence
  chemically synthesized
tttctttttgcctgatcatg

SEQ ID NO: 38855 - DNA, 20 bp, Artificial Sequence
  chemically synthesized
tctttttgcctgatcatgaa

SEQ ID NO: 38856 - DNA, 20 bp, Artificial Sequence
  chemically synthesized
tgcctgatcatgaagagtca

SEQ ID NO: 38857 - DNA, 20 bp, Artificial Sequence
  chemically synthesized
gatcatgaagagtcatagta

SEQ ID NO: 38858 - DNA, 20 bp, Artificial Sequence
  chemically synthesized
atcatgaagagtcatagtaa

SEQ ID NO: 38859 - DNA, 20 bp, Artificial Sequence
  chemically synthesized
tgaagagtcatagtaaaggc

SEQ ID NO: 38860 - DNA, 20 bp, Artificial Sequence
  chemically synthesized
agtaaaggcaagacatatgt

SEQ ID NO: 38861 - DNA, 20 bp, Artificial Sequence
  chemically synthesized
gacatatgtcagaaaatgat

SEQ ID NO: 38862 - DNA, 20 bp, Artificial Sequence
  chemically synthesized
cagaaaatgatgagaattta

SEQ ID NO: 38863 - DNA, 20 bp, Artificial Sequence
  chemically synthesized
tgatgagaatttacagatgc

SEQ ID NO: 38864 - DNA, 20 bp, Artificial Sequence
  chemically synthesized
aatttacagatgcaagacaa

SEQ ID NO: 38865 - DNA, 20 bp, Artificial Sequence
  chemically synthesized
aagacaacagaaacaaactg

SEQ ID NO: 38866 - DNA, 20 bp, Artificial Sequence
  chemically synthesized
acaacagaaacaaactgaag

SEQ ID NO: 38867 - DNA, 20 bp, Artificial Sequence
  chemically synthesized
actgaagcagatgacaccca

SEQ ID NO: 38868 - DNA, 20 bp, Artificial Sequence
  chemically synthesized
gaagcagatgacacccaaag

SEQ ID NO: 38869 - DNA, 20 bp, Artificial Sequence
  chemically synthesized
aagcagatgacacccaaaga

SEQ ID NO: 38870 - DNA, 20 bp, Artificial Sequence
  chemically synthesized
agatgacacccaaagaaggt

SEQ ID NO: 38871 - DNA, 20 bp, Artificial Sequence
  chemically synthesized
atgacacccaaagaaggtca

SEQ ID NO: 38872 - DNA, 20 bp, Artificial Sequence
  chemically synthesized
cccaaagaaggtcagagaat

SEQ ID NO: 38873 - DNA, 20 bp, Artificial Sequence
  chemically synthesized
aggtcagagaataagtgaaa

SEQ ID NO: 38874 - DNA, 20 bp, Artificial Sequence
  chemically synthesized
tcagagaataagtgaaacag

SEQ ID NO: 38875 - DNA, 20 bp, Artificial Sequence
  chemically synthesized
gaaacagtggctcactatcc

SEQ ID NO: 38876 - DNA, 20 bp, Artificial Sequence
  chemically synthesized
aaacagtggctcactatcct

SEQ ID NO: 38877 - DNA, 20 bp, Artificial Sequence
  chemically synthesized
acagtggctcactatcctag

SEQ ID NO: 38878 - DNA, 20 bp, Artificial Sequence
  chemically synthesized
tggctcactatcctaggaga

SEQ ID NO: 38879 - DNA, 20 bp, Artificial Sequence
  chemically synthesized
ctcactatcctaggagaaag

SEQ ID NO: 38880 - DNA, 20 bp, Artificial Sequence
  chemically synthesized
tcactatcctaggagaaagc

SEQ ID NO: 38881 - DNA, 20 bp, Artificial Sequence
  chemically synthesized
tatcctaggagaaagcagga

SEQ ID NO: 38882 - DNA, 20 bp, Artificial Sequence
  chemically synthesized
aggagaaagcaggatagatc

SEQ ID NO: 38883 - DNA, 20 bp, Artificial Sequence
  chemically synthesized
ggagaaagcaggatagatcc

SEQ ID NO: 38884 - DNA, 20 bp, Artificial Sequence
  chemically synthesized
ggatagatccgggtttttct

SEQ ID NO: 38885 - DNA, 20 bp, Artificial Sequence
  chemically synthesized
gatagatccgggtttttctt

SEQ ID NO: 38886 - DNA, 20 bp, Artificial Sequence
  chemically synthesized
ttcttgggtgtcattcactg

SEQ ID NO: 38887 - DNA, 20 bp, Artificial Sequence
  chemically synthesized
ttgggtgtcattcactgaag

SEQ ID NO: 38888 - DNA, 20 bp, Artificial Sequence
  chemically synthesized
gtcattcactgaagtagacc

SEQ ID NO: 38889 - DNA, 20 bp, Artificial Sequence
  chemically synthesized
aagtagacccagttttaaaa

SEQ ID NO: 38890 - DNA, 20 bp, Artificial Sequence
  chemically synthesized
tagacccagttttaaaatag

SEQ ID NO: 38891 - DNA, 20 bp, Artificial Sequence
  chemically synthesized
caaaaaatactgccaaacgt

SEQ ID NO: 38892 - DNA, 20 bp, Artificial Sequence
  chemically synthesized
tatcaattatatgatacaac

SEQ ID NO: 38893 - DNA, 20 bp, Artificial Sequence
  chemically synthesized
aattatatgatacaactggt

SEQ ID NO: 38894 - DNA, 20 bp, Artificial Sequence
  chemically synthesized
ttatatgatacaactggtta

SEQ ID NO: 38895 - DNA, 20 bp, Artificial Sequence
  chemically synthesized
atgatacaactggttagagc

SEQ ID NO: 38896 - DNA, 20 bp, Artificial Sequence
  chemically synthesized
taatctgatacaaacataaa

SEQ ID NO: 38897 - DNA, 20 bp, Artificial Sequence
  chemically synthesized
aatctgatacaaacataaat

SEQ ID NO: 38898 - DNA, 20 bp, Artificial Sequence
  chemically synthesized
ctgatacaaacataaatagg

SEQ ID NO: 38899 - DNA, 20 bp, Artificial Sequence
  chemically synthesized
tacaaacataaataggaaga

SEQ ID NO: 38900 - DNA, 20 bp, Artificial Sequence
  chemically synthesized
ttaactaaattctgaattac

SEQ ID NO: 38901 - DNA, 20 bp, Artificial Sequence
  chemically synthesized
taaattctgaattaccagat

SEQ ID NO: 38902 - DNA, 20 bp, Artificial Sequence
  chemically synthesized
ttaccagatgagtaaataac

SEQ ID NO: 38903 - DNA, 20 bp, Artificial Sequence
  chemically synthesized
caagaatttattgaaaaatg

SEQ ID NO: 38904 - DNA, 20 bp, Artificial Sequence
  chemically synthesized
gaaaaatgaagttttttcat

SEQ ID NO: 38905 - DNA, 20 bp, Artificial Sequence
  chemically synthesized
tttttcatgagtgcttatgt

SEQ ID NO: 38906 - DNA, 20 bp, Artificial Sequence
  chemically synthesized
agtgcttatgttagttaccc

SEQ ID NO: 38907 - DNA, 20 bp, Artificial Sequence
  chemically synthesized
tgttagttaccctagatttg

SEQ ID NO: 38908 - DNA, 20 bp, Artificial Sequence
  chemically synthesized
agatttgcggcatgccttca

SEQ ID NO: 38909 - DNA, 20 bp, Artificial Sequence
  chemically synthesized
ccttcacagatgtccaatca

SEQ ID NO: 38910 - DNA, 20 bp, Artificial Sequence
  chemically synthesized
atgtccaatcatagatattt

SEQ ID NO: 38911 - DNA, 20 bp, Artificial Sequence
  chemically synthesized
tgtccaatcatagatatttg

SEQ ID NO: 38912 - DNA, 20 bp, Artificial Sequence
  chemically synthesized
tccaatcatagatatttgag

SEQ ID NO: 38913 - DNA, 20 bp, Artificial Sequence
  chemically synthesized
ccaatcatagatatttgagg

SEQ ID NO: 38914 - DNA, 20 bp, Artificial Sequence
  chemically synthesized
gatatttgaggaggaccata

SEQ ID NO: 38915 - DNA, 20 bp, Artificial Sequence
  chemically synthesized
tatgcttgattctttctctc

SEQ ID NO: 38916 - DNA, 20 bp, Artificial Sequence
  chemically synthesized
ttctctcaagtgaaattgtt

SEQ ID NO: 38917 - DNA, 20 bp, Artificial Sequence
  chemically synthesized
atttattaaaatcaaataaa

SEQ ID NO: 38918 - DNA, 20 bp, Artificial Sequence
  chemically synthesized
aaatcaaataaatggtcttt

SEQ ID NO: 38919 - DNA, 20 bp, Artificial Sequence
  chemically synthesized
ataaatggtctttaagatat

SEQ ID NO: 38920 - DNA, 20 bp, Artificial Sequence
  chemically synthesized
aaatggtctttaagatataa

SEQ ID NO: 38921 - DNA, 20 bp, Artificial Sequence
  chemically synthesized
agatataagagactttatcc

SEQ ID NO: 38922 - DNA, 20 bp, Artificial Sequence
  chemically synthesized
tatcctagtatgtatatata

SEQ ID NO: 38923 - DNA, 20 bp, Artificial Sequence
  chemically synthesized
gttgtgtttgcatgtgtgtg

SEQ ID NO: 38924 - DNA, 20 bp, Artificial Sequence
  chemically synthesized
tgtgtggacacctgcacatg

SEQ ID NO: 38925 - DNA, 20 bp, Artificial Sequence
  chemically synthesized
aatcttttaatattttatct

SEQ ID NO: 38926 - DNA, 20 bp, Artificial Sequence
  chemically synthesized
catttattgttttattttta

SEQ ID NO: 38927 - DNA, 20 bp, Artificial Sequence
  chemically synthesized
ttattgttttatttttatag

SEQ ID NO: 38928 - DNA, 20 bp, Artificial Sequence
  chemically synthesized
atatatacaatttgccactt

SEQ ID NO: 38929 - DNA, 20 bp, Artificial Sequence
  chemically synthesized
cctttttataatgtataatg

SEQ ID NO: 38930 - DNA, 20 bp, Artificial Sequence
  chemically synthesized
ttttataatgtataatgcag

SEQ ID NO: 38931 - DNA, 20 bp, Artificial Sequence
  chemically synthesized
aaaactctatattgattaat

SEQ ID NO: 38932 - DNA, 20 bp, Artificial Sequence
  chemically synthesized
tccatgttcttcctacactc

SEQ ID NO: 38933 - DNA, 20 bp, Artificial Sequence
  chemically synthesized
ctctatgaatttgcctattc

SEQ ID NO: 38934 - DNA, 20 bp, Artificial Sequence
  chemically synthesized
atgaatttgcctattctaga

SEQ ID NO: 38935 - DNA, 20 bp, Artificial Sequence
  chemically synthesized
ctattctagatagctcatgt

SEQ ID NO: 38936 - DNA, 20 bp, Artificial Sequence
  chemically synthesized
atagctcatgtaagtgaaat

SEQ ID NO: 38937 - DNA, 20 bp, Artificial Sequence
  chemically synthesized
tgcgtatgacttattgcact

SEQ ID NO: 38938 - DNA, 20 bp, Artificial Sequence
  chemically synthesized
gcgtatgacttattgcactt

SEQ ID NO: 38939 - DNA, 20 bp, Artificial Sequence
  chemically synthesized
atgacttattgcacttagga

SEQ ID NO: 38940 - DNA, 20 bp, Artificial Sequence
  chemically synthesized
tgcacttaggatagtttttt

SEQ ID NO: 38941 - DNA, 20 bp, Artificial Sequence
  chemically synthesized
gcacttaggatagtttttta

SEQ ID NO: 38942 - DNA, 20 bp, Artificial Sequence
  chemically synthesized
tttaaggtttattcatgttg

SEQ ID NO: 38943 - DNA, 20 bp, Artificial Sequence
  chemically synthesized
attcatgttgtagcatgtgt

SEQ ID NO: 38944 - DNA, 20 bp, Artificial Sequence
  chemically synthesized
tgtgtcagacctacttttta

SEQ ID NO: 38945 - DNA, 20 bp, Artificial Sequence
  chemically synthesized
taatattctatcacatatat

SEQ ID NO: 38946 - DNA, 20 bp, Artificial Sequence
  chemically synthesized
ttgatatacgcatctgttga

SEQ ID NO: 38947 - DNA, 20 bp, Artificial Sequence
  chemically synthesized
cttgtattgtttctattcct

SEQ ID NO: 38948 - DNA, 20 bp, Artificial Sequence
  chemically synthesized
tgtcttcccttcaatatgcc

SEQ ID NO: 38949 - DNA, 20 bp, Artificial Sequence
  chemically synthesized
tctgaatattctgcttttca

SEQ ID NO: 38950 - DNA, 20 bp, Artificial Sequence
  chemically synthesized
gcttttcaaagaatattcct

SEQ ID NO: 38951 - DNA, 20 bp, Artificial Sequence
  chemically synthesized
atattccttggaatattcca

SEQ ID NO: 38952 - DNA, 20 bp, Artificial Sequence
  chemically synthesized
ttccttggaatattccatgg

SEQ ID NO: 38953 - DNA, 20 bp, Artificial Sequence
  chemically synthesized
cttggaatattccatggaag

SEQ ID NO: 38954 - DNA, 20 bp, Artificial Sequence
  chemically synthesized
attccatggaagaagaaaat

SEQ ID NO: 38955 - DNA, 20 bp, Artificial Sequence
  chemically synthesized
atggaagaagaaaatgagac

SEQ ID NO: 38956 - DNA, 20 bp, Artificial Sequence
  chemically synthesized
agaaaatgagacaagctttc

SEQ ID NO: 38957 - DNA, 20 bp, Artificial Sequence
  chemically synthesized
aaaatgagacaagctttctg

SEQ ID NO: 38958 - DNA, 20 bp, Artificial Sequence
  chemically synthesized
tgagacaagctttctggaga

SEQ ID NO: 38959 - DNA, 20 bp, Artificial Sequence
  chemically synthesized
gagacaagctttctggagaa

SEQ ID NO: 38960 - DNA, 20 bp, Artificial Sequence
  chemically synthesized
acaagctttctggagaaagg

SEQ ID NO: 38961 - DNA, 20 bp, Artificial Sequence
  chemically synthesized
ttctggagaaaggaagtttt

SEQ ID NO: 38962 - DNA, 20 bp, Artificial Sequence
  chemically synthesized
agttttcagtgccttgatct

SEQ ID NO: 38963 - DNA, 20 bp, Artificial Sequence
  chemically synthesized
tgactgcaacctctgcctcc

SEQ ID NO: 38964 - DNA, 20 bp, Artificial Sequence
  chemically synthesized
gactgcaacctctgcctcct

SEQ ID NO: 38965 - DNA, 20 bp, Artificial Sequence
  chemically synthesized
caacctctgcctcctgggtt

SEQ ID NO: 38966 - DNA, 20 bp, Artificial Sequence
  chemically synthesized
tgcctcctgggttcagtttt

SEQ ID NO: 38967 - DNA, 20 bp, Artificial Sequence
  chemically synthesized
ctgggttcagttttcagtta

SEQ ID NO: 38968 - DNA, 20 bp, Artificial Sequence
  chemically synthesized
aacaaattttttcactcaac

SEQ ID NO: 38969 - DNA, 20 bp, Artificial Sequence
  chemically synthesized
caaattttttcactcaacta

SEQ ID NO: 38970 - DNA, 20 bp, Artificial Sequence
  chemically synthesized
gattttatgataatgcaata

SEQ ID NO: 38971 - DNA, 20 bp, Artificial Sequence
  chemically synthesized
tgataatgcaatacagataa

SEQ ID NO: 38972 - DNA, 20 bp, Artificial Sequence
  chemically synthesized
aaaagataatgcaatccttc

SEQ ID NO: 38973 - DNA, 20 bp, Artificial Sequence
  chemically synthesized
cttccagacctaaaaatatg

SEQ ID NO: 38974 - DNA, 20 bp, Artificial Sequence
  chemically synthesized
tatgtggcatccacatttta

SEQ ID NO: 38975 - DNA, 20 bp, Artificial Sequence
  chemically synthesized
atgtggcatccacattttac

SEQ ID NO: 38976 - DNA, 20 bp, Artificial Sequence
  chemically synthesized
attttacaggtacattttca

SEQ ID NO: 38977 - DNA, 20 bp, Artificial Sequence
  chemically synthesized
tttacaggtacattttcacg

SEQ ID NO: 38978 - DNA, 20 bp, Artificial Sequence
  chemically synthesized
caggtacattttcacggaga

SEQ ID NO: 38979 - DNA, 20 bp, Artificial Sequence
  chemically synthesized
acattttcacggagaaagat

SEQ ID NO: 38980 - DNA, 20 bp, Artificial Sequence
  chemically synthesized
tcacggagaaagataagaac

SEQ ID NO: 38981 - DNA, 20 bp, Artificial Sequence
  chemically synthesized
tttgcaacaaatctttgctc

SEQ ID NO: 38982 - DNA, 20 bp, Artificial Sequence
  chemically synthesized
tctttgctctggacttcact

SEQ ID NO: 38983 - DNA, 20 bp, Artificial Sequence
  chemically synthesized
gctctggacttcactgagta

SEQ ID NO: 38984 - DNA, 20 bp, Artificial Sequence
  chemically synthesized
ctttgttttgttttgttttt

SEQ ID NO: 38985 - DNA, 20 bp, Artificial Sequence
  chemically synthesized
gttttgttttgtttttgaga

SEQ ID NO: 38986 - DNA, 20 bp, Artificial Sequence
  chemically synthesized
tttgttttgtttttgagatg

SEQ ID NO: 38987 - DNA, 20 bp, Artificial Sequence
  chemically synthesized
tggagtctcgctctgtcgcc

SEQ ID NO: 38988 - DNA, 20 bp, Artificial Sequence
  chemically synthesized
ggagtctcgctctgtcgccc

SEQ ID NO: 38989 - DNA, 20 bp, Artificial Sequence
  chemically synthesized
tctcgctctgtcgcccaggc

SEQ ID NO: 38990 - DNA, 20 bp, Artificial Sequence
  chemically synthesized
tcgctctgtcgcccaggctg

SEQ ID NO: 38991 - DNA, 20 bp, Artificial Sequence
  chemically synthesized
ctgtcgcccaggctggagtg

SEQ ID NO: 38992 - DNA, 20 bp, Artificial Sequence
  chemically synthesized
tcgcccaggctggagtgcag

SEQ ID NO: 38993 - DNA, 20 bp, Artificial Sequence
  chemically synthesized
ggagtgcagtggcgtgatct

SEQ ID NO: 38994 - DNA, 20 bp, Artificial Sequence
  chemically synthesized
gcgtgatctcagctcactgc

SEQ ID NO: 38995 - DNA, 20 bp, Artificial Sequence
  chemically synthesized
tcactgcaagctctgcctcc

SEQ ID NO: 38996 - DNA, 20 bp, Artificial Sequence
  chemically synthesized
cactgcaagctctgcctccc

SEQ ID NO: 38997 - DNA, 20 bp, Artificial Sequence
  chemically synthesized
ttcacgccattctcctgcct

SEQ ID NO: 38998 - DNA, 20 bp, Artificial Sequence
  chemically synthesized
ttctcctgcctcagcctccc

SEQ ID NO: 38999 - DNA, 20 bp, Artificial Sequence
  chemically synthesized
tcctgcctcagcctcccgag

SEQ ID NO: 39000 - DNA, 20 bp, Artificial Sequence
  chemically synthesized
gcctcagcctcccgagtagc

SEQ ID NO: 39001 - DNA, 20 bp, Artificial Sequence
  chemically synthesized
cctcagcctcccgagtagct

SEQ ID NO: 39002 - DNA, 20 bp, Artificial Sequence
  chemically synthesized
ctcccgagtagctgggacta

SEQ ID NO: 39003 - DNA, 20 bp, Artificial Sequence
  chemically synthesized
tcccgagtagctgggactac

SEQ ID NO: 39004 - DNA, 20 bp, Artificial Sequence
  chemically synthesized
acaggcgcccgccaccacgc

SEQ ID NO: 39005 - DNA, 20 bp, Artificial Sequence
  chemically synthesized
caggcgcccgccaccacgcc

SEQ ID NO: 39006 - DNA, 20 bp, Artificial Sequence
  chemically synthesized
ggcaaatttttttgtctttt

SEQ ID NO: 39007 - DNA, 20 bp, Artificial Sequence
  chemically synthesized
aaatttttttgtctttttag

SEQ ID NO: 39008 - DNA, 20 bp, Artificial Sequence
  chemically synthesized
atttttttgtctttttagta

SEQ ID NO: 39009 - DNA, 20 bp, Artificial Sequence
  chemically synthesized
ttttgtctttttagtagaga

SEQ ID NO: 39010 - DNA, 20 bp, Artificial Sequence
  chemically synthesized
tttgtctttttagtagagac

SEQ ID NO: 39011 - DNA, 20 bp, Artificial Sequence
  chemically synthesized
ttgtctttttagtagagacg

SEQ ID NO: 39012 - DNA, 20 bp, Artificial Sequence
  chemically synthesized
gagacggggtttcactgtgt

SEQ ID NO: 39013 - DNA, 20 bp, Artificial Sequence
  chemically synthesized
cggggtttcactgtgttagc

SEQ ID NO: 39014 - DNA, 20 bp, Artificial Sequence
  chemically synthesized
ggggtttcactgtgttagcc

SEQ ID NO: 39015 - DNA, 20 bp, Artificial Sequence
  chemically synthesized
tttcactgtgttagccagga

SEQ ID NO: 39016 - DNA, 20 bp, Artificial Sequence
  chemically synthesized
acctcgtgatccacccgcct

SEQ ID NO: 39017 - DNA, 20 bp, Artificial Sequence
  chemically synthesized
ccacccgcctcggcctccca

SEQ ID NO: 39018 - DNA, 20 bp, Artificial Sequence
  chemically synthesized
gcctcggcctcccaaagtgc

SEQ ID NO: 39019 - DNA, 20 bp, Artificial Sequence
  chemically synthesized
cctcggcctcccaaagtgct

SEQ ID NO: 39020 - DNA, 20 bp, Artificial Sequence
  chemically synthesized
ctcccaaagtgctgggatta

SEQ ID NO: 39021 - DNA, 20 bp, Artificial Sequence
  chemically synthesized
tcccaaagtgctgggattac

SEQ ID NO: 39022 - DNA, 20 bp, Artificial Sequence
  chemically synthesized
agtgctgggattacaggcgt

SEQ ID NO: 39023 - DNA, 20 bp, Artificial Sequence
  chemically synthesized
caggcgtgagccaccgcgcc

SEQ ID NO: 39024 - DNA, 20 bp, Artificial Sequence
  chemically synthesized
tgagccaccgcgcccggcct

SEQ ID NO: 39025 - DNA, 20 bp, Artificial Sequence
  chemically synthesized
caccgcgcccggcctgagta

SEQ ID NO: 39026 - DNA, 20 bp, Artificial Sequence
  chemically synthesized
gcctgagtaaagttttatat

SEQ ID NO: 39027 - DNA, 20 bp, Artificial Sequence
  chemically synthesized
cctgagtaaagttttatatt

SEQ ID NO: 39028 - DNA, 20 bp, Artificial Sequence
  chemically synthesized
gagtaaagttttatattggg

SEQ ID NO: 39029 - DNA, 20 bp, Artificial Sequence
  chemically synthesized
attgggaagacataaaaatg

SEQ ID NO: 39030 - DNA, 20 bp, Artificial Sequence
  chemically synthesized
tgggaagacataaaaatgtg

SEQ ID NO: 39031 - DNA, 20 bp, Artificial Sequence
  chemically synthesized
ggaagacataaaaatgtgga

SEQ ID NO: 39032 - DNA, 20 bp, Artificial Sequence
  chemically synthesized
ataaaaatgtggagagaaat

SEQ ID NO: 39033 - DNA, 20 bp, Artificial Sequence
  chemically synthesized
gagaaatgagatccaatcta

SEQ ID NO: 39034 - DNA, 20 bp, Artificial Sequence
  chemically synthesized
ctatggaatgcttaaaaaaa

SEQ ID NO: 39035 - DNA, 20 bp, Artificial Sequence
  chemically synthesized
tatggaatgcttaaaaaaat

SEQ ID NO: 39036 - DNA, 20 bp, Artificial Sequence
  chemically synthesized
aatgcttaaaaaaataggtg

SEQ ID NO: 39037 - DNA, 20 bp, Artificial Sequence
  chemically synthesized
atgcttaaaaaaataggtgt

SEQ ID NO: 39038 - DNA, 20 bp, Artificial Sequence
  chemically synthesized
aaaaaaataggtgtaggcgc

SEQ ID NO: 39039 - DNA, 20 bp, Artificial Sequence
  chemically synthesized
atttacccaatgcatgctgt

SEQ ID NO: 39040 - DNA, 20 bp, Artificial Sequence
  chemically synthesized
aagcaaaattatatgctatt

SEQ ID NO: 39041 - DNA, 20 bp, Artificial Sequence
  chemically synthesized
tgctattgagtacaatgttt

SEQ ID NO: 39042 - DNA, 20 bp, Artificial Sequence
  chemically synthesized
atgtttaagctattgatact

SEQ ID NO: 39043 - DNA, 20 bp, Artificial Sequence
  chemically synthesized
taaacacaaatcttaaaatc

SEQ ID NO: 39044 - DNA, 20 bp, Artificial Sequence
  chemically synthesized
taaaatctggttatccccca

SEQ ID NO: 39045 - DNA, 20 bp, Artificial Sequence
  chemically synthesized
tctgtttctcataatgtgcc

SEQ ID NO: 39046 - DNA, 20 bp, Artificial Sequence
  chemically synthesized
tttctcataatgtgcccagt

SEQ ID NO: 39047 - DNA, 20 bp, Artificial Sequence
  chemically synthesized
agtaagttcctaatgtttat

SEQ ID NO: 39048 - DNA, 20 bp, Artificial Sequence
  chemically synthesized
cctaatgtttattagtgtgt

SEQ ID NO: 39049 - DNA, 20 bp, Artificial Sequence
  chemically synthesized
aatgtttattagtgtgttgg

SEQ ID NO: 39050 - DNA, 20 bp, Artificial Sequence
  chemically synthesized
atgtttattagtgtgttggt

SEQ ID NO: 39051 - DNA, 20 bp, Artificial Sequence
  chemically synthesized
tccatcttgatttgctgacc

SEQ ID NO: 39052 - DNA, 20 bp, Artificial Sequence
  chemically synthesized
ccatcttgatttgctgacct

SEQ ID NO: 39053 - DNA, 20 bp, Artificial Sequence
  chemically synthesized
ttgatttgctgacctgggtg

SEQ ID NO: 39054 - DNA, 20 bp, Artificial Sequence
  chemically synthesized
tgatttgctgacctgggtgc

SEQ ID NO: 39055 - DNA, 20 bp, Artificial Sequence
  chemically synthesized
ctgggtgcaggttcttatga

SEQ ID NO: 39056 - DNA, 20 bp, Artificial Sequence
  chemically synthesized
gggtgcaggttcttatgaca

SEQ ID NO: 39057 - DNA, 20 bp, Artificial Sequence
  chemically synthesized
ggtgcaggttcttatgacag

SEQ ID NO: 39058 - DNA, 20 bp, Artificial Sequence
  chemically synthesized
caggttcttatgacagagga

SEQ ID NO: 39059 - DNA, 20 bp, Artificial Sequence
  chemically synthesized
agaggaaagactgtctttgt

SEQ ID NO: 39060 - DNA, 20 bp, Artificial Sequence
  chemically synthesized
actgtctttgtaagttattt

SEQ ID NO: 39061 - DNA, 20 bp, Artificial Sequence
  chemically synthesized
gtctttgtaagttattttgg

SEQ ID NO: 39062 - DNA, 20 bp, Artificial Sequence
  chemically synthesized
tgtaagttattttggaagaa

SEQ ID NO: 39063 - DNA, 20 bp, Artificial Sequence
  chemically synthesized
tagaaactgtgaaaaatata

SEQ ID NO: 39064 - DNA, 20 bp, Artificial Sequence
  chemically synthesized
tgaaaaatatatggcttctt

SEQ ID NO: 39065 - DNA, 20 bp, Artificial Sequence
  chemically synthesized
atggcttctttggtgctcat

SEQ ID NO: 39066 - DNA, 20 bp, Artificial Sequence
  chemically synthesized
tggcttctttggtgctcatg

SEQ ID NO: 39067 - DNA, 20 bp, Artificial Sequence
  chemically synthesized
atacatctgctcctctttta

SEQ ID NO: 39068 - DNA, 20 bp, Artificial Sequence
  chemically synthesized
cctcttttacagctttatct

SEQ ID NO: 39069 - DNA, 20 bp, Artificial Sequence
  chemically synthesized
ctcttttacagctttatctt

SEQ ID NO: 39070 - DNA, 20 bp, Artificial Sequence
  chemically synthesized
ttttacagctttatcttagg

SEQ ID NO: 39071 - DNA, 20 bp, Artificial Sequence
  chemically synthesized
tacagctttatcttaggtgg

SEQ ID NO: 39072 - DNA, 20 bp, Artificial Sequence
  chemically synthesized
acagctttatcttaggtgga

SEQ ID NO: 39073 - DNA, 20 bp, Artificial Sequence
  chemically synthesized
cagctttatcttaggtggaa

SEQ ID NO: 39074 - DNA, 20 bp, Artificial Sequence
  chemically synthesized
atcttaggtggaagggactt

SEQ ID NO: 39075 - DNA, 20 bp, Artificial Sequence
  chemically synthesized
aggtggaagggacttcagct

SEQ ID NO: 39076 - DNA, 20 bp, Artificial Sequence
  chemically synthesized
ggaagggacttcagctaagt

SEQ ID NO: 39077 - DNA, 20 bp, Artificial Sequence
  chemically synthesized
ggacttcagctaagttggct

SEQ ID NO: 39078 - DNA, 20 bp, Artificial Sequence
  chemically synthesized
gacttcagctaagttggcta

SEQ ID NO: 39079 - DNA, 20 bp, Artificial Sequence
  chemically synthesized
ccttcaaattaaaactctgt

SEQ ID NO: 39080 - DNA, 20 bp, Artificial Sequence
  chemically synthesized
ctgttagtttttctcatgct

SEQ ID NO: 39081 - DNA, 20 bp, Artificial Sequence
  chemically synthesized
tagtttttctcatgcttagt

SEQ ID NO: 39082 - DNA, 20 bp, Artificial Sequence
  chemically synthesized
ttttctcatgcttagtgaga

SEQ ID NO: 39083 - DNA, 20 bp, Artificial Sequence
  chemically synthesized
actttctgctatgaaacttc

SEQ ID NO: 39084 - DNA, 20 bp, Artificial Sequence
  chemically synthesized
tgctatgaaacttcaagtta

SEQ ID NO: 39085 - DNA, 20 bp, Artificial Sequence
  chemically synthesized
ataacctgcaatttacgtcc

SEQ ID NO: 39086 - DNA, 20 bp, Artificial Sequence
  chemically synthesized
acctgcaatttacgtccaag

SEQ ID NO: 39087 - DNA, 20 bp, Artificial Sequence
  chemically synthesized
gcaatttacgtccaagaaga

SEQ ID NO: 39088 - DNA, 20 bp, Artificial Sequence
  chemically synthesized
caatttacgtccaagaagaa

SEQ ID NO: 39089 - DNA, 20 bp, Artificial Sequence
  chemically synthesized
tttacgtccaagaagaaagg

SEQ ID NO: 39090 - DNA, 20 bp, Artificial Sequence
  chemically synthesized
aggaagattcaatctatctt

SEQ ID NO: 39091 - DNA, 20 bp, Artificial Sequence
  chemically synthesized
aatctatcttcagtgatgac

SEQ ID NO: 39092 - DNA, 20 bp, Artificial Sequence
  chemically synthesized
tgatgaccagcatcactgaa

SEQ ID NO: 39093 - DNA, 20 bp, Artificial Sequence
  chemically synthesized
agcatcactgaacggttatc

SEQ ID NO: 39094 - DNA, 20 bp, Artificial Sequence
  chemically synthesized
gcatcactgaacggttatct

SEQ ID NO: 39095 - DNA, 20 bp, Artificial Sequence
  chemically synthesized
acggttatctgggcctgttg

SEQ ID NO: 39096 - DNA, 20 bp, Artificial Sequence
  chemically synthesized
aatatttgaatctctctgac

SEQ ID NO: 39097 - DNA, 20 bp, Artificial Sequence
  chemically synthesized
atatttgaatctctctgacg

SEQ ID NO: 39098 - DNA, 20 bp, Artificial Sequence
  chemically synthesized
gaatctctctgacgaggtat

SEQ ID NO: 39099 - DNA, 20 bp, Artificial Sequence
  chemically synthesized
atctctctgacgaggtataa

SEQ ID NO: 39100 - DNA, 20 bp, Artificial Sequence
  chemically synthesized
ctctctgacgaggtataaga

SEQ ID NO: 39101 - DNA, 20 bp, Artificial Sequence
  chemically synthesized
tctctgacgaggtataagag

SEQ ID NO: 39102 - DNA, 20 bp, Artificial Sequence
  chemically synthesized
ctctgacgaggtataagaga

SEQ ID NO: 39103 - DNA, 20 bp, Artificial Sequence
  chemically synthesized
gacactcacttttgaatatg

SEQ ID NO: 39104 - DNA, 20 bp, Artificial Sequence
  chemically synthesized
acactcacttttgaatatgc

SEQ ID NO: 39105 - DNA, 20 bp, Artificial Sequence
  chemically synthesized
cactcacttttgaatatgca

SEQ ID NO: 39106 - DNA, 20 bp, Artificial Sequence
  chemically synthesized
atgcagggctgtttccatga

SEQ ID NO: 39107 - DNA, 20 bp, Artificial Sequence
  chemically synthesized
gcagggctgtttccatgatg

SEQ ID NO: 39108 - DNA, 20 bp, Artificial Sequence
  chemically synthesized
cagggctgtttccatgatgg

SEQ ID NO: 39109 - DNA, 20 bp, Artificial Sequence
  chemically synthesized
gctgtttccatgatggagga

SEQ ID NO: 39110 - DNA, 20 bp, Artificial Sequence
  chemically synthesized
tgtttccatgatggaggaaa

SEQ ID NO: 39111 - DNA, 20 bp, Artificial Sequence
  chemically synthesized
ccatgatggaggaaagagat

SEQ ID NO: 39112 - DNA, 20 bp, Artificial Sequence
  chemically synthesized
atgatggaggaaagagattg

SEQ ID NO: 39113 - DNA, 20 bp, Artificial Sequence
  chemically synthesized
tgatggaggaaagagattgg

SEQ ID NO: 39114 - DNA, 20 bp, Artificial Sequence
  chemically synthesized
ggaaagagattggaggaatg

SEQ ID NO: 39115 - DNA, 20 bp, Artificial Sequence
  chemically synthesized
attggaggaatgtagattta

SEQ ID NO: 39116 - DNA, 20 bp, Artificial Sequence
  chemically synthesized
ttggaggaatgtagatttat

SEQ ID NO: 39117 - DNA, 20 bp, Artificial Sequence
  chemically synthesized
ggaatgtagatttatgggtg

SEQ ID NO: 39118 - DNA, 20 bp, Artificial Sequence
  chemically synthesized
gatttatgggtgaagttgtt

SEQ ID NO: 39119 - DNA, 20 bp, Artificial Sequence
  chemically synthesized
atgggtgaagttgtttggct

SEQ ID NO: 39120 - DNA, 20 bp, Artificial Sequence
  chemically synthesized
ggtgaagttgtttggcttgg

SEQ ID NO: 39121 - DNA, 20 bp, Artificial Sequence
  chemically synthesized
aagttgtttggcttggaagt

SEQ ID NO: 39122 - DNA, 20 bp, Artificial Sequence
  chemically synthesized
tgtttggcttggaagttgga

SEQ ID NO: 39123 - DNA, 20 bp, Artificial Sequence
  chemically synthesized
tggcttggaagttggatggt

SEQ ID NO: 39124 - DNA, 20 bp, Artificial Sequence
  chemically synthesized
ggaagttggatggtcagttc

SEQ ID NO: 39125 - DNA, 20 bp, Artificial Sequence
  chemically synthesized
gaagttggatggtcagttcc

SEQ ID NO: 39126 - DNA, 20 bp, Artificial Sequence
  chemically synthesized
tcagttccaggtgctaccat

SEQ ID NO: 39127 - DNA, 20 bp, Artificial Sequence
  chemically synthesized
aggtgctaccattggtgctg

SEQ ID NO: 39128 - DNA, 20 bp, Artificial Sequence
  chemically synthesized
ggtgctaccattggtgctga

SEQ ID NO: 39129 - DNA, 20 bp, Artificial Sequence
  chemically synthesized
tgctaccattggtgctgaag

SEQ ID NO: 39130 - DNA, 20 bp, Artificial Sequence
  chemically synthesized
gaacgtttccaaaatgtctt

SEQ ID NO: 39131 - DNA, 20 bp, Artificial Sequence
  chemically synthesized
aacgtttccaaaatgtcttt

SEQ ID NO: 39132 - DNA, 20 bp, Artificial Sequence
  chemically synthesized
acgtttccaaaatgtctttg

SEQ ID NO: 39133 - DNA, 20 bp, Artificial Sequence
  chemically synthesized
caatttcctatcgttttgtt

SEQ ID NO: 39134 - DNA, 20 bp, Artificial Sequence
  chemically synthesized
agttgacacaaaatcttact

SEQ ID NO: 39135 - DNA, 20 bp, Artificial Sequence
  chemically synthesized
tgacacaaaatcttactcag

SEQ ID NO: 39136 - DNA, 20 bp, Artificial Sequence
  chemically synthesized
gacacaaaatcttactcagc

SEQ ID NO: 39137 - DNA, 20 bp, Artificial Sequence
  chemically synthesized
acacaaaatcttactcagca

SEQ ID NO: 39138 - DNA, 20 bp, Artificial Sequence
  chemically synthesized
cacaaaatcttactcagcag

SEQ ID NO: 39139 - DNA, 20 bp, Artificial Sequence
  chemically synthesized
tcttactcagcaggggccca

SEQ ID NO: 39140 - DNA, 20 bp, Artificial Sequence
  chemically synthesized
gcaggggcccaaagtgcaat

SEQ ID NO: 39141 - DNA, 20 bp, Artificial Sequence
  chemically synthesized
tcaactcctctatacatatt

SEQ ID NO: 39142 - DNA, 20 bp, Artificial Sequence
  chemically synthesized
atacatatttagacacttcg

SEQ ID NO: 39143 - DNA, 20 bp, Artificial Sequence
  chemically synthesized
tacatatttagacacttcgc

SEQ ID NO: 39144 - DNA, 20 bp, Artificial Sequence
  chemically synthesized
ttagacacttcgcaggtatc

SEQ ID NO: 39145 - DNA, 20 bp, Artificial Sequence
  chemically synthesized
cgcaggtatcaagtcattac

SEQ ID NO: 39146 - DNA, 20 bp, Artificial Sequence
  chemically synthesized
gcaggtatcaagtcattacc

SEQ ID NO: 39147 - DNA, 20 bp, Artificial Sequence
  chemically synthesized
aggtatcaagtcattaccag

SEQ ID NO: 39148 - DNA, 20 bp, Artificial Sequence
  chemically synthesized
caagtcattaccaggagcac

SEQ ID NO: 39149 - DNA, 20 bp, Artificial Sequence
  chemically synthesized
cattaccaggagcaccagct

SEQ ID NO: 39150 - DNA, 20 bp, Artificial Sequence
  chemically synthesized
ttcatcttctacaacctcat

SEQ ID NO: 39151 - DNA, 20 bp, Artificial Sequence
  chemically synthesized
acttctttcaacgtaatctc

SEQ ID NO: 39152 - DNA, 20 bp, Artificial Sequence
  chemically synthesized
caacgtaatctccagaaaac

SEQ ID NO: 39153 - DNA, 20 bp, Artificial Sequence
  chemically synthesized
aaccttaaaatgtctccttt

SEQ ID NO: 39154 - DNA, 20 bp, Artificial Sequence
  chemically synthesized
cagccttgtccctgtactat

SEQ ID NO: 39155 - DNA, 20 bp, Artificial Sequence
  chemically synthesized
ttagtcctatttgccttgca

SEQ ID NO: 39156 - DNA, 20 bp, Artificial Sequence
  chemically synthesized
tatttgccttgcatagatgt

SEQ ID NO: 39157 - DNA, 20 bp, Artificial Sequence
  chemically synthesized
tgccttgcatagatgtgaga

SEQ ID NO: 39158 - DNA, 20 bp, Artificial Sequence
  chemically synthesized
catagatgtgagatggtaca

SEQ ID NO: 39159 - DNA, 20 bp, Artificial Sequence
  chemically synthesized
attttctttctcttcctata

SEQ ID NO: 39160 - DNA, 20 bp, Artificial Sequence
  chemically synthesized
tatatggtaacataactgat

SEQ ID NO: 39161 - DNA, 20 bp, Artificial Sequence
  chemically synthesized
aacataactgataagacaca

SEQ ID NO: 39162 - DNA, 20 bp, Artificial Sequence
  chemically synthesized
ataactgataagacacaaag

SEQ ID NO: 39163 - DNA, 20 bp, Artificial Sequence
  chemically synthesized
aagacacaaagaagataaaa

SEQ ID NO: 39164 - DNA, 20 bp, Artificial Sequence
  chemically synthesized
aatgtctgatatattattgt

SEQ ID NO: 39165 - DNA, 20 bp, Artificial Sequence
  chemically synthesized
atgtctgatatattattgtt

SEQ ID NO: 39166 - DNA, 20 bp, Artificial Sequence
  chemically synthesized
tgtctgatatattattgttg

SEQ ID NO: 39167 - DNA, 20 bp, Artificial Sequence
  chemically synthesized
gatatattattgttggggta

SEQ ID NO: 39168 - DNA, 20 bp, Artificial Sequence
  chemically synthesized
ttggggtacagttctttatt

SEQ ID NO: 39169 - DNA, 20 bp, Artificial Sequence
  chemically synthesized
tacagttctttattgagaat

SEQ ID NO: 39170 - DNA, 20 bp, Artificial Sequence
  chemically synthesized
cagttctttattgagaataa

SEQ ID NO: 39171 - DNA, 20 bp, Artificial Sequence
  chemically synthesized
aagagtttcttttcatgtat

SEQ ID NO: 39172 - DNA, 20 bp, Artificial Sequence
  chemically synthesized
tttcttttcatgtattggtc

SEQ ID NO: 39173 - DNA, 20 bp, Artificial Sequence
  chemically synthesized
catgtattggtctagctatt

SEQ ID NO: 39174 - DNA, 20 bp, Artificial Sequence
  chemically synthesized
gtattggtctagctatttag

SEQ ID NO: 39175 - DNA, 20 bp, Artificial Sequence
  chemically synthesized
ggtctagctatttagtagta

SEQ ID NO: 39176 - DNA, 20 bp, Artificial Sequence
  chemically synthesized
tagctatttagtagtataga

SEQ ID NO: 39177 - DNA, 20 bp, Artificial Sequence
  chemically synthesized
ttagtagtatagatagatca

SEQ ID NO: 39178 - DNA, 20 bp, Artificial Sequence
  chemically synthesized
tagtagtatagatagatcac

SEQ ID NO: 39179 - DNA, 20 bp, Artificial Sequence
  chemically synthesized
agatagatcacaggaaattg

SEQ ID NO: 39180 - DNA, 20 bp, Artificial Sequence
  chemically synthesized
atcacaggaaattgtagact

SEQ ID NO: 39181 - DNA, 20 bp, Artificial Sequence
  chemically synthesized
aattgtagacttggtgtatt

SEQ ID NO: 39182 - DNA, 20 bp, Artificial Sequence
  chemically synthesized
catcaacaaaaacattttca

SEQ ID NO: 39183 - DNA, 20 bp, Artificial Sequence
  chemically synthesized
caacaaaaacattttcaaag

SEQ ID NO: 39184 - DNA, 20 bp, Artificial Sequence
  chemically synthesized
tttcaaagtagtcttttcat

SEQ ID NO: 39185 - DNA, 20 bp, Artificial Sequence
  chemically synthesized
aagtagtcttttcattggaa

SEQ ID NO: 39186 - DNA, 20 bp, Artificial Sequence
  chemically synthesized
agtagtcttttcattggaat

SEQ ID NO: 39187 - DNA, 20 bp, Artificial Sequence
  chemically synthesized
tagtcttttcattggaatgg

SEQ ID NO: 39188 - DNA, 20 bp, Artificial Sequence
  chemically synthesized
tcattggaatgggagaatat

SEQ ID NO: 39189 - DNA, 20 bp, Artificial Sequence
  chemically synthesized
tgggagaatataagttccat

SEQ ID NO: 39190 - DNA, 20 bp, Artificial Sequence
  chemically synthesized
gagaatataagttccataag

SEQ ID NO: 39191 - DNA, 20 bp, Artificial Sequence
  chemically synthesized
tggttaaaacatcttacctt

SEQ ID NO: 39192 - DNA, 20 bp, Artificial Sequence
  chemically synthesized
cttaccttgagactcacttg

SEQ ID NO: 39193 - DNA, 20 bp, Artificial Sequence
  chemically synthesized
ttgagactcacttgcagcca

SEQ ID NO: 39194 - DNA, 20 bp, Artificial Sequence
  chemically synthesized
tcacttgcagccaaagtact

SEQ ID NO: 39195 - DNA, 20 bp, Artificial Sequence
  chemically synthesized
cttgcagccaaagtactaag

SEQ ID NO: 39196 - DNA, 20 bp, Artificial Sequence
  chemically synthesized
ttgcagccaaagtactaaga

SEQ ID NO: 39197 - DNA, 20 bp, Artificial Sequence
  chemically synthesized
cataaatgtctcttctcatg

SEQ ID NO: 39198 - DNA, 20 bp, Artificial Sequence
  chemically synthesized
tgtctcttctcatgtggtca

SEQ ID NO: 39199 - DNA, 20 bp, Artificial Sequence
  chemically synthesized
ctcatgtggtcacagctatt

SEQ ID NO: 39200 - DNA, 20 bp, Artificial Sequence
  chemically synthesized
tcatgtggtcacagctattt

SEQ ID NO: 39201 - DNA, 20 bp, Artificial Sequence
  chemically synthesized
atgtggtcacagctatttgg

SEQ ID NO: 39202 - DNA, 20 bp, Artificial Sequence
  chemically synthesized
tgtggtcacagctatttggg

SEQ ID NO: 39203 - DNA, 20 bp, Artificial Sequence
  chemically synthesized
tcacagctatttgggaggct

SEQ ID NO: 39204 - DNA, 20 bp, Artificial Sequence
  chemically synthesized
cacagctatttgggaggctg

SEQ ID NO: 39205 - DNA, 20 bp, Artificial Sequence
  chemically synthesized
ctgaggtgtaaaaatcactt

SEQ ID NO: 39206 - DNA, 20 bp, Artificial Sequence
  chemically synthesized
taaaaatcacttaagcctaa

SEQ ID NO: 39207 - DNA, 20 bp, Artificial Sequence
  chemically synthesized
tcacttaagcctaaaagctt

SEQ ID NO: 39208 - DNA, 20 bp, Artificial Sequence
  chemically synthesized
cacttaagcctaaaagcttg

SEQ ID NO: 39209 - DNA, 20 bp, Artificial Sequence
  chemically synthesized
agcctaaaagcttgaggctg

SEQ ID NO: 39210 - DNA, 20 bp, Artificial Sequence
  chemically synthesized
ctcaccactgcactccctcc

SEQ ID NO: 39211 - DNA, 20 bp, Artificial Sequence
  chemically synthesized
tcaccactgcactccctcct

SEQ ID NO: 39212 - DNA, 20 bp, Artificial Sequence
  chemically synthesized
ctgcactccctcctgggtga

SEQ ID NO: 39213 - DNA, 20 bp, Artificial Sequence
  chemically synthesized
gcactccctcctgggtgaca

SEQ ID NO: 39214 - DNA, 20 bp, Artificial Sequence
  chemically synthesized
tccctcctgggtgacagagc

SEQ ID NO: 39215 - DNA, 20 bp, Artificial Sequence
  chemically synthesized
agagcaagacactgtctcaa

SEQ ID NO: 39216 - DNA, 20 bp, Artificial Sequence
  chemically synthesized
agcaagacactgtctcaaaa

SEQ ID NO: 39217 - DNA, 20 bp, Artificial Sequence
  chemically synthesized
caagacactgtctcaaaaga

SEQ ID NO: 39218 - DNA, 20 bp, Artificial Sequence
  chemically synthesized
aagacactgtctcaaaagag

SEQ ID NO: 39219 - DNA, 20 bp, Artificial Sequence
  chemically synthesized
cactgtctcaaaagagagga

SEQ ID NO: 39220 - DNA, 20 bp, Artificial Sequence
  chemically synthesized
tctcaaaagagaggaaagaa

SEQ ID NO: 39221 - DNA, 20 bp, Artificial Sequence
  chemically synthesized
aaagagaggaaagaaaagaa

SEQ ID NO: 39222 - DNA, 20 bp, Artificial Sequence
  chemically synthesized
agagaggaaagaaaagaaaa

SEQ ID NO: 39223 - DNA, 20 bp, Artificial Sequence
  chemically synthesized
aagaaaagaaaagagaataa

SEQ ID NO: 39224 - DNA, 20 bp, Artificial Sequence
  chemically synthesized
agaaaagaaaagagaataaa

SEQ ID NO: 39225 - DNA, 20 bp, Artificial Sequence
  chemically synthesized
aagaaaagagaataaaagga

SEQ ID NO: 39226 - DNA, 20 bp, Artificial Sequence
  chemically synthesized
agaaaagagaataaaaggaa

SEQ ID NO: 39227 - DNA, 20 bp, Artificial Sequence
  chemically synthesized
aagagaataaaaggaaagga

SEQ ID NO: 39228 - DNA, 20 bp, Artificial Sequence
  chemically synthesized
agagaataaaaggaaaggaa

SEQ ID NO: 39229 - DNA, 20 bp, Artificial Sequence
  chemically synthesized
aataaaaggaaaggaaagga

SEQ ID NO: 39230 - DNA, 20 bp, Artificial Sequence
  chemically synthesized
ataaaaggaaaggaaaggaa

SEQ ID NO: 39231 - DNA, 20 bp, Artificial Sequence
  chemically synthesized
taaaaggaaaggaaaggaaa

SEQ ID NO: 39232 - DNA, 20 bp, Artificial Sequence
  chemically synthesized
aaaggaaaggaaaggaaagg

SEQ ID NO: 39233 - DNA, 20 bp, Artificial Sequence
  chemically synthesized
gaaaggaaaggaaagggaga

SEQ ID NO: 39234 - DNA, 20 bp, Artificial Sequence
  chemically synthesized
ggaaaggaaagggagaaaga

SEQ ID NO: 39235 - DNA, 20 bp, Artificial Sequence
  chemically synthesized
gaaaggaaagggagaaagaa

SEQ ID NO: 39236 - DNA, 20 bp, Artificial Sequence
  chemically synthesized
aggaaagggagaaagaaagg

SEQ ID NO: 39237 - DNA, 20 bp, Artificial Sequence
  chemically synthesized
ggaaagggagaaagaaagga

SEQ ID NO: 39238 - DNA, 20 bp, Artificial Sequence
  chemically synthesized
aagggagaaagaaaggaagg

SEQ ID NO: 39239 - DNA, 20 bp, Artificial Sequence
  chemically synthesized
agggagaaagaaaggaagga

SEQ ID NO: 39240 - DNA, 20 bp, Artificial Sequence
  chemically synthesized
gagaaagaaaggaaggaagg

SEQ ID NO: 39241 - DNA, 20 bp, Artificial Sequence
  chemically synthesized
gaaaggaaggaaggaagaaa

SEQ ID NO: 39242 - DNA, 20 bp, Artificial Sequence
  chemically synthesized
aaggaaggaaggaagaaaaa

SEQ ID NO: 39243 - DNA, 20 bp, Artificial Sequence
  chemically synthesized
ggaaggaaggaagaaaaaga

SEQ ID NO: 39244 - DNA, 20 bp, Artificial Sequence
  chemically synthesized
aaggaaggaagaaaaagaga

SEQ ID NO: 39245 - DNA, 20 bp, Artificial Sequence
  chemically synthesized
ggaaggaagaaaaagagaga

SEQ ID NO: 39246 - DNA, 20 bp, Artificial Sequence
  chemically synthesized
agaaaaagagagagagaaat

SEQ ID NO: 39247 - DNA, 20 bp, Artificial Sequence
  chemically synthesized
gaaaaagagagagagaaata

SEQ ID NO: 39248 - DNA, 20 bp, Artificial Sequence
  chemically synthesized
aagagagagagaaataagga

SEQ ID NO: 39249 - DNA, 20 bp, Artificial Sequence
  chemically synthesized
gagagagaaataaggaaaga

SEQ ID NO: 39250 - DNA, 20 bp, Artificial Sequence
  chemically synthesized
aaataaggaaagaaagaaaa

SEQ ID NO: 39251 - DNA, 20 bp, Artificial Sequence
  chemically synthesized
aaggaaagaaagaaaaaaga

SEQ ID NO: 39252 - DNA, 20 bp, Artificial Sequence
  chemically synthesized
aggaaagaaagaaaaaagaa

SEQ ID NO: 39253 - DNA, 20 bp, Artificial Sequence
  chemically synthesized
aaagaaagaaaaaagaaagg

SEQ ID NO: 39254 - DNA, 20 bp, Artificial Sequence
  chemically synthesized
aagaaagaaaaaagaaagga

SEQ ID NO: 39255 - DNA, 20 bp, Artificial Sequence
  chemically synthesized
gaaaaaagaaaggaaggaat

SEQ ID NO: 39256 - DNA, 20 bp, Artificial Sequence
  chemically synthesized
aaaaaagaaaggaaggaatg

SEQ ID NO: 39257 - DNA, 20 bp, Artificial Sequence
  chemically synthesized
aaaaagaaaggaaggaatga

SEQ ID NO: 39258 - DNA, 20 bp, Artificial Sequence
  chemically synthesized
aagaaaggaaggaatgaggg

SEQ ID NO: 39259 - DNA, 20 bp, Artificial Sequence
  chemically synthesized
agaaaggaaggaatgaggga

SEQ ID NO: 39260 - DNA, 20 bp, Artificial Sequence
  chemically synthesized
aaaggaaggaatgagggaag

SEQ ID NO: 39261 - DNA, 20 bp, Artificial Sequence
  chemically synthesized
aaggaaggaatgagggaagg

SEQ ID NO: 39262 - DNA, 20 bp, Artificial Sequence
  chemically synthesized
aggaaggaatgagggaagga

SEQ ID NO: 39263 - DNA, 20 bp, Artificial Sequence
  chemically synthesized
aaggaatgagggaaggaggg

SEQ ID NO: 39264 - DNA, 20 bp, Artificial Sequence
  chemically synthesized
aggaatgagggaaggaggga

SEQ ID NO: 39265 - DNA, 20 bp, Artificial Sequence
  chemically synthesized
gaatgagggaaggagggaag

SEQ ID NO: 39266 - DNA, 20 bp, Artificial Sequence
  chemically synthesized
aatgagggaaggagggaagg

SEQ ID NO: 39267 - DNA, 20 bp, Artificial Sequence
  chemically synthesized
atgagggaaggagggaagga

SEQ ID NO: 39268 - DNA, 20 bp, Artificial Sequence
  chemically synthesized
agggaaggagggaaggaggg

SEQ ID NO: 39269 - DNA, 20 bp, Artificial Sequence
  chemically synthesized
gggaaggagggaaggaggga

SEQ ID NO: 39270 - DNA, 20 bp, Artificial Sequence
  chemically synthesized
ggaaggagggaaggagggaa

SEQ ID NO: 39271 - DNA, 20 bp, Artificial Sequence
  chemically synthesized
gaaggagggaaggagggaag

SEQ ID NO: 39272 - DNA, 20 bp, Artificial Sequence
  chemically synthesized
aaggagggaaggagggaagg

SEQ ID NO: 39273 - DNA, 20 bp, Artificial Sequence
  chemically synthesized
gagggaaggagggaaggggg

SEQ ID NO: 39274 - DNA, 20 bp, Artificial Sequence
  chemically synthesized
agggaaggagggaaggggga

SEQ ID NO: 39275 - DNA, 20 bp, Artificial Sequence
  chemically synthesized
gggaaggagggaagggggaa

SEQ ID NO: 39276 - DNA, 20 bp, Artificial Sequence
  chemically synthesized
ggaaggagggaagggggaag

SEQ ID NO: 39277 - DNA, 20 bp, Artificial Sequence
  chemically synthesized
gaaggagggaagggggaagg

SEQ ID NO: 39278 - DNA, 20 bp, Artificial Sequence
  chemically synthesized
ggagggaagggggaaggggg

SEQ ID NO: 39279 - DNA, 20 bp, Artificial Sequence
  chemically synthesized
gagggaagggggaaggggga

SEQ ID NO: 39280 - DNA, 20 bp, Artificial Sequence
  chemically synthesized
agggaagggggaagggggaa

SEQ ID NO: 39281 - DNA, 20 bp, Artificial Sequence
  chemically synthesized
gggaagggggaagggggaag

SEQ ID NO: 39282 - DNA, 20 bp, Artificial Sequence
  chemically synthesized
ggaagggggaagggggaagg

SEQ ID NO: 39283 - DNA, 20 bp, Artificial Sequence
  chemically synthesized
aagggggaagggggaagggg

SEQ ID NO: 39284 - DNA, 20 bp, Artificial Sequence
  chemically synthesized
agggggaagggggaaggggg

SEQ ID NO: 39285 - DNA, 20 bp, Artificial Sequence
  chemically synthesized
gggggaagggggaaggggga

SEQ ID NO: 39286 - DNA, 20 bp, Artificial Sequence
  chemically synthesized
gggaagggggaagggggagg

SEQ ID NO: 39287 - DNA, 20 bp, Artificial Sequence
  chemically synthesized
ggaagggggaagggggaggg

SEQ ID NO: 39288 - DNA, 20 bp, Artificial Sequence
  chemically synthesized
gaagggggaagggggaggga

SEQ ID NO: 39289 - DNA, 20 bp, Artificial Sequence
  chemically synthesized
agggggaagggggagggagg

SEQ ID NO: 39290 - DNA, 20 bp, Artificial Sequence
  chemically synthesized
gggggaagggggagggaggg

SEQ ID NO: 39291 - DNA, 20 bp, Artificial Sequence
  chemically synthesized
ggggaagggggagggaggga

SEQ ID NO: 39292 - DNA, 20 bp, Artificial Sequence
  chemically synthesized
ggaagggggagggagggagg

SEQ ID NO: 39293 - DNA, 20 bp, Artificial Sequence
  chemically synthesized
gaagggggagggagggaggg

SEQ ID NO: 39294 - DNA, 20 bp, Artificial Sequence
  chemically synthesized
gggggagggagggagggagg

SEQ ID NO: 39295 - DNA, 20 bp, Artificial Sequence
  chemically synthesized
ggggagggagggagggagga

SEQ ID NO: 39296 - DNA, 20 bp, Artificial Sequence
  chemically synthesized
gagggagggagggaggaagg

SEQ ID NO: 39297 - DNA, 20 bp, Artificial Sequence
  chemically synthesized
agggagggagggaggaagga

SEQ ID NO: 39298 - DNA, 20 bp, Artificial Sequence
  chemically synthesized
ctttcttcttgatgttgtta

SEQ ID NO: 39299 - DNA, 20 bp, Artificial Sequence
  chemically synthesized
accatgattgatgtaaaaat

SEQ ID NO: 39300 - DNA, 20 bp, Artificial Sequence
  chemically synthesized
catgattgatgtaaaaatta

SEQ ID NO: 39301 - DNA, 20 bp, Artificial Sequence
  chemically synthesized
tgtaaaaattagagacatcg

SEQ ID NO: 39302 - DNA, 20 bp, Artificial Sequence
  chemically synthesized
catcgaagtactaaacaata

SEQ ID NO: 39303 - DNA, 20 bp, Artificial Sequence
  chemically synthesized
aagtactaaacaataaagaa

SEQ ID NO: 39304 - DNA, 20 bp, Artificial Sequence
  chemically synthesized
agtactaaacaataaagaaa

SEQ ID NO: 39305 - DNA, 20 bp, Artificial Sequence
  chemically synthesized
tactaaacaataaagaaaag

SEQ ID NO: 39306 - DNA, 20 bp, Artificial Sequence
  chemically synthesized
aaacaataaagaaaaggaga

SEQ ID NO: 39307 - DNA, 20 bp, Artificial Sequence
  chemically synthesized
gaaaaggagatagcattgtt

SEQ ID NO: 39308 - DNA, 20 bp, Artificial Sequence
  chemically synthesized
attgtttggcatgcttgaac

SEQ ID NO: 39309 - DNA, 20 bp, Artificial Sequence
  chemically synthesized
actagtaatcttattacaaa

SEQ ID NO: 39310 - DNA, 20 bp, Artificial Sequence
  chemically synthesized
aatcttattacaaacagatg

SEQ ID NO: 39311 - DNA, 20 bp, Artificial Sequence
  chemically synthesized
tcttattacaaacagatgta

SEQ ID NO: 39312 - DNA, 20 bp, Artificial Sequence
  chemically synthesized
cttattacaaacagatgtag

SEQ ID NO: 39313 - DNA, 20 bp, Artificial Sequence
  chemically synthesized
aaacagatgtagaggttgta

SEQ ID NO: 39314 - DNA, 20 bp, Artificial Sequence
  chemically synthesized
aacagatgtagaggttgtaa

SEQ ID NO: 39315 - DNA, 20 bp, Artificial Sequence
  chemically synthesized
ggttgtaaaggtctacaatt

SEQ ID NO: 39316 - DNA, 20 bp, Artificial Sequence
  chemically synthesized
caatttggctacaaaaccaa

SEQ ID NO: 39317 - DNA, 20 bp, Artificial Sequence
  chemically synthesized
aaaaccaatggcttgatcac

SEQ ID NO: 39318 - DNA, 20 bp, Artificial Sequence
  chemically synthesized
caatggcttgatcacaagaa

SEQ ID NO: 39319 - DNA, 20 bp, Artificial Sequence
  chemically synthesized
atagcattcatttgcttaac

SEQ ID NO: 39320 - DNA, 20 bp, Artificial Sequence
  chemically synthesized
ttgcttaactagtacttact

SEQ ID NO: 39321 - DNA, 20 bp, Artificial Sequence
  chemically synthesized
ctgagcacccactatatgtt

SEQ ID NO: 39322 - DNA, 20 bp, Artificial Sequence
  chemically synthesized
tatatgttaagctccatttt

SEQ ID NO: 39323 - DNA, 20 bp, Artificial Sequence
  chemically synthesized
gtcactcacttaaaatcttt

SEQ ID NO: 39324 - DNA, 20 bp, Artificial Sequence
  chemically synthesized
actcacttaaaatctttcag

SEQ ID NO: 39325 - DNA, 20 bp, Artificial Sequence
  chemically synthesized
cagaagttttgttttactgt

SEQ ID NO: 39326 - DNA, 20 bp, Artificial Sequence
  chemically synthesized
tttgttttactgtgagtaca

SEQ ID NO: 39327 - DNA, 20 bp, Artificial Sequence
  chemically synthesized
tgttttactgtgagtacaaa

SEQ ID NO: 39328 - DNA, 20 bp, Artificial Sequence
  chemically synthesized
agagaactgactttatgata

SEQ ID NO: 39329 - DNA, 20 bp, Artificial Sequence
  chemically synthesized
ttatgatatggttatttacc

SEQ ID NO: 39330 - DNA, 20 bp, Artificial Sequence
  chemically synthesized
tttaccaagccgtcacttct

SEQ ID NO: 39331 - DNA, 20 bp, Artificial Sequence
  chemically synthesized
agccgtcacttcttagctac

SEQ ID NO: 39332 - DNA, 20 bp, Artificial Sequence
  chemically synthesized
tcacttcttagctacaagtc

SEQ ID NO: 39333 - DNA, 20 bp, Artificial Sequence
  chemically synthesized
agctacaagtctagaatcaa

SEQ ID NO: 39334 - DNA, 20 bp, Artificial Sequence
  chemically synthesized
gctacaagtctagaatcaac

SEQ ID NO: 39335 - DNA, 20 bp, Artificial Sequence
  chemically synthesized
aggttctgcaaaatgaattc

SEQ ID NO: 39336 - DNA, 20 bp, Artificial Sequence
  chemically synthesized
tatgacctaaaatcacgttt

SEQ ID NO: 39337 - DNA, 20 bp, Artificial Sequence
  chemically synthesized
aaaatcttacctgaatatat

SEQ ID NO: 39338 - DNA, 20 bp, Artificial Sequence
  chemically synthesized
aatcttacctgaatatatga

SEQ ID NO: 39339 - DNA, 20 bp, Artificial Sequence
  chemically synthesized
atcttacctgaatatatgag

SEQ ID NO: 39340 - DNA, 20 bp, Artificial Sequence
  chemically synthesized
tgaatatatgagaggatatt

SEQ ID NO: 39341 - DNA, 20 bp, Artificial Sequence
  chemically synthesized
gaatatatgagaggatattt

SEQ ID NO: 39342 - DNA, 20 bp, Artificial Sequence
  chemically synthesized
tatttaggtttttttcccct

SEQ ID NO: 39343 - DNA, 20 bp, Artificial Sequence
  chemically synthesized
ttttttcccctaagtataaa

SEQ ID NO: 39344 - DNA, 20 bp, Artificial Sequence
  chemically synthesized
tttttcccctaagtataaac

SEQ ID NO: 39345 - DNA, 20 bp, Artificial Sequence
  chemically synthesized
ccctaagtataaacaggtga

SEQ ID NO: 39346 - DNA, 20 bp, Artificial Sequence
  chemically synthesized
tataaacaggtgatagtaaa

SEQ ID NO: 39347 - DNA, 20 bp, Artificial Sequence
  chemically synthesized
taaacaggtgatagtaaata

SEQ ID NO: 39348 - DNA, 20 bp, Artificial Sequence
  chemically synthesized
taaatagagtaacttgctgc

SEQ ID NO: 39349 - DNA, 20 bp, Artificial Sequence
  chemically synthesized
cgagtgtcacatatattatg

SEQ ID NO: 39350 - DNA, 20 bp, Artificial Sequence
  chemically synthesized
tatcactattttaaatctga

SEQ ID NO: 39351 - DNA, 20 bp, Artificial Sequence
  chemically synthesized
gactgaatttgacatgtttt

SEQ ID NO: 39352 - DNA, 20 bp, Artificial Sequence
  chemically synthesized
aatttgacatgttttgagat

SEQ ID NO: 39353 - DNA, 20 bp, Artificial Sequence
  chemically synthesized
tttgacatgttttgagataa

SEQ ID NO: 39354 - DNA, 20 bp, Artificial Sequence
  chemically synthesized
catgttttgagataagagtt

SEQ ID NO: 39355 - DNA, 20 bp, Artificial Sequence
  chemically synthesized
atgttttgagataagagttt

SEQ ID NO: 39356 - DNA, 20 bp, Artificial Sequence
  chemically synthesized
tgttttgagataagagttta

SEQ ID NO: 39357 - DNA, 20 bp, Artificial Sequence
  chemically synthesized
tttgagataagagtttaggg

SEQ ID NO: 39358 - DNA, 20 bp, Artificial Sequence
  chemically synthesized
tgagataagagtttagggta

SEQ ID NO: 39359 - DNA, 20 bp, Artificial Sequence
  chemically synthesized
gttgtgtatctgcacgatct

SEQ ID NO: 39360 - DNA, 20 bp, Artificial Sequence
  chemically synthesized
acgatcttagactacttaaa

SEQ ID NO: 39361 - DNA, 20 bp, Artificial Sequence
  chemically synthesized
agactacttaaatagaaact

SEQ ID NO: 39362 - DNA, 20 bp, Artificial Sequence
  chemically synthesized
agcacataatccaatgaaaa

SEQ ID NO: 39363 - DNA, 20 bp, Artificial Sequence
  chemically synthesized
cacataatccaatgaaaaaa

SEQ ID NO: 39364 - DNA, 20 bp, Artificial Sequence
  chemically synthesized
tccaatgaaaaaagagattt

SEQ ID NO: 39365 - DNA, 20 bp, Artificial Sequence
  chemically synthesized
tgaaaaaagagatttcagaa

SEQ ID NO: 39366 - DNA, 20 bp, Artificial Sequence
  chemically synthesized
gaaaaaagagatttcagaat

SEQ ID NO: 39367 - DNA, 20 bp, Artificial Sequence
  chemically synthesized
gggactaatatgacaacatc

SEQ ID NO: 39368 - DNA, 20 bp, Artificial Sequence
  chemically synthesized
tctggattattatgttcaat

SEQ ID NO: 39369 - DNA, 20 bp, Artificial Sequence
  chemically synthesized
ctggattattatgttcaata

SEQ ID NO: 39370 - DNA, 20 bp, Artificial Sequence
  chemically synthesized
gattattatgttcaataagg

SEQ ID NO: 39371 - DNA, 20 bp, Artificial Sequence
  chemically synthesized
ttattatgttcaataaggtg

SEQ ID NO: 39372 - DNA, 20 bp, Artificial Sequence
  chemically synthesized
ttcaataaggtggagcatca

SEQ ID NO: 39373 - DNA, 20 bp, Artificial Sequence
  chemically synthesized
tcaataaggtggagcatcat

SEQ ID NO: 39374 - DNA, 20 bp, Artificial Sequence
  chemically synthesized
gagcatcataggaaataaat

SEQ ID NO: 39375 - DNA, 20 bp, Artificial Sequence
  chemically synthesized
agcatcataggaaataaatc

SEQ ID NO: 39376 - DNA, 20 bp, Artificial Sequence
  chemically synthesized
cataggaaataaatcaggat

SEQ ID NO: 39377 - DNA, 20 bp, Artificial Sequence
  chemically synthesized
ataggaaataaatcaggatt

SEQ ID NO: 39378 - DNA, 20 bp, Artificial Sequence
  chemically synthesized
aattacatgataaacattta

SEQ ID NO: 39379 - DNA, 20 bp, Artificial Sequence
  chemically synthesized
attacatgataaacatttaa

SEQ ID NO: 39380 - DNA, 20 bp, Artificial Sequence
  chemically synthesized
atttaaaggactgttgatat

SEQ ID NO: 39381 - DNA, 20 bp, Artificial Sequence
  chemically synthesized
gttgatattggttcacccat

SEQ ID NO: 39382 - DNA, 20 bp, Artificial Sequence
  chemically synthesized
ttgatattggttcacccatc

SEQ ID NO: 39383 - DNA, 20 bp, Artificial Sequence
  chemically synthesized
tattggttcacccatcagga

SEQ ID NO: 39384 - DNA, 20 bp, Artificial Sequence
  chemically synthesized
tggttcacccatcaggaaag

SEQ ID NO: 39385 - DNA, 20 bp, Artificial Sequence
  chemically synthesized
acccatcaggaaagaagtct

SEQ ID NO: 39386 - DNA, 20 bp, Artificial Sequence
  chemically synthesized
cccatcaggaaagaagtctt

SEQ ID NO: 39387 - DNA, 20 bp, Artificial Sequence
  chemically synthesized
ccatcaggaaagaagtctta

SEQ ID NO: 39388 - DNA, 20 bp, Artificial Sequence
  chemically synthesized
aagtcttagggtttttaatg

SEQ ID NO: 39389 - DNA, 20 bp, Artificial Sequence
  chemically synthesized
tgcagatatctttatacatc

SEQ ID NO: 39390 - DNA, 20 bp, Artificial Sequence
  chemically synthesized
aaaattatgtatgaatataa

SEQ ID NO: 39391 - DNA, 20 bp, Artificial Sequence
  chemically synthesized
tgaatataatggctaatata

SEQ ID NO: 39392 - DNA, 20 bp, Artificial Sequence
  chemically synthesized
aatatatggttattttattc

SEQ ID NO: 39393 - DNA, 20 bp, Artificial Sequence
  chemically synthesized
tatatggttattttattctg

SEQ ID NO: 39394 - DNA, 20 bp, Artificial Sequence
  chemically synthesized
ggttattttattctggagat

SEQ ID NO: 39395 - DNA, 20 bp, Artificial Sequence
  chemically synthesized
tggagatcagacctaaatat

SEQ ID NO: 39396 - DNA, 20 bp, Artificial Sequence
  chemically synthesized
ggagatcagacctaaatata

SEQ ID NO: 39397 - DNA, 20 bp, Artificial Sequence
  chemically synthesized
agatcagacctaaatataag

SEQ ID NO: 39398 - DNA, 20 bp, Artificial Sequence
  chemically synthesized
tcagacctaaatataaggag

SEQ ID NO: 39399 - DNA, 20 bp, Artificial Sequence
  chemically synthesized
ggagtagatattatatgttt

SEQ ID NO: 39400 - DNA, 20 bp, Artificial Sequence
  chemically synthesized
agtagatattatatgtttca

SEQ ID NO: 39401 - DNA, 20 bp, Artificial Sequence
  chemically synthesized
agatattatatgtttcagag

SEQ ID NO: 39402 - DNA, 20 bp, Artificial Sequence
  chemically synthesized
cctatgcatacatatattga

SEQ ID NO: 39403 - DNA, 20 bp, Artificial Sequence
  chemically synthesized
aaacccacatatatatgaat

SEQ ID NO: 39404 - DNA, 20 bp, Artificial Sequence
  chemically synthesized
ccacatatatatgaatgaga

SEQ ID NO: 39405 - DNA, 20 bp, Artificial Sequence
  chemically synthesized
tatatatgaatgagatagct

SEQ ID NO: 39406 - DNA, 20 bp, Artificial Sequence
  chemically synthesized
atatatgaatgagatagctc

SEQ ID NO: 39407 - DNA, 20 bp, Artificial Sequence
  chemically synthesized
tatatgaatgagatagctca

SEQ ID NO: 39408 - DNA, 20 bp, Artificial Sequence
  chemically synthesized
atgaatgagatagctcaggg

SEQ ID NO: 39409 - DNA, 20 bp, Artificial Sequence
  chemically synthesized
tgaatgagatagctcagggt

SEQ ID NO: 39410 - DNA, 20 bp, Artificial Sequence
  chemically synthesized
gaatgagatagctcagggta

SEQ ID NO: 39411 - DNA, 20 bp, Artificial Sequence
  chemically synthesized
tgagatagctcagggtaggg

SEQ ID NO: 39412 - DNA, 20 bp, Artificial Sequence
  chemically synthesized
atagctcagggtagggtagt

SEQ ID NO: 39413 - DNA, 20 bp, Artificial Sequence
  chemically synthesized
ggtagtgagttttgaatcaa

SEQ ID NO: 39414 - DNA, 20 bp, Artificial Sequence
  chemically synthesized
gtgagttttgaatcaataga

SEQ ID NO: 39415 - DNA, 20 bp, Artificial Sequence
  chemically synthesized
atgtctgatgaataatcatc

SEQ ID NO: 39416 - DNA, 20 bp, Artificial Sequence
  chemically synthesized
tgaataatcatcaagacgaa

SEQ ID NO: 39417 - DNA, 20 bp, Artificial Sequence
  chemically synthesized
gaataatcatcaagacgaaa

SEQ ID NO: 39418 - DNA, 20 bp, Artificial Sequence
  chemically synthesized
atcatcaagacgaaaaggtt

SEQ ID NO: 39419 - DNA, 20 bp, Artificial Sequence
  chemically synthesized
atcaagacgaaaaggtttgg

SEQ ID NO: 39420 - DNA, 20 bp, Artificial Sequence
  chemically synthesized
aagacgaaaaggtttggtgg

SEQ ID NO: 39421 - DNA, 20 bp, Artificial Sequence
  chemically synthesized
aaaaggtttggtggtggctc

SEQ ID NO: 39422 - DNA, 20 bp, Artificial Sequence
  chemically synthesized
aaaggtttggtggtggctca

SEQ ID NO: 39423 - DNA, 20 bp, Artificial Sequence
  chemically synthesized
ggtggctcaaggattttgta

SEQ ID NO: 39424 - DNA, 20 bp, Artificial Sequence
  chemically synthesized
gtggctcaaggattttgtaa

SEQ ID NO: 39425 - DNA, 20 bp, Artificial Sequence
  chemically synthesized
tggctcaaggattttgtaaa

SEQ ID NO: 39426 - DNA, 20 bp, Artificial Sequence
  chemically synthesized
gattttgtaaagggttgaat

SEQ ID NO: 39427 - DNA, 20 bp, Artificial Sequence
  chemically synthesized
ttttgtaaagggttgaatta

SEQ ID NO: 39428 - DNA, 20 bp, Artificial Sequence
  chemically synthesized
ttgaattagagaatataata

SEQ ID NO: 39429 - DNA, 20 bp, Artificial Sequence
  chemically synthesized
agaatataatacagtttgaa

SEQ ID NO: 39430 - DNA, 20 bp, Artificial Sequence
  chemically synthesized
gaatataatacagtttgaaa

SEQ ID NO: 39431 - DNA, 20 bp, Artificial Sequence
  chemically synthesized
aatataatacagtttgaaaa

SEQ ID NO: 39432 - DNA, 20 bp, Artificial Sequence
  chemically synthesized
atataatacagtttgaaaag

SEQ ID NO: 39433 - DNA, 20 bp, Artificial Sequence
  chemically synthesized
ttcaaatgttaacatttaca

SEQ ID NO: 39434 - DNA, 20 bp, Artificial Sequence
  chemically synthesized
tgttaacatttacaaagaca

SEQ ID NO: 39435 - DNA, 20 bp, Artificial Sequence
  chemically synthesized
atttacaaagacaaagtgac

SEQ ID NO: 39436 - DNA, 20 bp, Artificial Sequence
  chemically synthesized
gtgactggtcttcccactct

SEQ ID NO: 39437 - DNA, 20 bp, Artificial Sequence
  chemically synthesized
tcttcccactctaagaccaa

SEQ ID NO: 39438 - DNA, 20 bp, Artificial Sequence
  chemically synthesized
ctaagaccaatggaacactt

SEQ ID NO: 39439 - DNA, 20 bp, Artificial Sequence
  chemically synthesized
aagaccaatggaacacttga

SEQ ID NO: 39440 - DNA, 20 bp, Artificial Sequence
  chemically synthesized
cacttgagagtgactcattt

SEQ ID NO: 39441 - DNA, 20 bp, Artificial Sequence
  chemically synthesized
ggtcatgcctcatctgatgt

SEQ ID NO: 39442 - DNA, 20 bp, Artificial Sequence
  chemically synthesized
tcatgcctcatctgatgtta

SEQ ID NO: 39443 - DNA, 20 bp, Artificial Sequence
  chemically synthesized
gttagagacacaacttctct

SEQ ID NO: 39444 - DNA, 20 bp, Artificial Sequence
  chemically synthesized
tagagacacaacttctctta

SEQ ID NO: 39445 - DNA, 20 bp, Artificial Sequence
  chemically synthesized
tcttagagactctccttcca

SEQ ID NO: 39446 - DNA, 20 bp, Artificial Sequence
  chemically synthesized
ctccttccaaagaaaaaata

SEQ ID NO: 39447 - DNA, 20 bp, Artificial Sequence
  chemically synthesized
tccttccaaagaaaaaataa

SEQ ID NO: 39448 - DNA, 20 bp, Artificial Sequence
  chemically synthesized
caaagaaaaaataaaggcca

SEQ ID NO: 39449 - DNA, 20 bp, Artificial Sequence
  chemically synthesized
aaagaaaaaataaaggccat

SEQ ID NO: 39450 - DNA, 20 bp, Artificial Sequence
  chemically synthesized
aagaaaaaataaaggccatg

SEQ ID NO: 39451 - DNA, 20 bp, Artificial Sequence
  chemically synthesized
aaaataaaggccatggggac

SEQ ID NO: 39452 - DNA, 20 bp, Artificial Sequence
  chemically synthesized
gccatggggaccagtttcaa

SEQ ID NO: 39453 - DNA, 20 bp, Artificial Sequence
  chemically synthesized
ggggaccagtttcaatggcc

SEQ ID NO: 39454 - DNA, 20 bp, Artificial Sequence
  chemically synthesized
tcaatggcccagatctttcc

SEQ ID NO: 39455 - DNA, 20 bp, Artificial Sequence
  chemically synthesized
caatggcccagatctttccc

SEQ ID NO: 39456 - DNA, 20 bp, Artificial Sequence
  chemically synthesized
ggcccagatctttcccaggt

SEQ ID NO: 39457 - DNA, 20 bp, Artificial Sequence
  chemically synthesized
gcccagatctttcccaggtt

SEQ ID NO: 39458 - DNA, 20 bp, Artificial Sequence
  chemically synthesized
cccagatctttcccaggttg

SEQ ID NO: 39459 - DNA, 20 bp, Artificial Sequence
  chemically synthesized
cagatctttcccaggttggg

SEQ ID NO: 39460 - DNA, 20 bp, Artificial Sequence
  chemically synthesized
agatctttcccaggttgggg

SEQ ID NO: 39461 - DNA, 20 bp, Artificial Sequence
  chemically synthesized
tttcccaggttggggaggaa

SEQ ID NO: 39462 - DNA, 20 bp, Artificial Sequence
  chemically synthesized
tcccaggttggggaggaaaa

SEQ ID NO: 39463 - DNA, 20 bp, Artificial Sequence
  chemically synthesized
gggaggaaaagagaattatt

SEQ ID NO: 39464 - DNA, 20 bp, Artificial Sequence
  chemically synthesized
ctattcccaaatatcctatg

SEQ ID NO: 39465 - DNA, 20 bp, Artificial Sequence
  chemically synthesized
caaatatcctatgtggaaat

SEQ ID NO: 39466 - DNA, 20 bp, Artificial Sequence
  chemically synthesized
tatcctatgtggaaatgagc

SEQ ID NO: 39467 - DNA, 20 bp, Artificial Sequence
  chemically synthesized
atgagctagaataacccctt

SEQ ID NO: 39468 - DNA, 20 bp, Artificial Sequence
  chemically synthesized
gagctagaataaccccttga

SEQ ID NO: 39469 - DNA, 20 bp, Artificial Sequence
  chemically synthesized
gtaacaaatatatctctcat

SEQ ID NO: 39470 - DNA, 20 bp, Artificial Sequence
  chemically synthesized
atatatctctcatcagaatt

SEQ ID NO: 39471 - DNA, 20 bp, Artificial Sequence
  chemically synthesized
atatctctcatcagaattaa

SEQ ID NO: 39472 - DNA, 20 bp, Artificial Sequence
  chemically synthesized
cagaattaagagtaaatact

SEQ ID NO: 39473 - DNA, 20 bp, Artificial Sequence
  chemically synthesized
agaattaagagtaaatactg

SEQ ID NO: 39474 - DNA, 20 bp, Artificial Sequence
  chemically synthesized
aagagtaaatactgaggata

SEQ ID NO: 39475 - DNA, 20 bp, Artificial Sequence
  chemically synthesized
tatagcaaacaaccaatatt

SEQ ID NO: 39476 - DNA, 20 bp, Artificial Sequence
  chemically synthesized
atagcaaacaaccaatattc

SEQ ID NO: 39477 - DNA, 20 bp, Artificial Sequence
  chemically synthesized
accaatattcaggtcatgct

SEQ ID NO: 39478 - DNA, 20 bp, Artificial Sequence
  chemically synthesized
ggtcatgctcagaaaccgca

SEQ ID NO: 39479 - DNA, 20 bp, Artificial Sequence
  chemically synthesized
tcatgctcagaaaccgcaaa

SEQ ID NO: 39480 - DNA, 20 bp, Artificial Sequence
  chemically synthesized
aaaccgcaaagagaaaactg

SEQ ID NO: 39481 - DNA, 20 bp, Artificial Sequence
  chemically synthesized
gcaaagagaaaactgtggct

SEQ ID NO: 39482 - DNA, 20 bp, Artificial Sequence
  chemically synthesized
caaagagaaaactgtggctc

SEQ ID NO: 39483 - DNA, 20 bp, Artificial Sequence
  chemically synthesized
gagaaaactgtggctcaggt

SEQ ID NO: 39484 - DNA, 20 bp, Artificial Sequence
  chemically synthesized
aactgtggctcaggtaagaa

SEQ ID NO: 39485 - DNA, 20 bp, Artificial Sequence
  chemically synthesized
tggctcaggtaagaaaagcc

SEQ ID NO: 39486 - DNA, 20 bp, Artificial Sequence
  chemically synthesized
ggctcaggtaagaaaagcca

SEQ ID NO: 39487 - DNA, 20 bp, Artificial Sequence
  chemically synthesized
aaaagccaaggattcaaata

SEQ ID NO: 39488 - DNA, 20 bp, Artificial Sequence
  chemically synthesized
aaagccaaggattcaaatac

SEQ ID NO: 39489 - DNA, 20 bp, Artificial Sequence
  chemically synthesized
gccaaggattcaaatacggg

SEQ ID NO: 39490 - DNA, 20 bp, Artificial Sequence
  chemically synthesized
aggattcaaatacgggaagc

SEQ ID NO: 39491 - DNA, 20 bp, Artificial Sequence
  chemically synthesized
gtttaaccatttccatttga

SEQ ID NO: 39492 - DNA, 20 bp, Artificial Sequence
  chemically synthesized
catttccatttgatggacat

SEQ ID NO: 39493 - DNA, 20 bp, Artificial Sequence
  chemically synthesized
ccatttgatggacattggtt

SEQ ID NO: 39494 - DNA, 20 bp, Artificial Sequence
  chemically synthesized
tggacattggttgagaatat

SEQ ID NO: 39495 - DNA, 20 bp, Artificial Sequence
  chemically synthesized
attggttgagaatatgagct

SEQ ID NO: 39496 - DNA, 20 bp, Artificial Sequence
  chemically synthesized
ttggttgagaatatgagctt

SEQ ID NO: 39497 - DNA, 20 bp, Artificial Sequence
  chemically synthesized
gagaatatgagcttgggttt

SEQ ID NO: 39498 - DNA, 20 bp, Artificial Sequence
  chemically synthesized
agaatatgagcttgggtttt

SEQ ID NO: 39499 - DNA, 20 bp, Artificial Sequence
  chemically synthesized
tatgagcttgggttttgggt

SEQ ID NO: 39500 - DNA, 20 bp, Artificial Sequence
  chemically synthesized
aattcctttatgacacatat

SEQ ID NO: 39501 - DNA, 20 bp, Artificial Sequence
  chemically synthesized
acatattagttgcgtgatct

SEQ ID NO: 39502 - DNA, 20 bp, Artificial Sequence
  chemically synthesized
catattagttgcgtgatctt

SEQ ID NO: 39503 - DNA, 20 bp, Artificial Sequence
  chemically synthesized
gctaattgcttaacttgtct

SEQ ID NO: 39504 - DNA, 20 bp, Artificial Sequence
  chemically synthesized
ctaattgcttaacttgtcta

SEQ ID NO: 39505 - DNA, 20 bp, Artificial Sequence
  chemically synthesized
ttttctctctctctctttaa

SEQ ID NO: 39506 - DNA, 20 bp, Artificial Sequence
  chemically synthesized
acagatttttctctgttgcc

SEQ ID NO: 39507 - DNA, 20 bp, Artificial Sequence
  chemically synthesized
cagatttttctctgttgccc

SEQ ID NO: 39508 - DNA, 20 bp, Artificial Sequence
  chemically synthesized
tttttctctgttgcccaggc

SEQ ID NO: 39509 - DNA, 20 bp, Artificial Sequence
  chemically synthesized
tttctctgttgcccaggcta

SEQ ID NO: 39510 - DNA, 20 bp, Artificial Sequence
  chemically synthesized
ctgttgcccaggctagagtg

SEQ ID NO: 39511 - DNA, 20 bp, Artificial Sequence
  chemically synthesized
ttgcccaggctagagtgcag

SEQ ID NO: 39512 - DNA, 20 bp, Artificial Sequence
  chemically synthesized
agagtgcagtggtgcgatct

SEQ ID NO: 39513 - DNA, 20 bp, Artificial Sequence
  chemically synthesized
ctcactgcgacctcctccac

SEQ ID NO: 39514 - DNA, 20 bp, Artificial Sequence
  chemically synthesized
tcactgcgacctcctccacc

SEQ ID NO: 39515 - DNA, 20 bp, Artificial Sequence
  chemically synthesized
cactgcgacctcctccacca

SEQ ID NO: 39516 - DNA, 20 bp, Artificial Sequence
  chemically synthesized
cgacctcctccaccagggtt

SEQ ID NO: 39517 - DNA, 20 bp, Artificial Sequence
  chemically synthesized
gacctcctccaccagggttc

SEQ ID NO: 39518 - DNA, 20 bp, Artificial Sequence
  chemically synthesized
acctcctccaccagggttca

SEQ ID NO: 39519 - DNA, 20 bp, Artificial Sequence
  chemically synthesized
cctcctccaccagggttcag

SEQ ID NO: 39520 - DNA, 20 bp, Artificial Sequence
  chemically synthesized
ttcaggggattctcatgcct

SEQ ID NO: 39521 - DNA, 20 bp, Artificial Sequence
  chemically synthesized
gattctcatgcctcagcctc

SEQ ID NO: 39522 - DNA, 20 bp, Artificial Sequence
  chemically synthesized
ttctcatgcctcagcctcca

SEQ ID NO: 39523 - DNA, 20 bp, Artificial Sequence
  chemically synthesized
tcatgcctcagcctccagag

SEQ ID NO: 39524 - DNA, 20 bp, Artificial Sequence
  chemically synthesized
gcctcagcctccagagtagc

SEQ ID NO: 39525 - DNA, 20 bp, Artificial Sequence
  chemically synthesized
cctcagcctccagagtagct

SEQ ID NO: 39526 - DNA, 20 bp, Artificial Sequence
  chemically synthesized
tgatcatgtgccaccacacc

SEQ ID NO: 39527 - DNA, 20 bp, Artificial Sequence
  chemically synthesized
ctggcttatttttgtaatta

SEQ ID NO: 39528 - DNA, 20 bp, Artificial Sequence
  chemically synthesized
gcttatttttgtaattatag

SEQ ID NO: 39529 - DNA, 20 bp, Artificial Sequence
  chemically synthesized
ttttgtaattatagtagtga

SEQ ID NO: 39530 - DNA, 20 bp, Artificial Sequence
  chemically synthesized
gtgatggtgttttgccatgt

SEQ ID NO: 39531 - DNA, 20 bp, Artificial Sequence
  chemically synthesized
ggtgttttgccatgttggcc

SEQ ID NO: 39532 - DNA, 20 bp, Artificial Sequence
  chemically synthesized
ttttgccatgttggcccagc

SEQ ID NO: 39533 - DNA, 20 bp, Artificial Sequence
  chemically synthesized
ggtctcgaactcctgaactc

SEQ ID NO: 39534 - DNA, 20 bp, Artificial Sequence
  chemically synthesized
ctcaagtgatccaccctcct

SEQ ID NO: 39535 - DNA, 20 bp, Artificial Sequence
  chemically synthesized
ccaccctcctcggcctccca

SEQ ID NO: 39536 - DNA, 20 bp, Artificial Sequence
  chemically synthesized
tcctcggcctcccaaagtgc

SEQ ID NO: 39537 - DNA, 20 bp, Artificial Sequence
  chemically synthesized
cctcggcctcccaaagtgct

SEQ ID NO: 39538 - DNA, 20 bp, Artificial Sequence
  chemically synthesized
ctcccaaagtgctgggatta

SEQ ID NO: 39539 - DNA, 20 bp, Artificial Sequence
  chemically synthesized
tcccaaagtgctgggattat

SEQ ID NO: 39540 - DNA, 20 bp, Artificial Sequence
  chemically synthesized
agtgctgggattataggcat

SEQ ID NO: 39541 - DNA, 20 bp, Artificial Sequence
  chemically synthesized
taggcatgagccaccgtgcc

SEQ ID NO: 39542 - DNA, 20 bp, Artificial Sequence
  chemically synthesized
tttactcactttttgtctca

SEQ ID NO: 39543 - DNA, 20 bp, Artificial Sequence
  chemically synthesized
actttttgtctcacagtcat

SEQ ID NO: 39544 - DNA, 20 bp, Artificial Sequence
  chemically synthesized
ctttttgtctcacagtcatt

SEQ ID NO: 39545 - DNA, 20 bp, Artificial Sequence
  chemically synthesized
tgaaattgtcaatattacca

SEQ ID NO: 39546 - DNA, 20 bp, Artificial Sequence
  chemically synthesized
tgtcaatattaccaaagacc

SEQ ID NO: 39547 - DNA, 20 bp, Artificial Sequence
  chemically synthesized
ttttcactattaacctacca

SEQ ID NO: 39548 - DNA, 20 bp, Artificial Sequence
  chemically synthesized
tcattgtttttttgtaaata

SEQ ID NO: 39549 - DNA, 20 bp, Artificial Sequence
  chemically synthesized
cttctttgtctatctccttt

SEQ ID NO: 39550 - DNA, 20 bp, Artificial Sequence
  chemically synthesized
ttgagatctttctttttact

SEQ ID NO: 39551 - DNA, 20 bp, Artificial Sequence
  chemically synthesized
gagatctttctttttactga

SEQ ID NO: 39552 - DNA, 20 bp, Artificial Sequence
  chemically synthesized
actgagagcaaaatttgtcc

SEQ ID NO: 39553 - DNA, 20 bp, Artificial Sequence
  chemically synthesized
cctttttttttttttttttt

SEQ ID NO: 39554 - DNA, 20 bp, Artificial Sequence
  chemically synthesized
ttttttttttttttttgaga

SEQ ID NO: 39555 - DNA, 20 bp, Artificial Sequence
  chemically synthesized
ttttttttttttttgagaca

SEQ ID NO: 39556 - DNA, 20 bp, Artificial Sequence
  chemically synthesized
cagagccttgctttgtcgcc

SEQ ID NO: 39557 - DNA, 20 bp, Artificial Sequence
  chemically synthesized
agagccttgctttgtcgccc

SEQ ID NO: 39558 - DNA, 20 bp, Artificial Sequence
  chemically synthesized
ttgctttgtcgcccaggctg

SEQ ID NO: 39559 - DNA, 20 bp, Artificial Sequence
  chemically synthesized
ttgtcgcccaggctgtagtg

SEQ ID NO: 39560 - DNA, 20 bp, Artificial Sequence
  chemically synthesized
tcgcccaggctgtagtgcag

SEQ ID NO: 39561 - DNA, 20 bp, Artificial Sequence
  chemically synthesized
gtagtgcagtggcacaatct

SEQ ID NO: 39562 - DNA, 20 bp, Artificial Sequence
  chemically synthesized
ctgcgacgacctctgctccc

SEQ ID NO: 39563 - DNA, 20 bp, Artificial Sequence
  chemically synthesized
tctgctccccagttttttta

SEQ ID NO: 39564 - DNA, 20 bp, Artificial Sequence
  chemically synthesized
ttaaagcaattctcctgcct

SEQ ID NO: 39565 - DNA, 20 bp, Artificial Sequence
  chemically synthesized
ttctcctgcctcagcctccc

SEQ ID NO: 39566 - DNA, 20 bp, Artificial Sequence
  chemically synthesized
tcctgcctcagcctcccgag

SEQ ID NO: 39567 - DNA, 20 bp, Artificial Sequence
  chemically synthesized
gcctcagcctcccgagtagc

SEQ ID NO: 39568 - DNA, 20 bp, Artificial Sequence
  chemically synthesized
cctcagcctcccgagtagct

SEQ ID NO: 39569 - DNA, 20 bp, Artificial Sequence
  chemically synthesized
ctcccgagtagctgggatta

SEQ ID NO: 39570 - DNA, 20 bp, Artificial Sequence
  chemically synthesized
tcccgagtagctgggattac

SEQ ID NO: 39571 - DNA, 20 bp, Artificial Sequence
  chemically synthesized
caggcgctcaccaccacacc

SEQ ID NO: 39572 - DNA, 20 bp, Artificial Sequence
  chemically synthesized
ccagctaatttttgtatttt

SEQ ID NO: 39573 - DNA, 20 bp, Artificial Sequence
  chemically synthesized
gctaatttttgtatttttag

SEQ ID NO: 39574 - DNA, 20 bp, Artificial Sequence
  chemically synthesized
taatttttgtatttttagta

SEQ ID NO: 39575 - DNA, 20 bp, Artificial Sequence
  chemically synthesized
ttttgtatttttagtagaga

SEQ ID NO: 39576 - DNA, 20 bp, Artificial Sequence
  chemically synthesized
tttgtatttttagtagagac

SEQ ID NO: 39577 - DNA, 20 bp, Artificial Sequence
  chemically synthesized
ttgtatttttagtagagaca

SEQ ID NO: 39578 - DNA, 20 bp, Artificial Sequence
  chemically synthesized
gagacagggtttcaccatgt

SEQ ID NO: 39579 - DNA, 20 bp, Artificial Sequence
  chemically synthesized
cagggtttcaccatgttggc

SEQ ID NO: 39580 - DNA, 20 bp, Artificial Sequence
  chemically synthesized
agggtttcaccatgttggcc

SEQ ID NO: 39581 - DNA, 20 bp, Artificial Sequence
  chemically synthesized
tttcaccatgttggccaggc

SEQ ID NO: 39582 - DNA, 20 bp, Artificial Sequence
  chemically synthesized
gctgacctcgtgatccacct

SEQ ID NO: 39583 - DNA, 20 bp, Artificial Sequence
  chemically synthesized
tgatccacctcagccttcca

SEQ ID NO: 39584 - DNA, 20 bp, Artificial Sequence
  chemically synthesized
acctcagccttccaaagtgc

SEQ ID NO: 39585 - DNA, 20 bp, Artificial Sequence
  chemically synthesized
cctcagccttccaaagtgct

SEQ ID NO: 39586 - DNA, 20 bp, Artificial Sequence
  chemically synthesized
cttccaaagtgctaggatta

SEQ ID NO: 39587 - DNA, 20 bp, Artificial Sequence
  chemically synthesized
ttccaaagtgctaggattac

SEQ ID NO: 39588 - DNA, 20 bp, Artificial Sequence
  chemically synthesized
agtgctaggattacaggcat

SEQ ID NO: 39589 - DNA, 20 bp, Artificial Sequence
  chemically synthesized
caggcatgagcctctgtgcc

SEQ ID NO: 39590 - DNA, 20 bp, Artificial Sequence
  chemically synthesized
ttccattttaatttgtactt

SEQ ID NO: 39591 - DNA, 20 bp, Artificial Sequence
  chemically synthesized
tccattttaatttgtactta

SEQ ID NO: 39592 - DNA, 20 bp, Artificial Sequence
  chemically synthesized
ttttaatttgtacttaaggt

SEQ ID NO: 39593 - DNA, 20 bp, Artificial Sequence
  chemically synthesized
acttaaggtaagatataaaa

SEQ ID NO: 39594 - DNA, 20 bp, Artificial Sequence
  chemically synthesized
gatataaaaaagtcacttaa

SEQ ID NO: 39595 - DNA, 20 bp, Artificial Sequence
  chemically synthesized
aaaaaagtcacttaaaagct

SEQ ID NO: 39596 - DNA, 20 bp, Artificial Sequence
  chemically synthesized
acttaaaagctgagattttt

SEQ ID NO: 39597 - DNA, 20 bp, Artificial Sequence
  chemically synthesized
gatattttgtcttcatctca

SEQ ID NO: 39598 - DNA, 20 bp, Artificial Sequence
  chemically synthesized
atctcatggcttcccattgt

SEQ ID NO: 39599 - DNA, 20 bp, Artificial Sequence
  chemically synthesized
ttgactttaaatatttattt

SEQ ID NO: 39600 - DNA, 20 bp, Artificial Sequence
  chemically synthesized
atatttattaatttcttcta

SEQ ID NO: 39601 - DNA, 20 bp, Artificial Sequence
  chemically synthesized
tatttattaatttcttctat

SEQ ID NO: 39602 - DNA, 20 bp, Artificial Sequence
  chemically synthesized
cttctataggaacacaattt

SEQ ID NO: 39603 - DNA, 20 bp, Artificial Sequence
  chemically synthesized
ttctataggaacacaatttt

SEQ ID NO: 39604 - DNA, 20 bp, Artificial Sequence
  chemically synthesized
tctataggaacacaattttg

SEQ ID NO: 39605 - DNA, 20 bp, Artificial Sequence
  chemically synthesized
cacaattttggggcaatatg

SEQ ID NO: 39606 - DNA, 20 bp, Artificial Sequence
  chemically synthesized
caattttggggcaatatgtg

SEQ ID NO: 39607 - DNA, 20 bp, Artificial Sequence
  chemically synthesized
ggcaatatgtggagatgaaa

SEQ ID NO: 39608 - DNA, 20 bp, Artificial Sequence
  chemically synthesized
aatatgtggagatgaaaaag

SEQ ID NO: 39609 - DNA, 20 bp, Artificial Sequence
  chemically synthesized
tggagatgaaaaagtggatt

SEQ ID NO: 39610 - DNA, 20 bp, Artificial Sequence
  chemically synthesized
ggagatgaaaaagtggattc

SEQ ID NO: 39611 - DNA, 20 bp, Artificial Sequence
  chemically synthesized
gagatgaaaaagtggattca

SEQ ID NO: 39612 - DNA, 20 bp, Artificial Sequence
  chemically synthesized
agatgaaaaagtggattcag

SEQ ID NO: 39613 - DNA, 20 bp, Artificial Sequence
  chemically synthesized
ttcaggggacactgattgta

SEQ ID NO: 39614 - DNA, 20 bp, Artificial Sequence
  chemically synthesized
tcaggggacactgattgtac

SEQ ID NO: 39615 - DNA, 20 bp, Artificial Sequence
  chemically synthesized
caggggacactgattgtaca

SEQ ID NO: 39616 - DNA, 20 bp, Artificial Sequence
  chemically synthesized
ctgattgtacagggcacttg

SEQ ID NO: 39617 - DNA, 20 bp, Artificial Sequence
  chemically synthesized
cagggcacttgcagattatc

SEQ ID NO: 39618 - DNA, 20 bp, Artificial Sequence
  chemically synthesized
gcagattatctggaactaaa

SEQ ID NO: 39619 - DNA, 20 bp, Artificial Sequence
  chemically synthesized
gattatctggaactaaacgg

SEQ ID NO: 39620 - DNA, 20 bp, Artificial Sequence
  chemically synthesized
ctctttttgtcttctcattt

SEQ ID NO: 39621 - DNA, 20 bp, Artificial Sequence
  chemically synthesized
ttagtttatgtctttataaa

SEQ ID NO: 39622 - DNA, 20 bp, Artificial Sequence
  chemically synthesized
tttataaatggtttcctgaa

SEQ ID NO: 39623 - DNA, 20 bp, Artificial Sequence
  chemically synthesized
tggtttcctgaacagttcct

SEQ ID NO: 39624 - DNA, 20 bp, Artificial Sequence
  chemically synthesized
acagttcctaagctttttgt

SEQ ID NO: 39625 - DNA, 20 bp, Artificial Sequence
  chemically synthesized
tcctaagctttttgtcagca

SEQ ID NO: 39626 - DNA, 20 bp, Artificial Sequence
  chemically synthesized
aagctttttgtcagcatggc

SEQ ID NO: 39627 - DNA, 20 bp, Artificial Sequence
  chemically synthesized
tttgtcagcatggcaagttg

SEQ ID NO: 39628 - DNA, 20 bp, Artificial Sequence
  chemically synthesized
gtcagcatggcaagttgaag

SEQ ID NO: 39629 - DNA, 20 bp, Artificial Sequence
  chemically synthesized
atggcaagttgaagaagctc

SEQ ID NO: 39630 - DNA, 20 bp, Artificial Sequence
  chemically synthesized
gttgaagaagctctggatga

SEQ ID NO: 39631 - DNA, 20 bp, Artificial Sequence
  chemically synthesized
tgatggatctatgttacctt

SEQ ID NO: 39632 - DNA, 20 bp, Artificial Sequence
  chemically synthesized
tgttaccttcagaaactctt

SEQ ID NO: 39633 - DNA, 20 bp, Artificial Sequence
  chemically synthesized
gttaccttcagaaactcttg

SEQ ID NO: 39634 - DNA, 20 bp, Artificial Sequence
  chemically synthesized
tcagaaactcttgaggactc

SEQ ID NO: 39635 - DNA, 20 bp, Artificial Sequence
  chemically synthesized
cagaaactcttgaggactct

SEQ ID NO: 39636 - DNA, 20 bp, Artificial Sequence
  chemically synthesized
aactcttgaggactctggga

SEQ ID NO: 39637 - DNA, 20 bp, Artificial Sequence
  chemically synthesized
ctctgggatagttgctgtca

SEQ ID NO: 39638 - DNA, 20 bp, Artificial Sequence
  chemically synthesized
gatagttgctgtcaaagaat

SEQ ID NO: 39639 - DNA, 20 bp, Artificial Sequence
  chemically synthesized
gctgtcaaagaatcagtcca

SEQ ID NO: 39640 - DNA, 20 bp, Artificial Sequence
  chemically synthesized
ctgtcaaagaatcagtccaa

SEQ ID NO: 39641 - DNA, 20 bp, Artificial Sequence
  chemically synthesized
agaatcagtccaaaggcact

SEQ ID NO: 39642 - DNA, 20 bp, Artificial Sequence
  chemically synthesized
tcagtccaaaggcactcaga

SEQ ID NO: 39643 - DNA, 20 bp, Artificial Sequence
  chemically synthesized
cagtccaaaggcactcagaa

SEQ ID NO: 39644 - DNA, 20 bp, Artificial Sequence
  chemically synthesized
agtccaaaggcactcagaaa

SEQ ID NO: 39645 - DNA, 20 bp, Artificial Sequence
  chemically synthesized
gtccaaaggcactcagaaag

SEQ ID NO: 39646 - DNA, 20 bp, Artificial Sequence
  chemically synthesized
aaaggcactcagaaaggggc

SEQ ID NO: 39647 - DNA, 20 bp, Artificial Sequence
  chemically synthesized
aggcactcagaaaggggcaa

SEQ ID NO: 39648 - DNA, 20 bp, Artificial Sequence
  chemically synthesized
ctcagaaaggggcaagagaa

SEQ ID NO: 39649 - DNA, 20 bp, Artificial Sequence
  chemically synthesized
gaaaggggcaagagaacagt

SEQ ID NO: 39650 - DNA, 20 bp, Artificial Sequence
  chemically synthesized
ggggcaagagaacagtgagc

SEQ ID NO: 39651 - DNA, 20 bp, Artificial Sequence
  chemically synthesized
ccagtcatttttgcatccct

SEQ ID NO: 39652 - DNA, 20 bp, Artificial Sequence
  chemically synthesized
cagtcatttttgcatccctc

SEQ ID NO: 39653 - DNA, 20 bp, Artificial Sequence
  chemically synthesized
agtcatttttgcatccctca

SEQ ID NO: 39654 - DNA, 20 bp, Artificial Sequence
  chemically synthesized
gtcatttttgcatccctcag

SEQ ID NO: 39655 - DNA, 20 bp, Artificial Sequence
  chemically synthesized
tcatttttgcatccctcagg

SEQ ID NO: 39656 - DNA, 20 bp, Artificial Sequence
  chemically synthesized
gggggcctctatgcttgcct

SEQ ID NO: 39657 - DNA, 20 bp, Artificial Sequence
  chemically synthesized
gggcctctatgcttgcctga

SEQ ID NO: 39658 - DNA, 20 bp, Artificial Sequence
  chemically synthesized
gagagtgataaattccacta

SEQ ID NO: 39659 - DNA, 20 bp, Artificial Sequence
  chemically synthesized
ttttgtcatgtatcacattc

SEQ ID NO: 39660 - DNA, 20 bp, Artificial Sequence
  chemically synthesized
tttgtcatgtatcacattct

SEQ ID NO: 39661 - DNA, 20 bp, Artificial Sequence
  chemically synthesized
tgtcatgtatcacattctag

SEQ ID NO: 39662 - DNA, 20 bp, Artificial Sequence
  chemically synthesized
taggagactccctaaactat

SEQ ID NO: 39663 - DNA, 20 bp, Artificial Sequence
  chemically synthesized
aggagactccctaaactatt

SEQ ID NO: 39664 - DNA, 20 bp, Artificial Sequence
  chemically synthesized
ggagactccctaaactatta

SEQ ID NO: 39665 - DNA, 20 bp, Artificial Sequence
  chemically synthesized
attagggcaactattctccc

SEQ ID NO: 39666 - DNA, 20 bp, Artificial Sequence
  chemically synthesized
actattctccctggaatatt

SEQ ID NO: 39667 - DNA, 20 bp, Artificial Sequence
  chemically synthesized
ctattctccctggaatattt

SEQ ID NO: 39668 - DNA, 20 bp, Artificial Sequence
  chemically synthesized
ccctggaatatttgggtatg

SEQ ID NO: 39669 - DNA, 20 bp, Artificial Sequence
  chemically synthesized
ggaatatttgggtatgtgga

SEQ ID NO: 39670 - DNA, 20 bp, Artificial Sequence
  chemically synthesized
ttgggtatgtggacagtttc

SEQ ID NO: 39671 - DNA, 20 bp, Artificial Sequence
  chemically synthesized
aatttgccacaattaaatgc

SEQ ID NO: 39672 - DNA, 20 bp, Artificial Sequence
  chemically synthesized
gccacaattaaatgccagcg

SEQ ID NO: 39673 - DNA, 20 bp, Artificial Sequence
  chemically synthesized
tgccagcgtagctgttttgc

SEQ ID NO: 39674 - DNA, 20 bp, Artificial Sequence
  chemically synthesized
ccagcgtagctgttttgcta

SEQ ID NO: 39675 - DNA, 20 bp, Artificial Sequence
  chemically synthesized
agctgttttgctagagactg

SEQ ID NO: 39676 - DNA, 20 bp, Artificial Sequence
  chemically synthesized
tagagactgcagatgttaaa

SEQ ID NO: 39677 - DNA, 20 bp, Artificial Sequence
  chemically synthesized
gagactgcagatgttaaata

SEQ ID NO: 39678 - DNA, 20 bp, Artificial Sequence
  chemically synthesized
agactgcagatgttaaatag

SEQ ID NO: 39679 - DNA, 20 bp, Artificial Sequence
  chemically synthesized
gactgcagatgttaaataga

SEQ ID NO: 39680 - DNA, 20 bp, Artificial Sequence
  chemically synthesized
gttaaatagagggctatctt

SEQ ID NO: 39681 - DNA, 20 bp, Artificial Sequence
  chemically synthesized
ttaaatagagggctatcttt

SEQ ID NO: 39682 - DNA, 20 bp, Artificial Sequence
  chemically synthesized
aattgtattaactatttccc

SEQ ID NO: 39683 - DNA, 20 bp, Artificial Sequence
  chemically synthesized
tttccccagtaattaccaca

SEQ ID NO: 39684 - DNA, 20 bp, Artificial Sequence
  chemically synthesized
gcatccgcatgtcccaaacg

SEQ ID NO: 39685 - DNA, 20 bp, Artificial Sequence
  chemically synthesized
cgcatgtcccaaacgcagct

SEQ ID NO: 39686 - DNA, 20 bp, Artificial Sequence
  chemically synthesized
gcatgtcccaaacgcagctc

SEQ ID NO: 39687 - DNA, 20 bp, Artificial Sequence
  chemically synthesized
aggttttgaaaacacgacta

SEQ ID NO: 39688 - DNA, 20 bp, Artificial Sequence
  chemically synthesized
tgaaaacacgactatagttt

SEQ ID NO: 39689 - DNA, 20 bp, Artificial Sequence
  chemically synthesized
gactatagtttaagaataat

SEQ ID NO: 39690 - DNA, 20 bp, Artificial Sequence
  chemically synthesized
actatagtttaagaataatc

SEQ ID NO: 39691 - DNA, 20 bp, Artificial Sequence
  chemically synthesized
aagaataatcaggcctcctc

SEQ ID NO: 39692 - DNA, 20 bp, Artificial Sequence
  chemically synthesized
ctcctccggcttcctccatc

SEQ ID NO: 39693 - DNA, 20 bp, Artificial Sequence
  chemically synthesized
cctccatctggtccattatc

SEQ ID NO: 39694 - DNA, 20 bp, Artificial Sequence
  chemically synthesized
ctccatctggtccattatct

SEQ ID NO: 39695 - DNA, 20 bp, Artificial Sequence
  chemically synthesized
ctggtccattatctgggtga

SEQ ID NO: 39696 - DNA, 20 bp, Artificial Sequence
  chemically synthesized
gtccattatctgggtgacag

SEQ ID NO: 39697 - DNA, 20 bp, Artificial Sequence
  chemically synthesized
gggtgacagtagatccaaat

SEQ ID NO: 39698 - DNA, 20 bp, Artificial Sequence
  chemically synthesized
tgacagtagatccaaataag

SEQ ID NO: 39699 - DNA, 20 bp, Artificial Sequence
  chemically synthesized
agtagatccaaataagtggt

SEQ ID NO: 39700 - DNA, 20 bp, Artificial Sequence
  chemically synthesized
ttatcctgtacaacaaattt

SEQ ID NO: 39701 - DNA, 20 bp, Artificial Sequence
  chemically synthesized
gcattaatccattctcttat

SEQ ID NO: 39702 - DNA, 20 bp, Artificial Sequence
  chemically synthesized
cattaatccattctcttata

SEQ ID NO: 39703 - DNA, 20 bp, Artificial Sequence
  chemically synthesized
attctcttataaggcaacat

SEQ ID NO: 39704 - DNA, 20 bp, Artificial Sequence
  chemically synthesized
ctcttataaggcaacattgg

SEQ ID NO: 39705 - DNA, 20 bp, Artificial Sequence
  chemically synthesized
tcttataaggcaacattgga

SEQ ID NO: 39706 - DNA, 20 bp, Artificial Sequence
  chemically synthesized
taaggcaacattggaaggtt

SEQ ID NO: 39707 - DNA, 20 bp, Artificial Sequence
  chemically synthesized
aggcaacattggaaggttaa

SEQ ID NO: 39708 - DNA, 20 bp, Artificial Sequence
  chemically synthesized
tgatatacacatcactcctg

SEQ ID NO: 39709 - DNA, 20 bp, Artificial Sequence
  chemically synthesized
tatacacatcactcctgtgg

SEQ ID NO: 39710 - DNA, 20 bp, Artificial Sequence
  chemically synthesized
acacatcactcctgtggcgg

SEQ ID NO: 39711 - DNA, 20 bp, Artificial Sequence
  chemically synthesized
tcactcctgtggcggtagat

SEQ ID NO: 39712 - DNA, 20 bp, Artificial Sequence
  chemically synthesized
tagataagttctgccacatt

SEQ ID NO: 39713 - DNA, 20 bp, Artificial Sequence
  chemically synthesized
ctgccacattaagcactatg

SEQ ID NO: 39714 - DNA, 20 bp, Artificial Sequence
  chemically synthesized
tgccacattaagcactatgc

SEQ ID NO: 39715 - DNA, 20 bp, Artificial Sequence
  chemically synthesized
gcactatgcaggtcataatt

SEQ ID NO: 39716 - DNA, 20 bp, Artificial Sequence
  chemically synthesized
ctatgcaggtcataattcag

SEQ ID NO: 39717 - DNA, 20 bp, Artificial Sequence
  chemically synthesized
aggtcataattcagtggatc

SEQ ID NO: 39718 - DNA, 20 bp, Artificial Sequence
  chemically synthesized
cataattcagtggatcaagt

SEQ ID NO: 39719 - DNA, 20 bp, Artificial Sequence
  chemically synthesized
attcagtggatcaagttagt

SEQ ID NO: 39720 - DNA, 20 bp, Artificial Sequence
  chemically synthesized
cagtggatcaagttagttag

SEQ ID NO: 39721 - DNA, 20 bp, Artificial Sequence
  chemically synthesized
aagttagttagcagtgtttt

SEQ ID NO: 39722 - DNA, 20 bp, Artificial Sequence
  chemically synthesized
ttttagtatccatatgaaca

SEQ ID NO: 39723 - DNA, 20 bp, Artificial Sequence
  chemically synthesized
gaacatagtctctgctactg

SEQ ID NO: 39724 - DNA, 20 bp, Artificial Sequence
  chemically synthesized
gtctctgctactgcagtgcc

SEQ ID NO: 39725 - DNA, 20 bp, Artificial Sequence
  chemically synthesized
actgacatttttgttatcaa

SEQ ID NO: 39726 - DNA, 20 bp, Artificial Sequence
  chemically synthesized
gttatcaacagtgtcccctg

SEQ ID NO: 39727 - DNA, 20 bp, Artificial Sequence
  chemically synthesized
atcaacagtgtcccctgaag

SEQ ID NO: 39728 - DNA, 20 bp, Artificial Sequence
  chemically synthesized
aacagtgtcccctgaagtag

SEQ ID NO: 39729 - DNA, 20 bp, Artificial Sequence
  chemically synthesized
tgaagtagcagccctttcaa

SEQ ID NO: 39730 - DNA, 20 bp, Artificial Sequence
  chemically synthesized
ccaccaataattgcttatat

SEQ ID NO: 39731 - DNA, 20 bp, Artificial Sequence
  chemically synthesized
accaataattgcttatatta

SEQ ID NO: 39732 - DNA, 20 bp, Artificial Sequence
  chemically synthesized
tataattattattgtttcta

SEQ ID NO: 39733 - DNA, 20 bp, Artificial Sequence
  chemically synthesized
ataattattattgtttctat

SEQ ID NO: 39734 - DNA, 20 bp, Artificial Sequence
  chemically synthesized
taggtttttataaaataaaa

SEQ ID NO: 39735 - DNA, 20 bp, Artificial Sequence
  chemically synthesized
aggtttttataaaataaaaa

SEQ ID NO: 39736 - DNA, 20 bp, Artificial Sequence
  chemically synthesized
tataaaataaaaaaggtgca

SEQ ID NO: 39737 - DNA, 20 bp, Artificial Sequence
  chemically synthesized
ttttactgaattacacttca

SEQ ID NO: 39738 - DNA, 20 bp, Artificial Sequence
  chemically synthesized
tttactgaattacacttcaa

SEQ ID NO: 39739 - DNA, 20 bp, Artificial Sequence
  chemically synthesized
gaattacacttcaaaggtgt

SEQ ID NO: 39740 - DNA, 20 bp, Artificial Sequence
  chemically synthesized
ttacacttcaaaggtgtcgg

SEQ ID NO: 39741 - DNA, 20 bp, Artificial Sequence
  chemically synthesized
aatattgaatgatattttaa

SEQ ID NO: 39742 - DNA, 20 bp, Artificial Sequence
  chemically synthesized
aatgatattttaaaagactc

SEQ ID NO: 39743 - DNA, 20 bp, Artificial Sequence
  chemically synthesized
taaaagactctggacacata

SEQ ID NO: 39744 - DNA, 20 bp, Artificial Sequence
  chemically synthesized
catacagaatcaattgaatt

SEQ ID NO: 39745 - DNA, 20 bp, Artificial Sequence
  chemically synthesized
atacagaatcaattgaattt

SEQ ID NO: 39746 - DNA, 20 bp, Artificial Sequence
  chemically synthesized
acagaatcaattgaatttgg

SEQ ID NO: 39747 - DNA, 20 bp, Artificial Sequence
  chemically synthesized
aattgaatttgggagaaact

SEQ ID NO: 39748 - DNA, 20 bp, Artificial Sequence
  chemically synthesized
gagaaactgagtttcccttg

SEQ ID NO: 39749 - DNA, 20 bp, Artificial Sequence
  chemically synthesized
aaacctgctacaaaatttct

SEQ ID NO: 39750 - DNA, 20 bp, Artificial Sequence
  chemically synthesized
caaaaatcttgactttgtaa

SEQ ID NO: 39751 - DNA, 20 bp, Artificial Sequence
  chemically synthesized
aaataaatattaattataaa

SEQ ID NO: 39752 - DNA, 20 bp, Artificial Sequence
  chemically synthesized
ttaattataaatagacttca

SEQ ID NO: 39753 - DNA, 20 bp, Artificial Sequence
  chemically synthesized
tagacttcatagttccctat

SEQ ID NO: 39754 - DNA, 20 bp, Artificial Sequence
  chemically synthesized
agacttcatagttccctatg

SEQ ID NO: 39755 - DNA, 20 bp, Artificial Sequence
  chemically synthesized
ttgtgaatttttctcaatac

SEQ ID NO: 39756 - DNA, 20 bp, Artificial Sequence
  chemically synthesized
ttttctcaatacgagtctta

SEQ ID NO: 39757 - DNA, 20 bp, Artificial Sequence
  chemically synthesized
tcttacagattcataatgat

SEQ ID NO: 39758 - DNA, 20 bp, Artificial Sequence
  chemically synthesized
ttacagattcataatgatta

SEQ ID NO: 39759 - DNA, 20 bp, Artificial Sequence
  chemically synthesized
tacagattcataatgattag

SEQ ID NO: 39760 - DNA, 20 bp, Artificial Sequence
  chemically synthesized
acagattcataatgattaga

SEQ ID NO: 39761 - DNA, 20 bp, Artificial Sequence
  chemically synthesized
ataatgattagagggtctgt

SEQ ID NO: 39762 - DNA, 20 bp, Artificial Sequence
  chemically synthesized
gtctgtaagattgtctccat

SEQ ID NO: 39763 - DNA, 20 bp, Artificial Sequence
  chemically synthesized
gattgtctccatcagcaaca

SEQ ID NO: 39764 - DNA, 20 bp, Artificial Sequence
  chemically synthesized
tagttgccgtattttctctc

SEQ ID NO: 39765 - DNA, 20 bp, Artificial Sequence
  chemically synthesized
agttgccgtattttctctct

SEQ ID NO: 39766 - DNA, 20 bp, Artificial Sequence
  chemically synthesized
ttgccgtattttctctctgg

SEQ ID NO: 39767 - DNA, 20 bp, Artificial Sequence
  chemically synthesized
gggagtgcttatcttttccc

SEQ ID NO: 39768 - DNA, 20 bp, Artificial Sequence
  chemically synthesized
gcttatcttttccctagaac

SEQ ID NO: 39769 - DNA, 20 bp, Artificial Sequence
  chemically synthesized
tccctagaactggttgtgtg

SEQ ID NO: 39770 - DNA, 20 bp, Artificial Sequence
  chemically synthesized
ccgatattactattgccctt

SEQ ID NO: 39771 - DNA, 20 bp, Artificial Sequence
  chemically synthesized
tacgaatctatgactctaac

SEQ ID NO: 39772 - DNA, 20 bp, Artificial Sequence
  chemically synthesized
tctatgactctaacaagtat

SEQ ID NO: 39773 - DNA, 20 bp, Artificial Sequence
  chemically synthesized
ctatgactctaacaagtatt

SEQ ID NO: 39774 - DNA, 20 bp, Artificial Sequence
  chemically synthesized
taacaagtattaggcttttg

SEQ ID NO: 39775 - DNA, 20 bp, Artificial Sequence
  chemically synthesized
acaagtattaggcttttgtg

SEQ ID NO: 39776 - DNA, 20 bp, Artificial Sequence
  chemically synthesized
caagtattaggcttttgtgg

SEQ ID NO: 39777 - DNA, 20 bp, Artificial Sequence
  chemically synthesized
ttttgtggaggccctcattg

SEQ ID NO: 39778 - DNA, 20 bp, Artificial Sequence
  chemically synthesized
tgtggaggccctcattgtag

SEQ ID NO: 39779 - DNA, 20 bp, Artificial Sequence
  chemically synthesized
ccttaaaatatttccgttat

SEQ ID NO: 39780 - DNA, 20 bp, Artificial Sequence
  chemically synthesized
ccgttatgagcttccaacat

SEQ ID NO: 39781 - DNA, 20 bp, Artificial Sequence
  chemically synthesized
gtccctaatgtgccaaaact

SEQ ID NO: 39782 - DNA, 20 bp, Artificial Sequence
  chemically synthesized
gccaaaactcagactttttg

SEQ ID NO: 39783 - DNA, 20 bp, Artificial Sequence
  chemically synthesized
aactcagactttttgcagca

SEQ ID NO: 39784 - DNA, 20 bp, Artificial Sequence
  chemically synthesized
actcagactttttgcagcat

SEQ ID NO: 39785 - DNA, 20 bp, Artificial Sequence
  chemically synthesized
ctcagactttttgcagcata

SEQ ID NO: 39786 - DNA, 20 bp, Artificial Sequence
  chemically synthesized
tgcagcatagggaacttgct

SEQ ID NO: 39787 - DNA, 20 bp, Artificial Sequence
  chemically synthesized
tagggaacttgctgagtccc

SEQ ID NO: 39788 - DNA, 20 bp, Artificial Sequence
  chemically synthesized
tgctgagtcccaagtccact

SEQ ID NO: 39789 - DNA, 20 bp, Artificial Sequence
  chemically synthesized
taattacacctttctaaaat

SEQ ID NO: 39790 - DNA, 20 bp, Artificial Sequence
  chemically synthesized
actaactttacccacttgtt

SEQ ID NO: 39791 - DNA, 20 bp, Artificial Sequence
  chemically synthesized
ctaactttacccacttgttc

SEQ ID NO: 39792 - DNA, 20 bp, Artificial Sequence
  chemically synthesized
tacccacttgttcaggtgtt

SEQ ID NO: 39793 - DNA, 20 bp, Artificial Sequence
  chemically synthesized
ttcaggtgttcagatttctg

SEQ ID NO: 39794 - DNA, 20 bp, Artificial Sequence
  chemically synthesized
atttctgtggaaactcacaa

SEQ ID NO: 39795 - DNA, 20 bp, Artificial Sequence
  chemically synthesized
tgtggaaactcacaatagat

SEQ ID NO: 39796 - DNA, 20 bp, Artificial Sequence
  chemically synthesized
ttattttattttatttttta

SEQ ID NO: 39797 - DNA, 20 bp, Artificial Sequence
  chemically synthesized
attttattttattttttata

SEQ ID NO: 39798 - DNA, 20 bp, Artificial Sequence
  chemically synthesized
tattttattttttatagaga

SEQ ID NO: 39799 - DNA, 20 bp, Artificial Sequence
  chemically synthesized
ttttattttttatagagaca

SEQ ID NO: 39800 - DNA, 20 bp, Artificial Sequence
  chemically synthesized
cagagtctgactccgttgcc

SEQ ID NO: 39801 - DNA, 20 bp, Artificial Sequence
  chemically synthesized
agagtctgactccgttgccc

SEQ ID NO: 39802 - DNA, 20 bp, Artificial Sequence
  chemically synthesized
tctgactccgttgcccaggc

SEQ ID NO: 39803 - DNA, 20 bp, Artificial Sequence
  chemically synthesized
tgactccgttgcccaggctg

SEQ ID NO: 39804 - DNA, 20 bp, Artificial Sequence
  chemically synthesized
actccgttgcccaggctgga

SEQ ID NO: 39805 - DNA, 20 bp, Artificial Sequence
  chemically synthesized
ccgttgcccaggctggagag

SEQ ID NO: 39806 - DNA, 20 bp, Artificial Sequence
  chemically synthesized
ggagagcagtgctgcaatca

SEQ ID NO: 39807 - DNA, 20 bp, Artificial Sequence
  chemically synthesized
gctgcaatcatagctccctg

SEQ ID NO: 39808 - DNA, 20 bp, Artificial Sequence
  chemically synthesized
catagctccctgcagcctca

SEQ ID NO: 39809 - DNA, 20 bp, Artificial Sequence
  chemically synthesized
tccctgcagcctcacagtcc

SEQ ID NO: 39810 - DNA, 20 bp, Artificial Sequence
  chemically synthesized
ccctgcagcctcacagtcct

SEQ ID NO: 39811 - DNA, 20 bp, Artificial Sequence
  chemically synthesized
cagcctcacagtcctgggct

SEQ ID NO: 39812 - DNA, 20 bp, Artificial Sequence
  chemically synthesized
agcctcacagtcctgggctc

SEQ ID NO: 39813 - DNA, 20 bp, Artificial Sequence
  chemically synthesized
gtgatgtgtgcccctgtgcc

SEQ ID NO: 39814 - DNA, 20 bp, Artificial Sequence
  chemically synthesized
tttatcttttcttttttttt

SEQ ID NO: 39815 - DNA, 20 bp, Artificial Sequence
  chemically synthesized
atcttttcttttttttttgg

SEQ ID NO: 39816 - DNA, 20 bp, Artificial Sequence
  chemically synthesized
cttttcttttttttttggtg

SEQ ID NO: 39817 - DNA, 20 bp, Artificial Sequence
  chemically synthesized
ttttcttttttttttggtgg

SEQ ID NO: 39818 - DNA, 20 bp, Artificial Sequence
  chemically synthesized
tcttttttttttggtggagg

SEQ ID NO: 39819 - DNA, 20 bp, Artificial Sequence
  chemically synthesized
cttttttttttggtggaggc

SEQ ID NO: 39820 - DNA, 20 bp, Artificial Sequence
  chemically synthesized
ttttttttttggtggaggca

SEQ ID NO: 39821 - DNA, 20 bp, Artificial Sequence
  chemically synthesized
tttttggtggaggcagggtc

SEQ ID NO: 39822 - DNA, 20 bp, Artificial Sequence
  chemically synthesized
cagggtctagctatgttgcc

SEQ ID NO: 39823 - DNA, 20 bp, Artificial Sequence
  chemically synthesized
agggtctagctatgttgccc

SEQ ID NO: 39824 - DNA, 20 bp, Artificial Sequence
  chemically synthesized
tctagctatgttgcccaggc

SEQ ID NO: 39825 - DNA, 20 bp, Artificial Sequence
  chemically synthesized
ctagctatgttgcccaggct

SEQ ID NO: 39826 - DNA, 20 bp, Artificial Sequence
  chemically synthesized
ctgggttctcttcttattca

SEQ ID NO: 39827 - DNA, 20 bp, Artificial Sequence
  chemically synthesized
ttcttattcacagtccactt

SEQ ID NO: 39828 - DNA, 20 bp, Artificial Sequence
  chemically synthesized
tattcacagtccacttgaga

SEQ ID NO: 39829 - DNA, 20 bp, Artificial Sequence
  chemically synthesized
acattgatcacaatatttct

SEQ ID NO: 39830 - DNA, 20 bp, Artificial Sequence
  chemically synthesized
ctcagtcatttctattgaat

SEQ ID NO: 39831 - DNA, 20 bp, Artificial Sequence
  chemically synthesized
tattgaataagcattttcct

SEQ ID NO: 39832 - DNA, 20 bp, Artificial Sequence
  chemically synthesized
tgaataagcattttcctcag

SEQ ID NO: 39833 - DNA, 20 bp, Artificial Sequence
  chemically synthesized
tcagtggttaatcctaaata

SEQ ID NO: 39834 - DNA, 20 bp, Artificial Sequence
  chemically synthesized
cctaaatacagctgtcccat

SEQ ID NO: 39835 - DNA, 20 bp, Artificial Sequence
  chemically synthesized
acagctgtcccattagtttc

SEQ ID NO: 39836 - DNA, 20 bp, Artificial Sequence
  chemically synthesized
agctgtcccattagtttcaa

SEQ ID NO: 39837 - DNA, 20 bp, Artificial Sequence
  chemically synthesized
aaatttgaactgactcaact

SEQ ID NO: 39838 - DNA, 20 bp, Artificial Sequence
  chemically synthesized
ttgaactgactcaacttgga

SEQ ID NO: 39839 - DNA, 20 bp, Artificial Sequence
  chemically synthesized
actcaacttggatagtaaca

SEQ ID NO: 39840 - DNA, 20 bp, Artificial Sequence
  chemically synthesized
aacttggatagtaacacagt

SEQ ID NO: 39841 - DNA, 20 bp, Artificial Sequence
  chemically synthesized
acttggatagtaacacagta

SEQ ID NO: 39842 - DNA, 20 bp, Artificial Sequence
  chemically synthesized
cttggatagtaacacagtaa

SEQ ID NO: 39843 - DNA, 20 bp, Artificial Sequence
  chemically synthesized
agggcccatatgataaataa

SEQ ID NO: 39844 - DNA, 20 bp, Artificial Sequence
  chemically synthesized
gggcccatatgataaataat

SEQ ID NO: 39845 - DNA, 20 bp, Artificial Sequence
  chemically synthesized
gcccatatgataaataatag

SEQ ID NO: 39846 - DNA, 20 bp, Artificial Sequence
  chemically synthesized
cccatatgataaataatagg

SEQ ID NO: 39847 - DNA, 20 bp, Artificial Sequence
  chemically synthesized
catatgataaataataggag

SEQ ID NO: 39848 - DNA, 20 bp, Artificial Sequence
  chemically synthesized
atatgataaataataggagg

SEQ ID NO: 39849 - DNA, 20 bp, Artificial Sequence
  chemically synthesized
aataataggaggaggaataa

SEQ ID NO: 39850 - DNA, 20 bp, Artificial Sequence
  chemically synthesized
taataggaggaggaataaaa

SEQ ID NO: 39851 - DNA, 20 bp, Artificial Sequence
  chemically synthesized
ggaggaggaataaaagagta

SEQ ID NO: 39852 - DNA, 20 bp, Artificial Sequence
  chemically synthesized
aggaggaataaaagagtaaa

SEQ ID NO: 39853 - DNA, 20 bp, Artificial Sequence
  chemically synthesized
taaaagagtaaagagaataa

SEQ ID NO: 39854 - DNA, 20 bp, Artificial Sequence
  chemically synthesized
aaaagagtaaagagaataaa

SEQ ID NO: 39855 - DNA, 20 bp, Artificial Sequence
  chemically synthesized
aaagagtaaagagaataaaa

SEQ ID NO: 39856 - DNA, 20 bp, Artificial Sequence
  chemically synthesized
aaagagaataaaagggaaca

SEQ ID NO: 39857 - DNA, 20 bp, Artificial Sequence
  chemically synthesized
aagagaataaaagggaacaa

SEQ ID NO: 39858 - DNA, 20 bp, Artificial Sequence
  chemically synthesized
gagaataaaagggaacaaag

SEQ ID NO: 39859 - DNA, 20 bp, Artificial Sequence
  chemically synthesized
gggaacaaaggagtcctatt

SEQ ID NO: 39860 - DNA, 20 bp, Artificial Sequence
  chemically synthesized
ggaacaaaggagtcctattt

SEQ ID NO: 39861 - DNA, 20 bp, Artificial Sequence
  chemically synthesized
aaggagtcctatttgggacc

SEQ ID NO: 39862 - DNA, 20 bp, Artificial Sequence
  chemically synthesized
ggagtcctatttgggaccaa

SEQ ID NO: 39863 - DNA, 20 bp, Artificial Sequence
  chemically synthesized
cctatttgggaccaagagtc

SEQ ID NO: 39864 - DNA, 20 bp, Artificial Sequence
  chemically synthesized
ctatttgggaccaagagtca

SEQ ID NO: 39865 - DNA, 20 bp, Artificial Sequence
  chemically synthesized
ggaccaagagtcaaggctat

SEQ ID NO: 39866 - DNA, 20 bp, Artificial Sequence
  chemically synthesized
aagagtcaaggctatgagca

SEQ ID NO: 39867 - DNA, 20 bp, Artificial Sequence
  chemically synthesized
aaggctatgagcacagacgt

SEQ ID NO: 39868 - DNA, 20 bp, Artificial Sequence
  chemically synthesized
tatgagcacagacgtaagat

SEQ ID NO: 39869 - DNA, 20 bp, Artificial Sequence
  chemically synthesized
agatgagtgttgaaaaaata

SEQ ID NO: 39870 - DNA, 20 bp, Artificial Sequence
  chemically synthesized
gatgagtgttgaaaaaataa

SEQ ID NO: 39871 - DNA, 20 bp, Artificial Sequence
  chemically synthesized
aataaaggttgtatgcttca

SEQ ID NO: 39872 - DNA, 20 bp, Artificial Sequence
  chemically synthesized
ttgtatgcttcatagtgaat

SEQ ID NO: 39873 - DNA, 20 bp, Artificial Sequence
  chemically synthesized
atttttgttatttgttattc

SEQ ID NO: 39874 - DNA, 20 bp, Artificial Sequence
  chemically synthesized
tttttgttatttgttattct

SEQ ID NO: 39875 - DNA, 20 bp, Artificial Sequence
  chemically synthesized
ttttgttatttgttattcta

SEQ ID NO: 39876 - DNA, 20 bp, Artificial Sequence
  chemically synthesized
gttatttgttattctaggga

SEQ ID NO: 39877 - DNA, 20 bp, Artificial Sequence
  chemically synthesized
ttatttgttattctagggaa

SEQ ID NO: 39878 - DNA, 20 bp, Artificial Sequence
  chemically synthesized
attctagggaaaggccttgt

SEQ ID NO: 39879 - DNA, 20 bp, Artificial Sequence
  chemically synthesized
agggaaaggccttgtgagta

SEQ ID NO: 39880 - DNA, 20 bp, Artificial Sequence
  chemically synthesized
gggaaaggccttgtgagtac

SEQ ID NO: 39881 - DNA, 20 bp, Artificial Sequence
  chemically synthesized
gtacaggcttacaattaatt

SEQ ID NO: 39882 - DNA, 20 bp, Artificial Sequence
  chemically synthesized
gcttacaattaattaagtat

SEQ ID NO: 39883 - DNA, 20 bp, Artificial Sequence
  chemically synthesized
taattaagtatgagacaatc

SEQ ID NO: 39884 - DNA, 20 bp, Artificial Sequence
  chemically synthesized
gacaatccagaaaaatattt

SEQ ID NO: 39885 - DNA, 20 bp, Artificial Sequence
  chemically synthesized
cagaaaaatatttaagtttt

SEQ ID NO: 39886 - DNA, 20 bp, Artificial Sequence
  chemically synthesized
agaaaaatatttaagttttg

SEQ ID NO: 39887 - DNA, 20 bp, Artificial Sequence
  chemically synthesized
ttaagttttgaggtaaaaaa

SEQ ID NO: 39888 - DNA, 20 bp, Artificial Sequence
  chemically synthesized
atggcctgatgatgtgctac

SEQ ID NO: 39889 - DNA, 20 bp, Artificial Sequence
  chemically synthesized
gcctgatgatgtgctacaag

SEQ ID NO: 39890 - DNA, 20 bp, Artificial Sequence
  chemically synthesized
atgtgctacaagaagattgt

SEQ ID NO: 39891 - DNA, 20 bp, Artificial Sequence
  chemically synthesized
gtgctacaagaagattgtga

SEQ ID NO: 39892 - DNA, 20 bp, Artificial Sequence
  chemically synthesized
aagaagattgtgagagaaaa

SEQ ID NO: 39893 - DNA, 20 bp, Artificial Sequence
  chemically synthesized
aaaaaagaaaactgcatctt

SEQ ID NO: 39894 - DNA, 20 bp, Artificial Sequence
  chemically synthesized
aaaagaaaactgcatctttg

SEQ ID NO: 39895 - DNA, 20 bp, Artificial Sequence
  chemically synthesized
aaagaaaactgcatctttgg

SEQ ID NO: 39896 - DNA, 20 bp, Artificial Sequence
  chemically synthesized
cacctgcaaaacctaccatg

SEQ ID NO: 39897 - DNA, 20 bp, Artificial Sequence
  chemically synthesized
cctaccatgtggtataacaa

SEQ ID NO: 39898 - DNA, 20 bp, Artificial Sequence
  chemically synthesized
atgtggtataacaacagtgc

SEQ ID NO: 39899 - DNA, 20 bp, Artificial Sequence
  chemically synthesized
gctggccccttcttgctgac

SEQ ID NO: 39900 - DNA, 20 bp, Artificial Sequence
  chemically synthesized
cttcttgctgactggcttct

SEQ ID NO: 39901 - DNA, 20 bp, Artificial Sequence
  chemically synthesized
ttcttgctgactggcttctt

SEQ ID NO: 39902 - DNA, 20 bp, Artificial Sequence
  chemically synthesized
gctgactggcttcttgggct

SEQ ID NO: 39903 - DNA, 20 bp, Artificial Sequence
  chemically synthesized
tgactggcttcttgggctca

SEQ ID NO: 39904 - DNA, 20 bp, Artificial Sequence
  chemically synthesized
gactggcttcttgggctcag

SEQ ID NO: 39905 - DNA, 20 bp, Artificial Sequence
  chemically synthesized
tggcttcttgggctcagagg

SEQ ID NO: 39906 - DNA, 20 bp, Artificial Sequence
  chemically synthesized
gctcagaggcagttcactac

SEQ ID NO: 39907 - DNA, 20 bp, Artificial Sequence
  chemically synthesized
atctacttctccgtcctttt

SEQ ID NO: 39908 - DNA, 20 bp, Artificial Sequence
  chemically synthesized
ttctccgtcctttttggaaa

SEQ ID NO: 39909 - DNA, 20 bp, Artificial Sequence
  chemically synthesized
gcactcttcttgtcctcatt

SEQ ID NO: 39910 - DNA, 20 bp, Artificial Sequence
  chemically synthesized
gtcctcatttggaatgatca

SEQ ID NO: 39911 - DNA, 20 bp, Artificial Sequence
  chemically synthesized
ggaatgatcacagcctccat

SEQ ID NO: 39912 - DNA, 20 bp, Artificial Sequence
  chemically synthesized
tgagcccatgtactacttcc

SEQ ID NO: 39913 - DNA, 20 bp, Artificial Sequence
  chemically synthesized
gtactacttcctggctatgc

SEQ ID NO: 39914 - DNA, 20 bp, Artificial Sequence
  chemically synthesized
ctacttcctggctatgctgg

SEQ ID NO: 39915 - DNA, 20 bp, Artificial Sequence
  chemically synthesized
cctggctatgctggcagaca

SEQ ID NO: 39916 - DNA, 20 bp, Artificial Sequence
  chemically synthesized
atgctggcagacacggacct

SEQ ID NO: 39917 - DNA, 20 bp, Artificial Sequence
  chemically synthesized
tgctggcagacacggacctt

SEQ ID NO: 39918 - DNA, 20 bp, Artificial Sequence
  chemically synthesized
gacattcactacaatgccca

SEQ ID NO: 39919 - DNA, 20 bp, Artificial Sequence
  chemically synthesized
cactacaatgcccacagtcc

SEQ ID NO: 39920 - DNA, 20 bp, Artificial Sequence
  chemically synthesized
actacaatgcccacagtcct

SEQ ID NO: 39921 - DNA, 20 bp, Artificial Sequence
  chemically synthesized
agtcctgggtgtcctgctgc

SEQ ID NO: 39922 - DNA, 20 bp, Artificial Sequence
  chemically synthesized
tgggtgtcctgctgctagac

SEQ ID NO: 39923 - DNA, 20 bp, Artificial Sequence
  chemically synthesized
ggtgtcctgctgctagacca

SEQ ID NO: 39924 - DNA, 20 bp, Artificial Sequence
  chemically synthesized
gtgtcctgctgctagaccag

SEQ ID NO: 39925 - DNA, 20 bp, Artificial Sequence
  chemically synthesized
tgtcctgctgctagaccaga

SEQ ID NO: 39926 - DNA, 20 bp, Artificial Sequence
  chemically synthesized
tcctgctgctagaccagagg

SEQ ID NO: 39927 - DNA, 20 bp, Artificial Sequence
  chemically synthesized
ccaatccttcattcattcac

SEQ ID NO: 39928 - DNA, 20 bp, Artificial Sequence
  chemically synthesized
cattcattcactggccattg

SEQ ID NO: 39929 - DNA, 20 bp, Artificial Sequence
  chemically synthesized
ttcactggccattgtagaat

SEQ ID NO: 39930 - DNA, 20 bp, Artificial Sequence
  chemically synthesized
tcactggccattgtagaatc

SEQ ID NO: 39931 - DNA, 20 bp, Artificial Sequence
  chemically synthesized
atcaggtatcttgcttgttt

SEQ ID NO: 39932 - DNA, 20 bp, Artificial Sequence
  chemically synthesized
attgccatccgcacaccact

SEQ ID NO: 39933 - DNA, 20 bp, Artificial Sequence
  chemically synthesized
ttgccatccgcacaccactg

SEQ ID NO: 39934 - DNA, 20 bp, Artificial Sequence
  chemically synthesized
ctgcattcttaccaattccc

SEQ ID NO: 39935 - DNA, 20 bp, Artificial Sequence
  chemically synthesized
caattcccgagtgatgaaca

SEQ ID NO: 39936 - DNA, 20 bp, Artificial Sequence
  chemically synthesized
aattcccgagtgatgaacat

SEQ ID NO: 39937 - DNA, 20 bp, Artificial Sequence
  chemically synthesized
ccgagtgatgaacataggac

SEQ ID NO: 39938 - DNA, 20 bp, Artificial Sequence
  chemically synthesized
cgagtgatgaacataggact

SEQ ID NO: 39939 - DNA, 20 bp, Artificial Sequence
  chemically synthesized
gagtgatgaacataggactg

SEQ ID NO: 39940 - DNA, 20 bp, Artificial Sequence
  chemically synthesized
agtgatgaacataggactgg

SEQ ID NO: 39941 - DNA, 20 bp, Artificial Sequence
  chemically synthesized
ataggactgggggtactgat

SEQ ID NO: 39942 - DNA, 20 bp, Artificial Sequence
  chemically synthesized
aggactgggggtactgatga

SEQ ID NO: 39943 - DNA, 20 bp, Artificial Sequence
  chemically synthesized
ggactgggggtactgatgag

SEQ ID NO: 39944 - DNA, 20 bp, Artificial Sequence
  chemically synthesized
ctctactgctacccatattg

SEQ ID NO: 39945 - DNA, 20 bp, Artificial Sequence
  chemically synthesized
gcacacattttgcctccatc

SEQ ID NO: 39946 - DNA, 20 bp, Artificial Sequence
  chemically synthesized
atcacatatatccaattatt

SEQ ID NO: 39947 - DNA, 20 bp, Artificial Sequence
  chemically synthesized
gacttctttgactgtctttt

SEQ ID NO: 39948 - DNA, 20 bp, Artificial Sequence
  chemically synthesized
tttcttatatactaatcctc

SEQ ID NO: 39949 - DNA, 20 bp, Artificial Sequence
  chemically synthesized
ttatatactaatcctcaaga

SEQ ID NO: 39950 - DNA, 20 bp, Artificial Sequence
  chemically synthesized
actaatcctcaagacagtga

SEQ ID NO: 39951 - DNA, 20 bp, Artificial Sequence
  chemically synthesized
ctaatcctcaagacagtgat

SEQ ID NO: 39952 - DNA, 20 bp, Artificial Sequence
  chemically synthesized
acagtgatgggcattgcgtc

SEQ ID NO: 39953 - DNA, 20 bp, Artificial Sequence
  chemically synthesized
gatgggcattgcgtctggac

SEQ ID NO: 39954 - DNA, 20 bp, Artificial Sequence
  chemically synthesized
tgggcattgcgtctggacaa

SEQ ID NO: 39955 - DNA, 20 bp, Artificial Sequence
  chemically synthesized
gggcattgcgtctggacaag

SEQ ID NO: 39956 - DNA, 20 bp, Artificial Sequence
  chemically synthesized
cattgcgtctggacaagagg

SEQ ID NO: 39957 - DNA, 20 bp, Artificial Sequence
  chemically synthesized
aacacttgtgtctcccatat

SEQ ID NO: 39958 - DNA, 20 bp, Artificial Sequence
  chemically synthesized
ctcccatattagctgtgtcc

SEQ ID NO: 39959 - DNA, 20 bp, Artificial Sequence
  chemically synthesized
agtatttcacatcactgtga

SEQ ID NO: 39960 - DNA, 20 bp, Artificial Sequence
  chemically synthesized
gtatttcacatcactgtgat

SEQ ID NO: 39961 - DNA, 20 bp, Artificial Sequence
  chemically synthesized
atgggactgtcattcattca

SEQ ID NO: 39962 - DNA, 20 bp, Artificial Sequence
  chemically synthesized
tgggactgtcattcattcac

SEQ ID NO: 39963 - DNA, 20 bp, Artificial Sequence
  chemically synthesized
ctgtcattcattcacaggtt

SEQ ID NO: 39964 - DNA, 20 bp, Artificial Sequence
  chemically synthesized
tgtcattcattcacaggttt

SEQ ID NO: 39965 - DNA, 20 bp, Artificial Sequence
  chemically synthesized
tgggaaacatgcacctcatg

SEQ ID NO: 39966 - DNA, 20 bp, Artificial Sequence
  chemically synthesized
catgtggtccccattaccat

SEQ ID NO: 39967 - DNA, 20 bp, Artificial Sequence
  chemically synthesized
ttcgtgaatcctatcattta

SEQ ID NO: 39968 - DNA, 20 bp, Artificial Sequence
  chemically synthesized
atcctatcatttatagcatc

SEQ ID NO: 39969 - DNA, 20 bp, Artificial Sequence
  chemically synthesized
tcatttatagcatcaagacc

SEQ ID NO: 39970 - DNA, 20 bp, Artificial Sequence
  chemically synthesized
tttatagcatcaagaccaag

SEQ ID NO: 39971 - DNA, 20 bp, Artificial Sequence
  chemically synthesized
atcaagaccaagcagattca

SEQ ID NO: 39972 - DNA, 20 bp, Artificial Sequence
  chemically synthesized
aagaccaagcagattcaaag

SEQ ID NO: 39973 - DNA, 20 bp, Artificial Sequence
  chemically synthesized
agcattattcgcctattttc

SEQ ID NO: 39974 - DNA, 20 bp, Artificial Sequence
  chemically synthesized
gcattattcgcctattttct

SEQ ID NO: 39975 - DNA, 20 bp, Artificial Sequence
  chemically synthesized
ttattcgcctattttctggg

SEQ ID NO: 39976 - DNA, 20 bp, Artificial Sequence
  chemically synthesized
attcgcctattttctgggca

SEQ ID NO: 39977 - DNA, 20 bp, Artificial Sequence
  chemically synthesized
cgcctattttctgggcagag

SEQ ID NO: 39978 - DNA, 20 bp, Artificial Sequence
  chemically synthesized
gcctattttctgggcagagt

SEQ ID NO: 39979 - DNA, 20 bp, Artificial Sequence
  chemically synthesized
cctattttctgggcagagta

SEQ ID NO: 39980 - DNA, 20 bp, Artificial Sequence
  chemically synthesized
ttctgggcagagtagggctt

SEQ ID NO: 39981 - DNA, 20 bp, Artificial Sequence
  chemically synthesized
tagggcttgagcccttattt

SEQ ID NO: 39982 - DNA, 20 bp, Artificial Sequence
  chemically synthesized
agcccttatttcagaatctc

SEQ ID NO: 39983 - DNA, 20 bp, Artificial Sequence
  chemically synthesized
tttcagaatctcaagatctc

SEQ ID NO: 39984 - DNA, 20 bp, Artificial Sequence
  chemically synthesized
ttcagaatctcaagatctct

SEQ ID NO: 39985 - DNA, 20 bp, Artificial Sequence
  chemically synthesized
ctcaagatctctaggatttc

SEQ ID NO: 39986 - DNA, 20 bp, Artificial Sequence
  chemically synthesized
tcaagatctctaggatttct

SEQ ID NO: 39987 - DNA, 20 bp, Artificial Sequence
  chemically synthesized
gggcctctcccattactgaa

SEQ ID NO: 39988 - DNA, 20 bp, Artificial Sequence
  chemically synthesized
ggcctctcccattactgaaa

SEQ ID NO: 39989 - DNA, 20 bp, Artificial Sequence
  chemically synthesized
ccattactgaaaaggaaccc

SEQ ID NO: 39990 - DNA, 20 bp, Artificial Sequence
  chemically synthesized
tatccacacttttttttcct

SEQ ID NO: 39991 - DNA, 20 bp, Artificial Sequence
  chemically synthesized
tccacacttttttttcctca

SEQ ID NO: 39992 - DNA, 20 bp, Artificial Sequence
  chemically synthesized
cacttttttttcctcagagt

SEQ ID NO: 39993 - DNA, 20 bp, Artificial Sequence
  chemically synthesized
attttaattatcacatgaaa

SEQ ID NO: 39994 - DNA, 20 bp, Artificial Sequence
  chemically synthesized
tcacatgaaaaagctgatgt

SEQ ID NO: 39995 - DNA, 20 bp, Artificial Sequence
  chemically synthesized
atgaaaaagctgatgtgagc

SEQ ID NO: 39996 - DNA, 20 bp, Artificial Sequence
  chemically synthesized
tatatatatatcacctaata

SEQ ID NO: 39997 - DNA, 20 bp, Artificial Sequence
  chemically synthesized
tatatatatcacctaataaa

SEQ ID NO: 39998 - DNA, 20 bp, Artificial Sequence
  chemically synthesized
atatatatcacctaataaag

SEQ ID NO: 39999 - DNA, 20 bp, Artificial Sequence
  chemically synthesized
tatatatcacctaataaaga

SEQ ID NO: 40000 - DNA, 20 bp, Artificial Sequence
  chemically synthesized
acctaataaagagggaatgc

SEQ ID NO: 40001 - DNA, 20 bp, Artificial Sequence
  chemically synthesized
agggaatgccagtgatgctg

SEQ ID NO: 40002 - DNA, 20 bp, Artificial Sequence
  chemically synthesized
tgccagtgatgctgaagaaa

SEQ ID NO: 40003 - DNA, 20 bp, Artificial Sequence
  chemically synthesized
gatgctgaagaaaaagaata

SEQ ID NO: 40004 - DNA, 20 bp, Artificial Sequence
  chemically synthesized
atgctgaagaaaaagaatac

SEQ ID NO: 40005 - DNA, 20 bp, Artificial Sequence
  chemically synthesized
ctgaagaaaaagaatacagg

SEQ ID NO: 40006 - DNA, 20 bp, Artificial Sequence
  chemically synthesized
aagaaaaagaatacaggaag

SEQ ID NO: 40007 - DNA, 20 bp, Artificial Sequence
  chemically synthesized
gaaaaagaatacaggaagca

SEQ ID NO: 40008 - DNA, 20 bp, Artificial Sequence
  chemically synthesized
aaaaagaatacaggaagcag

SEQ ID NO: 40009 - DNA, 20 bp, Artificial Sequence
  chemically synthesized
aaagaatacaggaagcagag

SEQ ID NO: 40010 - DNA, 20 bp, Artificial Sequence
  chemically synthesized
gaggagatataacaatccaa

SEQ ID NO: 40011 - DNA, 20 bp, Artificial Sequence
  chemically synthesized
gagatataacaatccaaaag

SEQ ID NO: 40012 - DNA, 20 bp, Artificial Sequence
  chemically synthesized
gatataacaatccaaaagaa

SEQ ID NO: 40013 - DNA, 20 bp, Artificial Sequence
  chemically synthesized
aagaagagtaactatgattt

SEQ ID NO: 40014 - DNA, 20 bp, Artificial Sequence
  chemically synthesized
agtaactatgatttcagaaa

SEQ ID NO: 40015 - DNA, 20 bp, Artificial Sequence
  chemically synthesized
ctatgatttcagaaatagtc

SEQ ID NO: 40016 - DNA, 20 bp, Artificial Sequence
  chemically synthesized
atttcagaaatagtcaagat

SEQ ID NO: 40017 - DNA, 20 bp, Artificial Sequence
  chemically synthesized
tcagaaatagtcaagataag

SEQ ID NO: 40018 - DNA, 20 bp, Artificial Sequence
  chemically synthesized
tagtcaagataagtggacta

SEQ ID NO: 40019 - DNA, 20 bp, Artificial Sequence
  chemically synthesized
tcaagataagtggactaaag

SEQ ID NO: 40020 - DNA, 20 bp, Artificial Sequence
  chemically synthesized
ataagtggactaaagcagct

SEQ ID NO: 40021 - DNA, 20 bp, Artificial Sequence
  chemically synthesized
taagtggactaaagcagctt

SEQ ID NO: 40022 - DNA, 20 bp, Artificial Sequence
  chemically synthesized
aaagcagcttgggtcaaata

SEQ ID NO: 40023 - DNA, 20 bp, Artificial Sequence
  chemically synthesized
ggtcaaatacagttcatcta

SEQ ID NO: 40024 - DNA, 20 bp, Artificial Sequence
  chemically synthesized
ttcatctaaagaaaaatgtg

SEQ ID NO: 40025 - DNA, 20 bp, Artificial Sequence
  chemically synthesized
tctaaagaaaaatgtgcagt

SEQ ID NO: 40026 - DNA, 20 bp, Artificial Sequence
  chemically synthesized
taaagaaaaatgtgcagttg

SEQ ID NO: 40027 - DNA, 20 bp, Artificial Sequence
  chemically synthesized
aaagaaaaatgtgcagttgg

SEQ ID NO: 40028 - DNA, 20 bp, Artificial Sequence
  chemically synthesized
tacattttatgtgtcttata

SEQ ID NO: 40029 - DNA, 20 bp, Artificial Sequence
  chemically synthesized
acattttatgtgtcttataa

SEQ ID NO: 40030 - DNA, 20 bp, Artificial Sequence
  chemically synthesized
tcatctccatactttgaaac

SEQ ID NO: 40031 - DNA, 20 bp, Artificial Sequence
  chemically synthesized
ttgaaactagttactctgaa

SEQ ID NO: 40032 - DNA, 20 bp, Artificial Sequence
  chemically synthesized
tgaaactagttactctgaaa

SEQ ID NO: 40033 - DNA, 20 bp, Artificial Sequence
  chemically synthesized
tgaaaaggatcttgcttgat

SEQ ID NO: 40034 - DNA, 20 bp, Artificial Sequence
  chemically synthesized
aaggatcttgcttgattagt

SEQ ID NO: 40035 - DNA, 20 bp, Artificial Sequence
  chemically synthesized
attagtaagcaaacttgtgt

SEQ ID NO: 40036 - DNA, 20 bp, Artificial Sequence
  chemically synthesized
ttagtaagcaaacttgtgtg

SEQ ID NO: 40037 - DNA, 20 bp, Artificial Sequence
  chemically synthesized
caaacttgtgtgaggctaaa

SEQ ID NO: 40038 - DNA, 20 bp, Artificial Sequence
  chemically synthesized
gaggctaaacagcaaatatc

SEQ ID NO: 40039 - DNA, 20 bp, Artificial Sequence
  chemically synthesized
acagcaaatatctagaactt

SEQ ID NO: 40040 - DNA, 20 bp, Artificial Sequence
  chemically synthesized
cagcaaatatctagaacttt

SEQ ID NO: 40041 - DNA, 20 bp, Artificial Sequence
  chemically synthesized
caaatatctagaactttagg

SEQ ID NO: 40042 - DNA, 20 bp, Artificial Sequence
  chemically synthesized
tcatgaaatgtaatttccct

SEQ ID NO: 40043 - DNA, 20 bp, Artificial Sequence
  chemically synthesized
tgaaatgtaatttcccttag

SEQ ID NO: 40044 - DNA, 20 bp, Artificial Sequence
  chemically synthesized
tgtaatttcccttagtagac

SEQ ID NO: 40045 - DNA, 20 bp, Artificial Sequence
  chemically synthesized
ctggcatattttactactaa

SEQ ID NO: 40046 - DNA, 20 bp, Artificial Sequence
  chemically synthesized
tggcatattttactactaaa

SEQ ID NO: 40047 - DNA, 20 bp, Artificial Sequence
  chemically synthesized
ctactaaaaggcgtgtgata

SEQ ID NO: 40048 - DNA, 20 bp, Artificial Sequence
  chemically synthesized
aggcgtgtgatacagactaa

SEQ ID NO: 40049 - DNA, 20 bp, Artificial Sequence
  chemically synthesized
gatacagactaacagctaaa

SEQ ID NO: 40050 - DNA, 20 bp, Artificial Sequence
  chemically synthesized
acagactaacagctaaatag

SEQ ID NO: 40051 - DNA, 20 bp, Artificial Sequence
  chemically synthesized
acacatttcttatcatctcg

SEQ ID NO: 40052 - DNA, 20 bp, Artificial Sequence
  chemically synthesized
catttcttatcatctcgtgg

SEQ ID NO: 40053 - DNA, 20 bp, Artificial Sequence
  chemically synthesized
tcttatcatctcgtggaagc

SEQ ID NO: 40054 - DNA, 20 bp, Artificial Sequence
  chemically synthesized
ctcgtggaagccagatatcc

SEQ ID NO: 40055 - DNA, 20 bp, Artificial Sequence
  chemically synthesized
ttaatactttttcttctttc

SEQ ID NO: 40056 - DNA, 20 bp, Artificial Sequence
  chemically synthesized
aaaataaccaactataaatt

SEQ ID NO: 40057 - DNA, 20 bp, Artificial Sequence
  chemically synthesized
cttctcacataaaaaatctc

SEQ ID NO: 40058 - DNA, 20 bp, Artificial Sequence
  chemically synthesized
gactttttcacttcatgaaa

SEQ ID NO: 40059 - DNA, 20 bp, Artificial Sequence
  chemically synthesized
tgataattaatgcaaaaact

SEQ ID NO: 40060 - DNA, 20 bp, Artificial Sequence
  chemically synthesized
attaatgcaaaaacttggca

SEQ ID NO: 40061 - DNA, 20 bp, Artificial Sequence
  chemically synthesized
ttaatgcaaaaacttggcaa

SEQ ID NO: 40062 - DNA, 20 bp, Artificial Sequence
  chemically synthesized
gcaaaggtaatgttatattt

SEQ ID NO: 40063 - DNA, 20 bp, Artificial Sequence
  chemically synthesized
ttttagaaatttttcactga

SEQ ID NO: 40064 - DNA, 20 bp, Artificial Sequence
  chemically synthesized
gaaatttttcactgatggaa

SEQ ID NO: 40065 - DNA, 20 bp, Artificial Sequence
  chemically synthesized
tcttccttcaatcttcttca

SEQ ID NO: 40066 - DNA, 20 bp, Artificial Sequence
  chemically synthesized
atcttcttcaaagtgtttgt

SEQ ID NO: 40067 - DNA, 20 bp, Artificial Sequence
  chemically synthesized
taagtctttatgctgttcat

SEQ ID NO: 40068 - DNA, 20 bp, Artificial Sequence
  chemically synthesized
aagtctttatgctgttcatt

SEQ ID NO: 40069 - DNA, 20 bp, Artificial Sequence
  chemically synthesized
tgttcattgggtctgaaccg

SEQ ID NO: 40070 - DNA, 20 bp, Artificial Sequence
  chemically synthesized
cgcagtctaccacttgctat

SEQ ID NO: 40071 - DNA, 20 bp, Artificial Sequence
  chemically synthesized
accacttgctattagtgtaa

SEQ ID NO: 40072 - DNA, 20 bp, Artificial Sequence
  chemically synthesized
ccacttgctattagtgtaac

SEQ ID NO: 40073 - DNA, 20 bp, Artificial Sequence
  chemically synthesized
cacttgctattagtgtaaca

SEQ ID NO: 40074 - DNA, 20 bp, Artificial Sequence
  chemically synthesized
acttgctattagtgtaacag

SEQ ID NO: 40075 - DNA, 20 bp, Artificial Sequence
  chemically synthesized
acaatttcttcatctactgc

SEQ ID NO: 40076 - DNA, 20 bp, Artificial Sequence
  chemically synthesized
atctactgctagttctgcgc

SEQ ID NO: 40077 - DNA, 20 bp, Artificial Sequence
  chemically synthesized
tagttctgcgctagtatttg

SEQ ID NO: 40078 - DNA, 20 bp, Artificial Sequence
  chemically synthesized
atttgcagctgatctcctta

SEQ ID NO: 40079 - DNA, 20 bp, Artificial Sequence
  chemically synthesized
tttgcagctgatctccttat

SEQ ID NO: 40080 - DNA, 20 bp, Artificial Sequence
  chemically synthesized
ttataggaaactaatctcaa

SEQ ID NO: 40081 - DNA, 20 bp, Artificial Sequence
  chemically synthesized
gttgcattcattcctctctg

SEQ ID NO: 40082 - DNA, 20 bp, Artificial Sequence
  chemically synthesized
tgctgtttcttccaattttt

SEQ ID NO: 40083 - DNA, 20 bp, Artificial Sequence
  chemically synthesized
ccaatttttaagttctcgtt

SEQ ID NO: 40084 - DNA, 20 bp, Artificial Sequence
  chemically synthesized
atattttcttttctgattga

SEQ ID NO: 40085 - DNA, 20 bp, Artificial Sequence
  chemically synthesized
tctgattgaaagtccatgtt

SEQ ID NO: 40086 - DNA, 20 bp, Artificial Sequence
  chemically synthesized
gaaagtccatgttcagaacc

SEQ ID NO: 40087 - DNA, 20 bp, Artificial Sequence
  chemically synthesized
aaattctctctgcttcactt

SEQ ID NO: 40088 - DNA, 20 bp, Artificial Sequence
  chemically synthesized
tttcatatttattttacatc

SEQ ID NO: 40089 - DNA, 20 bp, Artificial Sequence
  chemically synthesized
atatttattttacatctgga

SEQ ID NO: 40090 - DNA, 20 bp, Artificial Sequence
  chemically synthesized
ttattttacatctggacagt

SEQ ID NO: 40091 - DNA, 20 bp, Artificial Sequence
  chemically synthesized
tgagcactctgaaaatattc

SEQ ID NO: 40092 - DNA, 20 bp, Artificial Sequence
  chemically synthesized
agcactctgaaaatattcca

SEQ ID NO: 40093 - DNA, 20 bp, Artificial Sequence
  chemically synthesized
aaatattccagagatttgat

SEQ ID NO: 40094 - DNA, 20 bp, Artificial Sequence
  chemically synthesized
aaaatacttactgaaaacta

SEQ ID NO: 40095 - DNA, 20 bp, Artificial Sequence
  chemically synthesized
aaaactaaagctaaataatg

SEQ ID NO: 40096 - DNA, 20 bp, Artificial Sequence
  chemically synthesized
aatgcagtatttctccaaat

SEQ ID NO: 40097 - DNA, 20 bp, Artificial Sequence
  chemically synthesized
gcagtatttctccaaattag

SEQ ID NO: 40098 - DNA, 20 bp, Artificial Sequence
  chemically synthesized
cagtatttctccaaattaga

SEQ ID NO: 40099 - DNA, 20 bp, Artificial Sequence
  chemically synthesized
tccaaattagaaggcccatt

SEQ ID NO: 40100 - DNA, 20 bp, Artificial Sequence
  chemically synthesized
ttagaaggcccatttggatg

SEQ ID NO: 40101 - DNA, 20 bp, Artificial Sequence
  chemically synthesized
tagaaggcccatttggatgc

SEQ ID NO: 40102 - DNA, 20 bp, Artificial Sequence
  chemically synthesized
ctaataaatgactactcctg

SEQ ID NO: 40103 - DNA, 20 bp, Artificial Sequence
  chemically synthesized
taataaatgactactcctga

SEQ ID NO: 40104 - DNA, 20 bp, Artificial Sequence
  chemically synthesized
atgactactcctgaaggatt

SEQ ID NO: 40105 - DNA, 20 bp, Artificial Sequence
  chemically synthesized
ttattgtgcgaattgtttgt

SEQ ID NO: 40106 - DNA, 20 bp, Artificial Sequence
  chemically synthesized
attgtgcgaattgtttgtga

SEQ ID NO: 40107 - DNA, 20 bp, Artificial Sequence
  chemically synthesized
tgtttgtgagagttctttga

SEQ ID NO: 40108 - DNA, 20 bp, Artificial Sequence
  chemically synthesized
ttgtgagagttctttgaaag

SEQ ID NO: 40109 - DNA, 20 bp, Artificial Sequence
  chemically synthesized
tgtgagagttctttgaaagt

SEQ ID NO: 40110 - DNA, 20 bp, Artificial Sequence
  chemically synthesized
agttctttgaaagtaggacg

SEQ ID NO: 40111 - DNA, 20 bp, Artificial Sequence
  chemically synthesized
gttctttgaaagtaggacgt

SEQ ID NO: 40112 - DNA, 20 bp, Artificial Sequence
  chemically synthesized
ttctttgaaagtaggacgtg

SEQ ID NO: 40113 - DNA, 20 bp, Artificial Sequence
  chemically synthesized
tctttgaaagtaggacgtgg

SEQ ID NO: 40114 - DNA, 20 bp, Artificial Sequence
  chemically synthesized
ctttgaaagtaggacgtggg

SEQ ID NO: 40115 - DNA, 20 bp, Artificial Sequence
  chemically synthesized
gggtttattcattgtcattt

SEQ ID NO: 40116 - DNA, 20 bp, Artificial Sequence
  chemically synthesized
tttatttatttgtttttcca

SEQ ID NO: 40117 - DNA, 20 bp, Artificial Sequence
  chemically synthesized
tttatttgtttttccaaagt

SEQ ID NO: 40118 - DNA, 20 bp, Artificial Sequence
  chemically synthesized
gtttttccaaagttggcata

SEQ ID NO: 40119 - DNA, 20 bp, Artificial Sequence
  chemically synthesized
ttttccaaagttggcataca

SEQ ID NO: 40120 - DNA, 20 bp, Artificial Sequence
  chemically synthesized
catacagagtttattctatt

SEQ ID NO: 40121 - DNA, 20 bp, Artificial Sequence
  chemically synthesized
tatttagaaacgtcgttttc

SEQ ID NO: 40122 - DNA, 20 bp, Artificial Sequence
  chemically synthesized
ttctggttgcctttgttgtt

SEQ ID NO: 40123 - DNA, 20 bp, Artificial Sequence
  chemically synthesized
gctaacatacaaactacatt

SEQ ID NO: 40124 - DNA, 20 bp, Artificial Sequence
  chemically synthesized
ctaacatacaaactacattt

SEQ ID NO: 40125 - DNA, 20 bp, Artificial Sequence
  chemically synthesized
catacaaactacatttagga

SEQ ID NO: 40126 - DNA, 20 bp, Artificial Sequence
  chemically synthesized
gcatctctattgaccactga

SEQ ID NO: 40127 - DNA, 20 bp, Artificial Sequence
  chemically synthesized
catctctattgaccactgaa

SEQ ID NO: 40128 - DNA, 20 bp, Artificial Sequence
  chemically synthesized
accactgaaaggatgtctgt

SEQ ID NO: 40129 - DNA, 20 bp, Artificial Sequence
  chemically synthesized
cactgaaaggatgtctgtaa

SEQ ID NO: 40130 - DNA, 20 bp, Artificial Sequence
  chemically synthesized
gtctgtaagagtaaaaaaca

SEQ ID NO: 40131 - DNA, 20 bp, Artificial Sequence
  chemically synthesized
tgtaagagtaaaaaacatag

SEQ ID NO: 40132 - DNA, 20 bp, Artificial Sequence
  chemically synthesized
catagcggtattaaaatttt

SEQ ID NO: 40133 - DNA, 20 bp, Artificial Sequence
  chemically synthesized
atagcggtattaaaattttc

SEQ ID NO: 40134 - DNA, 20 bp, Artificial Sequence
  chemically synthesized
attaaaattttcaggcgaat

SEQ ID NO: 40135 - DNA, 20 bp, Artificial Sequence
  chemically synthesized
ttaaaattttcaggcgaata

SEQ ID NO: 40136 - DNA, 20 bp, Artificial Sequence
  chemically synthesized
taaaattttcaggcgaataa

SEQ ID NO: 40137 - DNA, 20 bp, Artificial Sequence
  chemically synthesized
ataagggttttttgtaaaaa

SEQ ID NO: 40138 - DNA, 20 bp, Artificial Sequence
  chemically synthesized
aaaatggcaaatgtatttgt

SEQ ID NO: 40139 - DNA, 20 bp, Artificial Sequence
  chemically synthesized
atggcaaatgtatttgtcag

SEQ ID NO: 40140 - DNA, 20 bp, Artificial Sequence
  chemically synthesized
tggcaaatgtatttgtcagt

SEQ ID NO: 40141 - DNA, 20 bp, Artificial Sequence
  chemically synthesized
ggcaaatgtatttgtcagta

SEQ ID NO: 40142 - DNA, 20 bp, Artificial Sequence
  chemically synthesized
gcaaatgtatttgtcagtag

SEQ ID NO: 40143 - DNA, 20 bp, Artificial Sequence
  chemically synthesized
gctgttttcttgattgttat

SEQ ID NO: 40144 - DNA, 20 bp, Artificial Sequence
  chemically synthesized
gttttcttgattgttataag

SEQ ID NO: 40145 - DNA, 20 bp, Artificial Sequence
  chemically synthesized
tcttgattgttataagaaga

SEQ ID NO: 40146 - DNA, 20 bp, Artificial Sequence
  chemically synthesized
gtaaatgtgtaatgcaaact

SEQ ID NO: 40147 - DNA, 20 bp, Artificial Sequence
  chemically synthesized
taaatgtgtaatgcaaactt

SEQ ID NO: 40148 - DNA, 20 bp, Artificial Sequence
  chemically synthesized
aaatgtgtaatgcaaactta

SEQ ID NO: 40149 - DNA, 20 bp, Artificial Sequence
  chemically synthesized
aatgtgtaatgcaaacttag

SEQ ID NO: 40150 - DNA, 20 bp, Artificial Sequence
  chemically synthesized
aggggcgatgtgctgaaaat

SEQ ID NO: 40151 - DNA, 20 bp, Artificial Sequence
  chemically synthesized
ggggcgatgtgctgaaaata

SEQ ID NO: 40152 - DNA, 20 bp, Artificial Sequence
  chemically synthesized
gtgctgaaaataaggtatga

SEQ ID NO: 40153 - DNA, 20 bp, Artificial Sequence
  chemically synthesized
gaaaataaggtatgatagcg

SEQ ID NO: 40154 - DNA, 20 bp, Artificial Sequence
  chemically synthesized
aaggtatgatagcgaagtct

SEQ ID NO: 40155 - DNA, 20 bp, Artificial Sequence
  chemically synthesized
tgatagcgaagtctaagaaa

SEQ ID NO: 40156 - DNA, 20 bp, Artificial Sequence
  chemically synthesized
atagcgaagtctaagaaaca

SEQ ID NO: 40157 - DNA, 20 bp, Artificial Sequence
  chemically synthesized
tagcgaagtctaagaaacag

SEQ ID NO: 40158 - DNA, 20 bp, Artificial Sequence
  chemically synthesized
agaggtatctaattataaat

SEQ ID NO: 40159 - DNA, 20 bp, Artificial Sequence
  chemically synthesized
ggtatctaattataaataag

SEQ ID NO: 40160 - DNA, 20 bp, Artificial Sequence
  chemically synthesized
atctaattataaataagaag

SEQ ID NO: 40161 - DNA, 20 bp, Artificial Sequence
  chemically synthesized
taattataaataagaagaag

SEQ ID NO: 40162 - DNA, 20 bp, Artificial Sequence
  chemically synthesized
aattataaataagaagaagt

SEQ ID NO: 40163 - DNA, 20 bp, Artificial Sequence
  chemically synthesized
tataaataagaagaagtggg

SEQ ID NO: 40164 - DNA, 20 bp, Artificial Sequence
  chemically synthesized
taagaagaagtgggaagatc

SEQ ID NO: 40165 - DNA, 20 bp, Artificial Sequence
  chemically synthesized
agaagtgggaagatcaagtt

SEQ ID NO: 40166 - DNA, 20 bp, Artificial Sequence
  chemically synthesized
aagtgggaagatcaagttga

SEQ ID NO: 40167 - DNA, 20 bp, Artificial Sequence
  chemically synthesized
gaagatcaagttgagagctc

SEQ ID NO: 40168 - DNA, 20 bp, Artificial Sequence
  chemically synthesized
gctcaagtttactcatatgt

SEQ ID NO: 40169 - DNA, 20 bp, Artificial Sequence
  chemically synthesized
aagtttactcatatgttagc

SEQ ID NO: 40170 - DNA, 20 bp, Artificial Sequence
  chemically synthesized
agtttactcatatgttagca

SEQ ID NO: 40171 - DNA, 20 bp, Artificial Sequence
  chemically synthesized
gtttactcatatgttagcaa

SEQ ID NO: 40172 - DNA, 20 bp, Artificial Sequence
  chemically synthesized
gatgacataatatgatatta

SEQ ID NO: 40173 - DNA, 20 bp, Artificial Sequence
  chemically synthesized
atagcctattgatctttaaa

SEQ ID NO: 40174 - DNA, 20 bp, Artificial Sequence
  chemically synthesized
ctttaaacagcctgtatcaa

SEQ ID NO: 40175 - DNA, 20 bp, Artificial Sequence
  chemically synthesized
atagtcaaaaatcaattaaa

SEQ ID NO: 40176 - DNA, 20 bp, Artificial Sequence
  chemically synthesized
tagtcaaaaatcaattaaaa

SEQ ID NO: 40177 - DNA, 20 bp, Artificial Sequence
  chemically synthesized
taaaaatcactcattttctt

SEQ ID NO: 40178 - DNA, 20 bp, Artificial Sequence
  chemically synthesized
tattatattttacaacttct

SEQ ID NO: 40179 - DNA, 20 bp, Artificial Sequence
  chemically synthesized
tgaaaatcctttcaattatt

SEQ ID NO: 40180 - DNA, 20 bp, Artificial Sequence
  chemically synthesized
aatcctttcaattattaagt

SEQ ID NO: 40181 - DNA, 20 bp, Artificial Sequence
  chemically synthesized
tcagcatccacctgctgatc

SEQ ID NO: 40182 - DNA, 20 bp, Artificial Sequence
  chemically synthesized
ctgctgatccagtgatatat

SEQ ID NO: 40183 - DNA, 20 bp, Artificial Sequence
  chemically synthesized
tgctgatccagtgatatata

SEQ ID NO: 40184 - DNA, 20 bp, Artificial Sequence
  chemically synthesized
ggacatttattgcaccactg

SEQ ID NO: 40185 - DNA, 20 bp, Artificial Sequence
  chemically synthesized
ttgcaccactgaagtaaaat

SEQ ID NO: 40186 - DNA, 20 bp, Artificial Sequence
  chemically synthesized
aaatcagtgtcctttcaaac

SEQ ID NO: 40187 - DNA, 20 bp, Artificial Sequence
  chemically synthesized
agtgtcctttcaaacaagtg

SEQ ID NO: 40188 - DNA, 20 bp, Artificial Sequence
  chemically synthesized
tttcaaacaagtgcagcttc

SEQ ID NO: 40189 - DNA, 20 bp, Artificial Sequence
  chemically synthesized
aacaagtgcagcttccagac

SEQ ID NO: 40190 - DNA, 20 bp, Artificial Sequence
  chemically synthesized
cagcttccagacaagtctct

SEQ ID NO: 40191 - DNA, 20 bp, Artificial Sequence
  chemically synthesized
agtctcttagacctcatcct

SEQ ID NO: 40192 - DNA, 20 bp, Artificial Sequence
  chemically synthesized
tcagtctcaccctgactgac

SEQ ID NO: 40193 - DNA, 20 bp, Artificial Sequence
  chemically synthesized
ctgacaagtttgccatactt

SEQ ID NO: 40194 - DNA, 20 bp, Artificial Sequence
  chemically synthesized
ccatacttgagaaccttgtg

SEQ ID NO: 40195 - DNA, 20 bp, Artificial Sequence
  chemically synthesized
tacttgagaaccttgtgaag

SEQ ID NO: 40196 - DNA, 20 bp, Artificial Sequence
  chemically synthesized
acttgagaaccttgtgaagc

SEQ ID NO: 40197 - DNA, 20 bp, Artificial Sequence
  chemically synthesized
gaagcaggcgttgtgtctat

SEQ ID NO: 40198 - DNA, 20 bp, Artificial Sequence
  chemically synthesized
gttgtgtctataagctctct

SEQ ID NO: 40199 - DNA, 20 bp, Artificial Sequence
  chemically synthesized
tgtgtctataagctctctta

SEQ ID NO: 40200 - DNA, 20 bp, Artificial Sequence
  chemically synthesized
ctctcttagagatctgctct

SEQ ID NO: 40201 - DNA, 20 bp, Artificial Sequence
  chemically synthesized
tctcttagagatctgctctg

SEQ ID NO: 40202 - DNA, 20 bp, Artificial Sequence
  chemically synthesized
atctgctctgaggaattatc

SEQ ID NO: 40203 - DNA, 20 bp, Artificial Sequence
  chemically synthesized
gctctgaggaattatcaagt

SEQ ID NO: 40204 - DNA, 20 bp, Artificial Sequence
  chemically synthesized
gaggaattatcaagtcagca

SEQ ID NO: 40205 - DNA, 20 bp, Artificial Sequence
  chemically synthesized
ttaattctctgtcatactgt

SEQ ID NO: 40206 - DNA, 20 bp, Artificial Sequence
  chemically synthesized
tctctgtcatactgtgagtt

SEQ ID NO: 40207 - DNA, 20 bp, Artificial Sequence
  chemically synthesized
tgtcatactgtgagtttagt

SEQ ID NO: 40208 - DNA, 20 bp, Artificial Sequence
  chemically synthesized
gtcatactgtgagtttagtc

SEQ ID NO: 40209 - DNA, 20 bp, Artificial Sequence
  chemically synthesized
tcatactgtgagtttagtca

SEQ ID NO: 40210 - DNA, 20 bp, Artificial Sequence
  chemically synthesized
tactgtgagtttagtcaggg

SEQ ID NO: 40211 - DNA, 20 bp, Artificial Sequence
  chemically synthesized
cagtaattatatttccccat

SEQ ID NO: 40212 - DNA, 20 bp, Artificial Sequence
  chemically synthesized
catcagcatattgtcttccc

SEQ ID NO: 40213 - DNA, 20 bp, Artificial Sequence
  chemically synthesized
atcagcatattgtcttccca

SEQ ID NO: 40214 - DNA, 20 bp, Artificial Sequence
  chemically synthesized
aacccccaaatttattaatg

SEQ ID NO: 40215 - DNA, 20 bp, Artificial Sequence
  chemically synthesized
aatacacaatgttacttgtc

SEQ ID NO: 40216 - DNA, 20 bp, Artificial Sequence
  chemically synthesized
acaatgttacttgtctggtg

SEQ ID NO: 40217 - DNA, 20 bp, Artificial Sequence
  chemically synthesized
ttacttgtctggtgtggcta

SEQ ID NO: 40218 - DNA, 20 bp, Artificial Sequence
  chemically synthesized
tatttatttatttattttta

SEQ ID NO: 40219 - DNA, 20 bp, Artificial Sequence
  chemically synthesized
catgatcttgctctgttgcc

SEQ ID NO: 40220 - DNA, 20 bp, Artificial Sequence
  chemically synthesized
atgatcttgctctgttgccc

SEQ ID NO: 40221 - DNA, 20 bp, Artificial Sequence
  chemically synthesized
tcttgctctgttgcccaggc

SEQ ID NO: 40222 - DNA, 20 bp, Artificial Sequence
  chemically synthesized
ttgctctgttgcccaggctg

SEQ ID NO: 40223 - DNA, 20 bp, Artificial Sequence
  chemically synthesized
ctgttgcccaggctggagtg

SEQ ID NO: 40224 - DNA, 20 bp, Artificial Sequence
  chemically synthesized
ttgcccaggctggagtgcag

SEQ ID NO: 40225 - DNA, 20 bp, Artificial Sequence
  chemically synthesized
ggagtgcagtggtgccatca

SEQ ID NO: 40226 - DNA, 20 bp, Artificial Sequence
  chemically synthesized
ggtgccatcacagctcactg

SEQ ID NO: 40227 - DNA, 20 bp, Artificial Sequence
  chemically synthesized
tcactgcagccttgaaatcc

SEQ ID NO: 40228 - DNA, 20 bp, Artificial Sequence
  chemically synthesized
cactgcagccttgaaatcct

SEQ ID NO: 40229 - DNA, 20 bp, Artificial Sequence
  chemically synthesized
agccttgaaatcctgggctc

SEQ ID NO: 40230 - DNA, 20 bp, Artificial Sequence
  chemically synthesized
ctcaagcaatccttcttcct

SEQ ID NO: 40231 - DNA, 20 bp, Artificial Sequence
  chemically synthesized
tccttcttcctcagcttttt

SEQ ID NO: 40232 - DNA, 20 bp, Artificial Sequence
  chemically synthesized
tcctcagctttttgagtacc

SEQ ID NO: 40233 - DNA, 20 bp, Artificial Sequence
  chemically synthesized
cctcagctttttgagtacct

SEQ ID NO: 40234 - DNA, 20 bp, Artificial Sequence
  chemically synthesized
tttttgagtacctaggacta

SEQ ID NO: 40235 - DNA, 20 bp, Artificial Sequence
  chemically synthesized
ttttgagtacctaggactac

SEQ ID NO: 40236 - DNA, 20 bp, Artificial Sequence
  chemically synthesized
caggtttatgccactgcacc

SEQ ID NO: 40237 - DNA, 20 bp, Artificial Sequence
  chemically synthesized
gtttttattttttgtaaata

SEQ ID NO: 40238 - DNA, 20 bp, Artificial Sequence
  chemically synthesized
tttttattttttgtaaatat

SEQ ID NO: 40239 - DNA, 20 bp, Artificial Sequence
  chemically synthesized
tgggatcatgttatgttgcc

SEQ ID NO: 40240 - DNA, 20 bp, Artificial Sequence
  chemically synthesized
gggatcatgttatgttgccg

SEQ ID NO: 40241 - DNA, 20 bp, Artificial Sequence
  chemically synthesized
gctctccaattcctaacctc

SEQ ID NO: 40242 - DNA, 20 bp, Artificial Sequence
  chemically synthesized
ctcaagcaatcctcccaccc

SEQ ID NO: 40243 - DNA, 20 bp, Artificial Sequence
  chemically synthesized
ccaccctggcctcctaatga

SEQ ID NO: 40244 - DNA, 20 bp, Artificial Sequence
  chemically synthesized
caccctggcctcctaatgat

SEQ ID NO: 40245 - DNA, 20 bp, Artificial Sequence
  chemically synthesized
accctggcctcctaatgata

SEQ ID NO: 40246 - DNA, 20 bp, Artificial Sequence
  chemically synthesized
tggcctcctaatgataggga

SEQ ID NO: 40247 - DNA, 20 bp, Artificial Sequence
  chemically synthesized
ggcctcctaatgatagggac

SEQ ID NO: 40248 - DNA, 20 bp, Artificial Sequence
  chemically synthesized
cctcctaatgatagggacag

SEQ ID NO: 40249 - DNA, 20 bp, Artificial Sequence
  chemically synthesized
ctcctaatgatagggacagg

SEQ ID NO: 40250 - DNA, 20 bp, Artificial Sequence
  chemically synthesized
ctaatgatagggacaggagg

SEQ ID NO: 40251 - DNA, 20 bp, Artificial Sequence
  chemically synthesized
aatgatagggacaggaggca

SEQ ID NO: 40252 - DNA, 20 bp, Artificial Sequence
  chemically synthesized
gacaggaggcagagaaattt

SEQ ID NO: 40253 - DNA, 20 bp, Artificial Sequence
  chemically synthesized
acaggaggcagagaaatttt

SEQ ID NO: 40254 - DNA, 20 bp, Artificial Sequence
  chemically synthesized
ggaggcagagaaattttagg

SEQ ID NO: 40255 - DNA, 20 bp, Artificial Sequence
  chemically synthesized
cagagaaattttaggcagaa

SEQ ID NO: 40256 - DNA, 20 bp, Artificial Sequence
  chemically synthesized
agagaaattttaggcagaaa

SEQ ID NO: 40257 - DNA, 20 bp, Artificial Sequence
  chemically synthesized
gagaaattttaggcagaaaa

SEQ ID NO: 40258 - DNA, 20 bp, Artificial Sequence
  chemically synthesized
aaattttaggcagaaaaggg

SEQ ID NO: 40259 - DNA, 20 bp, Artificial Sequence
  chemically synthesized
aattttaggcagaaaagggc

SEQ ID NO: 40260 - DNA, 20 bp, Artificial Sequence
  chemically synthesized
attttaggcagaaaagggcg

SEQ ID NO: 40261 - DNA, 20 bp, Artificial Sequence
  chemically synthesized
gcagaaaagggcggggtccc

SEQ ID NO: 40262 - DNA, 20 bp, Artificial Sequence
  chemically synthesized
aaagggcggggtccctggca

SEQ ID NO: 40263 - DNA, 20 bp, Artificial Sequence
  chemically synthesized
aagggcggggtccctggcat

SEQ ID NO: 40264 - DNA, 20 bp, Artificial Sequence
  chemically synthesized
ctggcatgggtcctaccctg

SEQ ID NO: 40265 - DNA, 20 bp, Artificial Sequence
  chemically synthesized
atgggtcctaccctgaagcc

SEQ ID NO: 40266 - DNA, 20 bp, Artificial Sequence
  chemically synthesized
ctaccctgaagcctggaaca

SEQ ID NO: 40267 - DNA, 20 bp, Artificial Sequence
  chemically synthesized
cctggaacatggccattcct

SEQ ID NO: 40268 - DNA, 20 bp, Artificial Sequence
  chemically synthesized
cattcctgagatatttctct

SEQ ID NO: 40269 - DNA, 20 bp, Artificial Sequence
  chemically synthesized
cctgagatatttctctcagc

SEQ ID NO: 40270 - DNA, 20 bp, Artificial Sequence
  chemically synthesized
ctgtttcacattcacatttt

SEQ ID NO: 40271 - DNA, 20 bp, Artificial Sequence
  chemically synthesized
cacattcacattttaagtgc

SEQ ID NO: 40272 - DNA, 20 bp, Artificial Sequence
  chemically synthesized
acattcacattttaagtgcc

SEQ ID NO: 40273 - DNA, 20 bp, Artificial Sequence
  chemically synthesized
gccaggtctttctatctttc

SEQ ID NO: 40274 - DNA, 20 bp, Artificial Sequence
  chemically synthesized
tgtcttattcatgcactttc

SEQ ID NO: 40275 - DNA, 20 bp, Artificial Sequence
  chemically synthesized
ttgtctcatgaatattccct

SEQ ID NO: 40276 - DNA, 20 bp, Artificial Sequence
  chemically synthesized
tgtctcatgaatattccctc

SEQ ID NO: 40277 - DNA, 20 bp, Artificial Sequence
  chemically synthesized
cccacgccgttccctttatc

SEQ ID NO: 40278 - DNA, 20 bp, Artificial Sequence
  chemically synthesized
attcctcttgctgtactgat

SEQ ID NO: 40279 - DNA, 20 bp, Artificial Sequence
  chemically synthesized
attagccttgactcctctta

SEQ ID NO: 40280 - DNA, 20 bp, Artificial Sequence
  chemically synthesized
actcctcttatagctcaccc

SEQ ID NO: 40281 - DNA, 20 bp, Artificial Sequence
  chemically synthesized
tatagctcaccccagcctct

SEQ ID NO: 40282 - DNA, 20 bp, Artificial Sequence
  chemically synthesized
agcctcttggcattattatc

SEQ ID NO: 40283 - DNA, 20 bp, Artificial Sequence
  chemically synthesized
attattatcaagtgttacca

SEQ ID NO: 40284 - DNA, 20 bp, Artificial Sequence
  chemically synthesized
caagtgttaccacagttgaa

SEQ ID NO: 40285 - DNA, 20 bp, Artificial Sequence
  chemically synthesized
tgttaccacagttgaacagc

SEQ ID NO: 40286 - DNA, 20 bp, Artificial Sequence
  chemically synthesized
agttgaacagctggatccaa

SEQ ID NO: 40287 - DNA, 20 bp, Artificial Sequence
  chemically synthesized
atccaaaagtattgaccaat

SEQ ID NO: 40288 - DNA, 20 bp, Artificial Sequence
  chemically synthesized
tccaaaagtattgaccaata

SEQ ID NO: 40289 - DNA, 20 bp, Artificial Sequence
  chemically synthesized
aagtattgaccaataaggaa

SEQ ID NO: 40290 - DNA, 20 bp, Artificial Sequence
  chemically synthesized
ttgcaatgtaaattataata

SEQ ID NO: 40291 - DNA, 20 bp, Artificial Sequence
  chemically synthesized
atgtaaattataatatggat

SEQ ID NO: 40292 - DNA, 20 bp, Artificial Sequence
  chemically synthesized
attataatatggataagcat

SEQ ID NO: 40293 - DNA, 20 bp, Artificial Sequence
  chemically synthesized
aagcattggtactaaacctg

SEQ ID NO: 40294 - DNA, 20 bp, Artificial Sequence
  chemically synthesized
attggtactaaacctgaagt

SEQ ID NO: 40295 - DNA, 20 bp, Artificial Sequence
  chemically synthesized
gtattttactctatacctac

SEQ ID NO: 40296 - DNA, 20 bp, Artificial Sequence
  chemically synthesized
tattttactctatacctaca

SEQ ID NO: 40297 - DNA, 20 bp, Artificial Sequence
  chemically synthesized
tttactctatacctacaagg

SEQ ID NO: 40298 - DNA, 20 bp, Artificial Sequence
  chemically synthesized
tacctacaaggaagatatac

SEQ ID NO: 40299 - DNA, 20 bp, Artificial Sequence
  chemically synthesized
agatatacaagtatttctct

SEQ ID NO: 40300 - DNA, 20 bp, Artificial Sequence
  chemically synthesized
gatatacaagtatttctcta

SEQ ID NO: 40301 - DNA, 20 bp, Artificial Sequence
  chemically synthesized
atacaagtatttctctaagg

SEQ ID NO: 40302 - DNA, 20 bp, Artificial Sequence
  chemically synthesized
tttctctaaggtagtttgaa

SEQ ID NO: 40303 - DNA, 20 bp, Artificial Sequence
  chemically synthesized
ctaaggtagtttgaaaagcc

SEQ ID NO: 40304 - DNA, 20 bp, Artificial Sequence
  chemically synthesized
tagtttgaaaagcctagata

SEQ ID NO: 40305 - DNA, 20 bp, Artificial Sequence
  chemically synthesized
aaaagcctagatatagaaac

SEQ ID NO: 40306 - DNA, 20 bp, Artificial Sequence
  chemically synthesized
tagaaactggatcctcacat

SEQ ID NO: 40307 - DNA, 20 bp, Artificial Sequence
  chemically synthesized
actggatcctcacatgagtt

SEQ ID NO: 40308 - DNA, 20 bp, Artificial Sequence
  chemically synthesized
agttcagtatataattgtaa

SEQ ID NO: 40309 - DNA, 20 bp, Artificial Sequence
  chemically synthesized
aaaaaatcaattatgtattc

SEQ ID NO: 40310 - DNA, 20 bp, Artificial Sequence
  chemically synthesized
caattatgtattcaagttgc

SEQ ID NO: 40311 - DNA, 20 bp, Artificial Sequence
  chemically synthesized
attcaagttgctagtgtctt

SEQ ID NO: 40312 - DNA, 20 bp, Artificial Sequence
  chemically synthesized
tcaagttgctagtgtcttaa

SEQ ID NO: 40313 - DNA, 20 bp, Artificial Sequence
  chemically synthesized
caagttgctagtgtcttaag

SEQ ID NO: 40314 - DNA, 20 bp, Artificial Sequence
  chemically synthesized
gattatcacaaaaatacttc

SEQ ID NO: 40315 - DNA, 20 bp, Artificial Sequence
  chemically synthesized
ataattcctgactacacatg

SEQ ID NO: 40316 - DNA, 20 bp, Artificial Sequence
  chemically synthesized
aattcctgactacacatgaa

SEQ ID NO: 40317 - DNA, 20 bp, Artificial Sequence
  chemically synthesized
cacatgaagagactgacacg

SEQ ID NO: 40318 - DNA, 20 bp, Artificial Sequence
  chemically synthesized
acatgaagagactgacacgt

SEQ ID NO: 40319 - DNA, 20 bp, Artificial Sequence
  chemically synthesized
tgacacgtaggtgccttact

SEQ ID NO: 40320 - DNA, 20 bp, Artificial Sequence
  chemically synthesized
gacacgtaggtgccttactt

SEQ ID NO: 40321 - DNA, 20 bp, Artificial Sequence
  chemically synthesized
acgtaggtgccttacttagg

SEQ ID NO: 40322 - DNA, 20 bp, Artificial Sequence
  chemically synthesized
cgtaggtgccttacttaggt

SEQ ID NO: 40323 - DNA, 20 bp, Artificial Sequence
  chemically synthesized
gtgccttacttaggtaggtt

SEQ ID NO: 40324 - DNA, 20 bp, Artificial Sequence
  chemically synthesized
ttatccaaaaccacacaatg

SEQ ID NO: 40325 - DNA, 20 bp, Artificial Sequence
  chemically synthesized
aaccacacaatgtagaacct

SEQ ID NO: 40326 - DNA, 20 bp, Artificial Sequence
  chemically synthesized
atgtagaacctaagctgatt

SEQ ID NO: 40327 - DNA, 20 bp, Artificial Sequence
  chemically synthesized
aacctaagctgattcggcca

SEQ ID NO: 40328 - DNA, 20 bp, Artificial Sequence
  chemically synthesized
ggccatagaaacacaatatg

SEQ ID NO: 40329 - DNA, 20 bp, Artificial Sequence
  chemically synthesized
acacaatatgtggtataaat

SEQ ID NO: 40330 - DNA, 20 bp, Artificial Sequence
  chemically synthesized
aatatgtggtataaatgaga

SEQ ID NO: 40331 - DNA, 20 bp, Artificial Sequence
  chemically synthesized
tatgtggtataaatgagaca

SEQ ID NO: 40332 - DNA, 20 bp, Artificial Sequence
  chemically synthesized
atgtggtataaatgagacag

SEQ ID NO: 40333 - DNA, 20 bp, Artificial Sequence
  chemically synthesized
tgtggtataaatgagacaga

SEQ ID NO: 40334 - DNA, 20 bp, Artificial Sequence
  chemically synthesized
ttctctccttcctatgctgt

SEQ ID NO: 40335 - DNA, 20 bp, Artificial Sequence
  chemically synthesized
tatgctgtcagatgaatact

SEQ ID NO: 40336 - DNA, 20 bp, Artificial Sequence
  chemically synthesized
ctgtcagatgaatactgaga

SEQ ID NO: 40337 - DNA, 20 bp, Artificial Sequence
  chemically synthesized
gaatactgagatagaatatt

SEQ ID NO: 40338 - DNA, 20 bp, Artificial Sequence
  chemically synthesized
ttcatctatcacacattaaa

SEQ ID NO: 40339 - DNA, 20 bp, Artificial Sequence
  chemically synthesized
tcatctatcacacattaaac

SEQ ID NO: 40340 - DNA, 20 bp, Artificial Sequence
  chemically synthesized
ctttacatttctgtctgttg

SEQ ID NO: 40341 - DNA, 20 bp, Artificial Sequence
  chemically synthesized
atttctgtctgttgaagatt

SEQ ID NO: 40342 - DNA, 20 bp, Artificial Sequence
  chemically synthesized
tttctgtctgttgaagattt

SEQ ID NO: 40343 - DNA, 20 bp, Artificial Sequence
  chemically synthesized
gtctgttgaagatttgggtg

SEQ ID NO: 40344 - DNA, 20 bp, Artificial Sequence
  chemically synthesized
tctgttgaagatttgggtgt

SEQ ID NO: 40345 - DNA, 20 bp, Artificial Sequence
  chemically synthesized
ctgttgaagatttgggtgtg

SEQ ID NO: 40346 - DNA, 20 bp, Artificial Sequence
  chemically synthesized
tttgggtgtggggataactc

SEQ ID NO: 40347 - DNA, 20 bp, Artificial Sequence
  chemically synthesized
ttgggtgtggggataactca

SEQ ID NO: 40348 - DNA, 20 bp, Artificial Sequence
  chemically synthesized
taactcaaggtatcatatcc

SEQ ID NO: 40349 - DNA, 20 bp, Artificial Sequence
  chemically synthesized
aactcaaggtatcatatcca

SEQ ID NO: 40350 - DNA, 20 bp, Artificial Sequence
  chemically synthesized
actcaaggtatcatatccaa

SEQ ID NO: 40351 - DNA, 20 bp, Artificial Sequence
  chemically synthesized
aaggtatcatatccaaggga

SEQ ID NO: 40352 - DNA, 20 bp, Artificial Sequence
  chemically synthesized
tcatatccaagggatggatg

SEQ ID NO: 40353 - DNA, 20 bp, Artificial Sequence
  chemically synthesized
catatccaagggatggatga

SEQ ID NO: 40354 - DNA, 20 bp, Artificial Sequence
  chemically synthesized
atccaagggatggatgaagg

SEQ ID NO: 40355 - DNA, 20 bp, Artificial Sequence
  chemically synthesized
tccaagggatggatgaaggc

SEQ ID NO: 40356 - DNA, 20 bp, Artificial Sequence
  chemically synthesized
atgaaggcaggtgactctaa

SEQ ID NO: 40357 - DNA, 20 bp, Artificial Sequence
  chemically synthesized
aggcaggtgactctaacaga

SEQ ID NO: 40358 - DNA, 20 bp, Artificial Sequence
  chemically synthesized
ggcaggtgactctaacagaa

SEQ ID NO: 40359 - DNA, 20 bp, Artificial Sequence
  chemically synthesized
gcaggtgactctaacagaaa

SEQ ID NO: 40360 - DNA, 20 bp, Artificial Sequence
  chemically synthesized
gtgactctaacagaaaggga

SEQ ID NO: 40361 - DNA, 20 bp, Artificial Sequence
  chemically synthesized
tgactctaacagaaagggaa

SEQ ID NO: 40362 - DNA, 20 bp, Artificial Sequence
  chemically synthesized
aacagaaagggaaaggatgt

SEQ ID NO: 40363 - DNA, 20 bp, Artificial Sequence
  chemically synthesized
gaaagggaaaggatgttggc

SEQ ID NO: 40364 - DNA, 20 bp, Artificial Sequence
  chemically synthesized
aaagggaaaggatgttggca

SEQ ID NO: 40365 - DNA, 20 bp, Artificial Sequence
  chemically synthesized
tggcaaggctatgttcatga

SEQ ID NO: 40366 - DNA, 20 bp, Artificial Sequence
  chemically synthesized
gtatatgtaaaatccacatt

SEQ ID NO: 40367 - DNA, 20 bp, Artificial Sequence
  chemically synthesized
aagcttctttctgcatgcat

SEQ ID NO: 40368 - DNA, 20 bp, Artificial Sequence
  chemically synthesized
tatgaataatgtgtatgtaa

SEQ ID NO: 40369 - DNA, 20 bp, Artificial Sequence
  chemically synthesized
aaagtgtgctgtatattcaa

SEQ ID NO: 40370 - DNA, 20 bp, Artificial Sequence
  chemically synthesized
tcaaaagtgtttcatgtgcc

SEQ ID NO: 40371 - DNA, 20 bp, Artificial Sequence
  chemically synthesized
caaaagtgtttcatgtgcct

SEQ ID NO: 40372 - DNA, 20 bp, Artificial Sequence
  chemically synthesized
aaaagtgtttcatgtgccta

SEQ ID NO: 40373 - DNA, 20 bp, Artificial Sequence
  chemically synthesized
aaagtgtttcatgtgcctag

SEQ ID NO: 40374 - DNA, 20 bp, Artificial Sequence
  chemically synthesized
ctaggggtgtcaaatacttt

SEQ ID NO: 40375 - DNA, 20 bp, Artificial Sequence
  chemically synthesized
gtcaaatactttgagtttgt

SEQ ID NO: 40376 - DNA, 20 bp, Artificial Sequence
  chemically synthesized
ctatttacttgattctcaat

SEQ ID NO: 40377 - DNA, 20 bp, Artificial Sequence
  chemically synthesized
tttacttgattctcaataag

SEQ ID NO: 40378 - DNA, 20 bp, Artificial Sequence
  chemically synthesized
ttacttgattctcaataagt

SEQ ID NO: 40379 - DNA, 20 bp, Artificial Sequence
  chemically synthesized
ttctcaataagtaggtatca

SEQ ID NO: 40380 - DNA, 20 bp, Artificial Sequence
  chemically synthesized
tgaacatctgacaaatgttt

SEQ ID NO: 40381 - DNA, 20 bp, Artificial Sequence
  chemically synthesized
gaacatctgacaaatgtttg

SEQ ID NO: 40382 - DNA, 20 bp, Artificial Sequence
  chemically synthesized
caaatgtttgaggaacaatt

SEQ ID NO: 40383 - DNA, 20 bp, Artificial Sequence
  chemically synthesized
attaaatgcctaatctgtat

SEQ ID NO: 40384 - DNA, 20 bp, Artificial Sequence
  chemically synthesized
gtatcagatatacaattatc

SEQ ID NO: 40385 - DNA, 20 bp, Artificial Sequence
  chemically synthesized
tctgtaattcctaatttaaa

SEQ ID NO: 40386 - DNA, 20 bp, Artificial Sequence
  chemically synthesized
tcctaatttaaacagctgtg

SEQ ID NO: 40387 - DNA, 20 bp, Artificial Sequence
  chemically synthesized
aaacagctgtgtagcctaat

SEQ ID NO: 40388 - DNA, 20 bp, Artificial Sequence
  chemically synthesized
aacagctgtgtagcctaatt

SEQ ID NO: 40389 - DNA, 20 bp, Artificial Sequence
  chemically synthesized
acagctgtgtagcctaatta

SEQ ID NO: 40390 - DNA, 20 bp, Artificial Sequence
  chemically synthesized
gtgtagcctaattagggata

SEQ ID NO: 40391 - DNA, 20 bp, Artificial Sequence
  chemically synthesized
tgtagcctaattagggataa

SEQ ID NO: 40392 - DNA, 20 bp, Artificial Sequence
  chemically synthesized
atgcaaacccataatttgtg

SEQ ID NO: 40393 - DNA, 20 bp, Artificial Sequence
  chemically synthesized
tgcaaacccataatttgtgt

SEQ ID NO: 40394 - DNA, 20 bp, Artificial Sequence
  chemically synthesized
taatttgtgtaggttgaaat

SEQ ID NO: 40395 - DNA, 20 bp, Artificial Sequence
  chemically synthesized
gtgtaggttgaaatgagcta

SEQ ID NO: 40396 - DNA, 20 bp, Artificial Sequence
  chemically synthesized
aaatgagctatagaaaaatg

SEQ ID NO: 40397 - DNA, 20 bp, Artificial Sequence
  chemically synthesized
gaaaaatgcagtatatttat

SEQ ID NO: 40398 - DNA, 20 bp, Artificial Sequence
  chemically synthesized
aaatgcagtatatttatcag

SEQ ID NO: 40399 - DNA, 20 bp, Artificial Sequence
  chemically synthesized
gtatatttatcagaagtctt

SEQ ID NO: 40400 - DNA, 20 bp, Artificial Sequence
  chemically synthesized
tatatttatcagaagtcttt

SEQ ID NO: 40401 - DNA, 20 bp, Artificial Sequence
  chemically synthesized
atatttatcagaagtcttta

SEQ ID NO: 40402 - DNA, 20 bp, Artificial Sequence
  chemically synthesized
gaagtctttagggtcatgaa

SEQ ID NO: 40403 - DNA, 20 bp, Artificial Sequence
  chemically synthesized
aagtctttagggtcatgaaa

SEQ ID NO: 40404 - DNA, 20 bp, Artificial Sequence
  chemically synthesized
tttagggtcatgaaaaggaa

SEQ ID NO: 40405 - DNA, 20 bp, Artificial Sequence
  chemically synthesized
gaatggtcaactgacactgc

SEQ ID NO: 40406 - DNA, 20 bp, Artificial Sequence
  chemically synthesized
aatggtcaactgacactgcc

SEQ ID NO: 40407 - DNA, 20 bp, Artificial Sequence
  chemically synthesized
atggtcaactgacactgcca

SEQ ID NO: 40408 - DNA, 20 bp, Artificial Sequence
  chemically synthesized
actgccagggactcatatgt

SEQ ID NO: 40409 - DNA, 20 bp, Artificial Sequence
  chemically synthesized
tgccagggactcatatgtaa

SEQ ID NO: 40410 - DNA, 20 bp, Artificial Sequence
  chemically synthesized
tgtaagagataactaatgtg

SEQ ID NO: 40411 - DNA, 20 bp, Artificial Sequence
  chemically synthesized
actaatgtgaagtgacttta

SEQ ID NO: 40412 - DNA, 20 bp, Artificial Sequence
  chemically synthesized
ctaatgtgaagtgactttaa

SEQ ID NO: 40413 - DNA, 20 bp, Artificial Sequence
  chemically synthesized
aatgtgaagtgactttaaag

SEQ ID NO: 40414 - DNA, 20 bp, Artificial Sequence
  chemically synthesized
agtgactttaaaggagaaat

SEQ ID NO: 40415 - DNA, 20 bp, Artificial Sequence
  chemically synthesized
gactttaaaggagaaattag

SEQ ID NO: 40416 - DNA, 20 bp, Artificial Sequence
  chemically synthesized
tttaaaggagaaattagcag

SEQ ID NO: 40417 - DNA, 20 bp, Artificial Sequence
  chemically synthesized
tcctcatcatgttacaataa

SEQ ID NO: 40418 - DNA, 20 bp, Artificial Sequence
  chemically synthesized
tcatcatgttacaataacgg

SEQ ID NO: 40419 - DNA, 20 bp, Artificial Sequence
  chemically synthesized
atcatgttacaataacggaa

SEQ ID NO: 40420 - DNA, 20 bp, Artificial Sequence
  chemically synthesized
attaaaacaacaaatacatt

SEQ ID NO: 40421 - DNA, 20 bp, Artificial Sequence
  chemically synthesized
aaacaacaaatacatttaga

SEQ ID NO: 40422 - DNA, 20 bp, Artificial Sequence
  chemically synthesized
ttagacagcaatgtttatcc

SEQ ID NO: 40423 - DNA, 20 bp, Artificial Sequence
  chemically synthesized
acagcaatgtttatcctggt

SEQ ID NO: 40424 - DNA, 20 bp, Artificial Sequence
  chemically synthesized
gttttaatctaaatctatct

SEQ ID NO: 40425 - DNA, 20 bp, Artificial Sequence
  chemically synthesized
tttaatctaaatctatcttg

SEQ ID NO: 40426 - DNA, 20 bp, Artificial Sequence
  chemically synthesized
cctactttaaaatataaatg

SEQ ID NO: 40427 - DNA, 20 bp, Artificial Sequence
  chemically synthesized
ctactttaaaatataaatga

SEQ ID NO: 40428 - DNA, 20 bp, Artificial Sequence
  chemically synthesized
ctttaaaatataaatgaagg

SEQ ID NO: 40429 - DNA, 20 bp, Artificial Sequence
  chemically synthesized
tttaaaatataaatgaaggt

SEQ ID NO: 40430 - DNA, 20 bp, Artificial Sequence
  chemically synthesized
taaatgaaggtaggaacctg

SEQ ID NO: 40431 - DNA, 20 bp, Artificial Sequence
  chemically synthesized
taggaacctgtagatacaaa

SEQ ID NO: 40432 - DNA, 20 bp, Artificial Sequence
  chemically synthesized
aacctgtagatacaaaaagt

SEQ ID NO: 40433 - DNA, 20 bp, Artificial Sequence
  chemically synthesized
cctgtagatacaaaaagttg

SEQ ID NO: 40434 - DNA, 20 bp, Artificial Sequence
  chemically synthesized
tacaaaaagttggagaaaaa

SEQ ID NO: 40435 - DNA, 20 bp, Artificial Sequence
  chemically synthesized
ttggagaaaaaaagacaata

SEQ ID NO: 40436 - DNA, 20 bp, Artificial Sequence
  chemically synthesized
aaaaatctattaatccttga

SEQ ID NO: 40437 - DNA, 20 bp, Artificial Sequence
  chemically synthesized
attaatccttgatagaaaat

SEQ ID NO: 40438 - DNA, 20 bp, Artificial Sequence
  chemically synthesized
aatccttgatagaaaatgag

SEQ ID NO: 40439 - DNA, 20 bp, Artificial Sequence
  chemically synthesized
tccttgatagaaaatgagaa

SEQ ID NO: 40440 - DNA, 20 bp, Artificial Sequence
  chemically synthesized
aatgagaagagataaaacac

SEQ ID NO: 40441 - DNA, 20 bp, Artificial Sequence
  chemically synthesized
ataaaacactggtttacata

SEQ ID NO: 40442 - DNA, 20 bp, Artificial Sequence
  chemically synthesized
ctggtttacataaagaaaat

SEQ ID NO: 40443 - DNA, 20 bp, Artificial Sequence
  chemically synthesized
tttacataaagaaaataaga

SEQ ID NO: 40444 - DNA, 20 bp, Artificial Sequence
  chemically synthesized
cataaagaaaataagatgga

SEQ ID NO: 40445 - DNA, 20 bp, Artificial Sequence
  chemically synthesized
aagaaaataagatggataga

SEQ ID NO: 40446 - DNA, 20 bp, Artificial Sequence
  chemically synthesized
aaaataagatggatagatag

SEQ ID NO: 40447 - DNA, 20 bp, Artificial Sequence
  chemically synthesized
tagatagcagatccttataa

SEQ ID NO: 40448 - DNA, 20 bp, Artificial Sequence
  chemically synthesized
ccttataaaagtgataattt

SEQ ID NO: 40449 - DNA, 20 bp, Artificial Sequence
  chemically synthesized
aaaaaaatactccatattct

SEQ ID NO: 40450 - DNA, 20 bp, Artificial Sequence
  chemically synthesized
aaaataatacaaatctgctg

SEQ ID NO: 40451 - DNA, 20 bp, Artificial Sequence
  chemically synthesized
taatacaaatctgctgtggt

SEQ ID NO: 40452 - DNA, 20 bp, Artificial Sequence
  chemically synthesized
atctgctgtggtaagttaca

SEQ ID NO: 40453 - DNA, 20 bp, Artificial Sequence
  chemically synthesized
ctgctgtggtaagttacaaa

SEQ ID NO: 40454 - DNA, 20 bp, Artificial Sequence
  chemically synthesized
tgtggtaagttacaaagaga

SEQ ID NO: 40455 - DNA, 20 bp, Artificial Sequence
  chemically synthesized
gattttttatcattatataa

SEQ ID NO: 40456 - DNA, 20 bp, Artificial Sequence
  chemically synthesized
tatataaaagatattttaaa

SEQ ID NO: 40457 - DNA, 20 bp, Artificial Sequence
  chemically synthesized
tataaaagatattttaaaca

SEQ ID NO: 40458 - DNA, 20 bp, Artificial Sequence
  chemically synthesized
ttaaacagagttatacaaca

SEQ ID NO: 40459 - DNA, 20 bp, Artificial Sequence
  chemically synthesized
taaacagagttatacaacaa

SEQ ID NO: 40460 - DNA, 20 bp, Artificial Sequence
  chemically synthesized
agagttatacaacaaaggaa

SEQ ID NO: 40461 - DNA, 20 bp, Artificial Sequence
  chemically synthesized
acttatcactataaacatct

SEQ ID NO: 40462 - DNA, 20 bp, Artificial Sequence
  chemically synthesized
aaatctgcaaaatcatttca

SEQ ID NO: 40463 - DNA, 20 bp, Artificial Sequence
  chemically synthesized
tcatttcatagcattttaaa

SEQ ID NO: 40464 - DNA, 20 bp, Artificial Sequence
  chemically synthesized
ttcatagcattttaaatagt

SEQ ID NO: 40465 - DNA, 20 bp, Artificial Sequence
  chemically synthesized
tcatagcattttaaatagtt

SEQ ID NO: 40466 - DNA, 20 bp, Artificial Sequence
  chemically synthesized
ttaaatagttaggaataatg

SEQ ID NO: 40467 - DNA, 20 bp, Artificial Sequence
  chemically synthesized
aataatgtagaaaactgaaa

SEQ ID NO: 40468 - DNA, 20 bp, Artificial Sequence
  chemically synthesized
tagaaaactgaaacagttct

SEQ ID NO: 40469 - DNA, 20 bp, Artificial Sequence
  chemically synthesized
ttctaagtttcccacaaact

SEQ ID NO: 40470 - DNA, 20 bp, Artificial Sequence
  chemically synthesized
ctaagtttcccacaaactta

SEQ ID NO: 40471 - DNA, 20 bp, Artificial Sequence
  chemically synthesized
caaatttgcacatgctactc

SEQ ID NO: 40472 - DNA, 20 bp, Artificial Sequence
  chemically synthesized
tcaaaaatatatgtacatta

SEQ ID NO: 40473 - DNA, 20 bp, Artificial Sequence
  chemically synthesized
caaaaatatatgtacattat

SEQ ID NO: 40474 - DNA, 20 bp, Artificial Sequence
  chemically synthesized
ggtattttctgtgtgtaact

SEQ ID NO: 40475 - DNA, 20 bp, Artificial Sequence
  chemically synthesized
ttctgtgtgtaacttggttc

SEQ ID NO: 40476 - DNA, 20 bp, Artificial Sequence
  chemically synthesized
ttggttctagttgcttcttt

SEQ ID NO: 40477 - DNA, 20 bp, Artificial Sequence
  chemically synthesized
ctagttgcttctttcagaaa

SEQ ID NO: 40478 - DNA, 20 bp, Artificial Sequence
  chemically synthesized
taaaatcacattcctctcca

SEQ ID NO: 40479 - DNA, 20 bp, Artificial Sequence
  chemically synthesized
caaagccttctaaatacttc

SEQ ID NO: 40480 - DNA, 20 bp, Artificial Sequence
  chemically synthesized
cttccagactaactactttt

SEQ ID NO: 40481 - DNA, 20 bp, Artificial Sequence
  chemically synthesized
aactactttttagtacatct

SEQ ID NO: 40482 - DNA, 20 bp, Artificial Sequence
  chemically synthesized
tactttttagtacatctaag

SEQ ID NO: 40483 - DNA, 20 bp, Artificial Sequence
  chemically synthesized
tttagtacatctaagaagaa

SEQ ID NO: 40484 - DNA, 20 bp, Artificial Sequence
  chemically synthesized
tagtacatctaagaagaaaa

SEQ ID NO: 40485 - DNA, 20 bp, Artificial Sequence
  chemically synthesized
tttgtctcttatccacctct

SEQ ID NO: 40486 - DNA, 20 bp, Artificial Sequence
  chemically synthesized
ttatccacctctgagtcaaa

SEQ ID NO: 40487 - DNA, 20 bp, Artificial Sequence
  chemically synthesized
tccacctctgagtcaaaaag

SEQ ID NO: 40488 - DNA, 20 bp, Artificial Sequence
  chemically synthesized
aaagcagcatgtccatcaat

SEQ ID NO: 40489 - DNA, 20 bp, Artificial Sequence
  chemically synthesized
catgtccatcaattggtaca

SEQ ID NO: 40490 - DNA, 20 bp, Artificial Sequence
  chemically synthesized
caattggtacatagttccca

SEQ ID NO: 40491 - DNA, 20 bp, Artificial Sequence
  chemically synthesized
atagttcccacagccccact

SEQ ID NO: 40492 - DNA, 20 bp, Artificial Sequence
  chemically synthesized
cccacagccccacttagctc

SEQ ID NO: 40493 - DNA, 20 bp, Artificial Sequence
  chemically synthesized
agccccacttagctctggat

SEQ ID NO: 40494 - DNA, 20 bp, Artificial Sequence
  chemically synthesized
ccccacttagctctggattg

SEQ ID NO: 40495 - DNA, 20 bp, Artificial Sequence
  chemically synthesized
ctctggattggagttctact

SEQ ID NO: 40496 - DNA, 20 bp, Artificial Sequence
  chemically synthesized
tggcattgtttgcaactaca

SEQ ID NO: 40497 - DNA, 20 bp, Artificial Sequence
  chemically synthesized
ctacatggacgtaaaatgca

SEQ ID NO: 40498 - DNA, 20 bp, Artificial Sequence
  chemically synthesized
tctgccatgatgttctctga

SEQ ID NO: 40499 - DNA, 20 bp, Artificial Sequence
  chemically synthesized
tgccatgatgttctctgaaa

SEQ ID NO: 40500 - DNA, 20 bp, Artificial Sequence
  chemically synthesized
actaaccttccctcgctttg

SEQ ID NO: 40501 - DNA, 20 bp, Artificial Sequence
  chemically synthesized
taaccttccctcgctttgca

SEQ ID NO: 40502 - DNA, 20 bp, Artificial Sequence
  chemically synthesized
cttccctcgctttgcagaga

SEQ ID NO: 40503 - DNA, 20 bp, Artificial Sequence
  chemically synthesized
gaccttcatgtctttgctct

SEQ ID NO: 40504 - DNA, 20 bp, Artificial Sequence
  chemically synthesized
tacatcctcaatctacacac

SEQ ID NO: 40505 - DNA, 20 bp, Artificial Sequence
  chemically synthesized
acatcctcaatctacacact

SEQ ID NO: 40506 - DNA, 20 bp, Artificial Sequence
  chemically synthesized
cctcaatctacacactagga

SEQ ID NO: 40507 - DNA, 20 bp, Artificial Sequence
  chemically synthesized
tacacactaggatagtataa

SEQ ID NO: 40508 - DNA, 20 bp, Artificial Sequence
  chemically synthesized
ctaggatagtataaaagtaa

SEQ ID NO: 40509 - DNA, 20 bp, Artificial Sequence
  chemically synthesized
tataaaagtaatagtaataa

SEQ ID NO: 40510 - DNA, 20 bp, Artificial Sequence
  chemically synthesized
aaaagtaatagtaataatag

SEQ ID NO: 40511 - DNA, 20 bp, Artificial Sequence
  chemically synthesized
aatagtaataatagtagtaa

SEQ ID NO: 40512 - DNA, 20 bp, Artificial Sequence
  chemically synthesized
taataacaatacaatgatta

SEQ ID NO: 40513 - DNA, 20 bp, Artificial Sequence
  chemically synthesized
ttatggcttatactatacac

SEQ ID NO: 40514 - DNA, 20 bp, Artificial Sequence
  chemically synthesized
tgttgatatattatttcatt

SEQ ID NO: 40515 - DNA, 20 bp, Artificial Sequence
  chemically synthesized
attatttcatttagtattca

SEQ ID NO: 40516 - DNA, 20 bp, Artificial Sequence
  chemically synthesized
tcacagtaactctgtgcctc

SEQ ID NO: 40517 - DNA, 20 bp, Artificial Sequence
  chemically synthesized
gtactattgtaatacccttt

SEQ ID NO: 40518 - DNA, 20 bp, Artificial Sequence
  chemically synthesized
actattgtaataccctttaa

SEQ ID NO: 40519 - DNA, 20 bp, Artificial Sequence
  chemically synthesized
ctattgtaataccctttaag

SEQ ID NO: 40520 - DNA, 20 bp, Artificial Sequence
  chemically synthesized
attgtaataccctttaagag

SEQ ID NO: 40521 - DNA, 20 bp, Artificial Sequence
  chemically synthesized
ttgtaataccctttaagagg

SEQ ID NO: 40522 - DNA, 20 bp, Artificial Sequence
  chemically synthesized
ccctttaagaggaggaaact

SEQ ID NO: 40523 - DNA, 20 bp, Artificial Sequence
  chemically synthesized
cctttaagaggaggaaactg

SEQ ID NO: 40524 - DNA, 20 bp, Artificial Sequence
  chemically synthesized
aagaggaggaaactgaggca

SEQ ID NO: 40525 - DNA, 20 bp, Artificial Sequence
  chemically synthesized
agaggaggaaactgaggcac

SEQ ID NO: 40526 - DNA, 20 bp, Artificial Sequence
  chemically synthesized
gaggaggaaactgaggcaca

SEQ ID NO: 40527 - DNA, 20 bp, Artificial Sequence
  chemically synthesized
aactgaggcacagggcccta

SEQ ID NO: 40528 - DNA, 20 bp, Artificial Sequence
  chemically synthesized
gggccctaaagtaatattcc

SEQ ID NO: 40529 - DNA, 20 bp, Artificial Sequence
  chemically synthesized
taaagtaatattccaagatg

SEQ ID NO: 40530 - DNA, 20 bp, Artificial Sequence
  chemically synthesized
agtaatattccaagatgaag

SEQ ID NO: 40531 - DNA, 20 bp, Artificial Sequence
  chemically synthesized
atgaagtggctactaactga

SEQ ID NO: 40532 - DNA, 20 bp, Artificial Sequence
  chemically synthesized
gaagtggctactaactgaca

SEQ ID NO: 40533 - DNA, 20 bp, Artificial Sequence
  chemically synthesized
aagtggctactaactgacag

SEQ ID NO: 40534 - DNA, 20 bp, Artificial Sequence
  chemically synthesized
agtggctactaactgacaga

SEQ ID NO: 40535 - DNA, 20 bp, Artificial Sequence
  chemically synthesized
ataattcaactcatgatatt

SEQ ID NO: 40536 - DNA, 20 bp, Artificial Sequence
  chemically synthesized
caactcatgatatttggctc

SEQ ID NO: 40537 - DNA, 20 bp, Artificial Sequence
  chemically synthesized
attatacaataataattcat

SEQ ID NO: 40538 - DNA, 20 bp, Artificial Sequence
  chemically synthesized
ttatacaataataattcatg

SEQ ID NO: 40539 - DNA, 20 bp, Artificial Sequence
  chemically synthesized
tcatgaggaaacatttttta

SEQ ID NO: 40540 - DNA, 20 bp, Artificial Sequence
  chemically synthesized
ggaaacattttttaaagcct

SEQ ID NO: 40541 - DNA, 20 bp, Artificial Sequence
  chemically synthesized
taagttatttgctctgaaat

SEQ ID NO: 40542 - DNA, 20 bp, Artificial Sequence
  chemically synthesized
ctctgaaataagacataatt

SEQ ID NO: 40543 - DNA, 20 bp, Artificial Sequence
  chemically synthesized
tctgaaataagacataattt

SEQ ID NO: 40544 - DNA, 20 bp, Artificial Sequence
  chemically synthesized
ctgaaataagacataatttg

SEQ ID NO: 40545 - DNA, 20 bp, Artificial Sequence
  chemically synthesized
aataagacataatttggggt

SEQ ID NO: 40546 - DNA, 20 bp, Artificial Sequence
  chemically synthesized
agacataatttggggtgaga

SEQ ID NO: 40547 - DNA, 20 bp, Artificial Sequence
  chemically synthesized
taatttggggtgagaaagct

SEQ ID NO: 40548 - DNA, 20 bp, Artificial Sequence
  chemically synthesized
gagaaagcttagattccatg

SEQ ID NO: 40549 - DNA, 20 bp, Artificial Sequence
  chemically synthesized
ttagattccatgaagtatta

SEQ ID NO: 40550 - DNA, 20 bp, Artificial Sequence
  chemically synthesized
ccatgaagtattacagcatt

SEQ ID NO: 40551 - DNA, 20 bp, Artificial Sequence
  chemically synthesized
tgaagtattacagcatttgg

SEQ ID NO: 40552 - DNA, 20 bp, Artificial Sequence
  chemically synthesized
ttggtagtctttttgcactc

SEQ ID NO: 40553 - DNA, 20 bp, Artificial Sequence
  chemically synthesized
tggtagtctttttgcactcc

SEQ ID NO: 40554 - DNA, 20 bp, Artificial Sequence
  chemically synthesized
cttaaacataataaaacata

SEQ ID NO: 40555 - DNA, 20 bp, Artificial Sequence
  chemically synthesized
acataataaaacatatggtt

SEQ ID NO: 40556 - DNA, 20 bp, Artificial Sequence
  chemically synthesized
aataatattcctgttatttt

SEQ ID NO: 40557 - DNA, 20 bp, Artificial Sequence
  chemically synthesized
aatattcctgttatttttgg

SEQ ID NO: 40558 - DNA, 20 bp, Artificial Sequence
  chemically synthesized
tcctgttatttttggaagca

SEQ ID NO: 40559 - DNA, 20 bp, Artificial Sequence
  chemically synthesized
cctgttatttttggaagcac

SEQ ID NO: 40560 - DNA, 20 bp, Artificial Sequence
  chemically synthesized
ctgttatttttggaagcaca

SEQ ID NO: 40561 - DNA, 20 bp, Artificial Sequence
  chemically synthesized
atttttggaagcacagggtg

SEQ ID NO: 40562 - DNA, 20 bp, Artificial Sequence
  chemically synthesized
tttttggaagcacagggtgt

SEQ ID NO: 40563 - DNA, 20 bp, Artificial Sequence
  chemically synthesized
tgtgggataatgctaattac

SEQ ID NO: 40564 - DNA, 20 bp, Artificial Sequence
  chemically synthesized
taatgctaattactagtgat

SEQ ID NO: 40565 - DNA, 20 bp, Artificial Sequence
  chemically synthesized
aattactagtgattagtatt

SEQ ID NO: 40566 - DNA, 20 bp, Artificial Sequence
  chemically synthesized
ttactagtgattagtattga

SEQ ID NO: 40567 - DNA, 20 bp, Artificial Sequence
  chemically synthesized
tactagtgattagtattgag

SEQ ID NO: 40568 - DNA, 20 bp, Artificial Sequence
  chemically synthesized
tgattagtattgagaggtga

SEQ ID NO: 40569 - DNA, 20 bp, Artificial Sequence
  chemically synthesized
attgagaggtgacagcgtgc

SEQ ID NO: 40570 - DNA, 20 bp, Artificial Sequence
  chemically synthesized
gagaggtgacagcgtgctgg

SEQ ID NO: 40571 - DNA, 20 bp, Artificial Sequence
  chemically synthesized
cagcgtgctggcagtcctca

SEQ ID NO: 40572 - DNA, 20 bp, Artificial Sequence
  chemically synthesized
tcacagccctcgctcgctct

SEQ ID NO: 40573 - DNA, 20 bp, Artificial Sequence
  chemically synthesized
ctcttggcgcctcctctgcc

SEQ ID NO: 40574 - DNA, 20 bp, Artificial Sequence
  chemically synthesized
tcttggcgcctcctctgcct

SEQ ID NO: 40575 - DNA, 20 bp, Artificial Sequence
  chemically synthesized
ctctgcctgggctcccacat

SEQ ID NO: 40576 - DNA, 20 bp, Artificial Sequence
  chemically synthesized
tgcctgggctcccacattgg

SEQ ID NO: 40577 - DNA, 20 bp, Artificial Sequence
  chemically synthesized
ctcccacattggtggcactt

SEQ ID NO: 40578 - DNA, 20 bp, Artificial Sequence
  chemically synthesized
tcccacattggtggcacttg

SEQ ID NO: 40579 - DNA, 20 bp, Artificial Sequence
  chemically synthesized
ccacattggtggcacttgag

SEQ ID NO: 40580 - DNA, 20 bp, Artificial Sequence
  chemically synthesized
gtggcacttgaggagccctt

SEQ ID NO: 40581 - DNA, 20 bp, Artificial Sequence
  chemically synthesized
cacttgaggagcccttcagc

SEQ ID NO: 40582 - DNA, 20 bp, Artificial Sequence
  chemically synthesized
ttcagccggccgctgcactg

SEQ ID NO: 40583 - DNA, 20 bp, Artificial Sequence
  chemically synthesized
tcagccggccgctgcactgt

SEQ ID NO: 40584 - DNA, 20 bp, Artificial Sequence
  chemically synthesized
agccggccgctgcactgtgg

SEQ ID NO: 40585 - DNA, 20 bp, Artificial Sequence
  chemically synthesized
gcactgtgggagcccttttc

SEQ ID NO: 40586 - DNA, 20 bp, Artificial Sequence
  chemically synthesized
cactgtgggagcccttttct

SEQ ID NO: 40587 - DNA, 20 bp, Artificial Sequence
  chemically synthesized
gtgggagcccttttctgggc

SEQ ID NO: 40588 - DNA, 20 bp, Artificial Sequence
  chemically synthesized
agcccttttctgggctggcc

SEQ ID NO: 40589 - DNA, 20 bp, Artificial Sequence
  chemically synthesized
gcccttttctgggctggcca

SEQ ID NO: 40590 - DNA, 20 bp, Artificial Sequence
  chemically synthesized
ttttctgggctggccaaggc

SEQ ID NO: 40591 - DNA, 20 bp, Artificial Sequence
  chemically synthesized
ttctgggctggccaaggcca

SEQ ID NO: 40592 - DNA, 20 bp, Artificial Sequence
  chemically synthesized
gggctggccaaggccagagc

SEQ ID NO: 40593 - DNA, 20 bp, Artificial Sequence
  chemically synthesized
aaggccagagccggctccct

SEQ ID NO: 40594 - DNA, 20 bp, Artificial Sequence
  chemically synthesized
agccggctccctcagcttgc

SEQ ID NO: 40595 - DNA, 20 bp, Artificial Sequence
  chemically synthesized
gccggctccctcagcttgcc

SEQ ID NO: 40596 - DNA, 20 bp, Artificial Sequence
  chemically synthesized
cggctccctcagcttgccag

SEQ ID NO: 40597 - DNA, 20 bp, Artificial Sequence
  chemically synthesized
ggctccctcagcttgccagg

SEQ ID NO: 40598 - DNA, 20 bp, Artificial Sequence
  chemically synthesized
cctcagcttgccaggaggtg

SEQ ID NO: 40599 - DNA, 20 bp, Artificial Sequence
  chemically synthesized
tcagcttgccaggaggtgtg

SEQ ID NO: 40600 - DNA, 20 bp, Artificial Sequence
  chemically synthesized
cagcttgccaggaggtgtgg

SEQ ID NO: 40601 - DNA, 20 bp, Artificial Sequence
  chemically synthesized
agcttgccaggaggtgtgga

SEQ ID NO: 40602 - DNA, 20 bp, Artificial Sequence
  chemically synthesized
tgccaggaggtgtggaggga

SEQ ID NO: 40603 - DNA, 20 bp, Artificial Sequence
  chemically synthesized
gaggtgtggagggacagacg

SEQ ID NO: 40604 - DNA, 20 bp, Artificial Sequence
  chemically synthesized
aggtgtggagggacagacgc

SEQ ID NO: 40605 - DNA, 20 bp, Artificial Sequence
  chemically synthesized
tgtggagggacagacgcggg

SEQ ID NO: 40606 - DNA, 20 bp, Artificial Sequence
  chemically synthesized
gtggagggacagacgcgggc

SEQ ID NO: 40607 - DNA, 20 bp, Artificial Sequence
  chemically synthesized
ggacagacgcgggcaggaac

SEQ ID NO: 40608 - DNA, 20 bp, Artificial Sequence
  chemically synthesized
gacagacgcgggcaggaacc

SEQ ID NO: 40609 - DNA, 20 bp, Artificial Sequence
  chemically synthesized
ccgggctgtgcgccgtgctt

SEQ ID NO: 40610 - DNA, 20 bp, Artificial Sequence
  chemically synthesized
cgggctgtgcgccgtgcttg

SEQ ID NO: 40611 - DNA, 20 bp, Artificial Sequence
  chemically synthesized
gggctgtgcgccgtgcttga

SEQ ID NO: 40612 - DNA, 20 bp, Artificial Sequence
  chemically synthesized
gctgtgcgccgtgcttgagg

SEQ ID NO: 40613 - DNA, 20 bp, Artificial Sequence
  chemically synthesized
cgccgtgcttgagggagttc

SEQ ID NO: 40614 - DNA, 20 bp, Artificial Sequence
  chemically synthesized
gccgtgcttgagggagttcc

SEQ ID NO: 40615 - DNA, 20 bp, Artificial Sequence
  chemically synthesized
gtgcttgagggagttccggg

SEQ ID NO: 40616 - DNA, 20 bp, Artificial Sequence
  chemically synthesized
tgcttgagggagttccgggt

SEQ ID NO: 40617 - DNA, 20 bp, Artificial Sequence
  chemically synthesized
gagggagttccgggtgggca

SEQ ID NO: 40618 - DNA, 20 bp, Artificial Sequence
  chemically synthesized
agggagttccgggtgggcat

SEQ ID NO: 40619 - DNA, 20 bp, Artificial Sequence
  chemically synthesized
tccgggtgggcatgggctcc

SEQ ID NO: 40620 - DNA, 20 bp, Artificial Sequence
  chemically synthesized
ccgggtgggcatgggctccg

SEQ ID NO: 40621 - DNA, 20 bp, Artificial Sequence
  chemically synthesized
ggctccgaggaccccgcact

SEQ ID NO: 40622 - DNA, 20 bp, Artificial Sequence
  chemically synthesized
ctccgaggaccccgcactcg

SEQ ID NO: 40623 - DNA, 20 bp, Artificial Sequence
  chemically synthesized
gaccccgcactcggagccgc

SEQ ID NO: 40624 - DNA, 20 bp, Artificial Sequence
  chemically synthesized
ccgcactcggagccgccagc

SEQ ID NO: 40625 - DNA, 20 bp, Artificial Sequence
  chemically synthesized
gagccgccagccggccccac

SEQ ID NO: 40626 - DNA, 20 bp, Artificial Sequence
  chemically synthesized
ccagccggccccaccggccg

SEQ ID NO: 40627 - DNA, 20 bp, Artificial Sequence
  chemically synthesized
cagccggccccaccggccgc

SEQ ID NO: 40628 - DNA, 20 bp, Artificial Sequence
  chemically synthesized
ccggccccaccggccgcggg

SEQ ID NO: 40629 - DNA, 20 bp, Artificial Sequence
  chemically synthesized
ccccaccggccgcgggcagt

SEQ ID NO: 40630 - DNA, 20 bp, Artificial Sequence
  chemically synthesized
cccaccggccgcgggcagtg

SEQ ID NO: 40631 - DNA, 20 bp, Artificial Sequence
  chemically synthesized
ccaccggccgcgggcagtga

SEQ ID NO: 40632 - DNA, 20 bp, Artificial Sequence
  chemically synthesized
caccggccgcgggcagtgag

SEQ ID NO: 40633 - DNA, 20 bp, Artificial Sequence
  chemically synthesized
gccgcgggcagtgaggggct

SEQ ID NO: 40634 - DNA, 20 bp, Artificial Sequence
  chemically synthesized
gcagtgaggggcttagcacc

SEQ ID NO: 40635 - DNA, 20 bp, Artificial Sequence
  chemically synthesized
cagtgaggggcttagcacct

SEQ ID NO: 40636 - DNA, 20 bp, Artificial Sequence
  chemically synthesized
gaggggcttagcacctgggc

SEQ ID NO: 40637 - DNA, 20 bp, Artificial Sequence
  chemically synthesized
gggcttagcacctgggccag

SEQ ID NO: 40638 - DNA, 20 bp, Artificial Sequence
  chemically synthesized
tgctgtgctcaattcctcgc

SEQ ID NO: 40639 - DNA, 20 bp, Artificial Sequence
  chemically synthesized
gctgtgctcaattcctcgcc

SEQ ID NO: 40640 - DNA, 20 bp, Artificial Sequence
  chemically synthesized
ctcaattcctcgccgggcct

SEQ ID NO: 40641 - DNA, 20 bp, Artificial Sequence
  chemically synthesized
gggccttagctgccttcctg

SEQ ID NO: 40642 - DNA, 20 bp, Artificial Sequence
  chemically synthesized
ggccttagctgccttcctgc

SEQ ID NO: 40643 - DNA, 20 bp, Artificial Sequence
  chemically synthesized
gccttagctgccttcctgcg

SEQ ID NO: 40644 - DNA, 20 bp, Artificial Sequence
  chemically synthesized
ttagctgccttcctgcgggg

SEQ ID NO: 40645 - DNA, 20 bp, Artificial Sequence
  chemically synthesized
tagctgccttcctgcggggc

SEQ ID NO: 40646 - DNA, 20 bp, Artificial Sequence
  chemically synthesized
agctgccttcctgcggggca

SEQ ID NO: 40647 - DNA, 20 bp, Artificial Sequence
  chemically synthesized
ccttcctgcggggcagggct

SEQ ID NO: 40648 - DNA, 20 bp, Artificial Sequence
  chemically synthesized
cttcctgcggggcagggctc

SEQ ID NO: 40649 - DNA, 20 bp, Artificial Sequence
  chemically synthesized
ggggcagggctcgggacctg

SEQ ID NO: 40650 - DNA, 20 bp, Artificial Sequence
  chemically synthesized
acctgcagcgcgccatgcct

SEQ ID NO: 40651 - DNA, 20 bp, Artificial Sequence
  chemically synthesized
cctgagcctccccaccttca

SEQ ID NO: 40652 - DNA, 20 bp, Artificial Sequence
  chemically synthesized
ctgagcctccccaccttcat

SEQ ID NO: 40653 - DNA, 20 bp, Artificial Sequence
  chemically synthesized
caccttcatgggctcctgtg

SEQ ID NO: 40654 - DNA, 20 bp, Artificial Sequence
  chemically synthesized
catgggctcctgtgcggccc

SEQ ID NO: 40655 - DNA, 20 bp, Artificial Sequence
  chemically synthesized
gcggcccgagcctcgccgac

SEQ ID NO: 40656 - DNA, 20 bp, Artificial Sequence
  chemically synthesized
acgagcgccgccccctgctc

SEQ ID NO: 40657 - DNA, 20 bp, Artificial Sequence
  chemically synthesized
cgagcgccgccccctgctcc

SEQ ID NO: 40658 - DNA, 20 bp, Artificial Sequence
  chemically synthesized
gagcgccgccccctgctcca

SEQ ID NO: 40659 - DNA, 20 bp, Artificial Sequence
  chemically synthesized
gccccctgctccagggcacc

SEQ ID NO: 40660 - DNA, 20 bp, Artificial Sequence
  chemically synthesized
cccagtcccatcgaccaccc

SEQ ID NO: 40661 - DNA, 20 bp, Artificial Sequence
  chemically synthesized
ccagtcccatcgaccaccca

SEQ ID NO: 40662 - DNA, 20 bp, Artificial Sequence
  chemically synthesized
cagtcccatcgaccacccaa

SEQ ID NO: 40663 - DNA, 20 bp, Artificial Sequence
  chemically synthesized
catcgaccacccaagggctg

SEQ ID NO: 40664 - DNA, 20 bp, Artificial Sequence
  chemically synthesized
tcgaccacccaagggctgaa

SEQ ID NO: 40665 - DNA, 20 bp, Artificial Sequence
  chemically synthesized
cacccaagggctgaagagtg

SEQ ID NO: 40666 - DNA, 20 bp, Artificial Sequence
  chemically synthesized
acccaagggctgaagagtgc

SEQ ID NO: 40667 - DNA, 20 bp, Artificial Sequence
  chemically synthesized
ggctgaagagtgcgggcgca

SEQ ID NO: 40668 - DNA, 20 bp, Artificial Sequence
  chemically synthesized
tgaagagtgcgggcgcacgg

SEQ ID NO: 40669 - DNA, 20 bp, Artificial Sequence
  chemically synthesized
gaagagtgcgggcgcacggc

SEQ ID NO: 40670 - DNA, 20 bp, Artificial Sequence
  chemically synthesized
aagagtgcgggcgcacggca

SEQ ID NO: 40671 - DNA, 20 bp, Artificial Sequence
  chemically synthesized
agagtgcgggcgcacggcag

SEQ ID NO: 40672 - DNA, 20 bp, Artificial Sequence
  chemically synthesized
gcgggcgcacggcaggggac

SEQ ID NO: 40673 - DNA, 20 bp, Artificial Sequence
  chemically synthesized
ggcgcacggcaggggactgg

SEQ ID NO: 40674 - DNA, 20 bp, Artificial Sequence
  chemically synthesized
gcgcacggcaggggactggc

SEQ ID NO: 40675 - DNA, 20 bp, Artificial Sequence
  chemically synthesized
cacggcaggggactggcagg

SEQ ID NO: 40676 - DNA, 20 bp, Artificial Sequence
  chemically synthesized
ctggcaggcagctccccctg

SEQ ID NO: 40677 - DNA, 20 bp, Artificial Sequence
  chemically synthesized
aggcagctccccctgcagcc

SEQ ID NO: 40678 - DNA, 20 bp, Artificial Sequence
  chemically synthesized
ggcagctccccctgcagccc

SEQ ID NO: 40679 - DNA, 20 bp, Artificial Sequence
  chemically synthesized
ctccccctgcagcccaggtg

SEQ ID NO: 40680 - DNA, 20 bp, Artificial Sequence
  chemically synthesized
tccccctgcagcccaggtgc

SEQ ID NO: 40681 - DNA, 20 bp, Artificial Sequence
  chemically synthesized
agcccaggtgcgggatccac

SEQ ID NO: 40682 - DNA, 20 bp, Artificial Sequence
  chemically synthesized
gcccaggtgcgggatccact

SEQ ID NO: 40683 - DNA, 20 bp, Artificial Sequence
  chemically synthesized
ggtgcgggatccactgggtg

SEQ ID NO: 40684 - DNA, 20 bp, Artificial Sequence
  chemically synthesized
cgggatccactgggtgaagc

SEQ ID NO: 40685 - DNA, 20 bp, Artificial Sequence
  chemically synthesized
atccactgggtgaagccggc

SEQ ID NO: 40686 - DNA, 20 bp, Artificial Sequence
  chemically synthesized
tccactgggtgaagccggct

SEQ ID NO: 40687 - DNA, 20 bp, Artificial Sequence
  chemically synthesized
gtgaagccggctaggctcct

SEQ ID NO: 40688 - DNA, 20 bp, Artificial Sequence
  chemically synthesized
ggctaggctcctgagtttgc

SEQ ID NO: 40689 - DNA, 20 bp, Artificial Sequence
  chemically synthesized
gctaggctcctgagtttgct

SEQ ID NO: 40690 - DNA, 20 bp, Artificial Sequence
  chemically synthesized
ctaggctcctgagtttgctg

SEQ ID NO: 40691 - DNA, 20 bp, Artificial Sequence
  chemically synthesized
ctgagtttgctggggatgcg

SEQ ID NO: 40692 - DNA, 20 bp, Artificial Sequence
  chemically synthesized
atgcgaagaacccttatgtc

SEQ ID NO: 40693 - DNA, 20 bp, Artificial Sequence
  chemically synthesized
aagaacccttatgtctagat

SEQ ID NO: 40694 - DNA, 20 bp, Artificial Sequence
  chemically synthesized
agaacccttatgtctagata

SEQ ID NO: 40695 - DNA, 20 bp, Artificial Sequence
  chemically synthesized
gaacccttatgtctagataa

SEQ ID NO: 40696 - DNA, 20 bp, Artificial Sequence
  chemically synthesized
gggattgtaaatacaccaat

SEQ ID NO: 40697 - DNA, 20 bp, Artificial Sequence
  chemically synthesized
accaattggcactctgtatc

SEQ ID NO: 40698 - DNA, 20 bp, Artificial Sequence
  chemically synthesized
tggcactctgtatctagctc

SEQ ID NO: 40699 - DNA, 20 bp, Artificial Sequence
  chemically synthesized
ggcactctgtatctagctca

SEQ ID NO: 40700 - DNA, 20 bp, Artificial Sequence
  chemically synthesized
aggtttgtaaacacaccaat

SEQ ID NO: 40701 - DNA, 20 bp, Artificial Sequence
  chemically synthesized
accaatcagcaccctgtgtc

SEQ ID NO: 40702 - DNA, 20 bp, Artificial Sequence
  chemically synthesized
tcagcaccctgtgtctagct

SEQ ID NO: 40703 - DNA, 20 bp, Artificial Sequence
  chemically synthesized
cagcaccctgtgtctagctc

SEQ ID NO: 40704 - DNA, 20 bp, Artificial Sequence
  chemically synthesized
agcaccctgtgtctagctca

SEQ ID NO: 40705 - DNA, 20 bp, Artificial Sequence
  chemically synthesized
gcaccaatcaacactctatc

SEQ ID NO: 40706 - DNA, 20 bp, Artificial Sequence
  chemically synthesized
aacactctatctagctactc

SEQ ID NO: 40707 - DNA, 20 bp, Artificial Sequence
  chemically synthesized
actctatctagctactctgg

SEQ ID NO: 40708 - DNA, 20 bp, Artificial Sequence
  chemically synthesized
ctctatctagctactctggt

SEQ ID NO: 40709 - DNA, 20 bp, Artificial Sequence
  chemically synthesized
tctatctagctactctggtg

SEQ ID NO: 40710 - DNA, 20 bp, Artificial Sequence
  chemically synthesized
tagctactctggtggggcct

SEQ ID NO: 40711 - DNA, 20 bp, Artificial Sequence
  chemically synthesized
gctactctggtggggccttg

SEQ ID NO: 40712 - DNA, 20 bp, Artificial Sequence
  chemically synthesized
ccttggagaacctttatgtc

SEQ ID NO: 40713 - DNA, 20 bp, Artificial Sequence
  chemically synthesized
gagaacctttatgtctagct

SEQ ID NO: 40714 - DNA, 20 bp, Artificial Sequence
  chemically synthesized
agaacctttatgtctagctc

SEQ ID NO: 40715 - DNA, 20 bp, Artificial Sequence
  chemically synthesized
gaacctttatgtctagctca

SEQ ID NO: 40716 - DNA, 20 bp, Artificial Sequence
  chemically synthesized
gggattgtaaatacaccaat

SEQ ID NO: 40717 - DNA, 20 bp, Artificial Sequence
  chemically synthesized
attgtaaatacaccaatcgg

SEQ ID NO: 40718 - DNA, 20 bp, Artificial Sequence
  chemically synthesized
accaatcggcagtctgtatc

SEQ ID NO: 40719 - DNA, 20 bp, Artificial Sequence
  chemically synthesized
cggcagtctgtatctagctc

SEQ ID NO: 40720 - DNA, 20 bp, Artificial Sequence
  chemically synthesized
ggcagtctgtatctagctca

SEQ ID NO: 40721 - DNA, 20 bp, Artificial Sequence
  chemically synthesized
aggtttgtaaacacaccaat

SEQ ID NO: 40722 - DNA, 20 bp, Artificial Sequence
  chemically synthesized
accaatcagcaccctgtgtc

SEQ ID NO: 40723 - DNA, 20 bp, Artificial Sequence
  chemically synthesized
tcagcaccctgtgtctagct

SEQ ID NO: 40724 - DNA, 20 bp, Artificial Sequence
  chemically synthesized
cagcaccctgtgtctagctc

SEQ ID NO: 40725 - DNA, 20 bp, Artificial Sequence
  chemically synthesized
agcaccctgtgtctagctca

SEQ ID NO: 40726 - DNA, 20 bp, Artificial Sequence
  chemically synthesized
accaatcaacactctgtatc

SEQ ID NO: 40727 - DNA, 20 bp, Artificial Sequence
  chemically synthesized
cactctgtatctagctactc

SEQ ID NO: 40728 - DNA, 20 bp, Artificial Sequence
  chemically synthesized
tctgtatctagctactctgg

SEQ ID NO: 40729 - DNA, 20 bp, Artificial Sequence
  chemically synthesized
ctgtatctagctactctggt

SEQ ID NO: 40730 - DNA, 20 bp, Artificial Sequence
  chemically synthesized
tgtatctagctactctggtg

SEQ ID NO: 40731 - DNA, 20 bp, Artificial Sequence
  chemically synthesized
tagctactctggtggggacg

SEQ ID NO: 40732 - DNA, 20 bp, Artificial Sequence
  chemically synthesized
gctactctggtggggacgtg

SEQ ID NO: 40733 - DNA, 20 bp, Artificial Sequence
  chemically synthesized
acgtggagaacctttatgtc

SEQ ID NO: 40734 - DNA, 20 bp, Artificial Sequence
  chemically synthesized
gagaacctttatgtctagct

SEQ ID NO: 40735 - DNA, 20 bp, Artificial Sequence
  chemically synthesized
agaacctttatgtctagctc

SEQ ID NO: 40736 - DNA, 20 bp, Artificial Sequence
  chemically synthesized
gaacctttatgtctagctca

SEQ ID NO: 40737 - DNA, 20 bp, Artificial Sequence
  chemically synthesized
gggattgtaaatacaccact

SEQ ID NO: 40738 - DNA, 20 bp, Artificial Sequence
  chemically synthesized
attgtaaatacaccactcgg

SEQ ID NO: 40739 - DNA, 20 bp, Artificial Sequence
  chemically synthesized
accactcggcagtctgtatc

SEQ ID NO: 40740 - DNA, 20 bp, Artificial Sequence
  chemically synthesized
cggcagtctgtatctagctc

SEQ ID NO: 40741 - DNA, 20 bp, Artificial Sequence
  chemically synthesized
ggcagtctgtatctagctca

SEQ ID NO: 40742 - DNA, 20 bp, Artificial Sequence
  chemically synthesized
aggtttgtaaacacaccaat

SEQ ID NO: 40743 - DNA, 20 bp, Artificial Sequence
  chemically synthesized
accaatcagcaccctgtgtc

SEQ ID NO: 40744 - DNA, 20 bp, Artificial Sequence
  chemically synthesized
tcagcaccctgtgtctagct

SEQ ID NO: 40745 - DNA, 20 bp, Artificial Sequence
  chemically synthesized
cagcaccctgtgtctagctc

SEQ ID NO: 40746 - DNA, 20 bp, Artificial Sequence
  chemically synthesized
agcaccctgtgtctagctca

SEQ ID NO: 40747 - DNA, 20 bp, Artificial Sequence
  chemically synthesized
accaatcaacactctgtatc

SEQ ID NO: 40748 - DNA, 20 bp, Artificial Sequence
  chemically synthesized
cactctgtatctagctactc

SEQ ID NO: 40749 - DNA, 20 bp, Artificial Sequence
  chemically synthesized
tctgtatctagctactctgg

SEQ ID NO: 40750 - DNA, 20 bp, Artificial Sequence
  chemically synthesized
ctgtatctagctactctggt

SEQ ID NO: 40751 - DNA, 20 bp, Artificial Sequence
  chemically synthesized
tgtatctagctactctggtg

SEQ ID NO: 40752 - DNA, 20 bp, Artificial Sequence
  chemically synthesized
tagctactctggtggggact

SEQ ID NO: 40753 - DNA, 20 bp, Artificial Sequence
  chemically synthesized
gctactctggtggggacttg

SEQ ID NO: 40754 - DNA, 20 bp, Artificial Sequence
  chemically synthesized
ggacttggagaacctttgtg

SEQ ID NO: 40755 - DNA, 20 bp, Artificial Sequence
  chemically synthesized
ttgtgtggacactctgtatc

SEQ ID NO: 40756 - DNA, 20 bp, Artificial Sequence
  chemically synthesized
cactctgtatctagctaatc

SEQ ID NO: 40757 - DNA, 20 bp, Artificial Sequence
  chemically synthesized
tctgtatctagctaatctgg

SEQ ID NO: 40758 - DNA, 20 bp, Artificial Sequence
  chemically synthesized
ctgtatctagctaatctggt

SEQ ID NO: 40759 - DNA, 20 bp, Artificial Sequence
  chemically synthesized
tgtatctagctaatctggtg

SEQ ID NO: 40760 - DNA, 20 bp, Artificial Sequence
  chemically synthesized
tagctaatctggtggggacg

SEQ ID NO: 40761 - DNA, 20 bp, Artificial Sequence
  chemically synthesized
gctaatctggtggggacgtg

SEQ ID NO: 40762 - DNA, 20 bp, Artificial Sequence
  chemically synthesized
acgtggagaacctttgtgtc

SEQ ID NO: 40763 - DNA, 20 bp, Artificial Sequence
  chemically synthesized
gaacctttgtgtctagctca

SEQ ID NO: 40764 - DNA, 20 bp, Artificial Sequence
  chemically synthesized
tggattgtaaatgcaccaat

SEQ ID NO: 40765 - DNA, 20 bp, Artificial Sequence
  chemically synthesized
caatcagtgccctgtcaaaa

SEQ ID NO: 40766 - DNA, 20 bp, Artificial Sequence
  chemically synthesized
gccctgtcaaaacagaccac

SEQ ID NO: 40767 - DNA, 20 bp, Artificial Sequence
  chemically synthesized
ccctgtcaaaacagaccact

SEQ ID NO: 40768 - DNA, 20 bp, Artificial Sequence
  chemically synthesized
gaccactgggctctaccaat

SEQ ID NO: 40769 - DNA, 20 bp, Artificial Sequence
  chemically synthesized
cactgggctctaccaatcag

SEQ ID NO: 40770 - DNA, 20 bp, Artificial Sequence
  chemically synthesized
actgggctctaccaatcagc

SEQ ID NO: 40771 - DNA, 20 bp, Artificial Sequence
  chemically synthesized
ctctaccaatcagcaggatg

SEQ ID NO: 40772 - DNA, 20 bp, Artificial Sequence
  chemically synthesized
tctaccaatcagcaggatgt

SEQ ID NO: 40773 - DNA, 20 bp, Artificial Sequence
  chemically synthesized
accaatcagcaggatgtggg

SEQ ID NO: 40774 - DNA, 20 bp, Artificial Sequence
  chemically synthesized
ccaatcagcaggatgtgggt

SEQ ID NO: 40775 - DNA, 20 bp, Artificial Sequence
  chemically synthesized
caatcagcaggatgtgggtg

SEQ ID NO: 40776 - DNA, 20 bp, Artificial Sequence
  chemically synthesized
cagcaggatgtgggtggggc

SEQ ID NO: 40777 - DNA, 20 bp, Artificial Sequence
  chemically synthesized
ggatgtgggtggggccagat

SEQ ID NO: 40778 - DNA, 20 bp, Artificial Sequence
  chemically synthesized
atgtgggtggggccagataa

SEQ ID NO: 40779 - DNA, 20 bp, Artificial Sequence
  chemically synthesized
ggggccagataagagaataa

SEQ ID NO: 40780 - DNA, 20 bp, Artificial Sequence
  chemically synthesized
gccagataagagaataaaag

SEQ ID NO: 40781 - DNA, 20 bp, Artificial Sequence
  chemically synthesized
ccagataagagaataaaagc

SEQ ID NO: 40782 - DNA, 20 bp, Artificial Sequence
  chemically synthesized
agaataaaagcaggctgccc

SEQ ID NO: 40783 - DNA, 20 bp, Artificial Sequence
  chemically synthesized
taaaagcaggctgcccgagc

SEQ ID NO: 40784 - DNA, 20 bp, Artificial Sequence
  chemically synthesized
aagcaggctgcccgagccag

SEQ ID NO: 40785 - DNA, 20 bp, Artificial Sequence
  chemically synthesized
caggctgcccgagccagcag

SEQ ID NO: 40786 - DNA, 20 bp, Artificial Sequence
  chemically synthesized
gccagcagtggcaacccgct

SEQ ID NO: 40787 - DNA, 20 bp, Artificial Sequence
  chemically synthesized
ccagcagtggcaacccgctc

SEQ ID NO: 40788 - DNA, 20 bp, Artificial Sequence
  chemically synthesized
tcgggtccccttccacactg

SEQ ID NO: 40789 - DNA, 20 bp, Artificial Sequence
  chemically synthesized
ggtccccttccacactgtgg

SEQ ID NO: 40790 - DNA, 20 bp, Artificial Sequence
  chemically synthesized
tcttgctgctgctcactgtt

SEQ ID NO: 40791 - DNA, 20 bp, Artificial Sequence
  chemically synthesized
cttgctgctgctcactgttt

SEQ ID NO: 40792 - DNA, 20 bp, Artificial Sequence
  chemically synthesized
tgggtctacactgcctttat

SEQ ID NO: 40793 - DNA, 20 bp, Artificial Sequence
  chemically synthesized
gagctgtaacgctcaccgcg

SEQ ID NO: 40794 - DNA, 20 bp, Artificial Sequence
  chemically synthesized
agctgtaacgctcaccgcga

SEQ ID NO: 40795 - DNA, 20 bp, Artificial Sequence
  chemically synthesized
acgctcaccgcgaaggtctg

SEQ ID NO: 40796 - DNA, 20 bp, Artificial Sequence
  chemically synthesized
ggtctgcagcttcactcttg

SEQ ID NO: 40797 - DNA, 20 bp, Artificial Sequence
  chemically synthesized
tgcagcttcactcttgaagc

SEQ ID NO: 40798 - DNA, 20 bp, Artificial Sequence
  chemically synthesized
gcttcactcttgaagccagc

SEQ ID NO: 40799 - DNA, 20 bp, Artificial Sequence
  chemically synthesized
cagcgagaccacgaacccac

SEQ ID NO: 40800 - DNA, 20 bp, Artificial Sequence
  chemically synthesized
agcgagaccacgaacccacc

SEQ ID NO: 40801 - DNA, 20 bp, Artificial Sequence
  chemically synthesized
cgagaccacgaacccaccgg

SEQ ID NO: 40802 - DNA, 20 bp, Artificial Sequence
  chemically synthesized
gagaccacgaacccaccggg

SEQ ID NO: 40803 - DNA, 20 bp, Artificial Sequence
  chemically synthesized
ccgggaggaacgaacaactc

SEQ ID NO: 40804 - DNA, 20 bp, Artificial Sequence
  chemically synthesized
gggaggaacgaacaactcca

SEQ ID NO: 40805 - DNA, 20 bp, Artificial Sequence
  chemically synthesized
ggaggaacgaacaactccag

SEQ ID NO: 40806 - DNA, 20 bp, Artificial Sequence
  chemically synthesized
aactccagaggcgccgcctt

SEQ ID NO: 40807 - DNA, 20 bp, Artificial Sequence
  chemically synthesized
ctccagaggcgccgccttaa

SEQ ID NO: 40808 - DNA, 20 bp, Artificial Sequence
  chemically synthesized
agaggcgccgccttaagagc

SEQ ID NO: 40809 - DNA, 20 bp, Artificial Sequence
  chemically synthesized
gagctggaacgttcactgtg

SEQ ID NO: 40810 - DNA, 20 bp, Artificial Sequence
  chemically synthesized
agctggaacgttcactgtga

SEQ ID NO: 40811 - DNA, 20 bp, Artificial Sequence
  chemically synthesized
acgttcactgtgaaggtctg

SEQ ID NO: 40812 - DNA, 20 bp, Artificial Sequence
  chemically synthesized
aggtctgcagcttcactcct

SEQ ID NO: 40813 - DNA, 20 bp, Artificial Sequence
  chemically synthesized
ctgcagcttcactcctgagc

SEQ ID NO: 40814 - DNA, 20 bp, Artificial Sequence
  chemically synthesized
agcttcactcctgagccagc

SEQ ID NO: 40815 - DNA, 20 bp, Artificial Sequence
  chemically synthesized
cagcgagaccacgaacccat

SEQ ID NO: 40816 - DNA, 20 bp, Artificial Sequence
  chemically synthesized
cgagaccacgaacccatcag

SEQ ID NO: 40817 - DNA, 20 bp, Artificial Sequence
  chemically synthesized
gagaccacgaacccatcaga

SEQ ID NO: 40818 - DNA, 20 bp, Artificial Sequence
  chemically synthesized
accacgaacccatcagaagg

SEQ ID NO: 40819 - DNA, 20 bp, Artificial Sequence
  chemically synthesized
ctccgaacacatccaaacat

SEQ ID NO: 40820 - DNA, 20 bp, Artificial Sequence
  chemically synthesized
acgaacaaactccacacacg

SEQ ID NO: 40821 - DNA, 20 bp, Artificial Sequence
  chemically synthesized
actccacacacgcagccttt

SEQ ID NO: 40822 - DNA, 20 bp, Artificial Sequence
  chemically synthesized
agaactgtaacactcaccac

SEQ ID NO: 40823 - DNA, 20 bp, Artificial Sequence
  chemically synthesized
gaactgtaacactcaccacg

SEQ ID NO: 40824 - DNA, 20 bp, Artificial Sequence
  chemically synthesized
aactgtaacactcaccacga

SEQ ID NO: 40825 - DNA, 20 bp, Artificial Sequence
  chemically synthesized
acactcaccacgagggtccc

SEQ ID NO: 40826 - DNA, 20 bp, Artificial Sequence
  chemically synthesized
ggtccccggcttcattcttg

SEQ ID NO: 40827 - DNA, 20 bp, Artificial Sequence
  chemically synthesized
cccggcttcattcttgaagt

SEQ ID NO: 40828 - DNA, 20 bp, Artificial Sequence
  chemically synthesized
ttcttgaagtcagtgaaacc

SEQ ID NO: 40829 - DNA, 20 bp, Artificial Sequence
  chemically synthesized
aaccaagaacccaccaattc

SEQ ID NO: 40830 - DNA, 20 bp, Artificial Sequence
  chemically synthesized
gaacccaccaattccggaca

SEQ ID NO: 40831 - DNA, 20 bp, Artificial Sequence
  chemically synthesized
caattccggacacagtatgt

SEQ ID NO: 40832 - DNA, 20 bp, Artificial Sequence
  chemically synthesized
cagtatgtcagaaacaatat

SEQ ID NO: 40833 - DNA, 20 bp, Artificial Sequence
  chemically synthesized
tacttctcaacaatttccaa

SEQ ID NO: 40834 - DNA, 20 bp, Artificial Sequence
  chemically synthesized
aacagcccttgcaattaact

SEQ ID NO: 40835 - DNA, 20 bp, Artificial Sequence
  chemically synthesized
aattaacttggccatgtgac

SEQ ID NO: 40836 - DNA, 20 bp, Artificial Sequence
  chemically synthesized
tggttgtgactaaaataatg

SEQ ID NO: 40837 - DNA, 20 bp, Artificial Sequence
  chemically synthesized
gttgtgactaaaataatgtg

SEQ ID NO: 40838 - DNA, 20 bp, Artificial Sequence
  chemically synthesized
ataataatgtgttactccct

SEQ ID NO: 40839 - DNA, 20 bp, Artificial Sequence
  chemically synthesized
taataatgtgttactcccta

SEQ ID NO: 40840 - DNA, 20 bp, Artificial Sequence
  chemically synthesized
taatgtgttactccctaagg

SEQ ID NO: 40841 - DNA, 20 bp, Artificial Sequence
  chemically synthesized
atgtgttactccctaaggca

SEQ ID NO: 40842 - DNA, 20 bp, Artificial Sequence
  chemically synthesized
tctctttcccttcctctatg

SEQ ID NO: 40843 - DNA, 20 bp, Artificial Sequence
  chemically synthesized
ctttcccttcctctatgtgg

SEQ ID NO: 40844 - DNA, 20 bp, Artificial Sequence
  chemically synthesized
cccttcctctatgtggcaga

SEQ ID NO: 40845 - DNA, 20 bp, Artificial Sequence
  chemically synthesized
ctctatgtggcagaaagtaa

SEQ ID NO: 40846 - DNA, 20 bp, Artificial Sequence
  chemically synthesized
taaaagattctgaaatgata

SEQ ID NO: 40847 - DNA, 20 bp, Artificial Sequence
  chemically synthesized
tgaaatgataaagtcaatca

SEQ ID NO: 40848 - DNA, 20 bp, Artificial Sequence
  chemically synthesized
gaaatgataaagtcaatcac

SEQ ID NO: 40849 - DNA, 20 bp, Artificial Sequence
  chemically synthesized
atgataaagtcaatcacagg

SEQ ID NO: 40850 - DNA, 20 bp, Artificial Sequence
  chemically synthesized
tgataaagtcaatcacagga

SEQ ID NO: 40851 - DNA, 20 bp, Artificial Sequence
  chemically synthesized
gtcaatcacaggaaggcacc

SEQ ID NO: 40852 - DNA, 20 bp, Artificial Sequence
  chemically synthesized
caggaaggcacctggactcc

SEQ ID NO: 40853 - DNA, 20 bp, Artificial Sequence
  chemically synthesized
tggactcctggcccactgct

SEQ ID NO: 40854 - DNA, 20 bp, Artificial Sequence
  chemically synthesized
gactcctggcccactgcttg

SEQ ID NO: 40855 - DNA, 20 bp, Artificial Sequence
  chemically synthesized
actcctggcccactgcttgg

SEQ ID NO: 40856 - DNA, 20 bp, Artificial Sequence
  chemically synthesized
tcctggcccactgcttggag

SEQ ID NO: 40857 - DNA, 20 bp, Artificial Sequence
  chemically synthesized
ctggcccactgcttggagga

SEQ ID NO: 40858 - DNA, 20 bp, Artificial Sequence
  chemically synthesized
actgcttggaggagagcact

SEQ ID NO: 40859 - DNA, 20 bp, Artificial Sequence
  chemically synthesized
ctgcttggaggagagcactc

SEQ ID NO: 40860 - DNA, 20 bp, Artificial Sequence
  chemically synthesized
atgaacatctgactgtgacg

SEQ ID NO: 40861 - DNA, 20 bp, Artificial Sequence
  chemically synthesized
ctgactgtgacgtagcaata

SEQ ID NO: 40862 - DNA, 20 bp, Artificial Sequence
  chemically synthesized
atgaaactgcttaaaattaa

SEQ ID NO: 40863 - DNA, 20 bp, Artificial Sequence
  chemically synthesized
ctgcttaaaattaatggcac

SEQ ID NO: 40864 - DNA, 20 bp, Artificial Sequence
  chemically synthesized
tgcacatttgtctttatttg

SEQ ID NO: 40865 - DNA, 20 bp, Artificial Sequence
  chemically synthesized
gcttccacatcaatccactc

SEQ ID NO: 40866 - DNA, 20 bp, Artificial Sequence
  chemically synthesized
cttccacatcaatccactca

SEQ ID NO: 40867 - DNA, 20 bp, Artificial Sequence
  chemically synthesized
ttctgctataatgcaatttc

SEQ ID NO: 40868 - DNA, 20 bp, Artificial Sequence
  chemically synthesized
atgcaatttcaagttcttta

SEQ ID NO: 40869 - DNA, 20 bp, Artificial Sequence
  chemically synthesized
tgcaatttcaagttctttac

SEQ ID NO: 40870 - DNA, 20 bp, Artificial Sequence
  chemically synthesized
tttcaagttctttacaggcc

SEQ ID NO: 40871 - DNA, 20 bp, Artificial Sequence
  chemically synthesized
tctgaattcctgacctccaa

SEQ ID NO: 40872 - DNA, 20 bp, Artificial Sequence
  chemically synthesized
cctgacctccaaaagtgatc

SEQ ID NO: 40873 - DNA, 20 bp, Artificial Sequence
  chemically synthesized
aaaagtgatcaagatatttt

SEQ ID NO: 40874 - DNA, 20 bp, Artificial Sequence
  chemically synthesized
tgatcaagatatttttagtt

SEQ ID NO: 40875 - DNA, 20 bp, Artificial Sequence
  chemically synthesized
gatcaagatatttttagttc

SEQ ID NO: 40876 - DNA, 20 bp, Artificial Sequence
  chemically synthesized
ccaaaattttctcattttca

SEQ ID NO: 40877 - DNA, 20 bp, Artificial Sequence
  chemically synthesized
caaaattttctcattttcat

SEQ ID NO: 40878 - DNA, 20 bp, Artificial Sequence
  chemically synthesized
gatcattattcatgatttgc

SEQ ID NO: 40879 - DNA, 20 bp, Artificial Sequence
  chemically synthesized
atcattattcatgatttgca

SEQ ID NO: 40880 - DNA, 20 bp, Artificial Sequence
  chemically synthesized
atgacattttaactatgttc

SEQ ID NO: 40881 - DNA, 20 bp, Artificial Sequence
  chemically synthesized
atgttccagatttttgaatg

SEQ ID NO: 40882 - DNA, 20 bp, Artificial Sequence
  chemically synthesized
gttccagatttttgaatgaa

SEQ ID NO: 40883 - DNA, 20 bp, Artificial Sequence
  chemically synthesized
atgttttcaccacaaaaaat

SEQ ID NO: 40884 - DNA, 20 bp, Artificial Sequence
  chemically synthesized
ccacaaaaaataagtatgtg

SEQ ID NO: 40885 - DNA, 20 bp, Artificial Sequence
  chemically synthesized
caaaaaataagtatgtgaag

SEQ ID NO: 40886 - DNA, 20 bp, Artificial Sequence
  chemically synthesized
aaaataagtatgtgaagtgg

SEQ ID NO: 40887 - DNA, 20 bp, Artificial Sequence
  chemically synthesized
gaagtggtggatttgttaat

SEQ ID NO: 40888 - DNA, 20 bp, Artificial Sequence
  chemically synthesized
aatattgtacacgtacacca

SEQ ID NO: 40889 - DNA, 20 bp, Artificial Sequence
  chemically synthesized
tgaaataataaaaaataaca

SEQ ID NO: 40890 - DNA, 20 bp, Artificial Sequence
  chemically synthesized
gaaataataaaaaataacaa

SEQ ID NO: 40891 - DNA, 20 bp, Artificial Sequence
  chemically synthesized
ataaaaaataacaaaggcat

SEQ ID NO: 40892 - DNA, 20 bp, Artificial Sequence
  chemically synthesized
agcctctgcattgcctttac

SEQ ID NO: 40893 - DNA, 20 bp, Artificial Sequence
  chemically synthesized
gcctttaccggtcatcctca

SEQ ID NO: 40894 - DNA, 20 bp, Artificial Sequence
  chemically synthesized
atctttgatgcctctttgtc

SEQ ID NO: 40895 - DNA, 20 bp, Artificial Sequence
  chemically synthesized
ttttctctacgttatttata

SEQ ID NO: 40896 - DNA, 20 bp, Artificial Sequence
  chemically synthesized
tttctctacgttatttatat

SEQ ID NO: 40897 - DNA, 20 bp, Artificial Sequence
  chemically synthesized
tatgggtatcatcaccatcc

SEQ ID NO: 40898 - DNA, 20 bp, Artificial Sequence
  chemically synthesized
atcaccatcctggacaacat

SEQ ID NO: 40899 - DNA, 20 bp, Artificial Sequence
  chemically synthesized
tcaccatcctggacaacatc

SEQ ID NO: 40900 - DNA, 20 bp, Artificial Sequence
  chemically synthesized
catcctggacaacatcagga

SEQ ID NO: 40901 - DNA, 20 bp, Artificial Sequence
  chemically synthesized
caggacagatatccctcacc

SEQ ID NO: 40902 - DNA, 20 bp, Artificial Sequence
  chemically synthesized
gccaatgttcctctctatgt

SEQ ID NO: 40903 - DNA, 20 bp, Artificial Sequence
  chemically synthesized
tcctttcaccaccctttcca

SEQ ID NO: 40904 - DNA, 20 bp, Artificial Sequence
  chemically synthesized
accaccctttccacagtcaa

SEQ ID NO: 40905 - DNA, 20 bp, Artificial Sequence
  chemically synthesized
ccaccctttccacagtcaaa

SEQ ID NO: 40906 - DNA, 20 bp, Artificial Sequence
  chemically synthesized
ccacagtcaaaaggatattg

SEQ ID NO: 40907 - DNA, 20 bp, Artificial Sequence
  chemically synthesized
gatattgtagtttaatgcct

SEQ ID NO: 40908 - DNA, 20 bp, Artificial Sequence
  chemically synthesized
tattgtagtttaatgcctca

SEQ ID NO: 40909 - DNA, 20 bp, Artificial Sequence
  chemically synthesized
tagtttaatgcctcagagtt

SEQ ID NO: 40910 - DNA, 20 bp, Artificial Sequence
  chemically synthesized
tgcctcagagttcagctttt

SEQ ID NO: 40911 - DNA, 20 bp, Artificial Sequence
  chemically synthesized
gacaaattattcttcctctt

SEQ ID NO: 40912 - DNA, 20 bp, Artificial Sequence
  chemically synthesized
acaaattattcttcctcttt

SEQ ID NO: 40913 - DNA, 20 bp, Artificial Sequence
  chemically synthesized
cctctttaggttctccttta

SEQ ID NO: 40914 - DNA, 20 bp, Artificial Sequence
  chemically synthesized
tatggaatcttctgtactga

SEQ ID NO: 40915 - DNA, 20 bp, Artificial Sequence
  chemically synthesized
catgtcctttaactactatg

SEQ ID NO: 40916 - DNA, 20 bp, Artificial Sequence
  chemically synthesized
tattatgcctctacctttat

SEQ ID NO: 40917 - DNA, 20 bp, Artificial Sequence
  chemically synthesized
tatgcctctacctttattag

SEQ ID NO: 40918 - DNA, 20 bp, Artificial Sequence
  chemically synthesized
tgcctctacctttattagca

SEQ ID NO: 40919 - DNA, 20 bp, Artificial Sequence
  chemically synthesized
agcagagttatctgtactgt

SEQ ID NO: 40920 - DNA, 20 bp, Artificial Sequence
  chemically synthesized
ttctgctattcttgatcaaa

SEQ ID NO: 40921 - DNA, 20 bp, Artificial Sequence
  chemically synthesized
tcatttctcctgccttcact

SEQ ID NO: 40922 - DNA, 20 bp, Artificial Sequence
  chemically synthesized
tcacttggacgtgcttcacg

SEQ ID NO: 40923 - DNA, 20 bp, Artificial Sequence
  chemically synthesized
acgtagtctgtgcttatgac

SEQ ID NO: 40924 - DNA, 20 bp, Artificial Sequence
  chemically synthesized
gactggattaaaaattgata

SEQ ID NO: 40925 - DNA, 20 bp, Artificial Sequence
  chemically synthesized
taatgttgttcgtcataata

SEQ ID NO: 40926 - DNA, 20 bp, Artificial Sequence
  chemically synthesized
aatgttgttcgtcataatat

SEQ ID NO: 40927 - DNA, 20 bp, Artificial Sequence
  chemically synthesized
tcgtcataatatgggtttta

SEQ ID NO: 40928 - DNA, 20 bp, Artificial Sequence
  chemically synthesized
ttatttcctatgcattgatc

SEQ ID NO: 40929 - DNA, 20 bp, Artificial Sequence
  chemically synthesized
atttcctatgcattgatctg

SEQ ID NO: 40930 - DNA, 20 bp, Artificial Sequence
  chemically synthesized
tcctatgcattgatctggag

SEQ ID NO: 40931 - DNA, 20 bp, Artificial Sequence
  chemically synthesized
cctatgcattgatctggaga

SEQ ID NO: 40932 - DNA, 20 bp, Artificial Sequence
  chemically synthesized
ttcaatccttttactctttg

SEQ ID NO: 40933 - DNA, 20 bp, Artificial Sequence
  chemically synthesized
gaaaatatctgtaaaccttc

SEQ ID NO: 40934 - DNA, 20 bp, Artificial Sequence
  chemically synthesized
ccttctggttcactctgcta

SEQ ID NO: 40935 - DNA, 20 bp, Artificial Sequence
  chemically synthesized
tcactctgctatagcaattt

SEQ ID NO: 40936 - DNA, 20 bp, Artificial Sequence
  chemically synthesized
ctgctatagcaatttcagtt

SEQ ID NO: 40937 - DNA, 20 bp, Artificial Sequence
  chemically synthesized
tgctatagcaatttcagttt

SEQ ID NO: 40938 - DNA, 20 bp, Artificial Sequence
  chemically synthesized
atagcaatttcagtttaggc

SEQ ID NO: 40939 - DNA, 20 bp, Artificial Sequence
  chemically synthesized
caatttcagtttaggctagt

SEQ ID NO: 40940 - DNA, 20 bp, Artificial Sequence
  chemically synthesized
cagtttaggctagtaagcat

SEQ ID NO: 40941 - DNA, 20 bp, Artificial Sequence
  chemically synthesized
agtttaggctagtaagcatg

SEQ ID NO: 40942 - DNA, 20 bp, Artificial Sequence
  chemically synthesized
tccttctctgatttttccca

SEQ ID NO: 40943 - DNA, 20 bp, Artificial Sequence
  chemically synthesized
tgatttttcccacagtctgt

SEQ ID NO: 40944 - DNA, 20 bp, Artificial Sequence
  chemically synthesized
ttcccacagtctgttggtca

SEQ ID NO: 40945 - DNA, 20 bp, Artificial Sequence
  chemically synthesized
tgttggtcacagaataacct

SEQ ID NO: 40946 - DNA, 20 bp, Artificial Sequence
  chemically synthesized
acctgagtgattactgatga

SEQ ID NO: 40947 - DNA, 20 bp, Artificial Sequence
  chemically synthesized
ctgagtgattactgatgaaa

SEQ ID NO: 40948 - DNA, 20 bp, Artificial Sequence
  chemically synthesized
gtgattactgatgaaagagt

SEQ ID NO: 40949 - DNA, 20 bp, Artificial Sequence
  chemically synthesized
aagagtgagaatgttattga

SEQ ID NO: 40950 - DNA, 20 bp, Artificial Sequence
  chemically synthesized
tgacaaaaaacaaacaacta

SEQ ID NO: 40951 - DNA, 20 bp, Artificial Sequence
  chemically synthesized
caaaatgtttctctttttat

SEQ ID NO: 40952 - DNA, 20 bp, Artificial Sequence
  chemically synthesized
aatgtttctctttttattag

SEQ ID NO: 40953 - DNA, 20 bp, Artificial Sequence
  chemically synthesized
tatatttcctgacctatatc

SEQ ID NO: 40954 - DNA, 20 bp, Artificial Sequence
  chemically synthesized
atttcctgacctatatctgg

SEQ ID NO: 40955 - DNA, 20 bp, Artificial Sequence
  chemically synthesized
tttcctgacctatatctggc

SEQ ID NO: 40956 - DNA, 20 bp, Artificial Sequence
  chemically synthesized
ctatatctggcaggactctt

SEQ ID NO: 40957 - DNA, 20 bp, Artificial Sequence
  chemically synthesized
atatctggcaggactcttta

SEQ ID NO: 40958 - DNA, 20 bp, Artificial Sequence
  chemically synthesized
atctggcaggactctttaga

SEQ ID NO: 40959 - DNA, 20 bp, Artificial Sequence
  chemically synthesized
tctggcaggactctttagag

SEQ ID NO: 40960 - DNA, 20 bp, Artificial Sequence
  chemically synthesized
ggcaggactctttagagagg

SEQ ID NO: 40961 - DNA, 20 bp, Artificial Sequence
  chemically synthesized
actctttagagaggtagctg

SEQ ID NO: 40962 - DNA, 20 bp, Artificial Sequence
  chemically synthesized
gaagctgctgttatgaccac

SEQ ID NO: 40963 - DNA, 20 bp, Artificial Sequence
  chemically synthesized
agctgctgttatgaccacta

SEQ ID NO: 40964 - DNA, 20 bp, Artificial Sequence
  chemically synthesized
gctgctgttatgaccactag

SEQ ID NO: 40965 - DNA, 20 bp, Artificial Sequence
  chemically synthesized
ctgctgttatgaccactaga

SEQ ID NO: 40966 - DNA, 20 bp, Artificial Sequence
  chemically synthesized
ctgttatgaccactagaggg

SEQ ID NO: 40967 - DNA, 20 bp, Artificial Sequence
  chemically synthesized
ttatgaccactagagggaag

SEQ ID NO: 40968 - DNA, 20 bp, Artificial Sequence
  chemically synthesized
tagagggaagaagatacctg

SEQ ID NO: 40969 - DNA, 20 bp, Artificial Sequence
  chemically synthesized
gagggaagaagatacctgtg

SEQ ID NO: 40970 - DNA, 20 bp, Artificial Sequence
  chemically synthesized
gaagatacctgtggagctaa

SEQ ID NO: 40971 - DNA, 20 bp, Artificial Sequence
  chemically synthesized
acctgtggagctaatggtcc

SEQ ID NO: 40972 - DNA, 20 bp, Artificial Sequence
  chemically synthesized
gtggagctaatggtccaaga

SEQ ID NO: 40973 - DNA, 20 bp, Artificial Sequence
  chemically synthesized
gagctaatggtccaagatgg

SEQ ID NO: 40974 - DNA, 20 bp, Artificial Sequence
  chemically synthesized
gctaatggtccaagatggtg

SEQ ID NO: 40975 - DNA, 20 bp, Artificial Sequence
  chemically synthesized
gtccaagatggtggagcccc

SEQ ID NO: 40976 - DNA, 20 bp, Artificial Sequence
  chemically synthesized
aagatggtggagccccaagc

SEQ ID NO: 40977 - DNA, 20 bp, Artificial Sequence
  chemically synthesized
agatggtggagccccaagca

SEQ ID NO: 40978 - DNA, 20 bp, Artificial Sequence
  chemically synthesized
tggtggagccccaagcaagg

SEQ ID NO: 40979 - DNA, 20 bp, Artificial Sequence
  chemically synthesized
ccccaagcaaggaagttgtt

SEQ ID NO: 40980 - DNA, 20 bp, Artificial Sequence
  chemically synthesized
cccaagcaaggaagttgtta

SEQ ID NO: 40981 - DNA, 20 bp, Artificial Sequence
  chemically synthesized
caagcaaggaagttgttaag

SEQ ID NO: 40982 - DNA, 20 bp, Artificial Sequence
  chemically synthesized
ttaaggagcccttttgattg

SEQ ID NO: 40983 - DNA, 20 bp, Artificial Sequence
  chemically synthesized
taaggagcccttttgattga

SEQ ID NO: 40984 - DNA, 20 bp, Artificial Sequence
  chemically synthesized
ggagcccttttgattgaagg

SEQ ID NO: 40985 - DNA, 20 bp, Artificial Sequence
  chemically synthesized
gagcccttttgattgaaggt

SEQ ID NO: 40986 - DNA, 20 bp, Artificial Sequence
  chemically synthesized
aggtgggtgcccccacctta

SEQ ID NO: 40987 - DNA, 20 bp, Artificial Sequence
  chemically synthesized
ggtgggtgcccccaccttac

SEQ ID NO: 40988 - DNA, 20 bp, Artificial Sequence
  chemically synthesized
gtgggtgcccccaccttaca

SEQ ID NO: 40989 - DNA, 20 bp, Artificial Sequence
  chemically synthesized
gtgcccccaccttacaggga

SEQ ID NO: 40990 - DNA, 20 bp, Artificial Sequence
  chemically synthesized
tgcccccaccttacagggac

SEQ ID NO: 40991 - DNA, 20 bp, Artificial Sequence
  chemically synthesized
ccttacagggacaggacatc

SEQ ID NO: 40992 - DNA, 20 bp, Artificial Sequence
  chemically synthesized
ggacatctggatactcctcc

SEQ ID NO: 40993 - DNA, 20 bp, Artificial Sequence
  chemically synthesized
gatactcctcccagtttctc

SEQ ID NO: 40994 - DNA, 20 bp, Artificial Sequence
  chemically synthesized
cttccccatttctaataata

SEQ ID NO: 40995 - DNA, 20 bp, Artificial Sequence
  chemically synthesized
ccatttctaataataaagca

SEQ ID NO: 40996 - DNA, 20 bp, Artificial Sequence
  chemically synthesized
catttctaataataaagcaa

SEQ ID NO: 40997 - DNA, 20 bp, Artificial Sequence
  chemically synthesized
tctaataataaagcaaaggc

SEQ ID NO: 40998 - DNA, 20 bp, Artificial Sequence
  chemically synthesized
ataataaagcaaaggctagt

SEQ ID NO: 40999 - DNA, 20 bp, Artificial Sequence
  chemically synthesized
taaagcaaaggctagttagt

SEQ ID NO: 41000 - DNA, 20 bp, Artificial Sequence
  chemically synthesized
cttgcattttgaaaatgcca

SEQ ID NO: 41001 - DNA, 20 bp, Artificial Sequence
  chemically synthesized
ttcaaaattatttcatacat

SEQ ID NO: 41002 - DNA, 20 bp, Artificial Sequence
  chemically synthesized
catcggtctttctttatttc

SEQ ID NO: 41003 - DNA, 20 bp, Artificial Sequence
  chemically synthesized
tcggtctttctttatttcaa

SEQ ID NO: 41004 - DNA, 20 bp, Artificial Sequence
  chemically synthesized
ctttctttatttcaagagtc

SEQ ID NO: 41005 - DNA, 20 bp, Artificial Sequence
  chemically synthesized
ttatttcaagagtccagaaa

SEQ ID NO: 41006 - DNA, 20 bp, Artificial Sequence
  chemically synthesized
ttacctttgattcaatgtaa

SEQ ID NO: 41007 - DNA, 20 bp, Artificial Sequence
  chemically synthesized
ctttgattcaatgtaatgga

SEQ ID NO: 41008 - DNA, 20 bp, Artificial Sequence
  chemically synthesized
ttgattcaatgtaatggaaa

SEQ ID NO: 41009 - DNA, 20 bp, Artificial Sequence
  chemically synthesized
gtaatggaaagagctctttc

SEQ ID NO: 41010 - DNA, 20 bp, Artificial Sequence
  chemically synthesized
aatggaaagagctctttcaa

SEQ ID NO: 41011 - DNA, 20 bp, Artificial Sequence
  chemically synthesized
gaaagagctctttcaagaga

SEQ ID NO: 41012 - DNA, 20 bp, Artificial Sequence
  chemically synthesized
aagagctctttcaagagaca

SEQ ID NO: 41013 - DNA, 20 bp, Artificial Sequence
  chemically synthesized
ctctttcaagagacagagaa

SEQ ID NO: 41014 - DNA, 20 bp, Artificial Sequence
  chemically synthesized
catttctctctctcatttct

SEQ ID NO: 41015 - DNA, 20 bp, Artificial Sequence
  chemically synthesized
ttctctctctcatttctcag

SEQ ID NO: 41016 - DNA, 20 bp, Artificial Sequence
  chemically synthesized
ttctcagaagtatattttga

SEQ ID NO: 41017 - DNA, 20 bp, Artificial Sequence
  chemically synthesized
tctcagaagtatattttgaa

SEQ ID NO: 41018 - DNA, 20 bp, Artificial Sequence
  chemically synthesized
gtatattttgaaaggattca

SEQ ID NO: 41019 - DNA, 20 bp, Artificial Sequence
  chemically synthesized
tattttgaaaggattcatag

SEQ ID NO: 41020 - DNA, 20 bp, Artificial Sequence
  chemically synthesized
ttgaaaggattcatagcaga

SEQ ID NO: 41021 - DNA, 20 bp, Artificial Sequence
  chemically synthesized
aggattcatagcagacagct

SEQ ID NO: 41022 - DNA, 20 bp, Artificial Sequence
  chemically synthesized
ggattcatagcagacagcta

SEQ ID NO: 41023 - DNA, 20 bp, Artificial Sequence
  chemically synthesized
tcatagcagacagctaaggc

SEQ ID NO: 41024 - DNA, 20 bp, Artificial Sequence
  chemically synthesized
agctaaggctggttttttct

SEQ ID NO: 41025 - DNA, 20 bp, Artificial Sequence
  chemically synthesized
aggctggttttttctaagtg

SEQ ID NO: 41026 - DNA, 20 bp, Artificial Sequence
  chemically synthesized
ctggttttttctaagtgaag

SEQ ID NO: 41027 - DNA, 20 bp, Artificial Sequence
  chemically synthesized
ctaagtgaagaagtgatatt

SEQ ID NO: 41028 - DNA, 20 bp, Artificial Sequence
  chemically synthesized
agtgaagaagtgatattgag

SEQ ID NO: 41029 - DNA, 20 bp, Artificial Sequence
  chemically synthesized
gtgaagaagtgatattgaga

SEQ ID NO: 41030 - DNA, 20 bp, Artificial Sequence
  chemically synthesized
aagaagtgatattgagaagg

SEQ ID NO: 41031 - DNA, 20 bp, Artificial Sequence
  chemically synthesized
agaagtgatattgagaaggt

SEQ ID NO: 41032 - DNA, 20 bp, Artificial Sequence
  chemically synthesized
gaagtgatattgagaaggta

SEQ ID NO: 41033 - DNA, 20 bp, Artificial Sequence
  chemically synthesized
ttgagaaggtagggttgcat

SEQ ID NO: 41034 - DNA, 20 bp, Artificial Sequence
  chemically synthesized
tagggttgcatgagcccttt

SEQ ID NO: 41035 - DNA, 20 bp, Artificial Sequence
  chemically synthesized
catgagccctttcagttttt

SEQ ID NO: 41036 - DNA, 20 bp, Artificial Sequence
  chemically synthesized
tttatatacatctgtattgt

SEQ ID NO: 41037 - DNA, 20 bp, Artificial Sequence
  chemically synthesized
atataaataaaattatttct

SEQ ID NO: 41038 - DNA, 20 bp, Artificial Sequence
  chemically synthesized
attatttctcagttatatac

SEQ ID NO: 41039 - DNA, 20 bp, Artificial Sequence
  chemically synthesized
tatactagctatgtaacctg

SEQ ID NO: 41040 - DNA, 20 bp, Artificial Sequence
  chemically synthesized
taacctgtggatatttcctt

SEQ ID NO: 41041 - DNA, 20 bp, Artificial Sequence
  chemically synthesized
gatatttccttaagtattac

SEQ ID NO: 41042 - DNA, 20 bp, Artificial Sequence
  chemically synthesized
caagctatacttaactcact

SEQ ID NO: 41043 - DNA, 20 bp, Artificial Sequence
  chemically synthesized
tcaaataaatacctgcttca

SEQ ID NO: 41044 - DNA, 20 bp, Artificial Sequence
  chemically synthesized
cctgcttcatagttattaat

SEQ ID NO: 41045 - DNA, 20 bp, Artificial Sequence
  chemically synthesized
ctgcttcatagttattaata

SEQ ID NO: 41046 - DNA, 20 bp, Artificial Sequence
  chemically synthesized
catagttattaataaggatt

SEQ ID NO: 41047 - DNA, 20 bp, Artificial Sequence
  chemically synthesized
gttattaataaggattaagt

SEQ ID NO: 41048 - DNA, 20 bp, Artificial Sequence
  chemically synthesized
ttaagtgagataatgcccat

SEQ ID NO: 41049 - DNA, 20 bp, Artificial Sequence
  chemically synthesized
cataagattcctattaataa

SEQ ID NO: 41050 - DNA, 20 bp, Artificial Sequence
  chemically synthesized
tacacacacacacacattga

SEQ ID NO: 41051 - DNA, 20 bp, Artificial Sequence
  chemically synthesized
acacacacacacacattgaa

SEQ ID NO: 41052 - DNA, 20 bp, Artificial Sequence
  chemically synthesized
aaaggattcttactttgtgc

SEQ ID NO: 41053 - DNA, 20 bp, Artificial Sequence
  chemically synthesized
aaggattcttactttgtgct

SEQ ID NO: 41054 - DNA, 20 bp, Artificial Sequence
  chemically synthesized
tttgtgctaggaactataat

SEQ ID NO: 41055 - DNA, 20 bp, Artificial Sequence
  chemically synthesized
cattgatgcattatatcatt

SEQ ID NO: 41056 - DNA, 20 bp, Artificial Sequence
  chemically synthesized
ttaagttctaatttcaacac

SEQ ID NO: 41057 - DNA, 20 bp, Artificial Sequence
  chemically synthesized
agttctaatttcaacactag

SEQ ID NO: 41058 - DNA, 20 bp, Artificial Sequence
  chemically synthesized
gttctaatttcaacactaga

SEQ ID NO: 41059 - DNA, 20 bp, Artificial Sequence
  chemically synthesized
ctaatttcaacactagaagg

SEQ ID NO: 41060 - DNA, 20 bp, Artificial Sequence
  chemically synthesized
taatttcaacactagaaggc

SEQ ID NO: 41061 - DNA, 20 bp, Artificial Sequence
  chemically synthesized
gtattatctaaatttcatac

SEQ ID NO: 41062 - DNA, 20 bp, Artificial Sequence
  chemically synthesized
tggatacctccaaactcata

SEQ ID NO: 41063 - DNA, 20 bp, Artificial Sequence
  chemically synthesized
tttgtcatatatttattcaa

SEQ ID NO: 41064 - DNA, 20 bp, Artificial Sequence
  chemically synthesized
ttgtcatatatttattcaaa

SEQ ID NO: 41065 - DNA, 20 bp, Artificial Sequence
  chemically synthesized
tgtcatatatttattcaaaa

SEQ ID NO: 41066 - DNA, 20 bp, Artificial Sequence
  chemically synthesized
aaaagggtaaactcaaacta

SEQ ID NO: 41067 - DNA, 20 bp, Artificial Sequence
  chemically synthesized
tattttataaaattattctc

SEQ ID NO: 41068 - DNA, 20 bp, Artificial Sequence
  chemically synthesized
aattattctcaagttattat

SEQ ID NO: 41069 - DNA, 20 bp, Artificial Sequence
  chemically synthesized
attattctcaagttattatg

SEQ ID NO: 41070 - DNA, 20 bp, Artificial Sequence
  chemically synthesized
agttattatgaggatgttga

SEQ ID NO: 41071 - DNA, 20 bp, Artificial Sequence
  chemically synthesized
attatgaggatgttgaaaga

SEQ ID NO: 41072 - DNA, 20 bp, Artificial Sequence
  chemically synthesized
tatgaggatgttgaaagaca

SEQ ID NO: 41073 - DNA, 20 bp, Artificial Sequence
  chemically synthesized
tgaggatgttgaaagacaga

SEQ ID NO: 41074 - DNA, 20 bp, Artificial Sequence
  chemically synthesized
gaggatgttgaaagacagag

SEQ ID NO: 41075 - DNA, 20 bp, Artificial Sequence
  chemically synthesized
atgttgaaagacagagagga

SEQ ID NO: 41076 - DNA, 20 bp, Artificial Sequence
  chemically synthesized
tgttgaaagacagagaggat

SEQ ID NO: 41077 - DNA, 20 bp, Artificial Sequence
  chemically synthesized
gttgaaagacagagaggatg

SEQ ID NO: 41078 - DNA, 20 bp, Artificial Sequence
  chemically synthesized
tggggtgctatgccccaaat

SEQ ID NO: 41079 - DNA, 20 bp, Artificial Sequence
  chemically synthesized
cccaaatcagcctcacaatt

SEQ ID NO: 41080 - DNA, 20 bp, Artificial Sequence
  chemically synthesized
atcagcctcacaattaagct

SEQ ID NO: 41081 - DNA, 20 bp, Artificial Sequence
  chemically synthesized
agcctcacaattaagctaag

SEQ ID NO: 41082 - DNA, 20 bp, Artificial Sequence
  chemically synthesized
cacaattaagctaagcagct

SEQ ID NO: 41083 - DNA, 20 bp, Artificial Sequence
  chemically synthesized
caattaagctaagcagctaa

SEQ ID NO: 41084 - DNA, 20 bp, Artificial Sequence
  chemically synthesized
ctaagcagctaagagtcttg

SEQ ID NO: 41085 - DNA, 20 bp, Artificial Sequence
  chemically synthesized
taagcagctaagagtcttgc

SEQ ID NO: 41086 - DNA, 20 bp, Artificial Sequence
  chemically synthesized
aagcagctaagagtcttgca

SEQ ID NO: 41087 - DNA, 20 bp, Artificial Sequence
  chemically synthesized
cagctaagagtcttgcaggg

SEQ ID NO: 41088 - DNA, 20 bp, Artificial Sequence
  chemically synthesized
aagagtcttgcagggtagtg

SEQ ID NO: 41089 - DNA, 20 bp, Artificial Sequence
  chemically synthesized
agagtcttgcagggtagtgt

SEQ ID NO: 41090 - DNA, 20 bp, Artificial Sequence
  chemically synthesized
gagtcttgcagggtagtgta

SEQ ID NO: 41091 - DNA, 20 bp, Artificial Sequence
  chemically synthesized
gcagggtagtgtagggacca

SEQ ID NO: 41092 - DNA, 20 bp, Artificial Sequence
  chemically synthesized
cagggtagtgtagggaccac

SEQ ID NO: 41093 - DNA, 20 bp, Artificial Sequence
  chemically synthesized
agggtagtgtagggaccaca

SEQ ID NO: 41094 - DNA, 20 bp, Artificial Sequence
  chemically synthesized
agtgtagggaccacagggtt

SEQ ID NO: 41095 - DNA, 20 bp, Artificial Sequence
  chemically synthesized
gtgtagggaccacagggtta

SEQ ID NO: 41096 - DNA, 20 bp, Artificial Sequence
  chemically synthesized
tgtagggaccacagggttaa

SEQ ID NO: 41097 - DNA, 20 bp, Artificial Sequence
  chemically synthesized
gtagggaccacagggttaag

SEQ ID NO: 41098 - DNA, 20 bp, Artificial Sequence
  chemically synthesized
tagggaccacagggttaagg

SEQ ID NO: 41099 - DNA, 20 bp, Artificial Sequence
  chemically synthesized
ggaccacagggttaaggggg

SEQ ID NO: 41100 - DNA, 20 bp, Artificial Sequence
  chemically synthesized
ccacagggttaagggggcag

SEQ ID NO: 41101 - DNA, 20 bp, Artificial Sequence
  chemically synthesized
gtagaattatactcccactt

SEQ ID NO: 41102 - DNA, 20 bp, Artificial Sequence
  chemically synthesized
tcaaacaatccatacacaca

SEQ ID NO: 41103 - DNA, 20 bp, Artificial Sequence
  chemically synthesized
atccatacacacacagccct

SEQ ID NO: 41104 - DNA, 20 bp, Artificial Sequence
  chemically synthesized
ttttgtttaaatgtataaat

SEQ ID NO: 41105 - DNA, 20 bp, Artificial Sequence
  chemically synthesized
tgtttaaatgtataaataag

SEQ ID NO: 41106 - DNA, 20 bp, Artificial Sequence
  chemically synthesized
atgtataaataagtggatga

SEQ ID NO: 41107 - DNA, 20 bp, Artificial Sequence
  chemically synthesized
taaataagtggatgaaagaa

SEQ ID NO: 41108 - DNA, 20 bp, Artificial Sequence
  chemically synthesized
taagtggatgaaagaataga

SEQ ID NO: 41109 - DNA, 20 bp, Artificial Sequence
  chemically synthesized
tggatgaaagaatagataga

SEQ ID NO: 41110 - DNA, 20 bp, Artificial Sequence
  chemically synthesized
tgaaagaatagatagataga

SEQ ID NO: 41111 - DNA, 20 bp, Artificial Sequence
  chemically synthesized
agaatagatagatagataga

SEQ ID NO: 41112 - DNA, 20 bp, Artificial Sequence
  chemically synthesized
tagatagatagatagacaga

SEQ ID NO: 41113 - DNA, 20 bp, Artificial Sequence
  chemically synthesized
atagatagacagatagatga

SEQ ID NO: 41114 - DNA, 20 bp, Artificial Sequence
  chemically synthesized
atagacagatagatgataga

SEQ ID NO: 41115 - DNA, 20 bp, Artificial Sequence
  chemically synthesized
agaataaatgcttgccttca

SEQ ID NO: 41116 - DNA, 20 bp, Artificial Sequence
  chemically synthesized
ttgttcaaaatgttcctgtc

SEQ ID NO: 41117 - DNA, 20 bp, Artificial Sequence
  chemically synthesized
aaatgttcctgtccagacca

SEQ ID NO: 41118 - DNA, 20 bp, Artificial Sequence
  chemically synthesized
aaagtaccttgccttcactt

SEQ ID NO: 41119 - DNA, 20 bp, Artificial Sequence
  chemically synthesized
tcacttaagtaatcaattcc

SEQ ID NO: 41120 - DNA, 20 bp, Artificial Sequence
  chemically synthesized
cacttaagtaatcaattcct

SEQ ID NO: 41121 - DNA, 20 bp, Artificial Sequence
  chemically synthesized
taggttatattctgatgtca

SEQ ID NO: 41122 - DNA, 20 bp, Artificial Sequence
  chemically synthesized
aggttatattctgatgtcaa

SEQ ID NO: 41123 - DNA, 20 bp, Artificial Sequence
  chemically synthesized
ttatattctgatgtcaaagg

SEQ ID NO: 41124 - DNA, 20 bp, Artificial Sequence
  chemically synthesized
ctgatgtcaaaggaagtcaa

SEQ ID NO: 41125 - DNA, 20 bp, Artificial Sequence
  chemically synthesized
gacccacaactcatgctttg

SEQ ID NO: 41126 - DNA, 20 bp, Artificial Sequence
  chemically synthesized
actcatgctttgtagatgac

SEQ ID NO: 41127 - DNA, 20 bp, Artificial Sequence
  chemically synthesized
atgactagatcaaaaaattt

SEQ ID NO: 41128 - DNA, 20 bp, Artificial Sequence
  chemically synthesized
aaatttcagccatatcttaa

SEQ ID NO: 41129 - DNA, 20 bp, Artificial Sequence
  chemically synthesized
ttcagccatatcttaacagt

SEQ ID NO: 41130 - DNA, 20 bp, Artificial Sequence
  chemically synthesized
atatcttaacagtgagtgaa

SEQ ID NO: 41131 - DNA, 20 bp, Artificial Sequence
  chemically synthesized
tatcttaacagtgagtgaac

SEQ ID NO: 41132 - DNA, 20 bp, Artificial Sequence
  chemically synthesized
ctcctcttttccctacatct

SEQ ID NO: 41133 - DNA, 20 bp, Artificial Sequence
  chemically synthesized
tttccctacatctgagatcc

SEQ ID NO: 41134 - DNA, 20 bp, Artificial Sequence
  chemically synthesized
catctgagatcccagcttct

SEQ ID NO: 41135 - DNA, 20 bp, Artificial Sequence
  chemically synthesized
aattctcactcttgatgcaa

SEQ ID NO: 41136 - DNA, 20 bp, Artificial Sequence
  chemically synthesized
actcttgatgcaacagacct

SEQ ID NO: 41137 - DNA, 20 bp, Artificial Sequence
  chemically synthesized
cttgatgcaacagaccttgg

SEQ ID NO: 41138 - DNA, 20 bp, Artificial Sequence
  chemically synthesized
caacagaccttggaagcata

SEQ ID NO: 41139 - DNA, 20 bp, Artificial Sequence
  chemically synthesized
aacagaccttggaagcatac

SEQ ID NO: 41140 - DNA, 20 bp, Artificial Sequence
  chemically synthesized
cagaccttggaagcatacag

SEQ ID NO: 41141 - DNA, 20 bp, Artificial Sequence
  chemically synthesized
gaccttggaagcatacagga

SEQ ID NO: 41142 - DNA, 20 bp, Artificial Sequence
  chemically synthesized
gcatacaggagagctgaact

SEQ ID NO: 41143 - DNA, 20 bp, Artificial Sequence
  chemically synthesized
agagctgaacttggtcaaca

SEQ ID NO: 41144 - DNA, 20 bp, Artificial Sequence
  chemically synthesized
gagctgaacttggtcaacaa

SEQ ID NO: 41145 - DNA, 20 bp, Artificial Sequence
  chemically synthesized
gctgaacttggtcaacaaag

SEQ ID NO: 41146 - DNA, 20 bp, Artificial Sequence
  chemically synthesized
acttggtcaacaaaggagaa

SEQ ID NO: 41147 - DNA, 20 bp, Artificial Sequence
  chemically synthesized
aacaaaggagaaaagtttgt

SEQ ID NO: 41148 - DNA, 20 bp, Artificial Sequence
  chemically synthesized
gaaaagtttgttggcctcca

SEQ ID NO: 41149 - DNA, 20 bp, Artificial Sequence
  chemically synthesized
aaaagtttgttggcctccaa

SEQ ID NO: 41150 - DNA, 20 bp, Artificial Sequence
  chemically synthesized
tttgttggcctccaaaggca

SEQ ID NO: 41151 - DNA, 20 bp, Artificial Sequence
  chemically synthesized
aggcacagctcaaacttttc

SEQ ID NO: 41152 - DNA, 20 bp, Artificial Sequence
  chemically synthesized
tcaagccttctctaatctta

SEQ ID NO: 41153 - DNA, 20 bp, Artificial Sequence
  chemically synthesized
caagccttctctaatcttaa

SEQ ID NO: 41154 - DNA, 20 bp, Artificial Sequence
  chemically synthesized
ctctaatcttaaaggtaaac

SEQ ID NO: 41155 - DNA, 20 bp, Artificial Sequence
  chemically synthesized
tctaatcttaaaggtaaaca

SEQ ID NO: 41156 - DNA, 20 bp, Artificial Sequence
  chemically synthesized
ctaatcttaaaggtaaacaa

SEQ ID NO: 41157 - DNA, 20 bp, Artificial Sequence
  chemically synthesized
aacaagggtctcatttcttt

SEQ ID NO: 41158 - DNA, 20 bp, Artificial Sequence
  chemically synthesized
tctcatttctttgagaactt

SEQ ID NO: 41159 - DNA, 20 bp, Artificial Sequence
  chemically synthesized
ctcatttctttgagaacttc

SEQ ID NO: 41160 - DNA, 20 bp, Artificial Sequence
  chemically synthesized
tcatttctttgagaacttca

SEQ ID NO: 41161 - DNA, 20 bp, Artificial Sequence
  chemically synthesized
tttgagaacttcagggaaaa

SEQ ID NO: 41162 - DNA, 20 bp, Artificial Sequence
  chemically synthesized
gaacttcagggaaaatagac

SEQ ID NO: 41163 - DNA, 20 bp, Artificial Sequence
  chemically synthesized
aacttcagggaaaatagaca

SEQ ID NO: 41164 - DNA, 20 bp, Artificial Sequence
  chemically synthesized
aaaatagacaaggacttgcc

SEQ ID NO: 41165 - DNA, 20 bp, Artificial Sequence
  chemically synthesized
aaggacttgcctggtgcttt

SEQ ID NO: 41166 - DNA, 20 bp, Artificial Sequence
  chemically synthesized
gacttgcctggtgcttttgg

SEQ ID NO: 41167 - DNA, 20 bp, Artificial Sequence
  chemically synthesized
acttgcctggtgcttttggt

SEQ ID NO: 41168 - DNA, 20 bp, Artificial Sequence
  chemically synthesized
cttgcctggtgcttttggta

SEQ ID NO: 41169 - DNA, 20 bp, Artificial Sequence
  chemically synthesized
ttgcctggtgcttttggtag

SEQ ID NO: 41170 - DNA, 20 bp, Artificial Sequence
  chemically synthesized
gcctggtgcttttggtaggg

SEQ ID NO: 41171 - DNA, 20 bp, Artificial Sequence
  chemically synthesized
gcttgcactttccccctttc

SEQ ID NO: 41172 - DNA, 20 bp, Artificial Sequence
  chemically synthesized
ttgcactttccccctttctg

SEQ ID NO: 41173 - DNA, 20 bp, Artificial Sequence
  chemically synthesized
tgcactttccccctttctgg

SEQ ID NO: 41174 - DNA, 20 bp, Artificial Sequence
  chemically synthesized
ctggaggaaatatttatccc

SEQ ID NO: 41175 - DNA, 20 bp, Artificial Sequence
  chemically synthesized
tggaggaaatatttatcccc

SEQ ID NO: 41176 - DNA, 20 bp, Artificial Sequence
  chemically synthesized
aggaaatatttatccccagg

SEQ ID NO: 41177 - DNA, 20 bp, Artificial Sequence
  chemically synthesized
aggtagttccctttttgcac

SEQ ID NO: 41178 - DNA, 20 bp, Artificial Sequence
  chemically synthesized
tagttccctttttgcaccag

SEQ ID NO: 41179 - DNA, 20 bp, Artificial Sequence
  chemically synthesized
tttgcaccagtggttctttg

SEQ ID NO: 41180 - DNA, 20 bp, Artificial Sequence
  chemically synthesized
tgcaccagtggttctttgaa

SEQ ID NO: 41181 - DNA, 20 bp, Artificial Sequence
  chemically synthesized
tctttgaagagacttccacc

SEQ ID NO: 41182 - DNA, 20 bp, Artificial Sequence
  chemically synthesized
ctttgaagagacttccacct

SEQ ID NO: 41183 - DNA, 20 bp, Artificial Sequence
  chemically synthesized
aagagacttccacctgggaa

SEQ ID NO: 41184 - DNA, 20 bp, Artificial Sequence
  chemically synthesized
tccacctgggaacagttaaa

SEQ ID NO: 41185 - DNA, 20 bp, Artificial Sequence
  chemically synthesized
gaacagttaaacagcaacta

SEQ ID NO: 41186 - DNA, 20 bp, Artificial Sequence
  chemically synthesized
aacagttaaacagcaactac

SEQ ID NO: 41187 - DNA, 20 bp, Artificial Sequence
  chemically synthesized
acagttaaacagcaactaca

SEQ ID NO: 41188 - DNA, 20 bp, Artificial Sequence
  chemically synthesized
ggccttgaactgcacacttt

SEQ ID NO: 41189 - DNA, 20 bp, Artificial Sequence
  chemically synthesized
tgaactgcacactttcagtc

SEQ ID NO: 41190 - DNA, 20 bp, Artificial Sequence
  chemically synthesized
cactttcagtccggtcctca

SEQ ID NO: 41191 - DNA, 20 bp, Artificial Sequence
  chemically synthesized
gtccggtcctcacagttgaa

SEQ ID NO: 41192 - DNA, 20 bp, Artificial Sequence
  chemically synthesized
cctcacagttgaaaagacct

SEQ ID NO: 41193 - DNA, 20 bp, Artificial Sequence
  chemically synthesized
cctaagcttgtgcctgattt

SEQ ID NO: 41194 - DNA, 20 bp, Artificial Sequence
  chemically synthesized
gtgcctgatttaagcctttt

SEQ ID NO: 41195 - DNA, 20 bp, Artificial Sequence
  chemically synthesized
taatctccctctcaacccta

SEQ ID NO: 41196 - DNA, 20 bp, Artificial Sequence
  chemically synthesized
caaccctacagtcacccatt

SEQ ID NO: 41197 - DNA, 20 bp, Artificial Sequence
  chemically synthesized
gtcacccatttggtatatta

SEQ ID NO: 41198 - DNA, 20 bp, Artificial Sequence
  chemically synthesized
aagatgtgttgtctactgtc

SEQ ID NO: 41199 - DNA, 20 bp, Artificial Sequence
  chemically synthesized
tctactgtctagtatccctc

SEQ ID NO: 41200 - DNA, 20 bp, Artificial Sequence
  chemically synthesized
actgtctagtatccctcaag

SEQ ID NO: 41201 - DNA, 20 bp, Artificial Sequence
  chemically synthesized
tagtatccctcaagtagtgt

SEQ ID NO: 41202 - DNA, 20 bp, Artificial Sequence
  chemically synthesized
agtatccctcaagtagtgtc

SEQ ID NO: 41203 - DNA, 20 bp, Artificial Sequence
  chemically synthesized
cctcaagtagtgtcaggaat

SEQ ID NO: 41204 - DNA, 20 bp, Artificial Sequence
  chemically synthesized
tcaggaattagtcatttaaa

SEQ ID NO: 41205 - DNA, 20 bp, Artificial Sequence
  chemically synthesized
tagtcatttaaatagtctgc

SEQ ID NO: 41206 - DNA, 20 bp, Artificial Sequence
  chemically synthesized
catttaaatagtctgcaagc

SEQ ID NO: 41207 - DNA, 20 bp, Artificial Sequence
  chemically synthesized
atttaaatagtctgcaagcc

SEQ ID NO: 41208 - DNA, 20 bp, Artificial Sequence
  chemically synthesized
ttaaatagtctgcaagccag

SEQ ID NO: 41209 - DNA, 20 bp, Artificial Sequence
  chemically synthesized
aatagtctgcaagccaggag

SEQ ID NO: 41210 - DNA, 20 bp, Artificial Sequence
  chemically synthesized
agtctgcaagccaggagtgg

SEQ ID NO: 41211 - DNA, 20 bp, Artificial Sequence
  chemically synthesized
gtggctcatgtctgtaattc

SEQ ID NO: 41212 - DNA, 20 bp, Artificial Sequence
  chemically synthesized
tgtctgtaattccagcactt

SEQ ID NO: 41213 - DNA, 20 bp, Artificial Sequence
  chemically synthesized
tctgtaattccagcacttga

SEQ ID NO: 41214 - DNA, 20 bp, Artificial Sequence
  chemically synthesized
ctgtaattccagcacttgag

SEQ ID NO: 41215 - DNA, 20 bp, Artificial Sequence
  chemically synthesized
taattccagcacttgagagg

SEQ ID NO: 41216 - DNA, 20 bp, Artificial Sequence
  chemically synthesized
ttccagcacttgagaggtag

SEQ ID NO: 41217 - DNA, 20 bp, Artificial Sequence
  chemically synthesized
cagcacttgagaggtagaag

SEQ ID NO: 41218 - DNA, 20 bp, Artificial Sequence
  chemically synthesized
agcacttgagaggtagaagt

SEQ ID NO: 41219 - DNA, 20 bp, Artificial Sequence
  chemically synthesized
cacttgagaggtagaagtgg

SEQ ID NO: 41220 - DNA, 20 bp, Artificial Sequence
  chemically synthesized
acttgagaggtagaagtggg

SEQ ID NO: 41221 - DNA, 20 bp, Artificial Sequence
  chemically synthesized
tagaagtgggaggactgctt

SEQ ID NO: 41222 - DNA, 20 bp, Artificial Sequence
  chemically synthesized
tgggaggactgcttgagctc

SEQ ID NO: 41223 - DNA, 20 bp, Artificial Sequence
  chemically synthesized
ggaggactgcttgagctcaa

SEQ ID NO: 41224 - DNA, 20 bp, Artificial Sequence
  chemically synthesized
tcaagagtttgatattatcc

SEQ ID NO: 41225 - DNA, 20 bp, Artificial Sequence
  chemically synthesized
tgatattatcctggacaaca

SEQ ID NO: 41226 - DNA, 20 bp, Artificial Sequence
  chemically synthesized
attatcctggacaacatagc

SEQ ID NO: 41227 - DNA, 20 bp, Artificial Sequence
  chemically synthesized
cttaaaaaaaaaaaaaaaat

SEQ ID NO: 41228 - DNA, 20 bp, Artificial Sequence
  chemically synthesized
aaaaaaaaaaaaaaattagc

SEQ ID NO: 41229 - DNA, 20 bp, Artificial Sequence
  chemically synthesized
aaaaaaaaaaaaaattagcc

SEQ ID NO: 41230 - DNA, 20 bp, Artificial Sequence
  chemically synthesized
aggcatgtgatgtacacctg

SEQ ID NO: 41231 - DNA, 20 bp, Artificial Sequence
  chemically synthesized
gtgatgtacacctgtagtcc

SEQ ID NO: 41232 - DNA, 20 bp, Artificial Sequence
  chemically synthesized
cacctgtagtcccagctact

SEQ ID NO: 41233 - DNA, 20 bp, Artificial Sequence
  chemically synthesized
acctgtagtcccagctactc

SEQ ID NO: 41234 - DNA, 20 bp, Artificial Sequence
  chemically synthesized
ctgtagtcccagctactcag

SEQ ID NO: 41235 - DNA, 20 bp, Artificial Sequence
  chemically synthesized
tgtagtcccagctactcagg

SEQ ID NO: 41236 - DNA, 20 bp, Artificial Sequence
  chemically synthesized
agctactcaggaggccgaaa

SEQ ID NO: 41237 - DNA, 20 bp, Artificial Sequence
  chemically synthesized
gctactcaggaggccgaaat

SEQ ID NO: 41238 - DNA, 20 bp, Artificial Sequence
  chemically synthesized
tactcaggaggccgaaatgg

SEQ ID NO: 41239 - DNA, 20 bp, Artificial Sequence
  chemically synthesized
actcaggaggccgaaatggg

SEQ ID NO: 41240 - DNA, 20 bp, Artificial Sequence
  chemically synthesized
ccgaaatgggaggatccctt

SEQ ID NO: 41241 - DNA, 20 bp, Artificial Sequence
  chemically synthesized
atgggaggatcccttgagct

SEQ ID NO: 41242 - DNA, 20 bp, Artificial Sequence
  chemically synthesized
tgggaggatcccttgagctc

SEQ ID NO: 41243 - DNA, 20 bp, Artificial Sequence
  chemically synthesized
ggaggatcccttgagctcag

SEQ ID NO: 41244 - DNA, 20 bp, Artificial Sequence
  chemically synthesized
gaggatcccttgagctcagg

SEQ ID NO: 41245 - DNA, 20 bp, Artificial Sequence
  chemically synthesized
tcccttgagctcaggaggtc

SEQ ID NO: 41246 - DNA, 20 bp, Artificial Sequence
  chemically synthesized
cccttgagctcaggaggtca

SEQ ID NO: 41247 - DNA, 20 bp, Artificial Sequence
  chemically synthesized
agctcaggaggtcaaggctg

SEQ ID NO: 41248 - DNA, 20 bp, Artificial Sequence
  chemically synthesized
caggaggtcaaggctgcagt

SEQ ID NO: 41249 - DNA, 20 bp, Artificial Sequence
  chemically synthesized
atgatcttgccactgcactc

SEQ ID NO: 41250 - DNA, 20 bp, Artificial Sequence
  chemically synthesized
cttgccactgcactccagcc

SEQ ID NO: 41251 - DNA, 20 bp, Artificial Sequence
  chemically synthesized
ccactgcactccagcctgga

SEQ ID NO: 41252 - DNA, 20 bp, Artificial Sequence
  chemically synthesized
ctgcactccagcctggacag

SEQ ID NO: 41253 - DNA, 20 bp, Artificial Sequence
  chemically synthesized
gcactccagcctggacagca

SEQ ID NO: 41254 - DNA, 20 bp, Artificial Sequence
  chemically synthesized
tgaaaccttgcctcacgaaa

SEQ ID NO: 41255 - DNA, 20 bp, Artificial Sequence
  chemically synthesized
ttccttgatgctctaccaca

SEQ ID NO: 41256 - DNA, 20 bp, Artificial Sequence
  chemically synthesized
tccttgatgctctaccacat

SEQ ID NO: 41257 - DNA, 20 bp, Artificial Sequence
  chemically synthesized
gatgctctaccacataggtc

SEQ ID NO: 41258 - DNA, 20 bp, Artificial Sequence
  chemically synthesized
atgctctaccacataggtct

SEQ ID NO: 41259 - DNA, 20 bp, Artificial Sequence
  chemically synthesized
tcattgctgttcataattgt

SEQ ID NO: 41260 - DNA, 20 bp, Artificial Sequence
  chemically synthesized
tgtaatattgatattattcc

SEQ ID NO: 41261 - DNA, 20 bp, Artificial Sequence
  chemically synthesized
atattgatattattcctaga

SEQ ID NO: 41262 - DNA, 20 bp, Artificial Sequence
  chemically synthesized
gatattattcctagaaagct

SEQ ID NO: 41263 - DNA, 20 bp, Artificial Sequence
  chemically synthesized
atattattcctagaaagctg

SEQ ID NO: 41264 - DNA, 20 bp, Artificial Sequence
  chemically synthesized
tcctagaaagctgaggcctc

SEQ ID NO: 41265 - DNA, 20 bp, Artificial Sequence
  chemically synthesized
agatgataacttttattttc

SEQ ID NO: 41266 - DNA, 20 bp, Artificial Sequence
  chemically synthesized
tttattttctggacttgtaa

SEQ ID NO: 41267 - DNA, 20 bp, Artificial Sequence
  chemically synthesized
tcaccatgttgtaactttct

SEQ ID NO: 41268 - DNA, 20 bp, Artificial Sequence
  chemically synthesized
accatgttgtaactttctta

SEQ ID NO: 41269 - DNA, 20 bp, Artificial Sequence
  chemically synthesized
atgttgtaactttcttagag

SEQ ID NO: 41270 - DNA, 20 bp, Artificial Sequence
  chemically synthesized
cttagagtagtaacaatata

SEQ ID NO: 41271 - DNA, 20 bp, Artificial Sequence
  chemically synthesized
taacaatataaagttattgt

SEQ ID NO: 41272 - DNA, 20 bp, Artificial Sequence
  chemically synthesized
attgtgagtttttgcaaaca

SEQ ID NO: 41273 - DNA, 20 bp, Artificial Sequence
  chemically synthesized
agcaaacacaacgacccata

SEQ ID NO: 41274 - DNA, 20 bp, Artificial Sequence
  chemically synthesized
aattgtctattgtcaattta

SEQ ID NO: 41275 - DNA, 20 bp, Artificial Sequence
  chemically synthesized
attgtctattgtcaatttat

SEQ ID NO: 41276 - DNA, 20 bp, Artificial Sequence
  chemically synthesized
ttgtcaatttatgggaaaac

SEQ ID NO: 41277 - DNA, 20 bp, Artificial Sequence
  chemically synthesized
aagtatgtactttttctact

SEQ ID NO: 41278 - DNA, 20 bp, Artificial Sequence
  chemically synthesized
tttctactaagccattgaaa

SEQ ID NO: 41279 - DNA, 20 bp, Artificial Sequence
  chemically synthesized
ttctactaagccattgaaac

SEQ ID NO: 41280 - DNA, 20 bp, Artificial Sequence
  chemically synthesized
agccattgaaacaggaataa

SEQ ID NO: 41281 - DNA, 20 bp, Artificial Sequence
  chemically synthesized
tgaaacaggaataacagaac

SEQ ID NO: 41282 - DNA, 20 bp, Artificial Sequence
  chemically synthesized
gaataacagaacaagattga

SEQ ID NO: 41283 - DNA, 20 bp, Artificial Sequence
  chemically synthesized
tacattttccgaaattactt

SEQ ID NO: 41284 - DNA, 20 bp, Artificial Sequence
  chemically synthesized
aattacttgagtattataca

SEQ ID NO: 41285 - DNA, 20 bp, Artificial Sequence
  chemically synthesized
cttgagtattatacaaagac

SEQ ID NO: 41286 - DNA, 20 bp, Artificial Sequence
  chemically synthesized
attatacaaagacaagcacg

SEQ ID NO: 41287 - DNA, 20 bp, Artificial Sequence
  chemically synthesized
caaagacaagcacgtggacc

SEQ ID NO: 41288 - DNA, 20 bp, Artificial Sequence
  chemically synthesized
aaagacaagcacgtggacct

SEQ ID NO: 41289 - DNA, 20 bp, Artificial Sequence
  chemically synthesized
agacaagcacgtggacctgg

SEQ ID NO: 41290 - DNA, 20 bp, Artificial Sequence
  chemically synthesized
gacaagcacgtggacctggg

SEQ ID NO: 41291 - DNA, 20 bp, Artificial Sequence
  chemically synthesized
caagcacgtggacctgggag

SEQ ID NO: 41292 - DNA, 20 bp, Artificial Sequence
  chemically synthesized
aagcacgtggacctgggagg

SEQ ID NO: 41293 - DNA, 20 bp, Artificial Sequence
  chemically synthesized
agcacgtggacctgggagga

SEQ ID NO: 41294 - DNA, 20 bp, Artificial Sequence
  chemically synthesized
ggagggttattgtccatgac

SEQ ID NO: 41295 - DNA, 20 bp, Artificial Sequence
  chemically synthesized
tattgtccatgactggtgtg

SEQ ID NO: 41296 - DNA, 20 bp, Artificial Sequence
  chemically synthesized
ttgtccatgactggtgtgtg

SEQ ID NO: 41297 - DNA, 20 bp, Artificial Sequence
  chemically synthesized
ctggtgtgtggagacaaatg

SEQ ID NO: 41298 - DNA, 20 bp, Artificial Sequence
  chemically synthesized
tggtgtgtggagacaaatgc

SEQ ID NO: 41299 - DNA, 20 bp, Artificial Sequence
  chemically synthesized
agacaaatgcaggtttataa

SEQ ID NO: 41300 - DNA, 20 bp, Artificial Sequence
  chemically synthesized
aaatgcaggtttataataga

SEQ ID NO: 41301 - DNA, 20 bp, Artificial Sequence
  chemically synthesized
aatgcaggtttataatagat

SEQ ID NO: 41302 - DNA, 20 bp, Artificial Sequence
  chemically synthesized
caggtttataatagatggga

SEQ ID NO: 41303 - DNA, 20 bp, Artificial Sequence
  chemically synthesized
ataatagatgggatggcatc

SEQ ID NO: 41304 - DNA, 20 bp, Artificial Sequence
  chemically synthesized
aatgactttgccatcacttt

SEQ ID NO: 41305 - DNA, 20 bp, Artificial Sequence
  chemically synthesized
tgactttgccatcactttta

SEQ ID NO: 41306 - DNA, 20 bp, Artificial Sequence
  chemically synthesized
actttgccatcacttttaga

SEQ ID NO: 41307 - DNA, 20 bp, Artificial Sequence
  chemically synthesized
catcacttttagagagctct

SEQ ID NO: 41308 - DNA, 20 bp, Artificial Sequence
  chemically synthesized
atcacttttagagagctctt

SEQ ID NO: 41309 - DNA, 20 bp, Artificial Sequence
  chemically synthesized
tcacttttagagagctcttg

SEQ ID NO: 41310 - DNA, 20 bp, Artificial Sequence
  chemically synthesized
tagagagctcttggggaccc

SEQ ID NO: 41311 - DNA, 20 bp, Artificial Sequence
  chemically synthesized
tcttggggaccccagtacac

SEQ ID NO: 41312 - DNA, 20 bp, Artificial Sequence
  chemically synthesized
ttggggaccccagtacacaa

SEQ ID NO: 41313 - DNA, 20 bp, Artificial Sequence
  chemically synthesized
tggggaccccagtacacaag

SEQ ID NO: 41314 - DNA, 20 bp, Artificial Sequence
  chemically synthesized
ggggaccccagtacacaaga

SEQ ID NO: 41315 - DNA, 20 bp, Artificial Sequence
  chemically synthesized
gggaccccagtacacaagag

SEQ ID NO: 41316 - DNA, 20 bp, Artificial Sequence
  chemically synthesized
ccagtacacaagaggggacg

SEQ ID NO: 41317 - DNA, 20 bp, Artificial Sequence
  chemically synthesized
cagtacacaagaggggacgc

SEQ ID NO: 41318 - DNA, 20 bp, Artificial Sequence
  chemically synthesized
agtacacaagaggggacgca

SEQ ID NO: 41319 - DNA, 20 bp, Artificial Sequence
  chemically synthesized
gaggggacgcagggtatatg

SEQ ID NO: 41320 - DNA, 20 bp, Artificial Sequence
  chemically synthesized
agacatctcattctttttct

SEQ ID NO: 41321 - DNA, 20 bp, Artificial Sequence
  chemically synthesized
ctcattctttttcttagtgt

SEQ ID NO: 41322 - DNA, 20 bp, Artificial Sequence
  chemically synthesized
ctttttcttagtgtgagaat

SEQ ID NO: 41323 - DNA, 20 bp, Artificial Sequence
  chemically synthesized
tcttagtgtgagaataagaa

SEQ ID NO: 41324 - DNA, 20 bp, Artificial Sequence
  chemically synthesized
aataagaatagccatgacct

SEQ ID NO: 41325 - DNA, 20 bp, Artificial Sequence
  chemically synthesized
atagccatgacctgagttta

SEQ ID NO: 41326 - DNA, 20 bp, Artificial Sequence
  chemically synthesized
gacctgagtttatagacaat

SEQ ID NO: 41327 - DNA, 20 bp, Artificial Sequence
  chemically synthesized
gcccttttctctctcccact

SEQ ID NO: 41328 - DNA, 20 bp, Artificial Sequence
  chemically synthesized
cttttctctctcccactcag

SEQ ID NO: 41329 - DNA, 20 bp, Artificial Sequence
  chemically synthesized
ctctcccactcagcagctat

SEQ ID NO: 41330 - DNA, 20 bp, Artificial Sequence
  chemically synthesized
cccactcagcagctatgaga

SEQ ID NO: 41331 - DNA, 20 bp, Artificial Sequence
  chemically synthesized
ggcttgccctgcctctctac

SEQ ID NO: 41332 - DNA, 20 bp, Artificial Sequence
  chemically synthesized
gcttgccctgcctctctact

SEQ ID NO: 41333 - DNA, 20 bp, Artificial Sequence
  chemically synthesized
ctactaggctgactcactcc

SEQ ID NO: 41334 - DNA, 20 bp, Artificial Sequence
  chemically synthesized
tactaggctgactcactcca

SEQ ID NO: 41335 - DNA, 20 bp, Artificial Sequence
  chemically synthesized
ggctgactcactccaaggcc

SEQ ID NO: 41336 - DNA, 20 bp, Artificial Sequence
  chemically synthesized
ctcactccaaggcccagcaa

SEQ ID NO: 41337 - DNA, 20 bp, Artificial Sequence
  chemically synthesized
tcactccaaggcccagcaat

SEQ ID NO: 41338 - DNA, 20 bp, Artificial Sequence
  chemically synthesized
ctccaaggcccagcaatggg

SEQ ID NO: 41339 - DNA, 20 bp, Artificial Sequence
  chemically synthesized
tccaaggcccagcaatgggc

SEQ ID NO: 41340 - DNA, 20 bp, Artificial Sequence
  chemically synthesized
ccaaggcccagcaatgggca

SEQ ID NO: 41341 - DNA, 20 bp, Artificial Sequence
  chemically synthesized
agcaatgggcagggctctgt

SEQ ID NO: 41342 - DNA, 20 bp, Artificial Sequence
  chemically synthesized
gcaatgggcagggctctgtc

SEQ ID NO: 41343 - DNA, 20 bp, Artificial Sequence
  chemically synthesized
caatgggcagggctctgtca

SEQ ID NO: 41344 - DNA, 20 bp, Artificial Sequence
  chemically synthesized
gggctctgtcagggctttga

SEQ ID NO: 41345 - DNA, 20 bp, Artificial Sequence
  chemically synthesized
ggctttgatagcactatctg

SEQ ID NO: 41346 - DNA, 20 bp, Artificial Sequence
  chemically synthesized
ctttgatagcactatctgca

SEQ ID NO: 41347 - DNA, 20 bp, Artificial Sequence
  chemically synthesized
gatagcactatctgcagagc

SEQ ID NO: 41348 - DNA, 20 bp, Artificial Sequence
  chemically synthesized
atagcactatctgcagagcc

SEQ ID NO: 41349 - DNA, 20 bp, Artificial Sequence
  chemically synthesized
tagcactatctgcagagcca

SEQ ID NO: 41350 - DNA, 20 bp, Artificial Sequence
  chemically synthesized
ctatctgcagagccagggcc

SEQ ID NO: 41351 - DNA, 20 bp, Artificial Sequence
  chemically synthesized
tctgcagagccagggccgag

SEQ ID NO: 41352 - DNA, 20 bp, Artificial Sequence
  chemically synthesized
ctgcagagccagggccgaga

SEQ ID NO: 41353 - DNA, 20 bp, Artificial Sequence
  chemically synthesized
tgcagagccagggccgagaa

SEQ ID NO: 41354 - DNA, 20 bp, Artificial Sequence
  chemically synthesized
gcagagccagggccgagaag

SEQ ID NO: 41355 - DNA, 20 bp, Artificial Sequence
  chemically synthesized
gagccagggccgagaagggg

SEQ ID NO: 41356 - DNA, 20 bp, Artificial Sequence
  chemically synthesized
ggccgagaaggggtggactc

SEQ ID NO: 41357 - DNA, 20 bp, Artificial Sequence
  chemically synthesized
ccgagaaggggtggactcca

SEQ ID NO: 41358 - DNA, 20 bp, Artificial Sequence
  chemically synthesized
agactctccctcccattccc

SEQ ID NO: 41359 - DNA, 20 bp, Artificial Sequence
  chemically synthesized
ctctccctcccattcccgag

SEQ ID NO: 41360 - DNA, 20 bp, Artificial Sequence
  chemically synthesized
tctccctcccattcccgagc

SEQ ID NO: 41361 - DNA, 20 bp, Artificial Sequence
  chemically synthesized
ctccctcccattcccgagca

SEQ ID NO: 41362 - DNA, 20 bp, Artificial Sequence
  chemically synthesized
aaatgatatatttattttaa

SEQ ID NO: 41363 - DNA, 20 bp, Artificial Sequence
  chemically synthesized
atttattttaaaagaaataa

SEQ ID NO: 41364 - DNA, 20 bp, Artificial Sequence
  chemically synthesized
tttattttaaaagaaataac

SEQ ID NO: 41365 - DNA, 20 bp, Artificial Sequence
  chemically synthesized
tattttaaaagaaataacag

SEQ ID NO: 41366 - DNA, 20 bp, Artificial Sequence
  chemically synthesized
agaaataacaggagactgcc

SEQ ID NO: 41367 - DNA, 20 bp, Artificial Sequence
  chemically synthesized
aacaggagactgcccagccc

SEQ ID NO: 41368 - DNA, 20 bp, Artificial Sequence
  chemically synthesized
gcccagccctggctgtgaca

SEQ ID NO: 41369 - DNA, 20 bp, Artificial Sequence
  chemically synthesized
gctgtgacatggaaactatg

SEQ ID NO: 41370 - DNA, 20 bp, Artificial Sequence
  chemically synthesized
ggaaactatgtagaatattt

SEQ ID NO: 41371 - DNA, 20 bp, Artificial Sequence
  chemically synthesized
gaaactatgtagaatatttt

SEQ ID NO: 41372 - DNA, 20 bp, Artificial Sequence
  chemically synthesized
ccatttttttttccttcttt

SEQ ID NO: 41373 - DNA, 20 bp, Artificial Sequence
  chemically synthesized
ttttttttccttctttcagt

SEQ ID NO: 41374 - DNA, 20 bp, Artificial Sequence
  chemically synthesized
ttttttccttctttcagtta

SEQ ID NO: 41375 - DNA, 20 bp, Artificial Sequence
  chemically synthesized
tttttccttctttcagttag

SEQ ID NO: 41376 - DNA, 20 bp, Artificial Sequence
  chemically synthesized
ccttctttcagttagaggaa

SEQ ID NO: 41377 - DNA, 20 bp, Artificial Sequence
  chemically synthesized
cttctttcagttagaggaaa

SEQ ID NO: 41378 - DNA, 20 bp, Artificial Sequence
  chemically synthesized
ttctttcagttagaggaaaa

SEQ ID NO: 41379 - DNA, 20 bp, Artificial Sequence
  chemically synthesized
tctttcagttagaggaaaag

SEQ ID NO: 41380 - DNA, 20 bp, Artificial Sequence
  chemically synthesized
ggggctcactgcacatacac

SEQ ID NO: 41381 - DNA, 20 bp, Artificial Sequence
  chemically synthesized
ctcactgcacatacactaga

SEQ ID NO: 41382 - DNA, 20 bp, Artificial Sequence
  chemically synthesized
ctgcacatacactagacaga

SEQ ID NO: 41383 - DNA, 20 bp, Artificial Sequence
  chemically synthesized
acatacactagacagaaagt

SEQ ID NO: 41384 - DNA, 20 bp, Artificial Sequence
  chemically synthesized
catacactagacagaaagtc

SEQ ID NO: 41385 - DNA, 20 bp, Artificial Sequence
  chemically synthesized
tacactagacagaaagtcag

SEQ ID NO: 41386 - DNA, 20 bp, Artificial Sequence
  chemically synthesized
aagtcaggagctttgaatcc

SEQ ID NO: 41387 - DNA, 20 bp, Artificial Sequence
  chemically synthesized
gatcatttccatgtcatact

SEQ ID NO: 41388 - DNA, 20 bp, Artificial Sequence
  chemically synthesized
atttccatgtcatactgaga

SEQ ID NO: 41389 - DNA, 20 bp, Artificial Sequence
  chemically synthesized
gaaagtccccacccttctct

SEQ ID NO: 41390 - DNA, 20 bp, Artificial Sequence
  chemically synthesized
ccccacccttctctgagcct

SEQ ID NO: 41391 - DNA, 20 bp, Artificial Sequence
  chemically synthesized
gcctcagtttctctttttat

SEQ ID NO: 41392 - DNA, 20 bp, Artificial Sequence
  chemically synthesized
tcagtttctctttttataag

SEQ ID NO: 41393 - DNA, 20 bp, Artificial Sequence
  chemically synthesized
cagtttctctttttataagt

SEQ ID NO: 41394 - DNA, 20 bp, Artificial Sequence
  chemically synthesized
gtttctctttttataagtag

SEQ ID NO: 41395 - DNA, 20 bp, Artificial Sequence
  chemically synthesized
tctttttataagtaggagtc

SEQ ID NO: 41396 - DNA, 20 bp, Artificial Sequence
  chemically synthesized
tttttataagtaggagtctg

SEQ ID NO: 41397 - DNA, 20 bp, Artificial Sequence
  chemically synthesized
ctggagtaaatgatttccaa

SEQ ID NO: 41398 - DNA, 20 bp, Artificial Sequence
  chemically synthesized
tttccgtttattaaatgcat

SEQ ID NO: 41399 - DNA, 20 bp, Artificial Sequence
  chemically synthesized
gcatgagcttctgttactcc

SEQ ID NO: 41400 - DNA, 20 bp, Artificial Sequence
  chemically synthesized
gcttctgttactccaagact

SEQ ID NO: 41401 - DNA, 20 bp, Artificial Sequence
  chemically synthesized
tctgttactccaagactgag

SEQ ID NO: 41402 - DNA, 20 bp, Artificial Sequence
  chemically synthesized
ctgttactccaagactgaga

SEQ ID NO: 41403 - DNA, 20 bp, Artificial Sequence
  chemically synthesized
ctgagaaggaaattgaacct

SEQ ID NO: 41404 - DNA, 20 bp, Artificial Sequence
  chemically synthesized
tgaacctgagactcattgac

SEQ ID NO: 41405 - DNA, 20 bp, Artificial Sequence
  chemically synthesized
cctgagactcattgactggc

SEQ ID NO: 41406 - DNA, 20 bp, Artificial Sequence
  chemically synthesized
attgactggcaagatgtccc

SEQ ID NO: 41407 - DNA, 20 bp, Artificial Sequence
  chemically synthesized
tgactggcaagatgtcccca

SEQ ID NO: 41408 - DNA, 20 bp, Artificial Sequence
  chemically synthesized
gactggcaagatgtccccag

SEQ ID NO: 41409 - DNA, 20 bp, Artificial Sequence
  chemically synthesized
tgtccccagaggctctcatt

SEQ ID NO: 41410 - DNA, 20 bp, Artificial Sequence
  chemically synthesized
ataaaattctcaccttcacc

SEQ ID NO: 41411 - DNA, 20 bp, Artificial Sequence
  chemically synthesized
taaaattctcaccttcaccc

SEQ ID NO: 41412 - DNA, 20 bp, Artificial Sequence
  chemically synthesized
caccttcacccaggcccact

SEQ ID NO: 41413 - DNA, 20 bp, Artificial Sequence
  chemically synthesized
cacccaggcccactgagtgt

SEQ ID NO: 41414 - DNA, 20 bp, Artificial Sequence
  chemically synthesized
agtgtcagatttgcatgcac

SEQ ID NO: 41415 - DNA, 20 bp, Artificial Sequence
  chemically synthesized
cactagttcacgtgtgtaaa

SEQ ID NO: 41416 - DNA, 20 bp, Artificial Sequence
  chemically synthesized
actagttcacgtgtgtaaaa

SEQ ID NO: 41417 - DNA, 20 bp, Artificial Sequence
  chemically synthesized
tagttcacgtgtgtaaaaag

SEQ ID NO: 41418 - DNA, 20 bp, Artificial Sequence
  chemically synthesized
agttcacgtgtgtaaaaagg

SEQ ID NO: 41419 - DNA, 20 bp, Artificial Sequence
  chemically synthesized
tttgtattctcacatacctt

SEQ ID NO: 41420 - DNA, 20 bp, Artificial Sequence
  chemically synthesized
ttgtattctcacataccttt

SEQ ID NO: 41421 - DNA, 20 bp, Artificial Sequence
  chemically synthesized
attctcacatacctttagga

SEQ ID NO: 41422 - DNA, 20 bp, Artificial Sequence
  chemically synthesized
catacctttaggaaagaact

SEQ ID NO: 41423 - DNA, 20 bp, Artificial Sequence
  chemically synthesized
aacttagcacccttcccaca

SEQ ID NO: 41424 - DNA, 20 bp, Artificial Sequence
  chemically synthesized
gccatcccaataactcattt

SEQ ID NO: 41425 - DNA, 20 bp, Artificial Sequence
  chemically synthesized
ctcaacccttgactttataa

SEQ ID NO: 41426 - DNA, 20 bp, Artificial Sequence
  chemically synthesized
ccttgactttataaaagtct

SEQ ID NO: 41427 - DNA, 20 bp, Artificial Sequence
  chemically synthesized
cttgactttataaaagtctt

SEQ ID NO: 41428 - DNA, 20 bp, Artificial Sequence
  chemically synthesized
gactttataaaagtcttggg

SEQ ID NO: 41429 - DNA, 20 bp, Artificial Sequence
  chemically synthesized
tataaaagtcttgggcagta

SEQ ID NO: 41430 - DNA, 20 bp, Artificial Sequence
  chemically synthesized
taaaagtcttgggcagtata

SEQ ID NO: 41431 - DNA, 20 bp, Artificial Sequence
  chemically synthesized
aagtcttgggcagtatagag

SEQ ID NO: 41432 - DNA, 20 bp, Artificial Sequence
  chemically synthesized
gtcttgggcagtatagagca

SEQ ID NO: 41433 - DNA, 20 bp, Artificial Sequence
  chemically synthesized
ggcagtatagagcagagatt

SEQ ID NO: 41434 - DNA, 20 bp, Artificial Sequence
  chemically synthesized
cagtatagagcagagattaa

SEQ ID NO: 41435 - DNA, 20 bp, Artificial Sequence
  chemically synthesized
tagagcagagattaagagta

SEQ ID NO: 41436 - DNA, 20 bp, Artificial Sequence
  chemically synthesized
gagattaagagtacagatgc

SEQ ID NO: 41437 - DNA, 20 bp, Artificial Sequence
  chemically synthesized
gattaagagtacagatgctg

SEQ ID NO: 41438 - DNA, 20 bp, Artificial Sequence
  chemically synthesized
aagagtacagatgctggagc

SEQ ID NO: 41439 - DNA, 20 bp, Artificial Sequence
  chemically synthesized
atgctggagccagaccacct

SEQ ID NO: 41440 - DNA, 20 bp, Artificial Sequence
  chemically synthesized
agccagaccacctgagtgat

SEQ ID NO: 41441 - DNA, 20 bp, Artificial Sequence
  chemically synthesized
cacctgagtgattagtgact

SEQ ID NO: 41442 - DNA, 20 bp, Artificial Sequence
  chemically synthesized
attagtgactcagtttctct

SEQ ID NO: 41443 - DNA, 20 bp, Artificial Sequence
  chemically synthesized
agtgactcagtttctcttag

SEQ ID NO: 41444 - DNA, 20 bp, Artificial Sequence
  chemically synthesized
ctcttagtagttgtatgact

SEQ ID NO: 41445 - DNA, 20 bp, Artificial Sequence
  chemically synthesized
cagtttcttcatctgtaaaa

SEQ ID NO: 41446 - DNA, 20 bp, Artificial Sequence
  chemically synthesized
gtttcttcatctgtaaaatg

SEQ ID NO: 41447 - DNA, 20 bp, Artificial Sequence
  chemically synthesized
tttcttcatctgtaaaatgg

SEQ ID NO: 41448 - DNA, 20 bp, Artificial Sequence
  chemically synthesized
ttcttcatctgtaaaatgga

SEQ ID NO: 41449 - DNA, 20 bp, Artificial Sequence
  chemically synthesized
aaaatggagggttttttaat

SEQ ID NO: 41450 - DNA, 20 bp, Artificial Sequence
  chemically synthesized
tttttaattagtttgttttt

SEQ ID NO: 41451 - DNA, 20 bp, Artificial Sequence
  chemically synthesized
taattagtttgtttttgaga

SEQ ID NO: 41452 - DNA, 20 bp, Artificial Sequence
  chemically synthesized
aattagtttgtttttgagaa

SEQ ID NO: 41453 - DNA, 20 bp, Artificial Sequence
  chemically synthesized
attagtttgtttttgagaaa

SEQ ID NO: 41454 - DNA, 20 bp, Artificial Sequence
  chemically synthesized
gtctcactctgtcacccaaa

SEQ ID NO: 41455 - DNA, 20 bp, Artificial Sequence
  chemically synthesized
tctcactctgtcacccaaat

SEQ ID NO: 41456 - DNA, 20 bp, Artificial Sequence
  chemically synthesized
tcactctgtcacccaaatgg

SEQ ID NO: 41457 - DNA, 20 bp, Artificial Sequence
  chemically synthesized
ctgtcacccaaatgggagtg

SEQ ID NO: 41458 - DNA, 20 bp, Artificial Sequence
  chemically synthesized
tcacccaaatgggagtgtag

SEQ ID NO: 41459 - DNA, 20 bp, Artificial Sequence
  chemically synthesized
ggagtgtagtggcaaaatct

SEQ ID NO: 41460 - DNA, 20 bp, Artificial Sequence
  chemically synthesized
tcactgcaacttgcacttcc

SEQ ID NO: 41461 - DNA, 20 bp, Artificial Sequence
  chemically synthesized
cactgcaacttgcacttccc

SEQ ID NO: 41462 - DNA, 20 bp, Artificial Sequence
  chemically synthesized
aacttgcacttcccaggctc

SEQ ID NO: 41463 - DNA, 20 bp, Artificial Sequence
  chemically synthesized
ttgcacttcccaggctcaag

SEQ ID NO: 41464 - DNA, 20 bp, Artificial Sequence
  chemically synthesized
tcctcccacctcaacatcct

SEQ ID NO: 41465 - DNA, 20 bp, Artificial Sequence
  chemically synthesized
tcccacctcaacatcctgag

SEQ ID NO: 41466 - DNA, 20 bp, Artificial Sequence
  chemically synthesized
acctcaacatcctgagtagc

SEQ ID NO: 41467 - DNA, 20 bp, Artificial Sequence
  chemically synthesized
atcctgagtagctggaacca

SEQ ID NO: 41468 - DNA, 20 bp, Artificial Sequence
  chemically synthesized
tcctgagtagctggaaccac

SEQ ID NO: 41469 - DNA, 20 bp, Artificial Sequence
  chemically synthesized
tcgctaattttttgtatttt

SEQ ID NO: 41470 - DNA, 20 bp, Artificial Sequence
  chemically synthesized
ctaattttttgtatttttgg

SEQ ID NO: 41471 - DNA, 20 bp, Artificial Sequence
  chemically synthesized
aattttttgtatttttggta

SEQ ID NO: 41472 - DNA, 20 bp, Artificial Sequence
  chemically synthesized
ttttgtatttttggtagaga

SEQ ID NO: 41473 - DNA, 20 bp, Artificial Sequence
  chemically synthesized
tttgtatttttggtagagat

SEQ ID NO: 41474 - DNA, 20 bp, Artificial Sequence
  chemically synthesized
ttgtatttttggtagagatg

SEQ ID NO: 41475 - DNA, 20 bp, Artificial Sequence
  chemically synthesized
atggggtttcacatgttaca

SEQ ID NO: 41476 - DNA, 20 bp, Artificial Sequence
  chemically synthesized
tggggtttcacatgttacac

SEQ ID NO: 41477 - DNA, 20 bp, Artificial Sequence
  chemically synthesized
gtttcacatgttacacagga

SEQ ID NO: 41478 - DNA, 20 bp, Artificial Sequence
  chemically synthesized
catgttacacaggatggtct

SEQ ID NO: 41479 - DNA, 20 bp, Artificial Sequence
  chemically synthesized
cacaggatggtctcagactc

SEQ ID NO: 41480 - DNA, 20 bp, Artificial Sequence
  chemically synthesized
caggatggtctcagactccg

SEQ ID NO: 41481 - DNA, 20 bp, Artificial Sequence
  chemically synthesized
ggtctcagactccggagctc

SEQ ID NO: 41482 - DNA, 20 bp, Artificial Sequence
  chemically synthesized
ctcaagcaatctgcccacct

SEQ ID NO: 41483 - DNA, 20 bp, Artificial Sequence
  chemically synthesized
ctgcccacctcagccttcca

SEQ ID NO: 41484 - DNA, 20 bp, Artificial Sequence
  chemically synthesized
acctcagccttccaaagtgc

SEQ ID NO: 41485 - DNA, 20 bp, Artificial Sequence
  chemically synthesized
cctcagccttccaaagtgct

SEQ ID NO: 41486 - DNA, 20 bp, Artificial Sequence
  chemically synthesized
ttccaaagtgctgggattat

SEQ ID NO: 41487 - DNA, 20 bp, Artificial Sequence
  chemically synthesized
tgggattataagcatgatta

SEQ ID NO: 41488 - DNA, 20 bp, Artificial Sequence
  chemically synthesized
gggattataagcatgattac

SEQ ID NO: 41489 - DNA, 20 bp, Artificial Sequence
  chemically synthesized
gattataagcatgattacag

SEQ ID NO: 41490 - DNA, 20 bp, Artificial Sequence
  chemically synthesized
catgattacaggagttttaa

SEQ ID NO: 41491 - DNA, 20 bp, Artificial Sequence
  chemically synthesized
atgattacaggagttttaac

SEQ ID NO: 41492 - DNA, 20 bp, Artificial Sequence
  chemically synthesized
aggagttttaacaggctcat

SEQ ID NO: 41493 - DNA, 20 bp, Artificial Sequence
  chemically synthesized
aggctcataagattgttctg

SEQ ID NO: 41494 - DNA, 20 bp, Artificial Sequence
  chemically synthesized
ataagattgttctgcagccc

SEQ ID NO: 41495 - DNA, 20 bp, Artificial Sequence
  chemically synthesized
gattgttctgcagcccgagt

SEQ ID NO: 41496 - DNA, 20 bp, Artificial Sequence
  chemically synthesized
cgagtgagttaatacatgca

SEQ ID NO: 41497 - DNA, 20 bp, Artificial Sequence
  chemically synthesized
agtgagttaatacatgcaaa

SEQ ID NO: 41498 - DNA, 20 bp, Artificial Sequence
  chemically synthesized
taatacatgcaaagagttta

SEQ ID NO: 41499 - DNA, 20 bp, Artificial Sequence
  chemically synthesized
tacatgcaaagagtttaaag

SEQ ID NO: 41500 - DNA, 20 bp, Artificial Sequence
  chemically synthesized
cttataaatgctaactactc

SEQ ID NO: 41501 - DNA, 20 bp, Artificial Sequence
  chemically synthesized
actactctagaaatgtttgc

SEQ ID NO: 41502 - DNA, 20 bp, Artificial Sequence
  chemically synthesized
aactgcaatcattcttgctg

SEQ ID NO: 41503 - DNA, 20 bp, Artificial Sequence
  chemically synthesized
actgcaatcattcttgctgc

SEQ ID NO: 41504 - DNA, 20 bp, Artificial Sequence
  chemically synthesized
ttcttgctgcaggtgaaaac

SEQ ID NO: 41505 - DNA, 20 bp, Artificial Sequence
  chemically synthesized
aaaataactgacatttattg

SEQ ID NO: 41506 - DNA, 20 bp, Artificial Sequence
  chemically synthesized
aaataactgacatttattga

SEQ ID NO: 41507 - DNA, 20 bp, Artificial Sequence
  chemically synthesized
tgacatttattgaaggctat

SEQ ID NO: 41508 - DNA, 20 bp, Artificial Sequence
  chemically synthesized
acatttattgaaggctatca

SEQ ID NO: 41509 - DNA, 20 bp, Artificial Sequence
  chemically synthesized
aggctatcagagactgtaat

SEQ ID NO: 41510 - DNA, 20 bp, Artificial Sequence
  chemically synthesized
ttaatcatatttaatactct

SEQ ID NO: 41511 - DNA, 20 bp, Artificial Sequence
  chemically synthesized
ttaatactcttggattcttt

SEQ ID NO: 41512 - DNA, 20 bp, Artificial Sequence
  chemically synthesized
taatactcttggattctttc

SEQ ID NO: 41513 - DNA, 20 bp, Artificial Sequence
  chemically synthesized
tactcttggattctttcagg

SEQ ID NO: 41514 - DNA, 20 bp, Artificial Sequence
  chemically synthesized
ttattatccccattttacta

SEQ ID NO: 41515 - DNA, 20 bp, Artificial Sequence
  chemically synthesized
aactacctctcaacttgctc

SEQ ID NO: 41516 - DNA, 20 bp, Artificial Sequence
  chemically synthesized
cacacacaaacataaactac

SEQ ID NO: 41517 - DNA, 20 bp, Artificial Sequence
  chemically synthesized
aaacataaactactagcaaa

SEQ ID NO: 41518 - DNA, 20 bp, Artificial Sequence
  chemically synthesized
cataaactactagcaaatag

SEQ ID NO: 41519 - DNA, 20 bp, Artificial Sequence
  chemically synthesized
tactagcaaatagtagaatt

SEQ ID NO: 41520 - DNA, 20 bp, Artificial Sequence
  chemically synthesized
caaatagtagaattgagatt

SEQ ID NO: 41521 - DNA, 20 bp, Artificial Sequence
  chemically synthesized
atttattgacatgtacttct

SEQ ID NO: 41522 - DNA, 20 bp, Artificial Sequence
  chemically synthesized
tattgacatgtacttcttgg

SEQ ID NO: 41523 - DNA, 20 bp, Artificial Sequence
  chemically synthesized
cttcttggcagtctgtatgc

SEQ ID NO: 41524 - DNA, 20 bp, Artificial Sequence
  chemically synthesized
gcagtctgtatgctggatgc

SEQ ID NO: 41525 - DNA, 20 bp, Artificial Sequence
  chemically synthesized
cagtctgtatgctggatgct

SEQ ID NO: 41526 - DNA, 20 bp, Artificial Sequence
  chemically synthesized
agtctgtatgctggatgctg

SEQ ID NO: 41527 - DNA, 20 bp, Artificial Sequence
  chemically synthesized
tgctggatgctggggataca

SEQ ID NO: 41528 - DNA, 20 bp, Artificial Sequence
  chemically synthesized
atacaaagatgtttaaattt

SEQ ID NO: 41529 - DNA, 20 bp, Artificial Sequence
  chemically synthesized
agatgtttaaatttaagctc

SEQ ID NO: 41530 - DNA, 20 bp, Artificial Sequence
  chemically synthesized
agctccagtctctgcttcca

SEQ ID NO: 41531 - DNA, 20 bp, Artificial Sequence
  chemically synthesized
gctccagtctctgcttccaa

SEQ ID NO: 41532 - DNA, 20 bp, Artificial Sequence
  chemically synthesized
ctctgcttccaaaggcctcc

SEQ ID NO: 41533 - DNA, 20 bp, Artificial Sequence
  chemically synthesized
tctgcttccaaaggcctccc

SEQ ID NO: 41534 - DNA, 20 bp, Artificial Sequence
  chemically synthesized
ttccaaaggcctcccaggcc

SEQ ID NO: 41535 - DNA, 20 bp, Artificial Sequence
  chemically synthesized
cccaggccaagttatccatt

SEQ ID NO: 41536 - DNA, 20 bp, Artificial Sequence
  chemically synthesized
ggccaagttatccattcaga

SEQ ID NO: 41537 - DNA, 20 bp, Artificial Sequence
  chemically synthesized
tgcattccactgtttttcct

SEQ ID NO: 41538 - DNA, 20 bp, Artificial Sequence
  chemically synthesized
tattcgtctgtgtcctgctc

SEQ ID NO: 41539 - DNA, 20 bp, Artificial Sequence
  chemically synthesized
attcgtctgtgtcctgctct

SEQ ID NO: 41540 - DNA, 20 bp, Artificial Sequence
  chemically synthesized
tgtgtcctgctctgggatga

SEQ ID NO: 41541 - DNA, 20 bp, Artificial Sequence
  chemically synthesized
tagtctgactttcctaacct

SEQ ID NO: 41542 - DNA, 20 bp, Artificial Sequence
  chemically synthesized
gagcctaacatccctgacat

SEQ ID NO: 41543 - DNA, 20 bp, Artificial Sequence
  chemically synthesized
agcctaacatccctgacatc

SEQ ID NO: 41544 - DNA, 20 bp, Artificial Sequence
  chemically synthesized
taacatccctgacatcagga

SEQ ID NO: 41545 - DNA, 20 bp, Artificial Sequence
  chemically synthesized
tcaggaaagactacaccatg

SEQ ID NO: 41546 - DNA, 20 bp, Artificial Sequence
  chemically synthesized
aggaaagactacaccatgtg

SEQ ID NO: 41547 - DNA, 20 bp, Artificial Sequence
  chemically synthesized
aaagactacaccatgtggag

SEQ ID NO: 41548 - DNA, 20 bp, Artificial Sequence
  chemically synthesized
aagactacaccatgtggaga

SEQ ID NO: 41549 - DNA, 20 bp, Artificial Sequence
  chemically synthesized
agactacaccatgtggagaa

SEQ ID NO: 41550 - DNA, 20 bp, Artificial Sequence
  chemically synthesized
gactacaccatgtggagaag

SEQ ID NO: 41551 - DNA, 20 bp, Artificial Sequence
  chemically synthesized
tacaccatgtggagaagggg

SEQ ID NO: 41552 - DNA, 20 bp, Artificial Sequence
  chemically synthesized
accatgtggagaaggggtgg

SEQ ID NO: 41553 - DNA, 20 bp, Artificial Sequence
  chemically synthesized
gttttgattgctgctgtctt

SEQ ID NO: 41554 - DNA, 20 bp, Artificial Sequence
  chemically synthesized
tgattgctgctgtcttcagt

SEQ ID NO: 41555 - DNA, 20 bp, Artificial Sequence
  chemically synthesized
tgctgctgtcttcagttaga

SEQ ID NO: 41556 - DNA, 20 bp, Artificial Sequence
  chemically synthesized
gttagatggttaactttgtg

SEQ ID NO: 41557 - DNA, 20 bp, Artificial Sequence
  chemically synthesized
ctttgtgaagttgaaaactg

SEQ ID NO: 41558 - DNA, 20 bp, Artificial Sequence
  chemically synthesized
agttgaaaactgtggctctc

SEQ ID NO: 41559 - DNA, 20 bp, Artificial Sequence
  chemically synthesized
gtggctctctggttgactgt

SEQ ID NO: 41560 - DNA, 20 bp, Artificial Sequence
  chemically synthesized
ggctctctggttgactgtta

SEQ ID NO: 41561 - DNA, 20 bp, Artificial Sequence
  chemically synthesized
ctggttgactgttagagttc

SEQ ID NO: 41562 - DNA, 20 bp, Artificial Sequence
  chemically synthesized
taacaaatgcatgaatgctt

SEQ ID NO: 41563 - DNA, 20 bp, Artificial Sequence
  chemically synthesized
tgcatgaatgcttcagaata

SEQ ID NO: 41564 - DNA, 20 bp, Artificial Sequence
  chemically synthesized
gcatgaatgcttcagaatat

SEQ ID NO: 41565 - DNA, 20 bp, Artificial Sequence
  chemically synthesized
aatatgggaatattatcttc

SEQ ID NO: 41566 - DNA, 20 bp, Artificial Sequence
  chemically synthesized
gggaatattatcttctggaa

SEQ ID NO: 41567 - DNA, 20 bp, Artificial Sequence
  chemically synthesized
ggaatattatcttctggaat

SEQ ID NO: 41568 - DNA, 20 bp, Artificial Sequence
  chemically synthesized
gaatattatcttctggaata

SEQ ID NO: 41569 - DNA, 20 bp, Artificial Sequence
  chemically synthesized
atcttctggaatagggaatc

SEQ ID NO: 41570 - DNA, 20 bp, Artificial Sequence
  chemically synthesized
tcaagttatattatgtaacc

SEQ ID NO: 41571 - DNA, 20 bp, Artificial Sequence
  chemically synthesized
caagttatattatgtaaccc

SEQ ID NO: 41572 - DNA, 20 bp, Artificial Sequence
  chemically synthesized
tatattatgtaacccaggat

SEQ ID NO: 41573 - DNA, 20 bp, Artificial Sequence
  chemically synthesized
attatgtaacccaggattag

SEQ ID NO: 41574 - DNA, 20 bp, Artificial Sequence
  chemically synthesized
tagaagattcttctgtgtgt

SEQ ID NO: 41575 - DNA, 20 bp, Artificial Sequence
  chemically synthesized
gtaagaatttcataaacatt

SEQ ID NO: 41576 - DNA, 20 bp, Artificial Sequence
  chemically synthesized
ttcataaacattaagctgtc

SEQ ID NO: 41577 - DNA, 20 bp, Artificial Sequence
  chemically synthesized
aacattaagctgtctagcaa

SEQ ID NO: 41578 - DNA, 20 bp, Artificial Sequence
  chemically synthesized
ttaagctgtctagcaaaagc

SEQ ID NO: 41579 - DNA, 20 bp, Artificial Sequence
  chemically synthesized
taagctgtctagcaaaagca

SEQ ID NO: 41580 - DNA, 20 bp, Artificial Sequence
  chemically synthesized
aagctgtctagcaaaagcaa

SEQ ID NO: 41581 - DNA, 20 bp, Artificial Sequence
  chemically synthesized
gtctagcaaaagcaagggct

SEQ ID NO: 41582 - DNA, 20 bp, Artificial Sequence
  chemically synthesized
caagggcttggaaaatctgt

SEQ ID NO: 41583 - DNA, 20 bp, Artificial Sequence
  chemically synthesized
tctgtgagctcctcaccata

SEQ ID NO: 41584 - DNA, 20 bp, Artificial Sequence
  chemically synthesized
tgagctcctcaccatataga

SEQ ID NO: 41585 - DNA, 20 bp, Artificial Sequence
  chemically synthesized
catcattgaataaatcccta

SEQ ID NO: 41586 - DNA, 20 bp, Artificial Sequence
  chemically synthesized
atcattgaataaatccctat

SEQ ID NO: 41587 - DNA, 20 bp, Artificial Sequence
  chemically synthesized
tcattgaataaatccctata

SEQ ID NO: 41588 - DNA, 20 bp, Artificial Sequence
  chemically synthesized
cattgaataaatccctatag

SEQ ID NO: 41589 - DNA, 20 bp, Artificial Sequence
  chemically synthesized
ctataggggatttctaccct

SEQ ID NO: 41590 - DNA, 20 bp, Artificial Sequence
  chemically synthesized
gggatttctaccctgagcaa

SEQ ID NO: 41591 - DNA, 20 bp, Artificial Sequence
  chemically synthesized
ggatttctaccctgagcaaa

SEQ ID NO: 41592 - DNA, 20 bp, Artificial Sequence
  chemically synthesized
ttctaccctgagcaaaaggc

SEQ ID NO: 41593 - DNA, 20 bp, Artificial Sequence
  chemically synthesized
gattaattcccaaactcata

SEQ ID NO: 41594 - DNA, 20 bp, Artificial Sequence
  chemically synthesized
tcccaaactcatatagctct

SEQ ID NO: 41595 - DNA, 20 bp, Artificial Sequence
  chemically synthesized
aaactcatatagctctgaga

SEQ ID NO: 41596 - DNA, 20 bp, Artificial Sequence
  chemically synthesized
catatgcacaacaataaatg

SEQ ID NO: 41597 - DNA, 20 bp, Artificial Sequence
  chemically synthesized
atatgcacaacaataaatgc

SEQ ID NO: 41598 - DNA, 20 bp, Artificial Sequence
  chemically synthesized
cacaacaataaatgcaggcc

SEQ ID NO: 41599 - DNA, 20 bp, Artificial Sequence
  chemically synthesized
acaacaataaatgcaggcct

SEQ ID NO: 41600 - DNA, 20 bp, Artificial Sequence
  chemically synthesized
tgcaggcctaggcatgactg

SEQ ID NO: 41601 - DNA, 20 bp, Artificial Sequence
  chemically synthesized
gcaggcctaggcatgactga

SEQ ID NO: 41602 - DNA, 20 bp, Artificial Sequence
  chemically synthesized
gaaggctctctcataattct

SEQ ID NO: 41603 - DNA, 20 bp, Artificial Sequence
  chemically synthesized
taattcttggttgcatgaat

SEQ ID NO: 41604 - DNA, 20 bp, Artificial Sequence
  chemically synthesized
tgcatgaatcagattatcaa

SEQ ID NO: 41605 - DNA, 20 bp, Artificial Sequence
  chemically synthesized
agattatcaacagaaatgtt

SEQ ID NO: 41606 - DNA, 20 bp, Artificial Sequence
  chemically synthesized
agaaatgttgagacaaacta

SEQ ID NO: 41607 - DNA, 20 bp, Artificial Sequence
  chemically synthesized
gaaatgttgagacaaactat

SEQ ID NO: 41608 - DNA, 20 bp, Artificial Sequence
  chemically synthesized
aaatgttgagacaaactatg

SEQ ID NO: 41609 - DNA, 20 bp, Artificial Sequence
  chemically synthesized
tgttgagacaaactatgggg

SEQ ID NO: 41610 - DNA, 20 bp, Artificial Sequence
  chemically synthesized
tgagacaaactatggggaag

SEQ ID NO: 41611 - DNA, 20 bp, Artificial Sequence
  chemically synthesized
gagacaaactatggggaagc

SEQ ID NO: 41612 - DNA, 20 bp, Artificial Sequence
  chemically synthesized
agacaaactatggggaagca

SEQ ID NO: 41613 - DNA, 20 bp, Artificial Sequence
  chemically synthesized
tatggggaagcagggtatga

SEQ ID NO: 41614 - DNA, 20 bp, Artificial Sequence
  chemically synthesized
tggggaagcagggtatgaaa

SEQ ID NO: 41615 - DNA, 20 bp, Artificial Sequence
  chemically synthesized
tgaaagagctctgaatgaaa

SEQ ID NO: 41616 - DNA, 20 bp, Artificial Sequence
  chemically synthesized
cgcaatgcttcctgcccatt

SEQ ID NO: 41617 - DNA, 20 bp, Artificial Sequence
  chemically synthesized
gcaatgcttcctgcccattc

SEQ ID NO: 41618 - DNA, 20 bp, Artificial Sequence
  chemically synthesized
caatgcttcctgcccattca

SEQ ID NO: 41619 - DNA, 20 bp, Artificial Sequence
  chemically synthesized
ttcctgcccattcagggctc

SEQ ID NO: 41620 - DNA, 20 bp, Artificial Sequence
  chemically synthesized
ccattcagggctccagcatg

SEQ ID NO: 41621 - DNA, 20 bp, Artificial Sequence
  chemically synthesized
ggctccagcatgtagaaatc

SEQ ID NO: 41622 - DNA, 20 bp, Artificial Sequence
  chemically synthesized
gctccagcatgtagaaatct

SEQ ID NO: 41623 - DNA, 20 bp, Artificial Sequence
  chemically synthesized
ctccagcatgtagaaatctg

SEQ ID NO: 41624 - DNA, 20 bp, Artificial Sequence
  chemically synthesized
tagaaatctggggctttgtg

SEQ ID NO: 41625 - DNA, 20 bp, Artificial Sequence
  chemically synthesized
atctggggctttgtgaagac

SEQ ID NO: 41626 - DNA, 20 bp, Artificial Sequence
  chemically synthesized
tgtgaagactggcttaaaat

SEQ ID NO: 41627 - DNA, 20 bp, Artificial Sequence
  chemically synthesized
gaagactggcttaaaatcag

SEQ ID NO: 41628 - DNA, 20 bp, Artificial Sequence
  chemically synthesized
cttaaaatcagaagccccat

SEQ ID NO: 41629 - DNA, 20 bp, Artificial Sequence
  chemically synthesized
aatcagaagccccattggat

SEQ ID NO: 41630 - DNA, 20 bp, Artificial Sequence
  chemically synthesized
tcagaagccccattggataa

SEQ ID NO: 41631 - DNA, 20 bp, Artificial Sequence
  chemically synthesized
gaagccccattggataagag

SEQ ID NO: 41632 - DNA, 20 bp, Artificial Sequence
  chemically synthesized
aagccccattggataagagt

SEQ ID NO: 41633 - DNA, 20 bp, Artificial Sequence
  chemically synthesized
agccccattggataagagta

SEQ ID NO: 41634 - DNA, 20 bp, Artificial Sequence
  chemically synthesized
cccattggataagagtaggg

SEQ ID NO: 41635 - DNA, 20 bp, Artificial Sequence
  chemically synthesized
gataagagtagggaagaacc

SEQ ID NO: 41636 - DNA, 20 bp, Artificial Sequence
  chemically synthesized
taagagtagggaagaaccta

SEQ ID NO: 41637 - DNA, 20 bp, Artificial Sequence
  chemically synthesized
aagaacctagagcctacgct

SEQ ID NO: 41638 - DNA, 20 bp, Artificial Sequence
  chemically synthesized
aacctagagcctacgctgag

SEQ ID NO: 41639 - DNA, 20 bp, Artificial Sequence
  chemically synthesized
acctagagcctacgctgagc

SEQ ID NO: 41640 - DNA, 20 bp, Artificial Sequence
  chemically synthesized
agcaggtttccttcatgtga

SEQ ID NO: 41641 - DNA, 20 bp, Artificial Sequence
  chemically synthesized
gcaggtttccttcatgtgac

SEQ ID NO: 41642 - DNA, 20 bp, Artificial Sequence
  chemically synthesized
caggtttccttcatgtgaca

SEQ ID NO: 41643 - DNA, 20 bp, Artificial Sequence
  chemically synthesized
ggtttccttcatgtgacagg

SEQ ID NO: 41644 - DNA, 20 bp, Artificial Sequence
  chemically synthesized
agcctcctgccccgaacttc

SEQ ID NO: 41645 - DNA, 20 bp, Artificial Sequence
  chemically synthesized
gcctcctgccccgaacttcc

SEQ ID NO: 41646 - DNA, 20 bp, Artificial Sequence
  chemically synthesized
cctcctgccccgaacttcca

SEQ ID NO: 41647 - DNA, 20 bp, Artificial Sequence
  chemically synthesized
acttccagggatcctctctt

SEQ ID NO: 41648 - DNA, 20 bp, Artificial Sequence
  chemically synthesized
ctctcttaagtgtttcctgc

SEQ ID NO: 41649 - DNA, 20 bp, Artificial Sequence
  chemically synthesized
ggaatctcctcacttctatc

SEQ ID NO: 41650 - DNA, 20 bp, Artificial Sequence
  chemically synthesized
tcctcacttctatctggaaa

SEQ ID NO: 41651 - DNA, 20 bp, Artificial Sequence
  chemically synthesized
atctggaaatggtttctcca

SEQ ID NO: 41652 - DNA, 20 bp, Artificial Sequence
  chemically synthesized
gaaatggtttctccacagtc

SEQ ID NO: 41653 - DNA, 20 bp, Artificial Sequence
  chemically synthesized
tttctccacagtccagcccc

SEQ ID NO: 41654 - DNA, 20 bp, Artificial Sequence
  chemically synthesized
tccacagtccagcccctggc

SEQ ID NO: 41655 - DNA, 20 bp, Artificial Sequence
  chemically synthesized
tccagcccctggctagttga

SEQ ID NO: 41656 - DNA, 20 bp, Artificial Sequence
  chemically synthesized
cagcccctggctagttgaaa

SEQ ID NO: 41657 - DNA, 20 bp, Artificial Sequence
  chemically synthesized
agttgaaagagttacccatg

SEQ ID NO: 41658 - DNA, 20 bp, Artificial Sequence
  chemically synthesized
ttgaaagagttacccatgca

SEQ ID NO: 41659 - DNA, 20 bp, Artificial Sequence
  chemically synthesized
tgaaagagttacccatgcag

SEQ ID NO: 41660 - DNA, 20 bp, Artificial Sequence
  chemically synthesized
tacccatgcagaggccctcc

SEQ ID NO: 41661 - DNA, 20 bp, Artificial Sequence
  chemically synthesized
gcagaggccctcctagcatc

SEQ ID NO: 41662 - DNA, 20 bp, Artificial Sequence
  chemically synthesized
agaggccctcctagcatcca

SEQ ID NO: 41663 - DNA, 20 bp, Artificial Sequence
  chemically synthesized
ccctcctagcatccagagac

SEQ ID NO: 41664 - DNA, 20 bp, Artificial Sequence
  chemically synthesized
agcatccagagactagtgct

SEQ ID NO: 41665 - DNA, 20 bp, Artificial Sequence
  chemically synthesized
agtgcttagattcctacttt

SEQ ID NO: 41666 - DNA, 20 bp, Artificial Sequence
  chemically synthesized
tagattcctactttcagcgt

SEQ ID NO: 41667 - DNA, 20 bp, Artificial Sequence
  chemically synthesized
actttcagcgttggacaacc

SEQ ID NO: 41668 - DNA, 20 bp, Artificial Sequence
  chemically synthesized
acaacctggatccacttgcc

SEQ ID NO: 41669 - DNA, 20 bp, Artificial Sequence
  chemically synthesized
acttgcccagtgttcttcct

SEQ ID NO: 41670 - DNA, 20 bp, Artificial Sequence
  chemically synthesized
ttatcttcctgaaccctgct

SEQ ID NO: 41671 - DNA, 20 bp, Artificial Sequence
  chemically synthesized
ccctgctgagatgatctatg

SEQ ID NO: 41672 - DNA, 20 bp, Artificial Sequence
  chemically synthesized
cctgctgagatgatctatgt

SEQ ID NO: 41673 - DNA, 20 bp, Artificial Sequence
  chemically synthesized
ctgctgagatgatctatgtg

SEQ ID NO: 41674 - DNA, 20 bp, Artificial Sequence
  chemically synthesized
gctgagatgatctatgtggg

SEQ ID NO: 41675 - DNA, 20 bp, Artificial Sequence
  chemically synthesized
gatgatctatgtggggagaa

SEQ ID NO: 41676 - DNA, 20 bp, Artificial Sequence
  chemically synthesized
gtggggagaatggcttcttt

SEQ ID NO: 41677 - DNA, 20 bp, Artificial Sequence
  chemically synthesized
ttgagaaacatcttcttcgt

SEQ ID NO: 41678 - DNA, 20 bp, Artificial Sequence
  chemically synthesized
agaaacatcttcttcgttag

SEQ ID NO: 41679 - DNA, 20 bp, Artificial Sequence
  chemically synthesized
ctcattcccactttaatatc

SEQ ID NO: 41680 - DNA, 20 bp, Artificial Sequence
  chemically synthesized
ttaatatccagaatcactat

SEQ ID NO: 41681 - DNA, 20 bp, Artificial Sequence
  chemically synthesized
atatccagaatcactataag

SEQ ID NO: 41682 - DNA, 20 bp, Artificial Sequence
  chemically synthesized
cactataagaagaatataat

SEQ ID NO: 41683 - DNA, 20 bp, Artificial Sequence
  chemically synthesized
ctataagaagaatataataa

SEQ ID NO: 41684 - DNA, 20 bp, Artificial Sequence
  chemically synthesized
tataagaagaatataataag

SEQ ID NO: 41685 - DNA, 20 bp, Artificial Sequence
  chemically synthesized
aagaggaataactcttatta

SEQ ID NO: 41686 - DNA, 20 bp, Artificial Sequence
  chemically synthesized
agaggaataactcttattat

SEQ ID NO: 41687 - DNA, 20 bp, Artificial Sequence
  chemically synthesized
gaataactcttattataggt

SEQ ID NO: 41688 - DNA, 20 bp, Artificial Sequence
  chemically synthesized
aataactcttattataggta

SEQ ID NO: 41689 - DNA, 20 bp, Artificial Sequence
  chemically synthesized
ataactcttattataggtaa

SEQ ID NO: 41690 - DNA, 20 bp, Artificial Sequence
  chemically synthesized
attataggtaagggaaaatt

SEQ ID NO: 41691 - DNA, 20 bp, Artificial Sequence
  chemically synthesized
tataggtaagggaaaattaa

SEQ ID NO: 41692 - DNA, 20 bp, Artificial Sequence
  chemically synthesized
ataggtaagggaaaattaag

SEQ ID NO: 41693 - DNA, 20 bp, Artificial Sequence
  chemically synthesized
aaattaagaggcatacgtga

SEQ ID NO: 41694 - DNA, 20 bp, Artificial Sequence
  chemically synthesized
aattaagaggcatacgtgat

SEQ ID NO: 41695 - DNA, 20 bp, Artificial Sequence
  chemically synthesized
agaggcatacgtgatgggat

SEQ ID NO: 41696 - DNA, 20 bp, Artificial Sequence
  chemically synthesized
gcatacgtgatgggatgagt

SEQ ID NO: 41697 - DNA, 20 bp, Artificial Sequence
  chemically synthesized
atacgtgatgggatgagtaa

SEQ ID NO: 41698 - DNA, 20 bp, Artificial Sequence
  chemically synthesized
acgtgatgggatgagtaaga

SEQ ID NO: 41699 - DNA, 20 bp, Artificial Sequence
  chemically synthesized
cgtgatgggatgagtaagag

SEQ ID NO: 41700 - DNA, 20 bp, Artificial Sequence
  chemically synthesized
tgatgggatgagtaagagag

SEQ ID NO: 41701 - DNA, 20 bp, Artificial Sequence
  chemically synthesized
atgggatgagtaagagagga

SEQ ID NO: 41702 - DNA, 20 bp, Artificial Sequence
  chemically synthesized
tgggatgagtaagagaggag

SEQ ID NO: 41703 - DNA, 20 bp, Artificial Sequence
  chemically synthesized
gggatgagtaagagaggaga

SEQ ID NO: 41704 - DNA, 20 bp, Artificial Sequence
  chemically synthesized
atgagtaagagaggagaggg

SEQ ID NO: 41705 - DNA, 20 bp, Artificial Sequence
  chemically synthesized
tgagtaagagaggagaggga

SEQ ID NO: 41706 - DNA, 20 bp, Artificial Sequence
  chemically synthesized
agaggagagggaaggattaa

SEQ ID NO: 41707 - DNA, 20 bp, Artificial Sequence
  chemically synthesized
aaaatctactactatttgtt

SEQ ID NO: 41708 - DNA, 20 bp, Artificial Sequence
  chemically synthesized
ctatttgttgagacctttta

SEQ ID NO: 41709 - DNA, 20 bp, Artificial Sequence
  chemically synthesized
tatctttattttgccatgac

SEQ ID NO: 41710 - DNA, 20 bp, Artificial Sequence
  chemically synthesized
tattttgccatgacaagact

SEQ ID NO: 41711 - DNA, 20 bp, Artificial Sequence
  chemically synthesized
tgccatgacaagactgagct

SEQ ID NO: 41712 - DNA, 20 bp, Artificial Sequence
  chemically synthesized
catgacaagactgagctcag

SEQ ID NO: 41713 - DNA, 20 bp, Artificial Sequence
  chemically synthesized
tgacaagactgagctcagaa

SEQ ID NO: 41714 - DNA, 20 bp, Artificial Sequence
  chemically synthesized
agactgagctcagaagagtc

SEQ ID NO: 41715 - DNA, 20 bp, Artificial Sequence
  chemically synthesized
gaagagtcaagcatttgcct

SEQ ID NO: 41716 - DNA, 20 bp, Artificial Sequence
  chemically synthesized
aagagtcaagcatttgccta

SEQ ID NO: 41717 - DNA, 20 bp, Artificial Sequence
  chemically synthesized
gtcaagcatttgcctaaggt

SEQ ID NO: 41718 - DNA, 20 bp, Artificial Sequence
  chemically synthesized
ttgcctaaggtcggacatgt

SEQ ID NO: 41719 - DNA, 20 bp, Artificial Sequence
  chemically synthesized
gcctaaggtcggacatgtca

SEQ ID NO: 41720 - DNA, 20 bp, Artificial Sequence
  chemically synthesized
cctaaggtcggacatgtcag

SEQ ID NO: 41721 - DNA, 20 bp, Artificial Sequence
  chemically synthesized
aaggtcggacatgtcagagg

SEQ ID NO: 41722 - DNA, 20 bp, Artificial Sequence
  chemically synthesized
ggacatgtcagaggcagtgc

SEQ ID NO: 41723 - DNA, 20 bp, Artificial Sequence
  chemically synthesized
aggcagtgccagacctatgt

SEQ ID NO: 41724 - DNA, 20 bp, Artificial Sequence
  chemically synthesized
cagacctatgtgagactctg

SEQ ID NO: 41725 - DNA, 20 bp, Artificial Sequence
  chemically synthesized
gactctgcagctactgctca

SEQ ID NO: 41726 - DNA, 20 bp, Artificial Sequence
  chemically synthesized
actctgcagctactgctcat

SEQ ID NO: 41727 - DNA, 20 bp, Artificial Sequence
  chemically synthesized
gggccctgtgctgcactgat

SEQ ID NO: 41728 - DNA, 20 bp, Artificial Sequence
  chemically synthesized
ggccctgtgctgcactgatg

SEQ ID NO: 41729 - DNA, 20 bp, Artificial Sequence
  chemically synthesized
ccctgtgctgcactgatgag

SEQ ID NO: 41730 - DNA, 20 bp, Artificial Sequence
  chemically synthesized
cctgtgctgcactgatgagg

SEQ ID NO: 41731 - DNA, 20 bp, Artificial Sequence
  chemically synthesized
gctgcactgatgaggaggat

SEQ ID NO: 41732 - DNA, 20 bp, Artificial Sequence
  chemically synthesized
cactgatgaggaggatcaga

SEQ ID NO: 41733 - DNA, 20 bp, Artificial Sequence
  chemically synthesized
gatgaggaggatcagatgga

SEQ ID NO: 41734 - DNA, 20 bp, Artificial Sequence
  chemically synthesized
atgaggaggatcagatggat

SEQ ID NO: 41735 - DNA, 20 bp, Artificial Sequence
  chemically synthesized
tgaggaggatcagatggatg

SEQ ID NO: 41736 - DNA, 20 bp, Artificial Sequence
  chemically synthesized
atcagatggatggggcaatg

SEQ ID NO: 41737 - DNA, 20 bp, Artificial Sequence
  chemically synthesized
atggatggggcaatgaagca

SEQ ID NO: 41738 - DNA, 20 bp, Artificial Sequence
  chemically synthesized
tggatggggcaatgaagcaa

SEQ ID NO: 41739 - DNA, 20 bp, Artificial Sequence
  chemically synthesized
gaagcaaaggaatcattctg

SEQ ID NO: 41740 - DNA, 20 bp, Artificial Sequence
  chemically synthesized
aaggaatcattctgtggata

SEQ ID NO: 41741 - DNA, 20 bp, Artificial Sequence
  chemically synthesized
aggaatcattctgtggataa

SEQ ID NO: 41742 - DNA, 20 bp, Artificial Sequence
  chemically synthesized
gaatcattctgtggataaag

SEQ ID NO: 41743 - DNA, 20 bp, Artificial Sequence
  chemically synthesized
cattctgtggataaaggaga

SEQ ID NO: 41744 - DNA, 20 bp, Artificial Sequence
  chemically synthesized
ggataaaggagacagccatg

SEQ ID NO: 41745 - DNA, 20 bp, Artificial Sequence
  chemically synthesized
taaaggagacagccatgaag

SEQ ID NO: 41746 - DNA, 20 bp, Artificial Sequence
  chemically synthesized
gaagtctatgactgtaaatt

SEQ ID NO: 41747 - DNA, 20 bp, Artificial Sequence
  chemically synthesized
aagtctatgactgtaaattt

SEQ ID NO: 41748 - DNA, 20 bp, Artificial Sequence
  chemically synthesized
gtctatgactgtaaatttgg

SEQ ID NO: 41749 - DNA, 20 bp, Artificial Sequence
  chemically synthesized
tatgactgtaaatttgggag

SEQ ID NO: 41750 - DNA, 20 bp, Artificial Sequence
  chemically synthesized
atgactgtaaatttgggagc

SEQ ID NO: 41751 - DNA, 20 bp, Artificial Sequence
  chemically synthesized
gactgtaaatttgggagcag

SEQ ID NO: 41752 - DNA, 20 bp, Artificial Sequence
  chemically synthesized
atttgggagcaggagtctct

SEQ ID NO: 41753 - DNA, 20 bp, Artificial Sequence
  chemically synthesized
tttgggagcaggagtctcta

SEQ ID NO: 41754 - DNA, 20 bp, Artificial Sequence
  chemically synthesized
agcaggagtctctaaggact

SEQ ID NO: 41755 - DNA, 20 bp, Artificial Sequence
  chemically synthesized
tctctaaggacttggatttc

SEQ ID NO: 41756 - DNA, 20 bp, Artificial Sequence
  chemically synthesized
ctctaaggacttggatttca

SEQ ID NO: 41757 - DNA, 20 bp, Artificial Sequence
  chemically synthesized
gatttcaaggaattttgact

SEQ ID NO: 41758 - DNA, 20 bp, Artificial Sequence
  chemically synthesized
aattttgactcagcaaacac

SEQ ID NO: 41759 - DNA, 20 bp, Artificial Sequence
  chemically synthesized
cagcaaacacaagaccctca

SEQ ID NO: 41760 - DNA, 20 bp, Artificial Sequence
  chemically synthesized
gaccctcacggtgactttgc

SEQ ID NO: 41761 - DNA, 20 bp, Artificial Sequence
  chemically synthesized
ctcacggtgactttgcgagc

SEQ ID NO: 41762 - DNA, 20 bp, Artificial Sequence
  chemically synthesized
gactttgcgagctggtgtgc

SEQ ID NO: 41763 - DNA, 20 bp, Artificial Sequence
  chemically synthesized
ggtgtgccagatgtgtctat

SEQ ID NO: 41764 - DNA, 20 bp, Artificial Sequence
  chemically synthesized
tgtgccagatgtgtctatca

SEQ ID NO: 41765 - DNA, 20 bp, Artificial Sequence
  chemically synthesized
gtgccagatgtgtctatcag

SEQ ID NO: 41766 - DNA, 20 bp, Artificial Sequence
  chemically synthesized
gatgtgtctatcagaggttc

SEQ ID NO: 41767 - DNA, 20 bp, Artificial Sequence
  chemically synthesized
atgtgtctatcagaggttcc

SEQ ID NO: 41768 - DNA, 20 bp, Artificial Sequence
  chemically synthesized
tgtgtctatcagaggttcca

SEQ ID NO: 41769 - DNA, 20 bp, Artificial Sequence
  chemically synthesized
tgtctatcagaggttccagg

SEQ ID NO: 41770 - DNA, 20 bp, Artificial Sequence
  chemically synthesized
gtctatcagaggttccaggg

SEQ ID NO: 41771 - DNA, 20 bp, Artificial Sequence
  chemically synthesized
tctatcagaggttccaggga

SEQ ID NO: 41772 - DNA, 20 bp, Artificial Sequence
  chemically synthesized
atcagaggttccagggaggg

SEQ ID NO: 41773 - DNA, 20 bp, Artificial Sequence
  chemically synthesized
tcagaggttccagggagggt

SEQ ID NO: 41774 - DNA, 20 bp, Artificial Sequence
  chemically synthesized
cagaggttccagggagggtg

SEQ ID NO: 41775 - DNA, 20 bp, Artificial Sequence
  chemically synthesized
aggttccagggagggtgggg

SEQ ID NO: 41776 - DNA, 20 bp, Artificial Sequence
  chemically synthesized
ggttccagggagggtggggt

SEQ ID NO: 41777 - DNA, 20 bp, Artificial Sequence
  chemically synthesized
gttccagggagggtggggtg

SEQ ID NO: 41778 - DNA, 20 bp, Artificial Sequence
  chemically synthesized
cagggagggtggggtggggt

SEQ ID NO: 41779 - DNA, 20 bp, Artificial Sequence
  chemically synthesized
agggagggtggggtggggtc

SEQ ID NO: 41780 - DNA, 20 bp, Artificial Sequence
  chemically synthesized
gggagggtggggtggggtca

SEQ ID NO: 41781 - DNA, 20 bp, Artificial Sequence
  chemically synthesized
gggtggggtggggtcagggc

SEQ ID NO: 41782 - DNA, 20 bp, Artificial Sequence
  chemically synthesized
gtggggtcagggctggccac

SEQ ID NO: 41783 - DNA, 20 bp, Artificial Sequence
  chemically synthesized
cagggctggccaccagctat

SEQ ID NO: 41784 - DNA, 20 bp, Artificial Sequence
  chemically synthesized
agggctggccaccagctatc

SEQ ID NO: 41785 - DNA, 20 bp, Artificial Sequence
  chemically synthesized
gggctggccaccagctatca

SEQ ID NO: 41786 - DNA, 20 bp, Artificial Sequence
  chemically synthesized
ggccaccagctatcagggcc

SEQ ID NO: 41787 - DNA, 20 bp, Artificial Sequence
  chemically synthesized
accagctatcagggcccaga

SEQ ID NO: 41788 - DNA, 20 bp, Artificial Sequence
  chemically synthesized
ccagctatcagggcccagat

SEQ ID NO: 41789 - DNA, 20 bp, Artificial Sequence
  chemically synthesized
atcagggcccagatgggtta

SEQ ID NO: 41790 - DNA, 20 bp, Artificial Sequence
  chemically synthesized
tcagggcccagatgggttat

SEQ ID NO: 41791 - DNA, 20 bp, Artificial Sequence
  chemically synthesized
ggcccagatgggttataggc

SEQ ID NO: 41792 - DNA, 20 bp, Artificial Sequence
  chemically synthesized
ccagatgggttataggctgg

SEQ ID NO: 41793 - DNA, 20 bp, Artificial Sequence
  chemically synthesized
cagatgggttataggctggc

SEQ ID NO: 41794 - DNA, 20 bp, Artificial Sequence
  chemically synthesized
gggttataggctggcaggct

SEQ ID NO: 41795 - DNA, 20 bp, Artificial Sequence
  chemically synthesized
tataggctggcaggctcaga

SEQ ID NO: 41796 - DNA, 20 bp, Artificial Sequence
  chemically synthesized
ataggctggcaggctcagat

SEQ ID NO: 41797 - DNA, 20 bp, Artificial Sequence
  chemically synthesized
ggctggcaggctcagatagg

SEQ ID NO: 41798 - DNA, 20 bp, Artificial Sequence
  chemically synthesized
ggcaggctcagataggtggt

SEQ ID NO: 41799 - DNA, 20 bp, Artificial Sequence
  chemically synthesized
gcaggctcagataggtggtt

SEQ ID NO: 41800 - DNA, 20 bp, Artificial Sequence
  chemically synthesized
gctcagataggtggttaggt

SEQ ID NO: 41801 - DNA, 20 bp, Artificial Sequence
  chemically synthesized
ctcagataggtggttaggtc

SEQ ID NO: 41802 - DNA, 20 bp, Artificial Sequence
  chemically synthesized
gataggtggttaggtcaggt

SEQ ID NO: 41803 - DNA, 20 bp, Artificial Sequence
  chemically synthesized
aggtggttaggtcaggttgg

SEQ ID NO: 41804 - DNA, 20 bp, Artificial Sequence
  chemically synthesized
ttaggtcaggttggtggtgc

SEQ ID NO: 41805 - DNA, 20 bp, Artificial Sequence
  chemically synthesized
taggtcaggttggtggtgct

SEQ ID NO: 41806 - DNA, 20 bp, Artificial Sequence
  chemically synthesized
gtcaggttggtggtgctggg

SEQ ID NO: 41807 - DNA, 20 bp, Artificial Sequence
  chemically synthesized
caggttggtggtgctgggtg

SEQ ID NO: 41808 - DNA, 20 bp, Artificial Sequence
  chemically synthesized
tgggtggagtccatgactcc

SEQ ID NO: 41809 - DNA, 20 bp, Artificial Sequence
  chemically synthesized
gggtggagtccatgactccc

SEQ ID NO: 41810 - DNA, 20 bp, Artificial Sequence
  chemically synthesized
gtggagtccatgactcccag

SEQ ID NO: 41811 - DNA, 20 bp, Artificial Sequence
  chemically synthesized
agtccatgactcccaggagc

SEQ ID NO: 41812 - DNA, 20 bp, Artificial Sequence
  chemically synthesized
gtccatgactcccaggagcc

SEQ ID NO: 41813 - DNA, 20 bp, Artificial Sequence
  chemically synthesized
ccatgactcccaggagccag

SEQ ID NO: 41814 - DNA, 20 bp, Artificial Sequence
  chemically synthesized
atgactcccaggagccagga

SEQ ID NO: 41815 - DNA, 20 bp, Artificial Sequence
  chemically synthesized
ctcccaggagccaggagaga

SEQ ID NO: 41816 - DNA, 20 bp, Artificial Sequence
  chemically synthesized
agccaggagagatagaccat

SEQ ID NO: 41817 - DNA, 20 bp, Artificial Sequence
  chemically synthesized
caggagagatagaccatgag

SEQ ID NO: 41818 - DNA, 20 bp, Artificial Sequence
  chemically synthesized
ggagagatagaccatgagta

SEQ ID NO: 41819 - DNA, 20 bp, Artificial Sequence
  chemically synthesized
gagagatagaccatgagtag

SEQ ID NO: 41820 - DNA, 20 bp, Artificial Sequence
  chemically synthesized
agagatagaccatgagtaga

SEQ ID NO: 41821 - DNA, 20 bp, Artificial Sequence
  chemically synthesized
gatagaccatgagtagaggg

SEQ ID NO: 41822 - DNA, 20 bp, Artificial Sequence
  chemically synthesized
ccatgagtagagggcagaca

SEQ ID NO: 41823 - DNA, 20 bp, Artificial Sequence
  chemically synthesized
catgagtagagggcagacat

SEQ ID NO: 41824 - DNA, 20 bp, Artificial Sequence
  chemically synthesized
agtagagggcagacatggga

SEQ ID NO: 41825 - DNA, 20 bp, Artificial Sequence
  chemically synthesized
gtagagggcagacatgggaa

SEQ ID NO: 41826 - DNA, 20 bp, Artificial Sequence
  chemically synthesized
gagggcagacatgggaaagg

SEQ ID NO: 41827 - DNA, 20 bp, Artificial Sequence
  chemically synthesized
agggcagacatgggaaaggt

SEQ ID NO: 41828 - DNA, 20 bp, Artificial Sequence
  chemically synthesized
gggcagacatgggaaaggtg

SEQ ID NO: 41829 - DNA, 20 bp, Artificial Sequence
  chemically synthesized
ggcagacatgggaaaggtgg

SEQ ID NO: 41830 - DNA, 20 bp, Artificial Sequence
  chemically synthesized
cagacatgggaaaggtgggg

SEQ ID NO: 41831 - DNA, 20 bp, Artificial Sequence
  chemically synthesized
agacatgggaaaggtggggg

SEQ ID NO: 41832 - DNA, 20 bp, Artificial Sequence
  chemically synthesized
tgggaaaggtgggggaggca

SEQ ID NO: 41833 - DNA, 20 bp, Artificial Sequence
  chemically synthesized
aaggtgggggaggcacagca

SEQ ID NO: 41834 - DNA, 20 bp, Artificial Sequence
  chemically synthesized
gtgggggaggcacagcatag

SEQ ID NO: 41835 - DNA, 20 bp, Artificial Sequence
  chemically synthesized
tttttcattctactactaca

SEQ ID NO: 41836 - DNA, 20 bp, Artificial Sequence
  chemically synthesized
ttttcattctactactacat

SEQ ID NO: 41837 - DNA, 20 bp, Artificial Sequence
  chemically synthesized
ggactgctcccctatacccc

SEQ ID NO: 41838 - DNA, 20 bp, Artificial Sequence
  chemically synthesized
tgctcccctatacccccagc

SEQ ID NO: 41839 - DNA, 20 bp, Artificial Sequence
  chemically synthesized
gctcccctatacccccagct

SEQ ID NO: 41840 - DNA, 20 bp, Artificial Sequence
  chemically synthesized
ctcccctatacccccagcta

SEQ ID NO: 41841 - DNA, 20 bp, Artificial Sequence
  chemically synthesized
tcccctatacccccagctag

SEQ ID NO: 41842 - DNA, 20 bp, Artificial Sequence
  chemically synthesized
ctatacccccagctaggggc

SEQ ID NO: 41843 - DNA, 20 bp, Artificial Sequence
  chemically synthesized
tgccttgactcctatgtttt

SEQ ID NO: 41844 - DNA, 20 bp, Artificial Sequence
  chemically synthesized
gccttgactcctatgttttc

SEQ ID NO: 41845 - DNA, 20 bp, Artificial Sequence
  chemically synthesized
tttcaggatcatcatctata

SEQ ID NO: 41846 - DNA, 20 bp, Artificial Sequence
  chemically synthesized
aggatcatcatctataaagt

SEQ ID NO: 41847 - DNA, 20 bp, Artificial Sequence
  chemically synthesized
gatcatcatctataaagtaa

SEQ ID NO: 41848 - DNA, 20 bp, Artificial Sequence
  chemically synthesized
taataattgtgtctatctca

SEQ ID NO: 41849 - DNA, 20 bp, Artificial Sequence
  chemically synthesized
aataattgtgtctatctcat

SEQ ID NO: 41850 - DNA, 20 bp, Artificial Sequence
  chemically synthesized
ataattgtgtctatctcata

SEQ ID NO: 41851 - DNA, 20 bp, Artificial Sequence
  chemically synthesized
ctatctcatagggttattat

SEQ ID NO: 41852 - DNA, 20 bp, Artificial Sequence
  chemically synthesized
tatctcatagggttattatg

SEQ ID NO: 41853 - DNA, 20 bp, Artificial Sequence
  chemically synthesized
tagggttattatgaggatca

SEQ ID NO: 41854 - DNA, 20 bp, Artificial Sequence
  chemically synthesized
agggttattatgaggatcaa

SEQ ID NO: 41855 - DNA, 20 bp, Artificial Sequence
  chemically synthesized
ggttattatgaggatcaaag

SEQ ID NO: 41856 - DNA, 20 bp, Artificial Sequence
  chemically synthesized
caaaggagatgcacactctc

SEQ ID NO: 41857 - DNA, 20 bp, Artificial Sequence
  chemically synthesized
gagatgcacactctctggac

SEQ ID NO: 41858 - DNA, 20 bp, Artificial Sequence
  chemically synthesized
atgcacactctctggaccag

SEQ ID NO: 41859 - DNA, 20 bp, Artificial Sequence
  chemically synthesized
tctctggaccagtggcctaa

SEQ ID NO: 41860 - DNA, 20 bp, Artificial Sequence
  chemically synthesized
ggaccagtggcctaacagtt

SEQ ID NO: 41861 - DNA, 20 bp, Artificial Sequence
  chemically synthesized
gaccagtggcctaacagttc

SEQ ID NO: 41862 - DNA, 20 bp, Artificial Sequence
  chemically synthesized
agtggcctaacagttcagga

SEQ ID NO: 41863 - DNA, 20 bp, Artificial Sequence
  chemically synthesized
tggcctaacagttcaggaca

SEQ ID NO: 41864 - DNA, 20 bp, Artificial Sequence
  chemically synthesized
aacagttcaggacagagcta

SEQ ID NO: 41865 - DNA, 20 bp, Artificial Sequence
  chemically synthesized
acagttcaggacagagctat

SEQ ID NO: 41866 - DNA, 20 bp, Artificial Sequence
  chemically synthesized
agctatgggcttcctatgta

SEQ ID NO: 41867 - DNA, 20 bp, Artificial Sequence
  chemically synthesized
gctatgggcttcctatgtat

SEQ ID NO: 41868 - DNA, 20 bp, Artificial Sequence
  chemically synthesized
tgggcttcctatgtatgggt

SEQ ID NO: 41869 - DNA, 20 bp, Artificial Sequence
  chemically synthesized
gcttcctatgtatgggtcag

SEQ ID NO: 41870 - DNA, 20 bp, Artificial Sequence
  chemically synthesized
atgggtcagtggtctcaatg

SEQ ID NO: 41871 - DNA, 20 bp, Artificial Sequence
  chemically synthesized
ggtcagtggtctcaatgtag

SEQ ID NO: 41872 - DNA, 20 bp, Artificial Sequence
  chemically synthesized
gtcagtggtctcaatgtagc

SEQ ID NO: 41873 - DNA, 20 bp, Artificial Sequence
  chemically synthesized
gtggtctcaatgtagcaggc

SEQ ID NO: 41874 - DNA, 20 bp, Artificial Sequence
  chemically synthesized
tcaatgtagcaggcaagttc

SEQ ID NO: 41875 - DNA, 20 bp, Artificial Sequence
  chemically synthesized
atgtagcaggcaagttccag

SEQ ID NO: 41876 - DNA, 20 bp, Artificial Sequence
  chemically synthesized
agcaggcaagttccagaaga

SEQ ID NO: 41877 - DNA, 20 bp, Artificial Sequence
  chemically synthesized
aagatagcatcaaccactgt

SEQ ID NO: 41878 - DNA, 20 bp, Artificial Sequence
  chemically synthesized
gatagcatcaaccactgtta

SEQ ID NO: 41879 - DNA, 20 bp, Artificial Sequence
  chemically synthesized
cactgttagagatatactgc

SEQ ID NO: 41880 - DNA, 20 bp, Artificial Sequence
  chemically synthesized
tagagatatactgccagtct

SEQ ID NO: 41881 - DNA, 20 bp, Artificial Sequence
  chemically synthesized
gagatatactgccagtctca

SEQ ID NO: 41882 - DNA, 20 bp, Artificial Sequence
  chemically synthesized
ctcagagcctgatgttaatt

SEQ ID NO: 41883 - DNA, 20 bp, Artificial Sequence
  chemically synthesized
gcctgatgttaatttagcaa

SEQ ID NO: 41884 - DNA, 20 bp, Artificial Sequence
  chemically synthesized
cctgatgttaatttagcaat

SEQ ID NO: 41885 - DNA, 20 bp, Artificial Sequence
  chemically synthesized
atgttaatttagcaatgggc

SEQ ID NO: 41886 - DNA, 20 bp, Artificial Sequence
  chemically synthesized
tgttaatttagcaatgggct

SEQ ID NO: 41887 - DNA, 20 bp, Artificial Sequence
  chemically synthesized
aatgggctgggaccctcctc

SEQ ID NO: 41888 - DNA, 20 bp, Artificial Sequence
  chemically synthesized
gggctgggaccctcctccag

SEQ ID NO: 41889 - DNA, 20 bp, Artificial Sequence
  chemically synthesized
ctccagtagaaccttctaac

SEQ ID NO: 41890 - DNA, 20 bp, Artificial Sequence
  chemically synthesized
aaccttctaaccagctgctg

SEQ ID NO: 41891 - DNA, 20 bp, Artificial Sequence
  chemically synthesized
ctaaccagctgctgcagtca

SEQ ID NO: 41892 - DNA, 20 bp, Artificial Sequence
  chemically synthesized
gctgcagtcaaagtcgaatg

SEQ ID NO: 41893 - DNA, 20 bp, Artificial Sequence
  chemically synthesized
cagtcaaagtcgaatgcagc

SEQ ID NO: 41894 - DNA, 20 bp, Artificial Sequence
  chemically synthesized
caaagtcgaatgcagctggt

SEQ ID NO: 41895 - DNA, 20 bp, Artificial Sequence
  chemically synthesized
ggttagactttttttaatga

SEQ ID NO: 41896 - DNA, 20 bp, Artificial Sequence
  chemically synthesized
gactttttttaatgaaagct

SEQ ID NO: 41897 - DNA, 20 bp, Artificial Sequence
  chemically synthesized
tgaaagcttagctttcatta

SEQ ID NO: 41898 - DNA, 20 bp, Artificial Sequence
  chemically synthesized
cttagctttcattaaagatt

SEQ ID NO: 41899 - DNA, 20 bp, Artificial Sequence
  chemically synthesized
tcattaaagattaagctcct

SEQ ID NO: 41900 - DNA, 20 bp, Artificial Sequence
  chemically synthesized
ttaaagattaagctcctaag

SEQ ID NO: 41901 - DNA, 20 bp, Artificial Sequence
  chemically synthesized
taaagattaagctcctaagc

SEQ ID NO: 41902 - DNA, 20 bp, Artificial Sequence
  chemically synthesized
aaagattaagctcctaagca

SEQ ID NO: 41903 - DNA, 20 bp, Artificial Sequence
  chemically synthesized
ttaagctcctaagcagggca

SEQ ID NO: 41904 - DNA, 20 bp, Artificial Sequence
  chemically synthesized
gcacagatgaaattgtctaa

SEQ ID NO: 41905 - DNA, 20 bp, Artificial Sequence
  chemically synthesized
ctaaaaaaatctgacttcac

SEQ ID NO: 41906 - DNA, 20 bp, Artificial Sequence
  chemically synthesized
atctgacttcactggaaaca

SEQ ID NO: 41907 - DNA, 20 bp, Artificial Sequence
  chemically synthesized
tgacttcactggaaacatgg

SEQ ID NO: 41908 - DNA, 20 bp, Artificial Sequence
  chemically synthesized
cactggaaacatggaagccc

SEQ ID NO: 41909 - DNA, 20 bp, Artificial Sequence
  chemically synthesized
actggaaacatggaagccca

SEQ ID NO: 41910 - DNA, 20 bp, Artificial Sequence
  chemically synthesized
aagcccaaggttctgaacat

SEQ ID NO: 41911 - DNA, 20 bp, Artificial Sequence
  chemically synthesized
ttctgaacatgagaaatttt

SEQ ID NO: 41912 - DNA, 20 bp, Artificial Sequence
  chemically synthesized
tctgaacatgagaaattttt

SEQ ID NO: 41913 - DNA, 20 bp, Artificial Sequence
  chemically synthesized
gaaatttttaggaatctgca

SEQ ID NO: 41914 - DNA, 20 bp, Artificial Sequence
  chemically synthesized
aaatttttaggaatctgcac

SEQ ID NO: 41915 - DNA, 20 bp, Artificial Sequence
  chemically synthesized
atttttaggaatctgcacag

SEQ ID NO: 41916 - DNA, 20 bp, Artificial Sequence
  chemically synthesized
taggaatctgcacaggagtt

SEQ ID NO: 41917 - DNA, 20 bp, Artificial Sequence
  chemically synthesized
ggaatctgcacaggagttga

SEQ ID NO: 41918 - DNA, 20 bp, Artificial Sequence
  chemically synthesized
gaatctgcacaggagttgag

SEQ ID NO: 41919 - DNA, 20 bp, Artificial Sequence
  chemically synthesized
aatctgcacaggagttgaga

SEQ ID NO: 41920 - DNA, 20 bp, Artificial Sequence
  chemically synthesized
acaggagttgagagggaaac

SEQ ID NO: 41921 - DNA, 20 bp, Artificial Sequence
  chemically synthesized
gagttgagagggaaacaaga

SEQ ID NO: 41922 - DNA, 20 bp, Artificial Sequence
  chemically synthesized
gagagggaaacaagatggtg

SEQ ID NO: 41923 - DNA, 20 bp, Artificial Sequence
  chemically synthesized
agagggaaacaagatggtga

SEQ ID NO: 41924 - DNA, 20 bp, Artificial Sequence
  chemically synthesized
gagggaaacaagatggtgaa

SEQ ID NO: 41925 - DNA, 20 bp, Artificial Sequence
  chemically synthesized
aaacaagatggtgaagggac

SEQ ID NO: 41926 - DNA, 20 bp, Artificial Sequence
  chemically synthesized
gaagggactagaaaccacat

SEQ ID NO: 41927 - DNA, 20 bp, Artificial Sequence
  chemically synthesized
agggactagaaaccacatga

SEQ ID NO: 41928 - DNA, 20 bp, Artificial Sequence
  chemically synthesized
agaaaccacatgagagacac

SEQ ID NO: 41929 - DNA, 20 bp, Artificial Sequence
  chemically synthesized
gaaaccacatgagagacacg

SEQ ID NO: 41930 - DNA, 20 bp, Artificial Sequence
  chemically synthesized
acatgagagacacgaggaaa

SEQ ID NO: 41931 - DNA, 20 bp, Artificial Sequence
  chemically synthesized
agagacacgaggaaatagtg

SEQ ID NO: 41932 - DNA, 20 bp, Artificial Sequence
  chemically synthesized
acgaggaaatagtgtagatt

SEQ ID NO: 41933 - DNA, 20 bp, Artificial Sequence
  chemically synthesized
cgaggaaatagtgtagattt

SEQ ID NO: 41934 - DNA, 20 bp, Artificial Sequence
  chemically synthesized
gaaatagtgtagatttaggc

SEQ ID NO: 41935 - DNA, 20 bp, Artificial Sequence
  chemically synthesized
aatagtgtagatttaggctg

SEQ ID NO: 41936 - DNA, 20 bp, Artificial Sequence
  chemically synthesized
atagtgtagatttaggctgg

SEQ ID NO: 41937 - DNA, 20 bp, Artificial Sequence
  chemically synthesized
tttaggctggaggtaaatga

SEQ ID NO: 41938 - DNA, 20 bp, Artificial Sequence
  chemically synthesized
taggctggaggtaaatgaaa

SEQ ID NO: 41939 - DNA, 20 bp, Artificial Sequence
  chemically synthesized
gctggaggtaaatgaaagag

SEQ ID NO: 41940 - DNA, 20 bp, Artificial Sequence
  chemically synthesized
ggaggtaaatgaaagagaag

SEQ ID NO: 41941 - DNA, 20 bp, Artificial Sequence
  chemically synthesized
gaggtaaatgaaagagaagt

SEQ ID NO: 41942 - DNA, 20 bp, Artificial Sequence
  chemically synthesized
actgaaatctttctatatgt

SEQ ID NO: 41943 - DNA, 20 bp, Artificial Sequence
  chemically synthesized
ctgaaatctttctatatgtc

SEQ ID NO: 41944 - DNA, 20 bp, Artificial Sequence
  chemically synthesized
tttaataatctcattacata

SEQ ID NO: 41945 - DNA, 20 bp, Artificial Sequence
  chemically synthesized
attacatatggtaattctgt

SEQ ID NO: 41946 - DNA, 20 bp, Artificial Sequence
  chemically synthesized
ctataattaatactaatgat

SEQ ID NO: 41947 - DNA, 20 bp, Artificial Sequence
  chemically synthesized
aatgataagtaacacctctt

SEQ ID NO: 41948 - DNA, 20 bp, Artificial Sequence
  chemically synthesized
agtaacacctcttgagtact

SEQ ID NO: 41949 - DNA, 20 bp, Artificial Sequence
  chemically synthesized
cttgagtacttagtatatgc

SEQ ID NO: 41950 - DNA, 20 bp, Artificial Sequence
  chemically synthesized
tatatgctagaatcaaattt

SEQ ID NO: 41951 - DNA, 20 bp, Artificial Sequence
  chemically synthesized
caaatttaagtttatcatat

SEQ ID NO: 41952 - DNA, 20 bp, Artificial Sequence
  chemically synthesized
aaatttaagtttatcatatg

SEQ ID NO: 41953 - DNA, 20 bp, Artificial Sequence
  chemically synthesized
ttaagtttatcatatgaggc

SEQ ID NO: 41954 - DNA, 20 bp, Artificial Sequence
  chemically synthesized
taagtttatcatatgaggcc

SEQ ID NO: 41955 - DNA, 20 bp, Artificial Sequence
  chemically synthesized
ttatcatatgaggccgggca

SEQ ID NO: 41956 - DNA, 20 bp, Artificial Sequence
  chemically synthesized
tcatatgaggccgggcacgg

SEQ ID NO: 41957 - DNA, 20 bp, Artificial Sequence
  chemically synthesized
cgggcacggtggctcatata

SEQ ID NO: 41958 - DNA, 20 bp, Artificial Sequence
  chemically synthesized
gggcacggtggctcatatat

SEQ ID NO: 41959 - DNA, 20 bp, Artificial Sequence
  chemically synthesized
ggattacatgcctgtaatcc

SEQ ID NO: 41960 - DNA, 20 bp, Artificial Sequence
  chemically synthesized
tgcctgtaatcccagcactt

SEQ ID NO: 41961 - DNA, 20 bp, Artificial Sequence
  chemically synthesized
gcctgtaatcccagcacttt

SEQ ID NO: 41962 - DNA, 20 bp, Artificial Sequence
  chemically synthesized
ctgtaatcccagcactttgg

SEQ ID NO: 41963 - DNA, 20 bp, Artificial Sequence
  chemically synthesized
tgtaatcccagcactttggg

SEQ ID NO: 41964 - DNA, 20 bp, Artificial Sequence
  chemically synthesized
tcccagcactttgggaggcc

SEQ ID NO: 41965 - DNA, 20 bp, Artificial Sequence
  chemically synthesized
cccagcactttgggaggcca

SEQ ID NO: 41966 - DNA, 20 bp, Artificial Sequence
  chemically synthesized
ctttgggaggccaaggcaat

SEQ ID NO: 41967 - DNA, 20 bp, Artificial Sequence
  chemically synthesized
ccaaggcaattggatcacct

SEQ ID NO: 41968 - DNA, 20 bp, Artificial Sequence
  chemically synthesized
caaggcaattggatcacctg

SEQ ID NO: 41969 - DNA, 20 bp, Artificial Sequence
  chemically synthesized
gcaattggatcacctgaggt

SEQ ID NO: 41970 - DNA, 20 bp, Artificial Sequence
  chemically synthesized
caattggatcacctgaggtc

SEQ ID NO: 41971 - DNA, 20 bp, Artificial Sequence
  chemically synthesized
attggatcacctgaggtcag

SEQ ID NO: 41972 - DNA, 20 bp, Artificial Sequence
  chemically synthesized
tcacctgaggtcaggagttc

SEQ ID NO: 41973 - DNA, 20 bp, Artificial Sequence
  chemically synthesized
tgaggtcaggagttccagac

SEQ ID NO: 41974 - DNA, 20 bp, Artificial Sequence
  chemically synthesized
tcaggagttccagaccagcc

SEQ ID NO: 41975 - DNA, 20 bp, Artificial Sequence
  chemically synthesized
ccagaccagcctggccaaca

SEQ ID NO: 41976 - DNA, 20 bp, Artificial Sequence
  chemically synthesized
tactaaaaaatacaaaaaat

SEQ ID NO: 41977 - DNA, 20 bp, Artificial Sequence
  chemically synthesized
aaaaaatacaaaaaatcagc

SEQ ID NO: 41978 - DNA, 20 bp, Artificial Sequence
  chemically synthesized
aaaaatacaaaaaatcagcc

SEQ ID NO: 41979 - DNA, 20 bp, Artificial Sequence
  chemically synthesized
tacaaaaaatcagccaggtg

SEQ ID NO: 41980 - DNA, 20 bp, Artificial Sequence
  chemically synthesized
aaaaaatcagccaggtgtgg

SEQ ID NO: 41981 - DNA, 20 bp, Artificial Sequence
  chemically synthesized
gtggcacgcgtctataatcc

SEQ ID NO: 41982 - DNA, 20 bp, Artificial Sequence
  chemically synthesized
cgtctataatcccagctact

SEQ ID NO: 41983 - DNA, 20 bp, Artificial Sequence
  chemically synthesized
gtctataatcccagctactc

SEQ ID NO: 41984 - DNA, 20 bp, Artificial Sequence
  chemically synthesized
ctataatcccagctactcag

SEQ ID NO: 41985 - DNA, 20 bp, Artificial Sequence
  chemically synthesized
tataatcccagctactcagg

SEQ ID NO: 41986 - DNA, 20 bp, Artificial Sequence
  chemically synthesized
tcccagctactcaggaggct

SEQ ID NO: 41987 - DNA, 20 bp, Artificial Sequence
  chemically synthesized
cccagctactcaggaggctg

SEQ ID NO: 41988 - DNA, 20 bp, Artificial Sequence
  chemically synthesized
agctactcaggaggctgagg

SEQ ID NO: 41989 - DNA, 20 bp, Artificial Sequence
  chemically synthesized
gctactcaggaggctgaggc

SEQ ID NO: 41990 - DNA, 20 bp, Artificial Sequence
  chemically synthesized
tactcaggaggctgaggcag

SEQ ID NO: 41991 - DNA, 20 bp, Artificial Sequence
  chemically synthesized
gcaggagaatcacttgaacc

SEQ ID NO: 41992 - DNA, 20 bp, Artificial Sequence
  chemically synthesized
caggagaatcacttgaaccc

SEQ ID NO: 41993 - DNA, 20 bp, Artificial Sequence
  chemically synthesized
ggagaatcacttgaacccag

SEQ ID NO: 41994 - DNA, 20 bp, Artificial Sequence
  chemically synthesized
gagaatcacttgaacccagg

SEQ ID NO: 41995 - DNA, 20 bp, Artificial Sequence
  chemically synthesized
aatcacttgaacccaggagg

SEQ ID NO: 41996 - DNA, 20 bp, Artificial Sequence
  chemically synthesized
tcacttgaacccaggaggtg

SEQ ID NO: 41997 - DNA, 20 bp, Artificial Sequence
  chemically synthesized
cacttgaacccaggaggtgg

SEQ ID NO: 41998 - DNA, 20 bp, Artificial Sequence
  chemically synthesized
aacccaggaggtggaggttg

SEQ ID NO: 41999 - DNA, 20 bp, Artificial Sequence
  chemically synthesized
caggaggtggaggttgcagt

SEQ ID NO: 42000 - DNA, 20 bp, Artificial Sequence
  chemically synthesized
ggtggaggttgcagtgagct

SEQ ID NO: 42001 - DNA, 20 bp, Artificial Sequence
  chemically synthesized
aagattgcaccactgcactc

SEQ ID NO: 42002 - DNA, 20 bp, Artificial Sequence
  chemically synthesized
tgcaccactgcactccagcc

SEQ ID NO: 42003 - DNA, 20 bp, Artificial Sequence
  chemically synthesized
gcaccactgcactccagcct

SEQ ID NO: 42004 - DNA, 20 bp, Artificial Sequence
  chemically synthesized
ctgcactccagcctaggcga

SEQ ID NO: 42005 - DNA, 20 bp, Artificial Sequence
  chemically synthesized
gcactccagcctaggcgaca

SEQ ID NO: 42006 - DNA, 20 bp, Artificial Sequence
  chemically synthesized
tccagcctaggcgacagagt

SEQ ID NO: 42007 - DNA, 20 bp, Artificial Sequence
  chemically synthesized
ctccatctcaaaaaaaaaaa

SEQ ID NO: 42008 - DNA, 20 bp, Artificial Sequence
  chemically synthesized
catctcaaaaaaaaaaaaag

SEQ ID NO: 42009 - DNA, 20 bp, Artificial Sequence
  chemically synthesized
gtttattatatgaattaact

SEQ ID NO: 42010 - DNA, 20 bp, Artificial Sequence
  chemically synthesized
gttttactcacaccaatact

SEQ ID NO: 42011 - DNA, 20 bp, Artificial Sequence
  chemically synthesized
ttactcacaccaatactcag

SEQ ID NO: 42012 - DNA, 20 bp, Artificial Sequence
  chemically synthesized
ctcacaccaatactcagaag

SEQ ID NO: 42013 - DNA, 20 bp, Artificial Sequence
  chemically synthesized
ttattacctcatttattgat

SEQ ID NO: 42014 - DNA, 20 bp, Artificial Sequence
  chemically synthesized
tattacctcatttattgatg

SEQ ID NO: 42015 - DNA, 20 bp, Artificial Sequence
  chemically synthesized
ttacctcatttattgatgag

SEQ ID NO: 42016 - DNA, 20 bp, Artificial Sequence
  chemically synthesized
tgaggagcccaatgtacttg

SEQ ID NO: 42017 - DNA, 20 bp, Artificial Sequence
  chemically synthesized
agcccaatgtacttgtagtg

SEQ ID NO: 42018 - DNA, 20 bp, Artificial Sequence
  chemically synthesized
agtgtagatcaacttattga

SEQ ID NO: 42019 - DNA, 20 bp, Artificial Sequence
  chemically synthesized
gatcaacttattgaaagcac

SEQ ID NO: 42020 - DNA, 20 bp, Artificial Sequence
  chemically synthesized
tattgaaagcacaagctaat

SEQ ID NO: 42021 - DNA, 20 bp, Artificial Sequence
  chemically synthesized
tgaaagcacaagctaataag

SEQ ID NO: 42022 - DNA, 20 bp, Artificial Sequence
  chemically synthesized
caagctaataagtagacaat

SEQ ID NO: 42023 - DNA, 20 bp, Artificial Sequence
  chemically synthesized
ataagtagacaattagtaat

SEQ ID NO: 42024 - DNA, 20 bp, Artificial Sequence
  chemically synthesized
agtagacaattagtaattag

SEQ ID NO: 42025 - DNA, 20 bp, Artificial Sequence
  chemically synthesized
gacaattagtaattagaagt

SEQ ID NO: 42026 - DNA, 20 bp, Artificial Sequence
  chemically synthesized
attagtaattagaagtcaga

SEQ ID NO: 42027 - DNA, 20 bp, Artificial Sequence
  chemically synthesized
aattagaagtcagatggtct

SEQ ID NO: 42028 - DNA, 20 bp, Artificial Sequence
  chemically synthesized
tcctactgtctacattacat

SEQ ID NO: 42029 - DNA, 20 bp, Artificial Sequence
  chemically synthesized
ttacatgagctcttattaac

SEQ ID NO: 42030 - DNA, 20 bp, Artificial Sequence
  chemically synthesized
tacatgagctcttattaact

SEQ ID NO: 42031 - DNA, 20 bp, Artificial Sequence
  chemically synthesized
acatgagctcttattaactg

SEQ ID NO: 42032 - DNA, 20 bp, Artificial Sequence
  chemically synthesized
aactggggactcgaaaatca

SEQ ID NO: 42033 - DNA, 20 bp, Artificial Sequence
  chemically synthesized
agacatgaaataatttgtcc

SEQ ID NO: 42034 - DNA, 20 bp, Artificial Sequence
  chemically synthesized
aaataatttgtccaagctta

SEQ ID NO: 42035 - DNA, 20 bp, Artificial Sequence
  chemically synthesized
tccaagcttacagaaccacc

SEQ ID NO: 42036 - DNA, 20 bp, Artificial Sequence
  chemically synthesized
aagcttacagaaccaccaag

SEQ ID NO: 42037 - DNA, 20 bp, Artificial Sequence
  chemically synthesized
ttacagaaccaccaagtagt

SEQ ID NO: 42038 - DNA, 20 bp, Artificial Sequence
  chemically synthesized
tacagaaccaccaagtagta

SEQ ID NO: 42039 - DNA, 20 bp, Artificial Sequence
  chemically synthesized
gaaccaccaagtagtaaggc

SEQ ID NO: 42040 - DNA, 20 bp, Artificial Sequence
  chemically synthesized
aaccaccaagtagtaaggct

SEQ ID NO: 42041 - DNA, 20 bp, Artificial Sequence
  chemically synthesized
caagtagtaaggctaggatg

SEQ ID NO: 42042 - DNA, 20 bp, Artificial Sequence
  chemically synthesized
gtaaggctaggatgtagacc

SEQ ID NO: 42043 - DNA, 20 bp, Artificial Sequence
  chemically synthesized
acccagttctgctacctctg

SEQ ID NO: 42044 - DNA, 20 bp, Artificial Sequence
  chemically synthesized
agttctgctacctctgaaga

SEQ ID NO: 42045 - DNA, 20 bp, Artificial Sequence
  chemically synthesized
tgaagacagtgttttttcca

SEQ ID NO: 42046 - DNA, 20 bp, Artificial Sequence
  chemically synthesized
tccacagcaaaacacaaact

SEQ ID NO: 42047 - DNA, 20 bp, Artificial Sequence
  chemically synthesized
aaacacaaactcagatattg

SEQ ID NO: 42048 - DNA, 20 bp, Artificial Sequence
  chemically synthesized
aactcagatattgtggatgc

SEQ ID NO: 42049 - DNA, 20 bp, Artificial Sequence
  chemically synthesized
atattgtggatgcgagaaat

SEQ ID NO: 42050 - DNA, 20 bp, Artificial Sequence
  chemically synthesized
ttgtggatgcgagaaattag

SEQ ID NO: 42051 - DNA, 20 bp, Artificial Sequence
  chemically synthesized
tggatgcgagaaattagaag

SEQ ID NO: 42052 - DNA, 20 bp, Artificial Sequence
  chemically synthesized
aagtagatattcctgccctg

SEQ ID NO: 42053 - DNA, 20 bp, Artificial Sequence
  chemically synthesized
tacttttacttcttgtcgat

SEQ ID NO: 42054 - DNA, 20 bp, Artificial Sequence
  chemically synthesized
ttttacttcttgtcgattgg

SEQ ID NO: 42055 - DNA, 20 bp, Artificial Sequence
  chemically synthesized
ttcttgtcgattggaagttg

SEQ ID NO: 42056 - DNA, 20 bp, Artificial Sequence
  chemically synthesized
tcgattggaagttgtggtcc

SEQ ID NO: 42057 - DNA, 20 bp, Artificial Sequence
  chemically synthesized
ggaagttgtggtccaagcca

SEQ ID NO: 42058 - DNA, 20 bp, Artificial Sequence
  chemically synthesized
tgtggtccaagccacagttg

SEQ ID NO: 42059 - DNA, 20 bp, Artificial Sequence
  chemically synthesized
caaccataattgcatttctt

SEQ ID NO: 42060 - DNA, 20 bp, Artificial Sequence
  chemically synthesized
aaccataattgcatttcttc

SEQ ID NO: 42061 - DNA, 20 bp, Artificial Sequence
  chemically synthesized
ataattgcatttcttcagga

SEQ ID NO: 42062 - DNA, 20 bp, Artificial Sequence
  chemically synthesized
gcatttcttcaggaaagttt

SEQ ID NO: 42063 - DNA, 20 bp, Artificial Sequence
  chemically synthesized
catttcttcaggaaagtttg

SEQ ID NO: 42064 - DNA, 20 bp, Artificial Sequence
  chemically synthesized
atttcttcaggaaagtttga

SEQ ID NO: 42065 - DNA, 20 bp, Artificial Sequence
  chemically synthesized
ttcttcaggaaagtttgagg

SEQ ID NO: 42066 - DNA, 20 bp, Artificial Sequence
  chemically synthesized
aggaaagtttgagggagaaa

SEQ ID NO: 42067 - DNA, 20 bp, Artificial Sequence
  chemically synthesized
ggaaagtttgagggagaaaa

SEQ ID NO: 42068 - DNA, 20 bp, Artificial Sequence
  chemically synthesized
gtttgagggagaaaaaggta

SEQ ID NO: 42069 - DNA, 20 bp, Artificial Sequence
  chemically synthesized
gaaaaaggtaaagaaaaatt

SEQ ID NO: 42070 - DNA, 20 bp, Artificial Sequence
  chemically synthesized
gaaaaatttagaaacaactt

SEQ ID NO: 42071 - DNA, 20 bp, Artificial Sequence
  chemically synthesized
ttagaaacaacttcagaata

SEQ ID NO: 42072 - DNA, 20 bp, Artificial Sequence
  chemically synthesized
agaaacaacttcagaataaa

SEQ ID NO: 42073 - DNA, 20 bp, Artificial Sequence
  chemically synthesized
agaataaagagattttctct

SEQ ID NO: 42074 - DNA, 20 bp, Artificial Sequence
  chemically synthesized
gaataaagagattttctctt

SEQ ID NO: 42075 - DNA, 20 bp, Artificial Sequence
  chemically synthesized
agagattttctcttgggtta

SEQ ID NO: 42076 - DNA, 20 bp, Artificial Sequence
  chemically synthesized
agattttctcttgggttaca

SEQ ID NO: 42077 - DNA, 20 bp, Artificial Sequence
  chemically synthesized
attgtcatatgacaaattat

SEQ ID NO: 42078 - DNA, 20 bp, Artificial Sequence
  chemically synthesized
gtcatatgacaaattataag

SEQ ID NO: 42079 - DNA, 20 bp, Artificial Sequence
  chemically synthesized
caaattataagcagacactt

SEQ ID NO: 42080 - DNA, 20 bp, Artificial Sequence
  chemically synthesized
gcagacacttgagaaaactg

SEQ ID NO: 42081 - DNA, 20 bp, Artificial Sequence
  chemically synthesized
cagacacttgagaaaactga

SEQ ID NO: 42082 - DNA, 20 bp, Artificial Sequence
  chemically synthesized
caaattaccctttgacccct

SEQ ID NO: 42083 - DNA, 20 bp, Artificial Sequence
  chemically synthesized
taccctttgaccccttggtc

SEQ ID NO: 42084 - DNA, 20 bp, Artificial Sequence
  chemically synthesized
ccttggtcaagctgcaactt

SEQ ID NO: 42085 - DNA, 20 bp, Artificial Sequence
  chemically synthesized
tcaagctgcaactttggtta

SEQ ID NO: 42086 - DNA, 20 bp, Artificial Sequence
  chemically synthesized
caagctgcaactttggttaa

SEQ ID NO: 42087 - DNA, 20 bp, Artificial Sequence
  chemically synthesized
aagctgcaactttggttaaa

SEQ ID NO: 42088 - DNA, 20 bp, Artificial Sequence
  chemically synthesized
gctgcaactttggttaaagg

SEQ ID NO: 42089 - DNA, 20 bp, Artificial Sequence
  chemically synthesized
aagggagtgtttatgtgtta

SEQ ID NO: 42090 - DNA, 20 bp, Artificial Sequence
  chemically synthesized
atagtgttcatttactcttc

SEQ ID NO: 42091 - DNA, 20 bp, Artificial Sequence
  chemically synthesized
actcttctggtctaacccat

SEQ ID NO: 42092 - DNA, 20 bp, Artificial Sequence
  chemically synthesized
ttggctccgtcttcatcctg

SEQ ID NO: 42093 - DNA, 20 bp, Artificial Sequence
  chemically synthesized
tcttcatcctgcagtgacct

SEQ ID NO: 42094 - DNA, 20 bp, Artificial Sequence
  chemically synthesized
ctgcagtgacctcagtgcct

SEQ ID NO: 42095 - DNA, 20 bp, Artificial Sequence
  chemically synthesized
gaaacatacatatgtttgtc

SEQ ID NO: 42096 - DNA, 20 bp, Artificial Sequence
  chemically synthesized
tacatatgtttgtctagttt

SEQ ID NO: 42097 - DNA, 20 bp, Artificial Sequence
  chemically synthesized
agtttgtgtgaaattctaac

SEQ ID NO: 42098 - DNA, 20 bp, Artificial Sequence
  chemically synthesized
gtgaaattctaactagcgtc

SEQ ID NO: 42099 - DNA, 20 bp, Artificial Sequence
  chemically synthesized
tctaactagcgtcaagaact

SEQ ID NO: 42100 - DNA, 20 bp, Artificial Sequence
  chemically synthesized
ctaactagcgtcaagaactg

SEQ ID NO: 42101 - DNA, 20 bp, Artificial Sequence
  chemically synthesized
taactagcgtcaagaactga

SEQ ID NO: 42102 - DNA, 20 bp, Artificial Sequence
  chemically synthesized
ctgagggccctaaactatgc

SEQ ID NO: 42103 - DNA, 20 bp, Artificial Sequence
  chemically synthesized
tgagggccctaaactatgct

SEQ ID NO: 42104 - DNA, 20 bp, Artificial Sequence
  chemically synthesized
gccctaaactatgctaggaa

SEQ ID NO: 42105 - DNA, 20 bp, Artificial Sequence
  chemically synthesized
ctatgctaggaatagtgctg

SEQ ID NO: 42106 - DNA, 20 bp, Artificial Sequence
  chemically synthesized
atagtgctgtggtgctgtga

SEQ ID NO: 42107 - DNA, 20 bp, Artificial Sequence
  chemically synthesized
tagtgctgtggtgctgtgat

SEQ ID NO: 42108 - DNA, 20 bp, Artificial Sequence
  chemically synthesized
tggtgctgtgataggtacac

SEQ ID NO: 42109 - DNA, 20 bp, Artificial Sequence
  chemically synthesized
gtgataggtacacaagaaat

SEQ ID NO: 42110 - DNA, 20 bp, Artificial Sequence
  chemically synthesized
ataggtacacaagaaatgag

SEQ ID NO: 42111 - DNA, 20 bp, Artificial Sequence
  chemically synthesized
caagaaatgagaagaaactg

SEQ ID NO: 42112 - DNA, 20 bp, Artificial Sequence
  chemically synthesized
ttctctgcatctccctttgc

SEQ ID NO: 42113 - DNA, 20 bp, Artificial Sequence
  chemically synthesized
tctctgcatctccctttgcc

SEQ ID NO: 42114 - DNA, 20 bp, Artificial Sequence
  chemically synthesized
ctttgccgggtctgacaaca

SEQ ID NO: 42115 - DNA, 20 bp, Artificial Sequence
  chemically synthesized
tccccaaattttaccaatgc

SEQ ID NO: 42116 - DNA, 20 bp, Artificial Sequence
  chemically synthesized
ctaactactttaaaatcatt

SEQ ID NO: 42117 - DNA, 20 bp, Artificial Sequence
  chemically synthesized
taactactttaaaatcattt

SEQ ID NO: 42118 - DNA, 20 bp, Artificial Sequence
  chemically synthesized
aactactttaaaatcatttg

SEQ ID NO: 42119 - DNA, 20 bp, Artificial Sequence
  chemically synthesized
ttgtctttctcatctgtaaa

SEQ ID NO: 42120 - DNA, 20 bp, Artificial Sequence
  chemically synthesized
tttctcatctgtaaaaagaa

SEQ ID NO: 42121 - DNA, 20 bp, Artificial Sequence
  chemically synthesized
ctcatctgtaaaaagaatgg

SEQ ID NO: 42122 - DNA, 20 bp, Artificial Sequence
  chemically synthesized
aatggaagaactcattccta

SEQ ID NO: 42123 - DNA, 20 bp, Artificial Sequence
  chemically synthesized
actccctatgtcttccctga

SEQ ID NO: 42124 - DNA, 20 bp, Artificial Sequence
  chemically synthesized
ctccctatgtcttccctgat

SEQ ID NO: 42125 - DNA, 20 bp, Artificial Sequence
  chemically synthesized
ctatgtcttccctgatgggc

SEQ ID NO: 42126 - DNA, 20 bp, Artificial Sequence
  chemically synthesized
atgtcttccctgatgggcta

SEQ ID NO: 42127 - DNA, 20 bp, Artificial Sequence
  chemically synthesized
agttcctctttctcaaaaat

SEQ ID NO: 42128 - DNA, 20 bp, Artificial Sequence
  chemically synthesized
ccattattgtatttccttct

SEQ ID NO: 42129 - DNA, 20 bp, Artificial Sequence
  chemically synthesized
ttgtatttccttctaagcca

SEQ ID NO: 42130 - DNA, 20 bp, Artificial Sequence
  chemically synthesized
tttccttctaagccaaagct

SEQ ID NO: 42131 - DNA, 20 bp, Artificial Sequence
  chemically synthesized
tccttctaagccaaagctca

SEQ ID NO: 42132 - DNA, 20 bp, Artificial Sequence
  chemically synthesized
ccttctaagccaaagctcag

SEQ ID NO: 42133 - DNA, 20 bp, Artificial Sequence
  chemically synthesized
ctcagaggtcttgtattgcc

SEQ ID NO: 42134 - DNA, 20 bp, Artificial Sequence
  chemically synthesized
ttgcccagtgacatgcacac

SEQ ID NO: 42135 - DNA, 20 bp, Artificial Sequence
  chemically synthesized
gtgacatgcacactggtcaa

SEQ ID NO: 42136 - DNA, 20 bp, Artificial Sequence
  chemically synthesized
acatgcacactggtcaaaag

SEQ ID NO: 42137 - DNA, 20 bp, Artificial Sequence
  chemically synthesized
catgcacactggtcaaaagt

SEQ ID NO: 42138 - DNA, 20 bp, Artificial Sequence
  chemically synthesized
acactggtcaaaagtaggct

SEQ ID NO: 42139 - DNA, 20 bp, Artificial Sequence
  chemically synthesized
ctggtcaaaagtaggctaag

SEQ ID NO: 42140 - DNA, 20 bp, Artificial Sequence
  chemically synthesized
gtcaaaagtaggctaagtag

SEQ ID NO: 42141 - DNA, 20 bp, Artificial Sequence
  chemically synthesized
tcaaaagtaggctaagtaga

SEQ ID NO: 42142 - DNA, 20 bp, Artificial Sequence
  chemically synthesized
caaaagtaggctaagtagaa

SEQ ID NO: 42143 - DNA, 20 bp, Artificial Sequence
  chemically synthesized
taagtagaagggtactttca

SEQ ID NO: 42144 - DNA, 20 bp, Artificial Sequence
  chemically synthesized
aagtagaagggtactttcac

SEQ ID NO: 42145 - DNA, 20 bp, Artificial Sequence
  chemically synthesized
gaagggtactttcacaggaa

SEQ ID NO: 42146 - DNA, 20 bp, Artificial Sequence
  chemically synthesized
agggtactttcacaggaaca

SEQ ID NO: 42147 - DNA, 20 bp, Artificial Sequence
  chemically synthesized
ggtactttcacaggaacaga

SEQ ID NO: 42148 - DNA, 20 bp, Artificial Sequence
  chemically synthesized
ttcacaggaacagagagcaa

SEQ ID NO: 42149 - DNA, 20 bp, Artificial Sequence
  chemically synthesized
cacaggaacagagagcaaaa

SEQ ID NO: 42150 - DNA, 20 bp, Artificial Sequence
  chemically synthesized
acaggaacagagagcaaaag

SEQ ID NO: 42151 - DNA, 20 bp, Artificial Sequence
  chemically synthesized
ggaacagagagcaaaagagg

SEQ ID NO: 42152 - DNA, 20 bp, Artificial Sequence
  chemically synthesized
gaacagagagcaaaagaggt

SEQ ID NO: 42153 - DNA, 20 bp, Artificial Sequence
  chemically synthesized
agcaaaagaggtgggtgaat

SEQ ID NO: 42154 - DNA, 20 bp, Artificial Sequence
  chemically synthesized
caaaagaggtgggtgaatga

SEQ ID NO: 42155 - DNA, 20 bp, Artificial Sequence
  chemically synthesized
aaaagaggtgggtgaatgag

SEQ ID NO: 42156 - DNA, 20 bp, Artificial Sequence
  chemically synthesized
aaagaggtgggtgaatgaga

SEQ ID NO: 42157 - DNA, 20 bp, Artificial Sequence
  chemically synthesized
aggtgggtgaatgagagggt

SEQ ID NO: 42158 - DNA, 20 bp, Artificial Sequence
  chemically synthesized
gggtgaatgagagggtaagt

SEQ ID NO: 42159 - DNA, 20 bp, Artificial Sequence
  chemically synthesized
aatgagagggtaagtgagaa

SEQ ID NO: 42160 - DNA, 20 bp, Artificial Sequence
  chemically synthesized
gtaagtgagaaaagacaaat

SEQ ID NO: 42161 - DNA, 20 bp, Artificial Sequence
  chemically synthesized
agtgagaaaagacaaatgag

SEQ ID NO: 42162 - DNA, 20 bp, Artificial Sequence
  chemically synthesized
aatgagaagttacaacatga

SEQ ID NO: 42163 - DNA, 20 bp, Artificial Sequence
  chemically synthesized
cttgttgtctaaatatctcc

SEQ ID NO: 42164 - DNA, 20 bp, Artificial Sequence
  chemically synthesized
ttgttgtctaaatatctcct

SEQ ID NO: 42165 - DNA, 20 bp, Artificial Sequence
  chemically synthesized
tgttgtctaaatatctccta

SEQ ID NO: 42166 - DNA, 20 bp, Artificial Sequence
  chemically synthesized
atctcctagggaattattgt

SEQ ID NO: 42167 - DNA, 20 bp, Artificial Sequence
  chemically synthesized
ctcctagggaattattgtga

SEQ ID NO: 42168 - DNA, 20 bp, Artificial Sequence
  chemically synthesized
tcctagggaattattgtgag

SEQ ID NO: 42169 - DNA, 20 bp, Artificial Sequence
  chemically synthesized
attattgtgagaggtctgaa

SEQ ID NO: 42170 - DNA, 20 bp, Artificial Sequence
  chemically synthesized
tctgaatagtgttgtaaaat

SEQ ID NO: 42171 - DNA, 20 bp, Artificial Sequence
  chemically synthesized
gaatctgctgccaacattaa

SEQ ID NO: 42172 - DNA, 20 bp, Artificial Sequence
  chemically synthesized
tgctgccaacattaacagtc

SEQ ID NO: 42173 - DNA, 20 bp, Artificial Sequence
  chemically synthesized
tgtacctccaattattcttt

SEQ ID NO: 42174 - DNA, 20 bp, Artificial Sequence
  chemically synthesized
gtacctccaattattcttta

SEQ ID NO: 42175 - DNA, 20 bp, Artificial Sequence
  chemically synthesized
cctccaattattctttaagg

SEQ ID NO: 42176 - DNA, 20 bp, Artificial Sequence
  chemically synthesized
aaggtagcatgcaactgtaa

SEQ ID NO: 42177 - DNA, 20 bp, Artificial Sequence
  chemically synthesized
tatttatcataatactgtaa

SEQ ID NO: 42178 - DNA, 20 bp, Artificial Sequence
  chemically synthesized
ctgaatatatactgtgtccc

SEQ ID NO: 42179 - DNA, 20 bp, Artificial Sequence
  chemically synthesized
tctcatcctcataattctat

SEQ ID NO: 42180 - DNA, 20 bp, Artificial Sequence
  chemically synthesized
catattatcatcctatattt

SEQ ID NO: 42181 - DNA, 20 bp, Artificial Sequence
  chemically synthesized
tattatcatcctatatttca

SEQ ID NO: 42182 - DNA, 20 bp, Artificial Sequence
  chemically synthesized
tcctatatttcagagacttc

SEQ ID NO: 42183 - DNA, 20 bp, Artificial Sequence
  chemically synthesized
tatatttcagagacttcaag

SEQ ID NO: 42184 - DNA, 20 bp, Artificial Sequence
  chemically synthesized
ttcagagacttcaagaagtt

SEQ ID NO: 42185 - DNA, 20 bp, Artificial Sequence
  chemically synthesized
agaagttaagcaacttgctc

SEQ ID NO: 42186 - DNA, 20 bp, Artificial Sequence
  chemically synthesized
caacttgctcaagatcatct

SEQ ID NO: 42187 - DNA, 20 bp, Artificial Sequence
  chemically synthesized
cttgctcaagatcatctaag

SEQ ID NO: 42188 - DNA, 20 bp, Artificial Sequence
  chemically synthesized
gctcaagatcatctaagaag

SEQ ID NO: 42189 - DNA, 20 bp, Artificial Sequence
  chemically synthesized
ctcaagatcatctaagaagt

SEQ ID NO: 42190 - DNA, 20 bp, Artificial Sequence
  chemically synthesized
aagatcatctaagaagtagg

SEQ ID NO: 42191 - DNA, 20 bp, Artificial Sequence
  chemically synthesized
taagaagtaggtggtatttc

SEQ ID NO: 42192 - DNA, 20 bp, Artificial Sequence
  chemically synthesized
aagaagtaggtggtatttct

SEQ ID NO: 42193 - DNA, 20 bp, Artificial Sequence
  chemically synthesized
gtggtatttctgggctcatt

SEQ ID NO: 42194 - DNA, 20 bp, Artificial Sequence
  chemically synthesized
tggcccctcctaatctctca

SEQ ID NO: 42195 - DNA, 20 bp, Artificial Sequence
  chemically synthesized
cctaatctctcatggcaaca

SEQ ID NO: 42196 - DNA, 20 bp, Artificial Sequence
  chemically synthesized
catggcaacatggctgccta

SEQ ID NO: 42197 - DNA, 20 bp, Artificial Sequence
  chemically synthesized
tgttgattgccttaattcat

SEQ ID NO: 42198 - DNA, 20 bp, Artificial Sequence
  chemically synthesized
gttgattgccttaattcatc

SEQ ID NO: 42199 - DNA, 20 bp, Artificial Sequence
  chemically synthesized
ttgattgccttaattcatca

SEQ ID NO: 42200 - DNA, 20 bp, Artificial Sequence
  chemically synthesized
ttgccttaattcatcaggga

SEQ ID NO: 42201 - DNA, 20 bp, Artificial Sequence
  chemically synthesized
tgccttaattcatcagggat

SEQ ID NO: 42202 - DNA, 20 bp, Artificial Sequence
  chemically synthesized
ggatgggctcatactcactg

SEQ ID NO: 42203 - DNA, 20 bp, Artificial Sequence
  chemically synthesized
tactcactgcagaccttaac

SEQ ID NO: 42204 - DNA, 20 bp, Artificial Sequence
  chemically synthesized
ttatgtgatctgcctgaccc

SEQ ID NO: 42205 - DNA, 20 bp, Artificial Sequence
  chemically synthesized
tgtgatctgcctgaccctag

SEQ ID NO: 42206 - DNA, 20 bp, Artificial Sequence
  chemically synthesized
agacttatgaaatttctgat

SEQ ID NO: 42207 - DNA, 20 bp, Artificial Sequence
  chemically synthesized
ttatgaaatttctgatgaga

SEQ ID NO: 42208 - DNA, 20 bp, Artificial Sequence
  chemically synthesized
tatgaaatttctgatgagaa

SEQ ID NO: 42209 - DNA, 20 bp, Artificial Sequence
  chemically synthesized
tgaaatttctgatgagaaag

SEQ ID NO: 42210 - DNA, 20 bp, Artificial Sequence
  chemically synthesized
aaatttctgatgagaaagga

SEQ ID NO: 42211 - DNA, 20 bp, Artificial Sequence
  chemically synthesized
atttctgatgagaaaggaga

SEQ ID NO: 42212 - DNA, 20 bp, Artificial Sequence
  chemically synthesized
tttctgatgagaaaggagag

SEQ ID NO: 42213 - DNA, 20 bp, Artificial Sequence
  chemically synthesized
tctgatgagaaaggagagag

SEQ ID NO: 42214 - DNA, 20 bp, Artificial Sequence
  chemically synthesized
atgagaaaggagagaggaga

SEQ ID NO: 42215 - DNA, 20 bp, Artificial Sequence
  chemically synthesized
tgagaaaggagagaggagaa

SEQ ID NO: 42216 - DNA, 20 bp, Artificial Sequence
  chemically synthesized
gaaaggagagaggagaaagg

SEQ ID NO: 42217 - DNA, 20 bp, Artificial Sequence
  chemically synthesized
aaggagagaggagaaaggca

SEQ ID NO: 42218 - DNA, 20 bp, Artificial Sequence
  chemically synthesized
aaggcagagctgactgtgat

SEQ ID NO: 42219 - DNA, 20 bp, Artificial Sequence
  chemically synthesized
gctgactgtgatgagtgatg

SEQ ID NO: 42220 - DNA, 20 bp, Artificial Sequence
  chemically synthesized
ctgactgtgatgagtgatga

SEQ ID NO: 42221 - DNA, 20 bp, Artificial Sequence
  chemically synthesized
gatgaaggtgccttctcatc

SEQ ID NO: 42222 - DNA, 20 bp, Artificial Sequence
  chemically synthesized
atgaaggtgccttctcatct

SEQ ID NO: 42223 - DNA, 20 bp, Artificial Sequence
  chemically synthesized
gtgccttctcatctgggtac

SEQ ID NO: 42224 - DNA, 20 bp, Artificial Sequence
  chemically synthesized
ccttctcatctgggtaccag

SEQ ID NO: 42225 - DNA, 20 bp, Artificial Sequence
  chemically synthesized
cttctcatctgggtaccagt

SEQ ID NO: 42226 - DNA, 20 bp, Artificial Sequence
  chemically synthesized
ttctcatctgggtaccagtg

SEQ ID NO: 42227 - DNA, 20 bp, Artificial Sequence
  chemically synthesized
tgggtaccagtggggcctct

SEQ ID NO: 42228 - DNA, 20 bp, Artificial Sequence
  chemically synthesized
ccagtggggcctctaagact

SEQ ID NO: 42229 - DNA, 20 bp, Artificial Sequence
  chemically synthesized
cactctgtctcactgtgtct

SEQ ID NO: 42230 - DNA, 20 bp, Artificial Sequence
  chemically synthesized
ctgtctcactgtgtcttagc

SEQ ID NO: 42231 - DNA, 20 bp, Artificial Sequence
  chemically synthesized
gtgtcttagccagttcctta

SEQ ID NO: 42232 - DNA, 20 bp, Artificial Sequence
  chemically synthesized
ttccttacagcttgccctga

SEQ ID NO: 42233 - DNA, 20 bp, Artificial Sequence
  chemically synthesized
tccttacagcttgccctgat

SEQ ID NO: 42234 - DNA, 20 bp, Artificial Sequence
  chemically synthesized
cttacagcttgccctgatgg

SEQ ID NO: 42235 - DNA, 20 bp, Artificial Sequence
  chemically synthesized
cagcttgccctgatgggaga

SEQ ID NO: 42236 - DNA, 20 bp, Artificial Sequence
  chemically synthesized
gcttgccctgatgggagata

SEQ ID NO: 42237 - DNA, 20 bp, Artificial Sequence
  chemically synthesized
ccctgatgggagatagagaa

SEQ ID NO: 42238 - DNA, 20 bp, Artificial Sequence
  chemically synthesized
cctgatgggagatagagaat

SEQ ID NO: 42239 - DNA, 20 bp, Artificial Sequence
  chemically synthesized
aaaataaattttcatttctc

SEQ ID NO: 42240 - DNA, 20 bp, Artificial Sequence
  chemically synthesized
aaataaattttcatttctca

SEQ ID NO: 42241 - DNA, 20 bp, Artificial Sequence
  chemically synthesized
ccactctctaaaataatcca

SEQ ID NO: 42242 - DNA, 20 bp, Artificial Sequence
  chemically synthesized
tctctaaaataatccacagt

SEQ ID NO: 42243 - DNA, 20 bp, Artificial Sequence
  chemically synthesized
tctaaaataatccacagtga

SEQ ID NO: 42244 - DNA, 20 bp, Artificial Sequence
  chemically synthesized
ataaatacctctattaaata

SEQ ID NO: 42245 - DNA, 20 bp, Artificial Sequence
  chemically synthesized
tctattaaatatggaaaatc

SEQ ID NO: 42246 - DNA, 20 bp, Artificial Sequence
  chemically synthesized
ctattaaatatggaaaatct

SEQ ID NO: 42247 - DNA, 20 bp, Artificial Sequence
  chemically synthesized
aaatatggaaaatctgggca

SEQ ID NO: 42248 - DNA, 20 bp, Artificial Sequence
  chemically synthesized
gtgtctcacacctgtaatcc

SEQ ID NO: 42249 - DNA, 20 bp, Artificial Sequence
  chemically synthesized
cacctgtaatcccagcactt

SEQ ID NO: 42250 - DNA, 20 bp, Artificial Sequence
  chemically synthesized
acctgtaatcccagcacttt

SEQ ID NO: 42251 - DNA, 20 bp, Artificial Sequence
  chemically synthesized
ctgtaatcccagcactttgg

SEQ ID NO: 42252 - DNA, 20 bp, Artificial Sequence
  chemically synthesized
tgtaatcccagcactttggg

SEQ ID NO: 42253 - DNA, 20 bp, Artificial Sequence
  chemically synthesized
tcccagcactttgggaggct

SEQ ID NO: 42254 - DNA, 20 bp, Artificial Sequence
  chemically synthesized
cccagcactttgggaggctg

SEQ ID NO: 42255 - DNA, 20 bp, Artificial Sequence
  chemically synthesized
agcactttgggaggctgagg

SEQ ID NO: 42256 - DNA, 20 bp, Artificial Sequence
  chemically synthesized
gcactttgggaggctgaggt

SEQ ID NO: 42257 - DNA, 20 bp, Artificial Sequence
  chemically synthesized
ctttgggaggctgaggtggg

SEQ ID NO: 42258 - DNA, 20 bp, Artificial Sequence
  chemically synthesized
gctgaggtgggtggactgct

SEQ ID NO: 42259 - DNA, 20 bp, Artificial Sequence
  chemically synthesized
tgaggtgggtggactgcttg

SEQ ID NO: 42260 - DNA, 20 bp, Artificial Sequence
  chemically synthesized
tgggtggactgcttggagct

SEQ ID NO: 42261 - DNA, 20 bp, Artificial Sequence
  chemically synthesized
gggtggactgcttggagctc

SEQ ID NO: 42262 - DNA, 20 bp, Artificial Sequence
  chemically synthesized
gtggactgcttggagctcag

SEQ ID NO: 42263 - DNA, 20 bp, Artificial Sequence
  chemically synthesized
tgcttggagctcaggagttc

SEQ ID NO: 42264 - DNA, 20 bp, Artificial Sequence
  chemically synthesized
tcaggagttcaagaccatct

SEQ ID NO: 42265 - DNA, 20 bp, Artificial Sequence
  chemically synthesized
caagaccatcttggacaaca

SEQ ID NO: 42266 - DNA, 20 bp, Artificial Sequence
  chemically synthesized
tgataccctgcctctacaaa

SEQ ID NO: 42267 - DNA, 20 bp, Artificial Sequence
  chemically synthesized
tctacaaaaagtacaaaaat

SEQ ID NO: 42268 - DNA, 20 bp, Artificial Sequence
  chemically synthesized
aaaaagtacaaaaattagcc

SEQ ID NO: 42269 - DNA, 20 bp, Artificial Sequence
  chemically synthesized
gtacaaaaattagcctggca

SEQ ID NO: 42270 - DNA, 20 bp, Artificial Sequence
  chemically synthesized
caaaaattagcctggcatgg

SEQ ID NO: 42271 - DNA, 20 bp, Artificial Sequence
  chemically synthesized
gtggtgtgcacctgtaatcc

SEQ ID NO: 42272 - DNA, 20 bp, Artificial Sequence
  chemically synthesized
gcacctgtaatcccagctat

SEQ ID NO: 42273 - DNA, 20 bp, Artificial Sequence
  chemically synthesized
cacctgtaatcccagctatt

SEQ ID NO: 42274 - DNA, 20 bp, Artificial Sequence
  chemically synthesized
acctgtaatcccagctatta

SEQ ID NO: 42275 - DNA, 20 bp, Artificial Sequence
  chemically synthesized
tgtaatcccagctattaggg

SEQ ID NO: 42276 - DNA, 20 bp, Artificial Sequence
  chemically synthesized
tcccagctattagggtggct

SEQ ID NO: 42277 - DNA, 20 bp, Artificial Sequence
  chemically synthesized
cccagctattagggtggctg

SEQ ID NO: 42278 - DNA, 20 bp, Artificial Sequence
  chemically synthesized
agctattagggtggctgagg

SEQ ID NO: 42279 - DNA, 20 bp, Artificial Sequence
  chemically synthesized
gctattagggtggctgaggc

SEQ ID NO: 42280 - DNA, 20 bp, Artificial Sequence
  chemically synthesized
tattagggtggctgaggcag

SEQ ID NO: 42281 - DNA, 20 bp, Artificial Sequence
  chemically synthesized
gcaggagaattgcttgaacc

SEQ ID NO: 42282 - DNA, 20 bp, Artificial Sequence
  chemically synthesized
caggagaattgcttgaaccc

SEQ ID NO: 42283 - DNA, 20 bp, Artificial Sequence
  chemically synthesized
ggagaattgcttgaacccgg

SEQ ID NO: 42284 - DNA, 20 bp, Artificial Sequence
  chemically synthesized
gagaattgcttgaacccggg

SEQ ID NO: 42285 - DNA, 20 bp, Artificial Sequence
  chemically synthesized
aattgcttgaacccgggagg

SEQ ID NO: 42286 - DNA, 20 bp, Artificial Sequence
  chemically synthesized
ttgcttgaacccgggaggcg

SEQ ID NO: 42287 - DNA, 20 bp, Artificial Sequence
  chemically synthesized
tgcttgaacccgggaggcgg

SEQ ID NO: 42288 - DNA, 20 bp, Artificial Sequence
  chemically synthesized
aacccgggaggcggaggttg

SEQ ID NO: 42289 - DNA, 20 bp, Artificial Sequence
  chemically synthesized
cgggaggcggaggttgcagt

SEQ ID NO: 42290 - DNA, 20 bp, Artificial Sequence
  chemically synthesized
ggcggaggttgcagtgagct

SEQ ID NO: 42291 - DNA, 20 bp, Artificial Sequence
  chemically synthesized
gagatcgtgccactgcactc

SEQ ID NO: 42292 - DNA, 20 bp, Artificial Sequence
  chemically synthesized
cgtgccactgcactccagcc

SEQ ID NO: 42293 - DNA, 20 bp, Artificial Sequence
  chemically synthesized
gtgccactgcactccagcct

SEQ ID NO: 42294 - DNA, 20 bp, Artificial Sequence
  chemically synthesized
tgccactgcactccagcctg

SEQ ID NO: 42295 - DNA, 20 bp, Artificial Sequence
  chemically synthesized
gccactgcactccagcctgg

SEQ ID NO: 42296 - DNA, 20 bp, Artificial Sequence
  chemically synthesized
ctgcactccagcctggggga

SEQ ID NO: 42297 - DNA, 20 bp, Artificial Sequence
  chemically synthesized
gcactccagcctgggggaca

SEQ ID NO: 42298 - DNA, 20 bp, Artificial Sequence
  chemically synthesized
attaactgttattttttact

SEQ ID NO: 42299 - DNA, 20 bp, Artificial Sequence
  chemically synthesized
attttttacttggactcttg

SEQ ID NO: 42300 - DNA, 20 bp, Artificial Sequence
  chemically synthesized
ttttttacttggactcttgt

SEQ ID NO: 42301 - DNA, 20 bp, Artificial Sequence
  chemically synthesized
tttttacttggactcttgtg

SEQ ID NO: 42302 - DNA, 20 bp, Artificial Sequence
  chemically synthesized
cttggactcttgtggggaat

SEQ ID NO: 42303 - DNA, 20 bp, Artificial Sequence
  chemically synthesized
tttattcttatttatgattc

SEQ ID NO: 42304 - DNA, 20 bp, Artificial Sequence
  chemically synthesized
tatgattcaagcactgaaaa

SEQ ID NO: 42305 - DNA, 20 bp, Artificial Sequence
  chemically synthesized
caagcactgaaaatagtgtt

SEQ ID NO: 42306 - DNA, 20 bp, Artificial Sequence
  chemically synthesized
tgaaaatagtgtttagcatc

SEQ ID NO: 42307 - DNA, 20 bp, Artificial Sequence
  chemically synthesized
aaatagtgtttagcatccag

SEQ ID NO: 42308 - DNA, 20 bp, Artificial Sequence
  chemically synthesized
aatagtgtttagcatccagc

SEQ ID NO: 42309 - DNA, 20 bp, Artificial Sequence
  chemically synthesized
atgattactatactttttac

SEQ ID NO: 42310 - DNA, 20 bp, Artificial Sequence
  chemically synthesized
tactatactttttacaagct

SEQ ID NO: 42311 - DNA, 20 bp, Artificial Sequence
  chemically synthesized
tcagctccctctatcccttc

SEQ ID NO: 42312 - DNA, 20 bp, Artificial Sequence
  chemically synthesized
atcctcatctctgattaaat

SEQ ID NO: 42313 - DNA, 20 bp, Artificial Sequence
  chemically synthesized
atctctgattaaataagctt

SEQ ID NO: 42314 - DNA, 20 bp, Artificial Sequence
  chemically synthesized
aataagcttcagtttttcct

SEQ ID NO: 42315 - DNA, 20 bp, Artificial Sequence
  chemically synthesized
acatttctgtgtgtctccat

SEQ ID NO: 42316 - DNA, 20 bp, Artificial Sequence
  chemically synthesized
tctccattagtgacctccca

SEQ ID NO: 42317 - DNA, 20 bp, Artificial Sequence
  chemically synthesized
ttagtgacctcccatagtcc

SEQ ID NO: 42318 - DNA, 20 bp, Artificial Sequence
  chemically synthesized
acctcccatagtccaagcat

SEQ ID NO: 42319 - DNA, 20 bp, Artificial Sequence
  chemically synthesized
tcccatagtccaagcatgag

SEQ ID NO: 42320 - DNA, 20 bp, Artificial Sequence
  chemically synthesized
agtccaagcatgagcagttc

SEQ ID NO: 42321 - DNA, 20 bp, Artificial Sequence
  chemically synthesized
caagcatgagcagttctggc

SEQ ID NO: 42322 - DNA, 20 bp, Artificial Sequence
  chemically synthesized
aagcatgagcagttctggcc

SEQ ID NO: 42323 - DNA, 20 bp, Artificial Sequence
  chemically synthesized
agttctggccaggcccctgt

SEQ ID NO: 42324 - DNA, 20 bp, Artificial Sequence
  chemically synthesized
gttctggccaggcccctgtc

SEQ ID NO: 42325 - DNA, 20 bp, Artificial Sequence
  chemically synthesized
ttctggccaggcccctgtcg

SEQ ID NO: 42326 - DNA, 20 bp, Artificial Sequence
  chemically synthesized
ggccaggcccctgtcggggt

SEQ ID NO: 42327 - DNA, 20 bp, Artificial Sequence
  chemically synthesized
agtgccccacccccgccttc

SEQ ID NO: 42328 - DNA, 20 bp, Artificial Sequence
  chemically synthesized
ctggttctgtgtaaccttct

SEQ ID NO: 42329 - DNA, 20 bp, Artificial Sequence
  chemically synthesized
aaccttctaagcaaaccttc

SEQ ID NO: 42330 - DNA, 20 bp, Artificial Sequence
  chemically synthesized
ctaagcaaaccttctggctc

SEQ ID NO: 42331 - DNA, 20 bp, Artificial Sequence
  chemically synthesized
caaaccttctggctcaagca

SEQ ID NO: 42332 - DNA, 20 bp, Artificial Sequence
  chemically synthesized
ggctcaagcacagcaatgct

SEQ ID NO: 42333 - DNA, 20 bp, Artificial Sequence
  chemically synthesized
cagcaatgctgagtcatgat

SEQ ID NO: 42334 - DNA, 20 bp, Artificial Sequence
  chemically synthesized
gagtcatgatgagtcatgct

SEQ ID NO: 42335 - DNA, 20 bp, Artificial Sequence
  chemically synthesized
agtcatgatgagtcatgctg

SEQ ID NO: 42336 - DNA, 20 bp, Artificial Sequence
  chemically synthesized
tgatgagtcatgctgaggct

SEQ ID NO: 42337 - DNA, 20 bp, Artificial Sequence
  chemically synthesized
gatgagtcatgctgaggctt

SEQ ID NO: 42338 - DNA, 20 bp, Artificial Sequence
  chemically synthesized
atgagtcatgctgaggctta

SEQ ID NO: 42339 - DNA, 20 bp, Artificial Sequence
  chemically synthesized
tgaggcttagggtgtgtgcc

SEQ ID NO: 42340 - DNA, 20 bp, Artificial Sequence
  chemically synthesized
ggtgtgtgcccagatgttct

SEQ ID NO: 42341 - DNA, 20 bp, Artificial Sequence
  chemically synthesized
gtgcccagatgttctcagcc

SEQ ID NO: 42342 - DNA, 20 bp, Artificial Sequence
  chemically synthesized
gcccagatgttctcagccta

SEQ ID NO: 42343 - DNA, 20 bp, Artificial Sequence
  chemically synthesized
ctagagtgatgactcctatc

SEQ ID NO: 42344 - DNA, 20 bp, Artificial Sequence
  chemically synthesized
tagagtgatgactcctatct

SEQ ID NO: 42345 - DNA, 20 bp, Artificial Sequence
  chemically synthesized
atgactcctatctgggtccc

SEQ ID NO: 42346 - DNA, 20 bp, Artificial Sequence
  chemically synthesized
actcctatctgggtccccag

SEQ ID NO: 42347 - DNA, 20 bp, Artificial Sequence
  chemically synthesized
ctcctatctgggtccccagc

SEQ ID NO: 42348 - DNA, 20 bp, Artificial Sequence
  chemically synthesized
ggtccccagcaggatgctta

SEQ ID NO: 42349 - DNA, 20 bp, Artificial Sequence
  chemically synthesized
gtccccagcaggatgcttac

SEQ ID NO: 42350 - DNA, 20 bp, Artificial Sequence
  chemically synthesized
tccccagcaggatgcttaca

SEQ ID NO: 42351 - DNA, 20 bp, Artificial Sequence
  chemically synthesized
ccagcaggatgcttacaggg

SEQ ID NO: 42352 - DNA, 20 bp, Artificial Sequence
  chemically synthesized
caggatgcttacagggcaga

SEQ ID NO: 42353 - DNA, 20 bp, Artificial Sequence
  chemically synthesized
acagggcagatggcaaaaaa

SEQ ID NO: 42354 - DNA, 20 bp, Artificial Sequence
  chemically synthesized
cagggcagatggcaaaaaaa

SEQ ID NO: 42355 - DNA, 20 bp, Artificial Sequence
  chemically synthesized
gggcagatggcaaaaaaaag

SEQ ID NO: 42356 - DNA, 20 bp, Artificial Sequence
  chemically synthesized
cagatggcaaaaaaaaggag

SEQ ID NO: 42357 - DNA, 20 bp, Artificial Sequence
  chemically synthesized
gactaaaactccacctcaaa

SEQ ID NO: 42358 - DNA, 20 bp, Artificial Sequence
  chemically synthesized
ccacctcaaacggcatcata

SEQ ID NO: 42359 - DNA, 20 bp, Artificial Sequence
  chemically synthesized
aaacggcatcataaagaaaa

SEQ ID NO: 42360 - DNA, 20 bp, Artificial Sequence
  chemically synthesized
cataaagaaaatggatgcct

SEQ ID NO: 42361 - DNA, 20 bp, Artificial Sequence
  chemically synthesized
aagaaaatggatgcctgaga

SEQ ID NO: 42362 - DNA, 20 bp, Artificial Sequence
  chemically synthesized
agacagaatgtgacatattc

SEQ ID NO: 42363 - DNA, 20 bp, Artificial Sequence
  chemically synthesized
tttgttgttatcaattgcca

SEQ ID NO: 42364 - DNA, 20 bp, Artificial Sequence
  chemically synthesized
atcaattgccatagaatgat

SEQ ID NO: 42365 - DNA, 20 bp, Artificial Sequence
  chemically synthesized
tgaatcaaatatttatcttg

SEQ ID NO: 42366 - DNA, 20 bp, Artificial Sequence
  chemically synthesized
gaatcaaatatttatcttgc

SEQ ID NO: 42367 - DNA, 20 bp, Artificial Sequence
  chemically synthesized
tcaaatatttatcttgcagg

SEQ ID NO: 42368 - DNA, 20 bp, Artificial Sequence
  chemically synthesized
ttgcaggtggcctctatacc

SEQ ID NO: 42369 - DNA, 20 bp, Artificial Sequence
  chemically synthesized
caggtggcctctatacctag

SEQ ID NO: 42370 - DNA, 20 bp, Artificial Sequence
  chemically synthesized
gtggcctctatacctagaag

SEQ ID NO: 42371 - DNA, 20 bp, Artificial Sequence
  chemically synthesized
gcctctatacctagaagcgg

SEQ ID NO: 42372 - DNA, 20 bp, Artificial Sequence
  chemically synthesized
atacctagaagcggcagaat

SEQ ID NO: 42373 - DNA, 20 bp, Artificial Sequence
  chemically synthesized
tacctagaagcggcagaatc

SEQ ID NO: 42374 - DNA, 20 bp, Artificial Sequence
  chemically synthesized
gctttattaatacatgtgta

SEQ ID NO: 42375 - DNA, 20 bp, Artificial Sequence
  chemically synthesized
aatacatgtgtatagatttt

SEQ ID NO: 42376 - DNA, 20 bp, Artificial Sequence
  chemically synthesized
atacatgtgtatagattttt

SEQ ID NO: 42377 - DNA, 20 bp, Artificial Sequence
  chemically synthesized
cacatgtattaatatgaaac

SEQ ID NO: 42378 - DNA, 20 bp, Artificial Sequence
  chemically synthesized
acatgtattaatatgaaaca

SEQ ID NO: 42379 - DNA, 20 bp, Artificial Sequence
  chemically synthesized
attaatatgaaacaaggata

SEQ ID NO: 42380 - DNA, 20 bp, Artificial Sequence
  chemically synthesized
aatatgaaacaaggatatgg

SEQ ID NO: 42381 - DNA, 20 bp, Artificial Sequence
  chemically synthesized
tatgaaacaaggatatggaa

SEQ ID NO: 42382 - DNA, 20 bp, Artificial Sequence
  chemically synthesized
atgaaacaaggatatggaag

SEQ ID NO: 42383 - DNA, 20 bp, Artificial Sequence
  chemically synthesized
aaacaaggatatggaagagg

SEQ ID NO: 42384 - DNA, 20 bp, Artificial Sequence
  chemically synthesized
aacaaggatatggaagagga

SEQ ID NO: 42385 - DNA, 20 bp, Artificial Sequence
  chemically synthesized
ggaagaggaaggcatgaaaa

SEQ ID NO: 42386 - DNA, 20 bp, Artificial Sequence
  chemically synthesized
gaagaggaaggcatgaaaac

SEQ ID NO: 42387 - DNA, 20 bp, Artificial Sequence
  chemically synthesized
ggaaggcatgaaaacaggaa

SEQ ID NO: 42388 - DNA, 20 bp, Artificial Sequence
  chemically synthesized
caaaccttgtttgccatttt

SEQ ID NO: 42389 - DNA, 20 bp, Artificial Sequence
  chemically synthesized
aaaccttgtttgccatttta

SEQ ID NO: 42390 - DNA, 20 bp, Artificial Sequence
  chemically synthesized
ttgccattttaaggcacccc

SEQ ID NO: 42391 - DNA, 20 bp, Artificial Sequence
  chemically synthesized
cattttaaggcacccctgga

SEQ ID NO: 42392 - DNA, 20 bp, Artificial Sequence
  chemically synthesized
ttaaggcacccctggacagc

SEQ ID NO: 42393 - DNA, 20 bp, Artificial Sequence
  chemically synthesized
taaggcacccctggacagct

SEQ ID NO: 42394 - DNA, 20 bp, Artificial Sequence
  chemically synthesized
ggcacccctggacagctagg

SEQ ID NO: 42395 - DNA, 20 bp, Artificial Sequence
  chemically synthesized
cctggacagctaggtggcaa

SEQ ID NO: 42396 - DNA, 20 bp, Artificial Sequence
  chemically synthesized
ctggacagctaggtggcaaa

SEQ ID NO: 42397 - DNA, 20 bp, Artificial Sequence
  chemically synthesized
tggcaaaaggcctgtgctgt

SEQ ID NO: 42398 - DNA, 20 bp, Artificial Sequence
  chemically synthesized
gcaaaaggcctgtgctgtta

SEQ ID NO: 42399 - DNA, 20 bp, Artificial Sequence
  chemically synthesized
caaaaggcctgtgctgttag

SEQ ID NO: 42400 - DNA, 20 bp, Artificial Sequence
  chemically synthesized
agaggacacatgctcacata

SEQ ID NO: 42401 - DNA, 20 bp, Artificial Sequence
  chemically synthesized
gaggacacatgctcacatac

SEQ ID NO: 42402 - DNA, 20 bp, Artificial Sequence
  chemically synthesized
aggacacatgctcacatacg

SEQ ID NO: 42403 - DNA, 20 bp, Artificial Sequence
  chemically synthesized
cacatgctcacatacggggt

SEQ ID NO: 42404 - DNA, 20 bp, Artificial Sequence
  chemically synthesized
atacggggtcagatctgact

SEQ ID NO: 42405 - DNA, 20 bp, Artificial Sequence
  chemically synthesized
tacggggtcagatctgactt

SEQ ID NO: 42406 - DNA, 20 bp, Artificial Sequence
  chemically synthesized
acggggtcagatctgacttg

SEQ ID NO: 42407 - DNA, 20 bp, Artificial Sequence
  chemically synthesized
gatctgacttggggtgctac

SEQ ID NO: 42408 - DNA, 20 bp, Artificial Sequence
  chemically synthesized
atctgacttggggtgctact

SEQ ID NO: 42409 - DNA, 20 bp, Artificial Sequence
  chemically synthesized
tgacttggggtgctactggg

SEQ ID NO: 42410 - DNA, 20 bp, Artificial Sequence
  chemically synthesized
tactgggaagctctcatctt

SEQ ID NO: 42411 - DNA, 20 bp, Artificial Sequence
  chemically synthesized
actgggaagctctcatctta

SEQ ID NO: 42412 - DNA, 20 bp, Artificial Sequence
  chemically synthesized
ctcatcttaaggatacatct

SEQ ID NO: 42413 - DNA, 20 bp, Artificial Sequence
  chemically synthesized
tcatcttaaggatacatctc

SEQ ID NO: 42414 - DNA, 20 bp, Artificial Sequence
  chemically synthesized
cttaaggatacatctcaggc

SEQ ID NO: 42415 - DNA, 20 bp, Artificial Sequence
  chemically synthesized
gatacatctcaggccagtct

SEQ ID NO: 42416 - DNA, 20 bp, Artificial Sequence
  chemically synthesized
tcaggccagtcttggtgcat

SEQ ID NO: 42417 - DNA, 20 bp, Artificial Sequence
  chemically synthesized
caggccagtcttggtgcatt

SEQ ID NO: 42418 - DNA, 20 bp, Artificial Sequence
  chemically synthesized
gccagtcttggtgcattagg

SEQ ID NO: 42419 - DNA, 20 bp, Artificial Sequence
  chemically synthesized
cttggtgcattaggaagatg

SEQ ID NO: 42420 - DNA, 20 bp, Artificial Sequence
  chemically synthesized
ttggtgcattaggaagatgt

SEQ ID NO: 42421 - DNA, 20 bp, Artificial Sequence
  chemically synthesized
atgtaggcaactctgatcct

SEQ ID NO: 42422 - DNA, 20 bp, Artificial Sequence
  chemically synthesized
gtaggcaactctgatcctga

SEQ ID NO: 42423 - DNA, 20 bp, Artificial Sequence
  chemically synthesized
taggcaactctgatcctgag

SEQ ID NO: 42424 - DNA, 20 bp, Artificial Sequence
  chemically synthesized
caactctgatcctgagagga

SEQ ID NO: 42425 - DNA, 20 bp, Artificial Sequence
  chemically synthesized
agaggaaagaaacattcctc

SEQ ID NO: 42426 - DNA, 20 bp, Artificial Sequence
  chemically synthesized
gaggaaagaaacattcctcc

SEQ ID NO: 42427 - DNA, 20 bp, Artificial Sequence
  chemically synthesized
ggaaagaaacattcctccag

SEQ ID NO: 42428 - DNA, 20 bp, Artificial Sequence
  chemically synthesized
aaagaaacattcctccagga

SEQ ID NO: 42429 - DNA, 20 bp, Artificial Sequence
  chemically synthesized
cattcctccaggagagctaa

SEQ ID NO: 42430 - DNA, 20 bp, Artificial Sequence
  chemically synthesized
attcctccaggagagctaaa

SEQ ID NO: 42431 - DNA, 20 bp, Artificial Sequence
  chemically synthesized
ttcctccaggagagctaaaa

SEQ ID NO: 42432 - DNA, 20 bp, Artificial Sequence
  chemically synthesized
gctaaaagggttcacctgtg

SEQ ID NO: 42433 - DNA, 20 bp, Artificial Sequence
  chemically synthesized
ctaaaagggttcacctgtgt

SEQ ID NO: 42434 - DNA, 20 bp, Artificial Sequence
  chemically synthesized
cacctgtgtgggtaactgtg

SEQ ID NO: 42435 - DNA, 20 bp, Artificial Sequence
  chemically synthesized
acctgtgtgggtaactgtga

SEQ ID NO: 42436 - DNA, 20 bp, Artificial Sequence
  chemically synthesized
gggtaactgtgaaggactac

SEQ ID NO: 42437 - DNA, 20 bp, Artificial Sequence
  chemically synthesized
gtaactgtgaaggactacaa

SEQ ID NO: 42438 - DNA, 20 bp, Artificial Sequence
  chemically synthesized
taactgtgaaggactacaag

SEQ ID NO: 42439 - DNA, 20 bp, Artificial Sequence
  chemically synthesized
aagaggatgaaaaacaatga

SEQ ID NO: 42440 - DNA, 20 bp, Artificial Sequence
  chemically synthesized
ggatgaaaaacaatgacaga

SEQ ID NO: 42441 - DNA, 20 bp, Artificial Sequence
  chemically synthesized
acagacagacataatgcttg

SEQ ID NO: 42442 - DNA, 20 bp, Artificial Sequence
  chemically synthesized
cagacagacataatgcttgt

SEQ ID NO: 42443 - DNA, 20 bp, Artificial Sequence
  chemically synthesized
gacagacataatgcttgtgg

SEQ ID NO: 42444 - DNA, 20 bp, Artificial Sequence
  chemically synthesized
aatgcttgtgggagaaaaaa

SEQ ID NO: 42445 - DNA, 20 bp, Artificial Sequence
  chemically synthesized
atgcttgtgggagaaaaaac

SEQ ID NO: 42446 - DNA, 20 bp, Artificial Sequence
  chemically synthesized
gcttgtgggagaaaaaacag

SEQ ID NO: 42447 - DNA, 20 bp, Artificial Sequence
  chemically synthesized
cttgtgggagaaaaaacagg

SEQ ID NO: 42448 - DNA, 20 bp, Artificial Sequence
  chemically synthesized
gggagaaaaaacaggaggtc

SEQ ID NO: 42449 - DNA, 20 bp, Artificial Sequence
  chemically synthesized
ggagaaaaaacaggaggtca

SEQ ID NO: 42450 - DNA, 20 bp, Artificial Sequence
  chemically synthesized
gagaaaaaacaggaggtcaa

SEQ ID NO: 42451 - DNA, 20 bp, Artificial Sequence
  chemically synthesized
agaaaaaacaggaggtcaag

SEQ ID NO: 42452 - DNA, 20 bp, Artificial Sequence
  chemically synthesized
aaaacaggaggtcaagggga

SEQ ID NO: 42453 - DNA, 20 bp, Artificial Sequence
  chemically synthesized
aacaggaggtcaaggggata

SEQ ID NO: 42454 - DNA, 20 bp, Artificial Sequence
  chemically synthesized
aggaggtcaaggggatagag

SEQ ID NO: 42455 - DNA, 20 bp, Artificial Sequence
  chemically synthesized
ggaggtcaaggggatagaga

SEQ ID NO: 42456 - DNA, 20 bp, Artificial Sequence
  chemically synthesized
aaggggatagagaaggcttc

SEQ ID NO: 42457 - DNA, 20 bp, Artificial Sequence
  chemically synthesized
gggatagagaaggcttccag

SEQ ID NO: 42458 - DNA, 20 bp, Artificial Sequence
  chemically synthesized
agagaaggcttccagaagaa

SEQ ID NO: 42459 - DNA, 20 bp, Artificial Sequence
  chemically synthesized
cttccagaagaatggctttg

SEQ ID NO: 42460 - DNA, 20 bp, Artificial Sequence
  chemically synthesized
cagaagaatggctttgaagc

SEQ ID NO: 42461 - DNA, 20 bp, Artificial Sequence
  chemically synthesized
ggctttgaagctggcttctg

SEQ ID NO: 42462 - DNA, 20 bp, Artificial Sequence
  chemically synthesized
gctttgaagctggcttctgt

SEQ ID NO: 42463 - DNA, 20 bp, Artificial Sequence
  chemically synthesized
tttgaagctggcttctgtag

SEQ ID NO: 42464 - DNA, 20 bp, Artificial Sequence
  chemically synthesized
ctggcttctgtaggagttca

SEQ ID NO: 42465 - DNA, 20 bp, Artificial Sequence
  chemically synthesized
gcttctgtaggagttcacag

SEQ ID NO: 42466 - DNA, 20 bp, Artificial Sequence
  chemically synthesized
tgtaggagttcacagtggca

SEQ ID NO: 42467 - DNA, 20 bp, Artificial Sequence
  chemically synthesized
tcacagtggcaaagatgttt

SEQ ID NO: 42468 - DNA, 20 bp, Artificial Sequence
  chemically synthesized
tcagaaatgtgacatgactt

SEQ ID NO: 42469 - DNA, 20 bp, Artificial Sequence
  chemically synthesized
cagaaatgtgacatgactta

SEQ ID NO: 42470 - DNA, 20 bp, Artificial Sequence
  chemically synthesized
gacttaaggaactatacaaa

SEQ ID NO: 42471 - DNA, 20 bp, Artificial Sequence
  chemically synthesized
acttaaggaactatacaaaa

SEQ ID NO: 42472 - DNA, 20 bp, Artificial Sequence
  chemically synthesized
atacaaaaaggaacaaattt

SEQ ID NO: 42473 - DNA, 20 bp, Artificial Sequence
  chemically synthesized
tacaaaaaggaacaaattta

SEQ ID NO: 42474 - DNA, 20 bp, Artificial Sequence
  chemically synthesized
caaaaaggaacaaatttaag

SEQ ID NO: 42475 - DNA, 20 bp, Artificial Sequence
  chemically synthesized
aaaaggaacaaatttaagga

SEQ ID NO: 42476 - DNA, 20 bp, Artificial Sequence
  chemically synthesized
aaaggaacaaatttaaggag

SEQ ID NO: 42477 - DNA, 20 bp, Artificial Sequence
  chemically synthesized
ggaacaaatttaaggagagg

SEQ ID NO: 42478 - DNA, 20 bp, Artificial Sequence
  chemically synthesized
ttaaggagaggcagataaat

SEQ ID NO: 42479 - DNA, 20 bp, Artificial Sequence
  chemically synthesized
aggcagataaattagttcaa

SEQ ID NO: 42480 - DNA, 20 bp, Artificial Sequence
  chemically synthesized
aattagttcaacagacatgc

SEQ ID NO: 42481 - DNA, 20 bp, Artificial Sequence
  chemically synthesized
attagttcaacagacatgca

SEQ ID NO: 42482 - DNA, 20 bp, Artificial Sequence
  chemically synthesized
acagacatgcaaggaatttt

SEQ ID NO: 42483 - DNA, 20 bp, Artificial Sequence
  chemically synthesized
atgaatgttatgtctccact

SEQ ID NO: 42484 - DNA, 20 bp, Artificial Sequence
  chemically synthesized
atgtctccactgagcttctt

SEQ ID NO: 42485 - DNA, 20 bp, Artificial Sequence
  chemically synthesized
tgtctccactgagcttcttg

SEQ ID NO: 42486 - DNA, 20 bp, Artificial Sequence
  chemically synthesized
tccactgagcttcttgaggt

SEQ ID NO: 42487 - DNA, 20 bp, Artificial Sequence
  chemically synthesized
actgagcttcttgaggttag

SEQ ID NO: 42488 - DNA, 20 bp, Artificial Sequence
  chemically synthesized
ttcttgaggttagcagctgt

SEQ ID NO: 42489 - DNA, 20 bp, Artificial Sequence
  chemically synthesized
tcttgaggttagcagctgtg

SEQ ID NO: 42490 - DNA, 20 bp, Artificial Sequence
  chemically synthesized
cttgaggttagcagctgtga

SEQ ID NO: 42491 - DNA, 20 bp, Artificial Sequence
  chemically synthesized
tagcagctgtgagggttttg

SEQ ID NO: 42492 - DNA, 20 bp, Artificial Sequence
  chemically synthesized
agcagctgtgagggttttgc

SEQ ID NO: 42493 - DNA, 20 bp, Artificial Sequence
  chemically synthesized
ctgtgagggttttgcaggcc

SEQ ID NO: 42494 - DNA, 20 bp, Artificial Sequence
  chemically synthesized
tgtgagggttttgcaggccc

SEQ ID NO: 42495 - DNA, 20 bp, Artificial Sequence
  chemically synthesized
tgcaggcccaggacccatta

SEQ ID NO: 42496 - DNA, 20 bp, Artificial Sequence
  chemically synthesized
gcaggcccaggacccattac

SEQ ID NO: 42497 - DNA, 20 bp, Artificial Sequence
  chemically synthesized
gtgaatgaatgacctcttgt

SEQ ID NO: 42498 - DNA, 20 bp, Artificial Sequence
  chemically synthesized
tgacctcttgtcagtctact

SEQ ID NO: 42499 - DNA, 20 bp, Artificial Sequence
  chemically synthesized
gtgaatgaatgatgtcttgt

SEQ ID NO: 42500 - DNA, 20 bp, Artificial Sequence
  chemically synthesized
tgatgtcttgtcagcctact

SEQ ID NO: 42501 - DNA, 20 bp, Artificial Sequence
  chemically synthesized
tcagcctacttggtttcgct

SEQ ID NO: 42502 - DNA, 20 bp, Artificial Sequence
  chemically synthesized
agcctacttggtttcgctaa

SEQ ID NO: 42503 - DNA, 20 bp, Artificial Sequence
  chemically synthesized
acttggtttcgctaagagca

SEQ ID NO: 42504 - DNA, 20 bp, Artificial Sequence
  chemically synthesized
ttggtttcgctaagagcaca

SEQ ID NO: 42505 - DNA, 20 bp, Artificial Sequence
  chemically synthesized
ggtttcgctaagagcacaga

SEQ ID NO: 42506 - DNA, 20 bp, Artificial Sequence
  chemically synthesized
ttcgctaagagcacagagag

SEQ ID NO: 42507 - DNA, 20 bp, Artificial Sequence
  chemically synthesized
aagagcacagagagaagatt

SEQ ID NO: 42508 - DNA, 20 bp, Artificial Sequence
  chemically synthesized
ctatgtaaaaacttcctttt

SEQ ID NO: 42509 - DNA, 20 bp, Artificial Sequence
  chemically synthesized
aaaaacttcctttttggttc

SEQ ID NO: 42510 - DNA, 20 bp, Artificial Sequence
  chemically synthesized
gttcaagtgtatgtttgtga

SEQ ID NO: 42511 - DNA, 20 bp, Artificial Sequence
  chemically synthesized
gtatgtttgtgatagaaatg

SEQ ID NO: 42512 - DNA, 20 bp, Artificial Sequence
  chemically synthesized
gtttgtgatagaaatgaaga

SEQ ID NO: 42513 - DNA, 20 bp, Artificial Sequence
  chemically synthesized
tttgtgatagaaatgaagac

SEQ ID NO: 42514 - DNA, 20 bp, Artificial Sequence
  chemically synthesized
ctaacataaacacaaacatt

SEQ ID NO: 42515 - DNA, 20 bp, Artificial Sequence
  chemically synthesized
cataaacacaaacattaaga

SEQ ID NO: 42516 - DNA, 20 bp, Artificial Sequence
  chemically synthesized
ataaacacaaacattaagaa

SEQ ID NO: 42517 - DNA, 20 bp, Artificial Sequence
  chemically synthesized
taagaaaggaaatcaacctg

SEQ ID NO: 42518 - DNA, 20 bp, Artificial Sequence
  chemically synthesized
agaaaggaaatcaacctgaa

SEQ ID NO: 42519 - DNA, 20 bp, Artificial Sequence
  chemically synthesized
caacctgaagagtatttata

SEQ ID NO: 42520 - DNA, 20 bp, Artificial Sequence
  chemically synthesized
tttatacagataacaaaata

SEQ ID NO: 42521 - DNA, 20 bp, Artificial Sequence
  chemically synthesized
tatacagataacaaaataca

SEQ ID NO: 42522 - DNA, 20 bp, Artificial Sequence
  chemically synthesized
tacagataacaaaatacaga

SEQ ID NO: 42523 - DNA, 20 bp, Artificial Sequence
  chemically synthesized
gataacaaaatacagagagt

SEQ ID NO: 42524 - DNA, 20 bp, Artificial Sequence
  chemically synthesized
agttaaatgtgtaataactg

SEQ ID NO: 42525 - DNA, 20 bp, Artificial Sequence
  chemically synthesized
aatgtgtaataactgtggca

SEQ ID NO: 42526 - DNA, 20 bp, Artificial Sequence
  chemically synthesized
atgtgtaataactgtggcac

SEQ ID NO: 42527 - DNA, 20 bp, Artificial Sequence
  chemically synthesized
gtaataactgtggcacaggc

SEQ ID NO: 42528 - DNA, 20 bp, Artificial Sequence
  chemically synthesized
tgtggcacaggctggaatat

SEQ ID NO: 42529 - DNA, 20 bp, Artificial Sequence
  chemically synthesized
catttaaatcacaaattaat

SEQ ID NO: 42530 - DNA, 20 bp, Artificial Sequence
  chemically synthesized
caaattaattagaaaaaaaa

SEQ ID NO: 42531 - DNA, 20 bp, Artificial Sequence
  chemically synthesized
attaattagaaaaaaaacag

SEQ ID NO: 42532 - DNA, 20 bp, Artificial Sequence
  chemically synthesized
ttaattagaaaaaaaacagt

SEQ ID NO: 42533 - DNA, 20 bp, Artificial Sequence
  chemically synthesized
taattagaaaaaaaacagtg

SEQ ID NO: 42534 - DNA, 20 bp, Artificial Sequence
  chemically synthesized
acagtggggaaaaaattcca

SEQ ID NO: 42535 - DNA, 20 bp, Artificial Sequence
  chemically synthesized
tggggaaaaaattccatgga

SEQ ID NO: 42536 - DNA, 20 bp, Artificial Sequence
  chemically synthesized
ggggaaaaaattccatggat

SEQ ID NO: 42537 - DNA, 20 bp, Artificial Sequence
  chemically synthesized
aaaaattccatggatgggtc

SEQ ID NO: 42538 - DNA, 20 bp, Artificial Sequence
  chemically synthesized
attccatggatgggtctaga

SEQ ID NO: 42539 - DNA, 20 bp, Artificial Sequence
  chemically synthesized
atggatgggtctagaaagac

SEQ ID NO: 42540 - DNA, 20 bp, Artificial Sequence
  chemically synthesized
tagaaagactagcattgttt

SEQ ID NO: 42541 - DNA, 20 bp, Artificial Sequence
  chemically synthesized
agaaagactagcattgtttt

SEQ ID NO: 42542 - DNA, 20 bp, Artificial Sequence
  chemically synthesized
gactagcattgttttaggtt

SEQ ID NO: 42543 - DNA, 20 bp, Artificial Sequence
  chemically synthesized
tagcattgttttaggttgag

SEQ ID NO: 42544 - DNA, 20 bp, Artificial Sequence
  chemically synthesized
cattgttttaggttgagtgg

SEQ ID NO: 42545 - DNA, 20 bp, Artificial Sequence
  chemically synthesized
aggttgagtggcagtgttta

SEQ ID NO: 42546 - DNA, 20 bp, Artificial Sequence
  chemically synthesized
ggttgagtggcagtgtttaa

SEQ ID NO: 42547 - DNA, 20 bp, Artificial Sequence
  chemically synthesized
gttgagtggcagtgtttaaa

SEQ ID NO: 42548 - DNA, 20 bp, Artificial Sequence
  chemically synthesized
cagtgtttaaagggtgatat

SEQ ID NO: 42549 - DNA, 20 bp, Artificial Sequence
  chemically synthesized
cagactaaacttgaaatatg

SEQ ID NO: 42550 - DNA, 20 bp, Artificial Sequence
  chemically synthesized
gaaatatgtggctaaataac

SEQ ID NO: 42551 - DNA, 20 bp, Artificial Sequence
  chemically synthesized
ttattttttcgtatcatgaa

SEQ ID NO: 42552 - DNA, 20 bp, Artificial Sequence
  chemically synthesized
ttttttcgtatcatgaatag

SEQ ID NO: 42553 - DNA, 20 bp, Artificial Sequence
  chemically synthesized
cgtatcatgaatagcagata

SEQ ID NO: 42554 - DNA, 20 bp, Artificial Sequence
  chemically synthesized
gaatagcagatatagcttga

SEQ ID NO: 42555 - DNA, 20 bp, Artificial Sequence
  chemically synthesized
tagcttgatggccccatgct

SEQ ID NO: 42556 - DNA, 20 bp, Artificial Sequence
  chemically synthesized
gaaatccttaatttttgaca

SEQ ID NO: 42557 - DNA, 20 bp, Artificial Sequence
  chemically synthesized
aaatccttaatttttgacaa

SEQ ID NO: 42558 - DNA, 20 bp, Artificial Sequence
  chemically synthesized
aatccttaatttttgacaaa

SEQ ID NO: 42559 - DNA, 20 bp, Artificial Sequence
  chemically synthesized
atccttaatttttgacaaag

SEQ ID NO: 42560 - DNA, 20 bp, Artificial Sequence
  chemically synthesized
tattcattttcattttatat

SEQ ID NO: 42561 - DNA, 20 bp, Artificial Sequence
  chemically synthesized
attcattttcattttatatt

SEQ ID NO: 42562 - DNA, 20 bp, Artificial Sequence
  chemically synthesized
ttttcattttatattgggcc

SEQ ID NO: 42563 - DNA, 20 bp, Artificial Sequence
  chemically synthesized
tattgggcctagaaattatg

SEQ ID NO: 42564 - DNA, 20 bp, Artificial Sequence
  chemically synthesized
gggcctagaaattatgtaga

SEQ ID NO: 42565 - DNA, 20 bp, Artificial Sequence
  chemically synthesized
gaaattatgtagatggtcct

SEQ ID NO: 42566 - DNA, 20 bp, Artificial Sequence
  chemically synthesized
aaattatgtagatggtcctg

SEQ ID NO: 42567 - DNA, 20 bp, Artificial Sequence
  chemically synthesized
atgtagatggtcctgaggaa

SEQ ID NO: 42568 - DNA, 20 bp, Artificial Sequence
  chemically synthesized
tggtcctgaggaaaagttta

SEQ ID NO: 42569 - DNA, 20 bp, Artificial Sequence
  chemically synthesized
gtctatttctctctctaaca

SEQ ID NO: 42570 - DNA, 20 bp, Artificial Sequence
  chemically synthesized
tctctctctaacatagttgt

SEQ ID NO: 42571 - DNA, 20 bp, Artificial Sequence
  chemically synthesized
atagttgtcagcacaatgcc

SEQ ID NO: 42572 - DNA, 20 bp, Artificial Sequence
  chemically synthesized
tagttgtcagcacaatgcct

SEQ ID NO: 42573 - DNA, 20 bp, Artificial Sequence
  chemically synthesized
tcagcacaatgcctaggcta

SEQ ID NO: 42574 - DNA, 20 bp, Artificial Sequence
  chemically synthesized
cagcacaatgcctaggctat

SEQ ID NO: 42575 - DNA, 20 bp, Artificial Sequence
  chemically synthesized
cacaatgcctaggctatagg

SEQ ID NO: 42576 - DNA, 20 bp, Artificial Sequence
  chemically synthesized
taggctataggaagtactca

SEQ ID NO: 42577 - DNA, 20 bp, Artificial Sequence
  chemically synthesized
ttcttattcaattctacaca

SEQ ID NO: 42578 - DNA, 20 bp, Artificial Sequence
  chemically synthesized
cttattcaattctacacatg

SEQ ID NO: 42579 - DNA, 20 bp, Artificial Sequence
  chemically synthesized
ttattcaattctacacatgg

SEQ ID NO: 42580 - DNA, 20 bp, Artificial Sequence
  chemically synthesized
cacatggaggaaaaactcat

SEQ ID NO: 42581 - DNA, 20 bp, Artificial Sequence
  chemically synthesized
acatggaggaaaaactcatc

SEQ ID NO: 42582 - DNA, 20 bp, Artificial Sequence
  chemically synthesized
catggaggaaaaactcatca

SEQ ID NO: 42583 - DNA, 20 bp, Artificial Sequence
  chemically synthesized
gaggaaaaactcatcaggga

SEQ ID NO: 42584 - DNA, 20 bp, Artificial Sequence
  chemically synthesized
ggaaaaactcatcagggatg

SEQ ID NO: 42585 - DNA, 20 bp, Artificial Sequence
  chemically synthesized
gaaaaactcatcagggatgg

SEQ ID NO: 42586 - DNA, 20 bp, Artificial Sequence
  chemically synthesized
agggatggaggcacgcctct

SEQ ID NO: 42587 - DNA, 20 bp, Artificial Sequence
  chemically synthesized
gggatggaggcacgcctcta

SEQ ID NO: 42588 - DNA, 20 bp, Artificial Sequence
  chemically synthesized
atggaggcacgcctctaagg

SEQ ID NO: 42589 - DNA, 20 bp, Artificial Sequence
  chemically synthesized
tggaggcacgcctctaagga

SEQ ID NO: 42590 - DNA, 20 bp, Artificial Sequence
  chemically synthesized
aggcacgcctctaaggaagg

SEQ ID NO: 42591 - DNA, 20 bp, Artificial Sequence
  chemically synthesized
ggcacgcctctaaggaaggc

SEQ ID NO: 42592 - DNA, 20 bp, Artificial Sequence
  chemically synthesized
gcctctaaggaaggcaggtg

SEQ ID NO: 42593 - DNA, 20 bp, Artificial Sequence
  chemically synthesized
ggaaggcaggtgtggctctg

SEQ ID NO: 42594 - DNA, 20 bp, Artificial Sequence
  chemically synthesized
gtgtggctctgcagtgtgat

SEQ ID NO: 42595 - DNA, 20 bp, Artificial Sequence
  chemically synthesized
tgtggctctgcagtgtgatt

SEQ ID NO: 42596 - DNA, 20 bp, Artificial Sequence
  chemically synthesized
gcagtgtgattgggtacttg

SEQ ID NO: 42597 - DNA, 20 bp, Artificial Sequence
  chemically synthesized
cagtgtgattgggtacttgc

SEQ ID NO: 42598 - DNA, 20 bp, Artificial Sequence
  chemically synthesized
gattgggtacttgcaggacg

SEQ ID NO: 42599 - DNA, 20 bp, Artificial Sequence
  chemically synthesized
attgggtacttgcaggacga

SEQ ID NO: 42600 - DNA, 20 bp, Artificial Sequence
  chemically synthesized
ttgggtacttgcaggacgaa

SEQ ID NO: 42601 - DNA, 20 bp, Artificial Sequence
  chemically synthesized
ggtacttgcaggacgaaggg

SEQ ID NO: 42602 - DNA, 20 bp, Artificial Sequence
  chemically synthesized
gtacttgcaggacgaagggt

SEQ ID NO: 42603 - DNA, 20 bp, Artificial Sequence
  chemically synthesized
tacttgcaggacgaagggtg

SEQ ID NO: 42604 - DNA, 20 bp, Artificial Sequence
  chemically synthesized
ttgcaggacgaagggtgggg

SEQ ID NO: 42605 - DNA, 20 bp, Artificial Sequence
  chemically synthesized
tgcaggacgaagggtggggt

SEQ ID NO: 42606 - DNA, 20 bp, Artificial Sequence
  chemically synthesized
caggacgaagggtggggtgg

SEQ ID NO: 42607 - DNA, 20 bp, Artificial Sequence
  chemically synthesized
gacgaagggtggggtgggag

SEQ ID NO: 42608 - DNA, 20 bp, Artificial Sequence
  chemically synthesized
agtggctaaccttccattcc

SEQ ID NO: 42609 - DNA, 20 bp, Artificial Sequence
  chemically synthesized
ctaaccttccattcctagtg

SEQ ID NO: 42610 - DNA, 20 bp, Artificial Sequence
  chemically synthesized
aaccttccattcctagtgca

SEQ ID NO: 42611 - DNA, 20 bp, Artificial Sequence
  chemically synthesized
accttccattcctagtgcag

SEQ ID NO: 42612 - DNA, 20 bp, Artificial Sequence
  chemically synthesized
cattcctagtgcagaggtca

SEQ ID NO: 42613 - DNA, 20 bp, Artificial Sequence
  chemically synthesized
gcctaaacatcaaattcctt

SEQ ID NO: 42614 - DNA, 20 bp, Artificial Sequence
  chemically synthesized
cctaaacatcaaattccttg

SEQ ID NO: 42615 - DNA, 20 bp, Artificial Sequence
  chemically synthesized
acatcaaattccttgaggtg

SEQ ID NO: 42616 - DNA, 20 bp, Artificial Sequence
  chemically synthesized
tcaaattccttgaggtgcgg

SEQ ID NO: 42617 - DNA, 20 bp, Artificial Sequence
  chemically synthesized
gtggctcactcctgtaatca

SEQ ID NO: 42618 - DNA, 20 bp, Artificial Sequence
  chemically synthesized
gctcactcctgtaatcacag

SEQ ID NO: 42619 - DNA, 20 bp, Artificial Sequence
  chemically synthesized
ctcctgtaatcacagcagtt

SEQ ID NO: 42620 - DNA, 20 bp, Artificial Sequence
  chemically synthesized
tcctgtaatcacagcagttt

SEQ ID NO: 42621 - DNA, 20 bp, Artificial Sequence
  chemically synthesized
tcacagcagtttgggacgcc

SEQ ID NO: 42622 - DNA, 20 bp, Artificial Sequence
  chemically synthesized
cacagcagtttgggacgcca

SEQ ID NO: 42623 - DNA, 20 bp, Artificial Sequence
  chemically synthesized
agcagtttgggacgccaagg

SEQ ID NO: 42624 - DNA, 20 bp, Artificial Sequence
  chemically synthesized
gcagtttgggacgccaaggt

SEQ ID NO: 42625 - DNA, 20 bp, Artificial Sequence
  chemically synthesized
gtttgggacgccaaggtggg

SEQ ID NO: 42626 - DNA, 20 bp, Artificial Sequence
  chemically synthesized
ccaaggtgggcagatcactt

SEQ ID NO: 42627 - DNA, 20 bp, Artificial Sequence
  chemically synthesized
caaggtgggcagatcacttg

SEQ ID NO: 42628 - DNA, 20 bp, Artificial Sequence
  chemically synthesized
gtgggcagatcacttgaggt

SEQ ID NO: 42629 - DNA, 20 bp, Artificial Sequence
  chemically synthesized
tgggcagatcacttgaggtc

SEQ ID NO: 42630 - DNA, 20 bp, Artificial Sequence
  chemically synthesized
ggcagatcacttgaggtcag

SEQ ID NO: 42631 - DNA, 20 bp, Artificial Sequence
  chemically synthesized
gatcacttgaggtcaggagt

SEQ ID NO: 42632 - DNA, 20 bp, Artificial Sequence
  chemically synthesized
tgaggtcaggagttggacac

SEQ ID NO: 42633 - DNA, 20 bp, Artificial Sequence
  chemically synthesized
tcaggagttggacaccagcc

SEQ ID NO: 42634 - DNA, 20 bp, Artificial Sequence
  chemically synthesized
ggacaccagcccagccaaca

SEQ ID NO: 42635 - DNA, 20 bp, Artificial Sequence
  chemically synthesized
ccagccaacatagtgaaacc

SEQ ID NO: 42636 - DNA, 20 bp, Artificial Sequence
  chemically synthesized
ctgcttaaaaatataaaaat

SEQ ID NO: 42637 - DNA, 20 bp, Artificial Sequence
  chemically synthesized
ttaaaaatataaaaattagc

SEQ ID NO: 42638 - DNA, 20 bp, Artificial Sequence
  chemically synthesized
atataaaaattagctggacg

SEQ ID NO: 42639 - DNA, 20 bp, Artificial Sequence
  chemically synthesized
aaattagctggacgtggtga

SEQ ID NO: 42640 - DNA, 20 bp, Artificial Sequence
  chemically synthesized
aattagctggacgtggtgac

SEQ ID NO: 42641 - DNA, 20 bp, Artificial Sequence
  chemically synthesized
ttagctggacgtggtgacgg

SEQ ID NO: 42642 - DNA, 20 bp, Artificial Sequence
  chemically synthesized
gagcctgtaatccaactact

SEQ ID NO: 42643 - DNA, 20 bp, Artificial Sequence
  chemically synthesized
agcctgtaatccaactactt

SEQ ID NO: 42644 - DNA, 20 bp, Artificial Sequence
  chemically synthesized
cctgtaatccaactacttgg

SEQ ID NO: 42645 - DNA, 20 bp, Artificial Sequence
  chemically synthesized
ctgtaatccaactacttggg

SEQ ID NO: 42646 - DNA, 20 bp, Artificial Sequence
  chemically synthesized
atccaactacttgggaggct

SEQ ID NO: 42647 - DNA, 20 bp, Artificial Sequence
  chemically synthesized
tccaactacttgggaggctg

SEQ ID NO: 42648 - DNA, 20 bp, Artificial Sequence
  chemically synthesized
aactacttgggaggctgagg

SEQ ID NO: 42649 - DNA, 20 bp, Artificial Sequence
  chemically synthesized
actacttgggaggctgaggc

SEQ ID NO: 42650 - DNA, 20 bp, Artificial Sequence
  chemically synthesized
tacttgggaggctgaggcag

SEQ ID NO: 42651 - DNA, 20 bp, Artificial Sequence
  chemically synthesized
ggcaggagaatcgcttgaac

SEQ ID NO: 42652 - DNA, 20 bp, Artificial Sequence
  chemically synthesized
gcaggagaatcgcttgaacc

SEQ ID NO: 42653 - DNA, 20 bp, Artificial Sequence
  chemically synthesized
caggagaatcgcttgaaccg

SEQ ID NO: 42654 - DNA, 20 bp, Artificial Sequence
  chemically synthesized
ggagaatcgcttgaaccggg

SEQ ID NO: 42655 - DNA, 20 bp, Artificial Sequence
  chemically synthesized
gagaatcgcttgaaccgggg

SEQ ID NO: 42656 - DNA, 20 bp, Artificial Sequence
  chemically synthesized
aatcgcttgaaccggggagg

SEQ ID NO: 42657 - DNA, 20 bp, Artificial Sequence
  chemically synthesized
tcgcttgaaccggggaggtg

SEQ ID NO: 42658 - DNA, 20 bp, Artificial Sequence
  chemically synthesized
ggggaggtggagtttgcact

SEQ ID NO: 42659 - DNA, 20 bp, Artificial Sequence
  chemically synthesized
gaggtggagtttgcactgag

SEQ ID NO: 42660 - DNA, 20 bp, Artificial Sequence
  chemically synthesized
ggtggagtttgcactgagca

SEQ ID NO: 42661 - DNA, 20 bp, Artificial Sequence
  chemically synthesized
gagatcatgccattgcactc

SEQ ID NO: 42662 - DNA, 20 bp, Artificial Sequence
  chemically synthesized
tgccattgcactccagcctc

SEQ ID NO: 42663 - DNA, 20 bp, Artificial Sequence
  chemically synthesized
ccattgcactccagcctcca

SEQ ID NO: 42664 - DNA, 20 bp, Artificial Sequence
  chemically synthesized
tgcactccagcctccagagc

SEQ ID NO: 42665 - DNA, 20 bp, Artificial Sequence
  chemically synthesized
ccagagcgagactctgtcta

SEQ ID NO: 42666 - DNA, 20 bp, Artificial Sequence
  chemically synthesized
catcaaattccctgaccgaa

SEQ ID NO: 42667 - DNA, 20 bp, Artificial Sequence
  chemically synthesized
tctaccattttccctcctta

SEQ ID NO: 42668 - DNA, 20 bp, Artificial Sequence
  chemically synthesized
aagaaactgtgaacttcctt

SEQ ID NO: 42669 - DNA, 20 bp, Artificial Sequence
  chemically synthesized
aactgtgaacttccttcagc

SEQ ID NO: 42670 - DNA, 20 bp, Artificial Sequence
  chemically synthesized
ctgtgaacttccttcagcta

SEQ ID NO: 42671 - DNA, 20 bp, Artificial Sequence
  chemically synthesized
tgtgaacttccttcagctag

SEQ ID NO: 42672 - DNA, 20 bp, Artificial Sequence
  chemically synthesized
gtgaacttccttcagctaga

SEQ ID NO: 42673 - DNA, 20 bp, Artificial Sequence
  chemically synthesized
tgaacttccttcagctagag

SEQ ID NO: 42674 - DNA, 20 bp, Artificial Sequence
  chemically synthesized
ttccttcagctagaggggcc

SEQ ID NO: 42675 - DNA, 20 bp, Artificial Sequence
  chemically synthesized
tcagctagaggggcctggct

SEQ ID NO: 42676 - DNA, 20 bp, Artificial Sequence
  chemically synthesized
gctagaggggcctggctcag

SEQ ID NO: 42677 - DNA, 20 bp, Artificial Sequence
  chemically synthesized
gggcctggctcagaagcctc

SEQ ID NO: 42678 - DNA, 20 bp, Artificial Sequence
  chemically synthesized
ctggctcagaagcctctggt

SEQ ID NO: 42679 - DNA, 20 bp, Artificial Sequence
  chemically synthesized
gaagcctctggtcagcatcc

SEQ ID NO: 42680 - DNA, 20 bp, Artificial Sequence
  chemically synthesized
agaaatacttgatgtcactt

SEQ ID NO: 42681 - DNA, 20 bp, Artificial Sequence
  chemically synthesized
acttgatgtcactttggcta

SEQ ID NO: 42682 - DNA, 20 bp, Artificial Sequence
  chemically synthesized
cttgatgtcactttggctaa

SEQ ID NO: 42683 - DNA, 20 bp, Artificial Sequence
  chemically synthesized
ttggctaaaggtatgatgtg

SEQ ID NO: 42684 - DNA, 20 bp, Artificial Sequence
  chemically synthesized
taaaggtatgatgtgtagac

SEQ ID NO: 42685 - DNA, 20 bp, Artificial Sequence
  chemically synthesized
tatgatgtgtagacaagctc

SEQ ID NO: 42686 - DNA, 20 bp, Artificial Sequence
  chemically synthesized
tgatgtgtagacaagctcca

SEQ ID NO: 42687 - DNA, 20 bp, Artificial Sequence
  chemically synthesized
gtgtagacaagctccagaga

SEQ ID NO: 42688 - DNA, 20 bp, Artificial Sequence
  chemically synthesized
catttccatatccacccacc

SEQ ID NO: 42689 - DNA, 20 bp, Artificial Sequence
  chemically synthesized
cacccagctttccaatttta

SEQ ID NO: 42690 - DNA, 20 bp, Artificial Sequence
  chemically synthesized
ccaattttaaagccaattct

SEQ ID NO: 42691 - DNA, 20 bp, Artificial Sequence
  chemically synthesized
caattttaaagccaattctg

SEQ ID NO: 42692 - DNA, 20 bp, Artificial Sequence
  chemically synthesized
ttttaaagccaattctgagg

SEQ ID NO: 42693 - DNA, 20 bp, Artificial Sequence
  chemically synthesized
ttaaagccaattctgaggta

SEQ ID NO: 42694 - DNA, 20 bp, Artificial Sequence
  chemically synthesized
ccttgacaaaattcaaccca

SEQ ID NO: 42695 - DNA, 20 bp, Artificial Sequence
  chemically synthesized
acccaaagactcactttgcc

SEQ ID NO: 42696 - DNA, 20 bp, Artificial Sequence
  chemically synthesized
cttactctgacatatactca

SEQ ID NO: 42697 - DNA, 20 bp, Artificial Sequence
  chemically synthesized
ctctgacatatactcacagc

SEQ ID NO: 42698 - DNA, 20 bp, Artificial Sequence
  chemically synthesized
atatactcacagccagaaat

SEQ ID NO: 42699 - DNA, 20 bp, Artificial Sequence
  chemically synthesized
agccagaaattagcatgcac

SEQ ID NO: 42700 - DNA, 20 bp, Artificial Sequence
  chemically synthesized
ccagaaattagcatgcacta

SEQ ID NO: 42701 - DNA, 20 bp, Artificial Sequence
  chemically synthesized
gcatgcactagagtgtgcat

SEQ ID NO: 42702 - DNA, 20 bp, Artificial Sequence
  chemically synthesized
accaattccatattctctgt

SEQ ID NO: 42703 - DNA, 20 bp, Artificial Sequence
  chemically synthesized
tctctgtcagaaaatcctgt

SEQ ID NO: 42704 - DNA, 20 bp, Artificial Sequence
  chemically synthesized
atcctgttggtttttcgtga

SEQ ID NO: 42705 - DNA, 20 bp, Artificial Sequence
  chemically synthesized
tcctgttggtttttcgtgaa

SEQ ID NO: 42706 - DNA, 20 bp, Artificial Sequence
  chemically synthesized
ttttcgtgaaaggatgtttt

SEQ ID NO: 42707 - DNA, 20 bp, Artificial Sequence
  chemically synthesized
ttcgtgaaaggatgttttca

SEQ ID NO: 42708 - DNA, 20 bp, Artificial Sequence
  chemically synthesized
tcgtgaaaggatgttttcag

SEQ ID NO: 42709 - DNA, 20 bp, Artificial Sequence
  chemically synthesized
cacctccaatgctaccactc

SEQ ID NO: 42710 - DNA, 20 bp, Artificial Sequence
  chemically synthesized
caatgctaccactctggtct

SEQ ID NO: 42711 - DNA, 20 bp, Artificial Sequence
  chemically synthesized
tgtcaccaccacctaaatta

SEQ ID NO: 42712 - DNA, 20 bp, Artificial Sequence
  chemically synthesized
tcccaatatactatccaaat

SEQ ID NO: 42713 - DNA, 20 bp, Artificial Sequence
  chemically synthesized
aattagtcttttcaaaatgt

SEQ ID NO: 42714 - DNA, 20 bp, Artificial Sequence
  chemically synthesized
ttcaaaatgtaagtcatata

SEQ ID NO: 42715 - DNA, 20 bp, Artificial Sequence
  chemically synthesized
tatggtcacctctttgttca

SEQ ID NO: 42716 - DNA, 20 bp, Artificial Sequence
  chemically synthesized
ctttgttcaaagtcttctga

SEQ ID NO: 42717 - DNA, 20 bp, Artificial Sequence
  chemically synthesized
atccttacaattctctacaa

SEQ ID NO: 42718 - DNA, 20 bp, Artificial Sequence
  chemically synthesized
tgcatatattatgtttatta

SEQ ID NO: 42719 - DNA, 20 bp, Artificial Sequence
  chemically synthesized
ttattacagatacatatata

SEQ ID NO: 42720 - DNA, 20 bp, Artificial Sequence
  chemically synthesized
tatatttatgtgtatgtgtg

SEQ ID NO: 42721 - DNA, 20 bp, Artificial Sequence
  chemically synthesized
tatttatgtgtatgtgtgta

SEQ ID NO: 42722 - DNA, 20 bp, Artificial Sequence
  chemically synthesized
tttcttacaactctatgatg

SEQ ID NO: 42723 - DNA, 20 bp, Artificial Sequence
  chemically synthesized
ttcttacaactctatgatgt

SEQ ID NO: 42724 - DNA, 20 bp, Artificial Sequence
  chemically synthesized
ctctatgatgtaggtattat

SEQ ID NO: 42725 - DNA, 20 bp, Artificial Sequence
  chemically synthesized
gtgtcccaaattttataatt

SEQ ID NO: 42726 - DNA, 20 bp, Artificial Sequence
  chemically synthesized
tgtcccaaattttataattt

SEQ ID NO: 42727 - DNA, 20 bp, Artificial Sequence
  chemically synthesized
caccgaatctcatcctacat

SEQ ID NO: 42728 - DNA, 20 bp, Artificial Sequence
  chemically synthesized
tgatattccttgaaaattct

SEQ ID NO: 42729 - DNA, 20 bp, Artificial Sequence
  chemically synthesized
ttctaagcatcttacatctt

SEQ ID NO: 42730 - DNA, 20 bp, Artificial Sequence
  chemically synthesized
tctaagcatcttacatcttt

SEQ ID NO: 42731 - DNA, 20 bp, Artificial Sequence
  chemically synthesized
ctaagcatcttacatcttta

SEQ ID NO: 42732 - DNA, 20 bp, Artificial Sequence
  chemically synthesized
atgccctaaatatttaatca

SEQ ID NO: 42733 - DNA, 20 bp, Artificial Sequence
  chemically synthesized
taatcatagtttcatataaa

SEQ ID NO: 42734 - DNA, 20 bp, Artificial Sequence
  chemically synthesized
aatcatagtttcatataaat

SEQ ID NO: 42735 - DNA, 20 bp, Artificial Sequence
  chemically synthesized
aatgggttcctcatcatcta

SEQ ID NO: 42736 - DNA, 20 bp, Artificial Sequence
  chemically synthesized
atgggttcctcatcatctat

SEQ ID NO: 42737 - DNA, 20 bp, Artificial Sequence
  chemically synthesized
atcatctatgggtactctct

SEQ ID NO: 42738 - DNA, 20 bp, Artificial Sequence
  chemically synthesized
tcatctatgggtactctctc

SEQ ID NO: 42739 - DNA, 20 bp, Artificial Sequence
  chemically synthesized
tctctcaggtgttaacttta

SEQ ID NO: 42740 - DNA, 20 bp, Artificial Sequence
  chemically synthesized
tcaggtgttaactttatagt

SEQ ID NO: 42741 - DNA, 20 bp, Artificial Sequence
  chemically synthesized
caggtgttaactttatagtg

SEQ ID NO: 42742 - DNA, 20 bp, Artificial Sequence
  chemically synthesized
ctttcctgccatactactta

SEQ ID NO: 42743 - DNA, 20 bp, Artificial Sequence
  chemically synthesized
tcctgccatactacttaaag

SEQ ID NO: 42744 - DNA, 20 bp, Artificial Sequence
  chemically synthesized
accctgtcctaatcacactc

SEQ ID NO: 42745 - DNA, 20 bp, Artificial Sequence
  chemically synthesized
tcacactctggccttcattt

SEQ ID NO: 42746 - DNA, 20 bp, Artificial Sequence
  chemically synthesized
cagttttttttttttctcca

SEQ ID NO: 42747 - DNA, 20 bp, Artificial Sequence
  chemically synthesized
tccatagcacctaatctcat

SEQ ID NO: 42748 - DNA, 20 bp, Artificial Sequence
  chemically synthesized
tcatttgcttatttaatgtc

SEQ ID NO: 42749 - DNA, 20 bp, Artificial Sequence
  chemically synthesized
gtcaagctctttccactatc

SEQ ID NO: 42750 - DNA, 20 bp, Artificial Sequence
  chemically synthesized
cactatcaagtccatgaaaa

SEQ ID NO: 42751 - DNA, 20 bp, Artificial Sequence
  chemically synthesized
actatcaagtccatgaaaac

SEQ ID NO: 42752 - DNA, 20 bp, Artificial Sequence
  chemically synthesized
ctgtttttgtgctgtattct

SEQ ID NO: 42753 - DNA, 20 bp, Artificial Sequence
  chemically synthesized
acaattttgaatgaatgaat

SEQ ID NO: 42754 - DNA, 20 bp, Artificial Sequence
  chemically synthesized
attttgaatgaatgaatgag

SEQ ID NO: 42755 - DNA, 20 bp, Artificial Sequence
  chemically synthesized
acatatacaactataattaa

SEQ ID NO: 42756 - DNA, 20 bp, Artificial Sequence
  chemically synthesized
catatacaactataattaaa

SEQ ID NO: 42757 - DNA, 20 bp, Artificial Sequence
  chemically synthesized
tccactgctatgcacacaca

SEQ ID NO: 42758 - DNA, 20 bp, Artificial Sequence
  chemically synthesized
ctatgcacacacaaagaaat

SEQ ID NO: 42759 - DNA, 20 bp, Artificial Sequence
  chemically synthesized
tgcacacacaaagaaatcag

SEQ ID NO: 42760 - DNA, 20 bp, Artificial Sequence
  chemically synthesized
cacacacaaagaaatcagtg

SEQ ID NO: 42761 - DNA, 20 bp, Artificial Sequence
  chemically synthesized
acacaaagaaatcagtggag

SEQ ID NO: 42762 - DNA, 20 bp, Artificial Sequence
  chemically synthesized
acaaagaaatcagtggagta

SEQ ID NO: 42763 - DNA, 20 bp, Artificial Sequence
  chemically synthesized
agaaatcagtggagtagagc

SEQ ID NO: 42764 - DNA, 20 bp, Artificial Sequence
  chemically synthesized
aatcagtggagtagagctgg

SEQ ID NO: 42765 - DNA, 20 bp, Artificial Sequence
  chemically synthesized
ggagtagagctggaagtgct

SEQ ID NO: 42766 - DNA, 20 bp, Artificial Sequence
  chemically synthesized
ctggaagtgctaagcctgca

SEQ ID NO: 42767 - DNA, 20 bp, Artificial Sequence
  chemically synthesized
ggaagtgctaagcctgcata

SEQ ID NO: 42768 - DNA, 20 bp, Artificial Sequence
  chemically synthesized
gtgctaagcctgcatagagc

SEQ ID NO: 42769 - DNA, 20 bp, Artificial Sequence
  chemically synthesized
taagcctgcatagagctagt

SEQ ID NO: 42770 - DNA, 20 bp, Artificial Sequence
  chemically synthesized
tagagctagttagccctccg

SEQ ID NO: 42771 - DNA, 20 bp, Artificial Sequence
  chemically synthesized
agagctagttagccctccgc

SEQ ID NO: 42772 - DNA, 20 bp, Artificial Sequence
  chemically synthesized
gctagttagccctccgcagg

SEQ ID NO: 42773 - DNA, 20 bp, Artificial Sequence
  chemically synthesized
tagttagccctccgcaggca

SEQ ID NO: 42774 - DNA, 20 bp, Artificial Sequence
  chemically synthesized
ctccgcaggcagagccttga

SEQ ID NO: 42775 - DNA, 20 bp, Artificial Sequence
  chemically synthesized
tccgcaggcagagccttgat

SEQ ID NO: 42776 - DNA, 20 bp, Artificial Sequence
  chemically synthesized
agagccttgatgggattact

SEQ ID NO: 42777 - DNA, 20 bp, Artificial Sequence
  chemically synthesized
ttgatgggattactgagttc

SEQ ID NO: 42778 - DNA, 20 bp, Artificial Sequence
  chemically synthesized
ggattactgagttctagaat

SEQ ID NO: 42779 - DNA, 20 bp, Artificial Sequence
  chemically synthesized
aattggactcatttgttttg

SEQ ID NO: 42780 - DNA, 20 bp, Artificial Sequence
  chemically synthesized
attggactcatttgttttgt

SEQ ID NO: 42781 - DNA, 20 bp, Artificial Sequence
  chemically synthesized
actcatttgttttgtaggct

SEQ ID NO: 42782 - DNA, 20 bp, Artificial Sequence
  chemically synthesized
acttgttctgaccaaaataa

SEQ ID NO: 42783 - DNA, 20 bp, Artificial Sequence
  chemically synthesized
cttgttctgaccaaaataaa

SEQ ID NO: 42784 - DNA, 20 bp, Artificial Sequence
  chemically synthesized
gaccaaaataaaaggctcaa

SEQ ID NO: 42785 - DNA, 20 bp, Artificial Sequence
  chemically synthesized
caaaagatgaatatcgaaac

SEQ ID NO: 42786 - DNA, 20 bp, Artificial Sequence
  chemically synthesized
aaaagatgaatatcgaaacc

SEQ ID NO: 42787 - DNA, 20 bp, Artificial Sequence
  chemically synthesized
aaagatgaatatcgaaacca

SEQ ID NO: 42788 - DNA, 20 bp, Artificial Sequence
  chemically synthesized
aaccagggtgttttttacac

SEQ ID NO: 42789 - DNA, 20 bp, Artificial Sequence
  chemically synthesized
tttacactggaatttataac

SEQ ID NO: 42790 - DNA, 20 bp, Artificial Sequence
  chemically synthesized
tacactggaatttataacta

SEQ ID NO: 42791 - DNA, 20 bp, Artificial Sequence
  chemically synthesized
tagagcactcatgtttatgt

SEQ ID NO: 42792 - DNA, 20 bp, Artificial Sequence
  chemically synthesized
taagcaattaattgtttcat

SEQ ID NO: 42793 - DNA, 20 bp, Artificial Sequence
  chemically synthesized
caattaattgtttcatcagt

SEQ ID NO: 42794 - DNA, 20 bp, Artificial Sequence
  chemically synthesized
aattaattgtttcatcagtc

SEQ ID NO: 42795 - DNA, 20 bp, Artificial Sequence
  chemically synthesized
ttgtttcatcagtcaggtaa

SEQ ID NO: 42796 - DNA, 20 bp, Artificial Sequence
  chemically synthesized
tcatcagtcaggtaaaagta

SEQ ID NO: 42797 - DNA, 20 bp, Artificial Sequence
  chemically synthesized
aagtaaagaaaaactgtgcc

SEQ ID NO: 42798 - DNA, 20 bp, Artificial Sequence
  chemically synthesized
agtaaagaaaaactgtgcca

SEQ ID NO: 42799 - DNA, 20 bp, Artificial Sequence
  chemically synthesized
aaagaaaaactgtgccaagg

SEQ ID NO: 42800 - DNA, 20 bp, Artificial Sequence
  chemically synthesized
aagaaaaactgtgccaaggc

SEQ ID NO: 42801 - DNA, 20 bp, Artificial Sequence
  chemically synthesized
aaaaactgtgccaaggcagg

SEQ ID NO: 42802 - DNA, 20 bp, Artificial Sequence
  chemically synthesized
cctaatgcaatatgccacta

SEQ ID NO: 42803 - DNA, 20 bp, Artificial Sequence
  chemically synthesized
ctaaagtaaacattatttca

SEQ ID NO: 42804 - DNA, 20 bp, Artificial Sequence
  chemically synthesized
taaagtaaacattatttcat

SEQ ID NO: 42805 - DNA, 20 bp, Artificial Sequence
  chemically synthesized
aaacattatttcataggtgt

SEQ ID NO: 42806 - DNA, 20 bp, Artificial Sequence
  chemically synthesized
tatttcataggtgtcagata

SEQ ID NO: 42807 - DNA, 20 bp, Artificial Sequence
  chemically synthesized
ggcttattcatccatcttca

SEQ ID NO: 42808 - DNA, 20 bp, Artificial Sequence
  chemically synthesized
gcttattcatccatcttcat

SEQ ID NO: 42809 - DNA, 20 bp, Artificial Sequence
  chemically synthesized
tattcatccatcttcatggg

SEQ ID NO: 42810 - DNA, 20 bp, Artificial Sequence
  chemically synthesized
attcatccatcttcatggga

SEQ ID NO: 42811 - DNA, 20 bp, Artificial Sequence
  chemically synthesized
atccatcttcatgggaagga

SEQ ID NO: 42812 - DNA, 20 bp, Artificial Sequence
  chemically synthesized
cttcatgggaaggatggcct

SEQ ID NO: 42813 - DNA, 20 bp, Artificial Sequence
  chemically synthesized
tgggaaggatggccttggcc

SEQ ID NO: 42814 - DNA, 20 bp, Artificial Sequence
  chemically synthesized
gatggccttggcctggacat

SEQ ID NO: 42815 - DNA, 20 bp, Artificial Sequence
  chemically synthesized
cctggacatcagtgttatgt

SEQ ID NO: 42816 - DNA, 20 bp, Artificial Sequence
  chemically synthesized
ctggacatcagtgttatgtg

SEQ ID NO: 42817 - DNA, 20 bp, Artificial Sequence
  chemically synthesized
tgtgaggttcaaaacacctc

SEQ ID NO: 42818 - DNA, 20 bp, Artificial Sequence
  chemically synthesized
gtgaggttcaaaacacctct

SEQ ID NO: 42819 - DNA, 20 bp, Artificial Sequence
  chemically synthesized
tcaaaacacctctaggctat

SEQ ID NO: 42820 - DNA, 20 bp, Artificial Sequence
  chemically synthesized
caaaacacctctaggctata

SEQ ID NO: 42821 - DNA, 20 bp, Artificial Sequence
  chemically synthesized
acctctaggctataaggcaa

SEQ ID NO: 42822 - DNA, 20 bp, Artificial Sequence
  chemically synthesized
ctctaggctataaggcaaca

SEQ ID NO: 42823 - DNA, 20 bp, Artificial Sequence
  chemically synthesized
tttttttttctgtgctttcc

SEQ ID NO: 42824 - DNA, 20 bp, Artificial Sequence
  chemically synthesized
ctgtccaaatctctaatgat

SEQ ID NO: 42825 - DNA, 20 bp, Artificial Sequence
  chemically synthesized
taagcatacttctattcaat

SEQ ID NO: 42826 - DNA, 20 bp, Artificial Sequence
  chemically synthesized
attcaatgagaatattctgt

SEQ ID NO: 42827 - DNA, 20 bp, Artificial Sequence
  chemically synthesized
gagaatattctgtaagatta

SEQ ID NO: 42828 - DNA, 20 bp, Artificial Sequence
  chemically synthesized
tattctgtaagattatagtt

SEQ ID NO: 42829 - DNA, 20 bp, Artificial Sequence
  chemically synthesized
aagattatagttaagaattg

SEQ ID NO: 42830 - DNA, 20 bp, Artificial Sequence
  chemically synthesized
agattatagttaagaattgt

SEQ ID NO: 42831 - DNA, 20 bp, Artificial Sequence
  chemically synthesized
attatagttaagaattgtgg

SEQ ID NO: 42832 - DNA, 20 bp, Artificial Sequence
  chemically synthesized
gggagccattccgtctctta

SEQ ID NO: 42833 - DNA, 20 bp, Artificial Sequence
  chemically synthesized
cgtctcttatagttaaattt

SEQ ID NO: 42834 - DNA, 20 bp, Artificial Sequence
  chemically synthesized
ctgtttttttaatatgcttt

SEQ ID NO: 42835 - DNA, 20 bp, Artificial Sequence
  chemically synthesized
ttttaatatgctttaagttc

SEQ ID NO: 42836 - DNA, 20 bp, Artificial Sequence
  chemically synthesized
tttaatatgctttaagttct

SEQ ID NO: 42837 - DNA, 20 bp, Artificial Sequence
  chemically synthesized
ttaatatgctttaagttctg

SEQ ID NO: 42838 - DNA, 20 bp, Artificial Sequence
  chemically synthesized
gttctggggtacatgtgcca

SEQ ID NO: 42839 - DNA, 20 bp, Artificial Sequence
  chemically synthesized
ctggggtacatgtgccatgg

SEQ ID NO: 42840 - DNA, 20 bp, Artificial Sequence
  chemically synthesized
catcaacccgtcatctacat

SEQ ID NO: 42841 - DNA, 20 bp, Artificial Sequence
  chemically synthesized
atcaacccgtcatctacatt

SEQ ID NO: 42842 - DNA, 20 bp, Artificial Sequence
  chemically synthesized
tcctaatgctatccttcccc

SEQ ID NO: 42843 - DNA, 20 bp, Artificial Sequence
  chemically synthesized
ccctagccccccacccccaa

SEQ ID NO: 42844 - DNA, 20 bp, Artificial Sequence
  chemically synthesized
cctagccccccacccccaac

SEQ ID NO: 42845 - DNA, 20 bp, Artificial Sequence
  chemically synthesized
cccccacccccaacaggccc

SEQ ID NO: 42846 - DNA, 20 bp, Artificial Sequence
  chemically synthesized
tgttcccctccctgtgtcca

SEQ ID NO: 42847 - DNA, 20 bp, Artificial Sequence
  chemically synthesized
tccctgtgtccatggatcac

SEQ ID NO: 42848 - DNA, 20 bp, Artificial Sequence
  chemically synthesized
ttgtttttttttttttttta

SEQ ID NO: 42849 - DNA, 20 bp, Artificial Sequence
  chemically synthesized
tttttttttttttaaagtct

SEQ ID NO: 42850 - DNA, 20 bp, Artificial Sequence
  chemically synthesized
taaagtctcagttaaatttt

SEQ ID NO: 42851 - DNA, 20 bp, Artificial Sequence
  chemically synthesized
tggaatgtaatttattttcc

SEQ ID NO: 42852 - DNA, 20 bp, Artificial Sequence
  chemically synthesized
aatttattttcctggtatcc

SEQ ID NO: 42853 - DNA, 20 bp, Artificial Sequence
  chemically synthesized
atttattttcctggtatcct

SEQ ID NO: 42854 - DNA, 20 bp, Artificial Sequence
  chemically synthesized
cctggtatcctaggacttgc

SEQ ID NO: 42855 - DNA, 20 bp, Artificial Sequence
  chemically synthesized
cctaggacttgcaagttatc

SEQ ID NO: 42856 - DNA, 20 bp, Artificial Sequence
  chemically synthesized
tgcaagttatctggtcactt

SEQ ID NO: 42857 - DNA, 20 bp, Artificial Sequence
  chemically synthesized
aacacacataacatatttat

SEQ ID NO: 42858 - DNA, 20 bp, Artificial Sequence
  chemically synthesized
acacacataacatatttatc

SEQ ID NO: 42859 - DNA, 20 bp, Artificial Sequence
  chemically synthesized
catatttatcgggcatttct

SEQ ID NO: 42860 - DNA, 20 bp, Artificial Sequence
  chemically synthesized
tttctgagcaactaatcatg

SEQ ID NO: 42861 - DNA, 20 bp, Artificial Sequence
  chemically synthesized
ttctgagcaactaatcatgc

SEQ ID NO: 42862 - DNA, 20 bp, Artificial Sequence
  chemically synthesized
gactctcaaacactaaccta

SEQ ID NO: 42863 - DNA, 20 bp, Artificial Sequence
  chemically synthesized
tttctatgtatctacttgtg

SEQ ID NO: 42864 - DNA, 20 bp, Artificial Sequence
  chemically synthesized
tatctacttgtgtagaaacc

SEQ ID NO: 42865 - DNA, 20 bp, Artificial Sequence
  chemically synthesized
acttgtgtagaaaccaagcg

SEQ ID NO: 42866 - DNA, 20 bp, Artificial Sequence
  chemically synthesized
cttgtgtagaaaccaagcgt

SEQ ID NO: 42867 - DNA, 20 bp, Artificial Sequence
  chemically synthesized
ttgtgtagaaaccaagcgtg

SEQ ID NO: 42868 - DNA, 20 bp, Artificial Sequence
  chemically synthesized
agaaaccaagcgtggggact

SEQ ID NO: 42869 - DNA, 20 bp, Artificial Sequence
  chemically synthesized
aaccaagcgtggggactgag

SEQ ID NO: 42870 - DNA, 20 bp, Artificial Sequence
  chemically synthesized
accaagcgtggggactgaga

SEQ ID NO: 42871 - DNA, 20 bp, Artificial Sequence
  chemically synthesized
cgtggggactgagaaggcaa

SEQ ID NO: 42872 - DNA, 20 bp, Artificial Sequence
  chemically synthesized
ggggactgagaaggcaatag

SEQ ID NO: 42873 - DNA, 20 bp, Artificial Sequence
  chemically synthesized
gggactgagaaggcaatagc

SEQ ID NO: 42874 - DNA, 20 bp, Artificial Sequence
  chemically synthesized
gactgagaaggcaatagcag

SEQ ID NO: 42875 - DNA, 20 bp, Artificial Sequence
  chemically synthesized
attctgactctcactgcctt

SEQ ID NO: 42876 - DNA, 20 bp, Artificial Sequence
  chemically synthesized
tgactctcactgcctttagc

SEQ ID NO: 42877 - DNA, 20 bp, Artificial Sequence
  chemically synthesized
gactctcactgcctttagct

SEQ ID NO: 42878 - DNA, 20 bp, Artificial Sequence
  chemically synthesized
gctaggcccctccctcatca

SEQ ID NO: 42879 - DNA, 20 bp, Artificial Sequence
  chemically synthesized
gcccctccctcatcacagct

SEQ ID NO: 42880 - DNA, 20 bp, Artificial Sequence
  chemically synthesized
tccctcatcacagctcagca

SEQ ID NO: 42881 - DNA, 20 bp, Artificial Sequence
  chemically synthesized
tcacagctcagcatagtcct

SEQ ID NO: 42882 - DNA, 20 bp, Artificial Sequence
  chemically synthesized
ctcttatctatatccacaca

SEQ ID NO: 42883 - DNA, 20 bp, Artificial Sequence
  chemically synthesized
acacagtttctgacgctgcc

SEQ ID NO: 42884 - DNA, 20 bp, Artificial Sequence
  chemically synthesized
tgcccagctatcaccatccc

SEQ ID NO: 42885 - DNA, 20 bp, Artificial Sequence
  chemically synthesized
ctatcaccatcccaagtcta

SEQ ID NO: 42886 - DNA, 20 bp, Artificial Sequence
  chemically synthesized
aagtctaaagaaaaaaataa

SEQ ID NO: 42887 - DNA, 20 bp, Artificial Sequence
  chemically synthesized
agtctaaagaaaaaaataat

SEQ ID NO: 42888 - DNA, 20 bp, Artificial Sequence
  chemically synthesized
gtttgcccatctctgttgat

SEQ ID NO: 42889 - DNA, 20 bp, Artificial Sequence
  chemically synthesized
aaaacaaaacaaaataaaat

SEQ ID NO: 42890 - DNA, 20 bp, Artificial Sequence
  chemically synthesized
acaaaataaaataagcccct

SEQ ID NO: 42891 - DNA, 20 bp, Artificial Sequence
  chemically synthesized
aaaataagcccctaagctcc

SEQ ID NO: 42892 - DNA, 20 bp, Artificial Sequence
  chemically synthesized
cccagaaaacatgactaaac

SEQ ID NO: 42893 - DNA, 20 bp, Artificial Sequence
  chemically synthesized
gaaaacatgactaaaccagc

SEQ ID NO: 42894 - DNA, 20 bp, Artificial Sequence
  chemically synthesized
aacatgactaaaccagcaag

SEQ ID NO: 42895 - DNA, 20 bp, Artificial Sequence
  chemically synthesized
atgactaaaccagcaagaag

SEQ ID NO: 42896 - DNA, 20 bp, Artificial Sequence
  chemically synthesized
gcaagaagaagaaaatacaa

SEQ ID NO: 42897 - DNA, 20 bp, Artificial Sequence
  chemically synthesized
caagaagaagaaaatacaat

SEQ ID NO: 42898 - DNA, 20 bp, Artificial Sequence
  chemically synthesized
agaaaatacaataggtatat

SEQ ID NO: 42899 - DNA, 20 bp, Artificial Sequence
  chemically synthesized
gaaaatacaataggtatatg

SEQ ID NO: 42900 - DNA, 20 bp, Artificial Sequence
  chemically synthesized
aaatacaataggtatatgag

SEQ ID NO: 42901 - DNA, 20 bp, Artificial Sequence
  chemically synthesized
caataggtatatgaggagac

SEQ ID NO: 42902 - DNA, 20 bp, Artificial Sequence
  chemically synthesized
tatgaggagactggtgacac

SEQ ID NO: 42903 - DNA, 20 bp, Artificial Sequence
  chemically synthesized
ggtgacactagtgtctgaat

SEQ ID NO: 42904 - DNA, 20 bp, Artificial Sequence
  chemically synthesized
gtgacactagtgtctgaatg

SEQ ID NO: 42905 - DNA, 20 bp, Artificial Sequence
  chemically synthesized
ctagtgtctgaatgaggctt

SEQ ID NO: 42906 - DNA, 20 bp, Artificial Sequence
  chemically synthesized
gtctgaatgaggcttgagta

SEQ ID NO: 42907 - DNA, 20 bp, Artificial Sequence
  chemically synthesized
aatgaggcttgagtacagaa

SEQ ID NO: 42908 - DNA, 20 bp, Artificial Sequence
  chemically synthesized
tgaggcttgagtacagaaaa

SEQ ID NO: 42909 - DNA, 20 bp, Artificial Sequence
  chemically synthesized
gaggcttgagtacagaaaag

SEQ ID NO: 42910 - DNA, 20 bp, Artificial Sequence
  chemically synthesized
tgagtacagaaaagaggctc

SEQ ID NO: 42911 - DNA, 20 bp, Artificial Sequence
  chemically synthesized
gtacagaaaagaggctctag

SEQ ID NO: 42912 - DNA, 20 bp, Artificial Sequence
  chemically synthesized
gaaaagaggctctagcagca

SEQ ID NO: 42913 - DNA, 20 bp, Artificial Sequence
  chemically synthesized
aagaggctctagcagcatag

SEQ ID NO: 42914 - DNA, 20 bp, Artificial Sequence
  chemically synthesized
gctctagcagcatagtggtt

SEQ ID NO: 42915 - DNA, 20 bp, Artificial Sequence
  chemically synthesized
tctagcagcatagtggttta

SEQ ID NO: 42916 - DNA, 20 bp, Artificial Sequence
  chemically synthesized
ctagcagcatagtggtttag

SEQ ID NO: 42917 - DNA, 20 bp, Artificial Sequence
  chemically synthesized
agcagcatagtggtttagag

SEQ ID NO: 42918 - DNA, 20 bp, Artificial Sequence
  chemically synthesized
ggagatgtttctttccttca

SEQ ID NO: 42919 - DNA, 20 bp, Artificial Sequence
  chemically synthesized
tctttccttcacagatgcct

SEQ ID NO: 42920 - DNA, 20 bp, Artificial Sequence
  chemically synthesized
acagatgccttagcctcaat

SEQ ID NO: 42921 - DNA, 20 bp, Artificial Sequence
  chemically synthesized
ccttagcctcaataagcttg

SEQ ID NO: 42922 - DNA, 20 bp, Artificial Sequence
  chemically synthesized
cctcaataagcttgcggttg

SEQ ID NO: 42923 - DNA, 20 bp, Artificial Sequence
  chemically synthesized
caataagcttgcggttgtgg

SEQ ID NO: 42924 - DNA, 20 bp, Artificial Sequence
  chemically synthesized
cggttgtggaagtttacttt

SEQ ID NO: 42925 - DNA, 20 bp, Artificial Sequence
  chemically synthesized
actttcagaacaaactcctg

SEQ ID NO: 42926 - DNA, 20 bp, Artificial Sequence
  chemically synthesized
ctttcagaacaaactcctgt

SEQ ID NO: 42927 - DNA, 20 bp, Artificial Sequence
  chemically synthesized
tttcagaacaaactcctgtg

SEQ ID NO: 42928 - DNA, 20 bp, Artificial Sequence
  chemically synthesized
agaacaaactcctgtggggc

SEQ ID NO: 42929 - DNA, 20 bp, Artificial Sequence
  chemically synthesized
tgtggggctagaattattga

SEQ ID NO: 42930 - DNA, 20 bp, Artificial Sequence
  chemically synthesized
ctagaattattgatggctaa

SEQ ID NO: 42931 - DNA, 20 bp, Artificial Sequence
  chemically synthesized
gaattattgatggctaaaag

SEQ ID NO: 42932 - DNA, 20 bp, Artificial Sequence
  chemically synthesized
attgatggctaaaagaagcc

SEQ ID NO: 42933 - DNA, 20 bp, Artificial Sequence
  chemically synthesized
ttgatggctaaaagaagccc

SEQ ID NO: 42934 - DNA, 20 bp, Artificial Sequence
  chemically synthesized
tgatggctaaaagaagcccg

SEQ ID NO: 42935 - DNA, 20 bp, Artificial Sequence
  chemically synthesized
gatggctaaaagaagcccgg

SEQ ID NO: 42936 - DNA, 20 bp, Artificial Sequence
  chemically synthesized
tggctaaaagaagcccgggg

SEQ ID NO: 42937 - DNA, 20 bp, Artificial Sequence
  chemically synthesized
ggctaaaagaagcccggggg

SEQ ID NO: 42938 - DNA, 20 bp, Artificial Sequence
  chemically synthesized
gctaaaagaagcccggggga

SEQ ID NO: 42939 - DNA, 20 bp, Artificial Sequence
  chemically synthesized
cgggggagggaaaaatcatt

SEQ ID NO: 42940 - DNA, 20 bp, Artificial Sequence
  chemically synthesized
tcattcagcatcctcaccct

SEQ ID NO: 42941 - DNA, 20 bp, Artificial Sequence
  chemically synthesized
tcacccttagtgacacaaaa

SEQ ID NO: 42942 - DNA, 20 bp, Artificial Sequence
  chemically synthesized
acccttagtgacacaaaaca

SEQ ID NO: 42943 - DNA, 20 bp, Artificial Sequence
  chemically synthesized
cccttagtgacacaaaacag

SEQ ID NO: 42944 - DNA, 20 bp, Artificial Sequence
  chemically synthesized
ccttagtgacacaaaacaga

SEQ ID NO: 42945 - DNA, 20 bp, Artificial Sequence
  chemically synthesized
cttagtgacacaaaacagag

SEQ ID NO: 42946 - DNA, 20 bp, Artificial Sequence
  chemically synthesized
ttagtgacacaaaacagagg

SEQ ID NO: 42947 - DNA, 20 bp, Artificial Sequence
  chemically synthesized
gacacaaaacagagggggcc

SEQ ID NO: 42948 - DNA, 20 bp, Artificial Sequence
  chemically synthesized
ttttccatatttcctcatga

SEQ ID NO: 42949 - DNA, 20 bp, Artificial Sequence
  chemically synthesized
gatggatgatctcgttaatg

SEQ ID NO: 42950 - DNA, 20 bp, Artificial Sequence
  chemically synthesized
atggatgatctcgttaatga

SEQ ID NO: 42951 - DNA, 20 bp, Artificial Sequence
  chemically synthesized
gatgatctcgttaatgaagg

SEQ ID NO: 42952 - DNA, 20 bp, Artificial Sequence
  chemically synthesized
gttaatgaaggtggtctgac

SEQ ID NO: 42953 - DNA, 20 bp, Artificial Sequence
  chemically synthesized
gatcattgcttcttccattt

SEQ ID NO: 42954 - DNA, 20 bp, Artificial Sequence
  chemically synthesized
cttgctcacttgccaatcct

SEQ ID NO: 42955 - DNA, 20 bp, Artificial Sequence
  chemically synthesized
tcctcagttttaaccttctc

SEQ ID NO: 42956 - DNA, 20 bp, Artificial Sequence
  chemically synthesized
ctcagttttaaccttctcca

SEQ ID NO: 42957 - DNA, 20 bp, Artificial Sequence
  chemically synthesized
agaaatacacattttttatt

SEQ ID NO: 42958 - DNA, 20 bp, Artificial Sequence
  chemically synthesized
gaaatacacattttttattc

SEQ ID NO: 42959 - DNA, 20 bp, Artificial Sequence
  chemically synthesized
tcaggaaacatactatgtta

SEQ ID NO: 42960 - DNA, 20 bp, Artificial Sequence
  chemically synthesized
gtttcaatactaaataatca

SEQ ID NO: 42961 - DNA, 20 bp, Artificial Sequence
  chemically synthesized
actaaataatcaaagtactg

SEQ ID NO: 42962 - DNA, 20 bp, Artificial Sequence
  chemically synthesized
aataatcaaagtactgaaga

SEQ ID NO: 42963 - DNA, 20 bp, Artificial Sequence
  chemically synthesized
agtactgaagatagcatgca

SEQ ID NO: 42964 - DNA, 20 bp, Artificial Sequence
  chemically synthesized
gtactgaagatagcatgcat

SEQ ID NO: 42965 - DNA, 20 bp, Artificial Sequence
  chemically synthesized
tgaagatagcatgcataggc

SEQ ID NO: 42966 - DNA, 20 bp, Artificial Sequence
  chemically synthesized
tagcatgcataggcaagaaa

SEQ ID NO: 42967 - DNA, 20 bp, Artificial Sequence
  chemically synthesized
cataggcaagaaaaagtcct

SEQ ID NO: 42968 - DNA, 20 bp, Artificial Sequence
  chemically synthesized
gctttatgttgctgttgttt

SEQ ID NO: 42969 - DNA, 20 bp, Artificial Sequence
  chemically synthesized
tgttgtttcagaatttaaaa

SEQ ID NO: 42970 - DNA, 20 bp, Artificial Sequence
  chemically synthesized
agaatttaaaaaagatcacc

SEQ ID NO: 42971 - DNA, 20 bp, Artificial Sequence
  chemically synthesized
ttaaaaaagatcaccaagtc

SEQ ID NO: 42972 - DNA, 20 bp, Artificial Sequence
  chemically synthesized
taaaaaagatcaccaagtca

SEQ ID NO: 42973 - DNA, 20 bp, Artificial Sequence
  chemically synthesized
tcaccaagtcaaggacttct

SEQ ID NO: 42974 - DNA, 20 bp, Artificial Sequence
  chemically synthesized
agtcaaggacttctcagttc

SEQ ID NO: 42975 - DNA, 20 bp, Artificial Sequence
  chemically synthesized
ggacttctcagttctagcac

SEQ ID NO: 42976 - DNA, 20 bp, Artificial Sequence
  chemically synthesized
acttctcagttctagcacta

SEQ ID NO: 42977 - DNA, 20 bp, Artificial Sequence
  chemically synthesized
cttctcagttctagcactag

SEQ ID NO: 42978 - DNA, 20 bp, Artificial Sequence
  chemically synthesized
ctcagttctagcactagagg

SEQ ID NO: 42979 - DNA, 20 bp, Artificial Sequence
  chemically synthesized
tagcactagaggtggaatct

SEQ ID NO: 42980 - DNA, 20 bp, Artificial Sequence
  chemically synthesized
gtggaatcttagcatataat

SEQ ID NO: 42981 - DNA, 20 bp, Artificial Sequence
  chemically synthesized
ggaatcttagcatataatca

SEQ ID NO: 42982 - DNA, 20 bp, Artificial Sequence
  chemically synthesized
gaatcttagcatataatcag

SEQ ID NO: 42983 - DNA, 20 bp, Artificial Sequence
  chemically synthesized
cagaggtttttcaaaatttc

SEQ ID NO: 42984 - DNA, 20 bp, Artificial Sequence
  chemically synthesized
ttttcaaaatttctagacat

SEQ ID NO: 42985 - DNA, 20 bp, Artificial Sequence
  chemically synthesized
atttctagacataagattca

SEQ ID NO: 42986 - DNA, 20 bp, Artificial Sequence
  chemically synthesized
tcaaagccctgcacttaaaa

SEQ ID NO: 42987 - DNA, 20 bp, Artificial Sequence
  chemically synthesized
taactctttatataaattga

SEQ ID NO: 42988 - DNA, 20 bp, Artificial Sequence
  chemically synthesized
aagcacattctgaactactt

SEQ ID NO: 42989 - DNA, 20 bp, Artificial Sequence
  chemically synthesized
gcacattctgaactacttca

SEQ ID NO: 42990 - DNA, 20 bp, Artificial Sequence
  chemically synthesized
ttgttttatttctatgttct

SEQ ID NO: 42991 - DNA, 20 bp, Artificial Sequence
  chemically synthesized
ttcttagttcataaatacat

SEQ ID NO: 42992 - DNA, 20 bp, Artificial Sequence
  chemically synthesized
tcttagttcataaatacatt

SEQ ID NO: 42993 - DNA, 20 bp, Artificial Sequence
  chemically synthesized
caatttaattaaaaaaaccc

SEQ ID NO: 42994 - DNA, 20 bp, Artificial Sequence
  chemically synthesized
aaaaaaacccaagaatttct

SEQ ID NO: 42995 - DNA, 20 bp, Artificial Sequence
  chemically synthesized
tttaatcatgaaaataaatg

SEQ ID NO: 42996 - DNA, 20 bp, Artificial Sequence
  chemically synthesized
ttaatcatgaaaataaatga

SEQ ID NO: 42997 - DNA, 20 bp, Artificial Sequence
  chemically synthesized
gaaggcatctttacttactc

SEQ ID NO: 42998 - DNA, 20 bp, Artificial Sequence
  chemically synthesized
aaggcatctttacttactca

SEQ ID NO: 42999 - DNA, 20 bp, Artificial Sequence
  chemically synthesized
ttacttactcaaggtcccaa

SEQ ID NO: 43000 - DNA, 20 bp, Artificial Sequence
  chemically synthesized
tacttactcaaggtcccaaa

SEQ ID NO: 43001 - DNA, 20 bp, Artificial Sequence
  chemically synthesized
ctcaaggtcccaaaaggtca

SEQ ID NO: 43002 - DNA, 20 bp, Artificial Sequence
  chemically synthesized
tcccaaaaggtcaaagaaac

SEQ ID NO: 43003 - DNA, 20 bp, Artificial Sequence
  chemically synthesized
cccaaaaggtcaaagaaacc

SEQ ID NO: 43004 - DNA, 20 bp, Artificial Sequence
  chemically synthesized
aaaggtcaaagaaaccagga

SEQ ID NO: 43005 - DNA, 20 bp, Artificial Sequence
  chemically synthesized
tcaaagaaaccaggaaagta

SEQ ID NO: 43006 - DNA, 20 bp, Artificial Sequence
  chemically synthesized
aggaaagtaaagctatattt

SEQ ID NO: 43007 - DNA, 20 bp, Artificial Sequence
  chemically synthesized
aaagtaaagctatatttcag

SEQ ID NO: 43008 - DNA, 20 bp, Artificial Sequence
  chemically synthesized
agctatatttcagcggaaaa

SEQ ID NO: 43009 - DNA, 20 bp, Artificial Sequence
  chemically synthesized
gctatatttcagcggaaaat

SEQ ID NO: 43010 - DNA, 20 bp, Artificial Sequence
  chemically synthesized
gcggaaaatgggatatttat

SEQ ID NO: 43011 - DNA, 20 bp, Artificial Sequence
  chemically synthesized
gggatatttatgagttttct

SEQ ID NO: 43012 - DNA, 20 bp, Artificial Sequence
  chemically synthesized
ttatgagttttctaagttga

SEQ ID NO: 43013 - DNA, 20 bp, Artificial Sequence
  chemically synthesized
ttttctaagttgacagactc

SEQ ID NO: 43014 - DNA, 20 bp, Artificial Sequence
  chemically synthesized
cagactcaagttttaacctt

SEQ ID NO: 43015 - DNA, 20 bp, Artificial Sequence
  chemically synthesized
aaccttcagtgcccatcatg

SEQ ID NO: 43016 - DNA, 20 bp, Artificial Sequence
  chemically synthesized
accttcagtgcccatcatgt

SEQ ID NO: 43017 - DNA, 20 bp, Artificial Sequence
  chemically synthesized
tcagtgcccatcatgtagga

SEQ ID NO: 43018 - DNA, 20 bp, Artificial Sequence
  chemically synthesized
gcccatcatgtaggaaagtg

SEQ ID NO: 43019 - DNA, 20 bp, Artificial Sequence
  chemically synthesized
gtaggaaagtgtggcataac

SEQ ID NO: 43020 - DNA, 20 bp, Artificial Sequence
  chemically synthesized
gtggcataactggctgattc

SEQ ID NO: 43021 - DNA, 20 bp, Artificial Sequence
  chemically synthesized
tctactcctttttcccatta

SEQ ID NO: 43022 - DNA, 20 bp, Artificial Sequence
  chemically synthesized
cctgcttaattaacattcac

SEQ ID NO: 43023 - DNA, 20 bp, Artificial Sequence
  chemically synthesized
ttaacattcacaagtaactc

SEQ ID NO: 43024 - DNA, 20 bp, Artificial Sequence
  chemically synthesized
aagtaactctggttgtactt

SEQ ID NO: 43025 - DNA, 20 bp, Artificial Sequence
  chemically synthesized
agtaactctggttgtacttt

SEQ ID NO: 43026 - DNA, 20 bp, Artificial Sequence
  chemically synthesized
ctctggttgtactttaggca

SEQ ID NO: 43027 - DNA, 20 bp, Artificial Sequence
  chemically synthesized
tggttgtactttaggcacag

SEQ ID NO: 43028 - DNA, 20 bp, Artificial Sequence
  chemically synthesized
ctttaggcacagtggctccc

SEQ ID NO: 43029 - DNA, 20 bp, Artificial Sequence
  chemically synthesized
tttaggcacagtggctcccg

SEQ ID NO: 43030 - DNA, 20 bp, Artificial Sequence
  chemically synthesized
ggcacagtggctcccgaggt

SEQ ID NO: 43031 - DNA, 20 bp, Artificial Sequence
  chemically synthesized
tcccgaggtcagtcacacaa

SEQ ID NO: 43032 - DNA, 20 bp, Artificial Sequence
  chemically synthesized
cccgaggtcagtcacacaat

SEQ ID NO: 43033 - DNA, 20 bp, Artificial Sequence
  chemically synthesized
caataggatgtctgtgctcc

SEQ ID NO: 43034 - DNA, 20 bp, Artificial Sequence
  chemically synthesized
atgtctgtgctccaagttgc

SEQ ID NO: 43035 - DNA, 20 bp, Artificial Sequence
  chemically synthesized
gtctgtgctccaagttgcca

SEQ ID NO: 43036 - DNA, 20 bp, Artificial Sequence
  chemically synthesized
ctgtgctccaagttgccaga

SEQ ID NO: 43037 - DNA, 20 bp, Artificial Sequence
  chemically synthesized
gtgctccaagttgccagaga

SEQ ID NO: 43038 - DNA, 20 bp, Artificial Sequence
  chemically synthesized
gctccaagttgccagagaga

SEQ ID NO: 43039 - DNA, 20 bp, Artificial Sequence
  chemically synthesized
cagagagagagattactctt

SEQ ID NO: 43040 - DNA, 20 bp, Artificial Sequence
  chemically synthesized
gagagattactcttgagaat

SEQ ID NO: 43041 - DNA, 20 bp, Artificial Sequence
  chemically synthesized
ttactcttgagaatgagcct

SEQ ID NO: 43042 - DNA, 20 bp, Artificial Sequence
  chemically synthesized
ttgagaatgagcctcagccc

SEQ ID NO: 43043 - DNA, 20 bp, Artificial Sequence
  chemically synthesized
aactcacctgcaaacttcgt

SEQ ID NO: 43044 - DNA, 20 bp, Artificial Sequence
  chemically synthesized
ctcacctgcaaacttcgtga

SEQ ID NO: 43045 - DNA, 20 bp, Artificial Sequence
  chemically synthesized
ctgcaaacttcgtgagagat

SEQ ID NO: 43046 - DNA, 20 bp, Artificial Sequence
  chemically synthesized
tgcaaacttcgtgagagatg

SEQ ID NO: 43047 - DNA, 20 bp, Artificial Sequence
  chemically synthesized
aaacttcgtgagagatgagg

SEQ ID NO: 43048 - DNA, 20 bp, Artificial Sequence
  chemically synthesized
acttcgtgagagatgaggca

SEQ ID NO: 43049 - DNA, 20 bp, Artificial Sequence
  chemically synthesized
cttcgtgagagatgaggcag

SEQ ID NO: 43050 - DNA, 20 bp, Artificial Sequence
  chemically synthesized
gaggcagaggtacactacga

SEQ ID NO: 43051 - DNA, 20 bp, Artificial Sequence
  chemically synthesized
gaggtacactacgaaagcaa

SEQ ID NO: 43052 - DNA, 20 bp, Artificial Sequence
  chemically synthesized
tacactacgaaagcaacagt

SEQ ID NO: 43053 - DNA, 20 bp, Artificial Sequence
  chemically synthesized
actacgaaagcaacagttag

SEQ ID NO: 43054 - DNA, 20 bp, Artificial Sequence
  chemically synthesized
acagttagaagctaaatgat

SEQ ID NO: 43055 - DNA, 20 bp, Artificial Sequence
  chemically synthesized
agctaaatgatgagaacaca

SEQ ID NO: 43056 - DNA, 20 bp, Artificial Sequence
  chemically synthesized
gatgagaacacatggactca

SEQ ID NO: 43057 - DNA, 20 bp, Artificial Sequence
  chemically synthesized
tgagaacacatggactcata

SEQ ID NO: 43058 - DNA, 20 bp, Artificial Sequence
  chemically synthesized
gagaacacatggactcatag

SEQ ID NO: 43059 - DNA, 20 bp, Artificial Sequence
  chemically synthesized
agaacacatggactcataga

SEQ ID NO: 43060 - DNA, 20 bp, Artificial Sequence
  chemically synthesized
tagagggaaacaacgcatac

SEQ ID NO: 43061 - DNA, 20 bp, Artificial Sequence
  chemically synthesized
agagggaaacaacgcatact

SEQ ID NO: 43062 - DNA, 20 bp, Artificial Sequence
  chemically synthesized
gagggaaacaacgcatactg

SEQ ID NO: 43063 - DNA, 20 bp, Artificial Sequence
  chemically synthesized
caacgcatactggggcctat

SEQ ID NO: 43064 - DNA, 20 bp, Artificial Sequence
  chemically synthesized
acgcatactggggcctatca

SEQ ID NO: 43065 - DNA, 20 bp, Artificial Sequence
  chemically synthesized
cgcatactggggcctatcag

SEQ ID NO: 43066 - DNA, 20 bp, Artificial Sequence
  chemically synthesized
gcatactggggcctatcaga

SEQ ID NO: 43067 - DNA, 20 bp, Artificial Sequence
  chemically synthesized
tactggggcctatcagaggg

SEQ ID NO: 43068 - DNA, 20 bp, Artificial Sequence
  chemically synthesized
ctggggcctatcagagggtg

SEQ ID NO: 43069 - DNA, 20 bp, Artificial Sequence
  chemically synthesized
tggggcctatcagagggtgg

SEQ ID NO: 43070 - DNA, 20 bp, Artificial Sequence
  chemically synthesized
ggggcctatcagagggtgga

SEQ ID NO: 43071 - DNA, 20 bp, Artificial Sequence
  chemically synthesized
cctatcagagggtggagggt

SEQ ID NO: 43072 - DNA, 20 bp, Artificial Sequence
  chemically synthesized
tatcagagggtggagggtga

SEQ ID NO: 43073 - DNA, 20 bp, Artificial Sequence
  chemically synthesized
cagagggtggagggtgagag

SEQ ID NO: 43074 - DNA, 20 bp, Artificial Sequence
  chemically synthesized
agagggtggagggtgagaga

SEQ ID NO: 43075 - DNA, 20 bp, Artificial Sequence
  chemically synthesized
agggtggagggtgagagaag

SEQ ID NO: 43076 - DNA, 20 bp, Artificial Sequence
  chemically synthesized
ggtggagggtgagagaagga

SEQ ID NO: 43077 - DNA, 20 bp, Artificial Sequence
  chemically synthesized
gtggagggtgagagaaggag

SEQ ID NO: 43078 - DNA, 20 bp, Artificial Sequence
  chemically synthesized
gggtgagagaaggagaggat

SEQ ID NO: 43079 - DNA, 20 bp, Artificial Sequence
  chemically synthesized
ggtgagagaaggagaggatc

SEQ ID NO: 43080 - DNA, 20 bp, Artificial Sequence
  chemically synthesized
ggatcaggaaaaatcactaa

SEQ ID NO: 43081 - DNA, 20 bp, Artificial Sequence
  chemically synthesized
aaaaatcactaatggatgct

SEQ ID NO: 43082 - DNA, 20 bp, Artificial Sequence
  chemically synthesized
ggatgctaagcgtaatacct

SEQ ID NO: 43083 - DNA, 20 bp, Artificial Sequence
  chemically synthesized
aagcgtaatacctgagtgat

SEQ ID NO: 43084 - DNA, 20 bp, Artificial Sequence
  chemically synthesized
tacccctgaacttaaaataa

SEQ ID NO: 43085 - DNA, 20 bp, Artificial Sequence
  chemically synthesized
ttaaaataaaagttgaaaac

SEQ ID NO: 43086 - DNA, 20 bp, Artificial Sequence
  chemically synthesized
aataaaagttgaaaacaaga

SEQ ID NO: 43087 - DNA, 20 bp, Artificial Sequence
  chemically synthesized
agttgaaaacaagaaagcaa

SEQ ID NO: 43088 - DNA, 20 bp, Artificial Sequence
  chemically synthesized
aacagtttgaacacttgtta

SEQ ID NO: 43089 - DNA, 20 bp, Artificial Sequence
  chemically synthesized
ctcattctttacaattacac

SEQ ID NO: 43090 - DNA, 20 bp, Artificial Sequence
  chemically synthesized
tttacaattacactagaaaa

SEQ ID NO: 43091 - DNA, 20 bp, Artificial Sequence
  chemically synthesized
attacactagaaaatagcca

SEQ ID NO: 43092 - DNA, 20 bp, Artificial Sequence
  chemically synthesized
ttacactagaaaatagccac

SEQ ID NO: 43093 - DNA, 20 bp, Artificial Sequence
  chemically synthesized
aatagccacaggcttcctgc

SEQ ID NO: 43094 - DNA, 20 bp, Artificial Sequence
  chemically synthesized
atagccacaggcttcctgca

SEQ ID NO: 43095 - DNA, 20 bp, Artificial Sequence
  chemically synthesized
gccacaggcttcctgcaagg

SEQ ID NO: 43096 - DNA, 20 bp, Artificial Sequence
  chemically synthesized
ggcttcctgcaaggcagcca

SEQ ID NO: 43097 - DNA, 20 bp, Artificial Sequence
  chemically synthesized
atttatgacttgtgatatcc

SEQ ID NO: 43098 - DNA, 20 bp, Artificial Sequence
  chemically synthesized
tgtgatatccaagtcattcc

SEQ ID NO: 43099 - DNA, 20 bp, Artificial Sequence
  chemically synthesized
gcaaaatctaacacaaaatc

SEQ ID NO: 43100 - DNA, 20 bp, Artificial Sequence
  chemically synthesized
aaatctaacacaaaatctag

SEQ ID NO: 43101 - DNA, 20 bp, Artificial Sequence
  chemically synthesized
cttacatctatttttgttct

SEQ ID NO: 43102 - DNA, 20 bp, Artificial Sequence
  chemically synthesized
ctatttttgttctgagaata

SEQ ID NO: 43103 - DNA, 20 bp, Artificial Sequence
  chemically synthesized
ttgttctgagaatatagatt

SEQ ID NO: 43104 - DNA, 20 bp, Artificial Sequence
  chemically synthesized
atatagatttagatacataa

SEQ ID NO: 43105 - DNA, 20 bp, Artificial Sequence
  chemically synthesized
tagatttagatacataatgg

SEQ ID NO: 43106 - DNA, 20 bp, Artificial Sequence
  chemically synthesized
atttagatacataatggaag

SEQ ID NO: 43107 - DNA, 20 bp, Artificial Sequence
  chemically synthesized
aagcagaataatttaaaatc

SEQ ID NO: 43108 - DNA, 20 bp, Artificial Sequence
  chemically synthesized
aatttaaaatctggctaatt

SEQ ID NO: 43109 - DNA, 20 bp, Artificial Sequence
  chemically synthesized
tctggctaatttagaatcct

SEQ ID NO: 43110 - DNA, 20 bp, Artificial Sequence
  chemically synthesized
ggctaatttagaatcctaag

SEQ ID NO: 43111 - DNA, 20 bp, Artificial Sequence
  chemically synthesized
ctaagcagctcttttcctat

SEQ ID NO: 43112 - DNA, 20 bp, Artificial Sequence
  chemically synthesized
agcagctcttttcctatcag

SEQ ID NO: 43113 - DNA, 20 bp, Artificial Sequence
  chemically synthesized
ttttcctatcagtggtttac

SEQ ID NO: 43114 - DNA, 20 bp, Artificial Sequence
  chemically synthesized
ctattttaaaaataaaaata

SEQ ID NO: 43115 - DNA, 20 bp, Artificial Sequence
  chemically synthesized
tttaaaaataaaaataaagt

SEQ ID NO: 43116 - DNA, 20 bp, Artificial Sequence
  chemically synthesized
aaaataaagtaagttatttg

SEQ ID NO: 43117 - DNA, 20 bp, Artificial Sequence
  chemically synthesized
aaagtaagttatttgtggta

SEQ ID NO: 43118 - DNA, 20 bp, Artificial Sequence
  chemically synthesized
gtggtaaagaatattcatta

SEQ ID NO: 43119 - DNA, 20 bp, Artificial Sequence
  chemically synthesized
tcattaaagtatttatttct

SEQ ID NO: 43120 - DNA, 20 bp, Artificial Sequence
  chemically synthesized
ataataccatgaaaaacatt

SEQ ID NO: 43121 - DNA, 20 bp, Artificial Sequence
  chemically synthesized
accatgaaaaacattcagtg

SEQ ID NO: 43122 - DNA, 20 bp, Artificial Sequence
  chemically synthesized
gaaaaacattcagtgaagtg

SEQ ID NO: 43123 - DNA, 20 bp, Artificial Sequence
  chemically synthesized
aaaaacattcagtgaagtga

SEQ ID NO: 43124 - DNA, 20 bp, Artificial Sequence
  chemically synthesized
aaaacattcagtgaagtgaa

SEQ ID NO: 43125 - DNA, 20 bp, Artificial Sequence
  chemically synthesized
aagggcctactttacttaac

SEQ ID NO: 43126 - DNA, 20 bp, Artificial Sequence
  chemically synthesized
tatataatttttcatactaa

SEQ ID NO: 43127 - DNA, 20 bp, Artificial Sequence
  chemically synthesized
ttttcatactaatagcatct

SEQ ID NO: 43128 - DNA, 20 bp, Artificial Sequence
  chemically synthesized
atactaatagcatctaagaa

SEQ ID NO: 43129 - DNA, 20 bp, Artificial Sequence
  chemically synthesized
cagtacaatatttgactctt

SEQ ID NO: 43130 - DNA, 20 bp, Artificial Sequence
  chemically synthesized
agtacaatatttgactcttc

SEQ ID NO: 43131 - DNA, 20 bp, Artificial Sequence
  chemically synthesized
gttaaacatatgtcataaat

SEQ ID NO: 43132 - DNA, 20 bp, Artificial Sequence
  chemically synthesized
aacatatgtcataaattagc

SEQ ID NO: 43133 - DNA, 20 bp, Artificial Sequence
  chemically synthesized
tatgtcataaattagccaga

SEQ ID NO: 43134 - DNA, 20 bp, Artificial Sequence
  chemically synthesized
taaattagccagaaagattt

SEQ ID NO: 43135 - DNA, 20 bp, Artificial Sequence
  chemically synthesized
agaaagatttaagaaaatat

SEQ ID NO: 43136 - DNA, 20 bp, Artificial Sequence
  chemically synthesized
ggatgtttccttgtttaaat

SEQ ID NO: 43137 - DNA, 20 bp, Artificial Sequence
  chemically synthesized
gatgtttccttgtttaaatt

SEQ ID NO: 43138 - DNA, 20 bp, Artificial Sequence
  chemically synthesized
tgtttaaattaggcatctta

SEQ ID NO: 43139 - DNA, 20 bp, Artificial Sequence
  chemically synthesized
attaggcatcttacagtttt

SEQ ID NO: 43140 - DNA, 20 bp, Artificial Sequence
  chemically synthesized
acagtttttagaatcctgca

SEQ ID NO: 43141 - DNA, 20 bp, Artificial Sequence
  chemically synthesized
tagaatcctgcatagaactt

SEQ ID NO: 43142 - DNA, 20 bp, Artificial Sequence
  chemically synthesized
ttaagaaattacaaatgcta

SEQ ID NO: 43143 - DNA, 20 bp, Artificial Sequence
  chemically synthesized
aatgctaaagcaaacccaaa

SEQ ID NO: 43144 - DNA, 20 bp, Artificial Sequence
  chemically synthesized
atgctaaagcaaacccaaac

SEQ ID NO: 43145 - DNA, 20 bp, Artificial Sequence
  chemically synthesized
ctaaagcaaacccaaacagg

SEQ ID NO: 43146 - DNA, 20 bp, Artificial Sequence
  chemically synthesized
taaagcaaacccaaacaggc

SEQ ID NO: 43147 - DNA, 20 bp, Artificial Sequence
  chemically synthesized
gaattaatcttcatcgaatt

SEQ ID NO: 43148 - DNA, 20 bp, Artificial Sequence
  chemically synthesized
aattaatcttcatcgaattt

SEQ ID NO: 43149 - DNA, 20 bp, Artificial Sequence
  chemically synthesized
atttgggtgtttctttctaa

SEQ ID NO: 43150 - DNA, 20 bp, Artificial Sequence
  chemically synthesized
cctttatacttaaatgtctt

SEQ ID NO: 43151 - DNA, 20 bp, Artificial Sequence
  chemically synthesized
taaatgtcttaagacataca

SEQ ID NO: 43152 - DNA, 20 bp, Artificial Sequence
  chemically synthesized
ttttactaattttaattata

SEQ ID NO: 43153 - DNA, 20 bp, Artificial Sequence
  chemically synthesized
ctaatctttctgatctatcc

SEQ ID NO: 43154 - DNA, 20 bp, Artificial Sequence
  chemically synthesized
tctttctgatctatcctgga

SEQ ID NO: 43155 - DNA, 20 bp, Artificial Sequence
  chemically synthesized
acacttatctctctgaactt

SEQ ID NO: 43156 - DNA, 20 bp, Artificial Sequence
  chemically synthesized
cacttatctctctgaacttt

SEQ ID NO: 43157 - DNA, 20 bp, Artificial Sequence
  chemically synthesized
tgaactttgggcttttaata

SEQ ID NO: 43158 - DNA, 20 bp, Artificial Sequence
  chemically synthesized
gaactttgggcttttaatat

SEQ ID NO: 43159 - DNA, 20 bp, Artificial Sequence
  chemically synthesized
tttgggcttttaatatagga

SEQ ID NO: 43160 - DNA, 20 bp, Artificial Sequence
  chemically synthesized
gcttttaatataggaaagaa

SEQ ID NO: 43161 - DNA, 20 bp, Artificial Sequence
  chemically synthesized
aagcaataatccatttttca

SEQ ID NO: 43162 - DNA, 20 bp, Artificial Sequence
  chemically synthesized
caaataaaatgcttaaaaat

SEQ ID NO: 43163 - DNA, 20 bp, Artificial Sequence
  chemically synthesized
ataaaatgcttaaaaatgag

SEQ ID NO: 43164 - DNA, 20 bp, Artificial Sequence
  chemically synthesized
taaaatgcttaaaaatgagc

SEQ ID NO: 43165 - DNA, 20 bp, Artificial Sequence
  chemically synthesized
tgcttaaaaatgagcaggtg

SEQ ID NO: 43166 - DNA, 20 bp, Artificial Sequence
  chemically synthesized
gcaatttatcttgaaccaac

SEQ ID NO: 43167 - DNA, 20 bp, Artificial Sequence
  chemically synthesized
tcttgaaccaacaagcatcg

SEQ ID NO: 43168 - DNA, 20 bp, Artificial Sequence
  chemically synthesized
acaagcatcgaagcaataat

SEQ ID NO: 43169 - DNA, 20 bp, Artificial Sequence
  chemically synthesized
agcaataatgagactgcccg

SEQ ID NO: 43170 - DNA, 20 bp, Artificial Sequence
  chemically synthesized
ccgcagcctacctgacttct

SEQ ID NO: 43171 - DNA, 20 bp, Artificial Sequence
  chemically synthesized
agcctacctgacttctgagt

SEQ ID NO: 43172 - DNA, 20 bp, Artificial Sequence
  chemically synthesized
gcctacctgacttctgagtc

SEQ ID NO: 43173 - DNA, 20 bp, Artificial Sequence
  chemically synthesized
acttctgagtcaggatttat

SEQ ID NO: 43174 - DNA, 20 bp, Artificial Sequence
  chemically synthesized
gatttataagccttgttact

SEQ ID NO: 43175 - DNA, 20 bp, Artificial Sequence
  chemically synthesized
ttgttactgagacacaaacc

SEQ ID NO: 43176 - DNA, 20 bp, Artificial Sequence
  chemically synthesized
tgttactgagacacaaacct

SEQ ID NO: 43177 - DNA, 20 bp, Artificial Sequence
  chemically synthesized
caatgctataacctttcttg

SEQ ID NO: 43178 - DNA, 20 bp, Artificial Sequence
  chemically synthesized
aagctcctccctaccacctt

SEQ ID NO: 43179 - DNA, 20 bp, Artificial Sequence
  chemically synthesized
tccctaccacctttagccat

SEQ ID NO: 43180 - DNA, 20 bp, Artificial Sequence
  chemically synthesized
ccctaccacctttagccata

SEQ ID NO: 43181 - DNA, 20 bp, Artificial Sequence
  chemically synthesized
cctttagccataaggaaaca

SEQ ID NO: 43182 - DNA, 20 bp, Artificial Sequence
  chemically synthesized
agccataaggaaacatggaa

SEQ ID NO: 43183 - DNA, 20 bp, Artificial Sequence
  chemically synthesized
gccataaggaaacatggaat

SEQ ID NO: 43184 - DNA, 20 bp, Artificial Sequence
  chemically synthesized
taaggaaacatggaatgggt

SEQ ID NO: 43185 - DNA, 20 bp, Artificial Sequence
  chemically synthesized
catggaatgggtcagatccc

SEQ ID NO: 43186 - DNA, 20 bp, Artificial Sequence
  chemically synthesized
tgggtcagatccctggatgc

SEQ ID NO: 43187 - DNA, 20 bp, Artificial Sequence
  chemically synthesized
tcagatccctggatgcaagc

SEQ ID NO: 43188 - DNA, 20 bp, Artificial Sequence
  chemically synthesized
cagatccctggatgcaagcc

SEQ ID NO: 43189 - DNA, 20 bp, Artificial Sequence
  chemically synthesized
ccctggatgcaagccaggtc

SEQ ID NO: 43190 - DNA, 20 bp, Artificial Sequence
  chemically synthesized
gcaagccaggtctggaacca

SEQ ID NO: 43191 - DNA, 20 bp, Artificial Sequence
  chemically synthesized
caagccaggtctggaaccat

SEQ ID NO: 43192 - DNA, 20 bp, Artificial Sequence
  chemically synthesized
gccaggtctggaaccatagg

SEQ ID NO: 43193 - DNA, 20 bp, Artificial Sequence
  chemically synthesized
ggtctggaaccataggcagt

SEQ ID NO: 43194 - DNA, 20 bp, Artificial Sequence
  chemically synthesized
gtctggaaccataggcagta

SEQ ID NO: 43195 - DNA, 20 bp, Artificial Sequence
  chemically synthesized
ctggaaccataggcagtaag

SEQ ID NO: 43196 - DNA, 20 bp, Artificial Sequence
  chemically synthesized
ggaaccataggcagtaagga

SEQ ID NO: 43197 - DNA, 20 bp, Artificial Sequence
  chemically synthesized
accataggcagtaaggagag

SEQ ID NO: 43198 - DNA, 20 bp, Artificial Sequence
  chemically synthesized
agtaaggagagaagaaaatg

SEQ ID NO: 43199 - DNA, 20 bp, Artificial Sequence
  chemically synthesized
gtaaggagagaagaaaatgt

SEQ ID NO: 43200 - DNA, 20 bp, Artificial Sequence
  chemically synthesized
gaaaatgtgggctctgcaac

SEQ ID NO: 43201 - DNA, 20 bp, Artificial Sequence
  chemically synthesized
tgggctctgcaactggctcc

SEQ ID NO: 43202 - DNA, 20 bp, Artificial Sequence
  chemically synthesized
gggctctgcaactggctccg

SEQ ID NO: 43203 - DNA, 20 bp, Artificial Sequence
  chemically synthesized
ggctctgcaactggctccga

SEQ ID NO: 43204 - DNA, 20 bp, Artificial Sequence
  chemically synthesized
ctctgcaactggctccgagg

SEQ ID NO: 43205 - DNA, 20 bp, Artificial Sequence
  chemically synthesized
tgcaactggctccgagggag

SEQ ID NO: 43206 - DNA, 20 bp, Artificial Sequence
  chemically synthesized
gcaactggctccgagggagc

SEQ ID NO: 43207 - DNA, 20 bp, Artificial Sequence
  chemically synthesized
aactggctccgagggagcag

SEQ ID NO: 43208 - DNA, 20 bp, Artificial Sequence
  chemically synthesized
ctggctccgagggagcagga

SEQ ID NO: 43209 - DNA, 20 bp, Artificial Sequence
  chemically synthesized
tggctccgagggagcaggag

SEQ ID NO: 43210 - DNA, 20 bp, Artificial Sequence
  chemically synthesized
caaccccatactctgaatct

SEQ ID NO: 43211 - DNA, 20 bp, Artificial Sequence
  chemically synthesized
accccatactctgaatctaa

SEQ ID NO: 43212 - DNA, 20 bp, Artificial Sequence
  chemically synthesized
ccatactctgaatctaagag

SEQ ID NO: 43213 - DNA, 20 bp, Artificial Sequence
  chemically synthesized
ctctgaatctaagagaagac

SEQ ID NO: 43214 - DNA, 20 bp, Artificial Sequence
  chemically synthesized
actggtgtccatactctgaa

SEQ ID NO: 43215 - DNA, 20 bp, Artificial Sequence
  chemically synthesized
ctggtgtccatactctgaat

SEQ ID NO: 43216 - DNA, 20 bp, Artificial Sequence
  chemically synthesized
gtgtccatactctgaatggg

SEQ ID NO: 43217 - DNA, 20 bp, Artificial Sequence
  chemically synthesized
actctgaatgggaagaatga

SEQ ID NO: 43218 - DNA, 20 bp, Artificial Sequence
  chemically synthesized
ctctgaatgggaagaatgat

SEQ ID NO: 43219 - DNA, 20 bp, Artificial Sequence
  chemically synthesized
aagaatgatgggattaccca

SEQ ID NO: 43220 - DNA, 20 bp, Artificial Sequence
  chemically synthesized
agaatgatgggattacccat

SEQ ID NO: 43221 - DNA, 20 bp, Artificial Sequence
  chemically synthesized
gaatgatgggattacccata

SEQ ID NO: 43222 - DNA, 20 bp, Artificial Sequence
  chemically synthesized
attacccatagggcttgttt

SEQ ID NO: 43223 - DNA, 20 bp, Artificial Sequence
  chemically synthesized
ttacccatagggcttgtttt

SEQ ID NO: 43224 - DNA, 20 bp, Artificial Sequence
  chemically synthesized
tacccatagggcttgtttta

SEQ ID NO: 43225 - DNA, 20 bp, Artificial Sequence
  chemically synthesized
cccatagggcttgttttagg

SEQ ID NO: 43226 - DNA, 20 bp, Artificial Sequence
  chemically synthesized
aaacctgttctccaaactct

SEQ ID NO: 43227 - DNA, 20 bp, Artificial Sequence
  chemically synthesized
ttctccaaactcttggcctt

SEQ ID NO: 43228 - DNA, 20 bp, Artificial Sequence
  chemically synthesized
actcttggccttgagatacc

SEQ ID NO: 43229 - DNA, 20 bp, Artificial Sequence
  chemically synthesized
gatacctggtccttattcct

SEQ ID NO: 43230 - DNA, 20 bp, Artificial Sequence
  chemically synthesized
ggtccttattccttggactt

SEQ ID NO: 43231 - DNA, 20 bp, Artificial Sequence
  chemically synthesized
aatgtctgaccctcacattc

SEQ ID NO: 43232 - DNA, 20 bp, Artificial Sequence
  chemically synthesized
gaccctcacattcaagttct

SEQ ID NO: 43233 - DNA, 20 bp, Artificial Sequence
  chemically synthesized
accctcacattcaagttctg

SEQ ID NO: 43234 - DNA, 20 bp, Artificial Sequence
  chemically synthesized
ctcacattcaagttctgagg

SEQ ID NO: 43235 - DNA, 20 bp, Artificial Sequence
  chemically synthesized
tcacattcaagttctgagga

SEQ ID NO: 43236 - DNA, 20 bp, Artificial Sequence
  chemically synthesized
cacattcaagttctgaggaa

SEQ ID NO: 43237 - DNA, 20 bp, Artificial Sequence
  chemically synthesized
gggccactgccttcatactg

SEQ ID NO: 43238 - DNA, 20 bp, Artificial Sequence
  chemically synthesized
gccttcatactgtggatctg

SEQ ID NO: 43239 - DNA, 20 bp, Artificial Sequence
  chemically synthesized
gcaaattccccctgaaaacc

SEQ ID NO: 43240 - DNA, 20 bp, Artificial Sequence
  chemically synthesized
aaattccccctgaaaaccca

SEQ ID NO: 43241 - DNA, 20 bp, Artificial Sequence
  chemically synthesized
acccagagctgtatcttaat

SEQ ID NO: 43242 - DNA, 20 bp, Artificial Sequence
  chemically synthesized
ctcaacgactgttcttctct

SEQ ID NO: 43243 - DNA, 20 bp, Artificial Sequence
  chemically synthesized
aacgactgttcttctctgag

SEQ ID NO: 43244 - DNA, 20 bp, Artificial Sequence
  chemically synthesized
ctgttcttctctgagtagcc

SEQ ID NO: 43245 - DNA, 20 bp, Artificial Sequence
  chemically synthesized
cttctctgagtagccaagct

SEQ ID NO: 43246 - DNA, 20 bp, Artificial Sequence
  chemically synthesized
ctgagtagccaagctcagct

SEQ ID NO: 43247 - DNA, 20 bp, Artificial Sequence
  chemically synthesized
agccaagctcagcttggttc

SEQ ID NO: 43248 - DNA, 20 bp, Artificial Sequence
  chemically synthesized
ctcagcttggttcaagctac

SEQ ID NO: 43249 - DNA, 20 bp, Artificial Sequence
  chemically synthesized
agcttggttcaagctacaag

SEQ ID NO: 43250 - DNA, 20 bp, Artificial Sequence
  chemically synthesized
ggttcaagctacaagcagct

SEQ ID NO: 43251 - DNA, 20 bp, Artificial Sequence
  chemically synthesized
cagctgagctgctttttgtc

SEQ ID NO: 43252 - DNA, 20 bp, Artificial Sequence
  chemically synthesized
tagtcattgttcttttattt

SEQ ID NO: 43253 - DNA, 20 bp, Artificial Sequence
  chemically synthesized
tcattgttcttttatttcag

SEQ ID NO: 43254 - DNA, 20 bp, Artificial Sequence
  chemically synthesized
aaatacgttctttccaaacc

SEQ ID NO: 43255 - DNA, 20 bp, Artificial Sequence
  chemically synthesized
aatacgttctttccaaacct

SEQ ID NO: 43256 - DNA, 20 bp, Artificial Sequence
  chemically synthesized
aacctaggatcttgtcttcc

SEQ ID NO: 43257 - DNA, 20 bp, Artificial Sequence
  chemically synthesized
acctaggatcttgtcttcct

SEQ ID NO: 43258 - DNA, 20 bp, Artificial Sequence
  chemically synthesized
ctaggctatatattttgtcc

SEQ ID NO: 43259 - DNA, 20 bp, Artificial Sequence
  chemically synthesized
taggctatatattttgtccc

SEQ ID NO: 43260 - DNA, 20 bp, Artificial Sequence
  chemically synthesized
gctatatattttgtcccagg

SEQ ID NO: 43261 - DNA, 20 bp, Artificial Sequence
  chemically synthesized
tgtcccaggaagtcttaatc

SEQ ID NO: 43262 - DNA, 20 bp, Artificial Sequence
  chemically synthesized
gtcccaggaagtcttaatct

SEQ ID NO: 43263 - DNA, 20 bp, Artificial Sequence
  chemically synthesized
tcccaggaagtcttaatctg

SEQ ID NO: 43264 - DNA, 20 bp, Artificial Sequence
  chemically synthesized
aagtcttaatctggggtcca

SEQ ID NO: 43265 - DNA, 20 bp, Artificial Sequence
  chemically synthesized
atctggggtccacagaacac

SEQ ID NO: 43266 - DNA, 20 bp, Artificial Sequence
  chemically synthesized
tctggggtccacagaacact

SEQ ID NO: 43267 - DNA, 20 bp, Artificial Sequence
  chemically synthesized
ctggggtccacagaacacta

SEQ ID NO: 43268 - DNA, 20 bp, Artificial Sequence
  chemically synthesized
tggggtccacagaacactag

SEQ ID NO: 43269 - DNA, 20 bp, Artificial Sequence
  chemically synthesized
ggggtccacagaacactagg

SEQ ID NO: 43270 - DNA, 20 bp, Artificial Sequence
  chemically synthesized
tccacagaacactagggggc

SEQ ID NO: 43271 - DNA, 20 bp, Artificial Sequence
  chemically synthesized
agaacactagggggctggtg

SEQ ID NO: 43272 - DNA, 20 bp, Artificial Sequence
  chemically synthesized
tagggggctggtgaagttta

SEQ ID NO: 43273 - DNA, 20 bp, Artificial Sequence
  chemically synthesized
acttacatgtaactgaaatt

SEQ ID NO: 43274 - DNA, 20 bp, Artificial Sequence
  chemically synthesized
tttcttctactttgaatgca

SEQ ID NO: 43275 - DNA, 20 bp, Artificial Sequence
  chemically synthesized
ttcttctactttgaatgcaa

SEQ ID NO: 43276 - DNA, 20 bp, Artificial Sequence
  chemically synthesized
tttgaatgcaaaggacaaac

SEQ ID NO: 43277 - DNA, 20 bp, Artificial Sequence
  chemically synthesized
acaaactagaatgacatcat

SEQ ID NO: 43278 - DNA, 20 bp, Artificial Sequence
  chemically synthesized
catcatcagtacctattgca

SEQ ID NO: 43279 - DNA, 20 bp, Artificial Sequence
  chemically synthesized
gtacctattgcatagttata

SEQ ID NO: 43280 - DNA, 20 bp, Artificial Sequence
  chemically synthesized
acctattgcatagttataaa

SEQ ID NO: 43281 - DNA, 20 bp, Artificial Sequence
  chemically synthesized
atagttataaagagaaacca

SEQ ID NO: 43282 - DNA, 20 bp, Artificial Sequence
  chemically synthesized
gatattttcatactacacca

SEQ ID NO: 43283 - DNA, 20 bp, Artificial Sequence
  chemically synthesized
atattttcatactacaccat

SEQ ID NO: 43284 - DNA, 20 bp, Artificial Sequence
  chemically synthesized
atactacaccataggtattg

SEQ ID NO: 43285 - DNA, 20 bp, Artificial Sequence
  chemically synthesized
ttttgtttttgtttttgttt

SEQ ID NO: 43286 - DNA, 20 bp, Artificial Sequence
  chemically synthesized
gtttttgtttttgtttgaga

SEQ ID NO: 43287 - DNA, 20 bp, Artificial Sequence
  chemically synthesized
ttttgtttttgtttgagatg

SEQ ID NO: 43288 - DNA, 20 bp, Artificial Sequence
  chemically synthesized
ggagtttcgctcttattgcc

SEQ ID NO: 43289 - DNA, 20 bp, Artificial Sequence
  chemically synthesized
gagtttcgctcttattgccc

SEQ ID NO: 43290 - DNA, 20 bp, Artificial Sequence
  chemically synthesized
ttcgctcttattgcccaggc

SEQ ID NO: 43291 - DNA, 20 bp, Artificial Sequence
  chemically synthesized
cgctcttattgcccaggctg

SEQ ID NO: 43292 - DNA, 20 bp, Artificial Sequence
  chemically synthesized
ttattgcccaggctggagtg

SEQ ID NO: 43293 - DNA, 20 bp, Artificial Sequence
  chemically synthesized
ttgcccaggctggagtgcag

SEQ ID NO: 43294 - DNA, 20 bp, Artificial Sequence
  chemically synthesized
ggagtgcagtggcatgattt

SEQ ID NO: 43295 - DNA, 20 bp, Artificial Sequence
  chemically synthesized
aacctccccttcctgcattc

SEQ ID NO: 43296 - DNA, 20 bp, Artificial Sequence
  chemically synthesized
ttcaagcaattctcctgcct

SEQ ID NO: 43297 - DNA, 20 bp, Artificial Sequence
  chemically synthesized
ttctcctgccttggcctcct

SEQ ID NO: 43298 - DNA, 20 bp, Artificial Sequence
  chemically synthesized
tcctgccttggcctcctgag

SEQ ID NO: 43299 - DNA, 20 bp, Artificial Sequence
  chemically synthesized
gccttggcctcctgagtagc

SEQ ID NO: 43300 - DNA, 20 bp, Artificial Sequence
  chemically synthesized
ccttggcctcctgagtagct

SEQ ID NO: 43301 - DNA, 20 bp, Artificial Sequence
  chemically synthesized
cttggcctcctgagtagctg

SEQ ID NO: 43302 - DNA, 20 bp, Artificial Sequence
  chemically synthesized
tcctgagtagctggggatta

SEQ ID NO: 43303 - DNA, 20 bp, Artificial Sequence
  chemically synthesized
cctgagtagctggggattac

SEQ ID NO: 43304 - DNA, 20 bp, Artificial Sequence
  chemically synthesized
acaggcacctgccaccatgc

SEQ ID NO: 43305 - DNA, 20 bp, Artificial Sequence
  chemically synthesized
cagtctaatttttgtatttt

SEQ ID NO: 43306 - DNA, 20 bp, Artificial Sequence
  chemically synthesized
tctaatttttgtatttttag

SEQ ID NO: 43307 - DNA, 20 bp, Artificial Sequence
  chemically synthesized
taatttttgtatttttagta

SEQ ID NO: 43308 - DNA, 20 bp, Artificial Sequence
  chemically synthesized
ttttgtatttttagtagaga

SEQ ID NO: 43309 - DNA, 20 bp, Artificial Sequence
  chemically synthesized
tttgtatttttagtagagat

SEQ ID NO: 43310 - DNA, 20 bp, Artificial Sequence
  chemically synthesized
ttgtatttttagtagagatg

SEQ ID NO: 43311 - DNA, 20 bp, Artificial Sequence
  chemically synthesized
gagatggggtttcgccatgt

SEQ ID NO: 43312 - DNA, 20 bp, Artificial Sequence
  chemically synthesized
tggggtttcgccatgttggc

SEQ ID NO: 43313 - DNA, 20 bp, Artificial Sequence
  chemically synthesized
ggggtttcgccatgttggcc

SEQ ID NO: 43314 - DNA, 20 bp, Artificial Sequence
  chemically synthesized
tttcgccatgttggccaggc

SEQ ID NO: 43315 - DNA, 20 bp, Artificial Sequence
  chemically synthesized
tggtcttgaactcctgacct

SEQ ID NO: 43316 - DNA, 20 bp, Artificial Sequence
  chemically synthesized
ctcagatgatctgcccgcct

SEQ ID NO: 43317 - DNA, 20 bp, Artificial Sequence
  chemically synthesized
ctgcccgccttggcctcctg

SEQ ID NO: 43318 - DNA, 20 bp, Artificial Sequence
  chemically synthesized
gccttggcctcctgaagtgc

SEQ ID NO: 43319 - DNA, 20 bp, Artificial Sequence
  chemically synthesized
ccttggcctcctgaagtgct

SEQ ID NO: 43320 - DNA, 20 bp, Artificial Sequence
  chemically synthesized
ctcctgaagtgctgggatta

SEQ ID NO: 43321 - DNA, 20 bp, Artificial Sequence
  chemically synthesized
tcctgaagtgctgggattat

SEQ ID NO: 43322 - DNA, 20 bp, Artificial Sequence
  chemically synthesized
agtgctgggattataggtgt

SEQ ID NO: 43323 - DNA, 20 bp, Artificial Sequence
  chemically synthesized
taggtgtgagccaccacgcc

SEQ ID NO: 43324 - DNA, 20 bp, Artificial Sequence
  chemically synthesized
ccaccacgcctggcccattg

SEQ ID NO: 43325 - DNA, 20 bp, Artificial Sequence
  chemically synthesized
catttatctgcatcactact

SEQ ID NO: 43326 - DNA, 20 bp, Artificial Sequence
  chemically synthesized
tgcatcactacttggatctt

SEQ ID NO: 43327 - DNA, 20 bp, Artificial Sequence
  chemically synthesized
gcatcactacttggatctta

SEQ ID NO: 43328 - DNA, 20 bp, Artificial Sequence
  chemically synthesized
tcactacttggatcttaagg

SEQ ID NO: 43329 - DNA, 20 bp, Artificial Sequence
  chemically synthesized
cttggatcttaaggtagctg

SEQ ID NO: 43330 - DNA, 20 bp, Artificial Sequence
  chemically synthesized
ggtagctgtagacccaatcc

SEQ ID NO: 43331 - DNA, 20 bp, Artificial Sequence
  chemically synthesized
ctagatctaatgctttcata

SEQ ID NO: 43332 - DNA, 20 bp, Artificial Sequence
  chemically synthesized
gatctaatgctttcataaag

SEQ ID NO: 43333 - DNA, 20 bp, Artificial Sequence
  chemically synthesized
gatgtctgataatgatattt

SEQ ID NO: 43334 - DNA, 20 bp, Artificial Sequence
  chemically synthesized
tatttcagtgtaattaaact

SEQ ID NO: 43335 - DNA, 20 bp, Artificial Sequence
  chemically synthesized
gcaataaaaacatatttttt

SEQ ID NO: 43336 - DNA, 20 bp, Artificial Sequence
  chemically synthesized
acatatttttttagcactta

SEQ ID NO: 43337 - DNA, 20 bp, Artificial Sequence
  chemically synthesized
gcacttacagtctgccaaac

SEQ ID NO: 43338 - DNA, 20 bp, Artificial Sequence
  chemically synthesized
actggcctgtgacacaaaaa

SEQ ID NO: 43339 - DNA, 20 bp, Artificial Sequence
  chemically synthesized
cctgtgacacaaaaaaagtt

SEQ ID NO: 43340 - DNA, 20 bp, Artificial Sequence
  chemically synthesized
ctgtgacacaaaaaaagttt

SEQ ID NO: 43341 - DNA, 20 bp, Artificial Sequence
  chemically synthesized
aaaaaaagtttaggaattcc

SEQ ID NO: 43342 - DNA, 20 bp, Artificial Sequence
  chemically synthesized
attcctggttttgtctgtgt

SEQ ID NO: 43343 - DNA, 20 bp, Artificial Sequence
  chemically synthesized
gttttgtctgtgttagccaa

SEQ ID NO: 43344 - DNA, 20 bp, Artificial Sequence
  chemically synthesized
tgtctgtgttagccaatggt

SEQ ID NO: 43345 - DNA, 20 bp, Artificial Sequence
  chemically synthesized
caatggttagaatatatgct

SEQ ID NO: 43346 - DNA, 20 bp, Artificial Sequence
  chemically synthesized
ggttagaatatatgctcaga

SEQ ID NO: 43347 - DNA, 20 bp, Artificial Sequence
  chemically synthesized
tatgctcagaaagataccat

SEQ ID NO: 43348 - DNA, 20 bp, Artificial Sequence
  chemically synthesized
agaaagataccattggttaa

SEQ ID NO: 43349 - DNA, 20 bp, Artificial Sequence
  chemically synthesized
taccattggttaatagctaa

SEQ ID NO: 43350 - DNA, 20 bp, Artificial Sequence
  chemically synthesized
ggttaatagctaaaagaaaa

SEQ ID NO: 43351 - DNA, 20 bp, Artificial Sequence
  chemically synthesized
ttaatagctaaaagaaaatg

SEQ ID NO: 43352 - DNA, 20 bp, Artificial Sequence
  chemically synthesized
atagctaaaagaaaatggag

SEQ ID NO: 43353 - DNA, 20 bp, Artificial Sequence
  chemically synthesized
aagaaaatggagtagaaatt

SEQ ID NO: 43354 - DNA, 20 bp, Artificial Sequence
  chemically synthesized
aaaatggagtagaaattcag

SEQ ID NO: 43355 - DNA, 20 bp, Artificial Sequence
  chemically synthesized
ggagtagaaattcagtggcc

SEQ ID NO: 43356 - DNA, 20 bp, Artificial Sequence
  chemically synthesized
ggcctggaataataacaatt

SEQ ID NO: 43357 - DNA, 20 bp, Artificial Sequence
  chemically synthesized
gcctggaataataacaattt

SEQ ID NO: 43358 - DNA, 20 bp, Artificial Sequence
  chemically synthesized
tggaataataacaatttggg

SEQ ID NO: 43359 - DNA, 20 bp, Artificial Sequence
  chemically synthesized
taacaatttgggcagtcatt

SEQ ID NO: 43360 - DNA, 20 bp, Artificial Sequence
  chemically synthesized
aatttgggcagtcattaagt

SEQ ID NO: 43361 - DNA, 20 bp, Artificial Sequence
  chemically synthesized
atttgggcagtcattaagtc

SEQ ID NO: 43362 - DNA, 20 bp, Artificial Sequence
  chemically synthesized
ggcagtcattaagtcaggtg

SEQ ID NO: 43363 - DNA, 20 bp, Artificial Sequence
  chemically synthesized
ttaagtcaggtgaagacttc

SEQ ID NO: 43364 - DNA, 20 bp, Artificial Sequence
  chemically synthesized
ggtgaagacttctggaatca

SEQ ID NO: 43365 - DNA, 20 bp, Artificial Sequence
  chemically synthesized
gtgaagacttctggaatcat

SEQ ID NO: 43366 - DNA, 20 bp, Artificial Sequence
  chemically synthesized
gaagacttctggaatcatgg

SEQ ID NO: 43367 - DNA, 20 bp, Artificial Sequence
  chemically synthesized
cttctggaatcatgggagaa

SEQ ID NO: 43368 - DNA, 20 bp, Artificial Sequence
  chemically synthesized
tggaatcatgggagaaaagc

SEQ ID NO: 43369 - DNA, 20 bp, Artificial Sequence
  chemically synthesized
ggaatcatgggagaaaagca

SEQ ID NO: 43370 - DNA, 20 bp, Artificial Sequence
  chemically synthesized
gaatcatgggagaaaagcaa

SEQ ID NO: 43371 - DNA, 20 bp, Artificial Sequence
  chemically synthesized
atcatgggagaaaagcaagg

SEQ ID NO: 43372 - DNA, 20 bp, Artificial Sequence
  chemically synthesized
gagacattcttacttgccac

SEQ ID NO: 43373 - DNA, 20 bp, Artificial Sequence
  chemically synthesized
tttttttttatcacaaacat

SEQ ID NO: 43374 - DNA, 20 bp, Artificial Sequence
  chemically synthesized
agaaaatataataaataaca

SEQ ID NO: 43375 - DNA, 20 bp, Artificial Sequence
  chemically synthesized
aatataataaataacaaagt

SEQ ID NO: 43376 - DNA, 20 bp, Artificial Sequence
  chemically synthesized
atataataaataacaaagtc

SEQ ID NO: 43377 - DNA, 20 bp, Artificial Sequence
  chemically synthesized
taaataacaaagtcaggtta

SEQ ID NO: 43378 - DNA, 20 bp, Artificial Sequence
  chemically synthesized
ataacaaagtcaggttatag

SEQ ID NO: 43379 - DNA, 20 bp, Artificial Sequence
  chemically synthesized
aacaaagtcaggttatagaa

SEQ ID NO: 43380 - DNA, 20 bp, Artificial Sequence
  chemically synthesized
caaagtcaggttatagaaga

SEQ ID NO: 43381 - DNA, 20 bp, Artificial Sequence
  chemically synthesized
atagaagagagaaacgctct

SEQ ID NO: 43382 - DNA, 20 bp, Artificial Sequence
  chemically synthesized
agaaacgctcttagtaaact

SEQ ID NO: 43383 - DNA, 20 bp, Artificial Sequence
  chemically synthesized
ctcttagtaaacttggaata

SEQ ID NO: 43384 - DNA, 20 bp, Artificial Sequence
  chemically synthesized
cttggaatatggaatcccca

SEQ ID NO: 43385 - DNA, 20 bp, Artificial Sequence
  chemically synthesized
ttggaatatggaatccccaa

SEQ ID NO: 43386 - DNA, 20 bp, Artificial Sequence
  chemically synthesized
atccccaaaggcacttgact

SEQ ID NO: 43387 - DNA, 20 bp, Artificial Sequence
  chemically synthesized
tccccaaaggcacttgactt

SEQ ID NO: 43388 - DNA, 20 bp, Artificial Sequence
  chemically synthesized
cccaaaggcacttgacttgg

SEQ ID NO: 43389 - DNA, 20 bp, Artificial Sequence
  chemically synthesized
aaggcacttgacttgggaga

SEQ ID NO: 43390 - DNA, 20 bp, Artificial Sequence
  chemically synthesized
aggcacttgacttgggagac

SEQ ID NO: 43391 - DNA, 20 bp, Artificial Sequence
  chemically synthesized
gcacttgacttgggagacag

SEQ ID NO: 43392 - DNA, 20 bp, Artificial Sequence
  chemically synthesized
gagacaggagccatactgct

SEQ ID NO: 43393 - DNA, 20 bp, Artificial Sequence
  chemically synthesized
agccatactgctaagtgaaa

SEQ ID NO: 43394 - DNA, 20 bp, Artificial Sequence
  chemically synthesized
actgctaagtgaaaaagacg

SEQ ID NO: 43395 - DNA, 20 bp, Artificial Sequence
  chemically synthesized
tgaaaaagacgaagaacctc

SEQ ID NO: 43396 - DNA, 20 bp, Artificial Sequence
  chemically synthesized
gaaaaagacgaagaacctct

SEQ ID NO: 43397 - DNA, 20 bp, Artificial Sequence
  chemically synthesized
aaaaagacgaagaacctcta

SEQ ID NO: 43398 - DNA, 20 bp, Artificial Sequence
  chemically synthesized
acctctagggcctgaacata

SEQ ID NO: 43399 - DNA, 20 bp, Artificial Sequence
  chemically synthesized
cctctagggcctgaacatac

SEQ ID NO: 43400 - DNA, 20 bp, Artificial Sequence
  chemically synthesized
cctgaacatacaggaaattg

SEQ ID NO: 43401 - DNA, 20 bp, Artificial Sequence
  chemically synthesized
ctgaacatacaggaaattgt

SEQ ID NO: 43402 - DNA, 20 bp, Artificial Sequence
  chemically synthesized
catacaggaaattgtaggaa

SEQ ID NO: 43403 - DNA, 20 bp, Artificial Sequence
  chemically synthesized
attgtaggaacagaaattcc

SEQ ID NO: 43404 - DNA, 20 bp, Artificial Sequence
  chemically synthesized
ggaacagaaattcctagatc

SEQ ID NO: 43405 - DNA, 20 bp, Artificial Sequence
  chemically synthesized
acagaaattcctagatctgg

SEQ ID NO: 43406 - DNA, 20 bp, Artificial Sequence
  chemically synthesized
cagaaattcctagatctggt

SEQ ID NO: 43407 - DNA, 20 bp, Artificial Sequence
  chemically synthesized
agaaattcctagatctggtg

SEQ ID NO: 43408 - DNA, 20 bp, Artificial Sequence
  chemically synthesized
attcctagatctggtggggc

SEQ ID NO: 43409 - DNA, 20 bp, Artificial Sequence
  chemically synthesized
ttcctagatctggtggggca

SEQ ID NO: 43410 - DNA, 20 bp, Artificial Sequence
  chemically synthesized
tcctagatctggtggggcaa

SEQ ID NO: 43411 - DNA, 20 bp, Artificial Sequence
  chemically synthesized
cctagatctggtggggcaag

SEQ ID NO: 43412 - DNA, 20 bp, Artificial Sequence
  chemically synthesized
tagatctggtggggcaaggg

SEQ ID NO: 43413 - DNA, 20 bp, Artificial Sequence
  chemically synthesized
tggtggggcaaggggagcca

SEQ ID NO: 43414 - DNA, 20 bp, Artificial Sequence
  chemically synthesized
ggtggggcaaggggagccat

SEQ ID NO: 43415 - DNA, 20 bp, Artificial Sequence
  chemically synthesized
tggggcaaggggagccatag

SEQ ID NO: 43416 - DNA, 20 bp, Artificial Sequence
  chemically synthesized
gcaaggggagccataggaga

SEQ ID NO: 43417 - DNA, 20 bp, Artificial Sequence
  chemically synthesized
ggagccataggagaaagaaa

SEQ ID NO: 43418 - DNA, 20 bp, Artificial Sequence
  chemically synthesized
gccataggagaaagaaatgg

SEQ ID NO: 43419 - DNA, 20 bp, Artificial Sequence
  chemically synthesized
ggagaaagaaatggtagaaa

SEQ ID NO: 43420 - DNA, 20 bp, Artificial Sequence
  chemically synthesized
aaagaaatggtagaaatgga

SEQ ID NO: 43421 - DNA, 20 bp, Artificial Sequence
  chemically synthesized
agaaatggtagaaatggatg

SEQ ID NO: 43422 - DNA, 20 bp, Artificial Sequence
  chemically synthesized
atggtagaaatggatggaga

SEQ ID NO: 43423 - DNA, 20 bp, Artificial Sequence
  chemically synthesized
ggtagaaatggatggagacg

SEQ ID NO: 43424 - DNA, 20 bp, Artificial Sequence
  chemically synthesized
gtagaaatggatggagacgg

SEQ ID NO: 43425 - DNA, 20 bp, Artificial Sequence
  chemically synthesized
gaaatggatggagacggagg

SEQ ID NO: 43426 - DNA, 20 bp, Artificial Sequence
  chemically synthesized
aatggatggagacggaggca

SEQ ID NO: 43427 - DNA, 20 bp, Artificial Sequence
  chemically synthesized
atggatggagacggaggcag

SEQ ID NO: 43428 - DNA, 20 bp, Artificial Sequence
  chemically synthesized
gatggagacggaggcagagg

SEQ ID NO: 43429 - DNA, 20 bp, Artificial Sequence
  chemically synthesized
atggagacggaggcagaggt

SEQ ID NO: 43430 - DNA, 20 bp, Artificial Sequence
  chemically synthesized
gagacggaggcagaggtggg

SEQ ID NO: 43431 - DNA, 20 bp, Artificial Sequence
  chemically synthesized
ggcagaggtgggcagatcat

SEQ ID NO: 43432 - DNA, 20 bp, Artificial Sequence
  chemically synthesized
gcagaggtgggcagatcatg

SEQ ID NO: 43433 - DNA, 20 bp, Artificial Sequence
  chemically synthesized
ggtgggcagatcatgaggtc

SEQ ID NO: 43434 - DNA, 20 bp, Artificial Sequence
  chemically synthesized
tgggcagatcatgaggtcaa

SEQ ID NO: 43435 - DNA, 20 bp, Artificial Sequence
  chemically synthesized
gatcatgaggtcaagagatc

SEQ ID NO: 43436 - DNA, 20 bp, Artificial Sequence
  chemically synthesized
tcaagagatcgagaccatcc

SEQ ID NO: 43437 - DNA, 20 bp, Artificial Sequence
  chemically synthesized
cgagaccatcctggcaaaca

SEQ ID NO: 43438 - DNA, 20 bp, Artificial Sequence
  chemically synthesized
tctactaaaaataaaaaaat

SEQ ID NO: 43439 - DNA, 20 bp, Artificial Sequence
  chemically synthesized
ctaaaaataaaaaaattagc

SEQ ID NO: 43440 - DNA, 20 bp, Artificial Sequence
  chemically synthesized
taaaaataaaaaaattagct

SEQ ID NO: 43441 - DNA, 20 bp, Artificial Sequence
  chemically synthesized
ataaaaaaattagctgggca

SEQ ID NO: 43442 - DNA, 20 bp, Artificial Sequence
  chemically synthesized
aaaaaattagctgggcatgg

SEQ ID NO: 43443 - DNA, 20 bp, Artificial Sequence
  chemically synthesized
ggcatggtggcatgcgcctg

SEQ ID NO: 43444 - DNA, 20 bp, Artificial Sequence
  chemically synthesized
gtggcatgcgcctgtagtcc

SEQ ID NO: 43445 - DNA, 20 bp, Artificial Sequence
  chemically synthesized
cgcctgtagtcccagctgct

SEQ ID NO: 43446 - DNA, 20 bp, Artificial Sequence
  chemically synthesized
gcctgtagtcccagctgctc

SEQ ID NO: 43447 - DNA, 20 bp, Artificial Sequence
  chemically synthesized
ctgtagtcccagctgctcgg

SEQ ID NO: 43448 - DNA, 20 bp, Artificial Sequence
  chemically synthesized
tgtagtcccagctgctcggg

SEQ ID NO: 43449 - DNA, 20 bp, Artificial Sequence
  chemically synthesized
tcccagctgctcgggaggct

SEQ ID NO: 43450 - DNA, 20 bp, Artificial Sequence
  chemically synthesized
cccagctgctcgggaggctg

SEQ ID NO: 43451 - DNA, 20 bp, Artificial Sequence
  chemically synthesized
agctgctcgggaggctgagg

SEQ ID NO: 43452 - DNA, 20 bp, Artificial Sequence
  chemically synthesized
gctgctcgggaggctgaggc

SEQ ID NO: 43453 - DNA, 20 bp, Artificial Sequence
  chemically synthesized
tgctcgggaggctgaggcag

SEQ ID NO: 43454 - DNA, 20 bp, Artificial Sequence
  chemically synthesized
gcaggagaatcgtttgaacc

SEQ ID NO: 43455 - DNA, 20 bp, Artificial Sequence
  chemically synthesized
caggagaatcgtttgaaccc

SEQ ID NO: 43456 - DNA, 20 bp, Artificial Sequence
  chemically synthesized
ggagaatcgtttgaacccag

SEQ ID NO: 43457 - DNA, 20 bp, Artificial Sequence
  chemically synthesized
gagaatcgtttgaacccagg

SEQ ID NO: 43458 - DNA, 20 bp, Artificial Sequence
  chemically synthesized
tcgtttgaacccaggaggcg

SEQ ID NO: 43459 - DNA, 20 bp, Artificial Sequence
  chemically synthesized
cgtttgaacccaggaggcga

SEQ ID NO: 43460 - DNA, 20 bp, Artificial Sequence
  chemically synthesized
aacccaggaggcgaaggttg

SEQ ID NO: 43461 - DNA, 20 bp, Artificial Sequence
  chemically synthesized
caggaggcgaaggttgcagt

SEQ ID NO: 43462 - DNA, 20 bp, Artificial Sequence
  chemically synthesized
ggcgaaggttgcagtgagct

SEQ ID NO: 43463 - DNA, 20 bp, Artificial Sequence
  chemically synthesized
aaggttgcagtgagctgaga

SEQ ID NO: 43464 - DNA, 20 bp, Artificial Sequence
  chemically synthesized
gagatagtgccattgcactc

SEQ ID NO: 43465 - DNA, 20 bp, Artificial Sequence
  chemically synthesized
agtgccattgcactccagtc

SEQ ID NO: 43466 - DNA, 20 bp, Artificial Sequence
  chemically synthesized
attgcactccagtctggcaa

SEQ ID NO: 43467 - DNA, 20 bp, Artificial Sequence
  chemically synthesized
tgcactccagtctggcaaca

SEQ ID NO: 43468 - DNA, 20 bp, Artificial Sequence
  chemically synthesized
ctccagtctggcaacagagt

SEQ ID NO: 43469 - DNA, 20 bp, Artificial Sequence
  chemically synthesized
cgtctcaaaaaaaaaaaaaa

SEQ ID NO: 43470 - DNA, 20 bp, Artificial Sequence
  chemically synthesized
tcaaaaaaaaaaaaaaaaga

SEQ ID NO: 43471 - DNA, 20 bp, Artificial Sequence
  chemically synthesized
aaaaaaaaaaaaaagaaaga

SEQ ID NO: 43472 - DNA, 20 bp, Artificial Sequence
  chemically synthesized
aaaaaaaaagaaagaaagaa

SEQ ID NO: 43473 - DNA, 20 bp, Artificial Sequence
  chemically synthesized
aaagaaagaaagaaaagaaa

SEQ ID NO: 43474 - DNA, 20 bp, Artificial Sequence
  chemically synthesized
gaaagaaaagaaaaagaaaa

SEQ ID NO: 43475 - DNA, 20 bp, Artificial Sequence
  chemically synthesized
aagaaaaaagaaaaaataaa

SEQ ID NO: 43476 - DNA, 20 bp, Artificial Sequence
  chemically synthesized
aaagaaaaaataaatggatg

SEQ ID NO: 43477 - DNA, 20 bp, Artificial Sequence
  chemically synthesized
aaaataaatggatgtagaac

SEQ ID NO: 43478 - DNA, 20 bp, Artificial Sequence
  chemically synthesized
taaatggatgtagaacaagc

SEQ ID NO: 43479 - DNA, 20 bp, Artificial Sequence
  chemically synthesized
atggatgtagaacaagccag

SEQ ID NO: 43480 - DNA, 20 bp, Artificial Sequence
  chemically synthesized
tggatgtagaacaagccaga

SEQ ID NO: 43481 - DNA, 20 bp, Artificial Sequence
  chemically synthesized
gatgtagaacaagccagaag

SEQ ID NO: 43482 - DNA, 20 bp, Artificial Sequence
  chemically synthesized
atgtagaacaagccagaagg

SEQ ID NO: 43483 - DNA, 20 bp, Artificial Sequence
  chemically synthesized
aacaagccagaaggaggaac

SEQ ID NO: 43484 - DNA, 20 bp, Artificial Sequence
  chemically synthesized
acaagccagaaggaggaact

SEQ ID NO: 43485 - DNA, 20 bp, Artificial Sequence
  chemically synthesized
gccagaaggaggaactgggc

SEQ ID NO: 43486 - DNA, 20 bp, Artificial Sequence
  chemically synthesized
ccagaaggaggaactgggct

SEQ ID NO: 43487 - DNA, 20 bp, Artificial Sequence
  chemically synthesized
cagaaggaggaactgggctg

SEQ ID NO: 43488 - DNA, 20 bp, Artificial Sequence
  chemically synthesized
aggaactgggctggggcaat

SEQ ID NO: 43489 - DNA, 20 bp, Artificial Sequence
  chemically synthesized
gggctggggcaatgagatta

SEQ ID NO: 43490 - DNA, 20 bp, Artificial Sequence
  chemically synthesized
caatgagattatggtgatgt

SEQ ID NO: 43491 - DNA, 20 bp, Artificial Sequence
  chemically synthesized
aatgagattatggtgatgta

SEQ ID NO: 43492 - DNA, 20 bp, Artificial Sequence
  chemically synthesized
atgagattatggtgatgtaa

SEQ ID NO: 43493 - DNA, 20 bp, Artificial Sequence
  chemically synthesized
ggtgatgtaagggactttta

SEQ ID NO: 43494 - DNA, 20 bp, Artificial Sequence
  chemically synthesized
ttttatagaattaacaatgc

SEQ ID NO: 43495 - DNA, 20 bp, Artificial Sequence
  chemically synthesized
attaacaatgctggaatttg

SEQ ID NO: 43496 - DNA, 20 bp, Artificial Sequence
  chemically synthesized
cattacttctgtcacattga

SEQ ID NO: 43497 - DNA, 20 bp, Artificial Sequence
  chemically synthesized
attccttgattctaaaatat

SEQ ID NO: 43498 - DNA, 20 bp, Artificial Sequence
  chemically synthesized
ttccttgattctaaaatatg

SEQ ID NO: 43499 - DNA, 20 bp, Artificial Sequence
  chemically synthesized
aaatatgaggataatgacaa

SEQ ID NO: 43500 - DNA, 20 bp, Artificial Sequence
  chemically synthesized
gataatgacaatggtattat

SEQ ID NO: 43501 - DNA, 20 bp, Artificial Sequence
  chemically synthesized
ataatgacaatggtattata

SEQ ID NO: 43502 - DNA, 20 bp, Artificial Sequence
  chemically synthesized
taatgacaatggtattataa

SEQ ID NO: 43503 - DNA, 20 bp, Artificial Sequence
  chemically synthesized
tgacaatggtattataaggg

SEQ ID NO: 43504 - DNA, 20 bp, Artificial Sequence
  chemically synthesized
tggtattataagggcagatt

SEQ ID NO: 43505 - DNA, 20 bp, Artificial Sequence
  chemically synthesized
taagggcagattaagtgata

SEQ ID NO: 43506 - DNA, 20 bp, Artificial Sequence
  chemically synthesized
cagattaagtgatatagcat

SEQ ID NO: 43507 - DNA, 20 bp, Artificial Sequence
  chemically synthesized
atagcatgagcaatattctt

SEQ ID NO: 43508 - DNA, 20 bp, Artificial Sequence
  chemically synthesized
tagcatgagcaatattcttc

SEQ ID NO: 43509 - DNA, 20 bp, Artificial Sequence
  chemically synthesized
agcaatattcttcaggcaca

SEQ ID NO: 43510 - DNA, 20 bp, Artificial Sequence
  chemically synthesized
acactgtaaatcccaacttc

SEQ ID NO: 43511 - DNA, 20 bp, Artificial Sequence
  chemically synthesized
taaatcccaacttccagttt

SEQ ID NO: 43512 - DNA, 20 bp, Artificial Sequence
  chemically synthesized
cttccagtttcagctctacc

SEQ ID NO: 43513 - DNA, 20 bp, Artificial Sequence
  chemically synthesized
agtttcagctctaccaagta

SEQ ID NO: 43514 - DNA, 20 bp, Artificial Sequence
  chemically synthesized
tttcagctctaccaagtaaa

SEQ ID NO: 43515 - DNA, 20 bp, Artificial Sequence
  chemically synthesized
agctctaccaagtaaagagc

SEQ ID NO: 43516 - DNA, 20 bp, Artificial Sequence
  chemically synthesized
ctaccaagtaaagagctagc

SEQ ID NO: 43517 - DNA, 20 bp, Artificial Sequence
  chemically synthesized
gagctagcaagtcatcaaaa

SEQ ID NO: 43518 - DNA, 20 bp, Artificial Sequence
  chemically synthesized
agctagcaagtcatcaaaat

SEQ ID NO: 43519 - DNA, 20 bp, Artificial Sequence
  chemically synthesized
gctagcaagtcatcaaaatg

SEQ ID NO: 43520 - DNA, 20 bp, Artificial Sequence
  chemically synthesized
gtcatcaaaatggggacata

SEQ ID NO: 43521 - DNA, 20 bp, Artificial Sequence
  chemically synthesized
ggggacatacagaaaaaaaa

SEQ ID NO: 43522 - DNA, 20 bp, Artificial Sequence
  chemically synthesized
gggacatacagaaaaaaaaa

SEQ ID NO: 43523 - DNA, 20 bp, Artificial Sequence
  chemically synthesized
acagaaaaaaaaaaggacac

SEQ ID NO: 43524 - DNA, 20 bp, Artificial Sequence
  chemically synthesized
agaaaaaaaaaaggacacta

SEQ ID NO: 43525 - DNA, 20 bp, Artificial Sequence
  chemically synthesized
gaaaaaaaaaaggacactag

SEQ ID NO: 43526 - DNA, 20 bp, Artificial Sequence
  chemically synthesized
gaataatataccctgactcc

SEQ ID NO: 43527 - DNA, 20 bp, Artificial Sequence
  chemically synthesized
ctctgtttgatgacaaattc

SEQ ID NO: 43528 - DNA, 20 bp, Artificial Sequence
  chemically synthesized
attctggctttaaataattt

SEQ ID NO: 43529 - DNA, 20 bp, Artificial Sequence
  chemically synthesized
ttctggctttaaataatttt

SEQ ID NO: 43530 - DNA, 20 bp, Artificial Sequence
  chemically synthesized
tttaaataattttaggattt

SEQ ID NO: 43531 - DNA, 20 bp, Artificial Sequence
  chemically synthesized
ttaaataattttaggatttt

SEQ ID NO: 43532 - DNA, 20 bp, Artificial Sequence
  chemically synthesized
ttttaggattttaggcttct

SEQ ID NO: 43533 - DNA, 20 bp, Artificial Sequence
  chemically synthesized
aggcttctcagctcccttcc

SEQ ID NO: 43534 - DNA, 20 bp, Artificial Sequence
  chemically synthesized
ttctcagctcccttcccagt

SEQ ID NO: 43535 - DNA, 20 bp, Artificial Sequence
  chemically synthesized
tcagctcccttcccagtgag

SEQ ID NO: 43536 - DNA, 20 bp, Artificial Sequence
  chemically synthesized
cccttcccagtgagaagtat

SEQ ID NO: 43537 - DNA, 20 bp, Artificial Sequence
  chemically synthesized
ttcccagtgagaagtataag

SEQ ID NO: 43538 - DNA, 20 bp, Artificial Sequence
  chemically synthesized
tcccagtgagaagtataagc

SEQ ID NO: 43539 - DNA, 20 bp, Artificial Sequence
  chemically synthesized
agtgagaagtataagcagga

SEQ ID NO: 43540 - DNA, 20 bp, Artificial Sequence
  chemically synthesized
agaagtataagcaggacaga

SEQ ID NO: 43541 - DNA, 20 bp, Artificial Sequence
  chemically synthesized
gaagtataagcaggacagac

SEQ ID NO: 43542 - DNA, 20 bp, Artificial Sequence
  chemically synthesized
tataagcaggacagacaggc

SEQ ID NO: 43543 - DNA, 20 bp, Artificial Sequence
  chemically synthesized
agcaggacagacaggcaagc

SEQ ID NO: 43544 - DNA, 20 bp, Artificial Sequence
  chemically synthesized
aggacagacaggcaagcaag

SEQ ID NO: 43545 - DNA, 20 bp, Artificial Sequence
  chemically synthesized
gacagacaggcaagcaagaa

SEQ ID NO: 43546 - DNA, 20 bp, Artificial Sequence
  chemically synthesized
cagacaggcaagcaagaaga

SEQ ID NO: 43547 - DNA, 20 bp, Artificial Sequence
  chemically synthesized
ggcaagcaagaagagagccc

SEQ ID NO: 43548 - DNA, 20 bp, Artificial Sequence
  chemically synthesized
gcaagcaagaagagagcccc

SEQ ID NO: 43549 - DNA, 20 bp, Artificial Sequence
  chemically synthesized
agccccaggcaatactcaca

SEQ ID NO: 43550 - DNA, 20 bp, Artificial Sequence
  chemically synthesized
cccaggcaatactcacaaag

SEQ ID NO: 43551 - DNA, 20 bp, Artificial Sequence
  chemically synthesized
aaagtagccaatgtcccctg

SEQ ID NO: 43552 - DNA, 20 bp, Artificial Sequence
  chemically synthesized
gccaatgtcccctgtggtca

SEQ ID NO: 43553 - DNA, 20 bp, Artificial Sequence
  chemically synthesized
caatgtcccctgtggtcata

SEQ ID NO: 43554 - DNA, 20 bp, Artificial Sequence
  chemically synthesized
tgtggtcatagagaaatgaa

SEQ ID NO: 43555 - DNA, 20 bp, Artificial Sequence
  chemically synthesized
tggtcatagagaaatgaaaa

SEQ ID NO: 43556 - DNA, 20 bp, Artificial Sequence
  chemically synthesized
gtcatagagaaatgaaaaga

SEQ ID NO: 43557 - DNA, 20 bp, Artificial Sequence
  chemically synthesized
catagagaaatgaaaagaga

SEQ ID NO: 43558 - DNA, 20 bp, Artificial Sequence
  chemically synthesized
atagagaaatgaaaagagag

SEQ ID NO: 43559 - DNA, 20 bp, Artificial Sequence
  chemically synthesized
tgaaaagagagaggattctc

SEQ ID NO: 43560 - DNA, 20 bp, Artificial Sequence
  chemically synthesized
aaagagagaggattctctgg

SEQ ID NO: 43561 - DNA, 20 bp, Artificial Sequence
  chemically synthesized
agaggattctctggaagcac

SEQ ID NO: 43562 - DNA, 20 bp, Artificial Sequence
  chemically synthesized
tcttttctgtctgtcctctc

SEQ ID NO: 43563 - DNA, 20 bp, Artificial Sequence
  chemically synthesized
cttttctgtctgtcctctct

SEQ ID NO: 43564 - DNA, 20 bp, Artificial Sequence
  chemically synthesized
ttttctgtctgtcctctcta

SEQ ID NO: 43565 - DNA, 20 bp, Artificial Sequence
  chemically synthesized
cctctctagggaatcacccc

SEQ ID NO: 43566 - DNA, 20 bp, Artificial Sequence
  chemically synthesized
ctctctagggaatcacccca

SEQ ID NO: 43567 - DNA, 20 bp, Artificial Sequence
  chemically synthesized
caccccaaggtactgtactt

SEQ ID NO: 43568 - DNA, 20 bp, Artificial Sequence
  chemically synthesized
accccaaggtactgtacttt

SEQ ID NO: 43569 - DNA, 20 bp, Artificial Sequence
  chemically synthesized
aggtactgtactttgggatt

SEQ ID NO: 43570 - DNA, 20 bp, Artificial Sequence
  chemically synthesized
ggtactgtactttgggatta

SEQ ID NO: 43571 - DNA, 20 bp, Artificial Sequence
  chemically synthesized
gtactttgggattaaggctt

SEQ ID NO: 43572 - DNA, 20 bp, Artificial Sequence
  chemically synthesized
ttaaggctttagtcccactg

SEQ ID NO: 43573 - DNA, 20 bp, Artificial Sequence
  chemically synthesized
ggactacttgctattctgtt

SEQ ID NO: 43574 - DNA, 20 bp, Artificial Sequence
  chemically synthesized
ttgctattctgttcagtttc

SEQ ID NO: 43575 - DNA, 20 bp, Artificial Sequence
  chemically synthesized
ctattctgttcagtttctag

SEQ ID NO: 43576 - DNA, 20 bp, Artificial Sequence
  chemically synthesized
tattctgttcagtttctaga

SEQ ID NO: 43577 - DNA, 20 bp, Artificial Sequence
  chemically synthesized
tttctagaaggaactatgta

SEQ ID NO: 43578 - DNA, 20 bp, Artificial Sequence
  chemically synthesized
atgtacggtttttgtctccc

SEQ ID NO: 43579 - DNA, 20 bp, Artificial Sequence
  chemically synthesized
gtacggtttttgtctcccta

SEQ ID NO: 43580 - DNA, 20 bp, Artificial Sequence
  chemically synthesized
tttgtctccctagagaaact

SEQ ID NO: 43581 - DNA, 20 bp, Artificial Sequence
  chemically synthesized
ttgtctccctagagaaacta

SEQ ID NO: 43582 - DNA, 20 bp, Artificial Sequence
  chemically synthesized
tccctagagaaactaaggta

SEQ ID NO: 43583 - DNA, 20 bp, Artificial Sequence
  chemically synthesized
ctagagaaactaaggtacag

SEQ ID NO: 43584 - DNA, 20 bp, Artificial Sequence
  chemically synthesized
ttgtttacaatgcactcctt

SEQ ID NO: 43585 - DNA, 20 bp, Artificial Sequence
  chemically synthesized
gtttacaatgcactccttaa

SEQ ID NO: 43586 - DNA, 20 bp, Artificial Sequence
  chemically synthesized
ttacaatgcactccttaaga

SEQ ID NO: 43587 - DNA, 20 bp, Artificial Sequence
  chemically synthesized
aatgcactccttaagagagc

SEQ ID NO: 43588 - DNA, 20 bp, Artificial Sequence
  chemically synthesized
ctccttaagagagctagaac

SEQ ID NO: 43589 - DNA, 20 bp, Artificial Sequence
  chemically synthesized
tccttaagagagctagaact

SEQ ID NO: 43590 - DNA, 20 bp, Artificial Sequence
  chemically synthesized
taagagagctagaactgggt

SEQ ID NO: 43591 - DNA, 20 bp, Artificial Sequence
  chemically synthesized
tgggtgagattctgttttaa

SEQ ID NO: 43592 - DNA, 20 bp, Artificial Sequence
  chemically synthesized
cagctttattttcttttcct

SEQ ID NO: 43593 - DNA, 20 bp, Artificial Sequence
  chemically synthesized
ttgtcactgtcaccaccttt

SEQ ID NO: 43594 - DNA, 20 bp, Artificial Sequence
  chemically synthesized
tgtcactgtcaccaccttta

SEQ ID NO: 43595 - DNA, 20 bp, Artificial Sequence
  chemically synthesized
ggcaaatgttaaatgcgctt

SEQ ID NO: 43596 - DNA, 20 bp, Artificial Sequence
  chemically synthesized
gaaactttttttcctatttt

SEQ ID NO: 43597 - DNA, 20 bp, Artificial Sequence
  chemically synthesized
tgagatttgctcctttatat

SEQ ID NO: 43598 - DNA, 20 bp, Artificial Sequence
  chemically synthesized
gagatttgctcctttatatg

SEQ ID NO: 43599 - DNA, 20 bp, Artificial Sequence
  chemically synthesized
tcctttatatgaggctttct

SEQ ID NO: 43600 - DNA, 20 bp, Artificial Sequence
  chemically synthesized
tatatgaggctttcttggaa

SEQ ID NO: 43601 - DNA, 20 bp, Artificial Sequence
  chemically synthesized
atatgaggctttcttggaaa

SEQ ID NO: 43602 - DNA, 20 bp, Artificial Sequence
  chemically synthesized
atgaggctttcttggaaaag

SEQ ID NO: 43603 - DNA, 20 bp, Artificial Sequence
  chemically synthesized
gctttcttggaaaaggagaa

SEQ ID NO: 43604 - DNA, 20 bp, Artificial Sequence
  chemically synthesized
ctttcttggaaaaggagaat

SEQ ID NO: 43605 - DNA, 20 bp, Artificial Sequence
  chemically synthesized
ttcttggaaaaggagaatgg

SEQ ID NO: 43606 - DNA, 20 bp, Artificial Sequence
  chemically synthesized
cttggaaaaggagaatggga

SEQ ID NO: 43607 - DNA, 20 bp, Artificial Sequence
  chemically synthesized
gaaaaggagaatgggagaga

SEQ ID NO: 43608 - DNA, 20 bp, Artificial Sequence
  chemically synthesized
gggagagatggatatcattt

SEQ ID NO: 43609 - DNA, 20 bp, Artificial Sequence
  chemically synthesized
agagatggatatcattttgg

SEQ ID NO: 43610 - DNA, 20 bp, Artificial Sequence
  chemically synthesized
tatcattttggaagatgatg

SEQ ID NO: 43611 - DNA, 20 bp, Artificial Sequence
  chemically synthesized
tcattttggaagatgatgaa

SEQ ID NO: 43612 - DNA, 20 bp, Artificial Sequence
  chemically synthesized
cattttggaagatgatgaag

SEQ ID NO: 43613 - DNA, 20 bp, Artificial Sequence
  chemically synthesized
attttggaagatgatgaaga

SEQ ID NO: 43614 - DNA, 20 bp, Artificial Sequence
  chemically synthesized
agatgatgaagagggtaaaa

SEQ ID NO: 43615 - DNA, 20 bp, Artificial Sequence
  chemically synthesized
gatgatgaagagggtaaaaa

SEQ ID NO: 43616 - DNA, 20 bp, Artificial Sequence
  chemically synthesized
atgatgaagagggtaaaaaa

SEQ ID NO: 43617 - DNA, 20 bp, Artificial Sequence
  chemically synthesized
tgatgaagagggtaaaaaag

SEQ ID NO: 43618 - DNA, 20 bp, Artificial Sequence
  chemically synthesized
agggtaaaaaaggggacaaa

SEQ ID NO: 43619 - DNA, 20 bp, Artificial Sequence
  chemically synthesized
acaaatggaaatttgtgttg

SEQ ID NO: 43620 - DNA, 20 bp, Artificial Sequence
  chemically synthesized
atggaaatttgtgttgcaga

SEQ ID NO: 43621 - DNA, 20 bp, Artificial Sequence
  chemically synthesized
aatttgtgttgcagatagat

SEQ ID NO: 43622 - DNA, 20 bp, Artificial Sequence
  chemically synthesized
atttgtgttgcagatagatg

SEQ ID NO: 43623 - DNA, 20 bp, Artificial Sequence
  chemically synthesized
ttgtgttgcagatagatgag

SEQ ID NO: 43624 - DNA, 20 bp, Artificial Sequence
  chemically synthesized
tagatgaggagccaacaaaa

SEQ ID NO: 43625 - DNA, 20 bp, Artificial Sequence
  chemically synthesized
gatgaggagccaacaaaaaa

SEQ ID NO: 43626 - DNA, 20 bp, Artificial Sequence
  chemically synthesized
gagccaacaaaaaagagcct

SEQ ID NO: 43627 - DNA, 20 bp, Artificial Sequence
  chemically synthesized
agccaacaaaaaagagcctc

SEQ ID NO: 43628 - DNA, 20 bp, Artificial Sequence
  chemically synthesized
caaaaaagagcctcaggatc

SEQ ID NO: 43629 - DNA, 20 bp, Artificial Sequence
  chemically synthesized
agcacacattatcacaaact

SEQ ID NO: 43630 - DNA, 20 bp, Artificial Sequence
  chemically synthesized
ccatcactgctgaccctctc

SEQ ID NO: 43631 - DNA, 20 bp, Artificial Sequence
  chemically synthesized
ccggacctgactccacccct

SEQ ID NO: 43632 - DNA, 20 bp, Artificial Sequence
  chemically synthesized
cggacctgactccacccctg

SEQ ID NO: 43633 - DNA, 20 bp, Artificial Sequence
  chemically synthesized
ggacctgactccacccctga

SEQ ID NO: 43634 - DNA, 20 bp, Artificial Sequence
  chemically synthesized
gactccacccctgagggaca

SEQ ID NO: 43635 - DNA, 20 bp, Artificial Sequence
  chemically synthesized
actccacccctgagggacac

SEQ ID NO: 43636 - DNA, 20 bp, Artificial Sequence
  chemically synthesized
cacccctgagggacacaggt

SEQ ID NO: 43637 - DNA, 20 bp, Artificial Sequence
  chemically synthesized
agccttgaccaatgactttt

SEQ ID NO: 43638 - DNA, 20 bp, Artificial Sequence
  chemically synthesized
ccaatgacttttaagtacca

SEQ ID NO: 43639 - DNA, 20 bp, Artificial Sequence
  chemically synthesized
aatgacttttaagtaccatg

SEQ ID NO: 43640 - DNA, 20 bp, Artificial Sequence
  chemically synthesized
cttttaagtaccatggagaa

SEQ ID NO: 43641 - DNA, 20 bp, Artificial Sequence
  chemically synthesized
ttttaagtaccatggagaac

SEQ ID NO: 43642 - DNA, 20 bp, Artificial Sequence
  chemically synthesized
tttaagtaccatggagaaca

SEQ ID NO: 43643 - DNA, 20 bp, Artificial Sequence
  chemically synthesized
ttaagtaccatggagaacag

SEQ ID NO: 43644 - DNA, 20 bp, Artificial Sequence
  chemically synthesized
taagtaccatggagaacagg

SEQ ID NO: 43645 - DNA, 20 bp, Artificial Sequence
  chemically synthesized
taccatggagaacagggggc

SEQ ID NO: 43646 - DNA, 20 bp, Artificial Sequence
  chemically synthesized
agaacagggggccagaactt

SEQ ID NO: 43647 - DNA, 20 bp, Artificial Sequence
  chemically synthesized
acagggggccagaacttcgg

SEQ ID NO: 43648 - DNA, 20 bp, Artificial Sequence
  chemically synthesized
gggccagaacttcggcagta

SEQ ID NO: 43649 - DNA, 20 bp, Artificial Sequence
  chemically synthesized
acttcggcagtaaagaataa

SEQ ID NO: 43650 - DNA, 20 bp, Artificial Sequence
  chemically synthesized
cttcggcagtaaagaataaa

SEQ ID NO: 43651 - DNA, 20 bp, Artificial Sequence
  chemically synthesized
ggcagtaaagaataaaaggc

SEQ ID NO: 43652 - DNA, 20 bp, Artificial Sequence
  chemically synthesized
gtaaagaataaaaggccaga

SEQ ID NO: 43653 - DNA, 20 bp, Artificial Sequence
  chemically synthesized
aaagaataaaaggccagaca

SEQ ID NO: 43654 - DNA, 20 bp, Artificial Sequence
  chemically synthesized
agaataaaaggccagacaga

SEQ ID NO: 43655 - DNA, 20 bp, Artificial Sequence
  chemically synthesized
gaataaaaggccagacagag

SEQ ID NO: 43656 - DNA, 20 bp, Artificial Sequence
  chemically synthesized
taaaaggccagacagagagg

SEQ ID NO: 43657 - DNA, 20 bp, Artificial Sequence
  chemically synthesized
aaggccagacagagaggcag

SEQ ID NO: 43658 - DNA, 20 bp, Artificial Sequence
  chemically synthesized
gcacatatctgcttccgaca

SEQ ID NO: 43659 - DNA, 20 bp, Artificial Sequence
  chemically synthesized
tccgacacagctgcaatcac

SEQ ID NO: 43660 - DNA, 20 bp, Artificial Sequence
  chemically synthesized
acacagctgcaatcactagc

SEQ ID NO: 43661 - DNA, 20 bp, Artificial Sequence
  chemically synthesized
tgcaatcactagcaagctct

SEQ ID NO: 43662 - DNA, 20 bp, Artificial Sequence
  chemically synthesized
gcaatcactagcaagctctc

SEQ ID NO: 43663 - DNA, 20 bp, Artificial Sequence
  chemically synthesized
cactagcaagctctcaggcc

SEQ ID NO: 43664 - DNA, 20 bp, Artificial Sequence
  chemically synthesized
agctctcaggcctggcatca

SEQ ID NO: 43665 - DNA, 20 bp, Artificial Sequence
  chemically synthesized
tcatggtgcattttactgct

SEQ ID NO: 43666 - DNA, 20 bp, Artificial Sequence
  chemically synthesized
catggtgcattttactgctg

SEQ ID NO: 43667 - DNA, 20 bp, Artificial Sequence
  chemically synthesized
tggtgcattttactgctgag

SEQ ID NO: 43668 - DNA, 20 bp, Artificial Sequence
  chemically synthesized
tgcattttactgctgaggag

SEQ ID NO: 43669 - DNA, 20 bp, Artificial Sequence
  chemically synthesized
gcattttactgctgaggaga

SEQ ID NO: 43670 - DNA, 20 bp, Artificial Sequence
  chemically synthesized
gaggagaaggctgccgtcac

SEQ ID NO: 43671 - DNA, 20 bp, Artificial Sequence
  chemically synthesized
aggctgccgtcactagcctg

SEQ ID NO: 43672 - DNA, 20 bp, Artificial Sequence
  chemically synthesized
gctgccgtcactagcctgtg

SEQ ID NO: 43673 - DNA, 20 bp, Artificial Sequence
  chemically synthesized
ccgtcactagcctgtggagc

SEQ ID NO: 43674 - DNA, 20 bp, Artificial Sequence
  chemically synthesized
cctgtggagcaagatgaatg

SEQ ID NO: 43675 - DNA, 20 bp, Artificial Sequence
  chemically synthesized
gtggagcaagatgaatgtgg

SEQ ID NO: 43676 - DNA, 20 bp, Artificial Sequence
  chemically synthesized
ggagcaagatgaatgtggaa

SEQ ID NO: 43677 - DNA, 20 bp, Artificial Sequence
  chemically synthesized
gagcaagatgaatgtggaag

SEQ ID NO: 43678 - DNA, 20 bp, Artificial Sequence
  chemically synthesized
aagatgaatgtggaagaggc

SEQ ID NO: 43679 - DNA, 20 bp, Artificial Sequence
  chemically synthesized
gatgaatgtggaagaggctg

SEQ ID NO: 43680 - DNA, 20 bp, Artificial Sequence
  chemically synthesized
atgaatgtggaagaggctgg

SEQ ID NO: 43681 - DNA, 20 bp, Artificial Sequence
  chemically synthesized
tgtggaagaggctggaggtg

SEQ ID NO: 43682 - DNA, 20 bp, Artificial Sequence
  chemically synthesized
agaggctggaggtgaagcct

SEQ ID NO: 43683 - DNA, 20 bp, Artificial Sequence
  chemically synthesized
gaggctggaggtgaagcctt

SEQ ID NO: 43684 - DNA, 20 bp, Artificial Sequence
  chemically synthesized
gctggaggtgaagccttggg

SEQ ID NO: 43685 - DNA, 20 bp, Artificial Sequence
  chemically synthesized
ctggaggtgaagccttgggc

SEQ ID NO: 43686 - DNA, 20 bp, Artificial Sequence
  chemically synthesized
aggtgaagccttgggcaggt

SEQ ID NO: 43687 - DNA, 20 bp, Artificial Sequence
  chemically synthesized
agccttgggcaggtaagcat

SEQ ID NO: 43688 - DNA, 20 bp, Artificial Sequence
  chemically synthesized
aagcattggttctcaatgca

SEQ ID NO: 43689 - DNA, 20 bp, Artificial Sequence
  chemically synthesized
agcattggttctcaatgcat

SEQ ID NO: 43690 - DNA, 20 bp, Artificial Sequence
  chemically synthesized
gttctcaatgcatgggaatg

SEQ ID NO: 43691 - DNA, 20 bp, Artificial Sequence
  chemically synthesized
ttctcaatgcatgggaatga

SEQ ID NO: 43692 - DNA, 20 bp, Artificial Sequence
  chemically synthesized
tctcaatgcatgggaatgaa

SEQ ID NO: 43693 - DNA, 20 bp, Artificial Sequence
  chemically synthesized
atgaagggtgaatattaccc

SEQ ID NO: 43694 - DNA, 20 bp, Artificial Sequence
  chemically synthesized
agggtgaatattaccctagc

SEQ ID NO: 43695 - DNA, 20 bp, Artificial Sequence
  chemically synthesized
tattaccctagcaagttgat

SEQ ID NO: 43696 - DNA, 20 bp, Artificial Sequence
  chemically synthesized
attaccctagcaagttgatt

SEQ ID NO: 43697 - DNA, 20 bp, Artificial Sequence
  chemically synthesized
ccctagcaagttgattggga

SEQ ID NO: 43698 - DNA, 20 bp, Artificial Sequence
  chemically synthesized
agttgattgggaaagtcctc

SEQ ID NO: 43699 - DNA, 20 bp, Artificial Sequence
  chemically synthesized
ctctaattttgtatctgata

SEQ ID NO: 43700 - DNA, 20 bp, Artificial Sequence
  chemically synthesized
tctgatatggtgtcatttca

SEQ ID NO: 43701 - DNA, 20 bp, Artificial Sequence
  chemically synthesized
gactcctcgttgtttacccc

SEQ ID NO: 43702 - DNA, 20 bp, Artificial Sequence
  chemically synthesized
tcgttgtttacccctggacc

SEQ ID NO: 43703 - DNA, 20 bp, Artificial Sequence
  chemically synthesized
gttgtttacccctggaccca

SEQ ID NO: 43704 - DNA, 20 bp, Artificial Sequence
  chemically synthesized
tggacccagagattttttga

SEQ ID NO: 43705 - DNA, 20 bp, Artificial Sequence
  chemically synthesized
cagagattttttgacagctt

SEQ ID NO: 43706 - DNA, 20 bp, Artificial Sequence
  chemically synthesized
gtcgtctccctctgccatcc

SEQ ID NO: 43707 - DNA, 20 bp, Artificial Sequence
  chemically synthesized
tcgtctccctctgccatcct

SEQ ID NO: 43708 - DNA, 20 bp, Artificial Sequence
  chemically synthesized
ctgccatcctgggcaacccc

SEQ ID NO: 43709 - DNA, 20 bp, Artificial Sequence
  chemically synthesized
tgccatcctgggcaacccca

SEQ ID NO: 43710 - DNA, 20 bp, Artificial Sequence
  chemically synthesized
tcctgggcaaccccaaggtc

SEQ ID NO: 43711 - DNA, 20 bp, Artificial Sequence
  chemically synthesized
cctgggcaaccccaaggtca

SEQ ID NO: 43712 - DNA, 20 bp, Artificial Sequence
  chemically synthesized
aaccccaaggtcaaggccca

SEQ ID NO: 43713 - DNA, 20 bp, Artificial Sequence
  chemically synthesized
ccaaggtcaaggcccatggc

SEQ ID NO: 43714 - DNA, 20 bp, Artificial Sequence
  chemically synthesized
aggtcaaggcccatggcaag

SEQ ID NO: 43715 - DNA, 20 bp, Artificial Sequence
  chemically synthesized
ggtcaaggcccatggcaaga

SEQ ID NO: 43716 - DNA, 20 bp, Artificial Sequence
  chemically synthesized
aagaaggtgctgacttcctt

SEQ ID NO: 43717 - DNA, 20 bp, Artificial Sequence
  chemically synthesized
gaaggtgctgacttcctttg

SEQ ID NO: 43718 - DNA, 20 bp, Artificial Sequence
  chemically synthesized
tggagatgctattaaaaaca

SEQ ID NO: 43719 - DNA, 20 bp, Artificial Sequence
  chemically synthesized
ttaaaaacatggacaacctc

SEQ ID NO: 43720 - DNA, 20 bp, Artificial Sequence
  chemically synthesized
acctcaagcccgcctttgct

SEQ ID NO: 43721 - DNA, 20 bp, Artificial Sequence
  chemically synthesized
aagcccgcctttgctaagct

SEQ ID NO: 43722 - DNA, 20 bp, Artificial Sequence
  chemically synthesized
ccgcctttgctaagctgagt

SEQ ID NO: 43723 - DNA, 20 bp, Artificial Sequence
  chemically synthesized
tgagtgagctgcactgtgac

SEQ ID NO: 43724 - DNA, 20 bp, Artificial Sequence
  chemically synthesized
gcactgtgacaagctgcatg

SEQ ID NO: 43725 - DNA, 20 bp, Artificial Sequence
  chemically synthesized
acaagctgcatgtggatcct

SEQ ID NO: 43726 - DNA, 20 bp, Artificial Sequence
  chemically synthesized
atgtggatcctgagaacttc

SEQ ID NO: 43727 - DNA, 20 bp, Artificial Sequence
  chemically synthesized
tgtggatcctgagaacttca

SEQ ID NO: 43728 - DNA, 20 bp, Artificial Sequence
  chemically synthesized
gatcctgagaacttcaaggt

SEQ ID NO: 43729 - DNA, 20 bp, Artificial Sequence
  chemically synthesized
tgagaacttcaaggtgagtt

SEQ ID NO: 43730 - DNA, 20 bp, Artificial Sequence
  chemically synthesized
gagaacttcaaggtgagttc

SEQ ID NO: 43731 - DNA, 20 bp, Artificial Sequence
  chemically synthesized
ttcaaggtgagttcaggtgc

SEQ ID NO: 43732 - DNA, 20 bp, Artificial Sequence
  chemically synthesized
gtgctggtgatgtgattttt

SEQ ID NO: 43733 - DNA, 20 bp, Artificial Sequence
  chemically synthesized
ttatattttgacattaattg

SEQ ID NO: 43734 - DNA, 20 bp, Artificial Sequence
  chemically synthesized
attgaagctcataatcttat

SEQ ID NO: 43735 - DNA, 20 bp, Artificial Sequence
  chemically synthesized
aagctcataatcttattgga

SEQ ID NO: 43736 - DNA, 20 bp, Artificial Sequence
  chemically synthesized
tcttattggaaagaccaaca

SEQ ID NO: 43737 - DNA, 20 bp, Artificial Sequence
  chemically synthesized
ggaaagaccaacaaagatct

SEQ ID NO: 43738 - DNA, 20 bp, Artificial Sequence
  chemically synthesized
aacaaagatctcagaaatca

SEQ ID NO: 43739 - DNA, 20 bp, Artificial Sequence
  chemically synthesized
acaaagatctcagaaatcat

SEQ ID NO: 43740 - DNA, 20 bp, Artificial Sequence
  chemically synthesized
gatctcagaaatcatgggtc

SEQ ID NO: 43741 - DNA, 20 bp, Artificial Sequence
  chemically synthesized
tcatgggtcgagcttgatgt

SEQ ID NO: 43742 - DNA, 20 bp, Artificial Sequence
  chemically synthesized
ggtcgagcttgatgttagaa

SEQ ID NO: 43743 - DNA, 20 bp, Artificial Sequence
  chemically synthesized
cgagcttgatgttagaacag

SEQ ID NO: 43744 - DNA, 20 bp, Artificial Sequence
  chemically synthesized
atgttagaacagcagacttc

SEQ ID NO: 43745 - DNA, 20 bp, Artificial Sequence
  chemically synthesized
tagaacagcagacttctagt

SEQ ID NO: 43746 - DNA, 20 bp, Artificial Sequence
  chemically synthesized
taaccaaaacttacatgatt

SEQ ID NO: 43747 - DNA, 20 bp, Artificial Sequence
  chemically synthesized
aaacttacatgattcagaac

SEQ ID NO: 43748 - DNA, 20 bp, Artificial Sequence
  chemically synthesized
acatgattcagaactagtga

SEQ ID NO: 43749 - DNA, 20 bp, Artificial Sequence
  chemically synthesized
attcagaactagtgacagta

SEQ ID NO: 43750 - DNA, 20 bp, Artificial Sequence
  chemically synthesized
ttcagaactagtgacagtaa

SEQ ID NO: 43751 - DNA, 20 bp, Artificial Sequence
  chemically synthesized
tgacagtaaaggactactaa

SEQ ID NO: 43752 - DNA, 20 bp, Artificial Sequence
  chemically synthesized
ggactactaacagcctgaat

SEQ ID NO: 43753 - DNA, 20 bp, Artificial Sequence
  chemically synthesized
cctgaattggcttaactttt

SEQ ID NO: 43754 - DNA, 20 bp, Artificial Sequence
  chemically synthesized
ctgaattggcttaacttttc

SEQ ID NO: 43755 - DNA, 20 bp, Artificial Sequence
  chemically synthesized
aacttttcaggaaatcttgc

SEQ ID NO: 43756 - DNA, 20 bp, Artificial Sequence
  chemically synthesized
agaacttgatgtgtttatcc

SEQ ID NO: 43757 - DNA, 20 bp, Artificial Sequence
  chemically synthesized
aacttgatgtgtttatccca

SEQ ID NO: 43758 - DNA, 20 bp, Artificial Sequence
  chemically synthesized
tatcccagagaattgtatta

SEQ ID NO: 43759 - DNA, 20 bp, Artificial Sequence
  chemically synthesized
agaattgtattatagaattg

SEQ ID NO: 43760 - DNA, 20 bp, Artificial Sequence
  chemically synthesized
atagaattgtagacttgtga

SEQ ID NO: 43761 - DNA, 20 bp, Artificial Sequence
  chemically synthesized
gaattgtagacttgtgaaag

SEQ ID NO: 43762 - DNA, 20 bp, Artificial Sequence
  chemically synthesized
tgtgaaagaagaatgaaatt

SEQ ID NO: 43763 - DNA, 20 bp, Artificial Sequence
  chemically synthesized
gaagaatgaaatttggcttt

SEQ ID NO: 43764 - DNA, 20 bp, Artificial Sequence
  chemically synthesized
gaatgaaatttggcttttgg

SEQ ID NO: 43765 - DNA, 20 bp, Artificial Sequence
  chemically synthesized
atttggcttttggtagatga

SEQ ID NO: 43766 - DNA, 20 bp, Artificial Sequence
  chemically synthesized
ggtagatgaaagtccatttc

SEQ ID NO: 43767 - DNA, 20 bp, Artificial Sequence
  chemically synthesized
gtagatgaaagtccatttca

SEQ ID NO: 43768 - DNA, 20 bp, Artificial Sequence
  chemically synthesized
gaaagtccatttcaaggaaa

SEQ ID NO: 43769 - DNA, 20 bp, Artificial Sequence
  chemically synthesized
tagaaatgccttattttatg

SEQ ID NO: 43770 - DNA, 20 bp, Artificial Sequence
  chemically synthesized
agaaatgccttattttatgt

SEQ ID NO: 43771 - DNA, 20 bp, Artificial Sequence
  chemically synthesized
ttatgtgggtcatgataatt

SEQ ID NO: 43772 - DNA, 20 bp, Artificial Sequence
  chemically synthesized
tatgtgggtcatgataattg

SEQ ID NO: 43773 - DNA, 20 bp, Artificial Sequence
  chemically synthesized
gggtcatgataattgaggtt

SEQ ID NO: 43774 - DNA, 20 bp, Artificial Sequence
  chemically synthesized
catgataattgaggtttaga

SEQ ID NO: 43775 - DNA, 20 bp, Artificial Sequence
  chemically synthesized
tgataattgaggtttagaaa

SEQ ID NO: 43776 - DNA, 20 bp, Artificial Sequence
  chemically synthesized
gatttttgcaaaaaaaataa

SEQ ID NO: 43777 - DNA, 20 bp, Artificial Sequence
  chemically synthesized
aaaaataaaagatttgctca

SEQ ID NO: 43778 - DNA, 20 bp, Artificial Sequence
  chemically synthesized
agatttgctcaaagaaaaat

SEQ ID NO: 43779 - DNA, 20 bp, Artificial Sequence
  chemically synthesized
aaatatgttaaatttcccat

SEQ ID NO: 43780 - DNA, 20 bp, Artificial Sequence
  chemically synthesized
ttcccatcagtattgtgacc

SEQ ID NO: 43781 - DNA, 20 bp, Artificial Sequence
  chemically synthesized
atcagtattgtgaccaagtg

SEQ ID NO: 43782 - DNA, 20 bp, Artificial Sequence
  chemically synthesized
tcagtattgtgaccaagtga

SEQ ID NO: 43783 - DNA, 20 bp, Artificial Sequence
  chemically synthesized
aggcttgtttccgaatttgt

SEQ ID NO: 43784 - DNA, 20 bp, Artificial Sequence
  chemically synthesized
ggcttgtttccgaatttgtt

SEQ ID NO: 43785 - DNA, 20 bp, Artificial Sequence
  chemically synthesized
gcttgtttccgaatttgttg

SEQ ID NO: 43786 - DNA, 20 bp, Artificial Sequence
  chemically synthesized
ggggattttaaactcccgct

SEQ ID NO: 43787 - DNA, 20 bp, Artificial Sequence
  chemically synthesized
actcccgctgagaactcttg

SEQ ID NO: 43788 - DNA, 20 bp, Artificial Sequence
  chemically synthesized
cattctacatttacaaaaat

SEQ ID NO: 43789 - DNA, 20 bp, Artificial Sequence
  chemically synthesized
aaaaattagacaattgctta

SEQ ID NO: 43790 - DNA, 20 bp, Artificial Sequence
  chemically synthesized
gacaattgcttaaagaaaaa

SEQ ID NO: 43791 - DNA, 20 bp, Artificial Sequence
  chemically synthesized
acaattgcttaaagaaaaac

SEQ ID NO: 43792 - DNA, 20 bp, Artificial Sequence
  chemically synthesized
caattgcttaaagaaaaaca

SEQ ID NO: 43793 - DNA, 20 bp, Artificial Sequence
  chemically synthesized
attgcttaaagaaaaacagg

SEQ ID NO: 43794 - DNA, 20 bp, Artificial Sequence
  chemically synthesized
tgcttaaagaaaaacaggga

SEQ ID NO: 43795 - DNA, 20 bp, Artificial Sequence
  chemically synthesized
cttaaagaaaaacagggaga

SEQ ID NO: 43796 - DNA, 20 bp, Artificial Sequence
  chemically synthesized
ttaaagaaaaacagggagag

SEQ ID NO: 43797 - DNA, 20 bp, Artificial Sequence
  chemically synthesized
taaagaaaaacagggagaga

SEQ ID NO: 43798 - DNA, 20 bp, Artificial Sequence
  chemically synthesized
gagagggaacccaataatac

SEQ ID NO: 43799 - DNA, 20 bp, Artificial Sequence
  chemically synthesized
acccaataatactggtaaaa

SEQ ID NO: 43800 - DNA, 20 bp, Artificial Sequence
  chemically synthesized
cccaataatactggtaaaat

SEQ ID NO: 43801 - DNA, 20 bp, Artificial Sequence
  chemically synthesized
ccaataatactggtaaaatg

SEQ ID NO: 43802 - DNA, 20 bp, Artificial Sequence
  chemically synthesized
ataatactggtaaaatgggg

SEQ ID NO: 43803 - DNA, 20 bp, Artificial Sequence
  chemically synthesized
taatactggtaaaatgggga

SEQ ID NO: 43804 - DNA, 20 bp, Artificial Sequence
  chemically synthesized
aatactggtaaaatggggaa

SEQ ID NO: 43805 - DNA, 20 bp, Artificial Sequence
  chemically synthesized
atactggtaaaatggggaag

SEQ ID NO: 43806 - DNA, 20 bp, Artificial Sequence
  chemically synthesized
tactggtaaaatggggaagg

SEQ ID NO: 43807 - DNA, 20 bp, Artificial Sequence
  chemically synthesized
ggtaaaatggggaagggggt

SEQ ID NO: 43808 - DNA, 20 bp, Artificial Sequence
  chemically synthesized
gtaaaatggggaagggggtg

SEQ ID NO: 43809 - DNA, 20 bp, Artificial Sequence
  chemically synthesized
taaaatggggaagggggtga

SEQ ID NO: 43810 - DNA, 20 bp, Artificial Sequence
  chemically synthesized
tggggaagggggtgagggtg

SEQ ID NO: 43811 - DNA, 20 bp, Artificial Sequence
  chemically synthesized
ggggaagggggtgagggtgt

SEQ ID NO: 43812 - DNA, 20 bp, Artificial Sequence
  chemically synthesized
gaagggggtgagggtgtagg

SEQ ID NO: 43813 - DNA, 20 bp, Artificial Sequence
  chemically synthesized
aagggggtgagggtgtaggt

SEQ ID NO: 43814 - DNA, 20 bp, Artificial Sequence
  chemically synthesized
ggggtgagggtgtaggtagg

SEQ ID NO: 43815 - DNA, 20 bp, Artificial Sequence
  chemically synthesized
ggtaggtagaatgttgaatg

SEQ ID NO: 43816 - DNA, 20 bp, Artificial Sequence
  chemically synthesized
gtaggtagaatgttgaatgt

SEQ ID NO: 43817 - DNA, 20 bp, Artificial Sequence
  chemically synthesized
taggtagaatgttgaatgta

SEQ ID NO: 43818 - DNA, 20 bp, Artificial Sequence
  chemically synthesized
aatgttgaatgtagggctca

SEQ ID NO: 43819 - DNA, 20 bp, Artificial Sequence
  chemically synthesized
catagaataaaattgaacct

SEQ ID NO: 43820 - DNA, 20 bp, Artificial Sequence
  chemically synthesized
ctaagctcatctgaattttt

SEQ ID NO: 43821 - DNA, 20 bp, Artificial Sequence
  chemically synthesized
taagctcatctgaatttttt

SEQ ID NO: 43822 - DNA, 20 bp, Artificial Sequence
  chemically synthesized
gctcatctgaattttttggg

SEQ ID NO: 43823 - DNA, 20 bp, Artificial Sequence
  chemically synthesized
ctcatctgaattttttgggt

SEQ ID NO: 43824 - DNA, 20 bp, Artificial Sequence
  chemically synthesized
ttttgggtgggcacaaacct

SEQ ID NO: 43825 - DNA, 20 bp, Artificial Sequence
  chemically synthesized
ggtgggcacaaaccttggaa

SEQ ID NO: 43826 - DNA, 20 bp, Artificial Sequence
  chemically synthesized
cacaaaccttggaacagttt

SEQ ID NO: 43827 - DNA, 20 bp, Artificial Sequence
  chemically synthesized
acaaaccttggaacagtttg

SEQ ID NO: 43828 - DNA, 20 bp, Artificial Sequence
  chemically synthesized
accttggaacagtttgaggt

SEQ ID NO: 43829 - DNA, 20 bp, Artificial Sequence
  chemically synthesized
ccttggaacagtttgaggtc

SEQ ID NO: 43830 - DNA, 20 bp, Artificial Sequence
  chemically synthesized
cttggaacagtttgaggtca

SEQ ID NO: 43831 - DNA, 20 bp, Artificial Sequence
  chemically synthesized
agtttgaggtcagggttgtc

SEQ ID NO: 43832 - DNA, 20 bp, Artificial Sequence
  chemically synthesized
gtttgaggtcagggttgtct

SEQ ID NO: 43833 - DNA, 20 bp, Artificial Sequence
  chemically synthesized
gtcagggttgtctaggaatg

SEQ ID NO: 43834 - DNA, 20 bp, Artificial Sequence
  chemically synthesized
tcagggttgtctaggaatgt

SEQ ID NO: 43835 - DNA, 20 bp, Artificial Sequence
  chemically synthesized
tgtctaggaatgtaggtata

SEQ ID NO: 43836 - DNA, 20 bp, Artificial Sequence
  chemically synthesized
tgtttgtttgttttttcatc

SEQ ID NO: 43837 - DNA, 20 bp, Artificial Sequence
  chemically synthesized
ttttttcatcaagttgtttt

SEQ ID NO: 43838 - DNA, 20 bp, Artificial Sequence
  chemically synthesized
ttattttgtcttttgcctaa

SEQ ID NO: 43839 - DNA, 20 bp, Artificial Sequence
  chemically synthesized
gtcttttgcctaacagctcc

SEQ ID NO: 43840 - DNA, 20 bp, Artificial Sequence
  chemically synthesized
tcttttgcctaacagctcct

SEQ ID NO: 43841 - DNA, 20 bp, Artificial Sequence
  chemically synthesized
acagctcctgggtaacgtga

SEQ ID NO: 43842 - DNA, 20 bp, Artificial Sequence
  chemically synthesized
taacgtgatggtgattattc

SEQ ID NO: 43843 - DNA, 20 bp, Artificial Sequence
  chemically synthesized
attattctggctactcactt

SEQ ID NO: 43844 - DNA, 20 bp, Artificial Sequence
  chemically synthesized
ttctggctactcactttggc

SEQ ID NO: 43845 - DNA, 20 bp, Artificial Sequence
  chemically synthesized
tctggctactcactttggca

SEQ ID NO: 43846 - DNA, 20 bp, Artificial Sequence
  chemically synthesized
tggctactcactttggcaag

SEQ ID NO: 43847 - DNA, 20 bp, Artificial Sequence
  chemically synthesized
tggcaaggagttcacccctg

SEQ ID NO: 43848 - DNA, 20 bp, Artificial Sequence
  chemically synthesized
aggagttcacccctgaagtg

SEQ ID NO: 43849 - DNA, 20 bp, Artificial Sequence
  chemically synthesized
ggagttcacccctgaagtgc

SEQ ID NO: 43850 - DNA, 20 bp, Artificial Sequence
  chemically synthesized
cccctgaagtgcaggctgcc

SEQ ID NO: 43851 - DNA, 20 bp, Artificial Sequence
  chemically synthesized
ctgaagtgcaggctgcctgg

SEQ ID NO: 43852 - DNA, 20 bp, Artificial Sequence
  chemically synthesized
aagtgcaggctgcctggcag

SEQ ID NO: 43853 - DNA, 20 bp, Artificial Sequence
  chemically synthesized
gcaggctgcctggcagaagc

SEQ ID NO: 43854 - DNA, 20 bp, Artificial Sequence
  chemically synthesized
gtctgctgtcgccattgccc

SEQ ID NO: 43855 - DNA, 20 bp, Artificial Sequence
  chemically synthesized
tcgccattgccctggcccat

SEQ ID NO: 43856 - DNA, 20 bp, Artificial Sequence
  chemically synthesized
cctggcccataagtaccact

SEQ ID NO: 43857 - DNA, 20 bp, Artificial Sequence
  chemically synthesized
agtaccactgagttctcttc

SEQ ID NO: 43858 - DNA, 20 bp, Artificial Sequence
  chemically synthesized
ctgagttctcttccagtttg

SEQ ID NO: 43859 - DNA, 20 bp, Artificial Sequence
  chemically synthesized
tgagttctcttccagtttgc

SEQ ID NO: 43860 - DNA, 20 bp, Artificial Sequence
  chemically synthesized
tgacaccctccttctgcaca

SEQ ID NO: 43861 - DNA, 20 bp, Artificial Sequence
  chemically synthesized
gacaccctccttctgcacat

SEQ ID NO: 43862 - DNA, 20 bp, Artificial Sequence
  chemically synthesized
acaccctccttctgcacatg

SEQ ID NO: 43863 - DNA, 20 bp, Artificial Sequence
  chemically synthesized
ctccttctgcacatggggac

SEQ ID NO: 43864 - DNA, 20 bp, Artificial Sequence
  chemically synthesized
tccttctgcacatggggact

SEQ ID NO: 43865 - DNA, 20 bp, Artificial Sequence
  chemically synthesized
ctgcacatggggactgggct

SEQ ID NO: 43866 - DNA, 20 bp, Artificial Sequence
  chemically synthesized
tggggactgggcttggcctt

SEQ ID NO: 43867 - DNA, 20 bp, Artificial Sequence
  chemically synthesized
gggactgggcttggccttga

SEQ ID NO: 43868 - DNA, 20 bp, Artificial Sequence
  chemically synthesized
ctgggcttggccttgagaga

SEQ ID NO: 43869 - DNA, 20 bp, Artificial Sequence
  chemically synthesized
agaaagccttctgtttaata

SEQ ID NO: 43870 - DNA, 20 bp, Artificial Sequence
  chemically synthesized
ttaataaagtacattttctt

SEQ ID NO: 43871 - DNA, 20 bp, Artificial Sequence
  chemically synthesized
atcttttactcttgtgttaa

SEQ ID NO: 43872 - DNA, 20 bp, Artificial Sequence
  chemically synthesized
tcttttactcttgtgttaaa

SEQ ID NO: 43873 - DNA, 20 bp, Artificial Sequence
  chemically synthesized
actcttgtgttaaaaggaaa

SEQ ID NO: 43874 - DNA, 20 bp, Artificial Sequence
  chemically synthesized
ttaaaaggaaaaagtgttca

SEQ ID NO: 43875 - DNA, 20 bp, Artificial Sequence
  chemically synthesized
taaaaggaaaaagtgttcat

SEQ ID NO: 43876 - DNA, 20 bp, Artificial Sequence
  chemically synthesized
ggaaaaagtgttcatgggct

SEQ ID NO: 43877 - DNA, 20 bp, Artificial Sequence
  chemically synthesized
gaaaaagtgttcatgggctg

SEQ ID NO: 43878 - DNA, 20 bp, Artificial Sequence
  chemically synthesized
aaaaagtgttcatgggctga

SEQ ID NO: 43879 - DNA, 20 bp, Artificial Sequence
  chemically synthesized
agtgttcatgggctgaggga

SEQ ID NO: 43880 - DNA, 20 bp, Artificial Sequence
  chemically synthesized
tgttcatgggctgagggatg

SEQ ID NO: 43881 - DNA, 20 bp, Artificial Sequence
  chemically synthesized
ttcatgggctgagggatgga

SEQ ID NO: 43882 - DNA, 20 bp, Artificial Sequence
  chemically synthesized
ctgagggatggagagaaaca

SEQ ID NO: 43883 - DNA, 20 bp, Artificial Sequence
  chemically synthesized
tgagggatggagagaaacat

SEQ ID NO: 43884 - DNA, 20 bp, Artificial Sequence
  chemically synthesized
gggatggagagaaacatagg

SEQ ID NO: 43885 - DNA, 20 bp, Artificial Sequence
  chemically synthesized
agagaaacataggaagaacc

SEQ ID NO: 43886 - DNA, 20 bp, Artificial Sequence
  chemically synthesized
agaaacataggaagaaccaa

SEQ ID NO: 43887 - DNA, 20 bp, Artificial Sequence
  chemically synthesized
gaagaaccaagagcttcctt

SEQ ID NO: 43888 - DNA, 20 bp, Artificial Sequence
  chemically synthesized
gagcttccttaagaaatgta

SEQ ID NO: 43889 - DNA, 20 bp, Artificial Sequence
  chemically synthesized
agcttccttaagaaatgtat

SEQ ID NO: 43890 - DNA, 20 bp, Artificial Sequence
  chemically synthesized
gcttccttaagaaatgtatg

SEQ ID NO: 43891 - DNA, 20 bp, Artificial Sequence
  chemically synthesized
cttccttaagaaatgtatgg

SEQ ID NO: 43892 - DNA, 20 bp, Artificial Sequence
  chemically synthesized
gggggcttgtaaaattaatg

SEQ ID NO: 43893 - DNA, 20 bp, Artificial Sequence
  chemically synthesized
taaaattaatgtggatgtta

SEQ ID NO: 43894 - DNA, 20 bp, Artificial Sequence
  chemically synthesized
aaaattaatgtggatgttat

SEQ ID NO: 43895 - DNA, 20 bp, Artificial Sequence
  chemically synthesized
aattaatgtggatgttatgg

SEQ ID NO: 43896 - DNA, 20 bp, Artificial Sequence
  chemically synthesized
tggatgttatgggagaattc

SEQ ID NO: 43897 - DNA, 20 bp, Artificial Sequence
  chemically synthesized
ggatgttatgggagaattcc

SEQ ID NO: 43898 - DNA, 20 bp, Artificial Sequence
  chemically synthesized
tgggagaattccaggattcc

SEQ ID NO: 43899 - DNA, 20 bp, Artificial Sequence
  chemically synthesized
gggagaattccaggattcca

SEQ ID NO: 43900 - DNA, 20 bp, Artificial Sequence
  chemically synthesized
gagaattccaggattccaag

SEQ ID NO: 43901 - DNA, 20 bp, Artificial Sequence
  chemically synthesized
agaattccaggattccaagg

SEQ ID NO: 43902 - DNA, 20 bp, Artificial Sequence
  chemically synthesized
ttccaaggaggatgatatga

SEQ ID NO: 43903 - DNA, 20 bp, Artificial Sequence
  chemically synthesized
ccaaggaggatgatatgatg

SEQ ID NO: 43904 - DNA, 20 bp, Artificial Sequence
  chemically synthesized
tgatggagaaaaatctttat

SEQ ID NO: 43905 - DNA, 20 bp, Artificial Sequence
  chemically synthesized
gatggagaaaaatctttatc

SEQ ID NO: 43906 - DNA, 20 bp, Artificial Sequence
  chemically synthesized
atggagaaaaatctttatcg

SEQ ID NO: 43907 - DNA, 20 bp, Artificial Sequence
  chemically synthesized
gagaaaaatctttatcgggg

SEQ ID NO: 43908 - DNA, 20 bp, Artificial Sequence
  chemically synthesized
agaaaaatctttatcggggt

SEQ ID NO: 43909 - DNA, 20 bp, Artificial Sequence
  chemically synthesized
tctttatcggggtgggaaaa

SEQ ID NO: 43910 - DNA, 20 bp, Artificial Sequence
  chemically synthesized
gggtgggaaaatggttaatt

SEQ ID NO: 43911 - DNA, 20 bp, Artificial Sequence
  chemically synthesized
tgggaaaatggttaattaag

SEQ ID NO: 43912 - DNA, 20 bp, Artificial Sequence
  chemically synthesized
aaaatggttaattaagtgga

SEQ ID NO: 43913 - DNA, 20 bp, Artificial Sequence
  chemically synthesized
aatggttaattaagtggaca

SEQ ID NO: 43914 - DNA, 20 bp, Artificial Sequence
  chemically synthesized
attaagtggacagagactcc

SEQ ID NO: 43915 - DNA, 20 bp, Artificial Sequence
  chemically synthesized
ttaagtggacagagactcct

SEQ ID NO: 43916 - DNA, 20 bp, Artificial Sequence
  chemically synthesized
agtggacagagactcctagg

SEQ ID NO: 43917 - DNA, 20 bp, Artificial Sequence
  chemically synthesized
ctaggcagtttttactgcac

SEQ ID NO: 43918 - DNA, 20 bp, Artificial Sequence
  chemically synthesized
taggcagtttttactgcacc

SEQ ID NO: 43919 - DNA, 20 bp, Artificial Sequence
  chemically synthesized
aggcagtttttactgcaccg

SEQ ID NO: 43920 - DNA, 20 bp, Artificial Sequence
  chemically synthesized
agtttttactgcaccgggga

SEQ ID NO: 43921 - DNA, 20 bp, Artificial Sequence
  chemically synthesized
ttttactgcaccggggaaag

SEQ ID NO: 43922 - DNA, 20 bp, Artificial Sequence
  chemically synthesized
tttactgcaccggggaaaga

SEQ ID NO: 43923 - DNA, 20 bp, Artificial Sequence
  chemically synthesized
tactgcaccggggaaagaag

SEQ ID NO: 43924 - DNA, 20 bp, Artificial Sequence
  chemically synthesized
ccggggaaagaaggagctgt

SEQ ID NO: 43925 - DNA, 20 bp, Artificial Sequence
  chemically synthesized
gggaaagaaggagctgttag

SEQ ID NO: 43926 - DNA, 20 bp, Artificial Sequence
  chemically synthesized
aggagctgttagtggtacct

SEQ ID NO: 43927 - DNA, 20 bp, Artificial Sequence
  chemically synthesized
gctgttagtggtacctgaga

SEQ ID NO: 43928 - DNA, 20 bp, Artificial Sequence
  chemically synthesized
gttagtggtacctgagaaag

SEQ ID NO: 43929 - DNA, 20 bp, Artificial Sequence
  chemically synthesized
tacctgagaaagcagatttg

SEQ ID NO: 43930 - DNA, 20 bp, Artificial Sequence
  chemically synthesized
caaaacaaaacaaaacttca

SEQ ID NO: 43931 - DNA, 20 bp, Artificial Sequence
  chemically synthesized
acaaaacttcatagatatcc

SEQ ID NO: 43932 - DNA, 20 bp, Artificial Sequence
  chemically synthesized
cttcatagatatccaagata

SEQ ID NO: 43933 - DNA, 20 bp, Artificial Sequence
  chemically synthesized
ttcatagatatccaagatat

SEQ ID NO: 43934 - DNA, 20 bp, Artificial Sequence
  chemically synthesized
tagatatccaagatataggc

SEQ ID NO: 43935 - DNA, 20 bp, Artificial Sequence
  chemically synthesized
ttactcttatttacattttg

SEQ ID NO: 43936 - DNA, 20 bp, Artificial Sequence
  chemically synthesized
ctcttatttacattttgaag

SEQ ID NO: 43937 - DNA, 20 bp, Artificial Sequence
  chemically synthesized
tatttacattttgaagtagc

SEQ ID NO: 43938 - DNA, 20 bp, Artificial Sequence
  chemically synthesized
catgttttatgaaattgatt

SEQ ID NO: 43939 - DNA, 20 bp, Artificial Sequence
  chemically synthesized
tgttttatgaaattgatttg

SEQ ID NO: 43940 - DNA, 20 bp, Artificial Sequence
  chemically synthesized
tatgaaattgatttggagat

SEQ ID NO: 43941 - DNA, 20 bp, Artificial Sequence
  chemically synthesized
aattgatttggagataagat

SEQ ID NO: 43942 - DNA, 20 bp, Artificial Sequence
  chemically synthesized
agatgagtgtgtatcaacaa

SEQ ID NO: 43943 - DNA, 20 bp, Artificial Sequence
  chemically synthesized
aatagcctgctctttccatg

SEQ ID NO: 43944 - DNA, 20 bp, Artificial Sequence
  chemically synthesized
atagcctgctctttccatga

SEQ ID NO: 43945 - DNA, 20 bp, Artificial Sequence
  chemically synthesized
tgaaggattccattatttca

SEQ ID NO: 43946 - DNA, 20 bp, Artificial Sequence
  chemically synthesized
gaaggattccattatttcat

SEQ ID NO: 43947 - DNA, 20 bp, Artificial Sequence
  chemically synthesized
gattccattatttcatgggt

SEQ ID NO: 43948 - DNA, 20 bp, Artificial Sequence
  chemically synthesized
attatttcatgggttagctg

SEQ ID NO: 43949 - DNA, 20 bp, Artificial Sequence
  chemically synthesized
ttcatgggttagctgaagct

SEQ ID NO: 43950 - DNA, 20 bp, Artificial Sequence
  chemically synthesized
cattgtgcattatcttctga

SEQ ID NO: 43951 - DNA, 20 bp, Artificial Sequence
  chemically synthesized
atgtaacatgcactaaaata

SEQ ID NO: 43952 - DNA, 20 bp, Artificial Sequence
  chemically synthesized
aacatgcactaaaataaagt

SEQ ID NO: 43953 - DNA, 20 bp, Artificial Sequence
  chemically synthesized
catgcactaaaataaagtta

SEQ ID NO: 43954 - DNA, 20 bp, Artificial Sequence
  chemically synthesized
cactaaaataaagttagagt

SEQ ID NO: 43955 - DNA, 20 bp, Artificial Sequence
  chemically synthesized
actaaaataaagttagagtt

SEQ ID NO: 43956 - DNA, 20 bp, Artificial Sequence
  chemically synthesized
taaagttagagttaggacct

SEQ ID NO: 43957 - DNA, 20 bp, Artificial Sequence
  chemically synthesized
agttagagttaggacctgag

SEQ ID NO: 43958 - DNA, 20 bp, Artificial Sequence
  chemically synthesized
gttagagttaggacctgagt

SEQ ID NO: 43959 - DNA, 20 bp, Artificial Sequence
  chemically synthesized
gagttaggacctgagtggga

SEQ ID NO: 43960 - DNA, 20 bp, Artificial Sequence
  chemically synthesized
gacctgagtgggaaagtttt

SEQ ID NO: 43961 - DNA, 20 bp, Artificial Sequence
  chemically synthesized
cctgagtgggaaagtttttg

SEQ ID NO: 43962 - DNA, 20 bp, Artificial Sequence
  chemically synthesized
tgagtgggaaagtttttgga

SEQ ID NO: 43963 - DNA, 20 bp, Artificial Sequence
  chemically synthesized
agtttttggagagtgtgatg

SEQ ID NO: 43964 - DNA, 20 bp, Artificial Sequence
  chemically synthesized
agtgtgatgaagactttccg

SEQ ID NO: 43965 - DNA, 20 bp, Artificial Sequence
  chemically synthesized
gtgtgatgaagactttccgt

SEQ ID NO: 43966 - DNA, 20 bp, Artificial Sequence
  chemically synthesized
gtgatgaagactttccgtgg

SEQ ID NO: 43967 - DNA, 20 bp, Artificial Sequence
  chemically synthesized
tgaagactttccgtgggaga

SEQ ID NO: 43968 - DNA, 20 bp, Artificial Sequence
  chemically synthesized
tgggagatagaatactaata

SEQ ID NO: 43969 - DNA, 20 bp, Artificial Sequence
  chemically synthesized
gggagatagaatactaataa

SEQ ID NO: 43970 - DNA, 20 bp, Artificial Sequence
  chemically synthesized
aaaggcttaaattctaaaac

SEQ ID NO: 43971 - DNA, 20 bp, Artificial Sequence
  chemically synthesized
gcttaaattctaaaaccagc

SEQ ID NO: 43972 - DNA, 20 bp, Artificial Sequence
  chemically synthesized
aaattctaaaaccagcaagc

SEQ ID NO: 43973 - DNA, 20 bp, Artificial Sequence
  chemically synthesized
aattctaaaaccagcaagct

SEQ ID NO: 43974 - DNA, 20 bp, Artificial Sequence
  chemically synthesized
attctaaaaccagcaagcta

SEQ ID NO: 43975 - DNA, 20 bp, Artificial Sequence
  chemically synthesized
cttcgtgacttgcatgaaac

SEQ ID NO: 43976 - DNA, 20 bp, Artificial Sequence
  chemically synthesized
cttgcatgaaactggctctc

SEQ ID NO: 43977 - DNA, 20 bp, Artificial Sequence
  chemically synthesized
gcatgaaactggctctctgg

SEQ ID NO: 43978 - DNA, 20 bp, Artificial Sequence
  chemically synthesized
tgaaactggctctctggaag

SEQ ID NO: 43979 - DNA, 20 bp, Artificial Sequence
  chemically synthesized
aactggctctctggaagtag

SEQ ID NO: 43980 - DNA, 20 bp, Artificial Sequence
  chemically synthesized
actggctctctggaagtaga

SEQ ID NO: 43981 - DNA, 20 bp, Artificial Sequence
  chemically synthesized
ctggctctctggaagtagaa

SEQ ID NO: 43982 - DNA, 20 bp, Artificial Sequence
  chemically synthesized
ggctctctggaagtagaagg

SEQ ID NO: 43983 - DNA, 20 bp, Artificial Sequence
  chemically synthesized
ctctctggaagtagaaggga

SEQ ID NO: 43984 - DNA, 20 bp, Artificial Sequence
  chemically synthesized
ctggaagtagaagggagagt

SEQ ID NO: 43985 - DNA, 20 bp, Artificial Sequence
  chemically synthesized
aagggagagtaagacatacg

SEQ ID NO: 43986 - DNA, 20 bp, Artificial Sequence
  chemically synthesized
gggagagtaagacatacgta

SEQ ID NO: 43987 - DNA, 20 bp, Artificial Sequence
  chemically synthesized
ggagagtaagacatacgtag

SEQ ID NO: 43988 - DNA, 20 bp, Artificial Sequence
  chemically synthesized
gtaagacatacgtagaggac

SEQ ID NO: 43989 - DNA, 20 bp, Artificial Sequence
  chemically synthesized
taagacatacgtagaggact

SEQ ID NO: 43990 - DNA, 20 bp, Artificial Sequence
  chemically synthesized
acatacgtagaggactagga

SEQ ID NO: 43991 - DNA, 20 bp, Artificial Sequence
  chemically synthesized
cgtagaggactaggaaagac

SEQ ID NO: 43992 - DNA, 20 bp, Artificial Sequence
  chemically synthesized
gaggactaggaaagaccaga

SEQ ID NO: 43993 - DNA, 20 bp, Artificial Sequence
  chemically synthesized
ctaggaaagaccagatagta

SEQ ID NO: 43994 - DNA, 20 bp, Artificial Sequence
  chemically synthesized
taggaaagaccagatagtac

SEQ ID NO: 43995 - DNA, 20 bp, Artificial Sequence
  chemically synthesized
aggaaagaccagatagtaca

SEQ ID NO: 43996 - DNA, 20 bp, Artificial Sequence
  chemically synthesized
agaccagatagtacagggcc

SEQ ID NO: 43997 - DNA, 20 bp, Artificial Sequence
  chemically synthesized
gggcctggctacaaaaatac

SEQ ID NO: 43998 - DNA, 20 bp, Artificial Sequence
  chemically synthesized
ctattgcaatactaaacgat

SEQ ID NO: 43999 - DNA, 20 bp, Artificial Sequence
  chemically synthesized
caatactaaacgataagcat

SEQ ID NO: 44000 - DNA, 20 bp, Artificial Sequence
  chemically synthesized
aatactaaacgataagcatt

SEQ ID NO: 44001 - DNA, 20 bp, Artificial Sequence
  chemically synthesized
acgataagcattaggatgtt

SEQ ID NO: 44002 - DNA, 20 bp, Artificial Sequence
  chemically synthesized
cattaggatgttaagtgact

SEQ ID NO: 44003 - DNA, 20 bp, Artificial Sequence
  chemically synthesized
attaggatgttaagtgactc

SEQ ID NO: 44004 - DNA, 20 bp, Artificial Sequence
  chemically synthesized
tgttaagtgactcaggaaat

SEQ ID NO: 44005 - DNA, 20 bp, Artificial Sequence
  chemically synthesized
tgactcaggaaataagattt

SEQ ID NO: 44006 - DNA, 20 bp, Artificial Sequence
  chemically synthesized
gactcaggaaataagatttt

SEQ ID NO: 44007 - DNA, 20 bp, Artificial Sequence
  chemically synthesized
ggaaataagattttgggaaa

SEQ ID NO: 44008 - DNA, 20 bp, Artificial Sequence
  chemically synthesized
atctgcttatgtgcacaaaa

SEQ ID NO: 44009 - DNA, 20 bp, Artificial Sequence
  chemically synthesized
tatgtgcacaaaatggattc

SEQ ID NO: 44010 - DNA, 20 bp, Artificial Sequence
  chemically synthesized
acaaaatggattcaagtttg

SEQ ID NO: 44011 - DNA, 20 bp, Artificial Sequence
  chemically synthesized
tttgcagataaaataaaata

SEQ ID NO: 44012 - DNA, 20 bp, Artificial Sequence
  chemically synthesized
taaaatatggatgatgattc

SEQ ID NO: 44013 - DNA, 20 bp, Artificial Sequence
  chemically synthesized
aaaatatggatgatgattca

SEQ ID NO: 44014 - DNA, 20 bp, Artificial Sequence
  chemically synthesized
aaatatggatgatgattcaa

SEQ ID NO: 44015 - DNA, 20 bp, Artificial Sequence
  chemically synthesized
aatatggatgatgattcaag

SEQ ID NO: 44016 - DNA, 20 bp, Artificial Sequence
  chemically synthesized
tggatgatgattcaagggga

SEQ ID NO: 44017 - DNA, 20 bp, Artificial Sequence
  chemically synthesized
attcaaggggacagatacaa

SEQ ID NO: 44018 - DNA, 20 bp, Artificial Sequence
  chemically synthesized
agatacaatggttcaaaccc

SEQ ID NO: 44019 - DNA, 20 bp, Artificial Sequence
  chemically synthesized
atacaatggttcaaacccaa

SEQ ID NO: 44020 - DNA, 20 bp, Artificial Sequence
  chemically synthesized
tacaatggttcaaacccaag

SEQ ID NO: 44021 - DNA, 20 bp, Artificial Sequence
  chemically synthesized
caatggttcaaacccaagag

SEQ ID NO: 44022 - DNA, 20 bp, Artificial Sequence
  chemically synthesized
tggttcaaacccaagaggag

SEQ ID NO: 44023 - DNA, 20 bp, Artificial Sequence
  chemically synthesized
tcaaacccaagaggagcagt

SEQ ID NO: 44024 - DNA, 20 bp, Artificial Sequence
  chemically synthesized
caagaggagcagtgagtctg

SEQ ID NO: 44025 - DNA, 20 bp, Artificial Sequence
  chemically synthesized
cagtgagtctgtggaatttg

SEQ ID NO: 44026 - DNA, 20 bp, Artificial Sequence
  chemically synthesized
agtgagtctgtggaatttga

SEQ ID NO: 44027 - DNA, 20 bp, Artificial Sequence
  chemically synthesized
agtctgtggaatttgaagga

SEQ ID NO: 44028 - DNA, 20 bp, Artificial Sequence
  chemically synthesized
tggaatttgaaggatggaca

SEQ ID NO: 44029 - DNA, 20 bp, Artificial Sequence
  chemically synthesized
ggaatttgaaggatggacaa

SEQ ID NO: 44030 - DNA, 20 bp, Artificial Sequence
  chemically synthesized
atttgaaggatggacaaagg

SEQ ID NO: 44031 - DNA, 20 bp, Artificial Sequence
  chemically synthesized
tttgaaggatggacaaaggt

SEQ ID NO: 44032 - DNA, 20 bp, Artificial Sequence
  chemically synthesized
ttgaaggatggacaaaggtg

SEQ ID NO: 44033 - DNA, 20 bp, Artificial Sequence
  chemically synthesized
aggatggacaaaggtggggt

SEQ ID NO: 44034 - DNA, 20 bp, Artificial Sequence
  chemically synthesized
tggacaaaggtggggtgaga

SEQ ID NO: 44035 - DNA, 20 bp, Artificial Sequence
  chemically synthesized
aaggtggggtgagaaagaca

SEQ ID NO: 44036 - DNA, 20 bp, Artificial Sequence
  chemically synthesized
acatagtattcgactgactg

SEQ ID NO: 44037 - DNA, 20 bp, Artificial Sequence
  chemically synthesized
catagtattcgactgactgt

SEQ ID NO: 44038 - DNA, 20 bp, Artificial Sequence
  chemically synthesized
tagtattcgactgactgtgg

SEQ ID NO: 44039 - DNA, 20 bp, Artificial Sequence
  chemically synthesized
ttcgactgactgtgggagat

SEQ ID NO: 44040 - DNA, 20 bp, Artificial Sequence
  chemically synthesized
gactgactgtgggagatgag

SEQ ID NO: 44041 - DNA, 20 bp, Artificial Sequence
  chemically synthesized
actgactgtgggagatgaga

SEQ ID NO: 44042 - DNA, 20 bp, Artificial Sequence
  chemically synthesized
gactgtgggagatgagaagg

SEQ ID NO: 44043 - DNA, 20 bp, Artificial Sequence
  chemically synthesized
tgtgggagatgagaaggaag

SEQ ID NO: 44044 - DNA, 20 bp, Artificial Sequence
  chemically synthesized
gtgggagatgagaaggaaga

SEQ ID NO: 44045 - DNA, 20 bp, Artificial Sequence
  chemically synthesized
gggagatgagaaggaagaag

SEQ ID NO: 44046 - DNA, 20 bp, Artificial Sequence
  chemically synthesized
ggagatgagaaggaagaagg

SEQ ID NO: 44047 - DNA, 20 bp, Artificial Sequence
  chemically synthesized
aggaggtgataaatgactga

SEQ ID NO: 44048 - DNA, 20 bp, Artificial Sequence
  chemically synthesized
gataaatgactgaaagctcc

SEQ ID NO: 44049 - DNA, 20 bp, Artificial Sequence
  chemically synthesized
atgactgaaagctcccagac

SEQ ID NO: 44050 - DNA, 20 bp, Artificial Sequence
  chemically synthesized
tgaaagctcccagactggtg

SEQ ID NO: 44051 - DNA, 20 bp, Artificial Sequence
  chemically synthesized
tcccagactggtgaagataa

SEQ ID NO: 44052 - DNA, 20 bp, Artificial Sequence
  chemically synthesized
cccagactggtgaagataac

SEQ ID NO: 44053 - DNA, 20 bp, Artificial Sequence
  chemically synthesized
cagactggtgaagataacag

SEQ ID NO: 44054 - DNA, 20 bp, Artificial Sequence
  chemically synthesized
agactggtgaagataacagg

SEQ ID NO: 44055 - DNA, 20 bp, Artificial Sequence
  chemically synthesized
gaggaaaccatgcactgacc

SEQ ID NO: 44056 - DNA, 20 bp, Artificial Sequence
  chemically synthesized
cctggtgactctcatgtgtg

SEQ ID NO: 44057 - DNA, 20 bp, Artificial Sequence
  chemically synthesized
ctggtgactctcatgtgtga

SEQ ID NO: 44058 - DNA, 20 bp, Artificial Sequence
  chemically synthesized
tggtgactctcatgtgtgaa

SEQ ID NO: 44059 - DNA, 20 bp, Artificial Sequence
  chemically synthesized
tgactctcatgtgtgaaggg

SEQ ID NO: 44060 - DNA, 20 bp, Artificial Sequence
  chemically synthesized
actctcatgtgtgaagggta

SEQ ID NO: 44061 - DNA, 20 bp, Artificial Sequence
  chemically synthesized
ctctcatgtgtgaagggtag

SEQ ID NO: 44062 - DNA, 20 bp, Artificial Sequence
  chemically synthesized
tctcatgtgtgaagggtaga

SEQ ID NO: 44063 - DNA, 20 bp, Artificial Sequence
  chemically synthesized
gaagggtagagggatattaa

SEQ ID NO: 44064 - DNA, 20 bp, Artificial Sequence
  chemically synthesized
atattaacagatttactttt

SEQ ID NO: 44065 - DNA, 20 bp, Artificial Sequence
  chemically synthesized
tattaacagatttacttttt

SEQ ID NO: 44066 - DNA, 20 bp, Artificial Sequence
  chemically synthesized
taacagatttactttttagg

SEQ ID NO: 44067 - DNA, 20 bp, Artificial Sequence
  chemically synthesized
atttactttttaggaagtgc

SEQ ID NO: 44068 - DNA, 20 bp, Artificial Sequence
  chemically synthesized
ctttttaggaagtgctagat

SEQ ID NO: 44069 - DNA, 20 bp, Artificial Sequence
  chemically synthesized
ttaggaagtgctagattggt

SEQ ID NO: 44070 - DNA, 20 bp, Artificial Sequence
  chemically synthesized
taggaagtgctagattggtc

SEQ ID NO: 44071 - DNA, 20 bp, Artificial Sequence
  chemically synthesized
aggaagtgctagattggtca

SEQ ID NO: 44072 - DNA, 20 bp, Artificial Sequence
  chemically synthesized
gaagtgctagattggtcagg

SEQ ID NO: 44073 - DNA, 20 bp, Artificial Sequence
  chemically synthesized
ggtcagggagttttgacctt

SEQ ID NO: 44074 - DNA, 20 bp, Artificial Sequence
  chemically synthesized
gtcagggagttttgaccttc

SEQ ID NO: 44075 - DNA, 20 bp, Artificial Sequence
  chemically synthesized
ggtcttgtgtctttcatatc

SEQ ID NO: 44076 - DNA, 20 bp, Artificial Sequence
  chemically synthesized
gtcttgtgtctttcatatca

SEQ ID NO: 44077 - DNA, 20 bp, Artificial Sequence
  chemically synthesized
aaggaacctttgcattttcc

SEQ ID NO: 44078 - DNA, 20 bp, Artificial Sequence
  chemically synthesized
aacctttgcattttccaagt

SEQ ID NO: 44079 - DNA, 20 bp, Artificial Sequence
  chemically synthesized
cctttgcattttccaagtta

SEQ ID NO: 44080 - DNA, 20 bp, Artificial Sequence
  chemically synthesized
caagttagagtgccatattt

SEQ ID NO: 44081 - DNA, 20 bp, Artificial Sequence
  chemically synthesized
tttggcaaatataactttat

SEQ ID NO: 44082 - DNA, 20 bp, Artificial Sequence
  chemically synthesized
taactttattagtaatttta

SEQ ID NO: 44083 - DNA, 20 bp, Artificial Sequence
  chemically synthesized
tatagtgctctcacattgat

SEQ ID NO: 44084 - DNA, 20 bp, Artificial Sequence
  chemically synthesized
ctgtgaattacttttgaatt

SEQ ID NO: 44085 - DNA, 20 bp, Artificial Sequence
  chemically synthesized
tgaatttggctgtatatatc

SEQ ID NO: 44086 - DNA, 20 bp, Artificial Sequence
  chemically synthesized
ggctgtatatatccagaata

SEQ ID NO: 44087 - DNA, 20 bp, Artificial Sequence
  chemically synthesized
gctgtatatatccagaatat

SEQ ID NO: 44088 - DNA, 20 bp, Artificial Sequence
  chemically synthesized
tgtatatatccagaatatgg

SEQ ID NO: 44089 - DNA, 20 bp, Artificial Sequence
  chemically synthesized
tatatatccagaatatggga

SEQ ID NO: 44090 - DNA, 20 bp, Artificial Sequence
  chemically synthesized
tatatccagaatatgggaga

SEQ ID NO: 44091 - DNA, 20 bp, Artificial Sequence
  chemically synthesized
agagagacaaataattattg

SEQ ID NO: 44092 - DNA, 20 bp, Artificial Sequence
  chemically synthesized
acaaataattattgtagttg

SEQ ID NO: 44093 - DNA, 20 bp, Artificial Sequence
  chemically synthesized
caaataattattgtagttgc

SEQ ID NO: 44094 - DNA, 20 bp, Artificial Sequence
  chemically synthesized
ttgcaggctatcaacaatac

SEQ ID NO: 44095 - DNA, 20 bp, Artificial Sequence
  chemically synthesized
tcaacaatactggtctctct

SEQ ID NO: 44096 - DNA, 20 bp, Artificial Sequence
  chemically synthesized
cctttcaatatgcccataaa

SEQ ID NO: 44097 - DNA, 20 bp, Artificial Sequence
  chemically synthesized
tttcaatatgcccataaaca

SEQ ID NO: 44098 - DNA, 20 bp, Artificial Sequence
  chemically synthesized
atgcccataaacagagtaaa

SEQ ID NO: 44099 - DNA, 20 bp, Artificial Sequence
  chemically synthesized
tgcccataaacagagtaaac

SEQ ID NO: 44100 - DNA, 20 bp, Artificial Sequence
  chemically synthesized
gcccataaacagagtaaaca

SEQ ID NO: 44101 - DNA, 20 bp, Artificial Sequence
  chemically synthesized
gagtaaacagggattattca

SEQ ID NO: 44102 - DNA, 20 bp, Artificial Sequence
  chemically synthesized
tggcactaaatattttcacc

SEQ ID NO: 44103 - DNA, 20 bp, Artificial Sequence
  chemically synthesized
actaaatattttcacctagt

SEQ ID NO: 44104 - DNA, 20 bp, Artificial Sequence
  chemically synthesized
tcacctagtcagtcaacaaa

SEQ ID NO: 44105 - DNA, 20 bp, Artificial Sequence
  chemically synthesized
cacctagtcagtcaacaaat

SEQ ID NO: 44106 - DNA, 20 bp, Artificial Sequence
  chemically synthesized
cctagtcagtcaacaaatgg

SEQ ID NO: 44107 - DNA, 20 bp, Artificial Sequence
  chemically synthesized
tacatatttttatatattta

SEQ ID NO: 44108 - DNA, 20 bp, Artificial Sequence
  chemically synthesized
acatatttttatatatttat

SEQ ID NO: 44109 - DNA, 20 bp, Artificial Sequence
  chemically synthesized
catatttttatatatttatg

SEQ ID NO: 44110 - DNA, 20 bp, Artificial Sequence
  chemically synthesized
acatgtgatacttacatgcc

SEQ ID NO: 44111 - DNA, 20 bp, Artificial Sequence
  chemically synthesized
gcctagaacatgtgatgatt

SEQ ID NO: 44112 - DNA, 20 bp, Artificial Sequence
  chemically synthesized
gaacatgtgatgattaagtc

SEQ ID NO: 44113 - DNA, 20 bp, Artificial Sequence
  chemically synthesized
gatgattaagtctagatatt

SEQ ID NO: 44114 - DNA, 20 bp, Artificial Sequence
  chemically synthesized
atgattaagtctagatattt

SEQ ID NO: 44115 - DNA, 20 bp, Artificial Sequence
  chemically synthesized
tttaggatatccattgcttt

SEQ ID NO: 44116 - DNA, 20 bp, Artificial Sequence
  chemically synthesized
atttatcatttctatgtatt

SEQ ID NO: 44117 - DNA, 20 bp, Artificial Sequence
  chemically synthesized
aaatttcaaatcctcatttc

SEQ ID NO: 44118 - DNA, 20 bp, Artificial Sequence
  chemically synthesized
attttgaaatatataataaa

SEQ ID NO: 44119 - DNA, 20 bp, Artificial Sequence
  chemically synthesized
taataaatagtaattaacta

SEQ ID NO: 44120 - DNA, 20 bp, Artificial Sequence
  chemically synthesized
tactcaaatatcaaacatta

SEQ ID NO: 44121 - DNA, 20 bp, Artificial Sequence
  chemically synthesized
atacacactcacactttttc

SEQ ID NO: 44122 - DNA, 20 bp, Artificial Sequence
  chemically synthesized
attctactctctaccaccat

SEQ ID NO: 44123 - DNA, 20 bp, Artificial Sequence
  chemically synthesized
caccatgagacccacttttt

SEQ ID NO: 44124 - DNA, 20 bp, Artificial Sequence
  chemically synthesized
acccacttttttagctccca

SEQ ID NO: 44125 - DNA, 20 bp, Artificial Sequence
  chemically synthesized
gatatttgactttctgtatc

SEQ ID NO: 44126 - DNA, 20 bp, Artificial Sequence
  chemically synthesized
tattttattatctatctctt

SEQ ID NO: 44127 - DNA, 20 bp, Artificial Sequence
  chemically synthesized
atctatctctttggcatacc

SEQ ID NO: 44128 - DNA, 20 bp, Artificial Sequence
  chemically synthesized
ctatctctttggcataccaa

SEQ ID NO: 44129 - DNA, 20 bp, Artificial Sequence
  chemically synthesized
agtttgtttttgttctgctt

SEQ ID NO: 44130 - DNA, 20 bp, Artificial Sequence
  chemically synthesized
gtttgtttttgttctgcttc

SEQ ID NO: 44131 - DNA, 20 bp, Artificial Sequence
  chemically synthesized
tttgtttttgttctgcttca

SEQ ID NO: 44132 - DNA, 20 bp, Artificial Sequence
  chemically synthesized
tcaattaacataatgacctc

SEQ ID NO: 44133 - DNA, 20 bp, Artificial Sequence
  chemically synthesized
tccatgttgctacaaatgac

SEQ ID NO: 44134 - DNA, 20 bp, Artificial Sequence
  chemically synthesized
caagatttcattctttttca

SEQ ID NO: 44135 - DNA, 20 bp, Artificial Sequence
  chemically synthesized
cattctttttcatggcaaaa

SEQ ID NO: 44136 - DNA, 20 bp, Artificial Sequence
  chemically synthesized
ttaatccgttcatctgttga

SEQ ID NO: 44137 - DNA, 20 bp, Artificial Sequence
  chemically synthesized
ttcatctgttgatagacact

SEQ ID NO: 44138 - DNA, 20 bp, Artificial Sequence
  chemically synthesized
tcatctgttgatagacactt

SEQ ID NO: 44139 - DNA, 20 bp, Artificial Sequence
  chemically synthesized
caaaccttaactattgtgaa

SEQ ID NO: 44140 - DNA, 20 bp, Artificial Sequence
  chemically synthesized
aatagtgcttcaataaacat

SEQ ID NO: 44141 - DNA, 20 bp, Artificial Sequence
  chemically synthesized
catgagtgtaatgtgtccat

SEQ ID NO: 44142 - DNA, 20 bp, Artificial Sequence
  chemically synthesized
tatactgatttcctttcttt

SEQ ID NO: 44143 - DNA, 20 bp, Artificial Sequence
  chemically synthesized
tcttttggataaataaccac

SEQ ID NO: 44144 - DNA, 20 bp, Artificial Sequence
  chemically synthesized
ttggataaataaccactagt

SEQ ID NO: 44145 - DNA, 20 bp, Artificial Sequence
  chemically synthesized
ataaccactagtgagattgc

SEQ ID NO: 44146 - DNA, 20 bp, Artificial Sequence
  chemically synthesized
gagattgctggattgtatga

SEQ ID NO: 44147 - DNA, 20 bp, Artificial Sequence
  chemically synthesized
ttgtatgatagttctgtttt

SEQ ID NO: 44148 - DNA, 20 bp, Artificial Sequence
  chemically synthesized
agttctgtttttagtttact

SEQ ID NO: 44149 - DNA, 20 bp, Artificial Sequence
  chemically synthesized
cttcatactgttttccataa

SEQ ID NO: 44150 - DNA, 20 bp, Artificial Sequence
  chemically synthesized
ctattttacattcccaccaa

SEQ ID NO: 44151 - DNA, 20 bp, Artificial Sequence
  chemically synthesized
cattcccaccaacagtgtgt

SEQ ID NO: 44152 - DNA, 20 bp, Artificial Sequence
  chemically synthesized
cccaccaacagtgtgtaaga

SEQ ID NO: 44153 - DNA, 20 bp, Artificial Sequence
  chemically synthesized
caccaacagtgtgtaagaaa

SEQ ID NO: 44154 - DNA, 20 bp, Artificial Sequence
  chemically synthesized
ccttttctccatatcctcac

SEQ ID NO: 44155 - DNA, 20 bp, Artificial Sequence
  chemically synthesized
cttttctccatatcctcaca

SEQ ID NO: 44156 - DNA, 20 bp, Artificial Sequence
  chemically synthesized
ttttttgtcttttttgttaa

SEQ ID NO: 44157 - DNA, 20 bp, Artificial Sequence
  chemically synthesized
ttgttaatagccgttttaac

SEQ ID NO: 44158 - DNA, 20 bp, Artificial Sequence
  chemically synthesized
gttaatagccgttttaacta

SEQ ID NO: 44159 - DNA, 20 bp, Artificial Sequence
  chemically synthesized
atagccgttttaactagagt

SEQ ID NO: 44160 - DNA, 20 bp, Artificial Sequence
  chemically synthesized
gccgttttaactagagtaag

SEQ ID NO: 44161 - DNA, 20 bp, Artificial Sequence
  chemically synthesized
agtaagtagatatctcattg

SEQ ID NO: 44162 - DNA, 20 bp, Artificial Sequence
  chemically synthesized
atttgcatttccctgatcat

SEQ ID NO: 44163 - DNA, 20 bp, Artificial Sequence
  chemically synthesized
ccctgatcattagtgatgtt

SEQ ID NO: 44164 - DNA, 20 bp, Artificial Sequence
  chemically synthesized
gaattttttcatatgtttgt

SEQ ID NO: 44165 - DNA, 20 bp, Artificial Sequence
  chemically synthesized
tcatttgtatatctttttct

SEQ ID NO: 44166 - DNA, 20 bp, Artificial Sequence
  chemically synthesized
gaattgtctgttcatgtcct

SEQ ID NO: 44167 - DNA, 20 bp, Artificial Sequence
  chemically synthesized
gtccttagcctactttttat

SEQ ID NO: 44168 - DNA, 20 bp, Artificial Sequence
  chemically synthesized
tccttagcctactttttatt

SEQ ID NO: 44169 - DNA, 20 bp, Artificial Sequence
  chemically synthesized
taatctatttgtgttcattt

SEQ ID NO: 44170 - DNA, 20 bp, Artificial Sequence
  chemically synthesized
atctatttgtgttcatttta

SEQ ID NO: 44171 - DNA, 20 bp, Artificial Sequence
  chemically synthesized
tttgtgttcattttagagcc

SEQ ID NO: 44172 - DNA, 20 bp, Artificial Sequence
  chemically synthesized
cctggatattattcttttgt

SEQ ID NO: 44173 - DNA, 20 bp, Artificial Sequence
  chemically synthesized
ttattcttttgtcagatgta

SEQ ID NO: 44174 - DNA, 20 bp, Artificial Sequence
  chemically synthesized
tgtcagatgtatagattgtg

SEQ ID NO: 44175 - DNA, 20 bp, Artificial Sequence
  chemically synthesized
gaagattttctcccactctg

SEQ ID NO: 44176 - DNA, 20 bp, Artificial Sequence
  chemically synthesized
aagattttctcccactctgt

SEQ ID NO: 44177 - DNA, 20 bp, Artificial Sequence
  chemically synthesized
tgggttgtctgtttattctg

SEQ ID NO: 44178 - DNA, 20 bp, Artificial Sequence
  chemically synthesized
ctcttccttttgccatgcaa

SEQ ID NO: 44179 - DNA, 20 bp, Artificial Sequence
  chemically synthesized
tttgccatgcaaaagctctt

SEQ ID NO: 44180 - DNA, 20 bp, Artificial Sequence
  chemically synthesized
aaaagctctttagtttaatt

SEQ ID NO: 44181 - DNA, 20 bp, Artificial Sequence
  chemically synthesized
tctttagtttaatttagtcc

SEQ ID NO: 44182 - DNA, 20 bp, Artificial Sequence
  chemically synthesized
tgtatttgcatttgtgttct

SEQ ID NO: 44183 - DNA, 20 bp, Artificial Sequence
  chemically synthesized
tggtcatgaaatcctttcct

SEQ ID NO: 44184 - DNA, 20 bp, Artificial Sequence
  chemically synthesized
tcctttcctaagccaatgtg

SEQ ID NO: 44185 - DNA, 20 bp, Artificial Sequence
  chemically synthesized
tttcctaagccaatgtgtag

SEQ ID NO: 44186 - DNA, 20 bp, Artificial Sequence
  chemically synthesized
ttcctaagccaatgtgtaga

SEQ ID NO: 44187 - DNA, 20 bp, Artificial Sequence
  chemically synthesized
tcctaagccaatgtgtagaa

SEQ ID NO: 44188 - DNA, 20 bp, Artificial Sequence
  chemically synthesized
gtttttccgatgttattttc

SEQ ID NO: 44189 - DNA, 20 bp, Artificial Sequence
  chemically synthesized
gttattttctagaattgtta

SEQ ID NO: 44190 - DNA, 20 bp, Artificial Sequence
  chemically synthesized
ttctagaattgttacagttt

SEQ ID NO: 44191 - DNA, 20 bp, Artificial Sequence
  chemically synthesized
tctagaattgttacagtttc

SEQ ID NO: 44192 - DNA, 20 bp, Artificial Sequence
  chemically synthesized
ctagaattgttacagtttca

SEQ ID NO: 44193 - DNA, 20 bp, Artificial Sequence
  chemically synthesized
attgttacagtttcagggct

SEQ ID NO: 44194 - DNA, 20 bp, Artificial Sequence
  chemically synthesized
cagtttcagggcttagattt

SEQ ID NO: 44195 - DNA, 20 bp, Artificial Sequence
  chemically synthesized
ttaagtccttgatccatctt

SEQ ID NO: 44196 - DNA, 20 bp, Artificial Sequence
  chemically synthesized
tcttgagttgatttttgtat

SEQ ID NO: 44197 - DNA, 20 bp, Artificial Sequence
  chemically synthesized
cttgagttgatttttgtata

SEQ ID NO: 44198 - DNA, 20 bp, Artificial Sequence
  chemically synthesized
agttgatttttgtataaggt

SEQ ID NO: 44199 - DNA, 20 bp, Artificial Sequence
  chemically synthesized
ttgatttttgtataaggtga

SEQ ID NO: 44200 - DNA, 20 bp, Artificial Sequence
  chemically synthesized
tttgtataaggtgagagatg

SEQ ID NO: 44201 - DNA, 20 bp, Artificial Sequence
  chemically synthesized
taaggtgagagatgaagatc

SEQ ID NO: 44202 - DNA, 20 bp, Artificial Sequence
  chemically synthesized
cagtttcattctcctacatg

SEQ ID NO: 44203 - DNA, 20 bp, Artificial Sequence
  chemically synthesized
ttctcctacatgtagcttgc

SEQ ID NO: 44204 - DNA, 20 bp, Artificial Sequence
  chemically synthesized
tccccgcaccatttgttgaa

SEQ ID NO: 44205 - DNA, 20 bp, Artificial Sequence
  chemically synthesized
ccccgcaccatttgttgaat

SEQ ID NO: 44206 - DNA, 20 bp, Artificial Sequence
  chemically synthesized
cccgcaccatttgttgaata

SEQ ID NO: 44207 - DNA, 20 bp, Artificial Sequence
  chemically synthesized
tgtttttgtttgctttgtca

SEQ ID NO: 44208 - DNA, 20 bp, Artificial Sequence
  chemically synthesized
ttgtttgctttgtcaaagat

SEQ ID NO: 44209 - DNA, 20 bp, Artificial Sequence
  chemically synthesized
ttgctttgtcaaagatcagt

SEQ ID NO: 44210 - DNA, 20 bp, Artificial Sequence
  chemically synthesized
gtcaaagatcagttggatgt

SEQ ID NO: 44211 - DNA, 20 bp, Artificial Sequence
  chemically synthesized
tcagttggatgtaagtattt

SEQ ID NO: 44212 - DNA, 20 bp, Artificial Sequence
  chemically synthesized
taagtatttgagtttatttc

SEQ ID NO: 44213 - DNA, 20 bp, Artificial Sequence
  chemically synthesized
aagtatttgagtttatttct

SEQ ID NO: 44214 - DNA, 20 bp, Artificial Sequence
  chemically synthesized
ggttctctattctgttccat

SEQ ID NO: 44215 - DNA, 20 bp, Artificial Sequence
  chemically synthesized
cgatgtgcctatttgtacac

SEQ ID NO: 44216 - DNA, 20 bp, Artificial Sequence
  chemically synthesized
acaccagcatcatgctgttt

SEQ ID NO: 44217 - DNA, 20 bp, Artificial Sequence
  chemically synthesized
tcatgctgttttggtgacta

SEQ ID NO: 44218 - DNA, 20 bp, Artificial Sequence
  chemically synthesized
gtgactatggccttattgta

SEQ ID NO: 44219 - DNA, 20 bp, Artificial Sequence
  chemically synthesized
cttattgtatagtttgaaat

SEQ ID NO: 44220 - DNA, 20 bp, Artificial Sequence
  chemically synthesized
ttattgtatagtttgaaatg

SEQ ID NO: 44221 - DNA, 20 bp, Artificial Sequence
  chemically synthesized
atgaggtaatgtaatgcctt

SEQ ID NO: 44222 - DNA, 20 bp, Artificial Sequence
  chemically synthesized
ttcagatttgttcttttttt

SEQ ID NO: 44223 - DNA, 20 bp, Artificial Sequence
  chemically synthesized
ttttagacttgcttgtttat

SEQ ID NO: 44224 - DNA, 20 bp, Artificial Sequence
  chemically synthesized
tttagacttgcttgtttatt

SEQ ID NO: 44225 - DNA, 20 bp, Artificial Sequence
  chemically synthesized
ttgtttattgggctcttttt

SEQ ID NO: 44226 - DNA, 20 bp, Artificial Sequence
  chemically synthesized
gggctcttttttggttccat

SEQ ID NO: 44227 - DNA, 20 bp, Artificial Sequence
  chemically synthesized
ttttggttccataagaattt

SEQ ID NO: 44228 - DNA, 20 bp, Artificial Sequence
  chemically synthesized
tttggttccataagaatttt

SEQ ID NO: 44229 - DNA, 20 bp, Artificial Sequence
  chemically synthesized
aattttaggattgttttttc

SEQ ID NO: 44230 - DNA, 20 bp, Artificial Sequence
  chemically synthesized
ttgttttttctagttctgtg

SEQ ID NO: 44231 - DNA, 20 bp, Artificial Sequence
  chemically synthesized
tctagttctgtgaagactaa

SEQ ID NO: 44232 - DNA, 20 bp, Artificial Sequence
  chemically synthesized
agttctgtgaagactaatgg

SEQ ID NO: 44233 - DNA, 20 bp, Artificial Sequence
  chemically synthesized
gactaatggtggtattttga

SEQ ID NO: 44234 - DNA, 20 bp, Artificial Sequence
  chemically synthesized
actaatggtggtattttgat

SEQ ID NO: 44235 - DNA, 20 bp, Artificial Sequence
  chemically synthesized
tgggaattgcaatgaatttg

SEQ ID NO: 44236 - DNA, 20 bp, Artificial Sequence
  chemically synthesized
gggaattgcaatgaatttgt

SEQ ID NO: 44237 - DNA, 20 bp, Artificial Sequence
  chemically synthesized
atgaatttgtaggttgcttc

SEQ ID NO: 44238 - DNA, 20 bp, Artificial Sequence
  chemically synthesized
gtaggttgcttctggcatta

SEQ ID NO: 44239 - DNA, 20 bp, Artificial Sequence
  chemically synthesized
tattgattctacccatctat

SEQ ID NO: 44240 - DNA, 20 bp, Artificial Sequence
  chemically synthesized
attctacccatctatgagaa

SEQ ID NO: 44241 - DNA, 20 bp, Artificial Sequence
  chemically synthesized
gtgtcttatatgattacttt

SEQ ID NO: 44242 - DNA, 20 bp, Artificial Sequence
  chemically synthesized
ttactttcagccgtgttttg

SEQ ID NO: 44243 - DNA, 20 bp, Artificial Sequence
  chemically synthesized
gtgttttgtagttttccttg

SEQ ID NO: 44244 - DNA, 20 bp, Artificial Sequence
  chemically synthesized
gtagatgtctttcacctcct

SEQ ID NO: 44245 - DNA, 20 bp, Artificial Sequence
  chemically synthesized
atgtctttcacctccttggt

SEQ ID NO: 44246 - DNA, 20 bp, Artificial Sequence
  chemically synthesized
tgtctttcacctccttggtt

SEQ ID NO: 44247 - DNA, 20 bp, Artificial Sequence
  chemically synthesized
ttggttaggtatatattcct

SEQ ID NO: 44248 - DNA, 20 bp, Artificial Sequence
  chemically synthesized
ttgttttgttttgttttttg

SEQ ID NO: 44249 - DNA, 20 bp, Artificial Sequence
  chemically synthesized
gttttttgcagctattgtaa

SEQ ID NO: 44250 - DNA, 20 bp, Artificial Sequence
  chemically synthesized
ttttttgcagctattgtaaa

SEQ ID NO: 44251 - DNA, 20 bp, Artificial Sequence
  chemically synthesized
tttttgcagctattgtaaaa

SEQ ID NO: 44252 - DNA, 20 bp, Artificial Sequence
  chemically synthesized
ttttgcagctattgtaaaag

SEQ ID NO: 44253 - DNA, 20 bp, Artificial Sequence
  chemically synthesized
cagctattgtaaaaggggtt

SEQ ID NO: 44254 - DNA, 20 bp, Artificial Sequence
  chemically synthesized
tgagttcttgattttattct

SEQ ID NO: 44255 - DNA, 20 bp, Artificial Sequence
  chemically synthesized
tcttgattttattctcagct

SEQ ID NO: 44256 - DNA, 20 bp, Artificial Sequence
  chemically synthesized
attctcagcttggtcattgc

SEQ ID NO: 44257 - DNA, 20 bp, Artificial Sequence
  chemically synthesized
cttggtcattgctggtatgt

SEQ ID NO: 44258 - DNA, 20 bp, Artificial Sequence
  chemically synthesized
gtcattgctggtatgtaaga

SEQ ID NO: 44259 - DNA, 20 bp, Artificial Sequence
  chemically synthesized
tatgtaagaaagcaactcat

SEQ ID NO: 44260 - DNA, 20 bp, Artificial Sequence
  chemically synthesized
gtgtacgttaattttgtatc

SEQ ID NO: 44261 - DNA, 20 bp, Artificial Sequence
  chemically synthesized
actttgctgaattattttat

SEQ ID NO: 44262 - DNA, 20 bp, Artificial Sequence
  chemically synthesized
ctgaattattttatcagttc

SEQ ID NO: 44263 - DNA, 20 bp, Artificial Sequence
  chemically synthesized
tgaattattttatcagttct

SEQ ID NO: 44264 - DNA, 20 bp, Artificial Sequence
  chemically synthesized
gaattattttatcagttcta

SEQ ID NO: 44265 - DNA, 20 bp, Artificial Sequence
  chemically synthesized
aattattttatcagttctag

SEQ ID NO: 44266 - DNA, 20 bp, Artificial Sequence
  chemically synthesized
attattttatcagttctagg

SEQ ID NO: 44267 - DNA, 20 bp, Artificial Sequence
  chemically synthesized
ttatcagttctagggggttt

SEQ ID NO: 44268 - DNA, 20 bp, Artificial Sequence
  chemically synthesized
atcagttctagggggttttg

SEQ ID NO: 44269 - DNA, 20 bp, Artificial Sequence
  chemically synthesized
tcagttctagggggttttgg

SEQ ID NO: 44270 - DNA, 20 bp, Artificial Sequence
  chemically synthesized
agttctagggggttttggag

SEQ ID NO: 44271 - DNA, 20 bp, Artificial Sequence
  chemically synthesized
gggggttttggaggagtctt

SEQ ID NO: 44272 - DNA, 20 bp, Artificial Sequence
  chemically synthesized
gggttttggaggagtcttta

SEQ ID NO: 44273 - DNA, 20 bp, Artificial Sequence
  chemically synthesized
tacatacacaatcatatcat

SEQ ID NO: 44274 - DNA, 20 bp, Artificial Sequence
  chemically synthesized
acaatcatatcatcagcaaa

SEQ ID NO: 44275 - DNA, 20 bp, Artificial Sequence
  chemically synthesized
atatcatcagcaaacagtga

SEQ ID NO: 44276 - DNA, 20 bp, Artificial Sequence
  chemically synthesized
tgactttctctttaacaatt

SEQ ID NO: 44277 - DNA, 20 bp, Artificial Sequence
  chemically synthesized
tcttgtctgattgctcttgc

SEQ ID NO: 44278 - DNA, 20 bp, Artificial Sequence
  chemically synthesized
cttgtctgattgctcttgct

SEQ ID NO: 44279 - DNA, 20 bp, Artificial Sequence
  chemically synthesized
attgctcttgctaggacttc

SEQ ID NO: 44280 - DNA, 20 bp, Artificial Sequence
  chemically synthesized
ggacttccagtaatatgtta

SEQ ID NO: 44281 - DNA, 20 bp, Artificial Sequence
  chemically synthesized
acttccagtaatatgttaaa

SEQ ID NO: 44282 - DNA, 20 bp, Artificial Sequence
  chemically synthesized
tccagtaatatgttaaagag

SEQ ID NO: 44283 - DNA, 20 bp, Artificial Sequence
  chemically synthesized
agtaatatgttaaagagaag

SEQ ID NO: 44284 - DNA, 20 bp, Artificial Sequence
  chemically synthesized
atatgttaaagagaagtggt

SEQ ID NO: 44285 - DNA, 20 bp, Artificial Sequence
  chemically synthesized
atgttaaagagaagtggtga

SEQ ID NO: 44286 - DNA, 20 bp, Artificial Sequence
  chemically synthesized
ttaaagagaagtggtgagag

SEQ ID NO: 44287 - DNA, 20 bp, Artificial Sequence
  chemically synthesized
taaagagaagtggtgagagt

SEQ ID NO: 44288 - DNA, 20 bp, Artificial Sequence
  chemically synthesized
tgggtatccttgtctcattc

SEQ ID NO: 44289 - DNA, 20 bp, Artificial Sequence
  chemically synthesized
ccttgtctcattccagtttt

SEQ ID NO: 44290 - DNA, 20 bp, Artificial Sequence
  chemically synthesized
gtctcattccagttttcaga

SEQ ID NO: 44291 - DNA, 20 bp, Artificial Sequence
  chemically synthesized
tttcccattcaatataatgt

SEQ ID NO: 44292 - DNA, 20 bp, Artificial Sequence
  chemically synthesized
tgttggctgtgtgtttacca

SEQ ID NO: 44293 - DNA, 20 bp, Artificial Sequence
  chemically synthesized
ggctgtgtgtttaccatagc

SEQ ID NO: 44294 - DNA, 20 bp, Artificial Sequence
  chemically synthesized
tagctggcttttattacatt

SEQ ID NO: 44295 - DNA, 20 bp, Artificial Sequence
  chemically synthesized
agctggcttttattacattg

SEQ ID NO: 44296 - DNA, 20 bp, Artificial Sequence
  chemically synthesized
ctttgtaaaccgattttgct

SEQ ID NO: 44297 - DNA, 20 bp, Artificial Sequence
  chemically synthesized
aaaccgattttgctgagttt

SEQ ID NO: 44298 - DNA, 20 bp, Artificial Sequence
  chemically synthesized
tttgctgagttttagtcata

SEQ ID NO: 44299 - DNA, 20 bp, Artificial Sequence
  chemically synthesized
atgttgaattttgttgaatg

SEQ ID NO: 44300 - DNA, 20 bp, Artificial Sequence
  chemically synthesized
tttgttgaatgcagtttctg

SEQ ID NO: 44301 - DNA, 20 bp, Artificial Sequence
  chemically synthesized
atgcagtttctgtggctatt

SEQ ID NO: 44302 - DNA, 20 bp, Artificial Sequence
  chemically synthesized
gcatgaaacccacttgatca

SEQ ID NO: 44303 - DNA, 20 bp, Artificial Sequence
  chemically synthesized
catgaaacccacttgatcat

SEQ ID NO: 44304 - DNA, 20 bp, Artificial Sequence
  chemically synthesized
catgggttttgatatgctgt

SEQ ID NO: 44305 - DNA, 20 bp, Artificial Sequence
  chemically synthesized
gatatgctgtcggatgctat

SEQ ID NO: 44306 - DNA, 20 bp, Artificial Sequence
  chemically synthesized
tgctgtcggatgctattagc

SEQ ID NO: 44307 - DNA, 20 bp, Artificial Sequence
  chemically synthesized
ctattagctagtattttgtc

SEQ ID NO: 44308 - DNA, 20 bp, Artificial Sequence
  chemically synthesized
tattagctagtattttgtca

SEQ ID NO: 44309 - DNA, 20 bp, Artificial Sequence
  chemically synthesized
tagtattttgtcaaggatgt

SEQ ID NO: 44310 - DNA, 20 bp, Artificial Sequence
  chemically synthesized
atgttggcatctatgttcat

SEQ ID NO: 44311 - DNA, 20 bp, Artificial Sequence
  chemically synthesized
tgttggcatctatgttcatc

SEQ ID NO: 44312 - DNA, 20 bp, Artificial Sequence
  chemically synthesized
gttggcatctatgttcatca

SEQ ID NO: 44313 - DNA, 20 bp, Artificial Sequence
  chemically synthesized
tcatcagggatattgatctg

SEQ ID NO: 44314 - DNA, 20 bp, Artificial Sequence
  chemically synthesized
tctgtagtgttttttttttt

SEQ ID NO: 44315 - DNA, 20 bp, Artificial Sequence
  chemically synthesized
tttttggttatgttctttcc

SEQ ID NO: 44316 - DNA, 20 bp, Artificial Sequence
  chemically synthesized
gttatgttctttcccagttt

SEQ ID NO: 44317 - DNA, 20 bp, Artificial Sequence
  chemically synthesized
tctttcccagttttggtatt

SEQ ID NO: 44318 - DNA, 20 bp, Artificial Sequence
  chemically synthesized
ctttcccagttttggtatta

SEQ ID NO: 44319 - DNA, 20 bp, Artificial Sequence
  chemically synthesized
ttttggtattaaggtgatac

SEQ ID NO: 44320 - DNA, 20 bp, Artificial Sequence
  chemically synthesized
ttaaggtgatactggcttca

SEQ ID NO: 44321 - DNA, 20 bp, Artificial Sequence
  chemically synthesized
actggcttcatagaatgatt

SEQ ID NO: 44322 - DNA, 20 bp, Artificial Sequence
  chemically synthesized
ctggcttcatagaatgattt

SEQ ID NO: 44323 - DNA, 20 bp, Artificial Sequence
  chemically synthesized
tggcttcatagaatgattta

SEQ ID NO: 44324 - DNA, 20 bp, Artificial Sequence
  chemically synthesized
gcttcatagaatgatttagg

SEQ ID NO: 44325 - DNA, 20 bp, Artificial Sequence
  chemically synthesized
cttcatagaatgatttaggg

SEQ ID NO: 44326 - DNA, 20 bp, Artificial Sequence
  chemically synthesized
ttctctctttctctatcttg

SEQ ID NO: 44327 - DNA, 20 bp, Artificial Sequence
  chemically synthesized
atcttgtagaatactgtcaa

SEQ ID NO: 44328 - DNA, 20 bp, Artificial Sequence
  chemically synthesized
tcttgtagaatactgtcaat

SEQ ID NO: 44329 - DNA, 20 bp, Artificial Sequence
  chemically synthesized
tagaatactgtcaataggat

SEQ ID NO: 44330 - DNA, 20 bp, Artificial Sequence
  chemically synthesized
tcaattcttctttgaatgtc

SEQ ID NO: 44331 - DNA, 20 bp, Artificial Sequence
  chemically synthesized
attcttctttgaatgtctgg

SEQ ID NO: 44332 - DNA, 20 bp, Artificial Sequence
  chemically synthesized
tttgaatgtctggtagaatt

SEQ ID NO: 44333 - DNA, 20 bp, Artificial Sequence
  chemically synthesized
aattcagctgtgaatctatc

SEQ ID NO: 44334 - DNA, 20 bp, Artificial Sequence
  chemically synthesized
gctgtgaatctatctggtcc

SEQ ID NO: 44335 - DNA, 20 bp, Artificial Sequence
  chemically synthesized
gtcctggacttttttgttgt

SEQ ID NO: 44336 - DNA, 20 bp, Artificial Sequence
  chemically synthesized
gtaaatttttattatcattt

SEQ ID NO: 44337 - DNA, 20 bp, Artificial Sequence
  chemically synthesized
tcagtcttgctgcttattac

SEQ ID NO: 44338 - DNA, 20 bp, Artificial Sequence
  chemically synthesized
ctgcttattactggtctgtt

SEQ ID NO: 44339 - DNA, 20 bp, Artificial Sequence
  chemically synthesized
tgcttattactggtctgttc

SEQ ID NO: 44340 - DNA, 20 bp, Artificial Sequence
  chemically synthesized
gcttattactggtctgttca

SEQ ID NO: 44341 - DNA, 20 bp, Artificial Sequence
  chemically synthesized
tatctaattcttcctgactt

SEQ ID NO: 44342 - DNA, 20 bp, Artificial Sequence
  chemically synthesized
taattcttcctgacttaagc

SEQ ID NO: 44343 - DNA, 20 bp, Artificial Sequence
  chemically synthesized
attcttcctgacttaagcta

SEQ ID NO: 44344 - DNA, 20 bp, Artificial Sequence
  chemically synthesized
gctagagccctgtatctttc

SEQ ID NO: 44345 - DNA, 20 bp, Artificial Sequence
  chemically synthesized
ctagagccctgtatctttcc

SEQ ID NO: 44346 - DNA, 20 bp, Artificial Sequence
  chemically synthesized
aggaattcgaacgtctcctt

SEQ ID NO: 44347 - DNA, 20 bp, Artificial Sequence
  chemically synthesized
ggaattcgaacgtctccttt

SEQ ID NO: 44348 - DNA, 20 bp, Artificial Sequence
  chemically synthesized
aacgtctcctttaggttttc

SEQ ID NO: 44349 - DNA, 20 bp, Artificial Sequence
  chemically synthesized
ttttctagtttatgcatgta

SEQ ID NO: 44350 - DNA, 20 bp, Artificial Sequence
  chemically synthesized
tttctagtttatgcatgtaa

SEQ ID NO: 44351 - DNA, 20 bp, Artificial Sequence
  chemically synthesized
tatgcatgtaaaggtgttca

SEQ ID NO: 44352 - DNA, 20 bp, Artificial Sequence
  chemically synthesized
gcatgtaaaggtgttcatag

SEQ ID NO: 44353 - DNA, 20 bp, Artificial Sequence
  chemically synthesized
aataatcttttgtatttctg

SEQ ID NO: 44354 - DNA, 20 bp, Artificial Sequence
  chemically synthesized
cttttgtatttctgtggtat

SEQ ID NO: 44355 - DNA, 20 bp, Artificial Sequence
  chemically synthesized
tatttctgtggtatcagtaa

SEQ ID NO: 44356 - DNA, 20 bp, Artificial Sequence
  chemically synthesized
ctcctgttttgtttctaatt

SEQ ID NO: 44357 - DNA, 20 bp, Artificial Sequence
  chemically synthesized
gcacttctctcctcttttct

SEQ ID NO: 44358 - DNA, 20 bp, Artificial Sequence
  chemically synthesized
ttcttggttaatcttgctaa

SEQ ID NO: 44359 - DNA, 20 bp, Artificial Sequence
  chemically synthesized
taatcttgctaatggtctat

SEQ ID NO: 44360 - DNA, 20 bp, Artificial Sequence
  chemically synthesized
cagttttatttatcttttca

SEQ ID NO: 44361 - DNA, 20 bp, Artificial Sequence
  chemically synthesized
tatttatcttttcaaagaac

SEQ ID NO: 44362 - DNA, 20 bp, Artificial Sequence
  chemically synthesized
aaccagctttttatttcatt

SEQ ID NO: 44363 - DNA, 20 bp, Artificial Sequence
  chemically synthesized
ttagcttttgtatttttttg

SEQ ID NO: 44364 - DNA, 20 bp, Artificial Sequence
  chemically synthesized
gcagttgttttaatttcatt

SEQ ID NO: 44365 - DNA, 20 bp, Artificial Sequence
  chemically synthesized
atttagttctcctcttatct

SEQ ID NO: 44366 - DNA, 20 bp, Artificial Sequence
  chemically synthesized
agttattccctttcttttgc

SEQ ID NO: 44367 - DNA, 20 bp, Artificial Sequence
  chemically synthesized
gttattccctttcttttgct

SEQ ID NO: 44368 - DNA, 20 bp, Artificial Sequence
  chemically synthesized
ccctttcttttgctgggttt

SEQ ID NO: 44369 - DNA, 20 bp, Artificial Sequence
  chemically synthesized
tctgtttgtttttgtttctc

SEQ ID NO: 44370 - DNA, 20 bp, Artificial Sequence
  chemically synthesized
tttgtttctctagtttcttg

SEQ ID NO: 44371 - DNA, 20 bp, Artificial Sequence
  chemically synthesized
attgtctgtctgtcctcttt

SEQ ID NO: 44372 - DNA, 20 bp, Artificial Sequence
  chemically synthesized
gactctttgacatcgacatt

SEQ ID NO: 44373 - DNA, 20 bp, Artificial Sequence
  chemically synthesized
actctttgacatcgacattt

SEQ ID NO: 44374 - DNA, 20 bp, Artificial Sequence
  chemically synthesized
ctctttgacatcgacattta

SEQ ID NO: 44375 - DNA, 20 bp, Artificial Sequence
  chemically synthesized
agggctgtgaactttccttt

SEQ ID NO: 44376 - DNA, 20 bp, Artificial Sequence
  chemically synthesized
gcaccatctttgctgtatcc

SEQ ID NO: 44377 - DNA, 20 bp, Artificial Sequence
  chemically synthesized
accatctttgctgtatccta

SEQ ID NO: 44378 - DNA, 20 bp, Artificial Sequence
  chemically synthesized
ccatctttgctgtatcctag

SEQ ID NO: 44379 - DNA, 20 bp, Artificial Sequence
  chemically synthesized
ctgtatcctagaggttttga

SEQ ID NO: 44380 - DNA, 20 bp, Artificial Sequence
  chemically synthesized
tgtatcctagaggttttgat

SEQ ID NO: 44381 - DNA, 20 bp, Artificial Sequence
  chemically synthesized
ataggttgtgtcactattgt

SEQ ID NO: 44382 - DNA, 20 bp, Artificial Sequence
  chemically synthesized
gttgtgtcactattgtcggt

SEQ ID NO: 44383 - DNA, 20 bp, Artificial Sequence
  chemically synthesized
tcactattgtcggtcagttc

SEQ ID NO: 44384 - DNA, 20 bp, Artificial Sequence
  chemically synthesized
tgttgttcttattatacttt

SEQ ID NO: 44385 - DNA, 20 bp, Artificial Sequence
  chemically synthesized
tcttattatactttaagttc

SEQ ID NO: 44386 - DNA, 20 bp, Artificial Sequence
  chemically synthesized
cttattatactttaagttct

SEQ ID NO: 44387 - DNA, 20 bp, Artificial Sequence
  chemically synthesized
taagttctgggatacatgtg

SEQ ID NO: 44388 - DNA, 20 bp, Artificial Sequence
  chemically synthesized
ggatacatgtgcagaatgtg

SEQ ID NO: 44389 - DNA, 20 bp, Artificial Sequence
  chemically synthesized
gatacatgtgcagaatgtgc

SEQ ID NO: 44390 - DNA, 20 bp, Artificial Sequence
  chemically synthesized
gaatgtgcaggtttgttaca

SEQ ID NO: 44391 - DNA, 20 bp, Artificial Sequence
  chemically synthesized
aatgtgcaggtttgttacat

SEQ ID NO: 44392 - DNA, 20 bp, Artificial Sequence
  chemically synthesized
gcaggtttgttacataggta

SEQ ID NO: 44393 - DNA, 20 bp, Artificial Sequence
  chemically synthesized
acataggtatagatgtgcca

SEQ ID NO: 44394 - DNA, 20 bp, Artificial Sequence
  chemically synthesized
taggtatagatgtgccatgg

SEQ ID NO: 44395 - DNA, 20 bp, Artificial Sequence
  chemically synthesized
catcaacctgtcatctacat

SEQ ID NO: 44396 - DNA, 20 bp, Artificial Sequence
  chemically synthesized
atcaacctgtcatctacatt

SEQ ID NO: 44397 - DNA, 20 bp, Artificial Sequence
  chemically synthesized
ctaaccccctcaccccccga

SEQ ID NO: 44398 - DNA, 20 bp, Artificial Sequence
  chemically synthesized
taaccccctcaccccccgac

SEQ ID NO: 44399 - DNA, 20 bp, Artificial Sequence
  chemically synthesized
cctcaccccccgacaggccc

SEQ ID NO: 44400 - DNA, 20 bp, Artificial Sequence
  chemically synthesized
attgttcaactcccacttat

SEQ ID NO: 44401 - DNA, 20 bp, Artificial Sequence
  chemically synthesized
ttcaactcccacttatgagt

SEQ ID NO: 44402 - DNA, 20 bp, Artificial Sequence
  chemically synthesized
cacttatgagtgagaacgtg

SEQ ID NO: 44403 - DNA, 20 bp, Artificial Sequence
  chemically synthesized
gagtgagaacgtgtggtgtt

SEQ ID NO: 44404 - DNA, 20 bp, Artificial Sequence
  chemically synthesized
tggtttctctgttcctgtgt

SEQ ID NO: 44405 - DNA, 20 bp, Artificial Sequence
  chemically synthesized
tgttcctgtgttagtttgct

SEQ ID NO: 44406 - DNA, 20 bp, Artificial Sequence
  chemically synthesized
tgttagtttgctcagaatga

SEQ ID NO: 44407 - DNA, 20 bp, Artificial Sequence
  chemically synthesized
ccttcatccatgtccctgca

SEQ ID NO: 44408 - DNA, 20 bp, Artificial Sequence
  chemically synthesized
acatgaactcatcattttta

SEQ ID NO: 44409 - DNA, 20 bp, Artificial Sequence
  chemically synthesized
tcatcatttttatggctgca

SEQ ID NO: 44410 - DNA, 20 bp, Artificial Sequence
  chemically synthesized
tatggctgcatagtattcca

SEQ ID NO: 44411 - DNA, 20 bp, Artificial Sequence
  chemically synthesized
tttatccattatatcgctga

SEQ ID NO: 44412 - DNA, 20 bp, Artificial Sequence
  chemically synthesized
ttatatcgctgatggccatt

SEQ ID NO: 44413 - DNA, 20 bp, Artificial Sequence
  chemically synthesized
tatatcgctgatggccattt

SEQ ID NO: 44414 - DNA, 20 bp, Artificial Sequence
  chemically synthesized
tcgctgatggccatttgggt

SEQ ID NO: 44415 - DNA, 20 bp, Artificial Sequence
  chemically synthesized
tggccatttgggttggttcc

SEQ ID NO: 44416 - DNA, 20 bp, Artificial Sequence
  chemically synthesized
caagtctttgctattgtgaa

SEQ ID NO: 44417 - DNA, 20 bp, Artificial Sequence
  chemically synthesized
tacgtgtgcacgtgtcttta

SEQ ID NO: 44418 - DNA, 20 bp, Artificial Sequence
  chemically synthesized
gtgtgcacgtgtctttatag

SEQ ID NO: 44419 - DNA, 20 bp, Artificial Sequence
  chemically synthesized
tagaatgatttctaattctt

SEQ ID NO: 44420 - DNA, 20 bp, Artificial Sequence
  chemically synthesized
agaatgatttctaattcttt

SEQ ID NO: 44421 - DNA, 20 bp, Artificial Sequence
  chemically synthesized
taattctttgggtatatacc

SEQ ID NO: 44422 - DNA, 20 bp, Artificial Sequence
  chemically synthesized
tttgggtatatacccagtaa

SEQ ID NO: 44423 - DNA, 20 bp, Artificial Sequence
  chemically synthesized
ttgggtatatacccagtaat

SEQ ID NO: 44424 - DNA, 20 bp, Artificial Sequence
  chemically synthesized
atacccagtaatgggattgc

SEQ ID NO: 44425 - DNA, 20 bp, Artificial Sequence
  chemically synthesized
tacccagtaatgggattgct

SEQ ID NO: 44426 - DNA, 20 bp, Artificial Sequence
  chemically synthesized
aatgggattgctgggtcaaa

SEQ ID NO: 44427 - DNA, 20 bp, Artificial Sequence
  chemically synthesized
gctgggtcaaacagtatttc

SEQ ID NO: 44428 - DNA, 20 bp, Artificial Sequence
  chemically synthesized
tcaaacagtatttctggttc

SEQ ID NO: 44429 - DNA, 20 bp, Artificial Sequence
  chemically synthesized
atttctggttctagatcctt

SEQ ID NO: 44430 - DNA, 20 bp, Artificial Sequence
  chemically synthesized
tttctggttctagatccttg

SEQ ID NO: 44431 - DNA, 20 bp, Artificial Sequence
  chemically synthesized
cgccacactgtcttccacaa

SEQ ID NO: 44432 - DNA, 20 bp, Artificial Sequence
  chemically synthesized
ctaatttacacacccatcaa

SEQ ID NO: 44433 - DNA, 20 bp, Artificial Sequence
  chemically synthesized
ctattcttccacatcctctc

SEQ ID NO: 44434 - DNA, 20 bp, Artificial Sequence
  chemically synthesized
ttaataattgccattctaac

SEQ ID NO: 44435 - DNA, 20 bp, Artificial Sequence
  chemically synthesized
attgccattctaactggcat

SEQ ID NO: 44436 - DNA, 20 bp, Artificial Sequence
  chemically synthesized
ccattctaactggcatgaga

SEQ ID NO: 44437 - DNA, 20 bp, Artificial Sequence
  chemically synthesized
catgagatggtatctcattg

SEQ ID NO: 44438 - DNA, 20 bp, Artificial Sequence
  chemically synthesized
atttgcatttctctaatgac

SEQ ID NO: 44439 - DNA, 20 bp, Artificial Sequence
  chemically synthesized
ctctaatgaccagtgatgat

SEQ ID NO: 44440 - DNA, 20 bp, Artificial Sequence
  chemically synthesized
gcttcttttcatgtgtttct

SEQ ID NO: 44441 - DNA, 20 bp, Artificial Sequence
  chemically synthesized
ggccacataaatgacttctt

SEQ ID NO: 44442 - DNA, 20 bp, Artificial Sequence
  chemically synthesized
ccacataaatgacttcttta

SEQ ID NO: 44443 - DNA, 20 bp, Artificial Sequence
  chemically synthesized
cataaatgacttctttagag

SEQ ID NO: 44444 - DNA, 20 bp, Artificial Sequence
  chemically synthesized
atcctttgtccactttttga

SEQ ID NO: 44445 - DNA, 20 bp, Artificial Sequence
  chemically synthesized
tcctttgtccactttttgat

SEQ ID NO: 44446 - DNA, 20 bp, Artificial Sequence
  chemically synthesized
cctttgtccactttttgatg

SEQ ID NO: 44447 - DNA, 20 bp, Artificial Sequence
  chemically synthesized
ccactttttgatggggtcgt

SEQ ID NO: 44448 - DNA, 20 bp, Artificial Sequence
  chemically synthesized
cactttttgatggggtcgtt

SEQ ID NO: 44449 - DNA, 20 bp, Artificial Sequence
  chemically synthesized
tttttcttgtaaatttgttg

SEQ ID NO: 44450 - DNA, 20 bp, Artificial Sequence
  chemically synthesized
aaatttgttgaagttctttg

SEQ ID NO: 44451 - DNA, 20 bp, Artificial Sequence
  chemically synthesized
ttgaagttctttgtagattt

SEQ ID NO: 44452 - DNA, 20 bp, Artificial Sequence
  chemically synthesized
tctttgtagattttggatgt

SEQ ID NO: 44453 - DNA, 20 bp, Artificial Sequence
  chemically synthesized
tttggatgttagccctttgt

SEQ ID NO: 44454 - DNA, 20 bp, Artificial Sequence
  chemically synthesized
gatgttagccctttgtcaga

SEQ ID NO: 44455 - DNA, 20 bp, Artificial Sequence
  chemically synthesized
ttagccctttgtcagatgga

SEQ ID NO: 44456 - DNA, 20 bp, Artificial Sequence
  chemically synthesized
aaaaattttctcccattctg

SEQ ID NO: 44457 - DNA, 20 bp, Artificial Sequence
  chemically synthesized
aaaattttctcccattctgt

SEQ ID NO: 44458 - DNA, 20 bp, Artificial Sequence
  chemically synthesized
ttgcctgttcactctgatga

SEQ ID NO: 44459 - DNA, 20 bp, Artificial Sequence
  chemically synthesized
gatgatagtcttttgctgtg

SEQ ID NO: 44460 - DNA, 20 bp, Artificial Sequence
  chemically synthesized
gatagtcttttgctgtgcag

SEQ ID NO: 44461 - DNA, 20 bp, Artificial Sequence
  chemically synthesized
tttgctgtgcagaagctctt

SEQ ID NO: 44462 - DNA, 20 bp, Artificial Sequence
  chemically synthesized
cagaagctctttagtttaat

SEQ ID NO: 44463 - DNA, 20 bp, Artificial Sequence
  chemically synthesized
tagatcccatatgtcaattt

SEQ ID NO: 44464 - DNA, 20 bp, Artificial Sequence
  chemically synthesized
tgtcattgcttttgatgttt

SEQ ID NO: 44465 - DNA, 20 bp, Artificial Sequence
  chemically synthesized
gcccatgcctatgtcctgaa

SEQ ID NO: 44466 - DNA, 20 bp, Artificial Sequence
  chemically synthesized
atgtcctgaatggtattgcc

SEQ ID NO: 44467 - DNA, 20 bp, Artificial Sequence
  chemically synthesized
tgtcctgaatggtattgcct

SEQ ID NO: 44468 - DNA, 20 bp, Artificial Sequence
  chemically synthesized
gtattgcctaggttatcttc

SEQ ID NO: 44469 - DNA, 20 bp, Artificial Sequence
  chemically synthesized
tattgcctaggttatcttct

SEQ ID NO: 44470 - DNA, 20 bp, Artificial Sequence
  chemically synthesized
gttatcttctaggattttta

SEQ ID NO: 44471 - DNA, 20 bp, Artificial Sequence
  chemically synthesized
ttctaggatttttatggttt

SEQ ID NO: 44472 - DNA, 20 bp, Artificial Sequence
  chemically synthesized
tctaggatttttatggtttt

SEQ ID NO: 44473 - DNA, 20 bp, Artificial Sequence
  chemically synthesized
tggttttaggttgcacattt

SEQ ID NO: 44474 - DNA, 20 bp, Artificial Sequence
  chemically synthesized
ttaagtctttaatccacctt

SEQ ID NO: 44475 - DNA, 20 bp, Artificial Sequence
  chemically synthesized
ccttgagttaatttttgtat

SEQ ID NO: 44476 - DNA, 20 bp, Artificial Sequence
  chemically synthesized
cttgagttaatttttgtata

SEQ ID NO: 44477 - DNA, 20 bp, Artificial Sequence
  chemically synthesized
ttaatttttgtataaggtgt

SEQ ID NO: 44478 - DNA, 20 bp, Artificial Sequence
  chemically synthesized
taatttttgtataaggtgta

SEQ ID NO: 44479 - DNA, 20 bp, Artificial Sequence
  chemically synthesized
tttttgtataaggtgtaagg

SEQ ID NO: 44480 - DNA, 20 bp, Artificial Sequence
  chemically synthesized
ttttgtataaggtgtaagga

SEQ ID NO: 44481 - DNA, 20 bp, Artificial Sequence
  chemically synthesized
tttgtataaggtgtaaggaa

SEQ ID NO: 44482 - DNA, 20 bp, Artificial Sequence
  chemically synthesized
ttgtataaggtgtaaggaag

SEQ ID NO: 44483 - DNA, 20 bp, Artificial Sequence
  chemically synthesized
taaggtgtaaggaaggggta

SEQ ID NO: 44484 - DNA, 20 bp, Artificial Sequence
  chemically synthesized
gtaaggaaggggtacagttt

SEQ ID NO: 44485 - DNA, 20 bp, Artificial Sequence
  chemically synthesized
ttcagttttatgcatattgc

SEQ ID NO: 44486 - DNA, 20 bp, Artificial Sequence
  chemically synthesized
gttttatgcatattgctagc

SEQ ID NO: 44487 - DNA, 20 bp, Artificial Sequence
  chemically synthesized
atattgctagccagtttttc

SEQ ID NO: 44488 - DNA, 20 bp, Artificial Sequence
  chemically synthesized
ttccagcaccatttattaaa

SEQ ID NO: 44489 - DNA, 20 bp, Artificial Sequence
  chemically synthesized
tccagcaccatttattaaat

SEQ ID NO: 44490 - DNA, 20 bp, Artificial Sequence
  chemically synthesized
ccagcaccatttattaaata

SEQ ID NO: 44491 - DNA, 20 bp, Artificial Sequence
  chemically synthesized
tgcttttgtgatgtttgtca

SEQ ID NO: 44492 - DNA, 20 bp, Artificial Sequence
  chemically synthesized
ttgtgatgtttgtcaaagat

SEQ ID NO: 44493 - DNA, 20 bp, Artificial Sequence
  chemically synthesized
gatgtttgtcaaagatcaga

SEQ ID NO: 44494 - DNA, 20 bp, Artificial Sequence
  chemically synthesized
tgtcaaagatcagatggtcg

SEQ ID NO: 44495 - DNA, 20 bp, Artificial Sequence
  chemically synthesized
atcagatggtcgtagatgtg

SEQ ID NO: 44496 - DNA, 20 bp, Artificial Sequence
  chemically synthesized
agatgtgtggcattatttct

SEQ ID NO: 44497 - DNA, 20 bp, Artificial Sequence
  chemically synthesized
gatgtgtggcattatttctg

SEQ ID NO: 44498 - DNA, 20 bp, Artificial Sequence
  chemically synthesized
aggcttctgttctgttccac

SEQ ID NO: 44499 - DNA, 20 bp, Artificial Sequence
  chemically synthesized
actggtctatatatctgttt

SEQ ID NO: 44500 - DNA, 20 bp, Artificial Sequence
  chemically synthesized
ctatatatctgttttggtac

SEQ ID NO: 44501 - DNA, 20 bp, Artificial Sequence
  chemically synthesized
ccatgctgtttttgttactg

SEQ ID NO: 44502 - DNA, 20 bp, Artificial Sequence
  chemically synthesized
tttttgttactgtagccttg

SEQ ID NO: 44503 - DNA, 20 bp, Artificial Sequence
  chemically synthesized
gttactgtagccttgtagta

SEQ ID NO: 44504 - DNA, 20 bp, Artificial Sequence
  chemically synthesized
tagccttgtagtatagtttg

SEQ ID NO: 44505 - DNA, 20 bp, Artificial Sequence
  chemically synthesized
cttgtagtatagtttgaagt

SEQ ID NO: 44506 - DNA, 20 bp, Artificial Sequence
  chemically synthesized
ttgtagtatagtttgaagtc

SEQ ID NO: 44507 - DNA, 20 bp, Artificial Sequence
  chemically synthesized
tagtatagtttgaagtcagg

SEQ ID NO: 44508 - DNA, 20 bp, Artificial Sequence
  chemically synthesized
gtcaggtagcatcatgcctc

SEQ ID NO: 44509 - DNA, 20 bp, Artificial Sequence
  chemically synthesized
ccagctttgttctttttgtt

SEQ ID NO: 44510 - DNA, 20 bp, Artificial Sequence
  chemically synthesized
cagctttgttctttttgttt

SEQ ID NO: 44511 - DNA, 20 bp, Artificial Sequence
  chemically synthesized
ctttttgtttaggattgtct

SEQ ID NO: 44512 - DNA, 20 bp, Artificial Sequence
  chemically synthesized
ttaggattgtcttggctata

SEQ ID NO: 44513 - DNA, 20 bp, Artificial Sequence
  chemically synthesized
taggattgtcttggctatat

SEQ ID NO: 44514 - DNA, 20 bp, Artificial Sequence
  chemically synthesized
ttgattccatatgacattta

SEQ ID NO: 44515 - DNA, 20 bp, Artificial Sequence
  chemically synthesized
attccatatgacatttaaag

SEQ ID NO: 44516 - DNA, 20 bp, Artificial Sequence
  chemically synthesized
tttttctaattctttgaaaa

SEQ ID NO: 44517 - DNA, 20 bp, Artificial Sequence
  chemically synthesized
tctaattctttgaaaaaagt

SEQ ID NO: 44518 - DNA, 20 bp, Artificial Sequence
  chemically synthesized
aattctttgaaaaaagtcag

SEQ ID NO: 44519 - DNA, 20 bp, Artificial Sequence
  chemically synthesized
tctttgaaaaaagtcagtgg

SEQ ID NO: 44520 - DNA, 20 bp, Artificial Sequence
  chemically synthesized
aaaagtcagtggtagcttga

SEQ ID NO: 44521 - DNA, 20 bp, Artificial Sequence
  chemically synthesized
aaagtcagtggtagcttgat

SEQ ID NO: 44522 - DNA, 20 bp, Artificial Sequence
  chemically synthesized
aagtcagtggtagcttgatg

SEQ ID NO: 44523 - DNA, 20 bp, Artificial Sequence
  chemically synthesized
cagtggtagcttgatgggga

SEQ ID NO: 44524 - DNA, 20 bp, Artificial Sequence
  chemically synthesized
attgaatctataaattactt

SEQ ID NO: 44525 - DNA, 20 bp, Artificial Sequence
  chemically synthesized
ttgaatctataaattacttt

SEQ ID NO: 44526 - DNA, 20 bp, Artificial Sequence
  chemically synthesized
aatctataaattactttggg

SEQ ID NO: 44527 - DNA, 20 bp, Artificial Sequence
  chemically synthesized
ataaattactttgggcagta

SEQ ID NO: 44528 - DNA, 20 bp, Artificial Sequence
  chemically synthesized
tgggcagtatggccatttta

SEQ ID NO: 44529 - DNA, 20 bp, Artificial Sequence
  chemically synthesized
tattgattctttctatctat

SEQ ID NO: 44530 - DNA, 20 bp, Artificial Sequence
  chemically synthesized
attctttctatctatgagca

SEQ ID NO: 44531 - DNA, 20 bp, Artificial Sequence
  chemically synthesized
gtgtcctctcttatttcctt

SEQ ID NO: 44532 - DNA, 20 bp, Artificial Sequence
  chemically synthesized
tcctctcttatttccttgag

SEQ ID NO: 44533 - DNA, 20 bp, Artificial Sequence
  chemically synthesized
ctcttatttccttgagcagt

SEQ ID NO: 44534 - DNA, 20 bp, Artificial Sequence
  chemically synthesized
ttatttccttgagcagtgag

SEQ ID NO: 44535 - DNA, 20 bp, Artificial Sequence
  chemically synthesized
cttgagcagtgagtggtttg

SEQ ID NO: 44536 - DNA, 20 bp, Artificial Sequence
  chemically synthesized
gtggtttgtagctctccttg

SEQ ID NO: 44537 - DNA, 20 bp, Artificial Sequence
  chemically synthesized
ggtttgtagctctccttgaa

SEQ ID NO: 44538 - DNA, 20 bp, Artificial Sequence
  chemically synthesized
gtttgtagctctccttgaag

SEQ ID NO: 44539 - DNA, 20 bp, Artificial Sequence
  chemically synthesized
aagaggttcttcacatccct

SEQ ID NO: 44540 - DNA, 20 bp, Artificial Sequence
  chemically synthesized
aggttcttcacatcccttag

SEQ ID NO: 44541 - DNA, 20 bp, Artificial Sequence
  chemically synthesized
tcccttagaagttgtatttc

SEQ ID NO: 44542 - DNA, 20 bp, Artificial Sequence
  chemically synthesized
cccttagaagttgtatttct

SEQ ID NO: 44543 - DNA, 20 bp, Artificial Sequence
  chemically synthesized
attttattttattctctttg

SEQ ID NO: 44544 - DNA, 20 bp, Artificial Sequence
  chemically synthesized
ctctttgcagcaattgtgaa

SEQ ID NO: 44545 - DNA, 20 bp, Artificial Sequence
  chemically synthesized
tctttgcagcaattgtgaat

SEQ ID NO: 44546 - DNA, 20 bp, Artificial Sequence
  chemically synthesized
tttgcagcaattgtgaatgg

SEQ ID NO: 44547 - DNA, 20 bp, Artificial Sequence
  chemically synthesized
atgggagttcacccatgatt

SEQ ID NO: 44548 - DNA, 20 bp, Artificial Sequence
  chemically synthesized
gctctctgcttgtctattat

SEQ ID NO: 44549 - DNA, 20 bp, Artificial Sequence
  chemically synthesized
gcttgtctattattggtgta

SEQ ID NO: 44550 - DNA, 20 bp, Artificial Sequence
  chemically synthesized
cttgtctattattggtgtat

SEQ ID NO: 44551 - DNA, 20 bp, Artificial Sequence
  chemically synthesized
gcacactgattttgtatctt

SEQ ID NO: 44552 - DNA, 20 bp, Artificial Sequence
  chemically synthesized
tgtatcttgagactttgctg

SEQ ID NO: 44553 - DNA, 20 bp, Artificial Sequence
  chemically synthesized
actttgctgaagctgtttat

SEQ ID NO: 44554 - DNA, 20 bp, Artificial Sequence
  chemically synthesized
ctgaagctgtttatcagctt

SEQ ID NO: 44555 - DNA, 20 bp, Artificial Sequence
  chemically synthesized
tgtttatcagcttaagattt

SEQ ID NO: 44556 - DNA, 20 bp, Artificial Sequence
  chemically synthesized
gtttatcagcttaagatttt

SEQ ID NO: 44557 - DNA, 20 bp, Artificial Sequence
  chemically synthesized
tcagcttaagattttgggct

SEQ ID NO: 44558 - DNA, 20 bp, Artificial Sequence
  chemically synthesized
aagattttgggctgagatga

SEQ ID NO: 44559 - DNA, 20 bp, Artificial Sequence
  chemically synthesized
agattttgggctgagatgac

SEQ ID NO: 44560 - DNA, 20 bp, Artificial Sequence
  chemically synthesized
gattttgggctgagatgaca

SEQ ID NO: 44561 - DNA, 20 bp, Artificial Sequence
  chemically synthesized
acaatcatgtcatctgcaaa

SEQ ID NO: 44562 - DNA, 20 bp, Artificial Sequence
  chemically synthesized
aatcatgtcatctgcaaaca

SEQ ID NO: 44563 - DNA, 20 bp, Artificial Sequence
  chemically synthesized
tttctcttgcctgattgtcc

SEQ ID NO: 44564 - DNA, 20 bp, Artificial Sequence
  chemically synthesized
tcttgcctgattgtcctggc

SEQ ID NO: 44565 - DNA, 20 bp, Artificial Sequence
  chemically synthesized
agaacttccaatactatgtt

SEQ ID NO: 44566 - DNA, 20 bp, Artificial Sequence
  chemically synthesized
cttccaatactatgttgagt

SEQ ID NO: 44567 - DNA, 20 bp, Artificial Sequence
  chemically synthesized
tccaatactatgttgagtaa

SEQ ID NO: 44568 - DNA, 20 bp, Artificial Sequence
  chemically synthesized
aatactatgttgagtaagag

SEQ ID NO: 44569 - DNA, 20 bp, Artificial Sequence
  chemically synthesized
ctatgttgagtaagagtggc

SEQ ID NO: 44570 - DNA, 20 bp, Artificial Sequence
  chemically synthesized
atgttgagtaagagtggcga

SEQ ID NO: 44571 - DNA, 20 bp, Artificial Sequence
  chemically synthesized
tgttgagtaagagtggcgag

SEQ ID NO: 44572 - DNA, 20 bp, Artificial Sequence
  chemically synthesized
gttgagtaagagtggcgaga

SEQ ID NO: 44573 - DNA, 20 bp, Artificial Sequence
  chemically synthesized
agggcatccttgtcttgtgc

SEQ ID NO: 44574 - DNA, 20 bp, Artificial Sequence
  chemically synthesized
ttgtcttgtgccggttttca

SEQ ID NO: 44575 - DNA, 20 bp, Artificial Sequence
  chemically synthesized
ttgttgacccaatgatcatt

SEQ ID NO: 44576 - DNA, 20 bp, Artificial Sequence
  chemically synthesized
tgttgacccaatgatcattc

SEQ ID NO: 44577 - DNA, 20 bp, Artificial Sequence
  chemically synthesized
ttgacccaatgatcattcag

SEQ ID NO: 44578 - DNA, 20 bp, Artificial Sequence
  chemically synthesized
acccaatgatcattcaggag

SEQ ID NO: 44579 - DNA, 20 bp, Artificial Sequence
  chemically synthesized
cccaatgatcattcaggagc

SEQ ID NO: 44580 - DNA, 20 bp, Artificial Sequence
  chemically synthesized
ttaatttccctgtatttgca

SEQ ID NO: 44581 - DNA, 20 bp, Artificial Sequence
  chemically synthesized
cctgtatttgcatggttttg

SEQ ID NO: 44582 - DNA, 20 bp, Artificial Sequence
  chemically synthesized
ctgtatttgcatggttttga

SEQ ID NO: 44583 - DNA, 20 bp, Artificial Sequence
  chemically synthesized
ggttttgaaggttccttttg

SEQ ID NO: 44584 - DNA, 20 bp, Artificial Sequence
  chemically synthesized
tttccaattttattctactg

SEQ ID NO: 44585 - DNA, 20 bp, Artificial Sequence
  chemically synthesized
attttattctactgtggtct

SEQ ID NO: 44586 - DNA, 20 bp, Artificial Sequence
  chemically synthesized
tttattctactgtggtctga

SEQ ID NO: 44587 - DNA, 20 bp, Artificial Sequence
  chemically synthesized
tattctactgtggtctgaga

SEQ ID NO: 44588 - DNA, 20 bp, Artificial Sequence
  chemically synthesized
tcaatttttaaaaatttatt

SEQ ID NO: 44589 - DNA, 20 bp, Artificial Sequence
  chemically synthesized
caatttttaaaaatttattg

SEQ ID NO: 44590 - DNA, 20 bp, Artificial Sequence
  chemically synthesized
atttattgaggcttgttttg

SEQ ID NO: 44591 - DNA, 20 bp, Artificial Sequence
  chemically synthesized
ttgttttgtggcatatcata

SEQ ID NO: 44592 - DNA, 20 bp, Artificial Sequence
  chemically synthesized
gcatatcatatggcctatct

SEQ ID NO: 44593 - DNA, 20 bp, Artificial Sequence
  chemically synthesized
atatcatatggcctatcttg

SEQ ID NO: 44594 - DNA, 20 bp, Artificial Sequence
  chemically synthesized
catatggcctatcttggaga

SEQ ID NO: 44595 - DNA, 20 bp, Artificial Sequence
  chemically synthesized
aagttccatgtgctgatgaa

SEQ ID NO: 44596 - DNA, 20 bp, Artificial Sequence
  chemically synthesized
tgaatagaatgtgtattctg

SEQ ID NO: 44597 - DNA, 20 bp, Artificial Sequence
  chemically synthesized
aatgtgtattctgcagttgt

SEQ ID NO: 44598 - DNA, 20 bp, Artificial Sequence
  chemically synthesized
atgtgtattctgcagttgtt

SEQ ID NO: 44599 - DNA, 20 bp, Artificial Sequence
  chemically synthesized
tgtattctgcagttgttggg

SEQ ID NO: 44600 - DNA, 20 bp, Artificial Sequence
  chemically synthesized
atgtcctgtaaatatctgtt

SEQ ID NO: 44601 - DNA, 20 bp, Artificial Sequence
  chemically synthesized
ttaaatccattgtttctttg

SEQ ID NO: 44602 - DNA, 20 bp, Artificial Sequence
  chemically synthesized
gactgtcttgatgacctgcc

SEQ ID NO: 44603 - DNA, 20 bp, Artificial Sequence
  chemically synthesized
tcttgatgacctgcctagtg

SEQ ID NO: 44604 - DNA, 20 bp, Artificial Sequence
  chemically synthesized
gatgacctgcctagtgcagt

SEQ ID NO: 44605 - DNA, 20 bp, Artificial Sequence
  chemically synthesized
gacctgcctagtgcagtcag

SEQ ID NO: 44606 - DNA, 20 bp, Artificial Sequence
  chemically synthesized
cctgcctagtgcagtcagtg

SEQ ID NO: 44607 - DNA, 20 bp, Artificial Sequence
  chemically synthesized
gtgcagtcagtggagtattg

SEQ ID NO: 44608 - DNA, 20 bp, Artificial Sequence
  chemically synthesized
actattattatgttgctgtc

SEQ ID NO: 44609 - DNA, 20 bp, Artificial Sequence
  chemically synthesized
tattatgttgctgtctagtc

SEQ ID NO: 44610 - DNA, 20 bp, Artificial Sequence
  chemically synthesized
tatgttgctgtctagtctag

SEQ ID NO: 44611 - DNA, 20 bp, Artificial Sequence
  chemically synthesized
tagtaattgttttataaatt

SEQ ID NO: 44612 - DNA, 20 bp, Artificial Sequence
  chemically synthesized
agtaattgttttataaattt

SEQ ID NO: 44613 - DNA, 20 bp, Artificial Sequence
  chemically synthesized
ttttataaatttgggatctc

SEQ ID NO: 44614 - DNA, 20 bp, Artificial Sequence
  chemically synthesized
aaatttgggatctccagtat

SEQ ID NO: 44615 - DNA, 20 bp, Artificial Sequence
  chemically synthesized
gtattagatgcatatatatt

SEQ ID NO: 44616 - DNA, 20 bp, Artificial Sequence
  chemically synthesized
gaattgtaatattctcccat

SEQ ID NO: 44617 - DNA, 20 bp, Artificial Sequence
  chemically synthesized
gtaatattctcccattggac

SEQ ID NO: 44618 - DNA, 20 bp, Artificial Sequence
  chemically synthesized
taatattctcccattggaca

SEQ ID NO: 44619 - DNA, 20 bp, Artificial Sequence
  chemically synthesized
aatattctcccattggacaa

SEQ ID NO: 44620 - DNA, 20 bp, Artificial Sequence
  chemically synthesized
ttttaactgctgtttcttta

SEQ ID NO: 44621 - DNA, 20 bp, Artificial Sequence
  chemically synthesized
aagtttgttttgtctgacat

SEQ ID NO: 44622 - DNA, 20 bp, Artificial Sequence
  chemically synthesized
tgttttgtctgacataagaa

SEQ ID NO: 44623 - DNA, 20 bp, Artificial Sequence
  chemically synthesized
tgacataagaatagctgctt

SEQ ID NO: 44624 - DNA, 20 bp, Artificial Sequence
  chemically synthesized
tagctgctttggctcgcttt

SEQ ID NO: 44625 - DNA, 20 bp, Artificial Sequence
  chemically synthesized
gcttttggtgtccatttgtg

SEQ ID NO: 44626 - DNA, 20 bp, Artificial Sequence
  chemically synthesized
attttccacccctttacctt

SEQ ID NO: 44627 - DNA, 20 bp, Artificial Sequence
  chemically synthesized
cctttaccttaagtttatgt

SEQ ID NO: 44628 - DNA, 20 bp, Artificial Sequence
  chemically synthesized
ttatgtgagtccttatgtgt

SEQ ID NO: 44629 - DNA, 20 bp, Artificial Sequence
  chemically synthesized
tatgtgagtccttatgtgtt

SEQ ID NO: 44630 - DNA, 20 bp, Artificial Sequence
  chemically synthesized
tgagtccttatgtgttaggt

SEQ ID NO: 44631 - DNA, 20 bp, Artificial Sequence
  chemically synthesized
tgtgttaggtgagtctcctg

SEQ ID NO: 44632 - DNA, 20 bp, Artificial Sequence
  chemically synthesized
gtgttaggtgagtctcctga

SEQ ID NO: 44633 - DNA, 20 bp, Artificial Sequence
  chemically synthesized
ttaggtgagtctcctgaagg

SEQ ID NO: 44634 - DNA, 20 bp, Artificial Sequence
  chemically synthesized
ggtgagtctcctgaaggcgg

SEQ ID NO: 44635 - DNA, 20 bp, Artificial Sequence
  chemically synthesized
tcctgaaggcggcagataac

SEQ ID NO: 44636 - DNA, 20 bp, Artificial Sequence
  chemically synthesized
gaaggcggcagataactggt

SEQ ID NO: 44637 - DNA, 20 bp, Artificial Sequence
  chemically synthesized
tctgcaattctgtatctttt

SEQ ID NO: 44638 - DNA, 20 bp, Artificial Sequence
  chemically synthesized
gcaattctgtatcttttaag

SEQ ID NO: 44639 - DNA, 20 bp, Artificial Sequence
  chemically synthesized
aattctgtatcttttaagtg

SEQ ID NO: 44640 - DNA, 20 bp, Artificial Sequence
  chemically synthesized
tatcttttaagtggagcatt

SEQ ID NO: 44641 - DNA, 20 bp, Artificial Sequence
  chemically synthesized
agtccatttacattcaacat

SEQ ID NO: 44642 - DNA, 20 bp, Artificial Sequence
  chemically synthesized
ttacattcaacatcagtatt

SEQ ID NO: 44643 - DNA, 20 bp, Artificial Sequence
  chemically synthesized
tacattcaacatcagtattg

SEQ ID NO: 44644 - DNA, 20 bp, Artificial Sequence
  chemically synthesized
caacatcagtattgaggtgt

SEQ ID NO: 44645 - DNA, 20 bp, Artificial Sequence
  chemically synthesized
aacatcagtattgaggtgtg

SEQ ID NO: 44646 - DNA, 20 bp, Artificial Sequence
  chemically synthesized
aggtactattccattcttcg

SEQ ID NO: 44647 - DNA, 20 bp, Artificial Sequence
  chemically synthesized
tttttgttgtatatgtccta

SEQ ID NO: 44648 - DNA, 20 bp, Artificial Sequence
  chemically synthesized
ttttgttgtatatgtcctat

SEQ ID NO: 44649 - DNA, 20 bp, Artificial Sequence
  chemically synthesized
cctatgggatttatgcttta

SEQ ID NO: 44650 - DNA, 20 bp, Artificial Sequence
  chemically synthesized
tatgggatttatgctttaaa

SEQ ID NO: 44651 - DNA, 20 bp, Artificial Sequence
  chemically synthesized
atgggatttatgctttaaag

SEQ ID NO: 44652 - DNA, 20 bp, Artificial Sequence
  chemically synthesized
gttctgttttgatgtgcttc

SEQ ID NO: 44653 - DNA, 20 bp, Artificial Sequence
  chemically synthesized
ttctgttttgatgtgcttcc

SEQ ID NO: 44654 - DNA, 20 bp, Artificial Sequence
  chemically synthesized
tctgttttgatgtgcttcca

SEQ ID NO: 44655 - DNA, 20 bp, Artificial Sequence
  chemically synthesized
gtgcttccagggtttatttc

SEQ ID NO: 44656 - DNA, 20 bp, Artificial Sequence
  chemically synthesized
ccagggtttatttcaagatt

SEQ ID NO: 44657 - DNA, 20 bp, Artificial Sequence
  chemically synthesized
agggtttatttcaagattta

SEQ ID NO: 44658 - DNA, 20 bp, Artificial Sequence
  chemically synthesized
agatttagagctccttttat

SEQ ID NO: 44659 - DNA, 20 bp, Artificial Sequence
  chemically synthesized
gctccttttatcagttcttg

SEQ ID NO: 44660 - DNA, 20 bp, Artificial Sequence
  chemically synthesized
tttatcagttcttgtagtgt

SEQ ID NO: 44661 - DNA, 20 bp, Artificial Sequence
  chemically synthesized
cagttcttgtagtgttggct

SEQ ID NO: 44662 - DNA, 20 bp, Artificial Sequence
  chemically synthesized
ttcttgtagtgttggcttgg

SEQ ID NO: 44663 - DNA, 20 bp, Artificial Sequence
  chemically synthesized
ttggtagtgccgaattctct

SEQ ID NO: 44664 - DNA, 20 bp, Artificial Sequence
  chemically synthesized
gtgtattttcttcatttgtg

SEQ ID NO: 44665 - DNA, 20 bp, Artificial Sequence
  chemically synthesized
ttttcttcatttgtgaagct

SEQ ID NO: 44666 - DNA, 20 bp, Artificial Sequence
  chemically synthesized
tttgtgaagcttagtttcac

SEQ ID NO: 44667 - DNA, 20 bp, Artificial Sequence
  chemically synthesized
ttcactggatataaaattct

SEQ ID NO: 44668 - DNA, 20 bp, Artificial Sequence
  chemically synthesized
ggctgataattgttttgttt

SEQ ID NO: 44669 - DNA, 20 bp, Artificial Sequence
  chemically synthesized
tgataattgttttgtttaag

SEQ ID NO: 44670 - DNA, 20 bp, Artificial Sequence
  chemically synthesized
gataattgttttgtttaaga

SEQ ID NO: 44671 - DNA, 20 bp, Artificial Sequence
  chemically synthesized
tgttttgtttaagaaggctg

SEQ ID NO: 44672 - DNA, 20 bp, Artificial Sequence
  chemically synthesized
ttgtttaagaaggctgaaga

SEQ ID NO: 44673 - DNA, 20 bp, Artificial Sequence
  chemically synthesized
tgtttaagaaggctgaagat

SEQ ID NO: 44674 - DNA, 20 bp, Artificial Sequence
  chemically synthesized
gtttaagaaggctgaagata

SEQ ID NO: 44675 - DNA, 20 bp, Artificial Sequence
  chemically synthesized
gatagggccatattcacttc

SEQ ID NO: 44676 - DNA, 20 bp, Artificial Sequence
  chemically synthesized
atattcacttctagctttta

SEQ ID NO: 44677 - DNA, 20 bp, Artificial Sequence
  chemically synthesized
tagcttttacggtttctgct

SEQ ID NO: 44678 - DNA, 20 bp, Artificial Sequence
  chemically synthesized
gaaatctgctgttaatctga

SEQ ID NO: 44679 - DNA, 20 bp, Artificial Sequence
  chemically synthesized
aaatctgctgttaatctgat

SEQ ID NO: 44680 - DNA, 20 bp, Artificial Sequence
  chemically synthesized
atctgataggttttctttca

SEQ ID NO: 44681 - DNA, 20 bp, Artificial Sequence
  chemically synthesized
tctgataggttttctttcat

SEQ ID NO: 44682 - DNA, 20 bp, Artificial Sequence
  chemically synthesized
gttttctttcataggttacc

SEQ ID NO: 44683 - DNA, 20 bp, Artificial Sequence
  chemically synthesized
ttctttcataggttacctgg

SEQ ID NO: 44684 - DNA, 20 bp, Artificial Sequence
  chemically synthesized
tacctggtagtttcacctca

SEQ ID NO: 44685 - DNA, 20 bp, Artificial Sequence
  chemically synthesized
agtttcacctcacagctctt

SEQ ID NO: 44686 - DNA, 20 bp, Artificial Sequence
  chemically synthesized
cttaagattctctttgtctt

SEQ ID NO: 44687 - DNA, 20 bp, Artificial Sequence
  chemically synthesized
tctttgtctttagataactt

SEQ ID NO: 44688 - DNA, 20 bp, Artificial Sequence
  chemically synthesized
tactctgatgacaatgtacc

SEQ ID NO: 44689 - DNA, 20 bp, Artificial Sequence
  chemically synthesized
actctgatgacaatgtacct

SEQ ID NO: 44690 - DNA, 20 bp, Artificial Sequence
  chemically synthesized
tatttttgcaatgaatttcc

SEQ ID NO: 44691 - DNA, 20 bp, Artificial Sequence
  chemically synthesized
atttttgcaatgaatttccc

SEQ ID NO: 44692 - DNA, 20 bp, Artificial Sequence
  chemically synthesized
gaatttcccaggtgtttatt

SEQ ID NO: 44693 - DNA, 20 bp, Artificial Sequence
  chemically synthesized
tttattgagcttcttgtatt

SEQ ID NO: 44694 - DNA, 20 bp, Artificial Sequence
  chemically synthesized
gcttcttgtatttggatatc

SEQ ID NO: 44695 - DNA, 20 bp, Artificial Sequence
  chemically synthesized
cttcttgtatttggatatct

SEQ ID NO: 44696 - DNA, 20 bp, Artificial Sequence
  chemically synthesized
tatttggatatctaggtctc

SEQ ID NO: 44697 - DNA, 20 bp, Artificial Sequence
  chemically synthesized
tggatatctaggtctctagc

SEQ ID NO: 44698 - DNA, 20 bp, Artificial Sequence
  chemically synthesized
ggatatctaggtctctagca

SEQ ID NO: 44699 - DNA, 20 bp, Artificial Sequence
  chemically synthesized
tatctaggtctctagcaagg

SEQ ID NO: 44700 - DNA, 20 bp, Artificial Sequence
  chemically synthesized
atctaggtctctagcaaggt

SEQ ID NO: 44701 - DNA, 20 bp, Artificial Sequence
  chemically synthesized
tctaggtctctagcaaggtg

SEQ ID NO: 44702 - DNA, 20 bp, Artificial Sequence
  chemically synthesized
ctaggtctctagcaaggtgg

SEQ ID NO: 44703 - DNA, 20 bp, Artificial Sequence
  chemically synthesized
ggtctctagcaaggtggggg

SEQ ID NO: 44704 - DNA, 20 bp, Artificial Sequence
  chemically synthesized
gttttccttgattatttccc

SEQ ID NO: 44705 - DNA, 20 bp, Artificial Sequence
  chemically synthesized
ccttgattatttccctggat

SEQ ID NO: 44706 - DNA, 20 bp, Artificial Sequence
  chemically synthesized
ggataagttttccaaacttt

SEQ ID NO: 44707 - DNA, 20 bp, Artificial Sequence
  chemically synthesized
tttagatttctcttctttct

SEQ ID NO: 44708 - DNA, 20 bp, Artificial Sequence
  chemically synthesized
ttagatttctcttctttctc

SEQ ID NO: 44709 - DNA, 20 bp, Artificial Sequence
  chemically synthesized
tcaggaatgctgattattct

SEQ ID NO: 44710 - DNA, 20 bp, Artificial Sequence
  chemically synthesized
caggaatgctgattattctt

SEQ ID NO: 44711 - DNA, 20 bp, Artificial Sequence
  chemically synthesized
ttgattgtttaacataatcc

SEQ ID NO: 44712 - DNA, 20 bp, Artificial Sequence
  chemically synthesized
taacataatcccagatttct

SEQ ID NO: 44713 - DNA, 20 bp, Artificial Sequence
  chemically synthesized
acataatcccagatttcttg

SEQ ID NO: 44714 - DNA, 20 bp, Artificial Sequence
  chemically synthesized
cataatcccagatttcttgg

SEQ ID NO: 44715 - DNA, 20 bp, Artificial Sequence
  chemically synthesized
tcttttttctttgtctttgt

SEQ ID NO: 44716 - DNA, 20 bp, Artificial Sequence
  chemically synthesized
tttctttgtctttgttggat

SEQ ID NO: 44717 - DNA, 20 bp, Artificial Sequence
  chemically synthesized
ttctttgtctttgttggatt

SEQ ID NO: 44718 - DNA, 20 bp, Artificial Sequence
  chemically synthesized
aattcaaaaactttgtcttc

SEQ ID NO: 44719 - DNA, 20 bp, Artificial Sequence
  chemically synthesized
agctctgaatttcttctgct

SEQ ID NO: 44720 - DNA, 20 bp, Artificial Sequence
  chemically synthesized
tctgcttggattctattgct

SEQ ID NO: 44721 - DNA, 20 bp, Artificial Sequence
  chemically synthesized
attctattgctgagactttc

SEQ ID NO: 44722 - DNA, 20 bp, Artificial Sequence
  chemically synthesized
tctattgctgagactttcta

SEQ ID NO: 44723 - DNA, 20 bp, Artificial Sequence
  chemically synthesized
agagcattttgcatttctat

SEQ ID NO: 44724 - DNA, 20 bp, Artificial Sequence
  chemically synthesized
cattcatccattgtttcctg

SEQ ID NO: 44725 - DNA, 20 bp, Artificial Sequence
  chemically synthesized
ttatgctatctctttaactg

SEQ ID NO: 44726 - DNA, 20 bp, Artificial Sequence
  chemically synthesized
catttcttgtatcatatttt

SEQ ID NO: 44727 - DNA, 20 bp, Artificial Sequence
  chemically synthesized
atttttggtttttttaaaat

SEQ ID NO: 44728 - DNA, 20 bp, Artificial Sequence
  chemically synthesized
aaattggacttcaccttcct

SEQ ID NO: 44729 - DNA, 20 bp, Artificial Sequence
  chemically synthesized
tcctcggatgcctccttgat

SEQ ID NO: 44730 - DNA, 20 bp, Artificial Sequence
  chemically synthesized
tgaccttctgaattattttt

SEQ ID NO: 44731 - DNA, 20 bp, Artificial Sequence
  chemically synthesized
gaccttctgaattatttttc

SEQ ID NO: 44732 - DNA, 20 bp, Artificial Sequence
  chemically synthesized
gaattatttttcaggtaaat

SEQ ID NO: 44733 - DNA, 20 bp, Artificial Sequence
  chemically synthesized
aattatttttcaggtaaatc

SEQ ID NO: 44734 - DNA, 20 bp, Artificial Sequence
  chemically synthesized
attatttttcaggtaaatca

SEQ ID NO: 44735 - DNA, 20 bp, Artificial Sequence
  chemically synthesized
gtaaatcagggatttcttct

SEQ ID NO: 44736 - DNA, 20 bp, Artificial Sequence
  chemically synthesized
tcagggatttcttcttggtt

SEQ ID NO: 44737 - DNA, 20 bp, Artificial Sequence
  chemically synthesized
tcttggtttggatgcattgc

SEQ ID NO: 44738 - DNA, 20 bp, Artificial Sequence
  chemically synthesized
ggtttggatgcattgctggt

SEQ ID NO: 44739 - DNA, 20 bp, Artificial Sequence
  chemically synthesized
tggatgcattgctggtgagc

SEQ ID NO: 44740 - DNA, 20 bp, Artificial Sequence
  chemically synthesized
ggtgagctagtatgattttt

SEQ ID NO: 44741 - DNA, 20 bp, Artificial Sequence
  chemically synthesized
gtgagctagtatgatttttt

SEQ ID NO: 44742 - DNA, 20 bp, Artificial Sequence
  chemically synthesized
tgagctagtatgattttttg

SEQ ID NO: 44743 - DNA, 20 bp, Artificial Sequence
  chemically synthesized
gagctagtatgattttttgg

SEQ ID NO: 44744 - DNA, 20 bp, Artificial Sequence
  chemically synthesized
agctagtatgattttttggg

SEQ ID NO: 44745 - DNA, 20 bp, Artificial Sequence
  chemically synthesized
tgattttttggggggtgtta

SEQ ID NO: 44746 - DNA, 20 bp, Artificial Sequence
  chemically synthesized
aaccttgtttttcatattac

SEQ ID NO: 44747 - DNA, 20 bp, Artificial Sequence
  chemically synthesized
ccttgtttttcatattacca

SEQ ID NO: 44748 - DNA, 20 bp, Artificial Sequence
  chemically synthesized
gtttttcatattaccagagt

SEQ ID NO: 44749 - DNA, 20 bp, Artificial Sequence
  chemically synthesized
tattaccagagttagttttc

SEQ ID NO: 44750 - DNA, 20 bp, Artificial Sequence
  chemically synthesized
ttttctggttccttctcact

SEQ ID NO: 44751 - DNA, 20 bp, Artificial Sequence
  chemically synthesized
tttctggttccttctcactt

SEQ ID NO: 44752 - DNA, 20 bp, Artificial Sequence
  chemically synthesized
ctggttccttctcacttggg

SEQ ID NO: 44753 - DNA, 20 bp, Artificial Sequence
  chemically synthesized
tggttccttctcacttgggt

SEQ ID NO: 44754 - DNA, 20 bp, Artificial Sequence
  chemically synthesized
ctcacttgggtaggctctgt

SEQ ID NO: 44755 - DNA, 20 bp, Artificial Sequence
  chemically synthesized
cacttgggtaggctctgtca

SEQ ID NO: 44756 - DNA, 20 bp, Artificial Sequence
  chemically synthesized
acttgggtaggctctgtcag

SEQ ID NO: 44757 - DNA, 20 bp, Artificial Sequence
  chemically synthesized
cttgggtaggctctgtcaga

SEQ ID NO: 44758 - DNA, 20 bp, Artificial Sequence
  chemically synthesized
ggtaggctctgtcagaggga

SEQ ID NO: 44759 - DNA, 20 bp, Artificial Sequence
  chemically synthesized
gctctgtcagagggaaagtc

SEQ ID NO: 44760 - DNA, 20 bp, Artificial Sequence
  chemically synthesized
ctctgtcagagggaaagtct

SEQ ID NO: 44761 - DNA, 20 bp, Artificial Sequence
  chemically synthesized
agagggaaagtctaggcctc

SEQ ID NO: 44762 - DNA, 20 bp, Artificial Sequence
  chemically synthesized
gagggaaagtctaggcctca

SEQ ID NO: 44763 - DNA, 20 bp, Artificial Sequence
  chemically synthesized
aaagtctaggcctcaaggct

SEQ ID NO: 44764 - DNA, 20 bp, Artificial Sequence
  chemically synthesized
ggctgagacttttgtcccat

SEQ ID NO: 44765 - DNA, 20 bp, Artificial Sequence
  chemically synthesized
gctgagacttttgtcccatg

SEQ ID NO: 44766 - DNA, 20 bp, Artificial Sequence
  chemically synthesized
catgaggtgttcccttgatg

SEQ ID NO: 44767 - DNA, 20 bp, Artificial Sequence
  chemically synthesized
ggtgttcccttgatgtagca

SEQ ID NO: 44768 - DNA, 20 bp, Artificial Sequence
  chemically synthesized
tagcacagtcccccttttcc

SEQ ID NO: 44769 - DNA, 20 bp, Artificial Sequence
  chemically synthesized
agcacagtcccccttttcct

SEQ ID NO: 44770 - DNA, 20 bp, Artificial Sequence
  chemically synthesized
agtcccccttttcctaggcg

SEQ ID NO: 44771 - DNA, 20 bp, Artificial Sequence
  chemically synthesized
gtcccccttttcctaggcgt

SEQ ID NO: 44772 - DNA, 20 bp, Artificial Sequence
  chemically synthesized
tcccccttttcctaggcgtg

SEQ ID NO: 44773 - DNA, 20 bp, Artificial Sequence
  chemically synthesized
tcctaggcgtggggcttcct

SEQ ID NO: 44774 - DNA, 20 bp, Artificial Sequence
  chemically synthesized
ctaggcgtggggcttcctga

SEQ ID NO: 44775 - DNA, 20 bp, Artificial Sequence
  chemically synthesized
gcttcctgagagccgaactg

SEQ ID NO: 44776 - DNA, 20 bp, Artificial Sequence
  chemically synthesized
agtgattgttatctctcttc

SEQ ID NO: 44777 - DNA, 20 bp, Artificial Sequence
  chemically synthesized
tgttatctctcttctggatc

SEQ ID NO: 44778 - DNA, 20 bp, Artificial Sequence
  chemically synthesized
ttctggatctagccacccat

SEQ ID NO: 44779 - DNA, 20 bp, Artificial Sequence
  chemically synthesized
tctggatctagccacccatc

SEQ ID NO: 44780 - DNA, 20 bp, Artificial Sequence
  chemically synthesized
tagccacccatcaggtctac

SEQ ID NO: 44781 - DNA, 20 bp, Artificial Sequence
  chemically synthesized
ccatcaggtctaccagactc

SEQ ID NO: 44782 - DNA, 20 bp, Artificial Sequence
  chemically synthesized
catcaggtctaccagactcc

SEQ ID NO: 44783 - DNA, 20 bp, Artificial Sequence
  chemically synthesized
aggtctaccagactccaggc

SEQ ID NO: 44784 - DNA, 20 bp, Artificial Sequence
  chemically synthesized
accagactccaggctggtac

SEQ ID NO: 44785 - DNA, 20 bp, Artificial Sequence
  chemically synthesized
ccagactccaggctggtact

SEQ ID NO: 44786 - DNA, 20 bp, Artificial Sequence
  chemically synthesized
cagactccaggctggtactg

SEQ ID NO: 44787 - DNA, 20 bp, Artificial Sequence
  chemically synthesized
ggtactggggtttgtctgca

SEQ ID NO: 44788 - DNA, 20 bp, Artificial Sequence
  chemically synthesized
tactggggtttgtctgcaca

SEQ ID NO: 44789 - DNA, 20 bp, Artificial Sequence
  chemically synthesized
cttgtgacgtgaaccatctg

SEQ ID NO: 44790 - DNA, 20 bp, Artificial Sequence
  chemically synthesized
ttgtgacgtgaaccatctgt

SEQ ID NO: 44791 - DNA, 20 bp, Artificial Sequence
  chemically synthesized
tgaaccatctgtgggtctct

SEQ ID NO: 44792 - DNA, 20 bp, Artificial Sequence
  chemically synthesized
atctgtgggtctctcagcca

SEQ ID NO: 44793 - DNA, 20 bp, Artificial Sequence
  chemically synthesized
gatacaaccacctgctccaa

SEQ ID NO: 44794 - DNA, 20 bp, Artificial Sequence
  chemically synthesized
tacaaccacctgctccaatg

SEQ ID NO: 44795 - DNA, 20 bp, Artificial Sequence
  chemically synthesized
acaaccacctgctccaatgg

SEQ ID NO: 44796 - DNA, 20 bp, Artificial Sequence
  chemically synthesized
accacctgctccaatggagg

SEQ ID NO: 44797 - DNA, 20 bp, Artificial Sequence
  chemically synthesized
acctgctccaatggaggtgg

SEQ ID NO: 44798 - DNA, 20 bp, Artificial Sequence
  chemically synthesized
ctgctccaatggaggtggca

SEQ ID NO: 44799 - DNA, 20 bp, Artificial Sequence
  chemically synthesized
tgctccaatggaggtggcag

SEQ ID NO: 44800 - DNA, 20 bp, Artificial Sequence
  chemically synthesized
ggaggtggcagaggatgaaa

SEQ ID NO: 44801 - DNA, 20 bp, Artificial Sequence
  chemically synthesized
gaggatgaaatggactctgt

SEQ ID NO: 44802 - DNA, 20 bp, Artificial Sequence
  chemically synthesized
aggatgaaatggactctgtg

SEQ ID NO: 44803 - DNA, 20 bp, Artificial Sequence
  chemically synthesized
ggatgaaatggactctgtga

SEQ ID NO: 44804 - DNA, 20 bp, Artificial Sequence
  chemically synthesized
tctgtgagggtccttacttt

SEQ ID NO: 44805 - DNA, 20 bp, Artificial Sequence
  chemically synthesized
tcaatgcactatttttgtgc

SEQ ID NO: 44806 - DNA, 20 bp, Artificial Sequence
  chemically synthesized
tgcactatttttgtgctggt

SEQ ID NO: 44807 - DNA, 20 bp, Artificial Sequence
  chemically synthesized
tgtgctggttggcctcctgc

SEQ ID NO: 44808 - DNA, 20 bp, Artificial Sequence
  chemically synthesized
gtgctggttggcctcctgcc

SEQ ID NO: 44809 - DNA, 20 bp, Artificial Sequence
  chemically synthesized
gctggttggcctcctgccag

SEQ ID NO: 44810 - DNA, 20 bp, Artificial Sequence
  chemically synthesized
ctggttggcctcctgccagg

SEQ ID NO: 44811 - DNA, 20 bp, Artificial Sequence
  chemically synthesized
gttggcctcctgccaggagg

SEQ ID NO: 44812 - DNA, 20 bp, Artificial Sequence
  chemically synthesized
tgccaggaggtggcactttc

SEQ ID NO: 44813 - DNA, 20 bp, Artificial Sequence
  chemically synthesized
aggaggtggcactttctaga

SEQ ID NO: 44814 - DNA, 20 bp, Artificial Sequence
  chemically synthesized
tggcactttctagaaagcat

SEQ ID NO: 44815 - DNA, 20 bp, Artificial Sequence
  chemically synthesized
cactttctagaaagcatcag

SEQ ID NO: 44816 - DNA, 20 bp, Artificial Sequence
  chemically synthesized
ctttctagaaagcatcagca

SEQ ID NO: 44817 - DNA, 20 bp, Artificial Sequence
  chemically synthesized
tttctagaaagcatcagcag

SEQ ID NO: 44818 - DNA, 20 bp, Artificial Sequence
  chemically synthesized
ctagaaagcatcagcagagg

SEQ ID NO: 44819 - DNA, 20 bp, Artificial Sequence
  chemically synthesized
aaagcatcagcagaggcagt

SEQ ID NO: 44820 - DNA, 20 bp, Artificial Sequence
  chemically synthesized
aagcatcagcagaggcagtc

SEQ ID NO: 44821 - DNA, 20 bp, Artificial Sequence
  chemically synthesized
catcagcagaggcagtcagg

SEQ ID NO: 44822 - DNA, 20 bp, Artificial Sequence
  chemically synthesized
cagcagaggcagtcaggtgg

SEQ ID NO: 44823 - DNA, 20 bp, Artificial Sequence
  chemically synthesized
cagaggcagtcaggtggtgg

SEQ ID NO: 44824 - DNA, 20 bp, Artificial Sequence
  chemically synthesized
ggcagtcaggtggtggtggc

SEQ ID NO: 44825 - DNA, 20 bp, Artificial Sequence
  chemically synthesized
gcagtcaggtggtggtggct

SEQ ID NO: 44826 - DNA, 20 bp, Artificial Sequence
  chemically synthesized
cagtcaggtggtggtggctg

SEQ ID NO: 44827 - DNA, 20 bp, Artificial Sequence
  chemically synthesized
agtcaggtggtggtggctgg

SEQ ID NO: 44828 - DNA, 20 bp, Artificial Sequence
  chemically synthesized
gtcaggtggtggtggctggg

SEQ ID NO: 44829 - DNA, 20 bp, Artificial Sequence
  chemically synthesized
tcaggtggtggtggctgggg

SEQ ID NO: 44830 - DNA, 20 bp, Artificial Sequence
  chemically synthesized
gtggtggtggctgggggggc

SEQ ID NO: 44831 - DNA, 20 bp, Artificial Sequence
  chemically synthesized
tggtggtggctgggggggct

SEQ ID NO: 44832 - DNA, 20 bp, Artificial Sequence
  chemically synthesized
ggtggtggctgggggggctg

SEQ ID NO: 44833 - DNA, 20 bp, Artificial Sequence
  chemically synthesized
ctgggggggctggggcaccc

SEQ ID NO: 44834 - DNA, 20 bp, Artificial Sequence
  chemically synthesized
tggggcaccctagaactccc

SEQ ID NO: 44835 - DNA, 20 bp, Artificial Sequence
  chemically synthesized
gaatatatgccctttgtctt

SEQ ID NO: 44836 - DNA, 20 bp, Artificial Sequence
  chemically synthesized
tgccctttgtcttcagctac

SEQ ID NO: 44837 - DNA, 20 bp, Artificial Sequence
  chemically synthesized
gccctttgtcttcagctacc

SEQ ID NO: 44838 - DNA, 20 bp, Artificial Sequence
  chemically synthesized
ccctttgtcttcagctacca

SEQ ID NO: 44839 - DNA, 20 bp, Artificial Sequence
  chemically synthesized
ttgtcttcagctaccagggt

SEQ ID NO: 44840 - DNA, 20 bp, Artificial Sequence
  chemically synthesized
cttcagctaccagggtgagt

SEQ ID NO: 44841 - DNA, 20 bp, Artificial Sequence
  chemically synthesized
ttcagctaccagggtgagta

SEQ ID NO: 44842 - DNA, 20 bp, Artificial Sequence
  chemically synthesized
agctaccagggtgagtaagg

SEQ ID NO: 44843 - DNA, 20 bp, Artificial Sequence
  chemically synthesized
gctaccagggtgagtaagga

SEQ ID NO: 44844 - DNA, 20 bp, Artificial Sequence
  chemically synthesized
ggtgagtaaggaaggaccat

SEQ ID NO: 44845 - DNA, 20 bp, Artificial Sequence
  chemically synthesized
gtgagtaaggaaggaccatc

SEQ ID NO: 44846 - DNA, 20 bp, Artificial Sequence
  chemically synthesized
agtaaggaaggaccatcagg

SEQ ID NO: 44847 - DNA, 20 bp, Artificial Sequence
  chemically synthesized
gtaaggaaggaccatcaggt

SEQ ID NO: 44848 - DNA, 20 bp, Artificial Sequence
  chemically synthesized
taaggaaggaccatcaggtg

SEQ ID NO: 44849 - DNA, 20 bp, Artificial Sequence
  chemically synthesized
aaggaaggaccatcaggtgg

SEQ ID NO: 44850 - DNA, 20 bp, Artificial Sequence
  chemically synthesized
gaaggaccatcaggtggggg

SEQ ID NO: 44851 - DNA, 20 bp, Artificial Sequence
  chemically synthesized
aaggaccatcaggtgggggc

SEQ ID NO: 44852 - DNA, 20 bp, Artificial Sequence
  chemically synthesized
ccatcaggtgggggcaggac

SEQ ID NO: 44853 - DNA, 20 bp, Artificial Sequence
  chemically synthesized
gggcaggactagtcgtgtct

SEQ ID NO: 44854 - DNA, 20 bp, Artificial Sequence
  chemically synthesized
ggactagtcgtgtctgagct

SEQ ID NO: 44855 - DNA, 20 bp, Artificial Sequence
  chemically synthesized
actagtcgtgtctgagctca

SEQ ID NO: 44856 - DNA, 20 bp, Artificial Sequence
  chemically synthesized
gtctgagctcagagtctcct

SEQ ID NO: 44857 - DNA, 20 bp, Artificial Sequence
  chemically synthesized
tctgagctcagagtctcctt

SEQ ID NO: 44858 - DNA, 20 bp, Artificial Sequence
  chemically synthesized
gagctcagagtctccttggg

SEQ ID NO: 44859 - DNA, 20 bp, Artificial Sequence
  chemically synthesized
agctcagagtctccttgggc

SEQ ID NO: 44860 - DNA, 20 bp, Artificial Sequence
  chemically synthesized
tccttgggcaggtctttctg

SEQ ID NO: 44861 - DNA, 20 bp, Artificial Sequence
  chemically synthesized
aggtctttctgtggctactg

SEQ ID NO: 44862 - DNA, 20 bp, Artificial Sequence
  chemically synthesized
ggtctttctgtggctactgt

SEQ ID NO: 44863 - DNA, 20 bp, Artificial Sequence
  chemically synthesized
tctttctgtggctactgtgg

SEQ ID NO: 44864 - DNA, 20 bp, Artificial Sequence
  chemically synthesized
ctttctgtggctactgtggg

SEQ ID NO: 44865 - DNA, 20 bp, Artificial Sequence
  chemically synthesized
ctgtggctactgtgggagga

SEQ ID NO: 44866 - DNA, 20 bp, Artificial Sequence
  chemically synthesized
tgtggctactgtgggaggat

SEQ ID NO: 44867 - DNA, 20 bp, Artificial Sequence
  chemically synthesized
gtggctactgtgggaggatg

SEQ ID NO: 44868 - DNA, 20 bp, Artificial Sequence
  chemically synthesized
tggctactgtgggaggatgg

SEQ ID NO: 44869 - DNA, 20 bp, Artificial Sequence
  chemically synthesized
actgtgggaggatgggggtg

SEQ ID NO: 44870 - DNA, 20 bp, Artificial Sequence
  chemically synthesized
gaggatgggggtgtagtttc

SEQ ID NO: 44871 - DNA, 20 bp, Artificial Sequence
  chemically synthesized
aggatgggggtgtagtttcc

SEQ ID NO: 44872 - DNA, 20 bp, Artificial Sequence
  chemically synthesized
gggtgtagtttccaggtcaa

SEQ ID NO: 44873 - DNA, 20 bp, Artificial Sequence
  chemically synthesized
ggtcaatggatttatgttcc

SEQ ID NO: 44874 - DNA, 20 bp, Artificial Sequence
  chemically synthesized
gtcaatggatttatgttcct

SEQ ID NO: 44875 - DNA, 20 bp, Artificial Sequence
  chemically synthesized
ttatgttcctaggacaatta

SEQ ID NO: 44876 - DNA, 20 bp, Artificial Sequence
  chemically synthesized
gctgcctctgctgtgtcatg

SEQ ID NO: 44877 - DNA, 20 bp, Artificial Sequence
  chemically synthesized
ctgcctctgctgtgtcatgc

SEQ ID NO: 44878 - DNA, 20 bp, Artificial Sequence
  chemically synthesized
tgctgtgtcatgcaggtcat

SEQ ID NO: 44879 - DNA, 20 bp, Artificial Sequence
  chemically synthesized
gctgtgtcatgcaggtcatc

SEQ ID NO: 44880 - DNA, 20 bp, Artificial Sequence
  chemically synthesized
tgtcatgcaggtcatcagga

SEQ ID NO: 44881 - DNA, 20 bp, Artificial Sequence
  chemically synthesized
catgcaggtcatcaggaaag

SEQ ID NO: 44882 - DNA, 20 bp, Artificial Sequence
  chemically synthesized
atgcaggtcatcaggaaagt

SEQ ID NO: 44883 - DNA, 20 bp, Artificial Sequence
  chemically synthesized
tgcaggtcatcaggaaagtg

SEQ ID NO: 44884 - DNA, 20 bp, Artificial Sequence
  chemically synthesized
gcaggtcatcaggaaagtgg

SEQ ID NO: 44885 - DNA, 20 bp, Artificial Sequence
  chemically synthesized
gtcatcaggaaagtggggga

SEQ ID NO: 44886 - DNA, 20 bp, Artificial Sequence
  chemically synthesized
tcaggaaagtgggggaaagc

SEQ ID NO: 44887 - DNA, 20 bp, Artificial Sequence
  chemically synthesized
ggaaagtgggggaaagcaag

SEQ ID NO: 44888 - DNA, 20 bp, Artificial Sequence
  chemically synthesized
aagcagtcacgtgacttgcc

SEQ ID NO: 44889 - DNA, 20 bp, Artificial Sequence
  chemically synthesized
ccagctcccatgcaactcaa

SEQ ID NO: 44890 - DNA, 20 bp, Artificial Sequence
  chemically synthesized
cagctcccatgcaactcaaa

SEQ ID NO: 44891 - DNA, 20 bp, Artificial Sequence
  chemically synthesized
tcccatgcaactcaaaaggt

SEQ ID NO: 44892 - DNA, 20 bp, Artificial Sequence
  chemically synthesized
caaaaggttggtctcacttc

SEQ ID NO: 44893 - DNA, 20 bp, Artificial Sequence
  chemically synthesized
gcgtgcaccctcccccgcaa

SEQ ID NO: 44894 - DNA, 20 bp, Artificial Sequence
  chemically synthesized
gcaccgaatctgtttccatg

SEQ ID NO: 44895 - DNA, 20 bp, Artificial Sequence
  chemically synthesized
cgaatctgtttccatgcagt

SEQ ID NO: 44896 - DNA, 20 bp, Artificial Sequence
  chemically synthesized
tctgtttccatgcagtcagt

SEQ ID NO: 44897 - DNA, 20 bp, Artificial Sequence
  chemically synthesized
tttccatgcagtcagtgagc

SEQ ID NO: 44898 - DNA, 20 bp, Artificial Sequence
  chemically synthesized
ttccatgcagtcagtgagca

SEQ ID NO: 44899 - DNA, 20 bp, Artificial Sequence
  chemically synthesized
tgcagtcagtgagcaaggct

SEQ ID NO: 44900 - DNA, 20 bp, Artificial Sequence
  chemically synthesized
gcaaggctgagaacttgccc

SEQ ID NO: 44901 - DNA, 20 bp, Artificial Sequence
  chemically synthesized
caaggctgagaacttgcccc

SEQ ID NO: 44902 - DNA, 20 bp, Artificial Sequence
  chemically synthesized
gagaacttgccccaggctac

SEQ ID NO: 44903 - DNA, 20 bp, Artificial Sequence
  chemically synthesized
aggctaccagctgcgaaacc

SEQ ID NO: 44904 - DNA, 20 bp, Artificial Sequence
  chemically synthesized
ctaccagctgcgaaaccaag

SEQ ID NO: 44905 - DNA, 20 bp, Artificial Sequence
  chemically synthesized
taccagctgcgaaaccaagt

SEQ ID NO: 44906 - DNA, 20 bp, Artificial Sequence
  chemically synthesized
accagctgcgaaaccaagta

SEQ ID NO: 44907 - DNA, 20 bp, Artificial Sequence
  chemically synthesized
gggctgtcctacttccctgc

SEQ ID NO: 44908 - DNA, 20 bp, Artificial Sequence
  chemically synthesized
ctgtcctacttccctgccag

SEQ ID NO: 44909 - DNA, 20 bp, Artificial Sequence
  chemically synthesized
gtcctacttccctgccagtg

SEQ ID NO: 44910 - DNA, 20 bp, Artificial Sequence
  chemically synthesized
ccaccaacccccccactgcc

SEQ ID NO: 44911 - DNA, 20 bp, Artificial Sequence
  chemically synthesized
cccccccactgcccagcccc

SEQ ID NO: 44912 - DNA, 20 bp, Artificial Sequence
  chemically synthesized
cactgcccagcccctagatc

SEQ ID NO: 44913 - DNA, 20 bp, Artificial Sequence
  chemically synthesized
gcccagcccctagatctggc

SEQ ID NO: 44914 - DNA, 20 bp, Artificial Sequence
  chemically synthesized
cccagcccctagatctggcc

SEQ ID NO: 44915 - DNA, 20 bp, Artificial Sequence
  chemically synthesized
agcccctagatctggccagg

SEQ ID NO: 44916 - DNA, 20 bp, Artificial Sequence
  chemically synthesized
cccctagatctggccaggtg

SEQ ID NO: 44917 - DNA, 20 bp, Artificial Sequence
  chemically synthesized
tttttcctgtcatcttttcc

SEQ ID NO: 44918 - DNA, 20 bp, Artificial Sequence
  chemically synthesized
tcatcttttcccagttcctc

SEQ ID NO: 44919 - DNA, 20 bp, Artificial Sequence
  chemically synthesized
tcttttcccagttcctctgg

SEQ ID NO: 44920 - DNA, 20 bp, Artificial Sequence
  chemically synthesized
ccctcccaaatgacccctgt

SEQ ID NO: 44921 - DNA, 20 bp, Artificial Sequence
  chemically synthesized
cctcccaaatgacccctgtg

SEQ ID NO: 44922 - DNA, 20 bp, Artificial Sequence
  chemically synthesized
ccaaatgacccctgtgaggc

SEQ ID NO: 44923 - DNA, 20 bp, Artificial Sequence
  chemically synthesized
caaatgacccctgtgaggca

SEQ ID NO: 44924 - DNA, 20 bp, Artificial Sequence
  chemically synthesized
atgacccctgtgaggcaagg

SEQ ID NO: 44925 - DNA, 20 bp, Artificial Sequence
  chemically synthesized
cctgtgaggcaaggcagaaa

SEQ ID NO: 44926 - DNA, 20 bp, Artificial Sequence
  chemically synthesized
gcaaggcagaaatggcttcc

SEQ ID NO: 44927 - DNA, 20 bp, Artificial Sequence
  chemically synthesized
caaggcagaaatggcttcct

SEQ ID NO: 44928 - DNA, 20 bp, Artificial Sequence
  chemically synthesized
aaggcagaaatggcttccta

SEQ ID NO: 44929 - DNA, 20 bp, Artificial Sequence
  chemically synthesized
aggcagaaatggcttcctag

SEQ ID NO: 44930 - DNA, 20 bp, Artificial Sequence
  chemically synthesized
aaatggcttcctaggggacc

SEQ ID NO: 44931 - DNA, 20 bp, Artificial Sequence
  chemically synthesized
atggcttcctaggggaccca

SEQ ID NO: 44932 - DNA, 20 bp, Artificial Sequence
  chemically synthesized
ggcttcctaggggacccaga

SEQ ID NO: 44933 - DNA, 20 bp, Artificial Sequence
  chemically synthesized
taggggacccagagagccca

SEQ ID NO: 44934 - DNA, 20 bp, Artificial Sequence
  chemically synthesized
aggggacccagagagcccac

SEQ ID NO: 44935 - DNA, 20 bp, Artificial Sequence
  chemically synthesized
ggggacccagagagcccaca

SEQ ID NO: 44936 - DNA, 20 bp, Artificial Sequence
  chemically synthesized
ctctacccctgtattttgct

SEQ ID NO: 44937 - DNA, 20 bp, Artificial Sequence
  chemically synthesized
cttggccctctaaattgact

SEQ ID NO: 44938 - DNA, 20 bp, Artificial Sequence
  chemically synthesized
cctctaaattgactcagctc

SEQ ID NO: 44939 - DNA, 20 bp, Artificial Sequence
  chemically synthesized
ctctaaattgactcagctcc

SEQ ID NO: 44940 - DNA, 20 bp, Artificial Sequence
  chemically synthesized
aaattgactcagctccaggt

SEQ ID NO: 44941 - DNA, 20 bp, Artificial Sequence
  chemically synthesized
aattgactcagctccaggta

SEQ ID NO: 44942 - DNA, 20 bp, Artificial Sequence
  chemically synthesized
gactcagctccaggtaaggt

SEQ ID NO: 44943 - DNA, 20 bp, Artificial Sequence
  chemically synthesized
aaggtcagaatcttctcctg

SEQ ID NO: 44944 - DNA, 20 bp, Artificial Sequence
  chemically synthesized
cagaatcttctcctgtggtc

SEQ ID NO: 44945 - DNA, 20 bp, Artificial Sequence
  chemically synthesized
tctcctgtggtctagatctt

SEQ ID NO: 44946 - DNA, 20 bp, Artificial Sequence
  chemically synthesized
ctcctgtggtctagatcttc

SEQ ID NO: 44947 - DNA, 20 bp, Artificial Sequence
  chemically synthesized
gtctagatcttcaggttccc

SEQ ID NO: 44948 - DNA, 20 bp, Artificial Sequence
  chemically synthesized
agatcttcaggttccccagt

SEQ ID NO: 44949 - DNA, 20 bp, Artificial Sequence
  chemically synthesized
gatcttcaggttccccagtg

SEQ ID NO: 44950 - DNA, 20 bp, Artificial Sequence
  chemically synthesized
ccccagtgaggatgtgtgtt

SEQ ID NO: 44951 - DNA, 20 bp, Artificial Sequence
  chemically synthesized
cccagtgaggatgtgtgttt

SEQ ID NO: 44952 - DNA, 20 bp, Artificial Sequence
  chemically synthesized
ccagtgaggatgtgtgtttg

SEQ ID NO: 44953 - DNA, 20 bp, Artificial Sequence
  chemically synthesized
cagtgaggatgtgtgtttgg

SEQ ID NO: 44954 - DNA, 20 bp, Artificial Sequence
  chemically synthesized
tgaggatgtgtgtttggggg

SEQ ID NO: 44955 - DNA, 20 bp, Artificial Sequence
  chemically synthesized
gatgtgtgtttgggggtaga

SEQ ID NO: 44956 - DNA, 20 bp, Artificial Sequence
  chemically synthesized
gtcccccttttccacttcca

SEQ ID NO: 44957 - DNA, 20 bp, Artificial Sequence
  chemically synthesized
ccttttccacttccacagtt

SEQ ID NO: 44958 - DNA, 20 bp, Artificial Sequence
  chemically synthesized
cttttccacttccacagttt

SEQ ID NO: 44959 - DNA, 20 bp, Artificial Sequence
  chemically synthesized
gtttgggcactcacaatatt

SEQ ID NO: 44960 - DNA, 20 bp, Artificial Sequence
  chemically synthesized
tttgggcactcacaatattt

SEQ ID NO: 44961 - DNA, 20 bp, Artificial Sequence
  chemically synthesized
ttgggcactcacaatatttg

SEQ ID NO: 44962 - DNA, 20 bp, Artificial Sequence
  chemically synthesized
acaatatttggggtgtttcc

SEQ ID NO: 44963 - DNA, 20 bp, Artificial Sequence
  chemically synthesized
caatatttggggtgtttccc

SEQ ID NO: 44964 - DNA, 20 bp, Artificial Sequence
  chemically synthesized
ggggtgtttcccgggtcctg

SEQ ID NO: 44965 - DNA, 20 bp, Artificial Sequence
  chemically synthesized
gggtgtttcccgggtcctgc

SEQ ID NO: 44966 - DNA, 20 bp, Artificial Sequence
  chemically synthesized
gtgtttcccgggtcctgcag

SEQ ID NO: 44967 - DNA, 20 bp, Artificial Sequence
  chemically synthesized
caggagcaatctgcttcttt

SEQ ID NO: 44968 - DNA, 20 bp, Artificial Sequence
  chemically synthesized
ggagcaatctgcttctttca

SEQ ID NO: 44969 - DNA, 20 bp, Artificial Sequence
  chemically synthesized
gagcaatctgcttctttcag

SEQ ID NO: 44970 - DNA, 20 bp, Artificial Sequence
  chemically synthesized
agcaatctgcttctttcaga

SEQ ID NO: 44971 - DNA, 20 bp, Artificial Sequence
  chemically synthesized
agagggtgtgtgcgttctct

SEQ ID NO: 44972 - DNA, 20 bp, Artificial Sequence
  chemically synthesized
gctttcttgatttatttctg

SEQ ID NO: 44973 - DNA, 20 bp, Artificial Sequence
  chemically synthesized
ctttcttgatttatttctgc

SEQ ID NO: 44974 - DNA, 20 bp, Artificial Sequence
  chemically synthesized
tcttgatttatttctgcagg

SEQ ID NO: 44975 - DNA, 20 bp, Artificial Sequence
  chemically synthesized
tctgcaaaaaaaattcctga

SEQ ID NO: 44976 - DNA, 20 bp, Artificial Sequence
  chemically synthesized
ctgcaaaaaaaattcctgat

SEQ ID NO: 44977 - DNA, 20 bp, Artificial Sequence
  chemically synthesized
gcaaaaaaaattcctgatgg

SEQ ID NO: 44978 - DNA, 20 bp, Artificial Sequence
  chemically synthesized
acatgctgctctgtgcatcc

SEQ ID NO: 44979 - DNA, 20 bp, Artificial Sequence
  chemically synthesized
tgctgctctgtgcatccgag

SEQ ID NO: 44980 - DNA, 20 bp, Artificial Sequence
  chemically synthesized
gctgctctgtgcatccgagt

SEQ ID NO: 44981 - DNA, 20 bp, Artificial Sequence
  chemically synthesized
tgctctgtgcatccgagtgg

SEQ ID NO: 44982 - DNA, 20 bp, Artificial Sequence
  chemically synthesized
gccatcaccctctaatttgt

SEQ ID NO: 44983 - DNA, 20 bp, Artificial Sequence
  chemically synthesized
ctatactgccctttgatatc

SEQ ID NO: 44984 - DNA, 20 bp, Artificial Sequence
  chemically synthesized
tatactgccctttgatatca

SEQ ID NO: 44985 - DNA, 20 bp, Artificial Sequence
  chemically synthesized
ccctttgatatcaaggaatc

SEQ ID NO: 44986 - DNA, 20 bp, Artificial Sequence
  chemically synthesized
cctttgatatcaaggaatca

SEQ ID NO: 44987 - DNA, 20 bp, Artificial Sequence
  chemically synthesized
ggaatcaaggacgtgatgtt

SEQ ID NO: 44988 - DNA, 20 bp, Artificial Sequence
  chemically synthesized
gaatcaaggacgtgatgttg

SEQ ID NO: 44989 - DNA, 20 bp, Artificial Sequence
  chemically synthesized
aatcaaggacgtgatgttga

SEQ ID NO: 44990 - DNA, 20 bp, Artificial Sequence
  chemically synthesized
atcaaggacgtgatgttgag

SEQ ID NO: 44991 - DNA, 20 bp, Artificial Sequence
  chemically synthesized
aaggacgtgatgttgagggg

SEQ ID NO: 44992 - DNA, 20 bp, Artificial Sequence
  chemically synthesized
aggacgtgatgttgaggggt

SEQ ID NO: 44993 - DNA, 20 bp, Artificial Sequence
  chemically synthesized
acgtgatgttgaggggtggg

SEQ ID NO: 44994 - DNA, 20 bp, Artificial Sequence
  chemically synthesized
tgatgttgaggggtgggcag

SEQ ID NO: 44995 - DNA, 20 bp, Artificial Sequence
  chemically synthesized
tggatacactctttacccct

SEQ ID NO: 44996 - DNA, 20 bp, Artificial Sequence
  chemically synthesized
ggatacactctttacccctt

SEQ ID NO: 44997 - DNA, 20 bp, Artificial Sequence
  chemically synthesized
gatacactctttacccctta

SEQ ID NO: 44998 - DNA, 20 bp, Artificial Sequence
  chemically synthesized
tacactctttaccccttagg

SEQ ID NO: 44999 - DNA, 20 bp, Artificial Sequence
  chemically synthesized
accccttagggagctatatc

SEQ ID NO: 45000 - DNA, 20 bp, Artificial Sequence
  chemically synthesized
tagggagctatatctagatt

SEQ ID NO: 45001 - DNA, 20 bp, Artificial Sequence
  chemically synthesized
gatttagatattgccaattc

SEQ ID NO: 45002 - DNA, 20 bp, Artificial Sequence
  chemically synthesized
attcaagataacttaattga

SEQ ID NO: 45003 - DNA, 20 bp, Artificial Sequence
  chemically synthesized
cacacacacatctgcatgac

SEQ ID NO: 45004 - DNA, 20 bp, Artificial Sequence
  chemically synthesized
ctgcatgacaagatttttaa

SEQ ID NO: 45005 - DNA, 20 bp, Artificial Sequence
  chemically synthesized
acaagatttttaatagttga

SEQ ID NO: 45006 - DNA, 20 bp, Artificial Sequence
  chemically synthesized
gaataactaataattgtcca

SEQ ID NO: 45007 - DNA, 20 bp, Artificial Sequence
  chemically synthesized
aataactaataattgtccac

SEQ ID NO: 45008 - DNA, 20 bp, Artificial Sequence
  chemically synthesized
aataattgtccacaggcaat

SEQ ID NO: 45009 - DNA, 20 bp, Artificial Sequence
  chemically synthesized
ataattgtccacaggcaata

SEQ ID NO: 45010 - DNA, 20 bp, Artificial Sequence
  chemically synthesized
taattgtccacaggcaataa

SEQ ID NO: 45011 - DNA, 20 bp, Artificial Sequence
  chemically synthesized
acaggcaataagggcttttt

SEQ ID NO: 45012 - DNA, 20 bp, Artificial Sequence
  chemically synthesized
taagggctttttaagcaaaa

SEQ ID NO: 45013 - DNA, 20 bp, Artificial Sequence
  chemically synthesized
agcaaaacagttgtgataaa

SEQ ID NO: 45014 - DNA, 20 bp, Artificial Sequence
  chemically synthesized
gcaaaacagttgtgataaac

SEQ ID NO: 45015 - DNA, 20 bp, Artificial Sequence
  chemically synthesized
tgtgataaacaggtcattct

SEQ ID NO: 45016 - DNA, 20 bp, Artificial Sequence
  chemically synthesized
taaacaggtcattcttagaa

SEQ ID NO: 45017 - DNA, 20 bp, Artificial Sequence
  chemically synthesized
tcattcttagaatagtaatc

SEQ ID NO: 45018 - DNA, 20 bp, Artificial Sequence
  chemically synthesized
tagaatagtaatccagccaa

SEQ ID NO: 45019 - DNA, 20 bp, Artificial Sequence
  chemically synthesized
tagtaatccagccaatagta

SEQ ID NO: 45020 - DNA, 20 bp, Artificial Sequence
  chemically synthesized
agtaatccagccaatagtac

SEQ ID NO: 45021 - DNA, 20 bp, Artificial Sequence
  chemically synthesized
agccaatagtacaggttgct

SEQ ID NO: 45022 - DNA, 20 bp, Artificial Sequence
  chemically synthesized
ccaatagtacaggttgctta

SEQ ID NO: 45023 - DNA, 20 bp, Artificial Sequence
  chemically synthesized
cttagagattatgtcattac

SEQ ID NO: 45024 - DNA, 20 bp, Artificial Sequence
  chemically synthesized
tagagattatgtcattacca

SEQ ID NO: 45025 - DNA, 20 bp, Artificial Sequence
  chemically synthesized
ccagagttaaaattctataa

SEQ ID NO: 45026 - DNA, 20 bp, Artificial Sequence
  chemically synthesized
gcttctcactccctaccact

SEQ ID NO: 45027 - DNA, 20 bp, Artificial Sequence
  chemically synthesized
cttctcactccctaccactg

SEQ ID NO: 45028 - DNA, 20 bp, Artificial Sequence
  chemically synthesized
cactccctaccactgaggac

SEQ ID NO: 45029 - DNA, 20 bp, Artificial Sequence
  chemically synthesized
tgaggacaagtttatgtcct

SEQ ID NO: 45030 - DNA, 20 bp, Artificial Sequence
  chemically synthesized
gaggacaagtttatgtcctt

SEQ ID NO: 45031 - DNA, 20 bp, Artificial Sequence
  chemically synthesized
ttctccactttacatatcaa

SEQ ID NO: 45032 - DNA, 20 bp, Artificial Sequence
  chemically synthesized
actttacatatcaacggcac

SEQ ID NO: 45033 - DNA, 20 bp, Artificial Sequence
  chemically synthesized
tggttctttatctaactctc

SEQ ID NO: 45034 - DNA, 20 bp, Artificial Sequence
  chemically synthesized
ctttatctaactctctggca

SEQ ID NO: 45035 - DNA, 20 bp, Artificial Sequence
  chemically synthesized
tatctaactctctggcacag

SEQ ID NO: 45036 - DNA, 20 bp, Artificial Sequence
  chemically synthesized
atctaactctctggcacagc

SEQ ID NO: 45037 - DNA, 20 bp, Artificial Sequence
  chemically synthesized
ctaactctctggcacagcag

SEQ ID NO: 45038 - DNA, 20 bp, Artificial Sequence
  chemically synthesized
gagtttgttttcttctgctt

SEQ ID NO: 45039 - DNA, 20 bp, Artificial Sequence
  chemically synthesized
gtttgttttcttctgcttca

SEQ ID NO: 45040 - DNA, 20 bp, Artificial Sequence
  chemically synthesized
gagctttgaatttactattt

SEQ ID NO: 45041 - DNA, 20 bp, Artificial Sequence
  chemically synthesized
ttcagcttctaaactttatt

SEQ ID NO: 45042 - DNA, 20 bp, Artificial Sequence
  chemically synthesized
tatttggcaatgccttccca

SEQ ID NO: 45043 - DNA, 20 bp, Artificial Sequence
  chemically synthesized
ttggcaatgccttcccatgg

SEQ ID NO: 45044 - DNA, 20 bp, Artificial Sequence
  chemically synthesized
tttctccttaatttcattct

SEQ ID NO: 45045 - DNA, 20 bp, Artificial Sequence
  chemically synthesized
aattttatgtatgttctacc

SEQ ID NO: 45046 - DNA, 20 bp, Artificial Sequence
  chemically synthesized
tctacctagattataatctt

SEQ ID NO: 45047 - DNA, 20 bp, Artificial Sequence
  chemically synthesized
tacctagattataatcttca

SEQ ID NO: 45048 - DNA, 20 bp, Artificial Sequence
  chemically synthesized
acctagattataatcttcag

SEQ ID NO: 45049 - DNA, 20 bp, Artificial Sequence
  chemically synthesized
agattataatcttcagagga

SEQ ID NO: 45050 - DNA, 20 bp, Artificial Sequence
  chemically synthesized
aaattatgacatttatttaa

SEQ ID NO: 45051 - DNA, 20 bp, Artificial Sequence
  chemically synthesized
aacaaatgtttgaaaataca

SEQ ID NO: 45052 - DNA, 20 bp, Artificial Sequence
  chemically synthesized
acaaatgtttgaaaatacat

SEQ ID NO: 45053 - DNA, 20 bp, Artificial Sequence
  chemically synthesized
atgtttgaaaatacatggga

SEQ ID NO: 45054 - DNA, 20 bp, Artificial Sequence
  chemically synthesized
cacttgaaattgcttgtgta

SEQ ID NO: 45055 - DNA, 20 bp, Artificial Sequence
  chemically synthesized
aaattgcttgtgtaaagaaa

SEQ ID NO: 45056 - DNA, 20 bp, Artificial Sequence
  chemically synthesized
gtgtaaagaaacagttttat

SEQ ID NO: 45057 - DNA, 20 bp, Artificial Sequence
  chemically synthesized
aaagaaacagttttatcagt

SEQ ID NO: 45058 - DNA, 20 bp, Artificial Sequence
  chemically synthesized
aagaaacagttttatcagtt

SEQ ID NO: 45059 - DNA, 20 bp, Artificial Sequence
  chemically synthesized
agttaggatttaatcaatgt

SEQ ID NO: 45060 - DNA, 20 bp, Artificial Sequence
  chemically synthesized
taggatttaatcaatgtcag

SEQ ID NO: 45061 - DNA, 20 bp, Artificial Sequence
  chemically synthesized
caatgtcagaagcaatgata

SEQ ID NO: 45062 - DNA, 20 bp, Artificial Sequence
  chemically synthesized
aatgtcagaagcaatgatat

SEQ ID NO: 45063 - DNA, 20 bp, Artificial Sequence
  chemically synthesized
gcaatgatataggaaaaatc

SEQ ID NO: 45064 - DNA, 20 bp, Artificial Sequence
  chemically synthesized
caatgatataggaaaaatcg

SEQ ID NO: 45065 - DNA, 20 bp, Artificial Sequence
  chemically synthesized
tataggaaaaatcgaggaat

SEQ ID NO: 45066 - DNA, 20 bp, Artificial Sequence
  chemically synthesized
ggaaaaatcgaggaataaga

SEQ ID NO: 45067 - DNA, 20 bp, Artificial Sequence
  chemically synthesized
atcgaggaataagacagtta

SEQ ID NO: 45068 - DNA, 20 bp, Artificial Sequence
  chemically synthesized
ggaataagacagttatggat

SEQ ID NO: 45069 - DNA, 20 bp, Artificial Sequence
  chemically synthesized
gaataagacagttatggata

SEQ ID NO: 45070 - DNA, 20 bp, Artificial Sequence
  chemically synthesized
ataagacagttatggataag

SEQ ID NO: 45071 - DNA, 20 bp, Artificial Sequence
  chemically synthesized
agaaatcaacaaactcttaa

SEQ ID NO: 45072 - DNA, 20 bp, Artificial Sequence
  chemically synthesized
cttaaaagatattgcctcaa

SEQ ID NO: 45073 - DNA, 20 bp, Artificial Sequence
  chemically synthesized
agatattgcctcaaaagcat

SEQ ID NO: 45074 - DNA, 20 bp, Artificial Sequence
  chemically synthesized
atattgcctcaaaagcataa

SEQ ID NO: 45075 - DNA, 20 bp, Artificial Sequence
  chemically synthesized
tattgcctcaaaagcataag

SEQ ID NO: 45076 - DNA, 20 bp, Artificial Sequence
  chemically synthesized
tcaaaagcataagaggaaat

SEQ ID NO: 45077 - DNA, 20 bp, Artificial Sequence
  chemically synthesized
caaaagcataagaggaaata

SEQ ID NO: 45078 - DNA, 20 bp, Artificial Sequence
  chemically synthesized
aaaagcataagaggaaataa

SEQ ID NO: 45079 - DNA, 20 bp, Artificial Sequence
  chemically synthesized
aagggtttatacatgacttt

SEQ ID NO: 45080 - DNA, 20 bp, Artificial Sequence
  chemically synthesized
tgacttttagaacactgcct

SEQ ID NO: 45081 - DNA, 20 bp, Artificial Sequence
  chemically synthesized
tagaacactgccttggtttt

SEQ ID NO: 45082 - DNA, 20 bp, Artificial Sequence
  chemically synthesized
tgccttggtttttggataaa

SEQ ID NO: 45083 - DNA, 20 bp, Artificial Sequence
  chemically synthesized
gccttggtttttggataaat

SEQ ID NO: 45084 - DNA, 20 bp, Artificial Sequence
  chemically synthesized
ccttggtttttggataaatg

SEQ ID NO: 45085 - DNA, 20 bp, Artificial Sequence
  chemically synthesized
tggtttttggataaatgggg

SEQ ID NO: 45086 - DNA, 20 bp, Artificial Sequence
  chemically synthesized
atggggaagttgtttgaaaa

SEQ ID NO: 45087 - DNA, 20 bp, Artificial Sequence
  chemically synthesized
tggggaagttgtttgaaaac

SEQ ID NO: 45088 - DNA, 20 bp, Artificial Sequence
  chemically synthesized
gggaagttgtttgaaaacag

SEQ ID NO: 45089 - DNA, 20 bp, Artificial Sequence
  chemically synthesized
ggaagttgtttgaaaacagg

SEQ ID NO: 45090 - DNA, 20 bp, Artificial Sequence
  chemically synthesized
gaagttgtttgaaaacagga

SEQ ID NO: 45091 - DNA, 20 bp, Artificial Sequence
  chemically synthesized
tttgaaaacaggagggatcc

SEQ ID NO: 45092 - DNA, 20 bp, Artificial Sequence
  chemically synthesized
gagggatcctagatattcct

SEQ ID NO: 45093 - DNA, 20 bp, Artificial Sequence
  chemically synthesized
tcctagatattccttagtct

SEQ ID NO: 45094 - DNA, 20 bp, Artificial Sequence
  chemically synthesized
cctagatattccttagtctg

SEQ ID NO: 45095 - DNA, 20 bp, Artificial Sequence
  chemically synthesized
tagatattccttagtctgag

SEQ ID NO: 45096 - DNA, 20 bp, Artificial Sequence
  chemically synthesized
agatattccttagtctgagg

SEQ ID NO: 45097 - DNA, 20 bp, Artificial Sequence
  chemically synthesized
atattccttagtctgaggag

SEQ ID NO: 45098 - DNA, 20 bp, Artificial Sequence
  chemically synthesized
tagtctgaggaggagcaatt

SEQ ID NO: 45099 - DNA, 20 bp, Artificial Sequence
  chemically synthesized
gcaattaagattcacttgtt

SEQ ID NO: 45100 - DNA, 20 bp, Artificial Sequence
  chemically synthesized
aattaagattcacttgttta

SEQ ID NO: 45101 - DNA, 20 bp, Artificial Sequence
  chemically synthesized
attaagattcacttgtttag

SEQ ID NO: 45102 - DNA, 20 bp, Artificial Sequence
  chemically synthesized
agattcacttgtttagaggc

SEQ ID NO: 45103 - DNA, 20 bp, Artificial Sequence
  chemically synthesized
gattcacttgtttagaggct

SEQ ID NO: 45104 - DNA, 20 bp, Artificial Sequence
  chemically synthesized
ttcacttgtttagaggctgg

SEQ ID NO: 45105 - DNA, 20 bp, Artificial Sequence
  chemically synthesized
acttgtttagaggctgggag

SEQ ID NO: 45106 - DNA, 20 bp, Artificial Sequence
  chemically synthesized
tgtttagaggctgggagtgg

SEQ ID NO: 45107 - DNA, 20 bp, Artificial Sequence
  chemically synthesized
gtggctcacgcctgtaatcc

SEQ ID NO: 45108 - DNA, 20 bp, Artificial Sequence
  chemically synthesized
cgcctgtaatcccagaattt

SEQ ID NO: 45109 - DNA, 20 bp, Artificial Sequence
  chemically synthesized
gcctgtaatcccagaatttt

SEQ ID NO: 45110 - DNA, 20 bp, Artificial Sequence
  chemically synthesized
ctgtaatcccagaattttgg

SEQ ID NO: 45111 - DNA, 20 bp, Artificial Sequence
  chemically synthesized
tgtaatcccagaattttggg

SEQ ID NO: 45112 - DNA, 20 bp, Artificial Sequence
  chemically synthesized
tcccagaattttgggaggcc

SEQ ID NO: 45113 - DNA, 20 bp, Artificial Sequence
  chemically synthesized
cccagaattttgggaggcca

SEQ ID NO: 45114 - DNA, 20 bp, Artificial Sequence
  chemically synthesized
agaattttgggaggccaagg

SEQ ID NO: 45115 - DNA, 20 bp, Artificial Sequence
  chemically synthesized
gaattttgggaggccaaggc

SEQ ID NO: 45116 - DNA, 20 bp, Artificial Sequence
  chemically synthesized
ttttgggaggccaaggcagg

SEQ ID NO: 45117 - DNA, 20 bp, Artificial Sequence
  chemically synthesized
ccaaggcaggcagatcacct

SEQ ID NO: 45118 - DNA, 20 bp, Artificial Sequence
  chemically synthesized
caaggcaggcagatcacctg

SEQ ID NO: 45119 - DNA, 20 bp, Artificial Sequence
  chemically synthesized
caggcagatcacctgaggtc

SEQ ID NO: 45120 - DNA, 20 bp, Artificial Sequence
  chemically synthesized
ggcagatcacctgaggtcaa

SEQ ID NO: 45121 - DNA, 20 bp, Artificial Sequence
  chemically synthesized
tcacctgaggtcaagagttc

SEQ ID NO: 45122 - DNA, 20 bp, Artificial Sequence
  chemically synthesized
tcaagagttcaagaccaacc

SEQ ID NO: 45123 - DNA, 20 bp, Artificial Sequence
  chemically synthesized
caagaccaacctggccaaca

SEQ ID NO: 45124 - DNA, 20 bp, Artificial Sequence
  chemically synthesized
ctctacaaaaatacaaaaat

SEQ ID NO: 45125 - DNA, 20 bp, Artificial Sequence
  chemically synthesized
acaaaaatacaaaaattaga

SEQ ID NO: 45126 - DNA, 20 bp, Artificial Sequence
  chemically synthesized
caaaaatacaaaaattagac

SEQ ID NO: 45127 - DNA, 20 bp, Artificial Sequence
  chemically synthesized
caaaaattagacaggcatga

SEQ ID NO: 45128 - DNA, 20 bp, Artificial Sequence
  chemically synthesized
aattagacaggcatgatggc

SEQ ID NO: 45129 - DNA, 20 bp, Artificial Sequence
  chemically synthesized
atggcaagtgcctgtaatcc

SEQ ID NO: 45130 - DNA, 20 bp, Artificial Sequence
  chemically synthesized
tgcctgtaatcccagctact

SEQ ID NO: 45131 - DNA, 20 bp, Artificial Sequence
  chemically synthesized
gcctgtaatcccagctactt

SEQ ID NO: 45132 - DNA, 20 bp, Artificial Sequence
  chemically synthesized
ctgtaatcccagctacttgg

SEQ ID NO: 45133 - DNA, 20 bp, Artificial Sequence
  chemically synthesized
tgtaatcccagctacttggg

SEQ ID NO: 45134 - DNA, 20 bp, Artificial Sequence
  chemically synthesized
tcccagctacttgggaggct

SEQ ID NO: 45135 - DNA, 20 bp, Artificial Sequence
  chemically synthesized
cccagctacttgggaggctg

SEQ ID NO: 45136 - DNA, 20 bp, Artificial Sequence
  chemically synthesized
agctacttgggaggctgagg

SEQ ID NO: 45137 - DNA, 20 bp, Artificial Sequence
  chemically synthesized
gctacttgggaggctgagga

SEQ ID NO: 45138 - DNA, 20 bp, Artificial Sequence
  chemically synthesized
tacttgggaggctgaggaag

SEQ ID NO: 45139 - DNA, 20 bp, Artificial Sequence
  chemically synthesized
gaaggagaattgcttgaacc

SEQ ID NO: 45140 - DNA, 20 bp, Artificial Sequence
  chemically synthesized
ggagaattgcttgaacctgg

SEQ ID NO: 45141 - DNA, 20 bp, Artificial Sequence
  chemically synthesized
gagaattgcttgaacctgga

SEQ ID NO: 45142 - DNA, 20 bp, Artificial Sequence
  chemically synthesized
aattgcttgaacctggaagg

SEQ ID NO: 45143 - DNA, 20 bp, Artificial Sequence
  chemically synthesized
attgcttgaacctggaaggc

SEQ ID NO: 45144 - DNA, 20 bp, Artificial Sequence
  chemically synthesized
tgcttgaacctggaaggcag

SEQ ID NO: 45145 - DNA, 20 bp, Artificial Sequence
  chemically synthesized
aacctggaaggcaggagttg

SEQ ID NO: 45146 - DNA, 20 bp, Artificial Sequence
  chemically synthesized
tggaaggcaggagttgcagt

SEQ ID NO: 45147 - DNA, 20 bp, Artificial Sequence
  chemically synthesized
ggcaggagttgcagtgagcc

SEQ ID NO: 45148 - DNA, 20 bp, Artificial Sequence
  chemically synthesized
gagatcataccactgcactc

SEQ ID NO: 45149 - DNA, 20 bp, Artificial Sequence
  chemically synthesized
cataccactgcactccagcc

SEQ ID NO: 45150 - DNA, 20 bp, Artificial Sequence
  chemically synthesized
ataccactgcactccagcct

SEQ ID NO: 45151 - DNA, 20 bp, Artificial Sequence
  chemically synthesized
ctgcactccagcctgggtga

SEQ ID NO: 45152 - DNA, 20 bp, Artificial Sequence
  chemically synthesized
tccagcctgggtgacagaac

SEQ ID NO: 45153 - DNA, 20 bp, Artificial Sequence
  chemically synthesized
actctgtctcaaaaaaaaaa

SEQ ID NO: 45154 - DNA, 20 bp, Artificial Sequence
  chemically synthesized
tctgtctcaaaaaaaaaaaa

SEQ ID NO: 45155 - DNA, 20 bp, Artificial Sequence
  chemically synthesized
tgtctcaaaaaaaaaaaaga

SEQ ID NO: 45156 - DNA, 20 bp, Artificial Sequence
  chemically synthesized
aaaaaaaaagagagattcaa

SEQ ID NO: 45157 - DNA, 20 bp, Artificial Sequence
  chemically synthesized
attcaaaagattcacttgtt

SEQ ID NO: 45158 - DNA, 20 bp, Artificial Sequence
  chemically synthesized
ttcaaaagattcacttgttt

SEQ ID NO: 45159 - DNA, 20 bp, Artificial Sequence
  chemically synthesized
agattcacttgtttaggcct

SEQ ID NO: 45160 - DNA, 20 bp, Artificial Sequence
  chemically synthesized
ttcacttgtttaggccttag

SEQ ID NO: 45161 - DNA, 20 bp, Artificial Sequence
  chemically synthesized
tcacttgtttaggccttagc

SEQ ID NO: 45162 - DNA, 20 bp, Artificial Sequence
  chemically synthesized
tgtttaggccttagcgggct

SEQ ID NO: 45163 - DNA, 20 bp, Artificial Sequence
  chemically synthesized
gccttagcgggcttagacac

SEQ ID NO: 45164 - DNA, 20 bp, Artificial Sequence
  chemically synthesized
cagtctctgacacattctta

SEQ ID NO: 45165 - DNA, 20 bp, Artificial Sequence
  chemically synthesized
agtctctgacacattcttaa

SEQ ID NO: 45166 - DNA, 20 bp, Artificial Sequence
  chemically synthesized
tctgacacattcttaaaggt

SEQ ID NO: 45167 - DNA, 20 bp, Artificial Sequence
  chemically synthesized
ctgacacattcttaaaggtc

SEQ ID NO: 45168 - DNA, 20 bp, Artificial Sequence
  chemically synthesized
taaaggtcaggctctacaaa

SEQ ID NO: 45169 - DNA, 20 bp, Artificial Sequence
  chemically synthesized
ctctacaaatggaacccaac

SEQ ID NO: 45170 - DNA, 20 bp, Artificial Sequence
  chemically synthesized
atggaacccaaccagactct

SEQ ID NO: 45171 - DNA, 20 bp, Artificial Sequence
  chemically synthesized
cccaaccagactctcagata

SEQ ID NO: 45172 - DNA, 20 bp, Artificial Sequence
  chemically synthesized
cagactctcagatatggcca

SEQ ID NO: 45173 - DNA, 20 bp, Artificial Sequence
  chemically synthesized
atctatacacacccatctca

SEQ ID NO: 45174 - DNA, 20 bp, Artificial Sequence
  chemically synthesized
ctcacagatcccctatctta

SEQ ID NO: 45175 - DNA, 20 bp, Artificial Sequence
  chemically synthesized
cacagatcccctatcttaaa

SEQ ID NO: 45176 - DNA, 20 bp, Artificial Sequence
  chemically synthesized
atcttaaagagaccctaatt

SEQ ID NO: 45177 - DNA, 20 bp, Artificial Sequence
  chemically synthesized
tcttaaagagaccctaattt

SEQ ID NO: 45178 - DNA, 20 bp, Artificial Sequence
  chemically synthesized
accctaatttgggttcacct

SEQ ID NO: 45179 - DNA, 20 bp, Artificial Sequence
  chemically synthesized
tcagtctctataatctgtac

SEQ ID NO: 45180 - DNA, 20 bp, Artificial Sequence
  chemically synthesized
aaatctttctcacccatcct

SEQ ID NO: 45181 - DNA, 20 bp, Artificial Sequence
  chemically synthesized
ttctcacccatccttagatt

SEQ ID NO: 45182 - DNA, 20 bp, Artificial Sequence
  chemically synthesized
ctcacccatccttagattga

SEQ ID NO: 45183 - DNA, 20 bp, Artificial Sequence
  chemically synthesized
acccatccttagattgagag

SEQ ID NO: 45184 - DNA, 20 bp, Artificial Sequence
  chemically synthesized
gaagtcacttattattatgt

SEQ ID NO: 45185 - DNA, 20 bp, Artificial Sequence
  chemically synthesized
cttattattatgtgagtaac

SEQ ID NO: 45186 - DNA, 20 bp, Artificial Sequence
  chemically synthesized
attattatgtgagtaactgg

SEQ ID NO: 45187 - DNA, 20 bp, Artificial Sequence
  chemically synthesized
agtaactggaagatactgat

SEQ ID NO: 45188 - DNA, 20 bp, Artificial Sequence
  chemically synthesized
aacttttattttaacttcca

SEQ ID NO: 45189 - DNA, 20 bp, Artificial Sequence
  chemically synthesized
tattttaacttccaaagaac

SEQ ID NO: 45190 - DNA, 20 bp, Artificial Sequence
  chemically synthesized
aagaacaagtgcaatatgtg

SEQ ID NO: 45191 - DNA, 20 bp, Artificial Sequence
  chemically synthesized
atatgtgcagctttgttgcg

SEQ ID NO: 45192 - DNA, 20 bp, Artificial Sequence
  chemically synthesized
tatgtgcagctttgttgcgc

SEQ ID NO: 45193 - DNA, 20 bp, Artificial Sequence
  chemically synthesized
caggtcaacatgtatctttc

SEQ ID NO: 45194 - DNA, 20 bp, Artificial Sequence
  chemically synthesized
catgtatctttctggtcttt

SEQ ID NO: 45195 - DNA, 20 bp, Artificial Sequence
  chemically synthesized
ttttagccgcctaacacttt

SEQ ID NO: 45196 - DNA, 20 bp, Artificial Sequence
  chemically synthesized
tagccgcctaacactttgag

SEQ ID NO: 45197 - DNA, 20 bp, Artificial Sequence
  chemically synthesized
ctaacactttgagcagatat

SEQ ID NO: 45198 - DNA, 20 bp, Artificial Sequence
  chemically synthesized
gagcagatataagccttaca

SEQ ID NO: 45199 - DNA, 20 bp, Artificial Sequence
  chemically synthesized
agcagatataagccttacac

SEQ ID NO: 45200 - DNA, 20 bp, Artificial Sequence
  chemically synthesized
aagccttacacaggattatg

SEQ ID NO: 45201 - DNA, 20 bp, Artificial Sequence
  chemically synthesized
cacaggattatgaagtctga

SEQ ID NO: 45202 - DNA, 20 bp, Artificial Sequence
  chemically synthesized
acaggattatgaagtctgaa

SEQ ID NO: 45203 - DNA, 20 bp, Artificial Sequence
  chemically synthesized
tataattcctatcaacctga

SEQ ID NO: 45204 - DNA, 20 bp, Artificial Sequence
  chemically synthesized
ataattcctatcaacctgat

SEQ ID NO: 45205 - DNA, 20 bp, Artificial Sequence
  chemically synthesized
ttcctatcaacctgataggt

SEQ ID NO: 45206 - DNA, 20 bp, Artificial Sequence
  chemically synthesized
tcctatcaacctgataggtt

SEQ ID NO: 45207 - DNA, 20 bp, Artificial Sequence
  chemically synthesized
cctatcaacctgataggtta

SEQ ID NO: 45208 - DNA, 20 bp, Artificial Sequence
  chemically synthesized
ctatcaacctgataggttag

SEQ ID NO: 45209 - DNA, 20 bp, Artificial Sequence
  chemically synthesized
tcaacctgataggttagggg

SEQ ID NO: 45210 - DNA, 20 bp, Artificial Sequence
  chemically synthesized
caacctgataggttagggga

SEQ ID NO: 45211 - DNA, 20 bp, Artificial Sequence
  chemically synthesized
cctgataggttaggggaagg

SEQ ID NO: 45212 - DNA, 20 bp, Artificial Sequence
  chemically synthesized
tgataggttaggggaaggta

SEQ ID NO: 45213 - DNA, 20 bp, Artificial Sequence
  chemically synthesized
aggtagagctctcctccaat

SEQ ID NO: 45214 - DNA, 20 bp, Artificial Sequence
  chemically synthesized
agagctctcctccaataagc

SEQ ID NO: 45215 - DNA, 20 bp, Artificial Sequence
  chemically synthesized
cctccaataagccagatttc

SEQ ID NO: 45216 - DNA, 20 bp, Artificial Sequence
  chemically synthesized
tccaataagccagatttcca

SEQ ID NO: 45217 - DNA, 20 bp, Artificial Sequence
  chemically synthesized
ttctgacgtcataatctacc

SEQ ID NO: 45218 - DNA, 20 bp, Artificial Sequence
  chemically synthesized
tctgacgtcataatctacca

SEQ ID NO: 45219 - DNA, 20 bp, Artificial Sequence
  chemically synthesized
gtcataatctaccaaggtca

SEQ ID NO: 45220 - DNA, 20 bp, Artificial Sequence
  chemically synthesized
atctaccaaggtcatggatc

SEQ ID NO: 45221 - DNA, 20 bp, Artificial Sequence
  chemically synthesized
ccaaggtcatggatcgagtt

SEQ ID NO: 45222 - DNA, 20 bp, Artificial Sequence
  chemically synthesized
aaggtcatggatcgagttca

SEQ ID NO: 45223 - DNA, 20 bp, Artificial Sequence
  chemically synthesized
cgagttcagagaaaaaacaa

SEQ ID NO: 45224 - DNA, 20 bp, Artificial Sequence
  chemically synthesized
accaaaaaataaaaatccca

SEQ ID NO: 45225 - DNA, 20 bp, Artificial Sequence
  chemically synthesized
aaaatcccaaagaaaaaata

SEQ ID NO: 45226 - DNA, 20 bp, Artificial Sequence
  chemically synthesized
agaaaaaataaagaaaaaaa

SEQ ID NO: 45227 - DNA, 20 bp, Artificial Sequence
  chemically synthesized
tgaatacttcctgccatgtt

SEQ ID NO: 45228 - DNA, 20 bp, Artificial Sequence
  chemically synthesized
atacttcctgccatgttaag

SEQ ID NO: 45229 - DNA, 20 bp, Artificial Sequence
  chemically synthesized
atgttaagtggccaatatgt

SEQ ID NO: 45230 - DNA, 20 bp, Artificial Sequence
  chemically synthesized
agtggccaatatgtcagaaa

SEQ ID NO: 45231 - DNA, 20 bp, Artificial Sequence
  chemically synthesized
aatatgtcagaaacagcact

SEQ ID NO: 45232 - DNA, 20 bp, Artificial Sequence
  chemically synthesized
tcagaaacagcactgagtta

SEQ ID NO: 45233 - DNA, 20 bp, Artificial Sequence
  chemically synthesized
acagcactgagttacagata

SEQ ID NO: 45234 - DNA, 20 bp, Artificial Sequence
  chemically synthesized
agataaagatgtctaaacta

SEQ ID NO: 45235 - DNA, 20 bp, Artificial Sequence
  chemically synthesized
tctaaactacagtgacatcc

SEQ ID NO: 45236 - DNA, 20 bp, Artificial Sequence
  chemically synthesized
cagtgacatcccagctgtca

SEQ ID NO: 45237 - DNA, 20 bp, Artificial Sequence
  chemically synthesized
atcccagctgtcacagtgtg

SEQ ID NO: 45238 - DNA, 20 bp, Artificial Sequence
  chemically synthesized
tgtcacagtgtgtggactat

SEQ ID NO: 45239 - DNA, 20 bp, Artificial Sequence
  chemically synthesized
tggactattagtcaataaaa

SEQ ID NO: 45240 - DNA, 20 bp, Artificial Sequence
  chemically synthesized
taaaacagtccctgcctctt

SEQ ID NO: 45241 - DNA, 20 bp, Artificial Sequence
  chemically synthesized
aaacagtccctgcctcttaa

SEQ ID NO: 45242 - DNA, 20 bp, Artificial Sequence
  chemically synthesized
caaatacatgtcttatgtct

SEQ ID NO: 45243 - DNA, 20 bp, Artificial Sequence
  chemically synthesized
catgtcttatgtcttagaat

SEQ ID NO: 45244 - DNA, 20 bp, Artificial Sequence
  chemically synthesized
gtcttagaataagattccct

SEQ ID NO: 45245 - DNA, 20 bp, Artificial Sequence
  chemically synthesized
ttagaataagattccctaag

SEQ ID NO: 45246 - DNA, 20 bp, Artificial Sequence
  chemically synthesized
gattccctaagaagtgaacc

SEQ ID NO: 45247 - DNA, 20 bp, Artificial Sequence
  chemically synthesized
agtgaacctagcatttatac

SEQ ID NO: 45248 - DNA, 20 bp, Artificial Sequence
  chemically synthesized
agataattaattctaatcca

SEQ ID NO: 45249 - DNA, 20 bp, Artificial Sequence
  chemically synthesized
taattctaatccatagtatc

SEQ ID NO: 45250 - DNA, 20 bp, Artificial Sequence
  chemically synthesized
ctaatccatagtatctggta

SEQ ID NO: 45251 - DNA, 20 bp, Artificial Sequence
  chemically synthesized
aatccatagtatctggtaaa

SEQ ID NO: 45252 - DNA, 20 bp, Artificial Sequence
  chemically synthesized
attctaccatcatctttacc

SEQ ID NO: 45253 - DNA, 20 bp, Artificial Sequence
  chemically synthesized
accatcatctttaccgagca

SEQ ID NO: 45254 - DNA, 20 bp, Artificial Sequence
  chemically synthesized
atcatctttaccgagcatag

SEQ ID NO: 45255 - DNA, 20 bp, Artificial Sequence
  chemically synthesized
catctttaccgagcatagaa

SEQ ID NO: 45256 - DNA, 20 bp, Artificial Sequence
  chemically synthesized
gaagagctacaccaaaaccc

SEQ ID NO: 45257 - DNA, 20 bp, Artificial Sequence
  chemically synthesized
aagagctacaccaaaaccct

SEQ ID NO: 45258 - DNA, 20 bp, Artificial Sequence
  chemically synthesized
acaccaaaaccctgggtcat

SEQ ID NO: 45259 - DNA, 20 bp, Artificial Sequence
  chemically synthesized
caaaaccctgggtcatcagc

SEQ ID NO: 45260 - DNA, 20 bp, Artificial Sequence
  chemically synthesized
agccagcacatacacttatc

SEQ ID NO: 45261 - DNA, 20 bp, Artificial Sequence
  chemically synthesized
cagtgataaatacacatcat

SEQ ID NO: 45262 - DNA, 20 bp, Artificial Sequence
  chemically synthesized
agtgataaatacacatcatc

SEQ ID NO: 45263 - DNA, 20 bp, Artificial Sequence
  chemically synthesized
ataaaaaaaatacttttgct

SEQ ID NO: 45264 - DNA, 20 bp, Artificial Sequence
  chemically synthesized
atacttttgctgagatgaaa

SEQ ID NO: 45265 - DNA, 20 bp, Artificial Sequence
  chemically synthesized
tacttttgctgagatgaaac

SEQ ID NO: 45266 - DNA, 20 bp, Artificial Sequence
  chemically synthesized
caggcgtgatttatttcaaa

SEQ ID NO: 45267 - DNA, 20 bp, Artificial Sequence
  chemically synthesized
aggcgtgatttatttcaaat

SEQ ID NO: 45268 - DNA, 20 bp, Artificial Sequence
  chemically synthesized
tgatttatttcaaataggta

SEQ ID NO: 45269 - DNA, 20 bp, Artificial Sequence
  chemically synthesized
tatttcaaataggtacggat

SEQ ID NO: 45270 - DNA, 20 bp, Artificial Sequence
  chemically synthesized
ttcaaataggtacggataag

SEQ ID NO: 45271 - DNA, 20 bp, Artificial Sequence
  chemically synthesized
gtacggataagtagatattg

SEQ ID NO: 45272 - DNA, 20 bp, Artificial Sequence
  chemically synthesized
ggataagtagatattgaagt

SEQ ID NO: 45273 - DNA, 20 bp, Artificial Sequence
  chemically synthesized
gataagtagatattgaagta

SEQ ID NO: 45274 - DNA, 20 bp, Artificial Sequence
  chemically synthesized
tagatattgaagtaaggatt

SEQ ID NO: 45275 - DNA, 20 bp, Artificial Sequence
  chemically synthesized
gcactgaaactgttgcttta

SEQ ID NO: 45276 - DNA, 20 bp, Artificial Sequence
  chemically synthesized
cactgaaactgttgctttat

SEQ ID NO: 45277 - DNA, 20 bp, Artificial Sequence
  chemically synthesized
ggatttttcactacactaat

SEQ ID NO: 45278 - DNA, 20 bp, Artificial Sequence
  chemically synthesized
cactacactaatgagaactt

SEQ ID NO: 45279 - DNA, 20 bp, Artificial Sequence
  chemically synthesized
ctacactaatgagaacttaa

SEQ ID NO: 45280 - DNA, 20 bp, Artificial Sequence
  chemically synthesized
aatgagaacttaagagataa

SEQ ID NO: 45281 - DNA, 20 bp, Artificial Sequence
  chemically synthesized
gagataatggcctaaaacca

SEQ ID NO: 45282 - DNA, 20 bp, Artificial Sequence
  chemically synthesized
gataatggcctaaaaccaca

SEQ ID NO: 45283 - DNA, 20 bp, Artificial Sequence
  chemically synthesized
taatggcctaaaaccacaga

SEQ ID NO: 45284 - DNA, 20 bp, Artificial Sequence
  chemically synthesized
aaccacagagagtatattca

SEQ ID NO: 45285 - DNA, 20 bp, Artificial Sequence
  chemically synthesized
cagagagtatattcaaagat

SEQ ID NO: 45286 - DNA, 20 bp, Artificial Sequence
  chemically synthesized
agtatattcaaagataagta

SEQ ID NO: 45287 - DNA, 20 bp, Artificial Sequence
  chemically synthesized
taagtatagcacttcttatt

SEQ ID NO: 45288 - DNA, 20 bp, Artificial Sequence
  chemically synthesized
gaaaccaatgcttactaaat

SEQ ID NO: 45289 - DNA, 20 bp, Artificial Sequence
  chemically synthesized
aatgcttactaaatgagact

SEQ ID NO: 45290 - DNA, 20 bp, Artificial Sequence
  chemically synthesized
acgtgtcccatcaaaaatcc

SEQ ID NO: 45291 - DNA, 20 bp, Artificial Sequence
  chemically synthesized
tccctgaacttttcaaaaat

SEQ ID NO: 45292 - DNA, 20 bp, Artificial Sequence
  chemically synthesized
catgctttaactttaaacta

SEQ ID NO: 45293 - DNA, 20 bp, Artificial Sequence
  chemically synthesized
atgctttaactttaaactac

SEQ ID NO: 45294 - DNA, 20 bp, Artificial Sequence
  chemically synthesized
ctttaaactacaggcctcac

SEQ ID NO: 45295 - DNA, 20 bp, Artificial Sequence
  chemically synthesized
ttaaactacaggcctcactg

SEQ ID NO: 45296 - DNA, 20 bp, Artificial Sequence
  chemically synthesized
tacaggcctcactggagcta

SEQ ID NO: 45297 - DNA, 20 bp, Artificial Sequence
  chemically synthesized
gcctcactggagctacagac

SEQ ID NO: 45298 - DNA, 20 bp, Artificial Sequence
  chemically synthesized
tcactggagctacagacaag

SEQ ID NO: 45299 - DNA, 20 bp, Artificial Sequence
  chemically synthesized
cactggagctacagacaaga

SEQ ID NO: 45300 - DNA, 20 bp, Artificial Sequence
  chemically synthesized
acagacaagaaggtgaaaaa

SEQ ID NO: 45301 - DNA, 20 bp, Artificial Sequence
  chemically synthesized
aggtgaaaaacggctgacaa

SEQ ID NO: 45302 - DNA, 20 bp, Artificial Sequence
  chemically synthesized
tgaaaaacggctgacaaaag

SEQ ID NO: 45303 - DNA, 20 bp, Artificial Sequence
  chemically synthesized
acggctgacaaaagaagtcc

SEQ ID NO: 45304 - DNA, 20 bp, Artificial Sequence
  chemically synthesized
agaagtcctggtatcttcta

SEQ ID NO: 45305 - DNA, 20 bp, Artificial Sequence
  chemically synthesized
agtcctggtatcttctatgg

SEQ ID NO: 45306 - DNA, 20 bp, Artificial Sequence
  chemically synthesized
gtcctggtatcttctatggt

SEQ ID NO: 45307 - DNA, 20 bp, Artificial Sequence
  chemically synthesized
cctggtatcttctatggtgg

SEQ ID NO: 45308 - DNA, 20 bp, Artificial Sequence
  chemically synthesized
ggtatcttctatggtgggag

SEQ ID NO: 45309 - DNA, 20 bp, Artificial Sequence
  chemically synthesized
ctatggtgggagaagaaaac

SEQ ID NO: 45310 - DNA, 20 bp, Artificial Sequence
  chemically synthesized
tgggagaagaaaactagcta

SEQ ID NO: 45311 - DNA, 20 bp, Artificial Sequence
  chemically synthesized
gggagaagaaaactagctaa

SEQ ID NO: 45312 - DNA, 20 bp, Artificial Sequence
  chemically synthesized
ggagaagaaaactagctaaa

SEQ ID NO: 45313 - DNA, 20 bp, Artificial Sequence
  chemically synthesized
gaagaaaactagctaaaggg

SEQ ID NO: 45314 - DNA, 20 bp, Artificial Sequence
  chemically synthesized
agctaaagggaagaataaat

SEQ ID NO: 45315 - DNA, 20 bp, Artificial Sequence
  chemically synthesized
ctaaagggaagaataaatta

SEQ ID NO: 45316 - DNA, 20 bp, Artificial Sequence
  chemically synthesized
agaataaattagagaaaaat

SEQ ID NO: 45317 - DNA, 20 bp, Artificial Sequence
  chemically synthesized
aaaaattggaatgactgaat

SEQ ID NO: 45318 - DNA, 20 bp, Artificial Sequence
  chemically synthesized
tggaatgactgaatcggaac

SEQ ID NO: 45319 - DNA, 20 bp, Artificial Sequence
  chemically synthesized
ggaatgactgaatcggaaca

SEQ ID NO: 45320 - DNA, 20 bp, Artificial Sequence
  chemically synthesized
gactgaatcggaacaaggca

SEQ ID NO: 45321 - DNA, 20 bp, Artificial Sequence
  chemically synthesized
actgaatcggaacaaggcaa

SEQ ID NO: 45322 - DNA, 20 bp, Artificial Sequence
  chemically synthesized
caaaggctataaaaaaaatt

SEQ ID NO: 45323 - DNA, 20 bp, Artificial Sequence
  chemically synthesized
aggctataaaaaaaattaag

SEQ ID NO: 45324 - DNA, 20 bp, Artificial Sequence
  chemically synthesized
ctataaaaaaaattaagcag

SEQ ID NO: 45325 - DNA, 20 bp, Artificial Sequence
  chemically synthesized
attaagcagcagtatcctct

SEQ ID NO: 45326 - DNA, 20 bp, Artificial Sequence
  chemically synthesized
ttaagcagcagtatcctctt

SEQ ID NO: 45327 - DNA, 20 bp, Artificial Sequence
  chemically synthesized
taagcagcagtatcctcttg

SEQ ID NO: 45328 - DNA, 20 bp, Artificial Sequence
  chemically synthesized
aagcagcagtatcctcttgg

SEQ ID NO: 45329 - DNA, 20 bp, Artificial Sequence
  chemically synthesized
atgcaaatatctgtctgaaa

SEQ ID NO: 45330 - DNA, 20 bp, Artificial Sequence
  chemically synthesized
tatctgtctgaaacggtccc

SEQ ID NO: 45331 - DNA, 20 bp, Artificial Sequence
  chemically synthesized
ccctggctaaactccaccca

SEQ ID NO: 45332 - DNA, 20 bp, Artificial Sequence
  chemically synthesized
cctggctaaactccacccat

SEQ ID NO: 45333 - DNA, 20 bp, Artificial Sequence
  chemically synthesized
gctaaactccacccatgggt

SEQ ID NO: 45334 - DNA, 20 bp, Artificial Sequence
  chemically synthesized
aactccacccatgggttggc

SEQ ID NO: 45335 - DNA, 20 bp, Artificial Sequence
  chemically synthesized
gccagccttgccttgaccaa

SEQ ID NO: 45336 - DNA, 20 bp, Artificial Sequence
  chemically synthesized
ccttgaccaatagccttgac

SEQ ID NO: 45337 - DNA, 20 bp, Artificial Sequence
  chemically synthesized
cttgaccaatagccttgaca

SEQ ID NO: 45338 - DNA, 20 bp, Artificial Sequence
  chemically synthesized
gacaaggcaaacttgaccaa

SEQ ID NO: 45339 - DNA, 20 bp, Artificial Sequence
  chemically synthesized
gcaaacttgaccaatagtct

SEQ ID NO: 45340 - DNA, 20 bp, Artificial Sequence
  chemically synthesized
aaacttgaccaatagtctta

SEQ ID NO: 45341 - DNA, 20 bp, Artificial Sequence
  chemically synthesized
accaatagtcttagagtatc

SEQ ID NO: 45342 - DNA, 20 bp, Artificial Sequence
  chemically synthesized
atagtcttagagtatccagt

SEQ ID NO: 45343 - DNA, 20 bp, Artificial Sequence
  chemically synthesized
tagtcttagagtatccagtg

SEQ ID NO: 45344 - DNA, 20 bp, Artificial Sequence
  chemically synthesized
cttagagtatccagtgaggc

SEQ ID NO: 45345 - DNA, 20 bp, Artificial Sequence
  chemically synthesized
ttagagtatccagtgaggcc

SEQ ID NO: 45346 - DNA, 20 bp, Artificial Sequence
  chemically synthesized
tagagtatccagtgaggcca

SEQ ID NO: 45347 - DNA, 20 bp, Artificial Sequence
  chemically synthesized
agagtatccagtgaggccag

SEQ ID NO: 45348 - DNA, 20 bp, Artificial Sequence
  chemically synthesized
tatccagtgaggccaggggc

SEQ ID NO: 45349 - DNA, 20 bp, Artificial Sequence
  chemically synthesized
ccagtgaggccaggggccgg

SEQ ID NO: 45350 - DNA, 20 bp, Artificial Sequence
  chemically synthesized
tgaggccaggggccggcggc

SEQ ID NO: 45351 - DNA, 20 bp, Artificial Sequence
  chemically synthesized
gccaggggccggcggctggc

SEQ ID NO: 45352 - DNA, 20 bp, Artificial Sequence
  chemically synthesized
ccaggggccggcggctggct

SEQ ID NO: 45353 - DNA, 20 bp, Artificial Sequence
  chemically synthesized
caggggccggcggctggcta

SEQ ID NO: 45354 - DNA, 20 bp, Artificial Sequence
  chemically synthesized
ccggcggctggctagggatg

SEQ ID NO: 45355 - DNA, 20 bp, Artificial Sequence
  chemically synthesized
tggctagggatgaagaataa

SEQ ID NO: 45356 - DNA, 20 bp, Artificial Sequence
  chemically synthesized
ggctagggatgaagaataaa

SEQ ID NO: 45357 - DNA, 20 bp, Artificial Sequence
  chemically synthesized
tagggatgaagaataaaagg

SEQ ID NO: 45358 - DNA, 20 bp, Artificial Sequence
  chemically synthesized
gaataaaaggaagcaccctt

SEQ ID NO: 45359 - DNA, 20 bp, Artificial Sequence
  chemically synthesized
taaaaggaagcacccttcag

SEQ ID NO: 45360 - DNA, 20 bp, Artificial Sequence
  chemically synthesized
cagttccacacactcgcttc

SEQ ID NO: 45361 - DNA, 20 bp, Artificial Sequence
  chemically synthesized
cactcgcttctggaacgtct

SEQ ID NO: 45362 - DNA, 20 bp, Artificial Sequence
  chemically synthesized
actcgcttctggaacgtctg

SEQ ID NO: 45363 - DNA, 20 bp, Artificial Sequence
  chemically synthesized
gaacgtctgaggttatcaat

SEQ ID NO: 45364 - DNA, 20 bp, Artificial Sequence
  chemically synthesized
tgaggttatcaataagctcc

SEQ ID NO: 45365 - DNA, 20 bp, Artificial Sequence
  chemically synthesized
ttatcaataagctcctagtc

SEQ ID NO: 45366 - DNA, 20 bp, Artificial Sequence
  chemically synthesized
agctcctagtccagacgcca

SEQ ID NO: 45367 - DNA, 20 bp, Artificial Sequence
  chemically synthesized
gctcctagtccagacgccat

SEQ ID NO: 45368 - DNA, 20 bp, Artificial Sequence
  chemically synthesized
agacgccatgggtcatttca

SEQ ID NO: 45369 - DNA, 20 bp, Artificial Sequence
  chemically synthesized
acgccatgggtcatttcaca

SEQ ID NO: 45370 - DNA, 20 bp, Artificial Sequence
  chemically synthesized
cgccatgggtcatttcacag

SEQ ID NO: 45371 - DNA, 20 bp, Artificial Sequence
  chemically synthesized
ccatgggtcatttcacagag

SEQ ID NO: 45372 - DNA, 20 bp, Artificial Sequence
  chemically synthesized
catgggtcatttcacagagg

SEQ ID NO: 45373 - DNA, 20 bp, Artificial Sequence
  chemically synthesized
gtcatttcacagaggaggac

SEQ ID NO: 45374 - DNA, 20 bp, Artificial Sequence
  chemically synthesized
tcatttcacagaggaggaca

SEQ ID NO: 45375 - DNA, 20 bp, Artificial Sequence
  chemically synthesized
gaggacaaggctactatcac

SEQ ID NO: 45376 - DNA, 20 bp, Artificial Sequence
  chemically synthesized
aggctactatcacaagcctg

SEQ ID NO: 45377 - DNA, 20 bp, Artificial Sequence
  chemically synthesized
ggctactatcacaagcctgt

SEQ ID NO: 45378 - DNA, 20 bp, Artificial Sequence
  chemically synthesized
gctactatcacaagcctgtg

SEQ ID NO: 45379 - DNA, 20 bp, Artificial Sequence
  chemically synthesized
ctatcacaagcctgtggggc

SEQ ID NO: 45380 - DNA, 20 bp, Artificial Sequence
  chemically synthesized
tatcacaagcctgtggggca

SEQ ID NO: 45381 - DNA, 20 bp, Artificial Sequence
  chemically synthesized
cctgtggggcaaggtgaatg

SEQ ID NO: 45382 - DNA, 20 bp, Artificial Sequence
  chemically synthesized
gtggggcaaggtgaatgtgg

SEQ ID NO: 45383 - DNA, 20 bp, Artificial Sequence
  chemically synthesized
aaggtgaatgtggaagatgc

SEQ ID NO: 45384 - DNA, 20 bp, Artificial Sequence
  chemically synthesized
ggtgaatgtggaagatgctg

SEQ ID NO: 45385 - DNA, 20 bp, Artificial Sequence
  chemically synthesized
gtgaatgtggaagatgctgg

SEQ ID NO: 45386 - DNA, 20 bp, Artificial Sequence
  chemically synthesized
gaatgtggaagatgctggag

SEQ ID NO: 45387 - DNA, 20 bp, Artificial Sequence
  chemically synthesized
agatgctggaggagaaaccc

SEQ ID NO: 45388 - DNA, 20 bp, Artificial Sequence
  chemically synthesized
gatgctggaggagaaaccct

SEQ ID NO: 45389 - DNA, 20 bp, Artificial Sequence
  chemically synthesized
gctggaggagaaaccctggg

SEQ ID NO: 45390 - DNA, 20 bp, Artificial Sequence
  chemically synthesized
ctggaggagaaaccctggga

SEQ ID NO: 45391 - DNA, 20 bp, Artificial Sequence
  chemically synthesized
gaggagaaaccctgggaagg

SEQ ID NO: 45392 - DNA, 20 bp, Artificial Sequence
  chemically synthesized
aggagaaaccctgggaaggt

SEQ ID NO: 45393 - DNA, 20 bp, Artificial Sequence
  chemically synthesized
aaccctgggaaggtaggctc

SEQ ID NO: 45394 - DNA, 20 bp, Artificial Sequence
  chemically synthesized
ggaaggtaggctctggtgac

SEQ ID NO: 45395 - DNA, 20 bp, Artificial Sequence
  chemically synthesized
gaaggtaggctctggtgacc

SEQ ID NO: 45396 - DNA, 20 bp, Artificial Sequence
  chemically synthesized
taggctctggtgaccaggac

SEQ ID NO: 45397 - DNA, 20 bp, Artificial Sequence
  chemically synthesized
aggctctggtgaccaggaca

SEQ ID NO: 45398 - DNA, 20 bp, Artificial Sequence
  chemically synthesized
ggctctggtgaccaggacaa

SEQ ID NO: 45399 - DNA, 20 bp, Artificial Sequence
  chemically synthesized
ctctggtgaccaggacaagg

SEQ ID NO: 45400 - DNA, 20 bp, Artificial Sequence
  chemically synthesized
tctggtgaccaggacaaggg

SEQ ID NO: 45401 - DNA, 20 bp, Artificial Sequence
  chemically synthesized
ctggtgaccaggacaaggga

SEQ ID NO: 45402 - DNA, 20 bp, Artificial Sequence
  chemically synthesized
gtgaccaggacaagggaggg

SEQ ID NO: 45403 - DNA, 20 bp, Artificial Sequence
  chemically synthesized
tgaccaggacaagggaggga

SEQ ID NO: 45404 - DNA, 20 bp, Artificial Sequence
  chemically synthesized
ccaggacaagggagggaagg

SEQ ID NO: 45405 - DNA, 20 bp, Artificial Sequence
  chemically synthesized
caggacaagggagggaagga

SEQ ID NO: 45406 - DNA, 20 bp, Artificial Sequence
  chemically synthesized
ggaaggaaggaccctgtgcc

SEQ ID NO: 45407 - DNA, 20 bp, Artificial Sequence
  chemically synthesized
aaggaccctgtgcctggcaa

SEQ ID NO: 45408 - DNA, 20 bp, Artificial Sequence
  chemically synthesized
ccctgtgcctggcaaaagtc

SEQ ID NO: 45409 - DNA, 20 bp, Artificial Sequence
  chemically synthesized
cctgtgcctggcaaaagtcc

SEQ ID NO: 45410 - DNA, 20 bp, Artificial Sequence
  chemically synthesized
caaaagtccaggtcgcttct

SEQ ID NO: 45411 - DNA, 20 bp, Artificial Sequence
  chemically synthesized
aaaagtccaggtcgcttctc

SEQ ID NO: 45412 - DNA, 20 bp, Artificial Sequence
  chemically synthesized
aggtcgcttctcaggatttg

SEQ ID NO: 45413 - DNA, 20 bp, Artificial Sequence
  chemically synthesized
aactgttcttgtcaatctca

SEQ ID NO: 45414 - DNA, 20 bp, Artificial Sequence
  chemically synthesized
actgttcttgtcaatctcac

SEQ ID NO: 45415 - DNA, 20 bp, Artificial Sequence
  chemically synthesized
ttgtcaatctcacaggctcc

SEQ ID NO: 45416 - DNA, 20 bp, Artificial Sequence
  chemically synthesized
ggctcctggttgtctaccca

SEQ ID NO: 45417 - DNA, 20 bp, Artificial Sequence
  chemically synthesized
tggttgtctacccatggacc

SEQ ID NO: 45418 - DNA, 20 bp, Artificial Sequence
  chemically synthesized
gttgtctacccatggaccca

SEQ ID NO: 45419 - DNA, 20 bp, Artificial Sequence
  chemically synthesized
ttgtctacccatggacccag

SEQ ID NO: 45420 - DNA, 20 bp, Artificial Sequence
  chemically synthesized
tggacccagaggttctttga

SEQ ID NO: 45421 - DNA, 20 bp, Artificial Sequence
  chemically synthesized
cagaggttctttgacagctt

SEQ ID NO: 45422 - DNA, 20 bp, Artificial Sequence
  chemically synthesized
gtcctctgcctctgccatca

SEQ ID NO: 45423 - DNA, 20 bp, Artificial Sequence
  chemically synthesized
tcctctgcctctgccatcat

SEQ ID NO: 45424 - DNA, 20 bp, Artificial Sequence
  chemically synthesized
tgccatcatgggcaacccca

SEQ ID NO: 45425 - DNA, 20 bp, Artificial Sequence
  chemically synthesized
tcatgggcaaccccaaagtc

SEQ ID NO: 45426 - DNA, 20 bp, Artificial Sequence
  chemically synthesized
catgggcaaccccaaagtca

SEQ ID NO: 45427 - DNA, 20 bp, Artificial Sequence
  chemically synthesized
aaccccaaagtcaaggcaca

SEQ ID NO: 45428 - DNA, 20 bp, Artificial Sequence
  chemically synthesized
ccaaagtcaaggcacatggc

SEQ ID NO: 45429 - DNA, 20 bp, Artificial Sequence
  chemically synthesized
aagtcaaggcacatggcaag

SEQ ID NO: 45430 - DNA, 20 bp, Artificial Sequence
  chemically synthesized
agtcaaggcacatggcaaga

SEQ ID NO: 45431 - DNA, 20 bp, Artificial Sequence
  chemically synthesized
caagaaggtgctgacttcct

SEQ ID NO: 45432 - DNA, 20 bp, Artificial Sequence
  chemically synthesized
aagaaggtgctgacttcctt

SEQ ID NO: 45433 - DNA, 20 bp, Artificial Sequence
  chemically synthesized
gaaggtgctgacttccttgg

SEQ ID NO: 45434 - DNA, 20 bp, Artificial Sequence
  chemically synthesized
cttccttgggagatgccata

SEQ ID NO: 45435 - DNA, 20 bp, Artificial Sequence
  chemically synthesized
gggagatgccataaagcacc

SEQ ID NO: 45436 - DNA, 20 bp, Artificial Sequence
  chemically synthesized
taaagcacctggatgatctc

SEQ ID NO: 45437 - DNA, 20 bp, Artificial Sequence
  chemically synthesized
aaagcacctggatgatctca

SEQ ID NO: 45438 - DNA, 20 bp, Artificial Sequence
  chemically synthesized
aagcacctggatgatctcaa

SEQ ID NO: 45439 - DNA, 20 bp, Artificial Sequence
  chemically synthesized
atctcaagggcacctttgcc

SEQ ID NO: 45440 - DNA, 20 bp, Artificial Sequence
  chemically synthesized
aagggcacctttgcccagct

SEQ ID NO: 45441 - DNA, 20 bp, Artificial Sequence
  chemically synthesized
tgagtgaactgcactgtgac

SEQ ID NO: 45442 - DNA, 20 bp, Artificial Sequence
  chemically synthesized
gcactgtgacaagctgcatg

SEQ ID NO: 45443 - DNA, 20 bp, Artificial Sequence
  chemically synthesized
acaagctgcatgtggatcct

SEQ ID NO: 45444 - DNA, 20 bp, Artificial Sequence
  chemically synthesized
atgtggatcctgagaacttc

SEQ ID NO: 45445 - DNA, 20 bp, Artificial Sequence
  chemically synthesized
tgtggatcctgagaacttca

SEQ ID NO: 45446 - DNA, 20 bp, Artificial Sequence
  chemically synthesized
gatcctgagaacttcaaggt

SEQ ID NO: 45447 - DNA, 20 bp, Artificial Sequence
  chemically synthesized
tgagaacttcaaggtgagtc

SEQ ID NO: 45448 - DNA, 20 bp, Artificial Sequence
  chemically synthesized
gagaacttcaaggtgagtcc

SEQ ID NO: 45449 - DNA, 20 bp, Artificial Sequence
  chemically synthesized
gaacttcaaggtgagtccag

SEQ ID NO: 45450 - DNA, 20 bp, Artificial Sequence
  chemically synthesized
ggtgagtccaggagatgttt

SEQ ID NO: 45451 - DNA, 20 bp, Artificial Sequence
  chemically synthesized
tgtttcagcactgttgcctt

SEQ ID NO: 45452 - DNA, 20 bp, Artificial Sequence
  chemically synthesized
gcactgttgcctttagtctc

SEQ ID NO: 45453 - DNA, 20 bp, Artificial Sequence
  chemically synthesized
cactgttgcctttagtctcg

SEQ ID NO: 45454 - DNA, 20 bp, Artificial Sequence
  chemically synthesized
cctttagtctcgaggcaact

SEQ ID NO: 45455 - DNA, 20 bp, Artificial Sequence
  chemically synthesized
tcgaggcaacttagacaact

SEQ ID NO: 45456 - DNA, 20 bp, Artificial Sequence
  chemically synthesized
agacaactgagtattgatct

SEQ ID NO: 45457 - DNA, 20 bp, Artificial Sequence
  chemically synthesized
actgagtattgatctgagca

SEQ ID NO: 45458 - DNA, 20 bp, Artificial Sequence
  chemically synthesized
gagtattgatctgagcacag

SEQ ID NO: 45459 - DNA, 20 bp, Artificial Sequence
  chemically synthesized
agtattgatctgagcacagc

SEQ ID NO: 45460 - DNA, 20 bp, Artificial Sequence
  chemically synthesized
gtattgatctgagcacagca

SEQ ID NO: 45461 - DNA, 20 bp, Artificial Sequence
  chemically synthesized
atctgagcacagcagggtgt

SEQ ID NO: 45462 - DNA, 20 bp, Artificial Sequence
  chemically synthesized
agcagggtgtgagctgtttg

SEQ ID NO: 45463 - DNA, 20 bp, Artificial Sequence
  chemically synthesized
tgtgagctgtttgaagatac

SEQ ID NO: 45464 - DNA, 20 bp, Artificial Sequence
  chemically synthesized
gtgagctgtttgaagatact

SEQ ID NO: 45465 - DNA, 20 bp, Artificial Sequence
  chemically synthesized
tgagctgtttgaagatactg

SEQ ID NO: 45466 - DNA, 20 bp, Artificial Sequence
  chemically synthesized
ctgtttgaagatactggggt

SEQ ID NO: 45467 - DNA, 20 bp, Artificial Sequence
  chemically synthesized
tgtttgaagatactggggtt

SEQ ID NO: 45468 - DNA, 20 bp, Artificial Sequence
  chemically synthesized
tttgaagatactggggttgg

SEQ ID NO: 45469 - DNA, 20 bp, Artificial Sequence
  chemically synthesized
agatactggggttgggagtg

SEQ ID NO: 45470 - DNA, 20 bp, Artificial Sequence
  chemically synthesized
ggttgggagtgaagaaactg

SEQ ID NO: 45471 - DNA, 20 bp, Artificial Sequence
  chemically synthesized
ttgggagtgaagaaactgca

SEQ ID NO: 45472 - DNA, 20 bp, Artificial Sequence
  chemically synthesized
tgggagtgaagaaactgcag

SEQ ID NO: 45473 - DNA, 20 bp, Artificial Sequence
  chemically synthesized
agaaactgcagaggactaac

SEQ ID NO: 45474 - DNA, 20 bp, Artificial Sequence
  chemically synthesized
gaaactgcagaggactaact

SEQ ID NO: 45475 - DNA, 20 bp, Artificial Sequence
  chemically synthesized
tgcagaggactaactgggct

SEQ ID NO: 45476 - DNA, 20 bp, Artificial Sequence
  chemically synthesized
ggactaactgggctgagacc

SEQ ID NO: 45477 - DNA, 20 bp, Artificial Sequence
  chemically synthesized
ctaactgggctgagacccag

SEQ ID NO: 45478 - DNA, 20 bp, Artificial Sequence
  chemically synthesized
gagacccagtggcaatgttt

SEQ ID NO: 45479 - DNA, 20 bp, Artificial Sequence
  chemically synthesized
agacccagtggcaatgtttt

SEQ ID NO: 45480 - DNA, 20 bp, Artificial Sequence
  chemically synthesized
gacccagtggcaatgtttta

SEQ ID NO: 45481 - DNA, 20 bp, Artificial Sequence
  chemically synthesized
gtggcaatgttttagggcct

SEQ ID NO: 45482 - DNA, 20 bp, Artificial Sequence
  chemically synthesized
tggcaatgttttagggccta

SEQ ID NO: 45483 - DNA, 20 bp, Artificial Sequence
  chemically synthesized
gcaatgttttagggcctaag

SEQ ID NO: 45484 - DNA, 20 bp, Artificial Sequence
  chemically synthesized
aaggagtgcctctgaaaatc

SEQ ID NO: 45485 - DNA, 20 bp, Artificial Sequence
  chemically synthesized
agtgcctctgaaaatctaga

SEQ ID NO: 45486 - DNA, 20 bp, Artificial Sequence
  chemically synthesized
agatggacaactttgacttt

SEQ ID NO: 45487 - DNA, 20 bp, Artificial Sequence
  chemically synthesized
gacaactttgactttgagaa

SEQ ID NO: 45488 - DNA, 20 bp, Artificial Sequence
  chemically synthesized
caactttgactttgagaaaa

SEQ ID NO: 45489 - DNA, 20 bp, Artificial Sequence
  chemically synthesized
actttgactttgagaaaaga

SEQ ID NO: 45490 - DNA, 20 bp, Artificial Sequence
  chemically synthesized
ctttgactttgagaaaagag

SEQ ID NO: 45491 - DNA, 20 bp, Artificial Sequence
  chemically synthesized
tgactttgagaaaagagagg

SEQ ID NO: 45492 - DNA, 20 bp, Artificial Sequence
  chemically synthesized
gagaaaagagaggtggaaat

SEQ ID NO: 45493 - DNA, 20 bp, Artificial Sequence
  chemically synthesized
agaaaagagaggtggaaatg

SEQ ID NO: 45494 - DNA, 20 bp, Artificial Sequence
  chemically synthesized
ggaaaatgacttttctttat

SEQ ID NO: 45495 - DNA, 20 bp, Artificial Sequence
  chemically synthesized
gacttttctttattagattt

SEQ ID NO: 45496 - DNA, 20 bp, Artificial Sequence
  chemically synthesized
ttttctttattagatttcgg

SEQ ID NO: 45497 - DNA, 20 bp, Artificial Sequence
  chemically synthesized
ctttattagatttcggtaga

SEQ ID NO: 45498 - DNA, 20 bp, Artificial Sequence
  chemically synthesized
ttcgttttaaaacatctatc

SEQ ID NO: 45499 - DNA, 20 bp, Artificial Sequence
  chemically synthesized
cgttttaaaacatctatctg

SEQ ID NO: 45500 - DNA, 20 bp, Artificial Sequence
  chemically synthesized
gttttaaaacatctatctgg

SEQ ID NO: 45501 - DNA, 20 bp, Artificial Sequence
  chemically synthesized
ttaaaacatctatctggagg

SEQ ID NO: 45502 - DNA, 20 bp, Artificial Sequence
  chemically synthesized
taaaacatctatctggaggc

SEQ ID NO: 45503 - DNA, 20 bp, Artificial Sequence
  chemically synthesized
catctatctggaggcaggac

SEQ ID NO: 45504 - DNA, 20 bp, Artificial Sequence
  chemically synthesized
atctggaggcaggacaagta

SEQ ID NO: 45505 - DNA, 20 bp, Artificial Sequence
  chemically synthesized
ggacaagtatggtcattaaa

SEQ ID NO: 45506 - DNA, 20 bp, Artificial Sequence
  chemically synthesized
gtatggtcattaaaaagatg

SEQ ID NO: 45507 - DNA, 20 bp, Artificial Sequence
  chemically synthesized
tatggtcattaaaaagatgc

SEQ ID NO: 45508 - DNA, 20 bp, Artificial Sequence
  chemically synthesized
ggtcattaaaaagatgcagg

SEQ ID NO: 45509 - DNA, 20 bp, Artificial Sequence
  chemically synthesized
cattaaaaagatgcaggcag

SEQ ID NO: 45510 - DNA, 20 bp, Artificial Sequence
  chemically synthesized
attaaaaagatgcaggcaga

SEQ ID NO: 45511 - DNA, 20 bp, Artificial Sequence
  chemically synthesized
tgcaggcagaaggcatatat

SEQ ID NO: 45512 - DNA, 20 bp, Artificial Sequence
  chemically synthesized
gcagaaggcatatattggct

SEQ ID NO: 45513 - DNA, 20 bp, Artificial Sequence
  chemically synthesized
ggcatatattggctcagtca

SEQ ID NO: 45514 - DNA, 20 bp, Artificial Sequence
  chemically synthesized
atatattggctcagtcaaag

SEQ ID NO: 45515 - DNA, 20 bp, Artificial Sequence
  chemically synthesized
tatattggctcagtcaaagt

SEQ ID NO: 45516 - DNA, 20 bp, Artificial Sequence
  chemically synthesized
atattggctcagtcaaagtg

SEQ ID NO: 45517 - DNA, 20 bp, Artificial Sequence
  chemically synthesized
tcagtcaaagtggggaactt

SEQ ID NO: 45518 - DNA, 20 bp, Artificial Sequence
  chemically synthesized
gtcaaagtggggaactttgg

SEQ ID NO: 45519 - DNA, 20 bp, Artificial Sequence
  chemically synthesized
gtggccaaacatacattgct

SEQ ID NO: 45520 - DNA, 20 bp, Artificial Sequence
  chemically synthesized
tggccaaacatacattgcta

SEQ ID NO: 45521 - DNA, 20 bp, Artificial Sequence
  chemically synthesized
tgctaaggctattcctatat

SEQ ID NO: 45522 - DNA, 20 bp, Artificial Sequence
  chemically synthesized
aaggctattcctatatcagc

SEQ ID NO: 45523 - DNA, 20 bp, Artificial Sequence
  chemically synthesized
aaacttatatcctttaattc

SEQ ID NO: 45524 - DNA, 20 bp, Artificial Sequence
  chemically synthesized
ttatatcctttaattccaga

SEQ ID NO: 45525 - DNA, 20 bp, Artificial Sequence
  chemically synthesized
tatatcctttaattccagat

SEQ ID NO: 45526 - DNA, 20 bp, Artificial Sequence
  chemically synthesized
atatcctttaattccagatg

SEQ ID NO: 45527 - DNA, 20 bp, Artificial Sequence
  chemically synthesized
tatcctttaattccagatgg

SEQ ID NO: 45528 - DNA, 20 bp, Artificial Sequence
  chemically synthesized
tttaattccagatgggggca

SEQ ID NO: 45529 - DNA, 20 bp, Artificial Sequence
  chemically synthesized
agatgggggcaaagtatgtc

SEQ ID NO: 45530 - DNA, 20 bp, Artificial Sequence
  chemically synthesized
gatgggggcaaagtatgtcc

SEQ ID NO: 45531 - DNA, 20 bp, Artificial Sequence
  chemically synthesized
atgggggcaaagtatgtcca

SEQ ID NO: 45532 - DNA, 20 bp, Artificial Sequence
  chemically synthesized
tgggggcaaagtatgtccag

SEQ ID NO: 45533 - DNA, 20 bp, Artificial Sequence
  chemically synthesized
ggcaaagtatgtccaggggt

SEQ ID NO: 45534 - DNA, 20 bp, Artificial Sequence
  chemically synthesized
gcaaagtatgtccaggggtg

SEQ ID NO: 45535 - DNA, 20 bp, Artificial Sequence
  chemically synthesized
tgaggaacaattgaaacatt

SEQ ID NO: 45536 - DNA, 20 bp, Artificial Sequence
  chemically synthesized
gaggaacaattgaaacattt

SEQ ID NO: 45537 - DNA, 20 bp, Artificial Sequence
  chemically synthesized
aacaattgaaacatttgggc

SEQ ID NO: 45538 - DNA, 20 bp, Artificial Sequence
  chemically synthesized
caattgaaacatttgggctg

SEQ ID NO: 45539 - DNA, 20 bp, Artificial Sequence
  chemically synthesized
ttgaaacatttgggctggag

SEQ ID NO: 45540 - DNA, 20 bp, Artificial Sequence
  chemically synthesized
tgggctggagtagattttga

SEQ ID NO: 45541 - DNA, 20 bp, Artificial Sequence
  chemically synthesized
ctggagtagattttgaaagt

SEQ ID NO: 45542 - DNA, 20 bp, Artificial Sequence
  chemically synthesized
gcgtgtgtttgtgtgtgtgt

SEQ ID NO: 45543 - DNA, 20 bp, Artificial Sequence
  chemically synthesized
gtgtgtttgtgtgtgtgtga

SEQ ID NO: 45544 - DNA, 20 bp, Artificial Sequence
  chemically synthesized
tgtgtttcttttaacgtttt

SEQ ID NO: 45545 - DNA, 20 bp, Artificial Sequence
  chemically synthesized
cttttaacgttttcagccta

SEQ ID NO: 45546 - DNA, 20 bp, Artificial Sequence
  chemically synthesized
cgttttcagcctacagcata

SEQ ID NO: 45547 - DNA, 20 bp, Artificial Sequence
  chemically synthesized
gttttcagcctacagcatac

SEQ ID NO: 45548 - DNA, 20 bp, Artificial Sequence
  chemically synthesized
ttttcagcctacagcataca

SEQ ID NO: 45549 - DNA, 20 bp, Artificial Sequence
  chemically synthesized
cctacagcatacagggttca

SEQ ID NO: 45550 - DNA, 20 bp, Artificial Sequence
  chemically synthesized
acagcatacagggttcatgg

SEQ ID NO: 45551 - DNA, 20 bp, Artificial Sequence
  chemically synthesized
catacagggttcatggtggc

SEQ ID NO: 45552 - DNA, 20 bp, Artificial Sequence
  chemically synthesized
acagggttcatggtggcaag

SEQ ID NO: 45553 - DNA, 20 bp, Artificial Sequence
  chemically synthesized
catggtggcaagaagataac

SEQ ID NO: 45554 - DNA, 20 bp, Artificial Sequence
  chemically synthesized
agataacaagatttaaatta

SEQ ID NO: 45555 - DNA, 20 bp, Artificial Sequence
  chemically synthesized
aacaagatttaaattatggc

SEQ ID NO: 45556 - DNA, 20 bp, Artificial Sequence
  chemically synthesized
tttaaattatggccagtgac

SEQ ID NO: 45557 - DNA, 20 bp, Artificial Sequence
  chemically synthesized
tggccagtgactagtgctgc

SEQ ID NO: 45558 - DNA, 20 bp, Artificial Sequence
  chemically synthesized
ccagtgactagtgctgcaag

SEQ ID NO: 45559 - DNA, 20 bp, Artificial Sequence
  chemically synthesized
gaacaactacctgcatttaa

SEQ ID NO: 45560 - DNA, 20 bp, Artificial Sequence
  chemically synthesized
aacaactacctgcatttaat

SEQ ID NO: 45561 - DNA, 20 bp, Artificial Sequence
  chemically synthesized
actacctgcatttaatggga

SEQ ID NO: 45562 - DNA, 20 bp, Artificial Sequence
  chemically synthesized
ttaatgggaaagcaaaatct

SEQ ID NO: 45563 - DNA, 20 bp, Artificial Sequence
  chemically synthesized
taatgggaaagcaaaatctc

SEQ ID NO: 45564 - DNA, 20 bp, Artificial Sequence
  chemically synthesized
aaagcaaaatctcaggcttt

SEQ ID NO: 45565 - DNA, 20 bp, Artificial Sequence
  chemically synthesized
aagcaaaatctcaggctttg

SEQ ID NO: 45566 - DNA, 20 bp, Artificial Sequence
  chemically synthesized
agcaaaatctcaggctttga

SEQ ID NO: 45567 - DNA, 20 bp, Artificial Sequence
  chemically synthesized
aaaatctcaggctttgaggg

SEQ ID NO: 45568 - DNA, 20 bp, Artificial Sequence
  chemically synthesized
ggctttgagggaagttaaca

SEQ ID NO: 45569 - DNA, 20 bp, Artificial Sequence
  chemically synthesized
gctttgagggaagttaacat

SEQ ID NO: 45570 - DNA, 20 bp, Artificial Sequence
  chemically synthesized
agttaacataggcttgattc

SEQ ID NO: 45571 - DNA, 20 bp, Artificial Sequence
  chemically synthesized
gttaacataggcttgattct

SEQ ID NO: 45572 - DNA, 20 bp, Artificial Sequence
  chemically synthesized
aacataggcttgattctggg

SEQ ID NO: 45573 - DNA, 20 bp, Artificial Sequence
  chemically synthesized
ataggcttgattctgggtgg

SEQ ID NO: 45574 - DNA, 20 bp, Artificial Sequence
  chemically synthesized
cttgattctgggtggaagct

SEQ ID NO: 45575 - DNA, 20 bp, Artificial Sequence
  chemically synthesized
ctgggtggaagcttggtgtg

SEQ ID NO: 45576 - DNA, 20 bp, Artificial Sequence
  chemically synthesized
aagcttggtgtgtagttatc

SEQ ID NO: 45577 - DNA, 20 bp, Artificial Sequence
  chemically synthesized
gcttggtgtgtagttatctg

SEQ ID NO: 45578 - DNA, 20 bp, Artificial Sequence
  chemically synthesized
cttggtgtgtagttatctgg

SEQ ID NO: 45579 - DNA, 20 bp, Artificial Sequence
  chemically synthesized
gtgtgtagttatctggaggc

SEQ ID NO: 45580 - DNA, 20 bp, Artificial Sequence
  chemically synthesized
tgtgtagttatctggaggcc

SEQ ID NO: 45581 - DNA, 20 bp, Artificial Sequence
  chemically synthesized
tagttatctggaggccaggc

SEQ ID NO: 45582 - DNA, 20 bp, Artificial Sequence
  chemically synthesized
gttatctggaggccaggctg

SEQ ID NO: 45583 - DNA, 20 bp, Artificial Sequence
  chemically synthesized
ggaggccaggctggagctct

SEQ ID NO: 45584 - DNA, 20 bp, Artificial Sequence
  chemically synthesized
ctggagctctcagctcacta

SEQ ID NO: 45585 - DNA, 20 bp, Artificial Sequence
  chemically synthesized
tggagctctcagctcactat

SEQ ID NO: 45586 - DNA, 20 bp, Artificial Sequence
  chemically synthesized
attgtctcctttcatctcaa

SEQ ID NO: 45587 - DNA, 20 bp, Artificial Sequence
  chemically synthesized
cctttcatctcaacagctcc

SEQ ID NO: 45588 - DNA, 20 bp, Artificial Sequence
  chemically synthesized
ctttcatctcaacagctcct

SEQ ID NO: 45589 - DNA, 20 bp, Artificial Sequence
  chemically synthesized
acagctcctgggaaatgtgc

SEQ ID NO: 45590 - DNA, 20 bp, Artificial Sequence
  chemically synthesized
aaatgtgctggtgaccgttt

SEQ ID NO: 45591 - DNA, 20 bp, Artificial Sequence
  chemically synthesized
accgttttggcaatccattt

SEQ ID NO: 45592 - DNA, 20 bp, Artificial Sequence
  chemically synthesized
tttggcaatccatttcggca

SEQ ID NO: 45593 - DNA, 20 bp, Artificial Sequence
  chemically synthesized
tcggcaaagaattcacccct

SEQ ID NO: 45594 - DNA, 20 bp, Artificial Sequence
  chemically synthesized
cggcaaagaattcacccctg

SEQ ID NO: 45595 - DNA, 20 bp, Artificial Sequence
  chemically synthesized
aagaattcacccctgaggtg

SEQ ID NO: 45596 - DNA, 20 bp, Artificial Sequence
  chemically synthesized
agaattcacccctgaggtgc

SEQ ID NO: 45597 - DNA, 20 bp, Artificial Sequence
  chemically synthesized
cccctgaggtgcaggcttcc

SEQ ID NO: 45598 - DNA, 20 bp, Artificial Sequence
  chemically synthesized
ctgaggtgcaggcttcctgg

SEQ ID NO: 45599 - DNA, 20 bp, Artificial Sequence
  chemically synthesized
aggtgcaggcttcctggcag

SEQ ID NO: 45600 - DNA, 20 bp, Artificial Sequence
  chemically synthesized
gcaggcttcctggcagaaga

SEQ ID NO: 45601 - DNA, 20 bp, Artificial Sequence
  chemically synthesized
tcctggcagaagatggtgac

SEQ ID NO: 45602 - DNA, 20 bp, Artificial Sequence
  chemically synthesized
ctggcagaagatggtgactg

SEQ ID NO: 45603 - DNA, 20 bp, Artificial Sequence
  chemically synthesized
gcagaagatggtgactggag

SEQ ID NO: 45604 - DNA, 20 bp, Artificial Sequence
  chemically synthesized
aagatggtgactggagtggc

SEQ ID NO: 45605 - DNA, 20 bp, Artificial Sequence
  chemically synthesized
gtggccagtgccctgtcctc

SEQ ID NO: 45606 - DNA, 20 bp, Artificial Sequence
  chemically synthesized
cctgtcctccagataccact

SEQ ID NO: 45607 - DNA, 20 bp, Artificial Sequence
  chemically synthesized
tgagctcactgcccatgatg

SEQ ID NO: 45608 - DNA, 20 bp, Artificial Sequence
  chemically synthesized
agctcactgcccatgatgca

SEQ ID NO: 45609 - DNA, 20 bp, Artificial Sequence
  chemically synthesized
gcccatgatgcagagctttc

SEQ ID NO: 45610 - DNA, 20 bp, Artificial Sequence
  chemically synthesized
cccatgatgcagagctttca

SEQ ID NO: 45611 - DNA, 20 bp, Artificial Sequence
  chemically synthesized
tgatgcagagctttcaagga

SEQ ID NO: 45612 - DNA, 20 bp, Artificial Sequence
  chemically synthesized
gatgcagagctttcaaggat

SEQ ID NO: 45613 - DNA, 20 bp, Artificial Sequence
  chemically synthesized
aaggataggctttattctgc

SEQ ID NO: 45614 - DNA, 20 bp, Artificial Sequence
  chemically synthesized
aataataaatctattctgct

SEQ ID NO: 45615 - DNA, 20 bp, Artificial Sequence
  chemically synthesized
taataaatctattctgctaa

SEQ ID NO: 45616 - DNA, 20 bp, Artificial Sequence
  chemically synthesized
ttctgctaagagatcacaca

SEQ ID NO: 45617 - DNA, 20 bp, Artificial Sequence
  chemically synthesized
agatcacacatggttgtctt

SEQ ID NO: 45618 - DNA, 20 bp, Artificial Sequence
  chemically synthesized
ttatgtctttttaaatatat

SEQ ID NO: 45619 - DNA, 20 bp, Artificial Sequence
  chemically synthesized
ttttaaatatatgagccaca

SEQ ID NO: 45620 - DNA, 20 bp, Artificial Sequence
  chemically synthesized
tttaaatatatgagccacaa

SEQ ID NO: 45621 - DNA, 20 bp, Artificial Sequence
  chemically synthesized
ttaaatatatgagccacaaa

SEQ ID NO: 45622 - DNA, 20 bp, Artificial Sequence
  chemically synthesized
gccacaaagggttttatgtt

SEQ ID NO: 45623 - DNA, 20 bp, Artificial Sequence
  chemically synthesized
ccacaaagggttttatgttg

SEQ ID NO: 45624 - DNA, 20 bp, Artificial Sequence
  chemically synthesized
cacaaagggttttatgttga

SEQ ID NO: 45625 - DNA, 20 bp, Artificial Sequence
  chemically synthesized
tgtttatgtgtatttataca

SEQ ID NO: 45626 - DNA, 20 bp, Artificial Sequence
  chemically synthesized
ccacacttttttgtttacgt

SEQ ID NO: 45627 - DNA, 20 bp, Artificial Sequence
  chemically synthesized
ttttttgtttacgttagatg

SEQ ID NO: 45628 - DNA, 20 bp, Artificial Sequence
  chemically synthesized
tttttgtttacgttagatgt

SEQ ID NO: 45629 - DNA, 20 bp, Artificial Sequence
  chemically synthesized
cgttagatgtgggttttgat

SEQ ID NO: 45630 - DNA, 20 bp, Artificial Sequence
  chemically synthesized
gggttttgatgagcaaataa

SEQ ID NO: 45631 - DNA, 20 bp, Artificial Sequence
  chemically synthesized
tgatgagcaaataaaagaac

SEQ ID NO: 45632 - DNA, 20 bp, Artificial Sequence
  chemically synthesized
gatgagcaaataaaagaact

SEQ ID NO: 45633 - DNA, 20 bp, Artificial Sequence
  chemically synthesized
aataaaagaactaggcaata

SEQ ID NO: 45634 - DNA, 20 bp, Artificial Sequence
  chemically synthesized
gcaataaagaaacttgtaca

SEQ ID NO: 45635 - DNA, 20 bp, Artificial Sequence
  chemically synthesized
caataaagaaacttgtacat

SEQ ID NO: 45636 - DNA, 20 bp, Artificial Sequence
  chemically synthesized
ataaagaaacttgtacatgg

SEQ ID NO: 45637 - DNA, 20 bp, Artificial Sequence
  chemically synthesized
cttgtacatgggagttctgc

SEQ ID NO: 45638 - DNA, 20 bp, Artificial Sequence
  chemically synthesized
gtacatgggagttctgcaag

SEQ ID NO: 45639 - DNA, 20 bp, Artificial Sequence
  chemically synthesized
tacatgggagttctgcaagt

SEQ ID NO: 45640 - DNA, 20 bp, Artificial Sequence
  chemically synthesized
catgggagttctgcaagtgg

SEQ ID NO: 45641 - DNA, 20 bp, Artificial Sequence
  chemically synthesized
agttctgcaagtgggagtaa

SEQ ID NO: 45642 - DNA, 20 bp, Artificial Sequence
  chemically synthesized
gttctgcaagtgggagtaaa

SEQ ID NO: 45643 - DNA, 20 bp, Artificial Sequence
  chemically synthesized
gcaagtgggagtaaaaggtg

SEQ ID NO: 45644 - DNA, 20 bp, Artificial Sequence
  chemically synthesized
caagtgggagtaaaaggtgc

SEQ ID NO: 45645 - DNA, 20 bp, Artificial Sequence
  chemically synthesized
agtgggagtaaaaggtgcag

SEQ ID NO: 45646 - DNA, 20 bp, Artificial Sequence
  chemically synthesized
taaaaggtgcaggagaaatc

SEQ ID NO: 45647 - DNA, 20 bp, Artificial Sequence
  chemically synthesized
aggtgcaggagaaatctggt

SEQ ID NO: 45648 - DNA, 20 bp, Artificial Sequence
  chemically synthesized
tgcaggagaaatctggttgg

SEQ ID NO: 45649 - DNA, 20 bp, Artificial Sequence
  chemically synthesized
ggagaaatctggttggaaga

SEQ ID NO: 45650 - DNA, 20 bp, Artificial Sequence
  chemically synthesized
ggttggaagaaagacctcta

SEQ ID NO: 45651 - DNA, 20 bp, Artificial Sequence
  chemically synthesized
gttggaagaaagacctctat

SEQ ID NO: 45652 - DNA, 20 bp, Artificial Sequence
  chemically synthesized
gaagaaagacctctatagga

SEQ ID NO: 45653 - DNA, 20 bp, Artificial Sequence
  chemically synthesized
aagaaagacctctataggac

SEQ ID NO: 45654 - DNA, 20 bp, Artificial Sequence
  chemically synthesized
ctctataggacaggactcct

SEQ ID NO: 45655 - DNA, 20 bp, Artificial Sequence
  chemically synthesized
aggacaggactcctcagaaa

SEQ ID NO: 45656 - DNA, 20 bp, Artificial Sequence
  chemically synthesized
ctcctcagaaacagatgttt

SEQ ID NO: 45657 - DNA, 20 bp, Artificial Sequence
  chemically synthesized
ctcagaaacagatgttttgg

SEQ ID NO: 45658 - DNA, 20 bp, Artificial Sequence
  chemically synthesized
cagaaacagatgttttggaa

SEQ ID NO: 45659 - DNA, 20 bp, Artificial Sequence
  chemically synthesized
aacagatgttttggaagaga

SEQ ID NO: 45660 - DNA, 20 bp, Artificial Sequence
  chemically synthesized
acagatgttttggaagagat

SEQ ID NO: 45661 - DNA, 20 bp, Artificial Sequence
  chemically synthesized
cagatgttttggaagagatg

SEQ ID NO: 45662 - DNA, 20 bp, Artificial Sequence
  chemically synthesized
tgttttggaagagatgggga

SEQ ID NO: 45663 - DNA, 20 bp, Artificial Sequence
  chemically synthesized
gttttggaagagatggggaa

SEQ ID NO: 45664 - DNA, 20 bp, Artificial Sequence
  chemically synthesized
ggaagagatggggaaaggtt

SEQ ID NO: 45665 - DNA, 20 bp, Artificial Sequence
  chemically synthesized
agatggggaaaggttcagtg

SEQ ID NO: 45666 - DNA, 20 bp, Artificial Sequence
  chemically synthesized
gatggggaaaggttcagtga

SEQ ID NO: 45667 - DNA, 20 bp, Artificial Sequence
  chemically synthesized
atggggaaaggttcagtgaa

SEQ ID NO: 45668 - DNA, 20 bp, Artificial Sequence
  chemically synthesized
tggggaaaggttcagtgaag

SEQ ID NO: 45669 - DNA, 20 bp, Artificial Sequence
  chemically synthesized
ggggaaaggttcagtgaagg

SEQ ID NO: 45670 - DNA, 20 bp, Artificial Sequence
  chemically synthesized
gggggctgaacccccttccc

SEQ ID NO: 45671 - DNA, 20 bp, Artificial Sequence
  chemically synthesized
gaacccccttccctggattg

SEQ ID NO: 45672 - DNA, 20 bp, Artificial Sequence
  chemically synthesized
cccttccctggattgcagca

SEQ ID NO: 45673 - DNA, 20 bp, Artificial Sequence
  chemically synthesized
ttccctggattgcagcacag

SEQ ID NO: 45674 - DNA, 20 bp, Artificial Sequence
  chemically synthesized
ctggattgcagcacagcagc

SEQ ID NO: 45675 - DNA, 20 bp, Artificial Sequence
  chemically synthesized
tggattgcagcacagcagcg

SEQ ID NO: 45676 - DNA, 20 bp, Artificial Sequence
  chemically synthesized
attgcagcacagcagcgagg

SEQ ID NO: 45677 - DNA, 20 bp, Artificial Sequence
  chemically synthesized
ttgcagcacagcagcgagga

SEQ ID NO: 45678 - DNA, 20 bp, Artificial Sequence
  chemically synthesized
tgcagcacagcagcgaggaa

SEQ ID NO: 45679 - DNA, 20 bp, Artificial Sequence
  chemically synthesized
gcagcacagcagcgaggaag

SEQ ID NO: 45680 - DNA, 20 bp, Artificial Sequence
  chemically synthesized
agcgaggaaggggctcaacg

SEQ ID NO: 45681 - DNA, 20 bp, Artificial Sequence
  chemically synthesized
gaaggggctcaacgaagaaa

SEQ ID NO: 45682 - DNA, 20 bp, Artificial Sequence
  chemically synthesized
caacgaagaaaaagtgttcc

SEQ ID NO: 45683 - DNA, 20 bp, Artificial Sequence
  chemically synthesized
agaaaaagtgttccaagctt

SEQ ID NO: 45684 - DNA, 20 bp, Artificial Sequence
  chemically synthesized
gaaaaagtgttccaagcttt

SEQ ID NO: 45685 - DNA, 20 bp, Artificial Sequence
  chemically synthesized
aaagtgttccaagctttagg

SEQ ID NO: 45686 - DNA, 20 bp, Artificial Sequence
  chemically synthesized
gttccaagctttaggaagtc

SEQ ID NO: 45687 - DNA, 20 bp, Artificial Sequence
  chemically synthesized
ttccaagctttaggaagtca

SEQ ID NO: 45688 - DNA, 20 bp, Artificial Sequence
  chemically synthesized
agctttaggaagtcaaggtt

SEQ ID NO: 45689 - DNA, 20 bp, Artificial Sequence
  chemically synthesized
gctttaggaagtcaaggttt

SEQ ID NO: 45690 - DNA, 20 bp, Artificial Sequence
  chemically synthesized
ttaggaagtcaaggtttagg

SEQ ID NO: 45691 - DNA, 20 bp, Artificial Sequence
  chemically synthesized
taggaagtcaaggtttaggc

SEQ ID NO: 45692 - DNA, 20 bp, Artificial Sequence
  chemically synthesized
aggaagtcaaggtttaggca

SEQ ID NO: 45693 - DNA, 20 bp, Artificial Sequence
  chemically synthesized
agtcaaggtttaggcaggga

SEQ ID NO: 45694 - DNA, 20 bp, Artificial Sequence
  chemically synthesized
ggatagccattctattttat

SEQ ID NO: 45695 - DNA, 20 bp, Artificial Sequence
  chemically synthesized
gatagccattctattttatt

SEQ ID NO: 45696 - DNA, 20 bp, Artificial Sequence
  chemically synthesized
atagccattctattttatta

SEQ ID NO: 45697 - DNA, 20 bp, Artificial Sequence
  chemically synthesized
tagccattctattttattag

SEQ ID NO: 45698 - DNA, 20 bp, Artificial Sequence
  chemically synthesized
aggggcaatactatttccaa

SEQ ID NO: 45699 - DNA, 20 bp, Artificial Sequence
  chemically synthesized
atactatttccaacggcatc

SEQ ID NO: 45700 - DNA, 20 bp, Artificial Sequence
  chemically synthesized
caacggcatctggcttttct

SEQ ID NO: 45701 - DNA, 20 bp, Artificial Sequence
  chemically synthesized
tggcttttctcagcccttgt

SEQ ID NO: 45702 - DNA, 20 bp, Artificial Sequence
  chemically synthesized
ggcttttctcagcccttgtg

SEQ ID NO: 45703 - DNA, 20 bp, Artificial Sequence
  chemically synthesized
tcagcccttgtgaggctcta

SEQ ID NO: 45704 - DNA, 20 bp, Artificial Sequence
  chemically synthesized
cagcccttgtgaggctctac

SEQ ID NO: 45705 - DNA, 20 bp, Artificial Sequence
  chemically synthesized
agcccttgtgaggctctaca

SEQ ID NO: 45706 - DNA, 20 bp, Artificial Sequence
  chemically synthesized
cccttgtgaggctctacagg

SEQ ID NO: 45707 - DNA, 20 bp, Artificial Sequence
  chemically synthesized
ccttgtgaggctctacaggg

SEQ ID NO: 45708 - DNA, 20 bp, Artificial Sequence
  chemically synthesized
tgaggctctacagggaggtt

SEQ ID NO: 45709 - DNA, 20 bp, Artificial Sequence
  chemically synthesized
gaggctctacagggaggttg

SEQ ID NO: 45710 - DNA, 20 bp, Artificial Sequence
  chemically synthesized
ctacagggaggttgaggtgt

SEQ ID NO: 45711 - DNA, 20 bp, Artificial Sequence
  chemically synthesized
acagggaggttgaggtgtta

SEQ ID NO: 45712 - DNA, 20 bp, Artificial Sequence
  chemically synthesized
gaggttgaggtgttagagat

SEQ ID NO: 45713 - DNA, 20 bp, Artificial Sequence
  chemically synthesized
ggttgaggtgttagagatca

SEQ ID NO: 45714 - DNA, 20 bp, Artificial Sequence
  chemically synthesized
tgaggtgttagagatcagag

SEQ ID NO: 45715 - DNA, 20 bp, Artificial Sequence
  chemically synthesized
gaggtgttagagatcagagc

SEQ ID NO: 45716 - DNA, 20 bp, Artificial Sequence
  chemically synthesized
ttagagatcagagcaggaaa

SEQ ID NO: 45717 - DNA, 20 bp, Artificial Sequence
  chemically synthesized
tagagatcagagcaggaaac

SEQ ID NO: 45718 - DNA, 20 bp, Artificial Sequence
  chemically synthesized
gaaacaggtttttctttcca

SEQ ID NO: 45719 - DNA, 20 bp, Artificial Sequence
  chemically synthesized
tttccacggtaactacaatg

SEQ ID NO: 45720 - DNA, 20 bp, Artificial Sequence
  chemically synthesized
gaagtgatccttactttact

SEQ ID NO: 45721 - DNA, 20 bp, Artificial Sequence
  chemically synthesized
aagtgatccttactttacta

SEQ ID NO: 45722 - DNA, 20 bp, Artificial Sequence
  chemically synthesized
actaaggaacttttcatttt

SEQ ID NO: 45723 - DNA, 20 bp, Artificial Sequence
  chemically synthesized
taagtgttgacgcatgccta

SEQ ID NO: 45724 - DNA, 20 bp, Artificial Sequence
  chemically synthesized
agtgttgacgcatgcctaaa

SEQ ID NO: 45725 - DNA, 20 bp, Artificial Sequence
  chemically synthesized
gtgttgacgcatgcctaaag

SEQ ID NO: 45726 - DNA, 20 bp, Artificial Sequence
  chemically synthesized
gaaattaatcccataccctt

SEQ ID NO: 45727 - DNA, 20 bp, Artificial Sequence
  chemically synthesized
atcccatacccttaagtcta

SEQ ID NO: 45728 - DNA, 20 bp, Artificial Sequence
  chemically synthesized
atacccttaagtctacagac

SEQ ID NO: 45729 - DNA, 20 bp, Artificial Sequence
  chemically synthesized
ttaagtctacagactggtca

SEQ ID NO: 45730 - DNA, 20 bp, Artificial Sequence
  chemically synthesized
cagactggtcacagcatttc

SEQ ID NO: 45731 - DNA, 20 bp, Artificial Sequence
  chemically synthesized
agactggtcacagcatttca

SEQ ID NO: 45732 - DNA, 20 bp, Artificial Sequence
  chemically synthesized
actggtcacagcatttcaag

SEQ ID NO: 45733 - DNA, 20 bp, Artificial Sequence
  chemically synthesized
ctggtcacagcatttcaagg

SEQ ID NO: 45734 - DNA, 20 bp, Artificial Sequence
  chemically synthesized
ggtcacagcatttcaaggag

SEQ ID NO: 45735 - DNA, 20 bp, Artificial Sequence
  chemically synthesized
caaggaggagacctcattgt

SEQ ID NO: 45736 - DNA, 20 bp, Artificial Sequence
  chemically synthesized
gagacctcattgtaagcttc

SEQ ID NO: 45737 - DNA, 20 bp, Artificial Sequence
  chemically synthesized
agacctcattgtaagcttct

SEQ ID NO: 45738 - DNA, 20 bp, Artificial Sequence
  chemically synthesized
gacctcattgtaagcttcta

SEQ ID NO: 45739 - DNA, 20 bp, Artificial Sequence
  chemically synthesized
cctcattgtaagcttctagg

SEQ ID NO: 45740 - DNA, 20 bp, Artificial Sequence
  chemically synthesized
ctcattgtaagcttctaggg

SEQ ID NO: 45741 - DNA, 20 bp, Artificial Sequence
  chemically synthesized
attgtaagcttctagggagg

SEQ ID NO: 45742 - DNA, 20 bp, Artificial Sequence
  chemically synthesized
ttgtaagcttctagggaggt

SEQ ID NO: 45743 - DNA, 20 bp, Artificial Sequence
  chemically synthesized
tgtaagcttctagggaggtg

SEQ ID NO: 45744 - DNA, 20 bp, Artificial Sequence
  chemically synthesized
cttctagggaggtggggact

SEQ ID NO: 45745 - DNA, 20 bp, Artificial Sequence
  chemically synthesized
ttctagggaggtggggactt

SEQ ID NO: 45746 - DNA, 20 bp, Artificial Sequence
  chemically synthesized
gggaggtggggacttaggtg

SEQ ID NO: 45747 - DNA, 20 bp, Artificial Sequence
  chemically synthesized
ggaggtggggacttaggtga

SEQ ID NO: 45748 - DNA, 20 bp, Artificial Sequence
  chemically synthesized
gggacttaggtgaaggaaat

SEQ ID NO: 45749 - DNA, 20 bp, Artificial Sequence
  chemically synthesized
cttaggtgaaggaaatgagc

SEQ ID NO: 45750 - DNA, 20 bp, Artificial Sequence
  chemically synthesized
aggtgaaggaaatgagccag

SEQ ID NO: 45751 - DNA, 20 bp, Artificial Sequence
  chemically synthesized
tgaaggaaatgagccagcag

SEQ ID NO: 45752 - DNA, 20 bp, Artificial Sequence
  chemically synthesized
atgagccagcagaagctcac

SEQ ID NO: 45753 - DNA, 20 bp, Artificial Sequence
  chemically synthesized
gccagcagaagctcacaagt

SEQ ID NO: 45754 - DNA, 20 bp, Artificial Sequence
  chemically synthesized
agaagctcacaagtcagcat

SEQ ID NO: 45755 - DNA, 20 bp, Artificial Sequence
  chemically synthesized
agcatcagcgtgtcatgtct

SEQ ID NO: 45756 - DNA, 20 bp, Artificial Sequence
  chemically synthesized
atcagcgtgtcatgtctcag

SEQ ID NO: 45757 - DNA, 20 bp, Artificial Sequence
  chemically synthesized
agcgtgtcatgtctcagcag

SEQ ID NO: 45758 - DNA, 20 bp, Artificial Sequence
  chemically synthesized
gtcatgtctcagcagcagaa

SEQ ID NO: 45759 - DNA, 20 bp, Artificial Sequence
  chemically synthesized
gtctcagcagcagaacagca

SEQ ID NO: 45760 - DNA, 20 bp, Artificial Sequence
  chemically synthesized
cagcagcagaacagcacggt

SEQ ID NO: 45761 - DNA, 20 bp, Artificial Sequence
  chemically synthesized
agcacggtcagatgaaaata

SEQ ID NO: 45762 - DNA, 20 bp, Artificial Sequence
  chemically synthesized
tcagatgaaaatatagtgtg

SEQ ID NO: 45763 - DNA, 20 bp, Artificial Sequence
  chemically synthesized
gaatttgtataacattaatt

SEQ ID NO: 45764 - DNA, 20 bp, Artificial Sequence
  chemically synthesized
tttgtataacattaattgag

SEQ ID NO: 45765 - DNA, 20 bp, Artificial Sequence
  chemically synthesized
ttgtataacattaattgaga

SEQ ID NO: 45766 - DNA, 20 bp, Artificial Sequence
  chemically synthesized
tataacattaattgagaagg

SEQ ID NO: 45767 - DNA, 20 bp, Artificial Sequence
  chemically synthesized
aattgagaaggcagattcac

SEQ ID NO: 45768 - DNA, 20 bp, Artificial Sequence
  chemically synthesized
ttgagaaggcagattcactg

SEQ ID NO: 45769 - DNA, 20 bp, Artificial Sequence
  chemically synthesized
tggagttcttatataattga

SEQ ID NO: 45770 - DNA, 20 bp, Artificial Sequence
  chemically synthesized
gaaagttaatgcacgttaat

SEQ ID NO: 45771 - DNA, 20 bp, Artificial Sequence
  chemically synthesized
gttaatgcacgttaataagc

SEQ ID NO: 45772 - DNA, 20 bp, Artificial Sequence
  chemically synthesized
taatgcacgttaataagcaa

SEQ ID NO: 45773 - DNA, 20 bp, Artificial Sequence
  chemically synthesized
cacgttaataagcaagagtt

SEQ ID NO: 45774 - DNA, 20 bp, Artificial Sequence
  chemically synthesized
aagagtttagtttaatgtga

SEQ ID NO: 45775 - DNA, 20 bp, Artificial Sequence
  chemically synthesized
gaacttaacgcttgtgtctc

SEQ ID NO: 45776 - DNA, 20 bp, Artificial Sequence
  chemically synthesized
ctgaatccccaactcccaat

SEQ ID NO: 45777 - DNA, 20 bp, Artificial Sequence
  chemically synthesized
ctcccaattggctccatttg

SEQ ID NO: 45778 - DNA, 20 bp, Artificial Sequence
  chemically synthesized
tcccaattggctccatttgt

SEQ ID NO: 45779 - DNA, 20 bp, Artificial Sequence
  chemically synthesized
cccaattggctccatttgtg

SEQ ID NO: 45780 - DNA, 20 bp, Artificial Sequence
  chemically synthesized
ccaattggctccatttgtgg

SEQ ID NO: 45781 - DNA, 20 bp, Artificial Sequence
  chemically synthesized
aattggctccatttgtgggg

SEQ ID NO: 45782 - DNA, 20 bp, Artificial Sequence
  chemically synthesized
attggctccatttgtggggg

SEQ ID NO: 45783 - DNA, 20 bp, Artificial Sequence
  chemically synthesized
tccatttgtgggggaggctt

SEQ ID NO: 45784 - DNA, 20 bp, Artificial Sequence
  chemically synthesized
ttgtgggggaggctttggaa

SEQ ID NO: 45785 - DNA, 20 bp, Artificial Sequence
  chemically synthesized
ggaggctttggaaaagtaat

SEQ ID NO: 45786 - DNA, 20 bp, Artificial Sequence
  chemically synthesized
gaggctttggaaaagtaatc

SEQ ID NO: 45787 - DNA, 20 bp, Artificial Sequence
  chemically synthesized
tttggaaaagtaatcaggtt

SEQ ID NO: 45788 - DNA, 20 bp, Artificial Sequence
  chemically synthesized
tggaaaagtaatcaggttta

SEQ ID NO: 45789 - DNA, 20 bp, Artificial Sequence
  chemically synthesized
ggaaaagtaatcaggtttag

SEQ ID NO: 45790 - DNA, 20 bp, Artificial Sequence
  chemically synthesized
aaaagtaatcaggtttagag

SEQ ID NO: 45791 - DNA, 20 bp, Artificial Sequence
  chemically synthesized
tcaggtttagaggagctcat

SEQ ID NO: 45792 - DNA, 20 bp, Artificial Sequence
  chemically synthesized
aggtttagaggagctcatga

SEQ ID NO: 45793 - DNA, 20 bp, Artificial Sequence
  chemically synthesized
tttagaggagctcatgagag

SEQ ID NO: 45794 - DNA, 20 bp, Artificial Sequence
  chemically synthesized
atgagagcagatccccatca

SEQ ID NO: 45795 - DNA, 20 bp, Artificial Sequence
  chemically synthesized
catagaattattttcctcat

SEQ ID NO: 45796 - DNA, 20 bp, Artificial Sequence
  chemically synthesized
agaattattttcctcatcag

SEQ ID NO: 45797 - DNA, 20 bp, Artificial Sequence
  chemically synthesized
attattttcctcatcagaag

SEQ ID NO: 45798 - DNA, 20 bp, Artificial Sequence
  chemically synthesized
tattttcctcatcagaagca

SEQ ID NO: 45799 - DNA, 20 bp, Artificial Sequence
  chemically synthesized
ttttcctcatcagaagcaga

SEQ ID NO: 45800 - DNA, 20 bp, Artificial Sequence
  chemically synthesized
ctcatcagaagcagagagat

SEQ ID NO: 45801 - DNA, 20 bp, Artificial Sequence
  chemically synthesized
ttagccatttctcttccttc

SEQ ID NO: 45802 - DNA, 20 bp, Artificial Sequence
  chemically synthesized
ccatttctcttccttctggt

SEQ ID NO: 45803 - DNA, 20 bp, Artificial Sequence
  chemically synthesized
catttctcttccttctggtg

SEQ ID NO: 45804 - DNA, 20 bp, Artificial Sequence
  chemically synthesized
tcttccttctggtgaggaca

SEQ ID NO: 45805 - DNA, 20 bp, Artificial Sequence
  chemically synthesized
tccttctggtgaggacacag

SEQ ID NO: 45806 - DNA, 20 bp, Artificial Sequence
  chemically synthesized
ccttctggtgaggacacagt

SEQ ID NO: 45807 - DNA, 20 bp, Artificial Sequence
  chemically synthesized
tctggtgaggacacagtggg

SEQ ID NO: 45808 - DNA, 20 bp, Artificial Sequence
  chemically synthesized
gtgaggacacagtgggaagt

SEQ ID NO: 45809 - DNA, 20 bp, Artificial Sequence
  chemically synthesized
gaagtcagccacctgcaacc

SEQ ID NO: 45810 - DNA, 20 bp, Artificial Sequence
  chemically synthesized
aagtcagccacctgcaaccc

SEQ ID NO: 45811 - DNA, 20 bp, Artificial Sequence
  chemically synthesized
tcagccacctgcaacccagg

SEQ ID NO: 45812 - DNA, 20 bp, Artificial Sequence
  chemically synthesized
agccacctgcaacccaggaa

SEQ ID NO: 45813 - DNA, 20 bp, Artificial Sequence
  chemically synthesized
ccacctgcaacccaggaaga

SEQ ID NO: 45814 - DNA, 20 bp, Artificial Sequence
  chemically synthesized
cccaggaagagagccctgac

SEQ ID NO: 45815 - DNA, 20 bp, Artificial Sequence
  chemically synthesized
ccaggaagagagccctgacc

SEQ ID NO: 45816 - DNA, 20 bp, Artificial Sequence
  chemically synthesized
agagagccctgaccaggaac

SEQ ID NO: 45817 - DNA, 20 bp, Artificial Sequence
  chemically synthesized
gagccctgaccaggaaccag

SEQ ID NO: 45818 - DNA, 20 bp, Artificial Sequence
  chemically synthesized
ctgaccaggaaccagcagaa

SEQ ID NO: 45819 - DNA, 20 bp, Artificial Sequence
  chemically synthesized
ccaggaaccagcagaaaagt

SEQ ID NO: 45820 - DNA, 20 bp, Artificial Sequence
  chemically synthesized
gagaaaaaatcctgttgttg

SEQ ID NO: 45821 - DNA, 20 bp, Artificial Sequence
  chemically synthesized
atcctgttgttgaagtcacc

SEQ ID NO: 45822 - DNA, 20 bp, Artificial Sequence
  chemically synthesized
cagtctatgctattttgtta

SEQ ID NO: 45823 - DNA, 20 bp, Artificial Sequence
  chemically synthesized
ttgttatagcaccttgcact

SEQ ID NO: 45824 - DNA, 20 bp, Artificial Sequence
  chemically synthesized
tatagcaccttgcactaagt

SEQ ID NO: 45825 - DNA, 20 bp, Artificial Sequence
  chemically synthesized
atagcaccttgcactaagta

SEQ ID NO: 45826 - DNA, 20 bp, Artificial Sequence
  chemically synthesized
gcaccttgcactaagtaagg

SEQ ID NO: 45827 - DNA, 20 bp, Artificial Sequence
  chemically synthesized
tgcactaagtaaggcagatg

SEQ ID NO: 45828 - DNA, 20 bp, Artificial Sequence
  chemically synthesized
ctaagtaaggcagatgaaga

SEQ ID NO: 45829 - DNA, 20 bp, Artificial Sequence
  chemically synthesized
aagtaaggcagatgaagaaa

SEQ ID NO: 45830 - DNA, 20 bp, Artificial Sequence
  chemically synthesized
atgaagaaagagaaaaaaat

SEQ ID NO: 45831 - DNA, 20 bp, Artificial Sequence
  chemically synthesized
aaagagaaaaaaataagctt

SEQ ID NO: 45832 - DNA, 20 bp, Artificial Sequence
  chemically synthesized
aaaaaataagcttcggtgtt

SEQ ID NO: 45833 - DNA, 20 bp, Artificial Sequence
  chemically synthesized
aaataagcttcggtgttcag

SEQ ID NO: 45834 - DNA, 20 bp, Artificial Sequence
  chemically synthesized
agcttcggtgttcagtggat

SEQ ID NO: 45835 - DNA, 20 bp, Artificial Sequence
  chemically synthesized
attagaaaccatgtttatct

SEQ ID NO: 45836 - DNA, 20 bp, Artificial Sequence
  chemically synthesized
ttagaaaccatgtttatctc

SEQ ID NO: 45837 - DNA, 20 bp, Artificial Sequence
  chemically synthesized
tccacttgtcctctgtgttt

SEQ ID NO: 45838 - DNA, 20 bp, Artificial Sequence
  chemically synthesized
actctactactctcatctgt

SEQ ID NO: 45839 - DNA, 20 bp, Artificial Sequence
  chemically synthesized
tctcatctgtaagatgcaaa

SEQ ID NO: 45840 - DNA, 20 bp, Artificial Sequence
  chemically synthesized
atctgtaagatgcaaatagt

SEQ ID NO: 45841 - DNA, 20 bp, Artificial Sequence
  chemically synthesized
aagatgcaaatagtaagcct

SEQ ID NO: 45842 - DNA, 20 bp, Artificial Sequence
  chemically synthesized
attttttcttcaacgtactt

SEQ ID NO: 45843 - DNA, 20 bp, Artificial Sequence
  chemically synthesized
ttttttcttcaacgtacttt

SEQ ID NO: 45844 - DNA, 20 bp, Artificial Sequence
  chemically synthesized
gcttgtaatgtgtttatata

SEQ ID NO: 45845 - DNA, 20 bp, Artificial Sequence
  chemically synthesized
tttatatacagtgaaatgtc

SEQ ID NO: 45846 - DNA, 20 bp, Artificial Sequence
  chemically synthesized
ctttctttcttttttttcct

SEQ ID NO: 45847 - DNA, 20 bp, Artificial Sequence
  chemically synthesized
ttcttttttttcctcagcct

SEQ ID NO: 45848 - DNA, 20 bp, Artificial Sequence
  chemically synthesized
cttttttttcctcagcctca

SEQ ID NO: 45849 - DNA, 20 bp, Artificial Sequence
  chemically synthesized
ccacatgcccttcctacttt

SEQ ID NO: 45850 - DNA, 20 bp, Artificial Sequence
  chemically synthesized
cacatgcccttcctactttc

SEQ ID NO: 45851 - DNA, 20 bp, Artificial Sequence
  chemically synthesized
ttctccaaacgtcttctgcc

SEQ ID NO: 45852 - DNA, 20 bp, Artificial Sequence
  chemically synthesized
cctggctccatcaaatcata

SEQ ID NO: 45853 - DNA, 20 bp, Artificial Sequence
  chemically synthesized
ctggctccatcaaatcataa

SEQ ID NO: 45854 - DNA, 20 bp, Artificial Sequence
  chemically synthesized
ttctttgtcctttttttttt

SEQ ID NO: 45855 - DNA, 20 bp, Artificial Sequence
  chemically synthesized
ctttttttttttagtaaaac

SEQ ID NO: 45856 - DNA, 20 bp, Artificial Sequence
  chemically synthesized
aacaagtttataaaaaattg

SEQ ID NO: 45857 - DNA, 20 bp, Artificial Sequence
  chemically synthesized
acaagtttataaaaaattga

SEQ ID NO: 45858 - DNA, 20 bp, Artificial Sequence
  chemically synthesized
aaattgaaggaataaatgaa

SEQ ID NO: 45859 - DNA, 20 bp, Artificial Sequence
  chemically synthesized
ataaatgaatggctacttca

SEQ ID NO: 45860 - DNA, 20 bp, Artificial Sequence
  chemically synthesized
taaatgaatggctacttcat

SEQ ID NO: 45861 - DNA, 20 bp, Artificial Sequence
  chemically synthesized
atgaatggctacttcatagg

SEQ ID NO: 45862 - DNA, 20 bp, Artificial Sequence
  chemically synthesized
gaatggctacttcataggca

SEQ ID NO: 45863 - DNA, 20 bp, Artificial Sequence
  chemically synthesized
tggctacttcataggcagag

SEQ ID NO: 45864 - DNA, 20 bp, Artificial Sequence
  chemically synthesized
ttcataggcagagtagacgc

SEQ ID NO: 45865 - DNA, 20 bp, Artificial Sequence
  chemically synthesized
tcataggcagagtagacgca

SEQ ID NO: 45866 - DNA, 20 bp, Artificial Sequence
  chemically synthesized
cataggcagagtagacgcaa

SEQ ID NO: 45867 - DNA, 20 bp, Artificial Sequence
  chemically synthesized
agagtagacgcaagggctac

SEQ ID NO: 45868 - DNA, 20 bp, Artificial Sequence
  chemically synthesized
tttttattgttatttttcaa

SEQ ID NO: 45869 - DNA, 20 bp, Artificial Sequence
  chemically synthesized
ttttcaatagtatgctaaac

SEQ ID NO: 45870 - DNA, 20 bp, Artificial Sequence
  chemically synthesized
tttcaatagtatgctaaaca

SEQ ID NO: 45871 - DNA, 20 bp, Artificial Sequence
  chemically synthesized
ttcaatagtatgctaaacaa

SEQ ID NO: 45872 - DNA, 20 bp, Artificial Sequence
  chemically synthesized
tcaatagtatgctaaacaag

SEQ ID NO: 45873 - DNA, 20 bp, Artificial Sequence
  chemically synthesized
atagtatgctaaacaagggg

SEQ ID NO: 45874 - DNA, 20 bp, Artificial Sequence
  chemically synthesized
ttatttatgctgcccatttt

SEQ ID NO: 45875 - DNA, 20 bp, Artificial Sequence
  chemically synthesized
tgcccatttttagaccataa

SEQ ID NO: 45876 - DNA, 20 bp, Artificial Sequence
  chemically synthesized
ataacttcctgatgttgcca

SEQ ID NO: 45877 - DNA, 20 bp, Artificial Sequence
  chemically synthesized
ttcatttcattttaatttcg

SEQ ID NO: 45878 - DNA, 20 bp, Artificial Sequence
  chemically synthesized
tcatttcattttaatttcga

SEQ ID NO: 45879 - DNA, 20 bp, Artificial Sequence
  chemically synthesized
taatttcgaaggtacatgtg

SEQ ID NO: 45880 - DNA, 20 bp, Artificial Sequence
  chemically synthesized
aatttcgaaggtacatgtgc

SEQ ID NO: 45881 - DNA, 20 bp, Artificial Sequence
  chemically synthesized
aggtacatgtgcaggatgtg

SEQ ID NO: 45882 - DNA, 20 bp, Artificial Sequence
  chemically synthesized
ggtacatgtgcaggatgtgc

SEQ ID NO: 45883 - DNA, 20 bp, Artificial Sequence
  chemically synthesized
ggatgtgcaggcttgttaca

SEQ ID NO: 45884 - DNA, 20 bp, Artificial Sequence
  chemically synthesized
gatgtgcaggcttgttacat

SEQ ID NO: 45885 - DNA, 20 bp, Artificial Sequence
  chemically synthesized
tgggtaaatgtgtgtctttc

SEQ ID NO: 45886 - DNA, 20 bp, Artificial Sequence
  chemically synthesized
tgtgtgtctttctggccttt

SEQ ID NO: 45887 - DNA, 20 bp, Artificial Sequence
  chemically synthesized
ttttagccatctgtatcaat

SEQ ID NO: 45888 - DNA, 20 bp, Artificial Sequence
  chemically synthesized
tagccatctgtatcaatgag

SEQ ID NO: 45889 - DNA, 20 bp, Artificial Sequence
  chemically synthesized
ctgtatcaatgagcagatat

SEQ ID NO: 45890 - DNA, 20 bp, Artificial Sequence
  chemically synthesized
gagcagatataagctttaca

SEQ ID NO: 45891 - DNA, 20 bp, Artificial Sequence
  chemically synthesized
agcagatataagctttacac

SEQ ID NO: 45892 - DNA, 20 bp, Artificial Sequence
  chemically synthesized
aagctttacacaggatcatg

SEQ ID NO: 45893 - DNA, 20 bp, Artificial Sequence
  chemically synthesized
agctttacacaggatcatga

SEQ ID NO: 45894 - DNA, 20 bp, Artificial Sequence
  chemically synthesized
cacaggatcatgaaggatga

SEQ ID NO: 45895 - DNA, 20 bp, Artificial Sequence
  chemically synthesized
aataatttcaatcaacctga

SEQ ID NO: 45896 - DNA, 20 bp, Artificial Sequence
  chemically synthesized
tttcaatcaacctgatagct

SEQ ID NO: 45897 - DNA, 20 bp, Artificial Sequence
  chemically synthesized
ttcaatcaacctgatagctt

SEQ ID NO: 45898 - DNA, 20 bp, Artificial Sequence
  chemically synthesized
tcaatcaacctgatagctta

SEQ ID NO: 45899 - DNA, 20 bp, Artificial Sequence
  chemically synthesized
caatcaacctgatagcttag

SEQ ID NO: 45900 - DNA, 20 bp, Artificial Sequence
  chemically synthesized
ttaggggataaactaatttg

SEQ ID NO: 45901 - DNA, 20 bp, Artificial Sequence
  chemically synthesized
gataaactaatttgaagata

SEQ ID NO: 45902 - DNA, 20 bp, Artificial Sequence
  chemically synthesized
agatacagcttgcctccgat

SEQ ID NO: 45903 - DNA, 20 bp, Artificial Sequence
  chemically synthesized
acagcttgcctccgataagc

SEQ ID NO: 45904 - DNA, 20 bp, Artificial Sequence
  chemically synthesized
cctccgataagccagaattc

SEQ ID NO: 45905 - DNA, 20 bp, Artificial Sequence
  chemically synthesized
tccgataagccagaattcca

SEQ ID NO: 45906 - DNA, 20 bp, Artificial Sequence
  chemically synthesized
agccagaattccagagcttc

SEQ ID NO: 45907 - DNA, 20 bp, Artificial Sequence
  chemically synthesized
gagcttctggcattataatc

SEQ ID NO: 45908 - DNA, 20 bp, Artificial Sequence
  chemically synthesized
ttctggcattataatctagc

SEQ ID NO: 45909 - DNA, 20 bp, Artificial Sequence
  chemically synthesized
tctggcattataatctagca

SEQ ID NO: 45910 - DNA, 20 bp, Artificial Sequence
  chemically synthesized
gcattataatctagcaaggt

SEQ ID NO: 45911 - DNA, 20 bp, Artificial Sequence
  chemically synthesized
attataatctagcaaggtta

SEQ ID NO: 45912 - DNA, 20 bp, Artificial Sequence
  chemically synthesized
tctagcaaggttagagatca

SEQ ID NO: 45913 - DNA, 20 bp, Artificial Sequence
  chemically synthesized
tagagatcatggatcacttt

SEQ ID NO: 45914 - DNA, 20 bp, Artificial Sequence
  chemically synthesized
gagatcatggatcactttca

SEQ ID NO: 45915 - DNA, 20 bp, Artificial Sequence
  chemically synthesized
aacaaaaacaaactaaccaa

SEQ ID NO: 45916 - DNA, 20 bp, Artificial Sequence
  chemically synthesized
caaactaaccaaaagcaaaa

SEQ ID NO: 45917 - DNA, 20 bp, Artificial Sequence
  chemically synthesized
aatacttcctaccctgttaa

SEQ ID NO: 45918 - DNA, 20 bp, Artificial Sequence
  chemically synthesized
ctgttaatggtccaatatgt

SEQ ID NO: 45919 - DNA, 20 bp, Artificial Sequence
  chemically synthesized
atggtccaatatgtcagaaa

SEQ ID NO: 45920 - DNA, 20 bp, Artificial Sequence
  chemically synthesized
tgtcagaaacagcactgtgt

SEQ ID NO: 45921 - DNA, 20 bp, Artificial Sequence
  chemically synthesized
acagcactgtgttagaaata

SEQ ID NO: 45922 - DNA, 20 bp, Artificial Sequence
  chemically synthesized
gttagaaataaagctgtcta

SEQ ID NO: 45923 - DNA, 20 bp, Artificial Sequence
  chemically synthesized
tctaaagtacactaatattc

SEQ ID NO: 45924 - DNA, 20 bp, Artificial Sequence
  chemically synthesized
cactaatattcgagttataa

SEQ ID NO: 45925 - DNA, 20 bp, Artificial Sequence
  chemically synthesized
attcgagttataatagtgtg

SEQ ID NO: 45926 - DNA, 20 bp, Artificial Sequence
  chemically synthesized
tataatagtgtgtggactat

SEQ ID NO: 45927 - DNA, 20 bp, Artificial Sequence
  chemically synthesized
aaaaacaacccttgcctctt

SEQ ID NO: 45928 - DNA, 20 bp, Artificial Sequence
  chemically synthesized
aaacaacccttgcctcttta

SEQ ID NO: 45929 - DNA, 20 bp, Artificial Sequence
  chemically synthesized
tacacgcacatcttatgtct

SEQ ID NO: 45930 - DNA, 20 bp, Artificial Sequence
  chemically synthesized
cacgcacatcttatgtctta

SEQ ID NO: 45931 - DNA, 20 bp, Artificial Sequence
  chemically synthesized
cacatcttatgtcttagagt

SEQ ID NO: 45932 - DNA, 20 bp, Artificial Sequence
  chemically synthesized
gtcttagagtaagattccct

SEQ ID NO: 45933 - DNA, 20 bp, Artificial Sequence
  chemically synthesized
ttagagtaagattccctgag

SEQ ID NO: 45934 - DNA, 20 bp, Artificial Sequence
  chemically synthesized
gattccctgagaagtgaacc

SEQ ID NO: 45935 - DNA, 20 bp, Artificial Sequence
  chemically synthesized
agtgaacctagcatttatac

SEQ ID NO: 45936 - DNA, 20 bp, Artificial Sequence
  chemically synthesized
agataattaattctaatcca

SEQ ID NO: 45937 - DNA, 20 bp, Artificial Sequence
  chemically synthesized
ctaatccacagtacctgcca

SEQ ID NO: 45938 - DNA, 20 bp, Artificial Sequence
  chemically synthesized
attctaccatcatctttact

SEQ ID NO: 45939 - DNA, 20 bp, Artificial Sequence
  chemically synthesized
accatcatctttactgagca

SEQ ID NO: 45940 - DNA, 20 bp, Artificial Sequence
  chemically synthesized
atcatctttactgagcatag

SEQ ID NO: 45941 - DNA, 20 bp, Artificial Sequence
  chemically synthesized
catctttactgagcatagaa

SEQ ID NO: 45942 - DNA, 20 bp, Artificial Sequence
  chemically synthesized
gaagagctacgccaaaaccc

SEQ ID NO: 45943 - DNA, 20 bp, Artificial Sequence
  chemically synthesized
aagagctacgccaaaaccct

SEQ ID NO: 45944 - DNA, 20 bp, Artificial Sequence
  chemically synthesized
acgccaaaaccctgggtcat

SEQ ID NO: 45945 - DNA, 20 bp, Artificial Sequence
  chemically synthesized
caaaaccctgggtcatcagc

SEQ ID NO: 45946 - DNA, 20 bp, Artificial Sequence
  chemically synthesized
agccagcacacacacttatc

SEQ ID NO: 45947 - DNA, 20 bp, Artificial Sequence
  chemically synthesized
cagcacacacacttatccag

SEQ ID NO: 45948 - DNA, 20 bp, Artificial Sequence
  chemically synthesized
agtggtaaatacacatcatc

SEQ ID NO: 45949 - DNA, 20 bp, Artificial Sequence
  chemically synthesized
tatacatacatacctgaata

SEQ ID NO: 45950 - DNA, 20 bp, Artificial Sequence
  chemically synthesized
atggaatcaaatatttttct

SEQ ID NO: 45951 - DNA, 20 bp, Artificial Sequence
  chemically synthesized
aatatttttctaagatgaaa

SEQ ID NO: 45952 - DNA, 20 bp, Artificial Sequence
  chemically synthesized
cagtcatgatttatttcaaa

SEQ ID NO: 45953 - DNA, 20 bp, Artificial Sequence
  chemically synthesized
agtcatgatttatttcaaat

SEQ ID NO: 45954 - DNA, 20 bp, Artificial Sequence
  chemically synthesized
tgatttatttcaaataggta

SEQ ID NO: 45955 - DNA, 20 bp, Artificial Sequence
  chemically synthesized
tatttcaaataggtacggat

SEQ ID NO: 45956 - DNA, 20 bp, Artificial Sequence
  chemically synthesized
ttcaaataggtacggataag

SEQ ID NO: 45957 - DNA, 20 bp, Artificial Sequence
  chemically synthesized
ggtacggataagtagatatt

SEQ ID NO: 45958 - DNA, 20 bp, Artificial Sequence
  chemically synthesized
gtacggataagtagatattg

SEQ ID NO: 45959 - DNA, 20 bp, Artificial Sequence
  chemically synthesized
ggataagtagatattgaggt

SEQ ID NO: 45960 - DNA, 20 bp, Artificial Sequence
  chemically synthesized
gtagatattgaggtaagcat

SEQ ID NO: 45961 - DNA, 20 bp, Artificial Sequence
  chemically synthesized
tagatattgaggtaagcatt

SEQ ID NO: 45962 - DNA, 20 bp, Artificial Sequence
  chemically synthesized
ctattactgcgctgaaactg

SEQ ID NO: 45963 - DNA, 20 bp, Artificial Sequence
  chemically synthesized
gcgctgaaactgtggcttta

SEQ ID NO: 45964 - DNA, 20 bp, Artificial Sequence
  chemically synthesized
attgttttcactgcactatt

SEQ ID NO: 45965 - DNA, 20 bp, Artificial Sequence
  chemically synthesized
cactgcactattgagaaatt

SEQ ID NO: 45966 - DNA, 20 bp, Artificial Sequence
  chemically synthesized
ctgcactattgagaaattaa

SEQ ID NO: 45967 - DNA, 20 bp, Artificial Sequence
  chemically synthesized
attgagaaattaagagataa

SEQ ID NO: 45968 - DNA, 20 bp, Artificial Sequence
  chemically synthesized
aaattaagagataatggcaa

SEQ ID NO: 45969 - DNA, 20 bp, Artificial Sequence
  chemically synthesized
agataatggcaaaagtcaca

SEQ ID NO: 45970 - DNA, 20 bp, Artificial Sequence
  chemically synthesized
ataatggcaaaagtcacaaa

SEQ ID NO: 45971 - DNA, 20 bp, Artificial Sequence
  chemically synthesized
tcacaaagagtatattcaaa

SEQ ID NO: 45972 - DNA, 20 bp, Artificial Sequence
  chemically synthesized
caaagagtatattcaaaaag

SEQ ID NO: 45973 - DNA, 20 bp, Artificial Sequence
  chemically synthesized
agtatattcaaaaagaagta

SEQ ID NO: 45974 - DNA, 20 bp, Artificial Sequence
  chemically synthesized
gaagtatagcactttttcct

SEQ ID NO: 45975 - DNA, 20 bp, Artificial Sequence
  chemically synthesized
tagaaaccactgctaactga

SEQ ID NO: 45976 - DNA, 20 bp, Artificial Sequence
  chemically synthesized
gaaaccactgctaactgaaa

SEQ ID NO: 45977 - DNA, 20 bp, Artificial Sequence
  chemically synthesized
actgctaactgaaagagact

SEQ ID NO: 45978 - DNA, 20 bp, Artificial Sequence
  chemically synthesized
atttgtcccgtcaaaaatcc

SEQ ID NO: 45979 - DNA, 20 bp, Artificial Sequence
  chemically synthesized
tccctgaacttttcaaaaat

SEQ ID NO: 45980 - DNA, 20 bp, Artificial Sequence
  chemically synthesized
tcaaaaattggtacatgctt

SEQ ID NO: 45981 - DNA, 20 bp, Artificial Sequence
  chemically synthesized
catgctttagctttaaacta

SEQ ID NO: 45982 - DNA, 20 bp, Artificial Sequence
  chemically synthesized
atgctttagctttaaactac

SEQ ID NO: 45983 - DNA, 20 bp, Artificial Sequence
  chemically synthesized
ctttaaactacaggcctcac

SEQ ID NO: 45984 - DNA, 20 bp, Artificial Sequence
  chemically synthesized
ttaaactacaggcctcactg

SEQ ID NO: 45985 - DNA, 20 bp, Artificial Sequence
  chemically synthesized
actacaggcctcactggagc

SEQ ID NO: 45986 - DNA, 20 bp, Artificial Sequence
  chemically synthesized
tacaggcctcactggagcta

SEQ ID NO: 45987 - DNA, 20 bp, Artificial Sequence
  chemically synthesized
gcctcactggagctagagac

SEQ ID NO: 45988 - DNA, 20 bp, Artificial Sequence
  chemically synthesized
tcactggagctagagacaag

SEQ ID NO: 45989 - DNA, 20 bp, Artificial Sequence
  chemically synthesized
cactggagctagagacaaga

SEQ ID NO: 45990 - DNA, 20 bp, Artificial Sequence
  chemically synthesized
agagacaagaaggtaaaaaa

SEQ ID NO: 45991 - DNA, 20 bp, Artificial Sequence
  chemically synthesized
aggtaaaaaacggctgacaa

SEQ ID NO: 45992 - DNA, 20 bp, Artificial Sequence
  chemically synthesized
taaaaaacggctgacaaaag

SEQ ID NO: 45993 - DNA, 20 bp, Artificial Sequence
  chemically synthesized
acggctgacaaaagaagtcc

SEQ ID NO: 45994 - DNA, 20 bp, Artificial Sequence
  chemically synthesized
agtcctggtatcctctatga

SEQ ID NO: 45995 - DNA, 20 bp, Artificial Sequence
  chemically synthesized
gtcctggtatcctctatgat

SEQ ID NO: 45996 - DNA, 20 bp, Artificial Sequence
  chemically synthesized
cctggtatcctctatgatgg

SEQ ID NO: 45997 - DNA, 20 bp, Artificial Sequence
  chemically synthesized
ggtatcctctatgatgggag

SEQ ID NO: 45998 - DNA, 20 bp, Artificial Sequence
  chemically synthesized
gtatcctctatgatgggaga

SEQ ID NO: 45999 - DNA, 20 bp, Artificial Sequence
  chemically synthesized
ctatgatgggagaaggaaac

SEQ ID NO: 46000 - DNA, 20 bp, Artificial Sequence
  chemically synthesized
tgggagaaggaaactagcta

SEQ ID NO: 46001 - DNA, 20 bp, Artificial Sequence
  chemically synthesized
gggagaaggaaactagctaa

SEQ ID NO: 46002 - DNA, 20 bp, Artificial Sequence
  chemically synthesized
ggagaaggaaactagctaaa

SEQ ID NO: 46003 - DNA, 20 bp, Artificial Sequence
  chemically synthesized
gaaggaaactagctaaaggg

SEQ ID NO: 46004 - DNA, 20 bp, Artificial Sequence
  chemically synthesized
agctaaagggaagaataaat

SEQ ID NO: 46005 - DNA, 20 bp, Artificial Sequence
  chemically synthesized
ctaaagggaagaataaatta

SEQ ID NO: 46006 - DNA, 20 bp, Artificial Sequence
  chemically synthesized
agaataaattagagaaaaac

SEQ ID NO: 46007 - DNA, 20 bp, Artificial Sequence
  chemically synthesized
aaaaactggaatgactgaat

SEQ ID NO: 46008 - DNA, 20 bp, Artificial Sequence
  chemically synthesized
tggaatgactgaatcggaac

SEQ ID NO: 46009 - DNA, 20 bp, Artificial Sequence
  chemically synthesized
ggaatgactgaatcggaaca

SEQ ID NO: 46010 - DNA, 20 bp, Artificial Sequence
  chemically synthesized
gactgaatcggaacaaggca

SEQ ID NO: 46011 - DNA, 20 bp, Artificial Sequence
  chemically synthesized
actgaatcggaacaaggcaa

SEQ ID NO: 46012 - DNA, 20 bp, Artificial Sequence
  chemically synthesized
gcaaaggctataaaaaaaat

SEQ ID NO: 46013 - DNA, 20 bp, Artificial Sequence
  chemically synthesized
aaggctataaaaaaaattag

SEQ ID NO: 46014 - DNA, 20 bp, Artificial Sequence
  chemically synthesized
aaaaattagcagtatcctct

SEQ ID NO: 46015 - DNA, 20 bp, Artificial Sequence
  chemically synthesized
aaaattagcagtatcctctt

SEQ ID NO: 46016 - DNA, 20 bp, Artificial Sequence
  chemically synthesized
aaattagcagtatcctcttg

SEQ ID NO: 46017 - DNA, 20 bp, Artificial Sequence
  chemically synthesized
aattagcagtatcctcttgg

SEQ ID NO: 46018 - DNA, 20 bp, Artificial Sequence
  chemically synthesized
atgcaaatatctgtctgaaa

SEQ ID NO: 46019 - DNA, 20 bp, Artificial Sequence
  chemically synthesized
tatctgtctgaaacggtccc

SEQ ID NO: 46020 - DNA, 20 bp, Artificial Sequence
  chemically synthesized
ccctggctaaactccaccca

SEQ ID NO: 46021 - DNA, 20 bp, Artificial Sequence
  chemically synthesized
cctggctaaactccacccat

SEQ ID NO: 46022 - DNA, 20 bp, Artificial Sequence
  chemically synthesized
gctaaactccacccatgggt

SEQ ID NO: 46023 - DNA, 20 bp, Artificial Sequence
  chemically synthesized
aactccacccatgggttggc

SEQ ID NO: 46024 - DNA, 20 bp, Artificial Sequence
  chemically synthesized
gccagccttgccttgaccaa

SEQ ID NO: 46025 - DNA, 20 bp, Artificial Sequence
  chemically synthesized
ccttgaccaatagccttgac

SEQ ID NO: 46026 - DNA, 20 bp, Artificial Sequence
  chemically synthesized
cttgaccaatagccttgaca

SEQ ID NO: 46027 - DNA, 20 bp, Artificial Sequence
  chemically synthesized
gacaaggcaaacttgaccaa

SEQ ID NO: 46028 - DNA, 20 bp, Artificial Sequence
  chemically synthesized
gcaaacttgaccaatagtct

SEQ ID NO: 46029 - DNA, 20 bp, Artificial Sequence
  chemically synthesized
aaacttgaccaatagtctta

SEQ ID NO: 46030 - DNA, 20 bp, Artificial Sequence
  chemically synthesized
accaatagtcttagagtatc

SEQ ID NO: 46031 - DNA, 20 bp, Artificial Sequence
  chemically synthesized
atagtcttagagtatccagt

SEQ ID NO: 46032 - DNA, 20 bp, Artificial Sequence
  chemically synthesized
tagtcttagagtatccagtg

SEQ ID NO: 46033 - DNA, 20 bp, Artificial Sequence
  chemically synthesized
cttagagtatccagtgaggc

SEQ ID NO: 46034 - DNA, 20 bp, Artificial Sequence
  chemically synthesized
ttagagtatccagtgaggcc

SEQ ID NO: 46035 - DNA, 20 bp, Artificial Sequence
  chemically synthesized
tagagtatccagtgaggcca

SEQ ID NO: 46036 - DNA, 20 bp, Artificial Sequence
  chemically synthesized
agagtatccagtgaggccag

SEQ ID NO: 46037 - DNA, 20 bp, Artificial Sequence
  chemically synthesized
tatccagtgaggccaggggc

SEQ ID NO: 46038 - DNA, 20 bp, Artificial Sequence
  chemically synthesized
ccagtgaggccaggggccgg

SEQ ID NO: 46039 - DNA, 20 bp, Artificial Sequence
  chemically synthesized
tgaggccaggggccggcggc

SEQ ID NO: 46040 - DNA, 20 bp, Artificial Sequence
  chemically synthesized
gccaggggccggcggctggc

SEQ ID NO: 46041 - DNA, 20 bp, Artificial Sequence
  chemically synthesized
ccaggggccggcggctggct

SEQ ID NO: 46042 - DNA, 20 bp, Artificial Sequence
  chemically synthesized
caggggccggcggctggcta

SEQ ID NO: 46043 - DNA, 20 bp, Artificial Sequence
  chemically synthesized
ccggcggctggctagggatg

SEQ ID NO: 46044 - DNA, 20 bp, Artificial Sequence
  chemically synthesized
tggctagggatgaagaataa

SEQ ID NO: 46045 - DNA, 20 bp, Artificial Sequence
  chemically synthesized
ggctagggatgaagaataaa

SEQ ID NO: 46046 - DNA, 20 bp, Artificial Sequence
  chemically synthesized
tagggatgaagaataaaagg

SEQ ID NO: 46047 - DNA, 20 bp, Artificial Sequence
  chemically synthesized
gaataaaaggaagcaccctt

SEQ ID NO: 46048 - DNA, 20 bp, Artificial Sequence
  chemically synthesized
taaaaggaagcacccttcag

SEQ ID NO: 46049 - DNA, 20 bp, Artificial Sequence
  chemically synthesized
cagttccacacactcgcttc

SEQ ID NO: 46050 - DNA, 20 bp, Artificial Sequence
  chemically synthesized
cactcgcttctggaacgtct

SEQ ID NO: 46051 - DNA, 20 bp, Artificial Sequence
  chemically synthesized
actcgcttctggaacgtctg

SEQ ID NO: 46052 - DNA, 20 bp, Artificial Sequence
  chemically synthesized
gaacgtctgaggttatcaat

SEQ ID NO: 46053 - DNA, 20 bp, Artificial Sequence
  chemically synthesized
tgaggttatcaataagctcc

SEQ ID NO: 46054 - DNA, 20 bp, Artificial Sequence
  chemically synthesized
ttatcaataagctcctagtc

SEQ ID NO: 46055 - DNA, 20 bp, Artificial Sequence
  chemically synthesized
agctcctagtccagacgcca

SEQ ID NO: 46056 - DNA, 20 bp, Artificial Sequence
  chemically synthesized
gctcctagtccagacgccat

SEQ ID NO: 46057 - DNA, 20 bp, Artificial Sequence
  chemically synthesized
agacgccatgggtcatttca

SEQ ID NO: 46058 - DNA, 20 bp, Artificial Sequence
  chemically synthesized
acgccatgggtcatttcaca

SEQ ID NO: 46059 - DNA, 20 bp, Artificial Sequence
  chemically synthesized
cgccatgggtcatttcacag

SEQ ID NO: 46060 - DNA, 20 bp, Artificial Sequence
  chemically synthesized
ccatgggtcatttcacagag

SEQ ID NO: 46061 - DNA, 20 bp, Artificial Sequence
  chemically synthesized
catgggtcatttcacagagg

SEQ ID NO: 46062 - DNA, 20 bp, Artificial Sequence
  chemically synthesized
gtcatttcacagaggaggac

SEQ ID NO: 46063 - DNA, 20 bp, Artificial Sequence
  chemically synthesized
tcatttcacagaggaggaca

SEQ ID NO: 46064 - DNA, 20 bp, Artificial Sequence
  chemically synthesized
gaggacaaggctactatcac

SEQ ID NO: 46065 - DNA, 20 bp, Artificial Sequence
  chemically synthesized
aggctactatcacaagcctg

SEQ ID NO: 46066 - DNA, 20 bp, Artificial Sequence
  chemically synthesized
ggctactatcacaagcctgt

SEQ ID NO: 46067 - DNA, 20 bp, Artificial Sequence
  chemically synthesized
gctactatcacaagcctgtg

SEQ ID NO: 46068 - DNA, 20 bp, Artificial Sequence
  chemically synthesized
ctatcacaagcctgtggggc

SEQ ID NO: 46069 - DNA, 20 bp, Artificial Sequence
  chemically synthesized
tatcacaagcctgtggggca

SEQ ID NO: 46070 - DNA, 20 bp, Artificial Sequence
  chemically synthesized
cctgtggggcaaggtgaatg

SEQ ID NO: 46071 - DNA, 20 bp, Artificial Sequence
  chemically synthesized
gtggggcaaggtgaatgtgg

SEQ ID NO: 46072 - DNA, 20 bp, Artificial Sequence
  chemically synthesized
aaggtgaatgtggaagatgc

SEQ ID NO: 46073 - DNA, 20 bp, Artificial Sequence
  chemically synthesized
ggtgaatgtggaagatgctg

SEQ ID NO: 46074 - DNA, 20 bp, Artificial Sequence
  chemically synthesized
gtgaatgtggaagatgctgg

SEQ ID NO: 46075 - DNA, 20 bp, Artificial Sequence
  chemically synthesized
gaatgtggaagatgctggag

SEQ ID NO: 46076 - DNA, 20 bp, Artificial Sequence
  chemically synthesized
agatgctggaggagaaaccc

SEQ ID NO: 46077 - DNA, 20 bp, Artificial Sequence
  chemically synthesized
gatgctggaggagaaaccct

SEQ ID NO: 46078 - DNA, 20 bp, Artificial Sequence
  chemically synthesized
gctggaggagaaaccctggg

SEQ ID NO: 46079 - DNA, 20 bp, Artificial Sequence
  chemically synthesized
ctggaggagaaaccctggga

SEQ ID NO: 46080 - DNA, 20 bp, Artificial Sequence
  chemically synthesized
gaggagaaaccctgggaagg

SEQ ID NO: 46081 - DNA, 20 bp, Artificial Sequence
  chemically synthesized
aggagaaaccctgggaaggt

SEQ ID NO: 46082 - DNA, 20 bp, Artificial Sequence
  chemically synthesized
aaccctgggaaggtaggctc

SEQ ID NO: 46083 - DNA, 20 bp, Artificial Sequence
  chemically synthesized
ggaaggtaggctctggtgac

SEQ ID NO: 46084 - DNA, 20 bp, Artificial Sequence
  chemically synthesized
gaaggtaggctctggtgacc

SEQ ID NO: 46085 - DNA, 20 bp, Artificial Sequence
  chemically synthesized
taggctctggtgaccaggac

SEQ ID NO: 46086 - DNA, 20 bp, Artificial Sequence
  chemically synthesized
aggctctggtgaccaggaca

SEQ ID NO: 46087 - DNA, 20 bp, Artificial Sequence
  chemically synthesized
ggctctggtgaccaggacaa

SEQ ID NO: 46088 - DNA, 20 bp, Artificial Sequence
  chemically synthesized
ctctggtgaccaggacaagg

SEQ ID NO: 46089 - DNA, 20 bp, Artificial Sequence
  chemically synthesized
tctggtgaccaggacaaggg

SEQ ID NO: 46090 - DNA, 20 bp, Artificial Sequence
  chemically synthesized
ctggtgaccaggacaaggga

SEQ ID NO: 46091 - DNA, 20 bp, Artificial Sequence
  chemically synthesized
gtgaccaggacaagggaggg

SEQ ID NO: 46092 - DNA, 20 bp, Artificial Sequence
  chemically synthesized
tgaccaggacaagggaggga

SEQ ID NO: 46093 - DNA, 20 bp, Artificial Sequence
  chemically synthesized
ccaggacaagggagggaagg

SEQ ID NO: 46094 - DNA, 20 bp, Artificial Sequence
  chemically synthesized
caggacaagggagggaagga

SEQ ID NO: 46095 - DNA, 20 bp, Artificial Sequence
  chemically synthesized
ggaaggaaggaccctgtgcc

SEQ ID NO: 46096 - DNA, 20 bp, Artificial Sequence
  chemically synthesized
aaggaccctgtgcctggcaa

SEQ ID NO: 46097 - DNA, 20 bp, Artificial Sequence
  chemically synthesized
ccctgtgcctggcaaaagtc

SEQ ID NO: 46098 - DNA, 20 bp, Artificial Sequence
  chemically synthesized
cctgtgcctggcaaaagtcc

SEQ ID NO: 46099 - DNA, 20 bp, Artificial Sequence
  chemically synthesized
caaaagtccaggtcgcttct

SEQ ID NO: 46100 - DNA, 20 bp, Artificial Sequence
  chemically synthesized
aaaagtccaggtcgcttctc

SEQ ID NO: 46101 - DNA, 20 bp, Artificial Sequence
  chemically synthesized
aggtcgcttctcaggatttg

SEQ ID NO: 46102 - DNA, 20 bp, Artificial Sequence
  chemically synthesized
aactgttcttgtcaatctca

SEQ ID NO: 46103 - DNA, 20 bp, Artificial Sequence
  chemically synthesized
actgttcttgtcaatctcac

SEQ ID NO: 46104 - DNA, 20 bp, Artificial Sequence
  chemically synthesized
ttgtcaatctcacaggctcc

SEQ ID NO: 46105 - DNA, 20 bp, Artificial Sequence
  chemically synthesized
ggctcctggttgtctaccca

SEQ ID NO: 46106 - DNA, 20 bp, Artificial Sequence
  chemically synthesized
tggttgtctacccatggacc

SEQ ID NO: 46107 - DNA, 20 bp, Artificial Sequence
  chemically synthesized
gttgtctacccatggaccca

SEQ ID NO: 46108 - DNA, 20 bp, Artificial Sequence
  chemically synthesized
ttgtctacccatggacccag

SEQ ID NO: 46109 - DNA, 20 bp, Artificial Sequence
  chemically synthesized
tggacccagaggttctttga

SEQ ID NO: 46110 - DNA, 20 bp, Artificial Sequence
  chemically synthesized
cagaggttctttgacagctt

SEQ ID NO: 46111 - DNA, 20 bp, Artificial Sequence
  chemically synthesized
gtcctctgcctctgccatca

SEQ ID NO: 46112 - DNA, 20 bp, Artificial Sequence
  chemically synthesized
tcctctgcctctgccatcat

SEQ ID NO: 46113 - DNA, 20 bp, Artificial Sequence
  chemically synthesized
tgccatcatgggcaacccca

SEQ ID NO: 46114 - DNA, 20 bp, Artificial Sequence
  chemically synthesized
tcatgggcaaccccaaagtc

SEQ ID NO: 46115 - DNA, 20 bp, Artificial Sequence
  chemically synthesized
catgggcaaccccaaagtca

SEQ ID NO: 46116 - DNA, 20 bp, Artificial Sequence
  chemically synthesized
aaccccaaagtcaaggcaca

SEQ ID NO: 46117 - DNA, 20 bp, Artificial Sequence
  chemically synthesized
ccaaagtcaaggcacatggc

SEQ ID NO: 46118 - DNA, 20 bp, Artificial Sequence
  chemically synthesized
aagtcaaggcacatggcaag

SEQ ID NO: 46119 - DNA, 20 bp, Artificial Sequence
  chemically synthesized
agtcaaggcacatggcaaga

SEQ ID NO: 46120 - DNA, 20 bp, Artificial Sequence
  chemically synthesized
caagaaggtgctgacttcct

SEQ ID NO: 46121 - DNA, 20 bp, Artificial Sequence
  chemically synthesized
aagaaggtgctgacttcctt

SEQ ID NO: 46122 - DNA, 20 bp, Artificial Sequence
  chemically synthesized
gaaggtgctgacttccttgg

SEQ ID NO: 46123 - DNA, 20 bp, Artificial Sequence
  chemically synthesized
cttccttgggagatgccaca

SEQ ID NO: 46124 - DNA, 20 bp, Artificial Sequence
  chemically synthesized
gggagatgccacaaagcacc

SEQ ID NO: 46125 - DNA, 20 bp, Artificial Sequence
  chemically synthesized
caaagcacctggatgatctc

SEQ ID NO: 46126 - DNA, 20 bp, Artificial Sequence
  chemically synthesized
aaagcacctggatgatctca

SEQ ID NO: 46127 - DNA, 20 bp, Artificial Sequence
  chemically synthesized
aagcacctggatgatctcaa

SEQ ID NO: 46128 - DNA, 20 bp, Artificial Sequence
  chemically synthesized
atctcaagggcacctttgcc

SEQ ID NO: 46129 - DNA, 20 bp, Artificial Sequence
  chemically synthesized
aagggcacctttgcccagct

SEQ ID NO: 46130 - DNA, 20 bp, Artificial Sequence
  chemically synthesized
tgagtgaactgcactgtgac

SEQ ID NO: 46131 - DNA, 20 bp, Artificial Sequence
  chemically synthesized
gcactgtgacaagctgcatg

SEQ ID NO: 46132 - DNA, 20 bp, Artificial Sequence
  chemically synthesized
acaagctgcatgtggatcct

SEQ ID NO: 46133 - DNA, 20 bp, Artificial Sequence
  chemically synthesized
atgtggatcctgagaacttc

SEQ ID NO: 46134 - DNA, 20 bp, Artificial Sequence
  chemically synthesized
tgtggatcctgagaacttca

SEQ ID NO: 46135 - DNA, 20 bp, Artificial Sequence
  chemically synthesized
gatcctgagaacttcaaggt

SEQ ID NO: 46136 - DNA, 20 bp, Artificial Sequence
  chemically synthesized
tgagaacttcaaggtgagtc

SEQ ID NO: 46137 - DNA, 20 bp, Artificial Sequence
  chemically synthesized
gagaacttcaaggtgagtcc

SEQ ID NO: 46138 - DNA, 20 bp, Artificial Sequence
  chemically synthesized
gaacttcaaggtgagtccag

SEQ ID NO: 46139 - DNA, 20 bp, Artificial Sequence
  chemically synthesized
ggtgagtccaggagatgttt

SEQ ID NO: 46140 - DNA, 20 bp, Artificial Sequence
  chemically synthesized
tgtttcagccctgttgcctt

SEQ ID NO: 46141 - DNA, 20 bp, Artificial Sequence
  chemically synthesized
gccctgttgcctttagtctc

SEQ ID NO: 46142 - DNA, 20 bp, Artificial Sequence
  chemically synthesized
ccctgttgcctttagtctcg

SEQ ID NO: 46143 - DNA, 20 bp, Artificial Sequence
  chemically synthesized
cctttagtctcgaggcaact

SEQ ID NO: 46144 - DNA, 20 bp, Artificial Sequence
  chemically synthesized
tctcgaggcaacttagacaa

SEQ ID NO: 46145 - DNA, 20 bp, Artificial Sequence
  chemically synthesized
tcgaggcaacttagacaacg

SEQ ID NO: 46146 - DNA, 20 bp, Artificial Sequence
  chemically synthesized
agacaacggagtattgatct

SEQ ID NO: 46147 - DNA, 20 bp, Artificial Sequence
  chemically synthesized
acggagtattgatctgagca

SEQ ID NO: 46148 - DNA, 20 bp, Artificial Sequence
  chemically synthesized
gagtattgatctgagcacag

SEQ ID NO: 46149 - DNA, 20 bp, Artificial Sequence
  chemically synthesized
agtattgatctgagcacagc

SEQ ID NO: 46150 - DNA, 20 bp, Artificial Sequence
  chemically synthesized
gtattgatctgagcacagca

SEQ ID NO: 46151 - DNA, 20 bp, Artificial Sequence
  chemically synthesized
atctgagcacagcagggtgt

SEQ ID NO: 46152 - DNA, 20 bp, Artificial Sequence
  chemically synthesized
agcagggtgtgagctgtttg

SEQ ID NO: 46153 - DNA, 20 bp, Artificial Sequence
  chemically synthesized
tgtgagctgtttgaagatac

SEQ ID NO: 46154 - DNA, 20 bp, Artificial Sequence
  chemically synthesized
gtgagctgtttgaagatact

SEQ ID NO: 46155 - DNA, 20 bp, Artificial Sequence
  chemically synthesized
tgagctgtttgaagatactg

SEQ ID NO: 46156 - DNA, 20 bp, Artificial Sequence
  chemically synthesized
ctgtttgaagatactggggt

SEQ ID NO: 46157 - DNA, 20 bp, Artificial Sequence
  chemically synthesized
tgtttgaagatactggggtt

SEQ ID NO: 46158 - DNA, 20 bp, Artificial Sequence
  chemically synthesized
gtttgaagatactggggttg

SEQ ID NO: 46159 - DNA, 20 bp, Artificial Sequence
  chemically synthesized
tttgaagatactggggttgg

SEQ ID NO: 46160 - DNA, 20 bp, Artificial Sequence
  chemically synthesized
agatactggggttgggggtg

SEQ ID NO: 46161 - DNA, 20 bp, Artificial Sequence
  chemically synthesized
ggttgggggtgaagaaactg

SEQ ID NO: 46162 - DNA, 20 bp, Artificial Sequence
  chemically synthesized
ttgggggtgaagaaactgca

SEQ ID NO: 46163 - DNA, 20 bp, Artificial Sequence
  chemically synthesized
tgggggtgaagaaactgcag

SEQ ID NO: 46164 - DNA, 20 bp, Artificial Sequence
  chemically synthesized
agaaactgcagaggactaac

SEQ ID NO: 46165 - DNA, 20 bp, Artificial Sequence
  chemically synthesized
gaaactgcagaggactaact

SEQ ID NO: 46166 - DNA, 20 bp, Artificial Sequence
  chemically synthesized
tgcagaggactaactgggct

SEQ ID NO: 46167 - DNA, 20 bp, Artificial Sequence
  chemically synthesized
ggactaactgggctgagacc

SEQ ID NO: 46168 - DNA, 20 bp, Artificial Sequence
  chemically synthesized
ctaactgggctgagacccag

SEQ ID NO: 46169 - DNA, 20 bp, Artificial Sequence
  chemically synthesized
gagacccagtggtaatgttt

SEQ ID NO: 46170 - DNA, 20 bp, Artificial Sequence
  chemically synthesized
agacccagtggtaatgtttt

SEQ ID NO: 46171 - DNA, 20 bp, Artificial Sequence
  chemically synthesized
gacccagtggtaatgtttta

SEQ ID NO: 46172 - DNA, 20 bp, Artificial Sequence
  chemically synthesized
gtggtaatgttttagggcct

SEQ ID NO: 46173 - DNA, 20 bp, Artificial Sequence
  chemically synthesized
tggtaatgttttagggccta

SEQ ID NO: 46174 - DNA, 20 bp, Artificial Sequence
  chemically synthesized
gtaatgttttagggcctaag

SEQ ID NO: 46175 - DNA, 20 bp, Artificial Sequence
  chemically synthesized
aaggagtgcctctaaaaatc

SEQ ID NO: 46176 - DNA, 20 bp, Artificial Sequence
  chemically synthesized
agtgcctctaaaaatctaga

SEQ ID NO: 46177 - DNA, 20 bp, Artificial Sequence
  chemically synthesized
agatggacaattttgacttt

SEQ ID NO: 46178 - DNA, 20 bp, Artificial Sequence
  chemically synthesized
gacaattttgactttgagaa

SEQ ID NO: 46179 - DNA, 20 bp, Artificial Sequence
  chemically synthesized
caattttgactttgagaaaa

SEQ ID NO: 46180 - DNA, 20 bp, Artificial Sequence
  chemically synthesized
attttgactttgagaaaaga

SEQ ID NO: 46181 - DNA, 20 bp, Artificial Sequence
  chemically synthesized
ttttgactttgagaaaagag

SEQ ID NO: 46182 - DNA, 20 bp, Artificial Sequence
  chemically synthesized
tgactttgagaaaagagagg

SEQ ID NO: 46183 - DNA, 20 bp, Artificial Sequence
  chemically synthesized
gagaaaagagaggtggaaat

SEQ ID NO: 46184 - DNA, 20 bp, Artificial Sequence
  chemically synthesized
agaaaagagaggtggaaatg

SEQ ID NO: 46185 - DNA, 20 bp, Artificial Sequence
  chemically synthesized
ggaaaatgacttttctttat

SEQ ID NO: 46186 - DNA, 20 bp, Artificial Sequence
  chemically synthesized
gacttttctttattagattc

SEQ ID NO: 46187 - DNA, 20 bp, Artificial Sequence
  chemically synthesized
ttttctttattagattccag

SEQ ID NO: 46188 - DNA, 20 bp, Artificial Sequence
  chemically synthesized
ctttattagattccagtaga

SEQ ID NO: 46189 - DNA, 20 bp, Artificial Sequence
  chemically synthesized
gttgttttaaaacatctatc

SEQ ID NO: 46190 - DNA, 20 bp, Artificial Sequence
  chemically synthesized
tgttttaaaacatctatctg

SEQ ID NO: 46191 - DNA, 20 bp, Artificial Sequence
  chemically synthesized
gttttaaaacatctatctgg

SEQ ID NO: 46192 - DNA, 20 bp, Artificial Sequence
  chemically synthesized
ttaaaacatctatctggagg

SEQ ID NO: 46193 - DNA, 20 bp, Artificial Sequence
  chemically synthesized
taaaacatctatctggaggc

SEQ ID NO: 46194 - DNA, 20 bp, Artificial Sequence
  chemically synthesized
catctatctggaggcaggac

SEQ ID NO: 46195 - DNA, 20 bp, Artificial Sequence
  chemically synthesized
atctggaggcaggacaagta

SEQ ID NO: 46196 - DNA, 20 bp, Artificial Sequence
  chemically synthesized
ggacaagtatggtcgttaaa

SEQ ID NO: 46197 - DNA, 20 bp, Artificial Sequence
  chemically synthesized
gtatggtcgttaaaaagatg

SEQ ID NO: 46198 - DNA, 20 bp, Artificial Sequence
  chemically synthesized
tatggtcgttaaaaagatgc

SEQ ID NO: 46199 - DNA, 20 bp, Artificial Sequence
  chemically synthesized
ggtcgttaaaaagatgcagg

SEQ ID NO: 46200 - DNA, 20 bp, Artificial Sequence
  chemically synthesized
cgttaaaaagatgcaggcag

SEQ ID NO: 46201 - DNA, 20 bp, Artificial Sequence
  chemically synthesized
gttaaaaagatgcaggcaga

SEQ ID NO: 46202 - DNA, 20 bp, Artificial Sequence
  chemically synthesized
tgcaggcagaaggcatatat

SEQ ID NO: 46203 - DNA, 20 bp, Artificial Sequence
  chemically synthesized
gcagaaggcatatattggct

SEQ ID NO: 46204 - DNA, 20 bp, Artificial Sequence
  chemically synthesized
ggcatatattggctcagtca

SEQ ID NO: 46205 - DNA, 20 bp, Artificial Sequence
  chemically synthesized
atatattggctcagtcaaag

SEQ ID NO: 46206 - DNA, 20 bp, Artificial Sequence
  chemically synthesized
tatattggctcagtcaaagt

SEQ ID NO: 46207 - DNA, 20 bp, Artificial Sequence
  chemically synthesized
atattggctcagtcaaagtg

SEQ ID NO: 46208 - DNA, 20 bp, Artificial Sequence
  chemically synthesized
tcagtcaaagtggggaactt

SEQ ID NO: 46209 - DNA, 20 bp, Artificial Sequence
  chemically synthesized
gtcaaagtggggaactttgg

SEQ ID NO: 46210 - DNA, 20 bp, Artificial Sequence
  chemically synthesized
gtggccaaacatacattgct

SEQ ID NO: 46211 - DNA, 20 bp, Artificial Sequence
  chemically synthesized
tggccaaacatacattgcta

SEQ ID NO: 46212 - DNA, 20 bp, Artificial Sequence
  chemically synthesized
tgctaaggctattcctatat

SEQ ID NO: 46213 - DNA, 20 bp, Artificial Sequence
  chemically synthesized
aaggctattcctatatcagc

SEQ ID NO: 46214 - DNA, 20 bp, Artificial Sequence
  chemically synthesized
aaacttatatcctttaattc

SEQ ID NO: 46215 - DNA, 20 bp, Artificial Sequence
  chemically synthesized
ttatatcctttaattccaga

SEQ ID NO: 46216 - DNA, 20 bp, Artificial Sequence
  chemically synthesized
tatatcctttaattccagat

SEQ ID NO: 46217 - DNA, 20 bp, Artificial Sequence
  chemically synthesized
atatcctttaattccagatg

SEQ ID NO: 46218 - DNA, 20 bp, Artificial Sequence
  chemically synthesized
tatcctttaattccagatgg

SEQ ID NO: 46219 - DNA, 20 bp, Artificial Sequence
  chemically synthesized
tttaattccagatgggggca

SEQ ID NO: 46220 - DNA, 20 bp, Artificial Sequence
  chemically synthesized
agatgggggcaaagtatgtc

SEQ ID NO: 46221 - DNA, 20 bp, Artificial Sequence
  chemically synthesized
gatgggggcaaagtatgtcc

SEQ ID NO: 46222 - DNA, 20 bp, Artificial Sequence
  chemically synthesized
atgggggcaaagtatgtcca

SEQ ID NO: 46223 - DNA, 20 bp, Artificial Sequence
  chemically synthesized
tgggggcaaagtatgtccag

SEQ ID NO: 46224 - DNA, 20 bp, Artificial Sequence
  chemically synthesized
ggcaaagtatgtccaggggt

SEQ ID NO: 46225 - DNA, 20 bp, Artificial Sequence
  chemically synthesized
gcaaagtatgtccaggggtg

SEQ ID NO: 46226 - DNA, 20 bp, Artificial Sequence
  chemically synthesized
tgaggaacaattgaaacatt

SEQ ID NO: 46227 - DNA, 20 bp, Artificial Sequence
  chemically synthesized
gaggaacaattgaaacattt

SEQ ID NO: 46228 - DNA, 20 bp, Artificial Sequence
  chemically synthesized
aacaattgaaacatttgggc

SEQ ID NO: 46229 - DNA, 20 bp, Artificial Sequence
  chemically synthesized
caattgaaacatttgggctg

SEQ ID NO: 46230 - DNA, 20 bp, Artificial Sequence
  chemically synthesized
ttgaaacatttgggctggag

SEQ ID NO: 46231 - DNA, 20 bp, Artificial Sequence
  chemically synthesized
tgggctggagtagattttga

SEQ ID NO: 46232 - DNA, 20 bp, Artificial Sequence
  chemically synthesized
ctggagtagattttgaaagt

SEQ ID NO: 46233 - DNA, 20 bp, Artificial Sequence
  chemically synthesized
gcgcgtgtgtgtgtgtgtgt

SEQ ID NO: 46234 - DNA, 20 bp, Artificial Sequence
  chemically synthesized
tgtgtttcttttaacgtctt

SEQ ID NO: 46235 - DNA, 20 bp, Artificial Sequence
  chemically synthesized
cgtcttcagcctacaacata

SEQ ID NO: 46236 - DNA, 20 bp, Artificial Sequence
  chemically synthesized
gtcttcagcctacaacatac

SEQ ID NO: 46237 - DNA, 20 bp, Artificial Sequence
  chemically synthesized
tcttcagcctacaacataca

SEQ ID NO: 46238 - DNA, 20 bp, Artificial Sequence
  chemically synthesized
cctacaacatacagggttca

SEQ ID NO: 46239 - DNA, 20 bp, Artificial Sequence
  chemically synthesized
acaacatacagggttcatgg

SEQ ID NO: 46240 - DNA, 20 bp, Artificial Sequence
  chemically synthesized
catacagggttcatggtggc

SEQ ID NO: 46241 - DNA, 20 bp, Artificial Sequence
  chemically synthesized
acagggttcatggtggcaag

SEQ ID NO: 46242 - DNA, 20 bp, Artificial Sequence
  chemically synthesized
ggttcatggtggcaagaaga

SEQ ID NO: 46243 - DNA, 20 bp, Artificial Sequence
  chemically synthesized
catggtggcaagaagatagc

SEQ ID NO: 46244 - DNA, 20 bp, Artificial Sequence
  chemically synthesized
agatagcaagatttaaatta

SEQ ID NO: 46245 - DNA, 20 bp, Artificial Sequence
  chemically synthesized
agcaagatttaaattatggc

SEQ ID NO: 46246 - DNA, 20 bp, Artificial Sequence
  chemically synthesized
tttaaattatggccagtgac

SEQ ID NO: 46247 - DNA, 20 bp, Artificial Sequence
  chemically synthesized
tggccagtgactagtgcttg

SEQ ID NO: 46248 - DNA, 20 bp, Artificial Sequence
  chemically synthesized
ggccagtgactagtgcttga

SEQ ID NO: 46249 - DNA, 20 bp, Artificial Sequence
  chemically synthesized
gccagtgactagtgcttgaa

SEQ ID NO: 46250 - DNA, 20 bp, Artificial Sequence
  chemically synthesized
ccagtgactagtgcttgaag

SEQ ID NO: 46251 - DNA, 20 bp, Artificial Sequence
  chemically synthesized
gaacaactacctgcatttaa

SEQ ID NO: 46252 - DNA, 20 bp, Artificial Sequence
  chemically synthesized
aacaactacctgcatttaat

SEQ ID NO: 46253 - DNA, 20 bp, Artificial Sequence
  chemically synthesized
aactacctgcatttaatggg

SEQ ID NO: 46254 - DNA, 20 bp, Artificial Sequence
  chemically synthesized
actacctgcatttaatggga

SEQ ID NO: 46255 - DNA, 20 bp, Artificial Sequence
  chemically synthesized
ttaatgggaaggcaaaatct

SEQ ID NO: 46256 - DNA, 20 bp, Artificial Sequence
  chemically synthesized
taatgggaaggcaaaatctc

SEQ ID NO: 46257 - DNA, 20 bp, Artificial Sequence
  chemically synthesized
aaggcaaaatctcaggcttt

SEQ ID NO: 46258 - DNA, 20 bp, Artificial Sequence
  chemically synthesized
aggcaaaatctcaggctttg

SEQ ID NO: 46259 - DNA, 20 bp, Artificial Sequence
  chemically synthesized
ggcaaaatctcaggctttga

SEQ ID NO: 46260 - DNA, 20 bp, Artificial Sequence
  chemically synthesized
aaaatctcaggctttgaggg

SEQ ID NO: 46261 - DNA, 20 bp, Artificial Sequence
  chemically synthesized
ggctttgagggaagttaaca

SEQ ID NO: 46262 - DNA, 20 bp, Artificial Sequence
  chemically synthesized
gctttgagggaagttaacat

SEQ ID NO: 46263 - DNA, 20 bp, Artificial Sequence
  chemically synthesized
agttaacataggcttgattc

SEQ ID NO: 46264 - DNA, 20 bp, Artificial Sequence
  chemically synthesized
gttaacataggcttgattct

SEQ ID NO: 46265 - DNA, 20 bp, Artificial Sequence
  chemically synthesized
aacataggcttgattctggg

SEQ ID NO: 46266 - DNA, 20 bp, Artificial Sequence
  chemically synthesized
ataggcttgattctgggtgg

SEQ ID NO: 46267 - DNA, 20 bp, Artificial Sequence
  chemically synthesized
cttgattctgggtggaagct

SEQ ID NO: 46268 - DNA, 20 bp, Artificial Sequence
  chemically synthesized
ctgggtggaagcttggtgtg

SEQ ID NO: 46269 - DNA, 20 bp, Artificial Sequence
  chemically synthesized
aagcttggtgtgtagttatc

SEQ ID NO: 46270 - DNA, 20 bp, Artificial Sequence
  chemically synthesized
gcttggtgtgtagttatctg

SEQ ID NO: 46271 - DNA, 20 bp, Artificial Sequence
  chemically synthesized
cttggtgtgtagttatctgg

SEQ ID NO: 46272 - DNA, 20 bp, Artificial Sequence
  chemically synthesized
gtgtgtagttatctggaggc

SEQ ID NO: 46273 - DNA, 20 bp, Artificial Sequence
  chemically synthesized
tgtgtagttatctggaggcc

SEQ ID NO: 46274 - DNA, 20 bp, Artificial Sequence
  chemically synthesized
tagttatctggaggccaggc

SEQ ID NO: 46275 - DNA, 20 bp, Artificial Sequence
  chemically synthesized
gttatctggaggccaggctg

SEQ ID NO: 46276 - DNA, 20 bp, Artificial Sequence
  chemically synthesized
ggaggccaggctggagctct

SEQ ID NO: 46277 - DNA, 20 bp, Artificial Sequence
  chemically synthesized
ctggagctctcagctcacta

SEQ ID NO: 46278 - DNA, 20 bp, Artificial Sequence
  chemically synthesized
tggagctctcagctcactat

SEQ ID NO: 46279 - DNA, 20 bp, Artificial Sequence
  chemically synthesized
attgtctcctttcatctcaa

SEQ ID NO: 46280 - DNA, 20 bp, Artificial Sequence
  chemically synthesized
cctttcatctcaacagctcc

SEQ ID NO: 46281 - DNA, 20 bp, Artificial Sequence
  chemically synthesized
ctttcatctcaacagctcct

SEQ ID NO: 46282 - DNA, 20 bp, Artificial Sequence
  chemically synthesized
acagctcctgggaaatgtgc

SEQ ID NO: 46283 - DNA, 20 bp, Artificial Sequence
  chemically synthesized
aaatgtgctggtgaccgttt

SEQ ID NO: 46284 - DNA, 20 bp, Artificial Sequence
  chemically synthesized
accgttttggcaatccattt

SEQ ID NO: 46285 - DNA, 20 bp, Artificial Sequence
  chemically synthesized
tttggcaatccatttcggca

SEQ ID NO: 46286 - DNA, 20 bp, Artificial Sequence
  chemically synthesized
tcggcaaagaattcacccct

SEQ ID NO: 46287 - DNA, 20 bp, Artificial Sequence
  chemically synthesized
cggcaaagaattcacccctg

SEQ ID NO: 46288 - DNA, 20 bp, Artificial Sequence
  chemically synthesized
aagaattcacccctgaggtg

SEQ ID NO: 46289 - DNA, 20 bp, Artificial Sequence
  chemically synthesized
agaattcacccctgaggtgc

SEQ ID NO: 46290 - DNA, 20 bp, Artificial Sequence
  chemically synthesized
cccctgaggtgcaggcttcc

SEQ ID NO: 46291 - DNA, 20 bp, Artificial Sequence
  chemically synthesized
ctgaggtgcaggcttcctgg

SEQ ID NO: 46292 - DNA, 20 bp, Artificial Sequence
  chemically synthesized
aggtgcaggcttcctggcag

SEQ ID NO: 46293 - DNA, 20 bp, Artificial Sequence
  chemically synthesized
gcaggcttcctggcagaaga

SEQ ID NO: 46294 - DNA, 20 bp, Artificial Sequence
  chemically synthesized
ctggcagaagatggtgactg

SEQ ID NO: 46295 - DNA, 20 bp, Artificial Sequence
  chemically synthesized
gcagaagatggtgactgcag

SEQ ID NO: 46296 - DNA, 20 bp, Artificial Sequence
  chemically synthesized
aagatggtgactgcagtggc

SEQ ID NO: 46297 - DNA, 20 bp, Artificial Sequence
  chemically synthesized
gtggccagtgccctgtcctc

SEQ ID NO: 46298 - DNA, 20 bp, Artificial Sequence
  chemically synthesized
cctgtcctccagataccact

SEQ ID NO: 46299 - DNA, 20 bp, Artificial Sequence
  chemically synthesized
tgagctcactgcccatgatt

SEQ ID NO: 46300 - DNA, 20 bp, Artificial Sequence
  chemically synthesized
agctcactgcccatgattca

SEQ ID NO: 46301 - DNA, 20 bp, Artificial Sequence
  chemically synthesized
gcccatgattcagagctttc

SEQ ID NO: 46302 - DNA, 20 bp, Artificial Sequence
  chemically synthesized
cccatgattcagagctttca

SEQ ID NO: 46303 - DNA, 20 bp, Artificial Sequence
  chemically synthesized
tgattcagagctttcaagga

SEQ ID NO: 46304 - DNA, 20 bp, Artificial Sequence
  chemically synthesized
gattcagagctttcaaggat

SEQ ID NO: 46305 - DNA, 20 bp, Artificial Sequence
  chemically synthesized
aaggataggctttattctgc

SEQ ID NO: 46306 - DNA, 20 bp, Artificial Sequence
  chemically synthesized
aataataaatctattctgct

SEQ ID NO: 46307 - DNA, 20 bp, Artificial Sequence
  chemically synthesized
taataaatctattctgctga

SEQ ID NO: 46308 - DNA, 20 bp, Artificial Sequence
  chemically synthesized
agatcacacatgattttctt

SEQ ID NO: 46309 - DNA, 20 bp, Artificial Sequence
  chemically synthesized
ttacatctttttaaatatat

SEQ ID NO: 46310 - DNA, 20 bp, Artificial Sequence
  chemically synthesized
ttttaaatatatgagccaca

SEQ ID NO: 46311 - DNA, 20 bp, Artificial Sequence
  chemically synthesized
tttaaatatatgagccacaa

SEQ ID NO: 46312 - DNA, 20 bp, Artificial Sequence
  chemically synthesized
ttaaatatatgagccacaaa

SEQ ID NO: 46313 - DNA, 20 bp, Artificial Sequence
  chemically synthesized
agccacaaagggtttatatt

SEQ ID NO: 46314 - DNA, 20 bp, Artificial Sequence
  chemically synthesized
gccacaaagggtttatattg

SEQ ID NO: 46315 - DNA, 20 bp, Artificial Sequence
  chemically synthesized
ccacaaagggtttatattga

SEQ ID NO: 46316 - DNA, 20 bp, Artificial Sequence
  chemically synthesized
caaagggtttatattgaggg

SEQ ID NO: 46317 - DNA, 20 bp, Artificial Sequence
  chemically synthesized
tgcatgcctgtttgtgtttg

SEQ ID NO: 46318 - DNA, 20 bp, Artificial Sequence
  chemically synthesized
ctcctcatttatttttatat

SEQ ID NO: 46319 - DNA, 20 bp, Artificial Sequence
  chemically synthesized
tatgagatgtgcattttgat

SEQ ID NO: 46320 - DNA, 20 bp, Artificial Sequence
  chemically synthesized
gcattttgatgagcaaataa

SEQ ID NO: 46321 - DNA, 20 bp, Artificial Sequence
  chemically synthesized
ttttgatgagcaaataaaag

SEQ ID NO: 46322 - DNA, 20 bp, Artificial Sequence
  chemically synthesized
atgagcaaataaaagcagta

SEQ ID NO: 46323 - DNA, 20 bp, Artificial Sequence
  chemically synthesized
gcagtaaagacacttgtaca

SEQ ID NO: 46324 - DNA, 20 bp, Artificial Sequence
  chemically synthesized
cagtaaagacacttgtacac

SEQ ID NO: 46325 - DNA, 20 bp, Artificial Sequence
  chemically synthesized
gtaaagacacttgtacacgg

SEQ ID NO: 46326 - DNA, 20 bp, Artificial Sequence
  chemically synthesized
cttgtacacgggagttctgc

SEQ ID NO: 46327 - DNA, 20 bp, Artificial Sequence
  chemically synthesized
gtacacgggagttctgcaag

SEQ ID NO: 46328 - DNA, 20 bp, Artificial Sequence
  chemically synthesized
tacacgggagttctgcaagt

SEQ ID NO: 46329 - DNA, 20 bp, Artificial Sequence
  chemically synthesized
cacgggagttctgcaagtgg

SEQ ID NO: 46330 - DNA, 20 bp, Artificial Sequence
  chemically synthesized
gttctgcaagtgggagtaaa

SEQ ID NO: 46331 - DNA, 20 bp, Artificial Sequence
  chemically synthesized
gcaagtgggagtaaatggtg

SEQ ID NO: 46332 - DNA, 20 bp, Artificial Sequence
  chemically synthesized
caagtgggagtaaatggtgt

SEQ ID NO: 46333 - DNA, 20 bp, Artificial Sequence
  chemically synthesized
agtgggagtaaatggtgtag

SEQ ID NO: 46334 - DNA, 20 bp, Artificial Sequence
  chemically synthesized
taaatggtgtaggagaaatc

SEQ ID NO: 46335 - DNA, 20 bp, Artificial Sequence
  chemically synthesized
atggtgtaggagaaatccgg

SEQ ID NO: 46336 - DNA, 20 bp, Artificial Sequence
  chemically synthesized
tggtgtaggagaaatccggt

SEQ ID NO: 46337 - DNA, 20 bp, Artificial Sequence
  chemically synthesized
tgtaggagaaatccggtggg

SEQ ID NO: 46338 - DNA, 20 bp, Artificial Sequence
  chemically synthesized
ggagaaatccggtgggaaga

SEQ ID NO: 46339 - DNA, 20 bp, Artificial Sequence
  chemically synthesized
ggtgggaagaaagacctcta

SEQ ID NO: 46340 - DNA, 20 bp, Artificial Sequence
  chemically synthesized
gtgggaagaaagacctctat

SEQ ID NO: 46341 - DNA, 20 bp, Artificial Sequence
  chemically synthesized
gaagaaagacctctatagga

SEQ ID NO: 46342 - DNA, 20 bp, Artificial Sequence
  chemically synthesized
aagaaagacctctataggac

SEQ ID NO: 46343 - DNA, 20 bp, Artificial Sequence
  chemically synthesized
ctctataggacaggacttct

SEQ ID NO: 46344 - DNA, 20 bp, Artificial Sequence
  chemically synthesized
aggacaggacttctcagaaa

SEQ ID NO: 46345 - DNA, 20 bp, Artificial Sequence
  chemically synthesized
cttctcagaaacagatgttt

SEQ ID NO: 46346 - DNA, 20 bp, Artificial Sequence
  chemically synthesized
ctcagaaacagatgttttgg

SEQ ID NO: 46347 - DNA, 20 bp, Artificial Sequence
  chemically synthesized
cagaaacagatgttttggaa

SEQ ID NO: 46348 - DNA, 20 bp, Artificial Sequence
  chemically synthesized
aacagatgttttggaagaga

SEQ ID NO: 46349 - DNA, 20 bp, Artificial Sequence
  chemically synthesized
acagatgttttggaagagat

SEQ ID NO: 46350 - DNA, 20 bp, Artificial Sequence
  chemically synthesized
tgttttggaagagatgggaa

SEQ ID NO: 46351 - DNA, 20 bp, Artificial Sequence
  chemically synthesized
gttttggaagagatgggaaa

SEQ ID NO: 46352 - DNA, 20 bp, Artificial Sequence
  chemically synthesized
ggaagagatgggaaaaggtt

SEQ ID NO: 46353 - DNA, 20 bp, Artificial Sequence
  chemically synthesized
agatgggaaaaggttcagtg

SEQ ID NO: 46354 - DNA, 20 bp, Artificial Sequence
  chemically synthesized
gaaaaggttcagtgaagacc

SEQ ID NO: 46355 - DNA, 20 bp, Artificial Sequence
  chemically synthesized
aaaaggttcagtgaagacct

SEQ ID NO: 46356 - DNA, 20 bp, Artificial Sequence
  chemically synthesized
aaaggttcagtgaagacctg

SEQ ID NO: 46357 - DNA, 20 bp, Artificial Sequence
  chemically synthesized
aaggttcagtgaagacctgg

SEQ ID NO: 46358 - DNA, 20 bp, Artificial Sequence
  chemically synthesized
ttcagtgaagacctgggggc

SEQ ID NO: 46359 - DNA, 20 bp, Artificial Sequence
  chemically synthesized
cctgggggctggattgattg

SEQ ID NO: 46360 - DNA, 20 bp, Artificial Sequence
  chemically synthesized
gggctggattgattgcagct

SEQ ID NO: 46361 - DNA, 20 bp, Artificial Sequence
  chemically synthesized
ctggattgattgcagctgag

SEQ ID NO: 46362 - DNA, 20 bp, Artificial Sequence
  chemically synthesized
attgattgcagctgagtagc

SEQ ID NO: 46363 - DNA, 20 bp, Artificial Sequence
  chemically synthesized
ttgattgcagctgagtagca

SEQ ID NO: 46364 - DNA, 20 bp, Artificial Sequence
  chemically synthesized
ttgcagctgagtagcaagga

SEQ ID NO: 46365 - DNA, 20 bp, Artificial Sequence
  chemically synthesized
gagtagcaaggatggttctt

SEQ ID NO: 46366 - DNA, 20 bp, Artificial Sequence
  chemically synthesized
agtagcaaggatggttctta

SEQ ID NO: 46367 - DNA, 20 bp, Artificial Sequence
  chemically synthesized
agcaaggatggttcttaagg

SEQ ID NO: 46368 - DNA, 20 bp, Artificial Sequence
  chemically synthesized
gcaaggatggttcttaagga

SEQ ID NO: 46369 - DNA, 20 bp, Artificial Sequence
  chemically synthesized
caaggatggttcttaaggaa

SEQ ID NO: 46370 - DNA, 20 bp, Artificial Sequence
  chemically synthesized
gatggttcttaaggaaggga

SEQ ID NO: 46371 - DNA, 20 bp, Artificial Sequence
  chemically synthesized
taaggaagggaaagtgttcc

SEQ ID NO: 46372 - DNA, 20 bp, Artificial Sequence
  chemically synthesized
agggaaagtgttccaagctt

SEQ ID NO: 46373 - DNA, 20 bp, Artificial Sequence
  chemically synthesized
gggaaagtgttccaagcttt

SEQ ID NO: 46374 - DNA, 20 bp, Artificial Sequence
  chemically synthesized
gttccaagctttaggaattc

SEQ ID NO: 46375 - DNA, 20 bp, Artificial Sequence
  chemically synthesized
ttccaagctttaggaattca

SEQ ID NO: 46376 - DNA, 20 bp, Artificial Sequence
  chemically synthesized
agctttaggaattcaaggtt

SEQ ID NO: 46377 - DNA, 20 bp, Artificial Sequence
  chemically synthesized
ttaggaattcaaggtttagt

SEQ ID NO: 46378 - DNA, 20 bp, Artificial Sequence
  chemically synthesized
taggaattcaaggtttagtc

SEQ ID NO: 46379 - DNA, 20 bp, Artificial Sequence
  chemically synthesized
attcaaggtttagtcaggtg

SEQ ID NO: 46380 - DNA, 20 bp, Artificial Sequence
  chemically synthesized
gtgtagcaattctattttat

SEQ ID NO: 46381 - DNA, 20 bp, Artificial Sequence
  chemically synthesized
tgtagcaattctattttatt

SEQ ID NO: 46382 - DNA, 20 bp, Artificial Sequence
  chemically synthesized
tagcaattctattttattag

SEQ ID NO: 46383 - DNA, 20 bp, Artificial Sequence
  chemically synthesized
agcaattctattttattagg

SEQ ID NO: 46384 - DNA, 20 bp, Artificial Sequence
  chemically synthesized
aggaggaatactatttctaa

SEQ ID NO: 46385 - DNA, 20 bp, Artificial Sequence
  chemically synthesized
atactatttctaatggcact

SEQ ID NO: 46386 - DNA, 20 bp, Artificial Sequence
  chemically synthesized
taatggcacttagcttttca

SEQ ID NO: 46387 - DNA, 20 bp, Artificial Sequence
  chemically synthesized
ttagcttttcacagcccttg

SEQ ID NO: 46388 - DNA, 20 bp, Artificial Sequence
  chemically synthesized
cacagcccttgtggatgcct

SEQ ID NO: 46389 - DNA, 20 bp, Artificial Sequence
  chemically synthesized
gcccttgtggatgcctaaga

SEQ ID NO: 46390 - DNA, 20 bp, Artificial Sequence
  chemically synthesized
gaaattaatcccatgccctc

SEQ ID NO: 46391 - DNA, 20 bp, Artificial Sequence
  chemically synthesized
atcccatgccctcaagtgtg

SEQ ID NO: 46392 - DNA, 20 bp, Artificial Sequence
  chemically synthesized
atgccctcaagtgtgcagat

SEQ ID NO: 46393 - DNA, 20 bp, Artificial Sequence
  chemically synthesized
tcaagtgtgcagattggtca

SEQ ID NO: 46394 - DNA, 20 bp, Artificial Sequence
  chemically synthesized
cagattggtcacagcatttc

SEQ ID NO: 46395 - DNA, 20 bp, Artificial Sequence
  chemically synthesized
agattggtcacagcatttca

SEQ ID NO: 46396 - DNA, 20 bp, Artificial Sequence
  chemically synthesized
gattggtcacagcatttcaa

SEQ ID NO: 46397 - DNA, 20 bp, Artificial Sequence
  chemically synthesized
ttggtcacagcatttcaagg

SEQ ID NO: 46398 - DNA, 20 bp, Artificial Sequence
  chemically synthesized
ggtcacagcatttcaaggga

SEQ ID NO: 46399 - DNA, 20 bp, Artificial Sequence
  chemically synthesized
caagggagagacctcattgt

SEQ ID NO: 46400 - DNA, 20 bp, Artificial Sequence
  chemically synthesized
gagacctcattgtaagactc

SEQ ID NO: 46401 - DNA, 20 bp, Artificial Sequence
  chemically synthesized
agacctcattgtaagactct

SEQ ID NO: 46402 - DNA, 20 bp, Artificial Sequence
  chemically synthesized
gacctcattgtaagactctg

SEQ ID NO: 46403 - DNA, 20 bp, Artificial Sequence
  chemically synthesized
acctcattgtaagactctgg

SEQ ID NO: 46404 - DNA, 20 bp, Artificial Sequence
  chemically synthesized
ctcattgtaagactctgggg

SEQ ID NO: 46405 - DNA, 20 bp, Artificial Sequence
  chemically synthesized
tcattgtaagactctggggg

SEQ ID NO: 46406 - DNA, 20 bp, Artificial Sequence
  chemically synthesized
ttgtaagactctgggggagg

SEQ ID NO: 46407 - DNA, 20 bp, Artificial Sequence
  chemically synthesized
tgtaagactctgggggaggt

SEQ ID NO: 46408 - DNA, 20 bp, Artificial Sequence
  chemically synthesized
gtaagactctgggggaggtg

SEQ ID NO: 46409 - DNA, 20 bp, Artificial Sequence
  chemically synthesized
ctctgggggaggtggggact

SEQ ID NO: 46410 - DNA, 20 bp, Artificial Sequence
  chemically synthesized
tctgggggaggtggggactt

SEQ ID NO: 46411 - DNA, 20 bp, Artificial Sequence
  chemically synthesized
ggaggtggggacttaggtgt

SEQ ID NO: 46412 - DNA, 20 bp, Artificial Sequence
  chemically synthesized
cttaggtgtaagaaatgaat

SEQ ID NO: 46413 - DNA, 20 bp, Artificial Sequence
  chemically synthesized
aggtgtaagaaatgaatcag

SEQ ID NO: 46414 - DNA, 20 bp, Artificial Sequence
  chemically synthesized
gtgtaagaaatgaatcagca

SEQ ID NO: 46415 - DNA, 20 bp, Artificial Sequence
  chemically synthesized
tgtaagaaatgaatcagcag

SEQ ID NO: 46416 - DNA, 20 bp, Artificial Sequence
  chemically synthesized
atgaatcagcagaggctcac

SEQ ID NO: 46417 - DNA, 20 bp, Artificial Sequence
  chemically synthesized
atcagcagaggctcacaagt

SEQ ID NO: 46418 - DNA, 20 bp, Artificial Sequence
  chemically synthesized
agaggctcacaagtcagcat

SEQ ID NO: 46419 - DNA, 20 bp, Artificial Sequence
  chemically synthesized
agcatgagcatgttatgtct

SEQ ID NO: 46420 - DNA, 20 bp, Artificial Sequence
  chemically synthesized
agcatgttatgtctgagaaa

SEQ ID NO: 46421 - DNA, 20 bp, Artificial Sequence
  chemically synthesized
gttatgtctgagaaacagac

SEQ ID NO: 46422 - DNA, 20 bp, Artificial Sequence
  chemically synthesized
gagaaacagaccagcactgt

SEQ ID NO: 46423 - DNA, 20 bp, Artificial Sequence
  chemically synthesized
agcactgtgagatcaaaatg

SEQ ID NO: 46424 - DNA, 20 bp, Artificial Sequence
  chemically synthesized
actgtgagatcaaaatgtag

SEQ ID NO: 46425 - DNA, 20 bp, Artificial Sequence
  chemically synthesized
ctgtgagatcaaaatgtagt

SEQ ID NO: 46426 - DNA, 20 bp, Artificial Sequence
  chemically synthesized
tgagatcaaaatgtagtggg

SEQ ID NO: 46427 - DNA, 20 bp, Artificial Sequence
  chemically synthesized
agaatttgtacaacattaat

SEQ ID NO: 46428 - DNA, 20 bp, Artificial Sequence
  chemically synthesized
atttgtacaacattaattgg

SEQ ID NO: 46429 - DNA, 20 bp, Artificial Sequence
  chemically synthesized
tttgtacaacattaattgga

SEQ ID NO: 46430 - DNA, 20 bp, Artificial Sequence
  chemically synthesized
taattggaaggcttacttaa

SEQ ID NO: 46431 - DNA, 20 bp, Artificial Sequence
  chemically synthesized
tacttaatggaatttttgta

SEQ ID NO: 46432 - DNA, 20 bp, Artificial Sequence
  chemically synthesized
taatggaatttttgtatagt

SEQ ID NO: 46433 - DNA, 20 bp, Artificial Sequence
  chemically synthesized
atttttgtatagttggatgt

SEQ ID NO: 46434 - DNA, 20 bp, Artificial Sequence
  chemically synthesized
ggatgttagtgcatctctat

SEQ ID NO: 46435 - DNA, 20 bp, Artificial Sequence
  chemically synthesized
gttagtgcatctctataagt

SEQ ID NO: 46436 - DNA, 20 bp, Artificial Sequence
  chemically synthesized
tagtgcatctctataagtaa

SEQ ID NO: 46437 - DNA, 20 bp, Artificial Sequence
  chemically synthesized
taagtaagagtttaatatga

SEQ ID NO: 46438 - DNA, 20 bp, Artificial Sequence
  chemically synthesized
agtttaatatgatggtgtta

SEQ ID NO: 46439 - DNA, 20 bp, Artificial Sequence
  chemically synthesized
ctcccaactgaccttatctg

SEQ ID NO: 46440 - DNA, 20 bp, Artificial Sequence
  chemically synthesized
tcccaactgaccttatctgt

SEQ ID NO: 46441 - DNA, 20 bp, Artificial Sequence
  chemically synthesized
cccaactgaccttatctgtg

SEQ ID NO: 46442 - DNA, 20 bp, Artificial Sequence
  chemically synthesized
ccaactgaccttatctgtgg

SEQ ID NO: 46443 - DNA, 20 bp, Artificial Sequence
  chemically synthesized
aactgaccttatctgtgggg

SEQ ID NO: 46444 - DNA, 20 bp, Artificial Sequence
  chemically synthesized
actgaccttatctgtggggg

SEQ ID NO: 46445 - DNA, 20 bp, Artificial Sequence
  chemically synthesized
ctgtgggggaggcttttgaa

SEQ ID NO: 46446 - DNA, 20 bp, Artificial Sequence
  chemically synthesized
ggaggcttttgaaaagtaat

SEQ ID NO: 46447 - DNA, 20 bp, Artificial Sequence
  chemically synthesized
gaggcttttgaaaagtaatt

SEQ ID NO: 46448 - DNA, 20 bp, Artificial Sequence
  chemically synthesized
ttttgaaaagtaattaggtt

SEQ ID NO: 46449 - DNA, 20 bp, Artificial Sequence
  chemically synthesized
aaaagtaattaggtttagat

SEQ ID NO: 46450 - DNA, 20 bp, Artificial Sequence
  chemically synthesized
ttaggtttagatgagctcat

SEQ ID NO: 46451 - DNA, 20 bp, Artificial Sequence
  chemically synthesized
aggtttagatgagctcataa

SEQ ID NO: 46452 - DNA, 20 bp, Artificial Sequence
  chemically synthesized
tttagatgagctcataagag

SEQ ID NO: 46453 - DNA, 20 bp, Artificial Sequence
  chemically synthesized
cataaaattattttccttat

SEQ ID NO: 46454 - DNA, 20 bp, Artificial Sequence
  chemically synthesized
aaaattattttccttatcag

SEQ ID NO: 46455 - DNA, 20 bp, Artificial Sequence
  chemically synthesized
attattttccttatcagaag

SEQ ID NO: 46456 - DNA, 20 bp, Artificial Sequence
  chemically synthesized
tattttccttatcagaagca

SEQ ID NO: 46457 - DNA, 20 bp, Artificial Sequence
  chemically synthesized
ttttccttatcagaagcaga

SEQ ID NO: 46458 - DNA, 20 bp, Artificial Sequence
  chemically synthesized
cttatcagaagcagagagac

SEQ ID NO: 46459 - DNA, 20 bp, Artificial Sequence
  chemically synthesized
aagccatttctctttcctcc

SEQ ID NO: 46460 - DNA, 20 bp, Artificial Sequence
  chemically synthesized
catttctctttcctcccggt

SEQ ID NO: 46461 - DNA, 20 bp, Artificial Sequence
  chemically synthesized
atttctctttcctcccggtg

SEQ ID NO: 46462 - DNA, 20 bp, Artificial Sequence
  chemically synthesized
ctttcctcccggtgaggaca

SEQ ID NO: 46463 - DNA, 20 bp, Artificial Sequence
  chemically synthesized
cctcccggtgaggacacagt

SEQ ID NO: 46464 - DNA, 20 bp, Artificial Sequence
  chemically synthesized
cccggtgaggacacagtgag

SEQ ID NO: 46465 - DNA, 20 bp, Artificial Sequence
  chemically synthesized
gaagtccgccatctgcaatc

SEQ ID NO: 46466 - DNA, 20 bp, Artificial Sequence
  chemically synthesized
aagtccgccatctgcaatcc

SEQ ID NO: 46467 - DNA, 20 bp, Artificial Sequence
  chemically synthesized
tccgccatctgcaatccagg

SEQ ID NO: 46468 - DNA, 20 bp, Artificial Sequence
  chemically synthesized
cgccatctgcaatccaggaa

SEQ ID NO: 46469 - DNA, 20 bp, Artificial Sequence
  chemically synthesized
aggaagagaaccctgaccac

SEQ ID NO: 46470 - DNA, 20 bp, Artificial Sequence
  chemically synthesized
agagaaccctgaccacgagt

SEQ ID NO: 46471 - DNA, 20 bp, Artificial Sequence
  chemically synthesized
cctgaccacgagtcagcctt

SEQ ID NO: 46472 - DNA, 20 bp, Artificial Sequence
  chemically synthesized
gagtcagccttcagaaatgt

SEQ ID NO: 46473 - DNA, 20 bp, Artificial Sequence
  chemically synthesized
gagaaaaaactctgttgttg

SEQ ID NO: 46474 - DNA, 20 bp, Artificial Sequence
  chemically synthesized
actctgttgttgaagccacc

SEQ ID NO: 46475 - DNA, 20 bp, Artificial Sequence
  chemically synthesized
cagtcttttgtattttgtta

SEQ ID NO: 46476 - DNA, 20 bp, Artificial Sequence
  chemically synthesized
ttgttatagcaccttgcact

SEQ ID NO: 46477 - DNA, 20 bp, Artificial Sequence
  chemically synthesized
tatagcaccttgcactgagt

SEQ ID NO: 46478 - DNA, 20 bp, Artificial Sequence
  chemically synthesized
atagcaccttgcactgagta

SEQ ID NO: 46479 - DNA, 20 bp, Artificial Sequence
  chemically synthesized
gcaccttgcactgagtaagg

SEQ ID NO: 46480 - DNA, 20 bp, Artificial Sequence
  chemically synthesized
tgcactgagtaaggcagatg

SEQ ID NO: 46481 - DNA, 20 bp, Artificial Sequence
  chemically synthesized
actgagtaaggcagatgaag

SEQ ID NO: 46482 - DNA, 20 bp, Artificial Sequence
  chemically synthesized
ctgagtaaggcagatgaaga

SEQ ID NO: 46483 - DNA, 20 bp, Artificial Sequence
  chemically synthesized
gagtaaggcagatgaagaag

SEQ ID NO: 46484 - DNA, 20 bp, Artificial Sequence
  chemically synthesized
atgaagaaggagaaaaaaat

SEQ ID NO: 46485 - DNA, 20 bp, Artificial Sequence
  chemically synthesized
gaaggagaaaaaaataagct

SEQ ID NO: 46486 - DNA, 20 bp, Artificial Sequence
  chemically synthesized
aaggagaaaaaaataagctt

SEQ ID NO: 46487 - DNA, 20 bp, Artificial Sequence
  chemically synthesized
aaaaaataagcttgggtttt

SEQ ID NO: 46488 - DNA, 20 bp, Artificial Sequence
  chemically synthesized
aaataagcttgggttttgag

SEQ ID NO: 46489 - DNA, 20 bp, Artificial Sequence
  chemically synthesized
cttgggttttgagtggacta

SEQ ID NO: 46490 - DNA, 20 bp, Artificial Sequence
  chemically synthesized
actacagaccatgtttatct

SEQ ID NO: 46491 - DNA, 20 bp, Artificial Sequence
  chemically synthesized
ctacagaccatgtttatctc

SEQ ID NO: 46492 - DNA, 20 bp, Artificial Sequence
  chemically synthesized
atgtttatctcaggtttgca

SEQ ID NO: 46493 - DNA, 20 bp, Artificial Sequence
  chemically synthesized
tcccctcgtcccctatgttt

SEQ ID NO: 46494 - DNA, 20 bp, Artificial Sequence
  chemically synthesized
actctactactctcatctat

SEQ ID NO: 46495 - DNA, 20 bp, Artificial Sequence
  chemically synthesized
atctataagacccaaataat

SEQ ID NO: 46496 - DNA, 20 bp, Artificial Sequence
  chemically synthesized
tacttcaacatgctttactc

SEQ ID NO: 46497 - DNA, 20 bp, Artificial Sequence
  chemically synthesized
ccttgtaatgtctttacata

SEQ ID NO: 46498 - DNA, 20 bp, Artificial Sequence
  chemically synthesized
tttacatacagtgaaatgta

SEQ ID NO: 46499 - DNA, 20 bp, Artificial Sequence
  chemically synthesized
ctttctttcttttttctcct

SEQ ID NO: 46500 - DNA, 20 bp, Artificial Sequence
  chemically synthesized
ttcttttttctcctcagcct

SEQ ID NO: 46501 - DNA, 20 bp, Artificial Sequence
  chemically synthesized
ttctcctcagcctcagaatt

SEQ ID NO: 46502 - DNA, 20 bp, Artificial Sequence
  chemically synthesized
gcacatgcccttccttcttt

SEQ ID NO: 46503 - DNA, 20 bp, Artificial Sequence
  chemically synthesized
cacatgcccttccttctttc

SEQ ID NO: 46504 - DNA, 20 bp, Artificial Sequence
  chemically synthesized
acttctccaacatctctgcc

SEQ ID NO: 46505 - DNA, 20 bp, Artificial Sequence
  chemically synthesized
cctggctccatcatatcata

SEQ ID NO: 46506 - DNA, 20 bp, Artificial Sequence
  chemically synthesized
ctggctccatcatatcataa

SEQ ID NO: 46507 - DNA, 20 bp, Artificial Sequence
  chemically synthesized
taaaggtcccacttcaaatg

SEQ ID NO: 46508 - DNA, 20 bp, Artificial Sequence
  chemically synthesized
aaatgcagtcactaccgttt

SEQ ID NO: 46509 - DNA, 20 bp, Artificial Sequence
  chemically synthesized
ttttgttttttgtttttttt

SEQ ID NO: 46510 - DNA, 20 bp, Artificial Sequence
  chemically synthesized
tttttgttttttttaagtca

SEQ ID NO: 46511 - DNA, 20 bp, Artificial Sequence
  chemically synthesized
taagtcaaagcaaatttctt

SEQ ID NO: 46512 - DNA, 20 bp, Artificial Sequence
  chemically synthesized
agtcaaagcaaatttcttga

SEQ ID NO: 46513 - DNA, 20 bp, Artificial Sequence
  chemically synthesized
tcaaagcaaatttcttgaga

SEQ ID NO: 46514 - DNA, 20 bp, Artificial Sequence
  chemically synthesized
gcaaatttcttgagagagta

SEQ ID NO: 46515 - DNA, 20 bp, Artificial Sequence
  chemically synthesized
ataaacgaatgactactgca

SEQ ID NO: 46516 - DNA, 20 bp, Artificial Sequence
  chemically synthesized
taaacgaatgactactgcat

SEQ ID NO: 46517 - DNA, 20 bp, Artificial Sequence
  chemically synthesized
acgaatgactactgcatagg

SEQ ID NO: 46518 - DNA, 20 bp, Artificial Sequence
  chemically synthesized
gaatgactactgcataggca

SEQ ID NO: 46519 - DNA, 20 bp, Artificial Sequence
  chemically synthesized
tgactactgcataggcagag

SEQ ID NO: 46520 - DNA, 20 bp, Artificial Sequence
  chemically synthesized
tgcataggcagagcagcccc

SEQ ID NO: 46521 - DNA, 20 bp, Artificial Sequence
  chemically synthesized
gcataggcagagcagccccg

SEQ ID NO: 46522 - DNA, 20 bp, Artificial Sequence
  chemically synthesized
cataggcagagcagccccga

SEQ ID NO: 46523 - DNA, 20 bp, Artificial Sequence
  chemically synthesized
agagcagccccgagggccgc

SEQ ID NO: 46524 - DNA, 20 bp, Artificial Sequence
  chemically synthesized
gccgctggttgttcctttta

SEQ ID NO: 46525 - DNA, 20 bp, Artificial Sequence
  chemically synthesized
ttcttgatgatatgttaaac

SEQ ID NO: 46526 - DNA, 20 bp, Artificial Sequence
  chemically synthesized
atgatatgttaaacaagttt

SEQ ID NO: 46527 - DNA, 20 bp, Artificial Sequence
  chemically synthesized
ttatttatgccttctctttt

SEQ ID NO: 46528 - DNA, 20 bp, Artificial Sequence
  chemically synthesized
tatttatgccttctcttttt

SEQ ID NO: 46529 - DNA, 20 bp, Artificial Sequence
  chemically synthesized
ccttctctttttaggccata

SEQ ID NO: 46530 - DNA, 20 bp, Artificial Sequence
  chemically synthesized
cttctctttttaggccatat

SEQ ID NO: 46531 - DNA, 20 bp, Artificial Sequence
  chemically synthesized
ttctctttttaggccatata

SEQ ID NO: 46532 - DNA, 20 bp, Artificial Sequence
  chemically synthesized
gtaactttctgacattgcca

SEQ ID NO: 46533 - DNA, 20 bp, Artificial Sequence
  chemically synthesized
atttactgttaccttaaatt

SEQ ID NO: 46534 - DNA, 20 bp, Artificial Sequence
  chemically synthesized
tttactgttaccttaaattc

SEQ ID NO: 46535 - DNA, 20 bp, Artificial Sequence
  chemically synthesized
ttactgttaccttaaattca

SEQ ID NO: 46536 - DNA, 20 bp, Artificial Sequence
  chemically synthesized
tactgttaccttaaattcag

SEQ ID NO: 46537 - DNA, 20 bp, Artificial Sequence
  chemically synthesized
taaattcaggggtacacgta

SEQ ID NO: 46538 - DNA, 20 bp, Artificial Sequence
  chemically synthesized
aaattcaggggtacacgtac

SEQ ID NO: 46539 - DNA, 20 bp, Artificial Sequence
  chemically synthesized
gggtacacgtacaggatatg

SEQ ID NO: 46540 - DNA, 20 bp, Artificial Sequence
  chemically synthesized
ggtacacgtacaggatatgc

SEQ ID NO: 46541 - DNA, 20 bp, Artificial Sequence
  chemically synthesized
ggatatgcaggtttgtttta

SEQ ID NO: 46542 - DNA, 20 bp, Artificial Sequence
  chemically synthesized
gatatgcaggtttgttttat

SEQ ID NO: 46543 - DNA, 20 bp, Artificial Sequence
  chemically synthesized
caggtttgttttataggtaa

SEQ ID NO: 46544 - DNA, 20 bp, Artificial Sequence
  chemically synthesized
ttataggtaaaagtgtgcca

SEQ ID NO: 46545 - DNA, 20 bp, Artificial Sequence
  chemically synthesized
aaagtgtgccatggttttaa

SEQ ID NO: 46546 - DNA, 20 bp, Artificial Sequence
  chemically synthesized
aagtgtgccatggttttaat

SEQ ID NO: 46547 - DNA, 20 bp, Artificial Sequence
  chemically synthesized
tgggttttttttttcttgta

SEQ ID NO: 46548 - DNA, 20 bp, Artificial Sequence
  chemically synthesized
tttttcttgtaaagttgttt

SEQ ID NO: 46549 - DNA, 20 bp, Artificial Sequence
  chemically synthesized
tttaagtttcttgtttactc

SEQ ID NO: 46550 - DNA, 20 bp, Artificial Sequence
  chemically synthesized
ttcttgtttactctggatat

SEQ ID NO: 46551 - DNA, 20 bp, Artificial Sequence
  chemically synthesized
tcttgtttactctggatatt

SEQ ID NO: 46552 - DNA, 20 bp, Artificial Sequence
  chemically synthesized
tctggatattaggcctttgt

SEQ ID NO: 46553 - DNA, 20 bp, Artificial Sequence
  chemically synthesized
ggatattaggcctttgtcag

SEQ ID NO: 46554 - DNA, 20 bp, Artificial Sequence
  chemically synthesized
ttaggcctttgtcagaagaa

SEQ ID NO: 46555 - DNA, 20 bp, Artificial Sequence
  chemically synthesized
cctttgtcagaagaatagat

SEQ ID NO: 46556 - DNA, 20 bp, Artificial Sequence
  chemically synthesized
aaaatctttttcccattctg

SEQ ID NO: 46557 - DNA, 20 bp, Artificial Sequence
  chemically synthesized
tagattgtctttcgctctga

SEQ ID NO: 46558 - DNA, 20 bp, Artificial Sequence
  chemically synthesized
attgtctttcgctctgatgg

SEQ ID NO: 46559 - DNA, 20 bp, Artificial Sequence
  chemically synthesized
tgatggtagtttcttttgct

SEQ ID NO: 46560 - DNA, 20 bp, Artificial Sequence
  chemically synthesized
tggtagtttcttttgctgag

SEQ ID NO: 46561 - DNA, 20 bp, Artificial Sequence
  chemically synthesized
ggtagtttcttttgctgagc

SEQ ID NO: 46562 - DNA, 20 bp, Artificial Sequence
  chemically synthesized
tagtttcttttgctgagcag

SEQ ID NO: 46563 - DNA, 20 bp, Artificial Sequence
  chemically synthesized
tttgctgagcaggagctctt

SEQ ID NO: 46564 - DNA, 20 bp, Artificial Sequence
  chemically synthesized
caggagctctttagtttaat

SEQ ID NO: 46565 - DNA, 20 bp, Artificial Sequence
  chemically synthesized
ttagtttaattagattccat

SEQ ID NO: 46566 - DNA, 20 bp, Artificial Sequence
  chemically synthesized
gcccgtgtttatatcatgaa

SEQ ID NO: 46567 - DNA, 20 bp, Artificial Sequence
  chemically synthesized
gtattgccttgatttttttc

SEQ ID NO: 46568 - DNA, 20 bp, Artificial Sequence
  chemically synthesized
tattgccttgatttttttct

SEQ ID NO: 46569 - DNA, 20 bp, Artificial Sequence
  chemically synthesized
atttttttctaggcttttta

SEQ ID NO: 46570 - DNA, 20 bp, Artificial Sequence
  chemically synthesized
tttctaggctttttatagtt

SEQ ID NO: 46571 - DNA, 20 bp, Artificial Sequence
  chemically synthesized
ttctaggctttttatagttt

SEQ ID NO: 46572 - DNA, 20 bp, Artificial Sequence
  chemically synthesized
tctaggctttttatagtttg

SEQ ID NO: 46573 - DNA, 20 bp, Artificial Sequence
  chemically synthesized
tagtttggggtttttcattt

SEQ ID NO: 46574 - DNA, 20 bp, Artificial Sequence
  chemically synthesized
atttaagtctctaatccatc

SEQ ID NO: 46575 - DNA, 20 bp, Artificial Sequence
  chemically synthesized
ttaagtctctaatccatctg

SEQ ID NO: 46576 - DNA, 20 bp, Artificial Sequence
  chemically synthesized
aatccatctggagttaattt

SEQ ID NO: 46577 - DNA, 20 bp, Artificial Sequence
  chemically synthesized
atctggagttaattttggat

SEQ ID NO: 46578 - DNA, 20 bp, Artificial Sequence
  chemically synthesized
tctggagttaattttggata

SEQ ID NO: 46579 - DNA, 20 bp, Artificial Sequence
  chemically synthesized
gttaattttggataaggtat

SEQ ID NO: 46580 - DNA, 20 bp, Artificial Sequence
  chemically synthesized
ttaattttggataaggtata

SEQ ID NO: 46581 - DNA, 20 bp, Artificial Sequence
  chemically synthesized
attttggataaggtataagg

SEQ ID NO: 46582 - DNA, 20 bp, Artificial Sequence
  chemically synthesized
ttttggataaggtataagga

SEQ ID NO: 46583 - DNA, 20 bp, Artificial Sequence
  chemically synthesized
ttggataaggtataaggaag

SEQ ID NO: 46584 - DNA, 20 bp, Artificial Sequence
  chemically synthesized
taaggtataaggaaggagtc

SEQ ID NO: 46585 - DNA, 20 bp, Artificial Sequence
  chemically synthesized
aggagtccagtttcattttt

SEQ ID NO: 46586 - DNA, 20 bp, Artificial Sequence
  chemically synthesized
cagtttcatttttcagcata

SEQ ID NO: 46587 - DNA, 20 bp, Artificial Sequence
  chemically synthesized
ttcatttttcagcatatggc

SEQ ID NO: 46588 - DNA, 20 bp, Artificial Sequence
  chemically synthesized
tttttcagcatatggctagc

SEQ ID NO: 46589 - DNA, 20 bp, Artificial Sequence
  chemically synthesized
tccccattgcttgcttttgt

SEQ ID NO: 46590 - DNA, 20 bp, Artificial Sequence
  chemically synthesized
ccccattgcttgcttttgtc

SEQ ID NO: 46591 - DNA, 20 bp, Artificial Sequence
  chemically synthesized
tgcttttgtcaggtttctaa

SEQ ID NO: 46592 - DNA, 20 bp, Artificial Sequence
  chemically synthesized
ttgtcaggtttctaaaagac

SEQ ID NO: 46593 - DNA, 20 bp, Artificial Sequence
  chemically synthesized
caggtttctaaaagaccaga

SEQ ID NO: 46594 - DNA, 20 bp, Artificial Sequence
  chemically synthesized
tctaaaagaccagatggttg

SEQ ID NO: 46595 - DNA, 20 bp, Artificial Sequence
  chemically synthesized
ctaaaagaccagatggttgt

SEQ ID NO: 46596 - DNA, 20 bp, Artificial Sequence
  chemically synthesized
atggttgtaggtacaatatg

SEQ ID NO: 46597 - DNA, 20 bp, Artificial Sequence
  chemically synthesized
gtacaatatgcagtttcttc

SEQ ID NO: 46598 - DNA, 20 bp, Artificial Sequence
  chemically synthesized
tcttattaattcatttcttt

SEQ ID NO: 46599 - DNA, 20 bp, Artificial Sequence
  chemically synthesized
atttcttttagtatgtatgc

SEQ ID NO: 46600 - DNA, 20 bp, Artificial Sequence
  chemically synthesized
ctggtctcctctgctcacta

SEQ ID NO: 46601 - DNA, 20 bp, Artificial Sequence
  chemically synthesized
tctcctctgctcactatagt

SEQ ID NO: 46602 - DNA, 20 bp, Artificial Sequence
  chemically synthesized
ctcctctgctcactatagtg

SEQ ID NO: 46603 - DNA, 20 bp, Artificial Sequence
  chemically synthesized
tcctctgctcactatagtga

SEQ ID NO: 46604 - DNA, 20 bp, Artificial Sequence
  chemically synthesized
cactatagtgagggcaccat

SEQ ID NO: 46605 - DNA, 20 bp, Artificial Sequence
  chemically synthesized
atagtgagggcaccattagc

SEQ ID NO: 46606 - DNA, 20 bp, Artificial Sequence
  chemically synthesized
agtgagggcaccattagcca

SEQ ID NO: 46607 - DNA, 20 bp, Artificial Sequence
  chemically synthesized
agccagagaatctgtctgtc

SEQ ID NO: 46608 - DNA, 20 bp, Artificial Sequence
  chemically synthesized
tctgtctgtctagttcatgt

SEQ ID NO: 46609 - DNA, 20 bp, Artificial Sequence
  chemically synthesized
tctagttcatgtaagattct

SEQ ID NO: 46610 - DNA, 20 bp, Artificial Sequence
  chemically synthesized
catgtaagattctcagaatt

SEQ ID NO: 46611 - DNA, 20 bp, Artificial Sequence
  chemically synthesized
attctcagaattaagaaaaa

SEQ ID NO: 46612 - DNA, 20 bp, Artificial Sequence
  chemically synthesized
tcagaattaagaaaaatgga

SEQ ID NO: 46613 - DNA, 20 bp, Artificial Sequence
  chemically synthesized
ggcatatgaatgaaacttca

SEQ ID NO: 46614 - DNA, 20 bp, Artificial Sequence
  chemically synthesized
gaaacttcatggatgacata

SEQ ID NO: 46615 - DNA, 20 bp, Artificial Sequence
  chemically synthesized
tatttgttgaattaatgcat

SEQ ID NO: 46616 - DNA, 20 bp, Artificial Sequence
  chemically synthesized
aattaatgcataagatgcaa

SEQ ID NO: 46617 - DNA, 20 bp, Artificial Sequence
  chemically synthesized
ttaatgcataagatgcaaca

SEQ ID NO: 46618 - DNA, 20 bp, Artificial Sequence
  chemically synthesized
aatgcataagatgcaacaga

SEQ ID NO: 46619 - DNA, 20 bp, Artificial Sequence
  chemically synthesized
gcataagatgcaacagagag

SEQ ID NO: 46620 - DNA, 20 bp, Artificial Sequence
  chemically synthesized
tgacaactgcaatgataacc

SEQ ID NO: 46621 - DNA, 20 bp, Artificial Sequence
  chemically synthesized
taacctggtattgatgatat

SEQ ID NO: 46622 - DNA, 20 bp, Artificial Sequence
  chemically synthesized
acctggtattgatgatataa

SEQ ID NO: 46623 - DNA, 20 bp, Artificial Sequence
  chemically synthesized
attgatgatataagagtcta

SEQ ID NO: 46624 - DNA, 20 bp, Artificial Sequence
  chemically synthesized
atataagagtctatagatca

SEQ ID NO: 46625 - DNA, 20 bp, Artificial Sequence
  chemically synthesized
taagagtctatagatcacag

SEQ ID NO: 46626 - DNA, 20 bp, Artificial Sequence
  chemically synthesized
gagtctatagatcacagtag

SEQ ID NO: 46627 - DNA, 20 bp, Artificial Sequence
  chemically synthesized
cacagtagaagcaataatca

SEQ ID NO: 46628 - DNA, 20 bp, Artificial Sequence
  chemically synthesized
caataatcatggaaaacaat

SEQ ID NO: 46629 - DNA, 20 bp, Artificial Sequence
  chemically synthesized
tcatggaaaacaattggaaa

SEQ ID NO: 46630 - DNA, 20 bp, Artificial Sequence
  chemically synthesized
catggaaaacaattggaaat

SEQ ID NO: 46631 - DNA, 20 bp, Artificial Sequence
  chemically synthesized
atggaaaacaattggaaatg

SEQ ID NO: 46632 - DNA, 20 bp, Artificial Sequence
  chemically synthesized
aaacaattggaaatggggaa

SEQ ID NO: 46633 - DNA, 20 bp, Artificial Sequence
  chemically synthesized
aatggggaacagccacaaac

SEQ ID NO: 46634 - DNA, 20 bp, Artificial Sequence
  chemically synthesized
gggaacagccacaaacaaga

SEQ ID NO: 46635 - DNA, 20 bp, Artificial Sequence
  chemically synthesized
caagaaagaatcaatacttc

SEQ ID NO: 46636 - DNA, 20 bp, Artificial Sequence
  chemically synthesized
aagaaagaatcaatacttcc

SEQ ID NO: 46637 - DNA, 20 bp, Artificial Sequence
  chemically synthesized
aagaatcaatacttccagga

SEQ ID NO: 46638 - DNA, 20 bp, Artificial Sequence
  chemically synthesized
tacttccaggaaagtgactg

SEQ ID NO: 46639 - DNA, 20 bp, Artificial Sequence
  chemically synthesized
acttccaggaaagtgactgc

SEQ ID NO: 46640 - DNA, 20 bp, Artificial Sequence
  chemically synthesized
tgactgcaggtcacttttcc

SEQ ID NO: 46641 - DNA, 20 bp, Artificial Sequence
  chemically synthesized
actgcaggtcacttttcctg

SEQ ID NO: 46642 - DNA, 20 bp, Artificial Sequence
  chemically synthesized
gcaggtcacttttcctggag

SEQ ID NO: 46643 - DNA, 20 bp, Artificial Sequence
  chemically synthesized
caggtcacttttcctggagc

SEQ ID NO: 46644 - DNA, 20 bp, Artificial Sequence
  chemically synthesized
tcacttttcctggagcgggt

SEQ ID NO: 46645 - DNA, 20 bp, Artificial Sequence
  chemically synthesized
acttttcctggagcgggtga

SEQ ID NO: 46646 - DNA, 20 bp, Artificial Sequence
  chemically synthesized
tcctggagcgggtgagagaa

SEQ ID NO: 46647 - DNA, 20 bp, Artificial Sequence
  chemically synthesized
tggagcgggtgagagaaaag

SEQ ID NO: 46648 - DNA, 20 bp, Artificial Sequence
  chemically synthesized
agcgggtgagagaaaagtgg

SEQ ID NO: 46649 - DNA, 20 bp, Artificial Sequence
  chemically synthesized
ggtgagagaaaagtggaagt

SEQ ID NO: 46650 - DNA, 20 bp, Artificial Sequence
  chemically synthesized
gagagaaaagtggaagttag

SEQ ID NO: 46651 - DNA, 20 bp, Artificial Sequence
  chemically synthesized
agcagtaactgctgaattcc

SEQ ID NO: 46652 - DNA, 20 bp, Artificial Sequence
  chemically synthesized
gtaactgctgaattcctggt

SEQ ID NO: 46653 - DNA, 20 bp, Artificial Sequence
  chemically synthesized
ctgaattcctggttggctga

SEQ ID NO: 46654 - DNA, 20 bp, Artificial Sequence
  chemically synthesized
attcctggttggctgatgga

SEQ ID NO: 46655 - DNA, 20 bp, Artificial Sequence
  chemically synthesized
ctggttggctgatggaaaga

SEQ ID NO: 46656 - DNA, 20 bp, Artificial Sequence
  chemically synthesized
tggttggctgatggaaagat

SEQ ID NO: 46657 - DNA, 20 bp, Artificial Sequence
  chemically synthesized
ggttggctgatggaaagatg

SEQ ID NO: 46658 - DNA, 20 bp, Artificial Sequence
  chemically synthesized
tggctgatggaaagatgggg

SEQ ID NO: 46659 - DNA, 20 bp, Artificial Sequence
  chemically synthesized
aagatggggcagctgttcac

SEQ ID NO: 46660 - DNA, 20 bp, Artificial Sequence
  chemically synthesized
ggcagctgttcactggtacg

SEQ ID NO: 46661 - DNA, 20 bp, Artificial Sequence
  chemically synthesized
gcagctgttcactggtacgc

SEQ ID NO: 46662 - DNA, 20 bp, Artificial Sequence
  chemically synthesized
cagctgttcactggtacgca

SEQ ID NO: 46663 - DNA, 20 bp, Artificial Sequence
  chemically synthesized
ttcactggtacgcagggttt

SEQ ID NO: 46664 - DNA, 20 bp, Artificial Sequence
  chemically synthesized
ggttttagatgtatgtacct

SEQ ID NO: 46665 - DNA, 20 bp, Artificial Sequence
  chemically synthesized
gttttagatgtatgtaccta

SEQ ID NO: 46666 - DNA, 20 bp, Artificial Sequence
  chemically synthesized
atgtatgtacctaaggatat

SEQ ID NO: 46667 - DNA, 20 bp, Artificial Sequence
  chemically synthesized
tgtatgtacctaaggatatg

SEQ ID NO: 46668 - DNA, 20 bp, Artificial Sequence
  chemically synthesized
gtacctaaggatatgaggta

SEQ ID NO: 46669 - DNA, 20 bp, Artificial Sequence
  chemically synthesized
atatgaggtatggcaatgaa

SEQ ID NO: 46670 - DNA, 20 bp, Artificial Sequence
  chemically synthesized
gcaatgaacagaaattcttt

SEQ ID NO: 46671 - DNA, 20 bp, Artificial Sequence
  chemically synthesized
caatgaacagaaattctttt

SEQ ID NO: 46672 - DNA, 20 bp, Artificial Sequence
  chemically synthesized
acagaaattcttttgggaat

SEQ ID NO: 46673 - DNA, 20 bp, Artificial Sequence
  chemically synthesized
attcttttgggaatgagttt

SEQ ID NO: 46674 - DNA, 20 bp, Artificial Sequence
  chemically synthesized
ttcttttgggaatgagtttt

SEQ ID NO: 46675 - DNA, 20 bp, Artificial Sequence
  chemically synthesized
tcttttgggaatgagtttta

SEQ ID NO: 46676 - DNA, 20 bp, Artificial Sequence
  chemically synthesized
aatgagttttagggccatta

SEQ ID NO: 46677 - DNA, 20 bp, Artificial Sequence
  chemically synthesized
atgagttttagggccattaa

SEQ ID NO: 46678 - DNA, 20 bp, Artificial Sequence
  chemically synthesized
ccattaaaggacatgacctg

SEQ ID NO: 46679 - DNA, 20 bp, Artificial Sequence
  chemically synthesized
catgacctgaagtttcctct

SEQ ID NO: 46680 - DNA, 20 bp, Artificial Sequence
  chemically synthesized
atgacctgaagtttcctctg

SEQ ID NO: 46681 - DNA, 20 bp, Artificial Sequence
  chemically synthesized
cctgaagtttcctctgaggc

SEQ ID NO: 46682 - DNA, 20 bp, Artificial Sequence
  chemically synthesized
ataaatgtgtttcctgcata

SEQ ID NO: 46683 - DNA, 20 bp, Artificial Sequence
  chemically synthesized
gtgtttcctgcatatagtca

SEQ ID NO: 46684 - DNA, 20 bp, Artificial Sequence
  chemically synthesized
atcatcgatctctgctctta

SEQ ID NO: 46685 - DNA, 20 bp, Artificial Sequence
  chemically synthesized
tctgctcttaaagataatct

SEQ ID NO: 46686 - DNA, 20 bp, Artificial Sequence
  chemically synthesized
caaactttccccatgttcct

SEQ ID NO: 46687 - DNA, 20 bp, Artificial Sequence
  chemically synthesized
ccccatgttcctaagtaaaa

SEQ ID NO: 46688 - DNA, 20 bp, Artificial Sequence
  chemically synthesized
cccatgttcctaagtaaaac

SEQ ID NO: 46689 - DNA, 20 bp, Artificial Sequence
  chemically synthesized
aactgcctctcaactatatc

SEQ ID NO: 46690 - DNA, 20 bp, Artificial Sequence
  chemically synthesized
tgcctctcaactatatcaag

SEQ ID NO: 46691 - DNA, 20 bp, Artificial Sequence
  chemically synthesized
aaatattgtgtctctaatat

SEQ ID NO: 46692 - DNA, 20 bp, Artificial Sequence
  chemically synthesized
tgtctctaatatcagaaatt

SEQ ID NO: 46693 - DNA, 20 bp, Artificial Sequence
  chemically synthesized
gaaattcagctttaatatat

SEQ ID NO: 46694 - DNA, 20 bp, Artificial Sequence
  chemically synthesized
aaattcagctttaatatatt

SEQ ID NO: 46695 - DNA, 20 bp, Artificial Sequence
  chemically synthesized
gggtttaactctttgaaatt

SEQ ID NO: 46696 - DNA, 20 bp, Artificial Sequence
  chemically synthesized
gtttaactctttgaaattta

SEQ ID NO: 46697 - DNA, 20 bp, Artificial Sequence
  chemically synthesized
gagtctccttgaaatacaca

SEQ ID NO: 46698 - DNA, 20 bp, Artificial Sequence
  chemically synthesized
agtctccttgaaatacacat

SEQ ID NO: 46699 - DNA, 20 bp, Artificial Sequence
  chemically synthesized
gtctccttgaaatacacatg

SEQ ID NO: 46700 - DNA, 20 bp, Artificial Sequence
  chemically synthesized
tctccttgaaatacacatgg

SEQ ID NO: 46701 - DNA, 20 bp, Artificial Sequence
  chemically synthesized
tcctaaactttatttcttgt

SEQ ID NO: 46702 - DNA, 20 bp, Artificial Sequence
  chemically synthesized
cctaaactttatttcttgta

SEQ ID NO: 46703 - DNA, 20 bp, Artificial Sequence
  chemically synthesized
tttcttgtaaggatttatct

SEQ ID NO: 46704 - DNA, 20 bp, Artificial Sequence
  chemically synthesized
ttcttgtaaggatttatctc

SEQ ID NO: 46705 - DNA, 20 bp, Artificial Sequence
  chemically synthesized
tcttgtaaggatttatctca

SEQ ID NO: 46706 - DNA, 20 bp, Artificial Sequence
  chemically synthesized
cttgtaaggatttatctcag

SEQ ID NO: 46707 - DNA, 20 bp, Artificial Sequence
  chemically synthesized
ctcaggggtaacacacaaac

SEQ ID NO: 46708 - DNA, 20 bp, Artificial Sequence
  chemically synthesized
aaccagcatcctgaacctct

SEQ ID NO: 46709 - DNA, 20 bp, Artificial Sequence
  chemically synthesized
catcctgaacctctaagtat

SEQ ID NO: 46710 - DNA, 20 bp, Artificial Sequence
  chemically synthesized
atcctgaacctctaagtatg

SEQ ID NO: 46711 - DNA, 20 bp, Artificial Sequence
  chemically synthesized
tgaacctctaagtatgagga

SEQ ID NO: 46712 - DNA, 20 bp, Artificial Sequence
  chemically synthesized
cctctaagtatgaggacagt

SEQ ID NO: 46713 - DNA, 20 bp, Artificial Sequence
  chemically synthesized
gtatgaggacagtaagcctt

SEQ ID NO: 46714 - DNA, 20 bp, Artificial Sequence
  chemically synthesized
taaactgttcttctctctgc

SEQ ID NO: 46715 - DNA, 20 bp, Artificial Sequence
  chemically synthesized
actgttcttctctctgccgg

SEQ ID NO: 46716 - DNA, 20 bp, Artificial Sequence
  chemically synthesized
gttcttctctctgccggtgg

SEQ ID NO: 46717 - DNA, 20 bp, Artificial Sequence
  chemically synthesized
attcctgaaattgcttgttt

SEQ ID NO: 46718 - DNA, 20 bp, Artificial Sequence
  chemically synthesized
attgcttgtttgagacgcat

SEQ ID NO: 46719 - DNA, 20 bp, Artificial Sequence
  chemically synthesized
tttgagacgcatgagacgtg

SEQ ID NO: 46720 - DNA, 20 bp, Artificial Sequence
  chemically synthesized
gcatgagacgtgcagcacat

SEQ ID NO: 46721 - DNA, 20 bp, Artificial Sequence
  chemically synthesized
tgcagcacatgagacacgtg

SEQ ID NO: 46722 - DNA, 20 bp, Artificial Sequence
  chemically synthesized
agcacatgagacacgtgcag

SEQ ID NO: 46723 - DNA, 20 bp, Artificial Sequence
  chemically synthesized
gagacacgtgcagcagcctg

SEQ ID NO: 46724 - DNA, 20 bp, Artificial Sequence
  chemically synthesized
agcagcctgtggaatattgt

SEQ ID NO: 46725 - DNA, 20 bp, Artificial Sequence
  chemically synthesized
cctgtggaatattgtcagtg

SEQ ID NO: 46726 - DNA, 20 bp, Artificial Sequence
  chemically synthesized
gaagaatgtctttgcctgat

SEQ ID NO: 46727 - DNA, 20 bp, Artificial Sequence
  chemically synthesized
tctttgcctgattagatata

SEQ ID NO: 46728 - DNA, 20 bp, Artificial Sequence
  chemically synthesized
gcctgattagatataaagac

SEQ ID NO: 46729 - DNA, 20 bp, Artificial Sequence
  chemically synthesized
atataaagacaagttaaaca

SEQ ID NO: 46730 - DNA, 20 bp, Artificial Sequence
  chemically synthesized
agacaagttaaacacagcat

SEQ ID NO: 46731 - DNA, 20 bp, Artificial Sequence
  chemically synthesized
ttaaacacagcattagacta

SEQ ID NO: 46732 - DNA, 20 bp, Artificial Sequence
  chemically synthesized
acagcattagactatagatc

SEQ ID NO: 46733 - DNA, 20 bp, Artificial Sequence
  chemically synthesized
actatagatcaagcctgtgc

SEQ ID NO: 46734 - DNA, 20 bp, Artificial Sequence
  chemically synthesized
gacacaaatgacctaatgcc

SEQ ID NO: 46735 - DNA, 20 bp, Artificial Sequence
  chemically synthesized
aaatgacctaatgcccagca

SEQ ID NO: 46736 - DNA, 20 bp, Artificial Sequence
  chemically synthesized
aatgacctaatgcccagcac

SEQ ID NO: 46737 - DNA, 20 bp, Artificial Sequence
  chemically synthesized
ctaatgcccagcacgggcca

SEQ ID NO: 46738 - DNA, 20 bp, Artificial Sequence
  chemically synthesized
ctcctatcctcttgcttgaa

SEQ ID NO: 46739 - DNA, 20 bp, Artificial Sequence
  chemically synthesized
cctatcctcttgcttgaaca

SEQ ID NO: 46740 - DNA, 20 bp, Artificial Sequence
  chemically synthesized
atcctcttgcttgaacagag

SEQ ID NO: 46741 - DNA, 20 bp, Artificial Sequence
  chemically synthesized
cacttctcccccaacactat

SEQ ID NO: 46742 - DNA, 20 bp, Artificial Sequence
  chemically synthesized
cccaacactattagatgttc

SEQ ID NO: 46743 - DNA, 20 bp, Artificial Sequence
  chemically synthesized
gatgttctggcataattttg

SEQ ID NO: 46744 - DNA, 20 bp, Artificial Sequence
  chemically synthesized
ggcataattttgtagatatg

SEQ ID NO: 46745 - DNA, 20 bp, Artificial Sequence
  chemically synthesized
gcataattttgtagatatgt

SEQ ID NO: 46746 - DNA, 20 bp, Artificial Sequence
  chemically synthesized
tagatatgtaggatttgaca

SEQ ID NO: 46747 - DNA, 20 bp, Artificial Sequence
  chemically synthesized
tggactattgttcaatgatt

SEQ ID NO: 46748 - DNA, 20 bp, Artificial Sequence
  chemically synthesized
gactattgttcaatgattca

SEQ ID NO: 46749 - DNA, 20 bp, Artificial Sequence
  chemically synthesized
actattgttcaatgattcag

SEQ ID NO: 46750 - DNA, 20 bp, Artificial Sequence
  chemically synthesized
cagaggaaatctcctttgtt

SEQ ID NO: 46751 - DNA, 20 bp, Artificial Sequence
  chemically synthesized
gaaatctcctttgttcagat

SEQ ID NO: 46752 - DNA, 20 bp, Artificial Sequence
  chemically synthesized
taagtacactgactactaaa

SEQ ID NO: 46753 - DNA, 20 bp, Artificial Sequence
  chemically synthesized
actaaatggattaaaaaaca

SEQ ID NO: 46754 - DNA, 20 bp, Artificial Sequence
  chemically synthesized
aaaaacacagtaataaaacc

SEQ ID NO: 46755 - DNA, 20 bp, Artificial Sequence
  chemically synthesized
cagttttccccttacttccc

SEQ ID NO: 46756 - DNA, 20 bp, Artificial Sequence
  chemically synthesized
ttcttattctgctttcttcc

SEQ ID NO: 46757 - DNA, 20 bp, Artificial Sequence
  chemically synthesized
gctttcttccaagttgatgc

SEQ ID NO: 46758 - DNA, 20 bp, Artificial Sequence
  chemically synthesized
tcttccaagttgatgctgga

SEQ ID NO: 46759 - DNA, 20 bp, Artificial Sequence
  chemically synthesized
ttccaagttgatgctggata

SEQ ID NO: 46760 - DNA, 20 bp, Artificial Sequence
  chemically synthesized
tccaagttgatgctggatag

SEQ ID NO: 46761 - DNA, 20 bp, Artificial Sequence
  chemically synthesized
gtgtttatttctattctaaa

SEQ ID NO: 46762 - DNA, 20 bp, Artificial Sequence
  chemically synthesized
attctaaaaagtgatgaaat

SEQ ID NO: 46763 - DNA, 20 bp, Artificial Sequence
  chemically synthesized
taaaaagtgatgaaattggc

SEQ ID NO: 46764 - DNA, 20 bp, Artificial Sequence
  chemically synthesized
aaaaagtgatgaaattggcc

SEQ ID NO: 46765 - DNA, 20 bp, Artificial Sequence
  chemically synthesized
gtgatgaaattggccgggcg

SEQ ID NO: 46766 - DNA, 20 bp, Artificial Sequence
  chemically synthesized
atgaaattggccgggcgcgg

SEQ ID NO: 46767 - DNA, 20 bp, Artificial Sequence
  chemically synthesized
gtggctcacacctgtaatcc

SEQ ID NO: 46768 - DNA, 20 bp, Artificial Sequence
  chemically synthesized
cacctgtaatcccagcactt

SEQ ID NO: 46769 - DNA, 20 bp, Artificial Sequence
  chemically synthesized
acctgtaatcccagcacttt

SEQ ID NO: 46770 - DNA, 20 bp, Artificial Sequence
  chemically synthesized
ctgtaatcccagcactttgg

SEQ ID NO: 46771 - DNA, 20 bp, Artificial Sequence
  chemically synthesized
tgtaatcccagcactttggg

SEQ ID NO: 46772 - DNA, 20 bp, Artificial Sequence
  chemically synthesized
tcccagcactttgggaggct

SEQ ID NO: 46773 - DNA, 20 bp, Artificial Sequence
  chemically synthesized
cccagcactttgggaggctg

SEQ ID NO: 46774 - DNA, 20 bp, Artificial Sequence
  chemically synthesized
agcactttgggaggctgagg

SEQ ID NO: 46775 - DNA, 20 bp, Artificial Sequence
  chemically synthesized
gcactttgggaggctgaggt

SEQ ID NO: 46776 - DNA, 20 bp, Artificial Sequence
  chemically synthesized
ctttgggaggctgaggtggg

SEQ ID NO: 46777 - DNA, 20 bp, Artificial Sequence
  chemically synthesized
ggctgaggtgggcggatcac

SEQ ID NO: 46778 - DNA, 20 bp, Artificial Sequence
  chemically synthesized
gctgaggtgggcggatcacg

SEQ ID NO: 46779 - DNA, 20 bp, Artificial Sequence
  chemically synthesized
aggtgggcggatcacgaggt

SEQ ID NO: 46780 - DNA, 20 bp, Artificial Sequence
  chemically synthesized
ggtgggcggatcacgaggtc

SEQ ID NO: 46781 - DNA, 20 bp, Artificial Sequence
  chemically synthesized
tgggcggatcacgaggtcag

SEQ ID NO: 46782 - DNA, 20 bp, Artificial Sequence
  chemically synthesized
gatcacgaggtcaggagatc

SEQ ID NO: 46783 - DNA, 20 bp, Artificial Sequence
  chemically synthesized
tcaggagatcaagaccatcc

SEQ ID NO: 46784 - DNA, 20 bp, Artificial Sequence
  chemically synthesized
caagaccatcctggctaaca

SEQ ID NO: 46785 - DNA, 20 bp, Artificial Sequence
  chemically synthesized
ctactaaaaatacaaaaaat

SEQ ID NO: 46786 - DNA, 20 bp, Artificial Sequence
  chemically synthesized
taaaaatacaaaaaattagc

SEQ ID NO: 46787 - DNA, 20 bp, Artificial Sequence
  chemically synthesized
aaaatacaaaaaattagcca

SEQ ID NO: 46788 - DNA, 20 bp, Artificial Sequence
  chemically synthesized
tacaaaaaattagccagaga

SEQ ID NO: 46789 - DNA, 20 bp, Artificial Sequence
  chemically synthesized
aaaaaattagccagagacag

SEQ ID NO: 46790 - DNA, 20 bp, Artificial Sequence
  chemically synthesized
aaattagccagagacagtgg

SEQ ID NO: 46791 - DNA, 20 bp, Artificial Sequence
  chemically synthesized
aattagccagagacagtggc

SEQ ID NO: 46792 - DNA, 20 bp, Artificial Sequence
  chemically synthesized
gagacagtggcgggtgcctg

SEQ ID NO: 46793 - DNA, 20 bp, Artificial Sequence
  chemically synthesized
gtggcgggtgcctgtagtcc

SEQ ID NO: 46794 - DNA, 20 bp, Artificial Sequence
  chemically synthesized
tgcctgtagtcccagctact

SEQ ID NO: 46795 - DNA, 20 bp, Artificial Sequence
  chemically synthesized
gcctgtagtcccagctactc

SEQ ID NO: 46796 - DNA, 20 bp, Artificial Sequence
  chemically synthesized
ctgtagtcccagctactcgg

SEQ ID NO: 46797 - DNA, 20 bp, Artificial Sequence
  chemically synthesized
tgtagtcccagctactcggg

SEQ ID NO: 46798 - DNA, 20 bp, Artificial Sequence
  chemically synthesized
tcccagctactcgggaggct

SEQ ID NO: 46799 - DNA, 20 bp, Artificial Sequence
  chemically synthesized
cccagctactcgggaggctg

SEQ ID NO: 46800 - DNA, 20 bp, Artificial Sequence
  chemically synthesized
agctactcgggaggctgagg

SEQ ID NO: 46801 - DNA, 20 bp, Artificial Sequence
  chemically synthesized
gctactcgggaggctgaggc

SEQ ID NO: 46802 - DNA, 20 bp, Artificial Sequence
  chemically synthesized
tactcgggaggctgaggcag

SEQ ID NO: 46803 - DNA, 20 bp, Artificial Sequence
  chemically synthesized
gggaggctgaggcaggagaa

SEQ ID NO: 46804 - DNA, 20 bp, Artificial Sequence
  chemically synthesized
gcaggagaatggcgtgaacc

SEQ ID NO: 46805 - DNA, 20 bp, Artificial Sequence
  chemically synthesized
caggagaatggcgtgaacct

SEQ ID NO: 46806 - DNA, 20 bp, Artificial Sequence
  chemically synthesized
ggagaatggcgtgaacctgg

SEQ ID NO: 46807 - DNA, 20 bp, Artificial Sequence
  chemically synthesized
gagaatggcgtgaacctggg

SEQ ID NO: 46808 - DNA, 20 bp, Artificial Sequence
  chemically synthesized
aatggcgtgaacctgggagg

SEQ ID NO: 46809 - DNA, 20 bp, Artificial Sequence
  chemically synthesized
tggcgtgaacctgggaggca

SEQ ID NO: 46810 - DNA, 20 bp, Artificial Sequence
  chemically synthesized
aacctgggaggcagagcttg

SEQ ID NO: 46811 - DNA, 20 bp, Artificial Sequence
  chemically synthesized
tgggaggcagagcttgcggt

SEQ ID NO: 46812 - DNA, 20 bp, Artificial Sequence
  chemically synthesized
gaggcagagcttgcggtgag

SEQ ID NO: 46813 - DNA, 20 bp, Artificial Sequence
  chemically synthesized
ggcagagcttgcggtgagca

SEQ ID NO: 46814 - DNA, 20 bp, Artificial Sequence
  chemically synthesized
gatcgcgccactgcacactc

SEQ ID NO: 46815 - DNA, 20 bp, Artificial Sequence
  chemically synthesized
cgccactgcacactccagcc

SEQ ID NO: 46816 - DNA, 20 bp, Artificial Sequence
  chemically synthesized
gccactgcacactccagcct

SEQ ID NO: 46817 - DNA, 20 bp, Artificial Sequence
  chemically synthesized
acactccagcctgggtgaca

SEQ ID NO: 46818 - DNA, 20 bp, Artificial Sequence
  chemically synthesized
tccagcctgggtgacaaagc

SEQ ID NO: 46819 - DNA, 20 bp, Artificial Sequence
  chemically synthesized
tcaaaaaaaaaaaaaaaaaa

SEQ ID NO: 46820 - DNA, 20 bp, Artificial Sequence
  chemically synthesized
aaaaaaaaaaaaaaaagaaa

SEQ ID NO: 46821 - DNA, 20 bp, Artificial Sequence
  chemically synthesized
aaaaaaaaaaaagaaaaaga

SEQ ID NO: 46822 - DNA, 20 bp, Artificial Sequence
  chemically synthesized
aaaaaaaagaaaaagaaaga

SEQ ID NO: 46823 - DNA, 20 bp, Artificial Sequence
  chemically synthesized
aaaagaaaaagaaagaaaga

SEQ ID NO: 46824 - DNA, 20 bp, Artificial Sequence
  chemically synthesized
atgaaattgtgtattcaatg

SEQ ID NO: 46825 - DNA, 20 bp, Artificial Sequence
  chemically synthesized
tgtgtattcaatgtagtctc

SEQ ID NO: 46826 - DNA, 20 bp, Artificial Sequence
  chemically synthesized
tgtattcaatgtagtctcaa

SEQ ID NO: 46827 - DNA, 20 bp, Artificial Sequence
  chemically synthesized
tctcaagagaattgaaaacc

SEQ ID NO: 46828 - DNA, 20 bp, Artificial Sequence
  chemically synthesized
aagagaattgaaaaccaaga

SEQ ID NO: 46829 - DNA, 20 bp, Artificial Sequence
  chemically synthesized
agagaattgaaaaccaagaa

SEQ ID NO: 46830 - DNA, 20 bp, Artificial Sequence
  chemically synthesized
ttgaaaaccaagaaaggctg

SEQ ID NO: 46831 - DNA, 20 bp, Artificial Sequence
  chemically synthesized
gctgtggcttcttccacata

SEQ ID NO: 46832 - DNA, 20 bp, Artificial Sequence
  chemically synthesized
ggcttcttccacataaagcc

SEQ ID NO: 46833 - DNA, 20 bp, Artificial Sequence
  chemically synthesized
cataaagcctggatgaataa

SEQ ID NO: 46834 - DNA, 20 bp, Artificial Sequence
  chemically synthesized
ataaagcctggatgaataac

SEQ ID NO: 46835 - DNA, 20 bp, Artificial Sequence
  chemically synthesized
cattgtcacaactcctgatc

SEQ ID NO: 46836 - DNA, 20 bp, Artificial Sequence
  chemically synthesized
attgtcacaactcctgatcc

SEQ ID NO: 46837 - DNA, 20 bp, Artificial Sequence
  chemically synthesized
actcctgatccaggaattga

SEQ ID NO: 46838 - DNA, 20 bp, Artificial Sequence
  chemically synthesized
tgatccaggaattgatggct

SEQ ID NO: 46839 - DNA, 20 bp, Artificial Sequence
  chemically synthesized
ttcgtaattcttatcctttt

SEQ ID NO: 46840 - DNA, 20 bp, Artificial Sequence
  chemically synthesized
tgtaacttattcctatttgt

SEQ ID NO: 46841 - DNA, 20 bp, Artificial Sequence
  chemically synthesized
tattcctatttgtcagcatt

SEQ ID NO: 46842 - DNA, 20 bp, Artificial Sequence
  chemically synthesized
attcctatttgtcagcattc

SEQ ID NO: 46843 - DNA, 20 bp, Artificial Sequence
  chemically synthesized
tttgtcagcattcaggttat

SEQ ID NO: 46844 - DNA, 20 bp, Artificial Sequence
  chemically synthesized
gtcagcattcaggttattag

SEQ ID NO: 46845 - DNA, 20 bp, Artificial Sequence
  chemically synthesized
ttcaggttattagcggctgc

SEQ ID NO: 46846 - DNA, 20 bp, Artificial Sequence
  chemically synthesized
gttattagcggctgctggcg

SEQ ID NO: 46847 - DNA, 20 bp, Artificial Sequence
  chemically synthesized
cggctgctggcgaagtcctt

SEQ ID NO: 46848 - DNA, 20 bp, Artificial Sequence
  chemically synthesized
ttgagaaataaactgcacac

SEQ ID NO: 46849 - DNA, 20 bp, Artificial Sequence
  chemically synthesized
gaaataaactgcacactgga

SEQ ID NO: 46850 - DNA, 20 bp, Artificial Sequence
  chemically synthesized
ataaactgcacactggatgg

SEQ ID NO: 46851 - DNA, 20 bp, Artificial Sequence
  chemically synthesized
taaactgcacactggatggt

SEQ ID NO: 46852 - DNA, 20 bp, Artificial Sequence
  chemically synthesized
aaactgcacactggatggtg

SEQ ID NO: 46853 - DNA, 20 bp, Artificial Sequence
  chemically synthesized
aactgcacactggatggtgg

SEQ ID NO: 46854 - DNA, 20 bp, Artificial Sequence
  chemically synthesized
tgcacactggatggtggggg

SEQ ID NO: 46855 - DNA, 20 bp, Artificial Sequence
  chemically synthesized
actggatggtgggggtagtg

SEQ ID NO: 46856 - DNA, 20 bp, Artificial Sequence
  chemically synthesized
ctggatggtgggggtagtgt

SEQ ID NO: 46857 - DNA, 20 bp, Artificial Sequence
  chemically synthesized
gtgggggtagtgtaggaaaa

SEQ ID NO: 46858 - DNA, 20 bp, Artificial Sequence
  chemically synthesized
gggggtagtgtaggaaaatg

SEQ ID NO: 46859 - DNA, 20 bp, Artificial Sequence
  chemically synthesized
ggggtagtgtaggaaaatgg

SEQ ID NO: 46860 - DNA, 20 bp, Artificial Sequence
  chemically synthesized
gggtagtgtaggaaaatgga

SEQ ID NO: 46861 - DNA, 20 bp, Artificial Sequence
  chemically synthesized
ggtagtgtaggaaaatggag

SEQ ID NO: 46862 - DNA, 20 bp, Artificial Sequence
  chemically synthesized
agtgtaggaaaatggagggg

SEQ ID NO: 46863 - DNA, 20 bp, Artificial Sequence
  chemically synthesized
gtgtaggaaaatggagggga

SEQ ID NO: 46864 - DNA, 20 bp, Artificial Sequence
  chemically synthesized
taggaaaatggaggggaagg

SEQ ID NO: 46865 - DNA, 20 bp, Artificial Sequence
  chemically synthesized
aaatggaggggaaggaagta

SEQ ID NO: 46866 - DNA, 20 bp, Artificial Sequence
  chemically synthesized
aggaagtaaagtttcaaatt

SEQ ID NO: 46867 - DNA, 20 bp, Artificial Sequence
  chemically synthesized
agtttcaaattaagcctgaa

SEQ ID NO: 46868 - DNA, 20 bp, Artificial Sequence
  chemically synthesized
caaattaagcctgaacagca

SEQ ID NO: 46869 - DNA, 20 bp, Artificial Sequence
  chemically synthesized
ctgaacagcaaagttcccct

SEQ ID NO: 46870 - DNA, 20 bp, Artificial Sequence
  chemically synthesized
aacagcaaagttcccctgag

SEQ ID NO: 46871 - DNA, 20 bp, Artificial Sequence
  chemically synthesized
acagcaaagttcccctgaga

SEQ ID NO: 46872 - DNA, 20 bp, Artificial Sequence
  chemically synthesized
gttcccctgagaaggccacc

SEQ ID NO: 46873 - DNA, 20 bp, Artificial Sequence
  chemically synthesized
gaaggccacctggattctat

SEQ ID NO: 46874 - DNA, 20 bp, Artificial Sequence
  chemically synthesized
ccttgcccaaaccccacccc

SEQ ID NO: 46875 - DNA, 20 bp, Artificial Sequence
  chemically synthesized
ttgcccaaaccccacccctg

SEQ ID NO: 46876 - DNA, 20 bp, Artificial Sequence
  chemically synthesized
cacaacccacccttgaccaa

SEQ ID NO: 46877 - DNA, 20 bp, Artificial Sequence
  chemically synthesized
accaatagattcattttact

SEQ ID NO: 46878 - DNA, 20 bp, Artificial Sequence
  chemically synthesized
ccaatagattcattttactg

SEQ ID NO: 46879 - DNA, 20 bp, Artificial Sequence
  chemically synthesized
caatagattcattttactga

SEQ ID NO: 46880 - DNA, 20 bp, Artificial Sequence
  chemically synthesized
atagattcattttactgagg

SEQ ID NO: 46881 - DNA, 20 bp, Artificial Sequence
  chemically synthesized
tagattcattttactgaggg

SEQ ID NO: 46882 - DNA, 20 bp, Artificial Sequence
  chemically synthesized
tcattttactgagggaggca

SEQ ID NO: 46883 - DNA, 20 bp, Artificial Sequence
  chemically synthesized
cattttactgagggaggcaa

SEQ ID NO: 46884 - DNA, 20 bp, Artificial Sequence
  chemically synthesized
attttactgagggaggcaaa

SEQ ID NO: 46885 - DNA, 20 bp, Artificial Sequence
  chemically synthesized
tactgagggaggcaaagggc

SEQ ID NO: 46886 - DNA, 20 bp, Artificial Sequence
  chemically synthesized
ggaggcaaagggctggtcaa

SEQ ID NO: 46887 - DNA, 20 bp, Artificial Sequence
  chemically synthesized
ggtcaatagattcatttcac

SEQ ID NO: 46888 - DNA, 20 bp, Artificial Sequence
  chemically synthesized
gtcaatagattcatttcact

SEQ ID NO: 46889 - DNA, 20 bp, Artificial Sequence
  chemically synthesized
caatagattcatttcactgg

SEQ ID NO: 46890 - DNA, 20 bp, Artificial Sequence
  chemically synthesized
atagattcatttcactggga

SEQ ID NO: 46891 - DNA, 20 bp, Artificial Sequence
  chemically synthesized
tagattcatttcactgggag

SEQ ID NO: 46892 - DNA, 20 bp, Artificial Sequence
  chemically synthesized
tcatttcactgggagaggca

SEQ ID NO: 46893 - DNA, 20 bp, Artificial Sequence
  chemically synthesized
catttcactgggagaggcaa

SEQ ID NO: 46894 - DNA, 20 bp, Artificial Sequence
  chemically synthesized
atttcactgggagaggcaaa

SEQ ID NO: 46895 - DNA, 20 bp, Artificial Sequence
  chemically synthesized
cactgggagaggcaaagggc

SEQ ID NO: 46896 - DNA, 20 bp, Artificial Sequence
  chemically synthesized
actgggagaggcaaagggct

SEQ ID NO: 46897 - DNA, 20 bp, Artificial Sequence
  chemically synthesized
ctgggagaggcaaagggctg

SEQ ID NO: 46898 - DNA, 20 bp, Artificial Sequence
  chemically synthesized
tgggagaggcaaagggctgg

SEQ ID NO: 46899 - DNA, 20 bp, Artificial Sequence
  chemically synthesized
agaggcaaagggctgggggc

SEQ ID NO: 46900 - DNA, 20 bp, Artificial Sequence
  chemically synthesized
aggcaaagggctgggggcca

SEQ ID NO: 46901 - DNA, 20 bp, Artificial Sequence
  chemically synthesized
gcaaagggctgggggccaga

SEQ ID NO: 46902 - DNA, 20 bp, Artificial Sequence
  chemically synthesized
caaagggctgggggccagag

SEQ ID NO: 46903 - DNA, 20 bp, Artificial Sequence
  chemically synthesized
aagggctgggggccagagag

SEQ ID NO: 46904 - DNA, 20 bp, Artificial Sequence
  chemically synthesized
ggctgggggccagagaggag

SEQ ID NO: 46905 - DNA, 20 bp, Artificial Sequence
  chemically synthesized
ggccagagaggagaagtaaa

SEQ ID NO: 46906 - DNA, 20 bp, Artificial Sequence
  chemically synthesized
gaagtaaaaagccacacatg

SEQ ID NO: 46907 - DNA, 20 bp, Artificial Sequence
  chemically synthesized
gtaaaaagccacacatgaag

SEQ ID NO: 46908 - DNA, 20 bp, Artificial Sequence
  chemically synthesized
ccacacatgaagcagcaatg

SEQ ID NO: 46909 - DNA, 20 bp, Artificial Sequence
  chemically synthesized
cacacatgaagcagcaatgc

SEQ ID NO: 46910 - DNA, 20 bp, Artificial Sequence
  chemically synthesized
cagcaatgcaggcatgcttc

SEQ ID NO: 46911 - DNA, 20 bp, Artificial Sequence
  chemically synthesized
tctggctcatctgtgatcac

SEQ ID NO: 46912 - DNA, 20 bp, Artificial Sequence
  chemically synthesized
ctggctcatctgtgatcacc

SEQ ID NO: 46913 - DNA, 20 bp, Artificial Sequence
  chemically synthesized
tgtgatcaccaggaaactcc

SEQ ID NO: 46914 - DNA, 20 bp, Artificial Sequence
  chemically synthesized
aactcccagatctgacactg

SEQ ID NO: 46915 - DNA, 20 bp, Artificial Sequence
  chemically synthesized
tagtgcatttcactgctgac

SEQ ID NO: 46916 - DNA, 20 bp, Artificial Sequence
  chemically synthesized
tgcatttcactgctgacaag

SEQ ID NO: 46917 - DNA, 20 bp, Artificial Sequence
  chemically synthesized
gcatttcactgctgacaaga

SEQ ID NO: 46918 - DNA, 20 bp, Artificial Sequence
  chemically synthesized
gacaagaaggctgctgccac

SEQ ID NO: 46919 - DNA, 20 bp, Artificial Sequence
  chemically synthesized
gctgctgccaccagcctgtg

SEQ ID NO: 46920 - DNA, 20 bp, Artificial Sequence
  chemically synthesized
ctgccaccagcctgtgaagc

SEQ ID NO: 46921 - DNA, 20 bp, Artificial Sequence
  chemically synthesized
tgccaccagcctgtgaagca

SEQ ID NO: 46922 - DNA, 20 bp, Artificial Sequence
  chemically synthesized
ccagcctgtgaagcaaggtt

SEQ ID NO: 46923 - DNA, 20 bp, Artificial Sequence
  chemically synthesized
cagcctgtgaagcaaggtta

SEQ ID NO: 46924 - DNA, 20 bp, Artificial Sequence
  chemically synthesized
ctgtgaagcaaggttaaggt

SEQ ID NO: 46925 - DNA, 20 bp, Artificial Sequence
  chemically synthesized
tgaagcaaggttaaggtgag

SEQ ID NO: 46926 - DNA, 20 bp, Artificial Sequence
  chemically synthesized
gaagcaaggttaaggtgaga

SEQ ID NO: 46927 - DNA, 20 bp, Artificial Sequence
  chemically synthesized
caaggttaaggtgagaaggc

SEQ ID NO: 46928 - DNA, 20 bp, Artificial Sequence
  chemically synthesized
aggttaaggtgagaaggctg

SEQ ID NO: 46929 - DNA, 20 bp, Artificial Sequence
  chemically synthesized
ggttaaggtgagaaggctgg

SEQ ID NO: 46930 - DNA, 20 bp, Artificial Sequence
  chemically synthesized
aaggtgagaaggctggaggt

SEQ ID NO: 46931 - DNA, 20 bp, Artificial Sequence
  chemically synthesized
gaaggctggaggtgagattc

SEQ ID NO: 46932 - DNA, 20 bp, Artificial Sequence
  chemically synthesized
aaggctggaggtgagattct

SEQ ID NO: 46933 - DNA, 20 bp, Artificial Sequence
  chemically synthesized
gctggaggtgagattctggg

SEQ ID NO: 46934 - DNA, 20 bp, Artificial Sequence
  chemically synthesized
ctggaggtgagattctgggc

SEQ ID NO: 46935 - DNA, 20 bp, Artificial Sequence
  chemically synthesized
gaggtgagattctgggcagg

SEQ ID NO: 46936 - DNA, 20 bp, Artificial Sequence
  chemically synthesized
aggtgagattctgggcaggt

SEQ ID NO: 46937 - DNA, 20 bp, Artificial Sequence
  chemically synthesized
gattctgggcaggtaggtac

SEQ ID NO: 46938 - DNA, 20 bp, Artificial Sequence
  chemically synthesized
tctgggcaggtaggtactgg

SEQ ID NO: 46939 - DNA, 20 bp, Artificial Sequence
  chemically synthesized
ggcaggtaggtactggaagc

SEQ ID NO: 46940 - DNA, 20 bp, Artificial Sequence
  chemically synthesized
gcaggtaggtactggaagcc

SEQ ID NO: 46941 - DNA, 20 bp, Artificial Sequence
  chemically synthesized
taggtactggaagccgggac

SEQ ID NO: 46942 - DNA, 20 bp, Artificial Sequence
  chemically synthesized
aggtactggaagccgggaca

SEQ ID NO: 46943 - DNA, 20 bp, Artificial Sequence
  chemically synthesized
ctggaagccgggacaaggtg

SEQ ID NO: 46944 - DNA, 20 bp, Artificial Sequence
  chemically synthesized
aagccgggacaaggtgcaga

SEQ ID NO: 46945 - DNA, 20 bp, Artificial Sequence
  chemically synthesized
agccgggacaaggtgcagaa

SEQ ID NO: 46946 - DNA, 20 bp, Artificial Sequence
  chemically synthesized
cgggacaaggtgcagaaagg

SEQ ID NO: 46947 - DNA, 20 bp, Artificial Sequence
  chemically synthesized
acaaggtgcagaaaggcaga

SEQ ID NO: 46948 - DNA, 20 bp, Artificial Sequence
  chemically synthesized
aaggcagaaagtgtttctga

SEQ ID NO: 46949 - DNA, 20 bp, Artificial Sequence
  chemically synthesized
ggcagaaagtgtttctgaaa

SEQ ID NO: 46950 - DNA, 20 bp, Artificial Sequence
  chemically synthesized
gcagaaagtgtttctgaaag

SEQ ID NO: 46951 - DNA, 20 bp, Artificial Sequence
  chemically synthesized
cagaaagtgtttctgaaaga

SEQ ID NO: 46952 - DNA, 20 bp, Artificial Sequence
  chemically synthesized
agtgtttctgaaagagggat

SEQ ID NO: 46953 - DNA, 20 bp, Artificial Sequence
  chemically synthesized
gattagcccgttgtcttaca

SEQ ID NO: 46954 - DNA, 20 bp, Artificial Sequence
  chemically synthesized
ctgtgattatgactatccca

SEQ ID NO: 46955 - DNA, 20 bp, Artificial Sequence
  chemically synthesized
atgactatcccacagtctcc

SEQ ID NO: 46956 - DNA, 20 bp, Artificial Sequence
  chemically synthesized
gtctcctggttgtctaccca

SEQ ID NO: 46957 - DNA, 20 bp, Artificial Sequence
  chemically synthesized
tggttgtctacccatggacc

SEQ ID NO: 46958 - DNA, 20 bp, Artificial Sequence
  chemically synthesized
gttgtctacccatggaccta

SEQ ID NO: 46959 - DNA, 20 bp, Artificial Sequence
  chemically synthesized
ttgtctacccatggacctag

SEQ ID NO: 46960 - DNA, 20 bp, Artificial Sequence
  chemically synthesized
tggacctagaggtactttga

SEQ ID NO: 46961 - DNA, 20 bp, Artificial Sequence
  chemically synthesized
tagaggtactttgaaagttt

SEQ ID NO: 46962 - DNA, 20 bp, Artificial Sequence
  chemically synthesized
ctttgaaagttttggatatc

SEQ ID NO: 46963 - DNA, 20 bp, Artificial Sequence
  chemically synthesized
tttgaaagttttggatatct

SEQ ID NO: 46964 - DNA, 20 bp, Artificial Sequence
  chemically synthesized
gggctctgactgtgcaataa

SEQ ID NO: 46965 - DNA, 20 bp, Artificial Sequence
  chemically synthesized
ggctctgactgtgcaataat

SEQ ID NO: 46966 - DNA, 20 bp, Artificial Sequence
  chemically synthesized
tgcaataatgggcaacccca

SEQ ID NO: 46967 - DNA, 20 bp, Artificial Sequence
  chemically synthesized
taatgggcaaccccaaagtc

SEQ ID NO: 46968 - DNA, 20 bp, Artificial Sequence
  chemically synthesized
aatgggcaaccccaaagtca

SEQ ID NO: 46969 - DNA, 20 bp, Artificial Sequence
  chemically synthesized
aaccccaaagtcaaggcaca

SEQ ID NO: 46970 - DNA, 20 bp, Artificial Sequence
  chemically synthesized
ccaaagtcaaggcacatggc

SEQ ID NO: 46971 - DNA, 20 bp, Artificial Sequence
  chemically synthesized
aagtcaaggcacatggcaag

SEQ ID NO: 46972 - DNA, 20 bp, Artificial Sequence
  chemically synthesized
agtcaaggcacatggcaaga

SEQ ID NO: 46973 - DNA, 20 bp, Artificial Sequence
  chemically synthesized
aagaaggtgctgatctcctt

SEQ ID NO: 46974 - DNA, 20 bp, Artificial Sequence
  chemically synthesized
ggtgctgatctccttcggaa

SEQ ID NO: 46975 - DNA, 20 bp, Artificial Sequence
  chemically synthesized
cggaaaagctgttatgctca

SEQ ID NO: 46976 - DNA, 20 bp, Artificial Sequence
  chemically synthesized
tatgctcacggatgacctca

SEQ ID NO: 46977 - DNA, 20 bp, Artificial Sequence
  chemically synthesized
atgctcacggatgacctcaa

SEQ ID NO: 46978 - DNA, 20 bp, Artificial Sequence
  chemically synthesized
aaaggcacctttgctacact

SEQ ID NO: 46979 - DNA, 20 bp, Artificial Sequence
  chemically synthesized
tgagtgacctgcactgtaac

SEQ ID NO: 46980 - DNA, 20 bp, Artificial Sequence
  chemically synthesized
gcactgtaacaagctgcacg

SEQ ID NO: 46981 - DNA, 20 bp, Artificial Sequence
  chemically synthesized
acaagctgcacgtggaccct

SEQ ID NO: 46982 - DNA, 20 bp, Artificial Sequence
  chemically synthesized
cgtggaccctgagaacttcc

SEQ ID NO: 46983 - DNA, 20 bp, Artificial Sequence
  chemically synthesized
gaccctgagaacttcctggt

SEQ ID NO: 46984 - DNA, 20 bp, Artificial Sequence
  chemically synthesized
cctgagaacttcctggtgag

SEQ ID NO: 46985 - DNA, 20 bp, Artificial Sequence
  chemically synthesized
agaacttcctggtgagtagt

SEQ ID NO: 46986 - DNA, 20 bp, Artificial Sequence
  chemically synthesized
cacgctttcttctttaccct

SEQ ID NO: 46987 - DNA, 20 bp, Artificial Sequence
  chemically synthesized
acccttagatatttgcacta

SEQ ID NO: 46988 - DNA, 20 bp, Artificial Sequence
  chemically synthesized
cccttagatatttgcactat

SEQ ID NO: 46989 - DNA, 20 bp, Artificial Sequence
  chemically synthesized
tgcactatgggtacttttga

SEQ ID NO: 46990 - DNA, 20 bp, Artificial Sequence
  chemically synthesized
actatgggtacttttgaaag

SEQ ID NO: 46991 - DNA, 20 bp, Artificial Sequence
  chemically synthesized
tatgggtacttttgaaagca

SEQ ID NO: 46992 - DNA, 20 bp, Artificial Sequence
  chemically synthesized
atgggtacttttgaaagcag

SEQ ID NO: 46993 - DNA, 20 bp, Artificial Sequence
  chemically synthesized
ggtacttttgaaagcagagg

SEQ ID NO: 46994 - DNA, 20 bp, Artificial Sequence
  chemically synthesized
gtggctttctcttgtgttat

SEQ ID NO: 46995 - DNA, 20 bp, Artificial Sequence
  chemically synthesized
ctttctcttgtgttatgagt

SEQ ID NO: 46996 - DNA, 20 bp, Artificial Sequence
  chemically synthesized
cttgtgttatgagtcagcta

SEQ ID NO: 46997 - DNA, 20 bp, Artificial Sequence
  chemically synthesized
ttgtgttatgagtcagctat

SEQ ID NO: 46998 - DNA, 20 bp, Artificial Sequence
  chemically synthesized
agctatgggatatgatattt

SEQ ID NO: 46999 - DNA, 20 bp, Artificial Sequence
  chemically synthesized
tatgggatatgatatttcag

SEQ ID NO: 47000 - DNA, 20 bp, Artificial Sequence
  chemically synthesized
gggatatgatatttcagcag

SEQ ID NO: 47001 - DNA, 20 bp, Artificial Sequence
  chemically synthesized
ggatatgatatttcagcagt

SEQ ID NO: 47002 - DNA, 20 bp, Artificial Sequence
  chemically synthesized
tatttcagcagtgggatttt

SEQ ID NO: 47003 - DNA, 20 bp, Artificial Sequence
  chemically synthesized
tttcagcagtgggattttga

SEQ ID NO: 47004 - DNA, 20 bp, Artificial Sequence
  chemically synthesized
taaataacataactaaaatt

SEQ ID NO: 47005 - DNA, 20 bp, Artificial Sequence
  chemically synthesized
ataacataactaaaatttgg

SEQ ID NO: 47006 - DNA, 20 bp, Artificial Sequence
  chemically synthesized
aacataactaaaatttggta

SEQ ID NO: 47007 - DNA, 20 bp, Artificial Sequence
  chemically synthesized
taactaaaatttggtagagc

SEQ ID NO: 47008 - DNA, 20 bp, Artificial Sequence
  chemically synthesized
aactaaaatttggtagagca

SEQ ID NO: 47009 - DNA, 20 bp, Artificial Sequence
  chemically synthesized
agagcaaggactatgaataa

SEQ ID NO: 47010 - DNA, 20 bp, Artificial Sequence
  chemically synthesized
gcaaggactatgaataatgg

SEQ ID NO: 47011 - DNA, 20 bp, Artificial Sequence
  chemically synthesized
caaggactatgaataatgga

SEQ ID NO: 47012 - DNA, 20 bp, Artificial Sequence
  chemically synthesized
gaaggccacttaccatttga

SEQ ID NO: 47013 - DNA, 20 bp, Artificial Sequence
  chemically synthesized
acacatcttataaaaaattc

SEQ ID NO: 47014 - DNA, 20 bp, Artificial Sequence
  chemically synthesized
attctggccaaaatcaaact

SEQ ID NO: 47015 - DNA, 20 bp, Artificial Sequence
  chemically synthesized
aaaatcaaactgagtgtttt

SEQ ID NO: 47016 - DNA, 20 bp, Artificial Sequence
  chemically synthesized
caaactgagtgtttttggat

SEQ ID NO: 47017 - DNA, 20 bp, Artificial Sequence
  chemically synthesized
aaactgagtgtttttggatg

SEQ ID NO: 47018 - DNA, 20 bp, Artificial Sequence
  chemically synthesized
aactgagtgtttttggatga

SEQ ID NO: 47019 - DNA, 20 bp, Artificial Sequence
  chemically synthesized
agtgtttttggatgagggaa

SEQ ID NO: 47020 - DNA, 20 bp, Artificial Sequence
  chemically synthesized
gtttttggatgagggaacag

SEQ ID NO: 47021 - DNA, 20 bp, Artificial Sequence
  chemically synthesized
tggatgagggaacagaagtt

SEQ ID NO: 47022 - DNA, 20 bp, Artificial Sequence
  chemically synthesized
tgagggaacagaagttgaga

SEQ ID NO: 47023 - DNA, 20 bp, Artificial Sequence
  chemically synthesized
agggaacagaagttgagata

SEQ ID NO: 47024 - DNA, 20 bp, Artificial Sequence
  chemically synthesized
agaaaataacatctttcctt

SEQ ID NO: 47025 - DNA, 20 bp, Artificial Sequence
  chemically synthesized
aataacatctttcctttggt

SEQ ID NO: 47026 - DNA, 20 bp, Artificial Sequence
  chemically synthesized
aaattttctataaaaattaa

SEQ ID NO: 47027 - DNA, 20 bp, Artificial Sequence
  chemically synthesized
ttaatagtcacttttctgca

SEQ ID NO: 47028 - DNA, 20 bp, Artificial Sequence
  chemically synthesized
gtcacttttctgcatagtcc

SEQ ID NO: 47029 - DNA, 20 bp, Artificial Sequence
  chemically synthesized
cacttttctgcatagtcctg

SEQ ID NO: 47030 - DNA, 20 bp, Artificial Sequence
  chemically synthesized
acttttctgcatagtcctgg

SEQ ID NO: 47031 - DNA, 20 bp, Artificial Sequence
  chemically synthesized
ttctgcatagtcctggaggt

SEQ ID NO: 47032 - DNA, 20 bp, Artificial Sequence
  chemically synthesized
atagtcctggaggttagaaa

SEQ ID NO: 47033 - DNA, 20 bp, Artificial Sequence
  chemically synthesized
agaaaaagatcaactgaaca

SEQ ID NO: 47034 - DNA, 20 bp, Artificial Sequence
  chemically synthesized
aaaagatcaactgaacaaag

SEQ ID NO: 47035 - DNA, 20 bp, Artificial Sequence
  chemically synthesized
agatcaactgaacaaagtag

SEQ ID NO: 47036 - DNA, 20 bp, Artificial Sequence
  chemically synthesized
gatcaactgaacaaagtagt

SEQ ID NO: 47037 - DNA, 20 bp, Artificial Sequence
  chemically synthesized
caactgaacaaagtagtggg

SEQ ID NO: 47038 - DNA, 20 bp, Artificial Sequence
  chemically synthesized
agtagtgggaagctgttaaa

SEQ ID NO: 47039 - DNA, 20 bp, Artificial Sequence
  chemically synthesized
tagtgggaagctgttaaaaa

SEQ ID NO: 47040 - DNA, 20 bp, Artificial Sequence
  chemically synthesized
agtgggaagctgttaaaaag

SEQ ID NO: 47041 - DNA, 20 bp, Artificial Sequence
  chemically synthesized
tgtttccctccgaatgatga

SEQ ID NO: 47042 - DNA, 20 bp, Artificial Sequence
  chemically synthesized
atggtatacttttgtacgca

SEQ ID NO: 47043 - DNA, 20 bp, Artificial Sequence
  chemically synthesized
atacttttgtacgcatggta

SEQ ID NO: 47044 - DNA, 20 bp, Artificial Sequence
  chemically synthesized
tacttttgtacgcatggtac

SEQ ID NO: 47045 - DNA, 20 bp, Artificial Sequence
  chemically synthesized
ggtacaggattctttgttat

SEQ ID NO: 47046 - DNA, 20 bp, Artificial Sequence
  chemically synthesized
gattctttgttatgagtgtt

SEQ ID NO: 47047 - DNA, 20 bp, Artificial Sequence
  chemically synthesized
attctttgttatgagtgttt

SEQ ID NO: 47048 - DNA, 20 bp, Artificial Sequence
  chemically synthesized
gtatgtatgtatgtgatgac

SEQ ID NO: 47049 - DNA, 20 bp, Artificial Sequence
  chemically synthesized
tatgtatgtatgtgatgact

SEQ ID NO: 47050 - DNA, 20 bp, Artificial Sequence
  chemically synthesized
atgtatgtatgtgatgactg

SEQ ID NO: 47051 - DNA, 20 bp, Artificial Sequence
  chemically synthesized
ctatccattactgttccttg

SEQ ID NO: 47052 - DNA, 20 bp, Artificial Sequence
  chemically synthesized
actattatcctactttttaa

SEQ ID NO: 47053 - DNA, 20 bp, Artificial Sequence
  chemically synthesized
ctattatcctactttttaaa

SEQ ID NO: 47054 - DNA, 20 bp, Artificial Sequence
  chemically synthesized
tcctactttttaaaaggacg

SEQ ID NO: 47055 - DNA, 20 bp, Artificial Sequence
  chemically synthesized
atgaaacaatcacaatatgt

SEQ ID NO: 47056 - DNA, 20 bp, Artificial Sequence
  chemically synthesized
tgaaacaatcacaatatgtt

SEQ ID NO: 47057 - DNA, 20 bp, Artificial Sequence
  chemically synthesized
gaaacaatcacaatatgttg

SEQ ID NO: 47058 - DNA, 20 bp, Artificial Sequence
  chemically synthesized
acaatcacaatatgttgggg

SEQ ID NO: 47059 - DNA, 20 bp, Artificial Sequence
  chemically synthesized
tcacaatatgttggggtagt

SEQ ID NO: 47060 - DNA, 20 bp, Artificial Sequence
  chemically synthesized
aatatgttggggtagtgagt

SEQ ID NO: 47061 - DNA, 20 bp, Artificial Sequence
  chemically synthesized
gttggggtagtgagttggca

SEQ ID NO: 47062 - DNA, 20 bp, Artificial Sequence
  chemically synthesized
gggtagtgagttggcatagc

SEQ ID NO: 47063 - DNA, 20 bp, Artificial Sequence
  chemically synthesized
agtgagttggcatagcaagt

SEQ ID NO: 47064 - DNA, 20 bp, Artificial Sequence
  chemically synthesized
tgagttggcatagcaagtaa

SEQ ID NO: 47065 - DNA, 20 bp, Artificial Sequence
  chemically synthesized
gttggcatagcaagtaagag

SEQ ID NO: 47066 - DNA, 20 bp, Artificial Sequence
  chemically synthesized
ttggcatagcaagtaagaga

SEQ ID NO: 47067 - DNA, 20 bp, Artificial Sequence
  chemically synthesized
catagcaagtaagagaagga

SEQ ID NO: 47068 - DNA, 20 bp, Artificial Sequence
  chemically synthesized
atagcaagtaagagaaggat

SEQ ID NO: 47069 - DNA, 20 bp, Artificial Sequence
  chemically synthesized
aagagaaggataggacacaa

SEQ ID NO: 47070 - DNA, 20 bp, Artificial Sequence
  chemically synthesized
agagaaggataggacacaat

SEQ ID NO: 47071 - DNA, 20 bp, Artificial Sequence
  chemically synthesized
agaaggataggacacaatgg

SEQ ID NO: 47072 - DNA, 20 bp, Artificial Sequence
  chemically synthesized
gaaggataggacacaatggg

SEQ ID NO: 47073 - DNA, 20 bp, Artificial Sequence
  chemically synthesized
ataggacacaatgggaggtg

SEQ ID NO: 47074 - DNA, 20 bp, Artificial Sequence
  chemically synthesized
taggacacaatgggaggtgc

SEQ ID NO: 47075 - DNA, 20 bp, Artificial Sequence
  chemically synthesized
aggacacaatgggaggtgca

SEQ ID NO: 47076 - DNA, 20 bp, Artificial Sequence
  chemically synthesized
aatgggaggtgcagggctgc

SEQ ID NO: 47077 - DNA, 20 bp, Artificial Sequence
  chemically synthesized
cagggctgccagtcatattg

SEQ ID NO: 47078 - DNA, 20 bp, Artificial Sequence
  chemically synthesized
gtcatattgaagctgatatc

SEQ ID NO: 47079 - DNA, 20 bp, Artificial Sequence
  chemically synthesized
agctgatatctagcccataa

SEQ ID NO: 47080 - DNA, 20 bp, Artificial Sequence
  chemically synthesized
gatatctagcccataatggt

SEQ ID NO: 47081 - DNA, 20 bp, Artificial Sequence
  chemically synthesized
tatctagcccataatggtga

SEQ ID NO: 47082 - DNA, 20 bp, Artificial Sequence
  chemically synthesized
ggtgagagttgctcaaactc

SEQ ID NO: 47083 - DNA, 20 bp, Artificial Sequence
  chemically synthesized
ttgctcaaactctggtgaaa

SEQ ID NO: 47084 - DNA, 20 bp, Artificial Sequence
  chemically synthesized
tgctcaaactctggtgaaaa

SEQ ID NO: 47085 - DNA, 20 bp, Artificial Sequence
  chemically synthesized
actctggtgaaaaaggatgt

SEQ ID NO: 47086 - DNA, 20 bp, Artificial Sequence
  chemically synthesized
gtgttatatctatttactgc

SEQ ID NO: 47087 - DNA, 20 bp, Artificial Sequence
  chemically synthesized
atatctatttactgcaagtc

SEQ ID NO: 47088 - DNA, 20 bp, Artificial Sequence
  chemically synthesized
atttactgcaagtccagctt

SEQ ID NO: 47089 - DNA, 20 bp, Artificial Sequence
  chemically synthesized
tttactgcaagtccagcttg

SEQ ID NO: 47090 - DNA, 20 bp, Artificial Sequence
  chemically synthesized
ttttatcttcactccctccc

SEQ ID NO: 47091 - DNA, 20 bp, Artificial Sequence
  chemically synthesized
ttcactccctccccagctct

SEQ ID NO: 47092 - DNA, 20 bp, Artificial Sequence
  chemically synthesized
tcactccctccccagctctt

SEQ ID NO: 47093 - DNA, 20 bp, Artificial Sequence
  chemically synthesized
caacgtgatattgattgttt

SEQ ID NO: 47094 - DNA, 20 bp, Artificial Sequence
  chemically synthesized
attgttttggcaacccactt

SEQ ID NO: 47095 - DNA, 20 bp, Artificial Sequence
  chemically synthesized
ttttggcaacccacttcagc

SEQ ID NO: 47096 - DNA, 20 bp, Artificial Sequence
  chemically synthesized
tttggcaacccacttcagcg

SEQ ID NO: 47097 - DNA, 20 bp, Artificial Sequence
  chemically synthesized
tcagcgaggattttacccta

SEQ ID NO: 47098 - DNA, 20 bp, Artificial Sequence
  chemically synthesized
aggattttaccctacagata

SEQ ID NO: 47099 - DNA, 20 bp, Artificial Sequence
  chemically synthesized
ggattttaccctacagatac

SEQ ID NO: 47100 - DNA, 20 bp, Artificial Sequence
  chemically synthesized
ccctacagatacaggcttct

SEQ ID NO: 47101 - DNA, 20 bp, Artificial Sequence
  chemically synthesized
tacagatacaggcttcttgg

SEQ ID NO: 47102 - DNA, 20 bp, Artificial Sequence
  chemically synthesized
gcagtaactaacaaatgctg

SEQ ID NO: 47103 - DNA, 20 bp, Artificial Sequence
  chemically synthesized
aaatgctgtggttaatgctg

SEQ ID NO: 47104 - DNA, 20 bp, Artificial Sequence
  chemically synthesized
tggttaatgctgtagcccac

SEQ ID NO: 47105 - DNA, 20 bp, Artificial Sequence
  chemically synthesized
ctgtagcccacaagaccact

SEQ ID NO: 47106 - DNA, 20 bp, Artificial Sequence
  chemically synthesized
gtccactatgtttgtaccta

SEQ ID NO: 47107 - DNA, 20 bp, Artificial Sequence
  chemically synthesized
tcccaaaatctcatctcctt

SEQ ID NO: 47108 - DNA, 20 bp, Artificial Sequence
  chemically synthesized
aaaatctcatctcctttaga

SEQ ID NO: 47109 - DNA, 20 bp, Artificial Sequence
  chemically synthesized
aaatctcatctcctttagat

SEQ ID NO: 47110 - DNA, 20 bp, Artificial Sequence
  chemically synthesized
aatctcatctcctttagatg

SEQ ID NO: 47111 - DNA, 20 bp, Artificial Sequence
  chemically synthesized
atctcatctcctttagatgg

SEQ ID NO: 47112 - DNA, 20 bp, Artificial Sequence
  chemically synthesized
ctcatctcctttagatgggg

SEQ ID NO: 47113 - DNA, 20 bp, Artificial Sequence
  chemically synthesized
tcatctcctttagatggggg

SEQ ID NO: 47114 - DNA, 20 bp, Artificial Sequence
  chemically synthesized
ctcctttagatgggggaggt

SEQ ID NO: 47115 - DNA, 20 bp, Artificial Sequence
  chemically synthesized
tcctttagatgggggaggtt

SEQ ID NO: 47116 - DNA, 20 bp, Artificial Sequence
  chemically synthesized
cctttagatgggggaggttg

SEQ ID NO: 47117 - DNA, 20 bp, Artificial Sequence
  chemically synthesized
tttagatgggggaggttggg

SEQ ID NO: 47118 - DNA, 20 bp, Artificial Sequence
  chemically synthesized
agatgggggaggttggggag

SEQ ID NO: 47119 - DNA, 20 bp, Artificial Sequence
  chemically synthesized
atgggggaggttggggagaa

SEQ ID NO: 47120 - DNA, 20 bp, Artificial Sequence
  chemically synthesized
ggggaggttggggagaagag

SEQ ID NO: 47121 - DNA, 20 bp, Artificial Sequence
  chemically synthesized
cagtatcctgcctgctgatt

SEQ ID NO: 47122 - DNA, 20 bp, Artificial Sequence
  chemically synthesized
cagttcctgcatgataaaaa

SEQ ID NO: 47123 - DNA, 20 bp, Artificial Sequence
  chemically synthesized
tgcatgataaaaatagaata

SEQ ID NO: 47124 - DNA, 20 bp, Artificial Sequence
  chemically synthesized
aataaagaaatatgctctct

SEQ ID NO: 47125 - DNA, 20 bp, Artificial Sequence
  chemically synthesized
ctttatattttaccctgatt

SEQ ID NO: 47126 - DNA, 20 bp, Artificial Sequence
  chemically synthesized
ttttaccctgattcagccaa

SEQ ID NO: 47127 - DNA, 20 bp, Artificial Sequence
  chemically synthesized
tttaccctgattcagccaaa

SEQ ID NO: 47128 - DNA, 20 bp, Artificial Sequence
  chemically synthesized
aaaggacgcactatttctga

SEQ ID NO: 47129 - DNA, 20 bp, Artificial Sequence
  chemically synthesized
gcactatttctgatggaaat

SEQ ID NO: 47130 - DNA, 20 bp, Artificial Sequence
  chemically synthesized
tctgatggaaatgagaatgt

SEQ ID NO: 47131 - DNA, 20 bp, Artificial Sequence
  chemically synthesized
tgatggaaatgagaatgttg

SEQ ID NO: 47132 - DNA, 20 bp, Artificial Sequence
  chemically synthesized
gaaatgagaatgttggagaa

SEQ ID NO: 47133 - DNA, 20 bp, Artificial Sequence
  chemically synthesized
aaatgagaatgttggagaat

SEQ ID NO: 47134 - DNA, 20 bp, Artificial Sequence
  chemically synthesized
atgagaatgttggagaatgg

SEQ ID NO: 47135 - DNA, 20 bp, Artificial Sequence
  chemically synthesized
atgttggagaatgggagttt

SEQ ID NO: 47136 - DNA, 20 bp, Artificial Sequence
  chemically synthesized
tgttggagaatgggagttta

SEQ ID NO: 47137 - DNA, 20 bp, Artificial Sequence
  chemically synthesized
ggagaatgggagtttaagga

SEQ ID NO: 47138 - DNA, 20 bp, Artificial Sequence
  chemically synthesized
agaatgggagtttaaggaca

SEQ ID NO: 47139 - DNA, 20 bp, Artificial Sequence
  chemically synthesized
atgggagtttaaggacagag

SEQ ID NO: 47140 - DNA, 20 bp, Artificial Sequence
  chemically synthesized
atactttcttgcaatcctgc

SEQ ID NO: 47141 - DNA, 20 bp, Artificial Sequence
  chemically synthesized
ttcttgcaatcctgcaagaa

SEQ ID NO: 47142 - DNA, 20 bp, Artificial Sequence
  chemically synthesized
cttgcaatcctgcaagaaaa

SEQ ID NO: 47143 - DNA, 20 bp, Artificial Sequence
  chemically synthesized
tgcaatcctgcaagaaaaga

SEQ ID NO: 47144 - DNA, 20 bp, Artificial Sequence
  chemically synthesized
gcaagaaaagagagaactcg

SEQ ID NO: 47145 - DNA, 20 bp, Artificial Sequence
  chemically synthesized
caagaaaagagagaactcgt

SEQ ID NO: 47146 - DNA, 20 bp, Artificial Sequence
  chemically synthesized
gaaaagagagaactcgtggg

SEQ ID NO: 47147 - DNA, 20 bp, Artificial Sequence
  chemically synthesized
agagaactcgtgggtggatt

SEQ ID NO: 47148 - DNA, 20 bp, Artificial Sequence
  chemically synthesized
gaactcgtgggtggatttag

SEQ ID NO: 47149 - DNA, 20 bp, Artificial Sequence
  chemically synthesized
aactcgtgggtggatttagt

SEQ ID NO: 47150 - DNA, 20 bp, Artificial Sequence
  chemically synthesized
actcgtgggtggatttagtg

SEQ ID NO: 47151 - DNA, 20 bp, Artificial Sequence
  chemically synthesized
cgtgggtggatttagtgggg

SEQ ID NO: 47152 - DNA, 20 bp, Artificial Sequence
  chemically synthesized
tttagtggggtagttactcc

SEQ ID NO: 47153 - DNA, 20 bp, Artificial Sequence
  chemically synthesized
ttagtggggtagttactcct

SEQ ID NO: 47154 - DNA, 20 bp, Artificial Sequence
  chemically synthesized
gtggggtagttactcctagg

SEQ ID NO: 47155 - DNA, 20 bp, Artificial Sequence
  chemically synthesized
tggggtagttactcctagga

SEQ ID NO: 47156 - DNA, 20 bp, Artificial Sequence
  chemically synthesized
ggggtagttactcctaggaa

SEQ ID NO: 47157 - DNA, 20 bp, Artificial Sequence
  chemically synthesized
gggtagttactcctaggaag

SEQ ID NO: 47158 - DNA, 20 bp, Artificial Sequence
  chemically synthesized
taggaaggggaaatcgtctc

SEQ ID NO: 47159 - DNA, 20 bp, Artificial Sequence
  chemically synthesized
ggggaaatcgtctctagaat

SEQ ID NO: 47160 - DNA, 20 bp, Artificial Sequence
  chemically synthesized
agaataagacaatgttttta

SEQ ID NO: 47161 - DNA, 20 bp, Artificial Sequence
  chemically synthesized
taagacaatgtttttacaga

SEQ ID NO: 47162 - DNA, 20 bp, Artificial Sequence
  chemically synthesized
aagacaatgtttttacagaa

SEQ ID NO: 47163 - DNA, 20 bp, Artificial Sequence
  chemically synthesized
agacaatgtttttacagaaa

SEQ ID NO: 47164 - DNA, 20 bp, Artificial Sequence
  chemically synthesized
acaatgtttttacagaaagg

SEQ ID NO: 47165 - DNA, 20 bp, Artificial Sequence
  chemically synthesized
caatgtttttacagaaaggg

SEQ ID NO: 47166 - DNA, 20 bp, Artificial Sequence
  chemically synthesized
tttacagaaagggaggtcaa

SEQ ID NO: 47167 - DNA, 20 bp, Artificial Sequence
  chemically synthesized
tacagaaagggaggtcaatg

SEQ ID NO: 47168 - DNA, 20 bp, Artificial Sequence
  chemically synthesized
acagaaagggaggtcaatgg

SEQ ID NO: 47169 - DNA, 20 bp, Artificial Sequence
  chemically synthesized
aggtcaatggaggtactctt

SEQ ID NO: 47170 - DNA, 20 bp, Artificial Sequence
  chemically synthesized
gtcaatggaggtactctttg

SEQ ID NO: 47171 - DNA, 20 bp, Artificial Sequence
  chemically synthesized
tcaatggaggtactctttgg

SEQ ID NO: 47172 - DNA, 20 bp, Artificial Sequence
  chemically synthesized
gaggtactctttggaggtgt

SEQ ID NO: 47173 - DNA, 20 bp, Artificial Sequence
  chemically synthesized
ggtactctttggaggtgtaa

SEQ ID NO: 47174 - DNA, 20 bp, Artificial Sequence
  chemically synthesized
gtactctttggaggtgtaag

SEQ ID NO: 47175 - DNA, 20 bp, Artificial Sequence
  chemically synthesized
tggaggtgtaagaggattgt

SEQ ID NO: 47176 - DNA, 20 bp, Artificial Sequence
  chemically synthesized
aggtgtaagaggattgttgg

SEQ ID NO: 47177 - DNA, 20 bp, Artificial Sequence
  chemically synthesized
agaggattgttggtagtgtg

SEQ ID NO: 47178 - DNA, 20 bp, Artificial Sequence
  chemically synthesized
aggattgttggtagtgtgta

SEQ ID NO: 47179 - DNA, 20 bp, Artificial Sequence
  chemically synthesized
ggattgttggtagtgtgtag

SEQ ID NO: 47180 - DNA, 20 bp, Artificial Sequence
  chemically synthesized
ggtagtgtgtagaggtatgt

SEQ ID NO: 47181 - DNA, 20 bp, Artificial Sequence
  chemically synthesized
gtagtgtgtagaggtatgtt

SEQ ID NO: 47182 - DNA, 20 bp, Artificial Sequence
  chemically synthesized
aggtatgttaggactcaaat

SEQ ID NO: 47183 - DNA, 20 bp, Artificial Sequence
  chemically synthesized
tatgttaggactcaaattag

SEQ ID NO: 47184 - DNA, 20 bp, Artificial Sequence
  chemically synthesized
ctcaaattagaagttctgta

SEQ ID NO: 47185 - DNA, 20 bp, Artificial Sequence
  chemically synthesized
tcaaattagaagttctgtat

SEQ ID NO: 47186 - DNA, 20 bp, Artificial Sequence
  chemically synthesized
gctattatttgtatgaaact

SEQ ID NO: 47187 - DNA, 20 bp, Artificial Sequence
  chemically synthesized
ctattatttgtatgaaactc

SEQ ID NO: 47188 - DNA, 20 bp, Artificial Sequence
  chemically synthesized
tttgtatgaaactcaggata

SEQ ID NO: 47189 - DNA, 20 bp, Artificial Sequence
  chemically synthesized
aactcaggatatagctcatt

SEQ ID NO: 47190 - DNA, 20 bp, Artificial Sequence
  chemically synthesized
tatagctcatttggtgactg

SEQ ID NO: 47191 - DNA, 20 bp, Artificial Sequence
  chemically synthesized
attttttattatttataatg

SEQ ID NO: 47192 - DNA, 20 bp, Artificial Sequence
  chemically synthesized
ttttattatttataatgaag

SEQ ID NO: 47193 - DNA, 20 bp, Artificial Sequence
  chemically synthesized
tttattatttataatgaagt

SEQ ID NO: 47194 - DNA, 20 bp, Artificial Sequence
  chemically synthesized
ttattatttataatgaagtg

SEQ ID NO: 47195 - DNA, 20 bp, Artificial Sequence
  chemically synthesized
tatttataatgaagtgggga

SEQ ID NO: 47196 - DNA, 20 bp, Artificial Sequence
  chemically synthesized
atttataatgaagtggggat

SEQ ID NO: 47197 - DNA, 20 bp, Artificial Sequence
  chemically synthesized
tttataatgaagtggggatg

SEQ ID NO: 47198 - DNA, 20 bp, Artificial Sequence
  chemically synthesized
gaagtggggatggggcttcc

SEQ ID NO: 47199 - DNA, 20 bp, Artificial Sequence
  chemically synthesized
agtggggatggggcttccta

SEQ ID NO: 47200 - DNA, 20 bp, Artificial Sequence
  chemically synthesized
gggcttcctagagaccaatc

SEQ ID NO: 47201 - DNA, 20 bp, Artificial Sequence
  chemically synthesized
ggcttcctagagaccaatca

SEQ ID NO: 47202 - DNA, 20 bp, Artificial Sequence
  chemically synthesized
gcttcctagagaccaatcaa

SEQ ID NO: 47203 - DNA, 20 bp, Artificial Sequence
  chemically synthesized
ctttctcttaacgtcttcaa

SEQ ID NO: 47204 - DNA, 20 bp, Artificial Sequence
  chemically synthesized
aacgtcttcaatggtattaa

SEQ ID NO: 47205 - DNA, 20 bp, Artificial Sequence
  chemically synthesized
cgtcttcaatggtattaata

SEQ ID NO: 47206 - DNA, 20 bp, Artificial Sequence
  chemically synthesized
attaatagagaattatctct

SEQ ID NO: 47207 - DNA, 20 bp, Artificial Sequence
  chemically synthesized
ttaatagagaattatctcta

SEQ ID NO: 47208 - DNA, 20 bp, Artificial Sequence
  chemically synthesized
tatctctaaggcatgtgaac

SEQ ID NO: 47209 - DNA, 20 bp, Artificial Sequence
  chemically synthesized
ggcatgtgaactggctgtct

SEQ ID NO: 47210 - DNA, 20 bp, Artificial Sequence
  chemically synthesized
aacatatttataattccatt

SEQ ID NO: 47211 - DNA, 20 bp, Artificial Sequence
  chemically synthesized
ccattaagctgtgcatatga

SEQ ID NO: 47212 - DNA, 20 bp, Artificial Sequence
  chemically synthesized
tatcatatgtattttcctta

SEQ ID NO: 47213 - DNA, 20 bp, Artificial Sequence
  chemically synthesized
atcatatgtattttccttaa

SEQ ID NO: 47214 - DNA, 20 bp, Artificial Sequence
  chemically synthesized
tttccttaaaggatttttgt

SEQ ID NO: 47215 - DNA, 20 bp, Artificial Sequence
  chemically synthesized
taattgaattgatacctgta

SEQ ID NO: 47216 - DNA, 20 bp, Artificial Sequence
  chemically synthesized
aaataataaatctctttgtt

SEQ ID NO: 47217 - DNA, 20 bp, Artificial Sequence
  chemically synthesized
ctgtttctataaatatgtac

SEQ ID NO: 47218 - DNA, 20 bp, Artificial Sequence
  chemically synthesized
tgtacaagttttattgtttt

SEQ ID NO: 47219 - DNA, 20 bp, Artificial Sequence
  chemically synthesized
acaagttttattgtttttag

SEQ ID NO: 47220 - DNA, 20 bp, Artificial Sequence
  chemically synthesized
agttttattgtttttagtgg

SEQ ID NO: 47221 - DNA, 20 bp, Artificial Sequence
  chemically synthesized
ttttatgaataaaaaattat

SEQ ID NO: 47222 - DNA, 20 bp, Artificial Sequence
  chemically synthesized
ccactgatttttgtttatgt

SEQ ID NO: 47223 - DNA, 20 bp, Artificial Sequence
  chemically synthesized
tttttgtttatgtgagcaaa

SEQ ID NO: 47224 - DNA, 20 bp, Artificial Sequence
  chemically synthesized
ttgtttatgtgagcaaacag

SEQ ID NO: 47225 - DNA, 20 bp, Artificial Sequence
  chemically synthesized
gtgagcaaacagcagattaa

SEQ ID NO: 47226 - DNA, 20 bp, Artificial Sequence
  chemically synthesized
tgagcaaacagcagattaaa

SEQ ID NO: 47227 - DNA, 20 bp, Artificial Sequence
  chemically synthesized
aaacagcagattaaaaggct

SEQ ID NO: 47228 - DNA, 20 bp, Artificial Sequence
  chemically synthesized
cagattaaaaggctgagatt

SEQ ID NO: 47229 - DNA, 20 bp, Artificial Sequence
  chemically synthesized
agattaaaaggctgagattt

SEQ ID NO: 47230 - DNA, 20 bp, Artificial Sequence
  chemically synthesized
aaaggctgagatttaggaaa

SEQ ID NO: 47231 - DNA, 20 bp, Artificial Sequence
  chemically synthesized
gatttaggaaacagcacgtt

SEQ ID NO: 47232 - DNA, 20 bp, Artificial Sequence
  chemically synthesized
aggaaacagcacgttaagtc

SEQ ID NO: 47233 - DNA, 20 bp, Artificial Sequence
  chemically synthesized
agcacgttaagtcaagttga

SEQ ID NO: 47234 - DNA, 20 bp, Artificial Sequence
  chemically synthesized
cacgttaagtcaagttgata

SEQ ID NO: 47235 - DNA, 20 bp, Artificial Sequence
  chemically synthesized
acgttaagtcaagttgatag

SEQ ID NO: 47236 - DNA, 20 bp, Artificial Sequence
  chemically synthesized
gttaagtcaagttgatagag

SEQ ID NO: 47237 - DNA, 20 bp, Artificial Sequence
  chemically synthesized
caagttgatagaggagaata

SEQ ID NO: 47238 - DNA, 20 bp, Artificial Sequence
  chemically synthesized
aggagaatatggacatttaa

SEQ ID NO: 47239 - DNA, 20 bp, Artificial Sequence
  chemically synthesized
gagaatatggacatttaaaa

SEQ ID NO: 47240 - DNA, 20 bp, Artificial Sequence
  chemically synthesized
agaatatggacatttaaaag

SEQ ID NO: 47241 - DNA, 20 bp, Artificial Sequence
  chemically synthesized
atatggacatttaaaagagg

SEQ ID NO: 47242 - DNA, 20 bp, Artificial Sequence
  chemically synthesized
tatggacatttaaaagaggc

SEQ ID NO: 47243 - DNA, 20 bp, Artificial Sequence
  chemically synthesized
gaggcaggatgatataaaat

SEQ ID NO: 47244 - DNA, 20 bp, Artificial Sequence
  chemically synthesized
aggcaggatgatataaaatt

SEQ ID NO: 47245 - DNA, 20 bp, Artificial Sequence
  chemically synthesized
ggcaggatgatataaaatta

SEQ ID NO: 47246 - DNA, 20 bp, Artificial Sequence
  chemically synthesized
tgatataaaattagggaaac

SEQ ID NO: 47247 - DNA, 20 bp, Artificial Sequence
  chemically synthesized
aaaattagggaaactggatg

SEQ ID NO: 47248 - DNA, 20 bp, Artificial Sequence
  chemically synthesized
aattagggaaactggatgca

SEQ ID NO: 47249 - DNA, 20 bp, Artificial Sequence
  chemically synthesized
gggaaactggatgcagagac

SEQ ID NO: 47250 - DNA, 20 bp, Artificial Sequence
  chemically synthesized
ctggatgcagagaccagatg

SEQ ID NO: 47251 - DNA, 20 bp, Artificial Sequence
  chemically synthesized
atgcagagaccagatgaagt

SEQ ID NO: 47252 - DNA, 20 bp, Artificial Sequence
  chemically synthesized
accagatgaagtaagaaaaa

SEQ ID NO: 47253 - DNA, 20 bp, Artificial Sequence
  chemically synthesized
agaaaaatagctatcgtttt

SEQ ID NO: 47254 - DNA, 20 bp, Artificial Sequence
  chemically synthesized
gttttgagcaaaaatcactg

SEQ ID NO: 47255 - DNA, 20 bp, Artificial Sequence
  chemically synthesized
cactgaagtttcttgcatat

SEQ ID NO: 47256 - DNA, 20 bp, Artificial Sequence
  chemically synthesized
ctgaagtttcttgcatatga

SEQ ID NO: 47257 - DNA, 20 bp, Artificial Sequence
  chemically synthesized
tatgagagtgacataataaa

SEQ ID NO: 47258 - DNA, 20 bp, Artificial Sequence
  chemically synthesized
atgagagtgacataataaat

SEQ ID NO: 47259 - DNA, 20 bp, Artificial Sequence
  chemically synthesized
tgagagtgacataataaata

SEQ ID NO: 47260 - DNA, 20 bp, Artificial Sequence
  chemically synthesized
acataataaatagggaaacg

SEQ ID NO: 47261 - DNA, 20 bp, Artificial Sequence
  chemically synthesized
ttcacatgtatatatatata

SEQ ID NO: 47262 - DNA, 20 bp, Artificial Sequence
  chemically synthesized
tatatatatatagaactgat

SEQ ID NO: 47263 - DNA, 20 bp, Artificial Sequence
  chemically synthesized
tatatagaactgattagaca

SEQ ID NO: 47264 - DNA, 20 bp, Artificial Sequence
  chemically synthesized
tgattagacaaagtctaact

SEQ ID NO: 47265 - DNA, 20 bp, Artificial Sequence
  chemically synthesized
gattagacaaagtctaactt

SEQ ID NO: 47266 - DNA, 20 bp, Artificial Sequence
  chemically synthesized
gacaaagtctaacttgggta

SEQ ID NO: 47267 - DNA, 20 bp, Artificial Sequence
  chemically synthesized
aagtctaacttgggtatagt

SEQ ID NO: 47268 - DNA, 20 bp, Artificial Sequence
  chemically synthesized
gtctaacttgggtatagtca

SEQ ID NO: 47269 - DNA, 20 bp, Artificial Sequence
  chemically synthesized
tctaacttgggtatagtcag

SEQ ID NO: 47270 - DNA, 20 bp, Artificial Sequence
  chemically synthesized
taacttgggtatagtcagag

SEQ ID NO: 47271 - DNA, 20 bp, Artificial Sequence
  chemically synthesized
gagcttgctgtaattatatt

SEQ ID NO: 47272 - DNA, 20 bp, Artificial Sequence
  chemically synthesized
agcttgctgtaattatattg

SEQ ID NO: 47273 - DNA, 20 bp, Artificial Sequence
  chemically synthesized
ctgtaattatattgaggtga

SEQ ID NO: 47274 - DNA, 20 bp, Artificial Sequence
  chemically synthesized
ttatattgaggtgatggata

SEQ ID NO: 47275 - DNA, 20 bp, Artificial Sequence
  chemically synthesized
aggtgatggataaagaactg

SEQ ID NO: 47276 - DNA, 20 bp, Artificial Sequence
  chemically synthesized
ggataaagaactgaagttga

SEQ ID NO: 47277 - DNA, 20 bp, Artificial Sequence
  chemically synthesized
tgaagttgatggaaacaatg

SEQ ID NO: 47278 - DNA, 20 bp, Artificial Sequence
  chemically synthesized
ttgatggaaacaatgaagtt

SEQ ID NO: 47279 - DNA, 20 bp, Artificial Sequence
  chemically synthesized
tgaagttaagaaaaaaaatc

SEQ ID NO: 47280 - DNA, 20 bp, Artificial Sequence
  chemically synthesized
gttaagaaaaaaaatcgagt

SEQ ID NO: 47281 - DNA, 20 bp, Artificial Sequence
  chemically synthesized
taagaaaaaaaatcgagtaa

SEQ ID NO: 47282 - DNA, 20 bp, Artificial Sequence
  chemically synthesized
aatcgagtaagagaccattg

SEQ ID NO: 47283 - DNA, 20 bp, Artificial Sequence
  chemically synthesized
cgagtaagagaccattgtgg

SEQ ID NO: 47284 - DNA, 20 bp, Artificial Sequence
  chemically synthesized
ccattgtggcagtgattgca

SEQ ID NO: 47285 - DNA, 20 bp, Artificial Sequence
  chemically synthesized
tggcagtgattgcacagaac

SEQ ID NO: 47286 - DNA, 20 bp, Artificial Sequence
  chemically synthesized
aactggaaaacattgtgaaa

SEQ ID NO: 47287 - DNA, 20 bp, Artificial Sequence
  chemically synthesized
ctggaaaacattgtgaaaca

SEQ ID NO: 47288 - DNA, 20 bp, Artificial Sequence
  chemically synthesized
ggaaaacattgtgaaacaga

SEQ ID NO: 47289 - DNA, 20 bp, Artificial Sequence
  chemically synthesized
aacattgtgaaacagagagt

SEQ ID NO: 47290 - DNA, 20 bp, Artificial Sequence
  chemically synthesized
cattgtgaaacagagagtca

SEQ ID NO: 47291 - DNA, 20 bp, Artificial Sequence
  chemically synthesized
aaacagagagtcagagatga

SEQ ID NO: 47292 - DNA, 20 bp, Artificial Sequence
  chemically synthesized
aatccctgtctgtgaatgaa

SEQ ID NO: 47293 - DNA, 20 bp, Artificial Sequence
  chemically synthesized
ccctgtctgtgaatgaaaag

SEQ ID NO: 47294 - DNA, 20 bp, Artificial Sequence
  chemically synthesized
cctgtctgtgaatgaaaaga

SEQ ID NO: 47295 - DNA, 20 bp, Artificial Sequence
  chemically synthesized
aaaagaaggaaatttattga

SEQ ID NO: 47296 - DNA, 20 bp, Artificial Sequence
  chemically synthesized
aaggaaatttattgacagaa

SEQ ID NO: 47297 - DNA, 20 bp, Artificial Sequence
  chemically synthesized
acagaacagcaaatgcctac

SEQ ID NO: 47298 - DNA, 20 bp, Artificial Sequence
  chemically synthesized
atgcctacaagccccctgtt

SEQ ID NO: 47299 - DNA, 20 bp, Artificial Sequence
  chemically synthesized
acaagccccctgtttggatc

SEQ ID NO: 47300 - DNA, 20 bp, Artificial Sequence
  chemically synthesized
tttggatctggcaatgaacg

SEQ ID NO: 47301 - DNA, 20 bp, Artificial Sequence
  chemically synthesized
caatgaacgtagccattctg

SEQ ID NO: 47302 - DNA, 20 bp, Artificial Sequence
  chemically synthesized
cacttcaaactcctgtaccc

SEQ ID NO: 47303 - DNA, 20 bp, Artificial Sequence
  chemically synthesized
actcctgtacccaagaccct

SEQ ID NO: 47304 - DNA, 20 bp, Artificial Sequence
  chemically synthesized
ctcctgtacccaagaccctt

SEQ ID NO: 47305 - DNA, 20 bp, Artificial Sequence
  chemically synthesized
ctgtacccaagacccttagg

SEQ ID NO: 47306 - DNA, 20 bp, Artificial Sequence
  chemically synthesized
caagacccttaggaagtatg

SEQ ID NO: 47307 - DNA, 20 bp, Artificial Sequence
  chemically synthesized
ccctcaaacctaaaacctca

SEQ ID NO: 47308 - DNA, 20 bp, Artificial Sequence
  chemically synthesized
caaacctaaaacctcaaaga

SEQ ID NO: 47309 - DNA, 20 bp, Artificial Sequence
  chemically synthesized
aacctaaaacctcaaagaaa

SEQ ID NO: 47310 - DNA, 20 bp, Artificial Sequence
  chemically synthesized
acctaaaacctcaaagaaag

SEQ ID NO: 47311 - DNA, 20 bp, Artificial Sequence
  chemically synthesized
aacctcaaagaaagaggttt

SEQ ID NO: 47312 - DNA, 20 bp, Artificial Sequence
  chemically synthesized
ctcaaagaaagaggttttag

SEQ ID NO: 47313 - DNA, 20 bp, Artificial Sequence
  chemically synthesized
atataataccctttcttctc

SEQ ID NO: 47314 - DNA, 20 bp, Artificial Sequence
  chemically synthesized
atcccaaaacctctttctca

SEQ ID NO: 47315 - DNA, 20 bp, Artificial Sequence
  chemically synthesized
tcctctatgtgtccacccca

SEQ ID NO: 47316 - DNA, 20 bp, Artificial Sequence
  chemically synthesized
ctctatgtgtccaccccaaa

SEQ ID NO: 47317 - DNA, 20 bp, Artificial Sequence
  chemically synthesized
ctcacctcaccatatctctt

SEQ ID NO: 47318 - DNA, 20 bp, Artificial Sequence
  chemically synthesized
acctcaccatatctcttgag

SEQ ID NO: 47319 - DNA, 20 bp, Artificial Sequence
  chemically synthesized
cctcaccatatctcttgagt

SEQ ID NO: 47320 - DNA, 20 bp, Artificial Sequence
  chemically synthesized
tcaccatatctcttgagtgg

SEQ ID NO: 47321 - DNA, 20 bp, Artificial Sequence
  chemically synthesized
atctcttgagtgggagcaca

SEQ ID NO: 47322 - DNA, 20 bp, Artificial Sequence
  chemically synthesized
cttgagtgggagcacataga

SEQ ID NO: 47323 - DNA, 20 bp, Artificial Sequence
  chemically synthesized
ttgagtgggagcacatagat

SEQ ID NO: 47324 - DNA, 20 bp, Artificial Sequence
  chemically synthesized
agtgggagcacatagatagg

SEQ ID NO: 47325 - DNA, 20 bp, Artificial Sequence
  chemically synthesized
taggcggtgctaccatctaa

SEQ ID NO: 47326 - DNA, 20 bp, Artificial Sequence
  chemically synthesized
aattcctttgtcatattttt

SEQ ID NO: 47327 - DNA, 20 bp, Artificial Sequence
  chemically synthesized
gtccccactaataacccaca

SEQ ID NO: 47328 - DNA, 20 bp, Artificial Sequence
  chemically synthesized
cccactaataacccacaaag

SEQ ID NO: 47329 - DNA, 20 bp, Artificial Sequence
  chemically synthesized
ccacaaagcagaataaatac

SEQ ID NO: 47330 - DNA, 20 bp, Artificial Sequence
  chemically synthesized
atcactcaactgctgtcttg

SEQ ID NO: 47331 - DNA, 20 bp, Artificial Sequence
  chemically synthesized
tcttgtagcatacattaatt

SEQ ID NO: 47332 - DNA, 20 bp, Artificial Sequence
  chemically synthesized
gtcactctgtattttaaatg

SEQ ID NO: 47333 - DNA, 20 bp, Artificial Sequence
  chemically synthesized
cactctgtattttaaatgaa

SEQ ID NO: 47334 - DNA, 20 bp, Artificial Sequence
  chemically synthesized
tgtattttaaatgaagagat

SEQ ID NO: 47335 - DNA, 20 bp, Artificial Sequence
  chemically synthesized
gtattttaaatgaagagatg

SEQ ID NO: 47336 - DNA, 20 bp, Artificial Sequence
  chemically synthesized
tattttaaatgaagagatga

SEQ ID NO: 47337 - DNA, 20 bp, Artificial Sequence
  chemically synthesized
cttattgttcatttctcgat

SEQ ID NO: 47338 - DNA, 20 bp, Artificial Sequence
  chemically synthesized
ttattgttcatttctcgatg

SEQ ID NO: 47339 - DNA, 20 bp, Artificial Sequence
  chemically synthesized
attgttcatttctcgatgag

SEQ ID NO: 47340 - DNA, 20 bp, Artificial Sequence
  chemically synthesized
ggagttttcacattcacctt

SEQ ID NO: 47341 - DNA, 20 bp, Artificial Sequence
  chemically synthesized
gttttcacattcacctttag

SEQ ID NO: 47342 - DNA, 20 bp, Artificial Sequence
  chemically synthesized
acctttagtggaaaacacat

SEQ ID NO: 47343 - DNA, 20 bp, Artificial Sequence
  chemically synthesized
acacataagtacacatctta

SEQ ID NO: 47344 - DNA, 20 bp, Artificial Sequence
  chemically synthesized
cacataagtacacatcttac

SEQ ID NO: 47345 - DNA, 20 bp, Artificial Sequence
  chemically synthesized
aaatataccaaactgacatg

SEQ ID NO: 47346 - DNA, 20 bp, Artificial Sequence
  chemically synthesized
agcatgaatgcttgtgcatg

SEQ ID NO: 47347 - DNA, 20 bp, Artificial Sequence
  chemically synthesized
tgtagtcatataaaatcttg

SEQ ID NO: 47348 - DNA, 20 bp, Artificial Sequence
  chemically synthesized
cattctctgatatacacata

SEQ ID NO: 47349 - DNA, 20 bp, Artificial Sequence
  chemically synthesized
caaacattccatgcacacat

SEQ ID NO: 47350 - DNA, 20 bp, Artificial Sequence
  chemically synthesized
cataagaacacacactgtta

SEQ ID NO: 47351 - DNA, 20 bp, Artificial Sequence
  chemically synthesized
actgttacagatgcatactt

SEQ ID NO: 47352 - DNA, 20 bp, Artificial Sequence
  chemically synthesized
gtgcattgacaaaattaccc

SEQ ID NO: 47353 - DNA, 20 bp, Artificial Sequence
  chemically synthesized
caaaattaccccagtcaatc

SEQ ID NO: 47354 - DNA, 20 bp, Artificial Sequence
  chemically synthesized
aaattaccccagtcaatcta

SEQ ID NO: 47355 - DNA, 20 bp, Artificial Sequence
  chemically synthesized
cccagtcaatctagagaatt

SEQ ID NO: 47356 - DNA, 20 bp, Artificial Sequence
  chemically synthesized
atttctgcatttgactctgt

SEQ ID NO: 47357 - DNA, 20 bp, Artificial Sequence
  chemically synthesized
tacatgctgttcatttactc

SEQ ID NO: 47358 - DNA, 20 bp, Artificial Sequence
  chemically synthesized
acatgctgttcatttactct

SEQ ID NO: 47359 - DNA, 20 bp, Artificial Sequence
  chemically synthesized
ctatcttgtactcatacttt

SEQ ID NO: 47360 - DNA, 20 bp, Artificial Sequence
  chemically synthesized
acttatatgttatctcaact

SEQ ID NO: 47361 - DNA, 20 bp, Artificial Sequence
  chemically synthesized
tatatgttatctcaactaag

SEQ ID NO: 47362 - DNA, 20 bp, Artificial Sequence
  chemically synthesized
tatttttttttaattttaac

SEQ ID NO: 47363 - DNA, 20 bp, Artificial Sequence
  chemically synthesized
atttttttttaattttaact

SEQ ID NO: 47364 - DNA, 20 bp, Artificial Sequence
  chemically synthesized
tttaattttaactgggctta

SEQ ID NO: 47365 - DNA, 20 bp, Artificial Sequence
  chemically synthesized
tataaactctgctacaatta

SEQ ID NO: 47366 - DNA, 20 bp, Artificial Sequence
  chemically synthesized
ataaactctgctacaattat

SEQ ID NO: 47367 - DNA, 20 bp, Artificial Sequence
  chemically synthesized
gggctctttcttataatatt

SEQ ID NO: 47368 - DNA, 20 bp, Artificial Sequence
  chemically synthesized
ctaaattttaacctctttta

SEQ ID NO: 47369 - DNA, 20 bp, Artificial Sequence
  chemically synthesized
aattttaacctcttttatgg

SEQ ID NO: 47370 - DNA, 20 bp, Artificial Sequence
  chemically synthesized
ttttaacctcttttatggta

SEQ ID NO: 47371 - DNA, 20 bp, Artificial Sequence
  chemically synthesized
cttgtaaactcttatttccc

SEQ ID NO: 47372 - DNA, 20 bp, Artificial Sequence
  chemically synthesized
actcttatttccctagtatt

SEQ ID NO: 47373 - DNA, 20 bp, Artificial Sequence
  chemically synthesized
tcttatttccctagtatttg

SEQ ID NO: 47374 - DNA, 20 bp, Artificial Sequence
  chemically synthesized
agtatttggagatgaaaaaa

SEQ ID NO: 47375 - DNA, 20 bp, Artificial Sequence
  chemically synthesized
aagattaaattatccaaaat

SEQ ID NO: 47376 - DNA, 20 bp, Artificial Sequence
  chemically synthesized
atctctcttttctacattat

SEQ ID NO: 47377 - DNA, 20 bp, Artificial Sequence
  chemically synthesized
tatgagtattacactatcca

SEQ ID NO: 47378 - DNA, 20 bp, Artificial Sequence
  chemically synthesized
tgagtattacactatccata

SEQ ID NO: 47379 - DNA, 20 bp, Artificial Sequence
  chemically synthesized
gtattacactatccatagag

SEQ ID NO: 47380 - DNA, 20 bp, Artificial Sequence
  chemically synthesized
atccatagagaagtttgttt

SEQ ID NO: 47381 - DNA, 20 bp, Artificial Sequence
  chemically synthesized
gtttgtttgagacctaaact

SEQ ID NO: 47382 - DNA, 20 bp, Artificial Sequence
  chemically synthesized
tttgtttgagacctaaactg

SEQ ID NO: 47383 - DNA, 20 bp, Artificial Sequence
  chemically synthesized
gacctaaactgaggaacctt

SEQ ID NO: 47384 - DNA, 20 bp, Artificial Sequence
  chemically synthesized
aaaatgactatgtgatatct

SEQ ID NO: 47385 - DNA, 20 bp, Artificial Sequence
  chemically synthesized
atgtgatatcttagtattta

SEQ ID NO: 47386 - DNA, 20 bp, Artificial Sequence
  chemically synthesized
tgtgatatcttagtatttat

SEQ ID NO: 47387 - DNA, 20 bp, Artificial Sequence
  chemically synthesized
tcttagtatttataggtcat

SEQ ID NO: 47388 - DNA, 20 bp, Artificial Sequence
  chemically synthesized
cttagtatttataggtcatg

SEQ ID NO: 47389 - DNA, 20 bp, Artificial Sequence
  chemically synthesized
tccttcctctgcctctgcta

SEQ ID NO: 47390 - DNA, 20 bp, Artificial Sequence
  chemically synthesized
tgcctctgctatagtttgat

SEQ ID NO: 47391 - DNA, 20 bp, Artificial Sequence
  chemically synthesized
ctatagtttgattagtcaac

SEQ ID NO: 47392 - DNA, 20 bp, Artificial Sequence
  chemically synthesized
tgtcatgcatttattcacat

SEQ ID NO: 47393 - DNA, 20 bp, Artificial Sequence
  chemically synthesized
tcagaatttcatacactaat

SEQ ID NO: 47394 - DNA, 20 bp, Artificial Sequence
  chemically synthesized
tttcatacactaataagaca

SEQ ID NO: 47395 - DNA, 20 bp, Artificial Sequence
  chemically synthesized
acactaataagacatagtat

SEQ ID NO: 47396 - DNA, 20 bp, Artificial Sequence
  chemically synthesized
ctaataagacatagtatcag

SEQ ID NO: 47397 - DNA, 20 bp, Artificial Sequence
  chemically synthesized
taagacatagtatcagaagt

SEQ ID NO: 47398 - DNA, 20 bp, Artificial Sequence
  chemically synthesized
agtatcagaagtcagtttat

SEQ ID NO: 47399 - DNA, 20 bp, Artificial Sequence
  chemically synthesized
agtcagtttattagttatat

SEQ ID NO: 47400 - DNA, 20 bp, Artificial Sequence
  chemically synthesized
agtttattagttatatcagt

SEQ ID NO: 47401 - DNA, 20 bp, Artificial Sequence
  chemically synthesized
gtttattagttatatcagtt

SEQ ID NO: 47402 - DNA, 20 bp, Artificial Sequence
  chemically synthesized
tttattagttatatcagtta

SEQ ID NO: 47403 - DNA, 20 bp, Artificial Sequence
  chemically synthesized
tatatcagttagggtccatc

SEQ ID NO: 47404 - DNA, 20 bp, Artificial Sequence
  chemically synthesized
atatcagttagggtccatca

SEQ ID NO: 47405 - DNA, 20 bp, Artificial Sequence
  chemically synthesized
cagttagggtccatcaagga

SEQ ID NO: 47406 - DNA, 20 bp, Artificial Sequence
  chemically synthesized
agttagggtccatcaaggaa

SEQ ID NO: 47407 - DNA, 20 bp, Artificial Sequence
  chemically synthesized
aggaaaggacaaaccattat

SEQ ID NO: 47408 - DNA, 20 bp, Artificial Sequence
  chemically synthesized
ccattatcagttactcaacc

SEQ ID NO: 47409 - DNA, 20 bp, Artificial Sequence
  chemically synthesized
actcaacctagaattaaata

SEQ ID NO: 47410 - DNA, 20 bp, Artificial Sequence
  chemically synthesized
gaattaaatacagctcttaa

SEQ ID NO: 47411 - DNA, 20 bp, Artificial Sequence
  chemically synthesized
atagttaattatccttgtat

SEQ ID NO: 47412 - DNA, 20 bp, Artificial Sequence
  chemically synthesized
gttaattatccttgtattgg

SEQ ID NO: 47413 - DNA, 20 bp, Artificial Sequence
  chemically synthesized
taattatccttgtattggaa

SEQ ID NO: 47414 - DNA, 20 bp, Artificial Sequence
  chemically synthesized
aagagctaaaatatcaaata

SEQ ID NO: 47415 - DNA, 20 bp, Artificial Sequence
  chemically synthesized
agagctaaaatatcaaataa

SEQ ID NO: 47416 - DNA, 20 bp, Artificial Sequence
  chemically synthesized
ctaaaatatcaaataaagga

SEQ ID NO: 47417 - DNA, 20 bp, Artificial Sequence
  chemically synthesized
atatcaaataaaggacagtg

SEQ ID NO: 47418 - DNA, 20 bp, Artificial Sequence
  chemically synthesized
taaaggacagtgcagaaatc

SEQ ID NO: 47419 - DNA, 20 bp, Artificial Sequence
  chemically synthesized
cagtgcagaaatctagatgt

SEQ ID NO: 47420 - DNA, 20 bp, Artificial Sequence
  chemically synthesized
aatctagatgttagtaacat

SEQ ID NO: 47421 - DNA, 20 bp, Artificial Sequence
  chemically synthesized
cagaaaacctcttccgccat

SEQ ID NO: 47422 - DNA, 20 bp, Artificial Sequence
  chemically synthesized
agaaaacctcttccgccatt

SEQ ID NO: 47423 - DNA, 20 bp, Artificial Sequence
  chemically synthesized
acctcttccgccattaggcc

SEQ ID NO: 47424 - DNA, 20 bp, Artificial Sequence
  chemically synthesized
tcttccgccattaggcctag

SEQ ID NO: 47425 - DNA, 20 bp, Artificial Sequence
  chemically synthesized
cttccgccattaggcctaga

SEQ ID NO: 47426 - DNA, 20 bp, Artificial Sequence
  chemically synthesized
ttccgccattaggcctagaa

SEQ ID NO: 47427 - DNA, 20 bp, Artificial Sequence
  chemically synthesized
cgccattaggcctagaaggg

SEQ ID NO: 47428 - DNA, 20 bp, Artificial Sequence
  chemically synthesized
cattaggcctagaagggcag

SEQ ID NO: 47429 - DNA, 20 bp, Artificial Sequence
  chemically synthesized
attaggcctagaagggcaga

SEQ ID NO: 47430 - DNA, 20 bp, Artificial Sequence
  chemically synthesized
taggcctagaagggcagaag

SEQ ID NO: 47431 - DNA, 20 bp, Artificial Sequence
  chemically synthesized
ggagaaaatgtttataccac

SEQ ID NO: 47432 - DNA, 20 bp, Artificial Sequence
  chemically synthesized
agaaaatgtttataccacca

SEQ ID NO: 47433 - DNA, 20 bp, Artificial Sequence
  chemically synthesized
atgtttataccaccagagtc

SEQ ID NO: 47434 - DNA, 20 bp, Artificial Sequence
  chemically synthesized
ataccaccagagtccagaac

SEQ ID NO: 47435 - DNA, 20 bp, Artificial Sequence
  chemically synthesized
accaccagagtccagaacca

SEQ ID NO: 47436 - DNA, 20 bp, Artificial Sequence
  chemically synthesized
ccagaaccagagcccataac

SEQ ID NO: 47437 - DNA, 20 bp, Artificial Sequence
  chemically synthesized
agaaccagagcccataacca

SEQ ID NO: 47438 - DNA, 20 bp, Artificial Sequence
  chemically synthesized
gaaccagagcccataaccag

SEQ ID NO: 47439 - DNA, 20 bp, Artificial Sequence
  chemically synthesized
gcccataaccagaggtccac

SEQ ID NO: 47440 - DNA, 20 bp, Artificial Sequence
  chemically synthesized
aaccagaggtccactggatt

SEQ ID NO: 47441 - DNA, 20 bp, Artificial Sequence
  chemically synthesized
agaggtccactggattcagt

SEQ ID NO: 47442 - DNA, 20 bp, Artificial Sequence
  chemically synthesized
gtccactggattcagtgagc

SEQ ID NO: 47443 - DNA, 20 bp, Artificial Sequence
  chemically synthesized
cactggattcagtgagctag

SEQ ID NO: 47444 - DNA, 20 bp, Artificial Sequence
  chemically synthesized
actggattcagtgagctagt

SEQ ID NO: 47445 - DNA, 20 bp, Artificial Sequence
  chemically synthesized
gtgagctagtgggtgctcct

SEQ ID NO: 47446 - DNA, 20 bp, Artificial Sequence
  chemically synthesized
gagctagtgggtgctccttg

SEQ ID NO: 47447 - DNA, 20 bp, Artificial Sequence
  chemically synthesized
gctagtgggtgctccttgga

SEQ ID NO: 47448 - DNA, 20 bp, Artificial Sequence
  chemically synthesized
tagtgggtgctccttggaga

SEQ ID NO: 47449 - DNA, 20 bp, Artificial Sequence
  chemically synthesized
gggtgctccttggagagagc

SEQ ID NO: 47450 - DNA, 20 bp, Artificial Sequence
  chemically synthesized
agagagccagaactgtctaa

SEQ ID NO: 47451 - DNA, 20 bp, Artificial Sequence
  chemically synthesized
gagagccagaactgtctaat

SEQ ID NO: 47452 - DNA, 20 bp, Artificial Sequence
  chemically synthesized
agagccagaactgtctaatg

SEQ ID NO: 47453 - DNA, 20 bp, Artificial Sequence
  chemically synthesized
gagccagaactgtctaatgg

SEQ ID NO: 47454 - DNA, 20 bp, Artificial Sequence
  chemically synthesized
actgtctaatgggggcatca

SEQ ID NO: 47455 - DNA, 20 bp, Artificial Sequence
  chemically synthesized
taatgggggcatcaaagtat

SEQ ID NO: 47456 - DNA, 20 bp, Artificial Sequence
  chemically synthesized
agccataaaaaaccataaaa

SEQ ID NO: 47457 - DNA, 20 bp, Artificial Sequence
  chemically synthesized
ataaaaaagactgtctgctg

SEQ ID NO: 47458 - DNA, 20 bp, Artificial Sequence
  chemically synthesized
taaaaaagactgtctgctgt

SEQ ID NO: 47459 - DNA, 20 bp, Artificial Sequence
  chemically synthesized
aaaaagactgtctgctgtag

SEQ ID NO: 47460 - DNA, 20 bp, Artificial Sequence
  chemically synthesized
tctgctgtaggagatccgtt

SEQ ID NO: 47461 - DNA, 20 bp, Artificial Sequence
  chemically synthesized
tgctgtaggagatccgttca

SEQ ID NO: 47462 - DNA, 20 bp, Artificial Sequence
  chemically synthesized
ctgtaggagatccgttcaga

SEQ ID NO: 47463 - DNA, 20 bp, Artificial Sequence
  chemically synthesized
gtaggagatccgttcagaga

SEQ ID NO: 47464 - DNA, 20 bp, Artificial Sequence
  chemically synthesized
aggagatccgttcagagaga

SEQ ID NO: 47465 - DNA, 20 bp, Artificial Sequence
  chemically synthesized
gagatccgttcagagagaga

SEQ ID NO: 47466 - DNA, 20 bp, Artificial Sequence
  chemically synthesized
gatccgttcagagagagaga

SEQ ID NO: 47467 - DNA, 20 bp, Artificial Sequence
  chemically synthesized
gttcagagagagagagagac

SEQ ID NO: 47468 - DNA, 20 bp, Artificial Sequence
  chemically synthesized
atcttgcttatgctttccct

SEQ ID NO: 47469 - DNA, 20 bp, Artificial Sequence
  chemically synthesized
tgcttatgctttccctcagc

SEQ ID NO: 47470 - DNA, 20 bp, Artificial Sequence
  chemically synthesized
tcagccagtgtttaccattg

SEQ ID NO: 47471 - DNA, 20 bp, Artificial Sequence
  chemically synthesized
cagaatgtacatgcgactga

SEQ ID NO: 47472 - DNA, 20 bp, Artificial Sequence
  chemically synthesized
agaatgtacatgcgactgaa

SEQ ID NO: 47473 - DNA, 20 bp, Artificial Sequence
  chemically synthesized
gaatgtacatgcgactgaaa

SEQ ID NO: 47474 - DNA, 20 bp, Artificial Sequence
  chemically synthesized
gtacatgcgactgaaagggt

SEQ ID NO: 47475 - DNA, 20 bp, Artificial Sequence
  chemically synthesized
tacatgcgactgaaagggtg

SEQ ID NO: 47476 - DNA, 20 bp, Artificial Sequence
  chemically synthesized
actgaaagggtgaggaaacc

SEQ ID NO: 47477 - DNA, 20 bp, Artificial Sequence
  chemically synthesized
ctgaaagggtgaggaaacct

SEQ ID NO: 47478 - DNA, 20 bp, Artificial Sequence
  chemically synthesized
tgaggaaacctgggaaatgt

SEQ ID NO: 47479 - DNA, 20 bp, Artificial Sequence
  chemically synthesized
aaatgtcagttcctcaaata

SEQ ID NO: 47480 - DNA, 20 bp, Artificial Sequence
  chemically synthesized
atgtcagttcctcaaataca

SEQ ID NO: 47481 - DNA, 20 bp, Artificial Sequence
  chemically synthesized
cctcaaatacagagaacact

SEQ ID NO: 47482 - DNA, 20 bp, Artificial Sequence
  chemically synthesized
ctcaaatacagagaacactg

SEQ ID NO: 47483 - DNA, 20 bp, Artificial Sequence
  chemically synthesized
tcaaatacagagaacactga

SEQ ID NO: 47484 - DNA, 20 bp, Artificial Sequence
  chemically synthesized
aatacagagaacactgaggg

SEQ ID NO: 47485 - DNA, 20 bp, Artificial Sequence
  chemically synthesized
atacagagaacactgaggga

SEQ ID NO: 47486 - DNA, 20 bp, Artificial Sequence
  chemically synthesized
gagaacactgagggaaggat

SEQ ID NO: 47487 - DNA, 20 bp, Artificial Sequence
  chemically synthesized
aggatgagaaataaatgtga

SEQ ID NO: 47488 - DNA, 20 bp, Artificial Sequence
  chemically synthesized
atgagaaataaatgtgaaag

SEQ ID NO: 47489 - DNA, 20 bp, Artificial Sequence
  chemically synthesized
aatgtgaaagcagacatgaa

SEQ ID NO: 47490 - DNA, 20 bp, Artificial Sequence
  chemically synthesized
cagacatgaatggtaattga

SEQ ID NO: 47491 - DNA, 20 bp, Artificial Sequence
  chemically synthesized
acatgaatggtaattgacag

SEQ ID NO: 47492 - DNA, 20 bp, Artificial Sequence
  chemically synthesized
catgaatggtaattgacaga

SEQ ID NO: 47493 - DNA, 20 bp, Artificial Sequence
  chemically synthesized
ggtaattgacagaaggaaac

SEQ ID NO: 47494 - DNA, 20 bp, Artificial Sequence
  chemically synthesized
gtaattgacagaaggaaact

SEQ ID NO: 47495 - DNA, 20 bp, Artificial Sequence
  chemically synthesized
gaaggaaactaggatgtgtc

SEQ ID NO: 47496 - DNA, 20 bp, Artificial Sequence
  chemically synthesized
gtccagtaaatgaataatta

SEQ ID NO: 47497 - DNA, 20 bp, Artificial Sequence
  chemically synthesized
aaatgaataattacagtgtg

SEQ ID NO: 47498 - DNA, 20 bp, Artificial Sequence
  chemically synthesized
gcaatgattaatgtattgat

SEQ ID NO: 47499 - DNA, 20 bp, Artificial Sequence
  chemically synthesized
gataagataatatgaaaaca

SEQ ID NO: 47500 - DNA, 20 bp, Artificial Sequence
  chemically synthesized
atgaaaacacagaattcaaa

SEQ ID NO: 47501 - DNA, 20 bp, Artificial Sequence
  chemically synthesized
aaaacacagaattcaaacag

SEQ ID NO: 47502 - DNA, 20 bp, Artificial Sequence
  chemically synthesized
aattcaaacagcagtgaact

SEQ ID NO: 47503 - DNA, 20 bp, Artificial Sequence
  chemically synthesized
aaacagcagtgaactgagat

SEQ ID NO: 47504 - DNA, 20 bp, Artificial Sequence
  chemically synthesized
gtgaactgagattagaattg

SEQ ID NO: 47505 - DNA, 20 bp, Artificial Sequence
  chemically synthesized
gaactgagattagaattgtg

SEQ ID NO: 47506 - DNA, 20 bp, Artificial Sequence
  chemically synthesized
actgagattagaattgtgga

SEQ ID NO: 47507 - DNA, 20 bp, Artificial Sequence
  chemically synthesized
attagaattgtggagagcac

SEQ ID NO: 47508 - DNA, 20 bp, Artificial Sequence
  chemically synthesized
tgtggagagcactggcattt

SEQ ID NO: 47509 - DNA, 20 bp, Artificial Sequence
  chemically synthesized
gcatttaagaatgtcacact

SEQ ID NO: 47510 - DNA, 20 bp, Artificial Sequence
  chemically synthesized
tcacacttagaatgtgtctc

SEQ ID NO: 47511 - DNA, 20 bp, Artificial Sequence
  chemically synthesized
cacacttagaatgtgtctct

SEQ ID NO: 47512 - DNA, 20 bp, Artificial Sequence
  chemically synthesized
attatctgaaaattatgaat

SEQ ID NO: 47513 - DNA, 20 bp, Artificial Sequence
  chemically synthesized
ttatctgaaaattatgaatt

SEQ ID NO: 47514 - DNA, 20 bp, Artificial Sequence
  chemically synthesized
aaaattatgaattaggtaca

SEQ ID NO: 47515 - DNA, 20 bp, Artificial Sequence
  chemically synthesized
gctcaaataatttatttttt

SEQ ID NO: 47516 - DNA, 20 bp, Artificial Sequence
  chemically synthesized
ctcaaataatttattttttc

SEQ ID NO: 47517 - DNA, 20 bp, Artificial Sequence
  chemically synthesized
aataatttattttttcaggt

SEQ ID NO: 47518 - DNA, 20 bp, Artificial Sequence
  chemically synthesized
atttattttttcaggttagc

SEQ ID NO: 47519 - DNA, 20 bp, Artificial Sequence
  chemically synthesized
aactttttttttttttttct

SEQ ID NO: 47520 - DNA, 20 bp, Artificial Sequence
  chemically synthesized
ttttttttttttttctgaga

SEQ ID NO: 47521 - DNA, 20 bp, Artificial Sequence
  chemically synthesized
ttttttttttttctgagata

SEQ ID NO: 47522 - DNA, 20 bp, Artificial Sequence
  chemically synthesized
tctgagatagagcattgcta

SEQ ID NO: 47523 - DNA, 20 bp, Artificial Sequence
  chemically synthesized
agagcattgctatggttgcc

SEQ ID NO: 47524 - DNA, 20 bp, Artificial Sequence
  chemically synthesized
gagcattgctatggttgccc

SEQ ID NO: 47525 - DNA, 20 bp, Artificial Sequence
  chemically synthesized
attgctatggttgcccaggc

SEQ ID NO: 47526 - DNA, 20 bp, Artificial Sequence
  chemically synthesized
tgctatggttgcccaggctg

SEQ ID NO: 47527 - DNA, 20 bp, Artificial Sequence
  chemically synthesized
ttgcccaggctggagtgcaa

SEQ ID NO: 47528 - DNA, 20 bp, Artificial Sequence
  chemically synthesized
tggagtgcaatggcatgatc

SEQ ID NO: 47529 - DNA, 20 bp, Artificial Sequence
  chemically synthesized
ggagtgcaatggcatgatcc

SEQ ID NO: 47530 - DNA, 20 bp, Artificial Sequence
  chemically synthesized
tcactgcaacatctgcctcc

SEQ ID NO: 47531 - DNA, 20 bp, Artificial Sequence
  chemically synthesized
cactgcaacatctgcctccc

SEQ ID NO: 47532 - DNA, 20 bp, Artificial Sequence
  chemically synthesized
aacatctgcctcccaggttc

SEQ ID NO: 47533 - DNA, 20 bp, Artificial Sequence
  chemically synthesized
ttcaagcgattctcctgcct

SEQ ID NO: 47534 - DNA, 20 bp, Artificial Sequence
  chemically synthesized
ttctcctgcctcagcctccc

SEQ ID NO: 47535 - DNA, 20 bp, Artificial Sequence
  chemically synthesized
tcctgcctcagcctcccaag

SEQ ID NO: 47536 - DNA, 20 bp, Artificial Sequence
  chemically synthesized
gcctcagcctcccaagtagc

SEQ ID NO: 47537 - DNA, 20 bp, Artificial Sequence
  chemically synthesized
ctcccaagtagctggcacta

SEQ ID NO: 47538 - DNA, 20 bp, Artificial Sequence
  chemically synthesized
tcccaagtagctggcactac

SEQ ID NO: 47539 - DNA, 20 bp, Artificial Sequence
  chemically synthesized
gcatgtgccaccaccatgcc

SEQ ID NO: 47540 - DNA, 20 bp, Artificial Sequence
  chemically synthesized
cctggctaattttctatttt

SEQ ID NO: 47541 - DNA, 20 bp, Artificial Sequence
  chemically synthesized
ggctaattttctatttttag

SEQ ID NO: 47542 - DNA, 20 bp, Artificial Sequence
  chemically synthesized
aattttctatttttagtaga

SEQ ID NO: 47543 - DNA, 20 bp, Artificial Sequence
  chemically synthesized
attttctatttttagtagat

SEQ ID NO: 47544 - DNA, 20 bp, Artificial Sequence
  chemically synthesized
ttttctatttttagtagata

SEQ ID NO: 47545 - DNA, 20 bp, Artificial Sequence
  chemically synthesized
tttctatttttagtagatag

SEQ ID NO: 47546 - DNA, 20 bp, Artificial Sequence
  chemically synthesized
ttctatttttagtagatagg

SEQ ID NO: 47547 - DNA, 20 bp, Artificial Sequence
  chemically synthesized
gatagggggtttcaccatgt

SEQ ID NO: 47548 - DNA, 20 bp, Artificial Sequence
  chemically synthesized
gggggtttcaccatgttggt

SEQ ID NO: 47549 - DNA, 20 bp, Artificial Sequence
  chemically synthesized
ggggtttcaccatgttggtc

SEQ ID NO: 47550 - DNA, 20 bp, Artificial Sequence
  chemically synthesized
tgatctcgaactcctaacat

SEQ ID NO: 47551 - DNA, 20 bp, Artificial Sequence
  chemically synthesized
gatctcgaactcctaacatc

SEQ ID NO: 47552 - DNA, 20 bp, Artificial Sequence
  chemically synthesized
atcaggtgatccaccctcct

SEQ ID NO: 47553 - DNA, 20 bp, Artificial Sequence
  chemically synthesized
ccaccctcctcggcctctga

SEQ ID NO: 47554 - DNA, 20 bp, Artificial Sequence
  chemically synthesized
tcctcggcctctgaaagtgc

SEQ ID NO: 47555 - DNA, 20 bp, Artificial Sequence
  chemically synthesized
cctcggcctctgaaagtgct

SEQ ID NO: 47556 - DNA, 20 bp, Artificial Sequence
  chemically synthesized
ctctgaaagtgctgggatca

SEQ ID NO: 47557 - DNA, 20 bp, Artificial Sequence
  chemically synthesized
tctgaaagtgctgggatcac

SEQ ID NO: 47558 - DNA, 20 bp, Artificial Sequence
  chemically synthesized
agtgctgggatcacaggcgt

SEQ ID NO: 47559 - DNA, 20 bp, Artificial Sequence
  chemically synthesized
caggcgtgagccaccacacc

SEQ ID NO: 47560 - DNA, 20 bp, Artificial Sequence
  chemically synthesized
gtgagccaccacacccagcc

SEQ ID NO: 47561 - DNA, 20 bp, Artificial Sequence
  chemically synthesized
agccaagaatgtgaattttg

SEQ ID NO: 47562 - DNA, 20 bp, Artificial Sequence
  chemically synthesized
caagaatgtgaattttgtag

SEQ ID NO: 47563 - DNA, 20 bp, Artificial Sequence
  chemically synthesized
aagaatgtgaattttgtaga

SEQ ID NO: 47564 - DNA, 20 bp, Artificial Sequence
  chemically synthesized
aacccatatttctctgaccc

SEQ ID NO: 47565 - DNA, 20 bp, Artificial Sequence
  chemically synthesized
cccatatttctctgacccta

SEQ ID NO: 47566 - DNA, 20 bp, Artificial Sequence
  chemically synthesized
ttctctgaccctagagtcct

SEQ ID NO: 47567 - DNA, 20 bp, Artificial Sequence
  chemically synthesized
agtatacctcccataccatg

SEQ ID NO: 47568 - DNA, 20 bp, Artificial Sequence
  chemically synthesized
ctaccttttcctttttgttt

SEQ ID NO: 47569 - DNA, 20 bp, Artificial Sequence
  chemically synthesized
cttttcactgtgtcaaaatc

SEQ ID NO: 47570 - DNA, 20 bp, Artificial Sequence
  chemically synthesized
cctacctgctctgaaaccaa

SEQ ID NO: 47571 - DNA, 20 bp, Artificial Sequence
  chemically synthesized
cctgctctgaaaccaacagc

SEQ ID NO: 47572 - DNA, 20 bp, Artificial Sequence
  chemically synthesized
acttccattctaacccacat

SEQ ID NO: 47573 - DNA, 20 bp, Artificial Sequence
  chemically synthesized
cactaattaaaatcgatact

SEQ ID NO: 47574 - DNA, 20 bp, Artificial Sequence
  chemically synthesized
atactgagttctaaaatcat

SEQ ID NO: 47575 - DNA, 20 bp, Artificial Sequence
  chemically synthesized
tactgagttctaaaatcatc

SEQ ID NO: 47576 - DNA, 20 bp, Artificial Sequence
  chemically synthesized
actgagttctaaaatcatcg

SEQ ID NO: 47577 - DNA, 20 bp, Artificial Sequence
  chemically synthesized
tctaaaatcatcggggattt

SEQ ID NO: 47578 - DNA, 20 bp, Artificial Sequence
  chemically synthesized
ctaaaatcatcggggatttt

SEQ ID NO: 47579 - DNA, 20 bp, Artificial Sequence
  chemically synthesized
taaaatcatcggggattttg

SEQ ID NO: 47580 - DNA, 20 bp, Artificial Sequence
  chemically synthesized
gtcttacttcatacttcctt

SEQ ID NO: 47581 - DNA, 20 bp, Artificial Sequence
  chemically synthesized
tgagatttcacattaaatgt

SEQ ID NO: 47582 - DNA, 20 bp, Artificial Sequence
  chemically synthesized
ttaaatgttggtgttcatta

SEQ ID NO: 47583 - DNA, 20 bp, Artificial Sequence
  chemically synthesized
taaatgttggtgttcattaa

SEQ ID NO: 47584 - DNA, 20 bp, Artificial Sequence
  chemically synthesized
ctttgtattcatcacactct

SEQ ID NO: 47585 - DNA, 20 bp, Artificial Sequence
  chemically synthesized
tcatcacactcttggattca

SEQ ID NO: 47586 - DNA, 20 bp, Artificial Sequence
  chemically synthesized
tatatctaaactcttaaata

SEQ ID NO: 47587 - DNA, 20 bp, Artificial Sequence
  chemically synthesized
taacctctgacctccaacct

SEQ ID NO: 47588 - DNA, 20 bp, Artificial Sequence
  chemically synthesized
ccatatatcaaacaatgtac

SEQ ID NO: 47589 - DNA, 20 bp, Artificial Sequence
  chemically synthesized
catatatcaaacaatgtact

SEQ ID NO: 47590 - DNA, 20 bp, Artificial Sequence
  chemically synthesized
atgtactgggcttatttata

SEQ ID NO: 47591 - DNA, 20 bp, Artificial Sequence
  chemically synthesized
ttatttatatagatgtccta

SEQ ID NO: 47592 - DNA, 20 bp, Artificial Sequence
  chemically synthesized
tatttatatagatgtcctat

SEQ ID NO: 47593 - DNA, 20 bp, Artificial Sequence
  chemically synthesized
tagatgtcctataggcacct

SEQ ID NO: 47594 - DNA, 20 bp, Artificial Sequence
  chemically synthesized
tcctataggcacctcagact

SEQ ID NO: 47595 - DNA, 20 bp, Artificial Sequence
  chemically synthesized
taggcacctcagactcagca

SEQ ID NO: 47596 - DNA, 20 bp, Artificial Sequence
  chemically synthesized
aggcacctcagactcagcat

SEQ ID NO: 47597 - DNA, 20 bp, Artificial Sequence
  chemically synthesized
tactaaaactgtttctcttc

SEQ ID NO: 47598 - DNA, 20 bp, Artificial Sequence
  chemically synthesized
tcttccagtgttttccattt

SEQ ID NO: 47599 - DNA, 20 bp, Artificial Sequence
  chemically synthesized
gtgttttccattttagtcat

SEQ ID NO: 47600 - DNA, 20 bp, Artificial Sequence
  chemically synthesized
tttccattttagtcattaga

SEQ ID NO: 47601 - DNA, 20 bp, Artificial Sequence
  chemically synthesized
tagctacttgcccattcacc

SEQ ID NO: 47602 - DNA, 20 bp, Artificial Sequence
  chemically synthesized
agctacttgcccattcacca

SEQ ID NO: 47603 - DNA, 20 bp, Artificial Sequence
  chemically synthesized
ttgcccattcaccaaggtca

SEQ ID NO: 47604 - DNA, 20 bp, Artificial Sequence
  chemically synthesized
atttccctacctctaatcaa

SEQ ID NO: 47605 - DNA, 20 bp, Artificial Sequence
  chemically synthesized
taatcaccactcttactgcc

SEQ ID NO: 47606 - DNA, 20 bp, Artificial Sequence
  chemically synthesized
caccactcttactgcccagt

SEQ ID NO: 47607 - DNA, 20 bp, Artificial Sequence
  chemically synthesized
accactcttactgcccagtc

SEQ ID NO: 47608 - DNA, 20 bp, Artificial Sequence
  chemically synthesized
gtcctcattgtttcctgaac

SEQ ID NO: 47609 - DNA, 20 bp, Artificial Sequence
  chemically synthesized
cctcattgtttcctgaacaa

SEQ ID NO: 47610 - DNA, 20 bp, Artificial Sequence
  chemically synthesized
cattgtttcctgaacaagag

SEQ ID NO: 47611 - DNA, 20 bp, Artificial Sequence
  chemically synthesized
gatgctattctttccacttt

SEQ ID NO: 47612 - DNA, 20 bp, Artificial Sequence
  chemically synthesized
tccacttttagaccttatcc

SEQ ID NO: 47613 - DNA, 20 bp, Artificial Sequence
  chemically synthesized
cttttagaccttatcctggc

SEQ ID NO: 47614 - DNA, 20 bp, Artificial Sequence
  chemically synthesized
gaccttatcctggctggatg

SEQ ID NO: 47615 - DNA, 20 bp, Artificial Sequence
  chemically synthesized
cttatcctggctggatgcgg

SEQ ID NO: 47616 - DNA, 20 bp, Artificial Sequence
  chemically synthesized
cctggctggatgcggtggct

SEQ ID NO: 47617 - DNA, 20 bp, Artificial Sequence
  chemically synthesized
ctggctggatgcggtggctc

SEQ ID NO: 47618 - DNA, 20 bp, Artificial Sequence
  chemically synthesized
gtggctcaggcttgtaaacc

SEQ ID NO: 47619 - DNA, 20 bp, Artificial Sequence
  chemically synthesized
ggcttgtaaacccagcactt

SEQ ID NO: 47620 - DNA, 20 bp, Artificial Sequence
  chemically synthesized
gcttgtaaacccagcacttt

SEQ ID NO: 47621 - DNA, 20 bp, Artificial Sequence
  chemically synthesized
ttgtaaacccagcactttgg

SEQ ID NO: 47622 - DNA, 20 bp, Artificial Sequence
  chemically synthesized
tgtaaacccagcactttggg

SEQ ID NO: 47623 - DNA, 20 bp, Artificial Sequence
  chemically synthesized
acccagcactttgggaggcc

SEQ ID NO: 47624 - DNA, 20 bp, Artificial Sequence
  chemically synthesized
cccagcactttgggaggcca

SEQ ID NO: 47625 - DNA, 20 bp, Artificial Sequence
  chemically synthesized
agcactttgggaggccaagg

SEQ ID NO: 47626 - DNA, 20 bp, Artificial Sequence
  chemically synthesized
gcactttgggaggccaaggc

SEQ ID NO: 47627 - DNA, 20 bp, Artificial Sequence
  chemically synthesized
ctttgggaggccaaggcagg

SEQ ID NO: 47628 - DNA, 20 bp, Artificial Sequence
  chemically synthesized
ccaaggcaggcagatcactt

SEQ ID NO: 47629 - DNA, 20 bp, Artificial Sequence
  chemically synthesized
caaggcaggcagatcacttg

SEQ ID NO: 47630 - DNA, 20 bp, Artificial Sequence
  chemically synthesized
gcaggcagatcacttgaggt

SEQ ID NO: 47631 - DNA, 20 bp, Artificial Sequence
  chemically synthesized
caggcagatcacttgaggtc

SEQ ID NO: 47632 - DNA, 20 bp, Artificial Sequence
  chemically synthesized
ggcagatcacttgaggtcag

SEQ ID NO: 47633 - DNA, 20 bp, Artificial Sequence
  chemically synthesized
tcacttgaggtcaggagttc

SEQ ID NO: 47634 - DNA, 20 bp, Artificial Sequence
  chemically synthesized
tgaggtcaggagttcaagac

SEQ ID NO: 47635 - DNA, 20 bp, Artificial Sequence
  chemically synthesized
caagaccagcctgaccaaca

SEQ ID NO: 47636 - DNA, 20 bp, Artificial Sequence
  chemically synthesized
ctctactaaaaatacaaaat

SEQ ID NO: 47637 - DNA, 20 bp, Artificial Sequence
  chemically synthesized
actaaaaatacaaaatcagc

SEQ ID NO: 47638 - DNA, 20 bp, Artificial Sequence
  chemically synthesized
ctaaaaatacaaaatcagcc

SEQ ID NO: 47639 - DNA, 20 bp, Artificial Sequence
  chemically synthesized
tacaaaatcagccgggcgtg

SEQ ID NO: 47640 - DNA, 20 bp, Artificial Sequence
  chemically synthesized
gggcgtgtggtgcatgcctg

SEQ ID NO: 47641 - DNA, 20 bp, Artificial Sequence
  chemically synthesized
gtggtgcatgcctgcagtcc

SEQ ID NO: 47642 - DNA, 20 bp, Artificial Sequence
  chemically synthesized
tgcctgcagtcccagctatt

SEQ ID NO: 47643 - DNA, 20 bp, Artificial Sequence
  chemically synthesized
gcctgcagtcccagctattc

SEQ ID NO: 47644 - DNA, 20 bp, Artificial Sequence
  chemically synthesized
tgcagtcccagctattcagg

SEQ ID NO: 47645 - DNA, 20 bp, Artificial Sequence
  chemically synthesized
tcccagctattcaggtggct

SEQ ID NO: 47646 - DNA, 20 bp, Artificial Sequence
  chemically synthesized
cccagctattcaggtggctg

SEQ ID NO: 47647 - DNA, 20 bp, Artificial Sequence
  chemically synthesized
agctattcaggtggctgagg

SEQ ID NO: 47648 - DNA, 20 bp, Artificial Sequence
  chemically synthesized
gctattcaggtggctgaggc

SEQ ID NO: 47649 - DNA, 20 bp, Artificial Sequence
  chemically synthesized
tattcaggtggctgaggcag

SEQ ID NO: 47650 - DNA, 20 bp, Artificial Sequence
  chemically synthesized
gcaggagaattgcttgaacc

SEQ ID NO: 47651 - DNA, 20 bp, Artificial Sequence
  chemically synthesized
caggagaattgcttgaaccc

SEQ ID NO: 47652 - DNA, 20 bp, Artificial Sequence
  chemically synthesized
ggagaattgcttgaacccag

SEQ ID NO: 47653 - DNA, 20 bp, Artificial Sequence
  chemically synthesized
gagaattgcttgaacccagg

SEQ ID NO: 47654 - DNA, 20 bp, Artificial Sequence
  chemically synthesized
aattgcttgaacccaggagg

SEQ ID NO: 47655 - DNA, 20 bp, Artificial Sequence
  chemically synthesized
ttgcttgaacccaggaggca

SEQ ID NO: 47656 - DNA, 20 bp, Artificial Sequence
  chemically synthesized
tgcttgaacccaggaggcag

SEQ ID NO: 47657 - DNA, 20 bp, Artificial Sequence
  chemically synthesized
aacccaggaggcagaggttg

SEQ ID NO: 47658 - DNA, 20 bp, Artificial Sequence
  chemically synthesized
caggaggcagaggttgcggt

SEQ ID NO: 47659 - DNA, 20 bp, Artificial Sequence
  chemically synthesized
ggcagaggttgcggtgagcc

SEQ ID NO: 47660 - DNA, 20 bp, Artificial Sequence
  chemically synthesized
tagattgcaccattgcactc

SEQ ID NO: 47661 - DNA, 20 bp, Artificial Sequence
  chemically synthesized
tgcaccattgcactctagct

SEQ ID NO: 47662 - DNA, 20 bp, Artificial Sequence
  chemically synthesized
gcaccattgcactctagctt

SEQ ID NO: 47663 - DNA, 20 bp, Artificial Sequence
  chemically synthesized
ttgcactctagcttgggcaa

SEQ ID NO: 47664 - DNA, 20 bp, Artificial Sequence
  chemically synthesized
tgcactctagcttgggcaat

SEQ ID NO: 47665 - DNA, 20 bp, Artificial Sequence
  chemically synthesized
gcactctagcttgggcaata

SEQ ID NO: 47666 - DNA, 20 bp, Artificial Sequence
  chemically synthesized
atagggatgaaactccatct

SEQ ID NO: 47667 - DNA, 20 bp, Artificial Sequence
  chemically synthesized
gggatgaaactccatctcag

SEQ ID NO: 47668 - DNA, 20 bp, Artificial Sequence
  chemically synthesized
gatgaaactccatctcagaa

SEQ ID NO: 47669 - DNA, 20 bp, Artificial Sequence
  chemically synthesized
aactccatctcagaagagaa

SEQ ID NO: 47670 - DNA, 20 bp, Artificial Sequence
  chemically synthesized
ctcagaagagaaaagaaaaa

SEQ ID NO: 47671 - DNA, 20 bp, Artificial Sequence
  chemically synthesized
tcctctcaatgcaatccata

SEQ ID NO: 47672 - DNA, 20 bp, Artificial Sequence
  chemically synthesized
atatagaataaacatgtaac

SEQ ID NO: 47673 - DNA, 20 bp, Artificial Sequence
  chemically synthesized
cccaatgtgtaaaatcattt

SEQ ID NO: 47674 - DNA, 20 bp, Artificial Sequence
  chemically synthesized
ccaatgtgtaaaatcatttc

SEQ ID NO: 47675 - DNA, 20 bp, Artificial Sequence
  chemically synthesized
atgtgtaaaatcatttcagg

SEQ ID NO: 47676 - DNA, 20 bp, Artificial Sequence
  chemically synthesized
taaaatcatttcaggtagaa

SEQ ID NO: 47677 - DNA, 20 bp, Artificial Sequence
  chemically synthesized
tttcaggtagaacagaatta

SEQ ID NO: 47678 - DNA, 20 bp, Artificial Sequence
  chemically synthesized
tagaacagaattaaagtgaa

SEQ ID NO: 47679 - DNA, 20 bp, Artificial Sequence
  chemically synthesized
cagaattaaagtgaaaagcc

SEQ ID NO: 47680 - DNA, 20 bp, Artificial Sequence
  chemically synthesized
aaagtgaaaagccaagtctt

SEQ ID NO: 47681 - DNA, 20 bp, Artificial Sequence
  chemically synthesized
agccaagtctttggaattaa

SEQ ID NO: 47682 - DNA, 20 bp, Artificial Sequence
  chemically synthesized
gtctttggaattaacagaca

SEQ ID NO: 47683 - DNA, 20 bp, Artificial Sequence
  chemically synthesized
aacagacaaagatcaaataa

SEQ ID NO: 47684 - DNA, 20 bp, Artificial Sequence
  chemically synthesized
agatcaaataacagtcctca

SEQ ID NO: 47685 - DNA, 20 bp, Artificial Sequence
  chemically synthesized
ataacagtcctcatggcctt

SEQ ID NO: 47686 - DNA, 20 bp, Artificial Sequence
  chemically synthesized
aatttacctaacattttttt

SEQ ID NO: 47687 - DNA, 20 bp, Artificial Sequence
  chemically synthesized
caattttcttatatatgaat

SEQ ID NO: 47688 - DNA, 20 bp, Artificial Sequence
  chemically synthesized
ctccctcacaaacacattct

SEQ ID NO: 47689 - DNA, 20 bp, Artificial Sequence
  chemically synthesized
caaacacattctaagatttt

SEQ ID NO: 47690 - DNA, 20 bp, Artificial Sequence
  chemically synthesized
aaacacattctaagatttta

SEQ ID NO: 47691 - DNA, 20 bp, Artificial Sequence
  chemically synthesized
acacattctaagattttaag

SEQ ID NO: 47692 - DNA, 20 bp, Artificial Sequence
  chemically synthesized
attttaaggagatattgatg

SEQ ID NO: 47693 - DNA, 20 bp, Artificial Sequence
  chemically synthesized
acatcatctgtcatttttaa

SEQ ID NO: 47694 - DNA, 20 bp, Artificial Sequence
  chemically synthesized
catcatctgtcatttttaac

SEQ ID NO: 47695 - DNA, 20 bp, Artificial Sequence
  chemically synthesized
catctgtcatttttaacagg

SEQ ID NO: 47696 - DNA, 20 bp, Artificial Sequence
  chemically synthesized
ctgtcatttttaacaggtag

SEQ ID NO: 47697 - DNA, 20 bp, Artificial Sequence
  chemically synthesized
tcatttttaacaggtagtgg

SEQ ID NO: 47698 - DNA, 20 bp, Artificial Sequence
  chemically synthesized
ggtagtggtagtgattcaca

SEQ ID NO: 47699 - DNA, 20 bp, Artificial Sequence
  chemically synthesized
tccattctgtattcttgacc

SEQ ID NO: 47700 - DNA, 20 bp, Artificial Sequence
  chemically synthesized
gacctggttgtattctttct

SEQ ID NO: 47701 - DNA, 20 bp, Artificial Sequence
  chemically synthesized
gttgtattctttctgagctc

SEQ ID NO: 47702 - DNA, 20 bp, Artificial Sequence
  chemically synthesized
agctccagatccacatatct

SEQ ID NO: 47703 - DNA, 20 bp, Artificial Sequence
  chemically synthesized
tacatctttttgcattttac

SEQ ID NO: 47704 - DNA, 20 bp, Artificial Sequence
  chemically synthesized
catctttttgcattttacaa

SEQ ID NO: 47705 - DNA, 20 bp, Artificial Sequence
  chemically synthesized
gcatacaatacaatgtatcc

SEQ ID NO: 47706 - DNA, 20 bp, Artificial Sequence
  chemically synthesized
taccactaaactcacaaatg

SEQ ID NO: 47707 - DNA, 20 bp, Artificial Sequence
  chemically synthesized
cacgactgacatcaccgtca

SEQ ID NO: 47708 - DNA, 20 bp, Artificial Sequence
  chemically synthesized
tgacatcaccgtcatggtcc

SEQ ID NO: 47709 - DNA, 20 bp, Artificial Sequence
  chemically synthesized
tcatggtccaagtctgataa

SEQ ID NO: 47710 - DNA, 20 bp, Artificial Sequence
  chemically synthesized
tccaagtctgataatagaaa

SEQ ID NO: 47711 - DNA, 20 bp, Artificial Sequence
  chemically synthesized
cactttcttccctactgcaa

SEQ ID NO: 47712 - DNA, 20 bp, Artificial Sequence
  chemically synthesized
tttcttccctactgcaacag

SEQ ID NO: 47713 - DNA, 20 bp, Artificial Sequence
  chemically synthesized
tccctactgcaacagaagcc

SEQ ID NO: 47714 - DNA, 20 bp, Artificial Sequence
  chemically synthesized
ctaaaatacatttcttcact

SEQ ID NO: 47715 - DNA, 20 bp, Artificial Sequence
  chemically synthesized
aatacatttcttcactaagt

SEQ ID NO: 47716 - DNA, 20 bp, Artificial Sequence
  chemically synthesized
taagtgagaataatctttta

SEQ ID NO: 47717 - DNA, 20 bp, Artificial Sequence
  chemically synthesized
aattattcaatatctttcgt

SEQ ID NO: 47718 - DNA, 20 bp, Artificial Sequence
  chemically synthesized
caatatctttcgttggcttc

SEQ ID NO: 47719 - DNA, 20 bp, Artificial Sequence
  chemically synthesized
aatatctttcgttggcttcc

SEQ ID NO: 47720 - DNA, 20 bp, Artificial Sequence
  chemically synthesized
tttcgttggcttccaggtta

SEQ ID NO: 47721 - DNA, 20 bp, Artificial Sequence
  chemically synthesized
cagaaaaataacttgtaaca

SEQ ID NO: 47722 - DNA, 20 bp, Artificial Sequence
  chemically synthesized
ataacttgtaacaaagttta

SEQ ID NO: 47723 - DNA, 20 bp, Artificial Sequence
  chemically synthesized
taacttgtaacaaagtttaa

SEQ ID NO: 47724 - DNA, 20 bp, Artificial Sequence
  chemically synthesized
caaagtttaaaggtcattca

SEQ ID NO: 47725 - DNA, 20 bp, Artificial Sequence
  chemically synthesized
ataacatttccccttgtgat

SEQ ID NO: 47726 - DNA, 20 bp, Artificial Sequence
  chemically synthesized
tccccttgtgatcagaatct

SEQ ID NO: 47727 - DNA, 20 bp, Artificial Sequence
  chemically synthesized
ccccttgtgatcagaatctc

SEQ ID NO: 47728 - DNA, 20 bp, Artificial Sequence
  chemically synthesized
catctttctatatacaaata

SEQ ID NO: 47729 - DNA, 20 bp, Artificial Sequence
  chemically synthesized
tatatacaaataaagtcata

SEQ ID NO: 47730 - DNA, 20 bp, Artificial Sequence
  chemically synthesized
atatagtttgaactcacctc

SEQ ID NO: 47731 - DNA, 20 bp, Artificial Sequence
  chemically synthesized
catttgtatcgctacgtgtt

SEQ ID NO: 47732 - DNA, 20 bp, Artificial Sequence
  chemically synthesized
ttgtatcgctacgtgttaag

SEQ ID NO: 47733 - DNA, 20 bp, Artificial Sequence
  chemically synthesized
tatcgctacgtgttaagcag

SEQ ID NO: 47734 - DNA, 20 bp, Artificial Sequence
  chemically synthesized
taatttatcaattctactgt

SEQ ID NO: 47735 - DNA, 20 bp, Artificial Sequence
  chemically synthesized
ttatcaattctactgttggt

SEQ ID NO: 47736 - DNA, 20 bp, Artificial Sequence
  chemically synthesized
tctactgttggtaagcattt

SEQ ID NO: 47737 - DNA, 20 bp, Artificial Sequence
  chemically synthesized
actgttggtaagcatttaag

SEQ ID NO: 47738 - DNA, 20 bp, Artificial Sequence
  chemically synthesized
gtaagcatttaagtggctac

SEQ ID NO: 47739 - DNA, 20 bp, Artificial Sequence
  chemically synthesized
atttaagtggctaccggttt

SEQ ID NO: 47740 - DNA, 20 bp, Artificial Sequence
  chemically synthesized
tttaagtggctaccggtttg

SEQ ID NO: 47741 - DNA, 20 bp, Artificial Sequence
  chemically synthesized
tttatgattattgctgtcat

SEQ ID NO: 47742 - DNA, 20 bp, Artificial Sequence
  chemically synthesized
agcatttctatacatgtctt

SEQ ID NO: 47743 - DNA, 20 bp, Artificial Sequence
  chemically synthesized
atatctaaaaatgtaattgc

SEQ ID NO: 47744 - DNA, 20 bp, Artificial Sequence
  chemically synthesized
tatctaaaaatgtaattgct

SEQ ID NO: 47745 - DNA, 20 bp, Artificial Sequence
  chemically synthesized
aaaatgtaattgctaggtaa

SEQ ID NO: 47746 - DNA, 20 bp, Artificial Sequence
  chemically synthesized
tgctaggtaatagacttatc

SEQ ID NO: 47747 - DNA, 20 bp, Artificial Sequence
  chemically synthesized
taatagacttatcaagcatc

SEQ ID NO: 47748 - DNA, 20 bp, Artificial Sequence
  chemically synthesized
tatcaagcatccagcatttg

SEQ ID NO: 47749 - DNA, 20 bp, Artificial Sequence
  chemically synthesized
agcatttgtggatactatta

SEQ ID NO: 47750 - DNA, 20 bp, Artificial Sequence
  chemically synthesized
gcatttgtggatactattaa

SEQ ID NO: 47751 - DNA, 20 bp, Artificial Sequence
  chemically synthesized
atactattaaaggttttcca

SEQ ID NO: 47752 - DNA, 20 bp, Artificial Sequence
  chemically synthesized
tactattaaaggttttccaa

SEQ ID NO: 47753 - DNA, 20 bp, Artificial Sequence
  chemically synthesized
actattaaaggttttccaaa

SEQ ID NO: 47754 - DNA, 20 bp, Artificial Sequence
  chemically synthesized
ctattaaaggttttccaaag

SEQ ID NO: 47755 - DNA, 20 bp, Artificial Sequence
  chemically synthesized
aaaggggttatactattgta

SEQ ID NO: 47756 - DNA, 20 bp, Artificial Sequence
  chemically synthesized
ctattgtacagtgtcaccaa

SEQ ID NO: 47757 - DNA, 20 bp, Artificial Sequence
  chemically synthesized
attgtacagtgtcaccaaca

SEQ ID NO: 47758 - DNA, 20 bp, Artificial Sequence
  chemically synthesized
cagtgtcaccaacagagttt

SEQ ID NO: 47759 - DNA, 20 bp, Artificial Sequence
  chemically synthesized
accaccaaaatttgaactgt

SEQ ID NO: 47760 - DNA, 20 bp, Artificial Sequence
  chemically synthesized
tttccttcaatccttccttt

SEQ ID NO: 47761 - DNA, 20 bp, Artificial Sequence
  chemically synthesized
cttccttttggatatgctca

SEQ ID NO: 47762 - DNA, 20 bp, Artificial Sequence
  chemically synthesized
ttccttttggatatgctcat

SEQ ID NO: 47763 - DNA, 20 bp, Artificial Sequence
  chemically synthesized
tgtgtatttgtctgccattg

SEQ ID NO: 47764 - DNA, 20 bp, Artificial Sequence
  chemically synthesized
attgtggcattatttgaatt

SEQ ID NO: 47765 - DNA, 20 bp, Artificial Sequence
  chemically synthesized
ggcattatttgaattcagaa

SEQ ID NO: 47766 - DNA, 20 bp, Artificial Sequence
  chemically synthesized
cattatttgaattcagaaaa

SEQ ID NO: 47767 - DNA, 20 bp, Artificial Sequence
  chemically synthesized
agaaaagagtgaaaaactac

SEQ ID NO: 47768 - DNA, 20 bp, Artificial Sequence
  chemically synthesized
gaaaagagtgaaaaactact

SEQ ID NO: 47769 - DNA, 20 bp, Artificial Sequence
  chemically synthesized
actactgggatcttcattcc

SEQ ID NO: 47770 - DNA, 20 bp, Artificial Sequence
  chemically synthesized
ctactgggatcttcattcct

SEQ ID NO: 47771 - DNA, 20 bp, Artificial Sequence
  chemically synthesized
ctaattccacattttttttt

SEQ ID NO: 47772 - DNA, 20 bp, Artificial Sequence
  chemically synthesized
tctgtaaaaatgttctgtac

SEQ ID NO: 47773 - DNA, 20 bp, Artificial Sequence
  chemically synthesized
gttctgtactagcatattcc

SEQ ID NO: 47774 - DNA, 20 bp, Artificial Sequence
  chemically synthesized
ttctgtactagcatattccc

SEQ ID NO: 47775 - DNA, 20 bp, Artificial Sequence
  chemically synthesized
gaacttcgttaaatttaatc

SEQ ID NO: 47776 - DNA, 20 bp, Artificial Sequence
  chemically synthesized
aaatttaatctggctgaata

SEQ ID NO: 47777 - DNA, 20 bp, Artificial Sequence
  chemically synthesized
ttcactttgcattctttctt

SEQ ID NO: 47778 - DNA, 20 bp, Artificial Sequence
  chemically synthesized
aaccttaaaattcatgtttc

SEQ ID NO: 47779 - DNA, 20 bp, Artificial Sequence
  chemically synthesized
ccagaacctatttcaataac

SEQ ID NO: 47780 - DNA, 20 bp, Artificial Sequence
  chemically synthesized
ttttttaaatattcttttaa

SEQ ID NO: 47781 - DNA, 20 bp, Artificial Sequence
  chemically synthesized
atttcaatataataaaaaat

SEQ ID NO: 47782 - DNA, 20 bp, Artificial Sequence
  chemically synthesized
ttcaatataataaaaaatta

SEQ ID NO: 47783 - DNA, 20 bp, Artificial Sequence
  chemically synthesized
aaaaaattagagttttatta

SEQ ID NO: 47784 - DNA, 20 bp, Artificial Sequence
  chemically synthesized
aaaaattagagttttattat

SEQ ID NO: 47785 - DNA, 20 bp, Artificial Sequence
  chemically synthesized
aattagagttttattatagg

SEQ ID NO: 47786 - DNA, 20 bp, Artificial Sequence
  chemically synthesized
ttataggaagaatttaccaa

SEQ ID NO: 47787 - DNA, 20 bp, Artificial Sequence
  chemically synthesized
taggaagaatttaccaaaag

SEQ ID NO: 47788 - DNA, 20 bp, Artificial Sequence
  chemically synthesized
aggaagaatttaccaaaaga

SEQ ID NO: 47789 - DNA, 20 bp, Artificial Sequence
  chemically synthesized
gaagaatttaccaaaagaag

SEQ ID NO: 47790 - DNA, 20 bp, Artificial Sequence
  chemically synthesized
aagaatttaccaaaagaagg

SEQ ID NO: 47791 - DNA, 20 bp, Artificial Sequence
  chemically synthesized
aatttaccaaaagaaggagg

SEQ ID NO: 47792 - DNA, 20 bp, Artificial Sequence
  chemically synthesized
taccaaaagaaggaggaagc

SEQ ID NO: 47793 - DNA, 20 bp, Artificial Sequence
  chemically synthesized
aaaagaaggaggaagcaagc

SEQ ID NO: 47794 - DNA, 20 bp, Artificial Sequence
  chemically synthesized
aagcaagcaagtttaaactg

SEQ ID NO: 47795 - DNA, 20 bp, Artificial Sequence
  chemically synthesized
gcaagtttaaactgcagcaa

SEQ ID NO: 47796 - DNA, 20 bp, Artificial Sequence
  chemically synthesized
ccaacctctcaaaattccct

SEQ ID NO: 47797 - DNA, 20 bp, Artificial Sequence
  chemically synthesized
aacctctcaaaattcccttg

SEQ ID NO: 47798 - DNA, 20 bp, Artificial Sequence
  chemically synthesized
cccttggagacaaaaatctc

SEQ ID NO: 47799 - DNA, 20 bp, Artificial Sequence
  chemically synthesized
cttggagacaaaaatctcta

SEQ ID NO: 47800 - DNA, 20 bp, Artificial Sequence
  chemically synthesized
ttggagacaaaaatctctag

SEQ ID NO: 47801 - DNA, 20 bp, Artificial Sequence
  chemically synthesized
gacaaaaatctctagaggca

SEQ ID NO: 47802 - DNA, 20 bp, Artificial Sequence
  chemically synthesized
aaaaatctctagaggcaaag

SEQ ID NO: 47803 - DNA, 20 bp, Artificial Sequence
  chemically synthesized
gcaaagaagaactttatatt

SEQ ID NO: 47804 - DNA, 20 bp, Artificial Sequence
  chemically synthesized
cttgttaaaacatctgcttt

SEQ ID NO: 47805 - DNA, 20 bp, Artificial Sequence
  chemically synthesized
taaaacatctgcttttagat

SEQ ID NO: 47806 - DNA, 20 bp, Artificial Sequence
  chemically synthesized
tgcttttagataagttttct

SEQ ID NO: 47807 - DNA, 20 bp, Artificial Sequence
  chemically synthesized
agataagttttcttagtata

SEQ ID NO: 47808 - DNA, 20 bp, Artificial Sequence
  chemically synthesized
gttttcttagtataaagtga

SEQ ID NO: 47809 - DNA, 20 bp, Artificial Sequence
  chemically synthesized
ataaagtgacagaaacaaat

SEQ ID NO: 47810 - DNA, 20 bp, Artificial Sequence
  chemically synthesized
aaacaaataagttaaactct

SEQ ID NO: 47811 - DNA, 20 bp, Artificial Sequence
  chemically synthesized
taagatacattccactatat

SEQ ID NO: 47812 - DNA, 20 bp, Artificial Sequence
  chemically synthesized
cacttctgcaaaaatgaaac

SEQ ID NO: 47813 - DNA, 20 bp, Artificial Sequence
  chemically synthesized
acttctgcaaaaatgaaact

SEQ ID NO: 47814 - DNA, 20 bp, Artificial Sequence
  chemically synthesized
ttctgcaaaaatgaaactag

SEQ ID NO: 47815 - DNA, 20 bp, Artificial Sequence
  chemically synthesized
tctgcaaaaatgaaactagg

SEQ ID NO: 47816 - DNA, 20 bp, Artificial Sequence
  chemically synthesized
tgaaactaggaggatatttt

SEQ ID NO: 47817 - DNA, 20 bp, Artificial Sequence
  chemically synthesized
tttttagaaacaactgctga

SEQ ID NO: 47818 - DNA, 20 bp, Artificial Sequence
  chemically synthesized
tttagaaacaactgctgaaa

SEQ ID NO: 47819 - DNA, 20 bp, Artificial Sequence
  chemically synthesized
aacaactgctgaaagagatg

SEQ ID NO: 47820 - DNA, 20 bp, Artificial Sequence
  chemically synthesized
aactgctgaaagagatgcgg

SEQ ID NO: 47821 - DNA, 20 bp, Artificial Sequence
  chemically synthesized
actgctgaaagagatgcggt

SEQ ID NO: 47822 - DNA, 20 bp, Artificial Sequence
  chemically synthesized
ctgctgaaagagatgcggtg

SEQ ID NO: 47823 - DNA, 20 bp, Artificial Sequence
  chemically synthesized
gctgaaagagatgcggtggg

SEQ ID NO: 47824 - DNA, 20 bp, Artificial Sequence
  chemically synthesized
agatgcggtggggagatatg

SEQ ID NO: 47825 - DNA, 20 bp, Artificial Sequence
  chemically synthesized
atgcggtggggagatatgta

SEQ ID NO: 47826 - DNA, 20 bp, Artificial Sequence
  chemically synthesized
tgcggtggggagatatgtag

SEQ ID NO: 47827 - DNA, 20 bp, Artificial Sequence
  chemically synthesized
cggtggggagatatgtagag

SEQ ID NO: 47828 - DNA, 20 bp, Artificial Sequence
  chemically synthesized
gggagatatgtagaggagaa

SEQ ID NO: 47829 - DNA, 20 bp, Artificial Sequence
  chemically synthesized
ggagatatgtagaggagaac

SEQ ID NO: 47830 - DNA, 20 bp, Artificial Sequence
  chemically synthesized
gagatatgtagaggagaaca

SEQ ID NO: 47831 - DNA, 20 bp, Artificial Sequence
  chemically synthesized
tagaggagaacagggtttct

SEQ ID NO: 47832 - DNA, 20 bp, Artificial Sequence
  chemically synthesized
gagaacagggtttctgagtc

SEQ ID NO: 47833 - DNA, 20 bp, Artificial Sequence
  chemically synthesized
ctgagtcaagacacacatga

SEQ ID NO: 47834 - DNA, 20 bp, Artificial Sequence
  chemically synthesized
tcaagacacacatgacagaa

SEQ ID NO: 47835 - DNA, 20 bp, Artificial Sequence
  chemically synthesized
catgacagaacagccaatct

SEQ ID NO: 47836 - DNA, 20 bp, Artificial Sequence
  chemically synthesized
atgacagaacagccaatctc

SEQ ID NO: 47837 - DNA, 20 bp, Artificial Sequence
  chemically synthesized
tgacagaacagccaatctca

SEQ ID NO: 47838 - DNA, 20 bp, Artificial Sequence
  chemically synthesized
agaacagccaatctcagggc

SEQ ID NO: 47839 - DNA, 20 bp, Artificial Sequence
  chemically synthesized
agccaatctcagggcaagtt

SEQ ID NO: 47840 - DNA, 20 bp, Artificial Sequence
  chemically synthesized
gccaatctcagggcaagtta

SEQ ID NO: 47841 - DNA, 20 bp, Artificial Sequence
  chemically synthesized
ccaatctcagggcaagttaa

SEQ ID NO: 47842 - DNA, 20 bp, Artificial Sequence
  chemically synthesized
ctcagggcaagttaagggaa

SEQ ID NO: 47843 - DNA, 20 bp, Artificial Sequence
  chemically synthesized
agggcaagttaagggaatag

SEQ ID NO: 47844 - DNA, 20 bp, Artificial Sequence
  chemically synthesized
gttaagggaatagtggaatg

SEQ ID NO: 47845 - DNA, 20 bp, Artificial Sequence
  chemically synthesized
ttaagggaatagtggaatga

SEQ ID NO: 47846 - DNA, 20 bp, Artificial Sequence
  chemically synthesized
tcttaaaccaacctgctcac

SEQ ID NO: 47847 - DNA, 20 bp, Artificial Sequence
  chemically synthesized
ttaaaccaacctgctcactg

SEQ ID NO: 47848 - DNA, 20 bp, Artificial Sequence
  chemically synthesized
aaccaacctgctcactggag

SEQ ID NO: 47849 - DNA, 20 bp, Artificial Sequence
  chemically synthesized
accaacctgctcactggagc

SEQ ID NO: 47850 - DNA, 20 bp, Artificial Sequence
  chemically synthesized
ccaacctgctcactggagca

SEQ ID NO: 47851 - DNA, 20 bp, Artificial Sequence
  chemically synthesized
aacctgctcactggagcagg

SEQ ID NO: 47852 - DNA, 20 bp, Artificial Sequence
  chemically synthesized
acctgctcactggagcaggg

SEQ ID NO: 47853 - DNA, 20 bp, Artificial Sequence
  chemically synthesized
gctcactggagcagggagga

SEQ ID NO: 47854 - DNA, 20 bp, Artificial Sequence
  chemically synthesized
ctcactggagcagggaggac

SEQ ID NO: 47855 - DNA, 20 bp, Artificial Sequence
  chemically synthesized
tggagcagggaggacaggac

SEQ ID NO: 47856 - DNA, 20 bp, Artificial Sequence
  chemically synthesized
ggaggacaggaccagcataa

SEQ ID NO: 47857 - DNA, 20 bp, Artificial Sequence
  chemically synthesized
gaggacaggaccagcataaa

SEQ ID NO: 47858 - DNA, 20 bp, Artificial Sequence
  chemically synthesized
gacaggaccagcataaaagg

SEQ ID NO: 47859 - DNA, 20 bp, Artificial Sequence
  chemically synthesized
acaggaccagcataaaaggc

SEQ ID NO: 47860 - DNA, 20 bp, Artificial Sequence
  chemically synthesized
caggaccagcataaaaggca

SEQ ID NO: 47861 - DNA, 20 bp, Artificial Sequence
  chemically synthesized
gaccagcataaaaggcaggg

SEQ ID NO: 47862 - DNA, 20 bp, Artificial Sequence
  chemically synthesized
ccagcataaaaggcagggca

SEQ ID NO: 47863 - DNA, 20 bp, Artificial Sequence
  chemically synthesized
tacactttcttctgacataa

SEQ ID NO: 47864 - DNA, 20 bp, Artificial Sequence
  chemically synthesized
tctgacataacagtgttcac

SEQ ID NO: 47865 - DNA, 20 bp, Artificial Sequence
  chemically synthesized
tgttcactagcaacctcaaa

SEQ ID NO: 47866 - DNA, 20 bp, Artificial Sequence
  chemically synthesized
gcaacctcaaacagacacca

SEQ ID NO: 47867 - DNA, 20 bp, Artificial Sequence
  chemically synthesized
ccatggtgcatctgactcct

SEQ ID NO: 47868 - DNA, 20 bp, Artificial Sequence
  chemically synthesized
catggtgcatctgactcctg

SEQ ID NO: 47869 - DNA, 20 bp, Artificial Sequence
  chemically synthesized
tggtgcatctgactcctgag

SEQ ID NO: 47870 - DNA, 20 bp, Artificial Sequence
  chemically synthesized
tgcatctgactcctgaggag

SEQ ID NO: 47871 - DNA, 20 bp, Artificial Sequence
  chemically synthesized
agactgctgtcaatgccctg

SEQ ID NO: 47872 - DNA, 20 bp, Artificial Sequence
  chemically synthesized
gactgctgtcaatgccctgt

SEQ ID NO: 47873 - DNA, 20 bp, Artificial Sequence
  chemically synthesized
actgctgtcaatgccctgtg

SEQ ID NO: 47874 - DNA, 20 bp, Artificial Sequence
  chemically synthesized
tgtcaatgccctgtggggca

SEQ ID NO: 47875 - DNA, 20 bp, Artificial Sequence
  chemically synthesized
cctgtggggcaaagtgaacg

SEQ ID NO: 47876 - DNA, 20 bp, Artificial Sequence
  chemically synthesized
gggcaaagtgaacgtggatg

SEQ ID NO: 47877 - DNA, 20 bp, Artificial Sequence
  chemically synthesized
aaagtgaacgtggatgcagt

SEQ ID NO: 47878 - DNA, 20 bp, Artificial Sequence
  chemically synthesized
gtgaacgtggatgcagttgg

SEQ ID NO: 47879 - DNA, 20 bp, Artificial Sequence
  chemically synthesized
acgtggatgcagttggtggt

SEQ ID NO: 47880 - DNA, 20 bp, Artificial Sequence
  chemically synthesized
cgtggatgcagttggtggtg

SEQ ID NO: 47881 - DNA, 20 bp, Artificial Sequence
  chemically synthesized
tgcagttggtggtgaggccc

SEQ ID NO: 47882 - DNA, 20 bp, Artificial Sequence
  chemically synthesized
gcagttggtggtgaggccct

SEQ ID NO: 47883 - DNA, 20 bp, Artificial Sequence
  chemically synthesized
gttggtggtgaggccctggg

SEQ ID NO: 47884 - DNA, 20 bp, Artificial Sequence
  chemically synthesized
ttggtggtgaggccctgggc

SEQ ID NO: 47885 - DNA, 20 bp, Artificial Sequence
  chemically synthesized
tggtgaggccctgggcaggt

SEQ ID NO: 47886 - DNA, 20 bp, Artificial Sequence
  chemically synthesized
gccctgggcaggttggtatc

SEQ ID NO: 47887 - DNA, 20 bp, Artificial Sequence
  chemically synthesized
ccctgggcaggttggtatca

SEQ ID NO: 47888 - DNA, 20 bp, Artificial Sequence
  chemically synthesized
caggttggtatcaaggttat

SEQ ID NO: 47889 - DNA, 20 bp, Artificial Sequence
  chemically synthesized
ggttggtatcaaggttataa

SEQ ID NO: 47890 - DNA, 20 bp, Artificial Sequence
  chemically synthesized
ttggtatcaaggttataaga

SEQ ID NO: 47891 - DNA, 20 bp, Artificial Sequence
  chemically synthesized
tggtatcaaggttataagag

SEQ ID NO: 47892 - DNA, 20 bp, Artificial Sequence
  chemically synthesized
caaggttataagagaggctc

SEQ ID NO: 47893 - DNA, 20 bp, Artificial Sequence
  chemically synthesized
aaggttataagagaggctca

SEQ ID NO: 47894 - DNA, 20 bp, Artificial Sequence
  chemically synthesized
ggttataagagaggctcaag

SEQ ID NO: 47895 - DNA, 20 bp, Artificial Sequence
  chemically synthesized
gttataagagaggctcaagg

SEQ ID NO: 47896 - DNA, 20 bp, Artificial Sequence
  chemically synthesized
gagaggctcaaggaggcaaa

SEQ ID NO: 47897 - DNA, 20 bp, Artificial Sequence
  chemically synthesized
tcaaggaggcaaatggaaac

SEQ ID NO: 47898 - DNA, 20 bp, Artificial Sequence
  chemically synthesized
caaggaggcaaatggaaact

SEQ ID NO: 47899 - DNA, 20 bp, Artificial Sequence
  chemically synthesized
aaatggaaactgggcatgtg

SEQ ID NO: 47900 - DNA, 20 bp, Artificial Sequence
  chemically synthesized
ggaaactgggcatgtgtaga

SEQ ID NO: 47901 - DNA, 20 bp, Artificial Sequence
  chemically synthesized
aaactgggcatgtgtagaca

SEQ ID NO: 47902 - DNA, 20 bp, Artificial Sequence
  chemically synthesized
ctgggcatgtgtagacagag

SEQ ID NO: 47903 - DNA, 20 bp, Artificial Sequence
  chemically synthesized
gtgtagacagagaagactct

SEQ ID NO: 47904 - DNA, 20 bp, Artificial Sequence
  chemically synthesized
tgtagacagagaagactctt

SEQ ID NO: 47905 - DNA, 20 bp, Artificial Sequence
  chemically synthesized
gaagactcttgggtttctga

SEQ ID NO: 47906 - DNA, 20 bp, Artificial Sequence
  chemically synthesized
aagactcttgggtttctgat

SEQ ID NO: 47907 - DNA, 20 bp, Artificial Sequence
  chemically synthesized
ggcactgactctctgtccct

SEQ ID NO: 47908 - DNA, 20 bp, Artificial Sequence
  chemically synthesized
gcactgactctctgtccctt

SEQ ID NO: 47909 - DNA, 20 bp, Artificial Sequence
  chemically synthesized
ttgggctgttttcctaccct

SEQ ID NO: 47910 - DNA, 20 bp, Artificial Sequence
  chemically synthesized
ttttcctaccctcagattac

SEQ ID NO: 47911 - DNA, 20 bp, Artificial Sequence
  chemically synthesized
tcctaccctcagattactgg

SEQ ID NO: 47912 - DNA, 20 bp, Artificial Sequence
  chemically synthesized
gattactggtggtctaccct

SEQ ID NO: 47913 - DNA, 20 bp, Artificial Sequence
  chemically synthesized
tggtggtctacccttggacc

SEQ ID NO: 47914 - DNA, 20 bp, Artificial Sequence
  chemically synthesized
gtggtctacccttggaccca

SEQ ID NO: 47915 - DNA, 20 bp, Artificial Sequence
  chemically synthesized
tggtctacccttggacccag

SEQ ID NO: 47916 - DNA, 20 bp, Artificial Sequence
  chemically synthesized
cttggacccagaggttcttt

SEQ ID NO: 47917 - DNA, 20 bp, Artificial Sequence
  chemically synthesized
cagaggttctttgagtcctt

SEQ ID NO: 47918 - DNA, 20 bp, Artificial Sequence
  chemically synthesized
agaggttctttgagtccttt

SEQ ID NO: 47919 - DNA, 20 bp, Artificial Sequence
  chemically synthesized
gaggttctttgagtcctttg

SEQ ID NO: 47920 - DNA, 20 bp, Artificial Sequence
  chemically synthesized
gtcctctcctgatgctgtta

SEQ ID NO: 47921 - DNA, 20 bp, Artificial Sequence
  chemically synthesized
tcctctcctgatgctgttat

SEQ ID NO: 47922 - DNA, 20 bp, Artificial Sequence
  chemically synthesized
atgctgttatgggcaaccct

SEQ ID NO: 47923 - DNA, 20 bp, Artificial Sequence
  chemically synthesized
tgctgttatgggcaacccta

SEQ ID NO: 47924 - DNA, 20 bp, Artificial Sequence
  chemically synthesized
ttatgggcaaccctaaggtg

SEQ ID NO: 47925 - DNA, 20 bp, Artificial Sequence
  chemically synthesized
tatgggcaaccctaaggtga

SEQ ID NO: 47926 - DNA, 20 bp, Artificial Sequence
  chemically synthesized
aaccctaaggtgaaggctca

SEQ ID NO: 47927 - DNA, 20 bp, Artificial Sequence
  chemically synthesized
ctaaggtgaaggctcatggc

SEQ ID NO: 47928 - DNA, 20 bp, Artificial Sequence
  chemically synthesized
aggtgaaggctcatggcaag

SEQ ID NO: 47929 - DNA, 20 bp, Artificial Sequence
  chemically synthesized
ggtgaaggctcatggcaaga

SEQ ID NO: 47930 - DNA, 20 bp, Artificial Sequence
  chemically synthesized
ggctcatggcaagaaggtgc

SEQ ID NO: 47931 - DNA, 20 bp, Artificial Sequence
  chemically synthesized
gctcatggcaagaaggtgct

SEQ ID NO: 47932 - DNA, 20 bp, Artificial Sequence
  chemically synthesized
aagaaggtgctaggtgcctt

SEQ ID NO: 47933 - DNA, 20 bp, Artificial Sequence
  chemically synthesized
gtgctaggtgcctttagtga

SEQ ID NO: 47934 - DNA, 20 bp, Artificial Sequence
  chemically synthesized
aggtgcctttagtgatggcc

SEQ ID NO: 47935 - DNA, 20 bp, Artificial Sequence
  chemically synthesized
tagtgatggcctggctcacc

SEQ ID NO: 47936 - DNA, 20 bp, Artificial Sequence
  chemically synthesized
tggctcacctggacaacctc

SEQ ID NO: 47937 - DNA, 20 bp, Artificial Sequence
  chemically synthesized
ggctcacctggacaacctca

SEQ ID NO: 47938 - DNA, 20 bp, Artificial Sequence
  chemically synthesized
gctcacctggacaacctcaa

SEQ ID NO: 47939 - DNA, 20 bp, Artificial Sequence
  chemically synthesized
acctcaagggcactttttct

SEQ ID NO: 47940 - DNA, 20 bp, Artificial Sequence
  chemically synthesized
aagggcactttttctcagct

SEQ ID NO: 47941 - DNA, 20 bp, Artificial Sequence
  chemically synthesized
gcactttttctcagctgagt

SEQ ID NO: 47942 - DNA, 20 bp, Artificial Sequence
  chemically synthesized
tgagtgagctgcactgtgac

SEQ ID NO: 47943 - DNA, 20 bp, Artificial Sequence
  chemically synthesized
gcactgtgacaagctgcacg

SEQ ID NO: 47944 - DNA, 20 bp, Artificial Sequence
  chemically synthesized
acaagctgcacgtggatcct

SEQ ID NO: 47945 - DNA, 20 bp, Artificial Sequence
  chemically synthesized
cacgtggatcctgagaactt

SEQ ID NO: 47946 - DNA, 20 bp, Artificial Sequence
  chemically synthesized
acgtggatcctgagaacttc

SEQ ID NO: 47947 - DNA, 20 bp, Artificial Sequence
  chemically synthesized
cgtggatcctgagaacttca

SEQ ID NO: 47948 - DNA, 20 bp, Artificial Sequence
  chemically synthesized
gatcctgagaacttcagggt

SEQ ID NO: 47949 - DNA, 20 bp, Artificial Sequence
  chemically synthesized
tgagaacttcagggtgagtc

SEQ ID NO: 47950 - DNA, 20 bp, Artificial Sequence
  chemically synthesized
gagaacttcagggtgagtcc

SEQ ID NO: 47951 - DNA, 20 bp, Artificial Sequence
  chemically synthesized
gaacttcagggtgagtccag

SEQ ID NO: 47952 - DNA, 20 bp, Artificial Sequence
  chemically synthesized
tactttctaatcttacattt

SEQ ID NO: 47953 - DNA, 20 bp, Artificial Sequence
  chemically synthesized
acaactcaaattatgcatac

SEQ ID NO: 47954 - DNA, 20 bp, Artificial Sequence
  chemically synthesized
tcacctgctaattctgcact

SEQ ID NO: 47955 - DNA, 20 bp, Artificial Sequence
  chemically synthesized
aatccttttgtctctccaca

SEQ ID NO: 47956 - DNA, 20 bp, Artificial Sequence
  chemically synthesized
atccttttgtctctccacat

SEQ ID NO: 47957 - DNA, 20 bp, Artificial Sequence
  chemically synthesized
tttgtctctccacatgggta

SEQ ID NO: 47958 - DNA, 20 bp, Artificial Sequence
  chemically synthesized
ttgtctctccacatgggtat

SEQ ID NO: 47959 - DNA, 20 bp, Artificial Sequence
  chemically synthesized
gtctctccacatgggtatgg

SEQ ID NO: 47960 - DNA, 20 bp, Artificial Sequence
  chemically synthesized
ctctccacatgggtatggga

SEQ ID NO: 47961 - DNA, 20 bp, Artificial Sequence
  chemically synthesized
tctccacatgggtatgggag

SEQ ID NO: 47962 - DNA, 20 bp, Artificial Sequence
  chemically synthesized
atgggagaggctccaactca

SEQ ID NO: 47963 - DNA, 20 bp, Artificial Sequence
  chemically synthesized
agaggctccaactcaaagat

SEQ ID NO: 47964 - DNA, 20 bp, Artificial Sequence
  chemically synthesized
aggctccaactcaaagatga

SEQ ID NO: 47965 - DNA, 20 bp, Artificial Sequence
  chemically synthesized
ggctccaactcaaagatgag

SEQ ID NO: 47966 - DNA, 20 bp, Artificial Sequence
  chemically synthesized
caactcaaagatgagaggca

SEQ ID NO: 47967 - DNA, 20 bp, Artificial Sequence
  chemically synthesized
agaggcatagaatactgttt

SEQ ID NO: 47968 - DNA, 20 bp, Artificial Sequence
  chemically synthesized
aggcatagaatactgtttta

SEQ ID NO: 47969 - DNA, 20 bp, Artificial Sequence
  chemically synthesized
ggcatagaatactgttttag

SEQ ID NO: 47970 - DNA, 20 bp, Artificial Sequence
  chemically synthesized
gctataaatcattttacaat

SEQ ID NO: 47971 - DNA, 20 bp, Artificial Sequence
  chemically synthesized
ctataaatcattttacaata

SEQ ID NO: 47972 - DNA, 20 bp, Artificial Sequence
  chemically synthesized
attttacaataaggaataat

SEQ ID NO: 47973 - DNA, 20 bp, Artificial Sequence
  chemically synthesized
ttggaattttataaattctg

SEQ ID NO: 47974 - DNA, 20 bp, Artificial Sequence
  chemically synthesized
tttataaattctgtagtaaa

SEQ ID NO: 47975 - DNA, 20 bp, Artificial Sequence
  chemically synthesized
aaattctgtagtaaatggaa

SEQ ID NO: 47976 - DNA, 20 bp, Artificial Sequence
  chemically synthesized
tctgtagtaaatggaatgga

SEQ ID NO: 47977 - DNA, 20 bp, Artificial Sequence
  chemically synthesized
ctgtagtaaatggaatggaa

SEQ ID NO: 47978 - DNA, 20 bp, Artificial Sequence
  chemically synthesized
agtaaatggaatggaaagga

SEQ ID NO: 47979 - DNA, 20 bp, Artificial Sequence
  chemically synthesized
aagtgaatatttgattatga

SEQ ID NO: 47980 - DNA, 20 bp, Artificial Sequence
  chemically synthesized
aatatttgattatgaaagac

SEQ ID NO: 47981 - DNA, 20 bp, Artificial Sequence
  chemically synthesized
atatttgattatgaaagact

SEQ ID NO: 47982 - DNA, 20 bp, Artificial Sequence
  chemically synthesized
tttgattatgaaagactagg

SEQ ID NO: 47983 - DNA, 20 bp, Artificial Sequence
  chemically synthesized
gaaagactaggcagttacac

SEQ ID NO: 47984 - DNA, 20 bp, Artificial Sequence
  chemically synthesized
aagactaggcagttacactg

SEQ ID NO: 47985 - DNA, 20 bp, Artificial Sequence
  chemically synthesized
agactaggcagttacactgg

SEQ ID NO: 47986 - DNA, 20 bp, Artificial Sequence
  chemically synthesized
ctaggcagttacactggagg

SEQ ID NO: 47987 - DNA, 20 bp, Artificial Sequence
  chemically synthesized
taggcagttacactggaggt

SEQ ID NO: 47988 - DNA, 20 bp, Artificial Sequence
  chemically synthesized
aggcagttacactggaggtg

SEQ ID NO: 47989 - DNA, 20 bp, Artificial Sequence
  chemically synthesized
cagttacactggaggtgggg

SEQ ID NO: 47990 - DNA, 20 bp, Artificial Sequence
  chemically synthesized
ttacactggaggtggggcag

SEQ ID NO: 47991 - DNA, 20 bp, Artificial Sequence
  chemically synthesized
ggtggggcagaagtcgttgc

SEQ ID NO: 47992 - DNA, 20 bp, Artificial Sequence
  chemically synthesized
gtggggcagaagtcgttgct

SEQ ID NO: 47993 - DNA, 20 bp, Artificial Sequence
  chemically synthesized
ggggcagaagtcgttgctag

SEQ ID NO: 47994 - DNA, 20 bp, Artificial Sequence
  chemically synthesized
cagaagtcgttgctaggaga

SEQ ID NO: 47995 - DNA, 20 bp, Artificial Sequence
  chemically synthesized
tgtatctattaatctgttta

SEQ ID NO: 47996 - DNA, 20 bp, Artificial Sequence
  chemically synthesized
atacaaaattaaaactaatt

SEQ ID NO: 47997 - DNA, 20 bp, Artificial Sequence
  chemically synthesized
atttggaattaatttgtata

SEQ ID NO: 47998 - DNA, 20 bp, Artificial Sequence
  chemically synthesized
aatttgtatatagtattata

SEQ ID NO: 47999 - DNA, 20 bp, Artificial Sequence
  chemically synthesized
atagtattatacagcatata

SEQ ID NO: 48000 - DNA, 20 bp, Artificial Sequence
  chemically synthesized
atagcatatatgtacatata

SEQ ID NO: 48001 - DNA, 20 bp, Artificial Sequence
  chemically synthesized
tacatatatagactacatgc

SEQ ID NO: 48002 - DNA, 20 bp, Artificial Sequence
  chemically synthesized
atatagactacatgctagtt

SEQ ID NO: 48003 - DNA, 20 bp, Artificial Sequence
  chemically synthesized
ctacatgctagttaagtaca

SEQ ID NO: 48004 - DNA, 20 bp, Artificial Sequence
  chemically synthesized
acatgctagttaagtacata

SEQ ID NO: 48005 - DNA, 20 bp, Artificial Sequence
  chemically synthesized
catgctagttaagtacatag

SEQ ID NO: 48006 - DNA, 20 bp, Artificial Sequence
  chemically synthesized
acatagaggatgtgtgtgta

SEQ ID NO: 48007 - DNA, 20 bp, Artificial Sequence
  chemically synthesized
tatgtacttatttatgctga

SEQ ID NO: 48008 - DNA, 20 bp, Artificial Sequence
  chemically synthesized
atgtacttatttatgctgat

SEQ ID NO: 48009 - DNA, 20 bp, Artificial Sequence
  chemically synthesized
ttatgctgatgggaataacc

SEQ ID NO: 48010 - DNA, 20 bp, Artificial Sequence
  chemically synthesized
tatgctgatgggaataacct

SEQ ID NO: 48011 - DNA, 20 bp, Artificial Sequence
  chemically synthesized
atgctgatgggaataacctg

SEQ ID NO: 48012 - DNA, 20 bp, Artificial Sequence
  chemically synthesized
gatgggaataacctggggat

SEQ ID NO: 48013 - DNA, 20 bp, Artificial Sequence
  chemically synthesized
cctggggatcagttttgtct

SEQ ID NO: 48014 - DNA, 20 bp, Artificial Sequence
  chemically synthesized
gatcagttttgtctaagatt

SEQ ID NO: 48015 - DNA, 20 bp, Artificial Sequence
  chemically synthesized
atcagttttgtctaagattt

SEQ ID NO: 48016 - DNA, 20 bp, Artificial Sequence
  chemically synthesized
agttttgtctaagatttggg

SEQ ID NO: 48017 - DNA, 20 bp, Artificial Sequence
  chemically synthesized
aagatttgggcagaaaaaaa

SEQ ID NO: 48018 - DNA, 20 bp, Artificial Sequence
  chemically synthesized
agatttgggcagaaaaaaat

SEQ ID NO: 48019 - DNA, 20 bp, Artificial Sequence
  chemically synthesized
gggcagaaaaaaatgggtgt

SEQ ID NO: 48020 - DNA, 20 bp, Artificial Sequence
  chemically synthesized
gaaaaaaatgggtgttggct

SEQ ID NO: 48021 - DNA, 20 bp, Artificial Sequence
  chemically synthesized
tgggtgttggctcagtttct

SEQ ID NO: 48022 - DNA, 20 bp, Artificial Sequence
  chemically synthesized
gtgttggctcagtttctcag

SEQ ID NO: 48023 - DNA, 20 bp, Artificial Sequence
  chemically synthesized
tggctcagtttctcagaagc

SEQ ID NO: 48024 - DNA, 20 bp, Artificial Sequence
  chemically synthesized
atctgcctacctcttctccg

SEQ ID NO: 48025 - DNA, 20 bp, Artificial Sequence
  chemically synthesized
tacctcttctccgcagctct

SEQ ID NO: 48026 - DNA, 20 bp, Artificial Sequence
  chemically synthesized
acctcttctccgcagctctt

SEQ ID NO: 48027 - DNA, 20 bp, Artificial Sequence
  chemically synthesized
gcagctcttgggcaatgtgc

SEQ ID NO: 48028 - DNA, 20 bp, Artificial Sequence
  chemically synthesized
caatgtgctggtgtgtgtgc

SEQ ID NO: 48029 - DNA, 20 bp, Artificial Sequence
  chemically synthesized
tgtgtgctggcccgcaactt

SEQ ID NO: 48030 - DNA, 20 bp, Artificial Sequence
  chemically synthesized
tgctggcccgcaactttggc

SEQ ID NO: 48031 - DNA, 20 bp, Artificial Sequence
  chemically synthesized
gctggcccgcaactttggca

SEQ ID NO: 48032 - DNA, 20 bp, Artificial Sequence
  chemically synthesized
aggaattcaccccacaaatg

SEQ ID NO: 48033 - DNA, 20 bp, Artificial Sequence
  chemically synthesized
ggaattcaccccacaaatgc

SEQ ID NO: 48034 - DNA, 20 bp, Artificial Sequence
  chemically synthesized
cacaaatgcaggctgcctat

SEQ ID NO: 48035 - DNA, 20 bp, Artificial Sequence
  chemically synthesized
aaatgcaggctgcctatcag

SEQ ID NO: 48036 - DNA, 20 bp, Artificial Sequence
  chemically synthesized
aatgcaggctgcctatcaga

SEQ ID NO: 48037 - DNA, 20 bp, Artificial Sequence
  chemically synthesized
gcaggctgcctatcagaagg

SEQ ID NO: 48038 - DNA, 20 bp, Artificial Sequence
  chemically synthesized
ggctgcctatcagaaggtgg

SEQ ID NO: 48039 - DNA, 20 bp, Artificial Sequence
  chemically synthesized
gcctatcagaaggtggtggc

SEQ ID NO: 48040 - DNA, 20 bp, Artificial Sequence
  chemically synthesized
tcagaaggtggtggctggtg

SEQ ID NO: 48041 - DNA, 20 bp, Artificial Sequence
  chemically synthesized
ggctggtgtggctaatgccc

SEQ ID NO: 48042 - DNA, 20 bp, Artificial Sequence
  chemically synthesized
tggctaatgccctggctcac

SEQ ID NO: 48043 - DNA, 20 bp, Artificial Sequence
  chemically synthesized
cctggctcacaagtaccatt

SEQ ID NO: 48044 - DNA, 20 bp, Artificial Sequence
  chemically synthesized
cacaagtaccattgagatcc

SEQ ID NO: 48045 - DNA, 20 bp, Artificial Sequence
  chemically synthesized
gactgtttcctgataaccat

SEQ ID NO: 48046 - DNA, 20 bp, Artificial Sequence
  chemically synthesized
tgtttcctgataaccataag

SEQ ID NO: 48047 - DNA, 20 bp, Artificial Sequence
  chemically synthesized
ataagaagaccctatttccc

SEQ ID NO: 48048 - DNA, 20 bp, Artificial Sequence
  chemically synthesized
tagattctattttctgaact

SEQ ID NO: 48049 - DNA, 20 bp, Artificial Sequence
  chemically synthesized
agattctattttctgaactt

SEQ ID NO: 48050 - DNA, 20 bp, Artificial Sequence
  chemically synthesized
gggaacacaatgcctacttc

SEQ ID NO: 48051 - DNA, 20 bp, Artificial Sequence
  chemically synthesized
ggaacacaatgcctacttca

SEQ ID NO: 48052 - DNA, 20 bp, Artificial Sequence
  chemically synthesized
gaacacaatgcctacttcaa

SEQ ID NO: 48053 - DNA, 20 bp, Artificial Sequence
  chemically synthesized
caatgcctacttcaagggta

SEQ ID NO: 48054 - DNA, 20 bp, Artificial Sequence
  chemically synthesized
ggtatggcttctgcctaata

SEQ ID NO: 48055 - DNA, 20 bp, Artificial Sequence
  chemically synthesized
tctgcctaataaagaatgtt

SEQ ID NO: 48056 - DNA, 20 bp, Artificial Sequence
  chemically synthesized
acttatttcatttttttgtc

SEQ ID NO: 48057 - DNA, 20 bp, Artificial Sequence
  chemically synthesized
cttatttcatttttttgtcc

SEQ ID NO: 48058 - DNA, 20 bp, Artificial Sequence
  chemically synthesized
atttttttgtccaggtgtgt

SEQ ID NO: 48059 - DNA, 20 bp, Artificial Sequence
  chemically synthesized
tttttgtccaggtgtgtaag

SEQ ID NO: 48060 - DNA, 20 bp, Artificial Sequence
  chemically synthesized
ttttgtccaggtgtgtaaga

SEQ ID NO: 48061 - DNA, 20 bp, Artificial Sequence
  chemically synthesized
aggtgtgtaagaaggttcct

SEQ ID NO: 48062 - DNA, 20 bp, Artificial Sequence
  chemically synthesized
ggtgtgtaagaaggttcctg

SEQ ID NO: 48063 - DNA, 20 bp, Artificial Sequence
  chemically synthesized
agaaggttcctgaggctcta

SEQ ID NO: 48064 - DNA, 20 bp, Artificial Sequence
  chemically synthesized
ggttcctgaggctctacaga

SEQ ID NO: 48065 - DNA, 20 bp, Artificial Sequence
  chemically synthesized
gttcctgaggctctacagat

SEQ ID NO: 48066 - DNA, 20 bp, Artificial Sequence
  chemically synthesized
ttcctgaggctctacagata

SEQ ID NO: 48067 - DNA, 20 bp, Artificial Sequence
  chemically synthesized
cctgaggctctacagatagg

SEQ ID NO: 48068 - DNA, 20 bp, Artificial Sequence
  chemically synthesized
gagcacttgtttattttaca

SEQ ID NO: 48069 - DNA, 20 bp, Artificial Sequence
  chemically synthesized
gcacttgtttattttacaaa

SEQ ID NO: 48070 - DNA, 20 bp, Artificial Sequence
  chemically synthesized
tttattttacaaagagtaca

SEQ ID NO: 48071 - DNA, 20 bp, Artificial Sequence
  chemically synthesized
ttattttacaaagagtacat

SEQ ID NO: 48072 - DNA, 20 bp, Artificial Sequence
  chemically synthesized
ttacaaagagtacatgggaa

SEQ ID NO: 48073 - DNA, 20 bp, Artificial Sequence
  chemically synthesized
acaaagagtacatgggaaaa

SEQ ID NO: 48074 - DNA, 20 bp, Artificial Sequence
  chemically synthesized
gagtacatgggaaaagagaa

SEQ ID NO: 48075 - DNA, 20 bp, Artificial Sequence
  chemically synthesized
acatgggaaaagagaaaagc

SEQ ID NO: 48076 - DNA, 20 bp, Artificial Sequence
  chemically synthesized
catgggaaaagagaaaagca

SEQ ID NO: 48077 - DNA, 20 bp, Artificial Sequence
  chemically synthesized
atgggaaaagagaaaagcaa

SEQ ID NO: 48078 - DNA, 20 bp, Artificial Sequence
  chemically synthesized
gaaaagcaagggaaccgtac

SEQ ID NO: 48079 - DNA, 20 bp, Artificial Sequence
  chemically synthesized
aaaagcaagggaaccgtaca

SEQ ID NO: 48080 - DNA, 20 bp, Artificial Sequence
  chemically synthesized
ggaaccgtacaaggcattaa

SEQ ID NO: 48081 - DNA, 20 bp, Artificial Sequence
  chemically synthesized
gaaccgtacaaggcattaat

SEQ ID NO: 48082 - DNA, 20 bp, Artificial Sequence
  chemically synthesized
gggtgacacttctacctcca

SEQ ID NO: 48083 - DNA, 20 bp, Artificial Sequence
  chemically synthesized
gtgacacttctacctccaaa

SEQ ID NO: 48084 - DNA, 20 bp, Artificial Sequence
  chemically synthesized
acacttctacctccaaagag

SEQ ID NO: 48085 - DNA, 20 bp, Artificial Sequence
  chemically synthesized
tccaaagagcagaaattatc

SEQ ID NO: 48086 - DNA, 20 bp, Artificial Sequence
  chemically synthesized
tatcaagaactcttgataca

SEQ ID NO: 48087 - DNA, 20 bp, Artificial Sequence
  chemically synthesized
tcttgatacaaagataatac

SEQ ID NO: 48088 - DNA, 20 bp, Artificial Sequence
  chemically synthesized
caaagataatactggcactg

SEQ ID NO: 48089 - DNA, 20 bp, Artificial Sequence
  chemically synthesized
aagataatactggcactgca

SEQ ID NO: 48090 - DNA, 20 bp, Artificial Sequence
  chemically synthesized
agataatactggcactgcag

SEQ ID NO: 48091 - DNA, 20 bp, Artificial Sequence
  chemically synthesized
tactggcactgcagaggttc

SEQ ID NO: 48092 - DNA, 20 bp, Artificial Sequence
  chemically synthesized
actggcactgcagaggttct

SEQ ID NO: 48093 - DNA, 20 bp, Artificial Sequence
  chemically synthesized
ctggcactgcagaggttcta

SEQ ID NO: 48094 - DNA, 20 bp, Artificial Sequence
  chemically synthesized
gcactgcagaggttctaggg

SEQ ID NO: 48095 - DNA, 20 bp, Artificial Sequence
  chemically synthesized
ctagggaagacctcaaccct

SEQ ID NO: 48096 - DNA, 20 bp, Artificial Sequence
  chemically synthesized
aagacctcaaccctaagaca

SEQ ID NO: 48097 - DNA, 20 bp, Artificial Sequence
  chemically synthesized
caaccctaagacatagcctc

SEQ ID NO: 48098 - DNA, 20 bp, Artificial Sequence
  chemically synthesized
aaccctaagacatagcctca

SEQ ID NO: 48099 - DNA, 20 bp, Artificial Sequence
  chemically synthesized
accctaagacatagcctcaa

SEQ ID NO: 48100 - DNA, 20 bp, Artificial Sequence
  chemically synthesized
attaaactccaacaattact

SEQ ID NO: 48101 - DNA, 20 bp, Artificial Sequence
  chemically synthesized
gaaaataatgtgctcaatta

SEQ ID NO: 48102 - DNA, 20 bp, Artificial Sequence
  chemically synthesized
aaaataatgtgctcaattaa

SEQ ID NO: 48103 - DNA, 20 bp, Artificial Sequence
  chemically synthesized
taaaggcataatgattactc

SEQ ID NO: 48104 - DNA, 20 bp, Artificial Sequence
  chemically synthesized
cttcctttgcctgcacattg

SEQ ID NO: 48105 - DNA, 20 bp, Artificial Sequence
  chemically synthesized
ccataatactataccccatc

SEQ ID NO: 48106 - DNA, 20 bp, Artificial Sequence
  chemically synthesized
ccatcaagtgttcctgctcc

SEQ ID NO: 48107 - DNA, 20 bp, Artificial Sequence
  chemically synthesized
agtgttcctgctccaagaaa

SEQ ID NO: 48108 - DNA, 20 bp, Artificial Sequence
  chemically synthesized
cttcctcctcttacttgccc

SEQ ID NO: 48109 - DNA, 20 bp, Artificial Sequence
  chemically synthesized
tgccccagaacatctctgta

SEQ ID NO: 48110 - DNA, 20 bp, Artificial Sequence
  chemically synthesized
cctcttatcttcccatattt

SEQ ID NO: 48111 - DNA, 20 bp, Artificial Sequence
  chemically synthesized
tatcttcccatatttcagtc

SEQ ID NO: 48112 - DNA, 20 bp, Artificial Sequence
  chemically synthesized
cttgtgacctctcttgaccc

SEQ ID NO: 48113 - DNA, 20 bp, Artificial Sequence
  chemically synthesized
acacacactccgtgctttat

SEQ ID NO: 48114 - DNA, 20 bp, Artificial Sequence
  chemically synthesized
cctcatattaaattcatcaa

SEQ ID NO: 48115 - DNA, 20 bp, Artificial Sequence
  chemically synthesized
ctcatattaaattcatcaat

SEQ ID NO: 48116 - DNA, 20 bp, Artificial Sequence
  chemically synthesized
atattaaattcatcaatggg

SEQ ID NO: 48117 - DNA, 20 bp, Artificial Sequence
  chemically synthesized
taaattcatcaatgggcaga

SEQ ID NO: 48118 - DNA, 20 bp, Artificial Sequence
  chemically synthesized
cagaaagaaaatatttattc

SEQ ID NO: 48119 - DNA, 20 bp, Artificial Sequence
  chemically synthesized
aaaatatttattcaagaaaa

SEQ ID NO: 48120 - DNA, 20 bp, Artificial Sequence
  chemically synthesized
cagtgaatgaatgaacgaat

SEQ ID NO: 48121 - DNA, 20 bp, Artificial Sequence
  chemically synthesized
gaatgaacgaatgagtaaat

SEQ ID NO: 48122 - DNA, 20 bp, Artificial Sequence
  chemically synthesized
aatgagtaaatgagtaaatg

SEQ ID NO: 48123 - DNA, 20 bp, Artificial Sequence
  chemically synthesized
atgagtaaatgagtaaatga

SEQ ID NO: 48124 - DNA, 20 bp, Artificial Sequence
  chemically synthesized
ggaatgattattccttgctt

SEQ ID NO: 48125 - DNA, 20 bp, Artificial Sequence
  chemically synthesized
attccttgctttagaacttc

SEQ ID NO: 48126 - DNA, 20 bp, Artificial Sequence
  chemically synthesized
tgctttagaacttctggaat

SEQ ID NO: 48127 - DNA, 20 bp, Artificial Sequence
  chemically synthesized
ctttagaacttctggaatta

SEQ ID NO: 48128 - DNA, 20 bp, Artificial Sequence
  chemically synthesized
tttagaacttctggaattag

SEQ ID NO: 48129 - DNA, 20 bp, Artificial Sequence
  chemically synthesized
atattaataataccatcgca

SEQ ID NO: 48130 - DNA, 20 bp, Artificial Sequence
  chemically synthesized
tgttaatgctacaacataca

SEQ ID NO: 48131 - DNA, 20 bp, Artificial Sequence
  chemically synthesized
ttaatgctacaacatacaaa

SEQ ID NO: 48132 - DNA, 20 bp, Artificial Sequence
  chemically synthesized
taatgctacaacatacaaag

SEQ ID NO: 48133 - DNA, 20 bp, Artificial Sequence
  chemically synthesized
tgctacaacatacaaagagg

SEQ ID NO: 48134 - DNA, 20 bp, Artificial Sequence
  chemically synthesized
acatacaaagaggaagcatg

SEQ ID NO: 48135 - DNA, 20 bp, Artificial Sequence
  chemically synthesized
gcatgcagtaaacaaccgaa

SEQ ID NO: 48136 - DNA, 20 bp, Artificial Sequence
  chemically synthesized
agttatttcctttctgatca

SEQ ID NO: 48137 - DNA, 20 bp, Artificial Sequence
  chemically synthesized
gttatttcctttctgatcat

SEQ ID NO: 48138 - DNA, 20 bp, Artificial Sequence
  chemically synthesized
tatttcctttctgatcatag

SEQ ID NO: 48139 - DNA, 20 bp, Artificial Sequence
  chemically synthesized
ggagtaatatttttttcctt

SEQ ID NO: 48140 - DNA, 20 bp, Artificial Sequence
  chemically synthesized
cttgagcaccatttttgcca

SEQ ID NO: 48141 - DNA, 20 bp, Artificial Sequence
  chemically synthesized
ttgagcaccatttttgccat

SEQ ID NO: 48142 - DNA, 20 bp, Artificial Sequence
  chemically synthesized
atttttgccataggtaaaat

SEQ ID NO: 48143 - DNA, 20 bp, Artificial Sequence
  chemically synthesized
tttgccataggtaaaattag

SEQ ID NO: 48144 - DNA, 20 bp, Artificial Sequence
  chemically synthesized
ttgccataggtaaaattaga

SEQ ID NO: 48145 - DNA, 20 bp, Artificial Sequence
  chemically synthesized
ggtaaaattagaaggatttt

SEQ ID NO: 48146 - DNA, 20 bp, Artificial Sequence
  chemically synthesized
aaggatttttagaactttct

SEQ ID NO: 48147 - DNA, 20 bp, Artificial Sequence
  chemically synthesized
aacttacttgaatacctaaa

SEQ ID NO: 48148 - DNA, 20 bp, Artificial Sequence
  chemically synthesized
tgttgtttccttgtgtttga

SEQ ID NO: 48149 - DNA, 20 bp, Artificial Sequence
  chemically synthesized
tgtgtttgaaagtgctttca

SEQ ID NO: 48150 - DNA, 20 bp, Artificial Sequence
  chemically synthesized
agtaactctgtctgtactgc

SEQ ID NO: 48151 - DNA, 20 bp, Artificial Sequence
  chemically synthesized
aatatactgacaatgtgtta

SEQ ID NO: 48152 - DNA, 20 bp, Artificial Sequence
  chemically synthesized
tcacaacattttgaattgac

SEQ ID NO: 48153 - DNA, 20 bp, Artificial Sequence
  chemically synthesized
caacattttgaattgactgg

SEQ ID NO: 48154 - DNA, 20 bp, Artificial Sequence
  chemically synthesized
cattttgaattgactggcag

SEQ ID NO: 48155 - DNA, 20 bp, Artificial Sequence
  chemically synthesized
tttgaattgactggcagcag

SEQ ID NO: 48156 - DNA, 20 bp, Artificial Sequence
  chemically synthesized
tatatccatgtgttttcctt

SEQ ID NO: 48157 - DNA, 20 bp, Artificial Sequence
  chemically synthesized
tttccttaagtcattataca

SEQ ID NO: 48158 - DNA, 20 bp, Artificial Sequence
  chemically synthesized
ccttaagtcattatacatag

SEQ ID NO: 48159 - DNA, 20 bp, Artificial Sequence
  chemically synthesized
cttaagtcattatacatagt

SEQ ID NO: 48160 - DNA, 20 bp, Artificial Sequence
  chemically synthesized
cattatacatagtaggcact

SEQ ID NO: 48161 - DNA, 20 bp, Artificial Sequence
  chemically synthesized
agaactctttatatctgaat

SEQ ID NO: 48162 - DNA, 20 bp, Artificial Sequence
  chemically synthesized
ttatatctgaataagatatt

SEQ ID NO: 48163 - DNA, 20 bp, Artificial Sequence
  chemically synthesized
tatatctgaataagatattt

SEQ ID NO: 48164 - DNA, 20 bp, Artificial Sequence
  chemically synthesized
ataagatatttaggaaccac

SEQ ID NO: 48165 - DNA, 20 bp, Artificial Sequence
  chemically synthesized
ggaaccactggtttacatat

SEQ ID NO: 48166 - DNA, 20 bp, Artificial Sequence
  chemically synthesized
accactggtttacatatcag

SEQ ID NO: 48167 - DNA, 20 bp, Artificial Sequence
  chemically synthesized
actggtttacatatcagaag

SEQ ID NO: 48168 - DNA, 20 bp, Artificial Sequence
  chemically synthesized
tggtttacatatcagaagca

SEQ ID NO: 48169 - DNA, 20 bp, Artificial Sequence
  chemically synthesized
atatcagaagcagagctact

SEQ ID NO: 48170 - DNA, 20 bp, Artificial Sequence
  chemically synthesized
tatcagaagcagagctactc

SEQ ID NO: 48171 - DNA, 20 bp, Artificial Sequence
  chemically synthesized
atcagaagcagagctactca

SEQ ID NO: 48172 - DNA, 20 bp, Artificial Sequence
  chemically synthesized
cagagctactcagggcattt

SEQ ID NO: 48173 - DNA, 20 bp, Artificial Sequence
  chemically synthesized
agagctactcagggcatttt

SEQ ID NO: 48174 - DNA, 20 bp, Artificial Sequence
  chemically synthesized
gagctactcagggcattttg

SEQ ID NO: 48175 - DNA, 20 bp, Artificial Sequence
  chemically synthesized
ctactcagggcattttgggg

SEQ ID NO: 48176 - DNA, 20 bp, Artificial Sequence
  chemically synthesized
aagatcactttcacattcct

SEQ ID NO: 48177 - DNA, 20 bp, Artificial Sequence
  chemically synthesized
cactttcacattcctgagca

SEQ ID NO: 48178 - DNA, 20 bp, Artificial Sequence
  chemically synthesized
actttcacattcctgagcat

SEQ ID NO: 48179 - DNA, 20 bp, Artificial Sequence
  chemically synthesized
ctttcacattcctgagcata

SEQ ID NO: 48180 - DNA, 20 bp, Artificial Sequence
  chemically synthesized
tcacattcctgagcataggg

SEQ ID NO: 48181 - DNA, 20 bp, Artificial Sequence
  chemically synthesized
gagcatagggaagttctcat

SEQ ID NO: 48182 - DNA, 20 bp, Artificial Sequence
  chemically synthesized
gcatagggaagttctcataa

SEQ ID NO: 48183 - DNA, 20 bp, Artificial Sequence
  chemically synthesized
agggaagttctcataagagt

SEQ ID NO: 48184 - DNA, 20 bp, Artificial Sequence
  chemically synthesized
tcataagagtaagatattaa

SEQ ID NO: 48185 - DNA, 20 bp, Artificial Sequence
  chemically synthesized
cataagagtaagatattaaa

SEQ ID NO: 48186 - DNA, 20 bp, Artificial Sequence
  chemically synthesized
taagagtaagatattaaaag

SEQ ID NO: 48187 - DNA, 20 bp, Artificial Sequence
  chemically synthesized
attaaaaggagatacttgtg

SEQ ID NO: 48188 - DNA, 20 bp, Artificial Sequence
  chemically synthesized
gatacttgtgtggtattcga

SEQ ID NO: 48189 - DNA, 20 bp, Artificial Sequence
  chemically synthesized
cttgtgtggtattcgaaaga

SEQ ID NO: 48190 - DNA, 20 bp, Artificial Sequence
  chemically synthesized
tgtggtattcgaaagacagt

SEQ ID NO: 48191 - DNA, 20 bp, Artificial Sequence
  chemically synthesized
tggtattcgaaagacagtaa

SEQ ID NO: 48192 - DNA, 20 bp, Artificial Sequence
  chemically synthesized
gtattcgaaagacagtaaga

SEQ ID NO: 48193 - DNA, 20 bp, Artificial Sequence
  chemically synthesized
aaagacagtaagagagattg

SEQ ID NO: 48194 - DNA, 20 bp, Artificial Sequence
  chemically synthesized
tgtagaccttatgatcttga

SEQ ID NO: 48195 - DNA, 20 bp, Artificial Sequence
  chemically synthesized
gtagaccttatgatcttgat

SEQ ID NO: 48196 - DNA, 20 bp, Artificial Sequence
  chemically synthesized
tagaccttatgatcttgata

SEQ ID NO: 48197 - DNA, 20 bp, Artificial Sequence
  chemically synthesized
aactacattcctttctccaa

SEQ ID NO: 48198 - DNA, 20 bp, Artificial Sequence
  chemically synthesized
ttctccaaaagtcaaaaaaa

SEQ ID NO: 48199 - DNA, 20 bp, Artificial Sequence
  chemically synthesized
ctccaaaagtcaaaaaaaaa

SEQ ID NO: 48200 - DNA, 20 bp, Artificial Sequence
  chemically synthesized
tcaaaaaaaaagagcaaata

SEQ ID NO: 48201 - DNA, 20 bp, Artificial Sequence
  chemically synthesized
accttctattcctacaccat

SEQ ID NO: 48202 - DNA, 20 bp, Artificial Sequence
  chemically synthesized
ttctattcctacaccattag

SEQ ID NO: 48203 - DNA, 20 bp, Artificial Sequence
  chemically synthesized
tattcctacaccattagaag

SEQ ID NO: 48204 - DNA, 20 bp, Artificial Sequence
  chemically synthesized
cctacaccattagaagtagt

SEQ ID NO: 48205 - DNA, 20 bp, Artificial Sequence
  chemically synthesized
caccattagaagtagtcagt

SEQ ID NO: 48206 - DNA, 20 bp, Artificial Sequence
  chemically synthesized
ttagaagtagtcagtgagtc

SEQ ID NO: 48207 - DNA, 20 bp, Artificial Sequence
  chemically synthesized
tagaagtagtcagtgagtct

SEQ ID NO: 48208 - DNA, 20 bp, Artificial Sequence
  chemically synthesized
agtagtcagtgagtctaggc

SEQ ID NO: 48209 - DNA, 20 bp, Artificial Sequence
  chemically synthesized
agtgagtctaggcaagatgt

SEQ ID NO: 48210 - DNA, 20 bp, Artificial Sequence
  chemically synthesized
ggccctaaaaatccaaatac

SEQ ID NO: 48211 - DNA, 20 bp, Artificial Sequence
  chemically synthesized
ccctaaaaatccaaatacca

SEQ ID NO: 48212 - DNA, 20 bp, Artificial Sequence
  chemically synthesized
ccaaataccagagaattcat

SEQ ID NO: 48213 - DNA, 20 bp, Artificial Sequence
  chemically synthesized
gaattcatgagaacatcacc

SEQ ID NO: 48214 - DNA, 20 bp, Artificial Sequence
  chemically synthesized
tcatgagaacatcacctgga

SEQ ID NO: 48215 - DNA, 20 bp, Artificial Sequence
  chemically synthesized
catgagaacatcacctggat

SEQ ID NO: 48216 - DNA, 20 bp, Artificial Sequence
  chemically synthesized
acctggatgggacatgtgcc

SEQ ID NO: 48217 - DNA, 20 bp, Artificial Sequence
  chemically synthesized
cacacacaattactatatgc

SEQ ID NO: 48218 - DNA, 20 bp, Artificial Sequence
  chemically synthesized
acacacaattactatatgct

SEQ ID NO: 48219 - DNA, 20 bp, Artificial Sequence
  chemically synthesized
gcattgctatcttcatattg

SEQ ID NO: 48220 - DNA, 20 bp, Artificial Sequence
  chemically synthesized
gctatcttcatattgaagat

SEQ ID NO: 48221 - DNA, 20 bp, Artificial Sequence
  chemically synthesized
ctatcttcatattgaagatg

SEQ ID NO: 48222 - DNA, 20 bp, Artificial Sequence
  chemically synthesized
atcttcatattgaagatgag

SEQ ID NO: 48223 - DNA, 20 bp, Artificial Sequence
  chemically synthesized
tcttcatattgaagatgagg

SEQ ID NO: 48224 - DNA, 20 bp, Artificial Sequence
  chemically synthesized
atattgaagatgaggaggtc

SEQ ID NO: 48225 - DNA, 20 bp, Artificial Sequence
  chemically synthesized
attgaagatgaggaggtcaa

SEQ ID NO: 48226 - DNA, 20 bp, Artificial Sequence
  chemically synthesized
aggaggtcaagagatgaaaa

SEQ ID NO: 48227 - DNA, 20 bp, Artificial Sequence
  chemically synthesized
tcaagagatgaaaaaagact

SEQ ID NO: 48228 - DNA, 20 bp, Artificial Sequence
  chemically synthesized
gttatattaaaattatttgt

SEQ ID NO: 48229 - DNA, 20 bp, Artificial Sequence
  chemically synthesized
tatattaaaattatttgtta

SEQ ID NO: 48230 - DNA, 20 bp, Artificial Sequence
  chemically synthesized
attaaaattatttgttagag

SEQ ID NO: 48231 - DNA, 20 bp, Artificial Sequence
  chemically synthesized
taaaattatttgttagagta

SEQ ID NO: 48232 - DNA, 20 bp, Artificial Sequence
  chemically synthesized
tgttagagtagagcttttgt

SEQ ID NO: 48233 - DNA, 20 bp, Artificial Sequence
  chemically synthesized
ttagagtagagcttttgtaa

SEQ ID NO: 48234 - DNA, 20 bp, Artificial Sequence
  chemically synthesized
gtagagcttttgtaagagtc

SEQ ID NO: 48235 - DNA, 20 bp, Artificial Sequence
  chemically synthesized
tagagcttttgtaagagtct

SEQ ID NO: 48236 - DNA, 20 bp, Artificial Sequence
  chemically synthesized
gagcttttgtaagagtctag

SEQ ID NO: 48237 - DNA, 20 bp, Artificial Sequence
  chemically synthesized
tttgtaagagtctaggagtg

SEQ ID NO: 48238 - DNA, 20 bp, Artificial Sequence
  chemically synthesized
ttgtaagagtctaggagtgt

SEQ ID NO: 48239 - DNA, 20 bp, Artificial Sequence
  chemically synthesized
gtaagagtctaggagtgtgg

SEQ ID NO: 48240 - DNA, 20 bp, Artificial Sequence
  chemically synthesized
gagctaaatgatgatacaca

SEQ ID NO: 48241 - DNA, 20 bp, Artificial Sequence
  chemically synthesized
atacacatggacacaaaaaa

SEQ ID NO: 48242 - DNA, 20 bp, Artificial Sequence
  chemically synthesized
ggacacaaaaaatagatcaa

SEQ ID NO: 48243 - DNA, 20 bp, Artificial Sequence
  chemically synthesized
aaaatagatcaacagacacc

SEQ ID NO: 48244 - DNA, 20 bp, Artificial Sequence
  chemically synthesized
aaatagatcaacagacaccc

SEQ ID NO: 48245 - DNA, 20 bp, Artificial Sequence
  chemically synthesized
acagacacccaggcctactt

SEQ ID NO: 48246 - DNA, 20 bp, Artificial Sequence
  chemically synthesized
cagacacccaggcctacttg

SEQ ID NO: 48247 - DNA, 20 bp, Artificial Sequence
  chemically synthesized
agacacccaggcctacttga

SEQ ID NO: 48248 - DNA, 20 bp, Artificial Sequence
  chemically synthesized
cccaggcctacttgagggtt

SEQ ID NO: 48249 - DNA, 20 bp, Artificial Sequence
  chemically synthesized
ccaggcctacttgagggttg

SEQ ID NO: 48250 - DNA, 20 bp, Artificial Sequence
  chemically synthesized
caggcctacttgagggttga

SEQ ID NO: 48251 - DNA, 20 bp, Artificial Sequence
  chemically synthesized
gcctacttgagggttgaggg

SEQ ID NO: 48252 - DNA, 20 bp, Artificial Sequence
  chemically synthesized
cctacttgagggttgagggt

SEQ ID NO: 48253 - DNA, 20 bp, Artificial Sequence
  chemically synthesized
acttgagggttgagggtggg

SEQ ID NO: 48254 - DNA, 20 bp, Artificial Sequence
  chemically synthesized
ttgagggttgagggtgggaa

SEQ ID NO: 48255 - DNA, 20 bp, Artificial Sequence
  chemically synthesized
tgagggttgagggtgggaag

SEQ ID NO: 48256 - DNA, 20 bp, Artificial Sequence
  chemically synthesized
gagggttgagggtgggaaga

SEQ ID NO: 48257 - DNA, 20 bp, Artificial Sequence
  chemically synthesized
gggttgagggtgggaagagg

SEQ ID NO: 48258 - DNA, 20 bp, Artificial Sequence
  chemically synthesized
ggaagagggagacgatgaaa

SEQ ID NO: 48259 - DNA, 20 bp, Artificial Sequence
  chemically synthesized
gacgatgaaaaagaacctat

SEQ ID NO: 48260 - DNA, 20 bp, Artificial Sequence
  chemically synthesized
acgatgaaaaagaacctatt

SEQ ID NO: 48261 - DNA, 20 bp, Artificial Sequence
  chemically synthesized
aaaagaacctattgggtatt

SEQ ID NO: 48262 - DNA, 20 bp, Artificial Sequence
  chemically synthesized
tgggtattaagttcatcact

SEQ ID NO: 48263 - DNA, 20 bp, Artificial Sequence
  chemically synthesized
gatgaaataatctgtacatc

SEQ ID NO: 48264 - DNA, 20 bp, Artificial Sequence
  chemically synthesized
ataatctgtacatcaagacc

SEQ ID NO: 48265 - DNA, 20 bp, Artificial Sequence
  chemically synthesized
tacccccaaatttaaaatga

SEQ ID NO: 48266 - DNA, 20 bp, Artificial Sequence
  chemically synthesized
ttaaaatgaaagttaaaaca

SEQ ID NO: 48267 - DNA, 20 bp, Artificial Sequence
  chemically synthesized
atgaaagttaaaacaaagta

SEQ ID NO: 48268 - DNA, 20 bp, Artificial Sequence
  chemically synthesized
tgaaagttaaaacaaagtat

SEQ ID NO: 48269 - DNA, 20 bp, Artificial Sequence
  chemically synthesized
gttaaaacaaagtataggaa

SEQ ID NO: 48270 - DNA, 20 bp, Artificial Sequence
  chemically synthesized
aggaatggaattaattcctc

SEQ ID NO: 48271 - DNA, 20 bp, Artificial Sequence
  chemically synthesized
ggaattaattcctcaagatt

SEQ ID NO: 48272 - DNA, 20 bp, Artificial Sequence
  chemically synthesized
ttatttgataatttatcaaa

SEQ ID NO: 48273 - DNA, 20 bp, Artificial Sequence
  chemically synthesized
ttgtttttcttttctcacta

SEQ ID NO: 48274 - DNA, 20 bp, Artificial Sequence
  chemically synthesized
gttgctttataaactatgtt

SEQ ID NO: 48275 - DNA, 20 bp, Artificial Sequence
  chemically synthesized
tgttcagtatgtctgaatga

SEQ ID NO: 48276 - DNA, 20 bp, Artificial Sequence
  chemically synthesized
gttcagtatgtctgaatgaa

SEQ ID NO: 48277 - DNA, 20 bp, Artificial Sequence
  chemically synthesized
ttcagtatgtctgaatgaaa

SEQ ID NO: 48278 - DNA, 20 bp, Artificial Sequence
  chemically synthesized
aagggtgtgtgtgtgtgtga

SEQ ID NO: 48279 - DNA, 20 bp, Artificial Sequence
  chemically synthesized
gggtgtgtgtgtgtgtgaaa

SEQ ID NO: 48280 - DNA, 20 bp, Artificial Sequence
  chemically synthesized
gtgtgtgtgtgtgtgaaaga

SEQ ID NO: 48281 - DNA, 20 bp, Artificial Sequence
  chemically synthesized
tgtgtgtgtgtgtgaaagag

SEQ ID NO: 48282 - DNA, 20 bp, Artificial Sequence
  chemically synthesized
gtgtgtgtgtgtgaaagaga

SEQ ID NO: 48283 - DNA, 20 bp, Artificial Sequence
  chemically synthesized
gtgtgtgtgtgaaagagagg

SEQ ID NO: 48284 - DNA, 20 bp, Artificial Sequence
  chemically synthesized
gtgtgtgtgaaagagaggga

SEQ ID NO: 48285 - DNA, 20 bp, Artificial Sequence
  chemically synthesized
gtgtgtgaaagagagggaga

SEQ ID NO: 48286 - DNA, 20 bp, Artificial Sequence
  chemically synthesized
tgtgtgaaagagagggagag

SEQ ID NO: 48287 - DNA, 20 bp, Artificial Sequence
  chemically synthesized
gtgaaagagagggagagagg

SEQ ID NO: 48288 - DNA, 20 bp, Artificial Sequence
  chemically synthesized
tgaaagagagggagagagga

SEQ ID NO: 48289 - DNA, 20 bp, Artificial Sequence
  chemically synthesized
gaaagagagggagagaggaa

SEQ ID NO: 48290 - DNA, 20 bp, Artificial Sequence
  chemically synthesized
agagagggagagaggaaggg

SEQ ID NO: 48291 - DNA, 20 bp, Artificial Sequence
  chemically synthesized
agagggagagaggaagggaa

SEQ ID NO: 48292 - DNA, 20 bp, Artificial Sequence
  chemically synthesized
agggagagaggaagggaaga

SEQ ID NO: 48293 - DNA, 20 bp, Artificial Sequence
  chemically synthesized
gggagagaggaagggaagag

SEQ ID NO: 48294 - DNA, 20 bp, Artificial Sequence
  chemically synthesized
ggacgtaataatgtgaattt

SEQ ID NO: 48295 - DNA, 20 bp, Artificial Sequence
  chemically synthesized
tcaataaaataatttaatgt

SEQ ID NO: 48296 - DNA, 20 bp, Artificial Sequence
  chemically synthesized
caataaaataatttaatgtc

SEQ ID NO: 48297 - DNA, 20 bp, Artificial Sequence
  chemically synthesized
ataaaataatttaatgtcag

SEQ ID NO: 48298 - DNA, 20 bp, Artificial Sequence
  chemically synthesized
aatttaatgtcaggagaatt

SEQ ID NO: 48299 - DNA, 20 bp, Artificial Sequence
  chemically synthesized
gtcaggagaattaagcctaa

SEQ ID NO: 48300 - DNA, 20 bp, Artificial Sequence
  chemically synthesized
tcctaaatcatccatctctt

SEQ ID NO: 48301 - DNA, 20 bp, Artificial Sequence
  chemically synthesized
atcatccatctcttgagctt

SEQ ID NO: 48302 - DNA, 20 bp, Artificial Sequence
  chemically synthesized
catccatctcttgagcttca

SEQ ID NO: 48303 - DNA, 20 bp, Artificial Sequence
  chemically synthesized
ccatctcttgagcttcagag

SEQ ID NO: 48304 - DNA, 20 bp, Artificial Sequence
  chemically synthesized
ttaatgcctacatgtttgta

SEQ ID NO: 48305 - DNA, 20 bp, Artificial Sequence
  chemically synthesized
taatgcctacatgtttgtaa

SEQ ID NO: 48306 - DNA, 20 bp, Artificial Sequence
  chemically synthesized
aatgcctacatgtttgtaaa

SEQ ID NO: 48307 - DNA, 20 bp, Artificial Sequence
  chemically synthesized
acatgtttgtaaagggtgtt

SEQ ID NO: 48308 - DNA, 20 bp, Artificial Sequence
  chemically synthesized
tgtaaagggtgttcagactg

SEQ ID NO: 48309 - DNA, 20 bp, Artificial Sequence
  chemically synthesized
agggtgttcagactgaagcc

SEQ ID NO: 48310 - DNA, 20 bp, Artificial Sequence
  chemically synthesized
aagccaagattctacctcta

SEQ ID NO: 48311 - DNA, 20 bp, Artificial Sequence
  chemically synthesized
gccaagattctacctctaaa

SEQ ID NO: 48312 - DNA, 20 bp, Artificial Sequence
  chemically synthesized
tgcaatctcaaatttatctg

SEQ ID NO: 48313 - DNA, 20 bp, Artificial Sequence
  chemically synthesized
ctctccataaattgacacca

SEQ ID NO: 48314 - DNA, 20 bp, Artificial Sequence
  chemically synthesized
gacaccatggcccacttaat

SEQ ID NO: 48315 - DNA, 20 bp, Artificial Sequence
  chemically synthesized
acaccatggcccacttaatg

SEQ ID NO: 48316 - DNA, 20 bp, Artificial Sequence
  chemically synthesized
cacttaatgaggttaaaaaa

SEQ ID NO: 48317 - DNA, 20 bp, Artificial Sequence
  chemically synthesized
ctaattctgaatgaaaatct

SEQ ID NO: 48318 - DNA, 20 bp, Artificial Sequence
  chemically synthesized
tctgaatgaaaatctgagcc

SEQ ID NO: 48319 - DNA, 20 bp, Artificial Sequence
  chemically synthesized
gaatgaaaatctgagcccag

SEQ ID NO: 48320 - DNA, 20 bp, Artificial Sequence
  chemically synthesized
atgaaaatctgagcccagtg

SEQ ID NO: 48321 - DNA, 20 bp, Artificial Sequence
  chemically synthesized
tgaaaatctgagcccagtgg

SEQ ID NO: 48322 - DNA, 20 bp, Artificial Sequence
  chemically synthesized
tggaggaaatattaatgaac

SEQ ID NO: 48323 - DNA, 20 bp, Artificial Sequence
  chemically synthesized
ggaggaaatattaatgaaca

SEQ ID NO: 48324 - DNA, 20 bp, Artificial Sequence
  chemically synthesized
aaatattaatgaacaaggtg

SEQ ID NO: 48325 - DNA, 20 bp, Artificial Sequence
  chemically synthesized
taataattatgcatatactt

SEQ ID NO: 48326 - DNA, 20 bp, Artificial Sequence
  chemically synthesized
attatgcatatactttagca

SEQ ID NO: 48327 - DNA, 20 bp, Artificial Sequence
  chemically synthesized
atgttgactttattgctttt

SEQ ID NO: 48328 - DNA, 20 bp, Artificial Sequence
  chemically synthesized
tgactttattgctttttggt

SEQ ID NO: 48329 - DNA, 20 bp, Artificial Sequence
  chemically synthesized
gtaagaaatacaacttttta

SEQ ID NO: 48330 - DNA, 20 bp, Artificial Sequence
  chemically synthesized
caaactattttgtgtgtgtg

SEQ ID NO: 48331 - DNA, 20 bp, Artificial Sequence
  chemically synthesized
gtgtgtgcggtttgtttcta

SEQ ID NO: 48332 - DNA, 20 bp, Artificial Sequence
  chemically synthesized
tgtgtgcggtttgtttctat

SEQ ID NO: 48333 - DNA, 20 bp, Artificial Sequence
  chemically synthesized
cggtttgtttctatgggttc

SEQ ID NO: 48334 - DNA, 20 bp, Artificial Sequence
  chemically synthesized
tctatgggttctggttttct

SEQ ID NO: 48335 - DNA, 20 bp, Artificial Sequence
  chemically synthesized
tatgggttctggttttcttg

SEQ ID NO: 48336 - DNA, 20 bp, Artificial Sequence
  chemically synthesized
cattttaattaattaattct

SEQ ID NO: 48337 - DNA, 20 bp, Artificial Sequence
  chemically synthesized
ttttaattaattaattctga

SEQ ID NO: 48338 - DNA, 20 bp, Artificial Sequence
  chemically synthesized
aattaattctgagagctgct

SEQ ID NO: 48339 - DNA, 20 bp, Artificial Sequence
  chemically synthesized
gctgctgagttgtgtttact

SEQ ID NO: 48340 - DNA, 20 bp, Artificial Sequence
  chemically synthesized
tgctgagttgtgtttactga

SEQ ID NO: 48341 - DNA, 20 bp, Artificial Sequence
  chemically synthesized
ctgagagattgtgtatctgc

SEQ ID NO: 48342 - DNA, 20 bp, Artificial Sequence
  chemically synthesized
gagagattgtgtatctgcga

SEQ ID NO: 48343 - DNA, 20 bp, Artificial Sequence
  chemically synthesized
agattgtgtatctgcgagag

SEQ ID NO: 48344 - DNA, 20 bp, Artificial Sequence
  chemically synthesized
gtatctgcgagagaagtctg

SEQ ID NO: 48345 - DNA, 20 bp, Artificial Sequence
  chemically synthesized
ctgcgagagaagtctgtagc

SEQ ID NO: 48346 - DNA, 20 bp, Artificial Sequence
  chemically synthesized
cgagagaagtctgtagcaag

SEQ ID NO: 48347 - DNA, 20 bp, Artificial Sequence
  chemically synthesized
agaagtctgtagcaagtagc

SEQ ID NO: 48348 - DNA, 20 bp, Artificial Sequence
  chemically synthesized
tagctagactgtgcttgacc

SEQ ID NO: 48349 - DNA, 20 bp, Artificial Sequence
  chemically synthesized
agctagactgtgcttgacct

SEQ ID NO: 48350 - DNA, 20 bp, Artificial Sequence
  chemically synthesized
gcttgacctaggaacatata

SEQ ID NO: 48351 - DNA, 20 bp, Artificial Sequence
  chemically synthesized
tgacctaggaacatatacag

SEQ ID NO: 48352 - DNA, 20 bp, Artificial Sequence
  chemically synthesized
gattgctaaaatgtctcact

SEQ ID NO: 48353 - DNA, 20 bp, Artificial Sequence
  chemically synthesized
attgctaaaatgtctcactt

SEQ ID NO: 48354 - DNA, 20 bp, Artificial Sequence
  chemically synthesized
ttgctaaaatgtctcacttg

SEQ ID NO: 48355 - DNA, 20 bp, Artificial Sequence
  chemically synthesized
atgtctcacttggggaattt

SEQ ID NO: 48356 - DNA, 20 bp, Artificial Sequence
  chemically synthesized
ttggggaattttagactaaa

SEQ ID NO: 48357 - DNA, 20 bp, Artificial Sequence
  chemically synthesized
gggaattttagactaaacag

SEQ ID NO: 48358 - DNA, 20 bp, Artificial Sequence
  chemically synthesized
gaattttagactaaacagta

SEQ ID NO: 48359 - DNA, 20 bp, Artificial Sequence
  chemically synthesized
gagcatgtataaaaatactc

SEQ ID NO: 48360 - DNA, 20 bp, Artificial Sequence
  chemically synthesized
tgtataaaaatactctagtc

SEQ ID NO: 48361 - DNA, 20 bp, Artificial Sequence
  chemically synthesized
atgataaaaccacactccca

SEQ ID NO: 48362 - DNA, 20 bp, Artificial Sequence
  chemically synthesized
aaaaccacactcccatagat

SEQ ID NO: 48363 - DNA, 20 bp, Artificial Sequence
  chemically synthesized
gatgagtgtcatgattttca

SEQ ID NO: 48364 - DNA, 20 bp, Artificial Sequence
  chemically synthesized
tgagtgtcatgattttcatg

SEQ ID NO: 48365 - DNA, 20 bp, Artificial Sequence
  chemically synthesized
gagtgtcatgattttcatgg

SEQ ID NO: 48366 - DNA, 20 bp, Artificial Sequence
  chemically synthesized
tgtcatgattttcatggagg

SEQ ID NO: 48367 - DNA, 20 bp, Artificial Sequence
  chemically synthesized
gaagttaatattcatcctct

SEQ ID NO: 48368 - DNA, 20 bp, Artificial Sequence
  chemically synthesized
attcatcctctaagtatacc

SEQ ID NO: 48369 - DNA, 20 bp, Artificial Sequence
  chemically synthesized
tcctctaagtatacccagac

SEQ ID NO: 48370 - DNA, 20 bp, Artificial Sequence
  chemically synthesized
cctctaagtatacccagact

SEQ ID NO: 48371 - DNA, 20 bp, Artificial Sequence
  chemically synthesized
ctctaagtatacccagacta

SEQ ID NO: 48372 - DNA, 20 bp, Artificial Sequence
  chemically synthesized
gccattctgatataaaacat

SEQ ID NO: 48373 - DNA, 20 bp, Artificial Sequence
  chemically synthesized
ccattctgatataaaacatt

SEQ ID NO: 48374 - DNA, 20 bp, Artificial Sequence
  chemically synthesized
gatataaaacattaggactt

SEQ ID NO: 48375 - DNA, 20 bp, Artificial Sequence
  chemically synthesized
taaaacattaggacttaaga

SEQ ID NO: 48376 - DNA, 20 bp, Artificial Sequence
  chemically synthesized
taggacttaagaaagattaa

SEQ ID NO: 48377 - DNA, 20 bp, Artificial Sequence
  chemically synthesized
cttaagaaagattaatagac

SEQ ID NO: 48378 - DNA, 20 bp, Artificial Sequence
  chemically synthesized
taagaaagattaatagactg

SEQ ID NO: 48379 - DNA, 20 bp, Artificial Sequence
  chemically synthesized
aagattaatagactggagta

SEQ ID NO: 48380 - DNA, 20 bp, Artificial Sequence
  chemically synthesized
agattaatagactggagtaa

SEQ ID NO: 48381 - DNA, 20 bp, Artificial Sequence
  chemically synthesized
atagactggagtaaaggaaa

SEQ ID NO: 48382 - DNA, 20 bp, Artificial Sequence
  chemically synthesized
tctctcgctgtctctttttt

SEQ ID NO: 48383 - DNA, 20 bp, Artificial Sequence
  chemically synthesized
ctctcgctgtctcttttttg

SEQ ID NO: 48384 - DNA, 20 bp, Artificial Sequence
  chemically synthesized
gtgtgtgtgtgtgtgtgttg

SEQ ID NO: 48385 - DNA, 20 bp, Artificial Sequence
  chemically synthesized
gtgtgtgtgtgtgttgtggt

SEQ ID NO: 48386 - DNA, 20 bp, Artificial Sequence
  chemically synthesized
tgtgtgtgtgttgtggtcag

SEQ ID NO: 48387 - DNA, 20 bp, Artificial Sequence
  chemically synthesized
gtgtgtgtgttgtggtcagt

SEQ ID NO: 48388 - DNA, 20 bp, Artificial Sequence
  chemically synthesized
tgtgtgtgttgtggtcagtg

SEQ ID NO: 48389 - DNA, 20 bp, Artificial Sequence
  chemically synthesized
tgtgttgtggtcagtggggc

SEQ ID NO: 48390 - DNA, 20 bp, Artificial Sequence
  chemically synthesized
ggtcagtggggctggaataa

SEQ ID NO: 48391 - DNA, 20 bp, Artificial Sequence
  chemically synthesized
cagtggggctggaataaaag

SEQ ID NO: 48392 - DNA, 20 bp, Artificial Sequence
  chemically synthesized
gggctggaataaaagtagaa

SEQ ID NO: 48393 - DNA, 20 bp, Artificial Sequence
  chemically synthesized
gaatagacctgcacctgctg

SEQ ID NO: 48394 - DNA, 20 bp, Artificial Sequence
  chemically synthesized
cctgctgtggcatccattca

SEQ ID NO: 48395 - DNA, 20 bp, Artificial Sequence
  chemically synthesized
tgctgtggcatccattcaca

SEQ ID NO: 48396 - DNA, 20 bp, Artificial Sequence
  chemically synthesized
tgtggcatccattcacagag

SEQ ID NO: 48397 - DNA, 20 bp, Artificial Sequence
  chemically synthesized
ggcatccattcacagagtag

SEQ ID NO: 48398 - DNA, 20 bp, Artificial Sequence
  chemically synthesized
tccattcacagagtagaagc

SEQ ID NO: 48399 - DNA, 20 bp, Artificial Sequence
  chemically synthesized
gagtagaagcaagctcacaa

SEQ ID NO: 48400 - DNA, 20 bp, Artificial Sequence
  chemically synthesized
gaagcaagctcacaatagtg

SEQ ID NO: 48401 - DNA, 20 bp, Artificial Sequence
  chemically synthesized
gctcacaatagtgaagatgt

SEQ ID NO: 48402 - DNA, 20 bp, Artificial Sequence
  chemically synthesized
acaatagtgaagatgtcagt

SEQ ID NO: 48403 - DNA, 20 bp, Artificial Sequence
  chemically synthesized
aagatgtcagtaagcttgaa

SEQ ID NO: 48404 - DNA, 20 bp, Artificial Sequence
  chemically synthesized
agtaagcttgaatagttttt

SEQ ID NO: 48405 - DNA, 20 bp, Artificial Sequence
  chemically synthesized
gtaagcttgaatagtttttc

SEQ ID NO: 48406 - DNA, 20 bp, Artificial Sequence
  chemically synthesized
aggaactttgaatgctgatt

SEQ ID NO: 48407 - DNA, 20 bp, Artificial Sequence
  chemically synthesized
gctgatttagatttgaaact

SEQ ID NO: 48408 - DNA, 20 bp, Artificial Sequence
  chemically synthesized
ctgatttagatttgaaactg

SEQ ID NO: 48409 - DNA, 20 bp, Artificial Sequence
  chemically synthesized
cttcttgaaacttatttgcc

SEQ ID NO: 48410 - DNA, 20 bp, Artificial Sequence
  chemically synthesized
acttatttgcctggtatgcc

SEQ ID NO: 48411 - DNA, 20 bp, Artificial Sequence
  chemically synthesized
cttatttgcctggtatgcct

SEQ ID NO: 48412 - DNA, 20 bp, Artificial Sequence
  chemically synthesized
tggtatgcctgggcttttga

SEQ ID NO: 48413 - DNA, 20 bp, Artificial Sequence
  chemically synthesized
gcctgggcttttgatggtct

SEQ ID NO: 48414 - DNA, 20 bp, Artificial Sequence
  chemically synthesized
ggcttttgatggtcttagta

SEQ ID NO: 48415 - DNA, 20 bp, Artificial Sequence
  chemically synthesized
gatggtcttagtatagcttg

SEQ ID NO: 48416 - DNA, 20 bp, Artificial Sequence
  chemically synthesized
agcttgcagccttgtccctg

SEQ ID NO: 48417 - DNA, 20 bp, Artificial Sequence
  chemically synthesized
gcttgcagccttgtccctgc

SEQ ID NO: 48418 - DNA, 20 bp, Artificial Sequence
  chemically synthesized
cttgcagccttgtccctgca

SEQ ID NO: 48419 - DNA, 20 bp, Artificial Sequence
  chemically synthesized
cttgtccctgcagggtatta

SEQ ID NO: 48420 - DNA, 20 bp, Artificial Sequence
  chemically synthesized
ttgtccctgcagggtattat

SEQ ID NO: 48421 - DNA, 20 bp, Artificial Sequence
  chemically synthesized
ctgcagggtattatgggtaa

SEQ ID NO: 48422 - DNA, 20 bp, Artificial Sequence
  chemically synthesized
agggtattatgggtaataga

SEQ ID NO: 48423 - DNA, 20 bp, Artificial Sequence
  chemically synthesized
attatgggtaatagaaagaa

SEQ ID NO: 48424 - DNA, 20 bp, Artificial Sequence
  chemically synthesized
gaaaagtctgcgttacactc

SEQ ID NO: 48425 - DNA, 20 bp, Artificial Sequence
  chemically synthesized
cgttacactctagtcacact

SEQ ID NO: 48426 - DNA, 20 bp, Artificial Sequence
  chemically synthesized
tcacactaagtaactaccat

SEQ ID NO: 48427 - DNA, 20 bp, Artificial Sequence
  chemically synthesized
ctaagtaactaccattggaa

SEQ ID NO: 48428 - DNA, 20 bp, Artificial Sequence
  chemically synthesized
gaaaagcaacccctgccttg

SEQ ID NO: 48429 - DNA, 20 bp, Artificial Sequence
  chemically synthesized
agcaacccctgccttgaagc

SEQ ID NO: 48430 - DNA, 20 bp, Artificial Sequence
  chemically synthesized
gcaacccctgccttgaagcc

SEQ ID NO: 48431 - DNA, 20 bp, Artificial Sequence
  chemically synthesized
ctgccttgaagccaggatga

SEQ ID NO: 48432 - DNA, 20 bp, Artificial Sequence
  chemically synthesized
agccaggatgatggtatctg

SEQ ID NO: 48433 - DNA, 20 bp, Artificial Sequence
  chemically synthesized
caggatgatggtatctgcag

SEQ ID NO: 48434 - DNA, 20 bp, Artificial Sequence
  chemically synthesized
tctgcagcagttgccaacac

SEQ ID NO: 48435 - DNA, 20 bp, Artificial Sequence
  chemically synthesized
tgcagcagttgccaacacaa

SEQ ID NO: 48436 - DNA, 20 bp, Artificial Sequence
  chemically synthesized
agcagttgccaacacaagag

SEQ ID NO: 48437 - DNA, 20 bp, Artificial Sequence
  chemically synthesized
gcagttgccaacacaagaga

SEQ ID NO: 48438 - DNA, 20 bp, Artificial Sequence
  chemically synthesized
caacacaagagaaggatcca

SEQ ID NO: 48439 - DNA, 20 bp, Artificial Sequence
  chemically synthesized
ccatagttcatcatttaaaa

SEQ ID NO: 48440 - DNA, 20 bp, Artificial Sequence
  chemically synthesized
atttaaaaaagaaaacaaaa

SEQ ID NO: 48441 - DNA, 20 bp, Artificial Sequence
  chemically synthesized
aaaagaaaacaaaatagaaa

SEQ ID NO: 48442 - DNA, 20 bp, Artificial Sequence
  chemically synthesized
aaagaaaacaaaatagaaaa

SEQ ID NO: 48443 - DNA, 20 bp, Artificial Sequence
  chemically synthesized
gaaaaaggaaaactatttct

SEQ ID NO: 48444 - DNA, 20 bp, Artificial Sequence
  chemically synthesized
ggaaaactatttctgagcat

SEQ ID NO: 48445 - DNA, 20 bp, Artificial Sequence
  chemically synthesized
aaactatttctgagcataag

SEQ ID NO: 48446 - DNA, 20 bp, Artificial Sequence
  chemically synthesized
tttctgagcataagaagttg

SEQ ID NO: 48447 - DNA, 20 bp, Artificial Sequence
  chemically synthesized
ttctgagcataagaagttgt

SEQ ID NO: 48448 - DNA, 20 bp, Artificial Sequence
  chemically synthesized
tctgagcataagaagttgta

SEQ ID NO: 48449 - DNA, 20 bp, Artificial Sequence
  chemically synthesized
agcataagaagttgtagggt

SEQ ID NO: 48450 - DNA, 20 bp, Artificial Sequence
  chemically synthesized
aagttgtagggtaagtcttt

SEQ ID NO: 48451 - DNA, 20 bp, Artificial Sequence
  chemically synthesized
ttgtagggtaagtctttaag

SEQ ID NO: 48452 - DNA, 20 bp, Artificial Sequence
  chemically synthesized
tgtagggtaagtctttaaga

SEQ ID NO: 48453 - DNA, 20 bp, Artificial Sequence
  chemically synthesized
aggtgacaatttctgccaat

SEQ ID NO: 48454 - DNA, 20 bp, Artificial Sequence
  chemically synthesized
ggtgacaatttctgccaatc

SEQ ID NO: 48455 - DNA, 20 bp, Artificial Sequence
  chemically synthesized
ttctgccaatcaggatttca

SEQ ID NO: 48456 - DNA, 20 bp, Artificial Sequence
  chemically synthesized
agctcttgctttgacaattt

SEQ ID NO: 48457 - DNA, 20 bp, Artificial Sequence
  chemically synthesized
ctttgacaattttggtcttt

SEQ ID NO: 48458 - DNA, 20 bp, Artificial Sequence
  chemically synthesized
acctatattataatttcata

SEQ ID NO: 48459 - DNA, 20 bp, Artificial Sequence
  chemically synthesized
tctgtgcattttctttgacc

SEQ ID NO: 48460 - DNA, 20 bp, Artificial Sequence
  chemically synthesized
ctgtgcattttctttgaccc

SEQ ID NO: 48461 - DNA, 20 bp, Artificial Sequence
  chemically synthesized
ttgacccaggatatttgcaa

SEQ ID NO: 48462 - DNA, 20 bp, Artificial Sequence
  chemically synthesized
aagacatattcaaacttccg

SEQ ID NO: 48463 - DNA, 20 bp, Artificial Sequence
  chemically synthesized
catatacatgcctcttatat

SEQ ID NO: 48464 - DNA, 20 bp, Artificial Sequence
  chemically synthesized
atatacatgcctcttatatc

SEQ ID NO: 48465 - DNA, 20 bp, Artificial Sequence
  chemically synthesized
tatacatgcctcttatatca

SEQ ID NO: 48466 - DNA, 20 bp, Artificial Sequence
  chemically synthesized
cttatatcagggatgtgaaa

SEQ ID NO: 48467 - DNA, 20 bp, Artificial Sequence
  chemically synthesized
ttatatcagggatgtgaaac

SEQ ID NO: 48468 - DNA, 20 bp, Artificial Sequence
  chemically synthesized
tatatcagggatgtgaaaca

SEQ ID NO: 48469 - DNA, 20 bp, Artificial Sequence
  chemically synthesized
aatctaaaacaatgctaatg

SEQ ID NO: 48470 - DNA, 20 bp, Artificial Sequence
  chemically synthesized
atctaaaacaatgctaatgc

SEQ ID NO: 48471 - DNA, 20 bp, Artificial Sequence
  chemically synthesized
aaataaaatccaaaatctaa

SEQ ID NO: 48472 - DNA, 20 bp, Artificial Sequence
  chemically synthesized
aaatccaaaatctaacagcc

SEQ ID NO: 48473 - DNA, 20 bp, Artificial Sequence
  chemically synthesized
ttaacatttaaaatatttta

SEQ ID NO: 48474 - DNA, 20 bp, Artificial Sequence
  chemically synthesized
attttaaagacgtcttttcc

SEQ ID NO: 48475 - DNA, 20 bp, Artificial Sequence
  chemically synthesized
ttttaaagacgtcttttccc

SEQ ID NO: 48476 - DNA, 20 bp, Artificial Sequence
  chemically synthesized
caacatgtgaaatcttttct

SEQ ID NO: 48477 - DNA, 20 bp, Artificial Sequence
  chemically synthesized
aacatgtgaaatcttttctc

SEQ ID NO: 48478 - DNA, 20 bp, Artificial Sequence
  chemically synthesized
acatgtgaaatcttttctca

SEQ ID NO: 48479 - DNA, 20 bp, Artificial Sequence
  chemically synthesized
ctcagggatacacgtgtgcc

SEQ ID NO: 48480 - DNA, 20 bp, Artificial Sequence
  chemically synthesized
tgcctagatcctcattgctt

SEQ ID NO: 48481 - DNA, 20 bp, Artificial Sequence
  chemically synthesized
ctcattgctttagtttttta

SEQ ID NO: 48482 - DNA, 20 bp, Artificial Sequence
  chemically synthesized
cattgctttagttttttaca

SEQ ID NO: 48483 - DNA, 20 bp, Artificial Sequence
  chemically synthesized
attgctttagttttttacag

SEQ ID NO: 48484 - DNA, 20 bp, Artificial Sequence
  chemically synthesized
tacagaggaatgaatataaa

SEQ ID NO: 48485 - DNA, 20 bp, Artificial Sequence
  chemically synthesized
cttacctctataatcataca

SEQ ID NO: 48486 - DNA, 20 bp, Artificial Sequence
  chemically synthesized
ttacctctataatcatacat

SEQ ID NO: 48487 - DNA, 20 bp, Artificial Sequence
  chemically synthesized
ataggcataattttttaacc

SEQ ID NO: 48488 - DNA, 20 bp, Artificial Sequence
  chemically synthesized
taggcataattttttaacct

SEQ ID NO: 48489 - DNA, 20 bp, Artificial Sequence
  chemically synthesized
taattttttaacctaggctc

SEQ ID NO: 48490 - DNA, 20 bp, Artificial Sequence
  chemically synthesized
tttttaacctaggctccaga

SEQ ID NO: 48491 - DNA, 20 bp, Artificial Sequence
  chemically synthesized
acctaggctccagatagcca

SEQ ID NO: 48492 - DNA, 20 bp, Artificial Sequence
  chemically synthesized
taggctccagatagccatag

SEQ ID NO: 48493 - DNA, 20 bp, Artificial Sequence
  chemically synthesized
caaacactttctgcgtgtgt

SEQ ID NO: 48494 - DNA, 20 bp, Artificial Sequence
  chemically synthesized
tctgcgtgtgtgagaataat

SEQ ID NO: 48495 - DNA, 20 bp, Artificial Sequence
  chemically synthesized
tgcgtgtgtgagaataatca

SEQ ID NO: 48496 - DNA, 20 bp, Artificial Sequence
  chemically synthesized
tgtgtgagaataatcagagt

SEQ ID NO: 48497 - DNA, 20 bp, Artificial Sequence
  chemically synthesized
tcagagtgagattttttcac

SEQ ID NO: 48498 - DNA, 20 bp, Artificial Sequence
  chemically synthesized
ttttttcacaagtacctgat

SEQ ID NO: 48499 - DNA, 20 bp, Artificial Sequence
  chemically synthesized
tttttcacaagtacctgatg

SEQ ID NO: 48500 - DNA, 20 bp, Artificial Sequence
  chemically synthesized
ttttcacaagtacctgatga

SEQ ID NO: 48501 - DNA, 20 bp, Artificial Sequence
  chemically synthesized
acaagtacctgatgagggtt

SEQ ID NO: 48502 - DNA, 20 bp, Artificial Sequence
  chemically synthesized
gtacctgatgagggttgaga

SEQ ID NO: 48503 - DNA, 20 bp, Artificial Sequence
  chemically synthesized
tacctgatgagggttgagac

SEQ ID NO: 48504 - DNA, 20 bp, Artificial Sequence
  chemically synthesized
ctgatgagggttgagacagg

SEQ ID NO: 48505 - DNA, 20 bp, Artificial Sequence
  chemically synthesized
agggttgagacaggtagaaa

SEQ ID NO: 48506 - DNA, 20 bp, Artificial Sequence
  chemically synthesized
ttgagacaggtagaaaaagt

SEQ ID NO: 48507 - DNA, 20 bp, Artificial Sequence
  chemically synthesized
gagacaggtagaaaaagtga

SEQ ID NO: 48508 - DNA, 20 bp, Artificial Sequence
  chemically synthesized
gtgagagatctctatttatt

SEQ ID NO: 48509 - DNA, 20 bp, Artificial Sequence
  chemically synthesized
ctctatttatttagcaataa

SEQ ID NO: 48510 - DNA, 20 bp, Artificial Sequence
  chemically synthesized
ctatttatttagcaataata

SEQ ID NO: 48511 - DNA, 20 bp, Artificial Sequence
  chemically synthesized
ttatttagcaataatagaga

SEQ ID NO: 48512 - DNA, 20 bp, Artificial Sequence
  chemically synthesized
caataatagagaaagcattt

SEQ ID NO: 48513 - DNA, 20 bp, Artificial Sequence
  chemically synthesized
ataatagagaaagcatttaa

SEQ ID NO: 48514 - DNA, 20 bp, Artificial Sequence
  chemically synthesized
agaaagcatttaagagaata

SEQ ID NO: 48515 - DNA, 20 bp, Artificial Sequence
  chemically synthesized
catttaagagaataaagcaa

SEQ ID NO: 48516 - DNA, 20 bp, Artificial Sequence
  chemically synthesized
gagaataaagcaatggaaat

SEQ ID NO: 48517 - DNA, 20 bp, Artificial Sequence
  chemically synthesized
gtaaatttccttctgataac

SEQ ID NO: 48518 - DNA, 20 bp, Artificial Sequence
  chemically synthesized
ttccttctgataactagaaa

SEQ ID NO: 48519 - DNA, 20 bp, Artificial Sequence
  chemically synthesized
ccttctgataactagaaata

SEQ ID NO: 48520 - DNA, 20 bp, Artificial Sequence
  chemically synthesized
cttctgataactagaaatag

SEQ ID NO: 48521 - DNA, 20 bp, Artificial Sequence
  chemically synthesized
ataactagaaatagaggatc

SEQ ID NO: 48522 - DNA, 20 bp, Artificial Sequence
  chemically synthesized
atagaggatccagtttcttt

SEQ ID NO: 48523 - DNA, 20 bp, Artificial Sequence
  chemically synthesized
tattttattttgtgtaatcg

SEQ ID NO: 48524 - DNA, 20 bp, Artificial Sequence
  chemically synthesized
attttgtgtaatcgtagttt

SEQ ID NO: 48525 - DNA, 20 bp, Artificial Sequence
  chemically synthesized
tttgtgtaatcgtagtttca

SEQ ID NO: 48526 - DNA, 20 bp, Artificial Sequence
  chemically synthesized
taatcgtagtttcagagtgt

SEQ ID NO: 48527 - DNA, 20 bp, Artificial Sequence
  chemically synthesized
atcgtagtttcagagtgtta

SEQ ID NO: 48528 - DNA, 20 bp, Artificial Sequence
  chemically synthesized
tttcagagtgttagagctga

SEQ ID NO: 48529 - DNA, 20 bp, Artificial Sequence
  chemically synthesized
ttcagagtgttagagctgaa

SEQ ID NO: 48530 - DNA, 20 bp, Artificial Sequence
  chemically synthesized
agagtgttagagctgaaagg

SEQ ID NO: 48531 - DNA, 20 bp, Artificial Sequence
  chemically synthesized
gtgttagagctgaaaggaag

SEQ ID NO: 48532 - DNA, 20 bp, Artificial Sequence
  chemically synthesized
ttagagctgaaaggaagaag

SEQ ID NO: 48533 - DNA, 20 bp, Artificial Sequence
  chemically synthesized
tagagctgaaaggaagaagt

SEQ ID NO: 48534 - DNA, 20 bp, Artificial Sequence
  chemically synthesized
gagctgaaaggaagaagtag

SEQ ID NO: 48535 - DNA, 20 bp, Artificial Sequence
  chemically synthesized
agaagtaggagaaacatgca

SEQ ID NO: 48536 - DNA, 20 bp, Artificial Sequence
  chemically synthesized
aggagaaacatgcaaagtaa

SEQ ID NO: 48537 - DNA, 20 bp, Artificial Sequence
  chemically synthesized
ctttccttactaaaccgaca

SEQ ID NO: 48538 - DNA, 20 bp, Artificial Sequence
  chemically synthesized
tttccttactaaaccgacat

SEQ ID NO: 48539 - DNA, 20 bp, Artificial Sequence
  chemically synthesized
actaaaccgacatgggtttc

SEQ ID NO: 48540 - DNA, 20 bp, Artificial Sequence
  chemically synthesized
ctaaaccgacatgggtttcc

SEQ ID NO: 48541 - DNA, 20 bp, Artificial Sequence
  chemically synthesized
aaccgacatgggtttccagg

SEQ ID NO: 48542 - DNA, 20 bp, Artificial Sequence
  chemically synthesized
accgacatgggtttccaggt

SEQ ID NO: 48543 - DNA, 20 bp, Artificial Sequence
  chemically synthesized
ccgacatgggtttccaggta

SEQ ID NO: 48544 - DNA, 20 bp, Artificial Sequence
  chemically synthesized
cgacatgggtttccaggtag

SEQ ID NO: 48545 - DNA, 20 bp, Artificial Sequence
  chemically synthesized
catgggtttccaggtagggg

SEQ ID NO: 48546 - DNA, 20 bp, Artificial Sequence
  chemically synthesized
atgggtttccaggtaggggc

SEQ ID NO: 48547 - DNA, 20 bp, Artificial Sequence
  chemically synthesized
ttccaggtaggggcaggatt

SEQ ID NO: 48548 - DNA, 20 bp, Artificial Sequence
  chemically synthesized
tccaggtaggggcaggattc

SEQ ID NO: 48549 - DNA, 20 bp, Artificial Sequence
  chemically synthesized
gcaggattcaggatgactga

SEQ ID NO: 48550 - DNA, 20 bp, Artificial Sequence
  chemically synthesized
caggattcaggatgactgac

SEQ ID NO: 48551 - DNA, 20 bp, Artificial Sequence
  chemically synthesized
aggattcaggatgactgaca

SEQ ID NO: 48552 - DNA, 20 bp, Artificial Sequence
  chemically synthesized
aggatgactgacagggccct

SEQ ID NO: 48553 - DNA, 20 bp, Artificial Sequence
  chemically synthesized
ggatgactgacagggccctt

SEQ ID NO: 48554 - DNA, 20 bp, Artificial Sequence
  chemically synthesized
gatgactgacagggccctta

SEQ ID NO: 48555 - DNA, 20 bp, Artificial Sequence
  chemically synthesized
cagggcccttagggaacact

SEQ ID NO: 48556 - DNA, 20 bp, Artificial Sequence
  chemically synthesized
gttttaattacatcttttaa

SEQ ID NO: 48557 - DNA, 20 bp, Artificial Sequence
  chemically synthesized
ttaattacatcttttaatag

SEQ ID NO: 48558 - DNA, 20 bp, Artificial Sequence
  chemically synthesized
taattacatcttttaatagc

SEQ ID NO: 48559 - DNA, 20 bp, Artificial Sequence
  chemically synthesized
ttacatcttttaatagcagg

SEQ ID NO: 48560 - DNA, 20 bp, Artificial Sequence
  chemically synthesized
catcttttaatagcaggaag

SEQ ID NO: 48561 - DNA, 20 bp, Artificial Sequence
  chemically synthesized
agcagaactctgcacttcaa

SEQ ID NO: 48562 - DNA, 20 bp, Artificial Sequence
  chemically synthesized
tcaaaagtttttcctcacct

SEQ ID NO: 48563 - DNA, 20 bp, Artificial Sequence
  chemically synthesized
caaaagtttttcctcacctg

SEQ ID NO: 48564 - DNA, 20 bp, Artificial Sequence
  chemically synthesized
aaagtttttcctcacctgag

SEQ ID NO: 48565 - DNA, 20 bp, Artificial Sequence
  chemically synthesized
cctcacctgaggagttaatt

SEQ ID NO: 48566 - DNA, 20 bp, Artificial Sequence
  chemically synthesized
ctgaggagttaatttagtac

SEQ ID NO: 48567 - DNA, 20 bp, Artificial Sequence
  chemically synthesized
tgaggagttaatttagtaca

SEQ ID NO: 48568 - DNA, 20 bp, Artificial Sequence
  chemically synthesized
gaggagttaatttagtacaa

SEQ ID NO: 48569 - DNA, 20 bp, Artificial Sequence
  chemically synthesized
aggagttaatttagtacaag

SEQ ID NO: 48570 - DNA, 20 bp, Artificial Sequence
  chemically synthesized
taatttagtacaaggggaaa

SEQ ID NO: 48571 - DNA, 20 bp, Artificial Sequence
  chemically synthesized
tagtacaaggggaaaaagta

SEQ ID NO: 48572 - DNA, 20 bp, Artificial Sequence
  chemically synthesized
agtacaaggggaaaaagtac

SEQ ID NO: 48573 - DNA, 20 bp, Artificial Sequence
  chemically synthesized
gtacaaggggaaaaagtaca

SEQ ID NO: 48574 - DNA, 20 bp, Artificial Sequence
  chemically synthesized
tacaaggggaaaaagtacag

SEQ ID NO: 48575 - DNA, 20 bp, Artificial Sequence
  chemically synthesized
acaaggggaaaaagtacagg

SEQ ID NO: 48576 - DNA, 20 bp, Artificial Sequence
  chemically synthesized
ggggaaaaagtacaggggga

SEQ ID NO: 48577 - DNA, 20 bp, Artificial Sequence
  chemically synthesized
gggaaaaagtacagggggat

SEQ ID NO: 48578 - DNA, 20 bp, Artificial Sequence
  chemically synthesized
gaaaaagtacagggggatgg

SEQ ID NO: 48579 - DNA, 20 bp, Artificial Sequence
  chemically synthesized
aagtacagggggatgggaga

SEQ ID NO: 48580 - DNA, 20 bp, Artificial Sequence
  chemically synthesized
agtacagggggatgggagaa

SEQ ID NO: 48581 - DNA, 20 bp, Artificial Sequence
  chemically synthesized
tgggagaaaggcgatcacgt

SEQ ID NO: 48582 - DNA, 20 bp, Artificial Sequence
  chemically synthesized
gggagaaaggcgatcacgtt

SEQ ID NO: 48583 - DNA, 20 bp, Artificial Sequence
  chemically synthesized
agaaaggcgatcacgttggg

SEQ ID NO: 48584 - DNA, 20 bp, Artificial Sequence
  chemically synthesized
gcgatcacgttgggaagcta

SEQ ID NO: 48585 - DNA, 20 bp, Artificial Sequence
  chemically synthesized
gatcacgttgggaagctata

SEQ ID NO: 48586 - DNA, 20 bp, Artificial Sequence
  chemically synthesized
acgttgggaagctatagaga

SEQ ID NO: 48587 - DNA, 20 bp, Artificial Sequence
  chemically synthesized
ttgggaagctatagagaaag

SEQ ID NO: 48588 - DNA, 20 bp, Artificial Sequence
  chemically synthesized
gggaagctatagagaaagaa

SEQ ID NO: 48589 - DNA, 20 bp, Artificial Sequence
  chemically synthesized
agagaaagaagagtaaattt

SEQ ID NO: 48590 - DNA, 20 bp, Artificial Sequence
  chemically synthesized
aagaagagtaaattttagta

SEQ ID NO: 48591 - DNA, 20 bp, Artificial Sequence
  chemically synthesized
agaagagtaaattttagtaa

SEQ ID NO: 48592 - DNA, 20 bp, Artificial Sequence
  chemically synthesized
aagagtaaattttagtaaag

SEQ ID NO: 48593 - DNA, 20 bp, Artificial Sequence
  chemically synthesized
agagtaaattttagtaaagg

SEQ ID NO: 48594 - DNA, 20 bp, Artificial Sequence
  chemically synthesized
gtttaaacaaacaaaatata

SEQ ID NO: 48595 - DNA, 20 bp, Artificial Sequence
  chemically synthesized
ttaaacaaacaaaatataaa

SEQ ID NO: 48596 - DNA, 20 bp, Artificial Sequence
  chemically synthesized
aaacaaaatataaagagaaa

SEQ ID NO: 48597 - DNA, 20 bp, Artificial Sequence
  chemically synthesized
aacaaaatataaagagaaat

SEQ ID NO: 48598 - DNA, 20 bp, Artificial Sequence
  chemically synthesized
gagaaataggaacttgaatc

SEQ ID NO: 48599 - DNA, 20 bp, Artificial Sequence
  chemically synthesized
agaaataggaacttgaatca

SEQ ID NO: 48600 - DNA, 20 bp, Artificial Sequence
  chemically synthesized
aaggaaatgattttaaaacg

SEQ ID NO: 48601 - DNA, 20 bp, Artificial Sequence
  chemically synthesized
attttaaaacgcagtattct

SEQ ID NO: 48602 - DNA, 20 bp, Artificial Sequence
  chemically synthesized
ttaaaacgcagtattcttag

SEQ ID NO: 48603 - DNA, 20 bp, Artificial Sequence
  chemically synthesized
acgcagtattcttagtggac

SEQ ID NO: 48604 - DNA, 20 bp, Artificial Sequence
  chemically synthesized
gcagtattcttagtggacta

SEQ ID NO: 48605 - DNA, 20 bp, Artificial Sequence
  chemically synthesized
cagtattcttagtggactag

SEQ ID NO: 48606 - DNA, 20 bp, Artificial Sequence
  chemically synthesized
ctagaggaaaaaaataatct

SEQ ID NO: 48607 - DNA, 20 bp, Artificial Sequence
  chemically synthesized
ggaaaaaaataatctgagcc

SEQ ID NO: 48608 - DNA, 20 bp, Artificial Sequence
  chemically synthesized
aaaaaataatctgagccaag

SEQ ID NO: 48609 - DNA, 20 bp, Artificial Sequence
  chemically synthesized
aaataatctgagccaagtag

SEQ ID NO: 48610 - DNA, 20 bp, Artificial Sequence
  chemically synthesized
ccctcctacccctactttct

SEQ ID NO: 48611 - DNA, 20 bp, Artificial Sequence
  chemically synthesized
tacccctactttctaagtca

SEQ ID NO: 48612 - DNA, 20 bp, Artificial Sequence
  chemically synthesized
cccctactttctaagtcaca

SEQ ID NO: 48613 - DNA, 20 bp, Artificial Sequence
  chemically synthesized
ccctactttctaagtcacag

SEQ ID NO: 48614 - DNA, 20 bp, Artificial Sequence
  chemically synthesized
acagaggctttttgttcccc

SEQ ID NO: 48615 - DNA, 20 bp, Artificial Sequence
  chemically synthesized
tgttcccccagacactcttg

SEQ ID NO: 48616 - DNA, 20 bp, Artificial Sequence
  chemically synthesized
ccccagacactcttgcagat

SEQ ID NO: 48617 - DNA, 20 bp, Artificial Sequence
  chemically synthesized
gacactcttgcagattagtc

SEQ ID NO: 48618 - DNA, 20 bp, Artificial Sequence
  chemically synthesized
acactcttgcagattagtcc

SEQ ID NO: 48619 - DNA, 20 bp, Artificial Sequence
  chemically synthesized
ctcttgcagattagtccagg

SEQ ID NO: 48620 - DNA, 20 bp, Artificial Sequence
  chemically synthesized
cagattagtccaggcagaaa

SEQ ID NO: 48621 - DNA, 20 bp, Artificial Sequence
  chemically synthesized
ttagtccaggcagaaacagt

SEQ ID NO: 48622 - DNA, 20 bp, Artificial Sequence
  chemically synthesized
cagaaacagttagatgtccc

SEQ ID NO: 48623 - DNA, 20 bp, Artificial Sequence
  chemically synthesized
accactgattaccccattga

SEQ ID NO: 48624 - DNA, 20 bp, Artificial Sequence
  chemically synthesized
ccccattgatagtcacactt

SEQ ID NO: 48625 - DNA, 20 bp, Artificial Sequence
  chemically synthesized
cccattgatagtcacacttt

SEQ ID NO: 48626 - DNA, 20 bp, Artificial Sequence
  chemically synthesized
atagtcacactttgggttgt

SEQ ID NO: 48627 - DNA, 20 bp, Artificial Sequence
  chemically synthesized
tttgtatttttgactgcatt

SEQ ID NO: 48628 - DNA, 20 bp, Artificial Sequence
  chemically synthesized
tgtatttttgactgcattaa

SEQ ID NO: 48629 - DNA, 20 bp, Artificial Sequence
  chemically synthesized
gtatttttgactgcattaag

SEQ ID NO: 48630 - DNA, 20 bp, Artificial Sequence
  chemically synthesized
tgactgcattaagaggtctc

SEQ ID NO: 48631 - DNA, 20 bp, Artificial Sequence
  chemically synthesized
cttgtttcccaaaacctaat

SEQ ID NO: 48632 - DNA, 20 bp, Artificial Sequence
  chemically synthesized
cctaataagtaactaatgca

SEQ ID NO: 48633 - DNA, 20 bp, Artificial Sequence
  chemically synthesized
taataagtaactaatgcaca

SEQ ID NO: 48634 - DNA, 20 bp, Artificial Sequence
  chemically synthesized
atttgtatttattctatttt

SEQ ID NO: 48635 - DNA, 20 bp, Artificial Sequence
  chemically synthesized
tatttttagacataatttat

SEQ ID NO: 48636 - DNA, 20 bp, Artificial Sequence
  chemically synthesized
cataatttattagcatgcat

SEQ ID NO: 48637 - DNA, 20 bp, Artificial Sequence
  chemically synthesized
ttagcatgcatgagcaaatt

SEQ ID NO: 48638 - DNA, 20 bp, Artificial Sequence
  chemically synthesized
tatattttttcttttcttac

SEQ ID NO: 48639 - DNA, 20 bp, Artificial Sequence
  chemically synthesized
attttttcttttcttaccag

SEQ ID NO: 48640 - DNA, 20 bp, Artificial Sequence
  chemically synthesized
ttttttcttttcttaccaga

SEQ ID NO: 48641 - DNA, 20 bp, Artificial Sequence
  chemically synthesized
cagaaggttttaatccaaat

SEQ ID NO: 48642 - DNA, 20 bp, Artificial Sequence
  chemically synthesized
agaaggttttaatccaaata

SEQ ID NO: 48643 - DNA, 20 bp, Artificial Sequence
  chemically synthesized
aaggttttaatccaaataag

SEQ ID NO: 48644 - DNA, 20 bp, Artificial Sequence
  chemically synthesized
gttttaatccaaataaggag

SEQ ID NO: 48645 - DNA, 20 bp, Artificial Sequence
  chemically synthesized
aaataaggagaagatatgct

SEQ ID NO: 48646 - DNA, 20 bp, Artificial Sequence
  chemically synthesized
gagaagatatgcttagaacc

SEQ ID NO: 48647 - DNA, 20 bp, Artificial Sequence
  chemically synthesized
agaagatatgcttagaaccg

SEQ ID NO: 48648 - DNA, 20 bp, Artificial Sequence
  chemically synthesized
agatatgcttagaaccgagg

SEQ ID NO: 48649 - DNA, 20 bp, Artificial Sequence
  chemically synthesized
atatgcttagaaccgaggta

SEQ ID NO: 48650 - DNA, 20 bp, Artificial Sequence
  chemically synthesized
tttcatccattctgtcctgt

SEQ ID NO: 48651 - DNA, 20 bp, Artificial Sequence
  chemically synthesized
tgtaagtattttgcatattc

SEQ ID NO: 48652 - DNA, 20 bp, Artificial Sequence
  chemically synthesized
taagtattttgcatattctg

SEQ ID NO: 48653 - DNA, 20 bp, Artificial Sequence
  chemically synthesized
ttttgcatattctggagacg

SEQ ID NO: 48654 - DNA, 20 bp, Artificial Sequence
  chemically synthesized
tttgcatattctggagacgc

SEQ ID NO: 48655 - DNA, 20 bp, Artificial Sequence
  chemically synthesized
gcatattctggagacgcagg

SEQ ID NO: 48656 - DNA, 20 bp, Artificial Sequence
  chemically synthesized
atattctggagacgcaggaa

SEQ ID NO: 48657 - DNA, 20 bp, Artificial Sequence
  chemically synthesized
agatccatctacatatccca

SEQ ID NO: 48658 - DNA, 20 bp, Artificial Sequence
  chemically synthesized
catatcccaaagctgaatta

SEQ ID NO: 48659 - DNA, 20 bp, Artificial Sequence
  chemically synthesized
atcccaaagctgaattatgg

SEQ ID NO: 48660 - DNA, 20 bp, Artificial Sequence
  chemically synthesized
agacaaaactcttccacttt

SEQ ID NO: 48661 - DNA, 20 bp, Artificial Sequence
  chemically synthesized
caacttcttatttgtgtaat

SEQ ID NO: 48662 - DNA, 20 bp, Artificial Sequence
  chemically synthesized
tatttgtgtaataagaaaat

SEQ ID NO: 48663 - DNA, 20 bp, Artificial Sequence
  chemically synthesized
atttgtgtaataagaaaatt

SEQ ID NO: 48664 - DNA, 20 bp, Artificial Sequence
  chemically synthesized
cgatcttcaatatgcttacc

SEQ ID NO: 48665 - DNA, 20 bp, Artificial Sequence
  chemically synthesized
attacgtaaatacacttgca

SEQ ID NO: 48666 - DNA, 20 bp, Artificial Sequence
  chemically synthesized
ttacgtaaatacacttgcaa

SEQ ID NO: 48667 - DNA, 20 bp, Artificial Sequence
  chemically synthesized
acgtaaatacacttgcaaag

SEQ ID NO: 48668 - DNA, 20 bp, Artificial Sequence
  chemically synthesized
cgtaaatacacttgcaaagg

SEQ ID NO: 48669 - DNA, 20 bp, Artificial Sequence
  chemically synthesized
cttgcaaaggaggatgtttt

SEQ ID NO: 48670 - DNA, 20 bp, Artificial Sequence
  chemically synthesized
gcaaaggaggatgtttttag

SEQ ID NO: 48671 - DNA, 20 bp, Artificial Sequence
  chemically synthesized
ttagtagcaatttgtactga

SEQ ID NO: 48672 - DNA, 20 bp, Artificial Sequence
  chemically synthesized
agcaatttgtactgatggta

SEQ ID NO: 48673 - DNA, 20 bp, Artificial Sequence
  chemically synthesized
gcaatttgtactgatggtat

SEQ ID NO: 48674 - DNA, 20 bp, Artificial Sequence
  chemically synthesized
caatttgtactgatggtatg

SEQ ID NO: 48675 - DNA, 20 bp, Artificial Sequence
  chemically synthesized
tgtactgatggtatggggcc

SEQ ID NO: 48676 - DNA, 20 bp, Artificial Sequence
  chemically synthesized
tactgatggtatggggccaa

SEQ ID NO: 48677 - DNA, 20 bp, Artificial Sequence
  chemically synthesized
tggggccaagagatatatct

SEQ ID NO: 48678 - DNA, 20 bp, Artificial Sequence
  chemically synthesized
gggccaagagatatatctta

SEQ ID NO: 48679 - DNA, 20 bp, Artificial Sequence
  chemically synthesized
ggccaagagatatatcttag

SEQ ID NO: 48680 - DNA, 20 bp, Artificial Sequence
  chemically synthesized
gccaagagatatatcttaga

SEQ ID NO: 48681 - DNA, 20 bp, Artificial Sequence
  chemically synthesized
caagagatatatcttagagg

SEQ ID NO: 48682 - DNA, 20 bp, Artificial Sequence
  chemically synthesized
aagagatatatcttagaggg

SEQ ID NO: 48683 - DNA, 20 bp, Artificial Sequence
  chemically synthesized
agagatatatcttagaggga

SEQ ID NO: 48684 - DNA, 20 bp, Artificial Sequence
  chemically synthesized
tatatcttagagggagggct

SEQ ID NO: 48685 - DNA, 20 bp, Artificial Sequence
  chemically synthesized
atatcttagagggagggctg

SEQ ID NO: 48686 - DNA, 20 bp, Artificial Sequence
  chemically synthesized
tatcttagagggagggctga

SEQ ID NO: 48687 - DNA, 20 bp, Artificial Sequence
  chemically synthesized
gagggagggctgagggtttg

SEQ ID NO: 48688 - DNA, 20 bp, Artificial Sequence
  chemically synthesized
gggtttgaagtccaactcct

SEQ ID NO: 48689 - DNA, 20 bp, Artificial Sequence
  chemically synthesized
ttgaagtccaactcctaagc

SEQ ID NO: 48690 - DNA, 20 bp, Artificial Sequence
  chemically synthesized
tccaactcctaagccagtgc

SEQ ID NO: 48691 - DNA, 20 bp, Artificial Sequence
  chemically synthesized
aactcctaagccagtgccag

SEQ ID NO: 48692 - DNA, 20 bp, Artificial Sequence
  chemically synthesized
ctcctaagccagtgccagaa

SEQ ID NO: 48693 - DNA, 20 bp, Artificial Sequence
  chemically synthesized
aagccagtgccagaagagcc

SEQ ID NO: 48694 - DNA, 20 bp, Artificial Sequence
  chemically synthesized
agccagtgccagaagagcca

SEQ ID NO: 48695 - DNA, 20 bp, Artificial Sequence
  chemically synthesized
agtgccagaagagccaagga

SEQ ID NO: 48696 - DNA, 20 bp, Artificial Sequence
  chemically synthesized
gtgccagaagagccaaggac

SEQ ID NO: 48697 - DNA, 20 bp, Artificial Sequence
  chemically synthesized
agaagagccaaggacaggta

SEQ ID NO: 48698 - DNA, 20 bp, Artificial Sequence
  chemically synthesized
caggtacggctgtcatcact

SEQ ID NO: 48699 - DNA, 20 bp, Artificial Sequence
  chemically synthesized
atcacttagacctcaccctg

SEQ ID NO: 48700 - DNA, 20 bp, Artificial Sequence
  chemically synthesized
cacttagacctcaccctgtg

SEQ ID NO: 48701 - DNA, 20 bp, Artificial Sequence
  chemically synthesized
caccctgtggagccacaccc

SEQ ID NO: 48702 - DNA, 20 bp, Artificial Sequence
  chemically synthesized
accctgtggagccacaccct

SEQ ID NO: 48703 - DNA, 20 bp, Artificial Sequence
  chemically synthesized
ccctgtggagccacacccta

SEQ ID NO: 48704 - DNA, 20 bp, Artificial Sequence
  chemically synthesized
gtggagccacaccctagggt

SEQ ID NO: 48705 - DNA, 20 bp, Artificial Sequence
  chemically synthesized
agggttggccaatctactcc

SEQ ID NO: 48706 - DNA, 20 bp, Artificial Sequence
  chemically synthesized
gggttggccaatctactccc

SEQ ID NO: 48707 - DNA, 20 bp, Artificial Sequence
  chemically synthesized
gttggccaatctactcccag

SEQ ID NO: 48708 - DNA, 20 bp, Artificial Sequence
  chemically synthesized
ggccaatctactcccaggag

SEQ ID NO: 48709 - DNA, 20 bp, Artificial Sequence
  chemically synthesized
gccaatctactcccaggagc

SEQ ID NO: 48710 - DNA, 20 bp, Artificial Sequence
  chemically synthesized
ccaatctactcccaggagca

SEQ ID NO: 48711 - DNA, 20 bp, Artificial Sequence
  chemically synthesized
aatctactcccaggagcagg

SEQ ID NO: 48712 - DNA, 20 bp, Artificial Sequence
  chemically synthesized
atctactcccaggagcaggg

SEQ ID NO: 48713 - DNA, 20 bp, Artificial Sequence
  chemically synthesized
tctactcccaggagcaggga

SEQ ID NO: 48714 - DNA, 20 bp, Artificial Sequence
  chemically synthesized
actcccaggagcagggaggg

SEQ ID NO: 48715 - DNA, 20 bp, Artificial Sequence
  chemically synthesized
ctcccaggagcagggagggc

SEQ ID NO: 48716 - DNA, 20 bp, Artificial Sequence
  chemically synthesized
cccaggagcagggagggcag

SEQ ID NO: 48717 - DNA, 20 bp, Artificial Sequence
  chemically synthesized
ggagcagggagggcaggagc

SEQ ID NO: 48718 - DNA, 20 bp, Artificial Sequence
  chemically synthesized
gagcagggagggcaggagcc

SEQ ID NO: 48719 - DNA, 20 bp, Artificial Sequence
  chemically synthesized
agcagggagggcaggagcca

SEQ ID NO: 48720 - DNA, 20 bp, Artificial Sequence
  chemically synthesized
gggagggcaggagccagggc

SEQ ID NO: 48721 - DNA, 20 bp, Artificial Sequence
  chemically synthesized
ggagggcaggagccagggct

SEQ ID NO: 48722 - DNA, 20 bp, Artificial Sequence
  chemically synthesized
ggagccagggctgggcataa

SEQ ID NO: 48723 - DNA, 20 bp, Artificial Sequence
  chemically synthesized
ccagggctgggcataaaagt

SEQ ID NO: 48724 - DNA, 20 bp, Artificial Sequence
  chemically synthesized
cagggctgggcataaaagtc

SEQ ID NO: 48725 - DNA, 20 bp, Artificial Sequence
  chemically synthesized
agggctgggcataaaagtca

SEQ ID NO: 48726 - DNA, 20 bp, Artificial Sequence
  chemically synthesized
gctgggcataaaagtcaggg

SEQ ID NO: 48727 - DNA, 20 bp, Artificial Sequence
  chemically synthesized
tgggcataaaagtcagggca

SEQ ID NO: 48728 - DNA, 20 bp, Artificial Sequence
  chemically synthesized
tctgacacaactgtgttcac

SEQ ID NO: 48729 - DNA, 20 bp, Artificial Sequence
  chemically synthesized
tgttcactagcaacctcaaa

SEQ ID NO: 48730 - DNA, 20 bp, Artificial Sequence
  chemically synthesized
gcaacctcaaacagacacca

SEQ ID NO: 48731 - DNA, 20 bp, Artificial Sequence
  chemically synthesized
ccatggtgcatctgactcct

SEQ ID NO: 48732 - DNA, 20 bp, Artificial Sequence
  chemically synthesized
catggtgcatctgactcctg

SEQ ID NO: 48733 - DNA, 20 bp, Artificial Sequence
  chemically synthesized
tggtgcatctgactcctgag

SEQ ID NO: 48734 - DNA, 20 bp, Artificial Sequence
  chemically synthesized
tgcatctgactcctgaggag

SEQ ID NO: 48735 - DNA, 20 bp, Artificial Sequence
  chemically synthesized
agtctgccgttactgccctg

SEQ ID NO: 48736 - DNA, 20 bp, Artificial Sequence
  chemically synthesized
gtctgccgttactgccctgt

SEQ ID NO: 48737 - DNA, 20 bp, Artificial Sequence
  chemically synthesized
tctgccgttactgccctgtg

SEQ ID NO: 48738 - DNA, 20 bp, Artificial Sequence
  chemically synthesized
ccgttactgccctgtggggc

SEQ ID NO: 48739 - DNA, 20 bp, Artificial Sequence
  chemically synthesized
cgttactgccctgtggggca

SEQ ID NO: 48740 - DNA, 20 bp, Artificial Sequence
  chemically synthesized
cctgtggggcaaggtgaacg

SEQ ID NO: 48741 - DNA, 20 bp, Artificial Sequence
  chemically synthesized
gggcaaggtgaacgtggatg

SEQ ID NO: 48742 - DNA, 20 bp, Artificial Sequence
  chemically synthesized
aaggtgaacgtggatgaagt

SEQ ID NO: 48743 - DNA, 20 bp, Artificial Sequence
  chemically synthesized
gtgaacgtggatgaagttgg

SEQ ID NO: 48744 - DNA, 20 bp, Artificial Sequence
  chemically synthesized
acgtggatgaagttggtggt

SEQ ID NO: 48745 - DNA, 20 bp, Artificial Sequence
  chemically synthesized
cgtggatgaagttggtggtg

SEQ ID NO: 48746 - DNA, 20 bp, Artificial Sequence
  chemically synthesized
tgaagttggtggtgaggccc

SEQ ID NO: 48747 - DNA, 20 bp, Artificial Sequence
  chemically synthesized
gaagttggtggtgaggccct

SEQ ID NO: 48748 - DNA, 20 bp, Artificial Sequence
  chemically synthesized
gttggtggtgaggccctggg

SEQ ID NO: 48749 - DNA, 20 bp, Artificial Sequence
  chemically synthesized
ttggtggtgaggccctgggc

SEQ ID NO: 48750 - DNA, 20 bp, Artificial Sequence
  chemically synthesized
tggtgaggccctgggcaggt

SEQ ID NO: 48751 - DNA, 20 bp, Artificial Sequence
  chemically synthesized
gccctgggcaggttggtatc

SEQ ID NO: 48752 - DNA, 20 bp, Artificial Sequence
  chemically synthesized
ccctgggcaggttggtatca

SEQ ID NO: 48753 - DNA, 20 bp, Artificial Sequence
  chemically synthesized
caggttggtatcaaggttac

SEQ ID NO: 48754 - DNA, 20 bp, Artificial Sequence
  chemically synthesized
ttggtatcaaggttacaaga

SEQ ID NO: 48755 - DNA, 20 bp, Artificial Sequence
  chemically synthesized
tggtatcaaggttacaagac

SEQ ID NO: 48756 - DNA, 20 bp, Artificial Sequence
  chemically synthesized
caaggttacaagacaggttt

SEQ ID NO: 48757 - DNA, 20 bp, Artificial Sequence
  chemically synthesized
aaggttacaagacaggttta

SEQ ID NO: 48758 - DNA, 20 bp, Artificial Sequence
  chemically synthesized
ggttacaagacaggtttaag

SEQ ID NO: 48759 - DNA, 20 bp, Artificial Sequence
  chemically synthesized
gacaggtttaaggagaccaa

SEQ ID NO: 48760 - DNA, 20 bp, Artificial Sequence
  chemically synthesized
ttaaggagaccaatagaaac

SEQ ID NO: 48761 - DNA, 20 bp, Artificial Sequence
  chemically synthesized
taaggagaccaatagaaact

SEQ ID NO: 48762 - DNA, 20 bp, Artificial Sequence
  chemically synthesized
accaatagaaactgggcatg

SEQ ID NO: 48763 - DNA, 20 bp, Artificial Sequence
  chemically synthesized
caatagaaactgggcatgtg

SEQ ID NO: 48764 - DNA, 20 bp, Artificial Sequence
  chemically synthesized
agaaactgggcatgtggaga

SEQ ID NO: 48765 - DNA, 20 bp, Artificial Sequence
  chemically synthesized
aaactgggcatgtggagaca

SEQ ID NO: 48766 - DNA, 20 bp, Artificial Sequence
  chemically synthesized
ctgggcatgtggagacagag

SEQ ID NO: 48767 - DNA, 20 bp, Artificial Sequence
  chemically synthesized
gtggagacagagaagactct

SEQ ID NO: 48768 - DNA, 20 bp, Artificial Sequence
  chemically synthesized
tggagacagagaagactctt

SEQ ID NO: 48769 - DNA, 20 bp, Artificial Sequence
  chemically synthesized
gaagactcttgggtttctga

SEQ ID NO: 48770 - DNA, 20 bp, Artificial Sequence
  chemically synthesized
aagactcttgggtttctgat

SEQ ID NO: 48771 - DNA, 20 bp, Artificial Sequence
  chemically synthesized
cactgactctctctgcctat

SEQ ID NO: 48772 - DNA, 20 bp, Artificial Sequence
  chemically synthesized
ttggtctattttcccaccct

SEQ ID NO: 48773 - DNA, 20 bp, Artificial Sequence
  chemically synthesized
tggtctattttcccaccctt

SEQ ID NO: 48774 - DNA, 20 bp, Artificial Sequence
  chemically synthesized
ttttcccacccttaggctgc

SEQ ID NO: 48775 - DNA, 20 bp, Artificial Sequence
  chemically synthesized
tcccacccttaggctgctgg

SEQ ID NO: 48776 - DNA, 20 bp, Artificial Sequence
  chemically synthesized
ggctgctggtggtctaccct

SEQ ID NO: 48777 - DNA, 20 bp, Artificial Sequence
  chemically synthesized
tggtggtctacccttggacc

SEQ ID NO: 48778 - DNA, 20 bp, Artificial Sequence
  chemically synthesized
gtggtctacccttggaccca

SEQ ID NO: 48779 - DNA, 20 bp, Artificial Sequence
  chemically synthesized
tggtctacccttggacccag

SEQ ID NO: 48780 - DNA, 20 bp, Artificial Sequence
  chemically synthesized
cttggacccagaggttcttt

SEQ ID NO: 48781 - DNA, 20 bp, Artificial Sequence
  chemically synthesized
cagaggttctttgagtcctt

SEQ ID NO: 48782 - DNA, 20 bp, Artificial Sequence
  chemically synthesized
agaggttctttgagtccttt

SEQ ID NO: 48783 - DNA, 20 bp, Artificial Sequence
  chemically synthesized
gaggttctttgagtcctttg

SEQ ID NO: 48784 - DNA, 20 bp, Artificial Sequence
  chemically synthesized
gtccactcctgatgctgtta

SEQ ID NO: 48785 - DNA, 20 bp, Artificial Sequence
  chemically synthesized
tccactcctgatgctgttat

SEQ ID NO: 48786 - DNA, 20 bp, Artificial Sequence
  chemically synthesized
atgctgttatgggcaaccct

SEQ ID NO: 48787 - DNA, 20 bp, Artificial Sequence
  chemically synthesized
tgctgttatgggcaacccta

SEQ ID NO: 48788 - DNA, 20 bp, Artificial Sequence
  chemically synthesized
ttatgggcaaccctaaggtg

SEQ ID NO: 48789 - DNA, 20 bp, Artificial Sequence
  chemically synthesized
tatgggcaaccctaaggtga

SEQ ID NO: 48790 - DNA, 20 bp, Artificial Sequence
  chemically synthesized
aaccctaaggtgaaggctca

SEQ ID NO: 48791 - DNA, 20 bp, Artificial Sequence
  chemically synthesized
ctaaggtgaaggctcatggc

SEQ ID NO: 48792 - DNA, 20 bp, Artificial Sequence
  chemically synthesized
ggtgaaggctcatggcaaga

SEQ ID NO: 48793 - DNA, 20 bp, Artificial Sequence
  chemically synthesized
gctcatggcaagaaagtgct

SEQ ID NO: 48794 - DNA, 20 bp, Artificial Sequence
  chemically synthesized
aagaaagtgctcggtgcctt

SEQ ID NO: 48795 - DNA, 20 bp, Artificial Sequence
  chemically synthesized
gtgctcggtgcctttagtga

SEQ ID NO: 48796 - DNA, 20 bp, Artificial Sequence
  chemically synthesized
cggtgcctttagtgatggcc

SEQ ID NO: 48797 - DNA, 20 bp, Artificial Sequence
  chemically synthesized
tagtgatggcctggctcacc

SEQ ID NO: 48798 - DNA, 20 bp, Artificial Sequence
  chemically synthesized
tggctcacctggacaacctc

SEQ ID NO: 48799 - DNA, 20 bp, Artificial Sequence
  chemically synthesized
ggctcacctggacaacctca

SEQ ID NO: 48800 - DNA, 20 bp, Artificial Sequence
  chemically synthesized
gctcacctggacaacctcaa

SEQ ID NO: 48801 - DNA, 20 bp, Artificial Sequence
  chemically synthesized
aagggcacctttgccacact

SEQ ID NO: 48802 - DNA, 20 bp, Artificial Sequence
  chemically synthesized
gcacctttgccacactgagt

SEQ ID NO: 48803 - DNA, 20 bp, Artificial Sequence
  chemically synthesized
tgagtgagctgcactgtgac

SEQ ID NO: 48804 - DNA, 20 bp, Artificial Sequence
  chemically synthesized
gcactgtgacaagctgcacg

SEQ ID NO: 48805 - DNA, 20 bp, Artificial Sequence
  chemically synthesized
acaagctgcacgtggatcct

SEQ ID NO: 48806 - DNA, 20 bp, Artificial Sequence
  chemically synthesized
cacgtggatcctgagaactt

SEQ ID NO: 48807 - DNA, 20 bp, Artificial Sequence
  chemically synthesized
acgtggatcctgagaacttc

SEQ ID NO: 48808 - DNA, 20 bp, Artificial Sequence
  chemically synthesized
cgtggatcctgagaacttca

SEQ ID NO: 48809 - DNA, 20 bp, Artificial Sequence
  chemically synthesized
gatcctgagaacttcagggt

SEQ ID NO: 48810 - DNA, 20 bp, Artificial Sequence
  chemically synthesized
agaacttcagggtgagtcta

SEQ ID NO: 48811 - DNA, 20 bp, Artificial Sequence
  chemically synthesized
gaacttcagggtgagtctat

SEQ ID NO: 48812 - DNA, 20 bp, Artificial Sequence
  chemically synthesized
ttctttccccttcttttcta

SEQ ID NO: 48813 - DNA, 20 bp, Artificial Sequence
  chemically synthesized
tccccttcttttctatggtt

SEQ ID NO: 48814 - DNA, 20 bp, Artificial Sequence
  chemically synthesized
ctatggttaagttcatgtca

SEQ ID NO: 48815 - DNA, 20 bp, Artificial Sequence
  chemically synthesized
tatggttaagttcatgtcat

SEQ ID NO: 48816 - DNA, 20 bp, Artificial Sequence
  chemically synthesized
ggttaagttcatgtcatagg

SEQ ID NO: 48817 - DNA, 20 bp, Artificial Sequence
  chemically synthesized
gttaagttcatgtcatagga

SEQ ID NO: 48818 - DNA, 20 bp, Artificial Sequence
  chemically synthesized
ttaagttcatgtcataggaa

SEQ ID NO: 48819 - DNA, 20 bp, Artificial Sequence
  chemically synthesized
taagttcatgtcataggaag

SEQ ID NO: 48820 - DNA, 20 bp, Artificial Sequence
  chemically synthesized
tcatgtcataggaaggggat

SEQ ID NO: 48821 - DNA, 20 bp, Artificial Sequence
  chemically synthesized
cataggaaggggataagtaa

SEQ ID NO: 48822 - DNA, 20 bp, Artificial Sequence
  chemically synthesized
ataggaaggggataagtaac

SEQ ID NO: 48823 - DNA, 20 bp, Artificial Sequence
  chemically synthesized
taggaaggggataagtaaca

SEQ ID NO: 48824 - DNA, 20 bp, Artificial Sequence
  chemically synthesized
aggggataagtaacagggta

SEQ ID NO: 48825 - DNA, 20 bp, Artificial Sequence
  chemically synthesized
ataagtaacagggtacagtt

SEQ ID NO: 48826 - DNA, 20 bp, Artificial Sequence
  chemically synthesized
taacagggtacagtttagaa

SEQ ID NO: 48827 - DNA, 20 bp, Artificial Sequence
  chemically synthesized
aacagggtacagtttagaat

SEQ ID NO: 48828 - DNA, 20 bp, Artificial Sequence
  chemically synthesized
gtacagtttagaatgggaaa

SEQ ID NO: 48829 - DNA, 20 bp, Artificial Sequence
  chemically synthesized
aaacagacgaatgattgcat

SEQ ID NO: 48830 - DNA, 20 bp, Artificial Sequence
  chemically synthesized
gacgaatgattgcatcagtg

SEQ ID NO: 48831 - DNA, 20 bp, Artificial Sequence
  chemically synthesized
gaatgattgcatcagtgtgg

SEQ ID NO: 48832 - DNA, 20 bp, Artificial Sequence
  chemically synthesized
ttgcatcagtgtggaagtct

SEQ ID NO: 48833 - DNA, 20 bp, Artificial Sequence
  chemically synthesized
tgcatcagtgtggaagtctc

SEQ ID NO: 48834 - DNA, 20 bp, Artificial Sequence
  chemically synthesized
tggaagtctcaggatcgttt

SEQ ID NO: 48835 - DNA, 20 bp, Artificial Sequence
  chemically synthesized
cttaacattgtgtataacaa

SEQ ID NO: 48836 - DNA, 20 bp, Artificial Sequence
  chemically synthesized
ttaacattgtgtataacaaa

SEQ ID NO: 48837 - DNA, 20 bp, Artificial Sequence
  chemically synthesized
taacaaaaggaaatatctct

SEQ ID NO: 48838 - DNA, 20 bp, Artificial Sequence
  chemically synthesized
aaatatctctgagatacatt

SEQ ID NO: 48839 - DNA, 20 bp, Artificial Sequence
  chemically synthesized
acttaaaaaaaaactttaca

SEQ ID NO: 48840 - DNA, 20 bp, Artificial Sequence
  chemically synthesized
aaaactttacacagtctgcc

SEQ ID NO: 48841 - DNA, 20 bp, Artificial Sequence
  chemically synthesized
ctgcctagtacattactatt

SEQ ID NO: 48842 - DNA, 20 bp, Artificial Sequence
  chemically synthesized
ataatcattatacatattta

SEQ ID NO: 48843 - DNA, 20 bp, Artificial Sequence
  chemically synthesized
taatcattatacatatttat

SEQ ID NO: 48844 - DNA, 20 bp, Artificial Sequence
  chemically synthesized
ttatacatatttatgggtta

SEQ ID NO: 48845 - DNA, 20 bp, Artificial Sequence
  chemically synthesized
tgtacacatattgaccaaat

SEQ ID NO: 48846 - DNA, 20 bp, Artificial Sequence
  chemically synthesized
gtacacatattgaccaaatc

SEQ ID NO: 48847 - DNA, 20 bp, Artificial Sequence
  chemically synthesized
tacacatattgaccaaatca

SEQ ID NO: 48848 - DNA, 20 bp, Artificial Sequence
  chemically synthesized
tttccctaatctctttcttt

SEQ ID NO: 48849 - DNA, 20 bp, Artificial Sequence
  chemically synthesized
ttccctaatctctttctttc

SEQ ID NO: 48850 - DNA, 20 bp, Artificial Sequence
  chemically synthesized
tccctaatctctttctttca

SEQ ID NO: 48851 - DNA, 20 bp, Artificial Sequence
  chemically synthesized
tgcctctttgcaccattcta

SEQ ID NO: 48852 - DNA, 20 bp, Artificial Sequence
  chemically synthesized
tgcaccattctaaagaataa

SEQ ID NO: 48853 - DNA, 20 bp, Artificial Sequence
  chemically synthesized
agaataacagtgataatttc

SEQ ID NO: 48854 - DNA, 20 bp, Artificial Sequence
  chemically synthesized
gaataacagtgataatttct

SEQ ID NO: 48855 - DNA, 20 bp, Artificial Sequence
  chemically synthesized
acagtgataatttctgggtt

SEQ ID NO: 48856 - DNA, 20 bp, Artificial Sequence
  chemically synthesized
cagtgataatttctgggtta

SEQ ID NO: 48857 - DNA, 20 bp, Artificial Sequence
  chemically synthesized
taatttctgggttaaggcaa

SEQ ID NO: 48858 - DNA, 20 bp, Artificial Sequence
  chemically synthesized
atataaattgtaactgatgt

SEQ ID NO: 48859 - DNA, 20 bp, Artificial Sequence
  chemically synthesized
ataaattgtaactgatgtaa

SEQ ID NO: 48860 - DNA, 20 bp, Artificial Sequence
  chemically synthesized
taaattgtaactgatgtaag

SEQ ID NO: 48861 - DNA, 20 bp, Artificial Sequence
  chemically synthesized
aagaggtttcatattgctaa

SEQ ID NO: 48862 - DNA, 20 bp, Artificial Sequence
  chemically synthesized
aggtttcatattgctaatag

SEQ ID NO: 48863 - DNA, 20 bp, Artificial Sequence
  chemically synthesized
tgctaatagcagctacaatc

SEQ ID NO: 48864 - DNA, 20 bp, Artificial Sequence
  chemically synthesized
accattctgcttttatttta

SEQ ID NO: 48865 - DNA, 20 bp, Artificial Sequence
  chemically synthesized
ttctgcttttattttatggt

SEQ ID NO: 48866 - DNA, 20 bp, Artificial Sequence
  chemically synthesized
tctgcttttattttatggtt

SEQ ID NO: 48867 - DNA, 20 bp, Artificial Sequence
  chemically synthesized
ttttattttatggttgggat

SEQ ID NO: 48868 - DNA, 20 bp, Artificial Sequence
  chemically synthesized
tttattttatggttgggata

SEQ ID NO: 48869 - DNA, 20 bp, Artificial Sequence
  chemically synthesized
ttttatggttgggataaggc

SEQ ID NO: 48870 - DNA, 20 bp, Artificial Sequence
  chemically synthesized
ggataaggctggattattct

SEQ ID NO: 48871 - DNA, 20 bp, Artificial Sequence
  chemically synthesized
ggctggattattctgagtcc

SEQ ID NO: 48872 - DNA, 20 bp, Artificial Sequence
  chemically synthesized
ggattattctgagtccaagc

SEQ ID NO: 48873 - DNA, 20 bp, Artificial Sequence
  chemically synthesized
gattattctgagtccaagct

SEQ ID NO: 48874 - DNA, 20 bp, Artificial Sequence
  chemically synthesized
tacctcttatcttcctccca

SEQ ID NO: 48875 - DNA, 20 bp, Artificial Sequence
  chemically synthesized
tatcttcctcccacagctcc

SEQ ID NO: 48876 - DNA, 20 bp, Artificial Sequence
  chemically synthesized
atcttcctcccacagctcct

SEQ ID NO: 48877 - DNA, 20 bp, Artificial Sequence
  chemically synthesized
acagctcctgggcaacgtgc

SEQ ID NO: 48878 - DNA, 20 bp, Artificial Sequence
  chemically synthesized
caacgtgctggtctgtgtgc

SEQ ID NO: 48879 - DNA, 20 bp, Artificial Sequence
  chemically synthesized
tgtgtgctggcccatcactt

SEQ ID NO: 48880 - DNA, 20 bp, Artificial Sequence
  chemically synthesized
gctggcccatcactttggca

SEQ ID NO: 48881 - DNA, 20 bp, Artificial Sequence
  chemically synthesized
tggcaaagaattcaccccac

SEQ ID NO: 48882 - DNA, 20 bp, Artificial Sequence
  chemically synthesized
aagaattcaccccaccagtg

SEQ ID NO: 48883 - DNA, 20 bp, Artificial Sequence
  chemically synthesized
agaattcaccccaccagtgc

SEQ ID NO: 48884 - DNA, 20 bp, Artificial Sequence
  chemically synthesized
caccagtgcaggctgcctat

SEQ ID NO: 48885 - DNA, 20 bp, Artificial Sequence
  chemically synthesized
agtgcaggctgcctatcaga

SEQ ID NO: 48886 - DNA, 20 bp, Artificial Sequence
  chemically synthesized
gcaggctgcctatcagaaag

SEQ ID NO: 48887 - DNA, 20 bp, Artificial Sequence
  chemically synthesized
ggctgcctatcagaaagtgg

SEQ ID NO: 48888 - DNA, 20 bp, Artificial Sequence
  chemically synthesized
gcctatcagaaagtggtggc

SEQ ID NO: 48889 - DNA, 20 bp, Artificial Sequence
  chemically synthesized
tcagaaagtggtggctggtg

SEQ ID NO: 48890 - DNA, 20 bp, Artificial Sequence
  chemically synthesized
ggctggtgtggctaatgccc

SEQ ID NO: 48891 - DNA, 20 bp, Artificial Sequence
  chemically synthesized
tggctaatgccctggcccac

SEQ ID NO: 48892 - DNA, 20 bp, Artificial Sequence
  chemically synthesized
cctggcccacaagtatcact

SEQ ID NO: 48893 - DNA, 20 bp, Artificial Sequence
  chemically synthesized
ttgctgtccaatttctatta

SEQ ID NO: 48894 - DNA, 20 bp, Artificial Sequence
  chemically synthesized
tgctgtccaatttctattaa

SEQ ID NO: 48895 - DNA, 20 bp, Artificial Sequence
  chemically synthesized
taaaggttcctttgttccct

SEQ ID NO: 48896 - DNA, 20 bp, Artificial Sequence
  chemically synthesized
cctaagtccaactactaaac

SEQ ID NO: 48897 - DNA, 20 bp, Artificial Sequence
  chemically synthesized
ctaagtccaactactaaact

SEQ ID NO: 48898 - DNA, 20 bp, Artificial Sequence
  chemically synthesized
taagtccaactactaaactg

SEQ ID NO: 48899 - DNA, 20 bp, Artificial Sequence
  chemically synthesized
aagtccaactactaaactgg

SEQ ID NO: 48900 - DNA, 20 bp, Artificial Sequence
  chemically synthesized
ctaaactgggggatattatg

SEQ ID NO: 48901 - DNA, 20 bp, Artificial Sequence
  chemically synthesized
taaactgggggatattatga

SEQ ID NO: 48902 - DNA, 20 bp, Artificial Sequence
  chemically synthesized
aaactgggggatattatgaa

SEQ ID NO: 48903 - DNA, 20 bp, Artificial Sequence
  chemically synthesized
gggatattatgaagggcctt

SEQ ID NO: 48904 - DNA, 20 bp, Artificial Sequence
  chemically synthesized
tatgaagggccttgagcatc

SEQ ID NO: 48905 - DNA, 20 bp, Artificial Sequence
  chemically synthesized
tttctgaatattttactaaa

SEQ ID NO: 48906 - DNA, 20 bp, Artificial Sequence
  chemically synthesized
ttctgaatattttactaaaa

SEQ ID NO: 48907 - DNA, 20 bp, Artificial Sequence
  chemically synthesized
tctgaatattttactaaaaa

SEQ ID NO: 48908 - DNA, 20 bp, Artificial Sequence
  chemically synthesized
attttactaaaaagggaatg

SEQ ID NO: 48909 - DNA, 20 bp, Artificial Sequence
  chemically synthesized
ttttactaaaaagggaatgt

SEQ ID NO: 48910 - DNA, 20 bp, Artificial Sequence
  chemically synthesized
ttactaaaaagggaatgtgg

SEQ ID NO: 48911 - DNA, 20 bp, Artificial Sequence
  chemically synthesized
tactaaaaagggaatgtggg

SEQ ID NO: 48912 - DNA, 20 bp, Artificial Sequence
  chemically synthesized
aaaaagggaatgtgggaggt

SEQ ID NO: 48913 - DNA, 20 bp, Artificial Sequence
  chemically synthesized
gtcagtgcatttaaaacata

SEQ ID NO: 48914 - DNA, 20 bp, Artificial Sequence
  chemically synthesized
atttaaaacataaagaaatg

SEQ ID NO: 48915 - DNA, 20 bp, Artificial Sequence
  chemically synthesized
ttaaaacataaagaaatgaa

SEQ ID NO: 48916 - DNA, 20 bp, Artificial Sequence
  chemically synthesized
aacataaagaaatgaagagc

SEQ ID NO: 48917 - DNA, 20 bp, Artificial Sequence
  chemically synthesized
tgaagagctagttcaaacct

SEQ ID NO: 48918 - DNA, 20 bp, Artificial Sequence
  chemically synthesized
gaagagctagttcaaacctt

SEQ ID NO: 48919 - DNA, 20 bp, Artificial Sequence
  chemically synthesized
ctatatcttaaactccatga

SEQ ID NO: 48920 - DNA, 20 bp, Artificial Sequence
  chemically synthesized
tatcttaaactccatgaaag

SEQ ID NO: 48921 - DNA, 20 bp, Artificial Sequence
  chemically synthesized
atcttaaactccatgaaaga

SEQ ID NO: 48922 - DNA, 20 bp, Artificial Sequence
  chemically synthesized
taaactccatgaaagaaggt

SEQ ID NO: 48923 - DNA, 20 bp, Artificial Sequence
  chemically synthesized
aaactccatgaaagaaggtg

SEQ ID NO: 48924 - DNA, 20 bp, Artificial Sequence
  chemically synthesized
aaagaaggtgaggctgcaaa

SEQ ID NO: 48925 - DNA, 20 bp, Artificial Sequence
  chemically synthesized
tgcaaacagctaatgcacat

SEQ ID NO: 48926 - DNA, 20 bp, Artificial Sequence
  chemically synthesized
cagctaatgcacattggcaa

SEQ ID NO: 48927 - DNA, 20 bp, Artificial Sequence
  chemically synthesized
catatgccttattcatccct

SEQ ID NO: 48928 - DNA, 20 bp, Artificial Sequence
  chemically synthesized
gccttattcatccctcagaa

SEQ ID NO: 48929 - DNA, 20 bp, Artificial Sequence
  chemically synthesized
ccttattcatccctcagaaa

SEQ ID NO: 48930 - DNA, 20 bp, Artificial Sequence
  chemically synthesized
catccctcagaaaaggattc

SEQ ID NO: 48931 - DNA, 20 bp, Artificial Sequence
  chemically synthesized
ccctcagaaaaggattcaag

SEQ ID NO: 48932 - DNA, 20 bp, Artificial Sequence
  chemically synthesized
ctcagaaaaggattcaagta

SEQ ID NO: 48933 - DNA, 20 bp, Artificial Sequence
  chemically synthesized
tcagaaaaggattcaagtag

SEQ ID NO: 48934 - DNA, 20 bp, Artificial Sequence
  chemically synthesized
attcaagtagaggcttgatt

SEQ ID NO: 48935 - DNA, 20 bp, Artificial Sequence
  chemically synthesized
tcaagtagaggcttgatttg

SEQ ID NO: 48936 - DNA, 20 bp, Artificial Sequence
  chemically synthesized
caagtagaggcttgatttgg

SEQ ID NO: 48937 - DNA, 20 bp, Artificial Sequence
  chemically synthesized
gaggcttgatttggaggtta

SEQ ID NO: 48938 - DNA, 20 bp, Artificial Sequence
  chemically synthesized
ttttacattacttattgttt

SEQ ID NO: 48939 - DNA, 20 bp, Artificial Sequence
  chemically synthesized
tttgcttatcctgcatctct

SEQ ID NO: 48940 - DNA, 20 bp, Artificial Sequence
  chemically synthesized
ctctcagccttgactccact

SEQ ID NO: 48941 - DNA, 20 bp, Artificial Sequence
  chemically synthesized
ctccactcagttctcttgct

SEQ ID NO: 48942 - DNA, 20 bp, Artificial Sequence
  chemically synthesized
ccactcagttctcttgctta

SEQ ID NO: 48943 - DNA, 20 bp, Artificial Sequence
  chemically synthesized
gagataccacctttcccctg

SEQ ID NO: 48944 - DNA, 20 bp, Artificial Sequence
  chemically synthesized
agtgttccttccatgtttta

SEQ ID NO: 48945 - DNA, 20 bp, Artificial Sequence
  chemically synthesized
ttccttccatgttttacggc

SEQ ID NO: 48946 - DNA, 20 bp, Artificial Sequence
  chemically synthesized
ttccatgttttacggcgaga

SEQ ID NO: 48947 - DNA, 20 bp, Artificial Sequence
  chemically synthesized
cgagatggtttctcctcgcc

SEQ ID NO: 48948 - DNA, 20 bp, Artificial Sequence
  chemically synthesized
tttctcctcgcctggccact

SEQ ID NO: 48949 - DNA, 20 bp, Artificial Sequence
  chemically synthesized
ctcgcctggccactcagcct

SEQ ID NO: 48950 - DNA, 20 bp, Artificial Sequence
  chemically synthesized
tagttgtctctgttgtctta

SEQ ID NO: 48951 - DNA, 20 bp, Artificial Sequence
  chemically synthesized
gttgtctctgttgtcttata

SEQ ID NO: 48952 - DNA, 20 bp, Artificial Sequence
  chemically synthesized
ttgtctctgttgtcttatag

SEQ ID NO: 48953 - DNA, 20 bp, Artificial Sequence
  chemically synthesized
gtcttatagaggtctacttg

SEQ ID NO: 48954 - DNA, 20 bp, Artificial Sequence
  chemically synthesized
ttatagaggtctacttgaag

SEQ ID NO: 48955 - DNA, 20 bp, Artificial Sequence
  chemically synthesized
tatagaggtctacttgaaga

SEQ ID NO: 48956 - DNA, 20 bp, Artificial Sequence
  chemically synthesized
tctacttgaagaaggaaaaa

SEQ ID NO: 48957 - DNA, 20 bp, Artificial Sequence
  chemically synthesized
ctacttgaagaaggaaaaac

SEQ ID NO: 48958 - DNA, 20 bp, Artificial Sequence
  chemically synthesized
tacttgaagaaggaaaaaca

SEQ ID NO: 48959 - DNA, 20 bp, Artificial Sequence
  chemically synthesized
acttgaagaaggaaaaacag

SEQ ID NO: 48960 - DNA, 20 bp, Artificial Sequence
  chemically synthesized
agaaggaaaaacaggggtca

SEQ ID NO: 48961 - DNA, 20 bp, Artificial Sequence
  chemically synthesized
tcatggtttgactgtcctgt

SEQ ID NO: 48962 - DNA, 20 bp, Artificial Sequence
  chemically synthesized
ttccctgcctcccccactca

SEQ ID NO: 48963 - DNA, 20 bp, Artificial Sequence
  chemically synthesized
ctcccccactcacagtgacc

SEQ ID NO: 48964 - DNA, 20 bp, Artificial Sequence
  chemically synthesized
tcacagtgacccggaatctg

SEQ ID NO: 48965 - DNA, 20 bp, Artificial Sequence
  chemically synthesized
tgacccggaatctgcagtgc

SEQ ID NO: 48966 - DNA, 20 bp, Artificial Sequence
  chemically synthesized
aatctgcagtgctagtctcc

SEQ ID NO: 48967 - DNA, 20 bp, Artificial Sequence
  chemically synthesized
ccggaactatcactctttca

SEQ ID NO: 48968 - DNA, 20 bp, Artificial Sequence
  chemically synthesized
cactctttcacagtctgctt

SEQ ID NO: 48969 - DNA, 20 bp, Artificial Sequence
  chemically synthesized
tctttcacagtctgctttgg

SEQ ID NO: 48970 - DNA, 20 bp, Artificial Sequence
  chemically synthesized
ctttcacagtctgctttgga

SEQ ID NO: 48971 - DNA, 20 bp, Artificial Sequence
  chemically synthesized
acagtctgctttggaaggac

SEQ ID NO: 48972 - DNA, 20 bp, Artificial Sequence
  chemically synthesized
cagtctgctttggaaggact

SEQ ID NO: 48973 - DNA, 20 bp, Artificial Sequence
  chemically synthesized
tgctttggaaggactgggct

SEQ ID NO: 48974 - DNA, 20 bp, Artificial Sequence
  chemically synthesized
aggactgggcttagtatgaa

SEQ ID NO: 48975 - DNA, 20 bp, Artificial Sequence
  chemically synthesized
ctgggcttagtatgaaaagt

SEQ ID NO: 48976 - DNA, 20 bp, Artificial Sequence
  chemically synthesized
tgggcttagtatgaaaagtt

SEQ ID NO: 48977 - DNA, 20 bp, Artificial Sequence
  chemically synthesized
tagtatgaaaagttaggact

SEQ ID NO: 48978 - DNA, 20 bp, Artificial Sequence
  chemically synthesized
tatgaaaagttaggactgag

SEQ ID NO: 48979 - DNA, 20 bp, Artificial Sequence
  chemically synthesized
taggactgagaagaatttga

SEQ ID NO: 48980 - DNA, 20 bp, Artificial Sequence
  chemically synthesized
aggactgagaagaatttgaa

SEQ ID NO: 48981 - DNA, 20 bp, Artificial Sequence
  chemically synthesized
actgagaagaatttgaaagg

SEQ ID NO: 48982 - DNA, 20 bp, Artificial Sequence
  chemically synthesized
atttgaaaggcggctttttg

SEQ ID NO: 48983 - DNA, 20 bp, Artificial Sequence
  chemically synthesized
actgtcttattaccctgtca

SEQ ID NO: 48984 - DNA, 20 bp, Artificial Sequence
  chemically synthesized
ctgtcttattaccctgtcat

SEQ ID NO: 48985 - DNA, 20 bp, Artificial Sequence
  chemically synthesized
tgtcataggcccaccccaaa

SEQ ID NO: 48986 - DNA, 20 bp, Artificial Sequence
  chemically synthesized
cataggcccaccccaaatgg

SEQ ID NO: 48987 - DNA, 20 bp, Artificial Sequence
  chemically synthesized
atggaagtcccattcttcct

SEQ ID NO: 48988 - DNA, 20 bp, Artificial Sequence
  chemically synthesized
tggaagtcccattcttcctc

SEQ ID NO: 48989 - DNA, 20 bp, Artificial Sequence
  chemically synthesized
cattcttcctcaggatgttt

SEQ ID NO: 48990 - DNA, 20 bp, Artificial Sequence
  chemically synthesized
ttcctcaggatgtttaagat

SEQ ID NO: 48991 - DNA, 20 bp, Artificial Sequence
  chemically synthesized
ggatgtttaagattagcatt

SEQ ID NO: 48992 - DNA, 20 bp, Artificial Sequence
  chemically synthesized
gatgtttaagattagcattc

SEQ ID NO: 48993 - DNA, 20 bp, Artificial Sequence
  chemically synthesized
gtttaagattagcattcagg

SEQ ID NO: 48994 - DNA, 20 bp, Artificial Sequence
  chemically synthesized
ttaagattagcattcaggaa

SEQ ID NO: 48995 - DNA, 20 bp, Artificial Sequence
  chemically synthesized
attagcattcaggaagagat

SEQ ID NO: 48996 - DNA, 20 bp, Artificial Sequence
  chemically synthesized
tagcattcaggaagagatca

SEQ ID NO: 48997 - DNA, 20 bp, Artificial Sequence
  chemically synthesized
agcattcaggaagagatcag

SEQ ID NO: 48998 - DNA, 20 bp, Artificial Sequence
  chemically synthesized
ggaagagatcagaggtctgc

SEQ ID NO: 48999 - DNA, 20 bp, Artificial Sequence
  chemically synthesized
ctcccttatcatgtccctta

SEQ ID NO: 49000 - DNA, 20 bp, Artificial Sequence
  chemically synthesized
catgtcccttatggtgcttc

SEQ ID NO: 49001 - DNA, 20 bp, Artificial Sequence
  chemically synthesized
ttatggtgcttctggctctg

SEQ ID NO: 49002 - DNA, 20 bp, Artificial Sequence
  chemically synthesized
gcttctggctctgcagttat

SEQ ID NO: 49003 - DNA, 20 bp, Artificial Sequence
  chemically synthesized
tggctctgcagttattagca

SEQ ID NO: 49004 - DNA, 20 bp, Artificial Sequence
  chemically synthesized
catttttcttattcaatacc

SEQ ID NO: 49005 - DNA, 20 bp, Artificial Sequence
  chemically synthesized
atttttcttattcaatacct

SEQ ID NO: 49006 - DNA, 20 bp, Artificial Sequence
  chemically synthesized
tttcttattcaatacctagg

SEQ ID NO: 49007 - DNA, 20 bp, Artificial Sequence
  chemically synthesized
ttcttattcaatacctaggt

SEQ ID NO: 49008 - DNA, 20 bp, Artificial Sequence
  chemically synthesized
ttattcaatacctaggtagg

SEQ ID NO: 49009 - DNA, 20 bp, Artificial Sequence
  chemically synthesized
atacctaggtaggtagatgc

SEQ ID NO: 49010 - DNA, 20 bp, Artificial Sequence
  chemically synthesized
ggtaggtagatgctagattc

SEQ ID NO: 49011 - DNA, 20 bp, Artificial Sequence
  chemically synthesized
agattctggaaataaaatat

SEQ ID NO: 49012 - DNA, 20 bp, Artificial Sequence
  chemically synthesized
ggaaataaaatatgagtctc

SEQ ID NO: 49013 - DNA, 20 bp, Artificial Sequence
  chemically synthesized
aataaaatatgagtctcaag

SEQ ID NO: 49014 - DNA, 20 bp, Artificial Sequence
  chemically synthesized
gtggtccttgtcctctctcc

SEQ ID NO: 49015 - DNA, 20 bp, Artificial Sequence
  chemically synthesized
tcccagtcaaattctgaatc

SEQ ID NO: 49016 - DNA, 20 bp, Artificial Sequence
  chemically synthesized
agtcaaattctgaatctagt

SEQ ID NO: 49017 - DNA, 20 bp, Artificial Sequence
  chemically synthesized
aaattctgaatctagttggc

SEQ ID NO: 49018 - DNA, 20 bp, Artificial Sequence
  chemically synthesized
gttggcaagattctgaaatc

SEQ ID NO: 49019 - DNA, 20 bp, Artificial Sequence
  chemically synthesized
ttggcaagattctgaaatca

SEQ ID NO: 49020 - DNA, 20 bp, Artificial Sequence
  chemically synthesized
ctgaaatcaaggcatataat

SEQ ID NO: 49021 - DNA, 20 bp, Artificial Sequence
  chemically synthesized
caaggcatataatcagtaat

SEQ ID NO: 49022 - DNA, 20 bp, Artificial Sequence
  chemically synthesized
taatcagtaataagtgatga

SEQ ID NO: 49023 - DNA, 20 bp, Artificial Sequence
  chemically synthesized
tcagtaataagtgatgatag

SEQ ID NO: 49024 - DNA, 20 bp, Artificial Sequence
  chemically synthesized
cagtaataagtgatgataga

SEQ ID NO: 49025 - DNA, 20 bp, Artificial Sequence
  chemically synthesized
agtaataagtgatgatagaa

SEQ ID NO: 49026 - DNA, 20 bp, Artificial Sequence
  chemically synthesized
agtgatgatagaagggtata

SEQ ID NO: 49027 - DNA, 20 bp, Artificial Sequence
  chemically synthesized
gatgatagaagggtatatag

SEQ ID NO: 49028 - DNA, 20 bp, Artificial Sequence
  chemically synthesized
atagaagaattttattatat

SEQ ID NO: 49029 - DNA, 20 bp, Artificial Sequence
  chemically synthesized
agaagaattttattatatga

SEQ ID NO: 49030 - DNA, 20 bp, Artificial Sequence
  chemically synthesized
gaagaattttattatatgag

SEQ ID NO: 49031 - DNA, 20 bp, Artificial Sequence
  chemically synthesized
aagaattttattatatgaga

SEQ ID NO: 49032 - DNA, 20 bp, Artificial Sequence
  chemically synthesized
ccctcaaaatgaaatgaaat

SEQ ID NO: 49033 - DNA, 20 bp, Artificial Sequence
  chemically synthesized
taaacaaaaataaatttgaa

SEQ ID NO: 49034 - DNA, 20 bp, Artificial Sequence
  chemically synthesized
aaacaaaaataaatttgaat

SEQ ID NO: 49035 - DNA, 20 bp, Artificial Sequence
  chemically synthesized
aaataaatttgaatgggtta

SEQ ID NO: 49036 - DNA, 20 bp, Artificial Sequence
  chemically synthesized
atgggttaaagaattaaact

SEQ ID NO: 49037 - DNA, 20 bp, Artificial Sequence
  chemically synthesized
taaaaccataaaaattttta

SEQ ID NO: 49038 - DNA, 20 bp, Artificial Sequence
  chemically synthesized
aaaatttttaaagaaatcaa

SEQ ID NO: 49039 - DNA, 20 bp, Artificial Sequence
  chemically synthesized
atttttaaagaaatcaaaag

SEQ ID NO: 49040 - DNA, 20 bp, Artificial Sequence
  chemically synthesized
aaattctaatattcacgttg

SEQ ID NO: 49041 - DNA, 20 bp, Artificial Sequence
  chemically synthesized
ccgttttttgaatttgatat

SEQ ID NO: 49042 - DNA, 20 bp, Artificial Sequence
  chemically synthesized
ttttttgaatttgatatgag

SEQ ID NO: 49043 - DNA, 20 bp, Artificial Sequence
  chemically synthesized
tgaatttgatatgagaagca

SEQ ID NO: 49044 - DNA, 20 bp, Artificial Sequence
  chemically synthesized
gaatttgatatgagaagcaa

SEQ ID NO: 49045 - DNA, 20 bp, Artificial Sequence
  chemically synthesized
atgagaagcaaaggcaacaa

SEQ ID NO: 49046 - DNA, 20 bp, Artificial Sequence
  chemically synthesized
tgagaagcaaaggcaacaaa

SEQ ID NO: 49047 - DNA, 20 bp, Artificial Sequence
  chemically synthesized
aggcaacaaaaggaaaaata

SEQ ID NO: 49048 - DNA, 20 bp, Artificial Sequence
  chemically synthesized
caacaaaaggaaaaataaag

SEQ ID NO: 49049 - DNA, 20 bp, Artificial Sequence
  chemically synthesized
aaaaggaaaaataaagaagt

SEQ ID NO: 49050 - DNA, 20 bp, Artificial Sequence
  chemically synthesized
aaaggaaaaataaagaagtg

SEQ ID NO: 49051 - DNA, 20 bp, Artificial Sequence
  chemically synthesized
acaaaacaatgaacaaatga

SEQ ID NO: 49052 - DNA, 20 bp, Artificial Sequence
  chemically synthesized
caaaacaatgaacaaatgaa

SEQ ID NO: 49053 - DNA, 20 bp, Artificial Sequence
  chemically synthesized
atgaaaggtgaaccatgaaa

SEQ ID NO: 49054 - DNA, 20 bp, Artificial Sequence
  chemically synthesized
caaatatttcttaaatattt

SEQ ID NO: 49055 - DNA, 20 bp, Artificial Sequence
  chemically synthesized
ggttaatatccaaaatatat

SEQ ID NO: 49056 - DNA, 20 bp, Artificial Sequence
  chemically synthesized
tccaaaatatataagaaaca

SEQ ID NO: 49057 - DNA, 20 bp, Artificial Sequence
  chemically synthesized
aacaaacaaaaaattaaaaa

SEQ ID NO: 49058 - DNA, 20 bp, Artificial Sequence
  chemically synthesized
acaaacaaaaaattaaaaat

SEQ ID NO: 49059 - DNA, 20 bp, Artificial Sequence
  chemically synthesized
aggaaaataaaaaaattaaa

SEQ ID NO: 49060 - DNA, 20 bp, Artificial Sequence
  chemically synthesized
aaaataaaaaaattaaaaag

SEQ ID NO: 49061 - DNA, 20 bp, Artificial Sequence
  chemically synthesized
gaagaaaatcctgccattta

SEQ ID NO: 49062 - DNA, 20 bp, Artificial Sequence
  chemically synthesized
gaaaatcctgccatttatgg

SEQ ID NO: 49063 - DNA, 20 bp, Artificial Sequence
  chemically synthesized
tatggcagaattgatgaacc

SEQ ID NO: 49064 - DNA, 20 bp, Artificial Sequence
  chemically synthesized
tggcagaattgatgaacctg

SEQ ID NO: 49065 - DNA, 20 bp, Artificial Sequence
  chemically synthesized
ggcagaattgatgaacctgg

SEQ ID NO: 49066 - DNA, 20 bp, Artificial Sequence
  chemically synthesized
aacctggaggatgtaaaact

SEQ ID NO: 49067 - DNA, 20 bp, Artificial Sequence
  chemically synthesized
gatgtaaaactaagaaaaat

SEQ ID NO: 49068 - DNA, 20 bp, Artificial Sequence
  chemically synthesized
aaaaataagcctgacacaaa

SEQ ID NO: 49069 - DNA, 20 bp, Artificial Sequence
  chemically synthesized
ctcatatgtgaaacataaaa

SEQ ID NO: 49070 - DNA, 20 bp, Artificial Sequence
  chemically synthesized
acataaaaaagtcactctca

SEQ ID NO: 49071 - DNA, 20 bp, Artificial Sequence
  chemically synthesized
aaaagtcactctcatggaaa

SEQ ID NO: 49072 - DNA, 20 bp, Artificial Sequence
  chemically synthesized
gtcactctcatggaaacaga

SEQ ID NO: 49073 - DNA, 20 bp, Artificial Sequence
  chemically synthesized
actctcatggaaacagacag

SEQ ID NO: 49074 - DNA, 20 bp, Artificial Sequence
  chemically synthesized
tctcatggaaacagacagta

SEQ ID NO: 49075 - DNA, 20 bp, Artificial Sequence
  chemically synthesized
ctcatggaaacagacagtag

SEQ ID NO: 49076 - DNA, 20 bp, Artificial Sequence
  chemically synthesized
ggaaacagacagtagaggta

SEQ ID NO: 49077 - DNA, 20 bp, Artificial Sequence
  chemically synthesized
gacagtagaggtatggtttc

SEQ ID NO: 49078 - DNA, 20 bp, Artificial Sequence
  chemically synthesized
acagtagaggtatggtttcc

SEQ ID NO: 49079 - DNA, 20 bp, Artificial Sequence
  chemically synthesized
cagtagaggtatggtttcca

SEQ ID NO: 49080 - DNA, 20 bp, Artificial Sequence
  chemically synthesized
agtagaggtatggtttccag

SEQ ID NO: 49081 - DNA, 20 bp, Artificial Sequence
  chemically synthesized
gaggtatggtttccaggggt

SEQ ID NO: 49082 - DNA, 20 bp, Artificial Sequence
  chemically synthesized
aggtatggtttccaggggtt

SEQ ID NO: 49083 - DNA, 20 bp, Artificial Sequence
  chemically synthesized
ggtatggtttccaggggttg

SEQ ID NO: 49084 - DNA, 20 bp, Artificial Sequence
  chemically synthesized
gtatggtttccaggggttgg

SEQ ID NO: 49085 - DNA, 20 bp, Artificial Sequence
  chemically synthesized
tggtttccaggggttggggg

SEQ ID NO: 49086 - DNA, 20 bp, Artificial Sequence
  chemically synthesized
ggtttccaggggttgggggt

SEQ ID NO: 49087 - DNA, 20 bp, Artificial Sequence
  chemically synthesized
tttccaggggttgggggtgg

SEQ ID NO: 49088 - DNA, 20 bp, Artificial Sequence
  chemically synthesized
ggggttgggggtgggagaat

SEQ ID NO: 49089 - DNA, 20 bp, Artificial Sequence
  chemically synthesized
gggttgggggtgggagaatc

SEQ ID NO: 49090 - DNA, 20 bp, Artificial Sequence
  chemically synthesized
aatcaggaaactattactca

SEQ ID NO: 49091 - DNA, 20 bp, Artificial Sequence
  chemically synthesized
atcaggaaactattactcaa

SEQ ID NO: 49092 - DNA, 20 bp, Artificial Sequence
  chemically synthesized
tcaggaaactattactcaaa

SEQ ID NO: 49093 - DNA, 20 bp, Artificial Sequence
  chemically synthesized
actcaaagggtataaaattt

SEQ ID NO: 49094 - DNA, 20 bp, Artificial Sequence
  chemically synthesized
ggtataaaatttcagttatg

SEQ ID NO: 49095 - DNA, 20 bp, Artificial Sequence
  chemically synthesized
gtataaaatttcagttatgt

SEQ ID NO: 49096 - DNA, 20 bp, Artificial Sequence
  chemically synthesized
tatgtgggatgaataaattc

SEQ ID NO: 49097 - DNA, 20 bp, Artificial Sequence
  chemically synthesized
aattctagatatctaatgta

SEQ ID NO: 49098 - DNA, 20 bp, Artificial Sequence
  chemically synthesized
aatgtacagcatcgtgactg

SEQ ID NO: 49099 - DNA, 20 bp, Artificial Sequence
  chemically synthesized
actgtagttaattgtactgt

SEQ ID NO: 49100 - DNA, 20 bp, Artificial Sequence
  chemically synthesized
aagtatatttaaaatttgca

SEQ ID NO: 49101 - DNA, 20 bp, Artificial Sequence
  chemically synthesized
gtatatttaaaatttgcaaa

SEQ ID NO: 49102 - DNA, 20 bp, Artificial Sequence
  chemically synthesized
atatttaaaatttgcaaaga

SEQ ID NO: 49103 - DNA, 20 bp, Artificial Sequence
  chemically synthesized
tttaaaatttgcaaagagag

SEQ ID NO: 49104 - DNA, 20 bp, Artificial Sequence
  chemically synthesized
agtagatttttttttttttt

SEQ ID NO: 49105 - DNA, 20 bp, Artificial Sequence
  chemically synthesized
gatttttttttttttttaga

SEQ ID NO: 49106 - DNA, 20 bp, Artificial Sequence
  chemically synthesized
tttttttttttttttagatg

SEQ ID NO: 49107 - DNA, 20 bp, Artificial Sequence
  chemically synthesized
ggagttttgctcttgttgtc

SEQ ID NO: 49108 - DNA, 20 bp, Artificial Sequence
  chemically synthesized
gagttttgctcttgttgtcc

SEQ ID NO: 49109 - DNA, 20 bp, Artificial Sequence
  chemically synthesized
tttgctcttgttgtccaggc

SEQ ID NO: 49110 - DNA, 20 bp, Artificial Sequence
  chemically synthesized
tgctcttgttgtccaggctg

SEQ ID NO: 49111 - DNA, 20 bp, Artificial Sequence
  chemically synthesized
ttgtccaggctggagtgcaa

SEQ ID NO: 49112 - DNA, 20 bp, Artificial Sequence
  chemically synthesized
ccaggctggagtgcaatggc

SEQ ID NO: 49113 - DNA, 20 bp, Artificial Sequence
  chemically synthesized
ggagtgcaatggcaagatct

SEQ ID NO: 49114 - DNA, 20 bp, Artificial Sequence
  chemically synthesized
tcactgcaacctccgcctcc

SEQ ID NO: 49115 - DNA, 20 bp, Artificial Sequence
  chemically synthesized
cactgcaacctccgcctcct

SEQ ID NO: 49116 - DNA, 20 bp, Artificial Sequence
  chemically synthesized
aacctccgcctcctgggttc

SEQ ID NO: 49117 - DNA, 20 bp, Artificial Sequence
  chemically synthesized
ttcaagcaaatctcctgcct

SEQ ID NO: 49118 - DNA, 20 bp, Artificial Sequence
  chemically synthesized
atctcctgcctcagcctccc

SEQ ID NO: 49119 - DNA, 20 bp, Artificial Sequence
  chemically synthesized
tcctgcctcagcctcccgag

SEQ ID NO: 49120 - DNA, 20 bp, Artificial Sequence
  chemically synthesized
gcctcagcctcccgagtagc

SEQ ID NO: 49121 - DNA, 20 bp, Artificial Sequence
  chemically synthesized
cctcagcctcccgagtagct

SEQ ID NO: 49122 - DNA, 20 bp, Artificial Sequence
  chemically synthesized
ctcccgagtagctgggatta

SEQ ID NO: 49123 - DNA, 20 bp, Artificial Sequence
  chemically synthesized
tcccgagtagctgggattac

SEQ ID NO: 49124 - DNA, 20 bp, Artificial Sequence
  chemically synthesized
caggcatgcgacaccatgcc

SEQ ID NO: 49125 - DNA, 20 bp, Artificial Sequence
  chemically synthesized
cccagctaattttgtatttt

SEQ ID NO: 49126 - DNA, 20 bp, Artificial Sequence
  chemically synthesized
agctaattttgtatttttag

SEQ ID NO: 49127 - DNA, 20 bp, Artificial Sequence
  chemically synthesized
ctaattttgtatttttagta

SEQ ID NO: 49128 - DNA, 20 bp, Artificial Sequence
  chemically synthesized
ttttgtatttttagtagaga

SEQ ID NO: 49129 - DNA, 20 bp, Artificial Sequence
  chemically synthesized
tttgtatttttagtagagac

SEQ ID NO: 49130 - DNA, 20 bp, Artificial Sequence
  chemically synthesized
ttgtatttttagtagagacg

SEQ ID NO: 49131 - DNA, 20 bp, Artificial Sequence
  chemically synthesized
gagacggggtttctccatgt

SEQ ID NO: 49132 - DNA, 20 bp, Artificial Sequence
  chemically synthesized
cggggtttctccatgttggt

SEQ ID NO: 49133 - DNA, 20 bp, Artificial Sequence
  chemically synthesized
ggggtttctccatgttggtc

SEQ ID NO: 49134 - DNA, 20 bp, Artificial Sequence
  chemically synthesized
tcaggctgatccgcctgcct

SEQ ID NO: 49135 - DNA, 20 bp, Artificial Sequence
  chemically synthesized
ccgcctgcctcggccaccca

SEQ ID NO: 49136 - DNA, 20 bp, Artificial Sequence
  chemically synthesized
cgcctgcctcggccacccaa

SEQ ID NO: 49137 - DNA, 20 bp, Artificial Sequence
  chemically synthesized
gcctgcctcggccacccaaa

SEQ ID NO: 49138 - DNA, 20 bp, Artificial Sequence
  chemically synthesized
gcctcggccacccaaagggc

SEQ ID NO: 49139 - DNA, 20 bp, Artificial Sequence
  chemically synthesized
cctcggccacccaaagggct

SEQ ID NO: 49140 - DNA, 20 bp, Artificial Sequence
  chemically synthesized
cacccaaagggctgggatta

SEQ ID NO: 49141 - DNA, 20 bp, Artificial Sequence
  chemically synthesized
acccaaagggctgggattac

SEQ ID NO: 49142 - DNA, 20 bp, Artificial Sequence
  chemically synthesized
agggctgggattacaggcgt

SEQ ID NO: 49143 - DNA, 20 bp, Artificial Sequence
  chemically synthesized
ggattacaggcgtgagccac

SEQ ID NO: 49144 - DNA, 20 bp, Artificial Sequence
  chemically synthesized
gattacaggcgtgagccacc

SEQ ID NO: 49145 - DNA, 20 bp, Artificial Sequence
  chemically synthesized
caggcgtgagccaccgggcc

SEQ ID NO: 49146 - DNA, 20 bp, Artificial Sequence
  chemically synthesized
gtgagccaccgggcctggcc

SEQ ID NO: 49147 - DNA, 20 bp, Artificial Sequence
  chemically synthesized
gagccaccgggcctggccga

SEQ ID NO: 49148 - DNA, 20 bp, Artificial Sequence
  chemically synthesized
ccaccgggcctggccgagag

SEQ ID NO: 49149 - DNA, 20 bp, Artificial Sequence
  chemically synthesized
tggccgagagtagatcttaa

SEQ ID NO: 49150 - DNA, 20 bp, Artificial Sequence
  chemically synthesized
atcttaaaagcatttaccac

SEQ ID NO: 49151 - DNA, 20 bp, Artificial Sequence
  chemically synthesized
aaagcatttaccacaagaaa

SEQ ID NO: 49152 - DNA, 20 bp, Artificial Sequence
  chemically synthesized
aagcatttaccacaagaaaa

SEQ ID NO: 49153 - DNA, 20 bp, Artificial Sequence
  chemically synthesized
caagaaaaaggtaactatgt

SEQ ID NO: 49154 - DNA, 20 bp, Artificial Sequence
  chemically synthesized
aaggtaactatgtgagataa

SEQ ID NO: 49155 - DNA, 20 bp, Artificial Sequence
  chemically synthesized
aggtaactatgtgagataat

SEQ ID NO: 49156 - DNA, 20 bp, Artificial Sequence
  chemically synthesized
gagataatgggtatgttaat

SEQ ID NO: 49157 - DNA, 20 bp, Artificial Sequence
  chemically synthesized
tatgttaattagcttgattg

SEQ ID NO: 49158 - DNA, 20 bp, Artificial Sequence
  chemically synthesized
gattgtggtaatcatttcac

SEQ ID NO: 49159 - DNA, 20 bp, Artificial Sequence
  chemically synthesized
attgtggtaatcatttcaca

SEQ ID NO: 49160 - DNA, 20 bp, Artificial Sequence
  chemically synthesized
ttgtgaatgatacctcaata

SEQ ID NO: 49161 - DNA, 20 bp, Artificial Sequence
  chemically synthesized
atgatacctcaataaagttg

SEQ ID NO: 49162 - DNA, 20 bp, Artificial Sequence
  chemically synthesized
aaagttgaagaataataaaa

SEQ ID NO: 49163 - DNA, 20 bp, Artificial Sequence
  chemically synthesized
tgaagaataataaaaaagaa

SEQ ID NO: 49164 - DNA, 20 bp, Artificial Sequence
  chemically synthesized
aaaaaatgcatcttgatgat

SEQ ID NO: 49165 - DNA, 20 bp, Artificial Sequence
  chemically synthesized
gaattgcattcttgattttt

SEQ ID NO: 49166 - DNA, 20 bp, Artificial Sequence
  chemically synthesized
caaaacaatacaataaattt

SEQ ID NO: 49167 - DNA, 20 bp, Artificial Sequence
  chemically synthesized
aattatatatatatatattt

SEQ ID NO: 49168 - DNA, 20 bp, Artificial Sequence
  chemically synthesized
tatattttagatattttgta

SEQ ID NO: 49169 - DNA, 20 bp, Artificial Sequence
  chemically synthesized
ttttgtatagttttactccc

SEQ ID NO: 49170 - DNA, 20 bp, Artificial Sequence
  chemically synthesized
gttttactccctagattttc

SEQ ID NO: 49171 - DNA, 20 bp, Artificial Sequence
  chemically synthesized
tttctagtgttattattaaa

SEQ ID NO: 49172 - DNA, 20 bp, Artificial Sequence
  chemically synthesized
agtgttattattaaatagtg

SEQ ID NO: 49173 - DNA, 20 bp, Artificial Sequence
  chemically synthesized
tcatttctaacattctctct

SEQ ID NO: 49174 - DNA, 20 bp, Artificial Sequence
  chemically synthesized
ttaatattatctctttctgc

SEQ ID NO: 49175 - DNA, 20 bp, Artificial Sequence
  chemically synthesized
tggaaatacattgttacttt

SEQ ID NO: 49176 - DNA, 20 bp, Artificial Sequence
  chemically synthesized
acttttggtttatctaaaaa

SEQ ID NO: 49177 - DNA, 20 bp, Artificial Sequence
  chemically synthesized
aattaataccactcatgtgt

SEQ ID NO: 49178 - DNA, 20 bp, Artificial Sequence
  chemically synthesized
aataccactcatgtgtaagt

SEQ ID NO: 49179 - DNA, 20 bp, Artificial Sequence
  chemically synthesized
ccactcatgtgtaagtaaga

SEQ ID NO: 49180 - DNA, 20 bp, Artificial Sequence
  chemically synthesized
ctcatgtgtaagtaagatag

SEQ ID NO: 49181 - DNA, 20 bp, Artificial Sequence
  chemically synthesized
aagtaagatagtggaataaa

SEQ ID NO: 49182 - DNA, 20 bp, Artificial Sequence
  chemically synthesized
taatgtgatatataaaaata

SEQ ID NO: 49183 - DNA, 20 bp, Artificial Sequence
  chemically synthesized
aaaaatatagcttttaaatt

SEQ ID NO: 49184 - DNA, 20 bp, Artificial Sequence
  chemically synthesized
tatagcttttaaatttagct

SEQ ID NO: 49185 - DNA, 20 bp, Artificial Sequence
  chemically synthesized
gcttggaaataaaaaacaaa

SEQ ID NO: 49186 - DNA, 20 bp, Artificial Sequence
  chemically synthesized
gaacaactatactttttgaa

SEQ ID NO: 49187 - DNA, 20 bp, Artificial Sequence
  chemically synthesized
acaactatactttttgaaaa

SEQ ID NO: 49188 - DNA, 20 bp, Artificial Sequence
  chemically synthesized
tatactttttgaaaagagta

SEQ ID NO: 49189 - DNA, 20 bp, Artificial Sequence
  chemically synthesized
accacaatcgattacacaat

SEQ ID NO: 49190 - DNA, 20 bp, Artificial Sequence
  chemically synthesized
ccacaatcgattacacaatt

SEQ ID NO: 49191 - DNA, 20 bp, Artificial Sequence
  chemically synthesized
cgattacacaattaggtgtg

SEQ ID NO: 49192 - DNA, 20 bp, Artificial Sequence
  chemically synthesized
gattacacaattaggtgtga

SEQ ID NO: 49193 - DNA, 20 bp, Artificial Sequence
  chemically synthesized
ttaggtgtgaaggtaaaatt

SEQ ID NO: 49194 - DNA, 20 bp, Artificial Sequence
  chemically synthesized
aaattcagtcacgaaaaaac

SEQ ID NO: 49195 - DNA, 20 bp, Artificial Sequence
  chemically synthesized
aaaaaactagaataaaaata

SEQ ID NO: 49196 - DNA, 20 bp, Artificial Sequence
  chemically synthesized
aaaaactagaataaaaatat

SEQ ID NO: 49197 - DNA, 20 bp, Artificial Sequence
  chemically synthesized
aactagaataaaaatatggg

SEQ ID NO: 49198 - DNA, 20 bp, Artificial Sequence
  chemically synthesized
ggaagacatgtatataatct

SEQ ID NO: 49199 - DNA, 20 bp, Artificial Sequence
  chemically synthesized
aagacatgtatataatctta

SEQ ID NO: 49200 - DNA, 20 bp, Artificial Sequence
  chemically synthesized
gttatttaattatcaaccca

SEQ ID NO: 49201 - DNA, 20 bp, Artificial Sequence
  chemically synthesized
atttaattatcaacccaaag

SEQ ID NO: 49202 - DNA, 20 bp, Artificial Sequence
  chemically synthesized
aacccaaagtagaaactatc

SEQ ID NO: 49203 - DNA, 20 bp, Artificial Sequence
  chemically synthesized
acccaaagtagaaactatca

SEQ ID NO: 49204 - DNA, 20 bp, Artificial Sequence
  chemically synthesized
cccaaagtagaaactatcaa

SEQ ID NO: 49205 - DNA, 20 bp, Artificial Sequence
  chemically synthesized
caaagtagaaactatcaagg

SEQ ID NO: 49206 - DNA, 20 bp, Artificial Sequence
  chemically synthesized
tatcaagggagaaataaatt

SEQ ID NO: 49207 - DNA, 20 bp, Artificial Sequence
  chemically synthesized
ataaattcagtcaacaataa

SEQ ID NO: 49208 - DNA, 20 bp, Artificial Sequence
  chemically synthesized
agtcaacaataaaagcattt

SEQ ID NO: 49209 - DNA, 20 bp, Artificial Sequence
  chemically synthesized
caacaataaaagcatttaag

SEQ ID NO: 49210 - DNA, 20 bp, Artificial Sequence
  chemically synthesized
aagcatttaagaagttattc

SEQ ID NO: 49211 - DNA, 20 bp, Artificial Sequence
  chemically synthesized
agcatttaagaagttattct

SEQ ID NO: 49212 - DNA, 20 bp, Artificial Sequence
  chemically synthesized
tttaagaagttattctaggc

SEQ ID NO: 49213 - DNA, 20 bp, Artificial Sequence
  chemically synthesized
ttaagaagttattctaggct

SEQ ID NO: 49214 - DNA, 20 bp, Artificial Sequence
  chemically synthesized
aagaagttattctaggctgg

SEQ ID NO: 49215 - DNA, 20 bp, Artificial Sequence
  chemically synthesized
aagttattctaggctgggag

SEQ ID NO: 49216 - DNA, 20 bp, Artificial Sequence
  chemically synthesized
ttattctaggctgggagcgg

SEQ ID NO: 49217 - DNA, 20 bp, Artificial Sequence
  chemically synthesized
gtggctcacacctgcaattg

SEQ ID NO: 49218 - DNA, 20 bp, Artificial Sequence
  chemically synthesized
cacctgcaattgcagcactt

SEQ ID NO: 49219 - DNA, 20 bp, Artificial Sequence
  chemically synthesized
acctgcaattgcagcacttt

SEQ ID NO: 49220 - DNA, 20 bp, Artificial Sequence
  chemically synthesized
ctgcaattgcagcactttgg

SEQ ID NO: 49221 - DNA, 20 bp, Artificial Sequence
  chemically synthesized
tgcaattgcagcactttggg

SEQ ID NO: 49222 - DNA, 20 bp, Artificial Sequence
  chemically synthesized
ttgcagcactttgggaggcc

SEQ ID NO: 49223 - DNA, 20 bp, Artificial Sequence
  chemically synthesized
agcactttgggaggcctaga

SEQ ID NO: 49224 - DNA, 20 bp, Artificial Sequence
  chemically synthesized
gcactttgggaggcctagac

SEQ ID NO: 49225 - DNA, 20 bp, Artificial Sequence
  chemically synthesized
ctttgggaggcctagacagg

SEQ ID NO: 49226 - DNA, 20 bp, Artificial Sequence
  chemically synthesized
agacaggcggatcacgacgt

SEQ ID NO: 49227 - DNA, 20 bp, Artificial Sequence
  chemically synthesized
gacaggcggatcacgacgtc

SEQ ID NO: 49228 - DNA, 20 bp, Artificial Sequence
  chemically synthesized
caggcggatcacgacgtcag

SEQ ID NO: 49229 - DNA, 20 bp, Artificial Sequence
  chemically synthesized
gatcacgacgtcaggagttc

SEQ ID NO: 49230 - DNA, 20 bp, Artificial Sequence
  chemically synthesized
cgacgtcaggagttcaagat

SEQ ID NO: 49231 - DNA, 20 bp, Artificial Sequence
  chemically synthesized
tcaggagttcaagatcagcc

SEQ ID NO: 49232 - DNA, 20 bp, Artificial Sequence
  chemically synthesized
caagatcagcctggccaaca

SEQ ID NO: 49233 - DNA, 20 bp, Artificial Sequence
  chemically synthesized
ctactaaaaatataaaaact

SEQ ID NO: 49234 - DNA, 20 bp, Artificial Sequence
  chemically synthesized
aaaaatataaaaacttagcc

SEQ ID NO: 49235 - DNA, 20 bp, Artificial Sequence
  chemically synthesized
tataaaaacttagcctggcg

SEQ ID NO: 49236 - DNA, 20 bp, Artificial Sequence
  chemically synthesized
aaaaacttagcctggcgtgg

SEQ ID NO: 49237 - DNA, 20 bp, Artificial Sequence
  chemically synthesized
aacttagcctggcgtggtgg

SEQ ID NO: 49238 - DNA, 20 bp, Artificial Sequence
  chemically synthesized
acttagcctggcgtggtggc

SEQ ID NO: 49239 - DNA, 20 bp, Artificial Sequence
  chemically synthesized
gtggcaggcatgtgtaatcc

SEQ ID NO: 49240 - DNA, 20 bp, Artificial Sequence
  chemically synthesized
catgtgtaatcccagcaatt

SEQ ID NO: 49241 - DNA, 20 bp, Artificial Sequence
  chemically synthesized
atgtgtaatcccagcaattt

SEQ ID NO: 49242 - DNA, 20 bp, Artificial Sequence
  chemically synthesized
gtgtaatcccagcaatttgg

SEQ ID NO: 49243 - DNA, 20 bp, Artificial Sequence
  chemically synthesized
tgtaatcccagcaatttggg

SEQ ID NO: 49244 - DNA, 20 bp, Artificial Sequence
  chemically synthesized
tcccagcaatttgggaggct

SEQ ID NO: 49245 - DNA, 20 bp, Artificial Sequence
  chemically synthesized
cccagcaatttgggaggctg

SEQ ID NO: 49246 - DNA, 20 bp, Artificial Sequence
  chemically synthesized
agcaatttgggaggctgagg

SEQ ID NO: 49247 - DNA, 20 bp, Artificial Sequence
  chemically synthesized
gcaatttgggaggctgaggc

SEQ ID NO: 49248 - DNA, 20 bp, Artificial Sequence
  chemically synthesized
aatttgggaggctgaggcag

SEQ ID NO: 49249 - DNA, 20 bp, Artificial Sequence
  chemically synthesized
gcaggagaatcgcttgatcc

SEQ ID NO: 49250 - DNA, 20 bp, Artificial Sequence
  chemically synthesized
caggagaatcgcttgatcct

SEQ ID NO: 49251 - DNA, 20 bp, Artificial Sequence
  chemically synthesized
ggagaatcgcttgatcctgg

SEQ ID NO: 49252 - DNA, 20 bp, Artificial Sequence
  chemically synthesized
gagaatcgcttgatcctggg

SEQ ID NO: 49253 - DNA, 20 bp, Artificial Sequence
  chemically synthesized
aatcgcttgatcctgggagg

SEQ ID NO: 49254 - DNA, 20 bp, Artificial Sequence
  chemically synthesized
tcgcttgatcctgggaggca

SEQ ID NO: 49255 - DNA, 20 bp, Artificial Sequence
  chemically synthesized
cgcttgatcctgggaggcag

SEQ ID NO: 49256 - DNA, 20 bp, Artificial Sequence
  chemically synthesized
atcctgggaggcagaggttg

SEQ ID NO: 49257 - DNA, 20 bp, Artificial Sequence
  chemically synthesized
tgggaggcagaggttgcagt

SEQ ID NO: 49258 - DNA, 20 bp, Artificial Sequence
  chemically synthesized
ggcagaggttgcagtgagcc

SEQ ID NO: 49259 - DNA, 20 bp, Artificial Sequence
  chemically synthesized
aagattgtgccactgcattc

SEQ ID NO: 49260 - DNA, 20 bp, Artificial Sequence
  chemically synthesized
tgtgccactgcattccagcc

SEQ ID NO: 49261 - DNA, 20 bp, Artificial Sequence
  chemically synthesized
gtgccactgcattccagccc

SEQ ID NO: 49262 - DNA, 20 bp, Artificial Sequence
  chemically synthesized
ctgcattccagcccaggtga

SEQ ID NO: 49263 - DNA, 20 bp, Artificial Sequence
  chemically synthesized
tccagcccaggtgacagcat

SEQ ID NO: 49264 - DNA, 20 bp, Artificial Sequence
  chemically synthesized
agactccgtcacaaaaaaaa

SEQ ID NO: 49265 - DNA, 20 bp, Artificial Sequence
  chemically synthesized
caaaaaaaaaagaaaaaaaa

SEQ ID NO: 49266 - DNA, 20 bp, Artificial Sequence
  chemically synthesized
aaaaaaaaaagaaaaaaaaa

SEQ ID NO: 49267 - DNA, 20 bp, Artificial Sequence
  chemically synthesized
aaaaaaaaagaaaaaaaaaa

SEQ ID NO: 49268 - DNA, 20 bp, Artificial Sequence
  chemically synthesized
aaaaaaaagaaaaaaaaaag

SEQ ID NO: 49269 - DNA, 20 bp, Artificial Sequence
  chemically synthesized
aaaaaaagaaaaaaaaaagg

SEQ ID NO: 49270 - DNA, 20 bp, Artificial Sequence
  chemically synthesized
aaaaaagaaaaaaaaaaggg

SEQ ID NO: 49271 - DNA, 20 bp, Artificial Sequence
  chemically synthesized
aaaaagaaaaaaaaaagggg

SEQ ID NO: 49272 - DNA, 20 bp, Artificial Sequence
  chemically synthesized
aaaagaaaaaaaaaaggggg

SEQ ID NO: 49273 - DNA, 20 bp, Artificial Sequence
  chemically synthesized
aaagaaaaaaaaaagggggg

SEQ ID NO: 49274 - DNA, 20 bp, Artificial Sequence
  chemically synthesized
aagaaaaaaaaaaggggggg

SEQ ID NO: 49275 - DNA, 20 bp, Artificial Sequence
  chemically synthesized
gaaaaaaaaaaggggggggg

SEQ ID NO: 49276 - DNA, 20 bp, Artificial Sequence
  chemically synthesized
aaaaaaaaggggggggggag

SEQ ID NO: 49277 - DNA, 20 bp, Artificial Sequence
  chemically synthesized
aaaaaggggggggggagcgg

SEQ ID NO: 49278 - DNA, 20 bp, Artificial Sequence
  chemically synthesized
aaaggggggggggagcggtg

SEQ ID NO: 49279 - DNA, 20 bp, Artificial Sequence
  chemically synthesized
ggggggggagcggtggagcc

SEQ ID NO: 49280 - DNA, 20 bp, Artificial Sequence
  chemically synthesized
gtggagccaagatgaccgaa

SEQ ID NO: 49281 - DNA, 20 bp, Artificial Sequence
  chemically synthesized
tggagccaagatgaccgaat

SEQ ID NO: 49282 - DNA, 20 bp, Artificial Sequence
  chemically synthesized
ccaagatgaccgaataggaa

SEQ ID NO: 49283 - DNA, 20 bp, Artificial Sequence
  chemically synthesized
tgaccgaataggaacagctc

SEQ ID NO: 49284 - DNA, 20 bp, Artificial Sequence
  chemically synthesized
ataggaacagctccagtcta

SEQ ID NO: 49285 - DNA, 20 bp, Artificial Sequence
  chemically synthesized
cagtctatagctcccatcgt

SEQ ID NO: 49286 - DNA, 20 bp, Artificial Sequence
  chemically synthesized
agctcccatcgtgagtgacg

SEQ ID NO: 49287 - DNA, 20 bp, Artificial Sequence
  chemically synthesized
tcccatcgtgagtgacgcag

SEQ ID NO: 49288 - DNA, 20 bp, Artificial Sequence
  chemically synthesized
atcgtgagtgacgcagaaga

SEQ ID NO: 49289 - DNA, 20 bp, Artificial Sequence
  chemically synthesized
tcgtgagtgacgcagaagac

SEQ ID NO: 49290 - DNA, 20 bp, Artificial Sequence
  chemically synthesized
tgatttctgcatttccaact

SEQ ID NO: 49291 - DNA, 20 bp, Artificial Sequence
  chemically synthesized
gatttctgcatttccaactg

SEQ ID NO: 49292 - DNA, 20 bp, Artificial Sequence
  chemically synthesized
tgcatttccaactgaggtac

SEQ ID NO: 49293 - DNA, 20 bp, Artificial Sequence
  chemically synthesized
gcatttccaactgaggtacc

SEQ ID NO: 49294 - DNA, 20 bp, Artificial Sequence
  chemically synthesized
gaggtaccaggttcatctca

SEQ ID NO: 49295 - DNA, 20 bp, Artificial Sequence
  chemically synthesized
aggtaccaggttcatctcac

SEQ ID NO: 49296 - DNA, 20 bp, Artificial Sequence
  chemically synthesized
ggtaccaggttcatctcaca

SEQ ID NO: 49297 - DNA, 20 bp, Artificial Sequence
  chemically synthesized
accaggttcatctcacaggg

SEQ ID NO: 49298 - DNA, 20 bp, Artificial Sequence
  chemically synthesized
ttcatctcacagggaagtgc

SEQ ID NO: 49299 - DNA, 20 bp, Artificial Sequence
  chemically synthesized
tcatctcacagggaagtgcc

SEQ ID NO: 49300 - DNA, 20 bp, Artificial Sequence
  chemically synthesized
tctcacagggaagtgccagg

SEQ ID NO: 49301 - DNA, 20 bp, Artificial Sequence
  chemically synthesized
cacagggaagtgccaggcag

SEQ ID NO: 49302 - DNA, 20 bp, Artificial Sequence
  chemically synthesized
acagggaagtgccaggcagt

SEQ ID NO: 49303 - DNA, 20 bp, Artificial Sequence
  chemically synthesized
gaagtgccaggcagtgggtg

SEQ ID NO: 49304 - DNA, 20 bp, Artificial Sequence
  chemically synthesized
aagtgccaggcagtgggtgc

SEQ ID NO: 49305 - DNA, 20 bp, Artificial Sequence
  chemically synthesized
gccaggcagtgggtgcagga

SEQ ID NO: 49306 - DNA, 20 bp, Artificial Sequence
  chemically synthesized
aggcagtgggtgcaggacag

SEQ ID NO: 49307 - DNA, 20 bp, Artificial Sequence
  chemically synthesized
ggcagtgggtgcaggacagt

SEQ ID NO: 49308 - DNA, 20 bp, Artificial Sequence
  chemically synthesized
tgggtgcaggacagtaggtg

SEQ ID NO: 49309 - DNA, 20 bp, Artificial Sequence
  chemically synthesized
aggtgcagtgcactgtgcat

SEQ ID NO: 49310 - DNA, 20 bp, Artificial Sequence
  chemically synthesized
agtgcactgtgcatgagcca

SEQ ID NO: 49311 - DNA, 20 bp, Artificial Sequence
  chemically synthesized
gcactgtgcatgagccaaag

SEQ ID NO: 49312 - DNA, 20 bp, Artificial Sequence
  chemically synthesized
cactgtgcatgagccaaagc

SEQ ID NO: 49313 - DNA, 20 bp, Artificial Sequence
  chemically synthesized
actgtgcatgagccaaagca

SEQ ID NO: 49314 - DNA, 20 bp, Artificial Sequence
  chemically synthesized
tgcatgagccaaagcagggc

SEQ ID NO: 49315 - DNA, 20 bp, Artificial Sequence
  chemically synthesized
gcatgagccaaagcagggcg

SEQ ID NO: 49316 - DNA, 20 bp, Artificial Sequence
  chemically synthesized
gggcgaggcatcacctcacc

SEQ ID NO: 49317 - DNA, 20 bp, Artificial Sequence
  chemically synthesized
ggcgaggcatcacctcaccc

SEQ ID NO: 49318 - DNA, 20 bp, Artificial Sequence
  chemically synthesized
gaggcatcacctcacccggg

SEQ ID NO: 49319 - DNA, 20 bp, Artificial Sequence
  chemically synthesized
tcacctcacccgggaagcac

SEQ ID NO: 49320 - DNA, 20 bp, Artificial Sequence
  chemically synthesized
cacctcacccgggaagcaca

SEQ ID NO: 49321 - DNA, 20 bp, Artificial Sequence
  chemically synthesized
acctcacccgggaagcacaa

SEQ ID NO: 49322 - DNA, 20 bp, Artificial Sequence
  chemically synthesized
cctcacccgggaagcacaag

SEQ ID NO: 49323 - DNA, 20 bp, Artificial Sequence
  chemically synthesized
acccgggaagcacaaggggt

SEQ ID NO: 49324 - DNA, 20 bp, Artificial Sequence
  chemically synthesized
cccgggaagcacaaggggtc

SEQ ID NO: 49325 - DNA, 20 bp, Artificial Sequence
  chemically synthesized
ccgggaagcacaaggggtca

SEQ ID NO: 49326 - DNA, 20 bp, Artificial Sequence
  chemically synthesized
ggtcagggaattccctttcc

SEQ ID NO: 49327 - DNA, 20 bp, Artificial Sequence
  chemically synthesized
ggaattccctttcctagtca

SEQ ID NO: 49328 - DNA, 20 bp, Artificial Sequence
  chemically synthesized
tccctttcctagtcaaagaa

SEQ ID NO: 49329 - DNA, 20 bp, Artificial Sequence
  chemically synthesized
ccctttcctagtcaaagaaa

SEQ ID NO: 49330 - DNA, 20 bp, Artificial Sequence
  chemically synthesized
cctttcctagtcaaagaaaa

SEQ ID NO: 49331 - DNA, 20 bp, Artificial Sequence
  chemically synthesized
ctagtcaaagaaaagggtga

SEQ ID NO: 49332 - DNA, 20 bp, Artificial Sequence
  chemically synthesized
tcaaagaaaagggtgacaga

SEQ ID NO: 49333 - DNA, 20 bp, Artificial Sequence
  chemically synthesized
aaagggtgacagatggcacc

SEQ ID NO: 49334 - DNA, 20 bp, Artificial Sequence
  chemically synthesized
acagatggcacctggaaaat

SEQ ID NO: 49335 - DNA, 20 bp, Artificial Sequence
  chemically synthesized
cagatggcacctggaaaatc

SEQ ID NO: 49336 - DNA, 20 bp, Artificial Sequence
  chemically synthesized
taatactgcgctcttccaac

SEQ ID NO: 49337 - DNA, 20 bp, Artificial Sequence
  chemically synthesized
cttccaacaagcttaacaaa

SEQ ID NO: 49338 - DNA, 20 bp, Artificial Sequence
  chemically synthesized
aagcttaacaaatggcacac

SEQ ID NO: 49339 - DNA, 20 bp, Artificial Sequence
  chemically synthesized
agcttaacaaatggcacacc

SEQ ID NO: 49340 - DNA, 20 bp, Artificial Sequence
  chemically synthesized
cttaacaaatggcacaccag

SEQ ID NO: 49341 - DNA, 20 bp, Artificial Sequence
  chemically synthesized
aggagattatatcccatgcc

SEQ ID NO: 49342 - DNA, 20 bp, Artificial Sequence
  chemically synthesized
attatatcccatgcctggct

SEQ ID NO: 49343 - DNA, 20 bp, Artificial Sequence
  chemically synthesized
tatatcccatgcctggctca

SEQ ID NO: 49344 - DNA, 20 bp, Artificial Sequence
  chemically synthesized
atatcccatgcctggctcag

SEQ ID NO: 49345 - DNA, 20 bp, Artificial Sequence
  chemically synthesized
tatcccatgcctggctcaga

SEQ ID NO: 49346 - DNA, 20 bp, Artificial Sequence
  chemically synthesized
ctcagagggtcctacgccca

SEQ ID NO: 49347 - DNA, 20 bp, Artificial Sequence
  chemically synthesized
cagagggtcctacgcccatg

SEQ ID NO: 49348 - DNA, 20 bp, Artificial Sequence
  chemically synthesized
catggagcctcgctcattgc

SEQ ID NO: 49349 - DNA, 20 bp, Artificial Sequence
  chemically synthesized
agcctcgctcattgctagca

SEQ ID NO: 49350 - DNA, 20 bp, Artificial Sequence
  chemically synthesized
ctcgctcattgctagcacag

SEQ ID NO: 49351 - DNA, 20 bp, Artificial Sequence
  chemically synthesized
cattgctagcacagcagtct

SEQ ID NO: 49352 - DNA, 20 bp, Artificial Sequence
  chemically synthesized
attgctagcacagcagtctg

SEQ ID NO: 49353 - DNA, 20 bp, Artificial Sequence
  chemically synthesized
gcagtctgaggtcaaactgc

SEQ ID NO: 49354 - DNA, 20 bp, Artificial Sequence
  chemically synthesized
cagtctgaggtcaaactgca

SEQ ID NO: 49355 - DNA, 20 bp, Artificial Sequence
  chemically synthesized
tctgaggtcaaactgcaagg

SEQ ID NO: 49356 - DNA, 20 bp, Artificial Sequence
  chemically synthesized
gaggtcaaactgcaaggtgg

SEQ ID NO: 49357 - DNA, 20 bp, Artificial Sequence
  chemically synthesized
tcaaactgcaaggtggcagt

SEQ ID NO: 49358 - DNA, 20 bp, Artificial Sequence
  chemically synthesized
caaactgcaaggtggcagtg

SEQ ID NO: 49359 - DNA, 20 bp, Artificial Sequence
  chemically synthesized
ctgcaaggtggcagtgaggc

SEQ ID NO: 49360 - DNA, 20 bp, Artificial Sequence
  chemically synthesized
tgcaaggtggcagtgaggct

SEQ ID NO: 49361 - DNA, 20 bp, Artificial Sequence
  chemically synthesized
gcaaggtggcagtgaggctg

SEQ ID NO: 49362 - DNA, 20 bp, Artificial Sequence
  chemically synthesized
caaggtggcagtgaggctgg

SEQ ID NO: 49363 - DNA, 20 bp, Artificial Sequence
  chemically synthesized
aggtggcagtgaggctgggg

SEQ ID NO: 49364 - DNA, 20 bp, Artificial Sequence
  chemically synthesized
ggtggcagtgaggctggggg

SEQ ID NO: 49365 - DNA, 20 bp, Artificial Sequence
  chemically synthesized
gtggcagtgaggctggggga

SEQ ID NO: 49366 - DNA, 20 bp, Artificial Sequence
  chemically synthesized
tggcagtgaggctgggggag

SEQ ID NO: 49367 - DNA, 20 bp, Artificial Sequence
  chemically synthesized
gaggggtgcccaccattgtc

SEQ ID NO: 49368 - DNA, 20 bp, Artificial Sequence
  chemically synthesized
aggggtgcccaccattgtcc

SEQ ID NO: 49369 - DNA, 20 bp, Artificial Sequence
  chemically synthesized
gcccaccattgtccaggctt

SEQ ID NO: 49370 - DNA, 20 bp, Artificial Sequence
  chemically synthesized
caccattgtccaggcttgag

SEQ ID NO: 49371 - DNA, 20 bp, Artificial Sequence
  chemically synthesized
accattgtccaggcttgagc

SEQ ID NO: 49372 - DNA, 20 bp, Artificial Sequence
  chemically synthesized
caggcttgagcaggtaaaca

SEQ ID NO: 49373 - DNA, 20 bp, Artificial Sequence
  chemically synthesized
agcaggtaaacaaagccgcc

SEQ ID NO: 49374 - DNA, 20 bp, Artificial Sequence
  chemically synthesized
aggtaaacaaagccgcctgg

SEQ ID NO: 49375 - DNA, 20 bp, Artificial Sequence
  chemically synthesized
agccgcctggaagctcgaac

SEQ ID NO: 49376 - DNA, 20 bp, Artificial Sequence
  chemically synthesized
gccgcctggaagctcgaact

SEQ ID NO: 49377 - DNA, 20 bp, Artificial Sequence
  chemically synthesized
gcctggaagctcgaactggg

SEQ ID NO: 49378 - DNA, 20 bp, Artificial Sequence
  chemically synthesized
ctggaagctcgaactgggtg

SEQ ID NO: 49379 - DNA, 20 bp, Artificial Sequence
  chemically synthesized
gaactgggtggagcccacca

SEQ ID NO: 49380 - DNA, 20 bp, Artificial Sequence
  chemically synthesized
ggtggagcccaccacagctc

SEQ ID NO: 49381 - DNA, 20 bp, Artificial Sequence
  chemically synthesized
gtggagcccaccacagctca

SEQ ID NO: 49382 - DNA, 20 bp, Artificial Sequence
  chemically synthesized
ggagcccaccacagctcaag

SEQ ID NO: 49383 - DNA, 20 bp, Artificial Sequence
  chemically synthesized
gagcccaccacagctcaagg

SEQ ID NO: 49384 - DNA, 20 bp, Artificial Sequence
  chemically synthesized
aggaggcctgcctgcctctg

SEQ ID NO: 49385 - DNA, 20 bp, Artificial Sequence
  chemically synthesized
ggaggcctgcctgcctctgt

SEQ ID NO: 49386 - DNA, 20 bp, Artificial Sequence
  chemically synthesized
gcctctgtaggctccacctc

SEQ ID NO: 49387 - DNA, 20 bp, Artificial Sequence
  chemically synthesized
cctctgtaggctccacctct

SEQ ID NO: 49388 - DNA, 20 bp, Artificial Sequence
  chemically synthesized
ctctgtaggctccacctcta

SEQ ID NO: 49389 - DNA, 20 bp, Artificial Sequence
  chemically synthesized
tctgtaggctccacctctag

SEQ ID NO: 49390 - DNA, 20 bp, Artificial Sequence
  chemically synthesized
gtaggctccacctctagggg

SEQ ID NO: 49391 - DNA, 20 bp, Artificial Sequence
  chemically synthesized
taggctccacctctaggggc

SEQ ID NO: 49392 - DNA, 20 bp, Artificial Sequence
  chemically synthesized
aggctccacctctaggggca

SEQ ID NO: 49393 - DNA, 20 bp, Artificial Sequence
  chemically synthesized
ccacctctaggggcagggca

SEQ ID NO: 49394 - DNA, 20 bp, Artificial Sequence
  chemically synthesized
ggcagggcacagacaaacaa

SEQ ID NO: 49395 - DNA, 20 bp, Artificial Sequence
  chemically synthesized
acagacaaacaaaagacaac

SEQ ID NO: 49396 - DNA, 20 bp, Artificial Sequence
  chemically synthesized
aaagacaacaagaacctctg

SEQ ID NO: 49397 - DNA, 20 bp, Artificial Sequence
  chemically synthesized
acttaaatgtccctgtctga

SEQ ID NO: 49398 - DNA, 20 bp, Artificial Sequence
  chemically synthesized
gtccctgtctgacagctttg

SEQ ID NO: 49399 - DNA, 20 bp, Artificial Sequence
  chemically synthesized
ccctgtctgacagctttgaa

SEQ ID NO: 49400 - DNA, 20 bp, Artificial Sequence
  chemically synthesized
ctgtctgacagctttgaaga

SEQ ID NO: 49401 - DNA, 20 bp, Artificial Sequence
  chemically synthesized
tctgacagctttgaagagag

SEQ ID NO: 49402 - DNA, 20 bp, Artificial Sequence
  chemically synthesized
gacagctttgaagagagtag

SEQ ID NO: 49403 - DNA, 20 bp, Artificial Sequence
  chemically synthesized
gaagagagtagtggttctcc

SEQ ID NO: 49404 - DNA, 20 bp, Artificial Sequence
  chemically synthesized
gtagtggttctcccagcaca

SEQ ID NO: 49405 - DNA, 20 bp, Artificial Sequence
  chemically synthesized
gttctcccagcacatagctt

SEQ ID NO: 49406 - DNA, 20 bp, Artificial Sequence
  chemically synthesized
cagcacatagcttcagatct

SEQ ID NO: 49407 - DNA, 20 bp, Artificial Sequence
  chemically synthesized
catagcttcagatctgagaa

SEQ ID NO: 49408 - DNA, 20 bp, Artificial Sequence
  chemically synthesized
atagcttcagatctgagaac

SEQ ID NO: 49409 - DNA, 20 bp, Artificial Sequence
  chemically synthesized
gcttcagatctgagaacagg

SEQ ID NO: 49410 - DNA, 20 bp, Artificial Sequence
  chemically synthesized
aacaggcagactgcctcctc

SEQ ID NO: 49411 - DNA, 20 bp, Artificial Sequence
  chemically synthesized
aggcagactgcctcctcaag

SEQ ID NO: 49412 - DNA, 20 bp, Artificial Sequence
  chemically synthesized
ggcagactgcctcctcaagt

SEQ ID NO: 49413 - DNA, 20 bp, Artificial Sequence
  chemically synthesized
caagtgggtccctgaccccc

SEQ ID NO: 49414 - DNA, 20 bp, Artificial Sequence
  chemically synthesized
gtgggtccctgacccccgag

SEQ ID NO: 49415 - DNA, 20 bp, Artificial Sequence
  chemically synthesized
tgacccccgagtagcctaac

SEQ ID NO: 49416 - DNA, 20 bp, Artificial Sequence
  chemically synthesized
gacccccgagtagcctaact

SEQ ID NO: 49417 - DNA, 20 bp, Artificial Sequence
  chemically synthesized
cccccgagtagcctaactgg

SEQ ID NO: 49418 - DNA, 20 bp, Artificial Sequence
  chemically synthesized
ccccgagtagcctaactggg

SEQ ID NO: 49419 - DNA, 20 bp, Artificial Sequence
  chemically synthesized
cctaactgggaggcatcccc

SEQ ID NO: 49420 - DNA, 20 bp, Artificial Sequence
  chemically synthesized
aactgggaggcatcccccag

SEQ ID NO: 49421 - DNA, 20 bp, Artificial Sequence
  chemically synthesized
actgggaggcatcccccagt

SEQ ID NO: 49422 - DNA, 20 bp, Artificial Sequence
  chemically synthesized
ctgggaggcatcccccagta

SEQ ID NO: 49423 - DNA, 20 bp, Artificial Sequence
  chemically synthesized
tgggaggcatcccccagtag

SEQ ID NO: 49424 - DNA, 20 bp, Artificial Sequence
  chemically synthesized
gaggcatcccccagtagggg

SEQ ID NO: 49425 - DNA, 20 bp, Artificial Sequence
  chemically synthesized
gggcagactgacacctcaca

SEQ ID NO: 49426 - DNA, 20 bp, Artificial Sequence
  chemically synthesized
agactgacacctcacatggc

SEQ ID NO: 49427 - DNA, 20 bp, Artificial Sequence
  chemically synthesized
cacatggctggtactcctct

SEQ ID NO: 49428 - DNA, 20 bp, Artificial Sequence
  chemically synthesized
ctcctctaagacaaaacttc

SEQ ID NO: 49429 - DNA, 20 bp, Artificial Sequence
  chemically synthesized
cctctaagacaaaacttcca

SEQ ID NO: 49430 - DNA, 20 bp, Artificial Sequence
  chemically synthesized
ctctaagacaaaacttccag

SEQ ID NO: 49431 - DNA, 20 bp, Artificial Sequence
  chemically synthesized
aaaacttccagaggaatgat

SEQ ID NO: 49432 - DNA, 20 bp, Artificial Sequence
  chemically synthesized
aaacttccagaggaatgatc

SEQ ID NO: 49433 - DNA, 20 bp, Artificial Sequence
  chemically synthesized
cttccagaggaatgatcagg

SEQ ID NO: 49434 - DNA, 20 bp, Artificial Sequence
  chemically synthesized
ccagaggaatgatcaggcag

SEQ ID NO: 49435 - DNA, 20 bp, Artificial Sequence
  chemically synthesized
tgatcaggcagcagcatttg

SEQ ID NO: 49436 - DNA, 20 bp, Artificial Sequence
  chemically synthesized
caccaatatccactgttctg

SEQ ID NO: 49437 - DNA, 20 bp, Artificial Sequence
  chemically synthesized
cagccaccgctgttgatacc

SEQ ID NO: 49438 - DNA, 20 bp, Artificial Sequence
  chemically synthesized
agccaccgctgttgataccc

SEQ ID NO: 49439 - DNA, 20 bp, Artificial Sequence
  chemically synthesized
gctgttgatacccaggaaaa

SEQ ID NO: 49440 - DNA, 20 bp, Artificial Sequence
  chemically synthesized
atacccaggaaaacagcttc

SEQ ID NO: 49441 - DNA, 20 bp, Artificial Sequence
  chemically synthesized
acccaggaaaacagcttctg

SEQ ID NO: 49442 - DNA, 20 bp, Artificial Sequence
  chemically synthesized
caggaaaacagcttctggag

SEQ ID NO: 49443 - DNA, 20 bp, Artificial Sequence
  chemically synthesized
cagcttctggagtggacctc

SEQ ID NO: 49444 - DNA, 20 bp, Artificial Sequence
  chemically synthesized
ggacctccagtaaactccaa

SEQ ID NO: 49445 - DNA, 20 bp, Artificial Sequence
  chemically synthesized
agtaaactccaacagacctg

SEQ ID NO: 49446 - DNA, 20 bp, Artificial Sequence
  chemically synthesized
actccaacagacctgcagct

SEQ ID NO: 49447 - DNA, 20 bp, Artificial Sequence
  chemically synthesized
ctccaacagacctgcagctg

SEQ ID NO: 49448 - DNA, 20 bp, Artificial Sequence
  chemically synthesized
tccaacagacctgcagctga

SEQ ID NO: 49449 - DNA, 20 bp, Artificial Sequence
  chemically synthesized
cagctgagggtcctgactgt

SEQ ID NO: 49450 - DNA, 20 bp, Artificial Sequence
  chemically synthesized
ctgagggtcctgactgttag

SEQ ID NO: 49451 - DNA, 20 bp, Artificial Sequence
  chemically synthesized
tgagggtcctgactgttaga

SEQ ID NO: 49452 - DNA, 20 bp, Artificial Sequence
  chemically synthesized
ttagaaggaaaactaacaaa

SEQ ID NO: 49453 - DNA, 20 bp, Artificial Sequence
  chemically synthesized
aaggaaaactaacaaacaga

SEQ ID NO: 49454 - DNA, 20 bp, Artificial Sequence
  chemically synthesized
aggaaaactaacaaacagaa

SEQ ID NO: 49455 - DNA, 20 bp, Artificial Sequence
  chemically synthesized
tctgtacatcgccatcatca

SEQ ID NO: 49456 - DNA, 20 bp, Artificial Sequence
  chemically synthesized
atcgccatcatcaaagacca

SEQ ID NO: 49457 - DNA, 20 bp, Artificial Sequence
  chemically synthesized
tcgccatcatcaaagaccaa

SEQ ID NO: 49458 - DNA, 20 bp, Artificial Sequence
  chemically synthesized
ccatcatcaaagaccaaagg

SEQ ID NO: 49459 - DNA, 20 bp, Artificial Sequence
  chemically synthesized
caaaggtagataaaaccata

SEQ ID NO: 49460 - DNA, 20 bp, Artificial Sequence
  chemically synthesized
ggtagataaaaccataaaga

SEQ ID NO: 49461 - DNA, 20 bp, Artificial Sequence
  chemically synthesized
gtagataaaaccataaagat

SEQ ID NO: 49462 - DNA, 20 bp, Artificial Sequence
  chemically synthesized
tagataaaaccataaagatg

SEQ ID NO: 49463 - DNA, 20 bp, Artificial Sequence
  chemically synthesized
aaaccataaagatggggaaa

SEQ ID NO: 49464 - DNA, 20 bp, Artificial Sequence
  chemically synthesized
ccataaagatggggaaaaag

SEQ ID NO: 49465 - DNA, 20 bp, Artificial Sequence
  chemically synthesized
ataaagatggggaaaaagca

SEQ ID NO: 49466 - DNA, 20 bp, Artificial Sequence
  chemically synthesized
aagatggggaaaaagcagag

SEQ ID NO: 49467 - DNA, 20 bp, Artificial Sequence
  chemically synthesized
aaaaagcagagcagaaaaac

SEQ ID NO: 49468 - DNA, 20 bp, Artificial Sequence
  chemically synthesized
aaactggacactctaaaaat

SEQ ID NO: 49469 - DNA, 20 bp, Artificial Sequence
  chemically synthesized
actggacactctaaaaatga

SEQ ID NO: 49470 - DNA, 20 bp, Artificial Sequence
  chemically synthesized
agagtgcctctcctcctcca

SEQ ID NO: 49471 - DNA, 20 bp, Artificial Sequence
  chemically synthesized
tctcctcctccaaagtaacg

SEQ ID NO: 49472 - DNA, 20 bp, Artificial Sequence
  chemically synthesized
aaagtaacgcagctcctcac

SEQ ID NO: 49473 - DNA, 20 bp, Artificial Sequence
  chemically synthesized
acgcagctcctcaccagcaa

SEQ ID NO: 49474 - DNA, 20 bp, Artificial Sequence
  chemically synthesized
tcctcaccagcaatggaaca

SEQ ID NO: 49475 - DNA, 20 bp, Artificial Sequence
  chemically synthesized
caccagcaatggaacaaagc

SEQ ID NO: 49476 - DNA, 20 bp, Artificial Sequence
  chemically synthesized
accagcaatggaacaaagct

SEQ ID NO: 49477 - DNA, 20 bp, Artificial Sequence
  chemically synthesized
agcaatggaacaaagctggg

SEQ ID NO: 49478 - DNA, 20 bp, Artificial Sequence
  chemically synthesized
caatggaacaaagctgggca

SEQ ID NO: 49479 - DNA, 20 bp, Artificial Sequence
  chemically synthesized
gggcagagaatgactttgac

SEQ ID NO: 49480 - DNA, 20 bp, Artificial Sequence
  chemically synthesized
gagaatgactttgacgagtt

SEQ ID NO: 49481 - DNA, 20 bp, Artificial Sequence
  chemically synthesized
gaatgactttgacgagttga

SEQ ID NO: 49482 - DNA, 20 bp, Artificial Sequence
  chemically synthesized
atgactttgacgagttgaga

SEQ ID NO: 49483 - DNA, 20 bp, Artificial Sequence
  chemically synthesized
tgactttgacgagttgagag

SEQ ID NO: 49484 - DNA, 20 bp, Artificial Sequence
  chemically synthesized
ctttgacgagttgagagagg

SEQ ID NO: 49485 - DNA, 20 bp, Artificial Sequence
  chemically synthesized
tttgacgagttgagagagga

SEQ ID NO: 49486 - DNA, 20 bp, Artificial Sequence
  chemically synthesized
gagttgagagaggaaggctt

SEQ ID NO: 49487 - DNA, 20 bp, Artificial Sequence
  chemically synthesized
ttgagagaggaaggcttcag

SEQ ID NO: 49488 - DNA, 20 bp, Artificial Sequence
  chemically synthesized
tcagaagatcaaactactcc

SEQ ID NO: 49489 - DNA, 20 bp, Artificial Sequence
  chemically synthesized
gatcaaactactccaagcta

SEQ ID NO: 49490 - DNA, 20 bp, Artificial Sequence
  chemically synthesized
atcaaactactccaagctaa

SEQ ID NO: 49491 - DNA, 20 bp, Artificial Sequence
  chemically synthesized
caaactactccaagctaaag

SEQ ID NO: 49492 - DNA, 20 bp, Artificial Sequence
  chemically synthesized
aaactactccaagctaaagg

SEQ ID NO: 49493 - DNA, 20 bp, Artificial Sequence
  chemically synthesized
ctactccaagctaaaggagg

SEQ ID NO: 49494 - DNA, 20 bp, Artificial Sequence
  chemically synthesized
aaggaggaagttcgaacaaa

SEQ ID NO: 49495 - DNA, 20 bp, Artificial Sequence
  chemically synthesized
ggaagttcgaacaaacggca

SEQ ID NO: 49496 - DNA, 20 bp, Artificial Sequence
  chemically synthesized
agttcgaacaaacggcaaag

SEQ ID NO: 49497 - DNA, 20 bp, Artificial Sequence
  chemically synthesized
aaaaaactttgaaaaaaaat

SEQ ID NO: 49498 - DNA, 20 bp, Artificial Sequence
  chemically synthesized
ttgaaaaaaaattagatgaa

SEQ ID NO: 49499 - DNA, 20 bp, Artificial Sequence
  chemically synthesized
aaattagatgaatggataac

SEQ ID NO: 49500 - DNA, 20 bp, Artificial Sequence
  chemically synthesized
taactagaataaccaatgca

SEQ ID NO: 49501 - DNA, 20 bp, Artificial Sequence
  chemically synthesized
ctagaataaccaatgcacag

SEQ ID NO: 49502 - DNA, 20 bp, Artificial Sequence
  chemically synthesized
ccaatgcacagaagtcctta

SEQ ID NO: 49503 - DNA, 20 bp, Artificial Sequence
  chemically synthesized
caatgcacagaagtccttaa

SEQ ID NO: 49504 - DNA, 20 bp, Artificial Sequence
  chemically synthesized
gaagtccttaaaggacctga

SEQ ID NO: 49505 - DNA, 20 bp, Artificial Sequence
  chemically synthesized
agtccttaaaggacctgatg

SEQ ID NO: 49506 - DNA, 20 bp, Artificial Sequence
  chemically synthesized
acctgatggagctgaaaacc

SEQ ID NO: 49507 - DNA, 20 bp, Artificial Sequence
  chemically synthesized
cctgatggagctgaaaacca

SEQ ID NO: 49508 - DNA, 20 bp, Artificial Sequence
  chemically synthesized
gatggagctgaaaaccaagg

SEQ ID NO: 49509 - DNA, 20 bp, Artificial Sequence
  chemically synthesized
atggagctgaaaaccaaggc

SEQ ID NO: 49510 - DNA, 20 bp, Artificial Sequence
  chemically synthesized
ggagctgaaaaccaaggcag

SEQ ID NO: 49511 - DNA, 20 bp, Artificial Sequence
  chemically synthesized
gaactacgtgacaaatacac

SEQ ID NO: 49512 - DNA, 20 bp, Artificial Sequence
  chemically synthesized
cgtgacaaatacacaagcct

SEQ ID NO: 49513 - DNA, 20 bp, Artificial Sequence
  chemically synthesized
cacaagcctcagtaaccgat

SEQ ID NO: 49514 - DNA, 20 bp, Artificial Sequence
  chemically synthesized
cagtaaccgatgagatcaac

SEQ ID NO: 49515 - DNA, 20 bp, Artificial Sequence
  chemically synthesized
taaccgatgagatcaactgg

SEQ ID NO: 49516 - DNA, 20 bp, Artificial Sequence
  chemically synthesized
cgatgagatcaactggaaga

SEQ ID NO: 49517 - DNA, 20 bp, Artificial Sequence
  chemically synthesized
gatgagatcaactggaagaa

SEQ ID NO: 49518 - DNA, 20 bp, Artificial Sequence
  chemically synthesized
atgagatcaactggaagaaa

SEQ ID NO: 49519 - DNA, 20 bp, Artificial Sequence
  chemically synthesized
agaaagggtatcaatgacga

SEQ ID NO: 49520 - DNA, 20 bp, Artificial Sequence
  chemically synthesized
aagatgaaatgaatgaaatg

SEQ ID NO: 49521 - DNA, 20 bp, Artificial Sequence
  chemically synthesized
aatgaatgaaatgaagcatg

SEQ ID NO: 49522 - DNA, 20 bp, Artificial Sequence
  chemically synthesized
tgaatgaaatgaagcatgaa

SEQ ID NO: 49523 - DNA, 20 bp, Artificial Sequence
  chemically synthesized
atgaaatgaagcatgaagag

SEQ ID NO: 49524 - DNA, 20 bp, Artificial Sequence
  chemically synthesized
atgaagcatgaagagaagtt

SEQ ID NO: 49525 - DNA, 20 bp, Artificial Sequence
  chemically synthesized
gaagcatgaagagaagttta

SEQ ID NO: 49526 - DNA, 20 bp, Artificial Sequence
  chemically synthesized
gaagagaagtttagagaaaa

SEQ ID NO: 49527 - DNA, 20 bp, Artificial Sequence
  chemically synthesized
tttagagaaaaaagaataaa

SEQ ID NO: 49528 - DNA, 20 bp, Artificial Sequence
  chemically synthesized
agaataaaaagaaacgaaca

SEQ ID NO: 49529 - DNA, 20 bp, Artificial Sequence
  chemically synthesized
aagaaacgaacaaagcctcc

SEQ ID NO: 49530 - DNA, 20 bp, Artificial Sequence
  chemically synthesized
aacaaagcctccaagaaata

SEQ ID NO: 49531 - DNA, 20 bp, Artificial Sequence
  chemically synthesized
acaaagcctccaagaaatat

SEQ ID NO: 49532 - DNA, 20 bp, Artificial Sequence
  chemically synthesized
gaaatatgggactatgtgaa

SEQ ID NO: 49533 - DNA, 20 bp, Artificial Sequence
  chemically synthesized
agaccaaatctacatctaat

SEQ ID NO: 49534 - DNA, 20 bp, Artificial Sequence
  chemically synthesized
aaatctacatctaattggtg

SEQ ID NO: 49535 - DNA, 20 bp, Artificial Sequence
  chemically synthesized
catctaattggtgtagctga

SEQ ID NO: 49536 - DNA, 20 bp, Artificial Sequence
  chemically synthesized
attggtgtagctgaaagtga

SEQ ID NO: 49537 - DNA, 20 bp, Artificial Sequence
  chemically synthesized
ttggtgtagctgaaagtgat

SEQ ID NO: 49538 - DNA, 20 bp, Artificial Sequence
  chemically synthesized
tggtgtagctgaaagtgatg

SEQ ID NO: 49539 - DNA, 20 bp, Artificial Sequence
  chemically synthesized
gtgtagctgaaagtgatggg

SEQ ID NO: 49540 - DNA, 20 bp, Artificial Sequence
  chemically synthesized
gctgaaagtgatggggagaa

SEQ ID NO: 49541 - DNA, 20 bp, Artificial Sequence
  chemically synthesized
gtgatggggagaatggaacc

SEQ ID NO: 49542 - DNA, 20 bp, Artificial Sequence
  chemically synthesized
tggggagaatggaaccaagt

SEQ ID NO: 49543 - DNA, 20 bp, Artificial Sequence
  chemically synthesized
ccaagttggaaaacactctg

SEQ ID NO: 49544 - DNA, 20 bp, Artificial Sequence
  chemically synthesized
caagttggaaaacactctgc

SEQ ID NO: 49545 - DNA, 20 bp, Artificial Sequence
  chemically synthesized
acactctgcaggatattatc

SEQ ID NO: 49546 - DNA, 20 bp, Artificial Sequence
  chemically synthesized
cactctgcaggatattatcc

SEQ ID NO: 49547 - DNA, 20 bp, Artificial Sequence
  chemically synthesized
ctctgcaggatattatccag

SEQ ID NO: 49548 - DNA, 20 bp, Artificial Sequence
  chemically synthesized
ccaggagaacttccccaatc

SEQ ID NO: 49549 - DNA, 20 bp, Artificial Sequence
  chemically synthesized
gagaacttccccaatctagc

SEQ ID NO: 49550 - DNA, 20 bp, Artificial Sequence
  chemically synthesized
agaacttccccaatctagca

SEQ ID NO: 49551 - DNA, 20 bp, Artificial Sequence
  chemically synthesized
cttccccaatctagcaaggc

SEQ ID NO: 49552 - DNA, 20 bp, Artificial Sequence
  chemically synthesized
ggcaagcccaaattcacatt

SEQ ID NO: 49553 - DNA, 20 bp, Artificial Sequence
  chemically synthesized
gcaagcccaaattcacattc

SEQ ID NO: 49554 - DNA, 20 bp, Artificial Sequence
  chemically synthesized
aaattcacattcaggaaata

SEQ ID NO: 49555 - DNA, 20 bp, Artificial Sequence
  chemically synthesized
attcacattcaggaaataca

SEQ ID NO: 49556 - DNA, 20 bp, Artificial Sequence
  chemically synthesized
gaaatacagagaacgccaca

SEQ ID NO: 49557 - DNA, 20 bp, Artificial Sequence
  chemically synthesized
gaacgccacaaagatactcc

SEQ ID NO: 49558 - DNA, 20 bp, Artificial Sequence
  chemically synthesized
acgccacaaagatactccta

SEQ ID NO: 49559 - DNA, 20 bp, Artificial Sequence
  chemically synthesized
acaaagatactcctagagaa

SEQ ID NO: 49560 - DNA, 20 bp, Artificial Sequence
  chemically synthesized
tcctagagaaaagcaactcc

SEQ ID NO: 49561 - DNA, 20 bp, Artificial Sequence
  chemically synthesized
actccaagacacataactgt

SEQ ID NO: 49562 - DNA, 20 bp, Artificial Sequence
  chemically synthesized
cataactgtcagattcacca

SEQ ID NO: 49563 - DNA, 20 bp, Artificial Sequence
  chemically synthesized
gattcaccaaagttgaaatg

SEQ ID NO: 49564 - DNA, 20 bp, Artificial Sequence
  chemically synthesized
attcaccaaagttgaaatga

SEQ ID NO: 49565 - DNA, 20 bp, Artificial Sequence
  chemically synthesized
gaaatgaaggaaaaaatgtt

SEQ ID NO: 49566 - DNA, 20 bp, Artificial Sequence
  chemically synthesized
aaatgaaggaaaaaatgtta

SEQ ID NO: 49567 - DNA, 20 bp, Artificial Sequence
  chemically synthesized
aatgaaggaaaaaatgttaa

SEQ ID NO: 49568 - DNA, 20 bp, Artificial Sequence
  chemically synthesized
gaaggaaaaaatgttaaggg

SEQ ID NO: 49569 - DNA, 20 bp, Artificial Sequence
  chemically synthesized
gaaaaaatgttaagggcagc

SEQ ID NO: 49570 - DNA, 20 bp, Artificial Sequence
  chemically synthesized
aaaaatgttaagggcagcca

SEQ ID NO: 49571 - DNA, 20 bp, Artificial Sequence
  chemically synthesized
aaatgttaagggcagccaga

SEQ ID NO: 49572 - DNA, 20 bp, Artificial Sequence
  chemically synthesized
gttaagggcagccagagaga

SEQ ID NO: 49573 - DNA, 20 bp, Artificial Sequence
  chemically synthesized
ttaagggcagccagagagaa

SEQ ID NO: 49574 - DNA, 20 bp, Artificial Sequence
  chemically synthesized
gggcagccagagagaaaggt

SEQ ID NO: 49575 - DNA, 20 bp, Artificial Sequence
  chemically synthesized
ggcagccagagagaaaggtc

SEQ ID NO: 49576 - DNA, 20 bp, Artificial Sequence
  chemically synthesized
gaaaggtcgggttacccaca

SEQ ID NO: 49577 - DNA, 20 bp, Artificial Sequence
  chemically synthesized
aaaggtcgggttacccacaa

SEQ ID NO: 49578 - DNA, 20 bp, Artificial Sequence
  chemically synthesized
aaggtcgggttacccacaaa

SEQ ID NO: 49579 - DNA, 20 bp, Artificial Sequence
  chemically synthesized
gtcgggttacccacaaaggg

SEQ ID NO: 49580 - DNA, 20 bp, Artificial Sequence
  chemically synthesized
acccacaaagggaagcccat

SEQ ID NO: 49581 - DNA, 20 bp, Artificial Sequence
  chemically synthesized
agggaagcccatcagactaa

SEQ ID NO: 49582 - DNA, 20 bp, Artificial Sequence
  chemically synthesized
cagactaacagctgatctat

SEQ ID NO: 49583 - DNA, 20 bp, Artificial Sequence
  chemically synthesized
actaacagctgatctatcgg

SEQ ID NO: 49584 - DNA, 20 bp, Artificial Sequence
  chemically synthesized
tctatcggcagaaactctac

SEQ ID NO: 49585 - DNA, 20 bp, Artificial Sequence
  chemically synthesized
tcggcagaaactctacaagc

SEQ ID NO: 49586 - DNA, 20 bp, Artificial Sequence
  chemically synthesized
gcagaaactctacaagccag

SEQ ID NO: 49587 - DNA, 20 bp, Artificial Sequence
  chemically synthesized
aaactctacaagccagaaga

SEQ ID NO: 49588 - DNA, 20 bp, Artificial Sequence
  chemically synthesized
ctctacaagccagaagaaag

SEQ ID NO: 49589 - DNA, 20 bp, Artificial Sequence
  chemically synthesized
tctacaagccagaagaaagt

SEQ ID NO: 49590 - DNA, 20 bp, Artificial Sequence
  chemically synthesized
ctacaagccagaagaaagtg

SEQ ID NO: 49591 - DNA, 20 bp, Artificial Sequence
  chemically synthesized
tacaagccagaagaaagtgg

SEQ ID NO: 49592 - DNA, 20 bp, Artificial Sequence
  chemically synthesized
gccaatattcaacattgtta

SEQ ID NO: 49593 - DNA, 20 bp, Artificial Sequence
  chemically synthesized
tattcaacattgttaaagaa

SEQ ID NO: 49594 - DNA, 20 bp, Artificial Sequence
  chemically synthesized
aaagaaaagaattttcaacc

SEQ ID NO: 49595 - DNA, 20 bp, Artificial Sequence
  chemically synthesized
tcaacccagaatttcatatc

SEQ ID NO: 49596 - DNA, 20 bp, Artificial Sequence
  chemically synthesized
atttcatatccagccaaact

SEQ ID NO: 49597 - DNA, 20 bp, Artificial Sequence
  chemically synthesized
ccagccaaactaagcttcat

SEQ ID NO: 49598 - DNA, 20 bp, Artificial Sequence
  chemically synthesized
caaactaagcttcataagtg

SEQ ID NO: 49599 - DNA, 20 bp, Artificial Sequence
  chemically synthesized
aaactaagcttcataagtga

SEQ ID NO: 49600 - DNA, 20 bp, Artificial Sequence
  chemically synthesized
actaagcttcataagtgaag

SEQ ID NO: 49601 - DNA, 20 bp, Artificial Sequence
  chemically synthesized
aggagaaataaaatccttta

SEQ ID NO: 49602 - DNA, 20 bp, Artificial Sequence
  chemically synthesized
aaataaaatcctttacagac

SEQ ID NO: 49603 - DNA, 20 bp, Artificial Sequence
  chemically synthesized
tttacagacaagcaaatgct

SEQ ID NO: 49604 - DNA, 20 bp, Artificial Sequence
  chemically synthesized
tacagacaagcaaatgctga

SEQ ID NO: 49605 - DNA, 20 bp, Artificial Sequence
  chemically synthesized
ctgagagattttgtcaccac

SEQ ID NO: 49606 - DNA, 20 bp, Artificial Sequence
  chemically synthesized
tgagagattttgtcaccacc

SEQ ID NO: 49607 - DNA, 20 bp, Artificial Sequence
  chemically synthesized
caccaccaggcctgccctac

SEQ ID NO: 49608 - DNA, 20 bp, Artificial Sequence
  chemically synthesized
ccaccaggcctgccctacaa

SEQ ID NO: 49609 - DNA, 20 bp, Artificial Sequence
  chemically synthesized
ctgccctacaagagctcctg

SEQ ID NO: 49610 - DNA, 20 bp, Artificial Sequence
  chemically synthesized
tgccctacaagagctcctga

SEQ ID NO: 49611 - DNA, 20 bp, Artificial Sequence
  chemically synthesized
cctacaagagctcctgaagg

SEQ ID NO: 49612 - DNA, 20 bp, Artificial Sequence
  chemically synthesized
cctgaaggaagcactaaaca

SEQ ID NO: 49613 - DNA, 20 bp, Artificial Sequence
  chemically synthesized
aaggaagcactaaacatgga

SEQ ID NO: 49614 - DNA, 20 bp, Artificial Sequence
  chemically synthesized
aggaagcactaaacatggaa

SEQ ID NO: 49615 - DNA, 20 bp, Artificial Sequence
  chemically synthesized
taaacatggaaaggaacaac

SEQ ID NO: 49616 - DNA, 20 bp, Artificial Sequence
  chemically synthesized
tggaaaggaacaactagtat

SEQ ID NO: 49617 - DNA, 20 bp, Artificial Sequence
  chemically synthesized
caaaaacatgccaaattgta

SEQ ID NO: 49618 - DNA, 20 bp, Artificial Sequence
  chemically synthesized
gccaaattgtaaagaccatc

SEQ ID NO: 49619 - DNA, 20 bp, Artificial Sequence
  chemically synthesized
ccaaattgtaaagaccatca

SEQ ID NO: 49620 - DNA, 20 bp, Artificial Sequence
  chemically synthesized
attgtaaagaccatcaaggc

SEQ ID NO: 49621 - DNA, 20 bp, Artificial Sequence
  chemically synthesized
ttgtaaagaccatcaaggct

SEQ ID NO: 49622 - DNA, 20 bp, Artificial Sequence
  chemically synthesized
taaagaccatcaaggctagg

SEQ ID NO: 49623 - DNA, 20 bp, Artificial Sequence
  chemically synthesized
taggaagaaactgcatcaac

SEQ ID NO: 49624 - DNA, 20 bp, Artificial Sequence
  chemically synthesized
gcatcaacgagcaaaataac

SEQ ID NO: 49625 - DNA, 20 bp, Artificial Sequence
  chemically synthesized
accagctaacatcataatga

SEQ ID NO: 49626 - DNA, 20 bp, Artificial Sequence
  chemically synthesized
ccagctaacatcataatgac

SEQ ID NO: 49627 - DNA, 20 bp, Artificial Sequence
  chemically synthesized
atactcaccttaaatgtaaa

SEQ ID NO: 49628 - DNA, 20 bp, Artificial Sequence
  chemically synthesized
tactcaccttaaatgtaaat

SEQ ID NO: 49629 - DNA, 20 bp, Artificial Sequence
  chemically synthesized
aggctaaatgctccaattaa

SEQ ID NO: 49630 - DNA, 20 bp, Artificial Sequence
  chemically synthesized
aatgctccaattaaaagaca

SEQ ID NO: 49631 - DNA, 20 bp, Artificial Sequence
  chemically synthesized
tccaattaaaagacacagac

SEQ ID NO: 49632 - DNA, 20 bp, Artificial Sequence
  chemically synthesized
aaagacacagactggcaaat

SEQ ID NO: 49633 - DNA, 20 bp, Artificial Sequence
  chemically synthesized
cacagactggcaaattggat

SEQ ID NO: 49634 - DNA, 20 bp, Artificial Sequence
  chemically synthesized
acagactggcaaattggata

SEQ ID NO: 49635 - DNA, 20 bp, Artificial Sequence
  chemically synthesized
agactggcaaattggataag

SEQ ID NO: 49636 - DNA, 20 bp, Artificial Sequence
  chemically synthesized
ggcaaattggataaggagtc

SEQ ID NO: 49637 - DNA, 20 bp, Artificial Sequence
  chemically synthesized
acccatctgtgttctgtatt

SEQ ID NO: 49638 - DNA, 20 bp, Artificial Sequence
  chemically synthesized
cccatctgtgttctgtattc

SEQ ID NO: 49639 - DNA, 20 bp, Artificial Sequence
  chemically synthesized
caggaaacccatctcacgtg

SEQ ID NO: 49640 - DNA, 20 bp, Artificial Sequence
  chemically synthesized
ggaaacccatctcacgtgca

SEQ ID NO: 49641 - DNA, 20 bp, Artificial Sequence
  chemically synthesized
ctcacgtgcagagacacaca

SEQ ID NO: 49642 - DNA, 20 bp, Artificial Sequence
  chemically synthesized
tcacgtgcagagacacacat

SEQ ID NO: 49643 - DNA, 20 bp, Artificial Sequence
  chemically synthesized
cacacataggctcgaaataa

SEQ ID NO: 49644 - DNA, 20 bp, Artificial Sequence
  chemically synthesized
acacataggctcgaaataaa

SEQ ID NO: 49645 - DNA, 20 bp, Artificial Sequence
  chemically synthesized
ataggctcgaaataaaagga

SEQ ID NO: 49646 - DNA, 20 bp, Artificial Sequence
  chemically synthesized
aggctcgaaataaaaggatg

SEQ ID NO: 49647 - DNA, 20 bp, Artificial Sequence
  chemically synthesized
ggctcgaaataaaaggatgg

SEQ ID NO: 49648 - DNA, 20 bp, Artificial Sequence
  chemically synthesized
aggatggaggaatatctacc

SEQ ID NO: 49649 - DNA, 20 bp, Artificial Sequence
  chemically synthesized
aggaatatctaccaagcaaa

SEQ ID NO: 49650 - DNA, 20 bp, Artificial Sequence
  chemically synthesized
aagcaaatggaaaacaaaaa

SEQ ID NO: 49651 - DNA, 20 bp, Artificial Sequence
  chemically synthesized
agcaaatggaaaacaaaaaa

SEQ ID NO: 49652 - DNA, 20 bp, Artificial Sequence
  chemically synthesized
aaatggaaaacaaaaaaagg

SEQ ID NO: 49653 - DNA, 20 bp, Artificial Sequence
  chemically synthesized
aatggaaaacaaaaaaaggc

SEQ ID NO: 49654 - DNA, 20 bp, Artificial Sequence
  chemically synthesized
atggaaaacaaaaaaaggca

SEQ ID NO: 49655 - DNA, 20 bp, Artificial Sequence
  chemically synthesized
tggaaaacaaaaaaaggcag

SEQ ID NO: 49656 - DNA, 20 bp, Artificial Sequence
  chemically synthesized
aaaggcaggggttgcaatcc

SEQ ID NO: 49657 - DNA, 20 bp, Artificial Sequence
  chemically synthesized
aatcctagtctctgataaaa

SEQ ID NO: 49658 - DNA, 20 bp, Artificial Sequence
  chemically synthesized
aaacagattttaaaccaaca

SEQ ID NO: 49659 - DNA, 20 bp, Artificial Sequence
  chemically synthesized
tttaaaccaacaaagatcaa

SEQ ID NO: 49660 - DNA, 20 bp, Artificial Sequence
  chemically synthesized
taaaccaacaaagatcaaaa

SEQ ID NO: 49661 - DNA, 20 bp, Artificial Sequence
  chemically synthesized
aacaaagatcaaaagagaca

SEQ ID NO: 49662 - DNA, 20 bp, Artificial Sequence
  chemically synthesized
aaagatcaaaagagacaaag

SEQ ID NO: 49663 - DNA, 20 bp, Artificial Sequence
  chemically synthesized
aagatcaaaagagacaaaga

SEQ ID NO: 49664 - DNA, 20 bp, Artificial Sequence
  chemically synthesized
caaagaaggccattacataa

SEQ ID NO: 49665 - DNA, 20 bp, Artificial Sequence
  chemically synthesized
aaggccattacataatggca

SEQ ID NO: 49666 - DNA, 20 bp, Artificial Sequence
  chemically synthesized
aggccattacataatggcaa

SEQ ID NO: 49667 - DNA, 20 bp, Artificial Sequence
  chemically synthesized
ggccattacataatggcaaa

SEQ ID NO: 49668 - DNA, 20 bp, Artificial Sequence
  chemically synthesized
aatggcaaagggatctattc

SEQ ID NO: 49669 - DNA, 20 bp, Artificial Sequence
  chemically synthesized
ggcaaagggatctattcaag

SEQ ID NO: 49670 - DNA, 20 bp, Artificial Sequence
  chemically synthesized
aaagggatctattcaagaag

SEQ ID NO: 49671 - DNA, 20 bp, Artificial Sequence
  chemically synthesized
aaatatatatgcacccaata

SEQ ID NO: 49672 - DNA, 20 bp, Artificial Sequence
  chemically synthesized
aatatatatgcacccaatac

SEQ ID NO: 49673 - DNA, 20 bp, Artificial Sequence
  chemically synthesized
tatatatgcacccaatacag

SEQ ID NO: 49674 - DNA, 20 bp, Artificial Sequence
  chemically synthesized
gcacccaatacaggagcacc

SEQ ID NO: 49675 - DNA, 20 bp, Artificial Sequence
  chemically synthesized
agcacccagattcataaaac

SEQ ID NO: 49676 - DNA, 20 bp, Artificial Sequence
  chemically synthesized
agattcataaaacaagtcct

SEQ ID NO: 49677 - DNA, 20 bp, Artificial Sequence
  chemically synthesized
caagtcctgagtgacctaca

SEQ ID NO: 49678 - DNA, 20 bp, Artificial Sequence
  chemically synthesized
agtcctgagtgacctacaaa

SEQ ID NO: 49679 - DNA, 20 bp, Artificial Sequence
  chemically synthesized
gagtgacctacaaagagact

SEQ ID NO: 49680 - DNA, 20 bp, Artificial Sequence
  chemically synthesized
agatgcccacacaataataa

SEQ ID NO: 49681 - DNA, 20 bp, Artificial Sequence
  chemically synthesized
gatgcccacacaataataat

SEQ ID NO: 49682 - DNA, 20 bp, Artificial Sequence
  chemically synthesized
tgcccacacaataataatgg

SEQ ID NO: 49683 - DNA, 20 bp, Artificial Sequence
  chemically synthesized
taacaccccactgtcaacat

SEQ ID NO: 49684 - DNA, 20 bp, Artificial Sequence
  chemically synthesized
accccactgtcaacattaga

SEQ ID NO: 49685 - DNA, 20 bp, Artificial Sequence
  chemically synthesized
tcaacattagacagatcaac

SEQ ID NO: 49686 - DNA, 20 bp, Artificial Sequence
  chemically synthesized
cattagacagatcaacgaga

SEQ ID NO: 49687 - DNA, 20 bp, Artificial Sequence
  chemically synthesized
agacagatcaacgagacaga

SEQ ID NO: 49688 - DNA, 20 bp, Artificial Sequence
  chemically synthesized
caacgagacagaaagttaac

SEQ ID NO: 49689 - DNA, 20 bp, Artificial Sequence
  chemically synthesized
aacgagacagaaagttaaca

SEQ ID NO: 49690 - DNA, 20 bp, Artificial Sequence
  chemically synthesized
agaaagttaacaaggatatc

SEQ ID NO: 49691 - DNA, 20 bp, Artificial Sequence
  chemically synthesized
gaaagttaacaaggatatcc

SEQ ID NO: 49692 - DNA, 20 bp, Artificial Sequence
  chemically synthesized
taacaaggatatccaggaat

SEQ ID NO: 49693 - DNA, 20 bp, Artificial Sequence
  chemically synthesized
ggatatccaggaattggact

SEQ ID NO: 49694 - DNA, 20 bp, Artificial Sequence
  chemically synthesized
attggactcagctctgcacc

SEQ ID NO: 49695 - DNA, 20 bp, Artificial Sequence
  chemically synthesized
ggactcagctctgcaccaag

SEQ ID NO: 49696 - DNA, 20 bp, Artificial Sequence
  chemically synthesized
tctgcaccaagcagacctaa

SEQ ID NO: 49697 - DNA, 20 bp, Artificial Sequence
  chemically synthesized
gcagacctaatagacatcta

SEQ ID NO: 49698 - DNA, 20 bp, Artificial Sequence
  chemically synthesized
aactctccaccccaaatcaa

SEQ ID NO: 49699 - DNA, 20 bp, Artificial Sequence
  chemically synthesized
aacagaatatacattctttt

SEQ ID NO: 49700 - DNA, 20 bp, Artificial Sequence
  chemically synthesized
ctattccaaaactgaccaca

SEQ ID NO: 49701 - DNA, 20 bp, Artificial Sequence
  chemically synthesized
tccaaaactgaccacatagt

SEQ ID NO: 49702 - DNA, 20 bp, Artificial Sequence
  chemically synthesized
aaaactgaccacatagttgg

SEQ ID NO: 49703 - DNA, 20 bp, Artificial Sequence
  chemically synthesized
tgaccacatagttggaagta

SEQ ID NO: 49704 - DNA, 20 bp, Artificial Sequence
  chemically synthesized
gttggaagtaaagctctcct

SEQ ID NO: 49705 - DNA, 20 bp, Artificial Sequence
  chemically synthesized
gctctcctcagcaaatgtaa

SEQ ID NO: 49706 - DNA, 20 bp, Artificial Sequence
  chemically synthesized
cctcagcaaatgtaaaagaa

SEQ ID NO: 49707 - DNA, 20 bp, Artificial Sequence
  chemically synthesized
aactataacaaactgtctct

SEQ ID NO: 49708 - DNA, 20 bp, Artificial Sequence
  chemically synthesized
acaaactgtctctcagacca

SEQ ID NO: 49709 - DNA, 20 bp, Artificial Sequence
  chemically synthesized
agaccacagtgcaatcaaac

SEQ ID NO: 49710 - DNA, 20 bp, Artificial Sequence
  chemically synthesized
agtgcaatcaaactagaact

SEQ ID NO: 49711 - DNA, 20 bp, Artificial Sequence
  chemically synthesized
gtgcaatcaaactagaactc

SEQ ID NO: 49712 - DNA, 20 bp, Artificial Sequence
  chemically synthesized
tcaaactagaactcaggatt

SEQ ID NO: 49713 - DNA, 20 bp, Artificial Sequence
  chemically synthesized
gaaactcactcaaaaccact

SEQ ID NO: 49714 - DNA, 20 bp, Artificial Sequence
  chemically synthesized
ctcaaaaccactcagctaca

SEQ ID NO: 49715 - DNA, 20 bp, Artificial Sequence
  chemically synthesized
tcagctacatggaaactgaa

SEQ ID NO: 49716 - DNA, 20 bp, Artificial Sequence
  chemically synthesized
gcctgctcctgaatgactac

SEQ ID NO: 49717 - DNA, 20 bp, Artificial Sequence
  chemically synthesized
cctgctcctgaatgactact

SEQ ID NO: 49718 - DNA, 20 bp, Artificial Sequence
  chemically synthesized
actgggtacataacaaaatg

SEQ ID NO: 49719 - DNA, 20 bp, Artificial Sequence
  chemically synthesized
ctgggtacataacaaaatga

SEQ ID NO: 49720 - DNA, 20 bp, Artificial Sequence
  chemically synthesized
ggtacataacaaaatgaagg

SEQ ID NO: 49721 - DNA, 20 bp, Artificial Sequence
  chemically synthesized
acaaaatgaaggcagaaata

SEQ ID NO: 49722 - DNA, 20 bp, Artificial Sequence
  chemically synthesized
agatgttctttgaaaccaac

SEQ ID NO: 49723 - DNA, 20 bp, Artificial Sequence
  chemically synthesized
ctttgaaaccaacgagaaca

SEQ ID NO: 49724 - DNA, 20 bp, Artificial Sequence
  chemically synthesized
agaacaaagacacaacacac

SEQ ID NO: 49725 - DNA, 20 bp, Artificial Sequence
  chemically synthesized
cacaacacaccagaatctct

SEQ ID NO: 49726 - DNA, 20 bp, Artificial Sequence
  chemically synthesized
gaatctctgagacacattca

SEQ ID NO: 49727 - DNA, 20 bp, Artificial Sequence
  chemically synthesized
tctctgagacacattcaaag

SEQ ID NO: 49728 - DNA, 20 bp, Artificial Sequence
  chemically synthesized
gacacattcaaagcagtgtg

SEQ ID NO: 49729 - DNA, 20 bp, Artificial Sequence
  chemically synthesized
cacattcaaagcagtgtgta

SEQ ID NO: 49730 - DNA, 20 bp, Artificial Sequence
  chemically synthesized
acattcaaagcagtgtgtag

SEQ ID NO: 49731 - DNA, 20 bp, Artificial Sequence
  chemically synthesized
cattcaaagcagtgtgtaga

SEQ ID NO: 49732 - DNA, 20 bp, Artificial Sequence
  chemically synthesized
agtgtgtagagggaaattta

SEQ ID NO: 49733 - DNA, 20 bp, Artificial Sequence
  chemically synthesized
ttatagcactaaatgcccac

SEQ ID NO: 49734 - DNA, 20 bp, Artificial Sequence
  chemically synthesized
tatagcactaaatgcccaca

SEQ ID NO: 49735 - DNA, 20 bp, Artificial Sequence
  chemically synthesized
atagcactaaatgcccacaa

SEQ ID NO: 49736 - DNA, 20 bp, Artificial Sequence
  chemically synthesized
cactaaatgcccacaaggga

SEQ ID NO: 49737 - DNA, 20 bp, Artificial Sequence
  chemically synthesized
taaatgcccacaagggaaag

SEQ ID NO: 49738 - DNA, 20 bp, Artificial Sequence
  chemically synthesized
aaatgcccacaagggaaagc

SEQ ID NO: 49739 - DNA, 20 bp, Artificial Sequence
  chemically synthesized
gcccacaagggaaagcagga

SEQ ID NO: 49740 - DNA, 20 bp, Artificial Sequence
  chemically synthesized
taacatcacaattaaaaaac

SEQ ID NO: 49741 - DNA, 20 bp, Artificial Sequence
  chemically synthesized
acatcacaattaaaaaacta

SEQ ID NO: 49742 - DNA, 20 bp, Artificial Sequence
  chemically synthesized
tcacaattaaaaaactagag

SEQ ID NO: 49743 - DNA, 20 bp, Artificial Sequence
  chemically synthesized
caattaaaaaactagagaag

SEQ ID NO: 49744 - DNA, 20 bp, Artificial Sequence
  chemically synthesized
aattaaaaaactagagaagc

SEQ ID NO: 49745 - DNA, 20 bp, Artificial Sequence
  chemically synthesized
ttaaaaaactagagaagcag

SEQ ID NO: 49746 - DNA, 20 bp, Artificial Sequence
  chemically synthesized
gcaggagcaaacacattcaa

SEQ ID NO: 49747 - DNA, 20 bp, Artificial Sequence
  chemically synthesized
caaacacattcaaaagctaa

SEQ ID NO: 49748 - DNA, 20 bp, Artificial Sequence
  chemically synthesized
acacattcaaaagctaacag

SEQ ID NO: 49749 - DNA, 20 bp, Artificial Sequence
  chemically synthesized
ttcaaaagctaacagaagac

SEQ ID NO: 49750 - DNA, 20 bp, Artificial Sequence
  chemically synthesized
acagaagacaagaaataact

SEQ ID NO: 49751 - DNA, 20 bp, Artificial Sequence
  chemically synthesized
agacaagaaataactaagat

SEQ ID NO: 49752 - DNA, 20 bp, Artificial Sequence
  chemically synthesized
acaagaaataactaagatca

SEQ ID NO: 49753 - DNA, 20 bp, Artificial Sequence
  chemically synthesized
agaaataactaagatcagag

SEQ ID NO: 49754 - DNA, 20 bp, Artificial Sequence
  chemically synthesized
aataactaagatcagagcag

SEQ ID NO: 49755 - DNA, 20 bp, Artificial Sequence
  chemically synthesized
ctaagatcagagcagaagtg

SEQ ID NO: 49756 - DNA, 20 bp, Artificial Sequence
  chemically synthesized
taagatcagagcagaagtga

SEQ ID NO: 49757 - DNA, 20 bp, Artificial Sequence
  chemically synthesized
cagagcagaagtgaaggaca

SEQ ID NO: 49758 - DNA, 20 bp, Artificial Sequence
  chemically synthesized
gagcagaagtgaaggacata

SEQ ID NO: 49759 - DNA, 20 bp, Artificial Sequence
  chemically synthesized
ttcaaaaaaatcaatgaatc

SEQ ID NO: 49760 - DNA, 20 bp, Artificial Sequence
  chemically synthesized
aaaaaaatcaatgaatccag

SEQ ID NO: 49761 - DNA, 20 bp, Artificial Sequence
  chemically synthesized
ccagaagctgtttttttgaa

SEQ ID NO: 49762 - DNA, 20 bp, Artificial Sequence
  chemically synthesized
gaaaagatcaacaaaattga

SEQ ID NO: 49763 - DNA, 20 bp, Artificial Sequence
  chemically synthesized
caacaaaattgatagactgc

SEQ ID NO: 49764 - DNA, 20 bp, Artificial Sequence
  chemically synthesized
aaaattgatagactgctagc

SEQ ID NO: 49765 - DNA, 20 bp, Artificial Sequence
  chemically synthesized
gactgctagcaagactaata

SEQ ID NO: 49766 - DNA, 20 bp, Artificial Sequence
  chemically synthesized
tgctagcaagactaataaag

SEQ ID NO: 49767 - DNA, 20 bp, Artificial Sequence
  chemically synthesized
gcaagactaataaagaagaa

SEQ ID NO: 49768 - DNA, 20 bp, Artificial Sequence
  chemically synthesized
aagactaataaagaagaaaa

SEQ ID NO: 49769 - DNA, 20 bp, Artificial Sequence
  chemically synthesized
gactaataaagaagaaaaga

SEQ ID NO: 49770 - DNA, 20 bp, Artificial Sequence
  chemically synthesized
taataaagaagaaaagagag

SEQ ID NO: 49771 - DNA, 20 bp, Artificial Sequence
  chemically synthesized
gaaaagagagaagaatcaaa

SEQ ID NO: 49772 - DNA, 20 bp, Artificial Sequence
  chemically synthesized
agacgcaataaaaaatgaca

SEQ ID NO: 49773 - DNA, 20 bp, Artificial Sequence
  chemically synthesized
gacgcaataaaaaatgacac

SEQ ID NO: 49774 - DNA, 20 bp, Artificial Sequence
  chemically synthesized
acgcaataaaaaatgacacg

SEQ ID NO: 49775 - DNA, 20 bp, Artificial Sequence
  chemically synthesized
gggtatcaccactgatccca

SEQ ID NO: 49776 - DNA, 20 bp, Artificial Sequence
  chemically synthesized
acagaaatacaaactaccgt

SEQ ID NO: 49777 - DNA, 20 bp, Artificial Sequence
  chemically synthesized
agaaatacaaactaccgtca

SEQ ID NO: 49778 - DNA, 20 bp, Artificial Sequence
  chemically synthesized
acacctctacgcaaataaac

SEQ ID NO: 49779 - DNA, 20 bp, Artificial Sequence
  chemically synthesized
cgcaaataaactagaaaatc

SEQ ID NO: 49780 - DNA, 20 bp, Artificial Sequence
  chemically synthesized
aaataaactagaaaatctag

SEQ ID NO: 49781 - DNA, 20 bp, Artificial Sequence
  chemically synthesized
actagaaaatctagaagaaa

SEQ ID NO: 49782 - DNA, 20 bp, Artificial Sequence
  chemically synthesized
ctcgacacatacactctgcc

SEQ ID NO: 49783 - DNA, 20 bp, Artificial Sequence
  chemically synthesized
acactctgccaagactaaac

SEQ ID NO: 49784 - DNA, 20 bp, Artificial Sequence
  chemically synthesized
cactctgccaagactaaacc

SEQ ID NO: 49785 - DNA, 20 bp, Artificial Sequence
  chemically synthesized
tctgccaagactaaaccagg

SEQ ID NO: 49786 - DNA, 20 bp, Artificial Sequence
  chemically synthesized
gccaagactaaaccaggaag

SEQ ID NO: 49787 - DNA, 20 bp, Artificial Sequence
  chemically synthesized
gaagaagttgtatctctgaa

SEQ ID NO: 49788 - DNA, 20 bp, Artificial Sequence
  chemically synthesized
atctctgaatagaccaataa

SEQ ID NO: 49789 - DNA, 20 bp, Artificial Sequence
  chemically synthesized
tctctgaatagaccaataac

SEQ ID NO: 49790 - DNA, 20 bp, Artificial Sequence
  chemically synthesized
caataacaggctctgaaatt

SEQ ID NO: 49791 - DNA, 20 bp, Artificial Sequence
  chemically synthesized
aataacaggctctgaaattg

SEQ ID NO: 49792 - DNA, 20 bp, Artificial Sequence
  chemically synthesized
gaaattgaggcaataattaa

SEQ ID NO: 49793 - DNA, 20 bp, Artificial Sequence
  chemically synthesized
aatagcttatcaaccaaaaa

SEQ ID NO: 49794 - DNA, 20 bp, Artificial Sequence
  chemically synthesized
cttatcaaccaaaaaaagtc

SEQ ID NO: 49795 - DNA, 20 bp, Artificial Sequence
  chemically synthesized
ttatcaaccaaaaaaagtcc

SEQ ID NO: 49796 - DNA, 20 bp, Artificial Sequence
  chemically synthesized
aaccaaaaaaagtccgggac

SEQ ID NO: 49797 - DNA, 20 bp, Artificial Sequence
  chemically synthesized
caaaaaaagtccgggaccag

SEQ ID NO: 49798 - DNA, 20 bp, Artificial Sequence
  chemically synthesized
aaaaaaagtccgggaccagt

SEQ ID NO: 49799 - DNA, 20 bp, Artificial Sequence
  chemically synthesized
tccgggaccagtaggattca

SEQ ID NO: 49800 - DNA, 20 bp, Artificial Sequence
  chemically synthesized
gattcatagccgaattctac

SEQ ID NO: 49801 - DNA, 20 bp, Artificial Sequence
  chemically synthesized
ttcatagccgaattctacca

SEQ ID NO: 49802 - DNA, 20 bp, Artificial Sequence
  chemically synthesized
tcatagccgaattctaccag

SEQ ID NO: 49803 - DNA, 20 bp, Artificial Sequence
  chemically synthesized
ccgaattctaccagaggtac

SEQ ID NO: 49804 - DNA, 20 bp, Artificial Sequence
  chemically synthesized
cgaattctaccagaggtaca

SEQ ID NO: 49805 - DNA, 20 bp, Artificial Sequence
  chemically synthesized
aattctaccagaggtacaag

SEQ ID NO: 49806 - DNA, 20 bp, Artificial Sequence
  chemically synthesized
attctaccagaggtacaagg

SEQ ID NO: 49807 - DNA, 20 bp, Artificial Sequence
  chemically synthesized
tctaccagaggtacaaggag

SEQ ID NO: 49808 - DNA, 20 bp, Artificial Sequence
  chemically synthesized
ccagaggtacaaggaggagc

SEQ ID NO: 49809 - DNA, 20 bp, Artificial Sequence
  chemically synthesized
tctgaaactattccaatcaa

SEQ ID NO: 49810 - DNA, 20 bp, Artificial Sequence
  chemically synthesized
actattccaatcaatagaaa

SEQ ID NO: 49811 - DNA, 20 bp, Artificial Sequence
  chemically synthesized
tattccaatcaatagaaaaa

SEQ ID NO: 49812 - DNA, 20 bp, Artificial Sequence
  chemically synthesized
attccaatcaatagaaaaag

SEQ ID NO: 49813 - DNA, 20 bp, Artificial Sequence
  chemically synthesized
ttccaatcaatagaaaaaga

SEQ ID NO: 49814 - DNA, 20 bp, Artificial Sequence
  chemically synthesized
tcctccctaactcattttat

SEQ ID NO: 49815 - DNA, 20 bp, Artificial Sequence
  chemically synthesized
cctccctaactcattttatg

SEQ ID NO: 49816 - DNA, 20 bp, Artificial Sequence
  chemically synthesized
cctaactcattttatgaggc

SEQ ID NO: 49817 - DNA, 20 bp, Artificial Sequence
  chemically synthesized
ccagcatcatcctgatacca

SEQ ID NO: 49818 - DNA, 20 bp, Artificial Sequence
  chemically synthesized
atcctgataccaaagcctga

SEQ ID NO: 49819 - DNA, 20 bp, Artificial Sequence
  chemically synthesized
cctgataccaaagcctgaca

SEQ ID NO: 49820 - DNA, 20 bp, Artificial Sequence
  chemically synthesized
tgacagagacacaacaaaaa

SEQ ID NO: 49821 - DNA, 20 bp, Artificial Sequence
  chemically synthesized
acagagacacaacaaaaaaa

SEQ ID NO: 49822 - DNA, 20 bp, Artificial Sequence
  chemically synthesized
aaaaatcctcaataaaatac

SEQ ID NO: 49823 - DNA, 20 bp, Artificial Sequence
  chemically synthesized
caaactgatccaccatgatc

SEQ ID NO: 49824 - DNA, 20 bp, Artificial Sequence
  chemically synthesized
actgatccaccatgatcaag

SEQ ID NO: 49825 - DNA, 20 bp, Artificial Sequence
  chemically synthesized
ctgatccaccatgatcaagt

SEQ ID NO: 49826 - DNA, 20 bp, Artificial Sequence
  chemically synthesized
gggcttcatccctgccatgc

SEQ ID NO: 49827 - DNA, 20 bp, Artificial Sequence
  chemically synthesized
ggcttcatccctgccatgca

SEQ ID NO: 49828 - DNA, 20 bp, Artificial Sequence
  chemically synthesized
tcatccctgccatgcaaggc

SEQ ID NO: 49829 - DNA, 20 bp, Artificial Sequence
  chemically synthesized
gaaaatcaataaacataatc

SEQ ID NO: 49830 - DNA, 20 bp, Artificial Sequence
  chemically synthesized
aacataatccagcatataaa

SEQ ID NO: 49831 - DNA, 20 bp, Artificial Sequence
  chemically synthesized
ccagcatataaacagaacca

SEQ ID NO: 49832 - DNA, 20 bp, Artificial Sequence
  chemically synthesized
aaaccatatgattatctcaa

SEQ ID NO: 49833 - DNA, 20 bp, Artificial Sequence
  chemically synthesized
tatgattatctcaatagatg

SEQ ID NO: 49834 - DNA, 20 bp, Artificial Sequence
  chemically synthesized
ttatctcaatagatgcagaa

SEQ ID NO: 49835 - DNA, 20 bp, Artificial Sequence
  chemically synthesized
tatctcaatagatgcagaaa

SEQ ID NO: 49836 - DNA, 20 bp, Artificial Sequence
  chemically synthesized
gctaaaaactctcaataaat

SEQ ID NO: 49837 - DNA, 20 bp, Artificial Sequence
  chemically synthesized
ctaaaaactctcaataaatt

SEQ ID NO: 49838 - DNA, 20 bp, Artificial Sequence
  chemically synthesized
ctcaataaattaggtattga

SEQ ID NO: 49839 - DNA, 20 bp, Artificial Sequence
  chemically synthesized
tcaataaattaggtattgat

SEQ ID NO: 49840 - DNA, 20 bp, Artificial Sequence
  chemically synthesized
gggacatatctcaaaataat

SEQ ID NO: 49841 - DNA, 20 bp, Artificial Sequence
  chemically synthesized
gacatatctcaaaataataa

SEQ ID NO: 49842 - DNA, 20 bp, Artificial Sequence
  chemically synthesized
agctatctatgacaaaccca

SEQ ID NO: 49843 - DNA, 20 bp, Artificial Sequence
  chemically synthesized
cccacagccaatatcatact

SEQ ID NO: 49844 - DNA, 20 bp, Artificial Sequence
  chemically synthesized
acagccaatatcatactgag

SEQ ID NO: 49845 - DNA, 20 bp, Artificial Sequence
  chemically synthesized
catactgagtggacaaaaac

SEQ ID NO: 49846 - DNA, 20 bp, Artificial Sequence
  chemically synthesized
actgagtggacaaaaactgg

SEQ ID NO: 49847 - DNA, 20 bp, Artificial Sequence
  chemically synthesized
gaagcattccctttgaaaac

SEQ ID NO: 49848 - DNA, 20 bp, Artificial Sequence
  chemically synthesized
ttccctttgaaaactggcac

SEQ ID NO: 49849 - DNA, 20 bp, Artificial Sequence
  chemically synthesized
tccctttgaaaactggcaca

SEQ ID NO: 49850 - DNA, 20 bp, Artificial Sequence
  chemically synthesized
ctttgaaaactggcacaagg

SEQ ID NO: 49851 - DNA, 20 bp, Artificial Sequence
  chemically synthesized
tttgaaaactggcacaaggc

SEQ ID NO: 49852 - DNA, 20 bp, Artificial Sequence
  chemically synthesized
ttgaaaactggcacaaggca

SEQ ID NO: 49853 - DNA, 20 bp, Artificial Sequence
  chemically synthesized
ctcaccactcctattcaaca

SEQ ID NO: 49854 - DNA, 20 bp, Artificial Sequence
  chemically synthesized
cctattcaacatagtgttgt

SEQ ID NO: 49855 - DNA, 20 bp, Artificial Sequence
  chemically synthesized
caacatagtgttgtaagttc

SEQ ID NO: 49856 - DNA, 20 bp, Artificial Sequence
  chemically synthesized
atagtgttgtaagttctggc

SEQ ID NO: 49857 - DNA, 20 bp, Artificial Sequence
  chemically synthesized
tagtgttgtaagttctggcc

SEQ ID NO: 49858 - DNA, 20 bp, Artificial Sequence
  chemically synthesized
agtgttgtaagttctggcca

SEQ ID NO: 49859 - DNA, 20 bp, Artificial Sequence
  chemically synthesized
taagttctggccagggcaat

SEQ ID NO: 49860 - DNA, 20 bp, Artificial Sequence
  chemically synthesized
aagttctggccagggcaatc

SEQ ID NO: 49861 - DNA, 20 bp, Artificial Sequence
  chemically synthesized
ttctggccagggcaatcagg

SEQ ID NO: 49862 - DNA, 20 bp, Artificial Sequence
  chemically synthesized
tctggccagggcaatcaggc

SEQ ID NO: 49863 - DNA, 20 bp, Artificial Sequence
  chemically synthesized
tggccagggcaatcaggcag

SEQ ID NO: 49864 - DNA, 20 bp, Artificial Sequence
  chemically synthesized
ccagggcaatcaggcaggag

SEQ ID NO: 49865 - DNA, 20 bp, Artificial Sequence
  chemically synthesized
cagggcaatcaggcaggaga

SEQ ID NO: 49866 - DNA, 20 bp, Artificial Sequence
  chemically synthesized
tcaggcaggagaaggaaata

SEQ ID NO: 49867 - DNA, 20 bp, Artificial Sequence
  chemically synthesized
caggcaggagaaggaaataa

SEQ ID NO: 49868 - DNA, 20 bp, Artificial Sequence
  chemically synthesized
aggcaggagaaggaaataaa

SEQ ID NO: 49869 - DNA, 20 bp, Artificial Sequence
  chemically synthesized
ggaaataaagggcattcaat

SEQ ID NO: 49870 - DNA, 20 bp, Artificial Sequence
  chemically synthesized
gaaataaagggcattcaatt

SEQ ID NO: 49871 - DNA, 20 bp, Artificial Sequence
  chemically synthesized
aaagggcattcaattaggaa

SEQ ID NO: 49872 - DNA, 20 bp, Artificial Sequence
  chemically synthesized
agggcattcaattaggaaaa

SEQ ID NO: 49873 - DNA, 20 bp, Artificial Sequence
  chemically synthesized
gggcattcaattaggaaaag

SEQ ID NO: 49874 - DNA, 20 bp, Artificial Sequence
  chemically synthesized
cattcaattaggaaaagagg

SEQ ID NO: 49875 - DNA, 20 bp, Artificial Sequence
  chemically synthesized
agtgaaattgtccctgtttg

SEQ ID NO: 49876 - DNA, 20 bp, Artificial Sequence
  chemically synthesized
agatgacatgattgtatatc

SEQ ID NO: 49877 - DNA, 20 bp, Artificial Sequence
  chemically synthesized
tctagaaaaccccattgtct

SEQ ID NO: 49878 - DNA, 20 bp, Artificial Sequence
  chemically synthesized
tctcagcccaaaatctcctt

SEQ ID NO: 49879 - DNA, 20 bp, Artificial Sequence
  chemically synthesized
caaaatctccttaagctgat

SEQ ID NO: 49880 - DNA, 20 bp, Artificial Sequence
  chemically synthesized
cttaagctgataagcaactt

SEQ ID NO: 49881 - DNA, 20 bp, Artificial Sequence
  chemically synthesized
gctgataagcaacttcagca

SEQ ID NO: 49882 - DNA, 20 bp, Artificial Sequence
  chemically synthesized
aagcaacttcagcaaagtct

SEQ ID NO: 49883 - DNA, 20 bp, Artificial Sequence
  chemically synthesized
agcaacttcagcaaagtctc

SEQ ID NO: 49884 - DNA, 20 bp, Artificial Sequence
  chemically synthesized
aaagtctcaggatataaaat

SEQ ID NO: 49885 - DNA, 20 bp, Artificial Sequence
  chemically synthesized
aatcagtgtgcaaaaatcac

SEQ ID NO: 49886 - DNA, 20 bp, Artificial Sequence
  chemically synthesized
gtattcctatgcaccaataa

SEQ ID NO: 49887 - DNA, 20 bp, Artificial Sequence
  chemically synthesized
atgcaccaataacagacaaa

SEQ ID NO: 49888 - DNA, 20 bp, Artificial Sequence
  chemically synthesized
gcaccaataacagacaaaca

SEQ ID NO: 49889 - DNA, 20 bp, Artificial Sequence
  chemically synthesized
accaataacagacaaacaga

SEQ ID NO: 49890 - DNA, 20 bp, Artificial Sequence
  chemically synthesized
caaacagagagccaaatcat

SEQ ID NO: 49891 - DNA, 20 bp, Artificial Sequence
  chemically synthesized
tcccattcacaattgcttca

SEQ ID NO: 49892 - DNA, 20 bp, Artificial Sequence
  chemically synthesized
ccattcacaattgcttcaaa

SEQ ID NO: 49893 - DNA, 20 bp, Artificial Sequence
  chemically synthesized
ttcaaagagaataaaatacc

SEQ ID NO: 49894 - DNA, 20 bp, Artificial Sequence
  chemically synthesized
tcaaagagaataaaatacct

SEQ ID NO: 49895 - DNA, 20 bp, Artificial Sequence
  chemically synthesized
tacctaggaatccaacttac

SEQ ID NO: 49896 - DNA, 20 bp, Artificial Sequence
  chemically synthesized
acctaggaatccaacttaca

SEQ ID NO: 49897 - DNA, 20 bp, Artificial Sequence
  chemically synthesized
cctaggaatccaacttacaa

SEQ ID NO: 49898 - DNA, 20 bp, Artificial Sequence
  chemically synthesized
tccaacttacaagggatgtg

SEQ ID NO: 49899 - DNA, 20 bp, Artificial Sequence
  chemically synthesized
ccaacttacaagggatgtga

SEQ ID NO: 49900 - DNA, 20 bp, Artificial Sequence
  chemically synthesized
gggatgtgaaggacctcttc

SEQ ID NO: 49901 - DNA, 20 bp, Artificial Sequence
  chemically synthesized
ggatgtgaaggacctcttca

SEQ ID NO: 49902 - DNA, 20 bp, Artificial Sequence
  chemically synthesized
atgtgaaggacctcttcaag

SEQ ID NO: 49903 - DNA, 20 bp, Artificial Sequence
  chemically synthesized
accactgctcaatgaaataa

SEQ ID NO: 49904 - DNA, 20 bp, Artificial Sequence
  chemically synthesized
cactgctcaatgaaataaaa

SEQ ID NO: 49905 - DNA, 20 bp, Artificial Sequence
  chemically synthesized
actgctcaatgaaataaaag

SEQ ID NO: 49906 - DNA, 20 bp, Artificial Sequence
  chemically synthesized
taaaagaggatacaaacaaa

SEQ ID NO: 49907 - DNA, 20 bp, Artificial Sequence
  chemically synthesized
aagaggatacaaacaaatgg

SEQ ID NO: 49908 - DNA, 20 bp, Artificial Sequence
  chemically synthesized
ggaagaacattccatgctca

SEQ ID NO: 49909 - DNA, 20 bp, Artificial Sequence
  chemically synthesized
gaagaacattccatgctcat

SEQ ID NO: 49910 - DNA, 20 bp, Artificial Sequence
  chemically synthesized
gaacattccatgctcatggg

SEQ ID NO: 49911 - DNA, 20 bp, Artificial Sequence
  chemically synthesized
aacattccatgctcatgggt

SEQ ID NO: 49912 - DNA, 20 bp, Artificial Sequence
  chemically synthesized
attccatgctcatgggtagg

SEQ ID NO: 49913 - DNA, 20 bp, Artificial Sequence
  chemically synthesized
aagaatcaatatcgtgaaaa

SEQ ID NO: 49914 - DNA, 20 bp, Artificial Sequence
  chemically synthesized
tgaaaatggtcatactgccc

SEQ ID NO: 49915 - DNA, 20 bp, Artificial Sequence
  chemically synthesized
gaaaatggtcatactgccca

SEQ ID NO: 49916 - DNA, 20 bp, Artificial Sequence
  chemically synthesized
atactgcccaaggtaattta

SEQ ID NO: 49917 - DNA, 20 bp, Artificial Sequence
  chemically synthesized
gattcaatgccatccccatc

SEQ ID NO: 49918 - DNA, 20 bp, Artificial Sequence
  chemically synthesized
gctaccaatgactttcttca

SEQ ID NO: 49919 - DNA, 20 bp, Artificial Sequence
  chemically synthesized
aatgactttcttcacagaac

SEQ ID NO: 49920 - DNA, 20 bp, Artificial Sequence
  chemically synthesized
aactggaaaaaactacttta

SEQ ID NO: 49921 - DNA, 20 bp, Artificial Sequence
  chemically synthesized
aaactactttaaagttcata

SEQ ID NO: 49922 - DNA, 20 bp, Artificial Sequence
  chemically synthesized
aagttcatatggaaccaaaa

SEQ ID NO: 49923 - DNA, 20 bp, Artificial Sequence
  chemically synthesized
gttcatatggaaccaaaaaa

SEQ ID NO: 49924 - DNA, 20 bp, Artificial Sequence
  chemically synthesized
aaaaaagagcccacatcacc

SEQ ID NO: 49925 - DNA, 20 bp, Artificial Sequence
  chemically synthesized
aaaaagagcccacatcacca

SEQ ID NO: 49926 - DNA, 20 bp, Artificial Sequence
  chemically synthesized
cacatcaccaaggcaatcct

SEQ ID NO: 49927 - DNA, 20 bp, Artificial Sequence
  chemically synthesized
ccaaggcaatcctaagccaa

SEQ ID NO: 49928 - DNA, 20 bp, Artificial Sequence
  chemically synthesized
aatcctaagccaaaagaaca

SEQ ID NO: 49929 - DNA, 20 bp, Artificial Sequence
  chemically synthesized
ctaagccaaaagaacaaagc

SEQ ID NO: 49930 - DNA, 20 bp, Artificial Sequence
  chemically synthesized
aagccaaaagaacaaagctg

SEQ ID NO: 49931 - DNA, 20 bp, Artificial Sequence
  chemically synthesized
agccaaaagaacaaagctgg

SEQ ID NO: 49932 - DNA, 20 bp, Artificial Sequence
  chemically synthesized
caaactatactacaatgcta

SEQ ID NO: 49933 - DNA, 20 bp, Artificial Sequence
  chemically synthesized
caatgctacggtaaccaaaa

SEQ ID NO: 49934 - DNA, 20 bp, Artificial Sequence
  chemically synthesized
ctacggtaaccaaaacagca

SEQ ID NO: 49935 - DNA, 20 bp, Artificial Sequence
  chemically synthesized
taaccaaaacagcatggtac

SEQ ID NO: 49936 - DNA, 20 bp, Artificial Sequence
  chemically synthesized
gcatggtactggtaccaaaa

SEQ ID NO: 49937 - DNA, 20 bp, Artificial Sequence
  chemically synthesized
atggtactggtaccaaaaca

SEQ ID NO: 49938 - DNA, 20 bp, Artificial Sequence
  chemically synthesized
ctggtaccaaaacagagatc

SEQ ID NO: 49939 - DNA, 20 bp, Artificial Sequence
  chemically synthesized
aaaacagagatctagaccaa

SEQ ID NO: 49940 - DNA, 20 bp, Artificial Sequence
  chemically synthesized
agagatctagaccaatggaa

SEQ ID NO: 49941 - DNA, 20 bp, Artificial Sequence
  chemically synthesized
tctagaccaatggaacagaa

SEQ ID NO: 49942 - DNA, 20 bp, Artificial Sequence
  chemically synthesized
tagaccaatggaacagaaca

SEQ ID NO: 49943 - DNA, 20 bp, Artificial Sequence
  chemically synthesized
atggaacagaacagagccct

SEQ ID NO: 49944 - DNA, 20 bp, Artificial Sequence
  chemically synthesized
atctgatctttgacaaacct

SEQ ID NO: 49945 - DNA, 20 bp, Artificial Sequence
  chemically synthesized
ctgatctttgacaaacctga

SEQ ID NO: 49946 - DNA, 20 bp, Artificial Sequence
  chemically synthesized
ttgacaaacctgagagaaac

SEQ ID NO: 49947 - DNA, 20 bp, Artificial Sequence
  chemically synthesized
aacctgagagaaacaagcaa

SEQ ID NO: 49948 - DNA, 20 bp, Artificial Sequence
  chemically synthesized
acctgagagaaacaagcaat

SEQ ID NO: 49949 - DNA, 20 bp, Artificial Sequence
  chemically synthesized
cctgagagaaacaagcaatg

SEQ ID NO: 49950 - DNA, 20 bp, Artificial Sequence
  chemically synthesized
agagaaacaagcaatgggga

SEQ ID NO: 49951 - DNA, 20 bp, Artificial Sequence
  chemically synthesized
gagaaacaagcaatggggaa

SEQ ID NO: 49952 - DNA, 20 bp, Artificial Sequence
  chemically synthesized
aggattccctatttaataaa

SEQ ID NO: 49953 - DNA, 20 bp, Artificial Sequence
  chemically synthesized
ccctatttaataaatggtgc

SEQ ID NO: 49954 - DNA, 20 bp, Artificial Sequence
  chemically synthesized
cctatttaataaatggtgct

SEQ ID NO: 49955 - DNA, 20 bp, Artificial Sequence
  chemically synthesized
ataaatggtgctgggaaaac

SEQ ID NO: 49956 - DNA, 20 bp, Artificial Sequence
  chemically synthesized
atggtgctgggaaaactggc

SEQ ID NO: 49957 - DNA, 20 bp, Artificial Sequence
  chemically synthesized
gaaaactggctagccatatg

SEQ ID NO: 49958 - DNA, 20 bp, Artificial Sequence
  chemically synthesized
actggctagccatatgtaga

SEQ ID NO: 49959 - DNA, 20 bp, Artificial Sequence
  chemically synthesized
catatgtagaaagctgaaac

SEQ ID NO: 49960 - DNA, 20 bp, Artificial Sequence
  chemically synthesized
ccttatacaaaaattaattc

SEQ ID NO: 49961 - DNA, 20 bp, Artificial Sequence
  chemically synthesized
atacaaaaattaattcaaga

SEQ ID NO: 49962 - DNA, 20 bp, Artificial Sequence
  chemically synthesized
aattaattcaagatggatta

SEQ ID NO: 49963 - DNA, 20 bp, Artificial Sequence
  chemically synthesized
tggattaaagacttacatgt

SEQ ID NO: 49964 - DNA, 20 bp, Artificial Sequence
  chemically synthesized
acctaaaaccataaaaaccc

SEQ ID NO: 49965 - DNA, 20 bp, Artificial Sequence
  chemically synthesized
aaaaaccctagaaaaaaacc

SEQ ID NO: 49966 - DNA, 20 bp, Artificial Sequence
  chemically synthesized
aaaaccctagaaaaaaacct

SEQ ID NO: 49967 - DNA, 20 bp, Artificial Sequence
  chemically synthesized
aaaacctaggcaataccatt

SEQ ID NO: 49968 - DNA, 20 bp, Artificial Sequence
  chemically synthesized
aaacctaggcaataccattc

SEQ ID NO: 49969 - DNA, 20 bp, Artificial Sequence
  chemically synthesized
aggcaataccattcaggaca

SEQ ID NO: 49970 - DNA, 20 bp, Artificial Sequence
  chemically synthesized
ggcaataccattcaggacat

SEQ ID NO: 49971 - DNA, 20 bp, Artificial Sequence
  chemically synthesized
taccattcaggacataggca

SEQ ID NO: 49972 - DNA, 20 bp, Artificial Sequence
  chemically synthesized
accattcaggacataggcat

SEQ ID NO: 49973 - DNA, 20 bp, Artificial Sequence
  chemically synthesized
ttcaggacataggcatgggc

SEQ ID NO: 49974 - DNA, 20 bp, Artificial Sequence
  chemically synthesized
tcaggacataggcatgggca

SEQ ID NO: 49975 - DNA, 20 bp, Artificial Sequence
  chemically synthesized
cttcatgtctaaaacaccaa

SEQ ID NO: 49976 - DNA, 20 bp, Artificial Sequence
  chemically synthesized
gtctaaaacaccaaaagcaa

SEQ ID NO: 49977 - DNA, 20 bp, Artificial Sequence
  chemically synthesized
accaaaagcaatggcaacaa

SEQ ID NO: 49978 - DNA, 20 bp, Artificial Sequence
  chemically synthesized
aatggcaacaaaagacaaaa

SEQ ID NO: 49979 - DNA, 20 bp, Artificial Sequence
  chemically synthesized
caaaagacaaaatggacaaa

SEQ ID NO: 49980 - DNA, 20 bp, Artificial Sequence
  chemically synthesized
aaaagacaaaatggacaaac

SEQ ID NO: 49981 - DNA, 20 bp, Artificial Sequence
  chemically synthesized
aacgggatctaattaaacta

SEQ ID NO: 49982 - DNA, 20 bp, Artificial Sequence
  chemically synthesized
cgggatctaattaaactaaa

SEQ ID NO: 49983 - DNA, 20 bp, Artificial Sequence
  chemically synthesized
taaactaaagagcttctgca

SEQ ID NO: 49984 - DNA, 20 bp, Artificial Sequence
  chemically synthesized
aaagagcttctgcacagcta

SEQ ID NO: 49985 - DNA, 20 bp, Artificial Sequence
  chemically synthesized
acagctaaagaaactaccat

SEQ ID NO: 49986 - DNA, 20 bp, Artificial Sequence
  chemically synthesized
agctaaagaaactaccatca

SEQ ID NO: 49987 - DNA, 20 bp, Artificial Sequence
  chemically synthesized
gaaactaccatcagagtgaa

SEQ ID NO: 49988 - DNA, 20 bp, Artificial Sequence
  chemically synthesized
aaactaccatcagagtgaac

SEQ ID NO: 49989 - DNA, 20 bp, Artificial Sequence
  chemically synthesized
tgaacaggcaacctacaaaa

SEQ ID NO: 49990 - DNA, 20 bp, Artificial Sequence
  chemically synthesized
gaacaggcaacctacaaaat

SEQ ID NO: 49991 - DNA, 20 bp, Artificial Sequence
  chemically synthesized
acaggcaacctacaaaatgg

SEQ ID NO: 49992 - DNA, 20 bp, Artificial Sequence
  chemically synthesized
tgcaatctactcatctgaca

SEQ ID NO: 49993 - DNA, 20 bp, Artificial Sequence
  chemically synthesized
gcaatctactcatctgacaa

SEQ ID NO: 49994 - DNA, 20 bp, Artificial Sequence
  chemically synthesized
caatctactcatctgacaaa

SEQ ID NO: 49995 - DNA, 20 bp, Artificial Sequence
  chemically synthesized
tctgacaaagggctaatatc

SEQ ID NO: 49996 - DNA, 20 bp, Artificial Sequence
  chemically synthesized
atgaactcaaacaaatttac

SEQ ID NO: 49997 - DNA, 20 bp, Artificial Sequence
  chemically synthesized
aaacaaacaaccccatcaaa

SEQ ID NO: 49998 - DNA, 20 bp, Artificial Sequence
  chemically synthesized
caaacaaccccatcaaaaag

SEQ ID NO: 49999 - DNA, 20 bp, Artificial Sequence
  chemically synthesized
aaacaaccccatcaaaaagt

SEQ ID NO: 50000 - DNA, 20 bp, Artificial Sequence
  chemically synthesized
accccatcaaaaagtgggca

SEQ ID NO: 50001 - DNA, 20 bp, Artificial Sequence
  chemically synthesized
ccccatcaaaaagtgggcaa

SEQ ID NO: 50002 - DNA, 20 bp, Artificial Sequence
  chemically synthesized
aagtgggcaaaggatatgaa

SEQ ID NO: 50003 - DNA, 20 bp, Artificial Sequence
  chemically synthesized
tatgaacagacacttcgcaa

SEQ ID NO: 50004 - DNA, 20 bp, Artificial Sequence
  chemically synthesized
gaacagacacttcgcaaaag

SEQ ID NO: 50005 - DNA, 20 bp, Artificial Sequence
  chemically synthesized
gaaaaaatgctcatcatcac

SEQ ID NO: 50006 - DNA, 20 bp, Artificial Sequence
  chemically synthesized
tgctcatcatcactagccat

SEQ ID NO: 50007 - DNA, 20 bp, Artificial Sequence
  chemically synthesized
ctcatcatcactagccatca

SEQ ID NO: 50008 - DNA, 20 bp, Artificial Sequence
  chemically synthesized
atgcaaatcaaaaccacaat

SEQ ID NO: 50009 - DNA, 20 bp, Artificial Sequence
  chemically synthesized
aatgagataccatctcacac

SEQ ID NO: 50010 - DNA, 20 bp, Artificial Sequence
  chemically synthesized
agataccatctcacaccagt

SEQ ID NO: 50011 - DNA, 20 bp, Artificial Sequence
  chemically synthesized
ccatctcacaccagttagaa

SEQ ID NO: 50012 - DNA, 20 bp, Artificial Sequence
  chemically synthesized
ttagaatggcgatcattaaa

SEQ ID NO: 50013 - DNA, 20 bp, Artificial Sequence
  chemically synthesized
aatggcgatcattaaaaagt

SEQ ID NO: 50014 - DNA, 20 bp, Artificial Sequence
  chemically synthesized
atggcgatcattaaaaagtc

SEQ ID NO: 50015 - DNA, 20 bp, Artificial Sequence
  chemically synthesized
attaaaaagtcaggaaacaa

SEQ ID NO: 50016 - DNA, 20 bp, Artificial Sequence
  chemically synthesized
ttaaaaagtcaggaaacaac

SEQ ID NO: 50017 - DNA, 20 bp, Artificial Sequence
  chemically synthesized
agtcaggaaacaacaggtgc

SEQ ID NO: 50018 - DNA, 20 bp, Artificial Sequence
  chemically synthesized
tcaggaaacaacaggtgctg

SEQ ID NO: 50019 - DNA, 20 bp, Artificial Sequence
  chemically synthesized
aggaaacaacaggtgctgga

SEQ ID NO: 50020 - DNA, 20 bp, Artificial Sequence
  chemically synthesized
ggaaacaacaggtgctggag

SEQ ID NO: 50021 - DNA, 20 bp, Artificial Sequence
  chemically synthesized
aacaggtgctggagaggatg

SEQ ID NO: 50022 - DNA, 20 bp, Artificial Sequence
  chemically synthesized
caggtgctggagaggatgtg

SEQ ID NO: 50023 - DNA, 20 bp, Artificial Sequence
  chemically synthesized
ctggagaggatgtggagaaa

SEQ ID NO: 50024 - DNA, 20 bp, Artificial Sequence
  chemically synthesized
tggagaggatgtggagaaac

SEQ ID NO: 50025 - DNA, 20 bp, Artificial Sequence
  chemically synthesized
aggaacaacttttacactgt

SEQ ID NO: 50026 - DNA, 20 bp, Artificial Sequence
  chemically synthesized
aacaacttttacactgttgg

SEQ ID NO: 50027 - DNA, 20 bp, Artificial Sequence
  chemically synthesized
acaacttttacactgttggt

SEQ ID NO: 50028 - DNA, 20 bp, Artificial Sequence
  chemically synthesized
ctgttggtgggactgtaaac

SEQ ID NO: 50029 - DNA, 20 bp, Artificial Sequence
  chemically synthesized
gtaaactagttcaaccattg

SEQ ID NO: 50030 - DNA, 20 bp, Artificial Sequence
  chemically synthesized
aactagttcaaccattgcgg

SEQ ID NO: 50031 - DNA, 20 bp, Artificial Sequence
  chemically synthesized
agttcaaccattgcggaagt

SEQ ID NO: 50032 - DNA, 20 bp, Artificial Sequence
  chemically synthesized
aaccattgcggaagtcagtg

SEQ ID NO: 50033 - DNA, 20 bp, Artificial Sequence
  chemically synthesized
aagtcagtgtggcaattcct

SEQ ID NO: 50034 - DNA, 20 bp, Artificial Sequence
  chemically synthesized
agtcagtgtggcaattcctc

SEQ ID NO: 50035 - DNA, 20 bp, Artificial Sequence
  chemically synthesized
gtggcaattcctcaggaatc

SEQ ID NO: 50036 - DNA, 20 bp, Artificial Sequence
  chemically synthesized
attcctcaggaatctagaac

SEQ ID NO: 50037 - DNA, 20 bp, Artificial Sequence
  chemically synthesized
actagaaataccatttgacc

SEQ ID NO: 50038 - DNA, 20 bp, Artificial Sequence
  chemically synthesized
tgacccagccatcccattac

SEQ ID NO: 50039 - DNA, 20 bp, Artificial Sequence
  chemically synthesized
gacccagccatcccattact

SEQ ID NO: 50040 - DNA, 20 bp, Artificial Sequence
  chemically synthesized
cattactgggtacataccca

SEQ ID NO: 50041 - DNA, 20 bp, Artificial Sequence
  chemically synthesized
attactgggtacatacccaa

SEQ ID NO: 50042 - DNA, 20 bp, Artificial Sequence
  chemically synthesized
ttataaatcatgctgctata

SEQ ID NO: 50043 - DNA, 20 bp, Artificial Sequence
  chemically synthesized
atgcacacgtatgtttattg

SEQ ID NO: 50044 - DNA, 20 bp, Artificial Sequence
  chemically synthesized
tattgcagcactattcacaa

SEQ ID NO: 50045 - DNA, 20 bp, Artificial Sequence
  chemically synthesized
cagcactattcacaatagca

SEQ ID NO: 50046 - DNA, 20 bp, Artificial Sequence
  chemically synthesized
tattcacaatagcaaagact

SEQ ID NO: 50047 - DNA, 20 bp, Artificial Sequence
  chemically synthesized
acccaaatgtccaacaacga

SEQ ID NO: 50048 - DNA, 20 bp, Artificial Sequence
  chemically synthesized
aatgtccaacaacgatagac

SEQ ID NO: 50049 - DNA, 20 bp, Artificial Sequence
  chemically synthesized
caacaacgatagactggatt

SEQ ID NO: 50050 - DNA, 20 bp, Artificial Sequence
  chemically synthesized
tagactggattaagaaaatg

SEQ ID NO: 50051 - DNA, 20 bp, Artificial Sequence
  chemically synthesized
aatgtggcacatatacacca

SEQ ID NO: 50052 - DNA, 20 bp, Artificial Sequence
  chemically synthesized
atacaccatggaatactatg

SEQ ID NO: 50053 - DNA, 20 bp, Artificial Sequence
  chemically synthesized
atgcagccataaaaaatgat

SEQ ID NO: 50054 - DNA, 20 bp, Artificial Sequence
  chemically synthesized
tgatgagttcatgtcctttg

SEQ ID NO: 50055 - DNA, 20 bp, Artificial Sequence
  chemically synthesized
gatgagttcatgtcctttgt

SEQ ID NO: 50056 - DNA, 20 bp, Artificial Sequence
  chemically synthesized
atgagttcatgtcctttgta

SEQ ID NO: 50057 - DNA, 20 bp, Artificial Sequence
  chemically synthesized
tcatgtcctttgtagggaca

SEQ ID NO: 50058 - DNA, 20 bp, Artificial Sequence
  chemically synthesized
cctttgtagggacatggatg

SEQ ID NO: 50059 - DNA, 20 bp, Artificial Sequence
  chemically synthesized
tgtagggacatggatgaagc

SEQ ID NO: 50060 - DNA, 20 bp, Artificial Sequence
  chemically synthesized
aagctggaaactatcattct

SEQ ID NO: 50061 - DNA, 20 bp, Artificial Sequence
  chemically synthesized
cattctcagcaaactatcac

SEQ ID NO: 50062 - DNA, 20 bp, Artificial Sequence
  chemically synthesized
attctcagcaaactatcaca

SEQ ID NO: 50063 - DNA, 20 bp, Artificial Sequence
  chemically synthesized
tctcagcaaactatcacaag

SEQ ID NO: 50064 - DNA, 20 bp, Artificial Sequence
  chemically synthesized
acaccgcatgttctcactca

SEQ ID NO: 50065 - DNA, 20 bp, Artificial Sequence
  chemically synthesized
caccgcatgttctcactcat

SEQ ID NO: 50066 - DNA, 20 bp, Artificial Sequence
  chemically synthesized
cgcatgttctcactcatagg

SEQ ID NO: 50067 - DNA, 20 bp, Artificial Sequence
  chemically synthesized
gcatgttctcactcataggt

SEQ ID NO: 50068 - DNA, 20 bp, Artificial Sequence
  chemically synthesized
ataggtgggaattgaacaat

SEQ ID NO: 50069 - DNA, 20 bp, Artificial Sequence
  chemically synthesized
aattgaacaatgagaacaca

SEQ ID NO: 50070 - DNA, 20 bp, Artificial Sequence
  chemically synthesized
tgagaacacatggacacatg

SEQ ID NO: 50071 - DNA, 20 bp, Artificial Sequence
  chemically synthesized
agaacacatggacacatgaa

SEQ ID NO: 50072 - DNA, 20 bp, Artificial Sequence
  chemically synthesized
gaacacatggacacatgaag

SEQ ID NO: 50073 - DNA, 20 bp, Artificial Sequence
  chemically synthesized
tgaagaggaacatcacactc

SEQ ID NO: 50074 - DNA, 20 bp, Artificial Sequence
  chemically synthesized
gaagaggaacatcacactct

SEQ ID NO: 50075 - DNA, 20 bp, Artificial Sequence
  chemically synthesized
aagaggaacatcacactctg

SEQ ID NO: 50076 - DNA, 20 bp, Artificial Sequence
  chemically synthesized
tcacactctggggactgtta

SEQ ID NO: 50077 - DNA, 20 bp, Artificial Sequence
  chemically synthesized
cacactctggggactgttat

SEQ ID NO: 50078 - DNA, 20 bp, Artificial Sequence
  chemically synthesized
acactctggggactgttatg

SEQ ID NO: 50079 - DNA, 20 bp, Artificial Sequence
  chemically synthesized
ctctggggactgttatgggg

SEQ ID NO: 50080 - DNA, 20 bp, Artificial Sequence
  chemically synthesized
tctggggactgttatggggt

SEQ ID NO: 50081 - DNA, 20 bp, Artificial Sequence
  chemically synthesized
ctggggactgttatggggtg

SEQ ID NO: 50082 - DNA, 20 bp, Artificial Sequence
  chemically synthesized
tggggactgttatggggtgg

SEQ ID NO: 50083 - DNA, 20 bp, Artificial Sequence
  chemically synthesized
ggggactgttatggggtggg

SEQ ID NO: 50084 - DNA, 20 bp, Artificial Sequence
  chemically synthesized
gactgttatggggtgggggg

SEQ ID NO: 50085 - DNA, 20 bp, Artificial Sequence
  chemically synthesized
actgttatggggtggggggc

SEQ ID NO: 50086 - DNA, 20 bp, Artificial Sequence
  chemically synthesized
ctgttatggggtggggggca

SEQ ID NO: 50087 - DNA, 20 bp, Artificial Sequence
  chemically synthesized
tgttatggggtggggggcag

SEQ ID NO: 50088 - DNA, 20 bp, Artificial Sequence
  chemically synthesized
tatggggtggggggcagggg

SEQ ID NO: 50089 - DNA, 20 bp, Artificial Sequence
  chemically synthesized
atggggtggggggcaggggc

SEQ ID NO: 50090 - DNA, 20 bp, Artificial Sequence
  chemically synthesized
tggggtggggggcaggggca

SEQ ID NO: 50091 - DNA, 20 bp, Artificial Sequence
  chemically synthesized
gtggggggcaggggcaggga

SEQ ID NO: 50092 - DNA, 20 bp, Artificial Sequence
  chemically synthesized
ggcaggggcagggatagcac

SEQ ID NO: 50093 - DNA, 20 bp, Artificial Sequence
  chemically synthesized
gcaggggcagggatagcact

SEQ ID NO: 50094 - DNA, 20 bp, Artificial Sequence
  chemically synthesized
aggggcagggatagcactag

SEQ ID NO: 50095 - DNA, 20 bp, Artificial Sequence
  chemically synthesized
tatacctaatgctaaatgac

SEQ ID NO: 50096 - DNA, 20 bp, Artificial Sequence
  chemically synthesized
aatgctaaatgacgagttaa

SEQ ID NO: 50097 - DNA, 20 bp, Artificial Sequence
  chemically synthesized
atgctaaatgacgagttaat

SEQ ID NO: 50098 - DNA, 20 bp, Artificial Sequence
  chemically synthesized
aaatgacgagttaatgggtg

SEQ ID NO: 50099 - DNA, 20 bp, Artificial Sequence
  chemically synthesized
atgggtgcagcacaccaaca

SEQ ID NO: 50100 - DNA, 20 bp, Artificial Sequence
  chemically synthesized
cacatgtaccctaaaacttg

SEQ ID NO: 50101 - DNA, 20 bp, Artificial Sequence
  chemically synthesized
tgaagtataataataaaaaa

SEQ ID NO: 50102 - DNA, 20 bp, Artificial Sequence
  chemically synthesized
aaactgatctcacacatccg

SEQ ID NO: 50103 - DNA, 20 bp, Artificial Sequence
  chemically synthesized
actgatctcacacatccgta

SEQ ID NO: 50104 - DNA, 20 bp, Artificial Sequence
  chemically synthesized
acatccgtagagccattatc

SEQ ID NO: 50105 - DNA, 20 bp, Artificial Sequence
  chemically synthesized
tcaagtctttctctttgaaa

SEQ ID NO: 50106 - DNA, 20 bp, Artificial Sequence
  chemically synthesized
gtctttctctttgaaataga

SEQ ID NO: 50107 - DNA, 20 bp, Artificial Sequence
  chemically synthesized
ctttgaaatagacagaaatt

SEQ ID NO: 50108 - DNA, 20 bp, Artificial Sequence
  chemically synthesized
acagaaatttagtgttttct

SEQ ID NO: 50109 - DNA, 20 bp, Artificial Sequence
  chemically synthesized
aaatttagtgttttctcagt

SEQ ID NO: 50110 - DNA, 20 bp, Artificial Sequence
  chemically synthesized
tcagttaacattccttcaac

SEQ ID NO: 50111 - DNA, 20 bp, Artificial Sequence
  chemically synthesized
taacattccttcaactagat

SEQ ID NO: 50112 - DNA, 20 bp, Artificial Sequence
  chemically synthesized
gattagttgtgacaaaattt

SEQ ID NO: 50113 - DNA, 20 bp, Artificial Sequence
  chemically synthesized
attagttgtgacaaaatttc

SEQ ID NO: 50114 - DNA, 20 bp, Artificial Sequence
  chemically synthesized
gccttgctcaactctaacct

SEQ ID NO: 50115 - DNA, 20 bp, Artificial Sequence
  chemically synthesized
cagtctctccatatatttct

SEQ ID NO: 50116 - DNA, 20 bp, Artificial Sequence
  chemically synthesized
gtctctccatatatttctga

SEQ ID NO: 50117 - DNA, 20 bp, Artificial Sequence
  chemically synthesized
cttccttcttatttgtttat

SEQ ID NO: 50118 - DNA, 20 bp, Artificial Sequence
  chemically synthesized
cttatttgtttataagaatt

SEQ ID NO: 50119 - DNA, 20 bp, Artificial Sequence
  chemically synthesized
gtttataagaatttagtaaa

SEQ ID NO: 50120 - DNA, 20 bp, Artificial Sequence
  chemically synthesized
atttagtaaatggcaatatt

SEQ ID NO: 50121 - DNA, 20 bp, Artificial Sequence
  chemically synthesized
tagtaaatggcaatattgag

SEQ ID NO: 50122 - DNA, 20 bp, Artificial Sequence
  chemically synthesized
taaatggcaatattgagaag

SEQ ID NO: 50123 - DNA, 20 bp, Artificial Sequence
  chemically synthesized
tattgagaagtagaaaattt

SEQ ID NO: 50124 - DNA, 20 bp, Artificial Sequence
  chemically synthesized
ttgagaagtagaaaattttg

SEQ ID NO: 50125 - DNA, 20 bp, Artificial Sequence
  chemically synthesized
gagacttgtttttcatgaac

SEQ ID NO: 50126 - DNA, 20 bp, Artificial Sequence
  chemically synthesized
catgaaccagaacaatctca

SEQ ID NO: 50127 - DNA, 20 bp, Artificial Sequence
  chemically synthesized
gaaccagaacaatctcaaag

SEQ ID NO: 50128 - DNA, 20 bp, Artificial Sequence
  chemically synthesized
ctcaaagcagcaatactaaa

SEQ ID NO: 50129 - DNA, 20 bp, Artificial Sequence
  chemically synthesized
tcaaagcagcaatactaaac

SEQ ID NO: 50130 - DNA, 20 bp, Artificial Sequence
  chemically synthesized
aaagcagcaatactaaacag

SEQ ID NO: 50131 - DNA, 20 bp, Artificial Sequence
  chemically synthesized
agcaatactaaacaggagcc

SEQ ID NO: 50132 - DNA, 20 bp, Artificial Sequence
  chemically synthesized
tactaaacaggagccaagcc

SEQ ID NO: 50133 - DNA, 20 bp, Artificial Sequence
  chemically synthesized
caggagccaagcctagaata

SEQ ID NO: 50134 - DNA, 20 bp, Artificial Sequence
  chemically synthesized
ctagaataaagttgaatttc

SEQ ID NO: 50135 - DNA, 20 bp, Artificial Sequence
  chemically synthesized
gttgaatttctggaatcaac

SEQ ID NO: 50136 - DNA, 20 bp, Artificial Sequence
  chemically synthesized
aatttctggaatcaacaagc

SEQ ID NO: 50137 - DNA, 20 bp, Artificial Sequence
  chemically synthesized
atttctggaatcaacaagct

SEQ ID NO: 50138 - DNA, 20 bp, Artificial Sequence
  chemically synthesized
tttctggaatcaacaagcta

SEQ ID NO: 50139 - DNA, 20 bp, Artificial Sequence
  chemically synthesized
ttctggaatcaacaagctag

SEQ ID NO: 50140 - DNA, 20 bp, Artificial Sequence
  chemically synthesized
ggaatcaacaagctagggga

SEQ ID NO: 50141 - DNA, 20 bp, Artificial Sequence
  chemically synthesized
ctaggggaaagtctcccatt

SEQ ID NO: 50142 - DNA, 20 bp, Artificial Sequence
  chemically synthesized
taagtcaaatatttgacaac

SEQ ID NO: 50143 - DNA, 20 bp, Artificial Sequence
  chemically synthesized
aagtcaaatatttgacaact

SEQ ID NO: 50144 - DNA, 20 bp, Artificial Sequence
  chemically synthesized
gtcaaatatttgacaactgg

SEQ ID NO: 50145 - DNA, 20 bp, Artificial Sequence
  chemically synthesized
tcaaatatttgacaactggg

SEQ ID NO: 50146 - DNA, 20 bp, Artificial Sequence
  chemically synthesized
tatttgacaactgggaggtc

SEQ ID NO: 50147 - DNA, 20 bp, Artificial Sequence
  chemically synthesized
tgacaactgggaggtcaagt

SEQ ID NO: 50148 - DNA, 20 bp, Artificial Sequence
  chemically synthesized
acaactgggaggtcaagtca

SEQ ID NO: 50149 - DNA, 20 bp, Artificial Sequence
  chemically synthesized
caactgggaggtcaagtcag

SEQ ID NO: 50150 - DNA, 20 bp, Artificial Sequence
  chemically synthesized
tcagaggtgaaaaatgatta

SEQ ID NO: 50151 - DNA, 20 bp, Artificial Sequence
  chemically synthesized
gaaaaatgattaaagataac

SEQ ID NO: 50152 - DNA, 20 bp, Artificial Sequence
  chemically synthesized
aaaatgattaaagataacaa

SEQ ID NO: 50153 - DNA, 20 bp, Artificial Sequence
  chemically synthesized
aaatgattaaagataacaag

SEQ ID NO: 50154 - DNA, 20 bp, Artificial Sequence
  chemically synthesized
taacaagaggtctgaaaaca

SEQ ID NO: 50155 - DNA, 20 bp, Artificial Sequence
  chemically synthesized
aagtgaccaattaaaataaa

SEQ ID NO: 50156 - DNA, 20 bp, Artificial Sequence
  chemically synthesized
gaccaattaaaataaaaaga

SEQ ID NO: 50157 - DNA, 20 bp, Artificial Sequence
  chemically synthesized
ccaattaaaataaaaagaaa

SEQ ID NO: 50158 - DNA, 20 bp, Artificial Sequence
  chemically synthesized
taaaataaaaagaaagagcc

SEQ ID NO: 50159 - DNA, 20 bp, Artificial Sequence
  chemically synthesized
ataaaaagaaagagccaagc

SEQ ID NO: 50160 - DNA, 20 bp, Artificial Sequence
  chemically synthesized
taaaaagaaagagccaagct

SEQ ID NO: 50161 - DNA, 20 bp, Artificial Sequence
  chemically synthesized
agaaagagccaagctgggca

SEQ ID NO: 50162 - DNA, 20 bp, Artificial Sequence
  chemically synthesized
aagagccaagctgggcacag

SEQ ID NO: 50163 - DNA, 20 bp, Artificial Sequence
  chemically synthesized
ggcacagtggcttgcatctg

SEQ ID NO: 50164 - DNA, 20 bp, Artificial Sequence
  chemically synthesized
gtggcttgcatctgtagtcc

SEQ ID NO: 50165 - DNA, 20 bp, Artificial Sequence
  chemically synthesized
catctgtagtcccagtaacc

SEQ ID NO: 50166 - DNA, 20 bp, Artificial Sequence
  chemically synthesized
atctgtagtcccagtaaccc

SEQ ID NO: 50167 - DNA, 20 bp, Artificial Sequence
  chemically synthesized
ctgtagtcccagtaacccag

SEQ ID NO: 50168 - DNA, 20 bp, Artificial Sequence
  chemically synthesized
tgtagtcccagtaacccagg

SEQ ID NO: 50169 - DNA, 20 bp, Artificial Sequence
  chemically synthesized
cccagtaacccaggaggctg

SEQ ID NO: 50170 - DNA, 20 bp, Artificial Sequence
  chemically synthesized
aacccaggaggctgaagtga

SEQ ID NO: 50171 - DNA, 20 bp, Artificial Sequence
  chemically synthesized
acccaggaggctgaagtgat

SEQ ID NO: 50172 - DNA, 20 bp, Artificial Sequence
  chemically synthesized
ctgaagtgataggatcactt

SEQ ID NO: 50173 - DNA, 20 bp, Artificial Sequence
  chemically synthesized
gtgataggatcacttgagcc

SEQ ID NO: 50174 - DNA, 20 bp, Artificial Sequence
  chemically synthesized
tgataggatcacttgagccc

SEQ ID NO: 50175 - DNA, 20 bp, Artificial Sequence
  chemically synthesized
atcacttgagcccaggattt

SEQ ID NO: 50176 - DNA, 20 bp, Artificial Sequence
  chemically synthesized
tcacttgagcccaggatttc

SEQ ID NO: 50177 - DNA, 20 bp, Artificial Sequence
  chemically synthesized
cacttgagcccaggatttca

SEQ ID NO: 50178 - DNA, 20 bp, Artificial Sequence
  chemically synthesized
agcccaggatttcagggttg

SEQ ID NO: 50179 - DNA, 20 bp, Artificial Sequence
  chemically synthesized
caggatttcagggttgcagt

SEQ ID NO: 50180 - DNA, 20 bp, Artificial Sequence
  chemically synthesized
ataatgacaccactgctctc

SEQ ID NO: 50181 - DNA, 20 bp, Artificial Sequence
  chemically synthesized
acaccactgctctctagcct

SEQ ID NO: 50182 - DNA, 20 bp, Artificial Sequence
  chemically synthesized
gctctctagccttggtgact

SEQ ID NO: 50183 - DNA, 20 bp, Artificial Sequence
  chemically synthesized
gtgactgagatcctgtctct

SEQ ID NO: 50184 - DNA, 20 bp, Artificial Sequence
  chemically synthesized
tgactgagatcctgtctctg

SEQ ID NO: 50185 - DNA, 20 bp, Artificial Sequence
  chemically synthesized
ctgaggaaaaacaaacaaac

SEQ ID NO: 50186 - DNA, 20 bp, Artificial Sequence
  chemically synthesized
aaaacaaacaaacaaacaca

SEQ ID NO: 50187 - DNA, 20 bp, Artificial Sequence
  chemically synthesized
caaacaaacacacagatatt

SEQ ID NO: 50188 - DNA, 20 bp, Artificial Sequence
  chemically synthesized
acacacagatattaagaaca

SEQ ID NO: 50189 - DNA, 20 bp, Artificial Sequence
  chemically synthesized
cacagatattaagaacatag

SEQ ID NO: 50190 - DNA, 20 bp, Artificial Sequence
  chemically synthesized
agaacatagaagttttgtta

SEQ ID NO: 50191 - DNA, 20 bp, Artificial Sequence
  chemically synthesized
ggtgatgatattctccaaca

SEQ ID NO: 50192 - DNA, 20 bp, Artificial Sequence
  chemically synthesized
gtgatgatattctccaacac

SEQ ID NO: 50193 - DNA, 20 bp, Artificial Sequence
  chemically synthesized
acacaggtctgaaccccttg

SEQ ID NO: 50194 - DNA, 20 bp, Artificial Sequence
  chemically synthesized
ctgaaccccttgcagtgcct

SEQ ID NO: 50195 - DNA, 20 bp, Artificial Sequence
  chemically synthesized
tgaaccccttgcagtgcctc

SEQ ID NO: 50196 - DNA, 20 bp, Artificial Sequence
  chemically synthesized
gaaccccttgcagtgcctcg

SEQ ID NO: 50197 - DNA, 20 bp, Artificial Sequence
  chemically synthesized
gtgcctcggggctgtttctc

SEQ ID NO: 50198 - DNA, 20 bp, Artificial Sequence
  chemically synthesized
cctcggggctgtttctccag

SEQ ID NO: 50199 - DNA, 20 bp, Artificial Sequence
  chemically synthesized
ctgtttctccagtggattct

SEQ ID NO: 50200 - DNA, 20 bp, Artificial Sequence
  chemically synthesized
tgtttctccagtggattctt

SEQ ID NO: 50201 - DNA, 20 bp, Artificial Sequence
  chemically synthesized
catcttctcaactttgtgaa

SEQ ID NO: 50202 - DNA, 20 bp, Artificial Sequence
  chemically synthesized
tgtgaaaagatattcatcca

SEQ ID NO: 50203 - DNA, 20 bp, Artificial Sequence
  chemically synthesized
gtgaaaagatattcatccaa

SEQ ID NO: 50204 - DNA, 20 bp, Artificial Sequence
  chemically synthesized
aaggtctcacctgtcttatt

SEQ ID NO: 50205 - DNA, 20 bp, Artificial Sequence
  chemically synthesized
ggtctcacctgtcttattca

SEQ ID NO: 50206 - DNA, 20 bp, Artificial Sequence
  chemically synthesized
cacctgtcttattcagagct

SEQ ID NO: 50207 - DNA, 20 bp, Artificial Sequence
  chemically synthesized
cttattcagagcttggattt

SEQ ID NO: 50208 - DNA, 20 bp, Artificial Sequence
  chemically synthesized
tcagagcttggattttggac

SEQ ID NO: 50209 - DNA, 20 bp, Artificial Sequence
  chemically synthesized
gactagctttttctatttct

SEQ ID NO: 50210 - DNA, 20 bp, Artificial Sequence
  chemically synthesized
actagctttttctatttctt

SEQ ID NO: 50211 - DNA, 20 bp, Artificial Sequence
  chemically synthesized
ttctatttcttgggattctc

SEQ ID NO: 50212 - DNA, 20 bp, Artificial Sequence
  chemically synthesized
ctatttcttgggattctcta

SEQ ID NO: 50213 - DNA, 20 bp, Artificial Sequence
  chemically synthesized
attctctagagccatatatt

SEQ ID NO: 50214 - DNA, 20 bp, Artificial Sequence
  chemically synthesized
ccatatattcagatataaca

SEQ ID NO: 50215 - DNA, 20 bp, Artificial Sequence
  chemically synthesized
tataacacagatataaccaa

SEQ ID NO: 50216 - DNA, 20 bp, Artificial Sequence
  chemically synthesized
aacacagatataaccaaaag

SEQ ID NO: 50217 - DNA, 20 bp, Artificial Sequence
  chemically synthesized
agatataaccaaaagaagca

SEQ ID NO: 50218 - DNA, 20 bp, Artificial Sequence
  chemically synthesized
gatataaccaaaagaagcaa

SEQ ID NO: 50219 - DNA, 20 bp, Artificial Sequence
  chemically synthesized
tataaccaaaagaagcaaag

SEQ ID NO: 50220 - DNA, 20 bp, Artificial Sequence
  chemically synthesized
ataaccaaaagaagcaaagg

SEQ ID NO: 50221 - DNA, 20 bp, Artificial Sequence
  chemically synthesized
aagaagcaaaggaggcatca

SEQ ID NO: 50222 - DNA, 20 bp, Artificial Sequence
  chemically synthesized
aagcaaaggaggcatcacag

SEQ ID NO: 50223 - DNA, 20 bp, Artificial Sequence
  chemically synthesized
agcaaaggaggcatcacaga

SEQ ID NO: 50224 - DNA, 20 bp, Artificial Sequence
  chemically synthesized
gcaaaggaggcatcacagaa

SEQ ID NO: 50225 - DNA, 20 bp, Artificial Sequence
  chemically synthesized
caaaggaggcatcacagaag

SEQ ID NO: 50226 - DNA, 20 bp, Artificial Sequence
  chemically synthesized
acagaaggggctttgtattc

SEQ ID NO: 50227 - DNA, 20 bp, Artificial Sequence
  chemically synthesized
cagaaggggctttgtattct

SEQ ID NO: 50228 - DNA, 20 bp, Artificial Sequence
  chemically synthesized
agaaggggctttgtattctg

SEQ ID NO: 50229 - DNA, 20 bp, Artificial Sequence
  chemically synthesized
aaggggctttgtattctggg

SEQ ID NO: 50230 - DNA, 20 bp, Artificial Sequence
  chemically synthesized
aggggctttgtattctgggg

SEQ ID NO: 50231 - DNA, 20 bp, Artificial Sequence
  chemically synthesized
ggggctttgtattctgggga

SEQ ID NO: 50232 - DNA, 20 bp, Artificial Sequence
  chemically synthesized
gggctttgtattctggggag

SEQ ID NO: 50233 - DNA, 20 bp, Artificial Sequence
  chemically synthesized
ggctttgtattctggggagg

SEQ ID NO: 50234 - DNA, 20 bp, Artificial Sequence
  chemically synthesized
gtattctggggagggggaca

SEQ ID NO: 50235 - DNA, 20 bp, Artificial Sequence
  chemically synthesized
attctggggagggggacata

SEQ ID NO: 50236 - DNA, 20 bp, Artificial Sequence
  chemically synthesized
ggggagggggacatagagtt

SEQ ID NO: 50237 - DNA, 20 bp, Artificial Sequence
  chemically synthesized
ggagggggacatagagttga

SEQ ID NO: 50238 - DNA, 20 bp, Artificial Sequence
  chemically synthesized
acatagagttgagagaaata

SEQ ID NO: 50239 - DNA, 20 bp, Artificial Sequence
  chemically synthesized
catagagttgagagaaatac

SEQ ID NO: 50240 - DNA, 20 bp, Artificial Sequence
  chemically synthesized
gagagaaatacaggaattta

SEQ ID NO: 50241 - DNA, 20 bp, Artificial Sequence
  chemically synthesized
agagaaatacaggaatttat

SEQ ID NO: 50242 - DNA, 20 bp, Artificial Sequence
  chemically synthesized
aatttataggactctactca

SEQ ID NO: 50243 - DNA, 20 bp, Artificial Sequence
  chemically synthesized
tttataggactctactcaaa

SEQ ID NO: 50244 - DNA, 20 bp, Artificial Sequence
  chemically synthesized
actcaaagagccctcaaata

SEQ ID NO: 50245 - DNA, 20 bp, Artificial Sequence
  chemically synthesized
aagagccctcaaataaagta

SEQ ID NO: 50246 - DNA, 20 bp, Artificial Sequence
  chemically synthesized
gccctcaaataaagtacggc

SEQ ID NO: 50247 - DNA, 20 bp, Artificial Sequence
  chemically synthesized
acggctagtcttctttgcct

SEQ ID NO: 50248 - DNA, 20 bp, Artificial Sequence
  chemically synthesized
tcttctttgcctaagacaat

SEQ ID NO: 50249 - DNA, 20 bp, Artificial Sequence
  chemically synthesized
tctttgcctaagacaatgag

SEQ ID NO: 50250 - DNA, 20 bp, Artificial Sequence
  chemically synthesized
gcctaagacaatgagcagtc

SEQ ID NO: 50251 - DNA, 20 bp, Artificial Sequence
  chemically synthesized
cctaagacaatgagcagtcc

SEQ ID NO: 50252 - DNA, 20 bp, Artificial Sequence
  chemically synthesized
aagacaatgagcagtccagg

SEQ ID NO: 50253 - DNA, 20 bp, Artificial Sequence
  chemically synthesized
aggaagttatccatttcttt

SEQ ID NO: 50254 - DNA, 20 bp, Artificial Sequence
  chemically synthesized
tccatttcttttagattttc

SEQ ID NO: 50255 - DNA, 20 bp, Artificial Sequence
  chemically synthesized
gattttctagtttatgtaca

SEQ ID NO: 50256 - DNA, 20 bp, Artificial Sequence
  chemically synthesized
ttttctagtttatgtacata

SEQ ID NO: 50257 - DNA, 20 bp, Artificial Sequence
  chemically synthesized
tatgtacatagagatgttca

SEQ ID NO: 50258 - DNA, 20 bp, Artificial Sequence
  chemically synthesized
gtacatagagatgttcatag

SEQ ID NO: 50259 - DNA, 20 bp, Artificial Sequence
  chemically synthesized
gatgattatttgtatttctg

SEQ ID NO: 50260 - DNA, 20 bp, Artificial Sequence
  chemically synthesized
atgattatttgtatttctgt

SEQ ID NO: 50261 - DNA, 20 bp, Artificial Sequence
  chemically synthesized
tgattatttgtatttctgtg

SEQ ID NO: 50262 - DNA, 20 bp, Artificial Sequence
  chemically synthesized
tatttgtatttctgtggggt

SEQ ID NO: 50263 - DNA, 20 bp, Artificial Sequence
  chemically synthesized
catttctaactgtgcttatt

SEQ ID NO: 50264 - DNA, 20 bp, Artificial Sequence
  chemically synthesized
ttctctcttgtcttctttat

SEQ ID NO: 50265 - DNA, 20 bp, Artificial Sequence
  chemically synthesized
tcttgtcttctttattagtc

SEQ ID NO: 50266 - DNA, 20 bp, Artificial Sequence
  chemically synthesized
gtcttctttattagtctagc

SEQ ID NO: 50267 - DNA, 20 bp, Artificial Sequence
  chemically synthesized
tattaattttttcacaaaac

SEQ ID NO: 50268 - DNA, 20 bp, Artificial Sequence
  chemically synthesized
tttttcacaaaaccagctct

SEQ ID NO: 50269 - DNA, 20 bp, Artificial Sequence
  chemically synthesized
ggactcattaatcttttgaa

SEQ ID NO: 50270 - DNA, 20 bp, Artificial Sequence
  chemically synthesized
ttttgtgttttaatatcctt

SEQ ID NO: 50271 - DNA, 20 bp, Artificial Sequence
  chemically synthesized
gtgttttaatatccttcagt

SEQ ID NO: 50272 - DNA, 20 bp, Artificial Sequence
  chemically synthesized
gtttatttcttgtcttctgc

SEQ ID NO: 50273 - DNA, 20 bp, Artificial Sequence
  chemically synthesized
ttcttgtcttctgctagatt

SEQ ID NO: 50274 - DNA, 20 bp, Artificial Sequence
  chemically synthesized
tcttgtcttctgctagattt

SEQ ID NO: 50275 - DNA, 20 bp, Artificial Sequence
  chemically synthesized
cttgtcttctgctagattta

SEQ ID NO: 50276 - DNA, 20 bp, Artificial Sequence
  chemically synthesized
tcttctgctagatttagggt

SEQ ID NO: 50277 - DNA, 20 bp, Artificial Sequence
  chemically synthesized
atttagggttggtttgctct

SEQ ID NO: 50278 - DNA, 20 bp, Artificial Sequence
  chemically synthesized
ttggtttgctcttggttctc

SEQ ID NO: 50279 - DNA, 20 bp, Artificial Sequence
  chemically synthesized
tcttggttctctggttcttt

SEQ ID NO: 50280 - DNA, 20 bp, Artificial Sequence
  chemically synthesized
ggttcttttagttgtgacat

SEQ ID NO: 50281 - DNA, 20 bp, Artificial Sequence
  chemically synthesized
gttcttttagttgtgacatt

SEQ ID NO: 50282 - DNA, 20 bp, Artificial Sequence
  chemically synthesized
tgacattaggttgttaattt

SEQ ID NO: 50283 - DNA, 20 bp, Artificial Sequence
  chemically synthesized
gacattaggttgttaatttg

SEQ ID NO: 50284 - DNA, 20 bp, Artificial Sequence
  chemically synthesized
acattaggttgttaatttga

SEQ ID NO: 50285 - DNA, 20 bp, Artificial Sequence
  chemically synthesized
gttgttaatttgagggcttt

SEQ ID NO: 50286 - DNA, 20 bp, Artificial Sequence
  chemically synthesized
ggctttaagactttttgatg

SEQ ID NO: 50287 - DNA, 20 bp, Artificial Sequence
  chemically synthesized
gctttaagactttttgatgt

SEQ ID NO: 50288 - DNA, 20 bp, Artificial Sequence
  chemically synthesized
gactttttgatgtgggcatt

SEQ ID NO: 50289 - DNA, 20 bp, Artificial Sequence
  chemically synthesized
tttctctcttaacactgtct

SEQ ID NO: 50290 - DNA, 20 bp, Artificial Sequence
  chemically synthesized
acactgtctaagctgtgtcc

SEQ ID NO: 50291 - DNA, 20 bp, Artificial Sequence
  chemically synthesized
actgtctaagctgtgtccca

SEQ ID NO: 50292 - DNA, 20 bp, Artificial Sequence
  chemically synthesized
aagctgtgtcccagagattc

SEQ ID NO: 50293 - DNA, 20 bp, Artificial Sequence
  chemically synthesized
tattgtatctttgttctcat

SEQ ID NO: 50294 - DNA, 20 bp, Artificial Sequence
  chemically synthesized
ctttgttctcattagtttca

SEQ ID NO: 50295 - DNA, 20 bp, Artificial Sequence
  chemically synthesized
gaactattttatttttgcct

SEQ ID NO: 50296 - DNA, 20 bp, Artificial Sequence
  chemically synthesized
ttatttacccaaaattcatt

SEQ ID NO: 50297 - DNA, 20 bp, Artificial Sequence
  chemically synthesized
tatttacccaaaattcattc

SEQ ID NO: 50298 - DNA, 20 bp, Artificial Sequence
  chemically synthesized
tttacccaaaattcattcag

SEQ ID NO: 50299 - DNA, 20 bp, Artificial Sequence
  chemically synthesized
acccaaaattcattcaggag

SEQ ID NO: 50300 - DNA, 20 bp, Artificial Sequence
  chemically synthesized
cccaaaattcattcaggagc

SEQ ID NO: 50301 - DNA, 20 bp, Artificial Sequence
  chemically synthesized
ttaatttccatgtaattgca

SEQ ID NO: 50302 - DNA, 20 bp, Artificial Sequence
  chemically synthesized
ccatgtaattgcatagtttt

SEQ ID NO: 50303 - DNA, 20 bp, Artificial Sequence
  chemically synthesized
catagttttcagctattcat

SEQ ID NO: 50304 - DNA, 20 bp, Artificial Sequence
  chemically synthesized
aatctatttttattcctctg

SEQ ID NO: 50305 - DNA, 20 bp, Artificial Sequence
  chemically synthesized
tttttattcctctgtggtct

SEQ ID NO: 50306 - DNA, 20 bp, Artificial Sequence
  chemically synthesized
tttattcctctgtggtctga

SEQ ID NO: 50307 - DNA, 20 bp, Artificial Sequence
  chemically synthesized
attttttttttgcatttgct

SEQ ID NO: 50308 - DNA, 20 bp, Artificial Sequence
  chemically synthesized
ttttttttttgcatttgctg

SEQ ID NO: 50309 - DNA, 20 bp, Artificial Sequence
  chemically synthesized
gcatttgctgaggattgttt

SEQ ID NO: 50310 - DNA, 20 bp, Artificial Sequence
  chemically synthesized
catttgctgaggattgtttt

SEQ ID NO: 50311 - DNA, 20 bp, Artificial Sequence
  chemically synthesized
ggattgttttaggtcctccc

SEQ ID NO: 50312 - DNA, 20 bp, Artificial Sequence
  chemically synthesized
gattgttttaggtcctccca

SEQ ID NO: 50313 - DNA, 20 bp, Artificial Sequence
  chemically synthesized
aggtcctcccaaggctgaac

SEQ ID NO: 50314 - DNA, 20 bp, Artificial Sequence
  chemically synthesized
ggtcctcccaaggctgaacc

SEQ ID NO: 50315 - DNA, 20 bp, Artificial Sequence
  chemically synthesized
cctcccaaggctgaaccagg

SEQ ID NO: 50316 - DNA, 20 bp, Artificial Sequence
  chemically synthesized
aggaagaaatcaatttcctg

SEQ ID NO: 50317 - DNA, 20 bp, Artificial Sequence
  chemically synthesized
gaagaaatcaatttcctgaa

SEQ ID NO: 50318 - DNA, 20 bp, Artificial Sequence
  chemically synthesized
ttcctgaagagatccatgat

SEQ ID NO: 50319 - DNA, 20 bp, Artificial Sequence
  chemically synthesized
gatgagctctgaaaatgatt

SEQ ID NO: 50320 - DNA, 20 bp, Artificial Sequence
  chemically synthesized
gaaaatgattcagtaataaa

SEQ ID NO: 50321 - DNA, 20 bp, Artificial Sequence
  chemically synthesized
aatagcctatcaaacaaaaa

SEQ ID NO: 50322 - DNA, 20 bp, Artificial Sequence
  chemically synthesized
ctatcaaacaaaaaaagccc

SEQ ID NO: 50323 - DNA, 20 bp, Artificial Sequence
  chemically synthesized
gattcacaaccaaattctat

SEQ ID NO: 50324 - DNA, 20 bp, Artificial Sequence
  chemically synthesized
caaattctatcagatgcaca

SEQ ID NO: 50325 - DNA, 20 bp, Artificial Sequence
  chemically synthesized
attctatcagatgcacaaag

SEQ ID NO: 50326 - DNA, 20 bp, Artificial Sequence
  chemically synthesized
tctatcagatgcacaaagaa

SEQ ID NO: 50327 - DNA, 20 bp, Artificial Sequence
  chemically synthesized
tcagatgcacaaagaagagt

SEQ ID NO: 50328 - DNA, 20 bp, Artificial Sequence
  chemically synthesized
agttggaaaaattcctactg

SEQ ID NO: 50329 - DNA, 20 bp, Artificial Sequence
  chemically synthesized
tgaagctactccaaaaaatt

SEQ ID NO: 50330 - DNA, 20 bp, Artificial Sequence
  chemically synthesized
gaagctactccaaaaaattg

SEQ ID NO: 50331 - DNA, 20 bp, Artificial Sequence
  chemically synthesized
aagctactccaaaaaattga

SEQ ID NO: 50332 - DNA, 20 bp, Artificial Sequence
  chemically synthesized
agctactccaaaaaattgag

SEQ ID NO: 50333 - DNA, 20 bp, Artificial Sequence
  chemically synthesized
gctactccaaaaaattgagg

SEQ ID NO: 50334 - DNA, 20 bp, Artificial Sequence
  chemically synthesized
tactccaaaaaattgagggg

SEQ ID NO: 50335 - DNA, 20 bp, Artificial Sequence
  chemically synthesized
actccaaaaaattgaggggg

SEQ ID NO: 50336 - DNA, 20 bp, Artificial Sequence
  chemically synthesized
ctccaaaaaattgaggggga

SEQ ID NO: 50337 - DNA, 20 bp, Artificial Sequence
  chemically synthesized
gagggggagggattcaacct

SEQ ID NO: 50338 - DNA, 20 bp, Artificial Sequence
  chemically synthesized
tcaacctcagctcattttat

SEQ ID NO: 50339 - DNA, 20 bp, Artificial Sequence
  chemically synthesized
caacctcagctcattttatg

SEQ ID NO: 50340 - DNA, 20 bp, Artificial Sequence
  chemically synthesized
ctcagctcattttatgaggc

SEQ ID NO: 50341 - DNA, 20 bp, Artificial Sequence
  chemically synthesized
atcctgataccaaaacctga

SEQ ID NO: 50342 - DNA, 20 bp, Artificial Sequence
  chemically synthesized
tagacacacaacaacaaaaa

SEQ ID NO: 50343 - DNA, 20 bp, Artificial Sequence
  chemically synthesized
acaacaaaaaaagaaaactt

SEQ ID NO: 50344 - DNA, 20 bp, Artificial Sequence
  chemically synthesized
caacaaaaaaagaaaacttc

SEQ ID NO: 50345 - DNA, 20 bp, Artificial Sequence
  chemically synthesized
gaacattgatgcaaaaatac

SEQ ID NO: 50346 - DNA, 20 bp, Artificial Sequence
  chemically synthesized
attgatgcaaaaatactagc

SEQ ID NO: 50347 - DNA, 20 bp, Artificial Sequence
  chemically synthesized
aaatactagcaagccaaatc

SEQ ID NO: 50348 - DNA, 20 bp, Artificial Sequence
  chemically synthesized
aaatccagcaacacatcaca

SEQ ID NO: 50349 - DNA, 20 bp, Artificial Sequence
  chemically synthesized
aaagctaatccacctcaatc

SEQ ID NO: 50350 - DNA, 20 bp, Artificial Sequence
  chemically synthesized
gctaatccacctcaatcaag

SEQ ID NO: 50351 - DNA, 20 bp, Artificial Sequence
  chemically synthesized
ctaatccacctcaatcaagt

SEQ ID NO: 50352 - DNA, 20 bp, Artificial Sequence
  chemically synthesized
atcaagtaggctttatccct

SEQ ID NO: 50353 - DNA, 20 bp, Artificial Sequence
  chemically synthesized
aagtaggctttatccctgag

SEQ ID NO: 50354 - DNA, 20 bp, Artificial Sequence
  chemically synthesized
aggctttatccctgagaagc

SEQ ID NO: 50355 - DNA, 20 bp, Artificial Sequence
  chemically synthesized
ttatccctgagaagcaagat

SEQ ID NO: 50356 - DNA, 20 bp, Artificial Sequence
  chemically synthesized
cctgagaagcaagattggtt

SEQ ID NO: 50357 - DNA, 20 bp, Artificial Sequence
  chemically synthesized
aatgtgattcatcatatata

SEQ ID NO: 50358 - DNA, 20 bp, Artificial Sequence
  chemically synthesized
catatatacagcactaaaaa

SEQ ID NO: 50359 - DNA, 20 bp, Artificial Sequence
  chemically synthesized
catttcaatatgtgcaaaaa

SEQ ID NO: 50360 - DNA, 20 bp, Artificial Sequence
  chemically synthesized
gttaaaacctctcaacaaac

SEQ ID NO: 50361 - DNA, 20 bp, Artificial Sequence
  chemically synthesized
tctcaacaaactagctattt

SEQ ID NO: 50362 - DNA, 20 bp, Artificial Sequence
  chemically synthesized
ctcaacaaactagctattta

SEQ ID NO: 50363 - DNA, 20 bp, Artificial Sequence
  chemically synthesized
acatgacctcaaaataatat

SEQ ID NO: 50364 - DNA, 20 bp, Artificial Sequence
  chemically synthesized
agccatctatgacaaaccca

SEQ ID NO: 50365 - DNA, 20 bp, Artificial Sequence
  chemically synthesized
aacccacagccaacatcata

SEQ ID NO: 50366 - DNA, 20 bp, Artificial Sequence
  chemically synthesized
acagccaacatcatacagaa

SEQ ID NO: 50367 - DNA, 20 bp, Artificial Sequence
  chemically synthesized
cagccaacatcatacagaat

SEQ ID NO: 50368 - DNA, 20 bp, Artificial Sequence
  chemically synthesized
catacagaatgggcaaaacc

SEQ ID NO: 50369 - DNA, 20 bp, Artificial Sequence
  chemically synthesized
acagaatgggcaaaacctgg

SEQ ID NO: 50370 - DNA, 20 bp, Artificial Sequence
  chemically synthesized
gaagcattcttcttgaaaac

SEQ ID NO: 50371 - DNA, 20 bp, Artificial Sequence
  chemically synthesized
ttcttcttgaaaactggcac

SEQ ID NO: 50372 - DNA, 20 bp, Artificial Sequence
  chemically synthesized
cttgaaaactggcacaagac

SEQ ID NO: 50373 - DNA, 20 bp, Artificial Sequence
  chemically synthesized
ttgaaaactggcacaagaca

SEQ ID NO: 50374 - DNA, 20 bp, Artificial Sequence
  chemically synthesized
cctctctcaccactgctatt

SEQ ID NO: 50375 - DNA, 20 bp, Artificial Sequence
  chemically synthesized
ctcaccactgctattcagta

SEQ ID NO: 50376 - DNA, 20 bp, Artificial Sequence
  chemically synthesized
actgctattcagtatagtac

SEQ ID NO: 50377 - DNA, 20 bp, Artificial Sequence
  chemically synthesized
gctattcagtatagtactgg

SEQ ID NO: 50378 - DNA, 20 bp, Artificial Sequence
  chemically synthesized
cagtatagtactggcagtcc

SEQ ID NO: 50379 - DNA, 20 bp, Artificial Sequence
  chemically synthesized
atagtactggcagtcctggc

SEQ ID NO: 50380 - DNA, 20 bp, Artificial Sequence
  chemically synthesized
agtactggcagtcctggcca

SEQ ID NO: 50381 - DNA, 20 bp, Artificial Sequence
  chemically synthesized
gcagtcctggccagagcaat

SEQ ID NO: 50382 - DNA, 20 bp, Artificial Sequence
  chemically synthesized
cagtcctggccagagcaatc

SEQ ID NO: 50383 - DNA, 20 bp, Artificial Sequence
  chemically synthesized
cctggccagagcaatcaggc

SEQ ID NO: 50384 - DNA, 20 bp, Artificial Sequence
  chemically synthesized
tggccagagcaatcaggcaa

SEQ ID NO: 50385 - DNA, 20 bp, Artificial Sequence
  chemically synthesized
ccagagcaatcaggcaagag

SEQ ID NO: 50386 - DNA, 20 bp, Artificial Sequence
  chemically synthesized
cagagcaatcaggcaagaga

SEQ ID NO: 50387 - DNA, 20 bp, Artificial Sequence
  chemically synthesized
agagcaatcaggcaagagaa

SEQ ID NO: 50388 - DNA, 20 bp, Artificial Sequence
  chemically synthesized
tcaggcaagagaagggaata

SEQ ID NO: 50389 - DNA, 20 bp, Artificial Sequence
  chemically synthesized
caggcaagagaagggaataa

SEQ ID NO: 50390 - DNA, 20 bp, Artificial Sequence
  chemically synthesized
aggcaagagaagggaataaa

SEQ ID NO: 50391 - DNA, 20 bp, Artificial Sequence
  chemically synthesized
gggaataaagggcatccaaa

SEQ ID NO: 50392 - DNA, 20 bp, Artificial Sequence
  chemically synthesized
ggaataaagggcatccaaat

SEQ ID NO: 50393 - DNA, 20 bp, Artificial Sequence
  chemically synthesized
ataaagggcatccaaatagg

SEQ ID NO: 50394 - DNA, 20 bp, Artificial Sequence
  chemically synthesized
aaagggcatccaaataggaa

SEQ ID NO: 50395 - DNA, 20 bp, Artificial Sequence
  chemically synthesized
agggcatccaaataggaaga

SEQ ID NO: 50396 - DNA, 20 bp, Artificial Sequence
  chemically synthesized
catccaaataggaagagaga

SEQ ID NO: 50397 - DNA, 20 bp, Artificial Sequence
  chemically synthesized
aataggaagagagaaagtca

SEQ ID NO: 50398 - DNA, 20 bp, Artificial Sequence
  chemically synthesized
gtatccctgttttctgtatc

SEQ ID NO: 50399 - DNA, 20 bp, Artificial Sequence
  chemically synthesized
tctgtatctagaaaacacca

SEQ ID NO: 50400 - DNA, 20 bp, Artificial Sequence
  chemically synthesized
atctagaaaacaccatagtc

SEQ ID NO: 50401 - DNA, 20 bp, Artificial Sequence
  chemically synthesized
tctagaaaacaccatagtca

SEQ ID NO: 50402 - DNA, 20 bp, Artificial Sequence
  chemically synthesized
acaccatagtcaaggcccaa

SEQ ID NO: 50403 - DNA, 20 bp, Artificial Sequence
  chemically synthesized
tcaaggcccaaaagctcctt

SEQ ID NO: 50404 - DNA, 20 bp, Artificial Sequence
  chemically synthesized
gctccttcagctgataactt

SEQ ID NO: 50405 - DNA, 20 bp, Artificial Sequence
  chemically synthesized
ttcagctgataacttcagca

SEQ ID NO: 50406 - DNA, 20 bp, Artificial Sequence
  chemically synthesized
tgataacttcagcaaagttt

SEQ ID NO: 50407 - DNA, 20 bp, Artificial Sequence
  chemically synthesized
gataacttcagcaaagtttc

SEQ ID NO: 50408 - DNA, 20 bp, Artificial Sequence
  chemically synthesized
aatcaatgtacaaaaatcac

SEQ ID NO: 50409 - DNA, 20 bp, Artificial Sequence
  chemically synthesized
gcattcccatacatcaacaa

SEQ ID NO: 50410 - DNA, 20 bp, Artificial Sequence
  chemically synthesized
cccatacatcaacaatagcc

SEQ ID NO: 50411 - DNA, 20 bp, Artificial Sequence
  chemically synthesized
acatcaacaatagccaagcc

SEQ ID NO: 50412 - DNA, 20 bp, Artificial Sequence
  chemically synthesized
atcaacaatagccaagccta

SEQ ID NO: 50413 - DNA, 20 bp, Artificial Sequence
  chemically synthesized
agccaagcctagagccaaat

SEQ ID NO: 50414 - DNA, 20 bp, Artificial Sequence
  chemically synthesized
gccaagcctagagccaaatc

SEQ ID NO: 50415 - DNA, 20 bp, Artificial Sequence
  chemically synthesized
aagcctagagccaaatcagg

SEQ ID NO: 50416 - DNA, 20 bp, Artificial Sequence
  chemically synthesized
ccatttaccgttgccacaaa

SEQ ID NO: 50417 - DNA, 20 bp, Artificial Sequence
  chemically synthesized
acaaaaagaataaaatacct

SEQ ID NO: 50418 - DNA, 20 bp, Artificial Sequence
  chemically synthesized
caaaaagaataaaataccta

SEQ ID NO: 50419 - DNA, 20 bp, Artificial Sequence
  chemically synthesized
acctaaggatatatctaacc

SEQ ID NO: 50420 - DNA, 20 bp, Artificial Sequence
  chemically synthesized
taaggatatatctaaccaag

SEQ ID NO: 50421 - DNA, 20 bp, Artificial Sequence
  chemically synthesized
atatctaaccaagcagttga

SEQ ID NO: 50422 - DNA, 20 bp, Artificial Sequence
  chemically synthesized
agttgaaagatctctacaat

SEQ ID NO: 50423 - DNA, 20 bp, Artificial Sequence
  chemically synthesized
gatttacaaaacactgctca

SEQ ID NO: 50424 - DNA, 20 bp, Artificial Sequence
  chemically synthesized
aaaacactgctcaaagaaat

SEQ ID NO: 50425 - DNA, 20 bp, Artificial Sequence
  chemically synthesized
aacactgctcaaagaaatca

SEQ ID NO: 50426 - DNA, 20 bp, Artificial Sequence
  chemically synthesized
ctcaaagaaatcagagctga

SEQ ID NO: 50427 - DNA, 20 bp, Artificial Sequence
  chemically synthesized
tcagagctgatagaaacaaa

SEQ ID NO: 50428 - DNA, 20 bp, Artificial Sequence
  chemically synthesized
ggaaaaactttccatgctca

SEQ ID NO: 50429 - DNA, 20 bp, Artificial Sequence
  chemically synthesized
tttccatgctcatggataaa

SEQ ID NO: 50430 - DNA, 20 bp, Artificial Sequence
  chemically synthesized
gttaaaatgtccatactgcc

SEQ ID NO: 50431 - DNA, 20 bp, Artificial Sequence
  chemically synthesized
taaaatgtccatactgccta

SEQ ID NO: 50432 - DNA, 20 bp, Artificial Sequence
  chemically synthesized
atactgcctagagcaattta

SEQ ID NO: 50433 - DNA, 20 bp, Artificial Sequence
  chemically synthesized
tagagcaatttacagtttca

SEQ ID NO: 50434 - DNA, 20 bp, Artificial Sequence
  chemically synthesized
actaccaatgacattcttca

SEQ ID NO: 50435 - DNA, 20 bp, Artificial Sequence
  chemically synthesized
aatgacattcttcacagaac

SEQ ID NO: 50436 - DNA, 20 bp, Artificial Sequence
  chemically synthesized
aactagaaaaatacacttta

SEQ ID NO: 50437 - DNA, 20 bp, Artificial Sequence
  chemically synthesized
aatacactttaaagttcata

SEQ ID NO: 50438 - DNA, 20 bp, Artificial Sequence
  chemically synthesized
atatggaacaacaacaaaaa

SEQ ID NO: 50439 - DNA, 20 bp, Artificial Sequence
  chemically synthesized
aacaacaaaaaaagtccaaa

SEQ ID NO: 50440 - DNA, 20 bp, Artificial Sequence
  chemically synthesized
caaaaaaagtccaaatagcc

SEQ ID NO: 50441 - DNA, 20 bp, Artificial Sequence
  chemically synthesized
aaaaaaagtccaaatagcct

SEQ ID NO: 50442 - DNA, 20 bp, Artificial Sequence
  chemically synthesized
ctaggaaatcctaatactca

SEQ ID NO: 50443 - DNA, 20 bp, Artificial Sequence
  chemically synthesized
taggaaatcctaatactcac

SEQ ID NO: 50444 - DNA, 20 bp, Artificial Sequence
  chemically synthesized
gaaatcctaatactcacagg

SEQ ID NO: 50445 - DNA, 20 bp, Artificial Sequence
  chemically synthesized
aaatcctaatactcacaggt

SEQ ID NO: 50446 - DNA, 20 bp, Artificial Sequence
  chemically synthesized
acaggtgggaattgaaaaat

SEQ ID NO: 50447 - DNA, 20 bp, Artificial Sequence
  chemically synthesized
aattgaaaaatgagaacact

SEQ ID NO: 50448 - DNA, 20 bp, Artificial Sequence
  chemically synthesized
aaaatgagaacacttggaca

SEQ ID NO: 50449 - DNA, 20 bp, Artificial Sequence
  chemically synthesized
aaatgagaacacttggacac

SEQ ID NO: 50450 - DNA, 20 bp, Artificial Sequence
  chemically synthesized
aatgagaacacttggacaca

SEQ ID NO: 50451 - DNA, 20 bp, Artificial Sequence
  chemically synthesized
gagaacacttggacacaggg

SEQ ID NO: 50452 - DNA, 20 bp, Artificial Sequence
  chemically synthesized
agaacacttggacacagggt

SEQ ID NO: 50453 - DNA, 20 bp, Artificial Sequence
  chemically synthesized
gaacacttggacacagggtg

SEQ ID NO: 50454 - DNA, 20 bp, Artificial Sequence
  chemically synthesized
gggtggggaacatcacacac

SEQ ID NO: 50455 - DNA, 20 bp, Artificial Sequence
  chemically synthesized
ggtggggaacatcacacacc

SEQ ID NO: 50456 - DNA, 20 bp, Artificial Sequence
  chemically synthesized
gtggggaacatcacacaccg

SEQ ID NO: 50457 - DNA, 20 bp, Artificial Sequence
  chemically synthesized
tcacacaccggggcctgtcg

SEQ ID NO: 50458 - DNA, 20 bp, Artificial Sequence
  chemically synthesized
cacacaccggggcctgtcgt

SEQ ID NO: 50459 - DNA, 20 bp, Artificial Sequence
  chemically synthesized
acacaccggggcctgtcgtg

SEQ ID NO: 50460 - DNA, 20 bp, Artificial Sequence
  chemically synthesized
caccggggcctgtcgtgggg

SEQ ID NO: 50461 - DNA, 20 bp, Artificial Sequence
  chemically synthesized
cggggcctgtcgtggggtgg

SEQ ID NO: 50462 - DNA, 20 bp, Artificial Sequence
  chemically synthesized
ggggcctgtcgtggggtggt

SEQ ID NO: 50463 - DNA, 20 bp, Artificial Sequence
  chemically synthesized
ggcctgtcgtggggtggtag

SEQ ID NO: 50464 - DNA, 20 bp, Artificial Sequence
  chemically synthesized
cctgtcgtggggtggtagga

SEQ ID NO: 50465 - DNA, 20 bp, Artificial Sequence
  chemically synthesized
tgtcgtggggtggtaggaga

SEQ ID NO: 50466 - DNA, 20 bp, Artificial Sequence
  chemically synthesized
gtcgtggggtggtaggagag

SEQ ID NO: 50467 - DNA, 20 bp, Artificial Sequence
  chemically synthesized
cgtggggtggtaggagagag

SEQ ID NO: 50468 - DNA, 20 bp, Artificial Sequence
  chemically synthesized
gtggggtggtaggagagagg

SEQ ID NO: 50469 - DNA, 20 bp, Artificial Sequence
  chemically synthesized
tggggtggtaggagagagga

SEQ ID NO: 50470 - DNA, 20 bp, Artificial Sequence
  chemically synthesized
ggagagaggagggataacat

SEQ ID NO: 50471 - DNA, 20 bp, Artificial Sequence
  chemically synthesized
gagagaggagggataacatt

SEQ ID NO: 50472 - DNA, 20 bp, Artificial Sequence
  chemically synthesized
gagaggagggataacattag

SEQ ID NO: 50473 - DNA, 20 bp, Artificial Sequence
  chemically synthesized
atatatctaatgtaaatgac

SEQ ID NO: 50474 - DNA, 20 bp, Artificial Sequence
  chemically synthesized
taatgtaaatgacgagttaa

SEQ ID NO: 50475 - DNA, 20 bp, Artificial Sequence
  chemically synthesized
aatgtaaatgacgagttaac

SEQ ID NO: 50476 - DNA, 20 bp, Artificial Sequence
  chemically synthesized
aaatgacgagttaacgggtg

SEQ ID NO: 50477 - DNA, 20 bp, Artificial Sequence
  chemically synthesized
acgggtgcagcacaccaata

SEQ ID NO: 50478 - DNA, 20 bp, Artificial Sequence
  chemically synthesized
tacatatgtaacaaactgca

SEQ ID NO: 50479 - DNA, 20 bp, Artificial Sequence
  chemically synthesized
acatatgtaacaaactgcac

SEQ ID NO: 50480 - DNA, 20 bp, Artificial Sequence
  chemically synthesized
aacaaactgcacaggtaccg

SEQ ID NO: 50481 - DNA, 20 bp, Artificial Sequence
  chemically synthesized
tgcacaggtaccgtagaact

SEQ ID NO: 50482 - DNA, 20 bp, Artificial Sequence
  chemically synthesized
cacaggtaccgtagaactta

SEQ ID NO: 50483 - DNA, 20 bp, Artificial Sequence
  chemically synthesized
ttagagtacaaaaaaaaaaa

SEQ ID NO: 50484 - DNA, 20 bp, Artificial Sequence
  chemically synthesized
agagtacaaaaaaaaaaaaa

SEQ ID NO: 50485 - DNA, 20 bp, Artificial Sequence
  chemically synthesized
caaaaaaaaaaaaagagaaa

SEQ ID NO: 50486 - DNA, 20 bp, Artificial Sequence
  chemically synthesized
aaaaaaagagaaaaagaaaa

SEQ ID NO: 50487 - DNA, 20 bp, Artificial Sequence
  chemically synthesized
aaagagaaaaagaaaaaagc

SEQ ID NO: 50488 - DNA, 20 bp, Artificial Sequence
  chemically synthesized
agagaaaaagaaaaaagctg

SEQ ID NO: 50489 - DNA, 20 bp, Artificial Sequence
  chemically synthesized
cctaacttcaaaccatacca

SEQ ID NO: 50490 - DNA, 20 bp, Artificial Sequence
  chemically synthesized
ctaacttcaaaccataccac

SEQ ID NO: 50491 - DNA, 20 bp, Artificial Sequence
  chemically synthesized
taacttcaaaccataccaca

SEQ ID NO: 50492 - DNA, 20 bp, Artificial Sequence
  chemically synthesized
caaaccataccacagggcta

SEQ ID NO: 50493 - DNA, 20 bp, Artificial Sequence
  chemically synthesized
cagggctacagtaaccaaaa

SEQ ID NO: 50494 - DNA, 20 bp, Artificial Sequence
  chemically synthesized
ctacagtaaccaaaacagtg

SEQ ID NO: 50495 - DNA, 20 bp, Artificial Sequence
  chemically synthesized
aaaacagtgtggtactgtta

SEQ ID NO: 50496 - DNA, 20 bp, Artificial Sequence
  chemically synthesized
agtgtggtactgttacagaa

SEQ ID NO: 50497 - DNA, 20 bp, Artificial Sequence
  chemically synthesized
actgttacagaaaagacaca

SEQ ID NO: 50498 - DNA, 20 bp, Artificial Sequence
  chemically synthesized
agaaaagacacacagacaaa

SEQ ID NO: 50499 - DNA, 20 bp, Artificial Sequence
  chemically synthesized
agacacacagacaaatggaa

SEQ ID NO: 50500 - DNA, 20 bp, Artificial Sequence
  chemically synthesized
cacagacaaatggaacagaa

SEQ ID NO: 50501 - DNA, 20 bp, Artificial Sequence
  chemically synthesized
cagacaaatggaacagaata

SEQ ID NO: 50502 - DNA, 20 bp, Artificial Sequence
  chemically synthesized
gacaaatggaacagaataga

SEQ ID NO: 50503 - DNA, 20 bp, Artificial Sequence
  chemically synthesized
atggaacagaatagagagcc

SEQ ID NO: 50504 - DNA, 20 bp, Artificial Sequence
  chemically synthesized
agaatagagagcccagaaat

SEQ ID NO: 50505 - DNA, 20 bp, Artificial Sequence
  chemically synthesized
caaccatctgatctttgaca

SEQ ID NO: 50506 - DNA, 20 bp, Artificial Sequence
  chemically synthesized
ttgacaaagctgataaaaac

SEQ ID NO: 50507 - DNA, 20 bp, Artificial Sequence
  chemically synthesized
agctgataaaaacaagcaat

SEQ ID NO: 50508 - DNA, 20 bp, Artificial Sequence
  chemically synthesized
gctgataaaaacaagcaatg

SEQ ID NO: 50509 - DNA, 20 bp, Artificial Sequence
  chemically synthesized
taaaaacaagcaatgaggaa

SEQ ID NO: 50510 - DNA, 20 bp, Artificial Sequence
  chemically synthesized
gaaaagacaccctattcaac

SEQ ID NO: 50511 - DNA, 20 bp, Artificial Sequence
  chemically synthesized
aagacaccctattcaacaag

SEQ ID NO: 50512 - DNA, 20 bp, Artificial Sequence
  chemically synthesized
ccctattcaacaagtggtgt

SEQ ID NO: 50513 - DNA, 20 bp, Artificial Sequence
  chemically synthesized
cctattcaacaagtggtgtt

SEQ ID NO: 50514 - DNA, 20 bp, Artificial Sequence
  chemically synthesized
gataactgactaaccgtatg

SEQ ID NO: 50515 - DNA, 20 bp, Artificial Sequence
  chemically synthesized
aactgactaaccgtatgtag

SEQ ID NO: 50516 - DNA, 20 bp, Artificial Sequence
  chemically synthesized
cgtatgtagaagattgaaac

SEQ ID NO: 50517 - DNA, 20 bp, Artificial Sequence
  chemically synthesized
tcatatacacaaataaactc

SEQ ID NO: 50518 - DNA, 20 bp, Artificial Sequence
  chemically synthesized
atacacaaataaactcaaga

SEQ ID NO: 50519 - DNA, 20 bp, Artificial Sequence
  chemically synthesized
caaataaactcaagatggat

SEQ ID NO: 50520 - DNA, 20 bp, Artificial Sequence
  chemically synthesized
aataaactcaagatggatta

SEQ ID NO: 50521 - DNA, 20 bp, Artificial Sequence
  chemically synthesized
caaactataaaaatgcttga

SEQ ID NO: 50522 - DNA, 20 bp, Artificial Sequence
  chemically synthesized
aaaaatgcttgaaagcaacc

SEQ ID NO: 50523 - DNA, 20 bp, Artificial Sequence
  chemically synthesized
aaaatgcttgaaagcaacct

SEQ ID NO: 50524 - DNA, 20 bp, Artificial Sequence
  chemically synthesized
caacctaggcaataccattc

SEQ ID NO: 50525 - DNA, 20 bp, Artificial Sequence
  chemically synthesized
ggcaataccattccggacat

SEQ ID NO: 50526 - DNA, 20 bp, Artificial Sequence
  chemically synthesized
aataccattccggacataag

SEQ ID NO: 50527 - DNA, 20 bp, Artificial Sequence
  chemically synthesized
ataccattccggacataagc

SEQ ID NO: 50528 - DNA, 20 bp, Artificial Sequence
  chemically synthesized
taccattccggacataagca

SEQ ID NO: 50529 - DNA, 20 bp, Artificial Sequence
  chemically synthesized
accattccggacataagcag

SEQ ID NO: 50530 - DNA, 20 bp, Artificial Sequence
  chemically synthesized
tccggacataagcaggggca

SEQ ID NO: 50531 - DNA, 20 bp, Artificial Sequence
  chemically synthesized
ggggcaaagatttcatgaca

SEQ ID NO: 50532 - DNA, 20 bp, Artificial Sequence
  chemically synthesized
tttcatgacaaagatgccaa

SEQ ID NO: 50533 - DNA, 20 bp, Artificial Sequence
  chemically synthesized
aaagatgccaacagtcattg

SEQ ID NO: 50534 - DNA, 20 bp, Artificial Sequence
  chemically synthesized
gccaacagtcattgcagcaa

SEQ ID NO: 50535 - DNA, 20 bp, Artificial Sequence
  chemically synthesized
caaaagcaaaaattgacaaa

SEQ ID NO: 50536 - DNA, 20 bp, Artificial Sequence
  chemically synthesized
aaaagcaaaaattgacaaat

SEQ ID NO: 50537 - DNA, 20 bp, Artificial Sequence
  chemically synthesized
aataggatctaattaaaata

SEQ ID NO: 50538 - DNA, 20 bp, Artificial Sequence
  chemically synthesized
attaaaataaagtttctgca

SEQ ID NO: 50539 - DNA, 20 bp, Artificial Sequence
  chemically synthesized
ataaagtttctgcacagcaa

SEQ ID NO: 50540 - DNA, 20 bp, Artificial Sequence
  chemically synthesized
agcaaaagaaactatcaact

SEQ ID NO: 50541 - DNA, 20 bp, Artificial Sequence
  chemically synthesized
tcaactgagtaaacaaccta

SEQ ID NO: 50542 - DNA, 20 bp, Artificial Sequence
  chemically synthesized
tgagtaaacaacctatagaa

SEQ ID NO: 50543 - DNA, 20 bp, Artificial Sequence
  chemically synthesized
gagtaaacaacctatagaat

SEQ ID NO: 50544 - DNA, 20 bp, Artificial Sequence
  chemically synthesized
gtaaacaacctatagaatgg

SEQ ID NO: 50545 - DNA, 20 bp, Artificial Sequence
  chemically synthesized
tgcaaactatgcatccaaca

SEQ ID NO: 50546 - DNA, 20 bp, Artificial Sequence
  chemically synthesized
gcaaactatgcatccaacaa

SEQ ID NO: 50547 - DNA, 20 bp, Artificial Sequence
  chemically synthesized
tccaacaaaggcctaatatt

SEQ ID NO: 50548 - DNA, 20 bp, Artificial Sequence
  chemically synthesized
gcctaatattcagaatctat

SEQ ID NO: 50549 - DNA, 20 bp, Artificial Sequence
  chemically synthesized
cctaatattcagaatctata

SEQ ID NO: 50550 - DNA, 20 bp, Artificial Sequence
  chemically synthesized
aggaacttaaatgaatctac

SEQ ID NO: 50551 - DNA, 20 bp, Artificial Sequence
  chemically synthesized
acaaacaatgccacaaaaaa

SEQ ID NO: 50552 - DNA, 20 bp, Artificial Sequence
  chemically synthesized
caaacaatgccacaaaaaat

SEQ ID NO: 50553 - DNA, 20 bp, Artificial Sequence
  chemically synthesized
aatgccacaaaaaatgggta

SEQ ID NO: 50554 - DNA, 20 bp, Artificial Sequence
  chemically synthesized
atgccacaaaaaatgggtaa

SEQ ID NO: 50555 - DNA, 20 bp, Artificial Sequence
  chemically synthesized
aaatgggtaaaggacatgaa

SEQ ID NO: 50556 - DNA, 20 bp, Artificial Sequence
  chemically synthesized
gggtaaaggacatgaacaga

SEQ ID NO: 50557 - DNA, 20 bp, Artificial Sequence
  chemically synthesized
catgaacagacagtattcaa

SEQ ID NO: 50558 - DNA, 20 bp, Artificial Sequence
  chemically synthesized
gaacagacagtattcaaaag

SEQ ID NO: 50559 - DNA, 20 bp, Artificial Sequence
  chemically synthesized
ttcaaaagaagacatacatg

SEQ ID NO: 50560 - DNA, 20 bp, Artificial Sequence
  chemically synthesized
aagacatacatgtggccacc

SEQ ID NO: 50561 - DNA, 20 bp, Artificial Sequence
  chemically synthesized
ggccaccaagcatatgaaaa

SEQ ID NO: 50562 - DNA, 20 bp, Artificial Sequence
  chemically synthesized
ccaagcatatgaaaaaagct

SEQ ID NO: 50563 - DNA, 20 bp, Artificial Sequence
  chemically synthesized
agctcagtgtcactgatcat

SEQ ID NO: 50564 - DNA, 20 bp, Artificial Sequence
  chemically synthesized
ctcagtgtcactgatcatta

SEQ ID NO: 50565 - DNA, 20 bp, Artificial Sequence
  chemically synthesized
atgccaatcaaacccaaaat

SEQ ID NO: 50566 - DNA, 20 bp, Artificial Sequence
  chemically synthesized
ttaaaatatctataattaaa

SEQ ID NO: 50567 - DNA, 20 bp, Artificial Sequence
  chemically synthesized
attaaatagtcaaaaaataa

SEQ ID NO: 50568 - DNA, 20 bp, Artificial Sequence
  chemically synthesized
tagtcaaaaaataacagatg

SEQ ID NO: 50569 - DNA, 20 bp, Artificial Sequence
  chemically synthesized
agtcaaaaaataacagatgt

SEQ ID NO: 50570 - DNA, 20 bp, Artificial Sequence
  chemically synthesized
aaaaaataacagatgtgggt

SEQ ID NO: 50571 - DNA, 20 bp, Artificial Sequence
  chemically synthesized
aaaaataacagatgtgggta

SEQ ID NO: 50572 - DNA, 20 bp, Artificial Sequence
  chemically synthesized
aacagatgtgggtaaggttg

SEQ ID NO: 50573 - DNA, 20 bp, Artificial Sequence
  chemically synthesized
cagatgtgggtaaggttgtg

SEQ ID NO: 50574 - DNA, 20 bp, Artificial Sequence
  chemically synthesized
gtgggtaaggttgtggagaa

SEQ ID NO: 50575 - DNA, 20 bp, Artificial Sequence
  chemically synthesized
tgggtaaggttgtggagaaa

SEQ ID NO: 50576 - DNA, 20 bp, Artificial Sequence
  chemically synthesized
gggtaaggttgtggagaaaa

SEQ ID NO: 50577 - DNA, 20 bp, Artificial Sequence
  chemically synthesized
agggaatgtttatacaccat

SEQ ID NO: 50578 - DNA, 20 bp, Artificial Sequence
  chemically synthesized
gaatgtttatacaccattgg

SEQ ID NO: 50579 - DNA, 20 bp, Artificial Sequence
  chemically synthesized
ccattggtggcaatataaat

SEQ ID NO: 50580 - DNA, 20 bp, Artificial Sequence
  chemically synthesized
ataaattagttcgaccattg

SEQ ID NO: 50581 - DNA, 20 bp, Artificial Sequence
  chemically synthesized
attagttcgaccattgtaga

SEQ ID NO: 50582 - DNA, 20 bp, Artificial Sequence
  chemically synthesized
agttcgaccattgtagacag

SEQ ID NO: 50583 - DNA, 20 bp, Artificial Sequence
  chemically synthesized
gaccattgtagacagcagtg

SEQ ID NO: 50584 - DNA, 20 bp, Artificial Sequence
  chemically synthesized
agcagtgtggcaattcccta

SEQ ID NO: 50585 - DNA, 20 bp, Artificial Sequence
  chemically synthesized
attccctaaagacctaaaaa

SEQ ID NO: 50586 - DNA, 20 bp, Artificial Sequence
  chemically synthesized
aacccaacaatcctattatt

SEQ ID NO: 50587 - DNA, 20 bp, Artificial Sequence
  chemically synthesized
tattattgagtatataccta

SEQ ID NO: 50588 - DNA, 20 bp, Artificial Sequence
  chemically synthesized
attattgagtatatacctaa

SEQ ID NO: 50589 - DNA, 20 bp, Artificial Sequence
  chemically synthesized
aaataaaccattctatcaca

SEQ ID NO: 50590 - DNA, 20 bp, Artificial Sequence
  chemically synthesized
atgcacacctgtgtccattg

SEQ ID NO: 50591 - DNA, 20 bp, Artificial Sequence
  chemically synthesized
ccattgcagcataatcacaa

SEQ ID NO: 50592 - DNA, 20 bp, Artificial Sequence
  chemically synthesized
gcagcataatcacaatagca

SEQ ID NO: 50593 - DNA, 20 bp, Artificial Sequence
  chemically synthesized
taatcacaatagcaaagaca

SEQ ID NO: 50594 - DNA, 20 bp, Artificial Sequence
  chemically synthesized
aaagacatagaatcaacctg

SEQ ID NO: 50595 - DNA, 20 bp, Artificial Sequence
  chemically synthesized
aagacatagaatcaacctga

SEQ ID NO: 50596 - DNA, 20 bp, Artificial Sequence
  chemically synthesized
gaatcaacctgaaggcccat

SEQ ID NO: 50597 - DNA, 20 bp, Artificial Sequence
  chemically synthesized
tcaacctgaaggcccattag

SEQ ID NO: 50598 - DNA, 20 bp, Artificial Sequence
  chemically synthesized
ccattagtggtataccgata

SEQ ID NO: 50599 - DNA, 20 bp, Artificial Sequence
  chemically synthesized
gaacatgtacatatacacca

SEQ ID NO: 50600 - DNA, 20 bp, Artificial Sequence
  chemically synthesized
atacaccatggaatactatg

SEQ ID NO: 50601 - DNA, 20 bp, Artificial Sequence
  chemically synthesized
aatactatgtggccataaaa

SEQ ID NO: 50602 - DNA, 20 bp, Artificial Sequence
  chemically synthesized
atgtggccataaaaaagaat

SEQ ID NO: 50603 - DNA, 20 bp, Artificial Sequence
  chemically synthesized
gaatgagatcatgtcctttg

SEQ ID NO: 50604 - DNA, 20 bp, Artificial Sequence
  chemically synthesized
aatgagatcatgtcctttgc

SEQ ID NO: 50605 - DNA, 20 bp, Artificial Sequence
  chemically synthesized
tcatgtcctttgcaggaaca

SEQ ID NO: 50606 - DNA, 20 bp, Artificial Sequence
  chemically synthesized
gtcctttgcaggaacatgga

SEQ ID NO: 50607 - DNA, 20 bp, Artificial Sequence
  chemically synthesized
cctttgcaggaacatggatg

SEQ ID NO: 50608 - DNA, 20 bp, Artificial Sequence
  chemically synthesized
tgcaggaacatggatggagc

SEQ ID NO: 50609 - DNA, 20 bp, Artificial Sequence
  chemically synthesized
tatccttaacaaactaatgt

SEQ ID NO: 50610 - DNA, 20 bp, Artificial Sequence
  chemically synthesized
ttaacaaactaatgtaagaa

SEQ ID NO: 50611 - DNA, 20 bp, Artificial Sequence
  chemically synthesized
tactacatattatcacttac

SEQ ID NO: 50612 - DNA, 20 bp, Artificial Sequence
  chemically synthesized
tacatattatcacttacaag

SEQ ID NO: 50613 - DNA, 20 bp, Artificial Sequence
  chemically synthesized
acatattatcacttacaagt

SEQ ID NO: 50614 - DNA, 20 bp, Artificial Sequence
  chemically synthesized
acaagtaggaactaaatgat

SEQ ID NO: 50615 - DNA, 20 bp, Artificial Sequence
  chemically synthesized
gagaaaacatgcacacataa

SEQ ID NO: 50616 - DNA, 20 bp, Artificial Sequence
  chemically synthesized
agaaaacatgcacacataac

SEQ ID NO: 50617 - DNA, 20 bp, Artificial Sequence
  chemically synthesized
tgcacacataacgggaacaa

SEQ ID NO: 50618 - DNA, 20 bp, Artificial Sequence
  chemically synthesized
aacgggaacaaaagacactg

SEQ ID NO: 50619 - DNA, 20 bp, Artificial Sequence
  chemically synthesized
aaagacactgcagcctaatt

SEQ ID NO: 50620 - DNA, 20 bp, Artificial Sequence
  chemically synthesized
cactgcagcctaattgagtt

SEQ ID NO: 50621 - DNA, 20 bp, Artificial Sequence
  chemically synthesized
ctgcagcctaattgagtttg

SEQ ID NO: 50622 - DNA, 20 bp, Artificial Sequence
  chemically synthesized
tgcagcctaattgagtttgg

SEQ ID NO: 50623 - DNA, 20 bp, Artificial Sequence
  chemically synthesized
gcagcctaattgagtttgga

SEQ ID NO: 50624 - DNA, 20 bp, Artificial Sequence
  chemically synthesized
gcctaattgagtttggaggg

SEQ ID NO: 50625 - DNA, 20 bp, Artificial Sequence
  chemically synthesized
cctaattgagtttggagggt

SEQ ID NO: 50626 - DNA, 20 bp, Artificial Sequence
  chemically synthesized
ttgagtttggagggtgggaa

SEQ ID NO: 50627 - DNA, 20 bp, Artificial Sequence
  chemically synthesized
tgagtttggagggtgggaac

SEQ ID NO: 50628 - DNA, 20 bp, Artificial Sequence
  chemically synthesized
gagtttggagggtgggaacg

SEQ ID NO: 50629 - DNA, 20 bp, Artificial Sequence
  chemically synthesized
gtttggagggtgggaacggg

SEQ ID NO: 50630 - DNA, 20 bp, Artificial Sequence
  chemically synthesized
tggagggtgggaacggggag

SEQ ID NO: 50631 - DNA, 20 bp, Artificial Sequence
  chemically synthesized
gagggtgggaacggggagaa

SEQ ID NO: 50632 - DNA, 20 bp, Artificial Sequence
  chemically synthesized
ggtgggaacggggagaagag

SEQ ID NO: 50633 - DNA, 20 bp, Artificial Sequence
  chemically synthesized
aacggggagaagagcagaaa

SEQ ID NO: 50634 - DNA, 20 bp, Artificial Sequence
  chemically synthesized
gagcagaaaaagtaactatt

SEQ ID NO: 50635 - DNA, 20 bp, Artificial Sequence
  chemically synthesized
aaaaagtaactattgagtac

SEQ ID NO: 50636 - DNA, 20 bp, Artificial Sequence
  chemically synthesized
aaaagtaactattgagtact

SEQ ID NO: 50637 - DNA, 20 bp, Artificial Sequence
  chemically synthesized
aagtaactattgagtactgg

SEQ ID NO: 50638 - DNA, 20 bp, Artificial Sequence
  chemically synthesized
acaaacccatgacatgtgtt

SEQ ID NO: 50639 - DNA, 20 bp, Artificial Sequence
  chemically synthesized
gctatgtaacaaaccatcgt

SEQ ID NO: 50640 - DNA, 20 bp, Artificial Sequence
  chemically synthesized
aacaaaccatcgtgagtctt

SEQ ID NO: 50641 - DNA, 20 bp, Artificial Sequence
  chemically synthesized
aaaccatcgtgagtctttag

SEQ ID NO: 50642 - DNA, 20 bp, Artificial Sequence
  chemically synthesized
ttgctcctctttccacctat

SEQ ID NO: 50643 - DNA, 20 bp, Artificial Sequence
  chemically synthesized
attagtcacatatcttttta

SEQ ID NO: 50644 - DNA, 20 bp, Artificial Sequence
  chemically synthesized
tatctttttatagttataat

SEQ ID NO: 50645 - DNA, 20 bp, Artificial Sequence
  chemically synthesized
gttataatcagcttgttttt

SEQ ID NO: 50646 - DNA, 20 bp, Artificial Sequence
  chemically synthesized
ttgttttatgcgcattatga

SEQ ID NO: 50647 - DNA, 20 bp, Artificial Sequence
  chemically synthesized
gtaatttgattttatgcaac

SEQ ID NO: 50648 - DNA, 20 bp, Artificial Sequence
  chemically synthesized
gcatttattgtgttcctata

SEQ ID NO: 50649 - DNA, 20 bp, Artificial Sequence
  chemically synthesized
tataaaaactgtatatatgt

SEQ ID NO: 50650 - DNA, 20 bp, Artificial Sequence
  chemically synthesized
taaaaactgtatatatgttg

SEQ ID NO: 50651 - DNA, 20 bp, Artificial Sequence
  chemically synthesized
aaaaactgtatatatgttgg

SEQ ID NO: 50652 - DNA, 20 bp, Artificial Sequence
  chemically synthesized
ttttgccctcaaaataatgt

SEQ ID NO: 50653 - DNA, 20 bp, Artificial Sequence
  chemically synthesized
tcaaaataatgtgagcaatt

SEQ ID NO: 50654 - DNA, 20 bp, Artificial Sequence
  chemically synthesized
atgtgagcaatttagtccta

SEQ ID NO: 50655 - DNA, 20 bp, Artificial Sequence
  chemically synthesized
cctatggctcctatttgtta

SEQ ID NO: 50656 - DNA, 20 bp, Artificial Sequence
  chemically synthesized
tcctatttgttaaagacatt

SEQ ID NO: 50657 - DNA, 20 bp, Artificial Sequence
  chemically synthesized
attgttaatttctttctttc

SEQ ID NO: 50658 - DNA, 20 bp, Artificial Sequence
  chemically synthesized
tctcttttttttttttttga

SEQ ID NO: 50659 - DNA, 20 bp, Artificial Sequence
  chemically synthesized
ctcttttttttttttttgac

SEQ ID NO: 50660 - DNA, 20 bp, Artificial Sequence
  chemically synthesized
tcttttttttttttttgaca

SEQ ID NO: 50661 - DNA, 20 bp, Artificial Sequence
  chemically synthesized
cagggtctcgctgtgttgcc

SEQ ID NO: 50662 - DNA, 20 bp, Artificial Sequence
  chemically synthesized
agggtctcgctgtgttgccc

SEQ ID NO: 50663 - DNA, 20 bp, Artificial Sequence
  chemically synthesized
tctcgctgtgttgcccaggt

SEQ ID NO: 50664 - DNA, 20 bp, Artificial Sequence
  chemically synthesized
tcgctgtgttgcccaggttg

SEQ ID NO: 50665 - DNA, 20 bp, Artificial Sequence
  chemically synthesized
gtgttgcccaggttggagtg

SEQ ID NO: 50666 - DNA, 20 bp, Artificial Sequence
  chemically synthesized
ttgcccaggttggagtgcag

SEQ ID NO: 50667 - DNA, 20 bp, Artificial Sequence
  chemically synthesized
cactgcaatctccccctcct

SEQ ID NO: 50668 - DNA, 20 bp, Artificial Sequence
  chemically synthesized
aatctccccctccttggctc

SEQ ID NO: 50669 - DNA, 20 bp, Artificial Sequence
  chemically synthesized
ctcaagatatccttccacct

SEQ ID NO: 50670 - DNA, 20 bp, Artificial Sequence
  chemically synthesized
tccttccacctcagcctccc

SEQ ID NO: 50671 - DNA, 20 bp, Artificial Sequence
  chemically synthesized
ttccacctcagcctcccaag

SEQ ID NO: 50672 - DNA, 20 bp, Artificial Sequence
  chemically synthesized
acctcagcctcccaagtagc

SEQ ID NO: 50673 - DNA, 20 bp, Artificial Sequence
  chemically synthesized
cctcagcctcccaagtagct

SEQ ID NO: 50674 - DNA, 20 bp, Artificial Sequence
  chemically synthesized
ctcccaagtagctgggacta

SEQ ID NO: 50675 - DNA, 20 bp, Artificial Sequence
  chemically synthesized
tcccaagtagctgggactac

SEQ ID NO: 50676 - DNA, 20 bp, Artificial Sequence
  chemically synthesized
caggcacgtaacaccatatt

SEQ ID NO: 50677 - DNA, 20 bp, Artificial Sequence
  chemically synthesized
ctactttttaaaattttttg

SEQ ID NO: 50678 - DNA, 20 bp, Artificial Sequence
  chemically synthesized
actttttaaaattttttgta

SEQ ID NO: 50679 - DNA, 20 bp, Artificial Sequence
  chemically synthesized
tttttaaaattttttgtaga

SEQ ID NO: 50680 - DNA, 20 bp, Artificial Sequence
  chemically synthesized
ttttaaaattttttgtagag

SEQ ID NO: 50681 - DNA, 20 bp, Artificial Sequence
  chemically synthesized
tttaaaattttttgtagaga

SEQ ID NO: 50682 - DNA, 20 bp, Artificial Sequence
  chemically synthesized
ttaaaattttttgtagagag

SEQ ID NO: 50683 - DNA, 20 bp, Artificial Sequence
  chemically synthesized
ggggtttctccatgttgccc

SEQ ID NO: 50684 - DNA, 20 bp, Artificial Sequence
  chemically synthesized
tttctccatgttgcccaagc

SEQ ID NO: 50685 - DNA, 20 bp, Artificial Sequence
  chemically synthesized
caagctggtctccaactcct

SEQ ID NO: 50686 - DNA, 20 bp, Artificial Sequence
  chemically synthesized
agctcaaatcgttctccctc

SEQ ID NO: 50687 - DNA, 20 bp, Artificial Sequence
  chemically synthesized
aatcgttctccctccggcct

SEQ ID NO: 50688 - DNA, 20 bp, Artificial Sequence
  chemically synthesized
tccggcctcggctgtgatta

SEQ ID NO: 50689 - DNA, 20 bp, Artificial Sequence
  chemically synthesized
ccggcctcggctgtgattac

SEQ ID NO: 50690 - DNA, 20 bp, Artificial Sequence
  chemically synthesized
tcggctgtgattacaggtgt

SEQ ID NO: 50691 - DNA, 20 bp, Artificial Sequence
  chemically synthesized
caggtgtgagccactgtgct

SEQ ID NO: 50692 - DNA, 20 bp, Artificial Sequence
  chemically synthesized
gtgagccactgtgcttggcc

SEQ ID NO: 50693 - DNA, 20 bp, Artificial Sequence
  chemically synthesized
ctgttattttctaatccttc

SEQ ID NO: 50694 - DNA, 20 bp, Artificial Sequence
  chemically synthesized
tgttattttctaatccttcg

SEQ ID NO: 50695 - DNA, 20 bp, Artificial Sequence
  chemically synthesized
tctaatccttcgaggaactc

SEQ ID NO: 50696 - DNA, 20 bp, Artificial Sequence
  chemically synthesized
tatcttgaaaactaattcaa

SEQ ID NO: 50697 - DNA, 20 bp, Artificial Sequence
  chemically synthesized
atcttgaaaactaattcaaa

SEQ ID NO: 50698 - DNA, 20 bp, Artificial Sequence
  chemically synthesized
ctaattcaaaaggtactaac

SEQ ID NO: 50699 - DNA, 20 bp, Artificial Sequence
  chemically synthesized
tcaaaaggtactaacgagat

SEQ ID NO: 50700 - DNA, 20 bp, Artificial Sequence
  chemically synthesized
caaaaggtactaacgagatt

SEQ ID NO: 50701 - DNA, 20 bp, Artificial Sequence
  chemically synthesized
aaggtactaacgagattagg

SEQ ID NO: 50702 - DNA, 20 bp, Artificial Sequence
  chemically synthesized
acgagattaggaagtgcccc

SEQ ID NO: 50703 - DNA, 20 bp, Artificial Sequence
  chemically synthesized
gagattaggaagtgccccga

SEQ ID NO: 50704 - DNA, 20 bp, Artificial Sequence
  chemically synthesized
gattaggaagtgccccgaga

SEQ ID NO: 50705 - DNA, 20 bp, Artificial Sequence
  chemically synthesized
aagtgccccgagagagtgca

SEQ ID NO: 50706 - DNA, 20 bp, Artificial Sequence
  chemically synthesized
gtgccccgagagagtgcata

SEQ ID NO: 50707 - DNA, 20 bp, Artificial Sequence
  chemically synthesized
tgccccgagagagtgcatag

SEQ ID NO: 50708 - DNA, 20 bp, Artificial Sequence
  chemically synthesized
ccccgagagagtgcatagag

SEQ ID NO: 50709 - DNA, 20 bp, Artificial Sequence
  chemically synthesized
ccgagagagtgcatagagga

SEQ ID NO: 50710 - DNA, 20 bp, Artificial Sequence
  chemically synthesized
cgagagagtgcatagaggag

SEQ ID NO: 50711 - DNA, 20 bp, Artificial Sequence
  chemically synthesized
gagagagtgcatagaggaga

SEQ ID NO: 50712 - DNA, 20 bp, Artificial Sequence
  chemically synthesized
agagtgcatagaggagaggg

SEQ ID NO: 50713 - DNA, 20 bp, Artificial Sequence
  chemically synthesized
gtgcatagaggagagggtag

SEQ ID NO: 50714 - DNA, 20 bp, Artificial Sequence
  chemically synthesized
tagaggagagggtagaagta

SEQ ID NO: 50715 - DNA, 20 bp, Artificial Sequence
  chemically synthesized
ggagagggtagaagtaaagc

SEQ ID NO: 50716 - DNA, 20 bp, Artificial Sequence
  chemically synthesized
gagagggtagaagtaaagct

SEQ ID NO: 50717 - DNA, 20 bp, Artificial Sequence
  chemically synthesized
taaagctgggtttgctttgt

SEQ ID NO: 50718 - DNA, 20 bp, Artificial Sequence
  chemically synthesized
ctgggtttgctttgttagtg

SEQ ID NO: 50719 - DNA, 20 bp, Artificial Sequence
  chemically synthesized
tgggtttgctttgttagtga

SEQ ID NO: 50720 - DNA, 20 bp, Artificial Sequence
  chemically synthesized
agtgaaggaataaaatgcat

SEQ ID NO: 50721 - DNA, 20 bp, Artificial Sequence
  chemically synthesized
tgaaggaataaaatgcatca

SEQ ID NO: 50722 - DNA, 20 bp, Artificial Sequence
  chemically synthesized
gaaggaataaaatgcatcag

SEQ ID NO: 50723 - DNA, 20 bp, Artificial Sequence
  chemically synthesized
aaggaataaaatgcatcaga

SEQ ID NO: 50724 - DNA, 20 bp, Artificial Sequence
  chemically synthesized
catcagagggccgaccttct

SEQ ID NO: 50725 - DNA, 20 bp, Artificial Sequence
  chemically synthesized
ccgaccttctcagcctctga

SEQ ID NO: 50726 - DNA, 20 bp, Artificial Sequence
  chemically synthesized
cgaccttctcagcctctgat

SEQ ID NO: 50727 - DNA, 20 bp, Artificial Sequence
  chemically synthesized
ctcagcctctgataggccct

SEQ ID NO: 50728 - DNA, 20 bp, Artificial Sequence
  chemically synthesized
gcctctgataggccctgagc

SEQ ID NO: 50729 - DNA, 20 bp, Artificial Sequence
  chemically synthesized
cctctgataggccctgagct

SEQ ID NO: 50730 - DNA, 20 bp, Artificial Sequence
  chemically synthesized
tctgataggccctgagctgg

SEQ ID NO: 50731 - DNA, 20 bp, Artificial Sequence
  chemically synthesized
gccctgagctgggagctgct

SEQ ID NO: 50732 - DNA, 20 bp, Artificial Sequence
  chemically synthesized
ggagctgctaagccatcctg

SEQ ID NO: 50733 - DNA, 20 bp, Artificial Sequence
  chemically synthesized
agctgctaagccatcctgca

SEQ ID NO: 50734 - DNA, 20 bp, Artificial Sequence
  chemically synthesized
gctaagccatcctgcagagc

SEQ ID NO: 50735 - DNA, 20 bp, Artificial Sequence
  chemically synthesized
aagccatcctgcagagcaag

SEQ ID NO: 50736 - DNA, 20 bp, Artificial Sequence
  chemically synthesized
agccatcctgcagagcaagt

SEQ ID NO: 50737 - DNA, 20 bp, Artificial Sequence
  chemically synthesized
ccatcctgcagagcaagtgg

SEQ ID NO: 50738 - DNA, 20 bp, Artificial Sequence
  chemically synthesized
tgcagagcaagtgggagaaa

SEQ ID NO: 50739 - DNA, 20 bp, Artificial Sequence
  chemically synthesized
cagagcaagtgggagaaaca

SEQ ID NO: 50740 - DNA, 20 bp, Artificial Sequence
  chemically synthesized
agagcaagtgggagaaacag

SEQ ID NO: 50741 - DNA, 20 bp, Artificial Sequence
  chemically synthesized
gagcaagtgggagaaacaga

SEQ ID NO: 50742 - DNA, 20 bp, Artificial Sequence
  chemically synthesized
gtgggagaaacagagggcat

SEQ ID NO: 50743 - DNA, 20 bp, Artificial Sequence
  chemically synthesized
tgggagaaacagagggcatt

SEQ ID NO: 50744 - DNA, 20 bp, Artificial Sequence
  chemically synthesized
agaaacagagggcattaggt

SEQ ID NO: 50745 - DNA, 20 bp, Artificial Sequence
  chemically synthesized
agagggcattaggtcagact

SEQ ID NO: 50746 - DNA, 20 bp, Artificial Sequence
  chemically synthesized
gggcattaggtcagacttgg

SEQ ID NO: 50747 - DNA, 20 bp, Artificial Sequence
  chemically synthesized
ccccatccacttgctcattc

SEQ ID NO: 50748 - DNA, 20 bp, Artificial Sequence
  chemically synthesized
atccacttgctcattctgga

SEQ ID NO: 50749 - DNA, 20 bp, Artificial Sequence
  chemically synthesized
cacttgctcattctggatgg

SEQ ID NO: 50750 - DNA, 20 bp, Artificial Sequence
  chemically synthesized
acttgctcattctggatggc

SEQ ID NO: 50751 - DNA, 20 bp, Artificial Sequence
  chemically synthesized
ctcattctggatggcaggat

SEQ ID NO: 50752 - DNA, 20 bp, Artificial Sequence
  chemically synthesized
tcattctggatggcaggatt

SEQ ID NO: 50753 - DNA, 20 bp, Artificial Sequence
  chemically synthesized
tttatatttccctaccatat

SEQ ID NO: 50754 - DNA, 20 bp, Artificial Sequence
  chemically synthesized
catattagcttgtgcactta

SEQ ID NO: 50755 - DNA, 20 bp, Artificial Sequence
  chemically synthesized
atattagcttgtgcacttaa

SEQ ID NO: 50756 - DNA, 20 bp, Artificial Sequence
  chemically synthesized
ttagcttgtgcacttaaagg

SEQ ID NO: 50757 - DNA, 20 bp, Artificial Sequence
  chemically synthesized
ttgtgcacttaaaggaagtt

SEQ ID NO: 50758 - DNA, 20 bp, Artificial Sequence
  chemically synthesized
gcacttaaaggaagtttaga

SEQ ID NO: 50759 - DNA, 20 bp, Artificial Sequence
  chemically synthesized
tttagatagccttgactcca

SEQ ID NO: 50760 - DNA, 20 bp, Artificial Sequence
  chemically synthesized
ttagatagccttgactccat

SEQ ID NO: 50761 - DNA, 20 bp, Artificial Sequence
  chemically synthesized
tagatagccttgactccatg

SEQ ID NO: 50762 - DNA, 20 bp, Artificial Sequence
  chemically synthesized
agccttgactccatggggaa

SEQ ID NO: 50763 - DNA, 20 bp, Artificial Sequence
  chemically synthesized
gccttgactccatggggaaa

SEQ ID NO: 50764 - DNA, 20 bp, Artificial Sequence
  chemically synthesized
actccatggggaaaaggaaa

SEQ ID NO: 50765 - DNA, 20 bp, Artificial Sequence
  chemically synthesized
ggaaaaggaaaaagtacatt

SEQ ID NO: 50766 - DNA, 20 bp, Artificial Sequence
  chemically synthesized
aaaggaaaaagtacatttag

SEQ ID NO: 50767 - DNA, 20 bp, Artificial Sequence
  chemically synthesized
aaggaaaaagtacatttagt

SEQ ID NO: 50768 - DNA, 20 bp, Artificial Sequence
  chemically synthesized
aggaaaaagtacatttagtg

SEQ ID NO: 50769 - DNA, 20 bp, Artificial Sequence
  chemically synthesized
aaagtacatttagtggggtg

SEQ ID NO: 50770 - DNA, 20 bp, Artificial Sequence
  chemically synthesized
aagtacatttagtggggtgt

SEQ ID NO: 50771 - DNA, 20 bp, Artificial Sequence
  chemically synthesized
ttagtggggtgtgggactgt

SEQ ID NO: 50772 - DNA, 20 bp, Artificial Sequence
  chemically synthesized
gtgtgggactgttggattat

SEQ ID NO: 50773 - DNA, 20 bp, Artificial Sequence
  chemically synthesized
gcatttctctcattctgttc

SEQ ID NO: 50774 - DNA, 20 bp, Artificial Sequence
  chemically synthesized
tctctcattctgttccagtt

SEQ ID NO: 50775 - DNA, 20 bp, Artificial Sequence
  chemically synthesized
ctctcattctgttccagttg

SEQ ID NO: 50776 - DNA, 20 bp, Artificial Sequence
  chemically synthesized
cattctgttccagttgaggc

SEQ ID NO: 50777 - DNA, 20 bp, Artificial Sequence
  chemically synthesized
gaggccagcttgcttcccac

SEQ ID NO: 50778 - DNA, 20 bp, Artificial Sequence
  chemically synthesized
gccagcttgcttcccactag

SEQ ID NO: 50779 - DNA, 20 bp, Artificial Sequence
  chemically synthesized
tgttctctttatacaattcc

SEQ ID NO: 50780 - DNA, 20 bp, Artificial Sequence
  chemically synthesized
tctttatacaattcctagtc

SEQ ID NO: 50781 - DNA, 20 bp, Artificial Sequence
  chemically synthesized
ttatacaattcctagtcaag

SEQ ID NO: 50782 - DNA, 20 bp, Artificial Sequence
  chemically synthesized
tatacaattcctagtcaagt

SEQ ID NO: 50783 - DNA, 20 bp, Artificial Sequence
  chemically synthesized
atacaattcctagtcaagta

SEQ ID NO: 50784 - DNA, 20 bp, Artificial Sequence
  chemically synthesized
tacaattcctagtcaagtag

SEQ ID NO: 50785 - DNA, 20 bp, Artificial Sequence
  chemically synthesized
cctagtcaagtaggggcaaa

SEQ ID NO: 50786 - DNA, 20 bp, Artificial Sequence
  chemically synthesized
ttcatttattattgtttttc

SEQ ID NO: 50787 - DNA, 20 bp, Artificial Sequence
  chemically synthesized
tcatttattattgtttttct

SEQ ID NO: 50788 - DNA, 20 bp, Artificial Sequence
  chemically synthesized
attattgtttttctgggatg

SEQ ID NO: 50789 - DNA, 20 bp, Artificial Sequence
  chemically synthesized
ttgtttttctgggatgtagc

SEQ ID NO: 50790 - DNA, 20 bp, Artificial Sequence
  chemically synthesized
tgtttttctgggatgtagcc

SEQ ID NO: 50791 - DNA, 20 bp, Artificial Sequence
  chemically synthesized
tttttctgggatgtagccag

SEQ ID NO: 50792 - DNA, 20 bp, Artificial Sequence
  chemically synthesized
caggagcaatttaaacttgc

SEQ ID NO: 50793 - DNA, 20 bp, Artificial Sequence
  chemically synthesized
ggagcaatttaaacttgctg

SEQ ID NO: 50794 - DNA, 20 bp, Artificial Sequence
  chemically synthesized
caatttcttcaactacaaat

SEQ ID NO: 50795 - DNA, 20 bp, Artificial Sequence
  chemically synthesized
acaaatgagaataataataa

SEQ ID NO: 50796 - DNA, 20 bp, Artificial Sequence
  chemically synthesized
caaatgagaataataataac

SEQ ID NO: 50797 - DNA, 20 bp, Artificial Sequence
  chemically synthesized
acgaactaattgtaataata

SEQ ID NO: 50798 - DNA, 20 bp, Artificial Sequence
  chemically synthesized
gaactaaatgtaaatataca

SEQ ID NO: 50799 - DNA, 20 bp, Artificial Sequence
  chemically synthesized
aactaaatgtaaatatacaa

SEQ ID NO: 50800 - DNA, 20 bp, Artificial Sequence
  chemically synthesized
caaaggataaattcaaaatc

SEQ ID NO: 50801 - DNA, 20 bp, Artificial Sequence
  chemically synthesized
aaaggataaattcaaaatct

SEQ ID NO: 50802 - DNA, 20 bp, Artificial Sequence
  chemically synthesized
attcaaaatctgggcacatg

SEQ ID NO: 50803 - DNA, 20 bp, Artificial Sequence
  chemically synthesized
ttcaaaatctgggcacatgc

SEQ ID NO: 50804 - DNA, 20 bp, Artificial Sequence
  chemically synthesized
gggcacatgcaggctgctat

SEQ ID NO: 50805 - DNA, 20 bp, Artificial Sequence
  chemically synthesized
gcacatgcaggctgctataa

SEQ ID NO: 50806 - DNA, 20 bp, Artificial Sequence
  chemically synthesized
agaaaacatctatgatatta

SEQ ID NO: 50807 - DNA, 20 bp, Artificial Sequence
  chemically synthesized
gaaaacatctatgatattat

SEQ ID NO: 50808 - DNA, 20 bp, Artificial Sequence
  chemically synthesized
gaccaaatgacattaaatta

SEQ ID NO: 50809 - DNA, 20 bp, Artificial Sequence
  chemically synthesized
caaatgacattaaattatag

SEQ ID NO: 50810 - DNA, 20 bp, Artificial Sequence
  chemically synthesized
aaatgacattaaattatagt

SEQ ID NO: 50811 - DNA, 20 bp, Artificial Sequence
  chemically synthesized
aatgacattaaattatagtg

SEQ ID NO: 50812 - DNA, 20 bp, Artificial Sequence
  chemically synthesized
tgacattaaattatagtggg

SEQ ID NO: 50813 - DNA, 20 bp, Artificial Sequence
  chemically synthesized
gacattaaattatagtgggg

SEQ ID NO: 50814 - DNA, 20 bp, Artificial Sequence
  chemically synthesized
aattatagtggggaggtaaa

SEQ ID NO: 50815 - DNA, 20 bp, Artificial Sequence
  chemically synthesized
attatagtggggaggtaaac

SEQ ID NO: 50816 - DNA, 20 bp, Artificial Sequence
  chemically synthesized
tagtggggaggtaaacaggt

SEQ ID NO: 50817 - DNA, 20 bp, Artificial Sequence
  chemically synthesized
tggggaggtaaacaggttgg

SEQ ID NO: 50818 - DNA, 20 bp, Artificial Sequence
  chemically synthesized
caggttggcagtgtatttta

SEQ ID NO: 50819 - DNA, 20 bp, Artificial Sequence
  chemically synthesized
catatgcatattttatgacc

SEQ ID NO: 50820 - DNA, 20 bp, Artificial Sequence
  chemically synthesized
ttttatgacctagcaattta

SEQ ID NO: 50821 - DNA, 20 bp, Artificial Sequence
  chemically synthesized
atatatatacaaaaatatat

SEQ ID NO: 50822 - DNA, 20 bp, Artificial Sequence
  chemically synthesized
aaaatatataagaatcttca

SEQ ID NO: 50823 - DNA, 20 bp, Artificial Sequence
  chemically synthesized
atatataagaatcttcatag

SEQ ID NO: 50824 - DNA, 20 bp, Artificial Sequence
  chemically synthesized
catagcagcaatttatatta

SEQ ID NO: 50825 - DNA, 20 bp, Artificial Sequence
  chemically synthesized
gcaatttatattatagccaa

SEQ ID NO: 50826 - DNA, 20 bp, Artificial Sequence
  chemically synthesized
tttatattatagccaaaagc

SEQ ID NO: 50827 - DNA, 20 bp, Artificial Sequence
  chemically synthesized
atattatagccaaaagctag

SEQ ID NO: 50828 - DNA, 20 bp, Artificial Sequence
  chemically synthesized
tattatagccaaaagctaga

SEQ ID NO: 50829 - DNA, 20 bp, Artificial Sequence
  chemically synthesized
actcaaatatctatcaactg

SEQ ID NO: 50830 - DNA, 20 bp, Artificial Sequence
  chemically synthesized
tcaaatatctatcaactgtg

SEQ ID NO: 50831 - DNA, 20 bp, Artificial Sequence
  chemically synthesized
tggagtcaataaatatattg

SEQ ID NO: 50832 - DNA, 20 bp, Artificial Sequence
  chemically synthesized
attgtggtatatacataaaa

SEQ ID NO: 50833 - DNA, 20 bp, Artificial Sequence
  chemically synthesized
acataaaatagaatgacatt

SEQ ID NO: 50834 - DNA, 20 bp, Artificial Sequence
  chemically synthesized
cagaaatgaaaaatcaacta

SEQ ID NO: 50835 - DNA, 20 bp, Artificial Sequence
  chemically synthesized
aatcaactacagtcatacac

SEQ ID NO: 50836 - DNA, 20 bp, Artificial Sequence
  chemically synthesized
cacaaacataatattgaata

SEQ ID NO: 50837 - DNA, 20 bp, Artificial Sequence
  chemically synthesized
aacataatattgaataaagt

SEQ ID NO: 50838 - DNA, 20 bp, Artificial Sequence
  chemically synthesized
tattgaataaagtcagacat

SEQ ID NO: 50839 - DNA, 20 bp, Artificial Sequence
  chemically synthesized
aaagtcagacataagcaaca

SEQ ID NO: 50840 - DNA, 20 bp, Artificial Sequence
  chemically synthesized
tgtatacacacttttaaaaa

SEQ ID NO: 50841 - DNA, 20 bp, Artificial Sequence
  chemically synthesized
gtatacacacttttaaaaaa

SEQ ID NO: 50842 - DNA, 20 bp, Artificial Sequence
  chemically synthesized
tatacacacttttaaaaaaa

SEQ ID NO: 50843 - DNA, 20 bp, Artificial Sequence
  chemically synthesized
acttttaaaaaaagggacat

SEQ ID NO: 50844 - DNA, 20 bp, Artificial Sequence
  chemically synthesized
gtgataaaaatgaattatat

SEQ ID NO: 50845 - DNA, 20 bp, Artificial Sequence
  chemically synthesized
tgataaaaatgaattatatc

SEQ ID NO: 50846 - DNA, 20 bp, Artificial Sequence
  chemically synthesized
atcaggataattattaactt

SEQ ID NO: 50847 - DNA, 20 bp, Artificial Sequence
  chemically synthesized
caggataattattaactttg

SEQ ID NO: 50848 - DNA, 20 bp, Artificial Sequence
  chemically synthesized
ttattaactttggagacaat

SEQ ID NO: 50849 - DNA, 20 bp, Artificial Sequence
  chemically synthesized
ttaactttggagacaattag

SEQ ID NO: 50850 - DNA, 20 bp, Artificial Sequence
  chemically synthesized
agacaattagtggaatgata

SEQ ID NO: 50851 - DNA, 20 bp, Artificial Sequence
  chemically synthesized
acaattagtggaatgataaa

SEQ ID NO: 50852 - DNA, 20 bp, Artificial Sequence
  chemically synthesized
ttagtggaatgataaagagt

SEQ ID NO: 50853 - DNA, 20 bp, Artificial Sequence
  chemically synthesized
tctttaatttcctatcttat

SEQ ID NO: 50854 - DNA, 20 bp, Artificial Sequence
  chemically synthesized
ctatcttattagttgttaca

SEQ ID NO: 50855 - DNA, 20 bp, Artificial Sequence
  chemically synthesized
tatcttattagttgttacat

SEQ ID NO: 50856 - DNA, 20 bp, Artificial Sequence
  chemically synthesized
tgggtgtgttcaccttccaa

SEQ ID NO: 50857 - DNA, 20 bp, Artificial Sequence
  chemically synthesized
tcaccttccaaaagttaatt

SEQ ID NO: 50858 - DNA, 20 bp, Artificial Sequence
  chemically synthesized
attaaaataaaaactaaatt

SEQ ID NO: 50859 - DNA, 20 bp, Artificial Sequence
  chemically synthesized
taaatttagaaactaaacaa

SEQ ID NO: 50860 - DNA, 20 bp, Artificial Sequence
  chemically synthesized
agaaactaaacaatggaaaa

SEQ ID NO: 50861 - DNA, 20 bp, Artificial Sequence
  chemically synthesized
actaaacaatggaaaaaagt

SEQ ID NO: 50862 - DNA, 20 bp, Artificial Sequence
  chemically synthesized
agaccatttctttgcatttc

SEQ ID NO: 50863 - DNA, 20 bp, Artificial Sequence
  chemically synthesized
ccatttctttgcatttcaag

SEQ ID NO: 50864 - DNA, 20 bp, Artificial Sequence
  chemically synthesized
tcaagaagtgcatactaact

SEQ ID NO: 50865 - DNA, 20 bp, Artificial Sequence
  chemically synthesized
tgagatattacattcttaaa

SEQ ID NO: 50866 - DNA, 20 bp, Artificial Sequence
  chemically synthesized
attacattcttaaatggctt

SEQ ID NO: 50867 - DNA, 20 bp, Artificial Sequence
  chemically synthesized
cttaaatggctttagtcaat

SEQ ID NO: 50868 - DNA, 20 bp, Artificial Sequence
  chemically synthesized
ttaaatggctttagtcaatt

SEQ ID NO: 50869 - DNA, 20 bp, Artificial Sequence
  chemically synthesized
taaacatttgcttctaaatc

SEQ ID NO: 50870 - DNA, 20 bp, Artificial Sequence
  chemically synthesized
aaacatttgcttctaaatct

SEQ ID NO: 50871 - DNA, 20 bp, Artificial Sequence
  chemically synthesized
catttgcttctaaatctagg

SEQ ID NO: 50872 - DNA, 20 bp, Artificial Sequence
  chemically synthesized
tagactgtcttaacttcctg

SEQ ID NO: 50873 - DNA, 20 bp, Artificial Sequence
  chemically synthesized
actgtcttaacttcctgaag

SEQ ID NO: 50874 - DNA, 20 bp, Artificial Sequence
  chemically synthesized
tgtcttaacttcctgaagaa

SEQ ID NO: 50875 - DNA, 20 bp, Artificial Sequence
  chemically synthesized
gtcttaacttcctgaagaag

SEQ ID NO: 50876 - DNA, 20 bp, Artificial Sequence
  chemically synthesized
tcttaacttcctgaagaaga

SEQ ID NO: 50877 - DNA, 20 bp, Artificial Sequence
  chemically synthesized
taacttcctgaagaagaggg

SEQ ID NO: 50878 - DNA, 20 bp, Artificial Sequence
  chemically synthesized
gagggaagaaataatgaaaa

SEQ ID NO: 50879 - DNA, 20 bp, Artificial Sequence
  chemically synthesized
agggaagaaataatgaaaaa

SEQ ID NO: 50880 - DNA, 20 bp, Artificial Sequence
  chemically synthesized
taatgaaaaaaggaaaataa

SEQ ID NO: 50881 - DNA, 20 bp, Artificial Sequence
  chemically synthesized
aggaaaataacagaaatacc

SEQ ID NO: 50882 - DNA, 20 bp, Artificial Sequence
  chemically synthesized
gaaaataacagaaataccta

SEQ ID NO: 50883 - DNA, 20 bp, Artificial Sequence
  chemically synthesized
aaaataacagaaatacctag

SEQ ID NO: 50884 - DNA, 20 bp, Artificial Sequence
  chemically synthesized
aataacagaaatacctagag

SEQ ID NO: 50885 - DNA, 20 bp, Artificial Sequence
  chemically synthesized
ataacagaaatacctagagg

SEQ ID NO: 50886 - DNA, 20 bp, Artificial Sequence
  chemically synthesized
taacagaaatacctagagga

SEQ ID NO: 50887 - DNA, 20 bp, Artificial Sequence
  chemically synthesized
acctagaggagggaaataaa

SEQ ID NO: 50888 - DNA, 20 bp, Artificial Sequence
  chemically synthesized
gaggagggaaataaaaagcc

SEQ ID NO: 50889 - DNA, 20 bp, Artificial Sequence
  chemically synthesized
aggagggaaataaaaagcct

SEQ ID NO: 50890 - DNA, 20 bp, Artificial Sequence
  chemically synthesized
gggaaataaaaagcctagga

SEQ ID NO: 50891 - DNA, 20 bp, Artificial Sequence
  chemically synthesized
gcctaggaaagcaacatgaa

SEQ ID NO: 50892 - DNA, 20 bp, Artificial Sequence
  chemically synthesized
aggaaagcaacatgaaaaga

SEQ ID NO: 50893 - DNA, 20 bp, Artificial Sequence
  chemically synthesized
catgaaaagatggtgctctc

SEQ ID NO: 50894 - DNA, 20 bp, Artificial Sequence
  chemically synthesized
tggtacatcctgtgcttcct

SEQ ID NO: 50895 - DNA, 20 bp, Artificial Sequence
  chemically synthesized
gtcttttacacacactgtct

SEQ ID NO: 50896 - DNA, 20 bp, Artificial Sequence
  chemically synthesized
tcttttacacacactgtctt

SEQ ID NO: 50897 - DNA, 20 bp, Artificial Sequence
  chemically synthesized
ttacacacactgtcttggga

SEQ ID NO: 50898 - DNA, 20 bp, Artificial Sequence
  chemically synthesized
tacacacactgtcttgggat

SEQ ID NO: 50899 - DNA, 20 bp, Artificial Sequence
  chemically synthesized
actgtcttgggatgggcatt

SEQ ID NO: 50900 - DNA, 20 bp, Artificial Sequence
  chemically synthesized
ctgtcttgggatgggcatta

SEQ ID NO: 50901 - DNA, 20 bp, Artificial Sequence
  chemically synthesized
ggatgggcattaaggtgttg

SEQ ID NO: 50902 - DNA, 20 bp, Artificial Sequence
  chemically synthesized
attaaggtgttgtagctact

SEQ ID NO: 50903 - DNA, 20 bp, Artificial Sequence
  chemically synthesized
aggtgttgtagctactcagc

SEQ ID NO: 50904 - DNA, 20 bp, Artificial Sequence
  chemically synthesized
gttgtagctactcagctagt

SEQ ID NO: 50905 - DNA, 20 bp, Artificial Sequence
  chemically synthesized
gtagctactcagctagtaag

SEQ ID NO: 50906 - DNA, 20 bp, Artificial Sequence
  chemically synthesized
tactcagctagtaagtagct

SEQ ID NO: 50907 - DNA, 20 bp, Artificial Sequence
  chemically synthesized
agctagtaagtagctgagct

SEQ ID NO: 50908 - DNA, 20 bp, Artificial Sequence
  chemically synthesized
ctaagattctttcaattcca

SEQ ID NO: 50909 - DNA, 20 bp, Artificial Sequence
  chemically synthesized
gattctttcaattccaaagt

SEQ ID NO: 50910 - DNA, 20 bp, Artificial Sequence
  chemically synthesized
tctttcaattccaaagtcag

SEQ ID NO: 50911 - DNA, 20 bp, Artificial Sequence
  chemically synthesized
tcagcagtgtcttcactaca

SEQ ID NO: 50912 - DNA, 20 bp, Artificial Sequence
  chemically synthesized
tcactacatggtactatgtc

SEQ ID NO: 50913 - DNA, 20 bp, Artificial Sequence
  chemically synthesized
tacatggtactatgtcaaga

SEQ ID NO: 50914 - DNA, 20 bp, Artificial Sequence
  chemically synthesized
catggtactatgtcaagaaa

SEQ ID NO: 50915 - DNA, 20 bp, Artificial Sequence
  chemically synthesized
gaaagagaaactccactaaa

SEQ ID NO: 50916 - DNA, 20 bp, Artificial Sequence
  chemically synthesized
agaacttcattgctctctgt

SEQ ID NO: 50917 - DNA, 20 bp, Artificial Sequence
  chemically synthesized
gaacttcattgctctctgtt

SEQ ID NO: 50918 - DNA, 20 bp, Artificial Sequence
  chemically synthesized
aacttcattgctctctgtta

SEQ ID NO: 50919 - DNA, 20 bp, Artificial Sequence
  chemically synthesized
ttagggatacattaacattt

SEQ ID NO: 50920 - DNA, 20 bp, Artificial Sequence
  chemically synthesized
tagggatacattaacatttt

SEQ ID NO: 50921 - DNA, 20 bp, Artificial Sequence
  chemically synthesized
atgaaaaaaaaatgttacaa

SEQ ID NO: 50922 - DNA, 20 bp, Artificial Sequence
  chemically synthesized
aaaaatgttacaatagctta

SEQ ID NO: 50923 - DNA, 20 bp, Artificial Sequence
  chemically synthesized
aaaatgttacaatagcttac

SEQ ID NO: 50924 - DNA, 20 bp, Artificial Sequence
  chemically synthesized
acctccacttatatgaccta

SEQ ID NO: 50925 - DNA, 20 bp, Artificial Sequence
  chemically synthesized
acctatggacctcttaaact

SEQ ID NO: 50926 - DNA, 20 bp, Artificial Sequence
  chemically synthesized
atggacctcttaaactcagc

SEQ ID NO: 50927 - DNA, 20 bp, Artificial Sequence
  chemically synthesized
cttaaactcagcgagttgaa

SEQ ID NO: 50928 - DNA, 20 bp, Artificial Sequence
  chemically synthesized
aactcagcgagttgaaaaga

SEQ ID NO: 50929 - DNA, 20 bp, Artificial Sequence
  chemically synthesized
aaattatcctccacttcttt

SEQ ID NO: 50930 - DNA, 20 bp, Artificial Sequence
  chemically synthesized
atgcttccaaacttgatgaa

SEQ ID NO: 50931 - DNA, 20 bp, Artificial Sequence
  chemically synthesized
aacttgatgaatggttcact

SEQ ID NO: 50932 - DNA, 20 bp, Artificial Sequence
  chemically synthesized
aatggttcactcagatttcc

SEQ ID NO: 50933 - DNA, 20 bp, Artificial Sequence
  chemically synthesized
aataatcaatttctcacaac

SEQ ID NO: 50934 - DNA, 20 bp, Artificial Sequence
  chemically synthesized
attattatcataaatactga

SEQ ID NO: 50935 - DNA, 20 bp, Artificial Sequence
  chemically synthesized
cataaatactgatagctttt

SEQ ID NO: 50936 - DNA, 20 bp, Artificial Sequence
  chemically synthesized
aaatactgatagcttttgag

SEQ ID NO: 50937 - DNA, 20 bp, Artificial Sequence
  chemically synthesized
tactgatagcttttgagtgg

SEQ ID NO: 50938 - DNA, 20 bp, Artificial Sequence
  chemically synthesized
gcttttgagtggcagataat

SEQ ID NO: 50939 - DNA, 20 bp, Artificial Sequence
  chemically synthesized
caatatttttaaaaattgtg

SEQ ID NO: 50940 - DNA, 20 bp, Artificial Sequence
  chemically synthesized
tttttaaaaattgtgcagct

SEQ ID NO: 50941 - DNA, 20 bp, Artificial Sequence
  chemically synthesized
aaattgtgcagctaagtgtt

SEQ ID NO: 50942 - DNA, 20 bp, Artificial Sequence
  chemically synthesized
gagctaaaaattatatacct

SEQ ID NO: 50943 - DNA, 20 bp, Artificial Sequence
  chemically synthesized
acctaagaaatgacaaaacc

SEQ ID NO: 50944 - DNA, 20 bp, Artificial Sequence
  chemically synthesized
acaaaaccaagatttgaaac

SEQ ID NO: 50945 - DNA, 20 bp, Artificial Sequence
  chemically synthesized
tgaaaccagttctcactgac

SEQ ID NO: 50946 - DNA, 20 bp, Artificial Sequence
  chemically synthesized
aaccagttctcactgaccag

SEQ ID NO: 50947 - DNA, 20 bp, Artificial Sequence
  chemically synthesized
tgaccagaagatcattcttt

SEQ ID NO: 50948 - DNA, 20 bp, Artificial Sequence
  chemically synthesized
agaagatcattctttcagct

SEQ ID NO: 50949 - DNA, 20 bp, Artificial Sequence
  chemically synthesized
gaagatcattctttcagcta

SEQ ID NO: 50950 - DNA, 20 bp, Artificial Sequence
  chemically synthesized
agatcattctttcagctaag

SEQ ID NO: 50951 - DNA, 20 bp, Artificial Sequence
  chemically synthesized
ctaattactgcgttccttca

SEQ ID NO: 50952 - DNA, 20 bp, Artificial Sequence
  chemically synthesized
atagtttttttttttcctct

SEQ ID NO: 50953 - DNA, 20 bp, Artificial Sequence
  chemically synthesized
tagtttttttttttcctctc

SEQ ID NO: 50954 - DNA, 20 bp, Artificial Sequence
  chemically synthesized
ccctgaaatatgcattttct

SEQ ID NO: 50955 - DNA, 20 bp, Artificial Sequence
  chemically synthesized
gcccttcaataacttctaac

SEQ ID NO: 50956 - DNA, 20 bp, Artificial Sequence
  chemically synthesized
cctatttgtgtcttgcaaca

SEQ ID NO: 50957 - DNA, 20 bp, Artificial Sequence
  chemically synthesized
ctatttgtgtcttgcaacat

SEQ ID NO: 50958 - DNA, 20 bp, Artificial Sequence
  chemically synthesized
tgtcttgcaacatgggataa

SEQ ID NO: 50959 - DNA, 20 bp, Artificial Sequence
  chemically synthesized
gtcttgcaacatgggataat

SEQ ID NO: 50960 - DNA, 20 bp, Artificial Sequence
  chemically synthesized
caacatgggataataggttc

SEQ ID NO: 50961 - DNA, 20 bp, Artificial Sequence
  chemically synthesized
gggataataggttctggcat

SEQ ID NO: 50962 - DNA, 20 bp, Artificial Sequence
  chemically synthesized
taataggttctggcatgaga

SEQ ID NO: 50963 - DNA, 20 bp, Artificial Sequence
  chemically synthesized
ggttctggcatgagacagcc

SEQ ID NO: 50964 - DNA, 20 bp, Artificial Sequence
  chemically synthesized
gttctggcatgagacagccc

SEQ ID NO: 50965 - DNA, 20 bp, Artificial Sequence
  chemically synthesized
gacagcccgggctctactct

SEQ ID NO: 50966 - DNA, 20 bp, Artificial Sequence
  chemically synthesized
acagcccgggctctactctc

SEQ ID NO: 50967 - DNA, 20 bp, Artificial Sequence
  chemically synthesized
ggctctactctcaggtccat

SEQ ID NO: 50968 - DNA, 20 bp, Artificial Sequence
  chemically synthesized
ctctcaggtccataagttaa

SEQ ID NO: 50969 - DNA, 20 bp, Artificial Sequence
  chemically synthesized
taagttaatagctttgtttt

SEQ ID NO: 50970 - DNA, 20 bp, Artificial Sequence
  chemically synthesized
aagttaatagctttgttttg

SEQ ID NO: 50971 - DNA, 20 bp, Artificial Sequence
  chemically synthesized
aatagctttgttttgaggat

SEQ ID NO: 50972 - DNA, 20 bp, Artificial Sequence
  chemically synthesized
acattcctcaataataaatt

SEQ ID NO: 50973 - DNA, 20 bp, Artificial Sequence
  chemically synthesized
attcctcaataataaattaa

SEQ ID NO: 50974 - DNA, 20 bp, Artificial Sequence
  chemically synthesized
taataaattaagagctataa

SEQ ID NO: 50975 - DNA, 20 bp, Artificial Sequence
  chemically synthesized
tctactttataaatttctta

SEQ ID NO: 50976 - DNA, 20 bp, Artificial Sequence
  chemically synthesized
ctttataaatttcttatagt

SEQ ID NO: 50977 - DNA, 20 bp, Artificial Sequence
  chemically synthesized
cgaaaaatgacaaaccaaat

SEQ ID NO: 50978 - DNA, 20 bp, Artificial Sequence
  chemically synthesized
tgacaaaccaaataagttcc

SEQ ID NO: 50979 - DNA, 20 bp, Artificial Sequence
  chemically synthesized
actttttatcatgatgatca

SEQ ID NO: 50980 - DNA, 20 bp, Artificial Sequence
  chemically synthesized
ataatttttttcttcaccta

SEQ ID NO: 50981 - DNA, 20 bp, Artificial Sequence
  chemically synthesized
tttttcttcacctatagcca

SEQ ID NO: 50982 - DNA, 20 bp, Artificial Sequence
  chemically synthesized
tcttcacctatagccacagt

SEQ ID NO: 50983 - DNA, 20 bp, Artificial Sequence
  chemically synthesized
tagccacagtcagcttctca

SEQ ID NO: 50984 - DNA, 20 bp, Artificial Sequence
  chemically synthesized
ctcacctttttatgatctaa

SEQ ID NO: 50985 - DNA, 20 bp, Artificial Sequence
  chemically synthesized
ctccacgctgacgtttacca

SEQ ID NO: 50986 - DNA, 20 bp, Artificial Sequence
  chemically synthesized
ctgacgtttaccacagaacc

SEQ ID NO: 50987 - DNA, 20 bp, Artificial Sequence
  chemically synthesized
tttaccacagaacctggaca

SEQ ID NO: 50988 - DNA, 20 bp, Artificial Sequence
  chemically synthesized
ttaccacagaacctggacat

SEQ ID NO: 50989 - DNA, 20 bp, Artificial Sequence
  chemically synthesized
aataaataaaataaataaaa

SEQ ID NO: 50990 - DNA, 20 bp, Artificial Sequence
  chemically synthesized
aacagaaaaaaaacgataca

SEQ ID NO: 50991 - DNA, 20 bp, Artificial Sequence
  chemically synthesized
acagaaaaaaaacgatacaa

SEQ ID NO: 50992 - DNA, 20 bp, Artificial Sequence
  chemically synthesized
cagaaaaaaaacgatacaaa

SEQ ID NO: 50993 - DNA, 20 bp, Artificial Sequence
  chemically synthesized
aaaacgatacaaagggtatg

SEQ ID NO: 50994 - DNA, 20 bp, Artificial Sequence
  chemically synthesized
aaacgatacaaagggtatga

SEQ ID NO: 50995 - DNA, 20 bp, Artificial Sequence
  chemically synthesized
tacaaagggtatgaaggatt

SEQ ID NO: 50996 - DNA, 20 bp, Artificial Sequence
  chemically synthesized
agtgaatatgttatatgcta

SEQ ID NO: 50997 - DNA, 20 bp, Artificial Sequence
  chemically synthesized
tatgttatatgctacggcac

SEQ ID NO: 50998 - DNA, 20 bp, Artificial Sequence
  chemically synthesized
gttatatgctacggcaccag

SEQ ID NO: 50999 - DNA, 20 bp, Artificial Sequence
  chemically synthesized
tacggcaccagtggtctttc

SEQ ID NO: 51000 - DNA, 20 bp, Artificial Sequence
  chemically synthesized
acggcaccagtggtctttct

SEQ ID NO: 51001 - DNA, 20 bp, Artificial Sequence
  chemically synthesized
attgtacacttgccccattc

SEQ ID NO: 51002 - DNA, 20 bp, Artificial Sequence
  chemically synthesized
ttgtacacttgccccattct

SEQ ID NO: 51003 - DNA, 20 bp, Artificial Sequence
  chemically synthesized
cttgccccattctaggacaa

SEQ ID NO: 51004 - DNA, 20 bp, Artificial Sequence
  chemically synthesized
ggacaatggttccttctgat

SEQ ID NO: 51005 - DNA, 20 bp, Artificial Sequence
  chemically synthesized
ttctgattagttaccttttc

SEQ ID NO: 51006 - DNA, 20 bp, Artificial Sequence
  chemically synthesized
ttagttaccttttccagtct

SEQ ID NO: 51007 - DNA, 20 bp, Artificial Sequence
  chemically synthesized
agttaccttttccagtctga

SEQ ID NO: 51008 - DNA, 20 bp, Artificial Sequence
  chemically synthesized
tccagtctgagagacatgcc

SEQ ID NO: 51009 - DNA, 20 bp, Artificial Sequence
  chemically synthesized
ctggctcacacctgatttgt

SEQ ID NO: 51010 - DNA, 20 bp, Artificial Sequence
  chemically synthesized
tggctcacacctgatttgta

SEQ ID NO: 51011 - DNA, 20 bp, Artificial Sequence
  chemically synthesized
acacctgatttgtaaggcaa

SEQ ID NO: 51012 - DNA, 20 bp, Artificial Sequence
  chemically synthesized
acctgatttgtaaggcaatg

SEQ ID NO: 51013 - DNA, 20 bp, Artificial Sequence
  chemically synthesized
gatttgtaaggcaatggaga

SEQ ID NO: 51014 - DNA, 20 bp, Artificial Sequence
  chemically synthesized
tttgtaaggcaatggagatg

SEQ ID NO: 51015 - DNA, 20 bp, Artificial Sequence
  chemically synthesized
ggagacactcttatatccaa

SEQ ID NO: 51016 - DNA, 20 bp, Artificial Sequence
  chemically synthesized
ctcttatatccaaaagtaca

SEQ ID NO: 51017 - DNA, 20 bp, Artificial Sequence
  chemically synthesized
tatccaaaagtacatagctc

SEQ ID NO: 51018 - DNA, 20 bp, Artificial Sequence
  chemically synthesized
ccaaaagtacatagctccgg

SEQ ID NO: 51019 - DNA, 20 bp, Artificial Sequence
  chemically synthesized
agtacatagctccggtagct

SEQ ID NO: 51020 - DNA, 20 bp, Artificial Sequence
  chemically synthesized
taataaacctttgtcacctc

SEQ ID NO: 51021 - DNA, 20 bp, Artificial Sequence
  chemically synthesized
ataaacctttgtcacctcta

SEQ ID NO: 51022 - DNA, 20 bp, Artificial Sequence
  chemically synthesized
tagagaattctaaaaatcca

SEQ ID NO: 51023 - DNA, 20 bp, Artificial Sequence
  chemically synthesized
attctaaaaatccacagatt

SEQ ID NO: 51024 - DNA, 20 bp, Artificial Sequence
  chemically synthesized
atccacagatttagaaattc

SEQ ID NO: 51025 - DNA, 20 bp, Artificial Sequence
  chemically synthesized
tccacagatttagaaattct

SEQ ID NO: 51026 - DNA, 20 bp, Artificial Sequence
  chemically synthesized
tttagaaattctaggaatcc

SEQ ID NO: 51027 - DNA, 20 bp, Artificial Sequence
  chemically synthesized
aatccaagaaattacaattt

SEQ ID NO: 51028 - DNA, 20 bp, Artificial Sequence
  chemically synthesized
ataacaataaccaataaaca

SEQ ID NO: 51029 - DNA, 20 bp, Artificial Sequence
  chemically synthesized
cattttatttacataaataa

SEQ ID NO: 51030 - DNA, 20 bp, Artificial Sequence
  chemically synthesized
ttatttacataaataaaaga

SEQ ID NO: 51031 - DNA, 20 bp, Artificial Sequence
  chemically synthesized
tatttacataaataaaagat

SEQ ID NO: 51032 - DNA, 20 bp, Artificial Sequence
  chemically synthesized
tgtcacacaatttaaaaatc

SEQ ID NO: 51033 - DNA, 20 bp, Artificial Sequence
  chemically synthesized
gtcacacaatttaaaaatct

SEQ ID NO: 51034 - DNA, 20 bp, Artificial Sequence
  chemically synthesized
tcacacaatttaaaaatcta

SEQ ID NO: 51035 - DNA, 20 bp, Artificial Sequence
  chemically synthesized
atttaaaaatctagggtcga

SEQ ID NO: 51036 - DNA, 20 bp, Artificial Sequence
  chemically synthesized
aaatctagggtcgaaagcca

SEQ ID NO: 51037 - DNA, 20 bp, Artificial Sequence
  chemically synthesized
tagggtcgaaagccacagca

SEQ ID NO: 51038 - DNA, 20 bp, Artificial Sequence
  chemically synthesized
agggtcgaaagccacagcaa

SEQ ID NO: 51039 - DNA, 20 bp, Artificial Sequence
  chemically synthesized
ccacagcaaaggcaacctcc

SEQ ID NO: 51040 - DNA, 20 bp, Artificial Sequence
  chemically synthesized
ctcctggcactatatcacaa

SEQ ID NO: 51041 - DNA, 20 bp, Artificial Sequence
  chemically synthesized
cacaatagatgacacctgca

SEQ ID NO: 51042 - DNA, 20 bp, Artificial Sequence
  chemically synthesized
caatagatgacacctgcata

SEQ ID NO: 51043 - DNA, 20 bp, Artificial Sequence
  chemically synthesized
agatgacacctgcatagaga

SEQ ID NO: 51044 - DNA, 20 bp, Artificial Sequence
  chemically synthesized
acacctgcatagagaaagca

SEQ ID NO: 51045 - DNA, 20 bp, Artificial Sequence
  chemically synthesized
cctgcatagagaaagcaaag

SEQ ID NO: 51046 - DNA, 20 bp, Artificial Sequence
  chemically synthesized
agaaagcaaagtggtcatgt

SEQ ID NO: 51047 - DNA, 20 bp, Artificial Sequence
  chemically synthesized
attgcctcaaataatccctg

SEQ ID NO: 51048 - DNA, 20 bp, Artificial Sequence
  chemically synthesized
ttgcctcaaataatccctgt

SEQ ID NO: 51049 - DNA, 20 bp, Artificial Sequence
  chemically synthesized
tgcctcaaataatccctgtg

SEQ ID NO: 51050 - DNA, 20 bp, Artificial Sequence
  chemically synthesized
tctactcttttgtattccat

SEQ ID NO: 51051 - DNA, 20 bp, Artificial Sequence
  chemically synthesized
tattccatcagcttttttcc

SEQ ID NO: 51052 - DNA, 20 bp, Artificial Sequence
  chemically synthesized
ttcccagtaacaacacatcc

SEQ ID NO: 51053 - DNA, 20 bp, Artificial Sequence
  chemically synthesized
cctagcaataatatcctgac

SEQ ID NO: 51054 - DNA, 20 bp, Artificial Sequence
  chemically synthesized
aaaaaaaaaactcccctcct

SEQ ID NO: 51055 - DNA, 20 bp, Artificial Sequence
  chemically synthesized
aaaactcccctcctaagata

SEQ ID NO: 51056 - DNA, 20 bp, Artificial Sequence
  chemically synthesized
cctaagatacagtatctttg

SEQ ID NO: 51057 - DNA, 20 bp, Artificial Sequence
  chemically synthesized
tatctttgtggttgcatccc

SEQ ID NO: 51058 - DNA, 20 bp, Artificial Sequence
  chemically synthesized
atccccagccatccctcatt

SEQ ID NO: 51059 - DNA, 20 bp, Artificial Sequence
  chemically synthesized
cagccatccctcatttggtt

SEQ ID NO: 51060 - DNA, 20 bp, Artificial Sequence
  chemically synthesized
agccatccctcatttggttg

SEQ ID NO: 51061 - DNA, 20 bp, Artificial Sequence
  chemically synthesized
atccctcatttggttgaggt

SEQ ID NO: 51062 - DNA, 20 bp, Artificial Sequence
  chemically synthesized
ggttgaggttggaatttcaa

SEQ ID NO: 51063 - DNA, 20 bp, Artificial Sequence
  chemically synthesized
gttgaggttggaatttcaat

SEQ ID NO: 51064 - DNA, 20 bp, Artificial Sequence
  chemically synthesized
gaggttggaatttcaatggg

SEQ ID NO: 51065 - DNA, 20 bp, Artificial Sequence
  chemically synthesized
aggttggaatttcaatgggt

SEQ ID NO: 51066 - DNA, 20 bp, Artificial Sequence
  chemically synthesized
ttccctaaacaaacttgcca

SEQ ID NO: 51067 - DNA, 20 bp, Artificial Sequence
  chemically synthesized
aaacttgccatggtaaaatc

SEQ ID NO: 51068 - DNA, 20 bp, Artificial Sequence
  chemically synthesized
aacttgccatggtaaaatca

SEQ ID NO: 51069 - DNA, 20 bp, Artificial Sequence
  chemically synthesized
tgccatggtaaaatcaaggc

SEQ ID NO: 51070 - DNA, 20 bp, Artificial Sequence
  chemically synthesized
gctagcattactgttcacac

SEQ ID NO: 51071 - DNA, 20 bp, Artificial Sequence
  chemically synthesized
ctagcattactgttcacaca

SEQ ID NO: 51072 - DNA, 20 bp, Artificial Sequence
  chemically synthesized
ttcacacaaggcactgtgct

SEQ ID NO: 51073 - DNA, 20 bp, Artificial Sequence
  chemically synthesized
tgctaagatccccatcctta

SEQ ID NO: 51074 - DNA, 20 bp, Artificial Sequence
  chemically synthesized
gatccccatccttatagcaa

SEQ ID NO: 51075 - DNA, 20 bp, Artificial Sequence
  chemically synthesized
atccccatccttatagcaat

SEQ ID NO: 51076 - DNA, 20 bp, Artificial Sequence
  chemically synthesized
ccccatccttatagcaatgg

SEQ ID NO: 51077 - DNA, 20 bp, Artificial Sequence
  chemically synthesized
cccatccttatagcaatggg

SEQ ID NO: 51078 - DNA, 20 bp, Artificial Sequence
  chemically synthesized
ccatccttatagcaatggga

SEQ ID NO: 51079 - DNA, 20 bp, Artificial Sequence
  chemically synthesized
tatagcaatgggagggctca

SEQ ID NO: 51080 - DNA, 20 bp, Artificial Sequence
  chemically synthesized
atagcaatgggagggctcat

SEQ ID NO: 51081 - DNA, 20 bp, Artificial Sequence
  chemically synthesized
caatgggagggctcataggc

SEQ ID NO: 51082 - DNA, 20 bp, Artificial Sequence
  chemically synthesized
cataggcaagtcatgtcatg

SEQ ID NO: 51083 - DNA, 20 bp, Artificial Sequence
  chemically synthesized
taggcaagtcatgtcatgca

SEQ ID NO: 51084 - DNA, 20 bp, Artificial Sequence
  chemically synthesized
aggcaagtcatgtcatgcag

SEQ ID NO: 51085 - DNA, 20 bp, Artificial Sequence
  chemically synthesized
tcatcatcccttcttgtctt

SEQ ID NO: 51086 - DNA, 20 bp, Artificial Sequence
  chemically synthesized
catcatcccttcttgtcttt

SEQ ID NO: 51087 - DNA, 20 bp, Artificial Sequence
  chemically synthesized
atcatcccttcttgtctttg

SEQ ID NO: 51088 - DNA, 20 bp, Artificial Sequence
  chemically synthesized
ccttcttgtctttggggact

SEQ ID NO: 51089 - DNA, 20 bp, Artificial Sequence
  chemically synthesized
cttcttgtctttggggactt

SEQ ID NO: 51090 - DNA, 20 bp, Artificial Sequence
  chemically synthesized
tttggggacttgggtctctc

SEQ ID NO: 51091 - DNA, 20 bp, Artificial Sequence
  chemically synthesized
cttgggtctctccggttgta

SEQ ID NO: 51092 - DNA, 20 bp, Artificial Sequence
  chemically synthesized
ttgggtctctccggttgtat

SEQ ID NO: 51093 - DNA, 20 bp, Artificial Sequence
  chemically synthesized
gggtctctccggttgtatag

SEQ ID NO: 51094 - DNA, 20 bp, Artificial Sequence
  chemically synthesized
ggttgtataggagatttcgc

SEQ ID NO: 51095 - DNA, 20 bp, Artificial Sequence
  chemically synthesized
gttgtataggagatttcgcc

SEQ ID NO: 51096 - DNA, 20 bp, Artificial Sequence
  chemically synthesized
gcatttgaatccttcactgc

SEQ ID NO: 51097 - DNA, 20 bp, Artificial Sequence
  chemically synthesized
tccttcactgctagtcatcc

SEQ ID NO: 51098 - DNA, 20 bp, Artificial Sequence
  chemically synthesized
gctagtcatcctggactctg

SEQ ID NO: 51099 - DNA, 20 bp, Artificial Sequence
  chemically synthesized
atccatctctcctatgttct

SEQ ID NO: 51100 - DNA, 20 bp, Artificial Sequence
  chemically synthesized
tccatctctcctatgttctg

SEQ ID NO: 51101 - DNA, 20 bp, Artificial Sequence
  chemically synthesized
tctctcctatgttctgaggt

SEQ ID NO: 51102 - DNA, 20 bp, Artificial Sequence
  chemically synthesized
agaatgacctctctcttaac

SEQ ID NO: 51103 - DNA, 20 bp, Artificial Sequence
  chemically synthesized
ctctctcttaaccagttgtc

SEQ ID NO: 51104 - DNA, 20 bp, Artificial Sequence
  chemically synthesized
tctctcttaaccagttgtct

SEQ ID NO: 51105 - DNA, 20 bp, Artificial Sequence
  chemically synthesized
cttaaccagttgtctgggcc

SEQ ID NO: 51106 - DNA, 20 bp, Artificial Sequence
  chemically synthesized
ttaaccagttgtctgggccc

SEQ ID NO: 51107 - DNA, 20 bp, Artificial Sequence
  chemically synthesized
cccaggctccattattgata

SEQ ID NO: 51108 - DNA, 20 bp, Artificial Sequence
  chemically synthesized
atagtcatgatctcctctgt

SEQ ID NO: 51109 - DNA, 20 bp, Artificial Sequence
  chemically synthesized
tagtcatgatctcctctgtt

SEQ ID NO: 51110 - DNA, 20 bp, Artificial Sequence
  chemically synthesized
agtcatgatctcctctgttg

SEQ ID NO: 51111 - DNA, 20 bp, Artificial Sequence
  chemically synthesized
gatctcctctgttggggatg

SEQ ID NO: 51112 - DNA, 20 bp, Artificial Sequence
  chemically synthesized
ctcctctgttggggatgaag

SEQ ID NO: 51113 - DNA, 20 bp, Artificial Sequence
  chemically synthesized
tcctctgttggggatgaagt

SEQ ID NO: 51114 - DNA, 20 bp, Artificial Sequence
  chemically synthesized
gggatgaagtaggcaaattt

SEQ ID NO: 51115 - DNA, 20 bp, Artificial Sequence
  chemically synthesized
ggatgaagtaggcaaatttg

SEQ ID NO: 51116 - DNA, 20 bp, Artificial Sequence
  chemically synthesized
tctcacattcttttcttgaa

SEQ ID NO: 51117 - DNA, 20 bp, Artificial Sequence
  chemically synthesized
acattcttttcttgaacaga

SEQ ID NO: 51118 - DNA, 20 bp, Artificial Sequence
  chemically synthesized
tcttttcttgaacagaaaga

SEQ ID NO: 51119 - DNA, 20 bp, Artificial Sequence
  chemically synthesized
cttgaacagaaagatagaac

SEQ ID NO: 51120 - DNA, 20 bp, Artificial Sequence
  chemically synthesized
aagatagaactggaaattaa

SEQ ID NO: 51121 - DNA, 20 bp, Artificial Sequence
  chemically synthesized
atagaactggaaattaatag

SEQ ID NO: 51122 - DNA, 20 bp, Artificial Sequence
  chemically synthesized
agtatataaattcaaaattt

SEQ ID NO: 51123 - DNA, 20 bp, Artificial Sequence
  chemically synthesized
tagctttaataacatttaat

SEQ ID NO: 51124 - DNA, 20 bp, Artificial Sequence
  chemically synthesized
taatcagacataaataatta

SEQ ID NO: 51125 - DNA, 20 bp, Artificial Sequence
  chemically synthesized
gaatttcaataaataaattt

SEQ ID NO: 51126 - DNA, 20 bp, Artificial Sequence
  chemically synthesized
ataaattttagttctaatat

SEQ ID NO: 51127 - DNA, 20 bp, Artificial Sequence
  chemically synthesized
taatattcatactttttctg

SEQ ID NO: 51128 - DNA, 20 bp, Artificial Sequence
  chemically synthesized
aatattcatactttttctga

SEQ ID NO: 51129 - DNA, 20 bp, Artificial Sequence
  chemically synthesized
aaggctttactaatttgata

SEQ ID NO: 51130 - DNA, 20 bp, Artificial Sequence
  chemically synthesized
actattcttattccactgtg

SEQ ID NO: 51131 - DNA, 20 bp, Artificial Sequence
  chemically synthesized
ttattccactgtgtggtgat

SEQ ID NO: 51132 - DNA, 20 bp, Artificial Sequence
  chemically synthesized
tccactgtgtggtgatgaga

SEQ ID NO: 51133 - DNA, 20 bp, Artificial Sequence
  chemically synthesized
ctgtgtggtgatgagaaagt

SEQ ID NO: 51134 - DNA, 20 bp, Artificial Sequence
  chemically synthesized
gtgtggtgatgagaaagtga

SEQ ID NO: 51135 - DNA, 20 bp, Artificial Sequence
  chemically synthesized
tgagaaagtgagagatgttc

SEQ ID NO: 51136 - DNA, 20 bp, Artificial Sequence
  chemically synthesized
agaaagtgagagatgttctg

SEQ ID NO: 51137 - DNA, 20 bp, Artificial Sequence
  chemically synthesized
agtgagagatgttctggaga

SEQ ID NO: 51138 - DNA, 20 bp, Artificial Sequence
  chemically synthesized
tgttctggagatggtgatta

SEQ ID NO: 51139 - DNA, 20 bp, Artificial Sequence
  chemically synthesized
ctggagatggtgattataga

SEQ ID NO: 51140 - DNA, 20 bp, Artificial Sequence
  chemically synthesized
gattatagatagcttccctg

SEQ ID NO: 51141 - DNA, 20 bp, Artificial Sequence
  chemically synthesized
agatagcttccctgaagcca

SEQ ID NO: 51142 - DNA, 20 bp, Artificial Sequence
  chemically synthesized
ctgaagccatagtaaccccc

SEQ ID NO: 51143 - DNA, 20 bp, Artificial Sequence
  chemically synthesized
gaagccatagtaaccccctg

SEQ ID NO: 51144 - DNA, 20 bp, Artificial Sequence
  chemically synthesized
gtaaccccctggagaaaaat

SEQ ID NO: 51145 - DNA, 20 bp, Artificial Sequence
  chemically synthesized
ccctggagaaaaattggacc

SEQ ID NO: 51146 - DNA, 20 bp, Artificial Sequence
  chemically synthesized
ctggagaaaaattggacctg

SEQ ID NO: 51147 - DNA, 20 bp, Artificial Sequence
  chemically synthesized
gaaaaattggacctggagtc

SEQ ID NO: 51148 - DNA, 20 bp, Artificial Sequence
  chemically synthesized
aaattggacctggagtctag

SEQ ID NO: 51149 - DNA, 20 bp, Artificial Sequence
  chemically synthesized
ggacctggagtctagcagcc

SEQ ID NO: 51150 - DNA, 20 bp, Artificial Sequence
  chemically synthesized
gacctggagtctagcagcct

SEQ ID NO: 51151 - DNA, 20 bp, Artificial Sequence
  chemically synthesized
ggagtctagcagcctaggta

SEQ ID NO: 51152 - DNA, 20 bp, Artificial Sequence
  chemically synthesized
gagtctagcagcctaggtat

SEQ ID NO: 51153 - DNA, 20 bp, Artificial Sequence
  chemically synthesized
ggtatgggtactcgatttct

SEQ ID NO: 51154 - DNA, 20 bp, Artificial Sequence
  chemically synthesized
tgggtactcgatttcttaga

SEQ ID NO: 51155 - DNA, 20 bp, Artificial Sequence
  chemically synthesized
atttcctttatcttaaaaat

SEQ ID NO: 51156 - DNA, 20 bp, Artificial Sequence
  chemically synthesized
tttcctttatcttaaaaata

SEQ ID NO: 51157 - DNA, 20 bp, Artificial Sequence
  chemically synthesized
ttcctttatcttaaaaataa

SEQ ID NO: 51158 - DNA, 20 bp, Artificial Sequence
  chemically synthesized
tcttaaaaataagggtattg

SEQ ID NO: 51159 - DNA, 20 bp, Artificial Sequence
  chemically synthesized
taaaaataagggtattgaag

SEQ ID NO: 51160 - DNA, 20 bp, Artificial Sequence
  chemically synthesized
agggtattgaagtagaattc

SEQ ID NO: 51161 - DNA, 20 bp, Artificial Sequence
  chemically synthesized
aagtagaattctagaatttt

SEQ ID NO: 51162 - DNA, 20 bp, Artificial Sequence
  chemically synthesized
gtagaattctagaattttca

SEQ ID NO: 51163 - DNA, 20 bp, Artificial Sequence
  chemically synthesized
tagaattctagaattttcag

SEQ ID NO: 51164 - DNA, 20 bp, Artificial Sequence
  chemically synthesized
acaacttaaaatatgtgtaa

SEQ ID NO: 51165 - DNA, 20 bp, Artificial Sequence
  chemically synthesized
ctgttcattttaatatattt

SEQ ID NO: 51166 - DNA, 20 bp, Artificial Sequence
  chemically synthesized
tgttcattttaatatattta

SEQ ID NO: 51167 - DNA, 20 bp, Artificial Sequence
  chemically synthesized
ttaaggatgaattttttaaa

SEQ ID NO: 51168 - DNA, 20 bp, Artificial Sequence
  chemically synthesized
aaaagttgatttcataaaaa

SEQ ID NO: 51169 - DNA, 20 bp, Artificial Sequence
  chemically synthesized
aaagttgatttcataaaaac

SEQ ID NO: 51170 - DNA, 20 bp, Artificial Sequence
  chemically synthesized
tgatttcataaaaacgggaa

SEQ ID NO: 51171 - DNA, 20 bp, Artificial Sequence
  chemically synthesized
ttcataaaaacgggaataga

SEQ ID NO: 51172 - DNA, 20 bp, Artificial Sequence
  chemically synthesized
taaaaacgggaatagaaaga

SEQ ID NO: 51173 - DNA, 20 bp, Artificial Sequence
  chemically synthesized
ggaatagaaagatggttcca

SEQ ID NO: 51174 - DNA, 20 bp, Artificial Sequence
  chemically synthesized
gaatagaaagatggttccat

SEQ ID NO: 51175 - DNA, 20 bp, Artificial Sequence
  chemically synthesized
gatggttccataggctgact

SEQ ID NO: 51176 - DNA, 20 bp, Artificial Sequence
  chemically synthesized
tggttccataggctgactga

SEQ ID NO: 51177 - DNA, 20 bp, Artificial Sequence
  chemically synthesized
ccataggctgactgagagtg

SEQ ID NO: 51178 - DNA, 20 bp, Artificial Sequence
  chemically synthesized
ataggctgactgagagtgta

SEQ ID NO: 51179 - DNA, 20 bp, Artificial Sequence
  chemically synthesized
taggctgactgagagtgtag

SEQ ID NO: 51180 - DNA, 20 bp, Artificial Sequence
  chemically synthesized
ggctgactgagagtgtagag

SEQ ID NO: 51181 - DNA, 20 bp, Artificial Sequence
  chemically synthesized
gctgactgagagtgtagagg

SEQ ID NO: 51182 - DNA, 20 bp, Artificial Sequence
  chemically synthesized
ctgactgagagtgtagagga

SEQ ID NO: 51183 - DNA, 20 bp, Artificial Sequence
  chemically synthesized
ctgagagtgtagaggaggga

SEQ ID NO: 51184 - DNA, 20 bp, Artificial Sequence
  chemically synthesized
tgagagtgtagaggagggat

SEQ ID NO: 51185 - DNA, 20 bp, Artificial Sequence
  chemically synthesized
gagtgtagaggagggatggg

SEQ ID NO: 51186 - DNA, 20 bp, Artificial Sequence
  chemically synthesized
agtgtagaggagggatggga

SEQ ID NO: 51187 - DNA, 20 bp, Artificial Sequence
  chemically synthesized
gtgtagaggagggatgggaa

SEQ ID NO: 51188 - DNA, 20 bp, Artificial Sequence
  chemically synthesized
agaggagggatgggaaggga

SEQ ID NO: 51189 - DNA, 20 bp, Artificial Sequence
  chemically synthesized
ggagggatgggaagggaaag

SEQ ID NO: 51190 - DNA, 20 bp, Artificial Sequence
  chemically synthesized
aagggaaagaagttgatctt

SEQ ID NO: 51191 - DNA, 20 bp, Artificial Sequence
  chemically synthesized
gaaagaagttgatcttcagt

SEQ ID NO: 51192 - DNA, 20 bp, Artificial Sequence
  chemically synthesized
aagttgatcttcagttagac

SEQ ID NO: 51193 - DNA, 20 bp, Artificial Sequence
  chemically synthesized
gttgatcttcagttagacta

SEQ ID NO: 51194 - DNA, 20 bp, Artificial Sequence
  chemically synthesized
ttgatcttcagttagactag

SEQ ID NO: 51195 - DNA, 20 bp, Artificial Sequence
  chemically synthesized
ttcagttagactagaggaat

SEQ ID NO: 51196 - DNA, 20 bp, Artificial Sequence
  chemically synthesized
tagactagaggaataagttt

SEQ ID NO: 51197 - DNA, 20 bp, Artificial Sequence
  chemically synthesized
tagtgatctctcacactgca

SEQ ID NO: 51198 - DNA, 20 bp, Artificial Sequence
  chemically synthesized
ctcacactgcatagtgaaca

SEQ ID NO: 51199 - DNA, 20 bp, Artificial Sequence
  chemically synthesized
ttatgttctcaccacaaaaa

SEQ ID NO: 51200 - DNA, 20 bp, Artificial Sequence
  chemically synthesized
gttctcaccacaaaaaaagt

SEQ ID NO: 51201 - DNA, 20 bp, Artificial Sequence
  chemically synthesized
ctcaccacaaaaaaagttgg

SEQ ID NO: 51202 - DNA, 20 bp, Artificial Sequence
  chemically synthesized
tcaccacaaaaaaagttgga

SEQ ID NO: 51203 - DNA, 20 bp, Artificial Sequence
  chemically synthesized
aaggtgattcatatgctaat

SEQ ID NO: 51204 - DNA, 20 bp, Artificial Sequence
  chemically synthesized
tcatatgctaattagcttga

SEQ ID NO: 51205 - DNA, 20 bp, Artificial Sequence
  chemically synthesized
ctctctctacaatgtatata

SEQ ID NO: 51206 - DNA, 20 bp, Artificial Sequence
  chemically synthesized
tatatgcacttattatttgc

SEQ ID NO: 51207 - DNA, 20 bp, Artificial Sequence
  chemically synthesized
atatgcacttattatttgcc

SEQ ID NO: 51208 - DNA, 20 bp, Artificial Sequence
  chemically synthesized
cctccttttacttttctgct

SEQ ID NO: 51209 - DNA, 20 bp, Artificial Sequence
  chemically synthesized
cttggttttcttctttcatt

SEQ ID NO: 51210 - DNA, 20 bp, Artificial Sequence
  chemically synthesized
ttctttcattcagtgtttac

SEQ ID NO: 51211 - DNA, 20 bp, Artificial Sequence
  chemically synthesized
cagtgtttaccagtttctta

SEQ ID NO: 51212 - DNA, 20 bp, Artificial Sequence
  chemically synthesized
cttatagttaattttatttt

SEQ ID NO: 51213 - DNA, 20 bp, Artificial Sequence
  chemically synthesized
aagctgtctcacattttctg

SEQ ID NO: 51214 - DNA, 20 bp, Artificial Sequence
  chemically synthesized
gtctcacattttctgaagaa

SEQ ID NO: 51215 - DNA, 20 bp, Artificial Sequence
  chemically synthesized
tctcacattttctgaagaaa

SEQ ID NO: 51216 - DNA, 20 bp, Artificial Sequence
  chemically synthesized
ctcacattttctgaagaaaa

SEQ ID NO: 51217 - DNA, 20 bp, Artificial Sequence
  chemically synthesized
gaagaaaagggaacatatta

SEQ ID NO: 51218 - DNA, 20 bp, Artificial Sequence
  chemically synthesized
acaaatacactatcttgcat

SEQ ID NO: 51219 - DNA, 20 bp, Artificial Sequence
  chemically synthesized
gcatgagatgatttatgtca

SEQ ID NO: 51220 - DNA, 20 bp, Artificial Sequence
  chemically synthesized
tcttataaaaacttctcaaa

SEQ ID NO: 51221 - DNA, 20 bp, Artificial Sequence
  chemically synthesized
ataaaaacttctcaaatggt

SEQ ID NO: 51222 - DNA, 20 bp, Artificial Sequence
  chemically synthesized
aaacttctcaaatggttaga

SEQ ID NO: 51223 - DNA, 20 bp, Artificial Sequence
  chemically synthesized
ctcaaatggttagatggcta

SEQ ID NO: 51224 - DNA, 20 bp, Artificial Sequence
  chemically synthesized
gttagatggctacagttgaa

SEQ ID NO: 51225 - DNA, 20 bp, Artificial Sequence
  chemically synthesized
gatggctacagttgaacaga

SEQ ID NO: 51226 - DNA, 20 bp, Artificial Sequence
  chemically synthesized
atattttttataatgcttct

SEQ ID NO: 51227 - DNA, 20 bp, Artificial Sequence
  chemically synthesized
tattttttataatgcttcta

SEQ ID NO: 51228 - DNA, 20 bp, Artificial Sequence
  chemically synthesized
tttataatgcttctaaggta

SEQ ID NO: 51229 - DNA, 20 bp, Artificial Sequence
  chemically synthesized
ctaatttttaaaaaatattt

SEQ ID NO: 51230 - DNA, 20 bp, Artificial Sequence
  chemically synthesized
aaaaaatattttagtaatga

SEQ ID NO: 51231 - DNA, 20 bp, Artificial Sequence
  chemically synthesized
aaaaatattttagtaatgat

SEQ ID NO: 51232 - DNA, 20 bp, Artificial Sequence
  chemically synthesized
aatgatgggaatattattta

SEQ ID NO: 51233 - DNA, 20 bp, Artificial Sequence
  chemically synthesized
atataatgaaatatgtaata

SEQ ID NO: 51234 - DNA, 20 bp, Artificial Sequence
  chemically synthesized
atgaaatatgtaataaagtc

SEQ ID NO: 51235 - DNA, 20 bp, Artificial Sequence
  chemically synthesized
tataatatataataaatata

SEQ ID NO: 51236 - DNA, 20 bp, Artificial Sequence
  chemically synthesized
tgtatctatatatgtttata

SEQ ID NO: 51237 - DNA, 20 bp, Artificial Sequence
  chemically synthesized
tataaagtcattcctctaat

SEQ ID NO: 51238 - DNA, 20 bp, Artificial Sequence
  chemically synthesized
ataaagtcattcctctaatt

SEQ ID NO: 51239 - DNA, 20 bp, Artificial Sequence
  chemically synthesized
ctaattaggtcataaccatt

SEQ ID NO: 51240 - DNA, 20 bp, Artificial Sequence
  chemically synthesized
taattaggtcataaccattc

SEQ ID NO: 51241 - DNA, 20 bp, Artificial Sequence
  chemically synthesized
tcataaccattcaggtaaac

SEQ ID NO: 51242 - DNA, 20 bp, Artificial Sequence
  chemically synthesized
ttcaggtaaactggaaattt

SEQ ID NO: 51243 - DNA, 20 bp, Artificial Sequence
  chemically synthesized
ctggaaatttaagcctactt

SEQ ID NO: 51244 - DNA, 20 bp, Artificial Sequence
  chemically synthesized
tggaaatttaagcctacttc

SEQ ID NO: 51245 - DNA, 20 bp, Artificial Sequence
  chemically synthesized
ttaagcctacttcaggtttg

SEQ ID NO: 51246 - DNA, 20 bp, Artificial Sequence
  chemically synthesized
tacttcaggtttgtggtaaa

SEQ ID NO: 51247 - DNA, 20 bp, Artificial Sequence
  chemically synthesized
taaatagattctctctgaac

SEQ ID NO: 51248 - DNA, 20 bp, Artificial Sequence
  chemically synthesized
tctctctgaactagcatatt

SEQ ID NO: 51249 - DNA, 20 bp, Artificial Sequence
  chemically synthesized
gcatattcagaatcattaaa

SEQ ID NO: 51250 - DNA, 20 bp, Artificial Sequence
  chemically synthesized
attcagaatcattaaacagt

SEQ ID NO: 51251 - DNA, 20 bp, Artificial Sequence
  chemically synthesized
tcattaaacagtcagttctt

SEQ ID NO: 51252 - DNA, 20 bp, Artificial Sequence
  chemically synthesized
aaacagtcagttctttggac

SEQ ID NO: 51253 - DNA, 20 bp, Artificial Sequence
  chemically synthesized
agttctttggacaagtctta

SEQ ID NO: 51254 - DNA, 20 bp, Artificial Sequence
  chemically synthesized
atagaatgttcttacctctt

SEQ ID NO: 51255 - DNA, 20 bp, Artificial Sequence
  chemically synthesized
cttacctcttcagccatccc

SEQ ID NO: 51256 - DNA, 20 bp, Artificial Sequence
  chemically synthesized
tcagccatcccaagactctt

SEQ ID NO: 51257 - DNA, 20 bp, Artificial Sequence
  chemically synthesized
cagccatcccaagactcttg

SEQ ID NO: 51258 - DNA, 20 bp, Artificial Sequence
  chemically synthesized
agccatcccaagactcttga

SEQ ID NO: 51259 - DNA, 20 bp, Artificial Sequence
  chemically synthesized
gcctgacctcgcttacacta

SEQ ID NO: 51260 - DNA, 20 bp, Artificial Sequence
  chemically synthesized
tgacctcgcttacactaaag

SEQ ID NO: 51261 - DNA, 20 bp, Artificial Sequence
  chemically synthesized
atctgccttatgcatcactg

SEQ ID NO: 51262 - DNA, 20 bp, Artificial Sequence
  chemically synthesized
tgccttatgcatcactgaag

SEQ ID NO: 51263 - DNA, 20 bp, Artificial Sequence
  chemically synthesized
gccttatgcatcactgaagt

SEQ ID NO: 51264 - DNA, 20 bp, Artificial Sequence
  chemically synthesized
ccttatgcatcactgaagta

SEQ ID NO: 51265 - DNA, 20 bp, Artificial Sequence
  chemically synthesized
ttatgcatcactgaagtagg

SEQ ID NO: 51266 - DNA, 20 bp, Artificial Sequence
  chemically synthesized
tatgcatcactgaagtaggg

SEQ ID NO: 51267 - DNA, 20 bp, Artificial Sequence
  chemically synthesized
atgcatcactgaagtaggga

SEQ ID NO: 51268 - DNA, 20 bp, Artificial Sequence
  chemically synthesized
catcactgaagtagggaggg

SEQ ID NO: 51269 - DNA, 20 bp, Artificial Sequence
  chemically synthesized
actgaagtagggagggaaga

SEQ ID NO: 51270 - DNA, 20 bp, Artificial Sequence
  chemically synthesized
gatgaactacttctgacccc

SEQ ID NO: 51271 - DNA, 20 bp, Artificial Sequence
  chemically synthesized
gaactacttctgacccctag

SEQ ID NO: 51272 - DNA, 20 bp, Artificial Sequence
  chemically synthesized
ttctgacccctagtggtgtc

SEQ ID NO: 51273 - DNA, 20 bp, Artificial Sequence
  chemically synthesized
acccctagtggtgtccagaa

SEQ ID NO: 51274 - DNA, 20 bp, Artificial Sequence
  chemically synthesized
gtgtccagaaaagaccatta

SEQ ID NO: 51275 - DNA, 20 bp, Artificial Sequence
  chemically synthesized
tgtccagaaaagaccattaa

SEQ ID NO: 51276 - DNA, 20 bp, Artificial Sequence
  chemically synthesized
cattaaaggaatgaccttta

SEQ ID NO: 51277 - DNA, 20 bp, Artificial Sequence
  chemically synthesized
attaaaggaatgacctttaa

SEQ ID NO: 51278 - DNA, 20 bp, Artificial Sequence
  chemically synthesized
aaggaatgacctttaaagga

SEQ ID NO: 51279 - DNA, 20 bp, Artificial Sequence
  chemically synthesized
ggacatacaattttttgtcc

SEQ ID NO: 51280 - DNA, 20 bp, Artificial Sequence
  chemically synthesized
gacatacaattttttgtcca

SEQ ID NO: 51281 - DNA, 20 bp, Artificial Sequence
  chemically synthesized
atacaattttttgtccaagg

SEQ ID NO: 51282 - DNA, 20 bp, Artificial Sequence
  chemically synthesized
tacaattttttgtccaaggc

SEQ ID NO: 51283 - DNA, 20 bp, Artificial Sequence
  chemically synthesized
tgtccaaggcaggacatgtg

SEQ ID NO: 51284 - DNA, 20 bp, Artificial Sequence
  chemically synthesized
gtccaaggcaggacatgtgt

SEQ ID NO: 51285 - DNA, 20 bp, Artificial Sequence
  chemically synthesized
ggacatgtgtgggtgtcttt

SEQ ID NO: 51286 - DNA, 20 bp, Artificial Sequence
  chemically synthesized
tctttcagtaattatgttct

SEQ ID NO: 51287 - DNA, 20 bp, Artificial Sequence
  chemically synthesized
cagtaattatgttctaagaa

SEQ ID NO: 51288 - DNA, 20 bp, Artificial Sequence
  chemically synthesized
cagcaaaaactccactgcct

SEQ ID NO: 51289 - DNA, 20 bp, Artificial Sequence
  chemically synthesized
aactccactgccttggcaaa

SEQ ID NO: 51290 - DNA, 20 bp, Artificial Sequence
  chemically synthesized
actccactgccttggcaaat

SEQ ID NO: 51291 - DNA, 20 bp, Artificial Sequence
  chemically synthesized
cttggcaaataggaatgttt

SEQ ID NO: 51292 - DNA, 20 bp, Artificial Sequence
  chemically synthesized
ataggaatgttttagttcta

SEQ ID NO: 51293 - DNA, 20 bp, Artificial Sequence
  chemically synthesized
tttagttctatagaattata

SEQ ID NO: 51294 - DNA, 20 bp, Artificial Sequence
  chemically synthesized
agttctatagaattataaag

SEQ ID NO: 51295 - DNA, 20 bp, Artificial Sequence
  chemically synthesized
atatactttctctatgtctt

SEQ ID NO: 51296 - DNA, 20 bp, Artificial Sequence
  chemically synthesized
gtctttggaacaatgactat

SEQ ID NO: 51297 - DNA, 20 bp, Artificial Sequence
  chemically synthesized
ttggtcattaccctatttta

SEQ ID NO: 51298 - DNA, 20 bp, Artificial Sequence
  chemically synthesized
tcattaccctattttaaagt

SEQ ID NO: 51299 - DNA, 20 bp, Artificial Sequence
  chemically synthesized
taccctattttaaagtaagc

SEQ ID NO: 51300 - DNA, 20 bp, Artificial Sequence
  chemically synthesized
aaagtaagcaagtaatcaca

SEQ ID NO: 51301 - DNA, 20 bp, Artificial Sequence
  chemically synthesized
aagtaagcaagtaatcacac

SEQ ID NO: 51302 - DNA, 20 bp, Artificial Sequence
  chemically synthesized
agtaagcaagtaatcacaca

SEQ ID NO: 51303 - DNA, 20 bp, Artificial Sequence
  chemically synthesized
acacagggaattattctgaa

SEQ ID NO: 51304 - DNA, 20 bp, Artificial Sequence
  chemically synthesized
agggaattattctgaaaaga

SEQ ID NO: 51305 - DNA, 20 bp, Artificial Sequence
  chemically synthesized
acagaaaaaaaaaaaaaacc

SEQ ID NO: 51306 - DNA, 20 bp, Artificial Sequence
  chemically synthesized
agaaaaaaaaaaaaaaccaa

SEQ ID NO: 51307 - DNA, 20 bp, Artificial Sequence
  chemically synthesized
ccaagagatttctgcatatg

SEQ ID NO: 51308 - DNA, 20 bp, Artificial Sequence
  chemically synthesized
caagagatttctgcatatgt

SEQ ID NO: 51309 - DNA, 20 bp, Artificial Sequence
  chemically synthesized
agatttctgcatatgtaggt

SEQ ID NO: 51310 - DNA, 20 bp, Artificial Sequence
  chemically synthesized
atatgtaggtcagttttaat

SEQ ID NO: 51311 - DNA, 20 bp, Artificial Sequence
  chemically synthesized
atgtaggtcagttttaatca

SEQ ID NO: 51312 - DNA, 20 bp, Artificial Sequence
  chemically synthesized
tgtaggtcagttttaatcag

SEQ ID NO: 51313 - DNA, 20 bp, Artificial Sequence
  chemically synthesized
gtaggtcagttttaatcaga

SEQ ID NO: 51314 - DNA, 20 bp, Artificial Sequence
  chemically synthesized
cagttttaatcagagggcat

SEQ ID NO: 51315 - DNA, 20 bp, Artificial Sequence
  chemically synthesized
ttaatcagagggcatcagaa

SEQ ID NO: 51316 - DNA, 20 bp, Artificial Sequence
  chemically synthesized
gcatcagaaaagactcctga

SEQ ID NO: 51317 - DNA, 20 bp, Artificial Sequence
  chemically synthesized
agactcctgaaagaatgacc

SEQ ID NO: 51318 - DNA, 20 bp, Artificial Sequence
  chemically synthesized
tgacctggttattataatca

SEQ ID NO: 51319 - DNA, 20 bp, Artificial Sequence
  chemically synthesized
taatcacagatttgctttcc

SEQ ID NO: 51320 - DNA, 20 bp, Artificial Sequence
  chemically synthesized
tgctttccaagtcaacattc

SEQ ID NO: 51321 - DNA, 20 bp, Artificial Sequence
  chemically synthesized
ttccaagtcaacattccaga

SEQ ID NO: 51322 - DNA, 20 bp, Artificial Sequence
  chemically synthesized
tcaacattccagacagtgct

SEQ ID NO: 51323 - DNA, 20 bp, Artificial Sequence
  chemically synthesized
aacattccagacagtgctca

SEQ ID NO: 51324 - DNA, 20 bp, Artificial Sequence
  chemically synthesized
acattccagacagtgctcag

SEQ ID NO: 51325 - DNA, 20 bp, Artificial Sequence
  chemically synthesized
cattccagacagtgctcaga

SEQ ID NO: 51326 - DNA, 20 bp, Artificial Sequence
  chemically synthesized
attccagacagtgctcagag

SEQ ID NO: 51327 - DNA, 20 bp, Artificial Sequence
  chemically synthesized
cgaaaacccttttatttctc

SEQ ID NO: 51328 - DNA, 20 bp, Artificial Sequence
  chemically synthesized
cttctctatttattttatta

SEQ ID NO: 51329 - DNA, 20 bp, Artificial Sequence
  chemically synthesized
ttctctatttattttattat

SEQ ID NO: 51330 - DNA, 20 bp, Artificial Sequence
  chemically synthesized
ttttattataggcattgttc

SEQ ID NO: 51331 - DNA, 20 bp, Artificial Sequence
  chemically synthesized
ataggcattgttctggttgc

SEQ ID NO: 51332 - DNA, 20 bp, Artificial Sequence
  chemically synthesized
taggcattgttctggttgct

SEQ ID NO: 51333 - DNA, 20 bp, Artificial Sequence
  chemically synthesized
tgttctggttgctgggaact

SEQ ID NO: 51334 - DNA, 20 bp, Artificial Sequence
  chemically synthesized
ggttgctgggaactcagact

SEQ ID NO: 51335 - DNA, 20 bp, Artificial Sequence
  chemically synthesized
agataccatacactgactct

SEQ ID NO: 51336 - DNA, 20 bp, Artificial Sequence
  chemically synthesized
accatacactgactctcaga

SEQ ID NO: 51337 - DNA, 20 bp, Artificial Sequence
  chemically synthesized
cataacacaacatgatgtct

SEQ ID NO: 51338 - DNA, 20 bp, Artificial Sequence
  chemically synthesized
atctttttgttttttaaata

SEQ ID NO: 51339 - DNA, 20 bp, Artificial Sequence
  chemically synthesized
tctttttgttttttaaatac

SEQ ID NO: 51340 - DNA, 20 bp, Artificial Sequence
  chemically synthesized
ttttgttttttaaatacagg

SEQ ID NO: 51341 - DNA, 20 bp, Artificial Sequence
  chemically synthesized
ttgttttttaaatacaggtg

SEQ ID NO: 51342 - DNA, 20 bp, Artificial Sequence
  chemically synthesized
ttaaatacaggtggagcatc

SEQ ID NO: 51343 - DNA, 20 bp, Artificial Sequence
  chemically synthesized
ctccaacatgtattttgctc

SEQ ID NO: 51344 - DNA, 20 bp, Artificial Sequence
  chemically synthesized
ttttgctctggtaatcccaa

SEQ ID NO: 51345 - DNA, 20 bp, Artificial Sequence
  chemically synthesized
tttgctctggtaatcccaaa

SEQ ID NO: 51346 - DNA, 20 bp, Artificial Sequence
  chemically synthesized
tggtaatcccaaaaggctga

SEQ ID NO: 51347 - DNA, 20 bp, Artificial Sequence
  chemically synthesized
caaaaggctgatagtctcta

SEQ ID NO: 51348 - DNA, 20 bp, Artificial Sequence
  chemically synthesized
aaggctgatagtctctatgg

SEQ ID NO: 51349 - DNA, 20 bp, Artificial Sequence
  chemically synthesized
tagtctctatggtggcaaca

SEQ ID NO: 51350 - DNA, 20 bp, Artificial Sequence
  chemically synthesized
ggataatactgttccccatc

SEQ ID NO: 51351 - DNA, 20 bp, Artificial Sequence
  chemically synthesized
aatactgttccccatctaga

SEQ ID NO: 51352 - DNA, 20 bp, Artificial Sequence
  chemically synthesized
ggtctcatttcttctgtatc

SEQ ID NO: 51353 - DNA, 20 bp, Artificial Sequence
  chemically synthesized
tttcttctgtatctagtctg

SEQ ID NO: 51354 - DNA, 20 bp, Artificial Sequence
  chemically synthesized
cttctgtatctagtctgaag

SEQ ID NO: 51355 - DNA, 20 bp, Artificial Sequence
  chemically synthesized
gtctgaagaagcctgaatga

SEQ ID NO: 51356 - DNA, 20 bp, Artificial Sequence
  chemically synthesized
tgaagaagcctgaatgaaag

SEQ ID NO: 51357 - DNA, 20 bp, Artificial Sequence
  chemically synthesized
ctgaatgaaagtagattttt

SEQ ID NO: 51358 - DNA, 20 bp, Artificial Sequence
  chemically synthesized
aagtagatttttaagctttg

SEQ ID NO: 51359 - DNA, 20 bp, Artificial Sequence
  chemically synthesized
agatttttaagctttgtagc

SEQ ID NO: 51360 - DNA, 20 bp, Artificial Sequence
  chemically synthesized
taagctttgtagctagtctg

SEQ ID NO: 51361 - DNA, 20 bp, Artificial Sequence
  chemically synthesized
tagctagtctgaagcctttg

SEQ ID NO: 51362 - DNA, 20 bp, Artificial Sequence
  chemically synthesized
tagtctgaagcctttgtagt

SEQ ID NO: 51363 - DNA, 20 bp, Artificial Sequence
  chemically synthesized
aagcctttgtagtcagtctg

SEQ ID NO: 51364 - DNA, 20 bp, Artificial Sequence
  chemically synthesized
tgaagaaacctgcatgaaaa

SEQ ID NO: 51365 - DNA, 20 bp, Artificial Sequence
  chemically synthesized
aatagattttttttttcctt

SEQ ID NO: 51366 - DNA, 20 bp, Artificial Sequence
  chemically synthesized
atagattttttttttccttt

SEQ ID NO: 51367 - DNA, 20 bp, Artificial Sequence
  chemically synthesized
attttttttttcctttggga

SEQ ID NO: 51368 - DNA, 20 bp, Artificial Sequence
  chemically synthesized
tttttttttcctttgggaca

SEQ ID NO: 51369 - DNA, 20 bp, Artificial Sequence
  chemically synthesized
cagagtcttgctctgtcgcc

SEQ ID NO: 51370 - DNA, 20 bp, Artificial Sequence
  chemically synthesized
tcttgctctgtcgcccagac

SEQ ID NO: 51371 - DNA, 20 bp, Artificial Sequence
  chemically synthesized
ttgctctgtcgcccagactg

SEQ ID NO: 51372 - DNA, 20 bp, Artificial Sequence
  chemically synthesized
tcgcccagactggagtgcaa

SEQ ID NO: 51373 - DNA, 20 bp, Artificial Sequence
  chemically synthesized
ggagtgcaatggcgcgatct

SEQ ID NO: 51374 - DNA, 20 bp, Artificial Sequence
  chemically synthesized
tcactgcaacttccacctcc

SEQ ID NO: 51375 - DNA, 20 bp, Artificial Sequence
  chemically synthesized
cactgcaacttccacctccc

SEQ ID NO: 51376 - DNA, 20 bp, Artificial Sequence
  chemically synthesized
aacttccacctcccaggatc

SEQ ID NO: 51377 - DNA, 20 bp, Artificial Sequence
  chemically synthesized
atcaagcaattctcctgcct

SEQ ID NO: 51378 - DNA, 20 bp, Artificial Sequence
  chemically synthesized
ttctcctgcctcagtctccc

SEQ ID NO: 51379 - DNA, 20 bp, Artificial Sequence
  chemically synthesized
gcctcagtctcccaagtaac

SEQ ID NO: 51380 - DNA, 20 bp, Artificial Sequence
  chemically synthesized
cctcagtctcccaagtaact

SEQ ID NO: 51381 - DNA, 20 bp, Artificial Sequence
  chemically synthesized
ctcccaagtaactgggatta

SEQ ID NO: 51382 - DNA, 20 bp, Artificial Sequence
  chemically synthesized
tcccaagtaactgggattac

SEQ ID NO: 51383 - DNA, 20 bp, Artificial Sequence
  chemically synthesized
ccaagtaactgggattacag

SEQ ID NO: 51384 - DNA, 20 bp, Artificial Sequence
  chemically synthesized
caggagcacactgccatgcc

SEQ ID NO: 51385 - DNA, 20 bp, Artificial Sequence
  chemically synthesized
agctaattatttttgtgttt

SEQ ID NO: 51386 - DNA, 20 bp, Artificial Sequence
  chemically synthesized
taattatttttgtgttttag

SEQ ID NO: 51387 - DNA, 20 bp, Artificial Sequence
  chemically synthesized
attatttttgtgttttagta

SEQ ID NO: 51388 - DNA, 20 bp, Artificial Sequence
  chemically synthesized
tttttgtgttttagtagaga

SEQ ID NO: 51389 - DNA, 20 bp, Artificial Sequence
  chemically synthesized
ttttgtgttttagtagagac

SEQ ID NO: 51390 - DNA, 20 bp, Artificial Sequence
  chemically synthesized
tttgtgttttagtagagaca

SEQ ID NO: 51391 - DNA, 20 bp, Artificial Sequence
  chemically synthesized
cagggtttcaccattttgcc

SEQ ID NO: 51392 - DNA, 20 bp, Artificial Sequence
  chemically synthesized
agggtttcaccattttgccc

SEQ ID NO: 51393 - DNA, 20 bp, Artificial Sequence
  chemically synthesized
tttcaccattttgcccaggt

SEQ ID NO: 51394 - DNA, 20 bp, Artificial Sequence
  chemically synthesized
caggttggtctccaactcct

SEQ ID NO: 51395 - DNA, 20 bp, Artificial Sequence
  chemically synthesized
tggtctccaactcctgagct

SEQ ID NO: 51396 - DNA, 20 bp, Artificial Sequence
  chemically synthesized
ctcagccaatccacctgcct

SEQ ID NO: 51397 - DNA, 20 bp, Artificial Sequence
  chemically synthesized
ccacctgcctcggcctccca

SEQ ID NO: 51398 - DNA, 20 bp, Artificial Sequence
  chemically synthesized
gcctcggcctcccaaagtgc

SEQ ID NO: 51399 - DNA, 20 bp, Artificial Sequence
  chemically synthesized
cctcggcctcccaaagtgct

SEQ ID NO: 51400 - DNA, 20 bp, Artificial Sequence
  chemically synthesized
ctcccaaagtgctaggatta

SEQ ID NO: 51401 - DNA, 20 bp, Artificial Sequence
  chemically synthesized
tcccaaagtgctaggattac

SEQ ID NO: 51402 - DNA, 20 bp, Artificial Sequence
  chemically synthesized
agtgctaggattacaggcgt

SEQ ID NO: 51403 - DNA, 20 bp, Artificial Sequence
  chemically synthesized
gattacaggcgtgagccacc

SEQ ID NO: 51404 - DNA, 20 bp, Artificial Sequence
  chemically synthesized
caggcgtgagccaccaagcc

SEQ ID NO: 51405 - DNA, 20 bp, Artificial Sequence
  chemically synthesized
gagccaccaagcctggctga

SEQ ID NO: 51406 - DNA, 20 bp, Artificial Sequence
  chemically synthesized
ccaccaagcctggctgaaag

SEQ ID NO: 51407 - DNA, 20 bp, Artificial Sequence
  chemically synthesized
ttaacacatacctacattca

SEQ ID NO: 51408 - DNA, 20 bp, Artificial Sequence
  chemically synthesized
aaatcttttgtgatcaatcc

SEQ ID NO: 51409 - DNA, 20 bp, Artificial Sequence
  chemically synthesized
agatccttgacgatatgtct

SEQ ID NO: 51410 - DNA, 20 bp, Artificial Sequence
  chemically synthesized
ccttgacgatatgtctgagt

SEQ ID NO: 51411 - DNA, 20 bp, Artificial Sequence
  chemically synthesized
cttgacgatatgtctgagtc

SEQ ID NO: 51412 - DNA, 20 bp, Artificial Sequence
  chemically synthesized
acgatatgtctgagtcaggc

SEQ ID NO: 51413 - DNA, 20 bp, Artificial Sequence
  chemically synthesized
gtctgagtcaggctggaaat

SEQ ID NO: 51414 - DNA, 20 bp, Artificial Sequence
  chemically synthesized
ctgagtcaggctggaaatga

SEQ ID NO: 51415 - DNA, 20 bp, Artificial Sequence
  chemically synthesized
agagaaatcatgtttgaaat

SEQ ID NO: 51416 - DNA, 20 bp, Artificial Sequence
  chemically synthesized
agaaatcatgtttgaaattg

SEQ ID NO: 51417 - DNA, 20 bp, Artificial Sequence
  chemically synthesized
gaaattggagtgttgtattc

SEQ ID NO: 51418 - DNA, 20 bp, Artificial Sequence
  chemically synthesized
aaattggagtgttgtattca

SEQ ID NO: 51419 - DNA, 20 bp, Artificial Sequence
  chemically synthesized
tggagtgttgtattcaaggt

SEQ ID NO: 51420 - DNA, 20 bp, Artificial Sequence
  chemically synthesized
gtgttgtattcaaggtcagc

SEQ ID NO: 51421 - DNA, 20 bp, Artificial Sequence
  chemically synthesized
ttcaaggtcagcaagatccc

SEQ ID NO: 51422 - DNA, 20 bp, Artificial Sequence
  chemically synthesized
caaggtcagcaagatccctg

SEQ ID NO: 51423 - DNA, 20 bp, Artificial Sequence
  chemically synthesized
ggtcagcaagatccctggag

SEQ ID NO: 51424 - DNA, 20 bp, Artificial Sequence
  chemically synthesized
ttttataaaccattcaaact

SEQ ID NO: 51425 - DNA, 20 bp, Artificial Sequence
  chemically synthesized
ttggtatatgatgactcaat

SEQ ID NO: 51426 - DNA, 20 bp, Artificial Sequence
  chemically synthesized
gtatatgatgactcaattgg

SEQ ID NO: 51427 - DNA, 20 bp, Artificial Sequence
  chemically synthesized
gatgactcaattggtggcca

SEQ ID NO: 51428 - DNA, 20 bp, Artificial Sequence
  chemically synthesized
atgactcaattggtggccaa

SEQ ID NO: 51429 - DNA, 20 bp, Artificial Sequence
  chemically synthesized
ctcaattggtggccaaaggt

SEQ ID NO: 51430 - DNA, 20 bp, Artificial Sequence
  chemically synthesized
ttggtggccaaaggtcagaa

SEQ ID NO: 51431 - DNA, 20 bp, Artificial Sequence
  chemically synthesized
gccaaaggtcagaaaagact

SEQ ID NO: 51432 - DNA, 20 bp, Artificial Sequence
  chemically synthesized
cagaaaagactaagtgtaca

SEQ ID NO: 51433 - DNA, 20 bp, Artificial Sequence
  chemically synthesized
tgattttacacacactttga

SEQ ID NO: 51434 - DNA, 20 bp, Artificial Sequence
  chemically synthesized
gattttacacacactttgat

SEQ ID NO: 51435 - DNA, 20 bp, Artificial Sequence
  chemically synthesized
ttttacacacactttgatag

SEQ ID NO: 51436 - DNA, 20 bp, Artificial Sequence
  chemically synthesized
tttatatctctgtgattgtc

SEQ ID NO: 51437 - DNA, 20 bp, Artificial Sequence
  chemically synthesized
attgtctagctcttatttca

SEQ ID NO: 51438 - DNA, 20 bp, Artificial Sequence
  chemically synthesized
ttaattaaaaattatttgat

SEQ ID NO: 51439 - DNA, 20 bp, Artificial Sequence
  chemically synthesized
cccttatttttcatattctt

SEQ ID NO: 51440 - DNA, 20 bp, Artificial Sequence
  chemically synthesized
tcatattcttgagcaaaaaa

SEQ ID NO: 51441 - DNA, 20 bp, Artificial Sequence
  chemically synthesized
tcttgagcaaaaaacagata

SEQ ID NO: 51442 - DNA, 20 bp, Artificial Sequence
  chemically synthesized
atatggttcctaatcttcta

SEQ ID NO: 51443 - DNA, 20 bp, Artificial Sequence
  chemically synthesized
acagcctctaatgaatctaa

SEQ ID NO: 51444 - DNA, 20 bp, Artificial Sequence
  chemically synthesized
taatgaatctaatggaaatt

SEQ ID NO: 51445 - DNA, 20 bp, Artificial Sequence
  chemically synthesized
atggaaattcagtgtataat

SEQ ID NO: 51446 - DNA, 20 bp, Artificial Sequence
  chemically synthesized
gaaattcagtgtataataag

SEQ ID NO: 51447 - DNA, 20 bp, Artificial Sequence
  chemically synthesized
taagtggtataaatataaac

SEQ ID NO: 51448 - DNA, 20 bp, Artificial Sequence
  chemically synthesized
ataaactagtatactgtgat

SEQ ID NO: 51449 - DNA, 20 bp, Artificial Sequence
  chemically synthesized
aaactagtatactgtgatga

SEQ ID NO: 51450 - DNA, 20 bp, Artificial Sequence
  chemically synthesized
tagtatactgtgatgagagt

SEQ ID NO: 51451 - DNA, 20 bp, Artificial Sequence
  chemically synthesized
atactgtgatgagagtaagt

SEQ ID NO: 51452 - DNA, 20 bp, Artificial Sequence
  chemically synthesized
gtgatgagagtaagttagtt

SEQ ID NO: 51453 - DNA, 20 bp, Artificial Sequence
  chemically synthesized
tgatgagagtaagttagtta

SEQ ID NO: 51454 - DNA, 20 bp, Artificial Sequence
  chemically synthesized
gatgagagtaagttagttaa

SEQ ID NO: 51455 - DNA, 20 bp, Artificial Sequence
  chemically synthesized
atgagagtaagttagttaag

SEQ ID NO: 51456 - DNA, 20 bp, Artificial Sequence
  chemically synthesized
tgagagtaagttagttaagg

SEQ ID NO: 51457 - DNA, 20 bp, Artificial Sequence
  chemically synthesized
taagttagttaagggggttg

SEQ ID NO: 51458 - DNA, 20 bp, Artificial Sequence
  chemically synthesized
gttaagggggttgaagaaat

SEQ ID NO: 51459 - DNA, 20 bp, Artificial Sequence
  chemically synthesized
gttgaagaaatgagataatc

SEQ ID NO: 51460 - DNA, 20 bp, Artificial Sequence
  chemically synthesized
ttgaagaaatgagataatct

SEQ ID NO: 51461 - DNA, 20 bp, Artificial Sequence
  chemically synthesized
aagaaatgagataatctagg

SEQ ID NO: 51462 - DNA, 20 bp, Artificial Sequence
  chemically synthesized
agaaatgagataatctaggt

SEQ ID NO: 51463 - DNA, 20 bp, Artificial Sequence
  chemically synthesized
gaaatgagataatctaggtg

SEQ ID NO: 51464 - DNA, 20 bp, Artificial Sequence
  chemically synthesized
aatgagataatctaggtggg

SEQ ID NO: 51465 - DNA, 20 bp, Artificial Sequence
  chemically synthesized
gagataatctaggtggggag

SEQ ID NO: 51466 - DNA, 20 bp, Artificial Sequence
  chemically synthesized
atctaggtggggagcagtat

SEQ ID NO: 51467 - DNA, 20 bp, Artificial Sequence
  chemically synthesized
agtattagaaaaatccccct

SEQ ID NO: 51468 - DNA, 20 bp, Artificial Sequence
  chemically synthesized
gtattagaaaaatccccctg

SEQ ID NO: 51469 - DNA, 20 bp, Artificial Sequence
  chemically synthesized
ttagaaaaatccccctgagg

SEQ ID NO: 51470 - DNA, 20 bp, Artificial Sequence
  chemically synthesized
aagtaatcattttaactcaa

SEQ ID NO: 51471 - DNA, 20 bp, Artificial Sequence
  chemically synthesized
cattttaactcaaaagttaa

SEQ ID NO: 51472 - DNA, 20 bp, Artificial Sequence
  chemically synthesized
aactcaaaagttaatggtga

SEQ ID NO: 51473 - DNA, 20 bp, Artificial Sequence
  chemically synthesized
actcaaaagttaatggtgaa

SEQ ID NO: 51474 - DNA, 20 bp, Artificial Sequence
  chemically synthesized
ggaattgctgtgcaaatact

SEQ ID NO: 51475 - DNA, 20 bp, Artificial Sequence
  chemically synthesized
gaattgctgtgcaaatactt

SEQ ID NO: 51476 - DNA, 20 bp, Artificial Sequence
  chemically synthesized
aattgctgtgcaaatacttg

SEQ ID NO: 51477 - DNA, 20 bp, Artificial Sequence
  chemically synthesized
tgctgtgcaaatacttgggg

SEQ ID NO: 51478 - DNA, 20 bp, Artificial Sequence
  chemically synthesized
aatacttggggtagataatt

SEQ ID NO: 51479 - DNA, 20 bp, Artificial Sequence
  chemically synthesized
tacttggggtagataattcg

SEQ ID NO: 51480 - DNA, 20 bp, Artificial Sequence
  chemically synthesized
ggggtagataattcggagca

SEQ ID NO: 51481 - DNA, 20 bp, Artificial Sequence
  chemically synthesized
ggtagataattcggagcaca

SEQ ID NO: 51482 - DNA, 20 bp, Artificial Sequence
  chemically synthesized
agataattcggagcacagag

SEQ ID NO: 51483 - DNA, 20 bp, Artificial Sequence
  chemically synthesized
tcggagcacagagaagacca

SEQ ID NO: 51484 - DNA, 20 bp, Artificial Sequence
  chemically synthesized
cggagcacagagaagaccat

SEQ ID NO: 51485 - DNA, 20 bp, Artificial Sequence
  chemically synthesized
cacagagaagaccatgggca

SEQ ID NO: 51486 - DNA, 20 bp, Artificial Sequence
  chemically synthesized
agaccatgggcaaagatcct

SEQ ID NO: 51487 - DNA, 20 bp, Artificial Sequence
  chemically synthesized
tcctgagacatgcatgtact

SEQ ID NO: 51488 - DNA, 20 bp, Artificial Sequence
  chemically synthesized
gcatgtacttagcttgtttt

SEQ ID NO: 51489 - DNA, 20 bp, Artificial Sequence
  chemically synthesized
catgtacttagcttgttttg

SEQ ID NO: 51490 - DNA, 20 bp, Artificial Sequence
  chemically synthesized
gtacttagcttgttttgagg

SEQ ID NO: 51491 - DNA, 20 bp, Artificial Sequence
  chemically synthesized
agcttgttttgaggaagata

SEQ ID NO: 51492 - DNA, 20 bp, Artificial Sequence
  chemically synthesized
gataaagatacctaaatatt

SEQ ID NO: 51493 - DNA, 20 bp, Artificial Sequence
  chemically synthesized
ataaagatacctaaatatta

SEQ ID NO: 51494 - DNA, 20 bp, Artificial Sequence
  chemically synthesized
aaagatacctaaatattaag

SEQ ID NO: 51495 - DNA, 20 bp, Artificial Sequence
  chemically synthesized
tacctaaatattaaggagtg

SEQ ID NO: 51496 - DNA, 20 bp, Artificial Sequence
  chemically synthesized
acctaaatattaaggagtgt

SEQ ID NO: 51497 - DNA, 20 bp, Artificial Sequence
  chemically synthesized
taaatattaaggagtgtagg

SEQ ID NO: 51498 - DNA, 20 bp, Artificial Sequence
  chemically synthesized
atattaaggagtgtaggcag

SEQ ID NO: 51499 - DNA, 20 bp, Artificial Sequence
  chemically synthesized
ttaaggagtgtaggcagtag

SEQ ID NO: 51500 - DNA, 20 bp, Artificial Sequence
  chemically synthesized
gtgtaggcagtagtggtcta

SEQ ID NO: 51501 - DNA, 20 bp, Artificial Sequence
  chemically synthesized
gtagtggtctaaagatgtaa

SEQ ID NO: 51502 - DNA, 20 bp, Artificial Sequence
  chemically synthesized
gtggtctaaagatgtaatag

SEQ ID NO: 51503 - DNA, 20 bp, Artificial Sequence
  chemically synthesized
ggtctaaagatgtaatagaa

SEQ ID NO: 51504 - DNA, 20 bp, Artificial Sequence
  chemically synthesized
gtctaaagatgtaatagaag

SEQ ID NO: 51505 - DNA, 20 bp, Artificial Sequence
  chemically synthesized
taaagatgtaatagaagagg

SEQ ID NO: 51506 - DNA, 20 bp, Artificial Sequence
  chemically synthesized
aaagatgtaatagaagaggc

SEQ ID NO: 51507 - DNA, 20 bp, Artificial Sequence
  chemically synthesized
atgtaatagaagaggcaggt

SEQ ID NO: 51508 - DNA, 20 bp, Artificial Sequence
  chemically synthesized
gcaggtgagccacgttatac

SEQ ID NO: 51509 - DNA, 20 bp, Artificial Sequence
  chemically synthesized
caggtgagccacgttataca

SEQ ID NO: 51510 - DNA, 20 bp, Artificial Sequence
  chemically synthesized
aaggctttttgactatgata

SEQ ID NO: 51511 - DNA, 20 bp, Artificial Sequence
  chemically synthesized
gaatttgtattttacattac

SEQ ID NO: 51512 - DNA, 20 bp, Artificial Sequence
  chemically synthesized
gtattttacattacgagcaa

SEQ ID NO: 51513 - DNA, 20 bp, Artificial Sequence
  chemically synthesized
tattttacattacgagcaat

SEQ ID NO: 51514 - DNA, 20 bp, Artificial Sequence
  chemically synthesized
ttacattacgagcaatgggt

SEQ ID NO: 51515 - DNA, 20 bp, Artificial Sequence
  chemically synthesized
caatgggtaagtgaccatca

SEQ ID NO: 51516 - DNA, 20 bp, Artificial Sequence
  chemically synthesized
atgggtaagtgaccatcaaa

SEQ ID NO: 51517 - DNA, 20 bp, Artificial Sequence
  chemically synthesized
atcaaagagttttttcaaca

SEQ ID NO: 51518 - DNA, 20 bp, Artificial Sequence
  chemically synthesized
tcaaagagttttttcaacaa

SEQ ID NO: 51519 - DNA, 20 bp, Artificial Sequence
  chemically synthesized
caacaaaggtttgtgtgatt

SEQ ID NO: 51520 - DNA, 20 bp, Artificial Sequence
  chemically synthesized
caaaggtttgtgtgatttag

SEQ ID NO: 51521 - DNA, 20 bp, Artificial Sequence
  chemically synthesized
tgtgatttagtagatgtttg

SEQ ID NO: 51522 - DNA, 20 bp, Artificial Sequence
  chemically synthesized
tttagtagatgtttgtagaa

SEQ ID NO: 51523 - DNA, 20 bp, Artificial Sequence
  chemically synthesized
atgtttgtagaaaagcaatt

SEQ ID NO: 51524 - DNA, 20 bp, Artificial Sequence
  chemically synthesized
gaaaagcaatttggtttccc

SEQ ID NO: 51525 - DNA, 20 bp, Artificial Sequence
  chemically synthesized
aaagcaatttggtttccctg

SEQ ID NO: 51526 - DNA, 20 bp, Artificial Sequence
  chemically synthesized
cctggagataatacattttt

SEQ ID NO: 51527 - DNA, 20 bp, Artificial Sequence
  chemically synthesized
tggagataatacatttttta

SEQ ID NO: 51528 - DNA, 20 bp, Artificial Sequence
  chemically synthesized
ggagataatacattttttag

SEQ ID NO: 51529 - DNA, 20 bp, Artificial Sequence
  chemically synthesized
tacattttttagaggacaaa

SEQ ID NO: 51530 - DNA, 20 bp, Artificial Sequence
  chemically synthesized
aaacagataaatcatgatat

SEQ ID NO: 51531 - DNA, 20 bp, Artificial Sequence
  chemically synthesized
agataaatcatgatattagc

SEQ ID NO: 51532 - DNA, 20 bp, Artificial Sequence
  chemically synthesized
attaatttaataaattatca

SEQ ID NO: 51533 - DNA, 20 bp, Artificial Sequence
  chemically synthesized
aatttaataaattatcatag

SEQ ID NO: 51534 - DNA, 20 bp, Artificial Sequence
  chemically synthesized
taataaattatcatagtagc

SEQ ID NO: 51535 - DNA, 20 bp, Artificial Sequence
  chemically synthesized
aataaattatcatagtagcc

SEQ ID NO: 51536 - DNA, 20 bp, Artificial Sequence
  chemically synthesized
ataaattatcatagtagcca

SEQ ID NO: 51537 - DNA, 20 bp, Artificial Sequence
  chemically synthesized
aaacaatgatattataaacc

SEQ ID NO: 51538 - DNA, 20 bp, Artificial Sequence
  chemically synthesized
aatgatattataaaccaaga

SEQ ID NO: 51539 - DNA, 20 bp, Artificial Sequence
  chemically synthesized
atgatattataaaccaagac

SEQ ID NO: 51540 - DNA, 20 bp, Artificial Sequence
  chemically synthesized
ccaagacgggcaatgtgtaa

SEQ ID NO: 51541 - DNA, 20 bp, Artificial Sequence
  chemically synthesized
agacgggcaatgtgtaaaag

SEQ ID NO: 51542 - DNA, 20 bp, Artificial Sequence
  chemically synthesized
gacgggcaatgtgtaaaagt

SEQ ID NO: 51543 - DNA, 20 bp, Artificial Sequence
  chemically synthesized
tgtgtaaaagtgggcctatc

SEQ ID NO: 51544 - DNA, 20 bp, Artificial Sequence
  chemically synthesized
gtgtaaaagtgggcctatct

SEQ ID NO: 51545 - DNA, 20 bp, Artificial Sequence
  chemically synthesized
gcctatctgggatgtgtttc

SEQ ID NO: 51546 - DNA, 20 bp, Artificial Sequence
  chemically synthesized
tatctgggatgtgtttctgg

SEQ ID NO: 51547 - DNA, 20 bp, Artificial Sequence
  chemically synthesized
ggatgtgtttctggtagaaa

SEQ ID NO: 51548 - DNA, 20 bp, Artificial Sequence
  chemically synthesized
tgtgtttctggtagaaatgg

SEQ ID NO: 51549 - DNA, 20 bp, Artificial Sequence
  chemically synthesized
gaaatggtagaaattgatga

SEQ ID NO: 51550 - DNA, 20 bp, Artificial Sequence
  chemically synthesized
gaaattgatgaaagatttga

SEQ ID NO: 51551 - DNA, 20 bp, Artificial Sequence
  chemically synthesized
aattgatgaaagatttgatg

SEQ ID NO: 51552 - DNA, 20 bp, Artificial Sequence
  chemically synthesized
ttgatgaaagatttgatgga

SEQ ID NO: 51553 - DNA, 20 bp, Artificial Sequence
  chemically synthesized
gatgaaagatttgatggaga

SEQ ID NO: 51554 - DNA, 20 bp, Artificial Sequence
  chemically synthesized
atgaaagatttgatggagag

SEQ ID NO: 51555 - DNA, 20 bp, Artificial Sequence
  chemically synthesized
aagatttgatggagagagga

SEQ ID NO: 51556 - DNA, 20 bp, Artificial Sequence
  chemically synthesized
agatttgatggagagaggaa

SEQ ID NO: 51557 - DNA, 20 bp, Artificial Sequence
  chemically synthesized
gatttgatggagagaggaaa

SEQ ID NO: 51558 - DNA, 20 bp, Artificial Sequence
  chemically synthesized
ttgatggagagaggaaaggg

SEQ ID NO: 51559 - DNA, 20 bp, Artificial Sequence
  chemically synthesized
tgatggagagaggaaaggga

SEQ ID NO: 51560 - DNA, 20 bp, Artificial Sequence
  chemically synthesized
ggagagaggaaagggaagga

SEQ ID NO: 51561 - DNA, 20 bp, Artificial Sequence
  chemically synthesized
agagaggaaagggaaggaaa

SEQ ID NO: 51562 - DNA, 20 bp, Artificial Sequence
  chemically synthesized
agaggaaagggaaggaaaga

SEQ ID NO: 51563 - DNA, 20 bp, Artificial Sequence
  chemically synthesized
aaaaattttaaaaatgactc

SEQ ID NO: 51564 - DNA, 20 bp, Artificial Sequence
  chemically synthesized
gtcttatgcaattgtgttat

SEQ ID NO: 51565 - DNA, 20 bp, Artificial Sequence
  chemically synthesized
ttatgcaattgtgttattgg

SEQ ID NO: 51566 - DNA, 20 bp, Artificial Sequence
  chemically synthesized
atgcaattgtgttattggtg

SEQ ID NO: 51567 - DNA, 20 bp, Artificial Sequence
  chemically synthesized
gtggagtcactttataatat

SEQ ID NO: 51568 - DNA, 20 bp, Artificial Sequence
  chemically synthesized
tggagtcactttataatatt

SEQ ID NO: 51569 - DNA, 20 bp, Artificial Sequence
  chemically synthesized
gagtcactttataatattag

SEQ ID NO: 51570 - DNA, 20 bp, Artificial Sequence
  chemically synthesized
actttataatattaggagaa

SEQ ID NO: 51571 - DNA, 20 bp, Artificial Sequence
  chemically synthesized
ctttataatattaggagaaa

SEQ ID NO: 51572 - DNA, 20 bp, Artificial Sequence
  chemically synthesized
tttataatattaggagaaaa

SEQ ID NO: 51573 - DNA, 20 bp, Artificial Sequence
  chemically synthesized
taatattaggagaaaaggga

SEQ ID NO: 51574 - DNA, 20 bp, Artificial Sequence
  chemically synthesized
aggagaaaagggacagaaaa

SEQ ID NO: 51575 - DNA, 20 bp, Artificial Sequence
  chemically synthesized
aagggacagaaaatagattt

SEQ ID NO: 51576 - DNA, 20 bp, Artificial Sequence
  chemically synthesized
agggacagaaaatagatttt

SEQ ID NO: 51577 - DNA, 20 bp, Artificial Sequence
  chemically synthesized
gggacagaaaatagattttg

SEQ ID NO: 51578 - DNA, 20 bp, Artificial Sequence
  chemically synthesized
ggacagaaaatagattttgg

SEQ ID NO: 51579 - DNA, 20 bp, Artificial Sequence
  chemically synthesized
gacagaaaatagattttggg

SEQ ID NO: 51580 - DNA, 20 bp, Artificial Sequence
  chemically synthesized
tagattttggggggaaaatc

SEQ ID NO: 51581 - DNA, 20 bp, Artificial Sequence
  chemically synthesized
gggaaaatcaagtactttat

SEQ ID NO: 51582 - DNA, 20 bp, Artificial Sequence
  chemically synthesized
attggcatcattcttatttt

SEQ ID NO: 51583 - DNA, 20 bp, Artificial Sequence
  chemically synthesized
ttattttaagattaaacact

SEQ ID NO: 51584 - DNA, 20 bp, Artificial Sequence
  chemically synthesized
actcagatgaatatattaaa

SEQ ID NO: 51585 - DNA, 20 bp, Artificial Sequence
  chemically synthesized
agatgaatatattaaatagc

SEQ ID NO: 51586 - DNA, 20 bp, Artificial Sequence
  chemically synthesized
ccagttgtattcatgaattt

SEQ ID NO: 51587 - DNA, 20 bp, Artificial Sequence
  chemically synthesized
tattcatgaatttgagctct

SEQ ID NO: 51588 - DNA, 20 bp, Artificial Sequence
  chemically synthesized
attcatgaatttgagctctc

SEQ ID NO: 51589 - DNA, 20 bp, Artificial Sequence
  chemically synthesized
tcatgaatttgagctctcag

SEQ ID NO: 51590 - DNA, 20 bp, Artificial Sequence
  chemically synthesized
tgaatttgagctctcaggag

SEQ ID NO: 51591 - DNA, 20 bp, Artificial Sequence
  chemically synthesized
tttgagctctcaggagtggt

SEQ ID NO: 51592 - DNA, 20 bp, Artificial Sequence
  chemically synthesized
ttgagctctcaggagtggtc

SEQ ID NO: 51593 - DNA, 20 bp, Artificial Sequence
  chemically synthesized
tctcaggagtggtcaggaat

SEQ ID NO: 51594 - DNA, 20 bp, Artificial Sequence
  chemically synthesized
tcaggagtggtcaggaatca

SEQ ID NO: 51595 - DNA, 20 bp, Artificial Sequence
  chemically synthesized
caggagtggtcaggaatcag

SEQ ID NO: 51596 - DNA, 20 bp, Artificial Sequence
  chemically synthesized
ggaatcagaggtgcaaatgt

SEQ ID NO: 51597 - DNA, 20 bp, Artificial Sequence
  chemically synthesized
aaatgttagtttcaaataat

SEQ ID NO: 51598 - DNA, 20 bp, Artificial Sequence
  chemically synthesized
tagtttcaaataataagaaa

SEQ ID NO: 51599 - DNA, 20 bp, Artificial Sequence
  chemically synthesized
ataataagaaaaagttgaca

SEQ ID NO: 51600 - DNA, 20 bp, Artificial Sequence
  chemically synthesized
gttgacatagtctgcacatt

SEQ ID NO: 51601 - DNA, 20 bp, Artificial Sequence
  chemically synthesized
ttgacatagtctgcacatta

SEQ ID NO: 51602 - DNA, 20 bp, Artificial Sequence
  chemically synthesized
agtctgcacattaaggaact

SEQ ID NO: 51603 - DNA, 20 bp, Artificial Sequence
  chemically synthesized
acattaaggaactgagaatt

SEQ ID NO: 51604 - DNA, 20 bp, Artificial Sequence
  chemically synthesized
actgagaatttagtttgtaa

SEQ ID NO: 51605 - DNA, 20 bp, Artificial Sequence
  chemically synthesized
tgagaatttagtttgtaaca

SEQ ID NO: 51606 - DNA, 20 bp, Artificial Sequence
  chemically synthesized
ttagtttgtaacagagatat

SEQ ID NO: 51607 - DNA, 20 bp, Artificial Sequence
  chemically synthesized
agagatattagttaaatatt

SEQ ID NO: 51608 - DNA, 20 bp, Artificial Sequence
  chemically synthesized
taaatatttagtttaaatat

SEQ ID NO: 51609 - DNA, 20 bp, Artificial Sequence
  chemically synthesized
ttaaatattagttaaatatt

SEQ ID NO: 51610 - DNA, 20 bp, Artificial Sequence
  chemically synthesized
gctaataaatacaaaattat

SEQ ID NO: 51611 - DNA, 20 bp, Artificial Sequence
  chemically synthesized
gaaacatgataccaaaataa

SEQ ID NO: 51612 - DNA, 20 bp, Artificial Sequence
  chemically synthesized
ataccaaaataatagatata

SEQ ID NO: 51613 - DNA, 20 bp, Artificial Sequence
  chemically synthesized
tatatggataaatttgtctt

SEQ ID NO: 51614 - DNA, 20 bp, Artificial Sequence
  chemically synthesized
gtcttaagaaacttcttgaa

SEQ ID NO: 51615 - DNA, 20 bp, Artificial Sequence
  chemically synthesized
cttcttgaaaagtgattgtt

SEQ ID NO: 51616 - DNA, 20 bp, Artificial Sequence
  chemically synthesized
aaaagtgattgttgagttgc

SEQ ID NO: 51617 - DNA, 20 bp, Artificial Sequence
  chemically synthesized
agttgcaagatcgttttaaa

SEQ ID NO: 51618 - DNA, 20 bp, Artificial Sequence
  chemically synthesized
gttgcaagatcgttttaaaa

SEQ ID NO: 51619 - DNA, 20 bp, Artificial Sequence
  chemically synthesized
ttgcaagatcgttttaaaaa

SEQ ID NO: 51620 - DNA, 20 bp, Artificial Sequence
  chemically synthesized
caagatcgttttaaaaaggg

SEQ ID NO: 51621 - DNA, 20 bp, Artificial Sequence
  chemically synthesized
aagatcgttttaaaaagggt

SEQ ID NO: 51622 - DNA, 20 bp, Artificial Sequence
  chemically synthesized
atcgttttaaaaagggtagg

SEQ ID NO: 51623 - DNA, 20 bp, Artificial Sequence
  chemically synthesized
aaaaagggtaggaagaaatt

SEQ ID NO: 51624 - DNA, 20 bp, Artificial Sequence
  chemically synthesized
aaaagggtaggaagaaattg

SEQ ID NO: 51625 - DNA, 20 bp, Artificial Sequence
  chemically synthesized
ggtaggaagaaattgaggaa

SEQ ID NO: 51626 - DNA, 20 bp, Artificial Sequence
  chemically synthesized
ggaaaagatgatgaataatt

SEQ ID NO: 51627 - DNA, 20 bp, Artificial Sequence
  chemically synthesized
gaaaagatgatgaataattt

SEQ ID NO: 51628 - DNA, 20 bp, Artificial Sequence
  chemically synthesized
aagatgatgaataatttagg

SEQ ID NO: 51629 - DNA, 20 bp, Artificial Sequence
  chemically synthesized
tgatgaataatttaggcaga

SEQ ID NO: 51630 - DNA, 20 bp, Artificial Sequence
  chemically synthesized
ttaggcagatagaacatttc

SEQ ID NO: 51631 - DNA, 20 bp, Artificial Sequence
  chemically synthesized
tttcgagaaaaattttacga

SEQ ID NO: 51632 - DNA, 20 bp, Artificial Sequence
  chemically synthesized
cgagaaaaattttacgaaag

SEQ ID NO: 51633 - DNA, 20 bp, Artificial Sequence
  chemically synthesized
agaaaaattttacgaaagaa

SEQ ID NO: 51634 - DNA, 20 bp, Artificial Sequence
  chemically synthesized
gaaagaagagaaattcgatt

SEQ ID NO: 51635 - DNA, 20 bp, Artificial Sequence
  chemically synthesized
aagaagagaaattcgattta

SEQ ID NO: 51636 - DNA, 20 bp, Artificial Sequence
  chemically synthesized
aattcgatttagagaaatga

SEQ ID NO: 51637 - DNA, 20 bp, Artificial Sequence
  chemically synthesized
tcgatttagagaaatgaaag

SEQ ID NO: 51638 - DNA, 20 bp, Artificial Sequence
  chemically synthesized
gaaagaagatacgtattcaa

SEQ ID NO: 51639 - DNA, 20 bp, Artificial Sequence
  chemically synthesized
aagactgaaaaatcctctgc

SEQ ID NO: 51640 - DNA, 20 bp, Artificial Sequence
  chemically synthesized
aaaatcctctgcaagaaacg

SEQ ID NO: 51641 - DNA, 20 bp, Artificial Sequence
  chemically synthesized
gcaagaaacgaagaaacttc

SEQ ID NO: 51642 - DNA, 20 bp, Artificial Sequence
  chemically synthesized
aagaaacttcaagcattcta

SEQ ID NO: 51643 - DNA, 20 bp, Artificial Sequence
  chemically synthesized
gaaacttcaagcattctatg

SEQ ID NO: 51644 - DNA, 20 bp, Artificial Sequence
  chemically synthesized
caagcattctatggagaaaa

SEQ ID NO: 51645 - DNA, 20 bp, Artificial Sequence
  chemically synthesized
ggagaaaaaagtattaaaaa

SEQ ID NO: 51646 - DNA, 20 bp, Artificial Sequence
  chemically synthesized
aaaaaagtattaaaaatagt

SEQ ID NO: 51647 - DNA, 20 bp, Artificial Sequence
  chemically synthesized
agtattaaaaatagtgagct

SEQ ID NO: 51648 - DNA, 20 bp, Artificial Sequence
  chemically synthesized
gagctaagttattcaatgct

SEQ ID NO: 51649 - DNA, 20 bp, Artificial Sequence
  chemically synthesized
ctaagttattcaatgctgag

SEQ ID NO: 51650 - DNA, 20 bp, Artificial Sequence
  chemically synthesized
taagttattcaatgctgaga

SEQ ID NO: 51651 - DNA, 20 bp, Artificial Sequence
  chemically synthesized
agttattcaatgctgagaag

SEQ ID NO: 51652 - DNA, 20 bp, Artificial Sequence
  chemically synthesized
attcaatgctgagaaggagt

SEQ ID NO: 51653 - DNA, 20 bp, Artificial Sequence
  chemically synthesized
ttcaatgctgagaaggagtc

SEQ ID NO: 51654 - DNA, 20 bp, Artificial Sequence
  chemically synthesized
tcaatgctgagaaggagtca

SEQ ID NO: 51655 - DNA, 20 bp, Artificial Sequence
  chemically synthesized
tgctgagaaggagtcagggc

SEQ ID NO: 51656 - DNA, 20 bp, Artificial Sequence
  chemically synthesized
agtcagggcaagaaaaacaa

SEQ ID NO: 51657 - DNA, 20 bp, Artificial Sequence
  chemically synthesized
agggcaagaaaaacaatggt

SEQ ID NO: 51658 - DNA, 20 bp, Artificial Sequence
  chemically synthesized
aaaaacaatggttagactgc

SEQ ID NO: 51659 - DNA, 20 bp, Artificial Sequence
  chemically synthesized
aacaatggttagactgctag

SEQ ID NO: 51660 - DNA, 20 bp, Artificial Sequence
  chemically synthesized
gttagactgctagaagacgt

SEQ ID NO: 51661 - DNA, 20 bp, Artificial Sequence
  chemically synthesized
actgctagaagacgtcagtg

SEQ ID NO: 51662 - DNA, 20 bp, Artificial Sequence
  chemically synthesized
tagaagacgtcagtgtagta

SEQ ID NO: 51663 - DNA, 20 bp, Artificial Sequence
  chemically synthesized
gaagacgtcagtgtagtata

SEQ ID NO: 51664 - DNA, 20 bp, Artificial Sequence
  chemically synthesized
agacgtcagtgtagtataga

SEQ ID NO: 51665 - DNA, 20 bp, Artificial Sequence
  chemically synthesized
tgtagtatagagagtacatt

SEQ ID NO: 51666 - DNA, 20 bp, Artificial Sequence
  chemically synthesized
agtatagagagtacattgag

SEQ ID NO: 51667 - DNA, 20 bp, Artificial Sequence
  chemically synthesized
tagagagtacattgagaaga

SEQ ID NO: 51668 - DNA, 20 bp, Artificial Sequence
  chemically synthesized
tacattgagaagaaagtctg

SEQ ID NO: 51669 - DNA, 20 bp, Artificial Sequence
  chemically synthesized
agtctgtggaactgtgttgt

SEQ ID NO: 51670 - DNA, 20 bp, Artificial Sequence
  chemically synthesized
gtctgtggaactgtgttgtg

SEQ ID NO: 51671 - DNA, 20 bp, Artificial Sequence
  chemically synthesized
aactgtgttgtgaggctaat

SEQ ID NO: 51672 - DNA, 20 bp, Artificial Sequence
  chemically synthesized
gttgtgaggctaataagaca

SEQ ID NO: 51673 - DNA, 20 bp, Artificial Sequence
  chemically synthesized
gctaataagacaaagctgaa

SEQ ID NO: 51674 - DNA, 20 bp, Artificial Sequence
  chemically synthesized
aataagacaaagctgaaaag

SEQ ID NO: 51675 - DNA, 20 bp, Artificial Sequence
  chemically synthesized
ataagacaaagctgaaaagt

SEQ ID NO: 51676 - DNA, 20 bp, Artificial Sequence
  chemically synthesized
aagctgaaaagtaggacata

SEQ ID NO: 51677 - DNA, 20 bp, Artificial Sequence
  chemically synthesized
agctgaaaagtaggacataa

SEQ ID NO: 51678 - DNA, 20 bp, Artificial Sequence
  chemically synthesized
gctgaaaagtaggacataaa

SEQ ID NO: 51679 - DNA, 20 bp, Artificial Sequence
  chemically synthesized
gaaaagtaggacataaaggg

SEQ ID NO: 51680 - DNA, 20 bp, Artificial Sequence
  chemically synthesized
taaagggcagcccaaatctg

SEQ ID NO: 51681 - DNA, 20 bp, Artificial Sequence
  chemically synthesized
gaagttactttaacatctcg

SEQ ID NO: 51682 - DNA, 20 bp, Artificial Sequence
  chemically synthesized
agttactcaatcaaacatga

SEQ ID NO: 51683 - DNA, 20 bp, Artificial Sequence
  chemically synthesized
ctcaatcaaacatgaaagta

SEQ ID NO: 51684 - DNA, 20 bp, Artificial Sequence
  chemically synthesized
tgaacatctgtttacattat

SEQ ID NO: 51685 - DNA, 20 bp, Artificial Sequence
  chemically synthesized
aacatctgtttacattatta

SEQ ID NO: 51686 - DNA, 20 bp, Artificial Sequence
  chemically synthesized
aaaaaacttatgatgattct

SEQ ID NO: 51687 - DNA, 20 bp, Artificial Sequence
  chemically synthesized
aaaaacttatgatgattctc

SEQ ID NO: 51688 - DNA, 20 bp, Artificial Sequence
  chemically synthesized
cttatgatgattctcaggtc

SEQ ID NO: 51689 - DNA, 20 bp, Artificial Sequence
  chemically synthesized
attctcaggtctggaactta

SEQ ID NO: 51690 - DNA, 20 bp, Artificial Sequence
  chemically synthesized
ctcaggtctggaacttaaag

SEQ ID NO: 51691 - DNA, 20 bp, Artificial Sequence
  chemically synthesized
tcaggtctggaacttaaagc

SEQ ID NO: 51692 - DNA, 20 bp, Artificial Sequence
  chemically synthesized
taaagcaggcaaacaatgta

SEQ ID NO: 51693 - DNA, 20 bp, Artificial Sequence
  chemically synthesized
agcaggcaaacaatgtaaag

SEQ ID NO: 51694 - DNA, 20 bp, Artificial Sequence
  chemically synthesized
aggcaaacaatgtaaagaag

SEQ ID NO: 51695 - DNA, 20 bp, Artificial Sequence
  chemically synthesized
ccaattgattctgctaccat

SEQ ID NO: 51696 - DNA, 20 bp, Artificial Sequence
  chemically synthesized
caattgattctgctaccatg

SEQ ID NO: 51697 - DNA, 20 bp, Artificial Sequence
  chemically synthesized
catgaggcttttgaaattat

SEQ ID NO: 51698 - DNA, 20 bp, Artificial Sequence
  chemically synthesized
aattataagcttgcttgttt

SEQ ID NO: 51699 - DNA, 20 bp, Artificial Sequence
  chemically synthesized
taagcttgcttgtttgagcc

SEQ ID NO: 51700 - DNA, 20 bp, Artificial Sequence
  chemically synthesized
gagcctggctttgtgatctg

SEQ ID NO: 51701 - DNA, 20 bp, Artificial Sequence
  chemically synthesized
ctttgtgatctgtagaactg

SEQ ID NO: 51702 - DNA, 20 bp, Artificial Sequence
  chemically synthesized
tttgtgatctgtagaactgc

SEQ ID NO: 51703 - DNA, 20 bp, Artificial Sequence
  chemically synthesized
tctgtagaactgcaggttct

SEQ ID NO: 51704 - DNA, 20 bp, Artificial Sequence
  chemically synthesized
tagaactgcaggttctaaga

SEQ ID NO: 51705 - DNA, 20 bp, Artificial Sequence
  chemically synthesized
tctaagaaagaaaacacaat

SEQ ID NO: 51706 - DNA, 20 bp, Artificial Sequence
  chemically synthesized
ataaatgtatattgaataaa

SEQ ID NO: 51707 - DNA, 20 bp, Artificial Sequence
  chemically synthesized
atattgaataaatagttaat

SEQ ID NO: 51708 - DNA, 20 bp, Artificial Sequence
  chemically synthesized
gctcattaactgaataaata

SEQ ID NO: 51709 - DNA, 20 bp, Artificial Sequence
  chemically synthesized
ctcattaactgaataaataa

SEQ ID NO: 51710 - DNA, 20 bp, Artificial Sequence
  chemically synthesized
taactgaataaataaaggaa

SEQ ID NO: 51711 - DNA, 20 bp, Artificial Sequence
  chemically synthesized
aactgaataaataaaggaat

SEQ ID NO: 51712 - DNA, 20 bp, Artificial Sequence
  chemically synthesized
tgaataaataaaggaatggg

SEQ ID NO: 51713 - DNA, 20 bp, Artificial Sequence
  chemically synthesized
ataaaggaatgggaagcact

SEQ ID NO: 51714 - DNA, 20 bp, Artificial Sequence
  chemically synthesized
gaagcactgagctgctatca

SEQ ID NO: 51715 - DNA, 20 bp, Artificial Sequence
  chemically synthesized
aagcactgagctgctatcaa

SEQ ID NO: 51716 - DNA, 20 bp, Artificial Sequence
  chemically synthesized
ctgagctgctatcaaaggct

SEQ ID NO: 51717 - DNA, 20 bp, Artificial Sequence
  chemically synthesized
atctaattctctacatcaca

SEQ ID NO: 51718 - DNA, 20 bp, Artificial Sequence
  chemically synthesized
tctaattctctacatcacaa

SEQ ID NO: 51719 - DNA, 20 bp, Artificial Sequence
  chemically synthesized
tacatcacaaaggcacaaat

SEQ ID NO: 51720 - DNA, 20 bp, Artificial Sequence
  chemically synthesized
acaaatgagttgaacatctc

SEQ ID NO: 51721 - DNA, 20 bp, Artificial Sequence
  chemically synthesized
aaatgagttgaacatctcaa

SEQ ID NO: 51722 - DNA, 20 bp, Artificial Sequence
  chemically synthesized
aatgagttgaacatctcaag

SEQ ID NO: 51723 - DNA, 20 bp, Artificial Sequence
  chemically synthesized
agttgaacatctcaagaggc

SEQ ID NO: 51724 - DNA, 20 bp, Artificial Sequence
  chemically synthesized
ttgaacatctcaagaggcca

SEQ ID NO: 51725 - DNA, 20 bp, Artificial Sequence
  chemically synthesized
atctcaagaggccagagctc

SEQ ID NO: 51726 - DNA, 20 bp, Artificial Sequence
  chemically synthesized
caagaggccagagctccagt

SEQ ID NO: 51727 - DNA, 20 bp, Artificial Sequence
  chemically synthesized
cagtgagaaatcatttaccc

SEQ ID NO: 51728 - DNA, 20 bp, Artificial Sequence
  chemically synthesized
agtgagaaatcatttaccca

SEQ ID NO: 51729 - DNA, 20 bp, Artificial Sequence
  chemically synthesized
ctgtctgcttatcaccaatg

SEQ ID NO: 51730 - DNA, 20 bp, Artificial Sequence
  chemically synthesized
gcttatcaccaatgaagaaa

SEQ ID NO: 51731 - DNA, 20 bp, Artificial Sequence
  chemically synthesized
aatgaagaaaaagtaattgc

SEQ ID NO: 51732 - DNA, 20 bp, Artificial Sequence
  chemically synthesized
taattgctggctacgtcatc

SEQ ID NO: 51733 - DNA, 20 bp, Artificial Sequence
  chemically synthesized
attgctggctacgtcatctg

SEQ ID NO: 51734 - DNA, 20 bp, Artificial Sequence
  chemically synthesized
ttgctggctacgtcatctgg

SEQ ID NO: 51735 - DNA, 20 bp, Artificial Sequence
  chemically synthesized
tgctggctacgtcatctgga

SEQ ID NO: 51736 - DNA, 20 bp, Artificial Sequence
  chemically synthesized
gctggctacgtcatctggag

SEQ ID NO: 51737 - DNA, 20 bp, Artificial Sequence
  chemically synthesized
ctggctacgtcatctggagg

SEQ ID NO: 51738 - DNA, 20 bp, Artificial Sequence
  chemically synthesized
ggctacgtcatctggagggg

SEQ ID NO: 51739 - DNA, 20 bp, Artificial Sequence
  chemically synthesized
tcatctggagggggagaaaa

SEQ ID NO: 51740 - DNA, 20 bp, Artificial Sequence
  chemically synthesized
catctggagggggagaaaac

SEQ ID NO: 51741 - DNA, 20 bp, Artificial Sequence
  chemically synthesized
tctggagggggagaaaacag

SEQ ID NO: 51742 - DNA, 20 bp, Artificial Sequence
  chemically synthesized
acaggagtatcttcattaaa

SEQ ID NO: 51743 - DNA, 20 bp, Artificial Sequence
  chemically synthesized
tatcttcattaaatagtatt

SEQ ID NO: 51744 - DNA, 20 bp, Artificial Sequence
  chemically synthesized
tcttcattaaatagtatttg

SEQ ID NO: 51745 - DNA, 20 bp, Artificial Sequence
  chemically synthesized
atttggagaaaaaatatact

SEQ ID NO: 51746 - DNA, 20 bp, Artificial Sequence
  chemically synthesized
ttggagaaaaaatatacttg

SEQ ID NO: 51747 - DNA, 20 bp, Artificial Sequence
  chemically synthesized
agaaaaaatatacttggaga

SEQ ID NO: 51748 - DNA, 20 bp, Artificial Sequence
  chemically synthesized
tacttggagacggcacaaaa

SEQ ID NO: 51749 - DNA, 20 bp, Artificial Sequence
  chemically synthesized
cggcacaaaatggaaaatga

SEQ ID NO: 51750 - DNA, 20 bp, Artificial Sequence
  chemically synthesized
caaaatggaaaatgacggaa

SEQ ID NO: 51751 - DNA, 20 bp, Artificial Sequence
  chemically synthesized
acggaaaagtgactatttaa

SEQ ID NO: 51752 - DNA, 20 bp, Artificial Sequence
  chemically synthesized
taatagacttatgatattta

SEQ ID NO: 51753 - DNA, 20 bp, Artificial Sequence
  chemically synthesized
cttatgatatttaaagccca

SEQ ID NO: 51754 - DNA, 20 bp, Artificial Sequence
  chemically synthesized
acttcgaatgtttaatgaat

SEQ ID NO: 51755 - DNA, 20 bp, Artificial Sequence
  chemically synthesized
ttcgaatgtttaatgaattg

SEQ ID NO: 51756 - DNA, 20 bp, Artificial Sequence
  chemically synthesized
cgaatgtttaatgaattgga

SEQ ID NO: 51757 - DNA, 20 bp, Artificial Sequence
  chemically synthesized
atgtttaatgaattggagag

SEQ ID NO: 51758 - DNA, 20 bp, Artificial Sequence
  chemically synthesized
agagaagaaaataatttttc

SEQ ID NO: 51759 - DNA, 20 bp, Artificial Sequence
  chemically synthesized
aaataatttttcaagaacct

SEQ ID NO: 51760 - DNA, 20 bp, Artificial Sequence
  chemically synthesized
caagaacctcggctctttac

SEQ ID NO: 51761 - DNA, 20 bp, Artificial Sequence
  chemically synthesized
aaaatttttaccactatcct

SEQ ID NO: 51762 - DNA, 20 bp, Artificial Sequence
  chemically synthesized
aaatttttaccactatcctt

SEQ ID NO: 51763 - DNA, 20 bp, Artificial Sequence
  chemically synthesized
ctatccttgggaaaatgtct

SEQ ID NO: 51764 - DNA, 20 bp, Artificial Sequence
  chemically synthesized
gcaacgtatttttttaaaac

SEQ ID NO: 51765 - DNA, 20 bp, Artificial Sequence
  chemically synthesized
tccttatttgtttttgctta

SEQ ID NO: 51766 - DNA, 20 bp, Artificial Sequence
  chemically synthesized
tgtttttgcttatggcttct

SEQ ID NO: 51767 - DNA, 20 bp, Artificial Sequence
  chemically synthesized
gtttttgcttatggcttcta

SEQ ID NO: 51768 - DNA, 20 bp, Artificial Sequence
  chemically synthesized
tctaaggatatgttcacatc

SEQ ID NO: 51769 - DNA, 20 bp, Artificial Sequence
  chemically synthesized
aggatatgttcacatccaga

SEQ ID NO: 51770 - DNA, 20 bp, Artificial Sequence
  chemically synthesized
tgacttttaaatgacatcaa

SEQ ID NO: 51771 - DNA, 20 bp, Artificial Sequence
  chemically synthesized
cttttaaatgacatcaaaag

SEQ ID NO: 51772 - DNA, 20 bp, Artificial Sequence
  chemically synthesized
aaaagaagaccattttctca

SEQ ID NO: 51773 - DNA, 20 bp, Artificial Sequence
  chemically synthesized
aaagaagaccattttctcaa

SEQ ID NO: 51774 - DNA, 20 bp, Artificial Sequence
  chemically synthesized
gaccattttctcaaaggcaa

SEQ ID NO: 51775 - DNA, 20 bp, Artificial Sequence
  chemically synthesized
gcaatggatactatgtctca

SEQ ID NO: 51776 - DNA, 20 bp, Artificial Sequence
  chemically synthesized
gatactatgtctcaaagaaa

SEQ ID NO: 51777 - DNA, 20 bp, Artificial Sequence
  chemically synthesized
ctcaaagaaacagaatttct

SEQ ID NO: 51778 - DNA, 20 bp, Artificial Sequence
  chemically synthesized
atttctcagctgtttttttt

SEQ ID NO: 51779 - DNA, 20 bp, Artificial Sequence
  chemically synthesized
ctcagctgttttttttaagt

SEQ ID NO: 51780 - DNA, 20 bp, Artificial Sequence
  chemically synthesized
gctgttttttttaagtcagt

SEQ ID NO: 51781 - DNA, 20 bp, Artificial Sequence
  chemically synthesized
ttttttaagtcagtaagttt

SEQ ID NO: 51782 - DNA, 20 bp, Artificial Sequence
  chemically synthesized
tttttaagtcagtaagtttt

SEQ ID NO: 51783 - DNA, 20 bp, Artificial Sequence
  chemically synthesized
ttttaagtcagtaagtttta

SEQ ID NO: 51784 - DNA, 20 bp, Artificial Sequence
  chemically synthesized
tttagggtatttcatttact

SEQ ID NO: 51785 - DNA, 20 bp, Artificial Sequence
  chemically synthesized
cttagaaatttcattgtatt

SEQ ID NO: 51786 - DNA, 20 bp, Artificial Sequence
  chemically synthesized
ttagaaatttcattgtattc

SEQ ID NO: 51787 - DNA, 20 bp, Artificial Sequence
  chemically synthesized
aaatactctcacatgtttct

SEQ ID NO: 51788 - DNA, 20 bp, Artificial Sequence
  chemically synthesized
tctcacatgtttctcagttc

SEQ ID NO: 51789 - DNA, 20 bp, Artificial Sequence
  chemically synthesized
cagttccagaatgattactt

SEQ ID NO: 51790 - DNA, 20 bp, Artificial Sequence
  chemically synthesized
tccagaatgattacttcagt

SEQ ID NO: 51791 - DNA, 20 bp, Artificial Sequence
  chemically synthesized
atgattacttcagtaagccc

SEQ ID NO: 51792 - DNA, 20 bp, Artificial Sequence
  chemically synthesized
acttcagtaagccctagcac

SEQ ID NO: 51793 - DNA, 20 bp, Artificial Sequence
  chemically synthesized
aattcttcctttcttctcac

SEQ ID NO: 51794 - DNA, 20 bp, Artificial Sequence
  chemically synthesized
tttcttctcactggattttc

SEQ ID NO: 51795 - DNA, 20 bp, Artificial Sequence
  chemically synthesized
tctcactggattttctggca

SEQ ID NO: 51796 - DNA, 20 bp, Artificial Sequence
  chemically synthesized
tcactggattttctggcatg

SEQ ID NO: 51797 - DNA, 20 bp, Artificial Sequence
  chemically synthesized
ctggattttctggcatggag

SEQ ID NO: 51798 - DNA, 20 bp, Artificial Sequence
  chemically synthesized
gcatggagcagcaatacccc

SEQ ID NO: 51799 - DNA, 20 bp, Artificial Sequence
  chemically synthesized
cttctcctcaatctatgcca

SEQ ID NO: 51800 - DNA, 20 bp, Artificial Sequence
  chemically synthesized
aatctatgccatggtgcttt

SEQ ID NO: 51801 - DNA, 20 bp, Artificial Sequence
  chemically synthesized
atctatgccatggtgctttt

SEQ ID NO: 51802 - DNA, 20 bp, Artificial Sequence
  chemically synthesized
ggtgcttttgggcaattgca

SEQ ID NO: 51803 - DNA, 20 bp, Artificial Sequence
  chemically synthesized
gcatggttctccatgtgata

SEQ ID NO: 51804 - DNA, 20 bp, Artificial Sequence
  chemically synthesized
ttctccatgtgatatggact

SEQ ID NO: 51805 - DNA, 20 bp, Artificial Sequence
  chemically synthesized
catgtgatatggactgagcc

SEQ ID NO: 51806 - DNA, 20 bp, Artificial Sequence
  chemically synthesized
ggactgagccaagcctgcac

SEQ ID NO: 51807 - DNA, 20 bp, Artificial Sequence
  chemically synthesized
gttttacttcctgtccatgc

SEQ ID NO: 51808 - DNA, 20 bp, Artificial Sequence
  chemically synthesized
ggccctcactgacctgtgca

SEQ ID NO: 51809 - DNA, 20 bp, Artificial Sequence
  chemically synthesized
gccctcactgacctgtgcat

SEQ ID NO: 51810 - DNA, 20 bp, Artificial Sequence
  chemically synthesized
ccctcactgacctgtgcatg

SEQ ID NO: 51811 - DNA, 20 bp, Artificial Sequence
  chemically synthesized
ggggctgtccactgtgtaca

SEQ ID NO: 51812 - DNA, 20 bp, Artificial Sequence
  chemically synthesized
gtccactgtgtacacagtgc

SEQ ID NO: 51813 - DNA, 20 bp, Artificial Sequence
  chemically synthesized
tccactgtgtacacagtgct

SEQ ID NO: 51814 - DNA, 20 bp, Artificial Sequence
  chemically synthesized
ccactgtgtacacagtgctg

SEQ ID NO: 51815 - DNA, 20 bp, Artificial Sequence
  chemically synthesized
acacagtgctggggatcctg

SEQ ID NO: 51816 - DNA, 20 bp, Artificial Sequence
  chemically synthesized
cacagtgctggggatcctgt

SEQ ID NO: 51817 - DNA, 20 bp, Artificial Sequence
  chemically synthesized
acagtgctggggatcctgtg

SEQ ID NO: 51818 - DNA, 20 bp, Artificial Sequence
  chemically synthesized
cagtgctggggatcctgtgg

SEQ ID NO: 51819 - DNA, 20 bp, Artificial Sequence
  chemically synthesized
gatcctgtgggggatcattc

SEQ ID NO: 51820 - DNA, 20 bp, Artificial Sequence
  chemically synthesized
tcctgtgggggatcattcga

SEQ ID NO: 51821 - DNA, 20 bp, Artificial Sequence
  chemically synthesized
tgggggatcattcgagagat

SEQ ID NO: 51822 - DNA, 20 bp, Artificial Sequence
  chemically synthesized
gatcattcgagagatcagct

SEQ ID NO: 51823 - DNA, 20 bp, Artificial Sequence
  chemically synthesized
gcttggattcctgcattgcc

SEQ ID NO: 51824 - DNA, 20 bp, Artificial Sequence
  chemically synthesized
gcccagtcctatttcatcca

SEQ ID NO: 51825 - DNA, 20 bp, Artificial Sequence
  chemically synthesized
catccatggtctgtccttca

SEQ ID NO: 51826 - DNA, 20 bp, Artificial Sequence
  chemically synthesized
tccatggtctgtccttcatg

SEQ ID NO: 51827 - DNA, 20 bp, Artificial Sequence
  chemically synthesized
gtcctctgtcctcctcacta

SEQ ID NO: 51828 - DNA, 20 bp, Artificial Sequence
  chemically synthesized
tcctcactatggcctttgac

SEQ ID NO: 51829 - DNA, 20 bp, Artificial Sequence
  chemically synthesized
tcctccatcctgactaattc

SEQ ID NO: 51830 - DNA, 20 bp, Artificial Sequence
  chemically synthesized
aattccagaattatcaaaat

SEQ ID NO: 51831 - DNA, 20 bp, Artificial Sequence
  chemically synthesized
attccagaattatcaaaatt

SEQ ID NO: 51832 - DNA, 20 bp, Artificial Sequence
  chemically synthesized
caaaattgggctcactataa

SEQ ID NO: 51833 - DNA, 20 bp, Artificial Sequence
  chemically synthesized
aaaattgggctcactataat

SEQ ID NO: 51834 - DNA, 20 bp, Artificial Sequence
  chemically synthesized
attgggctcactataatagg

SEQ ID NO: 51835 - DNA, 20 bp, Artificial Sequence
  chemically synthesized
ttgggctcactataataggt

SEQ ID NO: 51836 - DNA, 20 bp, Artificial Sequence
  chemically synthesized
gggctcactataataggtag

SEQ ID NO: 51837 - DNA, 20 bp, Artificial Sequence
  chemically synthesized
ctcactctttctgcctgcac

SEQ ID NO: 51838 - DNA, 20 bp, Artificial Sequence
  chemically synthesized
tcactctttctgcctgcacc

SEQ ID NO: 51839 - DNA, 20 bp, Artificial Sequence
  chemically synthesized
gcaccaggatcttctccgct

SEQ ID NO: 51840 - DNA, 20 bp, Artificial Sequence
  chemically synthesized
tcttctccgcttagcctgtt

SEQ ID NO: 51841 - DNA, 20 bp, Artificial Sequence
  chemically synthesized
tgttcagacatccgattcaa

SEQ ID NO: 51842 - DNA, 20 bp, Artificial Sequence
  chemically synthesized
tagttactatgccctgatgc

SEQ ID NO: 51843 - DNA, 20 bp, Artificial Sequence
  chemically synthesized
ggttatttgcatactgttgt

SEQ ID NO: 51844 - DNA, 20 bp, Artificial Sequence
  chemically synthesized
tctcctacatcctgattctt

SEQ ID NO: 51845 - DNA, 20 bp, Artificial Sequence
  chemically synthesized
ctacatcctgattcttaagt

SEQ ID NO: 51846 - DNA, 20 bp, Artificial Sequence
  chemically synthesized
cctgattcttaagtcagtcc

SEQ ID NO: 51847 - DNA, 20 bp, Artificial Sequence
  chemically synthesized
gattcttaagtcagtcctgg

SEQ ID NO: 51848 - DNA, 20 bp, Artificial Sequence
  chemically synthesized
cagtcctggcagttgcctct

SEQ ID NO: 51849 - DNA, 20 bp, Artificial Sequence
  chemically synthesized
agtcctggcagttgcctctc

SEQ ID NO: 51850 - DNA, 20 bp, Artificial Sequence
  chemically synthesized
cctggcagttgcctctcagg

SEQ ID NO: 51851 - DNA, 20 bp, Artificial Sequence
  chemically synthesized
tggcagttgcctctcaggaa

SEQ ID NO: 51852 - DNA, 20 bp, Artificial Sequence
  chemically synthesized
gcagttgcctctcaggaaga

SEQ ID NO: 51853 - DNA, 20 bp, Artificial Sequence
  chemically synthesized
cagttgcctctcaggaagag

SEQ ID NO: 51854 - DNA, 20 bp, Artificial Sequence
  chemically synthesized
aagagaggcataaattattt

SEQ ID NO: 51855 - DNA, 20 bp, Artificial Sequence
  chemically synthesized
gtgttctacatccctatcat

SEQ ID NO: 51856 - DNA, 20 bp, Artificial Sequence
  chemically synthesized
ccctatcattagcctcacaa

SEQ ID NO: 51857 - DNA, 20 bp, Artificial Sequence
  chemically synthesized
ctcacaatggtgcaccgttt

SEQ ID NO: 51858 - DNA, 20 bp, Artificial Sequence
  chemically synthesized
caatggtgcaccgttttggc

SEQ ID NO: 51859 - DNA, 20 bp, Artificial Sequence
  chemically synthesized
tggcaagcacctttcccccg

SEQ ID NO: 51860 - DNA, 20 bp, Artificial Sequence
  chemically synthesized
cccgtggcccacgttctcat

SEQ ID NO: 51861 - DNA, 20 bp, Artificial Sequence
  chemically synthesized
ttaatgaatcccatcatcta

SEQ ID NO: 51862 - DNA, 20 bp, Artificial Sequence
  chemically synthesized
atcccatcatctacagtgtc

SEQ ID NO: 51863 - DNA, 20 bp, Artificial Sequence
  chemically synthesized
tctacagtgtcaagacccaa

SEQ ID NO: 51864 - DNA, 20 bp, Artificial Sequence
  chemically synthesized
aagacccaacagattcatac

SEQ ID NO: 51865 - DNA, 20 bp, Artificial Sequence
  chemically synthesized
cagattcataccagaatgct

SEQ ID NO: 51866 - DNA, 20 bp, Artificial Sequence
  chemically synthesized
cttagactcttttctctgaa

SEQ ID NO: 51867 - DNA, 20 bp, Artificial Sequence
  chemically synthesized
cttttctctgaaaagatatt

SEQ ID NO: 51868 - DNA, 20 bp, Artificial Sequence
  chemically synthesized
tttctctgaaaagatattga

SEQ ID NO: 51869 - DNA, 20 bp, Artificial Sequence
  chemically synthesized
aaaagatattgagagatatt

SEQ ID NO: 51870 - DNA, 20 bp, Artificial Sequence
  chemically synthesized
gagatgtattgcctaaaaaa

SEQ ID NO: 51871 - DNA, 20 bp, Artificial Sequence
  chemically synthesized
tgtattgcctaaaaaaaaga

SEQ ID NO: 51872 - DNA, 20 bp, Artificial Sequence
  chemically synthesized
tgcctaaaaaaaagaaagaa

SEQ ID NO: 51873 - DNA, 20 bp, Artificial Sequence
  chemically synthesized
ctaaaaaaaagaaagaaaag

SEQ ID NO: 51874 - DNA, 20 bp, Artificial Sequence
  chemically synthesized
caacaataataaacaaaaat

SEQ ID NO: 51875 - DNA, 20 bp, Artificial Sequence
  chemically synthesized
caaaaatcagtgccataaaa

SEQ ID NO: 51876 - DNA, 20 bp, Artificial Sequence
  chemically synthesized
agaaaaaattattaaaattg

SEQ ID NO: 51877 - DNA, 20 bp, Artificial Sequence
  chemically synthesized
taaaattgtagatttactct

SEQ ID NO: 51878 - DNA, 20 bp, Artificial Sequence
  chemically synthesized
ccttaaaaaatatttaaata

SEQ ID NO: 51879 - DNA, 20 bp, Artificial Sequence
  chemically synthesized
aaaaaatatttaaatatagt

SEQ ID NO: 51880 - DNA, 20 bp, Artificial Sequence
  chemically synthesized
aaaatatttaaatatagtca

SEQ ID NO: 51881 - DNA, 20 bp, Artificial Sequence
  chemically synthesized
tagtcagagaatcaacaaac

SEQ ID NO: 51882 - DNA, 20 bp, Artificial Sequence
  chemically synthesized
acaaacaagttccattgtgt

SEQ ID NO: 51883 - DNA, 20 bp, Artificial Sequence
  chemically synthesized
caagttccattgtgtcagcc

SEQ ID NO: 51884 - DNA, 20 bp, Artificial Sequence
  chemically synthesized
tgtgtcagcctggacacatg

SEQ ID NO: 51885 - DNA, 20 bp, Artificial Sequence
  chemically synthesized
gtgtcagcctggacacatgt

SEQ ID NO: 51886 - DNA, 20 bp, Artificial Sequence
  chemically synthesized
acacatgtaggtcactctat

SEQ ID NO: 51887 - DNA, 20 bp, Artificial Sequence
  chemically synthesized
ctatcagtctgaccatattt

SEQ ID NO: 51888 - DNA, 20 bp, Artificial Sequence
  chemically synthesized
cagtctgaccatatttaaga

SEQ ID NO: 51889 - DNA, 20 bp, Artificial Sequence
  chemically synthesized
gtctgaccatatttaagaaa

SEQ ID NO: 51890 - DNA, 20 bp, Artificial Sequence
  chemically synthesized
tctgaccatatttaagaaag

SEQ ID NO: 51891 - DNA, 20 bp, Artificial Sequence
  chemically synthesized
tttgcctgaaatgtactttt

SEQ ID NO: 51892 - DNA, 20 bp, Artificial Sequence
  chemically synthesized
atttcctttgctgtaaaaca

SEQ ID NO: 51893 - DNA, 20 bp, Artificial Sequence
  chemically synthesized
cctttgctgtaaaacaaagc

SEQ ID NO: 51894 - DNA, 20 bp, Artificial Sequence
  chemically synthesized
acaaagctggattaaaaacc

SEQ ID NO: 51895 - DNA, 20 bp, Artificial Sequence
  chemically synthesized
caaagctggattaaaaacct

SEQ ID NO: 51896 - DNA, 20 bp, Artificial Sequence
  chemically synthesized
gattaaaaacctaggttttc

SEQ ID NO: 51897 - DNA, 20 bp, Artificial Sequence
  chemically synthesized
acctaggttttcaagtttca

SEQ ID NO: 51898 - DNA, 20 bp, Artificial Sequence
  chemically synthesized
taggttttcaagtttcaaag

SEQ ID NO: 51899 - DNA, 20 bp, Artificial Sequence
  chemically synthesized
gtttcaaagtagaaaacttg

SEQ ID NO: 51900 - DNA, 20 bp, Artificial Sequence
  chemically synthesized
tgaagtttctttcattctct

SEQ ID NO: 51901 - DNA, 20 bp, Artificial Sequence
  chemically synthesized
gaagtttctttcattctctg

SEQ ID NO: 51902 - DNA, 20 bp, Artificial Sequence
  chemically synthesized
tacttaattaaccttcaaaa

SEQ ID NO: 51903 - DNA, 20 bp, Artificial Sequence
  chemically synthesized
cttaattaaccttcaaaatg

SEQ ID NO: 51904 - DNA, 20 bp, Artificial Sequence
  chemically synthesized
aaccttcaaaatggagacta

SEQ ID NO: 51905 - DNA, 20 bp, Artificial Sequence
  chemically synthesized
tggagactatagccaactca

SEQ ID NO: 51906 - DNA, 20 bp, Artificial Sequence
  chemically synthesized
ggagactatagccaactcac

SEQ ID NO: 51907 - DNA, 20 bp, Artificial Sequence
  chemically synthesized
ggaatgttgtgatatctgta

SEQ ID NO: 51908 - DNA, 20 bp, Artificial Sequence
  chemically synthesized
gttgtgatatctgtatggac

SEQ ID NO: 51909 - DNA, 20 bp, Artificial Sequence
  chemically synthesized
tgtatggaccagaattgtcc

SEQ ID NO: 51910 - DNA, 20 bp, Artificial Sequence
  chemically synthesized
gtatggaccagaattgtcca

SEQ ID NO: 51911 - DNA, 20 bp, Artificial Sequence
  chemically synthesized
tatggaccagaattgtccaa

SEQ ID NO: 51912 - DNA, 20 bp, Artificial Sequence
  chemically synthesized
agggaacttttctaaactga

SEQ ID NO: 51913 - DNA, 20 bp, Artificial Sequence
  chemically synthesized
ttctataaaataccataaaa

SEQ ID NO: 51914 - DNA, 20 bp, Artificial Sequence
  chemically synthesized
aaaataccataaaatggcta

SEQ ID NO: 51915 - DNA, 20 bp, Artificial Sequence
  chemically synthesized
ataccataaaatggctaaag

SEQ ID NO: 51916 - DNA, 20 bp, Artificial Sequence
  chemically synthesized
aatggctaaagtggaatata

SEQ ID NO: 51917 - DNA, 20 bp, Artificial Sequence
  chemically synthesized
ctcctgtgcgcttgaaatga

SEQ ID NO: 51918 - DNA, 20 bp, Artificial Sequence
  chemically synthesized
ctgtgcgcttgaaatgatgg

SEQ ID NO: 51919 - DNA, 20 bp, Artificial Sequence
  chemically synthesized
aacaactgcatttacaattt

SEQ ID NO: 51920 - DNA, 20 bp, Artificial Sequence
  chemically synthesized
tttacaatttcagttacttt

SEQ ID NO: 51921 - DNA, 20 bp, Artificial Sequence
  chemically synthesized
aatgtttaatgtccttgtat

SEQ ID NO: 51922 - DNA, 20 bp, Artificial Sequence
  chemically synthesized
tttaatgtccttgtattgga

SEQ ID NO: 51923 - DNA, 20 bp, Artificial Sequence
  chemically synthesized
tgtccttgtattggacagtt

SEQ ID NO: 51924 - DNA, 20 bp, Artificial Sequence
  chemically synthesized
ttgtattggacagttcagtt

SEQ ID NO: 51925 - DNA, 20 bp, Artificial Sequence
  chemically synthesized
tattggacagttcagttcag

SEQ ID NO: 51926 - DNA, 20 bp, Artificial Sequence
  chemically synthesized
cagttcagcagccactatat

SEQ ID NO: 51927 - DNA, 20 bp, Artificial Sequence
  chemically synthesized
tcagcagccactatattgga

SEQ ID NO: 51928 - DNA, 20 bp, Artificial Sequence
  chemically synthesized
cagcagccactatattggac

SEQ ID NO: 51929 - DNA, 20 bp, Artificial Sequence
  chemically synthesized
agcagccactatattggaca

SEQ ID NO: 51930 - DNA, 20 bp, Artificial Sequence
  chemically synthesized
agccactatattggacaggg

SEQ ID NO: 51931 - DNA, 20 bp, Artificial Sequence
  chemically synthesized
tatattggacagggaagcta

SEQ ID NO: 51932 - DNA, 20 bp, Artificial Sequence
  chemically synthesized
cagggaagctacagttcata

SEQ ID NO: 51933 - DNA, 20 bp, Artificial Sequence
  chemically synthesized
gggaagctacagttcataaa

SEQ ID NO: 51934 - DNA, 20 bp, Artificial Sequence
  chemically synthesized
ggaagctacagttcataaag

SEQ ID NO: 51935 - DNA, 20 bp, Artificial Sequence
  chemically synthesized
cagttcataaagaggacaca

SEQ ID NO: 51936 - DNA, 20 bp, Artificial Sequence
  chemically synthesized
gacacaaagaaatatgactt

SEQ ID NO: 51937 - DNA, 20 bp, Artificial Sequence
  chemically synthesized
ctaccatgtctaatttaaat

SEQ ID NO: 51938 - DNA, 20 bp, Artificial Sequence
  chemically synthesized
aaattagaatccttattttt

SEQ ID NO: 51939 - DNA, 20 bp, Artificial Sequence
  chemically synthesized
tattttttagattttatatg

SEQ ID NO: 51940 - DNA, 20 bp, Artificial Sequence
  chemically synthesized
tatgtggactccactgctac

SEQ ID NO: 51941 - DNA, 20 bp, Artificial Sequence
  chemically synthesized
atgtggactccactgctaca

SEQ ID NO: 51942 - DNA, 20 bp, Artificial Sequence
  chemically synthesized
ggactccactgctacaaggc

SEQ ID NO: 51943 - DNA, 20 bp, Artificial Sequence
  chemically synthesized
ctccactgctacaaggctgg

SEQ ID NO: 51944 - DNA, 20 bp, Artificial Sequence
  chemically synthesized
cactgctacaaggctggaag

SEQ ID NO: 51945 - DNA, 20 bp, Artificial Sequence
  chemically synthesized
gctggaagcagattttgctc

SEQ ID NO: 51946 - DNA, 20 bp, Artificial Sequence
  chemically synthesized
gatcttttgcttttatatct

SEQ ID NO: 51947 - DNA, 20 bp, Artificial Sequence
  chemically synthesized
cttttgcttttatatctaag

SEQ ID NO: 51948 - DNA, 20 bp, Artificial Sequence
  chemically synthesized
ttttgcttttatatctaagt

SEQ ID NO: 51949 - DNA, 20 bp, Artificial Sequence
  chemically synthesized
tttgcttttatatctaagtg

SEQ ID NO: 51950 - DNA, 20 bp, Artificial Sequence
  chemically synthesized
ttgcttttatatctaagtgg

SEQ ID NO: 51951 - DNA, 20 bp, Artificial Sequence
  chemically synthesized
taagtgggggatcttctgaa

SEQ ID NO: 51952 - DNA, 20 bp, Artificial Sequence
  chemically synthesized
gggggatcttctgaacagat

SEQ ID NO: 51953 - DNA, 20 bp, Artificial Sequence
  chemically synthesized
gtccgctaccgacttattct

SEQ ID NO: 51954 - DNA, 20 bp, Artificial Sequence
  chemically synthesized
ccgacttattctgagtttaa

SEQ ID NO: 51955 - DNA, 20 bp, Artificial Sequence
  chemically synthesized
attctgagtttaaaagaaaa

SEQ ID NO: 51956 - DNA, 20 bp, Artificial Sequence
  chemically synthesized
gtttaaaagaaaaaagataa

SEQ ID NO: 51957 - DNA, 20 bp, Artificial Sequence
  chemically synthesized
aaaaaagataaaagaacata

SEQ ID NO: 51958 - DNA, 20 bp, Artificial Sequence
  chemically synthesized
aaagataaaagaacataaag

SEQ ID NO: 51959 - DNA, 20 bp, Artificial Sequence
  chemically synthesized
acataaagcggttcttttct

SEQ ID NO: 51960 - DNA, 20 bp, Artificial Sequence
  chemically synthesized
aaagcggttcttttctaagt

SEQ ID NO: 51961 - DNA, 20 bp, Artificial Sequence
  chemically synthesized
cggttcttttctaagtaagc

SEQ ID NO: 51962 - DNA, 20 bp, Artificial Sequence
  chemically synthesized
cttttctaagtaagctagtg

SEQ ID NO: 51963 - DNA, 20 bp, Artificial Sequence
  chemically synthesized
taagctagtgcagctttcca

SEQ ID NO: 51964 - DNA, 20 bp, Artificial Sequence
  chemically synthesized
gctagtgcagctttccaaag

SEQ ID NO: 51965 - DNA, 20 bp, Artificial Sequence
  chemically synthesized
ctagtgcagctttccaaaga

SEQ ID NO: 51966 - DNA, 20 bp, Artificial Sequence
  chemically synthesized
tgcagctttccaaagaagga

SEQ ID NO: 51967 - DNA, 20 bp, Artificial Sequence
  chemically synthesized
gctttccaaagaaggaaaga

SEQ ID NO: 51968 - DNA, 20 bp, Artificial Sequence
  chemically synthesized
ctttccaaagaaggaaagaa

SEQ ID NO: 51969 - DNA, 20 bp, Artificial Sequence
  chemically synthesized
tccaaagaaggaaagaaagg

SEQ ID NO: 51970 - DNA, 20 bp, Artificial Sequence
  chemically synthesized
ccaaagaaggaaagaaagga

SEQ ID NO: 51971 - DNA, 20 bp, Artificial Sequence
  chemically synthesized
aggaaagaaaggaaggaaat

SEQ ID NO: 51972 - DNA, 20 bp, Artificial Sequence
  chemically synthesized
ggaaagaaaggaaggaaatc

SEQ ID NO: 51973 - DNA, 20 bp, Artificial Sequence
  chemically synthesized
atcaggtacaaaactatgca

SEQ ID NO: 51974 - DNA, 20 bp, Artificial Sequence
  chemically synthesized
caaaactatgcatggataac

SEQ ID NO: 51975 - DNA, 20 bp, Artificial Sequence
  chemically synthesized
ttaatcttcctatattctat

SEQ ID NO: 51976 - DNA, 20 bp, Artificial Sequence
  chemically synthesized
taatcttcctatattctatt

SEQ ID NO: 51977 - DNA, 20 bp, Artificial Sequence
  chemically synthesized
ctatattctattaggtatct

SEQ ID NO: 51978 - DNA, 20 bp, Artificial Sequence
  chemically synthesized
tattctattaggtatctaag

SEQ ID NO: 51979 - DNA, 20 bp, Artificial Sequence
  chemically synthesized
attctattaggtatctaaga

SEQ ID NO: 51980 - DNA, 20 bp, Artificial Sequence
  chemically synthesized
tattaggtatctaagaaggt

SEQ ID NO: 51981 - DNA, 20 bp, Artificial Sequence
  chemically synthesized
aagaaggtaagtgttaaaat

SEQ ID NO: 51982 - DNA, 20 bp, Artificial Sequence
  chemically synthesized
aattggacaaattaatgcat

SEQ ID NO: 51983 - DNA, 20 bp, Artificial Sequence
  chemically synthesized
ttggacaaattaatgcataa

SEQ ID NO: 51984 - DNA, 20 bp, Artificial Sequence
  chemically synthesized
aagagtcattttacaccaaa

SEQ ID NO: 51985 - DNA, 20 bp, Artificial Sequence
  chemically synthesized
caaatatttatttttatttt

SEQ ID NO: 51986 - DNA, 20 bp, Artificial Sequence
  chemically synthesized
tagatatcaactaaaacaac

SEQ ID NO: 51987 - DNA, 20 bp, Artificial Sequence
  chemically synthesized
gccttcctttcctttcactt

SEQ ID NO: 51988 - DNA, 20 bp, Artificial Sequence
  chemically synthesized
ttggacttcattcaataaca

SEQ ID NO: 51989 - DNA, 20 bp, Artificial Sequence
  chemically synthesized
ctctgtctacttatttgact

SEQ ID NO: 51990 - DNA, 20 bp, Artificial Sequence
  chemically synthesized
ctgtctacttatttgactca

SEQ ID NO: 51991 - DNA, 20 bp, Artificial Sequence
  chemically synthesized
tgtctacttatttgactcag

SEQ ID NO: 51992 - DNA, 20 bp, Artificial Sequence
  chemically synthesized
gtctacttatttgactcaga

SEQ ID NO: 51993 - DNA, 20 bp, Artificial Sequence
  chemically synthesized
ctcagagggaaacaaaaata

SEQ ID NO: 51994 - DNA, 20 bp, Artificial Sequence
  chemically synthesized
tcagagggaaacaaaaatac

SEQ ID NO: 51995 - DNA, 20 bp, Artificial Sequence
  chemically synthesized
ggaaacaaaaatacaggctt

SEQ ID NO: 51996 - DNA, 20 bp, Artificial Sequence
  chemically synthesized
atacaggctttggtttctaa

SEQ ID NO: 51997 - DNA, 20 bp, Artificial Sequence
  chemically synthesized
gctttggtttctaatagctt

SEQ ID NO: 51998 - DNA, 20 bp, Artificial Sequence
  chemically synthesized
ttctaatagcttaagcctca

SEQ ID NO: 51999 - DNA, 20 bp, Artificial Sequence
  chemically synthesized
aatagcttaagcctcaaagt

SEQ ID NO: 52000 - DNA, 20 bp, Artificial Sequence
  chemically synthesized
atagcttaagcctcaaagtg

SEQ ID NO: 52001 - DNA, 20 bp, Artificial Sequence
  chemically synthesized
caaagtgaggaaattgtttc

SEQ ID NO: 52002 - DNA, 20 bp, Artificial Sequence
  chemically synthesized
gtgaggaaattgtttctgga

SEQ ID NO: 52003 - DNA, 20 bp, Artificial Sequence
  chemically synthesized
gaggaaattgtttctggaca

SEQ ID NO: 52004 - DNA, 20 bp, Artificial Sequence
  chemically synthesized
aattgtttctggacagagta

SEQ ID NO: 52005 - DNA, 20 bp, Artificial Sequence
  chemically synthesized
tctggacagagtaaagtatc

SEQ ID NO: 52006 - DNA, 20 bp, Artificial Sequence
  chemically synthesized
gacagagtaaagtatctggt

SEQ ID NO: 52007 - DNA, 20 bp, Artificial Sequence
  chemically synthesized
gagtaaagtatctggttaga

SEQ ID NO: 52008 - DNA, 20 bp, Artificial Sequence
  chemically synthesized
aagtatctggttagaaagat

SEQ ID NO: 52009 - DNA, 20 bp, Artificial Sequence
  chemically synthesized
gataagtgtaaaattattcc

SEQ ID NO: 52010 - DNA, 20 bp, Artificial Sequence
  chemically synthesized
ttattcctagaacaataaat

SEQ ID NO: 52011 - DNA, 20 bp, Artificial Sequence
  chemically synthesized
tattcctagaacaataaatt

SEQ ID NO: 52012 - DNA, 20 bp, Artificial Sequence
  chemically synthesized
gaacaataaattaggtcttc

SEQ ID NO: 52013 - DNA, 20 bp, Artificial Sequence
  chemically synthesized
aacaataaattaggtcttct

SEQ ID NO: 52014 - DNA, 20 bp, Artificial Sequence
  chemically synthesized
aaattaggtcttctgggtta

SEQ ID NO: 52015 - DNA, 20 bp, Artificial Sequence
  chemically synthesized
ggtcttctgggttacagtat

SEQ ID NO: 52016 - DNA, 20 bp, Artificial Sequence
  chemically synthesized
gtcttctgggttacagtata

SEQ ID NO: 52017 - DNA, 20 bp, Artificial Sequence
  chemically synthesized
tacagtataaggttaatttg

SEQ ID NO: 52018 - DNA, 20 bp, Artificial Sequence
  chemically synthesized
acagtataaggttaatttga

SEQ ID NO: 52019 - DNA, 20 bp, Artificial Sequence
  chemically synthesized
taaggttaatttgaaggata

SEQ ID NO: 52020 - DNA, 20 bp, Artificial Sequence
  chemically synthesized
aaggttaatttgaaggataa

SEQ ID NO: 52021 - DNA, 20 bp, Artificial Sequence
  chemically synthesized
ggttaatttgaaggataaag

SEQ ID NO: 52022 - DNA, 20 bp, Artificial Sequence
  chemically synthesized
gagtgaatttcctgatgtca

SEQ ID NO: 52023 - DNA, 20 bp, Artificial Sequence
  chemically synthesized
gtgaatttcctgatgtcaaa

SEQ ID NO: 52024 - DNA, 20 bp, Artificial Sequence
  chemically synthesized
tgaatttcctgatgtcaaag

SEQ ID NO: 52025 - DNA, 20 bp, Artificial Sequence
  chemically synthesized
tcctgatgtcaaagaggatc

SEQ ID NO: 52026 - DNA, 20 bp, Artificial Sequence
  chemically synthesized
agaggatctagtgcatcttc

SEQ ID NO: 52027 - DNA, 20 bp, Artificial Sequence
  chemically synthesized
atctagtgcatcttctggta

SEQ ID NO: 52028 - DNA, 20 bp, Artificial Sequence
  chemically synthesized
gcatcttctggtatagctat

SEQ ID NO: 52029 - DNA, 20 bp, Artificial Sequence
  chemically synthesized
tcttctggtatagctatcag

SEQ ID NO: 52030 - DNA, 20 bp, Artificial Sequence
  chemically synthesized
ctatcagaagtgaaaactgt

SEQ ID NO: 52031 - DNA, 20 bp, Artificial Sequence
  chemically synthesized
tatcagaagtgaaaactgtg

SEQ ID NO: 52032 - DNA, 20 bp, Artificial Sequence
  chemically synthesized
cagaagtgaaaactgtgagg

SEQ ID NO: 52033 - DNA, 20 bp, Artificial Sequence
  chemically synthesized
agaagtgaaaactgtgaggt

SEQ ID NO: 52034 - DNA, 20 bp, Artificial Sequence
  chemically synthesized
gaaaactgtgaggtaggttc

SEQ ID NO: 52035 - DNA, 20 bp, Artificial Sequence
  chemically synthesized
aaactgtgaggtaggttcta

SEQ ID NO: 52036 - DNA, 20 bp, Artificial Sequence
  chemically synthesized
aactgtgaggtaggttctag

SEQ ID NO: 52037 - DNA, 20 bp, Artificial Sequence
  chemically synthesized
actgtgaggtaggttctaga

SEQ ID NO: 52038 - DNA, 20 bp, Artificial Sequence
  chemically synthesized
ctgtgaggtaggttctagag

SEQ ID NO: 52039 - DNA, 20 bp, Artificial Sequence
  chemically synthesized
tattttttactatataatca

SEQ ID NO: 52040 - DNA, 20 bp, Artificial Sequence
  chemically synthesized
tttttactatataatcatag

SEQ ID NO: 52041 - DNA, 20 bp, Artificial Sequence
  chemically synthesized
atataatcatagtagctgcc

SEQ ID NO: 52042 - DNA, 20 bp, Artificial Sequence
  chemically synthesized
tataatcatagtagctgccg

SEQ ID NO: 52043 - DNA, 20 bp, Artificial Sequence
  chemically synthesized
aatcatagtagctgccgagg

SEQ ID NO: 52044 - DNA, 20 bp, Artificial Sequence
  chemically synthesized
atcatagtagctgccgaggc

SEQ ID NO: 52045 - DNA, 20 bp, Artificial Sequence
  chemically synthesized
atagtagctgccgaggcggg

SEQ ID NO: 52046 - DNA, 20 bp, Artificial Sequence
  chemically synthesized
tgccgaggcgggcggatcat

SEQ ID NO: 52047 - DNA, 20 bp, Artificial Sequence
  chemically synthesized
gccgaggcgggcggatcatg

SEQ ID NO: 52048 - DNA, 20 bp, Artificial Sequence
  chemically synthesized
aggcgggcggatcatgaggt

SEQ ID NO: 52049 - DNA, 20 bp, Artificial Sequence
  chemically synthesized
ggcgggcggatcatgaggtc

SEQ ID NO: 52050 - DNA, 20 bp, Artificial Sequence
  chemically synthesized
cgggcggatcatgaggtcag

SEQ ID NO: 52051 - DNA, 20 bp, Artificial Sequence
  chemically synthesized
gatcatgaggtcaggagatc

SEQ ID NO: 52052 - DNA, 20 bp, Artificial Sequence
  chemically synthesized
tcaggagatcgagaccatcc

SEQ ID NO: 52053 - DNA, 20 bp, Artificial Sequence
  chemically synthesized
gagatcgagaccatcctggc

SEQ ID NO: 52054 - DNA, 20 bp, Artificial Sequence
  chemically synthesized
gagaccatcctggccagcaa

SEQ ID NO: 52055 - DNA, 20 bp, Artificial Sequence
  chemically synthesized
cgtctctactaaaaaaacac

SEQ ID NO: 52056 - DNA, 20 bp, Artificial Sequence
  chemically synthesized
tctactaaaaaaacacaaga

SEQ ID NO: 52057 - DNA, 20 bp, Artificial Sequence
  chemically synthesized
aaaaaacacaagaaagtatc

SEQ ID NO: 52058 - DNA, 20 bp, Artificial Sequence
  chemically synthesized
aaaaacacaagaaagtatcc

SEQ ID NO: 52059 - DNA, 20 bp, Artificial Sequence
  chemically synthesized
cacaagaaagtatccaggcg

SEQ ID NO: 52060 - DNA, 20 bp, Artificial Sequence
  chemically synthesized
aagaaagtatccaggcgtgg

SEQ ID NO: 52061 - DNA, 20 bp, Artificial Sequence
  chemically synthesized
aaagtatccaggcgtggtgg

SEQ ID NO: 52062 - DNA, 20 bp, Artificial Sequence
  chemically synthesized
aagtatccaggcgtggtggc

SEQ ID NO: 52063 - DNA, 20 bp, Artificial Sequence
  chemically synthesized
ggcgtggtggcgggcacctg

SEQ ID NO: 52064 - DNA, 20 bp, Artificial Sequence
  chemically synthesized
gtggcgggcacctgtagtcc

SEQ ID NO: 52065 - DNA, 20 bp, Artificial Sequence
  chemically synthesized
tggcgggcacctgtagtccc

SEQ ID NO: 52066 - DNA, 20 bp, Artificial Sequence
  chemically synthesized
cacctgtagtcccaggtact

SEQ ID NO: 52067 - DNA, 20 bp, Artificial Sequence
  chemically synthesized
acctgtagtcccaggtactc

SEQ ID NO: 52068 - DNA, 20 bp, Artificial Sequence
  chemically synthesized
ctgtagtcccaggtactcgg

SEQ ID NO: 52069 - DNA, 20 bp, Artificial Sequence
  chemically synthesized
tgtagtcccaggtactcggg

SEQ ID NO: 52070 - DNA, 20 bp, Artificial Sequence
  chemically synthesized
tcccaggtactcgggaggct

SEQ ID NO: 52071 - DNA, 20 bp, Artificial Sequence
  chemically synthesized
aggtactcgggaggctgaga

SEQ ID NO: 52072 - DNA, 20 bp, Artificial Sequence
  chemically synthesized
ggtactcgggaggctgagac

SEQ ID NO: 52073 - DNA, 20 bp, Artificial Sequence
  chemically synthesized
tactcgggaggctgagacag

SEQ ID NO: 52074 - DNA, 20 bp, Artificial Sequence
  chemically synthesized
gggaggctgagacaggagaa

SEQ ID NO: 52075 - DNA, 20 bp, Artificial Sequence
  chemically synthesized
acaggagaatggcgtgaacc

SEQ ID NO: 52076 - DNA, 20 bp, Artificial Sequence
  chemically synthesized
caggagaatggcgtgaaccc

SEQ ID NO: 52077 - DNA, 20 bp, Artificial Sequence
  chemically synthesized
ggagaatggcgtgaacccgg

SEQ ID NO: 52078 - DNA, 20 bp, Artificial Sequence
  chemically synthesized
gagaatggcgtgaacccggg

SEQ ID NO: 52079 - DNA, 20 bp, Artificial Sequence
  chemically synthesized
aatggcgtgaacccgggagg

SEQ ID NO: 52080 - DNA, 20 bp, Artificial Sequence
  chemically synthesized
tggcgtgaacccgggaggtg

SEQ ID NO: 52081 - DNA, 20 bp, Artificial Sequence
  chemically synthesized
aacccgggaggtggagcttg

SEQ ID NO: 52082 - DNA, 20 bp, Artificial Sequence
  chemically synthesized
cgggaggtggagcttgcagt

SEQ ID NO: 52083 - DNA, 20 bp, Artificial Sequence
  chemically synthesized
ggtggagcttgcagtgagtc

SEQ ID NO: 52084 - DNA, 20 bp, Artificial Sequence
  chemically synthesized
gagatcacgccactgcactc

SEQ ID NO: 52085 - DNA, 20 bp, Artificial Sequence
  chemically synthesized
cacgccactgcactccagcc

SEQ ID NO: 52086 - DNA, 20 bp, Artificial Sequence
  chemically synthesized
acgccactgcactccagcct

SEQ ID NO: 52087 - DNA, 20 bp, Artificial Sequence
  chemically synthesized
ctgcactccagcctgggcga

SEQ ID NO: 52088 - DNA, 20 bp, Artificial Sequence
  chemically synthesized
gcactccagcctgggcgaca

SEQ ID NO: 52089 - DNA, 20 bp, Artificial Sequence
  chemically synthesized
actccagcctgggcgacaga

SEQ ID NO: 52090 - DNA, 20 bp, Artificial Sequence
  chemically synthesized
tccagcctgggcgacagaga

SEQ ID NO: 52091 - DNA, 20 bp, Artificial Sequence
  chemically synthesized
gtctcaaaaaaaaaaaaaaa

SEQ ID NO: 52092 - DNA, 20 bp, Artificial Sequence
  chemically synthesized
ctcaaaaaaaaaaaaaaaaa

SEQ ID NO: 52093 - DNA, 20 bp, Artificial Sequence
  chemically synthesized
aaaaaaaaaagagaaaaaaa

SEQ ID NO: 52094 - DNA, 20 bp, Artificial Sequence
  chemically synthesized
aaaaagagaaaaaaaaagaa

SEQ ID NO: 52095 - DNA, 20 bp, Artificial Sequence
  chemically synthesized
agaaaagttgatatgaatgt

SEQ ID NO: 52096 - DNA, 20 bp, Artificial Sequence
  chemically synthesized
gaaaagttgatatgaatgtc

SEQ ID NO: 52097 - DNA, 20 bp, Artificial Sequence
  chemically synthesized
aagttgatatgaatgtcagg

SEQ ID NO: 52098 - DNA, 20 bp, Artificial Sequence
  chemically synthesized
ttgatatgaatgtcaggtgg

SEQ ID NO: 52099 - DNA, 20 bp, Artificial Sequence
  chemically synthesized
gtcaggtggtagtactgctc

SEQ ID NO: 52100 - DNA, 20 bp, Artificial Sequence
  chemically synthesized
tcaggtggtagtactgctcc

SEQ ID NO: 52101 - DNA, 20 bp, Artificial Sequence
  chemically synthesized
aatgataataaatgtctgca

SEQ ID NO: 52102 - DNA, 20 bp, Artificial Sequence
  chemically synthesized
aatgtctgcatggtccctcc

SEQ ID NO: 52103 - DNA, 20 bp, Artificial Sequence
  chemically synthesized
catggtccctcctggccgac

SEQ ID NO: 52104 - DNA, 20 bp, Artificial Sequence
  chemically synthesized
cctcctggccgactggaatg

SEQ ID NO: 52105 - DNA, 20 bp, Artificial Sequence
  chemically synthesized
tggaatgtggccaatctgac

SEQ ID NO: 52106 - DNA, 20 bp, Artificial Sequence
  chemically synthesized
ctgacaagattcctatgccc

SEQ ID NO: 52107 - DNA, 20 bp, Artificial Sequence
  chemically synthesized
tgccccagttttataatgaa

SEQ ID NO: 52108 - DNA, 20 bp, Artificial Sequence
  chemically synthesized
ccccagttttataatgaaaa

SEQ ID NO: 52109 - DNA, 20 bp, Artificial Sequence
  chemically synthesized
cagttttataatgaaaagag

SEQ ID NO: 52110 - DNA, 20 bp, Artificial Sequence
  chemically synthesized
tttataatgaaaagagaagt

SEQ ID NO: 52111 - DNA, 20 bp, Artificial Sequence
  chemically synthesized
gaagttagctgctgaatctg

SEQ ID NO: 52112 - DNA, 20 bp, Artificial Sequence
  chemically synthesized
agttagctgctgaatctgta

SEQ ID NO: 52113 - DNA, 20 bp, Artificial Sequence
  chemically synthesized
gttagctgctgaatctgtag

SEQ ID NO: 52114 - DNA, 20 bp, Artificial Sequence
  chemically synthesized
gaggtcatgtgaatgtctca

SEQ ID NO: 52115 - DNA, 20 bp, Artificial Sequence
  chemically synthesized
atgtctcatagatttctcaa

SEQ ID NO: 52116 - DNA, 20 bp, Artificial Sequence
  chemically synthesized
catagatttctcaatggcca

SEQ ID NO: 52117 - DNA, 20 bp, Artificial Sequence
  chemically synthesized
agatttctcaatggccaaag

SEQ ID NO: 52118 - DNA, 20 bp, Artificial Sequence
  chemically synthesized
gcttccttctaatgctttga

SEQ ID NO: 52119 - DNA, 20 bp, Artificial Sequence
  chemically synthesized
ctaatgctttgaaagtgaat

SEQ ID NO: 52120 - DNA, 20 bp, Artificial Sequence
  chemically synthesized
gcatccaccctcccatacgc

SEQ ID NO: 52121 - DNA, 20 bp, Artificial Sequence
  chemically synthesized
atccaccctcccatacgccg

SEQ ID NO: 52122 - DNA, 20 bp, Artificial Sequence
  chemically synthesized
ccaccctcccatacgccgga

SEQ ID NO: 52123 - DNA, 20 bp, Artificial Sequence
  chemically synthesized
ccggagagctgacacaacac

SEQ ID NO: 52124 - DNA, 20 bp, Artificial Sequence
  chemically synthesized
cggagagctgacacaacact

SEQ ID NO: 52125 - DNA, 20 bp, Artificial Sequence
  chemically synthesized
ggagagctgacacaacactg

SEQ ID NO: 52126 - DNA, 20 bp, Artificial Sequence
  chemically synthesized
gagctgacacaacactgggg

SEQ ID NO: 52127 - DNA, 20 bp, Artificial Sequence
  chemically synthesized
ctgacacaacactggggaag

SEQ ID NO: 52128 - DNA, 20 bp, Artificial Sequence
  chemically synthesized
gacacaacactggggaagca

SEQ ID NO: 52129 - DNA, 20 bp, Artificial Sequence
  chemically synthesized
actgacaatatgttttccac

SEQ ID NO: 52130 - DNA, 20 bp, Artificial Sequence
  chemically synthesized
tgttttccaccagccactca

SEQ ID NO: 52131 - DNA, 20 bp, Artificial Sequence
  chemically synthesized
gttttccaccagccactcat

SEQ ID NO: 52132 - DNA, 20 bp, Artificial Sequence
  chemically synthesized
ttttccaccagccactcata

SEQ ID NO: 52133 - DNA, 20 bp, Artificial Sequence
  chemically synthesized
tccaccagccactcataggg

SEQ ID NO: 52134 - DNA, 20 bp, Artificial Sequence
  chemically synthesized
agccactcatagggaagcat

SEQ ID NO: 52135 - DNA, 20 bp, Artificial Sequence
  chemically synthesized
attacatgtctgacacaact

SEQ ID NO: 52136 - DNA, 20 bp, Artificial Sequence
  chemically synthesized
gtctgacacaactgagttgt

SEQ ID NO: 52137 - DNA, 20 bp, Artificial Sequence
  chemically synthesized
cacaactgagttgttggttt

SEQ ID NO: 52138 - DNA, 20 bp, Artificial Sequence
  chemically synthesized
caactgagttgttggtttga

SEQ ID NO: 52139 - DNA, 20 bp, Artificial Sequence
  chemically synthesized
ggtttgagagttatgtttaa

SEQ ID NO: 52140 - DNA, 20 bp, Artificial Sequence
  chemically synthesized
gtttgagagttatgtttaac

SEQ ID NO: 52141 - DNA, 20 bp, Artificial Sequence
  chemically synthesized
tttgagagttatgtttaaca

SEQ ID NO: 52142 - DNA, 20 bp, Artificial Sequence
  chemically synthesized
tgagagttatgtttaacagg

SEQ ID NO: 52143 - DNA, 20 bp, Artificial Sequence
  chemically synthesized
agagttatgtttaacaggga

SEQ ID NO: 52144 - DNA, 20 bp, Artificial Sequence
  chemically synthesized
gttatgtttaacagggagag

SEQ ID NO: 52145 - DNA, 20 bp, Artificial Sequence
  chemically synthesized
ttatgtttaacagggagagt

SEQ ID NO: 52146 - DNA, 20 bp, Artificial Sequence
  chemically synthesized
tgtttaacagggagagtagg

SEQ ID NO: 52147 - DNA, 20 bp, Artificial Sequence
  chemically synthesized
gtttaacagggagagtagga

SEQ ID NO: 52148 - DNA, 20 bp, Artificial Sequence
  chemically synthesized
agagtaggaaggctcatctg

SEQ ID NO: 52149 - DNA, 20 bp, Artificial Sequence
  chemically synthesized
atctgaagacttcatactat

SEQ ID NO: 52150 - DNA, 20 bp, Artificial Sequence
  chemically synthesized
tactatgagtgtttgtgctt

SEQ ID NO: 52151 - DNA, 20 bp, Artificial Sequence
  chemically synthesized
tgagtgtttgtgcttcagat

SEQ ID NO: 52152 - DNA, 20 bp, Artificial Sequence
  chemically synthesized
gagtgtttgtgcttcagatt

SEQ ID NO: 52153 - DNA, 20 bp, Artificial Sequence
  chemically synthesized
gcttcagattaggcaaccta

SEQ ID NO: 52154 - DNA, 20 bp, Artificial Sequence
  chemically synthesized
ctatagaatgtgaaccaaaa

SEQ ID NO: 52155 - DNA, 20 bp, Artificial Sequence
  chemically synthesized
accaaaatagtttgaaataa

SEQ ID NO: 52156 - DNA, 20 bp, Artificial Sequence
  chemically synthesized
aaataatggccgtgacaaaa

SEQ ID NO: 52157 - DNA, 20 bp, Artificial Sequence
  chemically synthesized
acagttaataaaaaatacct

SEQ ID NO: 52158 - DNA, 20 bp, Artificial Sequence
  chemically synthesized
agttaataaaaaatacctaa

SEQ ID NO: 52159 - DNA, 20 bp, Artificial Sequence
  chemically synthesized
aaaatacctaagagtatcct

SEQ ID NO: 52160 - DNA, 20 bp, Artificial Sequence
  chemically synthesized
tcagaaatcattgcttattt

SEQ ID NO: 52161 - DNA, 20 bp, Artificial Sequence
  chemically synthesized
agaaatcattgcttatttta

SEQ ID NO: 52162 - DNA, 20 bp, Artificial Sequence
  chemically synthesized
tataattgtactatgatgat

SEQ ID NO: 52163 - DNA, 20 bp, Artificial Sequence
  chemically synthesized
ctatgatgataagatttatg

SEQ ID NO: 52164 - DNA, 20 bp, Artificial Sequence
  chemically synthesized
ataagatttatgaagaactt

SEQ ID NO: 52165 - DNA, 20 bp, Artificial Sequence
  chemically synthesized
acttcagaatctttacaatt

SEQ ID NO: 52166 - DNA, 20 bp, Artificial Sequence
  chemically synthesized
gaatctttacaattcagcca

SEQ ID NO: 52167 - DNA, 20 bp, Artificial Sequence
  chemically synthesized
aatctttacaattcagccaa

SEQ ID NO: 52168 - DNA, 20 bp, Artificial Sequence
  chemically synthesized
atctttacaattcagccaaa

SEQ ID NO: 52169 - DNA, 20 bp, Artificial Sequence
  chemically synthesized
ctttacaattcagccaaagg

SEQ ID NO: 52170 - DNA, 20 bp, Artificial Sequence
  chemically synthesized
tttacaattcagccaaaggg

SEQ ID NO: 52171 - DNA, 20 bp, Artificial Sequence
  chemically synthesized
tcagccaaagggaggaaaat

SEQ ID NO: 52172 - DNA, 20 bp, Artificial Sequence
  chemically synthesized
tcagtaaaaaaaaaaaaaaa

SEQ ID NO: 52173 - DNA, 20 bp, Artificial Sequence
  chemically synthesized
aaaaaaaaaaaagccaatga

SEQ ID NO: 52174 - DNA, 20 bp, Artificial Sequence
  chemically synthesized
agtaaactttatatgattac

SEQ ID NO: 52175 - DNA, 20 bp, Artificial Sequence
  chemically synthesized
gtaaactttatatgattact

SEQ ID NO: 52176 - DNA, 20 bp, Artificial Sequence
  chemically synthesized
tatgattactgggctttata

SEQ ID NO: 52177 - DNA, 20 bp, Artificial Sequence
  chemically synthesized
attactgggctttatacaga

SEQ ID NO: 52178 - DNA, 20 bp, Artificial Sequence
  chemically synthesized
gggctttatacagaaagaaa

SEQ ID NO: 52179 - DNA, 20 bp, Artificial Sequence
  chemically synthesized
ggctttatacagaaagaaac

SEQ ID NO: 52180 - DNA, 20 bp, Artificial Sequence
  chemically synthesized
tatacagaaagaaacaggtt

SEQ ID NO: 52181 - DNA, 20 bp, Artificial Sequence
  chemically synthesized
aagaaacaggtttagaacat

SEQ ID NO: 52182 - DNA, 20 bp, Artificial Sequence
  chemically synthesized
aaacaggtttagaacattag

SEQ ID NO: 52183 - DNA, 20 bp, Artificial Sequence
  chemically synthesized
ggtttagaacattagtagtt

SEQ ID NO: 52184 - DNA, 20 bp, Artificial Sequence
  chemically synthesized
tttagattgtttgttttgca

SEQ ID NO: 52185 - DNA, 20 bp, Artificial Sequence
  chemically synthesized
ttagattgtttgttttgcaa

SEQ ID NO: 52186 - DNA, 20 bp, Artificial Sequence
  chemically synthesized
gttttgcaaaggcctctatc

SEQ ID NO: 52187 - DNA, 20 bp, Artificial Sequence
  chemically synthesized
ttgcaaaggcctctatctgg

SEQ ID NO: 52188 - DNA, 20 bp, Artificial Sequence
  chemically synthesized
aaaataactaaacctctcct

SEQ ID NO: 52189 - DNA, 20 bp, Artificial Sequence
  chemically synthesized
aaataactaaacctctcctg

SEQ ID NO: 52190 - DNA, 20 bp, Artificial Sequence
  chemically synthesized
taactaaacctctcctgagg

SEQ ID NO: 52191 - DNA, 20 bp, Artificial Sequence
  chemically synthesized
aaacctctcctgaggaagaa

SEQ ID NO: 52192 - DNA, 20 bp, Artificial Sequence
  chemically synthesized
aacctctcctgaggaagaaa

SEQ ID NO: 52193 - DNA, 20 bp, Artificial Sequence
  chemically synthesized
tgaggaagaaaaggcaattt

SEQ ID NO: 52194 - DNA, 20 bp, Artificial Sequence
  chemically synthesized
aggaagaaaaggcaatttca

SEQ ID NO: 52195 - DNA, 20 bp, Artificial Sequence
  chemically synthesized
aaaggcaatttcagagacat

SEQ ID NO: 52196 - DNA, 20 bp, Artificial Sequence
  chemically synthesized
caatttcagagacatcagcc

SEQ ID NO: 52197 - DNA, 20 bp, Artificial Sequence
  chemically synthesized
aatttcagagacatcagccc

SEQ ID NO: 52198 - DNA, 20 bp, Artificial Sequence
  chemically synthesized
gacatcagcccaggtcctga

SEQ ID NO: 52199 - DNA, 20 bp, Artificial Sequence
  chemically synthesized
acatcagcccaggtcctgaa

SEQ ID NO: 52200 - DNA, 20 bp, Artificial Sequence
  chemically synthesized
tcagcccaggtcctgaaagg

SEQ ID NO: 52201 - DNA, 20 bp, Artificial Sequence
  chemically synthesized
agcccaggtcctgaaaggaa

SEQ ID NO: 52202 - DNA, 20 bp, Artificial Sequence
  chemically synthesized
ccaggtcctgaaaggaagag

SEQ ID NO: 52203 - DNA, 20 bp, Artificial Sequence
  chemically synthesized
gtcctgaaaggaagagcaga

SEQ ID NO: 52204 - DNA, 20 bp, Artificial Sequence
  chemically synthesized
cctgaaaggaagagcagatg

SEQ ID NO: 52205 - DNA, 20 bp, Artificial Sequence
  chemically synthesized
aagagcagatggagacatca

SEQ ID NO: 52206 - DNA, 20 bp, Artificial Sequence
  chemically synthesized
agagcagatggagacatcac

SEQ ID NO: 52207 - DNA, 20 bp, Artificial Sequence
  chemically synthesized
aaaacactgtctgttttgaa

SEQ ID NO: 52208 - DNA, 20 bp, Artificial Sequence
  chemically synthesized
gtctgttttgaaaagctaca

SEQ ID NO: 52209 - DNA, 20 bp, Artificial Sequence
  chemically synthesized
tgttttgaaaagctacatag

SEQ ID NO: 52210 - DNA, 20 bp, Artificial Sequence
  chemically synthesized
ttgaaaagctacatagtagc

SEQ ID NO: 52211 - DNA, 20 bp, Artificial Sequence
  chemically synthesized
tgaaaagctacatagtagcc

SEQ ID NO: 52212 - DNA, 20 bp, Artificial Sequence
  chemically synthesized
aaagctacatagtagccagg

SEQ ID NO: 52213 - DNA, 20 bp, Artificial Sequence
  chemically synthesized
agctacatagtagccaggtg

SEQ ID NO: 52214 - DNA, 20 bp, Artificial Sequence
  chemically synthesized
atttttccatatatctcaaa

SEQ ID NO: 52215 - DNA, 20 bp, Artificial Sequence
  chemically synthesized
ttccatatatctcaaaaagc

SEQ ID NO: 52216 - DNA, 20 bp, Artificial Sequence
  chemically synthesized
atctcaaaaagccagcttct

SEQ ID NO: 52217 - DNA, 20 bp, Artificial Sequence
  chemically synthesized
tctcaaaaagccagcttcta

SEQ ID NO: 52218 - DNA, 20 bp, Artificial Sequence
  chemically synthesized
gaaacttgttttccatgaat

SEQ ID NO: 52219 - DNA, 20 bp, Artificial Sequence
  chemically synthesized
aaacttgttttccatgaatt

SEQ ID NO: 52220 - DNA, 20 bp, Artificial Sequence
  chemically synthesized
ttccatgaattaggcaacaa

SEQ ID NO: 52221 - DNA, 20 bp, Artificial Sequence
  chemically synthesized
agctgaaactgttgttgatg

SEQ ID NO: 52222 - DNA, 20 bp, Artificial Sequence
  chemically synthesized
tgaaactgttgttgatgtgg

SEQ ID NO: 52223 - DNA, 20 bp, Artificial Sequence
  chemically synthesized
gttgttgatgtggtagcctg

SEQ ID NO: 52224 - DNA, 20 bp, Artificial Sequence
  chemically synthesized
tgttgatgtggtagcctgca

SEQ ID NO: 52225 - DNA, 20 bp, Artificial Sequence
  chemically synthesized
gatgtggtagcctgcagagc

SEQ ID NO: 52226 - DNA, 20 bp, Artificial Sequence
  chemically synthesized
tggtagcctgcagagccagt

SEQ ID NO: 52227 - DNA, 20 bp, Artificial Sequence
  chemically synthesized
tagcctgcagagccagtgag

SEQ ID NO: 52228 - DNA, 20 bp, Artificial Sequence
  chemically synthesized
cctgcagagccagtgagaag

SEQ ID NO: 52229 - DNA, 20 bp, Artificial Sequence
  chemically synthesized
agccagtgagaagcagttat

SEQ ID NO: 52230 - DNA, 20 bp, Artificial Sequence
  chemically synthesized
cagttatcagattcctttgt

SEQ ID NO: 52231 - DNA, 20 bp, Artificial Sequence
  chemically synthesized
agttatcagattcctttgta

SEQ ID NO: 52232 - DNA, 20 bp, Artificial Sequence
  chemically synthesized
gattcctttgtaaggcctgc

SEQ ID NO: 52233 - DNA, 20 bp, Artificial Sequence
  chemically synthesized
attcctttgtaaggcctgca

SEQ ID NO: 52234 - DNA, 20 bp, Artificial Sequence
  chemically synthesized
aggcctgcaaggctactatc

SEQ ID NO: 52235 - DNA, 20 bp, Artificial Sequence
  chemically synthesized
ggctactatccagcgtcact

SEQ ID NO: 52236 - DNA, 20 bp, Artificial Sequence
  chemically synthesized
actgagaaacgttacgaaaa

SEQ ID NO: 52237 - DNA, 20 bp, Artificial Sequence
  chemically synthesized
aaacgttacgaaaacagcca

SEQ ID NO: 52238 - DNA, 20 bp, Artificial Sequence
  chemically synthesized
gaaaacagccacagtgatgt

SEQ ID NO: 52239 - DNA, 20 bp, Artificial Sequence
  chemically synthesized
aaaacagccacagtgatgtt

SEQ ID NO: 52240 - DNA, 20 bp, Artificial Sequence
  chemically synthesized
aaacagccacagtgatgtta

SEQ ID NO: 52241 - DNA, 20 bp, Artificial Sequence
  chemically synthesized
acagtgatgttagggaaaca

SEQ ID NO: 52242 - DNA, 20 bp, Artificial Sequence
  chemically synthesized
ttttgcctttttttttttaa

SEQ ID NO: 52243 - DNA, 20 bp, Artificial Sequence
  chemically synthesized
tttgcctttttttttttaat

SEQ ID NO: 52244 - DNA, 20 bp, Artificial Sequence
  chemically synthesized
gcctttttttttttaatagg

SEQ ID NO: 52245 - DNA, 20 bp, Artificial Sequence
  chemically synthesized
tgtaactgctgccttaaatg

SEQ ID NO: 52246 - DNA, 20 bp, Artificial Sequence
  chemically synthesized
tgctgccttaaatgaagtca

SEQ ID NO: 52247 - DNA, 20 bp, Artificial Sequence
  chemically synthesized
gaagtcacggttattataat

SEQ ID NO: 52248 - DNA, 20 bp, Artificial Sequence
  chemically synthesized
aagtcacggttattataata

SEQ ID NO: 52249 - DNA, 20 bp, Artificial Sequence
  chemically synthesized
gtcacggttattataataag

SEQ ID NO: 52250 - DNA, 20 bp, Artificial Sequence
  chemically synthesized
gagaaaacaaaaatattgcc

SEQ ID NO: 52251 - DNA, 20 bp, Artificial Sequence
  chemically synthesized
acaaaaatattgccgagaac

SEQ ID NO: 52252 - DNA, 20 bp, Artificial Sequence
  chemically synthesized
caaaaatattgccgagaaca

SEQ ID NO: 52253 - DNA, 20 bp, Artificial Sequence
  chemically synthesized
tgccgagaacaaggtgacaa

SEQ ID NO: 52254 - DNA, 20 bp, Artificial Sequence
  chemically synthesized
gagaacaaggtgacaaaagt

SEQ ID NO: 52255 - DNA, 20 bp, Artificial Sequence
  chemically synthesized
aaggtgacaaaagtaagatt

SEQ ID NO: 52256 - DNA, 20 bp, Artificial Sequence
  chemically synthesized
aaaagtaagattcagaaaat

SEQ ID NO: 52257 - DNA, 20 bp, Artificial Sequence
  chemically synthesized
gtaagattcagaaaatcaga

SEQ ID NO: 52258 - DNA, 20 bp, Artificial Sequence
  chemically synthesized
attcagaaaatcagaaagtc

SEQ ID NO: 52259 - DNA, 20 bp, Artificial Sequence
  chemically synthesized
catttaactcttacaccgaa

SEQ ID NO: 52260 - DNA, 20 bp, Artificial Sequence
  chemically synthesized
aactcttacaccgaaaagct

SEQ ID NO: 52261 - DNA, 20 bp, Artificial Sequence
  chemically synthesized
actcttacaccgaaaagcta

SEQ ID NO: 52262 - DNA, 20 bp, Artificial Sequence
  chemically synthesized
tacaccgaaaagctaaggtc

SEQ ID NO: 52263 - DNA, 20 bp, Artificial Sequence
  chemically synthesized
accgaaaagctaaggtccag

SEQ ID NO: 52264 - DNA, 20 bp, Artificial Sequence
  chemically synthesized
ccgaaaagctaaggtccagt

SEQ ID NO: 52265 - DNA, 20 bp, Artificial Sequence
  chemically synthesized
gaaaagctaaggtccagtgg

SEQ ID NO: 52266 - DNA, 20 bp, Artificial Sequence
  chemically synthesized
taaggtccagtgggagaaat

SEQ ID NO: 52267 - DNA, 20 bp, Artificial Sequence
  chemically synthesized
tgggagaaatcagtgattct

SEQ ID NO: 52268 - DNA, 20 bp, Artificial Sequence
  chemically synthesized
gagaaatcagtgattcttag

SEQ ID NO: 52269 - DNA, 20 bp, Artificial Sequence
  chemically synthesized
aatcagtgattcttagaagt

SEQ ID NO: 52270 - DNA, 20 bp, Artificial Sequence
  chemically synthesized
tcagtgattcttagaagtga

SEQ ID NO: 52271 - DNA, 20 bp, Artificial Sequence
  chemically synthesized
cagtgattcttagaagtgag

SEQ ID NO: 52272 - DNA, 20 bp, Artificial Sequence
  chemically synthesized
agaagtgagaggacatgatt

SEQ ID NO: 52273 - DNA, 20 bp, Artificial Sequence
  chemically synthesized
gaagtgagaggacatgattc

SEQ ID NO: 52274 - DNA, 20 bp, Artificial Sequence
  chemically synthesized
gagaggacatgattcaggat

SEQ ID NO: 52275 - DNA, 20 bp, Artificial Sequence
  chemically synthesized
caggattagaaatgtgtttt

SEQ ID NO: 52276 - DNA, 20 bp, Artificial Sequence
  chemically synthesized
atctgctaataataaatcca

SEQ ID NO: 52277 - DNA, 20 bp, Artificial Sequence
  chemically synthesized
tctgctaataataaatccac

SEQ ID NO: 52278 - DNA, 20 bp, Artificial Sequence
  chemically synthesized
gctaataataaatccacagg

SEQ ID NO: 52279 - DNA, 20 bp, Artificial Sequence
  chemically synthesized
ggcagatgttcactgtacac

SEQ ID NO: 52280 - DNA, 20 bp, Artificial Sequence
  chemically synthesized
agatgttcactgtacaccag

SEQ ID NO: 52281 - DNA, 20 bp, Artificial Sequence
  chemically synthesized
ccagcagtcttcaatgtttt

SEQ ID NO: 52282 - DNA, 20 bp, Artificial Sequence
  chemically synthesized
gtcttcaatgtttttggtac

SEQ ID NO: 52283 - DNA, 20 bp, Artificial Sequence
  chemically synthesized
tcttcaatgtttttggtacc

SEQ ID NO: 52284 - DNA, 20 bp, Artificial Sequence
  chemically synthesized
cttcaatgtttttggtacca

SEQ ID NO: 52285 - DNA, 20 bp, Artificial Sequence
  chemically synthesized
ggtaccagggactgcttttg

SEQ ID NO: 52286 - DNA, 20 bp, Artificial Sequence
  chemically synthesized
accagggactgcttttgtgg

SEQ ID NO: 52287 - DNA, 20 bp, Artificial Sequence
  chemically synthesized
ggactgcttttgtggaagac

SEQ ID NO: 52288 - DNA, 20 bp, Artificial Sequence
  chemically synthesized
gactgcttttgtggaagaca

SEQ ID NO: 52289 - DNA, 20 bp, Artificial Sequence
  chemically synthesized
cttttgtggaagacaaggtg

SEQ ID NO: 52290 - DNA, 20 bp, Artificial Sequence
  chemically synthesized
ttttgtggaagacaaggtgc

SEQ ID NO: 52291 - DNA, 20 bp, Artificial Sequence
  chemically synthesized
ttgtggaagacaaggtgcag

SEQ ID NO: 52292 - DNA, 20 bp, Artificial Sequence
  chemically synthesized
tgtggaagacaaggtgcagg

SEQ ID NO: 52293 - DNA, 20 bp, Artificial Sequence
  chemically synthesized
gtggaagacaaggtgcagga

SEQ ID NO: 52294 - DNA, 20 bp, Artificial Sequence
  chemically synthesized
agacaaggtgcaggagggca

SEQ ID NO: 52295 - DNA, 20 bp, Artificial Sequence
  chemically synthesized
ggtgcaggagggcatggttt

SEQ ID NO: 52296 - DNA, 20 bp, Artificial Sequence
  chemically synthesized
gtgcaggagggcatggtttc

SEQ ID NO: 52297 - DNA, 20 bp, Artificial Sequence
  chemically synthesized
aggatgaaactgttccacct

SEQ ID NO: 52298 - DNA, 20 bp, Artificial Sequence
  chemically synthesized
gatgaaactgttccacctca

SEQ ID NO: 52299 - DNA, 20 bp, Artificial Sequence
  chemically synthesized
actgttccacctcagagcat

SEQ ID NO: 52300 - DNA, 20 bp, Artificial Sequence
  chemically synthesized
ctgttccacctcagagcatt

SEQ ID NO: 52301 - DNA, 20 bp, Artificial Sequence
  chemically synthesized
cacctcagagcattaggcat

SEQ ID NO: 52302 - DNA, 20 bp, Artificial Sequence
  chemically synthesized
attaggcattagattctcat

SEQ ID NO: 52303 - DNA, 20 bp, Artificial Sequence
  chemically synthesized
aggcattagattctcataag

SEQ ID NO: 52304 - DNA, 20 bp, Artificial Sequence
  chemically synthesized
tctcataagaagccgcaacc

SEQ ID NO: 52305 - DNA, 20 bp, Artificial Sequence
  chemically synthesized
gatcccttgcatgcctctat

SEQ ID NO: 52306 - DNA, 20 bp, Artificial Sequence
  chemically synthesized
tgccgccactgccgatgtga

SEQ ID NO: 52307 - DNA, 20 bp, Artificial Sequence
  chemically synthesized
gccgccactgccgatgtgac

SEQ ID NO: 52308 - DNA, 20 bp, Artificial Sequence
  chemically synthesized
cgccactgccgatgtgacag

SEQ ID NO: 52309 - DNA, 20 bp, Artificial Sequence
  chemically synthesized
gccactgccgatgtgacagg

SEQ ID NO: 52310 - DNA, 20 bp, Artificial Sequence
  chemically synthesized
cactgccgatgtgacaggag

SEQ ID NO: 52311 - DNA, 20 bp, Artificial Sequence
  chemically synthesized
actgccgatgtgacaggagg

SEQ ID NO: 52312 - DNA, 20 bp, Artificial Sequence
  chemically synthesized
tgccgatgtgacaggaggag

SEQ ID NO: 52313 - DNA, 20 bp, Artificial Sequence
  chemically synthesized
atgtgacaggaggaggagct

SEQ ID NO: 52314 - DNA, 20 bp, Artificial Sequence
  chemically synthesized
tgtgacaggaggaggagctc

SEQ ID NO: 52315 - DNA, 20 bp, Artificial Sequence
  chemically synthesized
gacaggaggaggagctcagg

SEQ ID NO: 52316 - DNA, 20 bp, Artificial Sequence
  chemically synthesized
cttgctcatccccctgctgt

SEQ ID NO: 52317 - DNA, 20 bp, Artificial Sequence
  chemically synthesized
tcatccccctgctgtgagac

SEQ ID NO: 52318 - DNA, 20 bp, Artificial Sequence
  chemically synthesized
catccccctgctgtgagacc

SEQ ID NO: 52319 - DNA, 20 bp, Artificial Sequence
  chemically synthesized
ctgctgtgagaccaggttcc

SEQ ID NO: 52320 - DNA, 20 bp, Artificial Sequence
  chemically synthesized
ctgtgagaccaggttcctag

SEQ ID NO: 52321 - DNA, 20 bp, Artificial Sequence
  chemically synthesized
tgtgagaccaggttcctagc

SEQ ID NO: 52322 - DNA, 20 bp, Artificial Sequence
  chemically synthesized
accaggttcctagcaggcca

SEQ ID NO: 52323 - DNA, 20 bp, Artificial Sequence
  chemically synthesized
gttcctagcaggccacggac

SEQ ID NO: 52324 - DNA, 20 bp, Artificial Sequence
  chemically synthesized
agcaggccacggaccagtac

SEQ ID NO: 52325 - DNA, 20 bp, Artificial Sequence
  chemically synthesized
ggccacggaccagtactggt

SEQ ID NO: 52326 - DNA, 20 bp, Artificial Sequence
  chemically synthesized
cacggaccagtactggtaag

SEQ ID NO: 52327 - DNA, 20 bp, Artificial Sequence
  chemically synthesized
gaccagtactggtaagtggc

SEQ ID NO: 52328 - DNA, 20 bp, Artificial Sequence
  chemically synthesized
accagtactggtaagtggcc

SEQ ID NO: 52329 - DNA, 20 bp, Artificial Sequence
  chemically synthesized
actatacctccctattttcc

SEQ ID NO: 52330 - DNA, 20 bp, Artificial Sequence
  chemically synthesized
ctatacctccctattttcct

SEQ ID NO: 52331 - DNA, 20 bp, Artificial Sequence
  chemically synthesized
atcaaaatcgtattgttaaa

SEQ ID NO: 52332 - DNA, 20 bp, Artificial Sequence
  chemically synthesized
tcgtattgttaaacagactt

SEQ ID NO: 52333 - DNA, 20 bp, Artificial Sequence
  chemically synthesized
gtattgttaaacagacttaa

SEQ ID NO: 52334 - DNA, 20 bp, Artificial Sequence
  chemically synthesized
acttaagagatgttctactt

SEQ ID NO: 52335 - DNA, 20 bp, Artificial Sequence
  chemically synthesized
cttaagagatgttctacttg

SEQ ID NO: 52336 - DNA, 20 bp, Artificial Sequence
  chemically synthesized
gaggttgtgtctccattccc

SEQ ID NO: 52337 - DNA, 20 bp, Artificial Sequence
  chemically synthesized
aggttgtgtctccattccct

SEQ ID NO: 52338 - DNA, 20 bp, Artificial Sequence
  chemically synthesized
atatttgttaccattacttg

SEQ ID NO: 52339 - DNA, 20 bp, Artificial Sequence
  chemically synthesized
tttgttaccattacttgcag

SEQ ID NO: 52340 - DNA, 20 bp, Artificial Sequence
  chemically synthesized
tacttgcagaagataattgc

SEQ ID NO: 52341 - DNA, 20 bp, Artificial Sequence
  chemically synthesized
cttgcagaagataattgcta

SEQ ID NO: 52342 - DNA, 20 bp, Artificial Sequence
  chemically synthesized
gcagaagataattgctagag

SEQ ID NO: 52343 - DNA, 20 bp, Artificial Sequence
  chemically synthesized
ataattgctagagtagtgaa

SEQ ID NO: 52344 - DNA, 20 bp, Artificial Sequence
  chemically synthesized
aattgctagagtagtgaata

SEQ ID NO: 52345 - DNA, 20 bp, Artificial Sequence
  chemically synthesized
attgctagagtagtgaatag

SEQ ID NO: 52346 - DNA, 20 bp, Artificial Sequence
  chemically synthesized
gagtagtgaatagaggcctc

SEQ ID NO: 52347 - DNA, 20 bp, Artificial Sequence
  chemically synthesized
tgaatagaggcctccagatg

SEQ ID NO: 52348 - DNA, 20 bp, Artificial Sequence
  chemically synthesized
gaatagaggcctccagatga

SEQ ID NO: 52349 - DNA, 20 bp, Artificial Sequence
  chemically synthesized
ccagatgaaggaaataaaaa

SEQ ID NO: 52350 - DNA, 20 bp, Artificial Sequence
  chemically synthesized
ataaaaatagtccattttcc

SEQ ID NO: 52351 - DNA, 20 bp, Artificial Sequence
  chemically synthesized
aaaatagtccattttcccag

SEQ ID NO: 52352 - DNA, 20 bp, Artificial Sequence
  chemically synthesized
attttcccagaagtctcttg

SEQ ID NO: 52353 - DNA, 20 bp, Artificial Sequence
  chemically synthesized
cttaaaaattaatgccaacc

SEQ ID NO: 52354 - DNA, 20 bp, Artificial Sequence
  chemically synthesized
aaattaatgccaacctagcc

SEQ ID NO: 52355 - DNA, 20 bp, Artificial Sequence
  chemically synthesized
cctagccaagaacacccctg

SEQ ID NO: 52356 - DNA, 20 bp, Artificial Sequence
  chemically synthesized
agccaagaacacccctgcag

SEQ ID NO: 52357 - DNA, 20 bp, Artificial Sequence
  chemically synthesized
gccaagaacacccctgcagt

SEQ ID NO: 52358 - DNA, 20 bp, Artificial Sequence
  chemically synthesized
caagaacacccctgcagtag

SEQ ID NO: 52359 - DNA, 20 bp, Artificial Sequence
  chemically synthesized
cagtaggagtcgatgtccta

SEQ ID NO: 52360 - DNA, 20 bp, Artificial Sequence
  chemically synthesized
tcgatgtcctaaagcttttc

SEQ ID NO: 52361 - DNA, 20 bp, Artificial Sequence
  chemically synthesized
tcctaaagcttttccagtaa

SEQ ID NO: 52362 - DNA, 20 bp, Artificial Sequence
  chemically synthesized
aagcttttccagtaaaagtg

SEQ ID NO: 52363 - DNA, 20 bp, Artificial Sequence
  chemically synthesized
aagtgtggtttctgcccctg

SEQ ID NO: 52364 - DNA, 20 bp, Artificial Sequence
  chemically synthesized
ggtttctgcccctgcagtct

SEQ ID NO: 52365 - DNA, 20 bp, Artificial Sequence
  chemically synthesized
gcagtcttggcaccatgtaa

SEQ ID NO: 52366 - DNA, 20 bp, Artificial Sequence
  chemically synthesized
tggcaccatgtaatggcaca

SEQ ID NO: 52367 - DNA, 20 bp, Artificial Sequence
  chemically synthesized
gtaatggcacatagaaaatg

SEQ ID NO: 52368 - DNA, 20 bp, Artificial Sequence
  chemically synthesized
taatggcacatagaaaatgc

SEQ ID NO: 52369 - DNA, 20 bp, Artificial Sequence
  chemically synthesized
acatagaaaatgcaggcttt

SEQ ID NO: 52370 - DNA, 20 bp, Artificial Sequence
  chemically synthesized
catagaaaatgcaggctttc

SEQ ID NO: 52371 - DNA, 20 bp, Artificial Sequence
  chemically synthesized
aaatgcaggctttcaggttg

SEQ ID NO: 52372 - DNA, 20 bp, Artificial Sequence
  chemically synthesized
gcaggctttcaggttgcagc

SEQ ID NO: 52373 - DNA, 20 bp, Artificial Sequence
  chemically synthesized
ttcaggttgcagccagaact

SEQ ID NO: 52374 - DNA, 20 bp, Artificial Sequence
  chemically synthesized
tcaggttgcagccagaactg

SEQ ID NO: 52375 - DNA, 20 bp, Artificial Sequence
  chemically synthesized
gccagaactgaggaatcaat

SEQ ID NO: 52376 - DNA, 20 bp, Artificial Sequence
  chemically synthesized
ctgaggaatcaatcggtgtt

SEQ ID NO: 52377 - DNA, 20 bp, Artificial Sequence
  chemically synthesized
tcaatcggtgtttagctttt

SEQ ID NO: 52378 - DNA, 20 bp, Artificial Sequence
  chemically synthesized
gtgtttagcttttgagatgc

SEQ ID NO: 52379 - DNA, 20 bp, Artificial Sequence
  chemically synthesized
gctggtaatgttctctttct

SEQ ID NO: 52380 - DNA, 20 bp, Artificial Sequence
  chemically synthesized
aatgttctctttcttggtct

SEQ ID NO: 52381 - DNA, 20 bp, Artificial Sequence
  chemically synthesized
ttggtctgagtgtttgttaa

SEQ ID NO: 52382 - DNA, 20 bp, Artificial Sequence
  chemically synthesized
gaataataaaatataaattt

SEQ ID NO: 52383 - DNA, 20 bp, Artificial Sequence
  chemically synthesized
aatataaatttaagaaatat

SEQ ID NO: 52384 - DNA, 20 bp, Artificial Sequence
  chemically synthesized
aatttaagaaatatgagtga

SEQ ID NO: 52385 - DNA, 20 bp, Artificial Sequence
  chemically synthesized
tgtcaatttacatataaacc

SEQ ID NO: 52386 - DNA, 20 bp, Artificial Sequence
  chemically synthesized
caatttacatataaacctgg

SEQ ID NO: 52387 - DNA, 20 bp, Artificial Sequence
  chemically synthesized
ctactttctctaatccacta

SEQ ID NO: 52388 - DNA, 20 bp, Artificial Sequence
  chemically synthesized
tctctaatccactaaagcta

SEQ ID NO: 52389 - DNA, 20 bp, Artificial Sequence
  chemically synthesized
actaaagctatagatgtaca

SEQ ID NO: 52390 - DNA, 20 bp, Artificial Sequence
  chemically synthesized
taaagctatagatgtacaca

SEQ ID NO: 52391 - DNA, 20 bp, Artificial Sequence
  chemically synthesized
atgtacacagagacactgtg

SEQ ID NO: 52392 - DNA, 20 bp, Artificial Sequence
  chemically synthesized
cagagacactgtgaagaaaa

SEQ ID NO: 52393 - DNA, 20 bp, Artificial Sequence
  chemically synthesized
atatgtatgaacaaattgat

SEQ ID NO: 52394 - DNA, 20 bp, Artificial Sequence
  chemically synthesized
aaatatgattttttaaaaaa

SEQ ID NO: 52395 - DNA, 20 bp, Artificial Sequence
  chemically synthesized
tgattttttaaaaaacagaa

SEQ ID NO: 52396 - DNA, 20 bp, Artificial Sequence
  chemically synthesized
gattttttaaaaaacagaac

SEQ ID NO: 52397 - DNA, 20 bp, Artificial Sequence
  chemically synthesized
atctgaaatctatatgtcta

SEQ ID NO: 52398 - DNA, 20 bp, Artificial Sequence
  chemically synthesized
aaatctatatgtctacagaa

SEQ ID NO: 52399 - DNA, 20 bp, Artificial Sequence
  chemically synthesized
aatctatatgtctacagaaa

SEQ ID NO: 52400 - DNA, 20 bp, Artificial Sequence
  chemically synthesized
ctacagaaaaggataccaat

SEQ ID NO: 52401 - DNA, 20 bp, Artificial Sequence
  chemically synthesized
gagaaaaaacgttatctgca

SEQ ID NO: 52402 - DNA, 20 bp, Artificial Sequence
  chemically synthesized
gaaaaaacgttatctgcaaa

SEQ ID NO: 52403 - DNA, 20 bp, Artificial Sequence
  chemically synthesized
tatctgcaaagagcattttc

SEQ ID NO: 52404 - DNA, 20 bp, Artificial Sequence
  chemically synthesized
gagcattttctggaaaaaca

SEQ ID NO: 52405 - DNA, 20 bp, Artificial Sequence
  chemically synthesized
aaacacagaaattacttata

SEQ ID NO: 52406 - DNA, 20 bp, Artificial Sequence
  chemically synthesized
attacttataaagcattcgt

SEQ ID NO: 52407 - DNA, 20 bp, Artificial Sequence
  chemically synthesized
ttacttataaagcattcgtg

SEQ ID NO: 52408 - DNA, 20 bp, Artificial Sequence
  chemically synthesized
tacttataaagcattcgtga

SEQ ID NO: 52409 - DNA, 20 bp, Artificial Sequence
  chemically synthesized
acttataaagcattcgtgag

SEQ ID NO: 52410 - DNA, 20 bp, Artificial Sequence
  chemically synthesized
tataaagcattcgtgagggg

SEQ ID NO: 52411 - DNA, 20 bp, Artificial Sequence
  chemically synthesized
ataaagcattcgtgaggggt

SEQ ID NO: 52412 - DNA, 20 bp, Artificial Sequence
  chemically synthesized
taaagcattcgtgaggggta

SEQ ID NO: 52413 - DNA, 20 bp, Artificial Sequence
  chemically synthesized
gtgaggggtagggctaaaaa

SEQ ID NO: 52414 - DNA, 20 bp, Artificial Sequence
  chemically synthesized
aggggtagggctaaaaatgg

SEQ ID NO: 52415 - DNA, 20 bp, Artificial Sequence
  chemically synthesized
tagggctaaaaatggtagaa

SEQ ID NO: 52416 - DNA, 20 bp, Artificial Sequence
  chemically synthesized
agggctaaaaatggtagaaa

SEQ ID NO: 52417 - DNA, 20 bp, Artificial Sequence
  chemically synthesized
gaaaaggtgaatacctgttt

SEQ ID NO: 52418 - DNA, 20 bp, Artificial Sequence
  chemically synthesized
aaaaggtgaatacctgttta

SEQ ID NO: 52419 - DNA, 20 bp, Artificial Sequence
  chemically synthesized
acctgtttaaggttgcctaa

SEQ ID NO: 52420 - DNA, 20 bp, Artificial Sequence
  chemically synthesized
gtttaaggttgcctaaaaga

SEQ ID NO: 52421 - DNA, 20 bp, Artificial Sequence
  chemically synthesized
aaggttgcctaaaagatagc

SEQ ID NO: 52422 - DNA, 20 bp, Artificial Sequence
  chemically synthesized
aggttgcctaaaagatagcc

SEQ ID NO: 52423 - DNA, 20 bp, Artificial Sequence
  chemically synthesized
gccaggtactcatttctctt

SEQ ID NO: 52424 - DNA, 20 bp, Artificial Sequence
  chemically synthesized
tactcatttctctttagttc

SEQ ID NO: 52425 - DNA, 20 bp, Artificial Sequence
  chemically synthesized
tttagttctggcaaaatgat

SEQ ID NO: 52426 - DNA, 20 bp, Artificial Sequence
  chemically synthesized
ggcaaaatgattagtgtctg

SEQ ID NO: 52427 - DNA, 20 bp, Artificial Sequence
  chemically synthesized
taaccaaatcaatgatgatc

SEQ ID NO: 52428 - DNA, 20 bp, Artificial Sequence
  chemically synthesized
atcaatgatgatccagacac

SEQ ID NO: 52429 - DNA, 20 bp, Artificial Sequence
  chemically synthesized
tcaatgatgatccagacact

SEQ ID NO: 52430 - DNA, 20 bp, Artificial Sequence
  chemically synthesized
gatccagacactgggaaatt

SEQ ID NO: 52431 - DNA, 20 bp, Artificial Sequence
  chemically synthesized
acactgggaaattcagtgca

SEQ ID NO: 52432 - DNA, 20 bp, Artificial Sequence
  chemically synthesized
cactgggaaattcagtgcaa

SEQ ID NO: 52433 - DNA, 20 bp, Artificial Sequence
  chemically synthesized
aaattcagtgcaaaggatgc

SEQ ID NO: 52434 - DNA, 20 bp, Artificial Sequence
  chemically synthesized
aattcagtgcaaaggatgcc

SEQ ID NO: 52435 - DNA, 20 bp, Artificial Sequence
  chemically synthesized
gtgcaaaggatgccaggact

SEQ ID NO: 52436 - DNA, 20 bp, Artificial Sequence
  chemically synthesized
tgcaaaggatgccaggacta

SEQ ID NO: 52437 - DNA, 20 bp, Artificial Sequence
  chemically synthesized
ctaaggtgtaatatatgaaa

SEQ ID NO: 52438 - DNA, 20 bp, Artificial Sequence
  chemically synthesized
aaggtgtaatatatgaaaca

SEQ ID NO: 52439 - DNA, 20 bp, Artificial Sequence
  chemically synthesized
ggtgtaatatatgaaacaga

SEQ ID NO: 52440 - DNA, 20 bp, Artificial Sequence
  chemically synthesized
gaaacagagagattatgcaa

SEQ ID NO: 52441 - DNA, 20 bp, Artificial Sequence
  chemically synthesized
gaatgatgataaactgtctc

SEQ ID NO: 52442 - DNA, 20 bp, Artificial Sequence
  chemically synthesized
atgatgataaactgtctcaa

SEQ ID NO: 52443 - DNA, 20 bp, Artificial Sequence
  chemically synthesized
tgataaactgtctcaagaga

SEQ ID NO: 52444 - DNA, 20 bp, Artificial Sequence
  chemically synthesized
gataaactgtctcaagagaa

SEQ ID NO: 52445 - DNA, 20 bp, Artificial Sequence
  chemically synthesized
gtctcaagagaaaggactaa

SEQ ID NO: 52446 - DNA, 20 bp, Artificial Sequence
  chemically synthesized
gagaaaggactaatagatat

SEQ ID NO: 52447 - DNA, 20 bp, Artificial Sequence
  chemically synthesized
actaatagatattggcattt

SEQ ID NO: 52448 - DNA, 20 bp, Artificial Sequence
  chemically synthesized
gcatttgagtattcgcttac

SEQ ID NO: 52449 - DNA, 20 bp, Artificial Sequence
  chemically synthesized
tgagtattcgcttactggat

SEQ ID NO: 52450 - DNA, 20 bp, Artificial Sequence
  chemically synthesized
tattcgcttactggattagc

SEQ ID NO: 52451 - DNA, 20 bp, Artificial Sequence
  chemically synthesized
attcgcttactggattagct

SEQ ID NO: 52452 - DNA, 20 bp, Artificial Sequence
  chemically synthesized
tagctaggcttctttctgat

SEQ ID NO: 52453 - DNA, 20 bp, Artificial Sequence
  chemically synthesized
ttctttctgatcagccttca

SEQ ID NO: 52454 - DNA, 20 bp, Artificial Sequence
  chemically synthesized
tgatcagccttcaaagtaac

SEQ ID NO: 52455 - DNA, 20 bp, Artificial Sequence
  chemically synthesized
cagccttcaaagtaactggc

SEQ ID NO: 52456 - DNA, 20 bp, Artificial Sequence
  chemically synthesized
aactaattgtaccgtgttca

SEQ ID NO: 52457 - DNA, 20 bp, Artificial Sequence
  chemically synthesized
ttttattattattatacttt

SEQ ID NO: 52458 - DNA, 20 bp, Artificial Sequence
  chemically synthesized
tattattatactttaagttt

SEQ ID NO: 52459 - DNA, 20 bp, Artificial Sequence
  chemically synthesized
attattatactttaagtttt

SEQ ID NO: 52460 - DNA, 20 bp, Artificial Sequence
  chemically synthesized
ttattatactttaagtttta

SEQ ID NO: 52461 - DNA, 20 bp, Artificial Sequence
  chemically synthesized
gggtacatgtgcacaatgtg

SEQ ID NO: 52462 - DNA, 20 bp, Artificial Sequence
  chemically synthesized
ggtacatgtgcacaatgtgc

SEQ ID NO: 52463 - DNA, 20 bp, Artificial Sequence
  chemically synthesized
catgtgcacaatgtgcaggt

SEQ ID NO: 52464 - DNA, 20 bp, Artificial Sequence
  chemically synthesized
tatgtatacatgtgccatgc

SEQ ID NO: 52465 - DNA, 20 bp, Artificial Sequence
  chemically synthesized
tcacccattaactcatcatt

SEQ ID NO: 52466 - DNA, 20 bp, Artificial Sequence
  chemically synthesized
attaactcatcatttagcat

SEQ ID NO: 52467 - DNA, 20 bp, Artificial Sequence
  chemically synthesized
ttaactcatcatttagcatt

SEQ ID NO: 52468 - DNA, 20 bp, Artificial Sequence
  chemically synthesized
tccctccccccaccccacaa

SEQ ID NO: 52469 - DNA, 20 bp, Artificial Sequence
  chemically synthesized
ccccaccccacaacagtccc

SEQ ID NO: 52470 - DNA, 20 bp, Artificial Sequence
  chemically synthesized
ccaccccacaacagtcccca

SEQ ID NO: 52471 - DNA, 20 bp, Artificial Sequence
  chemically synthesized
attgttcaattcccacctat

SEQ ID NO: 52472 - DNA, 20 bp, Artificial Sequence
  chemically synthesized
ttcaattcccacctatgagt

SEQ ID NO: 52473 - DNA, 20 bp, Artificial Sequence
  chemically synthesized
cacctatgagtgagaacatg

SEQ ID NO: 52474 - DNA, 20 bp, Artificial Sequence
  chemically synthesized
gagtgagaacatgcagtgtt

SEQ ID NO: 52475 - DNA, 20 bp, Artificial Sequence
  chemically synthesized
ttggtttttcgtccttgcga

SEQ ID NO: 52476 - DNA, 20 bp, Artificial Sequence
  chemically synthesized
cgtccttgcgatagtttact

SEQ ID NO: 52477 - DNA, 20 bp, Artificial Sequence
  chemically synthesized
atttcatccatgtccctaca

SEQ ID NO: 52478 - DNA, 20 bp, Artificial Sequence
  chemically synthesized
tttcatccatgtccctacaa

SEQ ID NO: 52479 - DNA, 20 bp, Artificial Sequence
  chemically synthesized
catgaactcatcctttttta

SEQ ID NO: 52480 - DNA, 20 bp, Artificial Sequence
  chemically synthesized
catccttttttatggctgca

SEQ ID NO: 52481 - DNA, 20 bp, Artificial Sequence
  chemically synthesized
tatggctgcatagtattcca

SEQ ID NO: 52482 - DNA, 20 bp, Artificial Sequence
  chemically synthesized
tgtgccacattttcttaatc

SEQ ID NO: 52483 - DNA, 20 bp, Artificial Sequence
  chemically synthesized
ttaatccagtctatcattgt

SEQ ID NO: 52484 - DNA, 20 bp, Artificial Sequence
  chemically synthesized
gtctatcattgttggacatt

SEQ ID NO: 52485 - DNA, 20 bp, Artificial Sequence
  chemically synthesized
tctatcattgttggacattt

SEQ ID NO: 52486 - DNA, 20 bp, Artificial Sequence
  chemically synthesized
tcattgttggacatttgggt

SEQ ID NO: 52487 - DNA, 20 bp, Artificial Sequence
  chemically synthesized
tggacatttgggttggttcc

SEQ ID NO: 52488 - DNA, 20 bp, Artificial Sequence
  chemically synthesized
caagtctttgctattgtgaa

SEQ ID NO: 52489 - DNA, 20 bp, Artificial Sequence
  chemically synthesized
aaattgcatttacaaacctt

SEQ ID NO: 52490 - DNA, 20 bp, Artificial Sequence
  chemically synthesized
tgcatttacaaacctttagc

SEQ ID NO: 52491 - DNA, 20 bp, Artificial Sequence
  chemically synthesized
aaacctttagctagacatga

SEQ ID NO: 52492 - DNA, 20 bp, Artificial Sequence
  chemically synthesized
agctagacatgaaagttctc

SEQ ID NO: 52493 - DNA, 20 bp, Artificial Sequence
  chemically synthesized
ttctccagttccatatttca

SEQ ID NO: 52494 - DNA, 20 bp, Artificial Sequence
  chemically synthesized
ccagttccatatttcatggt

SEQ ID NO: 52495 - DNA, 20 bp, Artificial Sequence
  chemically synthesized
cagttccatatttcatggtg

SEQ ID NO: 52496 - DNA, 20 bp, Artificial Sequence
  chemically synthesized
atatttcatggtgaggaaca

SEQ ID NO: 52497 - DNA, 20 bp, Artificial Sequence
  chemically synthesized
atggtgaggaacaaagaata

SEQ ID NO: 52498 - DNA, 20 bp, Artificial Sequence
  chemically synthesized
gtgaggaacaaagaatatgg

SEQ ID NO: 52499 - DNA, 20 bp, Artificial Sequence
  chemically synthesized
tgaggaacaaagaatatggt

SEQ ID NO: 52500 - DNA, 20 bp, Artificial Sequence
  chemically synthesized
gaggaacaaagaatatggtg

SEQ ID NO: 52501 - DNA, 20 bp, Artificial Sequence
  chemically synthesized
ttgttcctcaccatgaaata

SEQ ID NO: 52502 - DNA, 20 bp, Artificial Sequence
  chemically synthesized
ctcaccatgaaatatggaac

SEQ ID NO: 52503 - DNA, 20 bp, Artificial Sequence
  chemically synthesized
caccatgaaatatggaactg

SEQ ID NO: 52504 - DNA, 20 bp, Artificial Sequence
  chemically synthesized
aactggagaactttcatgtc

SEQ ID NO: 52505 - DNA, 20 bp, Artificial Sequence
  chemically synthesized
agaactttcatgtctagcta

SEQ ID NO: 52506 - DNA, 20 bp, Artificial Sequence
  chemically synthesized
gaactttcatgtctagctaa

SEQ ID NO: 52507 - DNA, 20 bp, Artificial Sequence
  chemically synthesized
aggtttgtaaatgcaccaat

SEQ ID NO: 52508 - DNA, 20 bp, Artificial Sequence
  chemically synthesized
cagcaatctgtgtctaactc

SEQ ID NO: 52509 - DNA, 20 bp, Artificial Sequence
  chemically synthesized
agcaatctgtgtctaactca

SEQ ID NO: 52510 - DNA, 20 bp, Artificial Sequence
  chemically synthesized
aggtttgtaaatgcaccaat

SEQ ID NO: 52511 - DNA, 20 bp, Artificial Sequence
  chemically synthesized
accaatcagtgctctgtgtc

SEQ ID NO: 52512 - DNA, 20 bp, Artificial Sequence
  chemically synthesized
tgctctgtgtctagctaatc

SEQ ID NO: 52513 - DNA, 20 bp, Artificial Sequence
  chemically synthesized
tctgtgtctagctaatctag

SEQ ID NO: 52514 - DNA, 20 bp, Artificial Sequence
  chemically synthesized
ctgtgtctagctaatctagt

SEQ ID NO: 52515 - DNA, 20 bp, Artificial Sequence
  chemically synthesized
tgtgtctagctaatctagtg

SEQ ID NO: 52516 - DNA, 20 bp, Artificial Sequence
  chemically synthesized
tagctaatctagtggggact

SEQ ID NO: 52517 - DNA, 20 bp, Artificial Sequence
  chemically synthesized
gctaatctagtggggacttg

SEQ ID NO: 52518 - DNA, 20 bp, Artificial Sequence
  chemically synthesized
acttggagaacttttgtgtc

SEQ ID NO: 52519 - DNA, 20 bp, Artificial Sequence
  chemically synthesized
agaacttttgtgtctagcta

SEQ ID NO: 52520 - DNA, 20 bp, Artificial Sequence
  chemically synthesized
gaacttttgtgtctagctaa

SEQ ID NO: 52521 - DNA, 20 bp, Artificial Sequence
  chemically synthesized
aggattgtaaatgcactaat

SEQ ID NO: 52522 - DNA, 20 bp, Artificial Sequence
  chemically synthesized
actaatcagcactctgtgtc

SEQ ID NO: 52523 - DNA, 20 bp, Artificial Sequence
  chemically synthesized
cagcactctgtgtctagctc

SEQ ID NO: 52524 - DNA, 20 bp, Artificial Sequence
  chemically synthesized
agcactctgtgtctagctca

SEQ ID NO: 52525 - DNA, 20 bp, Artificial Sequence
  chemically synthesized
aggtttgtaaatgcaccaat

SEQ ID NO: 52526 - DNA, 20 bp, Artificial Sequence
  chemically synthesized
caatcagcactctgccaaaa

SEQ ID NO: 52527 - DNA, 20 bp, Artificial Sequence
  chemically synthesized
ctctgccaaaacggaccaac

SEQ ID NO: 52528 - DNA, 20 bp, Artificial Sequence
  chemically synthesized
ccaaccagctctctgtaaaa

SEQ ID NO: 52529 - DNA, 20 bp, Artificial Sequence
  chemically synthesized
caaccagctctctgtaaaat

SEQ ID NO: 52530 - DNA, 20 bp, Artificial Sequence
  chemically synthesized
tctctgtaaaatgggccaat

SEQ ID NO: 52531 - DNA, 20 bp, Artificial Sequence
  chemically synthesized
ccaatcagctctctgtaaaa

SEQ ID NO: 52532 - DNA, 20 bp, Artificial Sequence
  chemically synthesized
tctctgtaaaatggaccaat

SEQ ID NO: 52533 - DNA, 20 bp, Artificial Sequence
  chemically synthesized
ctgtaaaatggaccaatcag

SEQ ID NO: 52534 - DNA, 20 bp, Artificial Sequence
  chemically synthesized
tgtaaaatggaccaatcagc

SEQ ID NO: 52535 - DNA, 20 bp, Artificial Sequence
  chemically synthesized
atggaccaatcagcaggatg

SEQ ID NO: 52536 - DNA, 20 bp, Artificial Sequence
  chemically synthesized
tggaccaatcagcaggatgt

SEQ ID NO: 52537 - DNA, 20 bp, Artificial Sequence
  chemically synthesized
accaatcagcaggatgtggg

SEQ ID NO: 52538 - DNA, 20 bp, Artificial Sequence
  chemically synthesized
ccaatcagcaggatgtgggt

SEQ ID NO: 52539 - DNA, 20 bp, Artificial Sequence
  chemically synthesized
caatcagcaggatgtgggtg

SEQ ID NO: 52540 - DNA, 20 bp, Artificial Sequence
  chemically synthesized
cagcaggatgtgggtggggt

SEQ ID NO: 52541 - DNA, 20 bp, Artificial Sequence
  chemically synthesized
ggatgtgggtggggtcagat

SEQ ID NO: 52542 - DNA, 20 bp, Artificial Sequence
  chemically synthesized
gatgtgggtggggtcagata

SEQ ID NO: 52543 - DNA, 20 bp, Artificial Sequence
  chemically synthesized
tggggtcagataaggaaata

SEQ ID NO: 52544 - DNA, 20 bp, Artificial Sequence
  chemically synthesized
ggggtcagataaggaaataa

SEQ ID NO: 52545 - DNA, 20 bp, Artificial Sequence
  chemically synthesized
gtcagataaggaaataaagg

SEQ ID NO: 52546 - DNA, 20 bp, Artificial Sequence
  chemically synthesized
tcagataaggaaataaaggc

SEQ ID NO: 52547 - DNA, 20 bp, Artificial Sequence
  chemically synthesized
aggaaataaaggcaggctgc

SEQ ID NO: 52548 - DNA, 20 bp, Artificial Sequence
  chemically synthesized
gaaataaaggcaggctgccg

SEQ ID NO: 52549 - DNA, 20 bp, Artificial Sequence
  chemically synthesized
taaaggcaggctgccggagc

SEQ ID NO: 52550 - DNA, 20 bp, Artificial Sequence
  chemically synthesized
gccagctgtgacaactgact

SEQ ID NO: 52551 - DNA, 20 bp, Artificial Sequence
  chemically synthesized
ccagctgtgacaactgactt

SEQ ID NO: 52552 - DNA, 20 bp, Artificial Sequence
  chemically synthesized
ttgggttccctaccatgctg

SEQ ID NO: 52553 - DNA, 20 bp, Artificial Sequence
  chemically synthesized
ggttccctaccatgctgtgg

SEQ ID NO: 52554 - DNA, 20 bp, Artificial Sequence
  chemically synthesized
tcttactgctgctcactctt

SEQ ID NO: 52555 - DNA, 20 bp, Artificial Sequence
  chemically synthesized
tggatccgcgctgcctttat

SEQ ID NO: 52556 - DNA, 20 bp, Artificial Sequence
  chemically synthesized
gagctgtaacactcactgcg

SEQ ID NO: 52557 - DNA, 20 bp, Artificial Sequence
  chemically synthesized
agctgtaacactcactgcga

SEQ ID NO: 52558 - DNA, 20 bp, Artificial Sequence
  chemically synthesized
acactcactgcgaaggtctg

SEQ ID NO: 52559 - DNA, 20 bp, Artificial Sequence
  chemically synthesized
ggtctgcggcttcacttctg

SEQ ID NO: 52560 - DNA, 20 bp, Artificial Sequence
  chemically synthesized
tgcggcttcacttctgaagc

SEQ ID NO: 52561 - DNA, 20 bp, Artificial Sequence
  chemically synthesized
gcttcacttctgaagccagc

SEQ ID NO: 52562 - DNA, 20 bp, Artificial Sequence
  chemically synthesized
agccagcaagaccacgaacc

SEQ ID NO: 52563 - DNA, 20 bp, Artificial Sequence
  chemically synthesized
gcaagaccacgaacccagca

SEQ ID NO: 52564 - DNA, 20 bp, Artificial Sequence
  chemically synthesized
caagaccacgaacccagcat

SEQ ID NO: 52565 - DNA, 20 bp, Artificial Sequence
  chemically synthesized
aagaccacgaacccagcatg

SEQ ID NO: 52566 - DNA, 20 bp, Artificial Sequence
  chemically synthesized
agaccacgaacccagcatgg

SEQ ID NO: 52567 - DNA, 20 bp, Artificial Sequence
  chemically synthesized
gcatgggggatgaacaaccc

SEQ ID NO: 52568 - DNA, 20 bp, Artificial Sequence
  chemically synthesized
gggggatgaacaacccaaga

SEQ ID NO: 52569 - DNA, 20 bp, Artificial Sequence
  chemically synthesized
ggggatgaacaacccaagac

SEQ ID NO: 52570 - DNA, 20 bp, Artificial Sequence
  chemically synthesized
ggatgaacaacccaagacag

SEQ ID NO: 52571 - DNA, 20 bp, Artificial Sequence
  chemically synthesized
gatgaacaacccaagacagg

SEQ ID NO: 52572 - DNA, 20 bp, Artificial Sequence
  chemically synthesized
caacccaagacaggaggaat

SEQ ID NO: 52573 - DNA, 20 bp, Artificial Sequence
  chemically synthesized
actccatacgctccgccttt

SEQ ID NO: 52574 - DNA, 20 bp, Artificial Sequence
  chemically synthesized
tccatacgctccgcctttaa

SEQ ID NO: 52575 - DNA, 20 bp, Artificial Sequence
  chemically synthesized
aagagctgtaacactccccg

SEQ ID NO: 52576 - DNA, 20 bp, Artificial Sequence
  chemically synthesized
agagctgtaacactccccgt

SEQ ID NO: 52577 - DNA, 20 bp, Artificial Sequence
  chemically synthesized
gagctgtaacactccccgtg

SEQ ID NO: 52578 - DNA, 20 bp, Artificial Sequence
  chemically synthesized
agctgtaacactccccgtgg

SEQ ID NO: 52579 - DNA, 20 bp, Artificial Sequence
  chemically synthesized
acactccccgtgggggtctg

SEQ ID NO: 52580 - DNA, 20 bp, Artificial Sequence
  chemically synthesized
ggggtctgcagcttcactcc

SEQ ID NO: 52581 - DNA, 20 bp, Artificial Sequence
  chemically synthesized
ggtctgcagcttcactcctg

SEQ ID NO: 52582 - DNA, 20 bp, Artificial Sequence
  chemically synthesized
tgcagcttcactcctggagc

SEQ ID NO: 52583 - DNA, 20 bp, Artificial Sequence
  chemically synthesized
gcttcactcctggagccagc

SEQ ID NO: 52584 - DNA, 20 bp, Artificial Sequence
  chemically synthesized
cagcaagaccgtgaacacac

SEQ ID NO: 52585 - DNA, 20 bp, Artificial Sequence
  chemically synthesized
caagaccgtgaacacaccag

SEQ ID NO: 52586 - DNA, 20 bp, Artificial Sequence
  chemically synthesized
aagaccgtgaacacaccaga

SEQ ID NO: 52587 - DNA, 20 bp, Artificial Sequence
  chemically synthesized
accgtgaacacaccagaagg

SEQ ID NO: 52588 - DNA, 20 bp, Artificial Sequence
  chemically synthesized
acaccagaaggaagaaactc

SEQ ID NO: 52589 - DNA, 20 bp, Artificial Sequence
  chemically synthesized
agaaactctggacacatctg

SEQ ID NO: 52590 - DNA, 20 bp, Artificial Sequence
  chemically synthesized
acatctgaagtaacaaactt

SEQ ID NO: 52591 - DNA, 20 bp, Artificial Sequence
  chemically synthesized
cctttgaacacaccatcttt

SEQ ID NO: 52592 - DNA, 20 bp, Artificial Sequence
  chemically synthesized
agaattgtaacactcaccac

SEQ ID NO: 52593 - DNA, 20 bp, Artificial Sequence
  chemically synthesized
gaattgtaacactcaccacg

SEQ ID NO: 52594 - DNA, 20 bp, Artificial Sequence
  chemically synthesized
aattgtaacactcaccacga

SEQ ID NO: 52595 - DNA, 20 bp, Artificial Sequence
  chemically synthesized
acactcaccacgagggttcg

SEQ ID NO: 52596 - DNA, 20 bp, Artificial Sequence
  chemically synthesized
ggttcgcggcttcattcttt

SEQ ID NO: 52597 - DNA, 20 bp, Artificial Sequence
  chemically synthesized
cgcggcttcattctttaagt

SEQ ID NO: 52598 - DNA, 20 bp, Artificial Sequence
  chemically synthesized
gcttcattctttaagtcagc

SEQ ID NO: 52599 - DNA, 20 bp, Artificial Sequence
  chemically synthesized
ttctttaagtcagcgagacc

SEQ ID NO: 52600 - DNA, 20 bp, Artificial Sequence
  chemically synthesized
gaccaagaacccaccaattc

SEQ ID NO: 52601 - DNA, 20 bp, Artificial Sequence
  chemically synthesized
gaacccaccaattccggaca

SEQ ID NO: 52602 - DNA, 20 bp, Artificial Sequence
  chemically synthesized
cccaccaattccggacacag

SEQ ID NO: 52603 - DNA, 20 bp, Artificial Sequence
  chemically synthesized
ccaccaattccggacacaga

SEQ ID NO: 52604 - DNA, 20 bp, Artificial Sequence
  chemically synthesized
caattccggacacagaagga

SEQ ID NO: 52605 - DNA, 20 bp, Artificial Sequence
  chemically synthesized
cggacacagaaggatggaca

SEQ ID NO: 52606 - DNA, 20 bp, Artificial Sequence
  chemically synthesized
gaaggatggacaaagattat

SEQ ID NO: 52607 - DNA, 20 bp, Artificial Sequence
  chemically synthesized
aaggatggacaaagattatc

SEQ ID NO: 52608 - DNA, 20 bp, Artificial Sequence
  chemically synthesized
agattatcaggaatgcaatt

SEQ ID NO: 52609 - DNA, 20 bp, Artificial Sequence
  chemically synthesized
caacacaaaaattacatacc

SEQ ID NO: 52610 - DNA, 20 bp, Artificial Sequence
  chemically synthesized
acctagaatcaattttaata

SEQ ID NO: 52611 - DNA, 20 bp, Artificial Sequence
  chemically synthesized
tttaataaagaaaacttatt

SEQ ID NO: 52612 - DNA, 20 bp, Artificial Sequence
  chemically synthesized
taataaagaaaacttatttg

SEQ ID NO: 52613 - DNA, 20 bp, Artificial Sequence
  chemically synthesized
aagaaaacttatttggagca

SEQ ID NO: 52614 - DNA, 20 bp, Artificial Sequence
  chemically synthesized
tatttggagcacagcttatt

SEQ ID NO: 52615 - DNA, 20 bp, Artificial Sequence
  chemically synthesized
atttggagcacagcttattc

SEQ ID NO: 52616 - DNA, 20 bp, Artificial Sequence
  chemically synthesized
tttggagcacagcttattca

SEQ ID NO: 52617 - DNA, 20 bp, Artificial Sequence
  chemically synthesized
ggagcacagcttattcaggg

SEQ ID NO: 52618 - DNA, 20 bp, Artificial Sequence
  chemically synthesized
ttattcagggcagaaaataa

SEQ ID NO: 52619 - DNA, 20 bp, Artificial Sequence
  chemically synthesized
aaaataaaagctaataataa

SEQ ID NO: 52620 - DNA, 20 bp, Artificial Sequence
  chemically synthesized
aataaaagctaataataaaa

SEQ ID NO: 52621 - DNA, 20 bp, Artificial Sequence
  chemically synthesized
ataaaagctaataataaaag

SEQ ID NO: 52622 - DNA, 20 bp, Artificial Sequence
  chemically synthesized
aattaaataaccactcattt

SEQ ID NO: 52623 - DNA, 20 bp, Artificial Sequence
  chemically synthesized
ttagatccttgatatttgaa

SEQ ID NO: 52624 - DNA, 20 bp, Artificial Sequence
  chemically synthesized
tccttgatatttgaacagaa

SEQ ID NO: 52625 - DNA, 20 bp, Artificial Sequence
  chemically synthesized
gaacagaatagtataaaaaa

SEQ ID NO: 52626 - DNA, 20 bp, Artificial Sequence
  chemically synthesized
acagaatagtataaaaaata

SEQ ID NO: 52627 - DNA, 20 bp, Artificial Sequence
  chemically synthesized
cagaatagtataaaaaatag

SEQ ID NO: 52628 - DNA, 20 bp, Artificial Sequence
  chemically synthesized
agaatagtataaaaaataga

SEQ ID NO: 52629 - DNA, 20 bp, Artificial Sequence
  chemically synthesized
aaaatagagggcatgataaa

SEQ ID NO: 52630 - DNA, 20 bp, Artificial Sequence
  chemically synthesized
ggcatgataaatagtaaata

SEQ ID NO: 52631 - DNA, 20 bp, Artificial Sequence
  chemically synthesized
agtaaataaagcaaaaatat

SEQ ID NO: 52632 - DNA, 20 bp, Artificial Sequence
  chemically synthesized
taaataaagcaaaaatatga

SEQ ID NO: 52633 - DNA, 20 bp, Artificial Sequence
  chemically synthesized
aaagcaaaaatatgagagat

SEQ ID NO: 52634 - DNA, 20 bp, Artificial Sequence
  chemically synthesized
aaaatatgagagatgagatg

SEQ ID NO: 52635 - DNA, 20 bp, Artificial Sequence
  chemically synthesized
atatgagagatgagatgaag

SEQ ID NO: 52636 - DNA, 20 bp, Artificial Sequence
  chemically synthesized
gatgagatgaagtagccaat

SEQ ID NO: 52637 - DNA, 20 bp, Artificial Sequence
  chemically synthesized
atgagatgaagtagccaata

SEQ ID NO: 52638 - DNA, 20 bp, Artificial Sequence
  chemically synthesized
tgagatgaagtagccaataa

SEQ ID NO: 52639 - DNA, 20 bp, Artificial Sequence
  chemically synthesized
gagatgaagtagccaataag

SEQ ID NO: 52640 - DNA, 20 bp, Artificial Sequence
  chemically synthesized
agatgaagtagccaataagg

SEQ ID NO: 52641 - DNA, 20 bp, Artificial Sequence
  chemically synthesized
gaagtagccaataaggggga

SEQ ID NO: 52642 - DNA, 20 bp, Artificial Sequence
  chemically synthesized
aagtagccaataagggggac

SEQ ID NO: 52643 - DNA, 20 bp, Artificial Sequence
  chemically synthesized
tagccaataagggggacagg

SEQ ID NO: 52644 - DNA, 20 bp, Artificial Sequence
  chemically synthesized
ccaataagggggacaggaag

SEQ ID NO: 52645 - DNA, 20 bp, Artificial Sequence
  chemically synthesized
gggggacaggaagtagattt

SEQ ID NO: 52646 - DNA, 20 bp, Artificial Sequence
  chemically synthesized
gggacaggaagtagatttaa

SEQ ID NO: 52647 - DNA, 20 bp, Artificial Sequence
  chemically synthesized
aggaagtagatttaagagtg

SEQ ID NO: 52648 - DNA, 20 bp, Artificial Sequence
  chemically synthesized
gatttaagagtgcagaaaaa

SEQ ID NO: 52649 - DNA, 20 bp, Artificial Sequence
  chemically synthesized
atttaagagtgcagaaaaaa

SEQ ID NO: 52650 - DNA, 20 bp, Artificial Sequence
  chemically synthesized
gagtgcagaaaaaaaggaca

SEQ ID NO: 52651 - DNA, 20 bp, Artificial Sequence
  chemically synthesized
agtgcagaaaaaaaggacaa

SEQ ID NO: 52652 - DNA, 20 bp, Artificial Sequence
  chemically synthesized
aaaggacaaaggaataaata

SEQ ID NO: 52653 - DNA, 20 bp, Artificial Sequence
  chemically synthesized
aaggacaaaggaataaatat

SEQ ID NO: 52654 - DNA, 20 bp, Artificial Sequence
  chemically synthesized
aggacaaaggaataaatatg

SEQ ID NO: 52655 - DNA, 20 bp, Artificial Sequence
  chemically synthesized
ggacaaaggaataaatatgg

SEQ ID NO: 52656 - DNA, 20 bp, Artificial Sequence
  chemically synthesized
gacaaaggaataaatatggg

SEQ ID NO: 52657 - DNA, 20 bp, Artificial Sequence
  chemically synthesized
aggaataaatatggggggca

SEQ ID NO: 52658 - DNA, 20 bp, Artificial Sequence
  chemically synthesized
gaataaatatggggggcatg

SEQ ID NO: 52659 - DNA, 20 bp, Artificial Sequence
  chemically synthesized
aataaatatggggggcatgg

SEQ ID NO: 52660 - DNA, 20 bp, Artificial Sequence
  chemically synthesized
ggggggcatggaggaaaaaa

SEQ ID NO: 52661 - DNA, 20 bp, Artificial Sequence
  chemically synthesized
gggggcatggaggaaaaaat

SEQ ID NO: 52662 - DNA, 20 bp, Artificial Sequence
  chemically synthesized
ggggcatggaggaaaaaata

SEQ ID NO: 52663 - DNA, 20 bp, Artificial Sequence
  chemically synthesized
atggaggaaaaaatagggtg

SEQ ID NO: 52664 - DNA, 20 bp, Artificial Sequence
  chemically synthesized
aggaaaaaatagggtgaagt

SEQ ID NO: 52665 - DNA, 20 bp, Artificial Sequence
  chemically synthesized
ggaaaaaatagggtgaagtc

SEQ ID NO: 52666 - DNA, 20 bp, Artificial Sequence
  chemically synthesized
aggaactccaaaatcttaac

SEQ ID NO: 52667 - DNA, 20 bp, Artificial Sequence
  chemically synthesized
gaactccaaaatcttaactg

SEQ ID NO: 52668 - DNA, 20 bp, Artificial Sequence
  chemically synthesized
ccaaaatcttaactggagtt

SEQ ID NO: 52669 - DNA, 20 bp, Artificial Sequence
  chemically synthesized
caaaatcttaactggagttc

SEQ ID NO: 52670 - DNA, 20 bp, Artificial Sequence
  chemically synthesized
aaatcttaactggagttcag

SEQ ID NO: 52671 - DNA, 20 bp, Artificial Sequence
  chemically synthesized
atcttaactggagttcagga

SEQ ID NO: 52672 - DNA, 20 bp, Artificial Sequence
  chemically synthesized
cttaactggagttcaggaga

SEQ ID NO: 52673 - DNA, 20 bp, Artificial Sequence
  chemically synthesized
agttcaggagagagtgaaaa

SEQ ID NO: 52674 - DNA, 20 bp, Artificial Sequence
  chemically synthesized
gagagtgaaaatagaacatg

SEQ ID NO: 52675 - DNA, 20 bp, Artificial Sequence
  chemically synthesized
agtgaaaatagaacatgtag

SEQ ID NO: 52676 - DNA, 20 bp, Artificial Sequence
  chemically synthesized
gtgaaaatagaacatgtaga

SEQ ID NO: 52677 - DNA, 20 bp, Artificial Sequence
  chemically synthesized
aacatgtagaaggaacttac

SEQ ID NO: 52678 - DNA, 20 bp, Artificial Sequence
  chemically synthesized
catgtagaaggaacttacta

SEQ ID NO: 52679 - DNA, 20 bp, Artificial Sequence
  chemically synthesized
aacttactagagatcaatac

SEQ ID NO: 52680 - DNA, 20 bp, Artificial Sequence
  chemically synthesized
caagacaattttctgaacaa

SEQ ID NO: 52681 - DNA, 20 bp, Artificial Sequence
  chemically synthesized
attttctgaacaaaagaaca

SEQ ID NO: 52682 - DNA, 20 bp, Artificial Sequence
  chemically synthesized
ttctgaacaaaagaacacag

SEQ ID NO: 52683 - DNA, 20 bp, Artificial Sequence
  chemically synthesized
agaacacagcagttgaaatt

SEQ ID NO: 52684 - DNA, 20 bp, Artificial Sequence
  chemically synthesized
aacacagcagttgaaattga

SEQ ID NO: 52685 - DNA, 20 bp, Artificial Sequence
  chemically synthesized
gagagtatccacaaaatacc

SEQ ID NO: 52686 - DNA, 20 bp, Artificial Sequence
  chemically synthesized
taaaataaaataaaaattca

SEQ ID NO: 52687 - DNA, 20 bp, Artificial Sequence
  chemically synthesized
ataaaataaaaattcatggt

SEQ ID NO: 52688 - DNA, 20 bp, Artificial Sequence
  chemically synthesized
ataaaaattcatggtaagtt

SEQ ID NO: 52689 - DNA, 20 bp, Artificial Sequence
  chemically synthesized
aaaaattcatggtaagttaa

SEQ ID NO: 52690 - DNA, 20 bp, Artificial Sequence
  chemically synthesized
gttaagagaatgaaaaaaac

SEQ ID NO: 52691 - DNA, 20 bp, Artificial Sequence
  chemically synthesized
agaatgaaaaaaacaagcca

SEQ ID NO: 52692 - DNA, 20 bp, Artificial Sequence
  chemically synthesized
aatgaaaaaaacaagccaca

SEQ ID NO: 52693 - DNA, 20 bp, Artificial Sequence
  chemically synthesized
gcaaaacatattatctgata

SEQ ID NO: 52694 - DNA, 20 bp, Artificial Sequence
  chemically synthesized
caaaacatattatctgataa

SEQ ID NO: 52695 - DNA, 20 bp, Artificial Sequence
  chemically synthesized
acttgtatacatattataca

SEQ ID NO: 52696 - DNA, 20 bp, Artificial Sequence
  chemically synthesized
aaacaaacaatccaattgca

SEQ ID NO: 52697 - DNA, 20 bp, Artificial Sequence
  chemically synthesized
caaacaatccaattgcaaag

SEQ ID NO: 52698 - DNA, 20 bp, Artificial Sequence
  chemically synthesized
aaacaatccaattgcaaagt

SEQ ID NO: 52699 - DNA, 20 bp, Artificial Sequence
  chemically synthesized
tccaattgcaaagtgggcaa

SEQ ID NO: 52700 - DNA, 20 bp, Artificial Sequence
  chemically synthesized
aagtgggcaaaagatctgaa

SEQ ID NO: 52701 - DNA, 20 bp, Artificial Sequence
  chemically synthesized
tctgaacagacactttacca

SEQ ID NO: 52702 - DNA, 20 bp, Artificial Sequence
  chemically synthesized
gaacagacactttaccaaag

SEQ ID NO: 52703 - DNA, 20 bp, Artificial Sequence
  chemically synthesized
actttaccaaagaagatata

SEQ ID NO: 52704 - DNA, 20 bp, Artificial Sequence
  chemically synthesized
gaagatatatagattgcaat

SEQ ID NO: 52705 - DNA, 20 bp, Artificial Sequence
  chemically synthesized
taagcacatgaaaatatact

SEQ ID NO: 52706 - DNA, 20 bp, Artificial Sequence
  chemically synthesized
actcagtaacacatgtcatt

SEQ ID NO: 52707 - DNA, 20 bp, Artificial Sequence
  chemically synthesized
aagaaactgcacattaaaac

SEQ ID NO: 52708 - DNA, 20 bp, Artificial Sequence
  chemically synthesized
aaactgcacattaaaacaag

SEQ ID NO: 52709 - DNA, 20 bp, Artificial Sequence
  chemically synthesized
accaaccactacacacatat

SEQ ID NO: 52710 - DNA, 20 bp, Artificial Sequence
  chemically synthesized
aaccactacacacatattag

SEQ ID NO: 52711 - DNA, 20 bp, Artificial Sequence
  chemically synthesized
accactacacacatattaga

SEQ ID NO: 52712 - DNA, 20 bp, Artificial Sequence
  chemically synthesized
tactgacatccaccaaacac

SEQ ID NO: 52713 - DNA, 20 bp, Artificial Sequence
  chemically synthesized
tccaccaaacactggcaacg

SEQ ID NO: 52714 - DNA, 20 bp, Artificial Sequence
  chemically synthesized
accaaacactggcaacgaag

SEQ ID NO: 52715 - DNA, 20 bp, Artificial Sequence
  chemically synthesized
caaacactggcaacgaagtg

SEQ ID NO: 52716 - DNA, 20 bp, Artificial Sequence
  chemically synthesized
ctggcaacgaagtggagcaa

SEQ ID NO: 52717 - DNA, 20 bp, Artificial Sequence
  chemically synthesized
taactctcacttattgcttg

SEQ ID NO: 52718 - DNA, 20 bp, Artificial Sequence
  chemically synthesized
aactctcacttattgcttgt

SEQ ID NO: 52719 - DNA, 20 bp, Artificial Sequence
  chemically synthesized
actctcacttattgcttgta

SEQ ID NO: 52720 - DNA, 20 bp, Artificial Sequence
  chemically synthesized
cacttattgcttgtagggat

SEQ ID NO: 52721 - DNA, 20 bp, Artificial Sequence
  chemically synthesized
ttgcttgtagggatgagaaa

SEQ ID NO: 52722 - DNA, 20 bp, Artificial Sequence
  chemically synthesized
tgtagggatgagaaatagtg

SEQ ID NO: 52723 - DNA, 20 bp, Artificial Sequence
  chemically synthesized
gagaaatagtgcagccaaat

SEQ ID NO: 52724 - DNA, 20 bp, Artificial Sequence
  chemically synthesized
aaatagtgcagccaaattgg

SEQ ID NO: 52725 - DNA, 20 bp, Artificial Sequence
  chemically synthesized
agtgcagccaaattggaaga

SEQ ID NO: 52726 - DNA, 20 bp, Artificial Sequence
  chemically synthesized
ccaaattggaagacagttta

SEQ ID NO: 52727 - DNA, 20 bp, Artificial Sequence
  chemically synthesized
tttacagtttcttacaaaac

SEQ ID NO: 52728 - DNA, 20 bp, Artificial Sequence
  chemically synthesized
tcctatgtatttacccaaat

SEQ ID NO: 52729 - DNA, 20 bp, Artificial Sequence
  chemically synthesized
caaaaatttatgtccacaca

SEQ ID NO: 52730 - DNA, 20 bp, Artificial Sequence
  chemically synthesized
cacacagacatgaactaacc

SEQ ID NO: 52731 - DNA, 20 bp, Artificial Sequence
  chemically synthesized
acacagacatgaactaacca

SEQ ID NO: 52732 - DNA, 20 bp, Artificial Sequence
  chemically synthesized
catgaactaaccaaggttta

SEQ ID NO: 52733 - DNA, 20 bp, Artificial Sequence
  chemically synthesized
atgaactaaccaaggtttat

SEQ ID NO: 52734 - DNA, 20 bp, Artificial Sequence
  chemically synthesized
actttactcataattgccaa

SEQ ID NO: 52735 - DNA, 20 bp, Artificial Sequence
  chemically synthesized
tcataattgccaaaagttga

SEQ ID NO: 52736 - DNA, 20 bp, Artificial Sequence
  chemically synthesized
gccaaaagttgaaagtaacc

SEQ ID NO: 52737 - DNA, 20 bp, Artificial Sequence
  chemically synthesized
ttgaaagtaaccaagatgaa

SEQ ID NO: 52738 - DNA, 20 bp, Artificial Sequence
  chemically synthesized
caagatgaatggataaactg

SEQ ID NO: 52739 - DNA, 20 bp, Artificial Sequence
  chemically synthesized
gataaactgtggaacatcca

SEQ ID NO: 52740 - DNA, 20 bp, Artificial Sequence
  chemically synthesized
ataaactgtggaacatccat

SEQ ID NO: 52741 - DNA, 20 bp, Artificial Sequence
  chemically synthesized
actgtggaacatccatagga

SEQ ID NO: 52742 - DNA, 20 bp, Artificial Sequence
  chemically synthesized
ccataggatagaatattatt

SEQ ID NO: 52743 - DNA, 20 bp, Artificial Sequence
  chemically synthesized
attattcagtgatataaata

SEQ ID NO: 52744 - DNA, 20 bp, Artificial Sequence
  chemically synthesized
ttattcagtgatataaataa

SEQ ID NO: 52745 - DNA, 20 bp, Artificial Sequence
  chemically synthesized
gatataaataaaggtctatc

SEQ ID NO: 52746 - DNA, 20 bp, Artificial Sequence
  chemically synthesized
aaggtctatcaagctgtgaa

SEQ ID NO: 52747 - DNA, 20 bp, Artificial Sequence
  chemically synthesized
tcaagctgtgaaaagacata

SEQ ID NO: 52748 - DNA, 20 bp, Artificial Sequence
  chemically synthesized
aagctgtgaaaagacataaa

SEQ ID NO: 52749 - DNA, 20 bp, Artificial Sequence
  chemically synthesized
taattcattttctttaatta

SEQ ID NO: 52750 - DNA, 20 bp, Artificial Sequence
  chemically synthesized
acctattttatcttgctgtt

SEQ ID NO: 52751 - DNA, 20 bp, Artificial Sequence
  chemically synthesized
ttgagaaacttccattccta

SEQ ID NO: 52752 - DNA, 20 bp, Artificial Sequence
  chemically synthesized
tattattcctcaaacaaata

SEQ ID NO: 52753 - DNA, 20 bp, Artificial Sequence
  chemically synthesized
caaatatagatattcaataa

SEQ ID NO: 52754 - DNA, 20 bp, Artificial Sequence
  chemically synthesized
gatattcaataatagacaaa

SEQ ID NO: 52755 - DNA, 20 bp, Artificial Sequence
  chemically synthesized
taatagacaaatagtgaata

SEQ ID NO: 52756 - DNA, 20 bp, Artificial Sequence
  chemically synthesized
gacaaatagtgaataaagta

SEQ ID NO: 52757 - DNA, 20 bp, Artificial Sequence
  chemically synthesized
gtatggtacattctttgact

SEQ ID NO: 52758 - DNA, 20 bp, Artificial Sequence
  chemically synthesized
tacattctttgacttagttt

SEQ ID NO: 52759 - DNA, 20 bp, Artificial Sequence
  chemically synthesized
ttctttgacttagtttcaga

SEQ ID NO: 52760 - DNA, 20 bp, Artificial Sequence
  chemically synthesized
agtttcagacagctattgca

SEQ ID NO: 52761 - DNA, 20 bp, Artificial Sequence
  chemically synthesized
agctattgcatagaatgaaa

SEQ ID NO: 52762 - DNA, 20 bp, Artificial Sequence
  chemically synthesized
aatagattaatatttaataa

SEQ ID NO: 52763 - DNA, 20 bp, Artificial Sequence
  chemically synthesized
atagattaatatttaataac

SEQ ID NO: 52764 - DNA, 20 bp, Artificial Sequence
  chemically synthesized
tgttatgatttattaaaaat

SEQ ID NO: 52765 - DNA, 20 bp, Artificial Sequence
  chemically synthesized
aaaaataagatgataaataa

SEQ ID NO: 52766 - DNA, 20 bp, Artificial Sequence
  chemically synthesized
aagatgataaataaaagatt

SEQ ID NO: 52767 - DNA, 20 bp, Artificial Sequence
  chemically synthesized
aaagatttagtatcttccca

SEQ ID NO: 52768 - DNA, 20 bp, Artificial Sequence
  chemically synthesized
agatttagtatcttcccatg

SEQ ID NO: 52769 - DNA, 20 bp, Artificial Sequence
  chemically synthesized
tcccatggagataacacact

SEQ ID NO: 52770 - DNA, 20 bp, Artificial Sequence
  chemically synthesized
ggagataacacacttagata

SEQ ID NO: 52771 - DNA, 20 bp, Artificial Sequence
  chemically synthesized
gagataacacacttagatac

SEQ ID NO: 52772 - DNA, 20 bp, Artificial Sequence
  chemically synthesized
atacaggtttcatgtcactt

SEQ ID NO: 52773 - DNA, 20 bp, Artificial Sequence
  chemically synthesized
tttcatgtcactttggacat

SEQ ID NO: 52774 - DNA, 20 bp, Artificial Sequence
  chemically synthesized
tgtcactttggacatgagta

SEQ ID NO: 52775 - DNA, 20 bp, Artificial Sequence
  chemically synthesized
tcactttggacatgagtaaa

SEQ ID NO: 52776 - DNA, 20 bp, Artificial Sequence
  chemically synthesized
cactttggacatgagtaaag

SEQ ID NO: 52777 - DNA, 20 bp, Artificial Sequence
  chemically synthesized
ctttggacatgagtaaagag

SEQ ID NO: 52778 - DNA, 20 bp, Artificial Sequence
  chemically synthesized
tcccaaatcttgatcacatt

SEQ ID NO: 52779 - DNA, 20 bp, Artificial Sequence
  chemically synthesized
cttgatcacattgagtatca

SEQ ID NO: 52780 - DNA, 20 bp, Artificial Sequence
  chemically synthesized
ttgatcacattgagtatcaa

SEQ ID NO: 52781 - DNA, 20 bp, Artificial Sequence
  chemically synthesized
atcacattgagtatcaaagg

SEQ ID NO: 52782 - DNA, 20 bp, Artificial Sequence
  chemically synthesized
tcacattgagtatcaaagga

SEQ ID NO: 52783 - DNA, 20 bp, Artificial Sequence
  chemically synthesized
cattgagtatcaaaggaagg

SEQ ID NO: 52784 - DNA, 20 bp, Artificial Sequence
  chemically synthesized
tgagtatcaaaggaaggaag

SEQ ID NO: 52785 - DNA, 20 bp, Artificial Sequence
  chemically synthesized
gaagaagaaaaaattattaa

SEQ ID NO: 52786 - DNA, 20 bp, Artificial Sequence
  chemically synthesized
gaagaaaaaattattaatgg

SEQ ID NO: 52787 - DNA, 20 bp, Artificial Sequence
  chemically synthesized
cattaaatatcatttattat

SEQ ID NO: 52788 - DNA, 20 bp, Artificial Sequence
  chemically synthesized
tttattattggatgtgttat

SEQ ID NO: 52789 - DNA, 20 bp, Artificial Sequence
  chemically synthesized
atgtgttattggcattgtat

SEQ ID NO: 52790 - DNA, 20 bp, Artificial Sequence
  chemically synthesized
actgctgtaaaaaaatacct

SEQ ID NO: 52791 - DNA, 20 bp, Artificial Sequence
  chemically synthesized
tgtaaaaaaatacctgagac

SEQ ID NO: 52792 - DNA, 20 bp, Artificial Sequence
  chemically synthesized
gtaaaaaaatacctgagact

SEQ ID NO: 52793 - DNA, 20 bp, Artificial Sequence
  chemically synthesized
ctgagactgggtaatttata

SEQ ID NO: 52794 - DNA, 20 bp, Artificial Sequence
  chemically synthesized
actgggtaatttataaagaa

SEQ ID NO: 52795 - DNA, 20 bp, Artificial Sequence
  chemically synthesized
tgggtaatttataaagaaca

SEQ ID NO: 52796 - DNA, 20 bp, Artificial Sequence
  chemically synthesized
gggtaatttataaagaacag

SEQ ID NO: 52797 - DNA, 20 bp, Artificial Sequence
  chemically synthesized
ataaagaacagaggtttaat

SEQ ID NO: 52798 - DNA, 20 bp, Artificial Sequence
  chemically synthesized
acagaggtttaattggctca

SEQ ID NO: 52799 - DNA, 20 bp, Artificial Sequence
  chemically synthesized
ttaattggctcaaagttctt

SEQ ID NO: 52800 - DNA, 20 bp, Artificial Sequence
  chemically synthesized
taattggctcaaagttcttc

SEQ ID NO: 52801 - DNA, 20 bp, Artificial Sequence
  chemically synthesized
caaagttcttcaggctgtac

SEQ ID NO: 52802 - DNA, 20 bp, Artificial Sequence
  chemically synthesized
agttcttcaggctgtacaag

SEQ ID NO: 52803 - DNA, 20 bp, Artificial Sequence
  chemically synthesized
ttcaggctgtacaagaagca

SEQ ID NO: 52804 - DNA, 20 bp, Artificial Sequence
  chemically synthesized
aggctgtacaagaagcatgg

SEQ ID NO: 52805 - DNA, 20 bp, Artificial Sequence
  chemically synthesized
gaagcatggcagcatctgct

SEQ ID NO: 52806 - DNA, 20 bp, Artificial Sequence
  chemically synthesized
ggcagcatctgctcagcttc

SEQ ID NO: 52807 - DNA, 20 bp, Artificial Sequence
  chemically synthesized
gcagcatctgctcagcttct

SEQ ID NO: 52808 - DNA, 20 bp, Artificial Sequence
  chemically synthesized
cagcatctgctcagcttcta

SEQ ID NO: 52809 - DNA, 20 bp, Artificial Sequence
  chemically synthesized
gcatctgctcagcttctagg

SEQ ID NO: 52810 - DNA, 20 bp, Artificial Sequence
  chemically synthesized
tcagcttctagggagacctc

SEQ ID NO: 52811 - DNA, 20 bp, Artificial Sequence
  chemically synthesized
cctcaagaaacttacaatca

SEQ ID NO: 52812 - DNA, 20 bp, Artificial Sequence
  chemically synthesized
caagaaacttacaatcatgg

SEQ ID NO: 52813 - DNA, 20 bp, Artificial Sequence
  chemically synthesized
gaaacttacaatcatggcag

SEQ ID NO: 52814 - DNA, 20 bp, Artificial Sequence
  chemically synthesized
tacaatcatggcagaagaca

SEQ ID NO: 52815 - DNA, 20 bp, Artificial Sequence
  chemically synthesized
aatcatggcagaagacaaag

SEQ ID NO: 52816 - DNA, 20 bp, Artificial Sequence
  chemically synthesized
atcatggcagaagacaaagc

SEQ ID NO: 52817 - DNA, 20 bp, Artificial Sequence
  chemically synthesized
catggcagaagacaaagcag

SEQ ID NO: 52818 - DNA, 20 bp, Artificial Sequence
  chemically synthesized
gcagaagacaaagcaggagc

SEQ ID NO: 52819 - DNA, 20 bp, Artificial Sequence
  chemically synthesized
caggagcaagtatcttcaca

SEQ ID NO: 52820 - DNA, 20 bp, Artificial Sequence
  chemically synthesized
agcaagtatcttcacatggc

SEQ ID NO: 52821 - DNA, 20 bp, Artificial Sequence
  chemically synthesized
gcaagtatcttcacatggcc

SEQ ID NO: 52822 - DNA, 20 bp, Artificial Sequence
  chemically synthesized
gtatcttcacatggccagga

SEQ ID NO: 52823 - DNA, 20 bp, Artificial Sequence
  chemically synthesized
tatcttcacatggccaggac

SEQ ID NO: 52824 - DNA, 20 bp, Artificial Sequence
  chemically synthesized
atcttcacatggccaggaca

SEQ ID NO: 52825 - DNA, 20 bp, Artificial Sequence
  chemically synthesized
cttcacatggccaggacagg

SEQ ID NO: 52826 - DNA, 20 bp, Artificial Sequence
  chemically synthesized
cacatggccaggacagggag

SEQ ID NO: 52827 - DNA, 20 bp, Artificial Sequence
  chemically synthesized
atggccaggacagggagaag

SEQ ID NO: 52828 - DNA, 20 bp, Artificial Sequence
  chemically synthesized
tggccaggacagggagaagc

SEQ ID NO: 52829 - DNA, 20 bp, Artificial Sequence
  chemically synthesized
ggccaggacagggagaagca

SEQ ID NO: 52830 - DNA, 20 bp, Artificial Sequence
  chemically synthesized
caggacagggagaagcaggg

SEQ ID NO: 52831 - DNA, 20 bp, Artificial Sequence
  chemically synthesized
aggacagggagaagcagggt

SEQ ID NO: 52832 - DNA, 20 bp, Artificial Sequence
  chemically synthesized
gacagggagaagcagggtag

SEQ ID NO: 52833 - DNA, 20 bp, Artificial Sequence
  chemically synthesized
acagggagaagcagggtagg

SEQ ID NO: 52834 - DNA, 20 bp, Artificial Sequence
  chemically synthesized
gctacacactttcaaacaac

SEQ ID NO: 52835 - DNA, 20 bp, Artificial Sequence
  chemically synthesized
tttcaaacaaccagcctctt

SEQ ID NO: 52836 - DNA, 20 bp, Artificial Sequence
  chemically synthesized
cctcttgagaactcactata

SEQ ID NO: 52837 - DNA, 20 bp, Artificial Sequence
  chemically synthesized
agaactcactatacagtacc

SEQ ID NO: 52838 - DNA, 20 bp, Artificial Sequence
  chemically synthesized
gaactcactatacagtacca

SEQ ID NO: 52839 - DNA, 20 bp, Artificial Sequence
  chemically synthesized
aactcactatacagtaccaa

SEQ ID NO: 52840 - DNA, 20 bp, Artificial Sequence
  chemically synthesized
actcactatacagtaccaag

SEQ ID NO: 52841 - DNA, 20 bp, Artificial Sequence
  chemically synthesized
ctcactatacagtaccaagg

SEQ ID NO: 52842 - DNA, 20 bp, Artificial Sequence
  chemically synthesized
ctatacagtaccaaggggga

SEQ ID NO: 52843 - DNA, 20 bp, Artificial Sequence
  chemically synthesized
gatggtactaaatcgctgat

SEQ ID NO: 52844 - DNA, 20 bp, Artificial Sequence
  chemically synthesized
atgattgaattacctcccac

SEQ ID NO: 52845 - DNA, 20 bp, Artificial Sequence
  chemically synthesized
tgattgaattacctcccaca

SEQ ID NO: 52846 - DNA, 20 bp, Artificial Sequence
  chemically synthesized
caaggccccacctccaacgc

SEQ ID NO: 52847 - DNA, 20 bp, Artificial Sequence
  chemically synthesized
ttataatttaacatgatatt

SEQ ID NO: 52848 - DNA, 20 bp, Artificial Sequence
  chemically synthesized
tataatttaacatgatattt

SEQ ID NO: 52849 - DNA, 20 bp, Artificial Sequence
  chemically synthesized
aatttaacatgatatttggg

SEQ ID NO: 52850 - DNA, 20 bp, Artificial Sequence
  chemically synthesized
atgatatttgggtggtgaca

SEQ ID NO: 52851 - DNA, 20 bp, Artificial Sequence
  chemically synthesized
aaaccatatccttccacctc

SEQ ID NO: 52852 - DNA, 20 bp, Artificial Sequence
  chemically synthesized
atacaatcattacttcccaa

SEQ ID NO: 52853 - DNA, 20 bp, Artificial Sequence
  chemically synthesized
tacttcccaacagtcctaca

SEQ ID NO: 52854 - DNA, 20 bp, Artificial Sequence
  chemically synthesized
tacaaagtcttaactcattc

SEQ ID NO: 52855 - DNA, 20 bp, Artificial Sequence
  chemically synthesized
tcattccagcattaactcaa

SEQ ID NO: 52856 - DNA, 20 bp, Artificial Sequence
  chemically synthesized
agcattaactcaaaagtcca

SEQ ID NO: 52857 - DNA, 20 bp, Artificial Sequence
  chemically synthesized
actcaaaagtccaaagtcca

SEQ ID NO: 52858 - DNA, 20 bp, Artificial Sequence
  chemically synthesized
caaagtccaaagtcttatcc

SEQ ID NO: 52859 - DNA, 20 bp, Artificial Sequence
  chemically synthesized
tccaaagtcttatccaagac

SEQ ID NO: 52860 - DNA, 20 bp, Artificial Sequence
  chemically synthesized
ccaaagtcttatccaagaca

SEQ ID NO: 52861 - DNA, 20 bp, Artificial Sequence
  chemically synthesized
agtcttatccaagacaaggc

SEQ ID NO: 52862 - DNA, 20 bp, Artificial Sequence
  chemically synthesized
ggcaagtcccttcaacctat

SEQ ID NO: 52863 - DNA, 20 bp, Artificial Sequence
  chemically synthesized
gagcctgtaaaatcaaaaac

SEQ ID NO: 52864 - DNA, 20 bp, Artificial Sequence
  chemically synthesized
ctgtaaaatcaaaaacaagt

SEQ ID NO: 52865 - DNA, 20 bp, Artificial Sequence
  chemically synthesized
aaaacaagttagttacttcc

SEQ ID NO: 52866 - DNA, 20 bp, Artificial Sequence
  chemically synthesized
tagttacttccaagacataa

SEQ ID NO: 52867 - DNA, 20 bp, Artificial Sequence
  chemically synthesized
gttacttccaagacataatg

SEQ ID NO: 52868 - DNA, 20 bp, Artificial Sequence
  chemically synthesized
ttacttccaagacataatgg

SEQ ID NO: 52869 - DNA, 20 bp, Artificial Sequence
  chemically synthesized
ccaagacataatggaggtac

SEQ ID NO: 52870 - DNA, 20 bp, Artificial Sequence
  chemically synthesized
cataatggaggtactggcat

SEQ ID NO: 52871 - DNA, 20 bp, Artificial Sequence
  chemically synthesized
ataatggaggtactggcatt

SEQ ID NO: 52872 - DNA, 20 bp, Artificial Sequence
  chemically synthesized
ggtacaaattcccattccaa

SEQ ID NO: 52873 - DNA, 20 bp, Artificial Sequence
  chemically synthesized
tacaaattcccattccaaaa

SEQ ID NO: 52874 - DNA, 20 bp, Artificial Sequence
  chemically synthesized
caaattcccattccaaaaga

SEQ ID NO: 52875 - DNA, 20 bp, Artificial Sequence
  chemically synthesized
aaaagagagaaatgcaccaa

SEQ ID NO: 52876 - DNA, 20 bp, Artificial Sequence
  chemically synthesized
gagagaaatgcaccaaaaga

SEQ ID NO: 52877 - DNA, 20 bp, Artificial Sequence
  chemically synthesized
agagaaatgcaccaaaagaa

SEQ ID NO: 52878 - DNA, 20 bp, Artificial Sequence
  chemically synthesized
gagaaatgcaccaaaagaaa

SEQ ID NO: 52879 - DNA, 20 bp, Artificial Sequence
  chemically synthesized
agaaatgcaccaaaagaaag

SEQ ID NO: 52880 - DNA, 20 bp, Artificial Sequence
  chemically synthesized
gcaccaaaagaaaggggcta

SEQ ID NO: 52881 - DNA, 20 bp, Artificial Sequence
  chemically synthesized
aggggctaaagatcccacac

SEQ ID NO: 52882 - DNA, 20 bp, Artificial Sequence
  chemically synthesized
ggctaaagatcccacacgag

SEQ ID NO: 52883 - DNA, 20 bp, Artificial Sequence
  chemically synthesized
tcccacacgagtagaaaacc

SEQ ID NO: 52884 - DNA, 20 bp, Artificial Sequence
  chemically synthesized
cacacgagtagaaaacccag

SEQ ID NO: 52885 - DNA, 20 bp, Artificial Sequence
  chemically synthesized
acacgagtagaaaacccagc

SEQ ID NO: 52886 - DNA, 20 bp, Artificial Sequence
  chemically synthesized
cacgagtagaaaacccagca

SEQ ID NO: 52887 - DNA, 20 bp, Artificial Sequence
  chemically synthesized
gagtagaaaacccagcaggg

SEQ ID NO: 52888 - DNA, 20 bp, Artificial Sequence
  chemically synthesized
gcagtcattacaccttgata

SEQ ID NO: 52889 - DNA, 20 bp, Artificial Sequence
  chemically synthesized
cattacaccttgatatggtt

SEQ ID NO: 52890 - DNA, 20 bp, Artificial Sequence
  chemically synthesized
tacaccttgatatggtttgg

SEQ ID NO: 52891 - DNA, 20 bp, Artificial Sequence
  chemically synthesized
cacccaaatttcttcttgaa

SEQ ID NO: 52892 - DNA, 20 bp, Artificial Sequence
  chemically synthesized
ccaaatttcttcttgaatag

SEQ ID NO: 52893 - DNA, 20 bp, Artificial Sequence
  chemically synthesized
caaatttcttcttgaatagt

SEQ ID NO: 52894 - DNA, 20 bp, Artificial Sequence
  chemically synthesized
cccataatccctgcctgtca

SEQ ID NO: 52895 - DNA, 20 bp, Artificial Sequence
  chemically synthesized
ataatccctgcctgtcatgg

SEQ ID NO: 52896 - DNA, 20 bp, Artificial Sequence
  chemically synthesized
taatccctgcctgtcatgga

SEQ ID NO: 52897 - DNA, 20 bp, Artificial Sequence
  chemically synthesized
ctgtcatggaaggaacacac

SEQ ID NO: 52898 - DNA, 20 bp, Artificial Sequence
  chemically synthesized
tgtcatggaaggaacacact

SEQ ID NO: 52899 - DNA, 20 bp, Artificial Sequence
  chemically synthesized
actgggatgtaattgaatca

SEQ ID NO: 52900 - DNA, 20 bp, Artificial Sequence
  chemically synthesized
ctgggatgtaattgaatcat

SEQ ID NO: 52901 - DNA, 20 bp, Artificial Sequence
  chemically synthesized
tgggatgtaattgaatcatg

SEQ ID NO: 52902 - DNA, 20 bp, Artificial Sequence
  chemically synthesized
gggatgtaattgaatcatgg

SEQ ID NO: 52903 - DNA, 20 bp, Artificial Sequence
  chemically synthesized
atgtaattgaatcatggggg

SEQ ID NO: 52904 - DNA, 20 bp, Artificial Sequence
  chemically synthesized
tgtaattgaatcatgggggt

SEQ ID NO: 52905 - DNA, 20 bp, Artificial Sequence
  chemically synthesized
ttcacatgctgttctcatga

SEQ ID NO: 52906 - DNA, 20 bp, Artificial Sequence
  chemically synthesized
catgctgttctcatgatagt

SEQ ID NO: 52907 - DNA, 20 bp, Artificial Sequence
  chemically synthesized
ctgttctcatgatagtgagt

SEQ ID NO: 52908 - DNA, 20 bp, Artificial Sequence
  chemically synthesized
tgatagtgagtaagtctcac

SEQ ID NO: 52909 - DNA, 20 bp, Artificial Sequence
  chemically synthesized
gtaagtctcacaagatctga

SEQ ID NO: 52910 - DNA, 20 bp, Artificial Sequence
  chemically synthesized
caagatctgatggttttata

SEQ ID NO: 52911 - DNA, 20 bp, Artificial Sequence
  chemically synthesized
aagatctgatggttttataa

SEQ ID NO: 52912 - DNA, 20 bp, Artificial Sequence
  chemically synthesized
agatctgatggttttataaa

SEQ ID NO: 52913 - DNA, 20 bp, Artificial Sequence
  chemically synthesized
tctcttgcctgccaccatgt

SEQ ID NO: 52914 - DNA, 20 bp, Artificial Sequence
  chemically synthesized
tcaccttccaccatgattgt

SEQ ID NO: 52915 - DNA, 20 bp, Artificial Sequence
  chemically synthesized
caccttccaccatgattgta

SEQ ID NO: 52916 - DNA, 20 bp, Artificial Sequence
  chemically synthesized
ccatgattgtaaggcctccc

SEQ ID NO: 52917 - DNA, 20 bp, Artificial Sequence
  chemically synthesized
gtaaggcctccccagcaatg

SEQ ID NO: 52918 - DNA, 20 bp, Artificial Sequence
  chemically synthesized
ccccagcaatgtggatctat

SEQ ID NO: 52919 - DNA, 20 bp, Artificial Sequence
  chemically synthesized
ctttttctttataaattacc

SEQ ID NO: 52920 - DNA, 20 bp, Artificial Sequence
  chemically synthesized
ctttataaattacccagtct

SEQ ID NO: 52921 - DNA, 20 bp, Artificial Sequence
  chemically synthesized
tttataaattacccagtctc

SEQ ID NO: 52922 - DNA, 20 bp, Artificial Sequence
  chemically synthesized
cagtctcgggtatttcttca

SEQ ID NO: 52923 - DNA, 20 bp, Artificial Sequence
  chemically synthesized
tctcgggtatttcttcatag

SEQ ID NO: 52924 - DNA, 20 bp, Artificial Sequence
  chemically synthesized
ttcttcatagcagtttaaaa

SEQ ID NO: 52925 - DNA, 20 bp, Artificial Sequence
  chemically synthesized
tttgaccccatgtctcatat

SEQ ID NO: 52926 - DNA, 20 bp, Artificial Sequence
  chemically synthesized
ttgaccccatgtctcatatc

SEQ ID NO: 52927 - DNA, 20 bp, Artificial Sequence
  chemically synthesized
tgaccccatgtctcatatca

SEQ ID NO: 52928 - DNA, 20 bp, Artificial Sequence
  chemically synthesized
tatcagggacacactgatgc

SEQ ID NO: 52929 - DNA, 20 bp, Artificial Sequence
  chemically synthesized
tcagggacacactgatgcaa

SEQ ID NO: 52930 - DNA, 20 bp, Artificial Sequence
  chemically synthesized
cagggacacactgatgcaag

SEQ ID NO: 52931 - DNA, 20 bp, Artificial Sequence
  chemically synthesized
ggacacactgatgcaagagg

SEQ ID NO: 52932 - DNA, 20 bp, Artificial Sequence
  chemically synthesized
gacacactgatgcaagaggt

SEQ ID NO: 52933 - DNA, 20 bp, Artificial Sequence
  chemically synthesized
gatgcaagaggtgggctccc

SEQ ID NO: 52934 - DNA, 20 bp, Artificial Sequence
  chemically synthesized
atgcaagaggtgggctccca

SEQ ID NO: 52935 - DNA, 20 bp, Artificial Sequence
  chemically synthesized
gaggtgggctcccaaggcct

SEQ ID NO: 52936 - DNA, 20 bp, Artificial Sequence
  chemically synthesized
aggtgggctcccaaggcctt

SEQ ID NO: 52937 - DNA, 20 bp, Artificial Sequence
  chemically synthesized
tgggctcccaaggccttggg

SEQ ID NO: 52938 - DNA, 20 bp, Artificial Sequence
  chemically synthesized
tccacccctattgctttgca

SEQ ID NO: 52939 - DNA, 20 bp, Artificial Sequence
  chemically synthesized
ccctattgctttgcacagtt

SEQ ID NO: 52940 - DNA, 20 bp, Artificial Sequence
  chemically synthesized
tagcccctgctgctgctctt

SEQ ID NO: 52941 - DNA, 20 bp, Artificial Sequence
  chemically synthesized
gcccctgctgctgctcttaa

SEQ ID NO: 52942 - DNA, 20 bp, Artificial Sequence
  chemically synthesized
tgctcttaagagattgtatt

SEQ ID NO: 52943 - DNA, 20 bp, Artificial Sequence
  chemically synthesized
gagattgtattgagtgtttg

SEQ ID NO: 52944 - DNA, 20 bp, Artificial Sequence
  chemically synthesized
ttgagtgtttgcagcttttc

SEQ ID NO: 52945 - DNA, 20 bp, Artificial Sequence
  chemically synthesized
tgagtgtttgcagcttttct

SEQ ID NO: 52946 - DNA, 20 bp, Artificial Sequence
  chemically synthesized
ttgcagcttttctaggtgca

SEQ ID NO: 52947 - DNA, 20 bp, Artificial Sequence
  chemically synthesized
aggtgcacggtgcaaactgt

SEQ ID NO: 52948 - DNA, 20 bp, Artificial Sequence
  chemically synthesized
tgcacggtgcaaactgtcag

SEQ ID NO: 52949 - DNA, 20 bp, Artificial Sequence
  chemically synthesized
tgtcagtggatctaccattc

SEQ ID NO: 52950 - DNA, 20 bp, Artificial Sequence
  chemically synthesized
gtcagtggatctaccattct

SEQ ID NO: 52951 - DNA, 20 bp, Artificial Sequence
  chemically synthesized
tcagtggatctaccattctg

SEQ ID NO: 52952 - DNA, 20 bp, Artificial Sequence
  chemically synthesized
ggatctaccattctggggtc

SEQ ID NO: 52953 - DNA, 20 bp, Artificial Sequence
  chemically synthesized
atctaccattctggggtctg

SEQ ID NO: 52954 - DNA, 20 bp, Artificial Sequence
  chemically synthesized
tctaccattctggggtctgg

SEQ ID NO: 52955 - DNA, 20 bp, Artificial Sequence
  chemically synthesized
ccattctggggtctggagga

SEQ ID NO: 52956 - DNA, 20 bp, Artificial Sequence
  chemically synthesized
ttctggggtctggaggacgg

SEQ ID NO: 52957 - DNA, 20 bp, Artificial Sequence
  chemically synthesized
ggacggtggcccttttctca

SEQ ID NO: 52958 - DNA, 20 bp, Artificial Sequence
  chemically synthesized
cccttttctcatagctctgc

SEQ ID NO: 52959 - DNA, 20 bp, Artificial Sequence
  chemically synthesized
ccttttctcatagctctgct

SEQ ID NO: 52960 - DNA, 20 bp, Artificial Sequence
  chemically synthesized
tttctcatagctctgctagg

SEQ ID NO: 52961 - DNA, 20 bp, Artificial Sequence
  chemically synthesized
agctctgctaggcagtgccc

SEQ ID NO: 52962 - DNA, 20 bp, Artificial Sequence
  chemically synthesized
tctgctaggcagtgccccag

SEQ ID NO: 52963 - DNA, 20 bp, Artificial Sequence
  chemically synthesized
tgctaggcagtgccccagtg

SEQ ID NO: 52964 - DNA, 20 bp, Artificial Sequence
  chemically synthesized
tgccccagtggagactctgt

SEQ ID NO: 52965 - DNA, 20 bp, Artificial Sequence
  chemically synthesized
gccccagtggagactctgtg

SEQ ID NO: 52966 - DNA, 20 bp, Artificial Sequence
  chemically synthesized
ccccagtggagactctgtga

SEQ ID NO: 52967 - DNA, 20 bp, Artificial Sequence
  chemically synthesized
cccagtggagactctgtgag

SEQ ID NO: 52968 - DNA, 20 bp, Artificial Sequence
  chemically synthesized
ccagtggagactctgtgagg

SEQ ID NO: 52969 - DNA, 20 bp, Artificial Sequence
  chemically synthesized
tttcctccacattgccctat

SEQ ID NO: 52970 - DNA, 20 bp, Artificial Sequence
  chemically synthesized
tcctccacattgccctatta

SEQ ID NO: 52971 - DNA, 20 bp, Artificial Sequence
  chemically synthesized
cctccacattgccctattag

SEQ ID NO: 52972 - DNA, 20 bp, Artificial Sequence
  chemically synthesized
ccctattagaggttcttcat

SEQ ID NO: 52973 - DNA, 20 bp, Artificial Sequence
  chemically synthesized
cctattagaggttcttcatg

SEQ ID NO: 52974 - DNA, 20 bp, Artificial Sequence
  chemically synthesized
ctattagaggttcttcatga

SEQ ID NO: 52975 - DNA, 20 bp, Artificial Sequence
  chemically synthesized
tcatgagggttctgcccctg

SEQ ID NO: 52976 - DNA, 20 bp, Artificial Sequence
  chemically synthesized
catgagggttctgcccctgc

SEQ ID NO: 52977 - DNA, 20 bp, Artificial Sequence
  chemically synthesized
tgagggttctgcccctgcag

SEQ ID NO: 52978 - DNA, 20 bp, Artificial Sequence
  chemically synthesized
gagggttctgcccctgcagg

SEQ ID NO: 52979 - DNA, 20 bp, Artificial Sequence
  chemically synthesized
gaggcttctgcctgaacact

SEQ ID NO: 52980 - DNA, 20 bp, Artificial Sequence
  chemically synthesized
aggcttctgcctgaacactc

SEQ ID NO: 52981 - DNA, 20 bp, Artificial Sequence
  chemically synthesized
tctacacatcctctgaaatc

SEQ ID NO: 52982 - DNA, 20 bp, Artificial Sequence
  chemically synthesized
ctacacatcctctgaaatct

SEQ ID NO: 52983 - DNA, 20 bp, Artificial Sequence
  chemically synthesized
cacatcctctgaaatctagg

SEQ ID NO: 52984 - DNA, 20 bp, Artificial Sequence
  chemically synthesized
catcctctgaaatctaggtg

SEQ ID NO: 52985 - DNA, 20 bp, Artificial Sequence
  chemically synthesized
atcctctgaaatctaggtgg

SEQ ID NO: 52986 - DNA, 20 bp, Artificial Sequence
  chemically synthesized
aaatctaggtggaggcttac

SEQ ID NO: 52987 - DNA, 20 bp, Artificial Sequence
  chemically synthesized
ttttgacctttgcacactcc

SEQ ID NO: 52988 - DNA, 20 bp, Artificial Sequence
  chemically synthesized
ctcccagatttatcaccatg

SEQ ID NO: 52989 - DNA, 20 bp, Artificial Sequence
  chemically synthesized
ccagatttatcaccatgtgg

SEQ ID NO: 52990 - DNA, 20 bp, Artificial Sequence
  chemically synthesized
atcaccatgtggaagcctcc

SEQ ID NO: 52991 - DNA, 20 bp, Artificial Sequence
  chemically synthesized
tcaccatgtggaagcctcca

SEQ ID NO: 52992 - DNA, 20 bp, Artificial Sequence
  chemically synthesized
cttatgtcttgcaccctctg

SEQ ID NO: 52993 - DNA, 20 bp, Artificial Sequence
  chemically synthesized
atgtcttgcaccctctgaag

SEQ ID NO: 52994 - DNA, 20 bp, Artificial Sequence
  chemically synthesized
tcttgcaccctctgaagcag

SEQ ID NO: 52995 - DNA, 20 bp, Artificial Sequence
  chemically synthesized
accctctgaagcagtggcct

SEQ ID NO: 52996 - DNA, 20 bp, Artificial Sequence
  chemically synthesized
gcagtggccttagctgttct

SEQ ID NO: 52997 - DNA, 20 bp, Artificial Sequence
  chemically synthesized
cagtggccttagctgttctt

SEQ ID NO: 52998 - DNA, 20 bp, Artificial Sequence
  chemically synthesized
agctgttcttgggccccttt

SEQ ID NO: 52999 - DNA, 20 bp, Artificial Sequence
  chemically synthesized
tcttgggcccctttgagcca

SEQ ID NO: 53000 - DNA, 20 bp, Artificial Sequence
  chemically synthesized
gggcccctttgagccacagc

SEQ ID NO: 53001 - DNA, 20 bp, Artificial Sequence
  chemically synthesized
ctttgagccacagctggtgc

SEQ ID NO: 53002 - DNA, 20 bp, Artificial Sequence
  chemically synthesized
ttgagccacagctggtgctg

SEQ ID NO: 53003 - DNA, 20 bp, Artificial Sequence
  chemically synthesized
agccacagctggtgctggag

SEQ ID NO: 53004 - DNA, 20 bp, Artificial Sequence
  chemically synthesized
acagctggtgctggagcagc

SEQ ID NO: 53005 - DNA, 20 bp, Artificial Sequence
  chemically synthesized
cagctggtgctggagcagcc

SEQ ID NO: 53006 - DNA, 20 bp, Artificial Sequence
  chemically synthesized
tgctggagcagccaggatgc

SEQ ID NO: 53007 - DNA, 20 bp, Artificial Sequence
  chemically synthesized
gctggagcagccaggatgca

SEQ ID NO: 53008 - DNA, 20 bp, Artificial Sequence
  chemically synthesized
agcagccaggatgcaaggaa

SEQ ID NO: 53009 - DNA, 20 bp, Artificial Sequence
  chemically synthesized
atgcaaggaacagtgtcctg

SEQ ID NO: 53010 - DNA, 20 bp, Artificial Sequence
  chemically synthesized
acagtgtcctgaagctgctc

SEQ ID NO: 53011 - DNA, 20 bp, Artificial Sequence
  chemically synthesized
cagtgtcctgaagctgctca

SEQ ID NO: 53012 - DNA, 20 bp, Artificial Sequence
  chemically synthesized
tgtcctgaagctgctcaagg

SEQ ID NO: 53013 - DNA, 20 bp, Artificial Sequence
  chemically synthesized
cctgaagctgctcaaggcag

SEQ ID NO: 53014 - DNA, 20 bp, Artificial Sequence
  chemically synthesized
ctgaagctgctcaaggcagc

SEQ ID NO: 53015 - DNA, 20 bp, Artificial Sequence
  chemically synthesized
tgaagctgctcaaggcagca

SEQ ID NO: 53016 - DNA, 20 bp, Artificial Sequence
  chemically synthesized
atctcacccacaaaatcatt

SEQ ID NO: 53017 - DNA, 20 bp, Artificial Sequence
  chemically synthesized
acaaaatcattcagtactcc

SEQ ID NO: 53018 - DNA, 20 bp, Artificial Sequence
  chemically synthesized
caaaatcattcagtactcct

SEQ ID NO: 53019 - DNA, 20 bp, Artificial Sequence
  chemically synthesized
attcagtactcctaggccac

SEQ ID NO: 53020 - DNA, 20 bp, Artificial Sequence
  chemically synthesized
ttcagtactcctaggccacc

SEQ ID NO: 53021 - DNA, 20 bp, Artificial Sequence
  chemically synthesized
ggccaccaggcctgtgatgt

SEQ ID NO: 53022 - DNA, 20 bp, Artificial Sequence
  chemically synthesized
gccaccaggcctgtgatgtg

SEQ ID NO: 53023 - DNA, 20 bp, Artificial Sequence
  chemically synthesized
ccaccaggcctgtgatgtga

SEQ ID NO: 53024 - DNA, 20 bp, Artificial Sequence
  chemically synthesized
caccaggcctgtgatgtgag

SEQ ID NO: 53025 - DNA, 20 bp, Artificial Sequence
  chemically synthesized
gtgatgtgaggggctgctac

SEQ ID NO: 53026 - DNA, 20 bp, Artificial Sequence
  chemically synthesized
tgatgtgaggggctgctaca

SEQ ID NO: 53027 - DNA, 20 bp, Artificial Sequence
  chemically synthesized
gatgtgaggggctgctacaa

SEQ ID NO: 53028 - DNA, 20 bp, Artificial Sequence
  chemically synthesized
agggtctctgaaatgtcttt

SEQ ID NO: 53029 - DNA, 20 bp, Artificial Sequence
  chemically synthesized
gggtctctgaaatgtctttg

SEQ ID NO: 53030 - DNA, 20 bp, Artificial Sequence
  chemically synthesized
aggcattctcccctttattt

SEQ ID NO: 53031 - DNA, 20 bp, Artificial Sequence
  chemically synthesized
ctcccctttattttggctat

SEQ ID NO: 53032 - DNA, 20 bp, Artificial Sequence
  chemically synthesized
ttattttggctattagaact

SEQ ID NO: 53033 - DNA, 20 bp, Artificial Sequence
  chemically synthesized
ttcatttatgcaaatttcta

SEQ ID NO: 53034 - DNA, 20 bp, Artificial Sequence
  chemically synthesized
tgaattgctcctttgaaaat

SEQ ID NO: 53035 - DNA, 20 bp, Artificial Sequence
  chemically synthesized
agcttctgttttctaccaca

SEQ ID NO: 53036 - DNA, 20 bp, Artificial Sequence
  chemically synthesized
ctgttttctaccacatggcc

SEQ ID NO: 53037 - DNA, 20 bp, Artificial Sequence
  chemically synthesized
ttttctaccacatggccgag

SEQ ID NO: 53038 - DNA, 20 bp, Artificial Sequence
  chemically synthesized
tctgcttcccttttaaatat

SEQ ID NO: 53039 - DNA, 20 bp, Artificial Sequence
  chemically synthesized
atttctttgctcacacatat

SEQ ID NO: 53040 - DNA, 20 bp, Artificial Sequence
  chemically synthesized
tttgctcacacatatgagca

SEQ ID NO: 53041 - DNA, 20 bp, Artificial Sequence
  chemically synthesized
ttgctcacacatatgagcat

SEQ ID NO: 53042 - DNA, 20 bp, Artificial Sequence
  chemically synthesized
cacatatgagcataggttgt

SEQ ID NO: 53043 - DNA, 20 bp, Artificial Sequence
  chemically synthesized
atatgagcataggttgttag

SEQ ID NO: 53044 - DNA, 20 bp, Artificial Sequence
  chemically synthesized
tgagcataggttgttagaag

SEQ ID NO: 53045 - DNA, 20 bp, Artificial Sequence
  chemically synthesized
cataggttgttagaagcagc

SEQ ID NO: 53046 - DNA, 20 bp, Artificial Sequence
  chemically synthesized
ataggttgttagaagcagcc

SEQ ID NO: 53047 - DNA, 20 bp, Artificial Sequence
  chemically synthesized
atcttgaacaccttgctgct

SEQ ID NO: 53048 - DNA, 20 bp, Artificial Sequence
  chemically synthesized
ttatcaacttcgaatttcca

SEQ ID NO: 53049 - DNA, 20 bp, Artificial Sequence
  chemically synthesized
cgaatttccacagattctct

SEQ ID NO: 53050 - DNA, 20 bp, Artificial Sequence
  chemically synthesized
gaatttccacagattctcta

SEQ ID NO: 53051 - DNA, 20 bp, Artificial Sequence
  chemically synthesized
tttccacagattctctaagg

SEQ ID NO: 53052 - DNA, 20 bp, Artificial Sequence
  chemically synthesized
tccacagattctctaaggta

SEQ ID NO: 53053 - DNA, 20 bp, Artificial Sequence
  chemically synthesized
ccacagattctctaaggtag

SEQ ID NO: 53054 - DNA, 20 bp, Artificial Sequence
  chemically synthesized
gattctctaaggtagaggca

SEQ ID NO: 53055 - DNA, 20 bp, Artificial Sequence
  chemically synthesized
tctaaggtagaggcacagtg

SEQ ID NO: 53056 - DNA, 20 bp, Artificial Sequence
  chemically synthesized
tctttgctaatgtataacaa

SEQ ID NO: 53057 - DNA, 20 bp, Artificial Sequence
  chemically synthesized
aacaaaagtgacctttgctc

SEQ ID NO: 53058 - DNA, 20 bp, Artificial Sequence
  chemically synthesized
caataaattcatttccatct

SEQ ID NO: 53059 - DNA, 20 bp, Artificial Sequence
  chemically synthesized
atttccatctgagaccacct

SEQ ID NO: 53060 - DNA, 20 bp, Artificial Sequence
  chemically synthesized
catctgagaccacctcagcc

SEQ ID NO: 53061 - DNA, 20 bp, Artificial Sequence
  chemically synthesized
ttcattgtccatatcactat

SEQ ID NO: 53062 - DNA, 20 bp, Artificial Sequence
  chemically synthesized
ccatatcactatcagaattt

SEQ ID NO: 53063 - DNA, 20 bp, Artificial Sequence
  chemically synthesized
tttggtcacaaccattccac

SEQ ID NO: 53064 - DNA, 20 bp, Artificial Sequence
  chemically synthesized
acaaccattccacaagtctc

SEQ ID NO: 53065 - DNA, 20 bp, Artificial Sequence
  chemically synthesized
ccattccacaagtctctaga

SEQ ID NO: 53066 - DNA, 20 bp, Artificial Sequence
  chemically synthesized
tcatctccctgtcttcttct

SEQ ID NO: 53067 - DNA, 20 bp, Artificial Sequence
  chemically synthesized
ctgcctgttatccaatgcca

SEQ ID NO: 53068 - DNA, 20 bp, Artificial Sequence
  chemically synthesized
cacattttcatgtatcttta

SEQ ID NO: 53069 - DNA, 20 bp, Artificial Sequence
  chemically synthesized
attttcatgtatctttatag

SEQ ID NO: 53070 - DNA, 20 bp, Artificial Sequence
  chemically synthesized
ttatagcagtaccccacttt

SEQ ID NO: 53071 - DNA, 20 bp, Artificial Sequence
  chemically synthesized
ttggtaccaattttctgtac

SEQ ID NO: 53072 - DNA, 20 bp, Artificial Sequence
  chemically synthesized
gtccattctcatcttgctat

SEQ ID NO: 53073 - DNA, 20 bp, Artificial Sequence
  chemically synthesized
tccattctcatcttgctata

SEQ ID NO: 53074 - DNA, 20 bp, Artificial Sequence
  chemically synthesized
cttgctataaggaaatacct

SEQ ID NO: 53075 - DNA, 20 bp, Artificial Sequence
  chemically synthesized
tataaggaaatacctgagac

SEQ ID NO: 53076 - DNA, 20 bp, Artificial Sequence
  chemically synthesized
ataaggaaatacctgagact

SEQ ID NO: 53077 - DNA, 20 bp, Artificial Sequence
  chemically synthesized
aatacctgagactgggtaaa

SEQ ID NO: 53078 - DNA, 20 bp, Artificial Sequence
  chemically synthesized
ctgagactgggtaaatggtg

SEQ ID NO: 53079 - DNA, 20 bp, Artificial Sequence
  chemically synthesized
actgggtaaatggtgaagaa

SEQ ID NO: 53080 - DNA, 20 bp, Artificial Sequence
  chemically synthesized
tgggtaaatggtgaagaaca

SEQ ID NO: 53081 - DNA, 20 bp, Artificial Sequence
  chemically synthesized
gtgaagaacagagatttaat

SEQ ID NO: 53082 - DNA, 20 bp, Artificial Sequence
  chemically synthesized
acagagatttaattggctca

SEQ ID NO: 53083 - DNA, 20 bp, Artificial Sequence
  chemically synthesized
ttaattggctcacagttcta

SEQ ID NO: 53084 - DNA, 20 bp, Artificial Sequence
  chemically synthesized
taattggctcacagttctaa

SEQ ID NO: 53085 - DNA, 20 bp, Artificial Sequence
  chemically synthesized
tcacagttctaaaggctgta

SEQ ID NO: 53086 - DNA, 20 bp, Artificial Sequence
  chemically synthesized
cacagttctaaaggctgtac

SEQ ID NO: 53087 - DNA, 20 bp, Artificial Sequence
  chemically synthesized
agttctaaaggctgtacagg

SEQ ID NO: 53088 - DNA, 20 bp, Artificial Sequence
  chemically synthesized
taaaggctgtacaggaagca

SEQ ID NO: 53089 - DNA, 20 bp, Artificial Sequence
  chemically synthesized
gaagcatggcaacgtctgct

SEQ ID NO: 53090 - DNA, 20 bp, Artificial Sequence
  chemically synthesized
ggcaacgtctgctcagcttc

SEQ ID NO: 53091 - DNA, 20 bp, Artificial Sequence
  chemically synthesized
gcaacgtctgctcagcttct

SEQ ID NO: 53092 - DNA, 20 bp, Artificial Sequence
  chemically synthesized
caacgtctgctcagcttcta

SEQ ID NO: 53093 - DNA, 20 bp, Artificial Sequence
  chemically synthesized
acgtctgctcagcttctagg

SEQ ID NO: 53094 - DNA, 20 bp, Artificial Sequence
  chemically synthesized
cgtctgctcagcttctaggg

SEQ ID NO: 53095 - DNA, 20 bp, Artificial Sequence
  chemically synthesized
ctcagcttctagggaggttt

SEQ ID NO: 53096 - DNA, 20 bp, Artificial Sequence
  chemically synthesized
tcagcttctagggaggtttc

SEQ ID NO: 53097 - DNA, 20 bp, Artificial Sequence
  chemically synthesized
tttcaggaaacttataatca

SEQ ID NO: 53098 - DNA, 20 bp, Artificial Sequence
  chemically synthesized
caggaaacttataatcatgg

SEQ ID NO: 53099 - DNA, 20 bp, Artificial Sequence
  chemically synthesized
ggaaacttataatcatggca

SEQ ID NO: 53100 - DNA, 20 bp, Artificial Sequence
  chemically synthesized
aaacttataatcatggcaga

SEQ ID NO: 53101 - DNA, 20 bp, Artificial Sequence
  chemically synthesized
aatcatggcagagagaaaaa

SEQ ID NO: 53102 - DNA, 20 bp, Artificial Sequence
  chemically synthesized
atcatggcagagagaaaaac

SEQ ID NO: 53103 - DNA, 20 bp, Artificial Sequence
  chemically synthesized
catggcagagagaaaaacag

SEQ ID NO: 53104 - DNA, 20 bp, Artificial Sequence
  chemically synthesized
caggagcatgtgtcttcaca

SEQ ID NO: 53105 - DNA, 20 bp, Artificial Sequence
  chemically synthesized
agcatgtgtcttcacatggc

SEQ ID NO: 53106 - DNA, 20 bp, Artificial Sequence
  chemically synthesized
catgtgtcttcacatggctg

SEQ ID NO: 53107 - DNA, 20 bp, Artificial Sequence
  chemically synthesized
gtgtcttcacatggctggag

SEQ ID NO: 53108 - DNA, 20 bp, Artificial Sequence
  chemically synthesized
tgtcttcacatggctggagc

SEQ ID NO: 53109 - DNA, 20 bp, Artificial Sequence
  chemically synthesized
cttcacatggctggagcagg

SEQ ID NO: 53110 - DNA, 20 bp, Artificial Sequence
  chemically synthesized
cacatggctggagcaggaag

SEQ ID NO: 53111 - DNA, 20 bp, Artificial Sequence
  chemically synthesized
catggctggagcaggaagaa

SEQ ID NO: 53112 - DNA, 20 bp, Artificial Sequence
  chemically synthesized
atggctggagcaggaagaag

SEQ ID NO: 53113 - DNA, 20 bp, Artificial Sequence
  chemically synthesized
gctggagcaggaagaagagg

SEQ ID NO: 53114 - DNA, 20 bp, Artificial Sequence
  chemically synthesized
ctggagcaggaagaagaggc

SEQ ID NO: 53115 - DNA, 20 bp, Artificial Sequence
  chemically synthesized
tggagcaggaagaagaggca

SEQ ID NO: 53116 - DNA, 20 bp, Artificial Sequence
  chemically synthesized
gagcaggaagaagaggcagg

SEQ ID NO: 53117 - DNA, 20 bp, Artificial Sequence
  chemically synthesized
agcaggaagaagaggcaggg

SEQ ID NO: 53118 - DNA, 20 bp, Artificial Sequence
  chemically synthesized
aggaagaagaggcagggagg

SEQ ID NO: 53119 - DNA, 20 bp, Artificial Sequence
  chemically synthesized
agtaaacaaccatatctcat

SEQ ID NO: 53120 - DNA, 20 bp, Artificial Sequence
  chemically synthesized
tcacccactatacgtaccaa

SEQ ID NO: 53121 - DNA, 20 bp, Artificial Sequence
  chemically synthesized
cacccactatacgtaccaaa

SEQ ID NO: 53122 - DNA, 20 bp, Artificial Sequence
  chemically synthesized
acccactatacgtaccaaaa

SEQ ID NO: 53123 - DNA, 20 bp, Artificial Sequence
  chemically synthesized
taccaaaagggactgatatt

SEQ ID NO: 53124 - DNA, 20 bp, Artificial Sequence
  chemically synthesized
atgatccaatcacttcccac

SEQ ID NO: 53125 - DNA, 20 bp, Artificial Sequence
  chemically synthesized
tgatccaatcacttcccacc

SEQ ID NO: 53126 - DNA, 20 bp, Artificial Sequence
  chemically synthesized
ccaggccccatcttcaacac

SEQ ID NO: 53127 - DNA, 20 bp, Artificial Sequence
  chemically synthesized
caggccccatcttcaacact

SEQ ID NO: 53128 - DNA, 20 bp, Artificial Sequence
  chemically synthesized
aggccccatcttcaacactg

SEQ ID NO: 53129 - DNA, 20 bp, Artificial Sequence
  chemically synthesized
atcttcaacactggggatta

SEQ ID NO: 53130 - DNA, 20 bp, Artificial Sequence
  chemically synthesized
tggggattacagctgaacat

SEQ ID NO: 53131 - DNA, 20 bp, Artificial Sequence
  chemically synthesized
attacagctgaacatgagat

SEQ ID NO: 53132 - DNA, 20 bp, Artificial Sequence
  chemically synthesized
ttacagctgaacatgagatt

SEQ ID NO: 53133 - DNA, 20 bp, Artificial Sequence
  chemically synthesized
tacagctgaacatgagatta

SEQ ID NO: 53134 - DNA, 20 bp, Artificial Sequence
  chemically synthesized
agctgaacatgagattaggg

SEQ ID NO: 53135 - DNA, 20 bp, Artificial Sequence
  chemically synthesized
ctgaacatgagattagggtg

SEQ ID NO: 53136 - DNA, 20 bp, Artificial Sequence
  chemically synthesized
atgagattagggtggagaca

SEQ ID NO: 53137 - DNA, 20 bp, Artificial Sequence
  chemically synthesized
gacacagatccaaaccatat

SEQ ID NO: 53138 - DNA, 20 bp, Artificial Sequence
  chemically synthesized
acacagatccaaaccatatc

SEQ ID NO: 53139 - DNA, 20 bp, Artificial Sequence
  chemically synthesized
caacaaaatacataaaatgt

SEQ ID NO: 53140 - DNA, 20 bp, Artificial Sequence
  chemically synthesized
aaactttgtttctttaatac

SEQ ID NO: 53141 - DNA, 20 bp, Artificial Sequence
  chemically synthesized
ctttgtttctttaatacaag

SEQ ID NO: 53142 - DNA, 20 bp, Artificial Sequence
  chemically synthesized
tttaatacaagcagtcgtat

SEQ ID NO: 53143 - DNA, 20 bp, Artificial Sequence
  chemically synthesized
agtcgtattggcttctatac

SEQ ID NO: 53144 - DNA, 20 bp, Artificial Sequence
  chemically synthesized
acacacatattatgatgtat

SEQ ID NO: 53145 - DNA, 20 bp, Artificial Sequence
  chemically synthesized
cacatattatgatgtattag

SEQ ID NO: 53146 - DNA, 20 bp, Artificial Sequence
  chemically synthesized
acatattatgatgtattaga

SEQ ID NO: 53147 - DNA, 20 bp, Artificial Sequence
  chemically synthesized
tattatgatgtattagaagg

SEQ ID NO: 53148 - DNA, 20 bp, Artificial Sequence
  chemically synthesized
gaaggaagataaatgtcatc

SEQ ID NO: 53149 - DNA, 20 bp, Artificial Sequence
  chemically synthesized
aaatgtcatcaagccttatt

SEQ ID NO: 53150 - DNA, 20 bp, Artificial Sequence
  chemically synthesized
aatgtcatcaagccttatta

SEQ ID NO: 53151 - DNA, 20 bp, Artificial Sequence
  chemically synthesized
gtcatcaagccttattaagg

SEQ ID NO: 53152 - DNA, 20 bp, Artificial Sequence
  chemically synthesized
tcatcaagccttattaaggc

SEQ ID NO: 53153 - DNA, 20 bp, Artificial Sequence
  chemically synthesized
agccttattaaggcaggtcc

SEQ ID NO: 53154 - DNA, 20 bp, Artificial Sequence
  chemically synthesized
tcctggtgtatccttcctta

SEQ ID NO: 53155 - DNA, 20 bp, Artificial Sequence
  chemically synthesized
gtgtatccttccttaaagaa

SEQ ID NO: 53156 - DNA, 20 bp, Artificial Sequence
  chemically synthesized
agtatctaataaccttacgt

SEQ ID NO: 53157 - DNA, 20 bp, Artificial Sequence
  chemically synthesized
aaccttacgttagctaaacg

SEQ ID NO: 53158 - DNA, 20 bp, Artificial Sequence
  chemically synthesized
ccttacgttagctaaacgaa

SEQ ID NO: 53159 - DNA, 20 bp, Artificial Sequence
  chemically synthesized
taaacgaagagataatatat

SEQ ID NO: 53160 - DNA, 20 bp, Artificial Sequence
  chemically synthesized
aatatattagtaattcttcc

SEQ ID NO: 53161 - DNA, 20 bp, Artificial Sequence
  chemically synthesized
ttagtaattcttcccagata

SEQ ID NO: 53162 - DNA, 20 bp, Artificial Sequence
  chemically synthesized
ccagataaagatcatctcta

SEQ ID NO: 53163 - DNA, 20 bp, Artificial Sequence
  chemically synthesized
agtaattcacaaactccacc

SEQ ID NO: 53164 - DNA, 20 bp, Artificial Sequence
  chemically synthesized
attcacaaactccacctgga

SEQ ID NO: 53165 - DNA, 20 bp, Artificial Sequence
  chemically synthesized
cacaaactccacctggaaag

SEQ ID NO: 53166 - DNA, 20 bp, Artificial Sequence
  chemically synthesized
caaactccacctggaaagaa

SEQ ID NO: 53167 - DNA, 20 bp, Artificial Sequence
  chemically synthesized
actccacctggaaagaagag

SEQ ID NO: 53168 - DNA, 20 bp, Artificial Sequence
  chemically synthesized
aagaagagtggctattgctc

SEQ ID NO: 53169 - DNA, 20 bp, Artificial Sequence
  chemically synthesized
gctcaagctattcttcaatg

SEQ ID NO: 53170 - DNA, 20 bp, Artificial Sequence
  chemically synthesized
caagctattcttcaatgtgg

SEQ ID NO: 53171 - DNA, 20 bp, Artificial Sequence
  chemically synthesized
aagctattcttcaatgtggc

SEQ ID NO: 53172 - DNA, 20 bp, Artificial Sequence
  chemically synthesized
agctattcttcaatgtggca

SEQ ID NO: 53173 - DNA, 20 bp, Artificial Sequence
  chemically synthesized
gctattcttcaatgtggcag

SEQ ID NO: 53174 - DNA, 20 bp, Artificial Sequence
  chemically synthesized
caggggaaaaatctttgaaa

SEQ ID NO: 53175 - DNA, 20 bp, Artificial Sequence
  chemically synthesized
aaaatctttgaaaaagctac

SEQ ID NO: 53176 - DNA, 20 bp, Artificial Sequence
  chemically synthesized
aaatattgattccaaccact

SEQ ID NO: 53177 - DNA, 20 bp, Artificial Sequence
  chemically synthesized
ccaaccactgagaaactcta

SEQ ID NO: 53178 - DNA, 20 bp, Artificial Sequence
  chemically synthesized
accactgagaaactctacag

SEQ ID NO: 53179 - DNA, 20 bp, Artificial Sequence
  chemically synthesized
ccactgagaaactctacagc

SEQ ID NO: 53180 - DNA, 20 bp, Artificial Sequence
  chemically synthesized
cactgagaaactctacagca

SEQ ID NO: 53181 - DNA, 20 bp, Artificial Sequence
  chemically synthesized
agcagggatgtccaatcttt

SEQ ID NO: 53182 - DNA, 20 bp, Artificial Sequence
  chemically synthesized
gtccaatcttttggcttccc

SEQ ID NO: 53183 - DNA, 20 bp, Artificial Sequence
  chemically synthesized
tccaatcttttggcttccct

SEQ ID NO: 53184 - DNA, 20 bp, Artificial Sequence
  chemically synthesized
aaatatactaacactaatga

SEQ ID NO: 53185 - DNA, 20 bp, Artificial Sequence
  chemically synthesized
taacactaatgacagctcat

SEQ ID NO: 53186 - DNA, 20 bp, Artificial Sequence
  chemically synthesized
ataaaatctcataatgtttt

SEQ ID NO: 53187 - DNA, 20 bp, Artificial Sequence
  chemically synthesized
aatctcataatgttttaaga

SEQ ID NO: 53188 - DNA, 20 bp, Artificial Sequence
  chemically synthesized
atgttttaagaaagttgtgt

SEQ ID NO: 53189 - DNA, 20 bp, Artificial Sequence
  chemically synthesized
tttaagaaagttgtgttgga

SEQ ID NO: 53190 - DNA, 20 bp, Artificial Sequence
  chemically synthesized
gttgtgttggatagcattca

SEQ ID NO: 53191 - DNA, 20 bp, Artificial Sequence
  chemically synthesized
gatagcattcaaagccatct

SEQ ID NO: 53192 - DNA, 20 bp, Artificial Sequence
  chemically synthesized
atagcattcaaagccatctt

SEQ ID NO: 53193 - DNA, 20 bp, Artificial Sequence
  chemically synthesized
aagccatcttgggatgcatg

SEQ ID NO: 53194 - DNA, 20 bp, Artificial Sequence
  chemically synthesized
cttgggatgcatgcagccca

SEQ ID NO: 53195 - DNA, 20 bp, Artificial Sequence
  chemically synthesized
ttgggatgcatgcagcccac

SEQ ID NO: 53196 - DNA, 20 bp, Artificial Sequence
  chemically synthesized
tgcatgcagcccacgggcca

SEQ ID NO: 53197 - DNA, 20 bp, Artificial Sequence
  chemically synthesized
gcatgcagcccacgggccac

SEQ ID NO: 53198 - DNA, 20 bp, Artificial Sequence
  chemically synthesized
gcagcccacgggccacaggt

SEQ ID NO: 53199 - DNA, 20 bp, Artificial Sequence
  chemically synthesized
ccacgggccacaggttggac

SEQ ID NO: 53200 - DNA, 20 bp, Artificial Sequence
  chemically synthesized
ggttggacaagcttgctcta

SEQ ID NO: 53201 - DNA, 20 bp, Artificial Sequence
  chemically synthesized
ttgctctacagcctacaaac

SEQ ID NO: 53202 - DNA, 20 bp, Artificial Sequence
  chemically synthesized
tgctctacagcctacaaaca

SEQ ID NO: 53203 - DNA, 20 bp, Artificial Sequence
  chemically synthesized
tctacagcctacaaacaagg

SEQ ID NO: 53204 - DNA, 20 bp, Artificial Sequence
  chemically synthesized
aatatttctgttctcttttc

SEQ ID NO: 53205 - DNA, 20 bp, Artificial Sequence
  chemically synthesized
tcttttctggcaccaactcc

SEQ ID NO: 53206 - DNA, 20 bp, Artificial Sequence
  chemically synthesized
gcaccaactcccagctttac

SEQ ID NO: 53207 - DNA, 20 bp, Artificial Sequence
  chemically synthesized
gctttactagcaccaactcc

SEQ ID NO: 53208 - DNA, 20 bp, Artificial Sequence
  chemically synthesized
agctttactaacttacaaat

SEQ ID NO: 53209 - DNA, 20 bp, Artificial Sequence
  chemically synthesized
tttactaacttacaaatgag

SEQ ID NO: 53210 - DNA, 20 bp, Artificial Sequence
  chemically synthesized
acttacaaatgagaagaaac

SEQ ID NO: 53211 - DNA, 20 bp, Artificial Sequence
  chemically synthesized
cttacaaatgagaagaaacc

SEQ ID NO: 53212 - DNA, 20 bp, Artificial Sequence
  chemically synthesized
tatgccaaattacttgttcg

SEQ ID NO: 53213 - DNA, 20 bp, Artificial Sequence
  chemically synthesized
ccaaattacttgttcgaaga

SEQ ID NO: 53214 - DNA, 20 bp, Artificial Sequence
  chemically synthesized
caaattacttgttcgaagaa

SEQ ID NO: 53215 - DNA, 20 bp, Artificial Sequence
  chemically synthesized
tgttcgaagaaaggatcatc

SEQ ID NO: 53216 - DNA, 20 bp, Artificial Sequence
  chemically synthesized
atcatctggaattcttttct

SEQ ID NO: 53217 - DNA, 20 bp, Artificial Sequence
  chemically synthesized
ttcttggatttcctccactc

SEQ ID NO: 53218 - DNA, 20 bp, Artificial Sequence
  chemically synthesized
tttcctccactcaagtccca

SEQ ID NO: 53219 - DNA, 20 bp, Artificial Sequence
  chemically synthesized
ctccactcaagtcccatagt

SEQ ID NO: 53220 - DNA, 20 bp, Artificial Sequence
  chemically synthesized
tcaagtcccatagtaagata

SEQ ID NO: 53221 - DNA, 20 bp, Artificial Sequence
  chemically synthesized
caagtcccatagtaagataa

SEQ ID NO: 53222 - DNA, 20 bp, Artificial Sequence
  chemically synthesized
attgtatctttttcattttt

SEQ ID NO: 53223 - DNA, 20 bp, Artificial Sequence
  chemically synthesized
tctttttcattttttggctg

SEQ ID NO: 53224 - DNA, 20 bp, Artificial Sequence
  chemically synthesized
tcattttttggctgaagcac

SEQ ID NO: 53225 - DNA, 20 bp, Artificial Sequence
  chemically synthesized
ttggctgaagcactagcatc

SEQ ID NO: 53226 - DNA, 20 bp, Artificial Sequence
  chemically synthesized
tggctgaagcactagcatcc

SEQ ID NO: 53227 - DNA, 20 bp, Artificial Sequence
  chemically synthesized
ccaggacactaatttaccta

SEQ ID NO: 53228 - DNA, 20 bp, Artificial Sequence
  chemically synthesized
ttacctatagaacaattatc

SEQ ID NO: 53229 - DNA, 20 bp, Artificial Sequence
  chemically synthesized
aacaattatctagactcaat

SEQ ID NO: 53230 - DNA, 20 bp, Artificial Sequence
  chemically synthesized
aattatctagactcaattag

SEQ ID NO: 53231 - DNA, 20 bp, Artificial Sequence
  chemically synthesized
tagaagtatcttacatattg

SEQ ID NO: 53232 - DNA, 20 bp, Artificial Sequence
  chemically synthesized
aagtatcttacatattgaag

SEQ ID NO: 53233 - DNA, 20 bp, Artificial Sequence
  chemically synthesized
gtatcttacatattgaagca

SEQ ID NO: 53234 - DNA, 20 bp, Artificial Sequence
  chemically synthesized
cttacatattgaagcagagt

SEQ ID NO: 53235 - DNA, 20 bp, Artificial Sequence
  chemically synthesized
tacatattgaagcagagtta

SEQ ID NO: 53236 - DNA, 20 bp, Artificial Sequence
  chemically synthesized
agagttagagctaaaatctc

SEQ ID NO: 53237 - DNA, 20 bp, Artificial Sequence
  chemically synthesized
aatccaacatccttaattta

SEQ ID NO: 53238 - DNA, 20 bp, Artificial Sequence
  chemically synthesized
ttaatttacagatactaaat

SEQ ID NO: 53239 - DNA, 20 bp, Artificial Sequence
  chemically synthesized
atttacagatactaaatcag

SEQ ID NO: 53240 - DNA, 20 bp, Artificial Sequence
  chemically synthesized
agatactaaatcagtagcca

SEQ ID NO: 53241 - DNA, 20 bp, Artificial Sequence
  chemically synthesized
agccatttttactgctattt

SEQ ID NO: 53242 - DNA, 20 bp, Artificial Sequence
  chemically synthesized
tttactgctattttggttaa

SEQ ID NO: 53243 - DNA, 20 bp, Artificial Sequence
  chemically synthesized
ttactgctattttggttaac

SEQ ID NO: 53244 - DNA, 20 bp, Artificial Sequence
  chemically synthesized
tactgctattttggttaaca

SEQ ID NO: 53245 - DNA, 20 bp, Artificial Sequence
  chemically synthesized
atccatttccttgaaatcca

SEQ ID NO: 53246 - DNA, 20 bp, Artificial Sequence
  chemically synthesized
tccatagaaatttaaaaact

SEQ ID NO: 53247 - DNA, 20 bp, Artificial Sequence
  chemically synthesized
ttaaaaactgagtcttttaa

SEQ ID NO: 53248 - DNA, 20 bp, Artificial Sequence
  chemically synthesized
taacagcacaatctgctcta

SEQ ID NO: 53249 - DNA, 20 bp, Artificial Sequence
  chemically synthesized
cacaatctgctctaaagtga

SEQ ID NO: 53250 - DNA, 20 bp, Artificial Sequence
  chemically synthesized
tttctgacatgaacttatgt

SEQ ID NO: 53251 - DNA, 20 bp, Artificial Sequence
  chemically synthesized
atgttccctgcaaaaatatc

SEQ ID NO: 53252 - DNA, 20 bp, Artificial Sequence
  chemically synthesized
tgttccctgcaaaaatatct

SEQ ID NO: 53253 - DNA, 20 bp, Artificial Sequence
  chemically synthesized
gcaaaaatatctaggtatat

SEQ ID NO: 53254 - DNA, 20 bp, Artificial Sequence
  chemically synthesized
aggtatattagataatcata

SEQ ID NO: 53255 - DNA, 20 bp, Artificial Sequence
  chemically synthesized
catatagatatatgattatt

SEQ ID NO: 53256 - DNA, 20 bp, Artificial Sequence
  chemically synthesized
atatagatatatgattatta

SEQ ID NO: 53257 - DNA, 20 bp, Artificial Sequence
  chemically synthesized
tatagatatatgattattaa

SEQ ID NO: 53258 - DNA, 20 bp, Artificial Sequence
  chemically synthesized
atgattattaagggcatacc

SEQ ID NO: 53259 - DNA, 20 bp, Artificial Sequence
  chemically synthesized
tatataacattcataaaaat

SEQ ID NO: 53260 - DNA, 20 bp, Artificial Sequence
  chemically synthesized
attggaaaattatttttcta

SEQ ID NO: 53261 - DNA, 20 bp, Artificial Sequence
  chemically synthesized
aattatttttctaaagcatg

SEQ ID NO: 53262 - DNA, 20 bp, Artificial Sequence
  chemically synthesized
tttctaaagcatgtggctca

SEQ ID NO: 53263 - DNA, 20 bp, Artificial Sequence
  chemically synthesized
agcatgtggctcaaagactg

SEQ ID NO: 53264 - DNA, 20 bp, Artificial Sequence
  chemically synthesized
caaagactgtagacttctat

SEQ ID NO: 53265 - DNA, 20 bp, Artificial Sequence
  chemically synthesized
taactattatttcatctgca

SEQ ID NO: 53266 - DNA, 20 bp, Artificial Sequence
  chemically synthesized
atctgcatagaatattgctg

SEQ ID NO: 53267 - DNA, 20 bp, Artificial Sequence
  chemically synthesized
tctgcatagaatattgctga

SEQ ID NO: 53268 - DNA, 20 bp, Artificial Sequence
  chemically synthesized
attgctgaaggtgtgtttta

SEQ ID NO: 53269 - DNA, 20 bp, Artificial Sequence
  chemically synthesized
gctgaaggtgtgttttaaag

SEQ ID NO: 53270 - DNA, 20 bp, Artificial Sequence
  chemically synthesized
tgtgttttaaagtagtaaca

SEQ ID NO: 53271 - DNA, 20 bp, Artificial Sequence
  chemically synthesized
gtaacatggtacttgtatca

SEQ ID NO: 53272 - DNA, 20 bp, Artificial Sequence
  chemically synthesized
acatggtacttgtatcacag

SEQ ID NO: 53273 - DNA, 20 bp, Artificial Sequence
  chemically synthesized
tacttgtatcacagcagccg

SEQ ID NO: 53274 - DNA, 20 bp, Artificial Sequence
  chemically synthesized
gtatcacagcagccgtagtt

SEQ ID NO: 53275 - DNA, 20 bp, Artificial Sequence
  chemically synthesized
ctcttgcatattatatttat

SEQ ID NO: 53276 - DNA, 20 bp, Artificial Sequence
  chemically synthesized
tgctcaaaaaaaaattcttc

SEQ ID NO: 53277 - DNA, 20 bp, Artificial Sequence
  chemically synthesized
aaaaaaaattcttcaagttt

SEQ ID NO: 53278 - DNA, 20 bp, Artificial Sequence
  chemically synthesized
aaaaaattcttcaagtttta

SEQ ID NO: 53279 - DNA, 20 bp, Artificial Sequence
  chemically synthesized
tcttcaagttttagagtccc

SEQ ID NO: 53280 - DNA, 20 bp, Artificial Sequence
  chemically synthesized
agatttaaaaacattataat

SEQ ID NO: 53281 - DNA, 20 bp, Artificial Sequence
  chemically synthesized
aaaacattataataagttat

SEQ ID NO: 53282 - DNA, 20 bp, Artificial Sequence
  chemically synthesized
acattataataagttatcag

SEQ ID NO: 53283 - DNA, 20 bp, Artificial Sequence
  chemically synthesized
attataataagttatcagca

SEQ ID NO: 53284 - DNA, 20 bp, Artificial Sequence
  chemically synthesized
tatcagcagagtatacctct

SEQ ID NO: 53285 - DNA, 20 bp, Artificial Sequence
  chemically synthesized
tttgttcttcctgtcactat

SEQ ID NO: 53286 - DNA, 20 bp, Artificial Sequence
  chemically synthesized
ttgttcttcctgtcactatc

SEQ ID NO: 53287 - DNA, 20 bp, Artificial Sequence
  chemically synthesized
ttcttcctgtcactatcagg

SEQ ID NO: 53288 - DNA, 20 bp, Artificial Sequence
  chemically synthesized
tcctgtcactatcaggtagt

SEQ ID NO: 53289 - DNA, 20 bp, Artificial Sequence
  chemically synthesized
cactatcaggtagtcagatg

SEQ ID NO: 53290 - DNA, 20 bp, Artificial Sequence
  chemically synthesized
attcctttaatttcttttcc

SEQ ID NO: 53291 - DNA, 20 bp, Artificial Sequence
  chemically synthesized
ttcctttaatttcttttcca

SEQ ID NO: 53292 - DNA, 20 bp, Artificial Sequence
  chemically synthesized
tttaatttcttttccaagga

SEQ ID NO: 53293 - DNA, 20 bp, Artificial Sequence
  chemically synthesized
ttaatttcttttccaaggat

SEQ ID NO: 53294 - DNA, 20 bp, Artificial Sequence
  chemically synthesized
atttcttttccaaggatagg

SEQ ID NO: 53295 - DNA, 20 bp, Artificial Sequence
  chemically synthesized
tttcttttccaaggataggt

SEQ ID NO: 53296 - DNA, 20 bp, Artificial Sequence
  chemically synthesized
cttttccaaggataggtggg

SEQ ID NO: 53297 - DNA, 20 bp, Artificial Sequence
  chemically synthesized
ccaaggataggtgggaagat

SEQ ID NO: 53298 - DNA, 20 bp, Artificial Sequence
  chemically synthesized
cctttctttaatgtctaaaa

SEQ ID NO: 53299 - DNA, 20 bp, Artificial Sequence
  chemically synthesized
tctttaatgtctaaaaaagc

SEQ ID NO: 53300 - DNA, 20 bp, Artificial Sequence
  chemically synthesized
ctttaatgtctaaaaaagca

SEQ ID NO: 53301 - DNA, 20 bp, Artificial Sequence
  chemically synthesized
atgtctaaaaaagcaaggtg

SEQ ID NO: 53302 - DNA, 20 bp, Artificial Sequence
  chemically synthesized
catccaatttaccctcacta

SEQ ID NO: 53303 - DNA, 20 bp, Artificial Sequence
  chemically synthesized
tttaccctcactatggtttc

SEQ ID NO: 53304 - DNA, 20 bp, Artificial Sequence
  chemically synthesized
atggtttcaagacctttgaa

SEQ ID NO: 53305 - DNA, 20 bp, Artificial Sequence
  chemically synthesized
tttcaagacctttgaatgga

SEQ ID NO: 53306 - DNA, 20 bp, Artificial Sequence
  chemically synthesized
ttcttatatctcccaccata

SEQ ID NO: 53307 - DNA, 20 bp, Artificial Sequence
  chemically synthesized
taataaaatatgacctctct

SEQ ID NO: 53308 - DNA, 20 bp, Artificial Sequence
  chemically synthesized
aaaatatgacctctcttagc

SEQ ID NO: 53309 - DNA, 20 bp, Artificial Sequence
  chemically synthesized
tatgacctctcttagccagt

SEQ ID NO: 53310 - DNA, 20 bp, Artificial Sequence
  chemically synthesized
tctcttagccagtgagaact

SEQ ID NO: 53311 - DNA, 20 bp, Artificial Sequence
  chemically synthesized
ccagtgagaactaagatgcc

SEQ ID NO: 53312 - DNA, 20 bp, Artificial Sequence
  chemically synthesized
aagatgcctagatgactgat

SEQ ID NO: 53313 - DNA, 20 bp, Artificial Sequence
  chemically synthesized
gatgcctagatgactgattg

SEQ ID NO: 53314 - DNA, 20 bp, Artificial Sequence
  chemically synthesized
atgcctagatgactgattgg

SEQ ID NO: 53315 - DNA, 20 bp, Artificial Sequence
  chemically synthesized
agatgactgattggaggacc

SEQ ID NO: 53316 - DNA, 20 bp, Artificial Sequence
  chemically synthesized
gatgactgattggaggacct

SEQ ID NO: 53317 - DNA, 20 bp, Artificial Sequence
  chemically synthesized
ggaggacctgggcacttgcc

SEQ ID NO: 53318 - DNA, 20 bp, Artificial Sequence
  chemically synthesized
cacttgcctagcatccaatc

SEQ ID NO: 53319 - DNA, 20 bp, Artificial Sequence
  chemically synthesized
agcatccaatcaagatcatc

SEQ ID NO: 53320 - DNA, 20 bp, Artificial Sequence
  chemically synthesized
tccaatcaagatcatccagt

SEQ ID NO: 53321 - DNA, 20 bp, Artificial Sequence
  chemically synthesized
ccaatcaagatcatccagtc

SEQ ID NO: 53322 - DNA, 20 bp, Artificial Sequence
  chemically synthesized
caatcaagatcatccagtca

SEQ ID NO: 53323 - DNA, 20 bp, Artificial Sequence
  chemically synthesized
caagatcatccagtcagggt

SEQ ID NO: 53324 - DNA, 20 bp, Artificial Sequence
  chemically synthesized
gatgtcaaacatcatattta

SEQ ID NO: 53325 - DNA, 20 bp, Artificial Sequence
  chemically synthesized
atgtcaaacatcatatttat

SEQ ID NO: 53326 - DNA, 20 bp, Artificial Sequence
  chemically synthesized
tgtcaaacatcatatttata

SEQ ID NO: 53327 - DNA, 20 bp, Artificial Sequence
  chemically synthesized
caaacatcatatttataggg

SEQ ID NO: 53328 - DNA, 20 bp, Artificial Sequence
  chemically synthesized
ttttactatttttttttact

SEQ ID NO: 53329 - DNA, 20 bp, Artificial Sequence
  chemically synthesized
tttactaagttttactacta

SEQ ID NO: 53330 - DNA, 20 bp, Artificial Sequence
  chemically synthesized
ttactaagttttactactat

SEQ ID NO: 53331 - DNA, 20 bp, Artificial Sequence
  chemically synthesized
tttactactataggtgaaaa

SEQ ID NO: 53332 - DNA, 20 bp, Artificial Sequence
  chemically synthesized
ctataggtgaaaaaagcttc

SEQ ID NO: 53333 - DNA, 20 bp, Artificial Sequence
  chemically synthesized
tataggtgaaaaaagcttct

SEQ ID NO: 53334 - DNA, 20 bp, Artificial Sequence
  chemically synthesized
ataggtgaaaaaagcttcta

SEQ ID NO: 53335 - DNA, 20 bp, Artificial Sequence
  chemically synthesized
agggattctttgaaaaatat

SEQ ID NO: 53336 - DNA, 20 bp, Artificial Sequence
  chemically synthesized
tgaaaaatatcagaaaatca

SEQ ID NO: 53337 - DNA, 20 bp, Artificial Sequence
  chemically synthesized
atcagaaaatcacagatata

SEQ ID NO: 53338 - DNA, 20 bp, Artificial Sequence
  chemically synthesized
agaaaatcacagatatatgg

SEQ ID NO: 53339 - DNA, 20 bp, Artificial Sequence
  chemically synthesized
gaaaatcacagatatatgga

SEQ ID NO: 53340 - DNA, 20 bp, Artificial Sequence
  chemically synthesized
atatatggaaggctccactt

SEQ ID NO: 53341 - DNA, 20 bp, Artificial Sequence
  chemically synthesized
atatggaaggctccacttga

SEQ ID NO: 53342 - DNA, 20 bp, Artificial Sequence
  chemically synthesized
aaggctccacttgagagaat

SEQ ID NO: 53343 - DNA, 20 bp, Artificial Sequence
  chemically synthesized
aggctccacttgagagaata

SEQ ID NO: 53344 - DNA, 20 bp, Artificial Sequence
  chemically synthesized
aacatctctctccataaatc

SEQ ID NO: 53345 - DNA, 20 bp, Artificial Sequence
  chemically synthesized
tctccataaatctggcttat

SEQ ID NO: 53346 - DNA, 20 bp, Artificial Sequence
  chemically synthesized
aaatctggcttatcagtgtg

SEQ ID NO: 53347 - DNA, 20 bp, Artificial Sequence
  chemically synthesized
ctggcttatcagtgtgaagc

SEQ ID NO: 53348 - DNA, 20 bp, Artificial Sequence
  chemically synthesized
ttttaattccatgaatatca

SEQ ID NO: 53349 - DNA, 20 bp, Artificial Sequence
  chemically synthesized
ttcatctgtattcctcatta

SEQ ID NO: 53350 - DNA, 20 bp, Artificial Sequence
  chemically synthesized
tcctcattaaagtatccttc

SEQ ID NO: 53351 - DNA, 20 bp, Artificial Sequence
  chemically synthesized
ctcattaaagtatccttcaa

SEQ ID NO: 53352 - DNA, 20 bp, Artificial Sequence
  chemically synthesized
taaagtatccttcaagagaa

SEQ ID NO: 53353 - DNA, 20 bp, Artificial Sequence
  chemically synthesized
aaagtatccttcaagagaat

SEQ ID NO: 53354 - DNA, 20 bp, Artificial Sequence
  chemically synthesized
tcaagagaatgggatatcta

SEQ ID NO: 53355 - DNA, 20 bp, Artificial Sequence
  chemically synthesized
agagaatgggatatctacag

SEQ ID NO: 53356 - DNA, 20 bp, Artificial Sequence
  chemically synthesized
cagtagctaatataatttct

SEQ ID NO: 53357 - DNA, 20 bp, Artificial Sequence
  chemically synthesized
aatataatttcttggccctt

SEQ ID NO: 53358 - DNA, 20 bp, Artificial Sequence
  chemically synthesized
gacccatttaccatgtgacc

SEQ ID NO: 53359 - DNA, 20 bp, Artificial Sequence
  chemically synthesized
tttaccatgtgaccaagaaa

SEQ ID NO: 53360 - DNA, 20 bp, Artificial Sequence
  chemically synthesized
accatgtgaccaagaaaaag

SEQ ID NO: 53361 - DNA, 20 bp, Artificial Sequence
  chemically synthesized
ccatgtgaccaagaaaaagc

SEQ ID NO: 53362 - DNA, 20 bp, Artificial Sequence
  chemically synthesized
catgtgaccaagaaaaagca

SEQ ID NO: 53363 - DNA, 20 bp, Artificial Sequence
  chemically synthesized
tgaccaagaaaaagcaggga

SEQ ID NO: 53364 - DNA, 20 bp, Artificial Sequence
  chemically synthesized
agaaaaagcagggaaagcaa

SEQ ID NO: 53365 - DNA, 20 bp, Artificial Sequence
  chemically synthesized
caatagaaccttaaaaatta

SEQ ID NO: 53366 - DNA, 20 bp, Artificial Sequence
  chemically synthesized
aatagaaccttaaaaattaa

SEQ ID NO: 53367 - DNA, 20 bp, Artificial Sequence
  chemically synthesized
atagaaccttaaaaattaaa

SEQ ID NO: 53368 - DNA, 20 bp, Artificial Sequence
  chemically synthesized
aaattaaagggaaataaaat

SEQ ID NO: 53369 - DNA, 20 bp, Artificial Sequence
  chemically synthesized
attaaagggaaataaaatga

SEQ ID NO: 53370 - DNA, 20 bp, Artificial Sequence
  chemically synthesized
aaaatgagagaattaacttt

SEQ ID NO: 53371 - DNA, 20 bp, Artificial Sequence
  chemically synthesized
aaatgagagaattaactttt

SEQ ID NO: 53372 - DNA, 20 bp, Artificial Sequence
  chemically synthesized
ttaacttttaggtgccatct

SEQ ID NO: 53373 - DNA, 20 bp, Artificial Sequence
  chemically synthesized
ggtgccatctaagatgtgta

SEQ ID NO: 53374 - DNA, 20 bp, Artificial Sequence
  chemically synthesized
ttgcaacctatatttgccaa

SEQ ID NO: 53375 - DNA, 20 bp, Artificial Sequence
  chemically synthesized
tatatttgccaatggctcat

SEQ ID NO: 53376 - DNA, 20 bp, Artificial Sequence
  chemically synthesized
tcattggaaacaatatatga

SEQ ID NO: 53377 - DNA, 20 bp, Artificial Sequence
  chemically synthesized
cattggaaacaatatatgac

SEQ ID NO: 53378 - DNA, 20 bp, Artificial Sequence
  chemically synthesized
attggaaacaatatatgaca

SEQ ID NO: 53379 - DNA, 20 bp, Artificial Sequence
  chemically synthesized
acaatatatgacagggacaa

SEQ ID NO: 53380 - DNA, 20 bp, Artificial Sequence
  chemically synthesized
tatgacagggacaaaagacc

SEQ ID NO: 53381 - DNA, 20 bp, Artificial Sequence
  chemically synthesized
ggacaaaagacctggacatg

SEQ ID NO: 53382 - DNA, 20 bp, Artificial Sequence
  chemically synthesized
tgtagatgtatgtattaact

SEQ ID NO: 53383 - DNA, 20 bp, Artificial Sequence
  chemically synthesized
gtagatgtatgtattaactt

SEQ ID NO: 53384 - DNA, 20 bp, Artificial Sequence
  chemically synthesized
gtatgtattaacttaggtgt

SEQ ID NO: 53385 - DNA, 20 bp, Artificial Sequence
  chemically synthesized
atgtattaacttaggtgtca

SEQ ID NO: 53386 - DNA, 20 bp, Artificial Sequence
  chemically synthesized
gtattaacttaggtgtcaga

SEQ ID NO: 53387 - DNA, 20 bp, Artificial Sequence
  chemically synthesized
ttaacttaggtgtcagagag

SEQ ID NO: 53388 - DNA, 20 bp, Artificial Sequence
  chemically synthesized
acttaggtgtcagagagtgg

SEQ ID NO: 53389 - DNA, 20 bp, Artificial Sequence
  chemically synthesized
gtgtcagagagtggtggctg

SEQ ID NO: 53390 - DNA, 20 bp, Artificial Sequence
  chemically synthesized
aaatgcacaaattataatga

SEQ ID NO: 53391 - DNA, 20 bp, Artificial Sequence
  chemically synthesized
atgcacaaattataatgaaa

SEQ ID NO: 53392 - DNA, 20 bp, Artificial Sequence
  chemically synthesized
aattataatgaaagagaatg

SEQ ID NO: 53393 - DNA, 20 bp, Artificial Sequence
  chemically synthesized
atgcagtatgtttctccctg

SEQ ID NO: 53394 - DNA, 20 bp, Artificial Sequence
  chemically synthesized
tctccctgtggactatgtac

SEQ ID NO: 53395 - DNA, 20 bp, Artificial Sequence
  chemically synthesized
ccctgtggactatgtaccag

SEQ ID NO: 53396 - DNA, 20 bp, Artificial Sequence
  chemically synthesized
tgtggactatgtaccagaag

SEQ ID NO: 53397 - DNA, 20 bp, Artificial Sequence
  chemically synthesized
ctctgtgtcatctccttcca

SEQ ID NO: 53398 - DNA, 20 bp, Artificial Sequence
  chemically synthesized
tctgtgtcatctccttccat

SEQ ID NO: 53399 - DNA, 20 bp, Artificial Sequence
  chemically synthesized
tgtgtcatctccttccatgg

SEQ ID NO: 53400 - DNA, 20 bp, Artificial Sequence
  chemically synthesized
gtgtcatctccttccatggg

SEQ ID NO: 53401 - DNA, 20 bp, Artificial Sequence
  chemically synthesized
gtcatctccttccatgggag

SEQ ID NO: 53402 - DNA, 20 bp, Artificial Sequence
  chemically synthesized
ggagtaaaattcgtcctctt

SEQ ID NO: 53403 - DNA, 20 bp, Artificial Sequence
  chemically synthesized
tcctcttaagctgaaaacct

SEQ ID NO: 53404 - DNA, 20 bp, Artificial Sequence
  chemically synthesized
cctcttaagctgaaaacctt

SEQ ID NO: 53405 - DNA, 20 bp, Artificial Sequence
  chemically synthesized
aagctgaaaaccttgggccc

SEQ ID NO: 53406 - DNA, 20 bp, Artificial Sequence
  chemically synthesized
gggcccaagacatgctttaa

SEQ ID NO: 53407 - DNA, 20 bp, Artificial Sequence
  chemically synthesized
cccaagacatgctttaaaag

SEQ ID NO: 53408 - DNA, 20 bp, Artificial Sequence
  chemically synthesized
tgctttaaaagaagtataaa

SEQ ID NO: 53409 - DNA, 20 bp, Artificial Sequence
  chemically synthesized
aaaagaagtataaatagttc

SEQ ID NO: 53410 - DNA, 20 bp, Artificial Sequence
  chemically synthesized
ctcaacctgctaaatatctt

SEQ ID NO: 53411 - DNA, 20 bp, Artificial Sequence
  chemically synthesized
tcaacctgctaaatatcttc

SEQ ID NO: 53412 - DNA, 20 bp, Artificial Sequence
  chemically synthesized
gctaaatatcttcaggattc

SEQ ID NO: 53413 - DNA, 20 bp, Artificial Sequence
  chemically synthesized
ttcaggattctagaaaatgc

SEQ ID NO: 53414 - DNA, 20 bp, Artificial Sequence
  chemically synthesized
ggattctagaaaatgcaagt

SEQ ID NO: 53415 - DNA, 20 bp, Artificial Sequence
  chemically synthesized
aaaatgcaagtaagtaaact

SEQ ID NO: 53416 - DNA, 20 bp, Artificial Sequence
  chemically synthesized
ttatgctcaatgaaaacttg

SEQ ID NO: 53417 - DNA, 20 bp, Artificial Sequence
  chemically synthesized
aaacttgtagaaaataacac

SEQ ID NO: 53418 - DNA, 20 bp, Artificial Sequence
  chemically synthesized
aaataacaccagaaaaaaaa

SEQ ID NO: 53419 - DNA, 20 bp, Artificial Sequence
  chemically synthesized
aataacaccagaaaaaaaaa

SEQ ID NO: 53420 - DNA, 20 bp, Artificial Sequence
  chemically synthesized
acaccagaaaaaaaaaaggc

SEQ ID NO: 53421 - DNA, 20 bp, Artificial Sequence
  chemically synthesized
aaaaaaaaggcaagaaactg

SEQ ID NO: 53422 - DNA, 20 bp, Artificial Sequence
  chemically synthesized
aaaaaggcaagaaactgcag

SEQ ID NO: 53423 - DNA, 20 bp, Artificial Sequence
  chemically synthesized
aaggcaagaaactgcagaag

SEQ ID NO: 53424 - DNA, 20 bp, Artificial Sequence
  chemically synthesized
tttccttgatttttgaccca

SEQ ID NO: 53425 - DNA, 20 bp, Artificial Sequence
  chemically synthesized
atttttgacccatggaatac

SEQ ID NO: 53426 - DNA, 20 bp, Artificial Sequence
  chemically synthesized
gacccatggaatactagact

SEQ ID NO: 53427 - DNA, 20 bp, Artificial Sequence
  chemically synthesized
tggaatactagacttggctt

SEQ ID NO: 53428 - DNA, 20 bp, Artificial Sequence
  chemically synthesized
atactagacttggctttagc

SEQ ID NO: 53429 - DNA, 20 bp, Artificial Sequence
  chemically synthesized
actagacttggctttagctg

SEQ ID NO: 53430 - DNA, 20 bp, Artificial Sequence
  chemically synthesized
ctggagttgatttgcaattg

SEQ ID NO: 53431 - DNA, 20 bp, Artificial Sequence
  chemically synthesized
attttttgtgttcttgtatt

SEQ ID NO: 53432 - DNA, 20 bp, Artificial Sequence
  chemically synthesized
tttgtgttcttgtattaagt

SEQ ID NO: 53433 - DNA, 20 bp, Artificial Sequence
  chemically synthesized
ttaagtaagtcattttcaaa

SEQ ID NO: 53434 - DNA, 20 bp, Artificial Sequence
  chemically synthesized
cattttcaaaaagaatattt

SEQ ID NO: 53435 - DNA, 20 bp, Artificial Sequence
  chemically synthesized
agaatattttagttttctct

SEQ ID NO: 53436 - DNA, 20 bp, Artificial Sequence
  chemically synthesized
tgctcattttctttgatatg

SEQ ID NO: 53437 - DNA, 20 bp, Artificial Sequence
  chemically synthesized
gcagatttgaatgttgtaca

SEQ ID NO: 53438 - DNA, 20 bp, Artificial Sequence
  chemically synthesized
gattcaatgaatttatattc

SEQ ID NO: 53439 - DNA, 20 bp, Artificial Sequence
  chemically synthesized
tcaatgaatttatattctag

SEQ ID NO: 53440 - DNA, 20 bp, Artificial Sequence
  chemically synthesized
tatattctagtagttaaaac

SEQ ID NO: 53441 - DNA, 20 bp, Artificial Sequence
  chemically synthesized
atattctagtagttaaaaca

SEQ ID NO: 53442 - DNA, 20 bp, Artificial Sequence
  chemically synthesized
ctagtagttaaaacaaggct

SEQ ID NO: 53443 - DNA, 20 bp, Artificial Sequence
  chemically synthesized
ggctcagtaataaaaaattt

SEQ ID NO: 53444 - DNA, 20 bp, Artificial Sequence
  chemically synthesized
tcagtaataaaaaattttag

SEQ ID NO: 53445 - DNA, 20 bp, Artificial Sequence
  chemically synthesized
tgtgtgtgtgcatcgttctg

SEQ ID NO: 53446 - DNA, 20 bp, Artificial Sequence
  chemically synthesized
gtttattgactattactcat

SEQ ID NO: 53447 - DNA, 20 bp, Artificial Sequence
  chemically synthesized
tttattgactattactcatc

SEQ ID NO: 53448 - DNA, 20 bp, Artificial Sequence
  chemically synthesized
gactattactcatcaggtaa

SEQ ID NO: 53449 - DNA, 20 bp, Artificial Sequence
  chemically synthesized
ttactcatcaggtaatagtc

SEQ ID NO: 53450 - DNA, 20 bp, Artificial Sequence
  chemically synthesized
tactcatcaggtaatagtct

SEQ ID NO: 53451 - DNA, 20 bp, Artificial Sequence
  chemically synthesized
atcaggtaatagtctaggca

SEQ ID NO: 53452 - DNA, 20 bp, Artificial Sequence
  chemically synthesized
taatagtctaggcacagatt

SEQ ID NO: 53453 - DNA, 20 bp, Artificial Sequence
  chemically synthesized
tagtctaggcacagattaag

SEQ ID NO: 53454 - DNA, 20 bp, Artificial Sequence
  chemically synthesized
ctaggcacagattaagaagc

SEQ ID NO: 53455 - DNA, 20 bp, Artificial Sequence
  chemically synthesized
actctcttccctatgtaaca

SEQ ID NO: 53456 - DNA, 20 bp, Artificial Sequence
  chemically synthesized
atgtaacaaagatattatac

SEQ ID NO: 53457 - DNA, 20 bp, Artificial Sequence
  chemically synthesized
caaagatattatactggtga

SEQ ID NO: 53458 - DNA, 20 bp, Artificial Sequence
  chemically synthesized
aaagatattatactggtgat

SEQ ID NO: 53459 - DNA, 20 bp, Artificial Sequence
  chemically synthesized
aagatattatactggtgatg

SEQ ID NO: 53460 - DNA, 20 bp, Artificial Sequence
  chemically synthesized
gaactatttgcaccttataa

SEQ ID NO: 53461 - DNA, 20 bp, Artificial Sequence
  chemically synthesized
caccttataaaagtaaatga

SEQ ID NO: 53462 - DNA, 20 bp, Artificial Sequence
  chemically synthesized
ataaaagtaaatgacagata

SEQ ID NO: 53463 - DNA, 20 bp, Artificial Sequence
  chemically synthesized
taaaagtaaatgacagatac

SEQ ID NO: 53464 - DNA, 20 bp, Artificial Sequence
  chemically synthesized
aaaagtaaatgacagataca

SEQ ID NO: 53465 - DNA, 20 bp, Artificial Sequence
  chemically synthesized
taaatgacagatacagggtg

SEQ ID NO: 53466 - DNA, 20 bp, Artificial Sequence
  chemically synthesized
accaattgataccatgtgcc

SEQ ID NO: 53467 - DNA, 20 bp, Artificial Sequence
  chemically synthesized
tgataccatgtgcccagtat

SEQ ID NO: 53468 - DNA, 20 bp, Artificial Sequence
  chemically synthesized
attaaaaaaaaatttattcc

SEQ ID NO: 53469 - DNA, 20 bp, Artificial Sequence
  chemically synthesized
aaatttattcctagtattta

SEQ ID NO: 53470 - DNA, 20 bp, Artificial Sequence
  chemically synthesized
actctaaatcaattcaatct

SEQ ID NO: 53471 - DNA, 20 bp, Artificial Sequence
  chemically synthesized
tcaattcaatctcagtttga

SEQ ID NO: 53472 - DNA, 20 bp, Artificial Sequence
  chemically synthesized
atctcagtttgatggataat

SEQ ID NO: 53473 - DNA, 20 bp, Artificial Sequence
  chemically synthesized
tttgatggataataagcctg

SEQ ID NO: 53474 - DNA, 20 bp, Artificial Sequence
  chemically synthesized
taataagcctgaagtcctga

SEQ ID NO: 53475 - DNA, 20 bp, Artificial Sequence
  chemically synthesized
cctgaaagttaaacttattc

SEQ ID NO: 53476 - DNA, 20 bp, Artificial Sequence
  chemically synthesized
attccagttgacaataattt

SEQ ID NO: 53477 - DNA, 20 bp, Artificial Sequence
  chemically synthesized
cttaattgctacaattttgt

SEQ ID NO: 53478 - DNA, 20 bp, Artificial Sequence
  chemically synthesized
gtcctgatgtcatctattgt

SEQ ID NO: 53479 - DNA, 20 bp, Artificial Sequence
  chemically synthesized
tcctgatgtcatctattgtt

SEQ ID NO: 53480 - DNA, 20 bp, Artificial Sequence
  chemically synthesized
gatgtcatctattgttggga

SEQ ID NO: 53481 - DNA, 20 bp, Artificial Sequence
  chemically synthesized
tgtcatctattgttgggata

SEQ ID NO: 53482 - DNA, 20 bp, Artificial Sequence
  chemically synthesized
agagatataaatgacttatg

SEQ ID NO: 53483 - DNA, 20 bp, Artificial Sequence
  chemically synthesized
acttatgtagctaccttcct

SEQ ID NO: 53484 - DNA, 20 bp, Artificial Sequence
  chemically synthesized
ccttcctaagacactgactt

SEQ ID NO: 53485 - DNA, 20 bp, Artificial Sequence
  chemically synthesized
ctaagacactgacttcagaa

SEQ ID NO: 53486 - DNA, 20 bp, Artificial Sequence
  chemically synthesized
tttaaatttatgcttattgt

SEQ ID NO: 53487 - DNA, 20 bp, Artificial Sequence
  chemically synthesized
ttaaatttatgcttattgtt

SEQ ID NO: 53488 - DNA, 20 bp, Artificial Sequence
  chemically synthesized
cttattgttaggtattttac

SEQ ID NO: 53489 - DNA, 20 bp, Artificial Sequence
  chemically synthesized
ttgttaggtattttacaagc

SEQ ID NO: 53490 - DNA, 20 bp, Artificial Sequence
  chemically synthesized
gttaggtattttacaagcaa

SEQ ID NO: 53491 - DNA, 20 bp, Artificial Sequence
  chemically synthesized
ttttacaagcaagagaacta

SEQ ID NO: 53492 - DNA, 20 bp, Artificial Sequence
  chemically synthesized
tttaaattaaatgacgtgtc

SEQ ID NO: 53493 - DNA, 20 bp, Artificial Sequence
  chemically synthesized
ttaaattaaatgacgtgtcc

SEQ ID NO: 53494 - DNA, 20 bp, Artificial Sequence
  chemically synthesized
taaattaaatgacgtgtcca

SEQ ID NO: 53495 - DNA, 20 bp, Artificial Sequence
  chemically synthesized
aaatgacgtgtccagggtca

SEQ ID NO: 53496 - DNA, 20 bp, Artificial Sequence
  chemically synthesized
atgacgtgtccagggtcata

SEQ ID NO: 53497 - DNA, 20 bp, Artificial Sequence
  chemically synthesized
cgtgtccagggtcatagagt

SEQ ID NO: 53498 - DNA, 20 bp, Artificial Sequence
  chemically synthesized
cagggtcatagagtcagaat

SEQ ID NO: 53499 - DNA, 20 bp, Artificial Sequence
  chemically synthesized
catagagtcagaataagatt

SEQ ID NO: 53500 - DNA, 20 bp, Artificial Sequence
  chemically synthesized
gagtcagaataagatttagc

SEQ ID NO: 53501 - DNA, 20 bp, Artificial Sequence
  chemically synthesized
aatacaactatatatgtcct

SEQ ID NO: 53502 - DNA, 20 bp, Artificial Sequence
  chemically synthesized
tacaactatatatgtcctta

SEQ ID NO: 53503 - DNA, 20 bp, Artificial Sequence
  chemically synthesized
accacactatctttgctccg

SEQ ID NO: 53504 - DNA, 20 bp, Artificial Sequence
  chemically synthesized
ccgtggatacattcatgatt

SEQ ID NO: 53505 - DNA, 20 bp, Artificial Sequence
  chemically synthesized
ggatacattcatgattcagt

SEQ ID NO: 53506 - DNA, 20 bp, Artificial Sequence
  chemically synthesized
attcagtcagaatatgctgt

SEQ ID NO: 53507 - DNA, 20 bp, Artificial Sequence
  chemically synthesized
atatgctgtcagaaatatcc

SEQ ID NO: 53508 - DNA, 20 bp, Artificial Sequence
  chemically synthesized
atatcctagaataatgctac

SEQ ID NO: 53509 - DNA, 20 bp, Artificial Sequence
  chemically synthesized
tatcctagaataatgctaca

SEQ ID NO: 53510 - DNA, 20 bp, Artificial Sequence
  chemically synthesized
gaataatgctacaaggaacc

SEQ ID NO: 53511 - DNA, 20 bp, Artificial Sequence
  chemically synthesized
aataatgctacaaggaaccc

SEQ ID NO: 53512 - DNA, 20 bp, Artificial Sequence
  chemically synthesized
aggaacccaggcctataatt

SEQ ID NO: 53513 - DNA, 20 bp, Artificial Sequence
  chemically synthesized
ggaacccaggcctataattt

SEQ ID NO: 53514 - DNA, 20 bp, Artificial Sequence
  chemically synthesized
catcacatatgacaatgttt

SEQ ID NO: 53515 - DNA, 20 bp, Artificial Sequence
  chemically synthesized
atcacatatgacaatgtttt

SEQ ID NO: 53516 - DNA, 20 bp, Artificial Sequence
  chemically synthesized
aaacaaatatttaaaaacca

SEQ ID NO: 53517 - DNA, 20 bp, Artificial Sequence
  chemically synthesized
aacaaatatttaaaaaccat

SEQ ID NO: 53518 - DNA, 20 bp, Artificial Sequence
  chemically synthesized
aaaaaccataggtatcacaa

SEQ ID NO: 53519 - DNA, 20 bp, Artificial Sequence
  chemically synthesized
taggtatcacaaaagatcac

SEQ ID NO: 53520 - DNA, 20 bp, Artificial Sequence
  chemically synthesized
agatcaccagaaaaaattta

SEQ ID NO: 53521 - DNA, 20 bp, Artificial Sequence
  chemically synthesized
gatcaccagaaaaaatttaa

SEQ ID NO: 53522 - DNA, 20 bp, Artificial Sequence
  chemically synthesized
accagaaaaaatttaaaggc

SEQ ID NO: 53523 - DNA, 20 bp, Artificial Sequence
  chemically synthesized
tcctgtatttttttttcact

SEQ ID NO: 53524 - DNA, 20 bp, Artificial Sequence
  chemically synthesized
ccatccctaatgtcctgatg

SEQ ID NO: 53525 - DNA, 20 bp, Artificial Sequence
  chemically synthesized
ctaatgtcctgatgaagccc

SEQ ID NO: 53526 - DNA, 20 bp, Artificial Sequence
  chemically synthesized
ctacgcttcactcacatgca

SEQ ID NO: 53527 - DNA, 20 bp, Artificial Sequence
  chemically synthesized
ttcactcacatgcatggctc

SEQ ID NO: 53528 - DNA, 20 bp, Artificial Sequence
  chemically synthesized
tcacatgcatggctctggcc

SEQ ID NO: 53529 - DNA, 20 bp, Artificial Sequence
  chemically synthesized
gctctggcctagaactgtgt

SEQ ID NO: 53530 - DNA, 20 bp, Artificial Sequence
  chemically synthesized
ctctggcctagaactgtgtc

SEQ ID NO: 53531 - DNA, 20 bp, Artificial Sequence
  chemically synthesized
tcctttctctgaaacatcaa

SEQ ID NO: 53532 - DNA, 20 bp, Artificial Sequence
  chemically synthesized
ttaaaatattctaacaatgt

SEQ ID NO: 53533 - DNA, 20 bp, Artificial Sequence
  chemically synthesized
aatgtgagatatatattaaa

SEQ ID NO: 53534 - DNA, 20 bp, Artificial Sequence
  chemically synthesized
atattaaatagtaaaacaat

SEQ ID NO: 53535 - DNA, 20 bp, Artificial Sequence
  chemically synthesized
acaattagtttatgtaaata

SEQ ID NO: 53536 - DNA, 20 bp, Artificial Sequence
  chemically synthesized
attagtttatgtaaataaag

SEQ ID NO: 53537 - DNA, 20 bp, Artificial Sequence
  chemically synthesized
atgtaaataaagtagatcca

SEQ ID NO: 53538 - DNA, 20 bp, Artificial Sequence
  chemically synthesized
gtaaataaagtagatccaca

SEQ ID NO: 53539 - DNA, 20 bp, Artificial Sequence
  chemically synthesized
attttatcttaatattttta

SEQ ID NO: 53540 - DNA, 20 bp, Artificial Sequence
  chemically synthesized
aagaacctcattccaactta

SEQ ID NO: 53541 - DNA, 20 bp, Artificial Sequence
  chemically synthesized
acctcattccaacttaaagc

SEQ ID NO: 53542 - DNA, 20 bp, Artificial Sequence
  chemically synthesized
cctcattccaacttaaagca

SEQ ID NO: 53543 - DNA, 20 bp, Artificial Sequence
  chemically synthesized
ctcattccaacttaaagcaa

SEQ ID NO: 53544 - DNA, 20 bp, Artificial Sequence
  chemically synthesized
taaagcaagggtaaattgct

SEQ ID NO: 53545 - DNA, 20 bp, Artificial Sequence
  chemically synthesized
gggtaaattgctcagctgtg

SEQ ID NO: 53546 - DNA, 20 bp, Artificial Sequence
  chemically synthesized
ggtaaattgctcagctgtgt

SEQ ID NO: 53547 - DNA, 20 bp, Artificial Sequence
  chemically synthesized
ctaaactgtaactcaaaaaa

SEQ ID NO: 53548 - DNA, 20 bp, Artificial Sequence
  chemically synthesized
taaactgtaactcaaaaaat

SEQ ID NO: 53549 - DNA, 20 bp, Artificial Sequence
  chemically synthesized
atttccatcatataaaattt

SEQ ID NO: 53550 - DNA, 20 bp, Artificial Sequence
  chemically synthesized
catcatataaaatttgagac

SEQ ID NO: 53551 - DNA, 20 bp, Artificial Sequence
  chemically synthesized
aaatttgagaccagaatatt

SEQ ID NO: 53552 - DNA, 20 bp, Artificial Sequence
  chemically synthesized
agaccagaatatttagcact

SEQ ID NO: 53553 - DNA, 20 bp, Artificial Sequence
  chemically synthesized
ttagcacttagcaaaaacaa

SEQ ID NO: 53554 - DNA, 20 bp, Artificial Sequence
  chemically synthesized
acttagcaaaaacaaaagta

SEQ ID NO: 53555 - DNA, 20 bp, Artificial Sequence
  chemically synthesized
cttagcaaaaacaaaagtaa

SEQ ID NO: 53556 - DNA, 20 bp, Artificial Sequence
  chemically synthesized
agcaaaaacaaaagtaaagg

SEQ ID NO: 53557 - DNA, 20 bp, Artificial Sequence
  chemically synthesized
aaaaacaaaagtaaaggtag

SEQ ID NO: 53558 - DNA, 20 bp, Artificial Sequence
  chemically synthesized
agactatgctatacaatgat

SEQ ID NO: 53559 - DNA, 20 bp, Artificial Sequence
  chemically synthesized
atcagtatattgaactgtaa

SEQ ID NO: 53560 - DNA, 20 bp, Artificial Sequence
  chemically synthesized
tattgaactgtaatggaatc

SEQ ID NO: 53561 - DNA, 20 bp, Artificial Sequence
  chemically synthesized
ttgaactgtaatggaatcaa

SEQ ID NO: 53562 - DNA, 20 bp, Artificial Sequence
  chemically synthesized
actgtaatggaatcaagaga

SEQ ID NO: 53563 - DNA, 20 bp, Artificial Sequence
  chemically synthesized
ctgtaatggaatcaagagat

SEQ ID NO: 53564 - DNA, 20 bp, Artificial Sequence
  chemically synthesized
tgtaatggaatcaagagatg

SEQ ID NO: 53565 - DNA, 20 bp, Artificial Sequence
  chemically synthesized
gtaatggaatcaagagatgg

SEQ ID NO: 53566 - DNA, 20 bp, Artificial Sequence
  chemically synthesized
aatggaatcaagagatgggg

SEQ ID NO: 53567 - DNA, 20 bp, Artificial Sequence
  chemically synthesized
ggaatcaagagatgggggag

SEQ ID NO: 53568 - DNA, 20 bp, Artificial Sequence
  chemically synthesized
tgggggagcagtcatttctt

SEQ ID NO: 53569 - DNA, 20 bp, Artificial Sequence
  chemically synthesized
cctgtgccacctcaaaaaac

SEQ ID NO: 53570 - DNA, 20 bp, Artificial Sequence
  chemically synthesized
acctcaaaaaacaagaactt

SEQ ID NO: 53571 - DNA, 20 bp, Artificial Sequence
  chemically synthesized
caaaaaacaagaactttagc

SEQ ID NO: 53572 - DNA, 20 bp, Artificial Sequence
  chemically synthesized
actttagccagcttttactt

SEQ ID NO: 53573 - DNA, 20 bp, Artificial Sequence
  chemically synthesized
tagccagcttttacttgaga

SEQ ID NO: 53574 - DNA, 20 bp, Artificial Sequence
  chemically synthesized
agccagcttttacttgagaa

SEQ ID NO: 53575 - DNA, 20 bp, Artificial Sequence
  chemically synthesized
gccagcttttacttgagaaa

SEQ ID NO: 53576 - DNA, 20 bp, Artificial Sequence
  chemically synthesized
tttacttgagaaagggaact

SEQ ID NO: 53577 - DNA, 20 bp, Artificial Sequence
  chemically synthesized
tacttgagaaagggaactta

SEQ ID NO: 53578 - DNA, 20 bp, Artificial Sequence
  chemically synthesized
cttgagaaagggaacttaga

SEQ ID NO: 53579 - DNA, 20 bp, Artificial Sequence
  chemically synthesized
gaaagggaacttagagagta

SEQ ID NO: 53580 - DNA, 20 bp, Artificial Sequence
  chemically synthesized
agggaacttagagagtatag

SEQ ID NO: 53581 - DNA, 20 bp, Artificial Sequence
  chemically synthesized
tatctatctatctatctttc

SEQ ID NO: 53582 - DNA, 20 bp, Artificial Sequence
  chemically synthesized
tatctatctatctttctagc

SEQ ID NO: 53583 - DNA, 20 bp, Artificial Sequence
  chemically synthesized
tatctatctttctagctagc

SEQ ID NO: 53584 - DNA, 20 bp, Artificial Sequence
  chemically synthesized
tatctttctagctagctagc

SEQ ID NO: 53585 - DNA, 20 bp, Artificial Sequence
  chemically synthesized
tttctagctagctagctagc

SEQ ID NO: 53586 - DNA, 20 bp, Artificial Sequence
  chemically synthesized
tagctagctagctagctagc

SEQ ID NO: 53587 - DNA, 20 bp, Artificial Sequence
  chemically synthesized
tagctagctagctagctagc

SEQ ID NO: 53588 - DNA, 20 bp, Artificial Sequence
  chemically synthesized
tctgtatatgtcacctaccc

SEQ ID NO: 53589 - DNA, 20 bp, Artificial Sequence
  chemically synthesized
ttgcttctatccacattttt

SEQ ID NO: 53590 - DNA, 20 bp, Artificial Sequence
  chemically synthesized
ctatccacattttttagaac

SEQ ID NO: 53591 - DNA, 20 bp, Artificial Sequence
  chemically synthesized
cattttttagaactagtaat

SEQ ID NO: 53592 - DNA, 20 bp, Artificial Sequence
  chemically synthesized
aactagtaattagtaataac

SEQ ID NO: 53593 - DNA, 20 bp, Artificial Sequence
  chemically synthesized
taataacaagtaatatattg

SEQ ID NO: 53594 - DNA, 20 bp, Artificial Sequence
  chemically synthesized
agtaatatattgaagtaata

SEQ ID NO: 53595 - DNA, 20 bp, Artificial Sequence
  chemically synthesized
cattaaattacttgctgctg

SEQ ID NO: 53596 - DNA, 20 bp, Artificial Sequence
  chemically synthesized
taaattacttgctgctgtgg

SEQ ID NO: 53597 - DNA, 20 bp, Artificial Sequence
  chemically synthesized
cttgctgctgtggtggtact

SEQ ID NO: 53598 - DNA, 20 bp, Artificial Sequence
  chemically synthesized
attaattattgtctcaattt

SEQ ID NO: 53599 - DNA, 20 bp, Artificial Sequence
  chemically synthesized
taattattgtctcaatttca

SEQ ID NO: 53600 - DNA, 20 bp, Artificial Sequence
  chemically synthesized
gagcctattatttgtctatt

SEQ ID NO: 53601 - DNA, 20 bp, Artificial Sequence
  chemically synthesized
gcctattatttgtctattaa

SEQ ID NO: 53602 - DNA, 20 bp, Artificial Sequence
  chemically synthesized
taagagattcaatttctccc

SEQ ID NO: 53603 - DNA, 20 bp, Artificial Sequence
  chemically synthesized
gattcaatttctccctggtt

SEQ ID NO: 53604 - DNA, 20 bp, Artificial Sequence
  chemically synthesized
atttctccctggtttagtct

SEQ ID NO: 53605 - DNA, 20 bp, Artificial Sequence
  chemically synthesized
tttctccctggtttagtctt

SEQ ID NO: 53606 - DNA, 20 bp, Artificial Sequence
  chemically synthesized
tctccctggtttagtcttgg

SEQ ID NO: 53607 - DNA, 20 bp, Artificial Sequence
  chemically synthesized
ctccctggtttagtcttggg

SEQ ID NO: 53608 - DNA, 20 bp, Artificial Sequence
  chemically synthesized
tccctggtttagtcttggga

SEQ ID NO: 53609 - DNA, 20 bp, Artificial Sequence
  chemically synthesized
cttgggagggtgtatgtgtc

SEQ ID NO: 53610 - DNA, 20 bp, Artificial Sequence
  chemically synthesized
ttgggagggtgtatgtgtcg

SEQ ID NO: 53611 - DNA, 20 bp, Artificial Sequence
  chemically synthesized
aggaatttatccatttctac

SEQ ID NO: 53612 - DNA, 20 bp, Artificial Sequence
  chemically synthesized
tccatttctactagattttc

SEQ ID NO: 53613 - DNA, 20 bp, Artificial Sequence
  chemically synthesized
gattttctagtttatttgcg

SEQ ID NO: 53614 - DNA, 20 bp, Artificial Sequence
  chemically synthesized
ttttctagtttatttgcgta

SEQ ID NO: 53615 - DNA, 20 bp, Artificial Sequence
  chemically synthesized
tttctagtttatttgcgtag

SEQ ID NO: 53616 - DNA, 20 bp, Artificial Sequence
  chemically synthesized
tatttgcgtagaggtgttta

SEQ ID NO: 53617 - DNA, 20 bp, Artificial Sequence
  chemically synthesized
gtgtttatagtattctctga

SEQ ID NO: 53618 - DNA, 20 bp, Artificial Sequence
  chemically synthesized
tttatagtattctctgatgg

SEQ ID NO: 53619 - DNA, 20 bp, Artificial Sequence
  chemically synthesized
gatggtagtttgtatgtctg

SEQ ID NO: 53620 - DNA, 20 bp, Artificial Sequence
  chemically synthesized
atggtagtttgtatgtctgt

SEQ ID NO: 53621 - DNA, 20 bp, Artificial Sequence
  chemically synthesized
agtttgtatgtctgtgggat

SEQ ID NO: 53622 - DNA, 20 bp, Artificial Sequence
  chemically synthesized
ttgtatgtctgtgggattgg

SEQ ID NO: 53623 - DNA, 20 bp, Artificial Sequence
  chemically synthesized
atttcttattgcatctattt

SEQ ID NO: 53624 - DNA, 20 bp, Artificial Sequence
  chemically synthesized
ttctctcttttcttctttat

SEQ ID NO: 53625 - DNA, 20 bp, Artificial Sequence
  chemically synthesized
ttcttctttattagtcttgc

SEQ ID NO: 53626 - DNA, 20 bp, Artificial Sequence
  chemically synthesized
ttctttattagtcttgctag

SEQ ID NO: 53627 - DNA, 20 bp, Artificial Sequence
  chemically synthesized
tgttgatcttttcaaaaaac

SEQ ID NO: 53628 - DNA, 20 bp, Artificial Sequence
  chemically synthesized
cttttcaaaaaaccagctcc

SEQ ID NO: 53629 - DNA, 20 bp, Artificial Sequence
  chemically synthesized
ctggattcattgattttttt

SEQ ID NO: 53630 - DNA, 20 bp, Artificial Sequence
  chemically synthesized
tggattcattgattttttta

SEQ ID NO: 53631 - DNA, 20 bp, Artificial Sequence
  chemically synthesized
ggattcattgatttttttaa

SEQ ID NO: 53632 - DNA, 20 bp, Artificial Sequence
  chemically synthesized
acttatttcttgccttccgc

SEQ ID NO: 53633 - DNA, 20 bp, Artificial Sequence
  chemically synthesized
tgccttccgctagcttttga

SEQ ID NO: 53634 - DNA, 20 bp, Artificial Sequence
  chemically synthesized
agtgtttgctcttgcttctc

SEQ ID NO: 53635 - DNA, 20 bp, Artificial Sequence
  chemically synthesized
agttcttttaattgtgatgt

SEQ ID NO: 53636 - DNA, 20 bp, Artificial Sequence
  chemically synthesized
gttcttttaattgtgatgtt

SEQ ID NO: 53637 - DNA, 20 bp, Artificial Sequence
  chemically synthesized
ttcttttaattgtgatgtta

SEQ ID NO: 53638 - DNA, 20 bp, Artificial Sequence
  chemically synthesized
tgatgttagggtgtcaattt

SEQ ID NO: 53639 - DNA, 20 bp, Artificial Sequence
  chemically synthesized
atctttcctgctttcttttg

SEQ ID NO: 53640 - DNA, 20 bp, Artificial Sequence
  chemically synthesized
tctttcctgctttcttttgt

SEQ ID NO: 53641 - DNA, 20 bp, Artificial Sequence
  chemically synthesized
tgctttcttttgtgggcatt

SEQ ID NO: 53642 - DNA, 20 bp, Artificial Sequence
  chemically synthesized
acactgctttaaatgtgtcc

SEQ ID NO: 53643 - DNA, 20 bp, Artificial Sequence
  chemically synthesized
actgctttaaatgtgtccca

SEQ ID NO: 53644 - DNA, 20 bp, Artificial Sequence
  chemically synthesized
tgttgtatctttattctcgt

SEQ ID NO: 53645 - DNA, 20 bp, Artificial Sequence
  chemically synthesized
ctttattctcgttggtttca

SEQ ID NO: 53646 - DNA, 20 bp, Artificial Sequence
  chemically synthesized
ccttcattttgttatgtacc

SEQ ID NO: 53647 - DNA, 20 bp, Artificial Sequence
  chemically synthesized
tcattttgttatgtacccag

SEQ ID NO: 53648 - DNA, 20 bp, Artificial Sequence
  chemically synthesized
ttatgtacccagtagtcatt

SEQ ID NO: 53649 - DNA, 20 bp, Artificial Sequence
  chemically synthesized
tatgtacccagtagtcattc

SEQ ID NO: 53650 - DNA, 20 bp, Artificial Sequence
  chemically synthesized
tgtacccagtagtcattcag

SEQ ID NO: 53651 - DNA, 20 bp, Artificial Sequence
  chemically synthesized
acccagtagtcattcaggag

SEQ ID NO: 53652 - DNA, 20 bp, Artificial Sequence
  chemically synthesized
cccagtagtcattcaggagc

SEQ ID NO: 53653 - DNA, 20 bp, Artificial Sequence
  chemically synthesized
tcattcaggagcaggctgtt

SEQ ID NO: 53654 - DNA, 20 bp, Artificial Sequence
  chemically synthesized
caggctgttcagtttccatg

SEQ ID NO: 53655 - DNA, 20 bp, Artificial Sequence
  chemically synthesized
tgttcagtttccatgtagtt

SEQ ID NO: 53656 - DNA, 20 bp, Artificial Sequence
  chemically synthesized
tcagtttccatgtagttgag

SEQ ID NO: 53657 - DNA, 20 bp, Artificial Sequence
  chemically synthesized
ccatgtagttgagtggtttt

SEQ ID NO: 53658 - DNA, 20 bp, Artificial Sequence
  chemically synthesized
gtagttgagtggttttgagt

SEQ ID NO: 53659 - DNA, 20 bp, Artificial Sequence
  chemically synthesized
tgagtgagtttcttaatcct

SEQ ID NO: 53660 - DNA, 20 bp, Artificial Sequence
  chemically synthesized
agtttcttaatcctgagttc

SEQ ID NO: 53661 - DNA, 20 bp, Artificial Sequence
  chemically synthesized
gttctagtttgattgcactg

SEQ ID NO: 53662 - DNA, 20 bp, Artificial Sequence
  chemically synthesized
gtttgattgcactgtggtct

SEQ ID NO: 53663 - DNA, 20 bp, Artificial Sequence
  chemically synthesized
ttgattgcactgtggtctga

SEQ ID NO: 53664 - DNA, 20 bp, Artificial Sequence
  chemically synthesized
ttgcactgtggtctgagaga

SEQ ID NO: 53665 - DNA, 20 bp, Artificial Sequence
  chemically synthesized
tctgttcttttacgtttgct

SEQ ID NO: 53666 - DNA, 20 bp, Artificial Sequence
  chemically synthesized
ctgttcttttacgtttgctg

SEQ ID NO: 53667 - DNA, 20 bp, Artificial Sequence
  chemically synthesized
gttcttttacgtttgctgag

SEQ ID NO: 53668 - DNA, 20 bp, Artificial Sequence
  chemically synthesized
gtgcttcacttccaactatg

SEQ ID NO: 53669 - DNA, 20 bp, Artificial Sequence
  chemically synthesized
cttccaactatgtggtcaac

SEQ ID NO: 53670 - DNA, 20 bp, Artificial Sequence
  chemically synthesized
aactatgtggtcaactggaa

SEQ ID NO: 53671 - DNA, 20 bp, Artificial Sequence
  chemically synthesized
actatgtggtcaactggaat

SEQ ID NO: 53672 - DNA, 20 bp, Artificial Sequence
  chemically synthesized
gtggtcaactggaataggtg

SEQ ID NO: 53673 - DNA, 20 bp, Artificial Sequence
  chemically synthesized
caactggaataggtgtggtg

SEQ ID NO: 53674 - DNA, 20 bp, Artificial Sequence
  chemically synthesized
aataggtgtggtgtggtgct

SEQ ID NO: 53675 - DNA, 20 bp, Artificial Sequence
  chemically synthesized
aggtgtggtgtggtgctgag

SEQ ID NO: 53676 - DNA, 20 bp, Artificial Sequence
  chemically synthesized
gaatgtatattctattgatt

SEQ ID NO: 53677 - DNA, 20 bp, Artificial Sequence
  chemically synthesized
aatgtatattctattgattt

SEQ ID NO: 53678 - DNA, 20 bp, Artificial Sequence
  chemically synthesized
tatattctattgatttggga

SEQ ID NO: 53679 - DNA, 20 bp, Artificial Sequence
  chemically synthesized
tattctattgatttgggatg

SEQ ID NO: 53680 - DNA, 20 bp, Artificial Sequence
  chemically synthesized
ttctattgatttgggatgga

SEQ ID NO: 53681 - DNA, 20 bp, Artificial Sequence
  chemically synthesized
atttgggatggagagttctg

SEQ ID NO: 53682 - DNA, 20 bp, Artificial Sequence
  chemically synthesized
agagttctgtagatgtctat

SEQ ID NO: 53683 - DNA, 20 bp, Artificial Sequence
  chemically synthesized
gagttctgtagatgtctatt

SEQ ID NO: 53684 - DNA, 20 bp, Artificial Sequence
  chemically synthesized
agatgtctattaggtctgct

SEQ ID NO: 53685 - DNA, 20 bp, Artificial Sequence
  chemically synthesized
tctattaggtctgcttggtg

SEQ ID NO: 53686 - DNA, 20 bp, Artificial Sequence
  chemically synthesized
tattaggtctgcttggtgca

SEQ ID NO: 53687 - DNA, 20 bp, Artificial Sequence
  chemically synthesized
gcagagctgaattcaattcc

SEQ ID NO: 53688 - DNA, 20 bp, Artificial Sequence
  chemically synthesized
gttgatctgtctaatgttga

SEQ ID NO: 53689 - DNA, 20 bp, Artificial Sequence
  chemically synthesized
gatctgtctaatgttgacag

SEQ ID NO: 53690 - DNA, 20 bp, Artificial Sequence
  chemically synthesized
atctgtctaatgttgacagt

SEQ ID NO: 53691 - DNA, 20 bp, Artificial Sequence
  chemically synthesized
tctgtctaatgttgacagtg

SEQ ID NO: 53692 - DNA, 20 bp, Artificial Sequence
  chemically synthesized
atgttgacagtggggtgtta

SEQ ID NO: 53693 - DNA, 20 bp, Artificial Sequence
  chemically synthesized
agtctcccattattattgtg

SEQ ID NO: 53694 - DNA, 20 bp, Artificial Sequence
  chemically synthesized
gtctcccattattattgtgt

SEQ ID NO: 53695 - DNA, 20 bp, Artificial Sequence
  chemically synthesized
ctcccattattattgtgtgg

SEQ ID NO: 53696 - DNA, 20 bp, Artificial Sequence
  chemically synthesized
ttattattgtgtgggagtct

SEQ ID NO: 53697 - DNA, 20 bp, Artificial Sequence
  chemically synthesized
tgggagtctaagtctctttg

SEQ ID NO: 53698 - DNA, 20 bp, Artificial Sequence
  chemically synthesized
gggagtctaagtctctttgt

SEQ ID NO: 53699 - DNA, 20 bp, Artificial Sequence
  chemically synthesized
aagtctctttgtaggtctct

SEQ ID NO: 53700 - DNA, 20 bp, Artificial Sequence
  chemically synthesized
agtctctttgtaggtctcta

SEQ ID NO: 53701 - DNA, 20 bp, Artificial Sequence
  chemically synthesized
aaggacttgctttatgaatc

SEQ ID NO: 53702 - DNA, 20 bp, Artificial Sequence
  chemically synthesized
aggacttgctttatgaatct

SEQ ID NO: 53703 - DNA, 20 bp, Artificial Sequence
  chemically synthesized
gaatctgggtgctgctgtat

SEQ ID NO: 53704 - DNA, 20 bp, Artificial Sequence
  chemically synthesized
aatctgggtgctgctgtatt

SEQ ID NO: 53705 - DNA, 20 bp, Artificial Sequence
  chemically synthesized
gtattgggtgcatatatatt

SEQ ID NO: 53706 - DNA, 20 bp, Artificial Sequence
  chemically synthesized
tattgggtgcatatatattt

SEQ ID NO: 53707 - DNA, 20 bp, Artificial Sequence
  chemically synthesized
gggtgcatatatatttagga

SEQ ID NO: 53708 - DNA, 20 bp, Artificial Sequence
  chemically synthesized
gcatatatatttaggatagt

SEQ ID NO: 53709 - DNA, 20 bp, Artificial Sequence
  chemically synthesized
tgttgaattgatccctttac

SEQ ID NO: 53710 - DNA, 20 bp, Artificial Sequence
  chemically synthesized
atccctttaccagtatgtaa

SEQ ID NO: 53711 - DNA, 20 bp, Artificial Sequence
  chemically synthesized
ttgtctcttttgatctttgt

SEQ ID NO: 53712 - DNA, 20 bp, Artificial Sequence
  chemically synthesized
ttttgatctttgttggttta

SEQ ID NO: 53713 - DNA, 20 bp, Artificial Sequence
  chemically synthesized
tggtttaaagtctgttttat

SEQ ID NO: 53714 - DNA, 20 bp, Artificial Sequence
  chemically synthesized
gtttaaagtctgttttatca

SEQ ID NO: 53715 - DNA, 20 bp, Artificial Sequence
  chemically synthesized
agtctgttttatcagagact

SEQ ID NO: 53716 - DNA, 20 bp, Artificial Sequence
  chemically synthesized
ttttttgttttccatttgct

SEQ ID NO: 53717 - DNA, 20 bp, Artificial Sequence
  chemically synthesized
tttgttttccatttgcttgg

SEQ ID NO: 53718 - DNA, 20 bp, Artificial Sequence
  chemically synthesized
ttcctccatccctttatttt

SEQ ID NO: 53719 - DNA, 20 bp, Artificial Sequence
  chemically synthesized
ctatgtgtgtctctccacat

SEQ ID NO: 53720 - DNA, 20 bp, Artificial Sequence
  chemically synthesized
tgtgtctctccacatgagat

SEQ ID NO: 53721 - DNA, 20 bp, Artificial Sequence
  chemically synthesized
tgagattggtttcctgaata

SEQ ID NO: 53722 - DNA, 20 bp, Artificial Sequence
  chemically synthesized
tcctgaatacagcacactga

SEQ ID NO: 53723 - DNA, 20 bp, Artificial Sequence
  chemically synthesized
cctgaatacagcacactgat

SEQ ID NO: 53724 - DNA, 20 bp, Artificial Sequence
  chemically synthesized
tgactctttatccaatttgc

SEQ ID NO: 53725 - DNA, 20 bp, Artificial Sequence
  chemically synthesized
gccagtctgtgtcttttaat

SEQ ID NO: 53726 - DNA, 20 bp, Artificial Sequence
  chemically synthesized
cagtctgtgtcttttaattg

SEQ ID NO: 53727 - DNA, 20 bp, Artificial Sequence
  chemically synthesized
tgtcttttaattggagcatt

SEQ ID NO: 53728 - DNA, 20 bp, Artificial Sequence
  chemically synthesized
catttagctcatttacattt

SEQ ID NO: 53729 - DNA, 20 bp, Artificial Sequence
  chemically synthesized
atttagctcatttacattta

SEQ ID NO: 53730 - DNA, 20 bp, Artificial Sequence
  chemically synthesized
taaggttaatattgttatgt

SEQ ID NO: 53731 - DNA, 20 bp, Artificial Sequence
  chemically synthesized
tgatcctgtcattatgatgt

SEQ ID NO: 53732 - DNA, 20 bp, Artificial Sequence
  chemically synthesized
cctgtcattatgatgttagc

SEQ ID NO: 53733 - DNA, 20 bp, Artificial Sequence
  chemically synthesized
tagctggttattttgcttgc

SEQ ID NO: 53734 - DNA, 20 bp, Artificial Sequence
  chemically synthesized
attttgcttgctagttgatg

SEQ ID NO: 53735 - DNA, 20 bp, Artificial Sequence
  chemically synthesized
tagttgatgcagtttctccc

SEQ ID NO: 53736 - DNA, 20 bp, Artificial Sequence
  chemically synthesized
cagtttctccctagccttga

SEQ ID NO: 53737 - DNA, 20 bp, Artificial Sequence
  chemically synthesized
ccttgatggtctttacaatt

SEQ ID NO: 53738 - DNA, 20 bp, Artificial Sequence
  chemically synthesized
tacaatttggcatgtttttg

SEQ ID NO: 53739 - DNA, 20 bp, Artificial Sequence
  chemically synthesized
aatttggcatgtttttgcag

SEQ ID NO: 53740 - DNA, 20 bp, Artificial Sequence
  chemically synthesized
tggcatgtttttgcagtggc

SEQ ID NO: 53741 - DNA, 20 bp, Artificial Sequence
  chemically synthesized
gtttttgcagtggctggtac

SEQ ID NO: 53742 - DNA, 20 bp, Artificial Sequence
  chemically synthesized
tccatgtttactgcttcctt

SEQ ID NO: 53743 - DNA, 20 bp, Artificial Sequence
  chemically synthesized
ccatgtttactgcttccttc

SEQ ID NO: 53744 - DNA, 20 bp, Artificial Sequence
  chemically synthesized
atgtttactgcttccttcag

SEQ ID NO: 53745 - DNA, 20 bp, Artificial Sequence
  chemically synthesized
gcttccttcaggagctcttt

SEQ ID NO: 53746 - DNA, 20 bp, Artificial Sequence
  chemically synthesized
cttccttcaggagctctttt

SEQ ID NO: 53747 - DNA, 20 bp, Artificial Sequence
  chemically synthesized
ttccttcaggagctctttta

SEQ ID NO: 53748 - DNA, 20 bp, Artificial Sequence
  chemically synthesized
cttcaggagctcttttaggg

SEQ ID NO: 53749 - DNA, 20 bp, Artificial Sequence
  chemically synthesized
ttcaggagctcttttagggc

SEQ ID NO: 53750 - DNA, 20 bp, Artificial Sequence
  chemically synthesized
gagctcttttagggcaggcc

SEQ ID NO: 53751 - DNA, 20 bp, Artificial Sequence
  chemically synthesized
ctcttttagggcaggcctgg

SEQ ID NO: 53752 - DNA, 20 bp, Artificial Sequence
  chemically synthesized
aggcctggtggtgacaaaat

SEQ ID NO: 53753 - DNA, 20 bp, Artificial Sequence
  chemically synthesized
tcagcaattgcttgtctgta

SEQ ID NO: 53754 - DNA, 20 bp, Artificial Sequence
  chemically synthesized
ttatttctccttcacttatg

SEQ ID NO: 53755 - DNA, 20 bp, Artificial Sequence
  chemically synthesized
tgaagcttaccaaccaaaaa

SEQ ID NO: 53756 - DNA, 20 bp, Artificial Sequence
  chemically synthesized
cttaccaaccaaaaaaagtc

SEQ ID NO: 53757 - DNA, 20 bp, Artificial Sequence
  chemically synthesized
ttaccaaccaaaaaaagtcc

SEQ ID NO: 53758 - DNA, 20 bp, Artificial Sequence
  chemically synthesized
aaccaaaaaaagtccaggac

SEQ ID NO: 53759 - DNA, 20 bp, Artificial Sequence
  chemically synthesized
aaaaaaagtccaggaccaga

SEQ ID NO: 53760 - DNA, 20 bp, Artificial Sequence
  chemically synthesized
tccaggaccagatggattca

SEQ ID NO: 53761 - DNA, 20 bp, Artificial Sequence
  chemically synthesized
gattcacagccgaattctac

SEQ ID NO: 53762 - DNA, 20 bp, Artificial Sequence
  chemically synthesized
ttcacagccgaattctacca

SEQ ID NO: 53763 - DNA, 20 bp, Artificial Sequence
  chemically synthesized
tcacagccgaattctaccag

SEQ ID NO: 53764 - DNA, 20 bp, Artificial Sequence
  chemically synthesized
ccgaattctaccagaggtac

SEQ ID NO: 53765 - DNA, 20 bp, Artificial Sequence
  chemically synthesized
cgaattctaccagaggtaca

SEQ ID NO: 53766 - DNA, 20 bp, Artificial Sequence
  chemically synthesized
aattctaccagaggtacaag

SEQ ID NO: 53767 - DNA, 20 bp, Artificial Sequence
  chemically synthesized
attctaccagaggtacaagg

SEQ ID NO: 53768 - DNA, 20 bp, Artificial Sequence
  chemically synthesized
tctaccagaggtacaaggag

SEQ ID NO: 53769 - DNA, 20 bp, Artificial Sequence
  chemically synthesized
ccagaggtacaaggaggagc

SEQ ID NO: 53770 - DNA, 20 bp, Artificial Sequence
  chemically synthesized
tctgaaactattccaatcaa

SEQ ID NO: 53771 - DNA, 20 bp, Artificial Sequence
  chemically synthesized
actattccaatcaatagaaa

SEQ ID NO: 53772 - DNA, 20 bp, Artificial Sequence
  chemically synthesized
tattccaatcaatagaaaaa

SEQ ID NO: 53773 - DNA, 20 bp, Artificial Sequence
  chemically synthesized
attccaatcaatagaaaaag

SEQ ID NO: 53774 - DNA, 20 bp, Artificial Sequence
  chemically synthesized
ttccaatcaatagaaaaaga

SEQ ID NO: 53775 - DNA, 20 bp, Artificial Sequence
  chemically synthesized
tcctccctaactcattttat

SEQ ID NO: 53776 - DNA, 20 bp, Artificial Sequence
  chemically synthesized
cctccctaactcattttatg

SEQ ID NO: 53777 - DNA, 20 bp, Artificial Sequence
  chemically synthesized
cctaactcattttatgaggc

SEQ ID NO: 53778 - DNA, 20 bp, Artificial Sequence
  chemically synthesized
ccagcatcatcttgatacca

SEQ ID NO: 53779 - DNA, 20 bp, Artificial Sequence
  chemically synthesized
atcatcttgataccaaagcc

SEQ ID NO: 53780 - DNA, 20 bp, Artificial Sequence
  chemically synthesized
atcttgataccaaagcctag

SEQ ID NO: 53781 - DNA, 20 bp, Artificial Sequence
  chemically synthesized
tagcagacacacaacaaaaa

SEQ ID NO: 53782 - DNA, 20 bp, Artificial Sequence
  chemically synthesized
gcagacacacaacaaaaaaa

SEQ ID NO: 53783 - DNA, 20 bp, Artificial Sequence
  chemically synthesized
aacatcgatgcaaaaatcct

SEQ ID NO: 53784 - DNA, 20 bp, Artificial Sequence
  chemically synthesized
aaaaatcctcagtaaaatac

SEQ ID NO: 53785 - DNA, 20 bp, Artificial Sequence
  chemically synthesized
aaatactggcaaaccaaatc

SEQ ID NO: 53786 - DNA, 20 bp, Artificial Sequence
  chemically synthesized
aatactggcaaaccaaatcc

SEQ ID NO: 53787 - DNA, 20 bp, Artificial Sequence
  chemically synthesized
tactggcaaaccaaatccag

SEQ ID NO: 53788 - DNA, 20 bp, Artificial Sequence
  chemically synthesized
aaatccaggagcacatcaaa

SEQ ID NO: 53789 - DNA, 20 bp, Artificial Sequence
  chemically synthesized
aaagcttatccaccatgatc

SEQ ID NO: 53790 - DNA, 20 bp, Artificial Sequence
  chemically synthesized
gcttatccaccatgatcaag

SEQ ID NO: 53791 - DNA, 20 bp, Artificial Sequence
  chemically synthesized
cttatccaccatgatcaagt

SEQ ID NO: 53792 - DNA, 20 bp, Artificial Sequence
  chemically synthesized
gatcaagtgggcttcatccc

SEQ ID NO: 53793 - DNA, 20 bp, Artificial Sequence
  chemically synthesized
atcaagtgggcttcatccct

SEQ ID NO: 53794 - DNA, 20 bp, Artificial Sequence
  chemically synthesized
tgggcttcatccctgggatg

SEQ ID NO: 53795 - DNA, 20 bp, Artificial Sequence
  chemically synthesized
gggcttcatccctgggatgc

SEQ ID NO: 53796 - DNA, 20 bp, Artificial Sequence
  chemically synthesized
ggcttcatccctgggatgca

SEQ ID NO: 53797 - DNA, 20 bp, Artificial Sequence
  chemically synthesized
tcatccctgggatgcagggc

SEQ ID NO: 53798 - DNA, 20 bp, Artificial Sequence
  chemically synthesized
gcaaatcaataaacataatc

SEQ ID NO: 53799 - DNA, 20 bp, Artificial Sequence
  chemically synthesized
aacataatccagcatataaa

SEQ ID NO: 53800 - DNA, 20 bp, Artificial Sequence
  chemically synthesized
ccagcatataaacagaacca

SEQ ID NO: 53801 - DNA, 20 bp, Artificial Sequence
  chemically synthesized
aaaccacatgattatctcaa

SEQ ID NO: 53802 - DNA, 20 bp, Artificial Sequence
  chemically synthesized
catgattatctcaatagatg

SEQ ID NO: 53803 - DNA, 20 bp, Artificial Sequence
  chemically synthesized
ttatctcaatagatgcagaa

SEQ ID NO: 53804 - DNA, 20 bp, Artificial Sequence
  chemically synthesized
tatctcaatagatgcagaaa

SEQ ID NO: 53805 - DNA, 20 bp, Artificial Sequence
  chemically synthesized
actaaaaactctcaataaat

SEQ ID NO: 53806 - DNA, 20 bp, Artificial Sequence
  chemically synthesized
ctaaaaactctcaataaatt

SEQ ID NO: 53807 - DNA, 20 bp, Artificial Sequence
  chemically synthesized
ctcaataaattaggtatcga

SEQ ID NO: 53808 - DNA, 20 bp, Artificial Sequence
  chemically synthesized
tcaataaattaggtatcgat

SEQ ID NO: 53809 - DNA, 20 bp, Artificial Sequence
  chemically synthesized
gggacatatctcaaaataat

SEQ ID NO: 53810 - DNA, 20 bp, Artificial Sequence
  chemically synthesized
gacatatctcaaaataataa

SEQ ID NO: 53811 - DNA, 20 bp, Artificial Sequence
  chemically synthesized
agctatctatgacaaaccca

SEQ ID NO: 53812 - DNA, 20 bp, Artificial Sequence
  chemically synthesized
acagccaatatcatactgaa

SEQ ID NO: 53813 - DNA, 20 bp, Artificial Sequence
  chemically synthesized
catactgaatggacaaaaac

SEQ ID NO: 53814 - DNA, 20 bp, Artificial Sequence
  chemically synthesized
actgaatggacaaaaactgg

SEQ ID NO: 53815 - DNA, 20 bp, Artificial Sequence
  chemically synthesized
gaagcattccctttgaaaac

SEQ ID NO: 53816 - DNA, 20 bp, Artificial Sequence
  chemically synthesized
ttccctttgaaaactggcac

SEQ ID NO: 53817 - DNA, 20 bp, Artificial Sequence
  chemically synthesized
ctttgaaaactggcacaaga

SEQ ID NO: 53818 - DNA, 20 bp, Artificial Sequence
  chemically synthesized
tttgaaaactggcacaagac

SEQ ID NO: 53819 - DNA, 20 bp, Artificial Sequence
  chemically synthesized
ttgaaaactggcacaagaca

SEQ ID NO: 53820 - DNA, 20 bp, Artificial Sequence
  chemically synthesized
ctcaccactcctattcaaca

SEQ ID NO: 53821 - DNA, 20 bp, Artificial Sequence
  chemically synthesized
actcctattcaacatagtgt

SEQ ID NO: 53822 - DNA, 20 bp, Artificial Sequence
  chemically synthesized
cctattcaacatagtgttgg

SEQ ID NO: 53823 - DNA, 20 bp, Artificial Sequence
  chemically synthesized
caacatagtgttggaagttc

SEQ ID NO: 53824 - DNA, 20 bp, Artificial Sequence
  chemically synthesized
atagtgttggaagttctggc

SEQ ID NO: 53825 - DNA, 20 bp, Artificial Sequence
  chemically synthesized
tagtgttggaagttctggcc

SEQ ID NO: 53826 - DNA, 20 bp, Artificial Sequence
  chemically synthesized
agtgttggaagttctggcca

SEQ ID NO: 53827 - DNA, 20 bp, Artificial Sequence
  chemically synthesized
gaagttctggccagggcaat

SEQ ID NO: 53828 - DNA, 20 bp, Artificial Sequence
  chemically synthesized
aagttctggccagggcaatc

SEQ ID NO: 53829 - DNA, 20 bp, Artificial Sequence
  chemically synthesized
tctggccagggcaatcaggc

SEQ ID NO: 53830 - DNA, 20 bp, Artificial Sequence
  chemically synthesized
tggccagggcaatcaggcaa

SEQ ID NO: 53831 - DNA, 20 bp, Artificial Sequence
  chemically synthesized
cagggcaatcaggcaagaga

SEQ ID NO: 53832 - DNA, 20 bp, Artificial Sequence
  chemically synthesized
tcaggcaagagaaagaaata

SEQ ID NO: 53833 - DNA, 20 bp, Artificial Sequence
  chemically synthesized
caggcaagagaaagaaataa

SEQ ID NO: 53834 - DNA, 20 bp, Artificial Sequence
  chemically synthesized
aggcaagagaaagaaataaa

SEQ ID NO: 53835 - DNA, 20 bp, Artificial Sequence
  chemically synthesized
agaaataaagggcattcaat

SEQ ID NO: 53836 - DNA, 20 bp, Artificial Sequence
  chemically synthesized
gaaataaagggcattcaatt

SEQ ID NO: 53837 - DNA, 20 bp, Artificial Sequence
  chemically synthesized
aaagggcattcaattaggaa

SEQ ID NO: 53838 - DNA, 20 bp, Artificial Sequence
  chemically synthesized
agggcattcaattaggaaaa

SEQ ID NO: 53839 - DNA, 20 bp, Artificial Sequence
  chemically synthesized
gggcattcaattaggaaaag

SEQ ID NO: 53840 - DNA, 20 bp, Artificial Sequence
  chemically synthesized
cattcaattaggaaaagagg

SEQ ID NO: 53841 - DNA, 20 bp, Artificial Sequence
  chemically synthesized
agtgaaattgtccctgtttg

SEQ ID NO: 53842 - DNA, 20 bp, Artificial Sequence
  chemically synthesized
agatgacgtgattgtatatc

SEQ ID NO: 53843 - DNA, 20 bp, Artificial Sequence
  chemically synthesized
tctagaaaaccccatcgtct

SEQ ID NO: 53844 - DNA, 20 bp, Artificial Sequence
  chemically synthesized
tctcagcccaaaatctcctt

SEQ ID NO: 53845 - DNA, 20 bp, Artificial Sequence
  chemically synthesized
caaaatctccttaagctgat

SEQ ID NO: 53846 - DNA, 20 bp, Artificial Sequence
  chemically synthesized
cttaagctgataagcaactt

SEQ ID NO: 53847 - DNA, 20 bp, Artificial Sequence
  chemically synthesized
gctgataagcaacttcagaa

SEQ ID NO: 53848 - DNA, 20 bp, Artificial Sequence
  chemically synthesized
aagcaacttcagaaaagtct

SEQ ID NO: 53849 - DNA, 20 bp, Artificial Sequence
  chemically synthesized
aatcaatgtgcaaaaatcac

SEQ ID NO: 53850 - DNA, 20 bp, Artificial Sequence
  chemically synthesized
gcattcctatacaccaataa

SEQ ID NO: 53851 - DNA, 20 bp, Artificial Sequence
  chemically synthesized
atacaccaataacagacaaa

SEQ ID NO: 53852 - DNA, 20 bp, Artificial Sequence
  chemically synthesized
acaccaataacagacaaaca

SEQ ID NO: 53853 - DNA, 20 bp, Artificial Sequence
  chemically synthesized
accaataacagacaaacaga

SEQ ID NO: 53854 - DNA, 20 bp, Artificial Sequence
  chemically synthesized
caaacagagagccaaatcat

SEQ ID NO: 53855 - DNA, 20 bp, Artificial Sequence
  chemically synthesized
tcccattcacaattgcctca

SEQ ID NO: 53856 - DNA, 20 bp, Artificial Sequence
  chemically synthesized
ccattcacaattgcctcaaa

SEQ ID NO: 53857 - DNA, 20 bp, Artificial Sequence
  chemically synthesized
ctcaaagagaataaaatacc

SEQ ID NO: 53858 - DNA, 20 bp, Artificial Sequence
  chemically synthesized
tcaaagagaataaaatacct

SEQ ID NO: 53859 - DNA, 20 bp, Artificial Sequence
  chemically synthesized
tacctaggaatccaacttac

SEQ ID NO: 53860 - DNA, 20 bp, Artificial Sequence
  chemically synthesized
acctaggaatccaacttaca

SEQ ID NO: 53861 - DNA, 20 bp, Artificial Sequence
  chemically synthesized
cctaggaatccaacttacaa

SEQ ID NO: 53862 - DNA, 20 bp, Artificial Sequence
  chemically synthesized
tccaacttacaagggatgtg

SEQ ID NO: 53863 - DNA, 20 bp, Artificial Sequence
  chemically synthesized
ccaacttacaagggatgtga

SEQ ID NO: 53864 - DNA, 20 bp, Artificial Sequence
  chemically synthesized
gggatgtgaaggacctcttc

SEQ ID NO: 53865 - DNA, 20 bp, Artificial Sequence
  chemically synthesized
ggatgtgaaggacctcttca

SEQ ID NO: 53866 - DNA, 20 bp, Artificial Sequence
  chemically synthesized
atgtgaaggacctcttcaag

SEQ ID NO: 53867 - DNA, 20 bp, Artificial Sequence
  chemically synthesized
aacactgctcaacgaaataa

SEQ ID NO: 53868 - DNA, 20 bp, Artificial Sequence
  chemically synthesized
cactgctcaacgaaataaaa

SEQ ID NO: 53869 - DNA, 20 bp, Artificial Sequence
  chemically synthesized
actgctcaacgaaataaaag

SEQ ID NO: 53870 - DNA, 20 bp, Artificial Sequence
  chemically synthesized
taaaagaggatacaaacaaa

SEQ ID NO: 53871 - DNA, 20 bp, Artificial Sequence
  chemically synthesized
aagaggatacaaacaaatgg

SEQ ID NO: 53872 - DNA, 20 bp, Artificial Sequence
  chemically synthesized
ggaagaacattccatgctca

SEQ ID NO: 53873 - DNA, 20 bp, Artificial Sequence
  chemically synthesized
gaacattccatgctcatgga

SEQ ID NO: 53874 - DNA, 20 bp, Artificial Sequence
  chemically synthesized
aacattccatgctcatggat

SEQ ID NO: 53875 - DNA, 20 bp, Artificial Sequence
  chemically synthesized
attccatgctcatggatagg

SEQ ID NO: 53876 - DNA, 20 bp, Artificial Sequence
  chemically synthesized
aagaatcaatatcgtgaaaa

SEQ ID NO: 53877 - DNA, 20 bp, Artificial Sequence
  chemically synthesized
tgaaaatggccttactgccc

SEQ ID NO: 53878 - DNA, 20 bp, Artificial Sequence
  chemically synthesized
gaaaatggccttactgccca

SEQ ID NO: 53879 - DNA, 20 bp, Artificial Sequence
  chemically synthesized
ttactgcccaaggtaattta

SEQ ID NO: 53880 - DNA, 20 bp, Artificial Sequence
  chemically synthesized
gattcaatgccatccccatc

SEQ ID NO: 53881 - DNA, 20 bp, Artificial Sequence
  chemically synthesized
gctaccaatgactttcttca

SEQ ID NO: 53882 - DNA, 20 bp, Artificial Sequence
  chemically synthesized
aatgactttcttcacagaat

SEQ ID NO: 53883 - DNA, 20 bp, Artificial Sequence
  chemically synthesized
aattggaaaaaactacttta

SEQ ID NO: 53884 - DNA, 20 bp, Artificial Sequence
  chemically synthesized
aaactactttaaagttcata

SEQ ID NO: 53885 - DNA, 20 bp, Artificial Sequence
  chemically synthesized
aagttcatatggaaccaaaa

SEQ ID NO: 53886 - DNA, 20 bp, Artificial Sequence
  chemically synthesized
gttcatatggaaccaaaaaa

SEQ ID NO: 53887 - DNA, 20 bp, Artificial Sequence
  chemically synthesized
aaaaaagagcccgcattgac

SEQ ID NO: 53888 - DNA, 20 bp, Artificial Sequence
  chemically synthesized
cgcattgacaagtcaatcct

SEQ ID NO: 53889 - DNA, 20 bp, Artificial Sequence
  chemically synthesized
acaagtcaatcctaagccaa

SEQ ID NO: 53890 - DNA, 20 bp, Artificial Sequence
  chemically synthesized
aatcctaagccaaaagaaca

SEQ ID NO: 53891 - DNA, 20 bp, Artificial Sequence
  chemically synthesized
ctaagccaaaagaacaaagc

SEQ ID NO: 53892 - DNA, 20 bp, Artificial Sequence
  chemically synthesized
aagccaaaagaacaaagcta

SEQ ID NO: 53893 - DNA, 20 bp, Artificial Sequence
  chemically synthesized
agccaaaagaacaaagctag

SEQ ID NO: 53894 - DNA, 20 bp, Artificial Sequence
  chemically synthesized
ctgacttcaaactatactac

SEQ ID NO: 53895 - DNA, 20 bp, Artificial Sequence
  chemically synthesized
tgacttcaaactatactaca

SEQ ID NO: 53896 - DNA, 20 bp, Artificial Sequence
  chemically synthesized
tcaaactatactacaaggta

SEQ ID NO: 53897 - DNA, 20 bp, Artificial Sequence
  chemically synthesized
gtacagtaaccaaaacaaca

SEQ ID NO: 53898 - DNA, 20 bp, Artificial Sequence
  chemically synthesized
taaccaaaacaacatggtac

SEQ ID NO: 53899 - DNA, 20 bp, Artificial Sequence
  chemically synthesized
acatggtactggtaccaaaa

SEQ ID NO: 53900 - DNA, 20 bp, Artificial Sequence
  chemically synthesized
atggtactggtaccaaaaca

SEQ ID NO: 53901 - DNA, 20 bp, Artificial Sequence
  chemically synthesized
ctggtaccaaaacagagatg

SEQ ID NO: 53902 - DNA, 20 bp, Artificial Sequence
  chemically synthesized
aaaacagagatgtagaccaa

SEQ ID NO: 53903 - DNA, 20 bp, Artificial Sequence
  chemically synthesized
aacagagatgtagaccaatg

SEQ ID NO: 53904 - DNA, 20 bp, Artificial Sequence
  chemically synthesized
agagatgtagaccaatggag

SEQ ID NO: 53905 - DNA, 20 bp, Artificial Sequence
  chemically synthesized
tgtagaccaatggagcagaa

SEQ ID NO: 53906 - DNA, 20 bp, Artificial Sequence
  chemically synthesized
tagaccaatggagcagaaca

SEQ ID NO: 53907 - DNA, 20 bp, Artificial Sequence
  chemically synthesized
atggagcagaacagagctct

SEQ ID NO: 53908 - DNA, 20 bp, Artificial Sequence
  chemically synthesized
ttgacaaacctgacaaaaac

SEQ ID NO: 53909 - DNA, 20 bp, Artificial Sequence
  chemically synthesized
aacctgacaaaaacaagcaa

SEQ ID NO: 53910 - DNA, 20 bp, Artificial Sequence
  chemically synthesized
acctgacaaaaacaagcaat

SEQ ID NO: 53911 - DNA, 20 bp, Artificial Sequence
  chemically synthesized
cctgacaaaaacaagcaatg

SEQ ID NO: 53912 - DNA, 20 bp, Artificial Sequence
  chemically synthesized
acaaaaacaagcaatgggga

SEQ ID NO: 53913 - DNA, 20 bp, Artificial Sequence
  chemically synthesized
caaaaacaagcaatggggaa

SEQ ID NO: 53914 - DNA, 20 bp, Artificial Sequence
  chemically synthesized
ccctatttaataaatgatgc

SEQ ID NO: 53915 - DNA, 20 bp, Artificial Sequence
  chemically synthesized
cctatttaataaatgatgct

SEQ ID NO: 53916 - DNA, 20 bp, Artificial Sequence
  chemically synthesized
ataaatgatgctgggaaaac

SEQ ID NO: 53917 - DNA, 20 bp, Artificial Sequence
  chemically synthesized
atgatgctgggaaaactggc

SEQ ID NO: 53918 - DNA, 20 bp, Artificial Sequence
  chemically synthesized
gaaaactggctagccatatg

SEQ ID NO: 53919 - DNA, 20 bp, Artificial Sequence
  chemically synthesized
actggctagccatatgtaga

SEQ ID NO: 53920 - DNA, 20 bp, Artificial Sequence
  chemically synthesized
catatgtagaaagctgaaac

SEQ ID NO: 53921 - DNA, 20 bp, Artificial Sequence
  chemically synthesized
ccttatacaaaaattatttc

SEQ ID NO: 53922 - DNA, 20 bp, Artificial Sequence
  chemically synthesized
atacaaaaattatttcaaga

SEQ ID NO: 53923 - DNA, 20 bp, Artificial Sequence
  chemically synthesized
aattatttcaagatggatta

SEQ ID NO: 53924 - DNA, 20 bp, Artificial Sequence
  chemically synthesized
tggattaaagacttacatgt

SEQ ID NO: 53925 - DNA, 20 bp, Artificial Sequence
  chemically synthesized
acctaaaaccataaaaacct

SEQ ID NO: 53926 - DNA, 20 bp, Artificial Sequence
  chemically synthesized
taaaaccataaaaaccttag

SEQ ID NO: 53927 - DNA, 20 bp, Artificial Sequence
  chemically synthesized
aaaaccttagaagaaaacct

SEQ ID NO: 53928 - DNA, 20 bp, Artificial Sequence
  chemically synthesized
aaaacctaagcaataccatt

SEQ ID NO: 53929 - DNA, 20 bp, Artificial Sequence
  chemically synthesized
aaacctaagcaataccattc

SEQ ID NO: 53930 - DNA, 20 bp, Artificial Sequence
  chemically synthesized
aagcaataccattcaggaca

SEQ ID NO: 53931 - DNA, 20 bp, Artificial Sequence
  chemically synthesized
agcaataccattcaggacat

SEQ ID NO: 53932 - DNA, 20 bp, Artificial Sequence
  chemically synthesized
taccattcaggacataggca

SEQ ID NO: 53933 - DNA, 20 bp, Artificial Sequence
  chemically synthesized
accattcaggacataggcat

SEQ ID NO: 53934 - DNA, 20 bp, Artificial Sequence
  chemically synthesized
ttcaggacataggcatgggc

SEQ ID NO: 53935 - DNA, 20 bp, Artificial Sequence
  chemically synthesized
tcaggacataggcatgggca

SEQ ID NO: 53936 - DNA, 20 bp, Artificial Sequence
  chemically synthesized
cttcatgtctaaaacaccaa

SEQ ID NO: 53937 - DNA, 20 bp, Artificial Sequence
  chemically synthesized
gtctaaaacaccaaaagcaa

SEQ ID NO: 53938 - DNA, 20 bp, Artificial Sequence
  chemically synthesized
accaaaagcaatggcaacaa

SEQ ID NO: 53939 - DNA, 20 bp, Artificial Sequence
  chemically synthesized
aatggcaacaaaagacaaaa

SEQ ID NO: 53940 - DNA, 20 bp, Artificial Sequence
  chemically synthesized
caaaagacaaaatggacaaa

SEQ ID NO: 53941 - DNA, 20 bp, Artificial Sequence
  chemically synthesized
aaaagacaaaatggacaaat

SEQ ID NO: 53942 - DNA, 20 bp, Artificial Sequence
  chemically synthesized
aatgggatctaattaaacta

SEQ ID NO: 53943 - DNA, 20 bp, Artificial Sequence
  chemically synthesized
tgggatctaattaaactaaa

SEQ ID NO: 53944 - DNA, 20 bp, Artificial Sequence
  chemically synthesized
taaactaaagagcttctgca

SEQ ID NO: 53945 - DNA, 20 bp, Artificial Sequence
  chemically synthesized
aaagagcttctgcacagcaa

SEQ ID NO: 53946 - DNA, 20 bp, Artificial Sequence
  chemically synthesized
acagcaaaagaaactaccat

SEQ ID NO: 53947 - DNA, 20 bp, Artificial Sequence
  chemically synthesized
agcaaaagaaactaccatca

SEQ ID NO: 53948 - DNA, 20 bp, Artificial Sequence
  chemically synthesized
gaaactaccatcagagtgaa

SEQ ID NO: 53949 - DNA, 20 bp, Artificial Sequence
  chemically synthesized
aaactaccatcagagtgaac

SEQ ID NO: 53950 - DNA, 20 bp, Artificial Sequence
  chemically synthesized
tgaacaggcaacctacacaa

SEQ ID NO: 53951 - DNA, 20 bp, Artificial Sequence
  chemically synthesized
gaacaggcaacctacacaat

SEQ ID NO: 53952 - DNA, 20 bp, Artificial Sequence
  chemically synthesized
acaggcaacctacacaatgg

SEQ ID NO: 53953 - DNA, 20 bp, Artificial Sequence
  chemically synthesized
tgcaatctactcatctgaca

SEQ ID NO: 53954 - DNA, 20 bp, Artificial Sequence
  chemically synthesized
gcaatctactcatctgacaa

SEQ ID NO: 53955 - DNA, 20 bp, Artificial Sequence
  chemically synthesized
caatctactcatctgacaaa

SEQ ID NO: 53956 - DNA, 20 bp, Artificial Sequence
  chemically synthesized
tctgacaaagggctaatatc

SEQ ID NO: 53957 - DNA, 20 bp, Artificial Sequence
  chemically synthesized
atgaactcaaacaaatttac

SEQ ID NO: 53958 - DNA, 20 bp, Artificial Sequence
  chemically synthesized
aaacaaacaactgcatcaac

SEQ ID NO: 53959 - DNA, 20 bp, Artificial Sequence
  chemically synthesized
aacaaacaactgcatcaaca

SEQ ID NO: 53960 - DNA, 20 bp, Artificial Sequence
  chemically synthesized
acaaacaactgcatcaacaa

SEQ ID NO: 53961 - DNA, 20 bp, Artificial Sequence
  chemically synthesized
caaacaactgcatcaacaag

SEQ ID NO: 53962 - DNA, 20 bp, Artificial Sequence
  chemically synthesized
aaacaactgcatcaacaagg

SEQ ID NO: 53963 - DNA, 20 bp, Artificial Sequence
  chemically synthesized
actgcatcaacaagggggtg

SEQ ID NO: 53964 - DNA, 20 bp, Artificial Sequence
  chemically synthesized
ctgcatcaacaagggggtga

SEQ ID NO: 53965 - DNA, 20 bp, Artificial Sequence
  chemically synthesized
aagggggtgaaggatatgaa

SEQ ID NO: 53966 - DNA, 20 bp, Artificial Sequence
  chemically synthesized
tatgaacagacacttctcaa

SEQ ID NO: 53967 - DNA, 20 bp, Artificial Sequence
  chemically synthesized
gaacagacacttctcaaaag

SEQ ID NO: 53968 - DNA, 20 bp, Artificial Sequence
  chemically synthesized
ctcaaaagaagacatttatg

SEQ ID NO: 53969 - DNA, 20 bp, Artificial Sequence
  chemically synthesized
gaaaaaatgctcatcatcac

SEQ ID NO: 53970 - DNA, 20 bp, Artificial Sequence
  chemically synthesized
tgctcatcatcactggccat

SEQ ID NO: 53971 - DNA, 20 bp, Artificial Sequence
  chemically synthesized
ctcatcatcactggccatca

SEQ ID NO: 53972 - DNA, 20 bp, Artificial Sequence
  chemically synthesized
atgcaaatcaaaaccacaat

SEQ ID NO: 53973 - DNA, 20 bp, Artificial Sequence
  chemically synthesized
aatgagatatcatctcacac

SEQ ID NO: 53974 - DNA, 20 bp, Artificial Sequence
  chemically synthesized
agatatcatctcacaccagt

SEQ ID NO: 53975 - DNA, 20 bp, Artificial Sequence
  chemically synthesized
tcatctcacaccagttagaa

SEQ ID NO: 53976 - DNA, 20 bp, Artificial Sequence
  chemically synthesized
ttagaatggtgatcattaaa

SEQ ID NO: 53977 - DNA, 20 bp, Artificial Sequence
  chemically synthesized
aatggtgatcattaaaaagt

SEQ ID NO: 53978 - DNA, 20 bp, Artificial Sequence
  chemically synthesized
atggtgatcattaaaaagtc

SEQ ID NO: 53979 - DNA, 20 bp, Artificial Sequence
  chemically synthesized
attaaaaagtcaggaaacca

SEQ ID NO: 53980 - DNA, 20 bp, Artificial Sequence
  chemically synthesized
ttaaaaagtcaggaaaccac

SEQ ID NO: 53981 - DNA, 20 bp, Artificial Sequence
  chemically synthesized
agtcaggaaaccacaggtgc

SEQ ID NO: 53982 - DNA, 20 bp, Artificial Sequence
  chemically synthesized
tcaggaaaccacaggtgctg

SEQ ID NO: 53983 - DNA, 20 bp, Artificial Sequence
  chemically synthesized
aggaaaccacaggtgctgga

SEQ ID NO: 53984 - DNA, 20 bp, Artificial Sequence
  chemically synthesized
ggaaaccacaggtgctggag

SEQ ID NO: 53985 - DNA, 20 bp, Artificial Sequence
  chemically synthesized
cacaggtgctggagaggatg

SEQ ID NO: 53986 - DNA, 20 bp, Artificial Sequence
  chemically synthesized
caggtgctggagaggatgtg

SEQ ID NO: 53987 - DNA, 20 bp, Artificial Sequence
  chemically synthesized
ctggagaggatgtggagaaa

SEQ ID NO: 53988 - DNA, 20 bp, Artificial Sequence
  chemically synthesized
tggagaggatgtggagaaat

SEQ ID NO: 53989 - DNA, 20 bp, Artificial Sequence
  chemically synthesized
taggaacacttttacactgt

SEQ ID NO: 53990 - DNA, 20 bp, Artificial Sequence
  chemically synthesized
gaacacttttacactgttgg

SEQ ID NO: 53991 - DNA, 20 bp, Artificial Sequence
  chemically synthesized
aacacttttacactgttggt

SEQ ID NO: 53992 - DNA, 20 bp, Artificial Sequence
  chemically synthesized
ctgttggtgggactataaac

SEQ ID NO: 53993 - DNA, 20 bp, Artificial Sequence
  chemically synthesized
ataaactagttcaaccattg

SEQ ID NO: 53994 - DNA, 20 bp, Artificial Sequence
  chemically synthesized
aactagttcaaccattgtgg

SEQ ID NO: 53995 - DNA, 20 bp, Artificial Sequence
  chemically synthesized
agttcaaccattgtggaagt

SEQ ID NO: 53996 - DNA, 20 bp, Artificial Sequence
  chemically synthesized
aaccattgtggaagtcagtg

SEQ ID NO: 53997 - DNA, 20 bp, Artificial Sequence
  chemically synthesized
aagtcagtgtggcaattcct

SEQ ID NO: 53998 - DNA, 20 bp, Artificial Sequence
  chemically synthesized
agtcagtgtggcaattcctc

SEQ ID NO: 53999 - DNA, 20 bp, Artificial Sequence
  chemically synthesized
gtcagtgtggcaattcctca

SEQ ID NO: 54000 - DNA, 20 bp, Artificial Sequence
  chemically synthesized
gtggcaattcctcagggatc

SEQ ID NO: 54001 - DNA, 20 bp, Artificial Sequence
  chemically synthesized
attcctcagggatctagaac

SEQ ID NO: 54002 - DNA, 20 bp, Artificial Sequence
  chemically synthesized
actagaaataccatttgacc

SEQ ID NO: 54003 - DNA, 20 bp, Artificial Sequence
  chemically synthesized
tgacccagccatcctattac

SEQ ID NO: 54004 - DNA, 20 bp, Artificial Sequence
  chemically synthesized
gacccagccatcctattact

SEQ ID NO: 54005 - DNA, 20 bp, Artificial Sequence
  chemically synthesized
tattactgggtatataccca

SEQ ID NO: 54006 - DNA, 20 bp, Artificial Sequence
  chemically synthesized
attactgggtatatacccaa

SEQ ID NO: 54007 - DNA, 20 bp, Artificial Sequence
  chemically synthesized
atgtaaatcatgctgctata

SEQ ID NO: 54008 - DNA, 20 bp, Artificial Sequence
  chemically synthesized
atgcacacgtatgtttattg

SEQ ID NO: 54009 - DNA, 20 bp, Artificial Sequence
  chemically synthesized
tattgtggcactattcacaa

SEQ ID NO: 54010 - DNA, 20 bp, Artificial Sequence
  chemically synthesized
tggcactattcacaatagca

SEQ ID NO: 54011 - DNA, 20 bp, Artificial Sequence
  chemically synthesized
tattcacaatagcaaagact

SEQ ID NO: 54012 - DNA, 20 bp, Artificial Sequence
  chemically synthesized
acccaaatgtccaacaatga

SEQ ID NO: 54013 - DNA, 20 bp, Artificial Sequence
  chemically synthesized
aatgtccaacaatgatagac

SEQ ID NO: 54014 - DNA, 20 bp, Artificial Sequence
  chemically synthesized
caacaatgatagactggatt

SEQ ID NO: 54015 - DNA, 20 bp, Artificial Sequence
  chemically synthesized
tagactggattaagaaaatg

SEQ ID NO: 54016 - DNA, 20 bp, Artificial Sequence
  chemically synthesized
aatgtggcacatatacatca

SEQ ID NO: 54017 - DNA, 20 bp, Artificial Sequence
  chemically synthesized
atacatcatggaatactatg

SEQ ID NO: 54018 - DNA, 20 bp, Artificial Sequence
  chemically synthesized
atgcagccataaaaaatgat

SEQ ID NO: 54019 - DNA, 20 bp, Artificial Sequence
  chemically synthesized
tgatgagttcatgtcctttg

SEQ ID NO: 54020 - DNA, 20 bp, Artificial Sequence
  chemically synthesized
gatgagttcatgtcctttgt

SEQ ID NO: 54021 - DNA, 20 bp, Artificial Sequence
  chemically synthesized
atgagttcatgtcctttgta

SEQ ID NO: 54022 - DNA, 20 bp, Artificial Sequence
  chemically synthesized
tcatgtcctttgtagggaca

SEQ ID NO: 54023 - DNA, 20 bp, Artificial Sequence
  chemically synthesized
tgtagggacatggatgaaac

SEQ ID NO: 54024 - DNA, 20 bp, Artificial Sequence
  chemically synthesized
aaactggaaaccatcattct

SEQ ID NO: 54025 - DNA, 20 bp, Artificial Sequence
  chemically synthesized
ggaaaccatcattctgagca

SEQ ID NO: 54026 - DNA, 20 bp, Artificial Sequence
  chemically synthesized
cattctgagcaaagtatcgc

SEQ ID NO: 54027 - DNA, 20 bp, Artificial Sequence
  chemically synthesized
attctgagcaaagtatcgca

SEQ ID NO: 54028 - DNA, 20 bp, Artificial Sequence
  chemically synthesized
acaccacatattctcactca

SEQ ID NO: 54029 - DNA, 20 bp, Artificial Sequence
  chemically synthesized
caccacatattctcactcat

SEQ ID NO: 54030 - DNA, 20 bp, Artificial Sequence
  chemically synthesized
cacatattctcactcatagg

SEQ ID NO: 54031 - DNA, 20 bp, Artificial Sequence
  chemically synthesized
acatattctcactcataggt

SEQ ID NO: 54032 - DNA, 20 bp, Artificial Sequence
  chemically synthesized
atattctcactcataggtgg

SEQ ID NO: 54033 - DNA, 20 bp, Artificial Sequence
  chemically synthesized
ataggtgggagttgaacaat

SEQ ID NO: 54034 - DNA, 20 bp, Artificial Sequence
  chemically synthesized
agttgaacaatgagaacatt

SEQ ID NO: 54035 - DNA, 20 bp, Artificial Sequence
  chemically synthesized
acaatgagaacatttggaca

SEQ ID NO: 54036 - DNA, 20 bp, Artificial Sequence
  chemically synthesized
tgagaacatttggacacagt

SEQ ID NO: 54037 - DNA, 20 bp, Artificial Sequence
  chemically synthesized
gagaacatttggacacagtg

SEQ ID NO: 54038 - DNA, 20 bp, Artificial Sequence
  chemically synthesized
agaacatttggacacagtga

SEQ ID NO: 54039 - DNA, 20 bp, Artificial Sequence
  chemically synthesized
gaacatttggacacagtgag

SEQ ID NO: 54040 - DNA, 20 bp, Artificial Sequence
  chemically synthesized
gtgaggggaacatcacacac

SEQ ID NO: 54041 - DNA, 20 bp, Artificial Sequence
  chemically synthesized
tgaggggaacatcacacacc

SEQ ID NO: 54042 - DNA, 20 bp, Artificial Sequence
  chemically synthesized
gaggggaacatcacacaccg

SEQ ID NO: 54043 - DNA, 20 bp, Artificial Sequence
  chemically synthesized
tcacacaccggggcctgttg

SEQ ID NO: 54044 - DNA, 20 bp, Artificial Sequence
  chemically synthesized
cacacaccggggcctgttgt

SEQ ID NO: 54045 - DNA, 20 bp, Artificial Sequence
  chemically synthesized
acacaccggggcctgttgtg

SEQ ID NO: 54046 - DNA, 20 bp, Artificial Sequence
  chemically synthesized
caccggggcctgttgtgggg

SEQ ID NO: 54047 - DNA, 20 bp, Artificial Sequence
  chemically synthesized
accggggcctgttgtggggt

SEQ ID NO: 54048 - DNA, 20 bp, Artificial Sequence
  chemically synthesized
ccggggcctgttgtggggtg

SEQ ID NO: 54049 - DNA, 20 bp, Artificial Sequence
  chemically synthesized
cggggcctgttgtggggtgg

SEQ ID NO: 54050 - DNA, 20 bp, Artificial Sequence
  chemically synthesized
gcctgttgtggggtgggggc

SEQ ID NO: 54051 - DNA, 20 bp, Artificial Sequence
  chemically synthesized
cctgttgtggggtgggggcc

SEQ ID NO: 54052 - DNA, 20 bp, Artificial Sequence
  chemically synthesized
ctgttgtggggtgggggccg

SEQ ID NO: 54053 - DNA, 20 bp, Artificial Sequence
  chemically synthesized
tgttgtggggtgggggccgg

SEQ ID NO: 54054 - DNA, 20 bp, Artificial Sequence
  chemically synthesized
gttgtggggtgggggccggg

SEQ ID NO: 54055 - DNA, 20 bp, Artificial Sequence
  chemically synthesized
tgtggggtgggggccggggg

SEQ ID NO: 54056 - DNA, 20 bp, Artificial Sequence
  chemically synthesized
gtggggtgggggccgggggg

SEQ ID NO: 54057 - DNA, 20 bp, Artificial Sequence
  chemically synthesized
tggggtgggggccgggggga

SEQ ID NO: 54058 - DNA, 20 bp, Artificial Sequence
  chemically synthesized
gtgggggccggggggaggga

SEQ ID NO: 54059 - DNA, 20 bp, Artificial Sequence
  chemically synthesized
gccggggggagggatagcat

SEQ ID NO: 54060 - DNA, 20 bp, Artificial Sequence
  chemically synthesized
ccggggggagggatagcatt

SEQ ID NO: 54061 - DNA, 20 bp, Artificial Sequence
  chemically synthesized
ggggggagggatagcattag

SEQ ID NO: 54062 - DNA, 20 bp, Artificial Sequence
  chemically synthesized
atatacctaatgtaaatgac

SEQ ID NO: 54063 - DNA, 20 bp, Artificial Sequence
  chemically synthesized
taatgtaaatgacgagttaa

SEQ ID NO: 54064 - DNA, 20 bp, Artificial Sequence
  chemically synthesized
aatgtaaatgacgagttaat

SEQ ID NO: 54065 - DNA, 20 bp, Artificial Sequence
  chemically synthesized
aaatgacgagttaatgggtg

SEQ ID NO: 54066 - DNA, 20 bp, Artificial Sequence
  chemically synthesized
atgggtgcagcacaccaaca

SEQ ID NO: 54067 - DNA, 20 bp, Artificial Sequence
  chemically synthesized
catgttgtgcacatgtaccc

SEQ ID NO: 54068 - DNA, 20 bp, Artificial Sequence
  chemically synthesized
cacatgtaccctagaactta

SEQ ID NO: 54069 - DNA, 20 bp, Artificial Sequence
  chemically synthesized
tgtattgtctcattttcaat

SEQ ID NO: 54070 - DNA, 20 bp, Artificial Sequence
  chemically synthesized
tcattttcaatcagtgactg

SEQ ID NO: 54071 - DNA, 20 bp, Artificial Sequence
  chemically synthesized
ttttcaatcagtgactgaag

SEQ ID NO: 54072 - DNA, 20 bp, Artificial Sequence
  chemically synthesized
caatcagtgactgaagtgga

SEQ ID NO: 54073 - DNA, 20 bp, Artificial Sequence
  chemically synthesized
ttttattctttaccacctat

SEQ ID NO: 54074 - DNA, 20 bp, Artificial Sequence
  chemically synthesized
tttattctttaccacctatg

SEQ ID NO: 54075 - DNA, 20 bp, Artificial Sequence
  chemically synthesized
aggcatatactttttttttt

SEQ ID NO: 54076 - DNA, 20 bp, Artificial Sequence
  chemically synthesized
gcatatacttttttttttga

SEQ ID NO: 54077 - DNA, 20 bp, Artificial Sequence
  chemically synthesized
catatacttttttttttgag

SEQ ID NO: 54078 - DNA, 20 bp, Artificial Sequence
  chemically synthesized
atatacttttttttttgaga

SEQ ID NO: 54079 - DNA, 20 bp, Artificial Sequence
  chemically synthesized
atacttttttttttgagagg

SEQ ID NO: 54080 - DNA, 20 bp, Artificial Sequence
  chemically synthesized
gggagtctcgctctgtcacc

SEQ ID NO: 54081 - DNA, 20 bp, Artificial Sequence
  chemically synthesized
ggagtctcgctctgtcacct

SEQ ID NO: 54082 - DNA, 20 bp, Artificial Sequence
  chemically synthesized
tctcgctctgtcacctaggc

SEQ ID NO: 54083 - DNA, 20 bp, Artificial Sequence
  chemically synthesized
tcgctctgtcacctaggctg

SEQ ID NO: 54084 - DNA, 20 bp, Artificial Sequence
  chemically synthesized
ctgtcacctaggctggagtg

SEQ ID NO: 54085 - DNA, 20 bp, Artificial Sequence
  chemically synthesized
tcactgaaacttctgcctcc

SEQ ID NO: 54086 - DNA, 20 bp, Artificial Sequence
  chemically synthesized
cactgaaacttctgcctccc

SEQ ID NO: 54087 - DNA, 20 bp, Artificial Sequence
  chemically synthesized
aacttctgcctcccaggttc

SEQ ID NO: 54088 - DNA, 20 bp, Artificial Sequence
  chemically synthesized
ttcaagcgattctcctgcct

SEQ ID NO: 54089 - DNA, 20 bp, Artificial Sequence
  chemically synthesized
ttctcctgcctcagcctctt

SEQ ID NO: 54090 - DNA, 20 bp, Artificial Sequence
  chemically synthesized
tcctgcctcagcctcttgag

SEQ ID NO: 54091 - DNA, 20 bp, Artificial Sequence
  chemically synthesized
gcctcagcctcttgagtagc

SEQ ID NO: 54092 - DNA, 20 bp, Artificial Sequence
  chemically synthesized
cctcagcctcttgagtagct

SEQ ID NO: 54093 - DNA, 20 bp, Artificial Sequence
  chemically synthesized
ctcttgagtagctgggatta

SEQ ID NO: 54094 - DNA, 20 bp, Artificial Sequence
  chemically synthesized
tcttgagtagctgggattaa

SEQ ID NO: 54095 - DNA, 20 bp, Artificial Sequence
  chemically synthesized
aaggtgcacaccactatgcc

SEQ ID NO: 54096 - DNA, 20 bp, Artificial Sequence
  chemically synthesized
ccagctaatttttgtatttt

SEQ ID NO: 54097 - DNA, 20 bp, Artificial Sequence
  chemically synthesized
gctaatttttgtatttttag

SEQ ID NO: 54098 - DNA, 20 bp, Artificial Sequence
  chemically synthesized
taatttttgtatttttagta

SEQ ID NO: 54099 - DNA, 20 bp, Artificial Sequence
  chemically synthesized
ttttgtatttttagtagaga

SEQ ID NO: 54100 - DNA, 20 bp, Artificial Sequence
  chemically synthesized
tttgtatttttagtagagac

SEQ ID NO: 54101 - DNA, 20 bp, Artificial Sequence
  chemically synthesized
ttgtatttttagtagagacg

SEQ ID NO: 54102 - DNA, 20 bp, Artificial Sequence
  chemically synthesized
gagacggggtttcattgttt

SEQ ID NO: 54103 - DNA, 20 bp, Artificial Sequence
  chemically synthesized
ggggtttcattgttttggtc

SEQ ID NO: 54104 - DNA, 20 bp, Artificial Sequence
  chemically synthesized
tttcattgttttggtcaagc

SEQ ID NO: 54105 - DNA, 20 bp, Artificial Sequence
  chemically synthesized
ttgttttggtcaagctggtc

SEQ ID NO: 54106 - DNA, 20 bp, Artificial Sequence
  chemically synthesized
accttgtgatctacccgcct

SEQ ID NO: 54107 - DNA, 20 bp, Artificial Sequence
  chemically synthesized
ctacccgcctcagcctctca

SEQ ID NO: 54108 - DNA, 20 bp, Artificial Sequence
  chemically synthesized
gcctcagcctctcaaagtgc

SEQ ID NO: 54109 - DNA, 20 bp, Artificial Sequence
  chemically synthesized
cctcagcctctcaaagtgct

SEQ ID NO: 54110 - DNA, 20 bp, Artificial Sequence
  chemically synthesized
ctctcaaagtgctgggatta

SEQ ID NO: 54111 - DNA, 20 bp, Artificial Sequence
  chemically synthesized
tctcaaagtgctgggattac

SEQ ID NO: 54112 - DNA, 20 bp, Artificial Sequence
  chemically synthesized
agtgctgggattacaggtgt

SEQ ID NO: 54113 - DNA, 20 bp, Artificial Sequence
  chemically synthesized
acaggtgtgagccaccgtgc

SEQ ID NO: 54114 - DNA, 20 bp, Artificial Sequence
  chemically synthesized
caggtgtgagccaccgtgcc

SEQ ID NO: 54115 - DNA, 20 bp, Artificial Sequence
  chemically synthesized
tgtgagccaccgtgccaggc

SEQ ID NO: 54116 - DNA, 20 bp, Artificial Sequence
  chemically synthesized
caccgtgccaggctggcata

SEQ ID NO: 54117 - DNA, 20 bp, Artificial Sequence
  chemically synthesized
ggcatatagatttaaaaacc

SEQ ID NO: 54118 - DNA, 20 bp, Artificial Sequence
  chemically synthesized
tctgccattgcaaatatcta

SEQ ID NO: 54119 - DNA, 20 bp, Artificial Sequence
  chemically synthesized
atgttttatcctatattttt

SEQ ID NO: 54120 - DNA, 20 bp, Artificial Sequence
  chemically synthesized
tatcctatatttttgagaaa

SEQ ID NO: 54121 - DNA, 20 bp, Artificial Sequence
  chemically synthesized
tttttgagaaatagattaat

SEQ ID NO: 54122 - DNA, 20 bp, Artificial Sequence
  chemically synthesized
ttgagaaatagattaattgg

SEQ ID NO: 54123 - DNA, 20 bp, Artificial Sequence
  chemically synthesized
aatttgctgtatgtcttcaa

SEQ ID NO: 54124 - DNA, 20 bp, Artificial Sequence
  chemically synthesized
tgctgtatgtcttcaatggc

SEQ ID NO: 54125 - DNA, 20 bp, Artificial Sequence
  chemically synthesized
tgtcttcaatggctagcata

SEQ ID NO: 54126 - DNA, 20 bp, Artificial Sequence
  chemically synthesized
ctagcatatggcttaacaat

SEQ ID NO: 54127 - DNA, 20 bp, Artificial Sequence
  chemically synthesized
atatggcttaacaataagtt

SEQ ID NO: 54128 - DNA, 20 bp, Artificial Sequence
  chemically synthesized
tatggcttaacaataagtta

SEQ ID NO: 54129 - DNA, 20 bp, Artificial Sequence
  chemically synthesized
taagttaaggccaatcaatg

SEQ ID NO: 54130 - DNA, 20 bp, Artificial Sequence
  chemically synthesized
gttaaggccaatcaatgtgg

SEQ ID NO: 54131 - DNA, 20 bp, Artificial Sequence
  chemically synthesized
aaggccaatcaatgtggaag

SEQ ID NO: 54132 - DNA, 20 bp, Artificial Sequence
  chemically synthesized
aggccaatcaatgtggaaga

SEQ ID NO: 54133 - DNA, 20 bp, Artificial Sequence
  chemically synthesized
ttgcttgaaatctattttgt

SEQ ID NO: 54134 - DNA, 20 bp, Artificial Sequence
  chemically synthesized
taattccctcccatttctgt

SEQ ID NO: 54135 - DNA, 20 bp, Artificial Sequence
  chemically synthesized
ttccctcccatttctgtaag

SEQ ID NO: 54136 - DNA, 20 bp, Artificial Sequence
  chemically synthesized
tcataactctctattttcct

SEQ ID NO: 54137 - DNA, 20 bp, Artificial Sequence
  chemically synthesized
cataactctctattttcctt

SEQ ID NO: 54138 - DNA, 20 bp, Artificial Sequence
  chemically synthesized
ataactctctattttcctta

SEQ ID NO: 54139 - DNA, 20 bp, Artificial Sequence
  chemically synthesized
attttccttagggatatgat

SEQ ID NO: 54140 - DNA, 20 bp, Artificial Sequence
  chemically synthesized
ttgatgctgcgttttatatc

SEQ ID NO: 54141 - DNA, 20 bp, Artificial Sequence
  chemically synthesized
tatatctagttttaccttga

SEQ ID NO: 54142 - DNA, 20 bp, Artificial Sequence
  chemically synthesized
atatctagttttaccttgat

SEQ ID NO: 54143 - DNA, 20 bp, Artificial Sequence
  chemically synthesized
tctagttttaccttgatagg

SEQ ID NO: 54144 - DNA, 20 bp, Artificial Sequence
  chemically synthesized
tttaccttgataggcagcat

SEQ ID NO: 54145 - DNA, 20 bp, Artificial Sequence
  chemically synthesized
ccttgataggcagcattgga

SEQ ID NO: 54146 - DNA, 20 bp, Artificial Sequence
  chemically synthesized
tgataggcagcattggatgg

SEQ ID NO: 54147 - DNA, 20 bp, Artificial Sequence
  chemically synthesized
ggcagcattggatggtagta

SEQ ID NO: 54148 - DNA, 20 bp, Artificial Sequence
  chemically synthesized
ttggatggtagtaaagatca

SEQ ID NO: 54149 - DNA, 20 bp, Artificial Sequence
  chemically synthesized
gtagtaaagatcaaagcttt

SEQ ID NO: 54150 - DNA, 20 bp, Artificial Sequence
  chemically synthesized
atcctgccttactttaaatc

SEQ ID NO: 54151 - DNA, 20 bp, Artificial Sequence
  chemically synthesized
ctgccttactttaaatccag

SEQ ID NO: 54152 - DNA, 20 bp, Artificial Sequence
  chemically synthesized
tgccttactttaaatccagt

SEQ ID NO: 54153 - DNA, 20 bp, Artificial Sequence
  chemically synthesized
gccttactttaaatccagta

SEQ ID NO: 54154 - DNA, 20 bp, Artificial Sequence
  chemically synthesized
actttaaatccagtagggcc

SEQ ID NO: 54155 - DNA, 20 bp, Artificial Sequence
  chemically synthesized
ctttaaatccagtagggcct

SEQ ID NO: 54156 - DNA, 20 bp, Artificial Sequence
  chemically synthesized
tttaaatccagtagggccta

SEQ ID NO: 54157 - DNA, 20 bp, Artificial Sequence
  chemically synthesized
aatccagtagggcctagggt

SEQ ID NO: 54158 - DNA, 20 bp, Artificial Sequence
  chemically synthesized
tccagtagggcctagggtaa

SEQ ID NO: 54159 - DNA, 20 bp, Artificial Sequence
  chemically synthesized
ccagtagggcctagggtaag

SEQ ID NO: 54160 - DNA, 20 bp, Artificial Sequence
  chemically synthesized
ggcctagggtaagaggctga

SEQ ID NO: 54161 - DNA, 20 bp, Artificial Sequence
  chemically synthesized
ggtaagaggctgaaagtctg

SEQ ID NO: 54162 - DNA, 20 bp, Artificial Sequence
  chemically synthesized
gtaagaggctgaaagtctgt

SEQ ID NO: 54163 - DNA, 20 bp, Artificial Sequence
  chemically synthesized
gtgggttttttttacatctg

SEQ ID NO: 54164 - DNA, 20 bp, Artificial Sequence
  chemically synthesized
ttttacatctgtagaaataa

SEQ ID NO: 54165 - DNA, 20 bp, Artificial Sequence
  chemically synthesized
aaataatagtatttatataa

SEQ ID NO: 54166 - DNA, 20 bp, Artificial Sequence
  chemically synthesized
atttatataatggttattta

SEQ ID NO: 54167 - DNA, 20 bp, Artificial Sequence
  chemically synthesized
tttatataatggttatttaa

SEQ ID NO: 54168 - DNA, 20 bp, Artificial Sequence
  chemically synthesized
ttatataatggttatttaaa

SEQ ID NO: 54169 - DNA, 20 bp, Artificial Sequence
  chemically synthesized
ttatttaaagggcttttcaa

SEQ ID NO: 54170 - DNA, 20 bp, Artificial Sequence
  chemically synthesized
tatttaaagggcttttcaat

SEQ ID NO: 54171 - DNA, 20 bp, Artificial Sequence
  chemically synthesized
cttttcaataggttattgtg

SEQ ID NO: 54172 - DNA, 20 bp, Artificial Sequence
  chemically synthesized
ggttattgtgaagatttaat

SEQ ID NO: 54173 - DNA, 20 bp, Artificial Sequence
  chemically synthesized
ttaataagttaatatttgta

SEQ ID NO: 54174 - DNA, 20 bp, Artificial Sequence
  chemically synthesized
ataagttaatatttgtaaag

SEQ ID NO: 54175 - DNA, 20 bp, Artificial Sequence
  chemically synthesized
aaagtagtatgacacatatt

SEQ ID NO: 54176 - DNA, 20 bp, Artificial Sequence
  chemically synthesized
gtagtatgacacatattaag

SEQ ID NO: 54177 - DNA, 20 bp, Artificial Sequence
  chemically synthesized
ataatatctactaatttttt

SEQ ID NO: 54178 - DNA, 20 bp, Artificial Sequence
  chemically synthesized
taatatctactaatttttta

SEQ ID NO: 54179 - DNA, 20 bp, Artificial Sequence
  chemically synthesized
ggtacaaaaaattaattatt

SEQ ID NO: 54180 - DNA, 20 bp, Artificial Sequence
  chemically synthesized
acaaaaaattaattatttgg

SEQ ID NO: 54181 - DNA, 20 bp, Artificial Sequence
  chemically synthesized
caaaaaattaattatttggt

SEQ ID NO: 54182 - DNA, 20 bp, Artificial Sequence
  chemically synthesized
tttggtaggacttatatatt

SEQ ID NO: 54183 - DNA, 20 bp, Artificial Sequence
  chemically synthesized
cccattttactctcctttcc

SEQ ID NO: 54184 - DNA, 20 bp, Artificial Sequence
  chemically synthesized
cattttactctcctttccca

SEQ ID NO: 54185 - DNA, 20 bp, Artificial Sequence
  chemically synthesized
tttactctcctttcccagag

SEQ ID NO: 54186 - DNA, 20 bp, Artificial Sequence
  chemically synthesized
tttcccagagaagaaaacat

SEQ ID NO: 54187 - DNA, 20 bp, Artificial Sequence
  chemically synthesized
ccagagaagaaaacattgga

SEQ ID NO: 54188 - DNA, 20 bp, Artificial Sequence
  chemically synthesized
ggaaagaaaacaaatctgat

SEQ ID NO: 54189 - DNA, 20 bp, Artificial Sequence
  chemically synthesized
aaatctgatgagacctcatt

SEQ ID NO: 54190 - DNA, 20 bp, Artificial Sequence
  chemically synthesized
gatgagacctcattcagcct

SEQ ID NO: 54191 - DNA, 20 bp, Artificial Sequence
  chemically synthesized
atgagacctcattcagccta

SEQ ID NO: 54192 - DNA, 20 bp, Artificial Sequence
  chemically synthesized
agacctcattcagcctaagg

SEQ ID NO: 54193 - DNA, 20 bp, Artificial Sequence
  chemically synthesized
tttctaaatcctcaactttg

SEQ ID NO: 54194 - DNA, 20 bp, Artificial Sequence
  chemically synthesized
actttgtagtctttcactaa

SEQ ID NO: 54195 - DNA, 20 bp, Artificial Sequence
  chemically synthesized
tagtctttcactaatggcac

SEQ ID NO: 54196 - DNA, 20 bp, Artificial Sequence
  chemically synthesized
agtctttcactaatggcact

SEQ ID NO: 54197 - DNA, 20 bp, Artificial Sequence
  chemically synthesized
ttcactaatggcactaggcc

SEQ ID NO: 54198 - DNA, 20 bp, Artificial Sequence
  chemically synthesized
cctggaataaactgtacata

SEQ ID NO: 54199 - DNA, 20 bp, Artificial Sequence
  chemically synthesized
ttcgcaatcacactaattcc

SEQ ID NO: 54200 - DNA, 20 bp, Artificial Sequence
  chemically synthesized
tcgcaatcacactaattccc

SEQ ID NO: 54201 - DNA, 20 bp, Artificial Sequence
  chemically synthesized
acactaattcccaggatgtg

SEQ ID NO: 54202 - DNA, 20 bp, Artificial Sequence
  chemically synthesized
ggatgtgtggtatgtcctga

SEQ ID NO: 54203 - DNA, 20 bp, Artificial Sequence
  chemically synthesized
gatgtgtggtatgtcctgat

SEQ ID NO: 54204 - DNA, 20 bp, Artificial Sequence
  chemically synthesized
gtatgtcctgatgggaatcc

SEQ ID NO: 54205 - DNA, 20 bp, Artificial Sequence
  chemically synthesized
tatgtcctgatgggaatccc

SEQ ID NO: 54206 - DNA, 20 bp, Artificial Sequence
  chemically synthesized
atgtcctgatgggaatccca

SEQ ID NO: 54207 - DNA, 20 bp, Artificial Sequence
  chemically synthesized
cctgatgggaatcccagggc

SEQ ID NO: 54208 - DNA, 20 bp, Artificial Sequence
  chemically synthesized
gatgggaatcccagggctgg

SEQ ID NO: 54209 - DNA, 20 bp, Artificial Sequence
  chemically synthesized
atgggaatcccagggctgga

SEQ ID NO: 54210 - DNA, 20 bp, Artificial Sequence
  chemically synthesized
ggctggaaggcttgcatacc

SEQ ID NO: 54211 - DNA, 20 bp, Artificial Sequence
  chemically synthesized
tttttcttttatgtacattg

SEQ ID NO: 54212 - DNA, 20 bp, Artificial Sequence
  chemically synthesized
tatgtacattgtggctgttg

SEQ ID NO: 54213 - DNA, 20 bp, Artificial Sequence
  chemically synthesized
atgtacattgtggctgttgc

SEQ ID NO: 54214 - DNA, 20 bp, Artificial Sequence
  chemically synthesized
tgatcttcctgatcatgact

SEQ ID NO: 54215 - DNA, 20 bp, Artificial Sequence
  chemically synthesized
ttcctgatcatgactgagcg

SEQ ID NO: 54216 - DNA, 20 bp, Artificial Sequence
  chemically synthesized
tgactgagcgcagtctccat

SEQ ID NO: 54217 - DNA, 20 bp, Artificial Sequence
  chemically synthesized
gtatctcttcctatccatgc

SEQ ID NO: 54218 - DNA, 20 bp, Artificial Sequence
  chemically synthesized
cttcctatccatgctggcct

SEQ ID NO: 54219 - DNA, 20 bp, Artificial Sequence
  chemically synthesized
cttcctgctcgccactgctg

SEQ ID NO: 54220 - DNA, 20 bp, Artificial Sequence
  chemically synthesized
tcgccactgctgcagcccct

SEQ ID NO: 54221 - DNA, 20 bp, Artificial Sequence
  chemically synthesized
cgccactgctgcagccccta

SEQ ID NO: 54222 - DNA, 20 bp, Artificial Sequence
  chemically synthesized
tgctgcagcccctaaggtgc

SEQ ID NO: 54223 - DNA, 20 bp, Artificial Sequence
  chemically synthesized
ctaaggtgctggctatcctc

SEQ ID NO: 54224 - DNA, 20 bp, Artificial Sequence
  chemically synthesized
tatcctctggttccactcca

SEQ ID NO: 54225 - DNA, 20 bp, Artificial Sequence
  chemically synthesized
cactccatggacatatcctt

SEQ ID NO: 54226 - DNA, 20 bp, Artificial Sequence
  chemically synthesized
tccatggacatatcctttgg

SEQ ID NO: 54227 - DNA, 20 bp, Artificial Sequence
  chemically synthesized
cctttggtagttgtgtgtct

SEQ ID NO: 54228 - DNA, 20 bp, Artificial Sequence
  chemically synthesized
cttcatacatttcatctttg

SEQ ID NO: 54229 - DNA, 20 bp, Artificial Sequence
  chemically synthesized
catacatttcatctttgtgg

SEQ ID NO: 54230 - DNA, 20 bp, Artificial Sequence
  chemically synthesized
ggcagaatctgctattctcc

SEQ ID NO: 54231 - DNA, 20 bp, Artificial Sequence
  chemically synthesized
atctgctattctcctggcaa

SEQ ID NO: 54232 - DNA, 20 bp, Artificial Sequence
  chemically synthesized
aatggcatttgaccgctatg

SEQ ID NO: 54233 - DNA, 20 bp, Artificial Sequence
  chemically synthesized
gtggccatctgttacccact

SEQ ID NO: 54234 - DNA, 20 bp, Artificial Sequence
  chemically synthesized
atacaccattttaacctcat

SEQ ID NO: 54235 - DNA, 20 bp, Artificial Sequence
  chemically synthesized
attttaacctcatcagccgt

SEQ ID NO: 54236 - DNA, 20 bp, Artificial Sequence
  chemically synthesized
ttttaacctcatcagccgtc

SEQ ID NO: 54237 - DNA, 20 bp, Artificial Sequence
  chemically synthesized
taacctcatcagccgtcagg

SEQ ID NO: 54238 - DNA, 20 bp, Artificial Sequence
  chemically synthesized
tcatcagccgtcaggaagat

SEQ ID NO: 54239 - DNA, 20 bp, Artificial Sequence
  chemically synthesized
agccgtcaggaagattggca

SEQ ID NO: 54240 - DNA, 20 bp, Artificial Sequence
  chemically synthesized
cgtcaggaagattggcatag

SEQ ID NO: 54241 - DNA, 20 bp, Artificial Sequence
  chemically synthesized
gaagattggcatagcagctg

SEQ ID NO: 54242 - DNA, 20 bp, Artificial Sequence
  chemically synthesized
attggcatagcagctgtggt

SEQ ID NO: 54243 - DNA, 20 bp, Artificial Sequence
  chemically synthesized
ttggcatagcagctgtggtc

SEQ ID NO: 54244 - DNA, 20 bp, Artificial Sequence
  chemically synthesized
ggcatagcagctgtggtcag

SEQ ID NO: 54245 - DNA, 20 bp, Artificial Sequence
  chemically synthesized
ctgctgtccgttcatcttcc

SEQ ID NO: 54246 - DNA, 20 bp, Artificial Sequence
  chemically synthesized
gtataccgacttacatattg

SEQ ID NO: 54247 - DNA, 20 bp, Artificial Sequence
  chemically synthesized
tataccgacttacatattgt

SEQ ID NO: 54248 - DNA, 20 bp, Artificial Sequence
  chemically synthesized
taccgacttacatattgtgg

SEQ ID NO: 54249 - DNA, 20 bp, Artificial Sequence
  chemically synthesized
tcattcctcattcctactgt

SEQ ID NO: 54250 - DNA, 20 bp, Artificial Sequence
  chemically synthesized
tcctactgtgagcacattgc

SEQ ID NO: 54251 - DNA, 20 bp, Artificial Sequence
  chemically synthesized
ctgtgagcacattgccagat

SEQ ID NO: 54252 - DNA, 20 bp, Artificial Sequence
  chemically synthesized
cacattgccagattggcttg

SEQ ID NO: 54253 - DNA, 20 bp, Artificial Sequence
  chemically synthesized
atcaatgtcaatatcattta

SEQ ID NO: 54254 - DNA, 20 bp, Artificial Sequence
  chemically synthesized
tatcatttatggcctcactg

SEQ ID NO: 54255 - DNA, 20 bp, Artificial Sequence
  chemically synthesized
cactgtggccctactctcta

SEQ ID NO: 54256 - DNA, 20 bp, Artificial Sequence
  chemically synthesized
actgtggccctactctctac

SEQ ID NO: 54257 - DNA, 20 bp, Artificial Sequence
  chemically synthesized
ggccctactctctacaggac

SEQ ID NO: 54258 - DNA, 20 bp, Artificial Sequence
  chemically synthesized
actctctacaggactggata

SEQ ID NO: 54259 - DNA, 20 bp, Artificial Sequence
  chemically synthesized
ctacacaatgatccttcact

SEQ ID NO: 54260 - DNA, 20 bp, Artificial Sequence
  chemically synthesized
tgatccttcactcagtgttt

SEQ ID NO: 54261 - DNA, 20 bp, Artificial Sequence
  chemically synthesized
cagtgtttcagatatcttcc

SEQ ID NO: 54262 - DNA, 20 bp, Artificial Sequence
  chemically synthesized
agtgtttcagatatcttcct

SEQ ID NO: 54263 - DNA, 20 bp, Artificial Sequence
  chemically synthesized
cagatatcttcctgggctgc

SEQ ID NO: 54264 - DNA, 20 bp, Artificial Sequence
  chemically synthesized
agatatcttcctgggctgcc

SEQ ID NO: 54265 - DNA, 20 bp, Artificial Sequence
  chemically synthesized
cttcctgggctgccaggttc

SEQ ID NO: 54266 - DNA, 20 bp, Artificial Sequence
  chemically synthesized
ttcctgggctgccaggttca

SEQ ID NO: 54267 - DNA, 20 bp, Artificial Sequence
  chemically synthesized
gctgccaggttcaaggccct

SEQ ID NO: 54268 - DNA, 20 bp, Artificial Sequence
  chemically synthesized
ttcaaggcccttagtacgtg

SEQ ID NO: 54269 - DNA, 20 bp, Artificial Sequence
  chemically synthesized
catatttatgttctataccc

SEQ ID NO: 54270 - DNA, 20 bp, Artificial Sequence
  chemically synthesized
tcatttcttgcccatcgctt

SEQ ID NO: 54271 - DNA, 20 bp, Artificial Sequence
  chemically synthesized
atttcttgcccatcgctttg

SEQ ID NO: 54272 - DNA, 20 bp, Artificial Sequence
  chemically synthesized
tttcttgcccatcgctttgg

SEQ ID NO: 54273 - DNA, 20 bp, Artificial Sequence
  chemically synthesized
ccctcaccacattcacatcc

SEQ ID NO: 54274 - DNA, 20 bp, Artificial Sequence
  chemically synthesized
tcaccacattcacatcctag

SEQ ID NO: 54275 - DNA, 20 bp, Artificial Sequence
  chemically synthesized
caccacattcacatcctagt

SEQ ID NO: 54276 - DNA, 20 bp, Artificial Sequence
  chemically synthesized
cacattcacatcctagtggg

SEQ ID NO: 54277 - DNA, 20 bp, Artificial Sequence
  chemically synthesized
agtgggcagtctctatgtgt

SEQ ID NO: 54278 - DNA, 20 bp, Artificial Sequence
  chemically synthesized
atgctaaaccccatcattta

SEQ ID NO: 54279 - DNA, 20 bp, Artificial Sequence
  chemically synthesized
tgctaaaccccatcatttat

SEQ ID NO: 54280 - DNA, 20 bp, Artificial Sequence
  chemically synthesized
gctaaaccccatcatttatg

SEQ ID NO: 54281 - DNA, 20 bp, Artificial Sequence
  chemically synthesized
accccatcatttatggggtg

SEQ ID NO: 54282 - DNA, 20 bp, Artificial Sequence
  chemically synthesized
ggtgaagaccaaacaaatta

SEQ ID NO: 54283 - DNA, 20 bp, Artificial Sequence
  chemically synthesized
gaccaaacaaattaaagatc

SEQ ID NO: 54284 - DNA, 20 bp, Artificial Sequence
  chemically synthesized
attttgcttttctctcctat

SEQ ID NO: 54285 - DNA, 20 bp, Artificial Sequence
  chemically synthesized
tcctatcagtgtatgctgtt

SEQ ID NO: 54286 - DNA, 20 bp, Artificial Sequence
  chemically synthesized
tgtatgctgttaagattaaa

SEQ ID NO: 54287 - DNA, 20 bp, Artificial Sequence
  chemically synthesized
taagattaaaaagtctgttt

SEQ ID NO: 54288 - DNA, 20 bp, Artificial Sequence
  chemically synthesized
aagattaaaaagtctgtttt

SEQ ID NO: 54289 - DNA, 20 bp, Artificial Sequence
  chemically synthesized
agattaaaaagtctgtttta

SEQ ID NO: 54290 - DNA, 20 bp, Artificial Sequence
  chemically synthesized
aaaaagtctgttttagggaa

SEQ ID NO: 54291 - DNA, 20 bp, Artificial Sequence
  chemically synthesized
aatagaataaatacaatcca

SEQ ID NO: 54292 - DNA, 20 bp, Artificial Sequence
  chemically synthesized
ctcaaacacacttaaaatga

SEQ ID NO: 54293 - DNA, 20 bp, Artificial Sequence
  chemically synthesized
taaaatgatggtgtctatca

SEQ ID NO: 54294 - DNA, 20 bp, Artificial Sequence
  chemically synthesized
ggtgtctatcaaagtgtcca

SEQ ID NO: 54295 - DNA, 20 bp, Artificial Sequence
  chemically synthesized
agtgtccacggaattttgct

SEQ ID NO: 54296 - DNA, 20 bp, Artificial Sequence
  chemically synthesized
gtgtccacggaattttgcta

SEQ ID NO: 54297 - DNA, 20 bp, Artificial Sequence
  chemically synthesized
gaattttgctaaggcactca

SEQ ID NO: 54298 - DNA, 20 bp, Artificial Sequence
  chemically synthesized
gctaaggcactcaaagatca

SEQ ID NO: 54299 - DNA, 20 bp, Artificial Sequence
  chemically synthesized
ctaaggcactcaaagatcaa

SEQ ID NO: 54300 - DNA, 20 bp, Artificial Sequence
  chemically synthesized
aatgaaattctccatttttt

SEQ ID NO: 54301 - DNA, 20 bp, Artificial Sequence
  chemically synthesized
ttttaacttaaaaatatata

SEQ ID NO: 54302 - DNA, 20 bp, Artificial Sequence
  chemically synthesized
aaaaatatataaagataatc

SEQ ID NO: 54303 - DNA, 20 bp, Artificial Sequence
  chemically synthesized
tatataaagataatcgagaa

SEQ ID NO: 54304 - DNA, 20 bp, Artificial Sequence
  chemically synthesized
tataaagataatcgagaaaa

SEQ ID NO: 54305 - DNA, 20 bp, Artificial Sequence
  chemically synthesized
gagaaaagagaaatatattt

SEQ ID NO: 54306 - DNA, 20 bp, Artificial Sequence
  chemically synthesized
agaaaagagaaatatatttt

SEQ ID NO: 54307 - DNA, 20 bp, Artificial Sequence
  chemically synthesized
gaaaagagaaatatatttta

SEQ ID NO: 54308 - DNA, 20 bp, Artificial Sequence
  chemically synthesized
atatattttagggtttaatc

SEQ ID NO: 54309 - DNA, 20 bp, Artificial Sequence
  chemically synthesized
ccagattgacttttcctacg

SEQ ID NO: 54310 - DNA, 20 bp, Artificial Sequence
  chemically synthesized
agattgacttttcctacgta

SEQ ID NO: 54311 - DNA, 20 bp, Artificial Sequence
  chemically synthesized
tgacttttcctacgtagagc

SEQ ID NO: 54312 - DNA, 20 bp, Artificial Sequence
  chemically synthesized
gacttttcctacgtagagct

SEQ ID NO: 54313 - DNA, 20 bp, Artificial Sequence
  chemically synthesized
ttttcctacgtagagctagg

SEQ ID NO: 54314 - DNA, 20 bp, Artificial Sequence
  chemically synthesized
tcctacgtagagctaggaag

SEQ ID NO: 54315 - DNA, 20 bp, Artificial Sequence
  chemically synthesized
cctacgtagagctaggaagt

SEQ ID NO: 54316 - DNA, 20 bp, Artificial Sequence
  chemically synthesized
ctacgtagagctaggaagtg

SEQ ID NO: 54317 - DNA, 20 bp, Artificial Sequence
  chemically synthesized
gagctaggaagtggggtttt

SEQ ID NO: 54318 - DNA, 20 bp, Artificial Sequence
  chemically synthesized
taggaagtggggttttgagt

SEQ ID NO: 54319 - DNA, 20 bp, Artificial Sequence
  chemically synthesized
tggggttttgagtcagtcac

SEQ ID NO: 54320 - DNA, 20 bp, Artificial Sequence
  chemically synthesized
ggggttttgagtcagtcact

SEQ ID NO: 54321 - DNA, 20 bp, Artificial Sequence
  chemically synthesized
gtcagtcactgggcttttta

SEQ ID NO: 54322 - DNA, 20 bp, Artificial Sequence
  chemically synthesized
gtcactgggctttttatagt

SEQ ID NO: 54323 - DNA, 20 bp, Artificial Sequence
  chemically synthesized
aacactcccgctgtactctg

SEQ ID NO: 54324 - DNA, 20 bp, Artificial Sequence
  chemically synthesized
cactcccgctgtactctgca

SEQ ID NO: 54325 - DNA, 20 bp, Artificial Sequence
  chemically synthesized
agacttgaaccaataacatg

SEQ ID NO: 54326 - DNA, 20 bp, Artificial Sequence
  chemically synthesized
tttgtcaacacctgttactt

SEQ ID NO: 54327 - DNA, 20 bp, Artificial Sequence
  chemically synthesized
ttaagttaaaatgttatccc

SEQ ID NO: 54328 - DNA, 20 bp, Artificial Sequence
  chemically synthesized
taactcactgacatctcaca

SEQ ID NO: 54329 - DNA, 20 bp, Artificial Sequence
  chemically synthesized
atctcacaaagtctcttgta

SEQ ID NO: 54330 - DNA, 20 bp, Artificial Sequence
  chemically synthesized
acaaagtctcttgtatggaa

SEQ ID NO: 54331 - DNA, 20 bp, Artificial Sequence
  chemically synthesized
ataatacatatgtattcaac

SEQ ID NO: 54332 - DNA, 20 bp, Artificial Sequence
  chemically synthesized
tgtattcaacaagtgaataa

SEQ ID NO: 54333 - DNA, 20 bp, Artificial Sequence
  chemically synthesized
aagtgaataatagtgaatta

SEQ ID NO: 54334 - DNA, 20 bp, Artificial Sequence
  chemically synthesized
aatattaaattaacaaatat

SEQ ID NO: 54335 - DNA, 20 bp, Artificial Sequence
  chemically synthesized
ttaacaaatatgagattgcc

SEQ ID NO: 54336 - DNA, 20 bp, Artificial Sequence
  chemically synthesized
ctgatacacatttcccccta

SEQ ID NO: 54337 - DNA, 20 bp, Artificial Sequence
  chemically synthesized
atacacatttccccctatag

SEQ ID NO: 54338 - DNA, 20 bp, Artificial Sequence
  chemically synthesized
acacatttccccctatagtg

SEQ ID NO: 54339 - DNA, 20 bp, Artificial Sequence
  chemically synthesized
tccccctatagtggagattt

SEQ ID NO: 54340 - DNA, 20 bp, Artificial Sequence
  chemically synthesized
atagtggagattttagaccc

SEQ ID NO: 54341 - DNA, 20 bp, Artificial Sequence
  chemically synthesized
ttttagacccaagtcatcaa

SEQ ID NO: 54342 - DNA, 20 bp, Artificial Sequence
  chemically synthesized
ttagacccaagtcatcaatg

SEQ ID NO: 54343 - DNA, 20 bp, Artificial Sequence
  chemically synthesized
aagtcatcaatggagcatca

SEQ ID NO: 54344 - DNA, 20 bp, Artificial Sequence
  chemically synthesized
atggagcatcatggcatcaa

SEQ ID NO: 54345 - DNA, 20 bp, Artificial Sequence
  chemically synthesized
catcaacagaaacatcactg

SEQ ID NO: 54346 - DNA, 20 bp, Artificial Sequence
  chemically synthesized
caacagaaacatcactgaag

SEQ ID NO: 54347 - DNA, 20 bp, Artificial Sequence
  chemically synthesized
tgattgaaaatttctatacc

SEQ ID NO: 54348 - DNA, 20 bp, Artificial Sequence
  chemically synthesized
gattgaaaatttctatacct

SEQ ID NO: 54349 - DNA, 20 bp, Artificial Sequence
  chemically synthesized
taaaataaacattttttaaa

SEQ ID NO: 54350 - DNA, 20 bp, Artificial Sequence
  chemically synthesized
ataaacattttttaaaaagc

SEQ ID NO: 54351 - DNA, 20 bp, Artificial Sequence
  chemically synthesized
aaacattttttaaaaagcta

SEQ ID NO: 54352 - DNA, 20 bp, Artificial Sequence
  chemically synthesized
cattttttaaaaagctagag

SEQ ID NO: 54353 - DNA, 20 bp, Artificial Sequence
  chemically synthesized
ttaaaaagctagagaagatt

SEQ ID NO: 54354 - DNA, 20 bp, Artificial Sequence
  chemically synthesized
taaaaagctagagaagatta

SEQ ID NO: 54355 - DNA, 20 bp, Artificial Sequence
  chemically synthesized
aaaagctagagaagattaag

SEQ ID NO: 54356 - DNA, 20 bp, Artificial Sequence
  chemically synthesized
gattaaggagaatattttcc

SEQ ID NO: 54357 - DNA, 20 bp, Artificial Sequence
  chemically synthesized
tccaagaaacttaaataaaa

SEQ ID NO: 54358 - DNA, 20 bp, Artificial Sequence
  chemically synthesized
aataaaaaagaatgtaatcc

SEQ ID NO: 54359 - DNA, 20 bp, Artificial Sequence
  chemically synthesized
aaagaatgtaatcccagcaa

SEQ ID NO: 54360 - DNA, 20 bp, Artificial Sequence
  chemically synthesized
attatctatgatattatcta

SEQ ID NO: 54361 - DNA, 20 bp, Artificial Sequence
  chemically synthesized
ttacaatctctccttcttaa

SEQ ID NO: 54362 - DNA, 20 bp, Artificial Sequence
  chemically synthesized
atctctccttcttaaaagcc

SEQ ID NO: 54363 - DNA, 20 bp, Artificial Sequence
  chemically synthesized
aaagcctagaacaatgccat

SEQ ID NO: 54364 - DNA, 20 bp, Artificial Sequence
  chemically synthesized
aatgaccttatttacaccta

SEQ ID NO: 54365 - DNA, 20 bp, Artificial Sequence
  chemically synthesized
accttatttacacctaaaga

SEQ ID NO: 54366 - DNA, 20 bp, Artificial Sequence
  chemically synthesized
aaagacaaaaaaaaaacttt

SEQ ID NO: 54367 - DNA, 20 bp, Artificial Sequence
  chemically synthesized
aaaaaaactttgagaaatct

SEQ ID NO: 54368 - DNA, 20 bp, Artificial Sequence
  chemically synthesized
aaaaaactttgagaaatctg

SEQ ID NO: 54369 - DNA, 20 bp, Artificial Sequence
  chemically synthesized
acttgaaatctactcatgct

SEQ ID NO: 54370 - DNA, 20 bp, Artificial Sequence
  chemically synthesized
actcatgcttggcttatgct

SEQ ID NO: 54371 - DNA, 20 bp, Artificial Sequence
  chemically synthesized
agctttttctgtgattttta

SEQ ID NO: 54372 - DNA, 20 bp, Artificial Sequence
  chemically synthesized
tttatacatgtattaacact

SEQ ID NO: 54373 - DNA, 20 bp, Artificial Sequence
  chemically synthesized
aatttatctacatttatatg

SEQ ID NO: 54374 - DNA, 20 bp, Artificial Sequence
  chemically synthesized
acacacacgtttgtgcacca

SEQ ID NO: 54375 - DNA, 20 bp, Artificial Sequence
  chemically synthesized
acgtttgtgcaccaaagaat

SEQ ID NO: 54376 - DNA, 20 bp, Artificial Sequence
  chemically synthesized
ttgtgcaccaaagaataaga

SEQ ID NO: 54377 - DNA, 20 bp, Artificial Sequence
  chemically synthesized
gcaccaaagaataagaaagt

SEQ ID NO: 54378 - DNA, 20 bp, Artificial Sequence
  chemically synthesized
aagaataagaaagttagaaa

SEQ ID NO: 54379 - DNA, 20 bp, Artificial Sequence
  chemically synthesized
agttagaaatagacttccta

SEQ ID NO: 54380 - DNA, 20 bp, Artificial Sequence
  chemically synthesized
tcctacagtatttccattat

SEQ ID NO: 54381 - DNA, 20 bp, Artificial Sequence
  chemically synthesized
cctacagtatttccattatt

SEQ ID NO: 54382 - DNA, 20 bp, Artificial Sequence
  chemically synthesized
acagtatttccattattggg

SEQ ID NO: 54383 - DNA, 20 bp, Artificial Sequence
  chemically synthesized
cagtatttccattattggga

SEQ ID NO: 54384 - DNA, 20 bp, Artificial Sequence
  chemically synthesized
agtatttccattattgggaa

SEQ ID NO: 54385 - DNA, 20 bp, Artificial Sequence
  chemically synthesized
tatttccattattgggaagg

SEQ ID NO: 54386 - DNA, 20 bp, Artificial Sequence
  chemically synthesized
tctaattaatttgtttctgc

SEQ ID NO: 54387 - DNA, 20 bp, Artificial Sequence
  chemically synthesized
tagtactacactaaatattt

SEQ ID NO: 54388 - DNA, 20 bp, Artificial Sequence
  chemically synthesized
ttcaaaatatttgcatttct

SEQ ID NO: 54389 - DNA, 20 bp, Artificial Sequence
  chemically synthesized
tacatctgttaaacttcata

SEQ ID NO: 54390 - DNA, 20 bp, Artificial Sequence
  chemically synthesized
ttctactctacacaatgttt

SEQ ID NO: 54391 - DNA, 20 bp, Artificial Sequence
  chemically synthesized
tctaatgtgaaatttacact

SEQ ID NO: 54392 - DNA, 20 bp, Artificial Sequence
  chemically synthesized
agcgttgcatttctccataa

SEQ ID NO: 54393 - DNA, 20 bp, Artificial Sequence
  chemically synthesized
ccataaaagtaataatatga

SEQ ID NO: 54394 - DNA, 20 bp, Artificial Sequence
  chemically synthesized
gtaataatatgatggaaaat

SEQ ID NO: 54395 - DNA, 20 bp, Artificial Sequence
  chemically synthesized
taataatatgatggaaaatg

SEQ ID NO: 54396 - DNA, 20 bp, Artificial Sequence
  chemically synthesized
aataatatgatggaaaatga

SEQ ID NO: 54397 - DNA, 20 bp, Artificial Sequence
  chemically synthesized
tatgatggaaaatgagggaa

SEQ ID NO: 54398 - DNA, 20 bp, Artificial Sequence
  chemically synthesized
atggaaaatgagggaataga

SEQ ID NO: 54399 - DNA, 20 bp, Artificial Sequence
  chemically synthesized
atgagggaatagatagattg

SEQ ID NO: 54400 - DNA, 20 bp, Artificial Sequence
  chemically synthesized
gatagattgcagtatgatga

SEQ ID NO: 54401 - DNA, 20 bp, Artificial Sequence
  chemically synthesized
tagattgcagtatgatgaca

SEQ ID NO: 54402 - DNA, 20 bp, Artificial Sequence
  chemically synthesized
agattgcagtatgatgacag

SEQ ID NO: 54403 - DNA, 20 bp, Artificial Sequence
  chemically synthesized
atgacagaggatttgactga

SEQ ID NO: 54404 - DNA, 20 bp, Artificial Sequence
  chemically synthesized
tgacagaggatttgactgaa

SEQ ID NO: 54405 - DNA, 20 bp, Artificial Sequence
  chemically synthesized
cagaggatttgactgaaagg

SEQ ID NO: 54406 - DNA, 20 bp, Artificial Sequence
  chemically synthesized
agaggatttgactgaaaggt

SEQ ID NO: 54407 - DNA, 20 bp, Artificial Sequence
  chemically synthesized
ggatttgactgaaaggtagg

SEQ ID NO: 54408 - DNA, 20 bp, Artificial Sequence
  chemically synthesized
agattttgtatacttgattt

SEQ ID NO: 54409 - DNA, 20 bp, Artificial Sequence
  chemically synthesized
ttttgtatacttgattttag

SEQ ID NO: 54410 - DNA, 20 bp, Artificial Sequence
  chemically synthesized
tgtatacttgattttagcag

SEQ ID NO: 54411 - DNA, 20 bp, Artificial Sequence
  chemically synthesized
gtatacttgattttagcagt

SEQ ID NO: 54412 - DNA, 20 bp, Artificial Sequence
  chemically synthesized
tatacttgattttagcagtg

SEQ ID NO: 54413 - DNA, 20 bp, Artificial Sequence
  chemically synthesized
tacttgattttagcagtggg

SEQ ID NO: 54414 - DNA, 20 bp, Artificial Sequence
  chemically synthesized
gattttagcagtggggagct

SEQ ID NO: 54415 - DNA, 20 bp, Artificial Sequence
  chemically synthesized
atgcaacatgatatcttaaa

SEQ ID NO: 54416 - DNA, 20 bp, Artificial Sequence
  chemically synthesized
tgcaacatgatatcttaaat

SEQ ID NO: 54417 - DNA, 20 bp, Artificial Sequence
  chemically synthesized
tataatcatatatacatata

SEQ ID NO: 54418 - DNA, 20 bp, Artificial Sequence
  chemically synthesized
tatatacatatatagctaca

SEQ ID NO: 54419 - DNA, 20 bp, Artificial Sequence
  chemically synthesized
acatatacatgtcattttga

SEQ ID NO: 54420 - DNA, 20 bp, Artificial Sequence
  chemically synthesized
tgtcattttgacagttaaaa

SEQ ID NO: 54421 - DNA, 20 bp, Artificial Sequence
  chemically synthesized
cattttgacagttaaaatgg

SEQ ID NO: 54422 - DNA, 20 bp, Artificial Sequence
  chemically synthesized
tttgacagttaaaatggtag

SEQ ID NO: 54423 - DNA, 20 bp, Artificial Sequence
  chemically synthesized
acaatctctaaataaacttt

SEQ ID NO: 54424 - DNA, 20 bp, Artificial Sequence
  chemically synthesized
ctctaaataaactttcagtt

SEQ ID NO: 54425 - DNA, 20 bp, Artificial Sequence
  chemically synthesized
taaactttcagttgagcact

SEQ ID NO: 54426 - DNA, 20 bp, Artificial Sequence
  chemically synthesized
gttgagcactcagattctga

SEQ ID NO: 54427 - DNA, 20 bp, Artificial Sequence
  chemically synthesized
ttgagcactcagattctgaa

SEQ ID NO: 54428 - DNA, 20 bp, Artificial Sequence
  chemically synthesized
actcagattctgaaaggatt

SEQ ID NO: 54429 - DNA, 20 bp, Artificial Sequence
  chemically synthesized
ctcagattctgaaaggattt

SEQ ID NO: 54430 - DNA, 20 bp, Artificial Sequence
  chemically synthesized
ttctgaaaggatttaggaaa

SEQ ID NO: 54431 - DNA, 20 bp, Artificial Sequence
  chemically synthesized
aggaaatggctgttgctatg

SEQ ID NO: 54432 - DNA, 20 bp, Artificial Sequence
  chemically synthesized
ctgctgaatttaacattact

SEQ ID NO: 54433 - DNA, 20 bp, Artificial Sequence
  chemically synthesized
acattactgagccattgccc

SEQ ID NO: 54434 - DNA, 20 bp, Artificial Sequence
  chemically synthesized
tgagccattgccctggacat

SEQ ID NO: 54435 - DNA, 20 bp, Artificial Sequence
  chemically synthesized
gccattgccctggacatgag

SEQ ID NO: 54436 - DNA, 20 bp, Artificial Sequence
  chemically synthesized
attgccctggacatgagaag

SEQ ID NO: 54437 - DNA, 20 bp, Artificial Sequence
  chemically synthesized
tgttctactgtctccttaac

SEQ ID NO: 54438 - DNA, 20 bp, Artificial Sequence
  chemically synthesized
ctccttaaccagtaatcctt

SEQ ID NO: 54439 - DNA, 20 bp, Artificial Sequence
  chemically synthesized
cttaaccagtaatccttcag

SEQ ID NO: 54440 - DNA, 20 bp, Artificial Sequence
  chemically synthesized
ttaaccagtaatccttcagc

SEQ ID NO: 54441 - DNA, 20 bp, Artificial Sequence
  chemically synthesized
accagtaatccttcagcagg

SEQ ID NO: 54442 - DNA, 20 bp, Artificial Sequence
  chemically synthesized
ccagtaatccttcagcagga

SEQ ID NO: 54443 - DNA, 20 bp, Artificial Sequence
  chemically synthesized
cagtaatccttcagcaggaa

SEQ ID NO: 54444 - DNA, 20 bp, Artificial Sequence
  chemically synthesized
aatccttcagcaggaaggga

SEQ ID NO: 54445 - DNA, 20 bp, Artificial Sequence
  chemically synthesized
atccttcagcaggaagggaa

SEQ ID NO: 54446 - DNA, 20 bp, Artificial Sequence
  chemically synthesized
tccttcagcaggaagggaaa

SEQ ID NO: 54447 - DNA, 20 bp, Artificial Sequence
  chemically synthesized
tcagcaggaagggaaaggga

SEQ ID NO: 54448 - DNA, 20 bp, Artificial Sequence
  chemically synthesized
cagcaggaagggaaagggaa

SEQ ID NO: 54449 - DNA, 20 bp, Artificial Sequence
  chemically synthesized
agcaggaagggaaagggaaa

SEQ ID NO: 54450 - DNA, 20 bp, Artificial Sequence
  chemically synthesized
ggaagggaaagggaaaggga

SEQ ID NO: 54451 - DNA, 20 bp, Artificial Sequence
  chemically synthesized
gaagggaaagggaaagggaa

SEQ ID NO: 54452 - DNA, 20 bp, Artificial Sequence
  chemically synthesized
aagggaaagggaaagggaaa

SEQ ID NO: 54453 - DNA, 20 bp, Artificial Sequence
  chemically synthesized
gaaagggaaagggaaaggga

SEQ ID NO: 54454 - DNA, 20 bp, Artificial Sequence
  chemically synthesized
aaagggaaagggaaagggaa

SEQ ID NO: 54455 - DNA, 20 bp, Artificial Sequence
  chemically synthesized
aagggaaagggaaagggaaa

SEQ ID NO: 54456 - DNA, 20 bp, Artificial Sequence
  chemically synthesized
gaaagggaaagggaaaggga

SEQ ID NO: 54457 - DNA, 20 bp, Artificial Sequence
  chemically synthesized
aaagggaaagggaaagggaa

SEQ ID NO: 54458 - DNA, 20 bp, Artificial Sequence
  chemically synthesized
aagggaaagggaaagggaaa

SEQ ID NO: 54459 - DNA, 20 bp, Artificial Sequence
  chemically synthesized
gaaagggaaagggaaaggga

SEQ ID NO: 54460 - DNA, 20 bp, Artificial Sequence
  chemically synthesized
aaagggaaagggaaagggaa

SEQ ID NO: 54461 - DNA, 20 bp, Artificial Sequence
  chemically synthesized
aagggaaagggaaagggaaa

SEQ ID NO: 54462 - DNA, 20 bp, Artificial Sequence
  chemically synthesized
gggaaagggaaagggaaagg

SEQ ID NO: 54463 - DNA, 20 bp, Artificial Sequence
  chemically synthesized
ggaaagggaaagggaaaggg

SEQ ID NO: 54464 - DNA, 20 bp, Artificial Sequence
  chemically synthesized
gaaagggaaagggaaaggga

SEQ ID NO: 54465 - DNA, 20 bp, Artificial Sequence
  chemically synthesized
agggaaagggaaagggaggg

SEQ ID NO: 54466 - DNA, 20 bp, Artificial Sequence
  chemically synthesized
gggaaagggaaagggaggga

SEQ ID NO: 54467 - DNA, 20 bp, Artificial Sequence
  chemically synthesized
ggaaagggaaagggagggaa

SEQ ID NO: 54468 - DNA, 20 bp, Artificial Sequence
  chemically synthesized
agggaaagggagggaaggga

SEQ ID NO: 54469 - DNA, 20 bp, Artificial Sequence
  chemically synthesized
gggaaagggagggaagggaa

SEQ ID NO: 54470 - DNA, 20 bp, Artificial Sequence
  chemically synthesized
aagggagggaagggaaagga

SEQ ID NO: 54471 - DNA, 20 bp, Artificial Sequence
  chemically synthesized
agggagggaagggaaaggaa

SEQ ID NO: 54472 - DNA, 20 bp, Artificial Sequence
  chemically synthesized
gggagggaagggaaaggaaa

SEQ ID NO: 54473 - DNA, 20 bp, Artificial Sequence
  chemically synthesized
agggaagggaaaggaaaggg

SEQ ID NO: 54474 - DNA, 20 bp, Artificial Sequence
  chemically synthesized
gggaagggaaaggaaaggga

SEQ ID NO: 54475 - DNA, 20 bp, Artificial Sequence
  chemically synthesized
ggaagggaaaggaaagggaa

SEQ ID NO: 54476 - DNA, 20 bp, Artificial Sequence
  chemically synthesized
agggaaaggaaagggaaggg

SEQ ID NO: 54477 - DNA, 20 bp, Artificial Sequence
  chemically synthesized
gggaaaggaaagggaaggga

SEQ ID NO: 54478 - DNA, 20 bp, Artificial Sequence
  chemically synthesized
aaggaaagggaagggaagga

SEQ ID NO: 54479 - DNA, 20 bp, Artificial Sequence
  chemically synthesized
aggaaagggaagggaaggaa

SEQ ID NO: 54480 - DNA, 20 bp, Artificial Sequence
  chemically synthesized
aagggaagggaaggaaagga

SEQ ID NO: 54481 - DNA, 20 bp, Artificial Sequence
  chemically synthesized
agggaagggaaggaaaggaa

SEQ ID NO: 54482 - DNA, 20 bp, Artificial Sequence
  chemically synthesized
gggaaggaaaggaaaggaaa

SEQ ID NO: 54483 - DNA, 20 bp, Artificial Sequence
  chemically synthesized
ggaaggaaaggaaaggaaaa

SEQ ID NO: 54484 - DNA, 20 bp, Artificial Sequence
  chemically synthesized
ggaaaggaaaggaaaaagga

SEQ ID NO: 54485 - DNA, 20 bp, Artificial Sequence
  chemically synthesized
gaaaggaaaggaaaaaggaa

SEQ ID NO: 54486 - DNA, 20 bp, Artificial Sequence
  chemically synthesized
ggaaaggaaaaaggaaagga

SEQ ID NO: 54487 - DNA, 20 bp, Artificial Sequence
  chemically synthesized
gaaaggaaaaaggaaaggaa

SEQ ID NO: 54488 - DNA, 20 bp, Artificial Sequence
  chemically synthesized
ggaaaaaggaaaggaaagga

SEQ ID NO: 54489 - DNA, 20 bp, Artificial Sequence
  chemically synthesized
gaaaaaggaaaggaaaggaa

SEQ ID NO: 54490 - DNA, 20 bp, Artificial Sequence
  chemically synthesized
aaggaaaggaaaggaaagga

SEQ ID NO: 54491 - DNA, 20 bp, Artificial Sequence
  chemically synthesized
aggaaaggaaaggaaaggaa

SEQ ID NO: 54492 - DNA, 20 bp, Artificial Sequence
  chemically synthesized
aaggaaaggaaaggaaagga

SEQ ID NO: 54493 - DNA, 20 bp, Artificial Sequence
  chemically synthesized
aggaaaggaaaggaaaggaa

SEQ ID NO: 54494 - DNA, 20 bp, Artificial Sequence
  chemically synthesized
aaggaaaggaaaggaaagga

SEQ ID NO: 54495 - DNA, 20 bp, Artificial Sequence
  chemically synthesized
aggaaaggaaaggaaaggaa

SEQ ID NO: 54496 - DNA, 20 bp, Artificial Sequence
  chemically synthesized
aaggaaaggaaaggaaagga

SEQ ID NO: 54497 - DNA, 20 bp, Artificial Sequence
  chemically synthesized
aggaaaggaaaggaaaggaa

SEQ ID NO: 54498 - DNA, 20 bp, Artificial Sequence
  chemically synthesized
aaggaaaggaaaggaaagga

SEQ ID NO: 54499 - DNA, 20 bp, Artificial Sequence
  chemically synthesized
aggaaaggaaaggaaaggaa

SEQ ID NO: 54500 - DNA, 20 bp, Artificial Sequence
  chemically synthesized
aggaaaggaaaggtccaaaa

SEQ ID NO: 54501 - DNA, 20 bp, Artificial Sequence
  chemically synthesized
ggaaaggaaaggtccaaaaa

SEQ ID NO: 54502 - DNA, 20 bp, Artificial Sequence
  chemically synthesized
gaaaggaaaggtccaaaaaa

SEQ ID NO: 54503 - DNA, 20 bp, Artificial Sequence
  chemically synthesized
aggaaaggtccaaaaaaggg

SEQ ID NO: 54504 - DNA, 20 bp, Artificial Sequence
  chemically synthesized
gcagaaaccaaacaatttta

SEQ ID NO: 54505 - DNA, 20 bp, Artificial Sequence
  chemically synthesized
gaaaccaaacaattttaaag

SEQ ID NO: 54506 - DNA, 20 bp, Artificial Sequence
  chemically synthesized
aaaccaaacaattttaaagc

SEQ ID NO: 54507 - DNA, 20 bp, Artificial Sequence
  chemically synthesized
aaccaaacaattttaaagca

SEQ ID NO: 54508 - DNA, 20 bp, Artificial Sequence
  chemically synthesized
ccaaacaattttaaagcagg

SEQ ID NO: 54509 - DNA, 20 bp, Artificial Sequence
  chemically synthesized
aattttaaagcagggagttt

SEQ ID NO: 54510 - DNA, 20 bp, Artificial Sequence
  chemically synthesized
tttaaagcagggagttttgg

SEQ ID NO: 54511 - DNA, 20 bp, Artificial Sequence
  chemically synthesized
cagggagttttggaagcact

SEQ ID NO: 54512 - DNA, 20 bp, Artificial Sequence
  chemically synthesized
gcacttagctaaaactgata

SEQ ID NO: 54513 - DNA, 20 bp, Artificial Sequence
  chemically synthesized
ctaaaactgatatggtgttc

SEQ ID NO: 54514 - DNA, 20 bp, Artificial Sequence
  chemically synthesized
aactgatatggtgttctaga

SEQ ID NO: 54515 - DNA, 20 bp, Artificial Sequence
  chemically synthesized
tatggtgttctagacagaat

SEQ ID NO: 54516 - DNA, 20 bp, Artificial Sequence
  chemically synthesized
ttagcaaaaacaaaaaacaa

SEQ ID NO: 54517 - DNA, 20 bp, Artificial Sequence
  chemically synthesized
tagcaaaaacaaaaaacaaa

SEQ ID NO: 54518 - DNA, 20 bp, Artificial Sequence
  chemically synthesized
aaaacaaaaaacaaaaggta

SEQ ID NO: 54519 - DNA, 20 bp, Artificial Sequence
  chemically synthesized
aaacaaaaaacaaaaggtac

SEQ ID NO: 54520 - DNA, 20 bp, Artificial Sequence
  chemically synthesized
aacaaaaaacaaaaggtaca

SEQ ID NO: 54521 - DNA, 20 bp, Artificial Sequence
  chemically synthesized
aacaaaaggtacagggtgct

SEQ ID NO: 54522 - DNA, 20 bp, Artificial Sequence
  chemically synthesized
cagggtgctaagtgattgat

SEQ ID NO: 54523 - DNA, 20 bp, Artificial Sequence
  chemically synthesized
agggtgctaagtgattgata

SEQ ID NO: 54524 - DNA, 20 bp, Artificial Sequence
  chemically synthesized
tgctaagtgattgataaggt

SEQ ID NO: 54525 - DNA, 20 bp, Artificial Sequence
  chemically synthesized
agtgattgataaggtgagaa

SEQ ID NO: 54526 - DNA, 20 bp, Artificial Sequence
  chemically synthesized
gtgagaatagtatttcaaat

SEQ ID NO: 54527 - DNA, 20 bp, Artificial Sequence
  chemically synthesized
gaatagtatttcaaatgagc

SEQ ID NO: 54528 - DNA, 20 bp, Artificial Sequence
  chemically synthesized
atagtatttcaaatgagcaa

SEQ ID NO: 54529 - DNA, 20 bp, Artificial Sequence
  chemically synthesized
ttcaaatgagcaagagatcc

SEQ ID NO: 54530 - DNA, 20 bp, Artificial Sequence
  chemically synthesized
atgagcaagagatccaagac

SEQ ID NO: 54531 - DNA, 20 bp, Artificial Sequence
  chemically synthesized
atccaagaccagtaccacta

SEQ ID NO: 54532 - DNA, 20 bp, Artificial Sequence
  chemically synthesized
cagactattgttttataact

SEQ ID NO: 54533 - DNA, 20 bp, Artificial Sequence
  chemically synthesized
agactattgttttataactg

SEQ ID NO: 54534 - DNA, 20 bp, Artificial Sequence
  chemically synthesized
ttgttttataactgaggtct

SEQ ID NO: 54535 - DNA, 20 bp, Artificial Sequence
  chemically synthesized
ggtcttagttaatatcaatc

SEQ ID NO: 54536 - DNA, 20 bp, Artificial Sequence
  chemically synthesized
atcaagcaaaattttgattt

SEQ ID NO: 54537 - DNA, 20 bp, Artificial Sequence
  chemically synthesized
tcaagcaaaattttgatttc

SEQ ID NO: 54538 - DNA, 20 bp, Artificial Sequence
  chemically synthesized
caagcaaaattttgatttcg

SEQ ID NO: 54539 - DNA, 20 bp, Artificial Sequence
  chemically synthesized
aagcaaaattttgatttcgg

SEQ ID NO: 54540 - DNA, 20 bp, Artificial Sequence
  chemically synthesized
agcaaaattttgatttcggg

SEQ ID NO: 54541 - DNA, 20 bp, Artificial Sequence
  chemically synthesized
caaaattttgatttcggggg

SEQ ID NO: 54542 - DNA, 20 bp, Artificial Sequence
  chemically synthesized
ttgatttcggggggagaaaa

SEQ ID NO: 54543 - DNA, 20 bp, Artificial Sequence
  chemically synthesized
aaaaagaccaaattgtaatc

SEQ ID NO: 54544 - DNA, 20 bp, Artificial Sequence
  chemically synthesized
aaaagaccaaattgtaatct

SEQ ID NO: 54545 - DNA, 20 bp, Artificial Sequence
  chemically synthesized
aaagaccaaattgtaatctg

SEQ ID NO: 54546 - DNA, 20 bp, Artificial Sequence
  chemically synthesized
tgtatatgatatgatcattt

SEQ ID NO: 54547 - DNA, 20 bp, Artificial Sequence
  chemically synthesized
tgatatgatcatttaagtat

SEQ ID NO: 54548 - DNA, 20 bp, Artificial Sequence
  chemically synthesized
tttaagtataagtcacctga

SEQ ID NO: 54549 - DNA, 20 bp, Artificial Sequence
  chemically synthesized
ataagtcacctgaaagtaaa

SEQ ID NO: 54550 - DNA, 20 bp, Artificial Sequence
  chemically synthesized
aagtcacctgaaagtaaaaa

SEQ ID NO: 54551 - DNA, 20 bp, Artificial Sequence
  chemically synthesized
gaaagtaaaaagagttatat

SEQ ID NO: 54552 - DNA, 20 bp, Artificial Sequence
  chemically synthesized
aaagtaaaaagagttatata

SEQ ID NO: 54553 - DNA, 20 bp, Artificial Sequence
  chemically synthesized
ataatgttttatgcaactgc

SEQ ID NO: 54554 - DNA, 20 bp, Artificial Sequence
  chemically synthesized
tatgcaactgcaagaaccaa

SEQ ID NO: 54555 - DNA, 20 bp, Artificial Sequence
  chemically synthesized
atgcaactgcaagaaccaat

SEQ ID NO: 54556 - DNA, 20 bp, Artificial Sequence
  chemically synthesized
tgcaagaaccaataggaaaa

SEQ ID NO: 54557 - DNA, 20 bp, Artificial Sequence
  chemically synthesized
gaaccaataggaaaatagaa

SEQ ID NO: 54558 - DNA, 20 bp, Artificial Sequence
  chemically synthesized
aaccaataggaaaatagaat

SEQ ID NO: 54559 - DNA, 20 bp, Artificial Sequence
  chemically synthesized
tgtcacattcaaaatgatga

SEQ ID NO: 54560 - DNA, 20 bp, Artificial Sequence
  chemically synthesized
tcacattcaaaatgatgata

SEQ ID NO: 54561 - DNA, 20 bp, Artificial Sequence
  chemically synthesized
cacattcaaaatgatgatag

SEQ ID NO: 54562 - DNA, 20 bp, Artificial Sequence
  chemically synthesized
ttcaaaatgatgatagaggc

SEQ ID NO: 54563 - DNA, 20 bp, Artificial Sequence
  chemically synthesized
atgatgatagaggccagacg

SEQ ID NO: 54564 - DNA, 20 bp, Artificial Sequence
  chemically synthesized
atgatagaggccagacgtgg

SEQ ID NO: 54565 - DNA, 20 bp, Artificial Sequence
  chemically synthesized
gtggcgcacacctgtaatcc

SEQ ID NO: 54566 - DNA, 20 bp, Artificial Sequence
  chemically synthesized
cacctgtaatcccagctaca

SEQ ID NO: 54567 - DNA, 20 bp, Artificial Sequence
  chemically synthesized
acctgtaatcccagctacat

SEQ ID NO: 54568 - DNA, 20 bp, Artificial Sequence
  chemically synthesized
ctgtaatcccagctacatgg

SEQ ID NO: 54569 - DNA, 20 bp, Artificial Sequence
  chemically synthesized
tgtaatcccagctacatggg

SEQ ID NO: 54570 - DNA, 20 bp, Artificial Sequence
  chemically synthesized
tcccagctacatgggaggct

SEQ ID NO: 54571 - DNA, 20 bp, Artificial Sequence
  chemically synthesized
cccagctacatgggaggctg

SEQ ID NO: 54572 - DNA, 20 bp, Artificial Sequence
  chemically synthesized
agctacatgggaggctgagg

SEQ ID NO: 54573 - DNA, 20 bp, Artificial Sequence
  chemically synthesized
gctacatgggaggctgaggc

SEQ ID NO: 54574 - DNA, 20 bp, Artificial Sequence
  chemically synthesized
tacatgggaggctgaggcag

SEQ ID NO: 54575 - DNA, 20 bp, Artificial Sequence
  chemically synthesized
caggagaatgatttgaattc

SEQ ID NO: 54576 - DNA, 20 bp, Artificial Sequence
  chemically synthesized
ggagaatgatttgaattctg

SEQ ID NO: 54577 - DNA, 20 bp, Artificial Sequence
  chemically synthesized
gagaatgatttgaattctgg

SEQ ID NO: 54578 - DNA, 20 bp, Artificial Sequence
  chemically synthesized
aatgatttgaattctggagg

SEQ ID NO: 54579 - DNA, 20 bp, Artificial Sequence
  chemically synthesized
tgatttgaattctggaggcg

SEQ ID NO: 54580 - DNA, 20 bp, Artificial Sequence
  chemically synthesized
gatttgaattctggaggcgg

SEQ ID NO: 54581 - DNA, 20 bp, Artificial Sequence
  chemically synthesized
aattctggaggcggaggttg

SEQ ID NO: 54582 - DNA, 20 bp, Artificial Sequence
  chemically synthesized
ctggaggcggaggttgcagt

SEQ ID NO: 54583 - DNA, 20 bp, Artificial Sequence
  chemically synthesized
ggcggaggttgcagtgagcc

SEQ ID NO: 54584 - DNA, 20 bp, Artificial Sequence
  chemically synthesized
gagatcgcgtcacctcactc

SEQ ID NO: 54585 - DNA, 20 bp, Artificial Sequence
  chemically synthesized
cgcgtcacctcactctagcc

SEQ ID NO: 54586 - DNA, 20 bp, Artificial Sequence
  chemically synthesized
cctcactctagcctggacca

SEQ ID NO: 54587 - DNA, 20 bp, Artificial Sequence
  chemically synthesized
tcactctagcctggaccaca

SEQ ID NO: 54588 - DNA, 20 bp, Artificial Sequence
  chemically synthesized
actctagcctggaccacaga

SEQ ID NO: 54589 - DNA, 20 bp, Artificial Sequence
  chemically synthesized
tctagcctggaccacagaga

SEQ ID NO: 54590 - DNA, 20 bp, Artificial Sequence
  chemically synthesized
atacgtaaaacaaaaacaaa

SEQ ID NO: 54591 - DNA, 20 bp, Artificial Sequence
  chemically synthesized
aataaaacccaaaatgataa

SEQ ID NO: 54592 - DNA, 20 bp, Artificial Sequence
  chemically synthesized
gtttattgtaacaattctct

SEQ ID NO: 54593 - DNA, 20 bp, Artificial Sequence
  chemically synthesized
tttccatttttattgtgata

SEQ ID NO: 54594 - DNA, 20 bp, Artificial Sequence
  chemically synthesized
accgtatatcatatataata

SEQ ID NO: 54595 - DNA, 20 bp, Artificial Sequence
  chemically synthesized
tcaccatattaaccattttt

SEQ ID NO: 54596 - DNA, 20 bp, Artificial Sequence
  chemically synthesized
catttttaagtataattatg

SEQ ID NO: 54597 - DNA, 20 bp, Artificial Sequence
  chemically synthesized
ccaaaactttttcatcatcc

SEQ ID NO: 54598 - DNA, 20 bp, Artificial Sequence
  chemically synthesized
aaactttttcatcatccaag

SEQ ID NO: 54599 - DNA, 20 bp, Artificial Sequence
  chemically synthesized
agcagaaatgctatacttgt

SEQ ID NO: 54600 - DNA, 20 bp, Artificial Sequence
  chemically synthesized
gcagaaatgctatacttgtt

SEQ ID NO: 54601 - DNA, 20 bp, Artificial Sequence
  chemically synthesized
gaaatgctatacttgttagg

SEQ ID NO: 54602 - DNA, 20 bp, Artificial Sequence
  chemically synthesized
cttgttaggcagtaactccc

SEQ ID NO: 54603 - DNA, 20 bp, Artificial Sequence
  chemically synthesized
gcagtaactccccagtccca

SEQ ID NO: 54604 - DNA, 20 bp, Artificial Sequence
  chemically synthesized
tactatatgtttctctaaat

SEQ ID NO: 54605 - DNA, 20 bp, Artificial Sequence
  chemically synthesized
ttctctaaatcagtctattt

SEQ ID NO: 54606 - DNA, 20 bp, Artificial Sequence
  chemically synthesized
ttttagataattcatataaa

SEQ ID NO: 54607 - DNA, 20 bp, Artificial Sequence
  chemically synthesized
aatatttgttgttttgtgtc

SEQ ID NO: 54608 - DNA, 20 bp, Artificial Sequence
  chemically synthesized
tggcttattttacccaacat

SEQ ID NO: 54609 - DNA, 20 bp, Artificial Sequence
  chemically synthesized
ggcttattttacccaacata

SEQ ID NO: 54610 - DNA, 20 bp, Artificial Sequence
  chemically synthesized
ttacccaacataaggtttca

SEQ ID NO: 54611 - DNA, 20 bp, Artificial Sequence
  chemically synthesized
catccatgccataacatgta

SEQ ID NO: 54612 - DNA, 20 bp, Artificial Sequence
  chemically synthesized
ccatgccataacatgtatag

SEQ ID NO: 54613 - DNA, 20 bp, Artificial Sequence
  chemically synthesized
gccataacatgtatagtggt

SEQ ID NO: 54614 - DNA, 20 bp, Artificial Sequence
  chemically synthesized
tgcttaatgttgtccattca

SEQ ID NO: 54615 - DNA, 20 bp, Artificial Sequence
  chemically synthesized
gttgtccattcatagattct

SEQ ID NO: 54616 - DNA, 20 bp, Artificial Sequence
  chemically synthesized
ttcttggaaactgaaacttt

SEQ ID NO: 54617 - DNA, 20 bp, Artificial Sequence
  chemically synthesized
ggaaactgaaactttaagcc

SEQ ID NO: 54618 - DNA, 20 bp, Artificial Sequence
  chemically synthesized
ccattttttttctcatctaa

SEQ ID NO: 54619 - DNA, 20 bp, Artificial Sequence
  chemically synthesized
tttttctcatctaacagtgt

SEQ ID NO: 54620 - DNA, 20 bp, Artificial Sequence
  chemically synthesized
tctaacagtgttggctaaaa

SEQ ID NO: 54621 - DNA, 20 bp, Artificial Sequence
  chemically synthesized
tggctaaaacagtgttattt

SEQ ID NO: 54622 - DNA, 20 bp, Artificial Sequence
  chemically synthesized
ggctaaaacagtgttatttg

SEQ ID NO: 54623 - DNA, 20 bp, Artificial Sequence
  chemically synthesized
gttttacatcatttcactta

SEQ ID NO: 54624 - DNA, 20 bp, Artificial Sequence
  chemically synthesized
acctattcatgacattaaat

SEQ ID NO: 54625 - DNA, 20 bp, Artificial Sequence
  chemically synthesized
cctattcatgacattaaata

SEQ ID NO: 54626 - DNA, 20 bp, Artificial Sequence
  chemically synthesized
tcatctgtttatgtacattc

SEQ ID NO: 54627 - DNA, 20 bp, Artificial Sequence
  chemically synthesized
ttctggttgtttccaccttt

SEQ ID NO: 54628 - DNA, 20 bp, Artificial Sequence
  chemically synthesized
taatgctacaatgaacattt

SEQ ID NO: 54629 - DNA, 20 bp, Artificial Sequence
  chemically synthesized
tacaatgaacatttcagtac

SEQ ID NO: 54630 - DNA, 20 bp, Artificial Sequence
  chemically synthesized
atatatttttaatatatacc

SEQ ID NO: 54631 - DNA, 20 bp, Artificial Sequence
  chemically synthesized
tatatttttaatatatacct

SEQ ID NO: 54632 - DNA, 20 bp, Artificial Sequence
  chemically synthesized
tatttttaatatatacctag

SEQ ID NO: 54633 - DNA, 20 bp, Artificial Sequence
  chemically synthesized
tttttaatatatacctagga

SEQ ID NO: 54634 - DNA, 20 bp, Artificial Sequence
  chemically synthesized
ttttaatatatacctaggag

SEQ ID NO: 54635 - DNA, 20 bp, Artificial Sequence
  chemically synthesized
tatacctaggagaggaattt

SEQ ID NO: 54636 - DNA, 20 bp, Artificial Sequence
  chemically synthesized
atacctaggagaggaatttt

SEQ ID NO: 54637 - DNA, 20 bp, Artificial Sequence
  chemically synthesized
tacctaggagaggaattttg

SEQ ID NO: 54638 - DNA, 20 bp, Artificial Sequence
  chemically synthesized
ttttggggtcatatgttatt

SEQ ID NO: 54639 - DNA, 20 bp, Artificial Sequence
  chemically synthesized
tcatatgttattcagtgcct

SEQ ID NO: 54640 - DNA, 20 bp, Artificial Sequence
  chemically synthesized
attcagtgcctaagtttttg

SEQ ID NO: 54641 - DNA, 20 bp, Artificial Sequence
  chemically synthesized
aactgtcaaaatattttcta

SEQ ID NO: 54642 - DNA, 20 bp, Artificial Sequence
  chemically synthesized
tgtcaaaatattttctacag

SEQ ID NO: 54643 - DNA, 20 bp, Artificial Sequence
  chemically synthesized
gttgcaccacttaacatttt

SEQ ID NO: 54644 - DNA, 20 bp, Artificial Sequence
  chemically synthesized
gcaccacttaacatttttag

SEQ ID NO: 54645 - DNA, 20 bp, Artificial Sequence
  chemically synthesized
catttttagcagcaatatat

SEQ ID NO: 54646 - DNA, 20 bp, Artificial Sequence
  chemically synthesized
atttttagcagcaatatatg

SEQ ID NO: 54647 - DNA, 20 bp, Artificial Sequence
  chemically synthesized
catttgttttgtttctctta

SEQ ID NO: 54648 - DNA, 20 bp, Artificial Sequence
  chemically synthesized
gttttgtttctcttaaagta

SEQ ID NO: 54649 - DNA, 20 bp, Artificial Sequence
  chemically synthesized
ctcttaaagtatagacattc

SEQ ID NO: 54650 - DNA, 20 bp, Artificial Sequence
  chemically synthesized
taaagtatagacattctagt

SEQ ID NO: 54651 - DNA, 20 bp, Artificial Sequence
  chemically synthesized
tagacattctagtaagtttg

SEQ ID NO: 54652 - DNA, 20 bp, Artificial Sequence
  chemically synthesized
acattctagtaagtttgaag

SEQ ID NO: 54653 - DNA, 20 bp, Artificial Sequence
  chemically synthesized
tttgaagtagtgtcttattg

SEQ ID NO: 54654 - DNA, 20 bp, Artificial Sequence
  chemically synthesized
gtagtgtcttattgtggttt

SEQ ID NO: 54655 - DNA, 20 bp, Artificial Sequence
  chemically synthesized
tcatttgtatatcttctttc

SEQ ID NO: 54656 - DNA, 20 bp, Artificial Sequence
  chemically synthesized
catttgcatatttttaaatt

SEQ ID NO: 54657 - DNA, 20 bp, Artificial Sequence
  chemically synthesized
ttgtttgtctttttgttttt

SEQ ID NO: 54658 - DNA, 20 bp, Artificial Sequence
  chemically synthesized
gtctttttgtttttgagttg

SEQ ID NO: 54659 - DNA, 20 bp, Artificial Sequence
  chemically synthesized
tctttttgtttttgagttgt

SEQ ID NO: 54660 - DNA, 20 bp, Artificial Sequence
  chemically synthesized
taggactttttcatacattc

SEQ ID NO: 54661 - DNA, 20 bp, Artificial Sequence
  chemically synthesized
tatgaaatacataatttgca

SEQ ID NO: 54662 - DNA, 20 bp, Artificial Sequence
  chemically synthesized
aaagatgttctctcatctta

SEQ ID NO: 54663 - DNA, 20 bp, Artificial Sequence
  chemically synthesized
aagatgttctctcatcttat

SEQ ID NO: 54664 - DNA, 20 bp, Artificial Sequence
  chemically synthesized
gttgtctttttactttctta

SEQ ID NO: 54665 - DNA, 20 bp, Artificial Sequence
  chemically synthesized
atactttttgtgtcatatct

SEQ ID NO: 54666 - DNA, 20 bp, Artificial Sequence
  chemically synthesized
aagaatctattgtaaaatca

SEQ ID NO: 54667 - DNA, 20 bp, Artificial Sequence
  chemically synthesized
ttgtaaaatcaaagttcatg

SEQ ID NO: 54668 - DNA, 20 bp, Artificial Sequence
  chemically synthesized
atttacccatgcttccttcc

SEQ ID NO: 54669 - DNA, 20 bp, Artificial Sequence
  chemically synthesized
tttacccatgcttccttccg

SEQ ID NO: 54670 - DNA, 20 bp, Artificial Sequence
  chemically synthesized
ttacccatgcttccttccga

SEQ ID NO: 54671 - DNA, 20 bp, Artificial Sequence
  chemically synthesized
gcttccttccgagggtgtta

SEQ ID NO: 54672 - DNA, 20 bp, Artificial Sequence
  chemically synthesized
ttccgagggtgttatggctt

SEQ ID NO: 54673 - DNA, 20 bp, Artificial Sequence
  chemically synthesized
gttatggctttagttcaatt

SEQ ID NO: 54674 - DNA, 20 bp, Artificial Sequence
  chemically synthesized
ttatggctttagttcaattt

SEQ ID NO: 54675 - DNA, 20 bp, Artificial Sequence
  chemically synthesized
tacacaatttttatgcatgc

SEQ ID NO: 54676 - DNA, 20 bp, Artificial Sequence
  chemically synthesized
ggcttttaatccttatttga

SEQ ID NO: 54677 - DNA, 20 bp, Artificial Sequence
  chemically synthesized
tccttatttgaaagaataca

SEQ ID NO: 54678 - DNA, 20 bp, Artificial Sequence
  chemically synthesized
tatttgaaagaatacaaagt

SEQ ID NO: 54679 - DNA, 20 bp, Artificial Sequence
  chemically synthesized
ttagcatgacaacaaaaata

SEQ ID NO: 54680 - DNA, 20 bp, Artificial Sequence
  chemically synthesized
agcttgaccaattgaatatg

SEQ ID NO: 54681 - DNA, 20 bp, Artificial Sequence
  chemically synthesized
tatgaagttgtatataaaaa

SEQ ID NO: 54682 - DNA, 20 bp, Artificial Sequence
  chemically synthesized
gttgtatataaaaacagaat

SEQ ID NO: 54683 - DNA, 20 bp, Artificial Sequence
  chemically synthesized
atataaaaacagaataagaa

SEQ ID NO: 54684 - DNA, 20 bp, Artificial Sequence
  chemically synthesized
taaaaacagaataagaacgg

SEQ ID NO: 54685 - DNA, 20 bp, Artificial Sequence
  chemically synthesized
agaacggcagtatgtgcatg

SEQ ID NO: 54686 - DNA, 20 bp, Artificial Sequence
  chemically synthesized
cagtatgtgcatgtggcaaa

SEQ ID NO: 54687 - DNA, 20 bp, Artificial Sequence
  chemically synthesized
agtatgtgcatgtggcaaaa

SEQ ID NO: 54688 - DNA, 20 bp, Artificial Sequence
  chemically synthesized
tgcatgtggcaaaaaggaca

SEQ ID NO: 54689 - DNA, 20 bp, Artificial Sequence
  chemically synthesized
aaaggacacagatcaaacaa

SEQ ID NO: 54690 - DNA, 20 bp, Artificial Sequence
  chemically synthesized
acagatcaaacaacagaaaa

SEQ ID NO: 54691 - DNA, 20 bp, Artificial Sequence
  chemically synthesized
tcaaacaacagaaaacagtc

SEQ ID NO: 54692 - DNA, 20 bp, Artificial Sequence
  chemically synthesized
aacagaaaacagtctagaat

SEQ ID NO: 54693 - DNA, 20 bp, Artificial Sequence
  chemically synthesized
atgtaatccctcatcatgct

SEQ ID NO: 54694 - DNA, 20 bp, Artificial Sequence
  chemically synthesized
gtaatccctcatcatgcttg

SEQ ID NO: 54695 - DNA, 20 bp, Artificial Sequence
  chemically synthesized
ccaacccttgatcttatact

SEQ ID NO: 54696 - DNA, 20 bp, Artificial Sequence
  chemically synthesized
cttgatcttatacttggtat

SEQ ID NO: 54697 - DNA, 20 bp, Artificial Sequence
  chemically synthesized
gaaaaattgtttatatgttt

SEQ ID NO: 54698 - DNA, 20 bp, Artificial Sequence
  chemically synthesized
ttatatgtttgagaatactt

SEQ ID NO: 54699 - DNA, 20 bp, Artificial Sequence
  chemically synthesized
aagtaaaattctaattaccc

SEQ ID NO: 54700 - DNA, 20 bp, Artificial Sequence
  chemically synthesized
caagtcccccaaacaaattt

SEQ ID NO: 54701 - DNA, 20 bp, Artificial Sequence
  chemically synthesized
aagtcccccaaacaaatttc

SEQ ID NO: 54702 - DNA, 20 bp, Artificial Sequence
  chemically synthesized
tcccccaaacaaatttcagg

SEQ ID NO: 54703 - DNA, 20 bp, Artificial Sequence
  chemically synthesized
aacaaatttcaggtggaatc

SEQ ID NO: 54704 - DNA, 20 bp, Artificial Sequence
  chemically synthesized
tacaccactatccctatctg

SEQ ID NO: 54705 - DNA, 20 bp, Artificial Sequence
  chemically synthesized
cctatctgcagttccgtctc

SEQ ID NO: 54706 - DNA, 20 bp, Artificial Sequence
  chemically synthesized
tgcagttccgtctctagctc

SEQ ID NO: 54707 - DNA, 20 bp, Artificial Sequence
  chemically synthesized
tccactttttactttgtata

SEQ ID NO: 54708 - DNA, 20 bp, Artificial Sequence
  chemically synthesized
tttttactttgtatatggaa

SEQ ID NO: 54709 - DNA, 20 bp, Artificial Sequence
  chemically synthesized
tgtatatggaatagcttctt

SEQ ID NO: 54710 - DNA, 20 bp, Artificial Sequence
  chemically synthesized
aatagcttcttaagaatgaa

SEQ ID NO: 54711 - DNA, 20 bp, Artificial Sequence
  chemically synthesized
atgttaacctgactacataa

SEQ ID NO: 54712 - DNA, 20 bp, Artificial Sequence
  chemically synthesized
tgtgtatgaaaaaattaatg

SEQ ID NO: 54713 - DNA, 20 bp, Artificial Sequence
  chemically synthesized
atgaaaaaattaatgaagat

SEQ ID NO: 54714 - DNA, 20 bp, Artificial Sequence
  chemically synthesized
aaattaatgaagataagatg

SEQ ID NO: 54715 - DNA, 20 bp, Artificial Sequence
  chemically synthesized
aattaatgaagataagatgc

SEQ ID NO: 54716 - DNA, 20 bp, Artificial Sequence
  chemically synthesized
attaatgaagataagatgcg

SEQ ID NO: 54717 - DNA, 20 bp, Artificial Sequence
  chemically synthesized
ttaatgaagataagatgcgg

SEQ ID NO: 54718 - DNA, 20 bp, Artificial Sequence
  chemically synthesized
atgaagataagatgcggggg

SEQ ID NO: 54719 - DNA, 20 bp, Artificial Sequence
  chemically synthesized
aagatgcgggggaagtatat

SEQ ID NO: 54720 - DNA, 20 bp, Artificial Sequence
  chemically synthesized
gtaactattttatgtttatt

SEQ ID NO: 54721 - DNA, 20 bp, Artificial Sequence
  chemically synthesized
taactattttatgtttattt

SEQ ID NO: 54722 - DNA, 20 bp, Artificial Sequence
  chemically synthesized
tttgggttttgcattgacat

SEQ ID NO: 54723 - DNA, 20 bp, Artificial Sequence
  chemically synthesized
gttcttatgtatactctctc

SEQ ID NO: 54724 - DNA, 20 bp, Artificial Sequence
  chemically synthesized
actctctccagcatgcttct

SEQ ID NO: 54725 - DNA, 20 bp, Artificial Sequence
  chemically synthesized
ctctctccagcatgcttctc

SEQ ID NO: 54726 - DNA, 20 bp, Artificial Sequence
  chemically synthesized
ctttctctctaatacacccg

SEQ ID NO: 54727 - DNA, 20 bp, Artificial Sequence
  chemically synthesized
tctaatacacccgaagtttc

SEQ ID NO: 54728 - DNA, 20 bp, Artificial Sequence
  chemically synthesized
ctaatacacccgaagtttct

SEQ ID NO: 54729 - DNA, 20 bp, Artificial Sequence
  chemically synthesized
tttctgggaataattattct

SEQ ID NO: 54730 - DNA, 20 bp, Artificial Sequence
  chemically synthesized
ttcttggttaattgcttctt

SEQ ID NO: 54731 - DNA, 20 bp, Artificial Sequence
  chemically synthesized
tcttggttaattgcttcttg

SEQ ID NO: 54732 - DNA, 20 bp, Artificial Sequence
  chemically synthesized
cttggttaattgcttcttga

SEQ ID NO: 54733 - DNA, 20 bp, Artificial Sequence
  chemically synthesized
cattctgtctctatgtcctc

SEQ ID NO: 54734 - DNA, 20 bp, Artificial Sequence
  chemically synthesized
tctatgtcctccagtcaact

SEQ ID NO: 54735 - DNA, 20 bp, Artificial Sequence
  chemically synthesized
cagtcaactaagcacatata

SEQ ID NO: 54736 - DNA, 20 bp, Artificial Sequence
  chemically synthesized
agtcaactaagcacatatac

SEQ ID NO: 54737 - DNA, 20 bp, Artificial Sequence
  chemically synthesized
gtcaactaagcacatataca

SEQ ID NO: 54738 - DNA, 20 bp, Artificial Sequence
  chemically synthesized
caactaagcacatatacagg

SEQ ID NO: 54739 - DNA, 20 bp, Artificial Sequence
  chemically synthesized
aactaagcacatatacaggg

SEQ ID NO: 54740 - DNA, 20 bp, Artificial Sequence
  chemically synthesized
taagcacatatacagggagg

SEQ ID NO: 54741 - DNA, 20 bp, Artificial Sequence
  chemically synthesized
ggaggtagtaactatgtcca

SEQ ID NO: 54742 - DNA, 20 bp, Artificial Sequence
  chemically synthesized
tagtaactatgtccacagcc

SEQ ID NO: 54743 - DNA, 20 bp, Artificial Sequence
  chemically synthesized
tatgtccacagcccagttga

SEQ ID NO: 54744 - DNA, 20 bp, Artificial Sequence
  chemically synthesized
acagcccagttgaaagtaaa

SEQ ID NO: 54745 - DNA, 20 bp, Artificial Sequence
  chemically synthesized
tgaaagtaaacagtaacaaa

SEQ ID NO: 54746 - DNA, 20 bp, Artificial Sequence
  chemically synthesized
acagtaacaaatagtatgca

SEQ ID NO: 54747 - DNA, 20 bp, Artificial Sequence
  chemically synthesized
atagtatgcatggattgatg

SEQ ID NO: 54748 - DNA, 20 bp, Artificial Sequence
  chemically synthesized
gtatgcatggattgatgtgg

SEQ ID NO: 54749 - DNA, 20 bp, Artificial Sequence
  chemically synthesized
tggattgatgtggtagctct

SEQ ID NO: 54750 - DNA, 20 bp, Artificial Sequence
  chemically synthesized
tggtagctctcagttccacc

SEQ ID NO: 54751 - DNA, 20 bp, Artificial Sequence
  chemically synthesized
ggtagctctcagttccacct

SEQ ID NO: 54752 - DNA, 20 bp, Artificial Sequence
  chemically synthesized
gctctcagttccacctaggt

SEQ ID NO: 54753 - DNA, 20 bp, Artificial Sequence
  chemically synthesized
ttccacctaggtaagtatct

SEQ ID NO: 54754 - DNA, 20 bp, Artificial Sequence
  chemically synthesized
tccacctaggtaagtatctg

SEQ ID NO: 54755 - DNA, 20 bp, Artificial Sequence
  chemically synthesized
ctaggtaagtatctgaggtc

SEQ ID NO: 54756 - DNA, 20 bp, Artificial Sequence
  chemically synthesized
taggtaagtatctgaggtct

SEQ ID NO: 54757 - DNA, 20 bp, Artificial Sequence
  chemically synthesized
ctgaggtctaggatcaacta

SEQ ID NO: 54758 - DNA, 20 bp, Artificial Sequence
  chemically synthesized
tcaactatagttatgcctaa

SEQ ID NO: 54759 - DNA, 20 bp, Artificial Sequence
  chemically synthesized
tgcctaatggtataatgtgc

SEQ ID NO: 54760 - DNA, 20 bp, Artificial Sequence
  chemically synthesized
tataatgtgctggcttgcac

SEQ ID NO: 54761 - DNA, 20 bp, Artificial Sequence
  chemically synthesized
tgtgctggcttgcaccagct

SEQ ID NO: 54762 - DNA, 20 bp, Artificial Sequence
  chemically synthesized
gtgctggcttgcaccagctt

SEQ ID NO: 54763 - DNA, 20 bp, Artificial Sequence
  chemically synthesized
tggcttgcaccagcttagga

SEQ ID NO: 54764 - DNA, 20 bp, Artificial Sequence
  chemically synthesized
aaagctgattatgctcatct

SEQ ID NO: 54765 - DNA, 20 bp, Artificial Sequence
  chemically synthesized
catctcagctctgcatttaa

SEQ ID NO: 54766 - DNA, 20 bp, Artificial Sequence
  chemically synthesized
tgcatttaatagcatctctt

SEQ ID NO: 54767 - DNA, 20 bp, Artificial Sequence
  chemically synthesized
atttaatagcatctctttgg

SEQ ID NO: 54768 - DNA, 20 bp, Artificial Sequence
  chemically synthesized
tggtagtctgaaattgatca

SEQ ID NO: 54769 - DNA, 20 bp, Artificial Sequence
  chemically synthesized
tagtctgaaattgatcatgg

SEQ ID NO: 54770 - DNA, 20 bp, Artificial Sequence
  chemically synthesized
agtctgaaattgatcatggt

SEQ ID NO: 54771 - DNA, 20 bp, Artificial Sequence
  chemically synthesized
tctgaaattgatcatggtag

SEQ ID NO: 54772 - DNA, 20 bp, Artificial Sequence
  chemically synthesized
gtcattaaaacacaaaaaat

SEQ ID NO: 54773 - DNA, 20 bp, Artificial Sequence
  chemically synthesized
aaacacaaaaaatcggtaac

SEQ ID NO: 54774 - DNA, 20 bp, Artificial Sequence
  chemically synthesized
aatcggtaactggtaaaaat

SEQ ID NO: 54775 - DNA, 20 bp, Artificial Sequence
  chemically synthesized
atcggtaactggtaaaaatc

SEQ ID NO: 54776 - DNA, 20 bp, Artificial Sequence
  chemically synthesized
tcggtaactggtaaaaatca

SEQ ID NO: 54777 - DNA, 20 bp, Artificial Sequence
  chemically synthesized
aaaatcagggcatttttatt

SEQ ID NO: 54778 - DNA, 20 bp, Artificial Sequence
  chemically synthesized
cccactgattatgcctaacg

SEQ ID NO: 54779 - DNA, 20 bp, Artificial Sequence
  chemically synthesized
cactgattatgcctaacgaa

SEQ ID NO: 54780 - DNA, 20 bp, Artificial Sequence
  chemically synthesized
ttatgcctaacgaagagccc

SEQ ID NO: 54781 - DNA, 20 bp, Artificial Sequence
  chemically synthesized
cgaagagccctggcccaaca

SEQ ID NO: 54782 - DNA, 20 bp, Artificial Sequence
  chemically synthesized
gaagagccctggcccaacac

SEQ ID NO: 54783 - DNA, 20 bp, Artificial Sequence
  chemically synthesized
gagccctggcccaacacggg

SEQ ID NO: 54784 - DNA, 20 bp, Artificial Sequence
  chemically synthesized
ccctggcccaacacgggaag

SEQ ID NO: 54785 - DNA, 20 bp, Artificial Sequence
  chemically synthesized
ctggcccaacacgggaagaa

SEQ ID NO: 54786 - DNA, 20 bp, Artificial Sequence
  chemically synthesized
ccaacacgggaagaagagtt

SEQ ID NO: 54787 - DNA, 20 bp, Artificial Sequence
  chemically synthesized
cgggaagaagagttcagcct

SEQ ID NO: 54788 - DNA, 20 bp, Artificial Sequence
  chemically synthesized
ttggtcacattcttatttct

SEQ ID NO: 54789 - DNA, 20 bp, Artificial Sequence
  chemically synthesized
cccatcctgaattccatttc

SEQ ID NO: 54790 - DNA, 20 bp, Artificial Sequence
  chemically synthesized
ggcctccaacgttaatacct

SEQ ID NO: 54791 - DNA, 20 bp, Artificial Sequence
  chemically synthesized
gcctccaacgttaataccta

SEQ ID NO: 54792 - DNA, 20 bp, Artificial Sequence
  chemically synthesized
taatacctaaggctctgctg

SEQ ID NO: 54793 - DNA, 20 bp, Artificial Sequence
  chemically synthesized
cctaaggctctgctgcagat

SEQ ID NO: 54794 - DNA, 20 bp, Artificial Sequence
  chemically synthesized
aaggctctgctgcagataag

SEQ ID NO: 54795 - DNA, 20 bp, Artificial Sequence
  chemically synthesized
gctgcagataagtggaactt

SEQ ID NO: 54796 - DNA, 20 bp, Artificial Sequence
  chemically synthesized
agtgttaataaacttgttcc

SEQ ID NO: 54797 - DNA, 20 bp, Artificial Sequence
  chemically synthesized
gttcccagataaatatctct

SEQ ID NO: 54798 - DNA, 20 bp, Artificial Sequence
  chemically synthesized
atatctctaagcctgtaccc

SEQ ID NO: 54799 - DNA, 20 bp, Artificial Sequence
  chemically synthesized
caccatcacatgtgacttgt

SEQ ID NO: 54800 - DNA, 20 bp, Artificial Sequence
  chemically synthesized
tctgatcttgctccctgacc

SEQ ID NO: 54801 - DNA, 20 bp, Artificial Sequence
  chemically synthesized
cttgctccctgacccggttc

SEQ ID NO: 54802 - DNA, 20 bp, Artificial Sequence
  chemically synthesized
gctccctgacccggttccag

SEQ ID NO: 54803 - DNA, 20 bp, Artificial Sequence
  chemically synthesized
ccctgacccggttccagcag

SEQ ID NO: 54804 - DNA, 20 bp, Artificial Sequence
  chemically synthesized
actgacccttctgcaaaata

SEQ ID NO: 54805 - DNA, 20 bp, Artificial Sequence
  chemically synthesized
tgacccttctgcaaaataca

SEQ ID NO: 54806 - DNA, 20 bp, Artificial Sequence
  chemically synthesized
gacccttctgcaaaatacag

SEQ ID NO: 54807 - DNA, 20 bp, Artificial Sequence
  chemically synthesized
cccttctgcaaaatacagag

SEQ ID NO: 54808 - DNA, 20 bp, Artificial Sequence
  chemically synthesized
agaggagcttttctaatcta

SEQ ID NO: 54809 - DNA, 20 bp, Artificial Sequence
  chemically synthesized
gagcttttctaatctatgga

SEQ ID NO: 54810 - DNA, 20 bp, Artificial Sequence
  chemically synthesized
cttttctaatctatggatag

SEQ ID NO: 54811 - DNA, 20 bp, Artificial Sequence
  chemically synthesized
ttttctaatctatggatagc

SEQ ID NO: 54812 - DNA, 20 bp, Artificial Sequence
  chemically synthesized
tctaatctatggatagcagg

SEQ ID NO: 54813 - DNA, 20 bp, Artificial Sequence
  chemically synthesized
taatctatggatagcaggtg

SEQ ID NO: 54814 - DNA, 20 bp, Artificial Sequence
  chemically synthesized
ctatggatagcaggtggaga

SEQ ID NO: 54815 - DNA, 20 bp, Artificial Sequence
  chemically synthesized
atggatagcaggtggagaaa

SEQ ID NO: 54816 - DNA, 20 bp, Artificial Sequence
  chemically synthesized
caggtggagaaagagtgaac

SEQ ID NO: 54817 - DNA, 20 bp, Artificial Sequence
  chemically synthesized
tggagaaagagtgaactggt

SEQ ID NO: 54818 - DNA, 20 bp, Artificial Sequence
  chemically synthesized
aagagtgaactggtaagtta

SEQ ID NO: 54819 - DNA, 20 bp, Artificial Sequence
  chemically synthesized
tggtaagttaaagaaaaaaa

SEQ ID NO: 54820 - DNA, 20 bp, Artificial Sequence
  chemically synthesized
aaatggaaaatactttattc

SEQ ID NO: 54821 - DNA, 20 bp, Artificial Sequence
  chemically synthesized
aatggaaaatactttattct

SEQ ID NO: 54822 - DNA, 20 bp, Artificial Sequence
  chemically synthesized
tggaaaatactttattctag

SEQ ID NO: 54823 - DNA, 20 bp, Artificial Sequence
  chemically synthesized
aaatactattattgtcttta

SEQ ID NO: 54824 - DNA, 20 bp, Artificial Sequence
  chemically synthesized
ttgtctttatagcaaatatc

SEQ ID NO: 54825 - DNA, 20 bp, Artificial Sequence
  chemically synthesized
tgtctttatagcaaatatct

SEQ ID NO: 54826 - DNA, 20 bp, Artificial Sequence
  chemically synthesized
tatagcaaatatctgggtct

SEQ ID NO: 54827 - DNA, 20 bp, Artificial Sequence
  chemically synthesized
atcaactttaatataatccc

SEQ ID NO: 54828 - DNA, 20 bp, Artificial Sequence
  chemically synthesized
attacacgtcaattaaatgt

SEQ ID NO: 54829 - DNA, 20 bp, Artificial Sequence
  chemically synthesized
gaaccatcaatactctttat

SEQ ID NO: 54830 - DNA, 20 bp, Artificial Sequence
  chemically synthesized
ttattagtgttatattactt

SEQ ID NO: 54831 - DNA, 20 bp, Artificial Sequence
  chemically synthesized
actctctttataaacactac

SEQ ID NO: 54832 - DNA, 20 bp, Artificial Sequence
  chemically synthesized
tctttataaacactacaagt

SEQ ID NO: 54833 - DNA, 20 bp, Artificial Sequence
  chemically synthesized
ttataaacactacaagttag

SEQ ID NO: 54834 - DNA, 20 bp, Artificial Sequence
  chemically synthesized
ctacaagttagcagtttctt

SEQ ID NO: 54835 - DNA, 20 bp, Artificial Sequence
  chemically synthesized
ttaactgtttttcactgcca

SEQ ID NO: 54836 - DNA, 20 bp, Artificial Sequence
  chemically synthesized
tgccatagatgacccaactt

SEQ ID NO: 54837 - DNA, 20 bp, Artificial Sequence
  chemically synthesized
atttctattaatgccttatc

SEQ ID NO: 54838 - DNA, 20 bp, Artificial Sequence
  chemically synthesized
ttaatgccttatctggcata

SEQ ID NO: 54839 - DNA, 20 bp, Artificial Sequence
  chemically synthesized
taatgccttatctggcatat

SEQ ID NO: 54840 - DNA, 20 bp, Artificial Sequence
  chemically synthesized
atctggcatataggctatgt

SEQ ID NO: 54841 - DNA, 20 bp, Artificial Sequence
  chemically synthesized
tacttttctgcatgacccat

SEQ ID NO: 54842 - DNA, 20 bp, Artificial Sequence
  chemically synthesized
acttttctgcatgacccatt

SEQ ID NO: 54843 - DNA, 20 bp, Artificial Sequence
  chemically synthesized
ggtttctcttccactcactg

SEQ ID NO: 54844 - DNA, 20 bp, Artificial Sequence
  chemically synthesized
gcttacctgtgcccttgttt

SEQ ID NO: 54845 - DNA, 20 bp, Artificial Sequence
  chemically synthesized
aattttttatccctttttct

SEQ ID NO: 54846 - DNA, 20 bp, Artificial Sequence
  chemically synthesized
attttttatccctttttctg

SEQ ID NO: 54847 - DNA, 20 bp, Artificial Sequence
  chemically synthesized
ctttttctgaggaaatgtct

SEQ ID NO: 54848 - DNA, 20 bp, Artificial Sequence
  chemically synthesized
aatgtcttagatatgactgt

SEQ ID NO: 54849 - DNA, 20 bp, Artificial Sequence
  chemically synthesized
cttagatatgactgttagct

SEQ ID NO: 54850 - DNA, 20 bp, Artificial Sequence
  chemically synthesized
gaacttgatgtgcaataact

SEQ ID NO: 54851 - DNA, 20 bp, Artificial Sequence
  chemically synthesized
cttgatgtgcaataactgag

SEQ ID NO: 54852 - DNA, 20 bp, Artificial Sequence
  chemically synthesized
gagtagaaacttatatattc

SEQ ID NO: 54853 - DNA, 20 bp, Artificial Sequence
  chemically synthesized
catgtgcttctcaatatctt

SEQ ID NO: 54854 - DNA, 20 bp, Artificial Sequence
  chemically synthesized
tgtgcttctcaatatcttca

SEQ ID NO: 54855 - DNA, 20 bp, Artificial Sequence
  chemically synthesized
gtgcttctcaatatcttcag

SEQ ID NO: 54856 - DNA, 20 bp, Artificial Sequence
  chemically synthesized
cttctcaatatcttcagagg

SEQ ID NO: 54857 - DNA, 20 bp, Artificial Sequence
  chemically synthesized
cctacaacattcactctcgt

SEQ ID NO: 54858 - DNA, 20 bp, Artificial Sequence
  chemically synthesized
attcactctcgttggcatcc

SEQ ID NO: 54859 - DNA, 20 bp, Artificial Sequence
  chemically synthesized
ttcactctcgttggcatccc

SEQ ID NO: 54860 - DNA, 20 bp, Artificial Sequence
  chemically synthesized
tctcgttggcatcccgggac

SEQ ID NO: 54861 - DNA, 20 bp, Artificial Sequence
  chemically synthesized
tcgttggcatcccgggactg

SEQ ID NO: 54862 - DNA, 20 bp, Artificial Sequence
  chemically synthesized
cgttggcatcccgggactgg

SEQ ID NO: 54863 - DNA, 20 bp, Artificial Sequence
  chemically synthesized
tggcatcccgggactggagg

SEQ ID NO: 54864 - DNA, 20 bp, Artificial Sequence
  chemically synthesized
actggaggcagaacattatg

SEQ ID NO: 54865 - DNA, 20 bp, Artificial Sequence
  chemically synthesized
gatatacaccatcatctttc

SEQ ID NO: 54866 - DNA, 20 bp, Artificial Sequence
  chemically synthesized
atatacaccatcatctttcc

SEQ ID NO: 54867 - DNA, 20 bp, Artificial Sequence
  chemically synthesized
accatcatctttccgggaaa

SEQ ID NO: 54868 - DNA, 20 bp, Artificial Sequence
  chemically synthesized
ccaacccatgtactattttc

SEQ ID NO: 54869 - DNA, 20 bp, Artificial Sequence
  chemically synthesized
gtactattttctggccatgc

SEQ ID NO: 54870 - DNA, 20 bp, Artificial Sequence
  chemically synthesized
atgccggcctttgttgaact

SEQ ID NO: 54871 - DNA, 20 bp, Artificial Sequence
  chemically synthesized
tccaccatgcccactgtgtt

SEQ ID NO: 54872 - DNA, 20 bp, Artificial Sequence
  chemically synthesized
gtgttaagcatattcctctt

SEQ ID NO: 54873 - DNA, 20 bp, Artificial Sequence
  chemically synthesized
ctctttggcattaacgatgt

SEQ ID NO: 54874 - DNA, 20 bp, Artificial Sequence
  chemically synthesized
ggcattaacgatgtcagttt

SEQ ID NO: 54875 - DNA, 20 bp, Artificial Sequence
  chemically synthesized
attaacgatgtcagttttgg

SEQ ID NO: 54876 - DNA, 20 bp, Artificial Sequence
  chemically synthesized
gttttggtggttgcctgctc

SEQ ID NO: 54877 - DNA, 20 bp, Artificial Sequence
  chemically synthesized
tatgcactctttcactctta

SEQ ID NO: 54878 - DNA, 20 bp, Artificial Sequence
  chemically synthesized
tgcactctttcactcttatg

SEQ ID NO: 54879 - DNA, 20 bp, Artificial Sequence
  chemically synthesized
ctctttcactcttatggagt

SEQ ID NO: 54880 - DNA, 20 bp, Artificial Sequence
  chemically synthesized
tctttcactcttatggagtc

SEQ ID NO: 54881 - DNA, 20 bp, Artificial Sequence
  chemically synthesized
tatggagtcaggtgtccttc

SEQ ID NO: 54882 - DNA, 20 bp, Artificial Sequence
  chemically synthesized
aggtgtccttctggcaatgt

SEQ ID NO: 54883 - DNA, 20 bp, Artificial Sequence
  chemically synthesized
tgtccttctggcaatgtcag

SEQ ID NO: 54884 - DNA, 20 bp, Artificial Sequence
  chemically synthesized
aatgtcagtggaccgctttg

SEQ ID NO: 54885 - DNA, 20 bp, Artificial Sequence
  chemically synthesized
gaccgctttgtggccatcta

SEQ ID NO: 54886 - DNA, 20 bp, Artificial Sequence
  chemically synthesized
ctgacaattgcctgcatttc

SEQ ID NO: 54887 - DNA, 20 bp, Artificial Sequence
  chemically synthesized
tgacaattgcctgcatttct

SEQ ID NO: 54888 - DNA, 20 bp, Artificial Sequence
  chemically synthesized
aattgcctgcatttctggga

SEQ ID NO: 54889 - DNA, 20 bp, Artificial Sequence
  chemically synthesized
attgcctgcatttctgggac

SEQ ID NO: 54890 - DNA, 20 bp, Artificial Sequence
  chemically synthesized
ggtgccgccattgccttgcg

SEQ ID NO: 54891 - DNA, 20 bp, Artificial Sequence
  chemically synthesized
ctcccactgctctttctcct

SEQ ID NO: 54892 - DNA, 20 bp, Artificial Sequence
  chemically synthesized
tcccactgctctttctcctg

SEQ ID NO: 54893 - DNA, 20 bp, Artificial Sequence
  chemically synthesized
ctgaggcgtctgcctttctg

SEQ ID NO: 54894 - DNA, 20 bp, Artificial Sequence
  chemically synthesized
acactcttattgcctccact

SEQ ID NO: 54895 - DNA, 20 bp, Artificial Sequence
  chemically synthesized
gatctgatcaaattgccctg

SEQ ID NO: 54896 - DNA, 20 bp, Artificial Sequence
  chemically synthesized
tctgatcaaattgccctgtg

SEQ ID NO: 54897 - DNA, 20 bp, Artificial Sequence
  chemically synthesized
tgtggagacacacgtcccaa

SEQ ID NO: 54898 - DNA, 20 bp, Artificial Sequence
  chemically synthesized
cacacgtcccaatagcatcc

SEQ ID NO: 54899 - DNA, 20 bp, Artificial Sequence
  chemically synthesized
tttgtcattaccttcacatt

SEQ ID NO: 54900 - DNA, 20 bp, Artificial Sequence
  chemically synthesized
cattaccttcacatttggac

SEQ ID NO: 54901 - DNA, 20 bp, Artificial Sequence
  chemically synthesized
actggacttattgttcattg

SEQ ID NO: 54902 - DNA, 20 bp, Artificial Sequence
  chemically synthesized
ttatgtgctgattcttcata

SEQ ID NO: 54903 - DNA, 20 bp, Artificial Sequence
  chemically synthesized
gctgattcttcatacagtac

SEQ ID NO: 54904 - DNA, 20 bp, Artificial Sequence
  chemically synthesized
tcttcatacagtactggaaa

SEQ ID NO: 54905 - DNA, 20 bp, Artificial Sequence
  chemically synthesized
acagtactggaaatagcttc

SEQ ID NO: 54906 - DNA, 20 bp, Artificial Sequence
  chemically synthesized
agtactggaaatagcttctg

SEQ ID NO: 54907 - DNA, 20 bp, Artificial Sequence
  chemically synthesized
actggaaatagcttctggag

SEQ ID NO: 54908 - DNA, 20 bp, Artificial Sequence
  chemically synthesized
ctggaaatagcttctggagc

SEQ ID NO: 54909 - DNA, 20 bp, Artificial Sequence
  chemically synthesized
tggaaatagcttctggagca

SEQ ID NO: 54910 - DNA, 20 bp, Artificial Sequence
  chemically synthesized
aaatagcttctggagcaggg

SEQ ID NO: 54911 - DNA, 20 bp, Artificial Sequence
  chemically synthesized
tagcttctggagcagggcgg

SEQ ID NO: 54912 - DNA, 20 bp, Artificial Sequence
  chemically synthesized
cttctggagcagggcggtgg

SEQ ID NO: 54913 - DNA, 20 bp, Artificial Sequence
  chemically synthesized
ttctggagcagggcggtggc

SEQ ID NO: 54914 - DNA, 20 bp, Artificial Sequence
  chemically synthesized
gtgtactatgtgcccatgat

SEQ ID NO: 54915 - DNA, 20 bp, Artificial Sequence
  chemically synthesized
ctctccctgatgcaccgctt

SEQ ID NO: 54916 - DNA, 20 bp, Artificial Sequence
  chemically synthesized
ccctgatgcaccgctttgga

SEQ ID NO: 54917 - DNA, 20 bp, Artificial Sequence
  chemically synthesized
ggcatttacctccacttttc

SEQ ID NO: 54918 - DNA, 20 bp, Artificial Sequence
  chemically synthesized
tccacttttccagactgtca

SEQ ID NO: 54919 - DNA, 20 bp, Artificial Sequence
  chemically synthesized
ttacctcttttttcctcctg

SEQ ID NO: 54920 - DNA, 20 bp, Artificial Sequence
  chemically synthesized
gtggtcaaccccattgtcta

SEQ ID NO: 54921 - DNA, 20 bp, Artificial Sequence
  chemically synthesized
tgtctatagtatcaaaatca

SEQ ID NO: 54922 - DNA, 20 bp, Artificial Sequence
  chemically synthesized
aaaatcaaagaaattcgcaa

SEQ ID NO: 54923 - DNA, 20 bp, Artificial Sequence
  chemically synthesized
agcgttgttcttacactatc

SEQ ID NO: 54924 - DNA, 20 bp, Artificial Sequence
  chemically synthesized
gcgttgttcttacactatcc

SEQ ID NO: 54925 - DNA, 20 bp, Artificial Sequence
  chemically synthesized
ttgttcttacactatccagg

SEQ ID NO: 54926 - DNA, 20 bp, Artificial Sequence
  chemically synthesized
gttcttacactatccaggaa

SEQ ID NO: 54927 - DNA, 20 bp, Artificial Sequence
  chemically synthesized
ttcttacactatccaggaag

SEQ ID NO: 54928 - DNA, 20 bp, Artificial Sequence
  chemically synthesized
tcttacactatccaggaaga

SEQ ID NO: 54929 - DNA, 20 bp, Artificial Sequence
  chemically synthesized
cttacactatccaggaagag

SEQ ID NO: 54930 - DNA, 20 bp, Artificial Sequence
  chemically synthesized
cactatccaggaagaggggt

SEQ ID NO: 54931 - DNA, 20 bp, Artificial Sequence
  chemically synthesized
ggaagaggggtgagttctaa

SEQ ID NO: 54932 - DNA, 20 bp, Artificial Sequence
  chemically synthesized
aagaggggtgagttctaatg

SEQ ID NO: 54933 - DNA, 20 bp, Artificial Sequence
  chemically synthesized
gtgagttctaatggagactg

SEQ ID NO: 54934 - DNA, 20 bp, Artificial Sequence
  chemically synthesized
ggagactgaagataccctga

SEQ ID NO: 54935 - DNA, 20 bp, Artificial Sequence
  chemically synthesized
ctgaagataccctgacagca

SEQ ID NO: 54936 - DNA, 20 bp, Artificial Sequence
  chemically synthesized
tgaagataccctgacagcac

SEQ ID NO: 54937 - DNA, 20 bp, Artificial Sequence
  chemically synthesized
accctgacagcacaggcact

SEQ ID NO: 54938 - DNA, 20 bp, Artificial Sequence
  chemically synthesized
gacagcacaggcacttagat

SEQ ID NO: 54939 - DNA, 20 bp, Artificial Sequence
  chemically synthesized
acagcacaggcacttagatc

SEQ ID NO: 54940 - DNA, 20 bp, Artificial Sequence
  chemically synthesized
aggctttattacctgaatat

SEQ ID NO: 54941 - DNA, 20 bp, Artificial Sequence
  chemically synthesized
tgcaaatatgaaaaattcca

SEQ ID NO: 54942 - DNA, 20 bp, Artificial Sequence
  chemically synthesized
gcttattattgcttgttaat

SEQ ID NO: 54943 - DNA, 20 bp, Artificial Sequence
  chemically synthesized
taatgagctttaacattttg

SEQ ID NO: 54944 - DNA, 20 bp, Artificial Sequence
  chemically synthesized
gctttaacattttgtagatg

SEQ ID NO: 54945 - DNA, 20 bp, Artificial Sequence
  chemically synthesized
ttgtagatgaagaaaaaaaa

SEQ ID NO: 54946 - DNA, 20 bp, Artificial Sequence
  chemically synthesized
acagttttatatatttccct

SEQ ID NO: 54947 - DNA, 20 bp, Artificial Sequence
  chemically synthesized
tttatatatttccctgagaa

SEQ ID NO: 54948 - DNA, 20 bp, Artificial Sequence
  chemically synthesized
ttatatatttccctgagaat

SEQ ID NO: 54949 - DNA, 20 bp, Artificial Sequence
  chemically synthesized
atttccctgagaataggaaa

SEQ ID NO: 54950 - DNA, 20 bp, Artificial Sequence
  chemically synthesized
attactctgaaataaaattg

SEQ ID NO: 54951 - DNA, 20 bp, Artificial Sequence
  chemically synthesized
ttactctgaaataaaattgt

SEQ ID NO: 54952 - DNA, 20 bp, Artificial Sequence
  chemically synthesized
actctgaaataaaattgtgg

SEQ ID NO: 54953 - DNA, 20 bp, Artificial Sequence
  chemically synthesized
ctctgaaataaaattgtggg

SEQ ID NO: 54954 - DNA, 20 bp, Artificial Sequence
  chemically synthesized
ctgaaataaaattgtgggag

SEQ ID NO: 54955 - DNA, 20 bp, Artificial Sequence
  chemically synthesized
tgaaataaaattgtgggagg

SEQ ID NO: 54956 - DNA, 20 bp, Artificial Sequence
  chemically synthesized
taaaattgtgggaggaggca

SEQ ID NO: 54957 - DNA, 20 bp, Artificial Sequence
  chemically synthesized
gtgggaggaggcatagaaca

SEQ ID NO: 54958 - DNA, 20 bp, Artificial Sequence
  chemically synthesized
tgggaggaggcatagaacac

SEQ ID NO: 54959 - DNA, 20 bp, Artificial Sequence
  chemically synthesized
atagaacacaggctttgtcc

SEQ ID NO: 54960 - DNA, 20 bp, Artificial Sequence
  chemically synthesized
gaatccttgaatactcaatt

SEQ ID NO: 54961 - DNA, 20 bp, Artificial Sequence
  chemically synthesized
atactcaattcagtgacatt

SEQ ID NO: 54962 - DNA, 20 bp, Artificial Sequence
  chemically synthesized
aattcagtgacatttggttc

SEQ ID NO: 54963 - DNA, 20 bp, Artificial Sequence
  chemically synthesized
attcagtgacatttggttct

SEQ ID NO: 54964 - DNA, 20 bp, Artificial Sequence
  chemically synthesized
catttggttctgggaatatg

SEQ ID NO: 54965 - DNA, 20 bp, Artificial Sequence
  chemically synthesized
tggttctgggaatatgtaga

SEQ ID NO: 54966 - DNA, 20 bp, Artificial Sequence
  chemically synthesized
gttctgggaatatgtagaaa

SEQ ID NO: 54967 - DNA, 20 bp, Artificial Sequence
  chemically synthesized
ggaatatgtagaaagagtct

SEQ ID NO: 54968 - DNA, 20 bp, Artificial Sequence
  chemically synthesized
gaatatgtagaaagagtctt

SEQ ID NO: 54969 - DNA, 20 bp, Artificial Sequence
  chemically synthesized
aatatgtagaaagagtcttg

SEQ ID NO: 54970 - DNA, 20 bp, Artificial Sequence
  chemically synthesized
tatgtagaaagagtcttggg

SEQ ID NO: 54971 - DNA, 20 bp, Artificial Sequence
  chemically synthesized
atgtagaaagagtcttgggg

SEQ ID NO: 54972 - DNA, 20 bp, Artificial Sequence
  chemically synthesized
aaagagtcttggggaggttt

SEQ ID NO: 54973 - DNA, 20 bp, Artificial Sequence
  chemically synthesized
cttggggaggtttaagtttc

SEQ ID NO: 54974 - DNA, 20 bp, Artificial Sequence
  chemically synthesized
gtttctggttatattaaaat

SEQ ID NO: 54975 - DNA, 20 bp, Artificial Sequence
  chemically synthesized
attagtgatacatacttgtg

SEQ ID NO: 54976 - DNA, 20 bp, Artificial Sequence
  chemically synthesized
ttagtgatacatacttgtga

SEQ ID NO: 54977 - DNA, 20 bp, Artificial Sequence
  chemically synthesized
tacttgtgaaggaaaataat

SEQ ID NO: 54978 - DNA, 20 bp, Artificial Sequence
  chemically synthesized
acttgtgaaggaaaataatc

SEQ ID NO: 54979 - DNA, 20 bp, Artificial Sequence
  chemically synthesized
ggaaaataatcaggacacaa

SEQ ID NO: 54980 - DNA, 20 bp, Artificial Sequence
  chemically synthesized
aaaataatcaggacacaaaa

SEQ ID NO: 54981 - DNA, 20 bp, Artificial Sequence
  chemically synthesized
attgtattattttgtttgta

SEQ ID NO: 54982 - DNA, 20 bp, Artificial Sequence
  chemically synthesized
ttattttgtttgtatagttt

SEQ ID NO: 54983 - DNA, 20 bp, Artificial Sequence
  chemically synthesized
ctaatttaatgtcaaaaaat

SEQ ID NO: 54984 - DNA, 20 bp, Artificial Sequence
  chemically synthesized
agaaccctgcttacctctga

SEQ ID NO: 54985 - DNA, 20 bp, Artificial Sequence
  chemically synthesized
gcttacctctgatggatata

SEQ ID NO: 54986 - DNA, 20 bp, Artificial Sequence
  chemically synthesized
acctctgatggatataaaga

SEQ ID NO: 54987 - DNA, 20 bp, Artificial Sequence
  chemically synthesized
tctgatggatataaagatgg

SEQ ID NO: 54988 - DNA, 20 bp, Artificial Sequence
  chemically synthesized
tggatataaagatggaagaa

SEQ ID NO: 54989 - DNA, 20 bp, Artificial Sequence
  chemically synthesized
ggatataaagatggaagaat

SEQ ID NO: 54990 - DNA, 20 bp, Artificial Sequence
  chemically synthesized
gatataaagatggaagaatg

SEQ ID NO: 54991 - DNA, 20 bp, Artificial Sequence
  chemically synthesized
tataaagatggaagaatggg

SEQ ID NO: 54992 - DNA, 20 bp, Artificial Sequence
  chemically synthesized
taaagatggaagaatgggga

SEQ ID NO: 54993 - DNA, 20 bp, Artificial Sequence
  chemically synthesized
ggaagaatggggagagacat

SEQ ID NO: 54994 - DNA, 20 bp, Artificial Sequence
  chemically synthesized
gaagaatggggagagacatg

SEQ ID NO: 54995 - DNA, 20 bp, Artificial Sequence
  chemically synthesized
gagagacatgaggcaatttc

SEQ ID NO: 54996 - DNA, 20 bp, Artificial Sequence
  chemically synthesized
agagacatgaggcaatttct

SEQ ID NO: 54997 - DNA, 20 bp, Artificial Sequence
  chemically synthesized
gagacatgaggcaatttctg

SEQ ID NO: 54998 - DNA, 20 bp, Artificial Sequence
  chemically synthesized
gacatgaggcaatttctggg

SEQ ID NO: 54999 - DNA, 20 bp, Artificial Sequence
  chemically synthesized
tgaggcaatttctggggaga

SEQ ID NO: 55000 - DNA, 20 bp, Artificial Sequence
  chemically synthesized
atggaaatattttgttgtgt

SEQ ID NO: 55001 - DNA, 20 bp, Artificial Sequence
  chemically synthesized
tggaaatattttgttgtgtt

SEQ ID NO: 55002 - DNA, 20 bp, Artificial Sequence
  chemically synthesized
ggaaatattttgttgtgtta

SEQ ID NO: 55003 - DNA, 20 bp, Artificial Sequence
  chemically synthesized
attttgttgtgttagggatg

SEQ ID NO: 55004 - DNA, 20 bp, Artificial Sequence
  chemically synthesized
gttttgtcaatttgtcaaaa

SEQ ID NO: 55005 - DNA, 20 bp, Artificial Sequence
  chemically synthesized
gtcaatttgtcaaaacggta

SEQ ID NO: 55006 - DNA, 20 bp, Artificial Sequence
  chemically synthesized
tttgtcaaaacggtacagct

SEQ ID NO: 55007 - DNA, 20 bp, Artificial Sequence
  chemically synthesized
agctaagatttgcacatttc

SEQ ID NO: 55008 - DNA, 20 bp, Artificial Sequence
  chemically synthesized
gctaagatttgcacatttct

SEQ ID NO: 55009 - DNA, 20 bp, Artificial Sequence
  chemically synthesized
tgaatgataataataacaaa

SEQ ID NO: 55010 - DNA, 20 bp, Artificial Sequence
  chemically synthesized
gaatgataataataacaaaa

SEQ ID NO: 55011 - DNA, 20 bp, Artificial Sequence
  chemically synthesized
aataataacaaaaaggaaaa

SEQ ID NO: 55012 - DNA, 20 bp, Artificial Sequence
  chemically synthesized
ggaaaatagtaataataata

SEQ ID NO: 55013 - DNA, 20 bp, Artificial Sequence
  chemically synthesized
gtaataataatacagatgat

SEQ ID NO: 55014 - DNA, 20 bp, Artificial Sequence
  chemically synthesized
atacagatgattagatttca

SEQ ID NO: 55015 - DNA, 20 bp, Artificial Sequence
  chemically synthesized
ttagatttcatagtgaatac

SEQ ID NO: 55016 - DNA, 20 bp, Artificial Sequence
  chemically synthesized
tttcatagtgaatacaagtg

SEQ ID NO: 55017 - DNA, 20 bp, Artificial Sequence
  chemically synthesized
aatacaagtgtggaaaatac

SEQ ID NO: 55018 - DNA, 20 bp, Artificial Sequence
  chemically synthesized
aagtgtggaaaatacaagaa

SEQ ID NO: 55019 - DNA, 20 bp, Artificial Sequence
  chemically synthesized
tgtaatgttgataattgttg

SEQ ID NO: 55020 - DNA, 20 bp, Artificial Sequence
  chemically synthesized
taattgttgaagttgtgtca

SEQ ID NO: 55021 - DNA, 20 bp, Artificial Sequence
  chemically synthesized
aattgttgaagttgtgtcat

SEQ ID NO: 55022 - DNA, 20 bp, Artificial Sequence
  chemically synthesized
gaagttgtgtcatgggtgcc

SEQ ID NO: 55023 - DNA, 20 bp, Artificial Sequence
  chemically synthesized
aatattctgtttactttgtg

SEQ ID NO: 55024 - DNA, 20 bp, Artificial Sequence
  chemically synthesized
tttacaatttctgtaataaa

SEQ ID NO: 55025 - DNA, 20 bp, Artificial Sequence
  chemically synthesized
attcttaaaaaaattatact

SEQ ID NO: 55026 - DNA, 20 bp, Artificial Sequence
  chemically synthesized
ttaattgaatatgcaccatg

SEQ ID NO: 55027 - DNA, 20 bp, Artificial Sequence
  chemically synthesized
attgaatatgcaccatgaag

SEQ ID NO: 55028 - DNA, 20 bp, Artificial Sequence
  chemically synthesized
tgaatatgcaccatgaagca

SEQ ID NO: 55029 - DNA, 20 bp, Artificial Sequence
  chemically synthesized
aagcagagataacttttaac

SEQ ID NO: 55030 - DNA, 20 bp, Artificial Sequence
  chemically synthesized
agagataacttttaactggt

SEQ ID NO: 55031 - DNA, 20 bp, Artificial Sequence
  chemically synthesized
gagataacttttaactggtc

SEQ ID NO: 55032 - DNA, 20 bp, Artificial Sequence
  chemically synthesized
gataacttttaactggtcag

SEQ ID NO: 55033 - DNA, 20 bp, Artificial Sequence
  chemically synthesized
ataacttttaactggtcagg

SEQ ID NO: 55034 - DNA, 20 bp, Artificial Sequence
  chemically synthesized
ctggtcaggaggaaactgtt

SEQ ID NO: 55035 - DNA, 20 bp, Artificial Sequence
  chemically synthesized
aggaggaaactgtttggctt

SEQ ID NO: 55036 - DNA, 20 bp, Artificial Sequence
  chemically synthesized
ggaaactgtttggctttaga

SEQ ID NO: 55037 - DNA, 20 bp, Artificial Sequence
  chemically synthesized
aaagctattttatttttaat

SEQ ID NO: 55038 - DNA, 20 bp, Artificial Sequence
  chemically synthesized
atttttaatgagttcaatac

SEQ ID NO: 55039 - DNA, 20 bp, Artificial Sequence
  chemically synthesized
ttaatgagttcaatactaga

SEQ ID NO: 55040 - DNA, 20 bp, Artificial Sequence
  chemically synthesized
actacttgaaaatactgttt

SEQ ID NO: 55041 - DNA, 20 bp, Artificial Sequence
  chemically synthesized
acttgaaaatactgttttag

SEQ ID NO: 55042 - DNA, 20 bp, Artificial Sequence
  chemically synthesized
agaagaaaataactaaaaaa

SEQ ID NO: 55043 - DNA, 20 bp, Artificial Sequence
  chemically synthesized
aaataactaaaaaacagaaa

SEQ ID NO: 55044 - DNA, 20 bp, Artificial Sequence
  chemically synthesized
aactaaaaaacagaaaaagc

SEQ ID NO: 55045 - DNA, 20 bp, Artificial Sequence
  chemically synthesized
actaaaaaacagaaaaagca

SEQ ID NO: 55046 - DNA, 20 bp, Artificial Sequence
  chemically synthesized
agcaaggcctactcctgcaa

SEQ ID NO: 55047 - DNA, 20 bp, Artificial Sequence
  chemically synthesized
cctactcctgcaatagtctt

SEQ ID NO: 55048 - DNA, 20 bp, Artificial Sequence
  chemically synthesized
ctttggtgacatcaatcact

SEQ ID NO: 55049 - DNA, 20 bp, Artificial Sequence
  chemically synthesized
tggtgacatcaatcactcgg

SEQ ID NO: 55050 - DNA, 20 bp, Artificial Sequence
  chemically synthesized
tgacatcaatcactcggtag

SEQ ID NO: 55051 - DNA, 20 bp, Artificial Sequence
  chemically synthesized
tcaatcactcggtagtagac

SEQ ID NO: 55052 - DNA, 20 bp, Artificial Sequence
  chemically synthesized
acaagcttctgacaaacaaa

SEQ ID NO: 55053 - DNA, 20 bp, Artificial Sequence
  chemically synthesized
caagcttctgacaaacaaaa

SEQ ID NO: 55054 - DNA, 20 bp, Artificial Sequence
  chemically synthesized
gcttctgacaaacaaaaagg

SEQ ID NO: 55055 - DNA, 20 bp, Artificial Sequence
  chemically synthesized
cttctgacaaacaaaaaggt

SEQ ID NO: 55056 - DNA, 20 bp, Artificial Sequence
  chemically synthesized
ttctgacaaacaaaaaggta

SEQ ID NO: 55057 - DNA, 20 bp, Artificial Sequence
  chemically synthesized
ctgacaaacaaaaaggtagg

SEQ ID NO: 55058 - DNA, 20 bp, Artificial Sequence
  chemically synthesized
tgacaaacaaaaaggtaggg

SEQ ID NO: 55059 - DNA, 20 bp, Artificial Sequence
  chemically synthesized
aacaaaaaggtagggaggac

SEQ ID NO: 55060 - DNA, 20 bp, Artificial Sequence
  chemically synthesized
aaaaaggtagggaggaccag

SEQ ID NO: 55061 - DNA, 20 bp, Artificial Sequence
  chemically synthesized
agggaggaccagaagaattc

SEQ ID NO: 55062 - DNA, 20 bp, Artificial Sequence
  chemically synthesized
aagaattctagaaaatccct

SEQ ID NO: 55063 - DNA, 20 bp, Artificial Sequence
  chemically synthesized
attctagaaaatccctcaga

SEQ ID NO: 55064 - DNA, 20 bp, Artificial Sequence
  chemically synthesized
ttctagaaaatccctcagac

SEQ ID NO: 55065 - DNA, 20 bp, Artificial Sequence
  chemically synthesized
tctagaaaatccctcagaca

SEQ ID NO: 55066 - DNA, 20 bp, Artificial Sequence
  chemically synthesized
aatccctcagacagggattg

SEQ ID NO: 55067 - DNA, 20 bp, Artificial Sequence
  chemically synthesized
tccctcagacagggattgca

SEQ ID NO: 55068 - DNA, 20 bp, Artificial Sequence
  chemically synthesized
gcccaactttttgttttctt

SEQ ID NO: 55069 - DNA, 20 bp, Artificial Sequence
  chemically synthesized
ttttgaatttccatgaacca

SEQ ID NO: 55070 - DNA, 20 bp, Artificial Sequence
  chemically synthesized
gaatatcctattaaaccaca

SEQ ID NO: 55071 - DNA, 20 bp, Artificial Sequence
  chemically synthesized
ctattaaaccacacagtctt

SEQ ID NO: 55072 - DNA, 20 bp, Artificial Sequence
  chemically synthesized
acacagtcttgagtgattat

SEQ ID NO: 55073 - DNA, 20 bp, Artificial Sequence
  chemically synthesized
tgagtgattatcagccaacc

SEQ ID NO: 55074 - DNA, 20 bp, Artificial Sequence
  chemically synthesized
tcagccaaccaagtaactaa

SEQ ID NO: 55075 - DNA, 20 bp, Artificial Sequence
  chemically synthesized
gccaaccaagtaactaatag

SEQ ID NO: 55076 - DNA, 20 bp, Artificial Sequence
  chemically synthesized
ccaaccaagtaactaataga

SEQ ID NO: 55077 - DNA, 20 bp, Artificial Sequence
  chemically synthesized
caagtaactaatagaaggtt

SEQ ID NO: 55078 - DNA, 20 bp, Artificial Sequence
  chemically synthesized
gtcaaataaaaatatgtatc

SEQ ID NO: 55079 - DNA, 20 bp, Artificial Sequence
  chemically synthesized
aaaaatatgtatcaagtaat

SEQ ID NO: 55080 - DNA, 20 bp, Artificial Sequence
  chemically synthesized
aatatgtatcaagtaatgag

SEQ ID NO: 55081 - DNA, 20 bp, Artificial Sequence
  chemically synthesized
ttttcctcgaaattaattta

SEQ ID NO: 55082 - DNA, 20 bp, Artificial Sequence
  chemically synthesized
aatgtatgaaacacctttga

SEQ ID NO: 55083 - DNA, 20 bp, Artificial Sequence
  chemically synthesized
acctttgaaagtgttcaatg

SEQ ID NO: 55084 - DNA, 20 bp, Artificial Sequence
  chemically synthesized
tgaaagtgttcaatgtagtg

SEQ ID NO: 55085 - DNA, 20 bp, Artificial Sequence
  chemically synthesized
gtgaagtcataaaaacaaca

SEQ ID NO: 55086 - DNA, 20 bp, Artificial Sequence
  chemically synthesized
tgaagtcataaaaacaacat

SEQ ID NO: 55087 - DNA, 20 bp, Artificial Sequence
  chemically synthesized
aaaaaaaattctcaaaattt

SEQ ID NO: 55088 - DNA, 20 bp, Artificial Sequence
  chemically synthesized
aaaaaattctcaaaatttca

SEQ ID NO: 55089 - DNA, 20 bp, Artificial Sequence
  chemically synthesized
ctcaaaatttcagagtaatt

SEQ ID NO: 55090 - DNA, 20 bp, Artificial Sequence
  chemically synthesized
aaaatttcagagtaatttag

SEQ ID NO: 55091 - DNA, 20 bp, Artificial Sequence
  chemically synthesized
ccttccttaacaataattat

SEQ ID NO: 55092 - DNA, 20 bp, Artificial Sequence
  chemically synthesized
attattggtaacctccatta

SEQ ID NO: 55093 - DNA, 20 bp, Artificial Sequence
  chemically synthesized
gtcctgtattactattctta

SEQ ID NO: 55094 - DNA, 20 bp, Artificial Sequence
  chemically synthesized
atggtatacatgaaaaaact

SEQ ID NO: 55095 - DNA, 20 bp, Artificial Sequence
  chemically synthesized
ggtatacatgaaaaaactaa

SEQ ID NO: 55096 - DNA, 20 bp, Artificial Sequence
  chemically synthesized
ataatttttgtaactttatc

SEQ ID NO: 55097 - DNA, 20 bp, Artificial Sequence
  chemically synthesized
actttatcaagttcacacaa

SEQ ID NO: 55098 - DNA, 20 bp, Artificial Sequence
  chemically synthesized
aatggaaaacttgtacaccc

SEQ ID NO: 55099 - DNA, 20 bp, Artificial Sequence
  chemically synthesized
tggaaaacttgtacacccaa

SEQ ID NO: 55100 - DNA, 20 bp, Artificial Sequence
  chemically synthesized
aacttgtacacccaagagcc

SEQ ID NO: 55101 - DNA, 20 bp, Artificial Sequence
  chemically synthesized
acacccaagagccaagtcct

SEQ ID NO: 55102 - DNA, 20 bp, Artificial Sequence
  chemically synthesized
gtgatgttatacacttgaac

SEQ ID NO: 55103 - DNA, 20 bp, Artificial Sequence
  chemically synthesized
acacttgaaccagatgtacc

SEQ ID NO: 55104 - DNA, 20 bp, Artificial Sequence
  chemically synthesized
cacttgaaccagatgtacct

SEQ ID NO: 55105 - DNA, 20 bp, Artificial Sequence
  chemically synthesized
atgtacctaggttgaaatct

SEQ ID NO: 55106 - DNA, 20 bp, Artificial Sequence
  chemically synthesized
aatcttagctatcttgctat

SEQ ID NO: 55107 - DNA, 20 bp, Artificial Sequence
  chemically synthesized
tatcttgctattagtaattg

SEQ ID NO: 55108 - DNA, 20 bp, Artificial Sequence
  chemically synthesized
atcttgctattagtaattgt

SEQ ID NO: 55109 - DNA, 20 bp, Artificial Sequence
  chemically synthesized
tagtaattgtgggatcttgc

SEQ ID NO: 55110 - DNA, 20 bp, Artificial Sequence
  chemically synthesized
taattgtgggatcttgctag

SEQ ID NO: 55111 - DNA, 20 bp, Artificial Sequence
  chemically synthesized
ttattcatttataaatgaat

SEQ ID NO: 55112 - DNA, 20 bp, Artificial Sequence
  chemically synthesized
atgaataagaaaataaaatc

SEQ ID NO: 55113 - DNA, 20 bp, Artificial Sequence
  chemically synthesized
atccagcttttatgatcttg

SEQ ID NO: 55114 - DNA, 20 bp, Artificial Sequence
  chemically synthesized
atcttgaagattaaatgaaa

SEQ ID NO: 55115 - DNA, 20 bp, Artificial Sequence
  chemically synthesized
taaatgaaatggtgcacatt

SEQ ID NO: 55116 - DNA, 20 bp, Artificial Sequence
  chemically synthesized
aatggtgcacattaagcaat

SEQ ID NO: 55117 - DNA, 20 bp, Artificial Sequence
  chemically synthesized
tgcacattaagcaattagca

SEQ ID NO: 55118 - DNA, 20 bp, Artificial Sequence
  chemically synthesized
taagcaattagcaaagttcc

SEQ ID NO: 55119 - DNA, 20 bp, Artificial Sequence
  chemically synthesized
cctagtaaaatttgctcaat

SEQ ID NO: 55120 - DNA, 20 bp, Artificial Sequence
  chemically synthesized
ataagtaattatattttatt

SEQ ID NO: 55121 - DNA, 20 bp, Artificial Sequence
  chemically synthesized
gactacaatacgtgaataca

SEQ ID NO: 55122 - DNA, 20 bp, Artificial Sequence
  chemically synthesized
tcaaatttcacaattcctga

SEQ ID NO: 55123 - DNA, 20 bp, Artificial Sequence
  chemically synthesized
taaatgctaattttaaactc

SEQ ID NO: 55124 - DNA, 20 bp, Artificial Sequence
  chemically synthesized
actcaagtacataaaaatta

SEQ ID NO: 55125 - DNA, 20 bp, Artificial Sequence
  chemically synthesized
gtcacaaatttctctgtcac

SEQ ID NO: 55126 - DNA, 20 bp, Artificial Sequence
  chemically synthesized
aatttctctgtcacgagcta

SEQ ID NO: 55127 - DNA, 20 bp, Artificial Sequence
  chemically synthesized
gagctatagtgtaccatact

SEQ ID NO: 55128 - DNA, 20 bp, Artificial Sequence
  chemically synthesized
accatactaagtgatttata

SEQ ID NO: 55129 - DNA, 20 bp, Artificial Sequence
  chemically synthesized
actaagtgatttatatagat

SEQ ID NO: 55130 - DNA, 20 bp, Artificial Sequence
  chemically synthesized
agattagttcatttaatcca

SEQ ID NO: 55131 - DNA, 20 bp, Artificial Sequence
  chemically synthesized
atccacggaacaaatatatg

SEQ ID NO: 55132 - DNA, 20 bp, Artificial Sequence
  chemically synthesized
caaatatatgaagaaattat

SEQ ID NO: 55133 - DNA, 20 bp, Artificial Sequence
  chemically synthesized
ttgtctacatgttacaaatg

SEQ ID NO: 55134 - DNA, 20 bp, Artificial Sequence
  chemically synthesized
acatgttacaaatgtagaaa

SEQ ID NO: 55135 - DNA, 20 bp, Artificial Sequence
  chemically synthesized
caaatgtagaaacagaaaca

SEQ ID NO: 55136 - DNA, 20 bp, Artificial Sequence
  chemically synthesized
aatgtagaaacagaaacata

SEQ ID NO: 55137 - DNA, 20 bp, Artificial Sequence
  chemically synthesized
gtagaaacagaaacatagag

SEQ ID NO: 55138 - DNA, 20 bp, Artificial Sequence
  chemically synthesized
aacagaaacatagagaagtc

SEQ ID NO: 55139 - DNA, 20 bp, Artificial Sequence
  chemically synthesized
aagtcaagtcatcatgcccc

SEQ ID NO: 55140 - DNA, 20 bp, Artificial Sequence
  chemically synthesized
agtcatcatgccccaagtca

SEQ ID NO: 55141 - DNA, 20 bp, Artificial Sequence
  chemically synthesized
tcatcatgccccaagtcaaa

SEQ ID NO: 55142 - DNA, 20 bp, Artificial Sequence
  chemically synthesized
ccccaagtcaaagagttaat

SEQ ID NO: 55143 - DNA, 20 bp, Artificial Sequence
  chemically synthesized
caagtcaaagagttaataag

SEQ ID NO: 55144 - DNA, 20 bp, Artificial Sequence
  chemically synthesized
gtcaaagagttaataagtgg

SEQ ID NO: 55145 - DNA, 20 bp, Artificial Sequence
  chemically synthesized
gcagaatcacaactcaaaac

SEQ ID NO: 55146 - DNA, 20 bp, Artificial Sequence
  chemically synthesized
caactaaaaacctgattctt

SEQ ID NO: 55147 - DNA, 20 bp, Artificial Sequence
  chemically synthesized
tctttagcccaccatattat

SEQ ID NO: 55148 - DNA, 20 bp, Artificial Sequence
  chemically synthesized
ttagcccaccatattatcag

SEQ ID NO: 55149 - DNA, 20 bp, Artificial Sequence
  chemically synthesized
tggtcccataacttaaaatt

SEQ ID NO: 55150 - DNA, 20 bp, Artificial Sequence
  chemically synthesized
ttcagatttgactttaaaat

SEQ ID NO: 55151 - DNA, 20 bp, Artificial Sequence
  chemically synthesized
gactttaaaattggaatctg

SEQ ID NO: 55152 - DNA, 20 bp, Artificial Sequence
  chemically synthesized
attggaatctgaagaacacc

SEQ ID NO: 55153 - DNA, 20 bp, Artificial Sequence
  chemically synthesized
tgtaaaccattttctccttt

SEQ ID NO: 55154 - DNA, 20 bp, Artificial Sequence
  chemically synthesized
ttttctcctttgagattcat

SEQ ID NO: 55155 - DNA, 20 bp, Artificial Sequence
  chemically synthesized
tttctcctttgagattcatg

SEQ ID NO: 55156 - DNA, 20 bp, Artificial Sequence
  chemically synthesized
acctctgtttcctctaatta

SEQ ID NO: 55157 - DNA, 20 bp, Artificial Sequence
  chemically synthesized
tcatatattaataatgtata

SEQ ID NO: 55158 - DNA, 20 bp, Artificial Sequence
  chemically synthesized
catatattaataatgtataa

SEQ ID NO: 55159 - DNA, 20 bp, Artificial Sequence
  chemically synthesized
taatgtataaaggttttctc

SEQ ID NO: 55160 - DNA, 20 bp, Artificial Sequence
  chemically synthesized
atgtataaaggttttctcaa

SEQ ID NO: 55161 - DNA, 20 bp, Artificial Sequence
  chemically synthesized
tgtataaaggttttctcaag

SEQ ID NO: 55162 - DNA, 20 bp, Artificial Sequence
  chemically synthesized
tctcaagaggatctttataa

SEQ ID NO: 55163 - DNA, 20 bp, Artificial Sequence
  chemically synthesized
ctcaagaggatctttataaa

SEQ ID NO: 55164 - DNA, 20 bp, Artificial Sequence
  chemically synthesized
tcaagaggatctttataaaa

SEQ ID NO: 55165 - DNA, 20 bp, Artificial Sequence
  chemically synthesized
caagaggatctttataaaag

SEQ ID NO: 55166 - DNA, 20 bp, Artificial Sequence
  chemically synthesized
taaaaggggccttcccacat

SEQ ID NO: 55167 - DNA, 20 bp, Artificial Sequence
  chemically synthesized
cccacattagtttaactgct

SEQ ID NO: 55168 - DNA, 20 bp, Artificial Sequence
  chemically synthesized
ccacattagtttaactgctt

SEQ ID NO: 55169 - DNA, 20 bp, Artificial Sequence
  chemically synthesized
acttcctcaaccaacacttt

SEQ ID NO: 55170 - DNA, 20 bp, Artificial Sequence
  chemically synthesized
cacttttagaactatcatct

SEQ ID NO: 55171 - DNA, 20 bp, Artificial Sequence
  chemically synthesized
actatcatctaagattacat

SEQ ID NO: 55172 - DNA, 20 bp, Artificial Sequence
  chemically synthesized
acaataaataaatacttttt

SEQ ID NO: 55173 - DNA, 20 bp, Artificial Sequence
  chemically synthesized
taaataaatactttttaagc

SEQ ID NO: 55174 - DNA, 20 bp, Artificial Sequence
  chemically synthesized
tattacatattattcattct

SEQ ID NO: 55175 - DNA, 20 bp, Artificial Sequence
  chemically synthesized
catattattcattctaagtg

SEQ ID NO: 55176 - DNA, 20 bp, Artificial Sequence
  chemically synthesized
attcattctaagtgtagtcc

SEQ ID NO: 55177 - DNA, 20 bp, Artificial Sequence
  chemically synthesized
tctaagtgtagtcctagata

SEQ ID NO: 55178 - DNA, 20 bp, Artificial Sequence
  chemically synthesized
aagtgtagtcctagatatag

SEQ ID NO: 55179 - DNA, 20 bp, Artificial Sequence
  chemically synthesized
gtgtagtcctagatatagta

SEQ ID NO: 55180 - DNA, 20 bp, Artificial Sequence
  chemically synthesized
atatagtagagtactacgcc

SEQ ID NO: 55181 - DNA, 20 bp, Artificial Sequence
  chemically synthesized
agagtactacgccaagacat

SEQ ID NO: 55182 - DNA, 20 bp, Artificial Sequence
  chemically synthesized
gagtactacgccaagacatc

SEQ ID NO: 55183 - DNA, 20 bp, Artificial Sequence
  chemically synthesized
ctacgccaagacatcaggtc

SEQ ID NO: 55184 - DNA, 20 bp, Artificial Sequence
  chemically synthesized
tacgccaagacatcaggtca

SEQ ID NO: 55185 - DNA, 20 bp, Artificial Sequence
  chemically synthesized
gacatcaggtcaaggacaaa

SEQ ID NO: 55186 - DNA, 20 bp, Artificial Sequence
  chemically synthesized
ggacaaaaagatgatcctaa

SEQ ID NO: 55187 - DNA, 20 bp, Artificial Sequence
  chemically synthesized
caaaaagatgatcctaaaag

SEQ ID NO: 55188 - DNA, 20 bp, Artificial Sequence
  chemically synthesized
aaagatgatcctaaaagcag

SEQ ID NO: 55189 - DNA, 20 bp, Artificial Sequence
  chemically synthesized
agatgatcctaaaagcagaa

SEQ ID NO: 55190 - DNA, 20 bp, Artificial Sequence
  chemically synthesized
atcctaaaagcagaagagat

SEQ ID NO: 55191 - DNA, 20 bp, Artificial Sequence
  chemically synthesized
cagaagagatgagaaacaaa

SEQ ID NO: 55192 - DNA, 20 bp, Artificial Sequence
  chemically synthesized
tgagaaacaaatagcatata

SEQ ID NO: 55193 - DNA, 20 bp, Artificial Sequence
  chemically synthesized
gagaaacaaatagcatataa

SEQ ID NO: 55194 - DNA, 20 bp, Artificial Sequence
  chemically synthesized
gaaacaaatagcatataaag

SEQ ID NO: 55195 - DNA, 20 bp, Artificial Sequence
  chemically synthesized
tgtgacaacaaacatctcaa

SEQ ID NO: 55196 - DNA, 20 bp, Artificial Sequence
  chemically synthesized
acatctcaatagaaatcaca

SEQ ID NO: 55197 - DNA, 20 bp, Artificial Sequence
  chemically synthesized
caatagaaatcacacagtcc

SEQ ID NO: 55198 - DNA, 20 bp, Artificial Sequence
  chemically synthesized
atagaaatcacacagtccaa

SEQ ID NO: 55199 - DNA, 20 bp, Artificial Sequence
  chemically synthesized
agaaatcacacagtccaaga

SEQ ID NO: 55200 - DNA, 20 bp, Artificial Sequence
  chemically synthesized
aaatcacacagtccaagaga

SEQ ID NO: 55201 - DNA, 20 bp, Artificial Sequence
  chemically synthesized
agagtcgaatgaaattttca

SEQ ID NO: 55202 - DNA, 20 bp, Artificial Sequence
  chemically synthesized
aatgaaattttcaaagcgct

SEQ ID NO: 55203 - DNA, 20 bp, Artificial Sequence
  chemically synthesized
atgaaattttcaaagcgctc

SEQ ID NO: 55204 - DNA, 20 bp, Artificial Sequence
  chemically synthesized
tgaaattttcaaagcgctca

SEQ ID NO: 55205 - DNA, 20 bp, Artificial Sequence
  chemically synthesized
ttcaaagcgctcagggataa

SEQ ID NO: 55206 - DNA, 20 bp, Artificial Sequence
  chemically synthesized
ataaaagaaaactgatattc

SEQ ID NO: 55207 - DNA, 20 bp, Artificial Sequence
  chemically synthesized
tgatattcaagaatatttta

SEQ ID NO: 55208 - DNA, 20 bp, Artificial Sequence
  chemically synthesized
gatattcaagaatattttat

SEQ ID NO: 55209 - DNA, 20 bp, Artificial Sequence
  chemically synthesized
atattcaagaatattttata

SEQ ID NO: 55210 - DNA, 20 bp, Artificial Sequence
  chemically synthesized
taaaactgttattcaaatat

SEQ ID NO: 55211 - DNA, 20 bp, Artificial Sequence
  chemically synthesized
tcaaatataagcaatatata

SEQ ID NO: 55212 - DNA, 20 bp, Artificial Sequence
  chemically synthesized
gcaatatataaagtctttcc

SEQ ID NO: 55213 - DNA, 20 bp, Artificial Sequence
  chemically synthesized
agtctttcccagacaaacaa

SEQ ID NO: 55214 - DNA, 20 bp, Artificial Sequence
  chemically synthesized
ttcccagacaaacaaaagtt

SEQ ID NO: 55215 - DNA, 20 bp, Artificial Sequence
  chemically synthesized
cccagacaaacaaaagttga

SEQ ID NO: 55216 - DNA, 20 bp, Artificial Sequence
  chemically synthesized
ttgagagaattcaccaacac

SEQ ID NO: 55217 - DNA, 20 bp, Artificial Sequence
  chemically synthesized
ccatcttgcaaaaaatgcta

SEQ ID NO: 55218 - DNA, 20 bp, Artificial Sequence
  chemically synthesized
catcttgcaaaaaatgctaa

SEQ ID NO: 55219 - DNA, 20 bp, Artificial Sequence
  chemically synthesized
atcttgcaaaaaatgctaaa

SEQ ID NO: 55220 - DNA, 20 bp, Artificial Sequence
  chemically synthesized
cttgcaaaaaatgctaaagg

SEQ ID NO: 55221 - DNA, 20 bp, Artificial Sequence
  chemically synthesized
aagggagttatgcaatctga

SEQ ID NO: 55222 - DNA, 20 bp, Artificial Sequence
  chemically synthesized
ttatgcaatctgaaagaaaa

SEQ ID NO: 55223 - DNA, 20 bp, Artificial Sequence
  chemically synthesized
aaaaagacattaacatgcaa

SEQ ID NO: 55224 - DNA, 20 bp, Artificial Sequence
  chemically synthesized
atgcaaaagaaaacttttca

SEQ ID NO: 55225 - DNA, 20 bp, Artificial Sequence
  chemically synthesized
tttcaaagtatgaaacccac

SEQ ID NO: 55226 - DNA, 20 bp, Artificial Sequence
  chemically synthesized
tgaaacccactggtaaaatt

SEQ ID NO: 55227 - DNA, 20 bp, Artificial Sequence
  chemically synthesized
cactggtaaaattaagtaca

SEQ ID NO: 55228 - DNA, 20 bp, Artificial Sequence
  chemically synthesized
attaagtacatagacaaacc

SEQ ID NO: 55229 - DNA, 20 bp, Artificial Sequence
  chemically synthesized
taccccattactgtattttt

SEQ ID NO: 55230 - DNA, 20 bp, Artificial Sequence
  chemically synthesized
tttttggtgtgcaatccaca

SEQ ID NO: 55231 - DNA, 20 bp, Artificial Sequence
  chemically synthesized
gtgcaatccacacagaactc

SEQ ID NO: 55232 - DNA, 20 bp, Artificial Sequence
  chemically synthesized
aaaaacaaatctttcaaaaa

SEQ ID NO: 55233 - DNA, 20 bp, Artificial Sequence
  chemically synthesized
aaatctttcaaaaacagtaa

SEQ ID NO: 55234 - DNA, 20 bp, Artificial Sequence
  chemically synthesized
ttcaaaaacagtaatagcta

SEQ ID NO: 55235 - DNA, 20 bp, Artificial Sequence
  chemically synthesized
aatagctatagcaacctttt

SEQ ID NO: 55236 - DNA, 20 bp, Artificial Sequence
  chemically synthesized
tatagcaaccttttaagatg

SEQ ID NO: 55237 - DNA, 20 bp, Artificial Sequence
  chemically synthesized
atagcaaccttttaagatgt

SEQ ID NO: 55238 - DNA, 20 bp, Artificial Sequence
  chemically synthesized
taatataaaatatgtaaaat

SEQ ID NO: 55239 - DNA, 20 bp, Artificial Sequence
  chemically synthesized
aaatatgtaaaatgagacaa

SEQ ID NO: 55240 - DNA, 20 bp, Artificial Sequence
  chemically synthesized
atgagacaaaagtcaaaatg

SEQ ID NO: 55241 - DNA, 20 bp, Artificial Sequence
  chemically synthesized
tgagacaaaagtcaaaatgt

SEQ ID NO: 55242 - DNA, 20 bp, Artificial Sequence
  chemically synthesized
gagacaaaagtcaaaatgtg

SEQ ID NO: 55243 - DNA, 20 bp, Artificial Sequence
  chemically synthesized
agacaaaagtcaaaatgtgg

SEQ ID NO: 55244 - DNA, 20 bp, Artificial Sequence
  chemically synthesized
caaaagtcaaaatgtggggg

SEQ ID NO: 55245 - DNA, 20 bp, Artificial Sequence
  chemically synthesized
aaagtcaaaatgtgggggtg

SEQ ID NO: 55246 - DNA, 20 bp, Artificial Sequence
  chemically synthesized
gtcaaaatgtgggggtggag

SEQ ID NO: 55247 - DNA, 20 bp, Artificial Sequence
  chemically synthesized
caaaatgtgggggtggagtg

SEQ ID NO: 55248 - DNA, 20 bp, Artificial Sequence
  chemically synthesized
gtgggggtggagtggagtta

SEQ ID NO: 55249 - DNA, 20 bp, Artificial Sequence
  chemically synthesized
ggtggagtggagttaaagtg

SEQ ID NO: 55250 - DNA, 20 bp, Artificial Sequence
  chemically synthesized
tattcctttatttgcgatct

SEQ ID NO: 55251 - DNA, 20 bp, Artificial Sequence
  chemically synthesized
aaataacttgctatatttat

SEQ ID NO: 55252 - DNA, 20 bp, Artificial Sequence
  chemically synthesized
atttataagatgtttcttgt

SEQ ID NO: 55253 - DNA, 20 bp, Artificial Sequence
  chemically synthesized
gatgtttcttgtaagcccca

SEQ ID NO: 55254 - DNA, 20 bp, Artificial Sequence
  chemically synthesized
tgtaagccccatggtaacca

SEQ ID NO: 55255 - DNA, 20 bp, Artificial Sequence
  chemically synthesized
cacagcacaaaaatctataa

SEQ ID NO: 55256 - DNA, 20 bp, Artificial Sequence
  chemically synthesized
atagatttactaaaaataaa

SEQ ID NO: 55257 - DNA, 20 bp, Artificial Sequence
  chemically synthesized
aacaaattaaaatatgctac

SEQ ID NO: 55258 - DNA, 20 bp, Artificial Sequence
  chemically synthesized
caaattaaaatatgctacca

SEQ ID NO: 55259 - DNA, 20 bp, Artificial Sequence
  chemically synthesized
gagataatcacataaccatg

SEQ ID NO: 55260 - DNA, 20 bp, Artificial Sequence
  chemically synthesized
agataatcacataaccatga

SEQ ID NO: 55261 - DNA, 20 bp, Artificial Sequence
  chemically synthesized
cataaccatgaaggaaaaaa

SEQ ID NO: 55262 - DNA, 20 bp, Artificial Sequence
  chemically synthesized
ataaccatgaaggaaaaaaa

SEQ ID NO: 55263 - DNA, 20 bp, Artificial Sequence
  chemically synthesized
accatgaaggaaaaaaaagg

SEQ ID NO: 55264 - DNA, 20 bp, Artificial Sequence
  chemically synthesized
catgaaggaaaaaaaaggaa

SEQ ID NO: 55265 - DNA, 20 bp, Artificial Sequence
  chemically synthesized
tgaaggaaaaaaaaggaaga

SEQ ID NO: 55266 - DNA, 20 bp, Artificial Sequence
  chemically synthesized
gaaggaaaaaaaaggaagag

SEQ ID NO: 55267 - DNA, 20 bp, Artificial Sequence
  chemically synthesized
aggaaaaaaaaggaagagag

SEQ ID NO: 55268 - DNA, 20 bp, Artificial Sequence
  chemically synthesized
ggaagagaggagtctccata

SEQ ID NO: 55269 - DNA, 20 bp, Artificial Sequence
  chemically synthesized
gtctccatacagccaaaaat

SEQ ID NO: 55270 - DNA, 20 bp, Artificial Sequence
  chemically synthesized
aaaaaaaaaaaaaaaaaaaa

SEQ ID NO: 55271 - DNA, 20 bp, Artificial Sequence
  chemically synthesized
aaaaaaaaaaaaaaaaaaaa

SEQ ID NO: 55272 - DNA, 20 bp, Artificial Sequence
  chemically synthesized
aaaaaaaggaaatccttact

SEQ ID NO: 55273 - DNA, 20 bp, Artificial Sequence
  chemically synthesized
ccttacttagtaactacact

SEQ ID NO: 55274 - DNA, 20 bp, Artificial Sequence
  chemically synthesized
gtaactacactgagtgtaaa

SEQ ID NO: 55275 - DNA, 20 bp, Artificial Sequence
  chemically synthesized
acactgagtgtaaatagtct

SEQ ID NO: 55276 - DNA, 20 bp, Artificial Sequence
  chemically synthesized
agtctcagttccccaattaa

SEQ ID NO: 55277 - DNA, 20 bp, Artificial Sequence
  chemically synthesized
agttccccaattaaaagtaa

SEQ ID NO: 55278 - DNA, 20 bp, Artificial Sequence
  chemically synthesized
cccaattaaaagtaatagaa

SEQ ID NO: 55279 - DNA, 20 bp, Artificial Sequence
  chemically synthesized
aaaagtaatagaatggtaaa

SEQ ID NO: 55280 - DNA, 20 bp, Artificial Sequence
  chemically synthesized
aatagaatggtaaatggata

SEQ ID NO: 55281 - DNA, 20 bp, Artificial Sequence
  chemically synthesized
tccaactttatgcgatcttc

SEQ ID NO: 55282 - DNA, 20 bp, Artificial Sequence
  chemically synthesized
agaaacccacttcacctata

SEQ ID NO: 55283 - DNA, 20 bp, Artificial Sequence
  chemically synthesized
gaaacccacttcacctataa

SEQ ID NO: 55284 - DNA, 20 bp, Artificial Sequence
  chemically synthesized
ataaaggcacacataaatga

SEQ ID NO: 55285 - DNA, 20 bp, Artificial Sequence
  chemically synthesized
ggcacacataaatgaaagtg

SEQ ID NO: 55286 - DNA, 20 bp, Artificial Sequence
  chemically synthesized
gcacacataaatgaaagtga

SEQ ID NO: 55287 - DNA, 20 bp, Artificial Sequence
  chemically synthesized
cacacataaatgaaagtgaa

SEQ ID NO: 55288 - DNA, 20 bp, Artificial Sequence
  chemically synthesized
cataaatgaaagtgaagggt

SEQ ID NO: 55289 - DNA, 20 bp, Artificial Sequence
  chemically synthesized
tggaaaaaaattccatgaac

SEQ ID NO: 55290 - DNA, 20 bp, Artificial Sequence
  chemically synthesized
aaattccatgaactggaaac

SEQ ID NO: 55291 - DNA, 20 bp, Artificial Sequence
  chemically synthesized
tccatgaactggaaaccaga

SEQ ID NO: 55292 - DNA, 20 bp, Artificial Sequence
  chemically synthesized
catgaactggaaaccagaaa

SEQ ID NO: 55293 - DNA, 20 bp, Artificial Sequence
  chemically synthesized
gaactggaaaccagaaagag

SEQ ID NO: 55294 - DNA, 20 bp, Artificial Sequence
  chemically synthesized
ctggaaaccagaaagagcag

SEQ ID NO: 55295 - DNA, 20 bp, Artificial Sequence
  chemically synthesized
agtagtaattgtacttaaat

SEQ ID NO: 55296 - DNA, 20 bp, Artificial Sequence
  chemically synthesized
tgtacttaaatcagataaaa

SEQ ID NO: 55297 - DNA, 20 bp, Artificial Sequence
  chemically synthesized
actacaaatttaaaaactgt

SEQ ID NO: 55298 - DNA, 20 bp, Artificial Sequence
  chemically synthesized
aaatttaaaaactgtaagaa

SEQ ID NO: 55299 - DNA, 20 bp, Artificial Sequence
  chemically synthesized
taaaaactgtaagaaaagat

SEQ ID NO: 55300 - DNA, 20 bp, Artificial Sequence
  chemically synthesized
aaaaactgtaagaaaagata

SEQ ID NO: 55301 - DNA, 20 bp, Artificial Sequence
  chemically synthesized
aaactgtaagaaaagataag

SEQ ID NO: 55302 - DNA, 20 bp, Artificial Sequence
  chemically synthesized
aactgtaagaaaagataagg

SEQ ID NO: 55303 - DNA, 20 bp, Artificial Sequence
  chemically synthesized
actgtaagaaaagataagga

SEQ ID NO: 55304 - DNA, 20 bp, Artificial Sequence
  chemically synthesized
agggtcactgtataataata

SEQ ID NO: 55305 - DNA, 20 bp, Artificial Sequence
  chemically synthesized
gggtcactgtataataataa

SEQ ID NO: 55306 - DNA, 20 bp, Artificial Sequence
  chemically synthesized
ggtcactgtataataataaa

SEQ ID NO: 55307 - DNA, 20 bp, Artificial Sequence
  chemically synthesized
gtcactgtataataataaag

SEQ ID NO: 55308 - DNA, 20 bp, Artificial Sequence
  chemically synthesized
taataataaaggggtcaatt

SEQ ID NO: 55309 - DNA, 20 bp, Artificial Sequence
  chemically synthesized
aataaaggggtcaattcagc

SEQ ID NO: 55310 - DNA, 20 bp, Artificial Sequence
  chemically synthesized
taaaggggtcaattcagcaa

SEQ ID NO: 55311 - DNA, 20 bp, Artificial Sequence
  chemically synthesized
aaaggggtcaattcagcaag

SEQ ID NO: 55312 - DNA, 20 bp, Artificial Sequence
  chemically synthesized
tattgatgtatccaacatca

SEQ ID NO: 55313 - DNA, 20 bp, Artificial Sequence
  chemically synthesized
tatccaacatcaaagttccc

SEQ ID NO: 55314 - DNA, 20 bp, Artificial Sequence
  chemically synthesized
atcaaagttcccaagtatat

SEQ ID NO: 55315 - DNA, 20 bp, Artificial Sequence
  chemically synthesized
tcaaagttcccaagtatata

SEQ ID NO: 55316 - DNA, 20 bp, Artificial Sequence
  chemically synthesized
gtatataaggaaaacattaa

SEQ ID NO: 55317 - DNA, 20 bp, Artificial Sequence
  chemically synthesized
ggaaaacattaatagtccta

SEQ ID NO: 55318 - DNA, 20 bp, Artificial Sequence
  chemically synthesized
gaaaacattaatagtcctaa

SEQ ID NO: 55319 - DNA, 20 bp, Artificial Sequence
  chemically synthesized
aaaacattaatagtcctaaa

SEQ ID NO: 55320 - DNA, 20 bp, Artificial Sequence
  chemically synthesized
cattaatagtcctaaagggc

SEQ ID NO: 55321 - DNA, 20 bp, Artificial Sequence
  chemically synthesized
aatagtcctaaagggcgaga

SEQ ID NO: 55322 - DNA, 20 bp, Artificial Sequence
  chemically synthesized
gacagactgcaatacaataa

SEQ ID NO: 55323 - DNA, 20 bp, Artificial Sequence
  chemically synthesized
agactgcaatacaataatag

SEQ ID NO: 55324 - DNA, 20 bp, Artificial Sequence
  chemically synthesized
gactgcaatacaataatagt

SEQ ID NO: 55325 - DNA, 20 bp, Artificial Sequence
  chemically synthesized
actgcaatacaataatagta

SEQ ID NO: 55326 - DNA, 20 bp, Artificial Sequence
  chemically synthesized
gtagggaactttaaacactt

SEQ ID NO: 55327 - DNA, 20 bp, Artificial Sequence
  chemically synthesized
aactttaaacacttcagtct

SEQ ID NO: 55328 - DNA, 20 bp, Artificial Sequence
  chemically synthesized
acttcagtctcagtaatgaa

SEQ ID NO: 55329 - DNA, 20 bp, Artificial Sequence
  chemically synthesized
agtctcagtaatgaacagat

SEQ ID NO: 55330 - DNA, 20 bp, Artificial Sequence
  chemically synthesized
tcagtaatgaacagatcggc

SEQ ID NO: 55331 - DNA, 20 bp, Artificial Sequence
  chemically synthesized
aaatcaacaaatgaacaaca

SEQ ID NO: 55332 - DNA, 20 bp, Artificial Sequence
  chemically synthesized
aatgtacccactatatctaa

SEQ ID NO: 55333 - DNA, 20 bp, Artificial Sequence
  chemically synthesized
atagacccaactgacattaa

SEQ ID NO: 55334 - DNA, 20 bp, Artificial Sequence
  chemically synthesized
aacttgtcccccaactgctg

SEQ ID NO: 55335 - DNA, 20 bp, Artificial Sequence
  chemically synthesized
ttgtcccccaactgctgaag

SEQ ID NO: 55336 - DNA, 20 bp, Artificial Sequence
  chemically synthesized
gaagaagatacatttcttta

SEQ ID NO: 55337 - DNA, 20 bp, Artificial Sequence
  chemically synthesized
gaagatacatttctttaaag

SEQ ID NO: 55338 - DNA, 20 bp, Artificial Sequence
  chemically synthesized
tgtacaacattttcctaaat

SEQ ID NO: 55339 - DNA, 20 bp, Artificial Sequence
  chemically synthesized
gtacaacattttcctaaata

SEQ ID NO: 55340 - DNA, 20 bp, Artificial Sequence
  chemically synthesized
tcctaaataaggccatatgt

SEQ ID NO: 55341 - DNA, 20 bp, Artificial Sequence
  chemically synthesized
cctaaataaggccatatgtt

SEQ ID NO: 55342 - DNA, 20 bp, Artificial Sequence
  chemically synthesized
aaggccatatgttaggccac

SEQ ID NO: 55343 - DNA, 20 bp, Artificial Sequence
  chemically synthesized
aggccatatgttaggccaca

SEQ ID NO: 55344 - DNA, 20 bp, Artificial Sequence
  chemically synthesized
catatgttaggccacaaggt

SEQ ID NO: 55345 - DNA, 20 bp, Artificial Sequence
  chemically synthesized
gtaagtttgtacaaattttt

SEQ ID NO: 55346 - DNA, 20 bp, Artificial Sequence
  chemically synthesized
agtttgtacaaatttttcag

SEQ ID NO: 55347 - DNA, 20 bp, Artificial Sequence
  chemically synthesized
ttgtacaaatttttcagaag

SEQ ID NO: 55348 - DNA, 20 bp, Artificial Sequence
  chemically synthesized
tcagaagtagaaattttatc

SEQ ID NO: 55349 - DNA, 20 bp, Artificial Sequence
  chemically synthesized
tcaagtatattttctgacca

SEQ ID NO: 55350 - DNA, 20 bp, Artificial Sequence
  chemically synthesized
agtatattttctgaccacag

SEQ ID NO: 55351 - DNA, 20 bp, Artificial Sequence
  chemically synthesized
tgaccacagtggaataaaac

SEQ ID NO: 55352 - DNA, 20 bp, Artificial Sequence
  chemically synthesized
taaaactagaaatgaataac

SEQ ID NO: 55353 - DNA, 20 bp, Artificial Sequence
  chemically synthesized
aactagaaatgaataacaag

SEQ ID NO: 55354 - DNA, 20 bp, Artificial Sequence
  chemically synthesized
atgaataacaagaagatcat

SEQ ID NO: 55355 - DNA, 20 bp, Artificial Sequence
  chemically synthesized
aagaagatcatcagaaaata

SEQ ID NO: 55356 - DNA, 20 bp, Artificial Sequence
  chemically synthesized
tcagaaaatatagaaacata

SEQ ID NO: 55357 - DNA, 20 bp, Artificial Sequence
  chemically synthesized
agaaacatatggaaatcaaa

SEQ ID NO: 55358 - DNA, 20 bp, Artificial Sequence
  chemically synthesized
aacagtatgctcctgaatgt

SEQ ID NO: 55359 - DNA, 20 bp, Artificial Sequence
  chemically synthesized
acagtatgctcctgaatgtc

SEQ ID NO: 55360 - DNA, 20 bp, Artificial Sequence
  chemically synthesized
ctcctgaatgtcaggcctct

SEQ ID NO: 55361 - DNA, 20 bp, Artificial Sequence
  chemically synthesized
aatgtcaggcctctgagccc

SEQ ID NO: 55362 - DNA, 20 bp, Artificial Sequence
  chemically synthesized
caggcctctgagcccaagct

SEQ ID NO: 55363 - DNA, 20 bp, Artificial Sequence
  chemically synthesized
gtgacctgcatatacacata

SEQ ID NO: 55364 - DNA, 20 bp, Artificial Sequence
  chemically synthesized
cctgcatatacacatacaga

SEQ ID NO: 55365 - DNA, 20 bp, Artificial Sequence
  chemically synthesized
catatacacatacagatggc

SEQ ID NO: 55366 - DNA, 20 bp, Artificial Sequence
  chemically synthesized
ctgatgacattccaccacaa

SEQ ID NO: 55367 - DNA, 20 bp, Artificial Sequence
  chemically synthesized
atgacattccaccacaaaag

SEQ ID NO: 55368 - DNA, 20 bp, Artificial Sequence
  chemically synthesized
caccacaaaagaagtgaaaa

SEQ ID NO: 55369 - DNA, 20 bp, Artificial Sequence
  chemically synthesized
tcttgtgaaattccttctcc

SEQ ID NO: 55370 - DNA, 20 bp, Artificial Sequence
  chemically synthesized
ttccttctcctggctcatcc

SEQ ID NO: 55371 - DNA, 20 bp, Artificial Sequence
  chemically synthesized
cctggctcatcctggctcaa

SEQ ID NO: 55372 - DNA, 20 bp, Artificial Sequence
  chemically synthesized
ggctcaaaagctcccctact

SEQ ID NO: 55373 - DNA, 20 bp, Artificial Sequence
  chemically synthesized
tgacccccactcctgcccgc

SEQ ID NO: 55374 - DNA, 20 bp, Artificial Sequence
  chemically synthesized
acccccactcctgcccgcca

SEQ ID NO: 55375 - DNA, 20 bp, Artificial Sequence
  chemically synthesized
cctacccaaatcttataaaa

SEQ ID NO: 55376 - DNA, 20 bp, Artificial Sequence
  chemically synthesized
ccctttgctgactctctttt

SEQ ID NO: 55377 - DNA, 20 bp, Artificial Sequence
  chemically synthesized
gctgactctctttttggact

SEQ ID NO: 55378 - DNA, 20 bp, Artificial Sequence
  chemically synthesized
ggactcagcctgcctgcacc

SEQ ID NO: 55379 - DNA, 20 bp, Artificial Sequence
  chemically synthesized
gactcagcctgcctgcaccc

SEQ ID NO: 55380 - DNA, 20 bp, Artificial Sequence
  chemically synthesized
ctgcacccaggtgaaataaa

SEQ ID NO: 55381 - DNA, 20 bp, Artificial Sequence
  chemically synthesized
acagccttgttgcttacaca

SEQ ID NO: 55382 - DNA, 20 bp, Artificial Sequence
  chemically synthesized
ttgcttacacaaagcctgtt

SEQ ID NO: 55383 - DNA, 20 bp, Artificial Sequence
  chemically synthesized
cttacacaaagcctgtttgg

SEQ ID NO: 55384 - DNA, 20 bp, Artificial Sequence
  chemically synthesized
tgtttggtagtctcttcata

SEQ ID NO: 55385 - DNA, 20 bp, Artificial Sequence
  chemically synthesized
atatggacgcgcatgaaatt

SEQ ID NO: 55386 - DNA, 20 bp, Artificial Sequence
  chemically synthesized
tgaaatttggtgccgtgact

SEQ ID NO: 55387 - DNA, 20 bp, Artificial Sequence
  chemically synthesized
tttggtgccgtgactcagat

SEQ ID NO: 55388 - DNA, 20 bp, Artificial Sequence
  chemically synthesized
ttggtgccgtgactcagatt

SEQ ID NO: 55389 - DNA, 20 bp, Artificial Sequence
  chemically synthesized
tggtgccgtgactcagattg

SEQ ID NO: 55390 - DNA, 20 bp, Artificial Sequence
  chemically synthesized
ggtgccgtgactcagattgg

SEQ ID NO: 55391 - DNA, 20 bp, Artificial Sequence
  chemically synthesized
tcagattgggggacctccct

SEQ ID NO: 55392 - DNA, 20 bp, Artificial Sequence
  chemically synthesized
cagattgggggacctccctt

SEQ ID NO: 55393 - DNA, 20 bp, Artificial Sequence
  chemically synthesized
gattgggggacctcccttgg

SEQ ID NO: 55394 - DNA, 20 bp, Artificial Sequence
  chemically synthesized
cctcctgctctttgctccgt

SEQ ID NO: 55395 - DNA, 20 bp, Artificial Sequence
  chemically synthesized
ctgctctttgctccgtgaga

SEQ ID NO: 55396 - DNA, 20 bp, Artificial Sequence
  chemically synthesized
gaaagatccacctacgacct

SEQ ID NO: 55397 - DNA, 20 bp, Artificial Sequence
  chemically synthesized
aaagatccacctacgacctc

SEQ ID NO: 55398 - DNA, 20 bp, Artificial Sequence
  chemically synthesized
cctcaggtcctcaaactgac

SEQ ID NO: 55399 - DNA, 20 bp, Artificial Sequence
  chemically synthesized
gtcctcaaactgaccagccc

SEQ ID NO: 55400 - DNA, 20 bp, Artificial Sequence
  chemically synthesized
catttcaccaatttcaaatc

SEQ ID NO: 55401 - DNA, 20 bp, Artificial Sequence
  chemically synthesized
tcaccaatttcaaatccggt

SEQ ID NO: 55402 - DNA, 20 bp, Artificial Sequence
  chemically synthesized
ccaatttcaaatccggtaag

SEQ ID NO: 55403 - DNA, 20 bp, Artificial Sequence
  chemically synthesized
cttctttctcctttcaatct

SEQ ID NO: 55404 - DNA, 20 bp, Artificial Sequence
  chemically synthesized
tttcaattcctttcattttc

SEQ ID NO: 55405 - DNA, 20 bp, Artificial Sequence
  chemically synthesized
caattcctttcattttccag

SEQ ID NO: 55406 - DNA, 20 bp, Artificial Sequence
  chemically synthesized
attcctttcattttccagta

SEQ ID NO: 55407 - DNA, 20 bp, Artificial Sequence
  chemically synthesized
ttcattttccagtagagaca

SEQ ID NO: 55408 - DNA, 20 bp, Artificial Sequence
  chemically synthesized
tcattttccagtagagacaa

SEQ ID NO: 55409 - DNA, 20 bp, Artificial Sequence
  chemically synthesized
attttccagtagagacaaag

SEQ ID NO: 55410 - DNA, 20 bp, Artificial Sequence
  chemically synthesized
aaggagacatgttttatccg

SEQ ID NO: 55411 - DNA, 20 bp, Artificial Sequence
  chemically synthesized
tatccgtggacccaaaactc

SEQ ID NO: 55412 - DNA, 20 bp, Artificial Sequence
  chemically synthesized
tggacccaaaactccggtgc

SEQ ID NO: 55413 - DNA, 20 bp, Artificial Sequence
  chemically synthesized
caaaactccggtgccagtca

SEQ ID NO: 55414 - DNA, 20 bp, Artificial Sequence
  chemically synthesized
ctccggtgccagtcacggac

SEQ ID NO: 55415 - DNA, 20 bp, Artificial Sequence
  chemically synthesized
tccggtgccagtcacggact

SEQ ID NO: 55416 - DNA, 20 bp, Artificial Sequence
  chemically synthesized
ggtgccagtcacggactggg

SEQ ID NO: 55417 - DNA, 20 bp, Artificial Sequence
  chemically synthesized
gtgccagtcacggactggga

SEQ ID NO: 55418 - DNA, 20 bp, Artificial Sequence
  chemically synthesized
ccagtcacggactgggaagg

SEQ ID NO: 55419 - DNA, 20 bp, Artificial Sequence
  chemically synthesized
ctgggaaggcagccttccct

SEQ ID NO: 55420 - DNA, 20 bp, Artificial Sequence
  chemically synthesized
cccttggtgtttaatcattg

SEQ ID NO: 55421 - DNA, 20 bp, Artificial Sequence
  chemically synthesized
ccttggtgtttaatcattgc

SEQ ID NO: 55422 - DNA, 20 bp, Artificial Sequence
  chemically synthesized
cttggtgtttaatcattgca

SEQ ID NO: 55423 - DNA, 20 bp, Artificial Sequence
  chemically synthesized
ctgattattaaaccatgttt

SEQ ID NO: 55424 - DNA, 20 bp, Artificial Sequence
  chemically synthesized
gattattaaaccatgtttca

SEQ ID NO: 55425 - DNA, 20 bp, Artificial Sequence
  chemically synthesized
attattaaaccatgtttcag

SEQ ID NO: 55426 - DNA, 20 bp, Artificial Sequence
  chemically synthesized
aaaccatgtttcagaggtgt

SEQ ID NO: 55427 - DNA, 20 bp, Artificial Sequence
  chemically synthesized
ttcagaggtgtcagaccacg

SEQ ID NO: 55428 - DNA, 20 bp, Artificial Sequence
  chemically synthesized
tcagaggtgtcagaccacgc

SEQ ID NO: 55429 - DNA, 20 bp, Artificial Sequence
  chemically synthesized
cagaggtgtcagaccacgca

SEQ ID NO: 55430 - DNA, 20 bp, Artificial Sequence
  chemically synthesized
ccacgcagggatgcctgcct

SEQ ID NO: 55431 - DNA, 20 bp, Artificial Sequence
  chemically synthesized
ctgccttggtccttcaccct

SEQ ID NO: 55432 - DNA, 20 bp, Artificial Sequence
  chemically synthesized
ccttggtccttcacccttag

SEQ ID NO: 55433 - DNA, 20 bp, Artificial Sequence
  chemically synthesized
agcggcaaatcccacttttc

SEQ ID NO: 55434 - DNA, 20 bp, Artificial Sequence
  chemically synthesized
cggcaaatcccacttttctg

SEQ ID NO: 55435 - DNA, 20 bp, Artificial Sequence
  chemically synthesized
ggcaaatcccacttttctgg

SEQ ID NO: 55436 - DNA, 20 bp, Artificial Sequence
  chemically synthesized
gcaaatcccacttttctgga

SEQ ID NO: 55437 - DNA, 20 bp, Artificial Sequence
  chemically synthesized
caaatcccacttttctggag

SEQ ID NO: 55438 - DNA, 20 bp, Artificial Sequence
  chemically synthesized
aaatcccacttttctggagg

SEQ ID NO: 55439 - DNA, 20 bp, Artificial Sequence
  chemically synthesized
aatcccacttttctggaggg

SEQ ID NO: 55440 - DNA, 20 bp, Artificial Sequence
  chemically synthesized
ccacttttctggaggggggt

SEQ ID NO: 55441 - DNA, 20 bp, Artificial Sequence
  chemically synthesized
ctgccccttcactgcttttc

SEQ ID NO: 55442 - DNA, 20 bp, Artificial Sequence
  chemically synthesized
tgccccttcactgcttttct

SEQ ID NO: 55443 - DNA, 20 bp, Artificial Sequence
  chemically synthesized
gccccttcactgcttttctg

SEQ ID NO: 55444 - DNA, 20 bp, Artificial Sequence
  chemically synthesized
ccccttcactgcttttctgg

SEQ ID NO: 55445 - DNA, 20 bp, Artificial Sequence
  chemically synthesized
ttcactgcttttctgggggc

SEQ ID NO: 55446 - DNA, 20 bp, Artificial Sequence
  chemically synthesized
tgtgccccaacctcttatct

SEQ ID NO: 55447 - DNA, 20 bp, Artificial Sequence
  chemically synthesized
caaccccttgcccatttttc

SEQ ID NO: 55448 - DNA, 20 bp, Artificial Sequence
  chemically synthesized
cccttgcccatttttctggt

SEQ ID NO: 55449 - DNA, 20 bp, Artificial Sequence
  chemically synthesized
tgcccatttttctggtgagt

SEQ ID NO: 55450 - DNA, 20 bp, Artificial Sequence
  chemically synthesized
tctgtactctttcttttctc

SEQ ID NO: 55451 - DNA, 20 bp, Artificial Sequence
  chemically synthesized
ctgtactctttcttttctct

SEQ ID NO: 55452 - DNA, 20 bp, Artificial Sequence
  chemically synthesized
tctgggcttgcctccttcac

SEQ ID NO: 55453 - DNA, 20 bp, Artificial Sequence
  chemically synthesized
ctgggcttgcctccttcact

SEQ ID NO: 55454 - DNA, 20 bp, Artificial Sequence
  chemically synthesized
tgggcttgcctccttcacta

SEQ ID NO: 55455 - DNA, 20 bp, Artificial Sequence
  chemically synthesized
gggcttgcctccttcactag

SEQ ID NO: 55456 - DNA, 20 bp, Artificial Sequence
  chemically synthesized
ctccattcctccctctccct

SEQ ID NO: 55457 - DNA, 20 bp, Artificial Sequence
  chemically synthesized
ctcccttagcctgtgctctc

SEQ ID NO: 55458 - DNA, 20 bp, Artificial Sequence
  chemically synthesized
aatgccttattttcttctgc

SEQ ID NO: 55459 - DNA, 20 bp, Artificial Sequence
  chemically synthesized
atgccttattttcttctgca

SEQ ID NO: 55460 - DNA, 20 bp, Artificial Sequence
  chemically synthesized
tgactccaatacaaactcga

SEQ ID NO: 55461 - DNA, 20 bp, Artificial Sequence
  chemically synthesized
ctccaatacaaactcgacag

SEQ ID NO: 55462 - DNA, 20 bp, Artificial Sequence
  chemically synthesized
aactcgacagtggttccaaa

SEQ ID NO: 55463 - DNA, 20 bp, Artificial Sequence
  chemically synthesized
cgacagtggttccaaatagc

SEQ ID NO: 55464 - DNA, 20 bp, Artificial Sequence
  chemically synthesized
ggttccaaatagccagaaaa

SEQ ID NO: 55465 - DNA, 20 bp, Artificial Sequence
  chemically synthesized
tttcaatttttccattcttc

SEQ ID NO: 55466 - DNA, 20 bp, Artificial Sequence
  chemically synthesized
aaataatttttgtcgtaaaa

SEQ ID NO: 55467 - DNA, 20 bp, Artificial Sequence
  chemically synthesized
aataatttttgtcgtaaaac

SEQ ID NO: 55468 - DNA, 20 bp, Artificial Sequence
  chemically synthesized
tttgtcgtaaaacaggcaaa

SEQ ID NO: 55469 - DNA, 20 bp, Artificial Sequence
  chemically synthesized
gtaaaacaggcaaacagtct

SEQ ID NO: 55470 - DNA, 20 bp, Artificial Sequence
  chemically synthesized
taaaacaggcaaacagtctg

SEQ ID NO: 55471 - DNA, 20 bp, Artificial Sequence
  chemically synthesized
agtctgaggtgcctgacgtc

SEQ ID NO: 55472 - DNA, 20 bp, Artificial Sequence
  chemically synthesized
gtctgaggtgcctgacgtcc

SEQ ID NO: 55473 - DNA, 20 bp, Artificial Sequence
  chemically synthesized
ccaggcattcttttacacat

SEQ ID NO: 55474 - DNA, 20 bp, Artificial Sequence
  chemically synthesized
tttacacattggtccctccc

SEQ ID NO: 55475 - DNA, 20 bp, Artificial Sequence
  chemically synthesized
ttccctcccgcctgtcccct

SEQ ID NO: 55476 - DNA, 20 bp, Artificial Sequence
  chemically synthesized
gtcccctcagtcccaactcc

SEQ ID NO: 55477 - DNA, 20 bp, Artificial Sequence
  chemically synthesized
tcccaactccaagcgtcgct

SEQ ID NO: 55478 - DNA, 20 bp, Artificial Sequence
  chemically synthesized
tttctaatcttccttttcta

SEQ ID NO: 55479 - DNA, 20 bp, Artificial Sequence
  chemically synthesized
ctgacgtctcccctcctccc

SEQ ID NO: 55480 - DNA, 20 bp, Artificial Sequence
  chemically synthesized
tgacgtctcccctcctcccc

SEQ ID NO: 55481 - DNA, 20 bp, Artificial Sequence
  chemically synthesized
ctccccaggctgctccttgc

SEQ ID NO: 55482 - DNA, 20 bp, Artificial Sequence
  chemically synthesized
tccccaggctgctccttgcc

SEQ ID NO: 55483 - DNA, 20 bp, Artificial Sequence
  chemically synthesized
aggctgctccttgccaggcc

SEQ ID NO: 55484 - DNA, 20 bp, Artificial Sequence
  chemically synthesized
tgctccttgccaggccgagc

SEQ ID NO: 55485 - DNA, 20 bp, Artificial Sequence
  chemically synthesized
gctccttgccaggccgagct

SEQ ID NO: 55486 - DNA, 20 bp, Artificial Sequence
  chemically synthesized
gctaggtcccaaatcttcct

SEQ ID NO: 55487 - DNA, 20 bp, Artificial Sequence
  chemically synthesized
tcccaaatcttcctcagcct

SEQ ID NO: 55488 - DNA, 20 bp, Artificial Sequence
  chemically synthesized
tcacctcccctcctcacacc

SEQ ID NO: 55489 - DNA, 20 bp, Artificial Sequence
  chemically synthesized
tcccctcctcacacccggtc

SEQ ID NO: 55490 - DNA, 20 bp, Artificial Sequence
  chemically synthesized
ctcacacccggtccggttta

SEQ ID NO: 55491 - DNA, 20 bp, Artificial Sequence
  chemically synthesized
ttacagtttcattccgtgac

SEQ ID NO: 55492 - DNA, 20 bp, Artificial Sequence
  chemically synthesized
ctagccctccccaacctgcc

SEQ ID NO: 55493 - DNA, 20 bp, Artificial Sequence
  chemically synthesized
ctgcccagcaatttcctatt

SEQ ID NO: 55494 - DNA, 20 bp, Artificial Sequence
  chemically synthesized
cccagcaatttcctattaag

SEQ ID NO: 55495 - DNA, 20 bp, Artificial Sequence
  chemically synthesized
ccagcaatttcctattaaga

SEQ ID NO: 55496 - DNA, 20 bp, Artificial Sequence
  chemically synthesized
gcaatttcctattaagaagg

SEQ ID NO: 55497 - DNA, 20 bp, Artificial Sequence
  chemically synthesized
tcctattaagaaggtggctg

SEQ ID NO: 55498 - DNA, 20 bp, Artificial Sequence
  chemically synthesized
taagaaggtggctgaagcta

SEQ ID NO: 55499 - DNA, 20 bp, Artificial Sequence
  chemically synthesized
aagaaggtggctgaagctaa

SEQ ID NO: 55500 - DNA, 20 bp, Artificial Sequence
  chemically synthesized
ggtggctgaagctaaaggcg

SEQ ID NO: 55501 - DNA, 20 bp, Artificial Sequence
  chemically synthesized
ctgaagctaaaggcgtagtc

SEQ ID NO: 55502 - DNA, 20 bp, Artificial Sequence
  chemically synthesized
tgaagctaaaggcgtagtca

SEQ ID NO: 55503 - DNA, 20 bp, Artificial Sequence
  chemically synthesized
ttatccgacctctcccgaat

SEQ ID NO: 55504 - DNA, 20 bp, Artificial Sequence
  chemically synthesized
atccgacctctcccgaatca

SEQ ID NO: 55505 - DNA, 20 bp, Artificial Sequence
  chemically synthesized
ctctcccgaatcagagcgtt

SEQ ID NO: 55506 - DNA, 20 bp, Artificial Sequence
  chemically synthesized
tctcccgaatcagagcgttt

SEQ ID NO: 55507 - DNA, 20 bp, Artificial Sequence
  chemically synthesized
ttcatcaaatatgaaaaacc

SEQ ID NO: 55508 - DNA, 20 bp, Artificial Sequence
  chemically synthesized
caaatatgaaaaacccagcc

SEQ ID NO: 55509 - DNA, 20 bp, Artificial Sequence
  chemically synthesized
gaaaaacccagcccagttca

SEQ ID NO: 55510 - DNA, 20 bp, Artificial Sequence
  chemically synthesized
agcccagttcatggctcgtt

SEQ ID NO: 55511 - DNA, 20 bp, Artificial Sequence
  chemically synthesized
ccagttcatggctcgttcgg

SEQ ID NO: 55512 - DNA, 20 bp, Artificial Sequence
  chemically synthesized
gctcgttcggcagcaaccct

SEQ ID NO: 55513 - DNA, 20 bp, Artificial Sequence
  chemically synthesized
agcaaccctgagacgcttta

SEQ ID NO: 55514 - DNA, 20 bp, Artificial Sequence
  chemically synthesized
cctgagacgctttacagccc

SEQ ID NO: 55515 - DNA, 20 bp, Artificial Sequence
  chemically synthesized
tttacagccctagaccctaa

SEQ ID NO: 55516 - DNA, 20 bp, Artificial Sequence
  chemically synthesized
ttacagccctagaccctaaa

SEQ ID NO: 55517 - DNA, 20 bp, Artificial Sequence
  chemically synthesized
cctagaccctaaaaggacaa

SEQ ID NO: 55518 - DNA, 20 bp, Artificial Sequence
  chemically synthesized
ctagaccctaaaaggacaaa

SEQ ID NO: 55519 - DNA, 20 bp, Artificial Sequence
  chemically synthesized
aaactccaaaaattaaattc

SEQ ID NO: 55520 - DNA, 20 bp, Artificial Sequence
  chemically synthesized
ctggacctcaaaccccacaa

SEQ ID NO: 55521 - DNA, 20 bp, Artificial Sequence
  chemically synthesized
tggacctcaaaccccacaac

SEQ ID NO: 55522 - DNA, 20 bp, Artificial Sequence
  chemically synthesized
actcaattaacctcaccttc

SEQ ID NO: 55523 - DNA, 20 bp, Artificial Sequence
  chemically synthesized
ctcaattaacctcaccttca

SEQ ID NO: 55524 - DNA, 20 bp, Artificial Sequence
  chemically synthesized
accttcaaggtgtacaataa

SEQ ID NO: 55525 - DNA, 20 bp, Artificial Sequence
  chemically synthesized
cttcaaggtgtacaataata

SEQ ID NO: 55526 - DNA, 20 bp, Artificial Sequence
  chemically synthesized
caaggtgtacaataatagag

SEQ ID NO: 55527 - DNA, 20 bp, Artificial Sequence
  chemically synthesized
aggtgtacaataatagagta

SEQ ID NO: 55528 - DNA, 20 bp, Artificial Sequence
  chemically synthesized
ggtgtacaataatagagtag

SEQ ID NO: 55529 - DNA, 20 bp, Artificial Sequence
  chemically synthesized
gtacaataatagagtagagg

SEQ ID NO: 55530 - DNA, 20 bp, Artificial Sequence
  chemically synthesized
ataatagagtagaggcagcc

SEQ ID NO: 55531 - DNA, 20 bp, Artificial Sequence
  chemically synthesized
atagagtagaggcagccaag

SEQ ID NO: 55532 - DNA, 20 bp, Artificial Sequence
  chemically synthesized
ccaagtagcaacatattttt

SEQ ID NO: 55533 - DNA, 20 bp, Artificial Sequence
  chemically synthesized
caattccttgcctccactgt

SEQ ID NO: 55534 - DNA, 20 bp, Artificial Sequence
  chemically synthesized
ctccactgtgagacaaaccc

SEQ ID NO: 55535 - DNA, 20 bp, Artificial Sequence
  chemically synthesized
acaaaccccagccacatctc

SEQ ID NO: 55536 - DNA, 20 bp, Artificial Sequence
  chemically synthesized
cagccacatctccagcacac

SEQ ID NO: 55537 - DNA, 20 bp, Artificial Sequence
  chemically synthesized
acttccaaatgcctaaaccg

SEQ ID NO: 55538 - DNA, 20 bp, Artificial Sequence
  chemically synthesized
tccaaatgcctaaaccgcag

SEQ ID NO: 55539 - DNA, 20 bp, Artificial Sequence
  chemically synthesized
aatgcctaaaccgcagtggc

SEQ ID NO: 55540 - DNA, 20 bp, Artificial Sequence
  chemically synthesized
atgcctaaaccgcagtggcc

SEQ ID NO: 55541 - DNA, 20 bp, Artificial Sequence
  chemically synthesized
gcagtggccaggcgttcctc

SEQ ID NO: 55542 - DNA, 20 bp, Artificial Sequence
  chemically synthesized
tcctccggaaccacctcccc

SEQ ID NO: 55543 - DNA, 20 bp, Artificial Sequence
  chemically synthesized
cctccggaaccacctccccc

SEQ ID NO: 55544 - DNA, 20 bp, Artificial Sequence
  chemically synthesized
tccggaaccacctcccccag

SEQ ID NO: 55545 - DNA, 20 bp, Artificial Sequence
  chemically synthesized
ctcccccaggagcttgctac

SEQ ID NO: 55546 - DNA, 20 bp, Artificial Sequence
  chemically synthesized
caggagcttgctacaagtgc

SEQ ID NO: 55547 - DNA, 20 bp, Artificial Sequence
  chemically synthesized
tgctacaagtgccagaaatc

SEQ ID NO: 55548 - DNA, 20 bp, Artificial Sequence
  chemically synthesized
agtgccagaaatctggccac

SEQ ID NO: 55549 - DNA, 20 bp, Artificial Sequence
  chemically synthesized
gtgccagaaatctggccacc

SEQ ID NO: 55550 - DNA, 20 bp, Artificial Sequence
  chemically synthesized
agaaatctggccaccaggcc

SEQ ID NO: 55551 - DNA, 20 bp, Artificial Sequence
  chemically synthesized
gaaatctggccaccaggcca

SEQ ID NO: 55552 - DNA, 20 bp, Artificial Sequence
  chemically synthesized
accaggccaaggaatgcccg

SEQ ID NO: 55553 - DNA, 20 bp, Artificial Sequence
  chemically synthesized
gccaaggaatgcccgcagcc

SEQ ID NO: 55554 - DNA, 20 bp, Artificial Sequence
  chemically synthesized
ccaaggaatgcccgcagccc

SEQ ID NO: 55555 - DNA, 20 bp, Artificial Sequence
  chemically synthesized
cgcagcccaggattcctcct

SEQ ID NO: 55556 - DNA, 20 bp, Artificial Sequence
  chemically synthesized
taagccgtgtcccatctgtg

SEQ ID NO: 55557 - DNA, 20 bp, Artificial Sequence
  chemically synthesized
aagccgtgtcccatctgtgc

SEQ ID NO: 55558 - DNA, 20 bp, Artificial Sequence
  chemically synthesized
ccatctgtgcaggaccccac

SEQ ID NO: 55559 - DNA, 20 bp, Artificial Sequence
  chemically synthesized
tgcaggaccccactagaaat

SEQ ID NO: 55560 - DNA, 20 bp, Artificial Sequence
  chemically synthesized
atcggactgttcaactcacc

SEQ ID NO: 55561 - DNA, 20 bp, Artificial Sequence
  chemically synthesized
ggactgttcaactcacctgg

SEQ ID NO: 55562 - DNA, 20 bp, Artificial Sequence
  chemically synthesized
actcacctggcagccactcc

SEQ ID NO: 55563 - DNA, 20 bp, Artificial Sequence
  chemically synthesized
tcacctggcagccactccta

SEQ ID NO: 55564 - DNA, 20 bp, Artificial Sequence
  chemically synthesized
gcagccactcctagagcccc

SEQ ID NO: 55565 - DNA, 20 bp, Artificial Sequence
  chemically synthesized
tcctagagcccctggaactc

SEQ ID NO: 55566 - DNA, 20 bp, Artificial Sequence
  chemically synthesized
agcccctggaactctggccc

SEQ ID NO: 55567 - DNA, 20 bp, Artificial Sequence
  chemically synthesized
gcccctggaactctggccca

SEQ ID NO: 55568 - DNA, 20 bp, Artificial Sequence
  chemically synthesized
ctccctgactgactccttcc

SEQ ID NO: 55569 - DNA, 20 bp, Artificial Sequence
  chemically synthesized
gactccttcccagatcttct

SEQ ID NO: 55570 - DNA, 20 bp, Artificial Sequence
  chemically synthesized
cccagatcttctcggctttg

SEQ ID NO: 55571 - DNA, 20 bp, Artificial Sequence
  chemically synthesized
tcttctcggctttgcagctg

SEQ ID NO: 55572 - DNA, 20 bp, Artificial Sequence
  chemically synthesized
ctgccactgcctgatcgcct

SEQ ID NO: 55573 - DNA, 20 bp, Artificial Sequence
  chemically synthesized
ccactgcctgatcgcctcgg

SEQ ID NO: 55574 - DNA, 20 bp, Artificial Sequence
  chemically synthesized
tgatcgcctcggaagccctg

SEQ ID NO: 55575 - DNA, 20 bp, Artificial Sequence
  chemically synthesized
ggaagccctgtagaccatca

SEQ ID NO: 55576 - DNA, 20 bp, Artificial Sequence
  chemically synthesized
tgtagaccatcacagacacc

SEQ ID NO: 55577 - DNA, 20 bp, Artificial Sequence
  chemically synthesized
ccatcacagacaccgagctt

SEQ ID NO: 55578 - DNA, 20 bp, Artificial Sequence
  chemically synthesized
catcacagacaccgagcttt

SEQ ID NO: 55579 - DNA, 20 bp, Artificial Sequence
  chemically synthesized
cgagctttaggtaattctca

SEQ ID NO: 55580 - DNA, 20 bp, Artificial Sequence
  chemically synthesized
gctttaggtaattctcacag

SEQ ID NO: 55581 - DNA, 20 bp, Artificial Sequence
  chemically synthesized
tttaggtaattctcacagtg

SEQ ID NO: 55582 - DNA, 20 bp, Artificial Sequence
  chemically synthesized
ttaggtaattctcacagtgg

SEQ ID NO: 55583 - DNA, 20 bp, Artificial Sequence
  chemically synthesized
taggtaattctcacagtgga

SEQ ID NO: 55584 - DNA, 20 bp, Artificial Sequence
  chemically synthesized
taattctcacagtggagggt

SEQ ID NO: 55585 - DNA, 20 bp, Artificial Sequence
  chemically synthesized
aagtctgtacccttcttaat

SEQ ID NO: 55586 - DNA, 20 bp, Artificial Sequence
  chemically synthesized
tgtacccttcttaatcagta

SEQ ID NO: 55587 - DNA, 20 bp, Artificial Sequence
  chemically synthesized
tacccttcttaatcagtatg

SEQ ID NO: 55588 - DNA, 20 bp, Artificial Sequence
  chemically synthesized
acccttcttaatcagtatgg

SEQ ID NO: 55589 - DNA, 20 bp, Artificial Sequence
  chemically synthesized
tccacattaccttcttttca

SEQ ID NO: 55590 - DNA, 20 bp, Artificial Sequence
  chemically synthesized
ccacattaccttcttttcaa

SEQ ID NO: 55591 - DNA, 20 bp, Artificial Sequence
  chemically synthesized
ccttgcctccataactgttg

SEQ ID NO: 55592 - DNA, 20 bp, Artificial Sequence
  chemically synthesized
cttgcctccataactgttgt

SEQ ID NO: 55593 - DNA, 20 bp, Artificial Sequence
  chemically synthesized
ataactgttgtaggtattga

SEQ ID NO: 55594 - DNA, 20 bp, Artificial Sequence
  chemically synthesized
ctgttgtaggtattgatggc

SEQ ID NO: 55595 - DNA, 20 bp, Artificial Sequence
  chemically synthesized
tgttgtaggtattgatggcc

SEQ ID NO: 55596 - DNA, 20 bp, Artificial Sequence
  chemically synthesized
ctcttaaaattccccaactc

SEQ ID NO: 55597 - DNA, 20 bp, Artificial Sequence
  chemically synthesized
ccccaactctggtgctaacc

SEQ ID NO: 55598 - DNA, 20 bp, Artificial Sequence
  chemically synthesized
aaccgagacgatactctttt

SEQ ID NO: 55599 - DNA, 20 bp, Artificial Sequence
  chemically synthesized
ttttcattatccccacctgc

SEQ ID NO: 55600 - DNA, 20 bp, Artificial Sequence
  chemically synthesized
ccacctgccagttcccttat

SEQ ID NO: 55601 - DNA, 20 bp, Artificial Sequence
  chemically synthesized
cacctgccagttcccttatt

SEQ ID NO: 55602 - DNA, 20 bp, Artificial Sequence
  chemically synthesized
gccagttcccttattaggcc

SEQ ID NO: 55603 - DNA, 20 bp, Artificial Sequence
  chemically synthesized
tctgcttccctgactattcc

SEQ ID NO: 55604 - DNA, 20 bp, Artificial Sequence
  chemically synthesized
ctgcttccctgactattcct

SEQ ID NO: 55605 - DNA, 20 bp, Artificial Sequence
  chemically synthesized
ccctgactattcctgggcta

SEQ ID NO: 55606 - DNA, 20 bp, Artificial Sequence
  chemically synthesized
ctcattgccatgttttcccc

SEQ ID NO: 55607 - DNA, 20 bp, Artificial Sequence
  chemically synthesized
ccatgttttcccccagttca

SEQ ID NO: 55608 - DNA, 20 bp, Artificial Sequence
  chemically synthesized
atctccccaccttaatccac

SEQ ID NO: 55609 - DNA, 20 bp, Artificial Sequence
  chemically synthesized
ccaccttaatccacaagtat

SEQ ID NO: 55610 - DNA, 20 bp, Artificial Sequence
  chemically synthesized
actcttaccccgctcaatgc

SEQ ID NO: 55611 - DNA, 20 bp, Artificial Sequence
  chemically synthesized
aatgccagtatcccatccca

SEQ ID NO: 55612 - DNA, 20 bp, Artificial Sequence
  chemically synthesized
catcccacagcatgctttga

SEQ ID NO: 55613 - DNA, 20 bp, Artificial Sequence
  chemically synthesized
atcccacagcatgctttgaa

SEQ ID NO: 55614 - DNA, 20 bp, Artificial Sequence
  chemically synthesized
agcatgctttgaaaggatta

SEQ ID NO: 55615 - DNA, 20 bp, Artificial Sequence
  chemically synthesized
ctgttattacttgcctgtta

SEQ ID NO: 55616 - DNA, 20 bp, Artificial Sequence
  chemically synthesized
attacttgcctgttacagca

SEQ ID NO: 55617 - DNA, 20 bp, Artificial Sequence
  chemically synthesized
tgttacagcatggcctttta

SEQ ID NO: 55618 - DNA, 20 bp, Artificial Sequence
  chemically synthesized
cattttacctgtcctaaaac

SEQ ID NO: 55619 - DNA, 20 bp, Artificial Sequence
  chemically synthesized
tacctgtcctaaaaccagac

SEQ ID NO: 55620 - DNA, 20 bp, Artificial Sequence
  chemically synthesized
ctaaaaccagacaagcctta

SEQ ID NO: 55621 - DNA, 20 bp, Artificial Sequence
  chemically synthesized
taaaaccagacaagccttac

SEQ ID NO: 55622 - DNA, 20 bp, Artificial Sequence
  chemically synthesized
accagacaagccttacaggt

SEQ ID NO: 55623 - DNA, 20 bp, Artificial Sequence
  chemically synthesized
acaagccttacaggttagtt

SEQ ID NO: 55624 - DNA, 20 bp, Artificial Sequence
  chemically synthesized
tgttttgcctatccacccca

SEQ ID NO: 55625 - DNA, 20 bp, Artificial Sequence
  chemically synthesized
tataacccattattctgttc

SEQ ID NO: 55626 - DNA, 20 bp, Artificial Sequence
  chemically synthesized
ttcctttgcacccttcattc

SEQ ID NO: 55627 - DNA, 20 bp, Artificial Sequence
  chemically synthesized
agcctctcttcgctttcact

SEQ ID NO: 55628 - DNA, 20 bp, Artificial Sequence
  chemically synthesized
ggactgacactgacacccat

SEQ ID NO: 55629 - DNA, 20 bp, Artificial Sequence
  chemically synthesized
gactgacactgacacccatt

SEQ ID NO: 55630 - DNA, 20 bp, Artificial Sequence
  chemically synthesized
acactgacacccattaggct

SEQ ID NO: 55631 - DNA, 20 bp, Artificial Sequence
  chemically synthesized
attaggctcagcaaattacc

SEQ ID NO: 55632 - DNA, 20 bp, Artificial Sequence
  chemically synthesized
ttaggctcagcaaattacct

SEQ ID NO: 55633 - DNA, 20 bp, Artificial Sequence
  chemically synthesized
tacctgggctgtactgctgc

SEQ ID NO: 55634 - DNA, 20 bp, Artificial Sequence
  chemically synthesized
acctgggctgtactgctgca

SEQ ID NO: 55635 - DNA, 20 bp, Artificial Sequence
  chemically synthesized
tgtactgctgcaaggcttca

SEQ ID NO: 55636 - DNA, 20 bp, Artificial Sequence
  chemically synthesized
ctgctgcaaggcttcacaga

SEQ ID NO: 55637 - DNA, 20 bp, Artificial Sequence
  chemically synthesized
acagacagaccccattactt

SEQ ID NO: 55638 - DNA, 20 bp, Artificial Sequence
  chemically synthesized
cagaccccattacttcagtc

SEQ ID NO: 55639 - DNA, 20 bp, Artificial Sequence
  chemically synthesized
tcctcatgtgttacctatct

SEQ ID NO: 55640 - DNA, 20 bp, Artificial Sequence
  chemically synthesized
acaacaactcctttccttcc

SEQ ID NO: 55641 - DNA, 20 bp, Artificial Sequence
  chemically synthesized
caacaactcctttccttcct

SEQ ID NO: 55642 - DNA, 20 bp, Artificial Sequence
  chemically synthesized
actcctttccttcctaggca

SEQ ID NO: 55643 - DNA, 20 bp, Artificial Sequence
  chemically synthesized
ctttccttcctaggcatagt

SEQ ID NO: 55644 - DNA, 20 bp, Artificial Sequence
  chemically synthesized
cttcctaggcatagttagtg

SEQ ID NO: 55645 - DNA, 20 bp, Artificial Sequence
  chemically synthesized
ctaggcatagttagtgcggt

SEQ ID NO: 55646 - DNA, 20 bp, Artificial Sequence
  chemically synthesized
tgcggtcagaattcttacac

SEQ ID NO: 55647 - DNA, 20 bp, Artificial Sequence
  chemically synthesized
cagaattcttacacaagatc

SEQ ID NO: 55648 - DNA, 20 bp, Artificial Sequence
  chemically synthesized
agaattcttacacaagatcc

SEQ ID NO: 55649 - DNA, 20 bp, Artificial Sequence
  chemically synthesized
agatccaggactgcaccctg

SEQ ID NO: 55650 - DNA, 20 bp, Artificial Sequence
  chemically synthesized
ataacttgaccttactgttt

SEQ ID NO: 55651 - DNA, 20 bp, Artificial Sequence
  chemically synthesized
ttgaccttactgttttagcc

SEQ ID NO: 55652 - DNA, 20 bp, Artificial Sequence
  chemically synthesized
tactgttttagcctagccct

SEQ ID NO: 55653 - DNA, 20 bp, Artificial Sequence
  chemically synthesized
actgttttagcctagccctc

SEQ ID NO: 55654 - DNA, 20 bp, Artificial Sequence
  chemically synthesized
ctagccctcaggtctgcatg

SEQ ID NO: 55655 - DNA, 20 bp, Artificial Sequence
  chemically synthesized
gccctcaggtctgcatgcag

SEQ ID NO: 55656 - DNA, 20 bp, Artificial Sequence
  chemically synthesized
tgccgctgctttaatacttt

SEQ ID NO: 55657 - DNA, 20 bp, Artificial Sequence
  chemically synthesized
ccgctgctttaatactttta

SEQ ID NO: 55658 - DNA, 20 bp, Artificial Sequence
  chemically synthesized
cgctgctttaatacttttag

SEQ ID NO: 55659 - DNA, 20 bp, Artificial Sequence
  chemically synthesized
taaaaatcacaaactatgct

SEQ ID NO: 55660 - DNA, 20 bp, Artificial Sequence
  chemically synthesized
tgcatatactttctgatccc

SEQ ID NO: 55661 - DNA, 20 bp, Artificial Sequence
  chemically synthesized
tttctgatccccggctcctt

SEQ ID NO: 55662 - DNA, 20 bp, Artificial Sequence
  chemically synthesized
agctgtactcactctttgtt

SEQ ID NO: 55663 - DNA, 20 bp, Artificial Sequence
  chemically synthesized
ttaagtcccacaattaccat

SEQ ID NO: 55664 - DNA, 20 bp, Artificial Sequence
  chemically synthesized
cccacaattaccattggtcc

SEQ ID NO: 55665 - DNA, 20 bp, Artificial Sequence
  chemically synthesized
aattaccattggtcctggcc

SEQ ID NO: 55666 - DNA, 20 bp, Artificial Sequence
  chemically synthesized
tcctggcccggacttcaatc

SEQ ID NO: 55667 - DNA, 20 bp, Artificial Sequence
  chemically synthesized
gatcacacttgatttattga

SEQ ID NO: 55668 - DNA, 20 bp, Artificial Sequence
  chemically synthesized
tttattgatggccgttccac

SEQ ID NO: 55669 - DNA, 20 bp, Artificial Sequence
  chemically synthesized
ttattgatggccgttccacc

SEQ ID NO: 55670 - DNA, 20 bp, Artificial Sequence
  chemically synthesized
ggccgttccaccaggcctaa

SEQ ID NO: 55671 - DNA, 20 bp, Artificial Sequence
  chemically synthesized
caggcctaatagccacacac

SEQ ID NO: 55672 - DNA, 20 bp, Artificial Sequence
  chemically synthesized
ctaatagccacacaccagca

SEQ ID NO: 55673 - DNA, 20 bp, Artificial Sequence
  chemically synthesized
taatagccacacaccagcaa

SEQ ID NO: 55674 - DNA, 20 bp, Artificial Sequence
  chemically synthesized
tagccacacaccagcaaagg

SEQ ID NO: 55675 - DNA, 20 bp, Artificial Sequence
  chemically synthesized
agccacacaccagcaaaggc

SEQ ID NO: 55676 - DNA, 20 bp, Artificial Sequence
  chemically synthesized
agcaaaggcaggctatgcta

SEQ ID NO: 55677 - DNA, 20 bp, Artificial Sequence
  chemically synthesized
tatgctatagtacaaaccac

SEQ ID NO: 55678 - DNA, 20 bp, Artificial Sequence
  chemically synthesized
ctctcatttcctttccatcg

SEQ ID NO: 55679 - DNA, 20 bp, Artificial Sequence
  chemically synthesized
atcgtagaaatctatcctca

SEQ ID NO: 55680 - DNA, 20 bp, Artificial Sequence
  chemically synthesized
tcctcaaagaaataacttct

SEQ ID NO: 55681 - DNA, 20 bp, Artificial Sequence
  chemically synthesized
tctgctattctgctactcct

SEQ ID NO: 55682 - DNA, 20 bp, Artificial Sequence
  chemically synthesized
ctgctattctgctactcctc

SEQ ID NO: 55683 - DNA, 20 bp, Artificial Sequence
  chemically synthesized
tgctattctgctactcctca

SEQ ID NO: 55684 - DNA, 20 bp, Artificial Sequence
  chemically synthesized
gctactcctcagggattatt

SEQ ID NO: 55685 - DNA, 20 bp, Artificial Sequence
  chemically synthesized
ctactcctcagggattattc

SEQ ID NO: 55686 - DNA, 20 bp, Artificial Sequence
  chemically synthesized
ccctcccttccctacacatc

SEQ ID NO: 55687 - DNA, 20 bp, Artificial Sequence
  chemically synthesized
cttccctacacatcaagctc

SEQ ID NO: 55688 - DNA, 20 bp, Artificial Sequence
  chemically synthesized
ttccctacacatcaagctcg

SEQ ID NO: 55689 - DNA, 20 bp, Artificial Sequence
  chemically synthesized
ctcgaggatttgcccccacc

SEQ ID NO: 55690 - DNA, 20 bp, Artificial Sequence
  chemically synthesized
tcgaggatttgcccccaccc

SEQ ID NO: 55691 - DNA, 20 bp, Artificial Sequence
  chemically synthesized
gatttgcccccacccaggac

SEQ ID NO: 55692 - DNA, 20 bp, Artificial Sequence
  chemically synthesized
cccacccaggactggcaaat

SEQ ID NO: 55693 - DNA, 20 bp, Artificial Sequence
  chemically synthesized
agatttactcaacatgccct

SEQ ID NO: 55694 - DNA, 20 bp, Artificial Sequence
  chemically synthesized
ttactcaacatgccctgagt

SEQ ID NO: 55695 - DNA, 20 bp, Artificial Sequence
  chemically synthesized
cagataactaaaatacctct

SEQ ID NO: 55696 - DNA, 20 bp, Artificial Sequence
  chemically synthesized
aactaaaatacctcttagtc

SEQ ID NO: 55697 - DNA, 20 bp, Artificial Sequence
  chemically synthesized
actaaaatacctcttagtct

SEQ ID NO: 55698 - DNA, 20 bp, Artificial Sequence
  chemically synthesized
aaaatacctcttagtctagg

SEQ ID NO: 55699 - DNA, 20 bp, Artificial Sequence
  chemically synthesized
gtctaggtagacactttcac

SEQ ID NO: 55700 - DNA, 20 bp, Artificial Sequence
  chemically synthesized
ggtagacactttcactggat

SEQ ID NO: 55701 - DNA, 20 bp, Artificial Sequence
  chemically synthesized
agacactttcactggataag

SEQ ID NO: 55702 - DNA, 20 bp, Artificial Sequence
  chemically synthesized
acactttcactggataagta

SEQ ID NO: 55703 - DNA, 20 bp, Artificial Sequence
  chemically synthesized
cactttcactggataagtag

SEQ ID NO: 55704 - DNA, 20 bp, Artificial Sequence
  chemically synthesized
ataagtagaggtctttccta

SEQ ID NO: 55705 - DNA, 20 bp, Artificial Sequence
  chemically synthesized
taagtagaggtctttcctac

SEQ ID NO: 55706 - DNA, 20 bp, Artificial Sequence
  chemically synthesized
aagtagaggtctttcctaca

SEQ ID NO: 55707 - DNA, 20 bp, Artificial Sequence
  chemically synthesized
aggtctttcctacagggtct

SEQ ID NO: 55708 - DNA, 20 bp, Artificial Sequence
  chemically synthesized
tctttcctacagggtctgag

SEQ ID NO: 55709 - DNA, 20 bp, Artificial Sequence
  chemically synthesized
ctttcctacagggtctgaga

SEQ ID NO: 55710 - DNA, 20 bp, Artificial Sequence
  chemically synthesized
agggtctgagaaggccaccg

SEQ ID NO: 55711 - DNA, 20 bp, Artificial Sequence
  chemically synthesized
agtcatttcttcccttctgt

SEQ ID NO: 55712 - DNA, 20 bp, Artificial Sequence
  chemically synthesized
ttctgtcagacataattcct

SEQ ID NO: 55713 - DNA, 20 bp, Artificial Sequence
  chemically synthesized
tcagacataattcctcagtt

SEQ ID NO: 55714 - DNA, 20 bp, Artificial Sequence
  chemically synthesized
ttagccttcctacctctata

SEQ ID NO: 55715 - DNA, 20 bp, Artificial Sequence
  chemically synthesized
acctctatacagtctgataa

SEQ ID NO: 55716 - DNA, 20 bp, Artificial Sequence
  chemically synthesized
tatacagtctgataacagac

SEQ ID NO: 55717 - DNA, 20 bp, Artificial Sequence
  chemically synthesized
gataacagaccagcctttat

SEQ ID NO: 55718 - DNA, 20 bp, Artificial Sequence
  chemically synthesized
ccagcctttattagtcaaat

SEQ ID NO: 55719 - DNA, 20 bp, Artificial Sequence
  chemically synthesized
ctttattagtcaaatcagcc

SEQ ID NO: 55720 - DNA, 20 bp, Artificial Sequence
  chemically synthesized
tattagtcaaatcagccaag

SEQ ID NO: 55721 - DNA, 20 bp, Artificial Sequence
  chemically synthesized
aaatcagccaagcagttttt

SEQ ID NO: 55722 - DNA, 20 bp, Artificial Sequence
  chemically synthesized
aatcagccaagcagtttttc

SEQ ID NO: 55723 - DNA, 20 bp, Artificial Sequence
  chemically synthesized
caagcagtttttcaggctct

SEQ ID NO: 55724 - DNA, 20 bp, Artificial Sequence
  chemically synthesized
tttttcaggctcttagtatt

SEQ ID NO: 55725 - DNA, 20 bp, Artificial Sequence
  chemically synthesized
taaaacctttatatccctta

SEQ ID NO: 55726 - DNA, 20 bp, Artificial Sequence
  chemically synthesized
cccttacggtcctccgtctt

SEQ ID NO: 55727 - DNA, 20 bp, Artificial Sequence
  chemically synthesized
ccttacggtcctccgtcttc

SEQ ID NO: 55728 - DNA, 20 bp, Artificial Sequence
  chemically synthesized
cggtcctccgtcttcaggaa

SEQ ID NO: 55729 - DNA, 20 bp, Artificial Sequence
  chemically synthesized
tcctccgtcttcaggaaaag

SEQ ID NO: 55730 - DNA, 20 bp, Artificial Sequence
  chemically synthesized
cgtcttcaggaaaagtagaa

SEQ ID NO: 55731 - DNA, 20 bp, Artificial Sequence
  chemically synthesized
ttttaaaaacacacctcacc

SEQ ID NO: 55732 - DNA, 20 bp, Artificial Sequence
  chemically synthesized
aaaacacacctcaccaagct

SEQ ID NO: 55733 - DNA, 20 bp, Artificial Sequence
  chemically synthesized
agctcagccaccaacttaaa

SEQ ID NO: 55734 - DNA, 20 bp, Artificial Sequence
  chemically synthesized
gctcagccaccaacttaaaa

SEQ ID NO: 55735 - DNA, 20 bp, Artificial Sequence
  chemically synthesized
gccaccaacttaaaaaggac

SEQ ID NO: 55736 - DNA, 20 bp, Artificial Sequence
  chemically synthesized
cttttaccacttttctttct

SEQ ID NO: 55737 - DNA, 20 bp, Artificial Sequence
  chemically synthesized
ttaccacttttctttctcag

SEQ ID NO: 55738 - DNA, 20 bp, Artificial Sequence
  chemically synthesized
cacttttctttctcagaagt

SEQ ID NO: 55739 - DNA, 20 bp, Artificial Sequence
  chemically synthesized
tcagaagtcagacctgtcct

SEQ ID NO: 55740 - DNA, 20 bp, Artificial Sequence
  chemically synthesized
gacctgtcctcagaatgcta

SEQ ID NO: 55741 - DNA, 20 bp, Artificial Sequence
  chemically synthesized
acctgtcctcagaatgctac

SEQ ID NO: 55742 - DNA, 20 bp, Artificial Sequence
  chemically synthesized
cctgtcctcagaatgctaca

SEQ ID NO: 55743 - DNA, 20 bp, Artificial Sequence
  chemically synthesized
cctcagaatgctacagggta

SEQ ID NO: 55744 - DNA, 20 bp, Artificial Sequence
  chemically synthesized
ctacagggtacagcccattt

SEQ ID NO: 55745 - DNA, 20 bp, Artificial Sequence
  chemically synthesized
agcccatttgagctcctgta

SEQ ID NO: 55746 - DNA, 20 bp, Artificial Sequence
  chemically synthesized
gtatagatttgcctttttat

SEQ ID NO: 55747 - DNA, 20 bp, Artificial Sequence
  chemically synthesized
tatagatttgcctttttatt

SEQ ID NO: 55748 - DNA, 20 bp, Artificial Sequence
  chemically synthesized
tttgcctttttattaggccc

SEQ ID NO: 55749 - DNA, 20 bp, Artificial Sequence
  chemically synthesized
attaggccccagtctaattc

SEQ ID NO: 55750 - DNA, 20 bp, Artificial Sequence
  chemically synthesized
cccagtctaattccagacac

SEQ ID NO: 55751 - DNA, 20 bp, Artificial Sequence
  chemically synthesized
ttccagacaccagaccaact

SEQ ID NO: 55752 - DNA, 20 bp, Artificial Sequence
  chemically synthesized
catccctgctatcttctgtc

SEQ ID NO: 55753 - DNA, 20 bp, Artificial Sequence
  chemically synthesized
cctgctcttgtttacactgc

SEQ ID NO: 55754 - DNA, 20 bp, Artificial Sequence
  chemically synthesized
ccggtttacactgtttttcc

SEQ ID NO: 55755 - DNA, 20 bp, Artificial Sequence
  chemically synthesized
actgtttttccaagccatca

SEQ ID NO: 55756 - DNA, 20 bp, Artificial Sequence
  chemically synthesized
ccatcacagctgatatctcc

SEQ ID NO: 55757 - DNA, 20 bp, Artificial Sequence
  chemically synthesized
actgccactcttaactcttg

SEQ ID NO: 55758 - DNA, 20 bp, Artificial Sequence
  chemically synthesized
agtaaataaataatctttgc

SEQ ID NO: 55759 - DNA, 20 bp, Artificial Sequence
  chemically synthesized
aaataaataatctttgctgg

SEQ ID NO: 55760 - DNA, 20 bp, Artificial Sequence
  chemically synthesized
aataaataatctttgctggc

SEQ ID NO: 55761 - DNA, 20 bp, Artificial Sequence
  chemically synthesized
aggactatgttgaatctcct

SEQ ID NO: 55762 - DNA, 20 bp, Artificial Sequence
  chemically synthesized
ggactatgttgaatctcctt

SEQ ID NO: 55763 - DNA, 20 bp, Artificial Sequence
  chemically synthesized
ctccttaggcactctttaat

SEQ ID NO: 55764 - DNA, 20 bp, Artificial Sequence
  chemically synthesized
cactctttaatcagatgtcc

SEQ ID NO: 55765 - DNA, 20 bp, Artificial Sequence
  chemically synthesized
actctttaatcagatgtcct

SEQ ID NO: 55766 - DNA, 20 bp, Artificial Sequence
  chemically synthesized
tcctaggtcctcccacttct

SEQ ID NO: 55767 - DNA, 20 bp, Artificial Sequence
  chemically synthesized
tctccttctcttattccatt

SEQ ID NO: 55768 - DNA, 20 bp, Artificial Sequence
  chemically synthesized
aatccatacaaaaccgtatc

SEQ ID NO: 55769 - DNA, 20 bp, Artificial Sequence
  chemically synthesized
atccatacaaaaccgtatcc

SEQ ID NO: 55770 - DNA, 20 bp, Artificial Sequence
  chemically synthesized
cttaccacaaaatcttcctt

SEQ ID NO: 55771 - DNA, 20 bp, Artificial Sequence
  chemically synthesized
cagcttaatctctcccactc

SEQ ID NO: 55772 - DNA, 20 bp, Artificial Sequence
  chemically synthesized
agcttaatctctcccactct

SEQ ID NO: 55773 - DNA, 20 bp, Artificial Sequence
  chemically synthesized
gccgcccctaatcccgctcg

SEQ ID NO: 55774 - DNA, 20 bp, Artificial Sequence
  chemically synthesized
gcccctaatcccgctcgaag

SEQ ID NO: 55775 - DNA, 20 bp, Artificial Sequence
  chemically synthesized
atcccgctcgaagcagccct

SEQ ID NO: 55776 - DNA, 20 bp, Artificial Sequence
  chemically synthesized
tttatttttcttattaatat

SEQ ID NO: 55777 - DNA, 20 bp, Artificial Sequence
  chemically synthesized
atttttcttattaatataag

SEQ ID NO: 55778 - DNA, 20 bp, Artificial Sequence
  chemically synthesized
ttcttattaatataagaaga

SEQ ID NO: 55779 - DNA, 20 bp, Artificial Sequence
  chemically synthesized
tcttattaatataagaagac

SEQ ID NO: 55780 - DNA, 20 bp, Artificial Sequence
  chemically synthesized
atataagaagacaggaatgt

SEQ ID NO: 55781 - DNA, 20 bp, Artificial Sequence
  chemically synthesized
tataagaagacaggaatgtc

SEQ ID NO: 55782 - DNA, 20 bp, Artificial Sequence
  chemically synthesized
gacaggaatgtcaggcctct

SEQ ID NO: 55783 - DNA, 20 bp, Artificial Sequence
  chemically synthesized
aatgtcaggcctctgagccc

SEQ ID NO: 55784 - DNA, 20 bp, Artificial Sequence
  chemically synthesized
caggcctctgagcccaagct

SEQ ID NO: 55785 - DNA, 20 bp, Artificial Sequence
  chemically synthesized
atcatgtcccctgtgacctg

SEQ ID NO: 55786 - DNA, 20 bp, Artificial Sequence
  chemically synthesized
tcatgtcccctgtgacctgc

SEQ ID NO: 55787 - DNA, 20 bp, Artificial Sequence
  chemically synthesized
gtgacctgcaggtacacata

SEQ ID NO: 55788 - DNA, 20 bp, Artificial Sequence
  chemically synthesized
cctgcaggtacacatacaga

SEQ ID NO: 55789 - DNA, 20 bp, Artificial Sequence
  chemically synthesized
caggtacacatacagatggc

SEQ ID NO: 55790 - DNA, 20 bp, Artificial Sequence
  chemically synthesized
ctgatgacattccaccacaa

SEQ ID NO: 55791 - DNA, 20 bp, Artificial Sequence
  chemically synthesized
atgacattccaccacaaaag

SEQ ID NO: 55792 - DNA, 20 bp, Artificial Sequence
  chemically synthesized
caccacaaaagaagtgaaaa

SEQ ID NO: 55793 - DNA, 20 bp, Artificial Sequence
  chemically synthesized
ctgatgacattgtcttgtga

SEQ ID NO: 55794 - DNA, 20 bp, Artificial Sequence
  chemically synthesized
tcttgtgaaagtccttctcc

SEQ ID NO: 55795 - DNA, 20 bp, Artificial Sequence
  chemically synthesized
gtccttctcctggctcatcc

SEQ ID NO: 55796 - DNA, 20 bp, Artificial Sequence
  chemically synthesized
cctggctcatcctggctcaa

SEQ ID NO: 55797 - DNA, 20 bp, Artificial Sequence
  chemically synthesized
ggctcaaaagctcccctact

SEQ ID NO: 55798 - DNA, 20 bp, Artificial Sequence
  chemically synthesized
gaccccccactcctgcccgc

SEQ ID NO: 55799 - DNA, 20 bp, Artificial Sequence
  chemically synthesized
ccccccactcctgcccgcca

SEQ ID NO: 55800 - DNA, 20 bp, Artificial Sequence
  chemically synthesized
cctacccaaatcttataaaa

SEQ ID NO: 55801 - DNA, 20 bp, Artificial Sequence
  chemically synthesized
ccctttgctgactctctttt

SEQ ID NO: 55802 - DNA, 20 bp, Artificial Sequence
  chemically synthesized
gctgactctcttttcggact

SEQ ID NO: 55803 - DNA, 20 bp, Artificial Sequence
  chemically synthesized
ggactcagcccgcctgcacc

SEQ ID NO: 55804 - DNA, 20 bp, Artificial Sequence
  chemically synthesized
gactcagcccgcctgcaccc

SEQ ID NO: 55805 - DNA, 20 bp, Artificial Sequence
  chemically synthesized
gcctgcacccaggtgataaa

SEQ ID NO: 55806 - DNA, 20 bp, Artificial Sequence
  chemically synthesized
aaagctttattgctcacaca

SEQ ID NO: 55807 - DNA, 20 bp, Artificial Sequence
  chemically synthesized
ttgctcacacaaagcctgtt

SEQ ID NO: 55808 - DNA, 20 bp, Artificial Sequence
  chemically synthesized
ctcacacaaagcctgtttgg

SEQ ID NO: 55809 - DNA, 20 bp, Artificial Sequence
  chemically synthesized
cctgtttggtagtctcctca

SEQ ID NO: 55810 - DNA, 20 bp, Artificial Sequence
  chemically synthesized
ctgtttggtagtctcctcac

SEQ ID NO: 55811 - DNA, 20 bp, Artificial Sequence
  chemically synthesized
tgtttggtagtctcctcaca

SEQ ID NO: 55812 - DNA, 20 bp, Artificial Sequence
  chemically synthesized
catgaaactgaataaccaat

SEQ ID NO: 55813 - DNA, 20 bp, Artificial Sequence
  chemically synthesized
gaataaccaatgagtcacta

SEQ ID NO: 55814 - DNA, 20 bp, Artificial Sequence
  chemically synthesized
aatgagtcactaaagaaatt

SEQ ID NO: 55815 - DNA, 20 bp, Artificial Sequence
  chemically synthesized
gagtcactaaagaaattaag

SEQ ID NO: 55816 - DNA, 20 bp, Artificial Sequence
  chemically synthesized
agtcactaaagaaattaaga

SEQ ID NO: 55817 - DNA, 20 bp, Artificial Sequence
  chemically synthesized
attttaaaacttcttgaaac

SEQ ID NO: 55818 - DNA, 20 bp, Artificial Sequence
  chemically synthesized
cttcttgaaacaagtgaaaa

SEQ ID NO: 55819 - DNA, 20 bp, Artificial Sequence
  chemically synthesized
atacaacataccaaaaccta

SEQ ID NO: 55820 - DNA, 20 bp, Artificial Sequence
  chemically synthesized
tacaacataccaaaacctac

SEQ ID NO: 55821 - DNA, 20 bp, Artificial Sequence
  chemically synthesized
ataccaaaacctacaggata

SEQ ID NO: 55822 - DNA, 20 bp, Artificial Sequence
  chemically synthesized
aaacctacaggatatggcaa

SEQ ID NO: 55823 - DNA, 20 bp, Artificial Sequence
  chemically synthesized
cctacaggatatggcaaaag

SEQ ID NO: 55824 - DNA, 20 bp, Artificial Sequence
  chemically synthesized
gatatggcaaaagcagtact

SEQ ID NO: 55825 - DNA, 20 bp, Artificial Sequence
  chemically synthesized
tatggcaaaagcagtactta

SEQ ID NO: 55826 - DNA, 20 bp, Artificial Sequence
  chemically synthesized
atggcaaaagcagtacttag

SEQ ID NO: 55827 - DNA, 20 bp, Artificial Sequence
  chemically synthesized
tggcaaaagcagtacttaga

SEQ ID NO: 55828 - DNA, 20 bp, Artificial Sequence
  chemically synthesized
caaaagcagtacttagaggg

SEQ ID NO: 55829 - DNA, 20 bp, Artificial Sequence
  chemically synthesized
agtacttagagggaagttca

SEQ ID NO: 55830 - DNA, 20 bp, Artificial Sequence
  chemically synthesized
ataaacacctatatccaaaa

SEQ ID NO: 55831 - DNA, 20 bp, Artificial Sequence
  chemically synthesized
aacacctatatccaaaaaag

SEQ ID NO: 55832 - DNA, 20 bp, Artificial Sequence
  chemically synthesized
cctatatccaaaaaagtaga

SEQ ID NO: 55833 - DNA, 20 bp, Artificial Sequence
  chemically synthesized
ctatatccaaaaaagtagaa

SEQ ID NO: 55834 - DNA, 20 bp, Artificial Sequence
  chemically synthesized
aaagtagaaaggcttcaact

SEQ ID NO: 55835 - DNA, 20 bp, Artificial Sequence
  chemically synthesized
gcaaccaaacaatgtacctc

SEQ ID NO: 55836 - DNA, 20 bp, Artificial Sequence
  chemically synthesized
caaccaaacaatgtacctca

SEQ ID NO: 55837 - DNA, 20 bp, Artificial Sequence
  chemically synthesized
aacaatgtacctcaaggaaa

SEQ ID NO: 55838 - DNA, 20 bp, Artificial Sequence
  chemically synthesized
acaatgtacctcaaggaaat

SEQ ID NO: 55839 - DNA, 20 bp, Artificial Sequence
  chemically synthesized
tgtacctcaaggaaatagga

SEQ ID NO: 55840 - DNA, 20 bp, Artificial Sequence
  chemically synthesized
cctcaaggaaataggaaagc

SEQ ID NO: 55841 - DNA, 20 bp, Artificial Sequence
  chemically synthesized
caaaccaaatgcaaaattaa

SEQ ID NO: 55842 - DNA, 20 bp, Artificial Sequence
  chemically synthesized
accaaatgcaaaattaatag

SEQ ID NO: 55843 - DNA, 20 bp, Artificial Sequence
  chemically synthesized
ccaaatgcaaaattaataga

SEQ ID NO: 55844 - DNA, 20 bp, Artificial Sequence
  chemically synthesized
caaatgcaaaattaatagaa

SEQ ID NO: 55845 - DNA, 20 bp, Artificial Sequence
  chemically synthesized
aaatgcaaaattaatagaag

SEQ ID NO: 55846 - DNA, 20 bp, Artificial Sequence
  chemically synthesized
atgcaaaattaatagaaggg

SEQ ID NO: 55847 - DNA, 20 bp, Artificial Sequence
  chemically synthesized
attaatagaaggggagaaat

SEQ ID NO: 55848 - DNA, 20 bp, Artificial Sequence
  chemically synthesized
atagaaggggagaaataaga

SEQ ID NO: 55849 - DNA, 20 bp, Artificial Sequence
  chemically synthesized
aggggagaaataagaaagat

SEQ ID NO: 55850 - DNA, 20 bp, Artificial Sequence
  chemically synthesized
gggagaaataagaaagatca

SEQ ID NO: 55851 - DNA, 20 bp, Artificial Sequence
  chemically synthesized
agaaataagaaagatcagag

SEQ ID NO: 55852 - DNA, 20 bp, Artificial Sequence
  chemically synthesized
gagaagaaacaaatgaaatt

SEQ ID NO: 55853 - DNA, 20 bp, Artificial Sequence
  chemically synthesized
gaaattgagaccaaaaaata

SEQ ID NO: 55854 - DNA, 20 bp, Artificial Sequence
  chemically synthesized
agaaaatcattaaaaacaaa

SEQ ID NO: 55855 - DNA, 20 bp, Artificial Sequence
  chemically synthesized
aaaacaaacagttgctttct

SEQ ID NO: 55856 - DNA, 20 bp, Artificial Sequence
  chemically synthesized
caaacagttgctttcttgga

SEQ ID NO: 55857 - DNA, 20 bp, Artificial Sequence
  chemically synthesized
aaacagttgctttcttggaa

SEQ ID NO: 55858 - DNA, 20 bp, Artificial Sequence
  chemically synthesized
aacaaaatcaacaaaacttt

SEQ ID NO: 55859 - DNA, 20 bp, Artificial Sequence
  chemically synthesized
tcaacaaaactttaagaaaa

SEQ ID NO: 55860 - DNA, 20 bp, Artificial Sequence
  chemically synthesized
aacaaaactttaagaaaaaa

SEQ ID NO: 55861 - DNA, 20 bp, Artificial Sequence
  chemically synthesized
aaaaaagagtcaaataaaat

SEQ ID NO: 55862 - DNA, 20 bp, Artificial Sequence
  chemically synthesized
aataaaattagaaaatgaaa

SEQ ID NO: 55863 - DNA, 20 bp, Artificial Sequence
  chemically synthesized
taaaattagaaaatgaaaaa

SEQ ID NO: 55864 - DNA, 20 bp, Artificial Sequence
  chemically synthesized
aaaattagaaaatgaaaaag

SEQ ID NO: 55865 - DNA, 20 bp, Artificial Sequence
  chemically synthesized
aaaaagaggatataacaatt

SEQ ID NO: 55866 - DNA, 20 bp, Artificial Sequence
  chemically synthesized
ggatataacaattgagacct

SEQ ID NO: 55867 - DNA, 20 bp, Artificial Sequence
  chemically synthesized
attgagacctcagcaacaca

SEQ ID NO: 55868 - DNA, 20 bp, Artificial Sequence
  chemically synthesized
tcagcaacacaaagactcat

SEQ ID NO: 55869 - DNA, 20 bp, Artificial Sequence
  chemically synthesized
acaactgtattccaacaaat

SEQ ID NO: 55870 - DNA, 20 bp, Artificial Sequence
  chemically synthesized
ttccaacaaattggaaaatc

SEQ ID NO: 55871 - DNA, 20 bp, Artificial Sequence
  chemically synthesized
attggaaaatctagaataaa

SEQ ID NO: 55872 - DNA, 20 bp, Artificial Sequence
  chemically synthesized
agaataaatggataaattcc

SEQ ID NO: 55873 - DNA, 20 bp, Artificial Sequence
  chemically synthesized
gataaattcctggacacata

SEQ ID NO: 55874 - DNA, 20 bp, Artificial Sequence
  chemically synthesized
attcctggacacatacagcc

SEQ ID NO: 55875 - DNA, 20 bp, Artificial Sequence
  chemically synthesized
ctggacacatacagcctagc

SEQ ID NO: 55876 - DNA, 20 bp, Artificial Sequence
  chemically synthesized
catacagcctagcaagactg

SEQ ID NO: 55877 - DNA, 20 bp, Artificial Sequence
  chemically synthesized
cctagcaagactgaagcatg

SEQ ID NO: 55878 - DNA, 20 bp, Artificial Sequence
  chemically synthesized
aagactgaagcatgtagaaa

SEQ ID NO: 55879 - DNA, 20 bp, Artificial Sequence
  chemically synthesized
gtagaaacagaaaacctcaa

SEQ ID NO: 55880 - DNA, 20 bp, Artificial Sequence
  chemically synthesized
atagaacaataatgaataac

SEQ ID NO: 55881 - DNA, 20 bp, Artificial Sequence
  chemically synthesized
aataatgaataacaagatta

SEQ ID NO: 55882 - DNA, 20 bp, Artificial Sequence
  chemically synthesized
aagattaaagttgtaatata

SEQ ID NO: 55883 - DNA, 20 bp, Artificial Sequence
  chemically synthesized
taatataaagtttcctatta

SEQ ID NO: 55884 - DNA, 20 bp, Artificial Sequence
  chemically synthesized
taaagtttcctattaaagaa

SEQ ID NO: 55885 - DNA, 20 bp, Artificial Sequence
  chemically synthesized
tttcctattaaagaaaagcc

SEQ ID NO: 55886 - DNA, 20 bp, Artificial Sequence
  chemically synthesized
ttcctattaaagaaaagccc

SEQ ID NO: 55887 - DNA, 20 bp, Artificial Sequence
  chemically synthesized
aagaaaagcccaggactcga

SEQ ID NO: 55888 - DNA, 20 bp, Artificial Sequence
  chemically synthesized
agaaaagcccaggactcgat

SEQ ID NO: 55889 - DNA, 20 bp, Artificial Sequence
  chemically synthesized
gatgggctaccaaacatttc

SEQ ID NO: 55890 - DNA, 20 bp, Artificial Sequence
  chemically synthesized
gggctaccaaacatttcaag

SEQ ID NO: 55891 - DNA, 20 bp, Artificial Sequence
  chemically synthesized
acaaacaaataaaaactgaa

SEQ ID NO: 55892 - DNA, 20 bp, Artificial Sequence
  chemically synthesized
aacaaataaaaactgaaaag

SEQ ID NO: 55893 - DNA, 20 bp, Artificial Sequence
  chemically synthesized
acaaataaaaactgaaaaga

SEQ ID NO: 55894 - DNA, 20 bp, Artificial Sequence
  chemically synthesized
caaataaaaactgaaaagaa

SEQ ID NO: 55895 - DNA, 20 bp, Artificial Sequence
  chemically synthesized
tacttctaaacttattctat

SEQ ID NO: 55896 - DNA, 20 bp, Artificial Sequence
  chemically synthesized
acttctaaacttattctatg

SEQ ID NO: 55897 - DNA, 20 bp, Artificial Sequence
  chemically synthesized
ctaaacttattctatgaggc

SEQ ID NO: 55898 - DNA, 20 bp, Artificial Sequence
  chemically synthesized
ttactctaatatacccaaac

SEQ ID NO: 55899 - DNA, 20 bp, Artificial Sequence
  chemically synthesized
ctaatatacccaaaccagac

SEQ ID NO: 55900 - DNA, 20 bp, Artificial Sequence
  chemically synthesized
taatatacccaaaccagacc

SEQ ID NO: 55901 - DNA, 20 bp, Artificial Sequence
  chemically synthesized
acaacaacaaatgcacctca

SEQ ID NO: 55902 - DNA, 20 bp, Artificial Sequence
  chemically synthesized
caacaacaaatgcacctcaa

SEQ ID NO: 55903 - DNA, 20 bp, Artificial Sequence
  chemically synthesized
acaacaaatgcacctcaaag

SEQ ID NO: 55904 - DNA, 20 bp, Artificial Sequence
  chemically synthesized
caacaaatgcacctcaaagg

SEQ ID NO: 55905 - DNA, 20 bp, Artificial Sequence
  chemically synthesized
aatgcacctcaaaggaggta

SEQ ID NO: 55906 - DNA, 20 bp, Artificial Sequence
  chemically synthesized
gcacctcaaaggaggtacag

SEQ ID NO: 55907 - DNA, 20 bp, Artificial Sequence
  chemically synthesized
cacctcaaaggaggtacagt

SEQ ID NO: 55908 - DNA, 20 bp, Artificial Sequence
  chemically synthesized
tcaaaataataaaaaccata

SEQ ID NO: 55909 - DNA, 20 bp, Artificial Sequence
  chemically synthesized
caaaataataaaaaccatat

SEQ ID NO: 55910 - DNA, 20 bp, Artificial Sequence
  chemically synthesized
aaaaccatataggacaaacc

SEQ ID NO: 55911 - DNA, 20 bp, Artificial Sequence
  chemically synthesized
agtgctaacattatgctgaa

SEQ ID NO: 55912 - DNA, 20 bp, Artificial Sequence
  chemically synthesized
tgctaacattatgctgaaca

SEQ ID NO: 55913 - DNA, 20 bp, Artificial Sequence
  chemically synthesized
tgctgaacagagaaacattg

SEQ ID NO: 55914 - DNA, 20 bp, Artificial Sequence
  chemically synthesized
gctgaacagagaaacattga

SEQ ID NO: 55915 - DNA, 20 bp, Artificial Sequence
  chemically synthesized
acattgaaggcctttcctct

SEQ ID NO: 55916 - DNA, 20 bp, Artificial Sequence
  chemically synthesized
cattgaaggcctttcctcta

SEQ ID NO: 55917 - DNA, 20 bp, Artificial Sequence
  chemically synthesized
tttcctctaaggactgaaat

SEQ ID NO: 55918 - DNA, 20 bp, Artificial Sequence
  chemically synthesized
ttcctctaaggactgaaata

SEQ ID NO: 55919 - DNA, 20 bp, Artificial Sequence
  chemically synthesized
tctaaggactgaaataaggc

SEQ ID NO: 55920 - DNA, 20 bp, Artificial Sequence
  chemically synthesized
gccattatttaacataatat

SEQ ID NO: 55921 - DNA, 20 bp, Artificial Sequence
  chemically synthesized
attatttaacataatattgg

SEQ ID NO: 55922 - DNA, 20 bp, Artificial Sequence
  chemically synthesized
taacataatattggaagtct

SEQ ID NO: 55923 - DNA, 20 bp, Artificial Sequence
  chemically synthesized
ataatattggaagtcttgga

SEQ ID NO: 55924 - DNA, 20 bp, Artificial Sequence
  chemically synthesized
aatattggaagtcttggaaa

SEQ ID NO: 55925 - DNA, 20 bp, Artificial Sequence
  chemically synthesized
aagtcttggaaagagaaatt

SEQ ID NO: 55926 - DNA, 20 bp, Artificial Sequence
  chemically synthesized
agtcttggaaagagaaattc

SEQ ID NO: 55927 - DNA, 20 bp, Artificial Sequence
  chemically synthesized
cttggaaagagaaattcagg

SEQ ID NO: 55928 - DNA, 20 bp, Artificial Sequence
  chemically synthesized
tggaaagagaaattcaggaa

SEQ ID NO: 55929 - DNA, 20 bp, Artificial Sequence
  chemically synthesized
aagagaaattcaggaagaga

SEQ ID NO: 55930 - DNA, 20 bp, Artificial Sequence
  chemically synthesized
gaaattcaggaagagaaaga

SEQ ID NO: 55931 - DNA, 20 bp, Artificial Sequence
  chemically synthesized
gaaagaaagtgcatccaaat

SEQ ID NO: 55932 - DNA, 20 bp, Artificial Sequence
  chemically synthesized
gaaagtgcatccaaattgga

SEQ ID NO: 55933 - DNA, 20 bp, Artificial Sequence
  chemically synthesized
aaagtgcatccaaattggaa

SEQ ID NO: 55934 - DNA, 20 bp, Artificial Sequence
  chemically synthesized
gtgcatccaaattggaaagg

SEQ ID NO: 55935 - DNA, 20 bp, Artificial Sequence
  chemically synthesized
catccaaattggaaaggaag

SEQ ID NO: 55936 - DNA, 20 bp, Artificial Sequence
  chemically synthesized
tggaaaggaagaagttaaat

SEQ ID NO: 55937 - DNA, 20 bp, Artificial Sequence
  chemically synthesized
aggaagaagttaaattagcc

SEQ ID NO: 55938 - DNA, 20 bp, Artificial Sequence
  chemically synthesized
agttaaattagcctagtttg

SEQ ID NO: 55939 - DNA, 20 bp, Artificial Sequence
  chemically synthesized
agatgacatgatcttatact

SEQ ID NO: 55940 - DNA, 20 bp, Artificial Sequence
  chemically synthesized
acgatttaaaaaaatcaata

SEQ ID NO: 55941 - DNA, 20 bp, Artificial Sequence
  chemically synthesized
taaaaaaatcaataaagtta

SEQ ID NO: 55942 - DNA, 20 bp, Artificial Sequence
  chemically synthesized
aaaaaaatcaataaagttac

SEQ ID NO: 55943 - DNA, 20 bp, Artificial Sequence
  chemically synthesized
atgaaataaaaatacaaaat

SEQ ID NO: 55944 - DNA, 20 bp, Artificial Sequence
  chemically synthesized
aaataaaaatacaaaatcag

SEQ ID NO: 55945 - DNA, 20 bp, Artificial Sequence
  chemically synthesized
agtagcatttcatatataaa

SEQ ID NO: 55946 - DNA, 20 bp, Artificial Sequence
  chemically synthesized
taaaacaatcttatttacaa

SEQ ID NO: 55947 - DNA, 20 bp, Artificial Sequence
  chemically synthesized
caataaaaatataaaatacc

SEQ ID NO: 55948 - DNA, 20 bp, Artificial Sequence
  chemically synthesized
aataaaaatataaaataccc

SEQ ID NO: 55949 - DNA, 20 bp, Artificial Sequence
  chemically synthesized
taaaaatataaaatacccag

SEQ ID NO: 55950 - DNA, 20 bp, Artificial Sequence
  chemically synthesized
cccaggagtcaatctaaccc

SEQ ID NO: 55951 - DNA, 20 bp, Artificial Sequence
  chemically synthesized
aggagtcaatctaacccaag

SEQ ID NO: 55952 - DNA, 20 bp, Artificial Sequence
  chemically synthesized
caatctaacccaagaagtaa

SEQ ID NO: 55953 - DNA, 20 bp, Artificial Sequence
  chemically synthesized
aagaagtaaaagatctctat

SEQ ID NO: 55954 - DNA, 20 bp, Artificial Sequence
  chemically synthesized
taagaaaaattataaaactc

SEQ ID NO: 55955 - DNA, 20 bp, Artificial Sequence
  chemically synthesized
aaattataaaactctggtga

SEQ ID NO: 55956 - DNA, 20 bp, Artificial Sequence
  chemically synthesized
taaaactctggtgaaagaaa

SEQ ID NO: 55957 - DNA, 20 bp, Artificial Sequence
  chemically synthesized
aactctggtgaaagaaatag

SEQ ID NO: 55958 - DNA, 20 bp, Artificial Sequence
  chemically synthesized
ctctggtgaaagaaatagaa

SEQ ID NO: 55959 - DNA, 20 bp, Artificial Sequence
  chemically synthesized
tctggtgaaagaaatagaag

SEQ ID NO: 55960 - DNA, 20 bp, Artificial Sequence
  chemically synthesized
ctggtgaaagaaatagaaga

SEQ ID NO: 55961 - DNA, 20 bp, Artificial Sequence
  chemically synthesized
aagagggcacacaaataaaa

SEQ ID NO: 55962 - DNA, 20 bp, Artificial Sequence
  chemically synthesized
gatattccatgctcatgaac

SEQ ID NO: 55963 - DNA, 20 bp, Artificial Sequence
  chemically synthesized
attccatgctcatgaactag

SEQ ID NO: 55964 - DNA, 20 bp, Artificial Sequence
  chemically synthesized
taaaatgacaatactaccca

SEQ ID NO: 55965 - DNA, 20 bp, Artificial Sequence
  chemically synthesized
atactacccaaagcaatgta

SEQ ID NO: 55966 - DNA, 20 bp, Artificial Sequence
  chemically synthesized
cccaaagcaatgtacagatt

SEQ ID NO: 55967 - DNA, 20 bp, Artificial Sequence
  chemically synthesized
aatttctgtcaaaataccaa

SEQ ID NO: 55968 - DNA, 20 bp, Artificial Sequence
  chemically synthesized
caaaataccaatggcattca

SEQ ID NO: 55969 - DNA, 20 bp, Artificial Sequence
  chemically synthesized
accaatggcattcacagaaa

SEQ ID NO: 55970 - DNA, 20 bp, Artificial Sequence
  chemically synthesized
aaacaatcctaatatttata

SEQ ID NO: 55971 - DNA, 20 bp, Artificial Sequence
  chemically synthesized
atatttatatggaaccacaa

SEQ ID NO: 55972 - DNA, 20 bp, Artificial Sequence
  chemically synthesized
gaaccacaaaagatccccaa

SEQ ID NO: 55973 - DNA, 20 bp, Artificial Sequence
  chemically synthesized
caaaagatccccaatagcta

SEQ ID NO: 55974 - DNA, 20 bp, Artificial Sequence
  chemically synthesized
ccaatagctaaagcaatcct

SEQ ID NO: 55975 - DNA, 20 bp, Artificial Sequence
  chemically synthesized
ctaaagcaatcctgagcaaa

SEQ ID NO: 55976 - DNA, 20 bp, Artificial Sequence
  chemically synthesized
gagcaaaaagaacaaaacca

SEQ ID NO: 55977 - DNA, 20 bp, Artificial Sequence
  chemically synthesized
tgacttcaaaatctactaca

SEQ ID NO: 55978 - DNA, 20 bp, Artificial Sequence
  chemically synthesized
caaaatctactacaaagcta

SEQ ID NO: 55979 - DNA, 20 bp, Artificial Sequence
  chemically synthesized
aatctactacaaagctacag

SEQ ID NO: 55980 - DNA, 20 bp, Artificial Sequence
  chemically synthesized
acaaagctacagtagccaaa

SEQ ID NO: 55981 - DNA, 20 bp, Artificial Sequence
  chemically synthesized
gctacagtagccaaacagca

SEQ ID NO: 55982 - DNA, 20 bp, Artificial Sequence
  chemically synthesized
aaacagcacagtactgcata

SEQ ID NO: 55983 - DNA, 20 bp, Artificial Sequence
  chemically synthesized
agcacagtactgcataaaga

SEQ ID NO: 55984 - DNA, 20 bp, Artificial Sequence
  chemically synthesized
actgcataaagacagacata

SEQ ID NO: 55985 - DNA, 20 bp, Artificial Sequence
  chemically synthesized
aagacagacatacagcccaa

SEQ ID NO: 55986 - DNA, 20 bp, Artificial Sequence
  chemically synthesized
agacatacagcccaatggaa

SEQ ID NO: 55987 - DNA, 20 bp, Artificial Sequence
  chemically synthesized
tacagcccaatggaacagca

SEQ ID NO: 55988 - DNA, 20 bp, Artificial Sequence
  chemically synthesized
cagcccaatggaacagcata

SEQ ID NO: 55989 - DNA, 20 bp, Artificial Sequence
  chemically synthesized
atggaacagcatagagaacc

SEQ ID NO: 55990 - DNA, 20 bp, Artificial Sequence
  chemically synthesized
agagaacccagatgcaaatc

SEQ ID NO: 55991 - DNA, 20 bp, Artificial Sequence
  chemically synthesized
gagaacccagatgcaaatcc

SEQ ID NO: 55992 - DNA, 20 bp, Artificial Sequence
  chemically synthesized
aatccaggcacttaacaacc

SEQ ID NO: 55993 - DNA, 20 bp, Artificial Sequence
  chemically synthesized
caaccaagtcatctttaaca

SEQ ID NO: 55994 - DNA, 20 bp, Artificial Sequence
  chemically synthesized
aaccaagtcatctttaacaa

SEQ ID NO: 55995 - DNA, 20 bp, Artificial Sequence
  chemically synthesized
tcatctttaacaaaggcatc

SEQ ID NO: 55996 - DNA, 20 bp, Artificial Sequence
  chemically synthesized
aggcatcaagaacataaaaa

SEQ ID NO: 55997 - DNA, 20 bp, Artificial Sequence
  chemically synthesized
ggcatcaagaacataaaaat

SEQ ID NO: 55998 - DNA, 20 bp, Artificial Sequence
  chemically synthesized
aacataaaaataggaacaaa

SEQ ID NO: 55999 - DNA, 20 bp, Artificial Sequence
  chemically synthesized
acataaaaataggaacaaat

SEQ ID NO: 56000 - DNA, 20 bp, Artificial Sequence
  chemically synthesized
aaaaataggaacaaatgggc

SEQ ID NO: 56001 - DNA, 20 bp, Artificial Sequence
  chemically synthesized
aaaataggaacaaatgggcc

SEQ ID NO: 56002 - DNA, 20 bp, Artificial Sequence
  chemically synthesized
aggaacaaatgggccaggtg

SEQ ID NO: 56003 - DNA, 20 bp, Artificial Sequence
  chemically synthesized
aacaaatgggccaggtgcag

SEQ ID NO: 56004 - DNA, 20 bp, Artificial Sequence
  chemically synthesized
gtggctcacacctgtaatcc

SEQ ID NO: 56005 - DNA, 20 bp, Artificial Sequence
  chemically synthesized
ctgtaatcccagcactttgt

SEQ ID NO: 56006 - DNA, 20 bp, Artificial Sequence
  chemically synthesized
tgtaatcccagcactttgtg

SEQ ID NO: 56007 - DNA, 20 bp, Artificial Sequence
  chemically synthesized
tcccagcactttgtgaggct

SEQ ID NO: 56008 - DNA, 20 bp, Artificial Sequence
  chemically synthesized
cccagcactttgtgaggctg

SEQ ID NO: 56009 - DNA, 20 bp, Artificial Sequence
  chemically synthesized
agcactttgtgaggctgagg

SEQ ID NO: 56010 - DNA, 20 bp, Artificial Sequence
  chemically synthesized
gcactttgtgaggctgaggt

SEQ ID NO: 56011 - DNA, 20 bp, Artificial Sequence
  chemically synthesized
cactttgtgaggctgaggtg

SEQ ID NO: 56012 - DNA, 20 bp, Artificial Sequence
  chemically synthesized
actttgtgaggctgaggtgg

SEQ ID NO: 56013 - DNA, 20 bp, Artificial Sequence
  chemically synthesized
ctttgtgaggctgaggtggg

SEQ ID NO: 56014 - DNA, 20 bp, Artificial Sequence
  chemically synthesized
ggctgaggtggggggatcac

SEQ ID NO: 56015 - DNA, 20 bp, Artificial Sequence
  chemically synthesized
gctgaggtggggggatcacg

SEQ ID NO: 56016 - DNA, 20 bp, Artificial Sequence
  chemically synthesized
aggtggggggatcacgaggt

SEQ ID NO: 56017 - DNA, 20 bp, Artificial Sequence
  chemically synthesized
ggtggggggatcacgaggtc

SEQ ID NO: 56018 - DNA, 20 bp, Artificial Sequence
  chemically synthesized
tggggggatcacgaggtcag

SEQ ID NO: 56019 - DNA, 20 bp, Artificial Sequence
  chemically synthesized
gatcacgaggtcaggagttc

SEQ ID NO: 56020 - DNA, 20 bp, Artificial Sequence
  chemically synthesized
cgaggtcaggagttcaagac

SEQ ID NO: 56021 - DNA, 20 bp, Artificial Sequence
  chemically synthesized
caagaccagcctgaccaacg

SEQ ID NO: 56022 - DNA, 20 bp, Artificial Sequence
  chemically synthesized
tctactaaaaatacaaaaat

SEQ ID NO: 56023 - DNA, 20 bp, Artificial Sequence
  chemically synthesized
ctaaaaatacaaaaattagc

SEQ ID NO: 56024 - DNA, 20 bp, Artificial Sequence
  chemically synthesized
taaaaatacaaaaattagcc

SEQ ID NO: 56025 - DNA, 20 bp, Artificial Sequence
  chemically synthesized
atacaaaaattagccaggca

SEQ ID NO: 56026 - DNA, 20 bp, Artificial Sequence
  chemically synthesized
caaaaattagccaggcatgg

SEQ ID NO: 56027 - DNA, 20 bp, Artificial Sequence
  chemically synthesized
aaaaattagccaggcatggt

SEQ ID NO: 56028 - DNA, 20 bp, Artificial Sequence
  chemically synthesized
aaaattagccaggcatggtg

SEQ ID NO: 56029 - DNA, 20 bp, Artificial Sequence
  chemically synthesized
gtggggcgctcctgtaatcc

SEQ ID NO: 56030 - DNA, 20 bp, Artificial Sequence
  chemically synthesized
ctcctgtaatcccagatact

SEQ ID NO: 56031 - DNA, 20 bp, Artificial Sequence
  chemically synthesized
tcctgtaatcccagatactc

SEQ ID NO: 56032 - DNA, 20 bp, Artificial Sequence
  chemically synthesized
ctgtaatcccagatactcag

SEQ ID NO: 56033 - DNA, 20 bp, Artificial Sequence
  chemically synthesized
tgtaatcccagatactcagg

SEQ ID NO: 56034 - DNA, 20 bp, Artificial Sequence
  chemically synthesized
tcccagatactcaggaggct

SEQ ID NO: 56035 - DNA, 20 bp, Artificial Sequence
  chemically synthesized
cccagatactcaggaggctg

SEQ ID NO: 56036 - DNA, 20 bp, Artificial Sequence
  chemically synthesized
agatactcaggaggctgagg

SEQ ID NO: 56037 - DNA, 20 bp, Artificial Sequence
  chemically synthesized
gatactcaggaggctgaggc

SEQ ID NO: 56038 - DNA, 20 bp, Artificial Sequence
  chemically synthesized
tactcaggaggctgaggcag

SEQ ID NO: 56039 - DNA, 20 bp, Artificial Sequence
  chemically synthesized
gcaggagaatcgcttgaacc

SEQ ID NO: 56040 - DNA, 20 bp, Artificial Sequence
  chemically synthesized
caggagaatcgcttgaacct

SEQ ID NO: 56041 - DNA, 20 bp, Artificial Sequence
  chemically synthesized
ggagaatcgcttgaacctgg

SEQ ID NO: 56042 - DNA, 20 bp, Artificial Sequence
  chemically synthesized
gagaatcgcttgaacctggg

SEQ ID NO: 56043 - DNA, 20 bp, Artificial Sequence
  chemically synthesized
aatcgcttgaacctgggagg

SEQ ID NO: 56044 - DNA, 20 bp, Artificial Sequence
  chemically synthesized
cgcttgaacctgggaggcag

SEQ ID NO: 56045 - DNA, 20 bp, Artificial Sequence
  chemically synthesized
aacctgggaggcagaagttg

SEQ ID NO: 56046 - DNA, 20 bp, Artificial Sequence
  chemically synthesized
ggcagaagttgcagtgatcc

SEQ ID NO: 56047 - DNA, 20 bp, Artificial Sequence
  chemically synthesized
attgtgctgccactgcactc

SEQ ID NO: 56048 - DNA, 20 bp, Artificial Sequence
  chemically synthesized
gctgccactgcactccagcc

SEQ ID NO: 56049 - DNA, 20 bp, Artificial Sequence
  chemically synthesized
ctgccactgcactccagcct

SEQ ID NO: 56050 - DNA, 20 bp, Artificial Sequence
  chemically synthesized
ctgcactccagcctgggcaa

SEQ ID NO: 56051 - DNA, 20 bp, Artificial Sequence
  chemically synthesized
actccagcctgggcaacagt

SEQ ID NO: 56052 - DNA, 20 bp, Artificial Sequence
  chemically synthesized
tctcaaaaaaaaaaaaaaaa

SEQ ID NO: 56053 - DNA, 20 bp, Artificial Sequence
  chemically synthesized
ctcaaaaaaaaaaaaaaaaa

SEQ ID NO: 56054 - DNA, 20 bp, Artificial Sequence
  chemically synthesized
aaaaaaaaaaaaggtacaaa

SEQ ID NO: 56055 - DNA, 20 bp, Artificial Sequence
  chemically synthesized
aaggtacaaacagtcttttc

SEQ ID NO: 56056 - DNA, 20 bp, Artificial Sequence
  chemically synthesized
caaacagtcttttcaagaaa

SEQ ID NO: 56057 - DNA, 20 bp, Artificial Sequence
  chemically synthesized
gtcttttcaagaaacagtgc

SEQ ID NO: 56058 - DNA, 20 bp, Artificial Sequence
  chemically synthesized
tcttttcaagaaacagtgct

SEQ ID NO: 56059 - DNA, 20 bp, Artificial Sequence
  chemically synthesized
agaaacagtgctaggaaaac

SEQ ID NO: 56060 - DNA, 20 bp, Artificial Sequence
  chemically synthesized
aactggatatccatttgcaa

SEQ ID NO: 56061 - DNA, 20 bp, Artificial Sequence
  chemically synthesized
ctggatatccatttgcaaaa

SEQ ID NO: 56062 - DNA, 20 bp, Artificial Sequence
  chemically synthesized
catttgcaaaagagtaaaat

SEQ ID NO: 56063 - DNA, 20 bp, Artificial Sequence
  chemically synthesized
ctatatacaaaaatcaaatc

SEQ ID NO: 56064 - DNA, 20 bp, Artificial Sequence
  chemically synthesized
atacaaaaatcaaatcaaga

SEQ ID NO: 56065 - DNA, 20 bp, Artificial Sequence
  chemically synthesized
aatcaaatcaagatggatta

SEQ ID NO: 56066 - DNA, 20 bp, Artificial Sequence
  chemically synthesized
acctgaaattatgaaactac

SEQ ID NO: 56067 - DNA, 20 bp, Artificial Sequence
  chemically synthesized
tgaaattatgaaactactgg

SEQ ID NO: 56068 - DNA, 20 bp, Artificial Sequence
  chemically synthesized
atgaaactactggaagaaaa

SEQ ID NO: 56069 - DNA, 20 bp, Artificial Sequence
  chemically synthesized
aaactactggaagaaaacag

SEQ ID NO: 56070 - DNA, 20 bp, Artificial Sequence
  chemically synthesized
aactactggaagaaaacagt

SEQ ID NO: 56071 - DNA, 20 bp, Artificial Sequence
  chemically synthesized
actactggaagaaaacagtg

SEQ ID NO: 56072 - DNA, 20 bp, Artificial Sequence
  chemically synthesized
aaaacagtggggaaaccctc

SEQ ID NO: 56073 - DNA, 20 bp, Artificial Sequence
  chemically synthesized
aaacagtggggaaaccctcc

SEQ ID NO: 56074 - DNA, 20 bp, Artificial Sequence
  chemically synthesized
aacagtggggaaaccctcca

SEQ ID NO: 56075 - DNA, 20 bp, Artificial Sequence
  chemically synthesized
ctccagggcattcattgatt

SEQ ID NO: 56076 - DNA, 20 bp, Artificial Sequence
  chemically synthesized
tccagggcattcattgattt

SEQ ID NO: 56077 - DNA, 20 bp, Artificial Sequence
  chemically synthesized
tttgggcaaatactgtctat

SEQ ID NO: 56078 - DNA, 20 bp, Artificial Sequence
  chemically synthesized
tactgtctatgagacttcaa

SEQ ID NO: 56079 - DNA, 20 bp, Artificial Sequence
  chemically synthesized
acaaataaccaaaacaaaaa

SEQ ID NO: 56080 - DNA, 20 bp, Artificial Sequence
  chemically synthesized
ccaaaacaaaaatagacaat

SEQ ID NO: 56081 - DNA, 20 bp, Artificial Sequence
  chemically synthesized
caaaacaaaaatagacaatt

SEQ ID NO: 56082 - DNA, 20 bp, Artificial Sequence
  chemically synthesized
tagacaattgggattgtttg

SEQ ID NO: 56083 - DNA, 20 bp, Artificial Sequence
  chemically synthesized
ggattgtttgaagctctgca

SEQ ID NO: 56084 - DNA, 20 bp, Artificial Sequence
  chemically synthesized
gtttgaagctctgcacagca

SEQ ID NO: 56085 - DNA, 20 bp, Artificial Sequence
  chemically synthesized
gcacagcaaagaaaataata

SEQ ID NO: 56086 - DNA, 20 bp, Artificial Sequence
  chemically synthesized
gcaaagaaaataataaagtg

SEQ ID NO: 56087 - DNA, 20 bp, Artificial Sequence
  chemically synthesized
aaagaaaataataaagtgaa

SEQ ID NO: 56088 - DNA, 20 bp, Artificial Sequence
  chemically synthesized
taaagtgaagagacaaccca

SEQ ID NO: 56089 - DNA, 20 bp, Artificial Sequence
  chemically synthesized
tgaagagacaacccaaagaa

SEQ ID NO: 56090 - DNA, 20 bp, Artificial Sequence
  chemically synthesized
gaagagacaacccaaagaat

SEQ ID NO: 56091 - DNA, 20 bp, Artificial Sequence
  chemically synthesized
agagacaacccaaagaatgg

SEQ ID NO: 56092 - DNA, 20 bp, Artificial Sequence
  chemically synthesized
ttgcaaactatatattttac

SEQ ID NO: 56093 - DNA, 20 bp, Artificial Sequence
  chemically synthesized
tgcaaactatatattttaca

SEQ ID NO: 56094 - DNA, 20 bp, Artificial Sequence
  chemically synthesized
ttttacaaggaattgataac

SEQ ID NO: 56095 - DNA, 20 bp, Artificial Sequence
  chemically synthesized
aattgataaccagaatatgc

SEQ ID NO: 56096 - DNA, 20 bp, Artificial Sequence
  chemically synthesized
ccagaatatgcaagaaactc

SEQ ID NO: 56097 - DNA, 20 bp, Artificial Sequence
  chemically synthesized
aagaaactcaagcaactcaa

SEQ ID NO: 56098 - DNA, 20 bp, Artificial Sequence
  chemically synthesized
ataaataaataaataaataa

SEQ ID NO: 56099 - DNA, 20 bp, Artificial Sequence
  chemically synthesized
aataaataaataatggccaa

SEQ ID NO: 56100 - DNA, 20 bp, Artificial Sequence
  chemically synthesized
taatggccaaaagacctgaa

SEQ ID NO: 56101 - DNA, 20 bp, Artificial Sequence
  chemically synthesized
cctgaatagatatttctcaa

SEQ ID NO: 56102 - DNA, 20 bp, Artificial Sequence
  chemically synthesized
gaatagatatttctcaaaag

SEQ ID NO: 56103 - DNA, 20 bp, Artificial Sequence
  chemically synthesized
ctcaaaagaagccatacaaa

SEQ ID NO: 56104 - DNA, 20 bp, Artificial Sequence
  chemically synthesized
aagaagccatacaaatggcc

SEQ ID NO: 56105 - DNA, 20 bp, Artificial Sequence
  chemically synthesized
gaagccatacaaatggccca

SEQ ID NO: 56106 - DNA, 20 bp, Artificial Sequence
  chemically synthesized
aagccatacaaatggcccag

SEQ ID NO: 56107 - DNA, 20 bp, Artificial Sequence
  chemically synthesized
tgttcaatatcactaatcac

SEQ ID NO: 56108 - DNA, 20 bp, Artificial Sequence
  chemically synthesized
aatgtgatatcatctcacct

SEQ ID NO: 56109 - DNA, 20 bp, Artificial Sequence
  chemically synthesized
tcatctcaccttagttaaaa

SEQ ID NO: 56110 - DNA, 20 bp, Artificial Sequence
  chemically synthesized
aatagcttataacaaaacaa

SEQ ID NO: 56111 - DNA, 20 bp, Artificial Sequence
  chemically synthesized
atagcttataacaaaacaaa

SEQ ID NO: 56112 - DNA, 20 bp, Artificial Sequence
  chemically synthesized
aacaaaacaaaaggaaataa

SEQ ID NO: 56113 - DNA, 20 bp, Artificial Sequence
  chemically synthesized
ggaaataacagatgcttgtg

SEQ ID NO: 56114 - DNA, 20 bp, Artificial Sequence
  chemically synthesized
aacagatgcttgtgtggatg

SEQ ID NO: 56115 - DNA, 20 bp, Artificial Sequence
  chemically synthesized
tgcttgtgtggatgtggaca

SEQ ID NO: 56116 - DNA, 20 bp, Artificial Sequence
  chemically synthesized
gcttgtgtggatgtggacaa

SEQ ID NO: 56117 - DNA, 20 bp, Artificial Sequence
  chemically synthesized
cttgtgtggatgtggacaaa

SEQ ID NO: 56118 - DNA, 20 bp, Artificial Sequence
  chemically synthesized
gggaaaccctcttacactgt

SEQ ID NO: 56119 - DNA, 20 bp, Artificial Sequence
  chemically synthesized
aaaccctcttacactgttgg

SEQ ID NO: 56120 - DNA, 20 bp, Artificial Sequence
  chemically synthesized
aaccctcttacactgttggt

SEQ ID NO: 56121 - DNA, 20 bp, Artificial Sequence
  chemically synthesized
ccctcttacactgttggtgg

SEQ ID NO: 56122 - DNA, 20 bp, Artificial Sequence
  chemically synthesized
ctgttggtgggagtacaaat

SEQ ID NO: 56123 - DNA, 20 bp, Artificial Sequence
  chemically synthesized
ggtgggagtacaaattggta

SEQ ID NO: 56124 - DNA, 20 bp, Artificial Sequence
  chemically synthesized
aaattggtacagcaattatg

SEQ ID NO: 56125 - DNA, 20 bp, Artificial Sequence
  chemically synthesized
aattggtacagcaattatga

SEQ ID NO: 56126 - DNA, 20 bp, Artificial Sequence
  chemically synthesized
ggtacagcaattatgaagga

SEQ ID NO: 56127 - DNA, 20 bp, Artificial Sequence
  chemically synthesized
agcaattatgaaggacagta

SEQ ID NO: 56128 - DNA, 20 bp, Artificial Sequence
  chemically synthesized
caattatgaaggacagtatg

SEQ ID NO: 56129 - DNA, 20 bp, Artificial Sequence
  chemically synthesized
ggagatttgtcaaaaatgta

SEQ ID NO: 56130 - DNA, 20 bp, Artificial Sequence
  chemically synthesized
gatttgtcaaaaatgtaaag

SEQ ID NO: 56131 - DNA, 20 bp, Artificial Sequence
  chemically synthesized
agtagaactaccatatgatc

SEQ ID NO: 56132 - DNA, 20 bp, Artificial Sequence
  chemically synthesized
tgatccagcaatatcactcc

SEQ ID NO: 56133 - DNA, 20 bp, Artificial Sequence
  chemically synthesized
gatccagcaatatcactcct

SEQ ID NO: 56134 - DNA, 20 bp, Artificial Sequence
  chemically synthesized
tcctaggtatatacccttaa

SEQ ID NO: 56135 - DNA, 20 bp, Artificial Sequence
  chemically synthesized
atacccttaaaagaataaat

SEQ ID NO: 56136 - DNA, 20 bp, Artificial Sequence
  chemically synthesized
aagaataaattagtatgtcg

SEQ ID NO: 56137 - DNA, 20 bp, Artificial Sequence
  chemically synthesized
ttagtatgtcgaagatatat

SEQ ID NO: 56138 - DNA, 20 bp, Artificial Sequence
  chemically synthesized
cagtactcccatctttatta

SEQ ID NO: 56139 - DNA, 20 bp, Artificial Sequence
  chemically synthesized
tagcactattcacaaacgcc

SEQ ID NO: 56140 - DNA, 20 bp, Artificial Sequence
  chemically synthesized
tcaactgatgtattcgtcaa

SEQ ID NO: 56141 - DNA, 20 bp, Artificial Sequence
  chemically synthesized
tgtattcgtcaacagataaa

SEQ ID NO: 56142 - DNA, 20 bp, Artificial Sequence
  chemically synthesized
cgtcaacagataaatggata

SEQ ID NO: 56143 - DNA, 20 bp, Artificial Sequence
  chemically synthesized
acacacacacacacacacaa

SEQ ID NO: 56144 - DNA, 20 bp, Artificial Sequence
  chemically synthesized
aatattattcaaccataaaa

SEQ ID NO: 56145 - DNA, 20 bp, Artificial Sequence
  chemically synthesized
gaatgaaatattatcaatta

SEQ ID NO: 56146 - DNA, 20 bp, Artificial Sequence
  chemically synthesized
atcaattacagtaacataaa

SEQ ID NO: 56147 - DNA, 20 bp, Artificial Sequence
  chemically synthesized
agtaacataaatggtactga

SEQ ID NO: 56148 - DNA, 20 bp, Artificial Sequence
  chemically synthesized
gtactgaaagcaattacgtt

SEQ ID NO: 56149 - DNA, 20 bp, Artificial Sequence
  chemically synthesized
gcaattacgttaagtgaaat

SEQ ID NO: 56150 - DNA, 20 bp, Artificial Sequence
  chemically synthesized
tacgttaagtgaaataagcc

SEQ ID NO: 56151 - DNA, 20 bp, Artificial Sequence
  chemically synthesized
taagtgaaataagccaagca

SEQ ID NO: 56152 - DNA, 20 bp, Artificial Sequence
  chemically synthesized
tgaaataagccaagcacaga

SEQ ID NO: 56153 - DNA, 20 bp, Artificial Sequence
  chemically synthesized
atcacatgttctaactcgtg

SEQ ID NO: 56154 - DNA, 20 bp, Artificial Sequence
  chemically synthesized
acatgttctaactcgtgtgg

SEQ ID NO: 56155 - DNA, 20 bp, Artificial Sequence
  chemically synthesized
tcgtgtggaagttaaaaacg

SEQ ID NO: 56156 - DNA, 20 bp, Artificial Sequence
  chemically synthesized
ttaaaaacgtggatcttatg

SEQ ID NO: 56157 - DNA, 20 bp, Artificial Sequence
  chemically synthesized
aaacgtggatcttatgaaga

SEQ ID NO: 56158 - DNA, 20 bp, Artificial Sequence
  chemically synthesized
acgtggatcttatgaagaca

SEQ ID NO: 56159 - DNA, 20 bp, Artificial Sequence
  chemically synthesized
gtggatcttatgaagacaga

SEQ ID NO: 56160 - DNA, 20 bp, Artificial Sequence
  chemically synthesized
gatcttatgaagacagagag

SEQ ID NO: 56161 - DNA, 20 bp, Artificial Sequence
  chemically synthesized
tatgaagacagagagtagat

SEQ ID NO: 56162 - DNA, 20 bp, Artificial Sequence
  chemically synthesized
gaagacagagagtagattgg

SEQ ID NO: 56163 - DNA, 20 bp, Artificial Sequence
  chemically synthesized
gagagtagattggtagttac

SEQ ID NO: 56164 - DNA, 20 bp, Artificial Sequence
  chemically synthesized
agtagattggtagttaccgg

SEQ ID NO: 56165 - DNA, 20 bp, Artificial Sequence
  chemically synthesized
agattggtagttaccggcgg

SEQ ID NO: 56166 - DNA, 20 bp, Artificial Sequence
  chemically synthesized
gattggtagttaccggcggc

SEQ ID NO: 56167 - DNA, 20 bp, Artificial Sequence
  chemically synthesized
ttggtagttaccggcggcgg

SEQ ID NO: 56168 - DNA, 20 bp, Artificial Sequence
  chemically synthesized
tggtagttaccggcggcggg

SEQ ID NO: 56169 - DNA, 20 bp, Artificial Sequence
  chemically synthesized
ggtagttaccggcggcggga

SEQ ID NO: 56170 - DNA, 20 bp, Artificial Sequence
  chemically synthesized
agttaccggcggcgggaggg

SEQ ID NO: 56171 - DNA, 20 bp, Artificial Sequence
  chemically synthesized
accggcggcgggagggaaga

SEQ ID NO: 56172 - DNA, 20 bp, Artificial Sequence
  chemically synthesized
ccggcggcgggagggaagaa

SEQ ID NO: 56173 - DNA, 20 bp, Artificial Sequence
  chemically synthesized
gcgggagggaagaaaggaat

SEQ ID NO: 56174 - DNA, 20 bp, Artificial Sequence
  chemically synthesized
gaagaaaggaatgagaaatc

SEQ ID NO: 56175 - DNA, 20 bp, Artificial Sequence
  chemically synthesized
ctgaaccgtacactcaaaaa

SEQ ID NO: 56176 - DNA, 20 bp, Artificial Sequence
  chemically synthesized
ccgtacactcaaaaatggta

SEQ ID NO: 56177 - DNA, 20 bp, Artificial Sequence
  chemically synthesized
acactcaaaaatggtaaaga

SEQ ID NO: 56178 - DNA, 20 bp, Artificial Sequence
  chemically synthesized
cactcaaaaatggtaaagat

SEQ ID NO: 56179 - DNA, 20 bp, Artificial Sequence
  chemically synthesized
caaaaatggtaaagatgggc

SEQ ID NO: 56180 - DNA, 20 bp, Artificial Sequence
  chemically synthesized
aaaaatggtaaagatgggct

SEQ ID NO: 56181 - DNA, 20 bp, Artificial Sequence
  chemically synthesized
tggtaaagatgggctgggtg

SEQ ID NO: 56182 - DNA, 20 bp, Artificial Sequence
  chemically synthesized
taaagatgggctgggtgcgg

SEQ ID NO: 56183 - DNA, 20 bp, Artificial Sequence
  chemically synthesized
gtggccaatgcctgtaatct

SEQ ID NO: 56184 - DNA, 20 bp, Artificial Sequence
  chemically synthesized
tgcctgtaatctcagcactt

SEQ ID NO: 56185 - DNA, 20 bp, Artificial Sequence
  chemically synthesized
gcctgtaatctcagcacttt

SEQ ID NO: 56186 - DNA, 20 bp, Artificial Sequence
  chemically synthesized
ctgtaatctcagcactttgg

SEQ ID NO: 56187 - DNA, 20 bp, Artificial Sequence
  chemically synthesized
tgtaatctcagcactttggg

SEQ ID NO: 56188 - DNA, 20 bp, Artificial Sequence
  chemically synthesized
tctcagcactttgggaggcc

SEQ ID NO: 56189 - DNA, 20 bp, Artificial Sequence
  chemically synthesized
ctcagcactttgggaggcca

SEQ ID NO: 56190 - DNA, 20 bp, Artificial Sequence
  chemically synthesized
agcactttgggaggccaagg

SEQ ID NO: 56191 - DNA, 20 bp, Artificial Sequence
  chemically synthesized
gcactttgggaggccaaggc

SEQ ID NO: 56192 - DNA, 20 bp, Artificial Sequence
  chemically synthesized
ctttgggaggccaaggcagg

SEQ ID NO: 56193 - DNA, 20 bp, Artificial Sequence
  chemically synthesized
ggccaaggcaggtggatcat

SEQ ID NO: 56194 - DNA, 20 bp, Artificial Sequence
  chemically synthesized
gccaaggcaggtggatcatg

SEQ ID NO: 56195 - DNA, 20 bp, Artificial Sequence
  chemically synthesized
aggcaggtggatcatgaggt

SEQ ID NO: 56196 - DNA, 20 bp, Artificial Sequence
  chemically synthesized
ggcaggtggatcatgaggtc

SEQ ID NO: 56197 - DNA, 20 bp, Artificial Sequence
  chemically synthesized
caggtggatcatgaggtcag

SEQ ID NO: 56198 - DNA, 20 bp, Artificial Sequence
  chemically synthesized
gatcatgaggtcaggagtcc

SEQ ID NO: 56199 - DNA, 20 bp, Artificial Sequence
  chemically synthesized
tgaggtcaggagtccaagac

SEQ ID NO: 56200 - DNA, 20 bp, Artificial Sequence
  chemically synthesized
caagaccagcctgaccaaca

SEQ ID NO: 56201 - DNA, 20 bp, Artificial Sequence
  chemically synthesized
ctactaaaaatacaaaaaat

SEQ ID NO: 56202 - DNA, 20 bp, Artificial Sequence
  chemically synthesized
taaaaatacaaaaaattagc

SEQ ID NO: 56203 - DNA, 20 bp, Artificial Sequence
  chemically synthesized
aaaaatacaaaaaattagcc

SEQ ID NO: 56204 - DNA, 20 bp, Artificial Sequence
  chemically synthesized
tacaaaaaattagccaggcg

SEQ ID NO: 56205 - DNA, 20 bp, Artificial Sequence
  chemically synthesized
aaaaaattagccaggcgtgg

SEQ ID NO: 56206 - DNA, 20 bp, Artificial Sequence
  chemically synthesized
aaattagccaggcgtggtgg

SEQ ID NO: 56207 - DNA, 20 bp, Artificial Sequence
  chemically synthesized
aattagccaggcgtggtggc

SEQ ID NO: 56208 - DNA, 20 bp, Artificial Sequence
  chemically synthesized
cgcctgtaatcccacctact

SEQ ID NO: 56209 - DNA, 20 bp, Artificial Sequence
  chemically synthesized
gcctgtaatcccacctactt

SEQ ID NO: 56210 - DNA, 20 bp, Artificial Sequence
  chemically synthesized
ctgtaatcccacctacttgg

SEQ ID NO: 56211 - DNA, 20 bp, Artificial Sequence
  chemically synthesized
tgtaatcccacctacttggg

SEQ ID NO: 56212 - DNA, 20 bp, Artificial Sequence
  chemically synthesized
tcccacctacttgggaggct

SEQ ID NO: 56213 - DNA, 20 bp, Artificial Sequence
  chemically synthesized
cccacctacttgggaggctt

SEQ ID NO: 56214 - DNA, 20 bp, Artificial Sequence
  chemically synthesized
acctacttgggaggcttggg

SEQ ID NO: 56215 - DNA, 20 bp, Artificial Sequence
  chemically synthesized
cctacttgggaggcttgggc

SEQ ID NO: 56216 - DNA, 20 bp, Artificial Sequence
  chemically synthesized
tacttgggaggcttgggcag

SEQ ID NO: 56217 - DNA, 20 bp, Artificial Sequence
  chemically synthesized
gcaggagaatcgcttgaacc

SEQ ID NO: 56218 - DNA, 20 bp, Artificial Sequence
  chemically synthesized
ggagaatcgcttgaacctgg

SEQ ID NO: 56219 - DNA, 20 bp, Artificial Sequence
  chemically synthesized
gagaatcgcttgaacctggt

SEQ ID NO: 56220 - DNA, 20 bp, Artificial Sequence
  chemically synthesized
agaatcgcttgaacctggtg

SEQ ID NO: 56221 - DNA, 20 bp, Artificial Sequence
  chemically synthesized
gaatcgcttgaacctggtgg

SEQ ID NO: 56222 - DNA, 20 bp, Artificial Sequence
  chemically synthesized
tcgcttgaacctggtggggg

SEQ ID NO: 56223 - DNA, 20 bp, Artificial Sequence
  chemically synthesized
gcttgaacctggtgggggcg

SEQ ID NO: 56224 - DNA, 20 bp, Artificial Sequence
  chemically synthesized
cttgaacctggtgggggcgg

SEQ ID NO: 56225 - DNA, 20 bp, Artificial Sequence
  chemically synthesized
cctggtgggggcggaggttg

SEQ ID NO: 56226 - DNA, 20 bp, Artificial Sequence
  chemically synthesized
gtgggggcggaggttgcagt

SEQ ID NO: 56227 - DNA, 20 bp, Artificial Sequence
  chemically synthesized
ggcggaggttgcagtgagcc

SEQ ID NO: 56228 - DNA, 20 bp, Artificial Sequence
  chemically synthesized
aagatcctaccactgcactc

SEQ ID NO: 56229 - DNA, 20 bp, Artificial Sequence
  chemically synthesized
cctaccactgcactccagcc

SEQ ID NO: 56230 - DNA, 20 bp, Artificial Sequence
  chemically synthesized
ctgcactccagcctggatga

SEQ ID NO: 56231 - DNA, 20 bp, Artificial Sequence
  chemically synthesized
gcactccagcctggatgacg

SEQ ID NO: 56232 - DNA, 20 bp, Artificial Sequence
  chemically synthesized
tccagcctggatgacggagc

SEQ ID NO: 56233 - DNA, 20 bp, Artificial Sequence
  chemically synthesized
acggagcgagactccgtctc

SEQ ID NO: 56234 - DNA, 20 bp, Artificial Sequence
  chemically synthesized
cggagcgagactccgtctca

SEQ ID NO: 56235 - DNA, 20 bp, Artificial Sequence
  chemically synthesized
ccgtctcaaggaaaaaaaaa

SEQ ID NO: 56236 - DNA, 20 bp, Artificial Sequence
  chemically synthesized
tcaaggaaaaaaaaaaagta

SEQ ID NO: 56237 - DNA, 20 bp, Artificial Sequence
  chemically synthesized
ggaaaaaaaaaaagtaaaga

SEQ ID NO: 56238 - DNA, 20 bp, Artificial Sequence
  chemically synthesized
aaataaatttaaaaaatatt

SEQ ID NO: 56239 - DNA, 20 bp, Artificial Sequence
  chemically synthesized
taaatttaaaaaatattcag

SEQ ID NO: 56240 - DNA, 20 bp, Artificial Sequence
  chemically synthesized
aaatttaaaaaatattcagt

SEQ ID NO: 56241 - DNA, 20 bp, Artificial Sequence
  chemically synthesized
ttaaaaaatattcagtaggc

SEQ ID NO: 56242 - DNA, 20 bp, Artificial Sequence
  chemically synthesized
taaaaaatattcagtaggcc

SEQ ID NO: 56243 - DNA, 20 bp, Artificial Sequence
  chemically synthesized
aatattcagtaggccgggtg

SEQ ID NO: 56244 - DNA, 20 bp, Artificial Sequence
  chemically synthesized
attcagtaggccgggtgcag

SEQ ID NO: 56245 - DNA, 20 bp, Artificial Sequence
  chemically synthesized
gtggctcacgcctgtgatcc

SEQ ID NO: 56246 - DNA, 20 bp, Artificial Sequence
  chemically synthesized
cgcctgtgatcccagcactt

SEQ ID NO: 56247 - DNA, 20 bp, Artificial Sequence
  chemically synthesized
gcctgtgatcccagcacttt

SEQ ID NO: 56248 - DNA, 20 bp, Artificial Sequence
  chemically synthesized
ctgtgatcccagcactttgg

SEQ ID NO: 56249 - DNA, 20 bp, Artificial Sequence
  chemically synthesized
tgtgatcccagcactttggg

SEQ ID NO: 56250 - DNA, 20 bp, Artificial Sequence
  chemically synthesized
gatcccagcactttgggagg

SEQ ID NO: 56251 - DNA, 20 bp, Artificial Sequence
  chemically synthesized
tcccagcactttgggaggcg

SEQ ID NO: 56252 - DNA, 20 bp, Artificial Sequence
  chemically synthesized
cccagcactttgggaggcgg

SEQ ID NO: 56253 - DNA, 20 bp, Artificial Sequence
  chemically synthesized
agcactttgggaggcggagg

SEQ ID NO: 56254 - DNA, 20 bp, Artificial Sequence
  chemically synthesized
gcactttgggaggcggaggc

SEQ ID NO: 56255 - DNA, 20 bp, Artificial Sequence
  chemically synthesized
ctttgggaggcggaggcggg

SEQ ID NO: 56256 - DNA, 20 bp, Artificial Sequence
  chemically synthesized
ggcggaggcgggtggatcac

SEQ ID NO: 56257 - DNA, 20 bp, Artificial Sequence
  chemically synthesized
gcggaggcgggtggatcacg

SEQ ID NO: 56258 - DNA, 20 bp, Artificial Sequence
  chemically synthesized
cgggtggatcacgaggtcgc

SEQ ID NO: 56259 - DNA, 20 bp, Artificial Sequence
  chemically synthesized
gatcacgaggtcgcgagatc

SEQ ID NO: 56260 - DNA, 20 bp, Artificial Sequence
  chemically synthesized
tcgcgagatcgagaccatcc

SEQ ID NO: 56261 - DNA, 20 bp, Artificial Sequence
  chemically synthesized
cgagaccatcctggctaaca

SEQ ID NO: 56262 - DNA, 20 bp, Artificial Sequence
  chemically synthesized
actaaaaaaatacaaaaaat

SEQ ID NO: 56263 - DNA, 20 bp, Artificial Sequence
  chemically synthesized
aaaaaatacaaaaaattagc

SEQ ID NO: 56264 - DNA, 20 bp, Artificial Sequence
  chemically synthesized
aaaaatacaaaaaattagcc

SEQ ID NO: 56265 - DNA, 20 bp, Artificial Sequence
  chemically synthesized
tacaaaaaattagccgggct

SEQ ID NO: 56266 - DNA, 20 bp, Artificial Sequence
  chemically synthesized
aaaaaattagccgggcttgg

SEQ ID NO: 56267 - DNA, 20 bp, Artificial Sequence
  chemically synthesized
aaattagccgggcttggtgg

SEQ ID NO: 56268 - DNA, 20 bp, Artificial Sequence
  chemically synthesized
aattagccgggcttggtggc

SEQ ID NO: 56269 - DNA, 20 bp, Artificial Sequence
  chemically synthesized
ggcttggtggcgggtgcctg

SEQ ID NO: 56270 - DNA, 20 bp, Artificial Sequence
  chemically synthesized
gtggcgggtgcctgtagtcc

SEQ ID NO: 56271 - DNA, 20 bp, Artificial Sequence
  chemically synthesized
gcctgtagtcccagctacta

SEQ ID NO: 56272 - DNA, 20 bp, Artificial Sequence
  chemically synthesized
ctgtagtcccagctactatg

SEQ ID NO: 56273 - DNA, 20 bp, Artificial Sequence
  chemically synthesized
tgtagtcccagctactatgg

SEQ ID NO: 56274 - DNA, 20 bp, Artificial Sequence
  chemically synthesized
tcccagctactatggaggct

SEQ ID NO: 56275 - DNA, 20 bp, Artificial Sequence
  chemically synthesized
cccagctactatggaggctg

SEQ ID NO: 56276 - DNA, 20 bp, Artificial Sequence
  chemically synthesized
agctactatggaggctgagg

SEQ ID NO: 56277 - DNA, 20 bp, Artificial Sequence
  chemically synthesized
gctactatggaggctgaggc

SEQ ID NO: 56278 - DNA, 20 bp, Artificial Sequence
  chemically synthesized
tactatggaggctgaggcgg

SEQ ID NO: 56279 - DNA, 20 bp, Artificial Sequence
  chemically synthesized
tggaggctgaggcgggagaa

SEQ ID NO: 56280 - DNA, 20 bp, Artificial Sequence
  chemically synthesized
gcgggagaatggcgtgaacg

SEQ ID NO: 56281 - DNA, 20 bp, Artificial Sequence
  chemically synthesized
cgggagaatggcgtgaacgc

SEQ ID NO: 56282 - DNA, 20 bp, Artificial Sequence
  chemically synthesized
gggagaatggcgtgaacgcg

SEQ ID NO: 56283 - DNA, 20 bp, Artificial Sequence
  chemically synthesized
ggagaatggcgtgaacgcgg

SEQ ID NO: 56284 - DNA, 20 bp, Artificial Sequence
  chemically synthesized
gagaatggcgtgaacgcggg

SEQ ID NO: 56285 - DNA, 20 bp, Artificial Sequence
  chemically synthesized
aatggcgtgaacgcgggggg

SEQ ID NO: 56286 - DNA, 20 bp, Artificial Sequence
  chemically synthesized
tggcgtgaacgcggggggcg

SEQ ID NO: 56287 - DNA, 20 bp, Artificial Sequence
  chemically synthesized
aacgcggggggcggagcttg

SEQ ID NO: 56288 - DNA, 20 bp, Artificial Sequence
  chemically synthesized
cggggggcggagcttgcagt

SEQ ID NO: 56289 - DNA, 20 bp, Artificial Sequence
  chemically synthesized
ggggcggagcttgcagtgag

SEQ ID NO: 56290 - DNA, 20 bp, Artificial Sequence
  chemically synthesized
ggcggagcttgcagtgagca

SEQ ID NO: 56291 - DNA, 20 bp, Artificial Sequence
  chemically synthesized
agcttgcagtgagcagagat

SEQ ID NO: 56292 - DNA, 20 bp, Artificial Sequence
  chemically synthesized
gcttgcagtgagcagagatc

SEQ ID NO: 56293 - DNA, 20 bp, Artificial Sequence
  chemically synthesized
cttgcagtgagcagagatca

SEQ ID NO: 56294 - DNA, 20 bp, Artificial Sequence
  chemically synthesized
ttgcagtgagcagagatcag

SEQ ID NO: 56295 - DNA, 20 bp, Artificial Sequence
  chemically synthesized
gatcaggggccactgcactc

SEQ ID NO: 56296 - DNA, 20 bp, Artificial Sequence
  chemically synthesized
ggggccactgcactccagcc

SEQ ID NO: 56297 - DNA, 20 bp, Artificial Sequence
  chemically synthesized
gggccactgcactccagcct

SEQ ID NO: 56298 - DNA, 20 bp, Artificial Sequence
  chemically synthesized
ctgcactccagcctgggcga

SEQ ID NO: 56299 - DNA, 20 bp, Artificial Sequence
  chemically synthesized
gcactccagcctgggcgaca

SEQ ID NO: 56300 - DNA, 20 bp, Artificial Sequence
  chemically synthesized
actccagcctgggcgacaga

SEQ ID NO: 56301 - DNA, 20 bp, Artificial Sequence
  chemically synthesized
tccagcctgggcgacagaga

SEQ ID NO: 56302 - DNA, 20 bp, Artificial Sequence
  chemically synthesized
agagactctgtctcaaaaaa

SEQ ID NO: 56303 - DNA, 20 bp, Artificial Sequence
  chemically synthesized
aaaaaaagaaaaaaaaaatt

SEQ ID NO: 56304 - DNA, 20 bp, Artificial Sequence
  chemically synthesized
aaaagaaaaaaaaaatttag

SEQ ID NO: 56305 - DNA, 20 bp, Artificial Sequence
  chemically synthesized
aaaaaaaaaatttagtagac

SEQ ID NO: 56306 - DNA, 20 bp, Artificial Sequence
  chemically synthesized
gtagactagctaaaaaaatc

SEQ ID NO: 56307 - DNA, 20 bp, Artificial Sequence
  chemically synthesized
agactagctaaaaaaatcca

SEQ ID NO: 56308 - DNA, 20 bp, Artificial Sequence
  chemically synthesized
tagctaaaaaaatccagaga

SEQ ID NO: 56309 - DNA, 20 bp, Artificial Sequence
  chemically synthesized
agttattgatgcatatgtaa

SEQ ID NO: 56310 - DNA, 20 bp, Artificial Sequence
  chemically synthesized
aaaagtcttccaatatttac

SEQ ID NO: 56311 - DNA, 20 bp, Artificial Sequence
  chemically synthesized
aaaaaaaataaccttgaatt

SEQ ID NO: 56312 - DNA, 20 bp, Artificial Sequence
  chemically synthesized
aaataaccttgaattaagtg

SEQ ID NO: 56313 - DNA, 20 bp, Artificial Sequence
  chemically synthesized
aactcattgacaatgtttca

SEQ ID NO: 56314 - DNA, 20 bp, Artificial Sequence
  chemically synthesized
actcattgacaatgtttcaa

SEQ ID NO: 56315 - DNA, 20 bp, Artificial Sequence
  chemically synthesized
gacaatgtttcaaaggatgt

SEQ ID NO: 56316 - DNA, 20 bp, Artificial Sequence
  chemically synthesized
acaatgtttcaaaggatgtg

SEQ ID NO: 56317 - DNA, 20 bp, Artificial Sequence
  chemically synthesized
caatgtttcaaaggatgtga

SEQ ID NO: 56318 - DNA, 20 bp, Artificial Sequence
  chemically synthesized
gtgagggataaactaaaatt

SEQ ID NO: 56319 - DNA, 20 bp, Artificial Sequence
  chemically synthesized
tgagggataaactaaaattt

SEQ ID NO: 56320 - DNA, 20 bp, Artificial Sequence
  chemically synthesized
gggataaactaaaatttggg

SEQ ID NO: 56321 - DNA, 20 bp, Artificial Sequence
  chemically synthesized
acatgctgttcctgtgtact

SEQ ID NO: 56322 - DNA, 20 bp, Artificial Sequence
  chemically synthesized
ctgttcctgtgtacttggaa

SEQ ID NO: 56323 - DNA, 20 bp, Artificial Sequence
  chemically synthesized
gttcctgtgtacttggaaca

SEQ ID NO: 56324 - DNA, 20 bp, Artificial Sequence
  chemically synthesized
ttcctgtgtacttggaacag

SEQ ID NO: 56325 - DNA, 20 bp, Artificial Sequence
  chemically synthesized
tcctgtgtacttggaacaga

SEQ ID NO: 56326 - DNA, 20 bp, Artificial Sequence
  chemically synthesized
ctgtgtacttggaacagagg

SEQ ID NO: 56327 - DNA, 20 bp, Artificial Sequence
  chemically synthesized
tggaacagagggagaaaatc

SEQ ID NO: 56328 - DNA, 20 bp, Artificial Sequence
  chemically synthesized
ggaacagagggagaaaatct

SEQ ID NO: 56329 - DNA, 20 bp, Artificial Sequence
  chemically synthesized
cagagggagaaaatctgggc

SEQ ID NO: 56330 - DNA, 20 bp, Artificial Sequence
  chemically synthesized
ctgggctggaaatattgtta

SEQ ID NO: 56331 - DNA, 20 bp, Artificial Sequence
  chemically synthesized
tgggctggaaatattgttat

SEQ ID NO: 56332 - DNA, 20 bp, Artificial Sequence
  chemically synthesized
ggctggaaatattgttatag

SEQ ID NO: 56333 - DNA, 20 bp, Artificial Sequence
  chemically synthesized
ggaaatattgttataggagt

SEQ ID NO: 56334 - DNA, 20 bp, Artificial Sequence
  chemically synthesized
gttataggagttagcacatg

SEQ ID NO: 56335 - DNA, 20 bp, Artificial Sequence
  chemically synthesized
ttataggagttagcacatga

SEQ ID NO: 56336 - DNA, 20 bp, Artificial Sequence
  chemically synthesized
aaggtgacaactaaattatt

SEQ ID NO: 56337 - DNA, 20 bp, Artificial Sequence
  chemically synthesized
ggtgacaactaaattatttg

SEQ ID NO: 56338 - DNA, 20 bp, Artificial Sequence
  chemically synthesized
gacaactaaattatttggag

SEQ ID NO: 56339 - DNA, 20 bp, Artificial Sequence
  chemically synthesized
actaaattatttggagtaga

SEQ ID NO: 56340 - DNA, 20 bp, Artificial Sequence
  chemically synthesized
taaattatttggagtagatg

SEQ ID NO: 56341 - DNA, 20 bp, Artificial Sequence
  chemically synthesized
tttggagtagatggagtcac

SEQ ID NO: 56342 - DNA, 20 bp, Artificial Sequence
  chemically synthesized
gagtcaccagcacatgtgaa

SEQ ID NO: 56343 - DNA, 20 bp, Artificial Sequence
  chemically synthesized
ccagcacatgtgaatagttt

SEQ ID NO: 56344 - DNA, 20 bp, Artificial Sequence
  chemically synthesized
gttttagaatgaaatgaccc

SEQ ID NO: 56345 - DNA, 20 bp, Artificial Sequence
  chemically synthesized
tagaatgaaatgacccaaga

SEQ ID NO: 56346 - DNA, 20 bp, Artificial Sequence
  chemically synthesized
aatgacccaagatagaactt

SEQ ID NO: 56347 - DNA, 20 bp, Artificial Sequence
  chemically synthesized
tgacccaagatagaactttg

SEQ ID NO: 56348 - DNA, 20 bp, Artificial Sequence
  chemically synthesized
acccaagatagaactttgga

SEQ ID NO: 56349 - DNA, 20 bp, Artificial Sequence
  chemically synthesized
cccccaaatttaaataaaat

SEQ ID NO: 56350 - DNA, 20 bp, Artificial Sequence
  chemically synthesized
aatttaaataaaatcagtat

SEQ ID NO: 56351 - DNA, 20 bp, Artificial Sequence
  chemically synthesized
tttaaataaaatcagtataa

SEQ ID NO: 56352 - DNA, 20 bp, Artificial Sequence
  chemically synthesized
aaataaaatcagtataagag

SEQ ID NO: 56353 - DNA, 20 bp, Artificial Sequence
  chemically synthesized
ataaaatcagtataagagaa

SEQ ID NO: 56354 - DNA, 20 bp, Artificial Sequence
  chemically synthesized
taaaatcagtataagagaag

SEQ ID NO: 56355 - DNA, 20 bp, Artificial Sequence
  chemically synthesized
aatcagtataagagaagagg

SEQ ID NO: 56356 - DNA, 20 bp, Artificial Sequence
  chemically synthesized
gagaagaggaagaaaccaaa

SEQ ID NO: 56357 - DNA, 20 bp, Artificial Sequence
  chemically synthesized
gaagaaaccaaatggtatac

SEQ ID NO: 56358 - DNA, 20 bp, Artificial Sequence
  chemically synthesized
tactagtctaaattgtttct

SEQ ID NO: 56359 - DNA, 20 bp, Artificial Sequence
  chemically synthesized
aaattgtttcttagtgacaa

SEQ ID NO: 56360 - DNA, 20 bp, Artificial Sequence
  chemically synthesized
caaaagaataacctgaatat

SEQ ID NO: 56361 - DNA, 20 bp, Artificial Sequence
  chemically synthesized
gaataacctgaatattagat

SEQ ID NO: 56362 - DNA, 20 bp, Artificial Sequence
  chemically synthesized
caatttcattcaacatgcaa

SEQ ID NO: 56363 - DNA, 20 bp, Artificial Sequence
  chemically synthesized
tattgttttatgctccttca

SEQ ID NO: 56364 - DNA, 20 bp, Artificial Sequence
  chemically synthesized
ttgttttatgctccttcaca

SEQ ID NO: 56365 - DNA, 20 bp, Artificial Sequence
  chemically synthesized
tgttttatgctccttcacag

SEQ ID NO: 56366 - DNA, 20 bp, Artificial Sequence
  chemically synthesized
ctccttcacagaggaaattc

SEQ ID NO: 56367 - DNA, 20 bp, Artificial Sequence
  chemically synthesized
ttcacagaggaaattctgga

SEQ ID NO: 56368 - DNA, 20 bp, Artificial Sequence
  chemically synthesized
cacagaggaaattctggaaa

SEQ ID NO: 56369 - DNA, 20 bp, Artificial Sequence
  chemically synthesized
gaaattctggaaagagcaca

SEQ ID NO: 56370 - DNA, 20 bp, Artificial Sequence
  chemically synthesized
aaattctggaaagagcacat

SEQ ID NO: 56371 - DNA, 20 bp, Artificial Sequence
  chemically synthesized
aattctggaaagagcacatg

SEQ ID NO: 56372 - DNA, 20 bp, Artificial Sequence
  chemically synthesized
atctgtattccttgttctcc

SEQ ID NO: 56373 - DNA, 20 bp, Artificial Sequence
  chemically synthesized
ttataaatattctccaccat

SEQ ID NO: 56374 - DNA, 20 bp, Artificial Sequence
  chemically synthesized
caatgtctaaacattatatc

SEQ ID NO: 56375 - DNA, 20 bp, Artificial Sequence
  chemically synthesized
acattatatcaagtgtctct

SEQ ID NO: 56376 - DNA, 20 bp, Artificial Sequence
  chemically synthesized
agtgtctcttagctacattc

SEQ ID NO: 56377 - DNA, 20 bp, Artificial Sequence
  chemically synthesized
tctcttagctacattcaaga

SEQ ID NO: 56378 - DNA, 20 bp, Artificial Sequence
  chemically synthesized
tagctacattcaagaaagcc

SEQ ID NO: 56379 - DNA, 20 bp, Artificial Sequence
  chemically synthesized
attcaagaaagcctagaaac

SEQ ID NO: 56380 - DNA, 20 bp, Artificial Sequence
  chemically synthesized
gaaaccagctgtaaaatgtc

SEQ ID NO: 56381 - DNA, 20 bp, Artificial Sequence
  chemically synthesized
aaaccagctgtaaaatgtca

SEQ ID NO: 56382 - DNA, 20 bp, Artificial Sequence
  chemically synthesized
accagctgtaaaatgtcaag

SEQ ID NO: 56383 - DNA, 20 bp, Artificial Sequence
  chemically synthesized
ctgtaaaatgtcaaggagaa

SEQ ID NO: 56384 - DNA, 20 bp, Artificial Sequence
  chemically synthesized
gagaatagtgtcatatgcat

SEQ ID NO: 56385 - DNA, 20 bp, Artificial Sequence
  chemically synthesized
tcatatgcataagtcttgct

SEQ ID NO: 56386 - DNA, 20 bp, Artificial Sequence
  chemically synthesized
aagtcttgcttagaatttat

SEQ ID NO: 56387 - DNA, 20 bp, Artificial Sequence
  chemically synthesized
cccattttactaataattta

SEQ ID NO: 56388 - DNA, 20 bp, Artificial Sequence
  chemically synthesized
ccattttactaataatttaa

SEQ ID NO: 56389 - DNA, 20 bp, Artificial Sequence
  chemically synthesized
tttactaataatttaaaggt

SEQ ID NO: 56390 - DNA, 20 bp, Artificial Sequence
  chemically synthesized
ataatttttttcatttcatt

SEQ ID NO: 56391 - DNA, 20 bp, Artificial Sequence
  chemically synthesized
tataacatctcactcataaa

SEQ ID NO: 56392 - DNA, 20 bp, Artificial Sequence
  chemically synthesized
aacatctcactcataaatag

SEQ ID NO: 56393 - DNA, 20 bp, Artificial Sequence
  chemically synthesized
acatctcactcataaatagt

SEQ ID NO: 56394 - DNA, 20 bp, Artificial Sequence
  chemically synthesized
atataatgactgttttttga

SEQ ID NO: 56395 - DNA, 20 bp, Artificial Sequence
  chemically synthesized
tgactgttttttgaaagaaa

SEQ ID NO: 56396 - DNA, 20 bp, Artificial Sequence
  chemically synthesized
ctgttttttgaaagaaaaag

SEQ ID NO: 56397 - DNA, 20 bp, Artificial Sequence
  chemically synthesized
tgttttttgaaagaaaaaga

SEQ ID NO: 56398 - DNA, 20 bp, Artificial Sequence
  chemically synthesized
tttttgaaagaaaaagaagg

SEQ ID NO: 56399 - DNA, 20 bp, Artificial Sequence
  chemically synthesized
ttttgaaagaaaaagaagga

SEQ ID NO: 56400 - DNA, 20 bp, Artificial Sequence
  chemically synthesized
gaaagaaaaagaaggaagga

SEQ ID NO: 56401 - DNA, 20 bp, Artificial Sequence
  chemically synthesized
aaagaaggaaggaaagtaac

SEQ ID NO: 56402 - DNA, 20 bp, Artificial Sequence
  chemically synthesized
aagaaggaaggaaagtaaca

SEQ ID NO: 56403 - DNA, 20 bp, Artificial Sequence
  chemically synthesized
aaggaaggaaagtaacaagg

SEQ ID NO: 56404 - DNA, 20 bp, Artificial Sequence
  chemically synthesized
aaggaaagtaacaaggaaga

SEQ ID NO: 56405 - DNA, 20 bp, Artificial Sequence
  chemically synthesized
ggaaagtaacaaggaagaaa

SEQ ID NO: 56406 - DNA, 20 bp, Artificial Sequence
  chemically synthesized
aaagtaacaaggaagaaaga

SEQ ID NO: 56407 - DNA, 20 bp, Artificial Sequence
  chemically synthesized
aacaaggaagaaagagagaa

SEQ ID NO: 56408 - DNA, 20 bp, Artificial Sequence
  chemically synthesized
caaggaagaaagagagaaaa

SEQ ID NO: 56409 - DNA, 20 bp, Artificial Sequence
  chemically synthesized
aaggaagaaagagagaaaag

SEQ ID NO: 56410 - DNA, 20 bp, Artificial Sequence
  chemically synthesized
gaaagagagaaaagaggaaa

SEQ ID NO: 56411 - DNA, 20 bp, Artificial Sequence
  chemically synthesized
agaaaagaggaaatggatac

SEQ ID NO: 56412 - DNA, 20 bp, Artificial Sequence
  chemically synthesized
aatgttcaacaacttgcttc

SEQ ID NO: 56413 - DNA, 20 bp, Artificial Sequence
  chemically synthesized
tgcttccagctttacatttg

SEQ ID NO: 56414 - DNA, 20 bp, Artificial Sequence
  chemically synthesized
gcttccagctttacatttgt

SEQ ID NO: 56415 - DNA, 20 bp, Artificial Sequence
  chemically synthesized
agctttacatttgtaggact

SEQ ID NO: 56416 - DNA, 20 bp, Artificial Sequence
  chemically synthesized
ccattataatttgtcactat

SEQ ID NO: 56417 - DNA, 20 bp, Artificial Sequence
  chemically synthesized
aatgttacttaatttactaa

SEQ ID NO: 56418 - DNA, 20 bp, Artificial Sequence
  chemically synthesized
aaaacttcaataaaataaaa

SEQ ID NO: 56419 - DNA, 20 bp, Artificial Sequence
  chemically synthesized
aaacttcaataaaataaaat

SEQ ID NO: 56420 - DNA, 20 bp, Artificial Sequence
  chemically synthesized
cttcaataaaataaaatggg

SEQ ID NO: 56421 - DNA, 20 bp, Artificial Sequence
  chemically synthesized
taaaataaaatgggaagaat

SEQ ID NO: 56422 - DNA, 20 bp, Artificial Sequence
  chemically synthesized
aaatgggaagaatgagactg

SEQ ID NO: 56423 - DNA, 20 bp, Artificial Sequence
  chemically synthesized
tgggaagaatgagactgaag

SEQ ID NO: 56424 - DNA, 20 bp, Artificial Sequence
  chemically synthesized
gaatgagactgaagaagact

SEQ ID NO: 56425 - DNA, 20 bp, Artificial Sequence
  chemically synthesized
aatgagactgaagaagactg

SEQ ID NO: 56426 - DNA, 20 bp, Artificial Sequence
  chemically synthesized
gagactgaagaagactgagg

SEQ ID NO: 56427 - DNA, 20 bp, Artificial Sequence
  chemically synthesized
agactgaggaagtaattgtg

SEQ ID NO: 56428 - DNA, 20 bp, Artificial Sequence
  chemically synthesized
ggaagtaattgtgtggtaaa

SEQ ID NO: 56429 - DNA, 20 bp, Artificial Sequence
  chemically synthesized
agtaattgtgtggtaaaaag

SEQ ID NO: 56430 - DNA, 20 bp, Artificial Sequence
  chemically synthesized
gtaaaaagtagttatgaata

SEQ ID NO: 56431 - DNA, 20 bp, Artificial Sequence
  chemically synthesized
atttttcttttctgaataaa

SEQ ID NO: 56432 - DNA, 20 bp, Artificial Sequence
  chemically synthesized
ttttcttttctgaataaaaa

SEQ ID NO: 56433 - DNA, 20 bp, Artificial Sequence
  chemically synthesized
aaaagagaaaaaccttgcct

SEQ ID NO: 56434 - DNA, 20 bp, Artificial Sequence
  chemically synthesized
gcctcagtgaaaatgtcacc

SEQ ID NO: 56435 - DNA, 20 bp, Artificial Sequence
  chemically synthesized
caccaagatatttatttaaa

SEQ ID NO: 56436 - DNA, 20 bp, Artificial Sequence
  chemically synthesized
accaagatatttatttaaat

SEQ ID NO: 56437 - DNA, 20 bp, Artificial Sequence
  chemically synthesized
atatttatttaaataggaat

SEQ ID NO: 56438 - DNA, 20 bp, Artificial Sequence
  chemically synthesized
tatttaaataggaattggca

SEQ ID NO: 56439 - DNA, 20 bp, Artificial Sequence
  chemically synthesized
agaaacatgtttgcattaaa

SEQ ID NO: 56440 - DNA, 20 bp, Artificial Sequence
  chemically synthesized
gaaacatgtttgcattaaat

SEQ ID NO: 56441 - DNA, 20 bp, Artificial Sequence
  chemically synthesized
tgtttgcattaaatgggctt

SEQ ID NO: 56442 - DNA, 20 bp, Artificial Sequence
  chemically synthesized
gggctttagaattttgcaaa

SEQ ID NO: 56443 - DNA, 20 bp, Artificial Sequence
  chemically synthesized
tagaattttgcaaatagaaa

SEQ ID NO: 56444 - DNA, 20 bp, Artificial Sequence
  chemically synthesized
aattttgcaaatagaaatgg

SEQ ID NO: 56445 - DNA, 20 bp, Artificial Sequence
  chemically synthesized
tgcaaatagaaatggcagaa

SEQ ID NO: 56446 - DNA, 20 bp, Artificial Sequence
  chemically synthesized
gcaaatagaaatggcagaaa

SEQ ID NO: 56447 - DNA, 20 bp, Artificial Sequence
  chemically synthesized
gaaatggcagaaaaggaaca

SEQ ID NO: 56448 - DNA, 20 bp, Artificial Sequence
  chemically synthesized
catatgaattattctgcatt

SEQ ID NO: 56449 - DNA, 20 bp, Artificial Sequence
  chemically synthesized
attattctgcatttagcctg

SEQ ID NO: 56450 - DNA, 20 bp, Artificial Sequence
  chemically synthesized
ttattctgcatttagcctgt

SEQ ID NO: 56451 - DNA, 20 bp, Artificial Sequence
  chemically synthesized
ctgcatttagcctgtgggaa

SEQ ID NO: 56452 - DNA, 20 bp, Artificial Sequence
  chemically synthesized
gcatttagcctgtgggaaaa

SEQ ID NO: 56453 - DNA, 20 bp, Artificial Sequence
  chemically synthesized
agcctgtgggaaaagagaaa

SEQ ID NO: 56454 - DNA, 20 bp, Artificial Sequence
  chemically synthesized
cctgtgggaaaagagaaaaa

SEQ ID NO: 56455 - DNA, 20 bp, Artificial Sequence
  chemically synthesized
tgtgggaaaagagaaaaaga

SEQ ID NO: 56456 - DNA, 20 bp, Artificial Sequence
  chemically synthesized
ggaaaagagaaaaagagaga

SEQ ID NO: 56457 - DNA, 20 bp, Artificial Sequence
  chemically synthesized
gaaaagagaaaaagagagaa

SEQ ID NO: 56458 - DNA, 20 bp, Artificial Sequence
  chemically synthesized
aaagagaaaaagagagaaag

SEQ ID NO: 56459 - DNA, 20 bp, Artificial Sequence
  chemically synthesized
gagagaaaggagatttctgc

SEQ ID NO: 56460 - DNA, 20 bp, Artificial Sequence
  chemically synthesized
aaaggagatttctgcaagtg

SEQ ID NO: 56461 - DNA, 20 bp, Artificial Sequence
  chemically synthesized
tgcaagtgtagaaataatta

SEQ ID NO: 56462 - DNA, 20 bp, Artificial Sequence
  chemically synthesized
gcaagtgtagaaataattac

SEQ ID NO: 56463 - DNA, 20 bp, Artificial Sequence
  chemically synthesized
caagtgtagaaataattacg

SEQ ID NO: 56464 - DNA, 20 bp, Artificial Sequence
  chemically synthesized
agaaataattacggggatat

SEQ ID NO: 56465 - DNA, 20 bp, Artificial Sequence
  chemically synthesized
gaaataattacggggatatt

SEQ ID NO: 56466 - DNA, 20 bp, Artificial Sequence
  chemically synthesized
attacggggatattaggtgc

SEQ ID NO: 56467 - DNA, 20 bp, Artificial Sequence
  chemically synthesized
tattaggtgccagtgaaccc

SEQ ID NO: 56468 - DNA, 20 bp, Artificial Sequence
  chemically synthesized
ttaggtgccagtgaacccaa

SEQ ID NO: 56469 - DNA, 20 bp, Artificial Sequence
  chemically synthesized
taggtgccagtgaacccaag

SEQ ID NO: 56470 - DNA, 20 bp, Artificial Sequence
  chemically synthesized
aggtgccagtgaacccaaga

SEQ ID NO: 56471 - DNA, 20 bp, Artificial Sequence
  chemically synthesized
agggctgacttaaaatttgc

SEQ ID NO: 56472 - DNA, 20 bp, Artificial Sequence
  chemically synthesized
gggctgacttaaaatttgct

SEQ ID NO: 56473 - DNA, 20 bp, Artificial Sequence
  chemically synthesized
aaaatttgctgggtccctcg

SEQ ID NO: 56474 - DNA, 20 bp, Artificial Sequence
  chemically synthesized
tgctgggtccctcgtggttt

SEQ ID NO: 56475 - DNA, 20 bp, Artificial Sequence
  chemically synthesized
tcgtggttttggctatcaac

SEQ ID NO: 56476 - DNA, 20 bp, Artificial Sequence
  chemically synthesized
cgtggttttggctatcaact

SEQ ID NO: 56477 - DNA, 20 bp, Artificial Sequence
  chemically synthesized
tacttctccacacattcata

SEQ ID NO: 56478 - DNA, 20 bp, Artificial Sequence
  chemically synthesized
acttctccacacattcataa

SEQ ID NO: 56479 - DNA, 20 bp, Artificial Sequence
  chemically synthesized
ttcataaaggaatattaaat

SEQ ID NO: 56480 - DNA, 20 bp, Artificial Sequence
  chemically synthesized
ataaaggaatattaaattgg

SEQ ID NO: 56481 - DNA, 20 bp, Artificial Sequence
  chemically synthesized
aggaatattaaattggtgga

SEQ ID NO: 56482 - DNA, 20 bp, Artificial Sequence
  chemically synthesized
gccacttttttctccaattt

SEQ ID NO: 56483 - DNA, 20 bp, Artificial Sequence
  chemically synthesized
aataaattcatcccgtgttt

SEQ ID NO: 56484 - DNA, 20 bp, Artificial Sequence
  chemically synthesized
tcccgtgtttcagaatgcta

SEQ ID NO: 56485 - DNA, 20 bp, Artificial Sequence
  chemically synthesized
aatgctacagacctcactat

SEQ ID NO: 56486 - DNA, 20 bp, Artificial Sequence
  chemically synthesized
gacctcactatgagttttac

SEQ ID NO: 56487 - DNA, 20 bp, Artificial Sequence
  chemically synthesized
acctcactatgagttttact

SEQ ID NO: 56488 - DNA, 20 bp, Artificial Sequence
  chemically synthesized
cctcactatgagttttactg

SEQ ID NO: 56489 - DNA, 20 bp, Artificial Sequence
  chemically synthesized
ctcactatgagttttactgg

SEQ ID NO: 56490 - DNA, 20 bp, Artificial Sequence
  chemically synthesized
tatgagttttactgggggat

SEQ ID NO: 56491 - DNA, 20 bp, Artificial Sequence
  chemically synthesized
tactgggggatgagcacaca

SEQ ID NO: 56492 - DNA, 20 bp, Artificial Sequence
  chemically synthesized
gggggatgagcacacaaaga

SEQ ID NO: 56493 - DNA, 20 bp, Artificial Sequence
  chemically synthesized
tgagcacacaaagatggtct

SEQ ID NO: 56494 - DNA, 20 bp, Artificial Sequence
  chemically synthesized
cacacaaagatggtctgaga

SEQ ID NO: 56495 - DNA, 20 bp, Artificial Sequence
  chemically synthesized
gatggtctgagacagacttc

SEQ ID NO: 56496 - DNA, 20 bp, Artificial Sequence
  chemically synthesized
ggtctgagacagacttccag

SEQ ID NO: 56497 - DNA, 20 bp, Artificial Sequence
  chemically synthesized
ctgagacagacttccagaag

SEQ ID NO: 56498 - DNA, 20 bp, Artificial Sequence
  chemically synthesized
agacagacttccagaagaag

SEQ ID NO: 56499 - DNA, 20 bp, Artificial Sequence
  chemically synthesized
cagacttccagaagaagaag

SEQ ID NO: 56500 - DNA, 20 bp, Artificial Sequence
  chemically synthesized
gaagaagaagatgtccgtgt

SEQ ID NO: 56501 - DNA, 20 bp, Artificial Sequence
  chemically synthesized
agaagaagatgtccgtgtta

SEQ ID NO: 56502 - DNA, 20 bp, Artificial Sequence
  chemically synthesized
ccgtgttagagataaatgaa

SEQ ID NO: 56503 - DNA, 20 bp, Artificial Sequence
  chemically synthesized
agataaatgaaaagtgtaaa

SEQ ID NO: 56504 - DNA, 20 bp, Artificial Sequence
  chemically synthesized
agtcatctgcaaaatgtcca

SEQ ID NO: 56505 - DNA, 20 bp, Artificial Sequence
  chemically synthesized
atgtccacagtatattatat

SEQ ID NO: 56506 - DNA, 20 bp, Artificial Sequence
  chemically synthesized
tattatattggcacatatcc

SEQ ID NO: 56507 - DNA, 20 bp, Artificial Sequence
  chemically synthesized
gcacatatcctggcaccaaa

SEQ ID NO: 56508 - DNA, 20 bp, Artificial Sequence
  chemically synthesized
acatatcctggcaccaaaca

SEQ ID NO: 56509 - DNA, 20 bp, Artificial Sequence
  chemically synthesized
cagagtaaaatttatgacat

SEQ ID NO: 56510 - DNA, 20 bp, Artificial Sequence
  chemically synthesized
gtaaaatttatgacattagc

SEQ ID NO: 56511 - DNA, 20 bp, Artificial Sequence
  chemically synthesized
attagctggatgctgttaca

SEQ ID NO: 56512 - DNA, 20 bp, Artificial Sequence
  chemically synthesized
tagctggatgctgttacaca

SEQ ID NO: 56513 - DNA, 20 bp, Artificial Sequence
  chemically synthesized
ggatgctgttacacagagtg

SEQ ID NO: 56514 - DNA, 20 bp, Artificial Sequence
  chemically synthesized
gctgttacacagagtgcaga

SEQ ID NO: 56515 - DNA, 20 bp, Artificial Sequence
  chemically synthesized
ttacacagagtgcagacaga

SEQ ID NO: 56516 - DNA, 20 bp, Artificial Sequence
  chemically synthesized
cacagagtgcagacagaaag

SEQ ID NO: 56517 - DNA, 20 bp, Artificial Sequence
  chemically synthesized
cagagtgcagacagaaagta

SEQ ID NO: 56518 - DNA, 20 bp, Artificial Sequence
  chemically synthesized
gacagaaagtagagccatca

SEQ ID NO: 56519 - DNA, 20 bp, Artificial Sequence
  chemically synthesized
catcacagaacccacaactt

SEQ ID NO: 56520 - DNA, 20 bp, Artificial Sequence
  chemically synthesized
atcacagaacccacaactta

SEQ ID NO: 56521 - DNA, 20 bp, Artificial Sequence
  chemically synthesized
tcacagaacccacaacttaa

SEQ ID NO: 56522 - DNA, 20 bp, Artificial Sequence
  chemically synthesized
acccacaacttaagggaatg

SEQ ID NO: 56523 - DNA, 20 bp, Artificial Sequence
  chemically synthesized
acaacttaagggaatgaagc

SEQ ID NO: 56524 - DNA, 20 bp, Artificial Sequence
  chemically synthesized
gggaatgaagctggaatcct

SEQ ID NO: 56525 - DNA, 20 bp, Artificial Sequence
  chemically synthesized
gaatgaagctggaatccttg

SEQ ID NO: 56526 - DNA, 20 bp, Artificial Sequence
  chemically synthesized
tgaagctggaatccttggag

SEQ ID NO: 56527 - DNA, 20 bp, Artificial Sequence
  chemically synthesized
aatccttggagaagaaaaat

SEQ ID NO: 56528 - DNA, 20 bp, Artificial Sequence
  chemically synthesized
cttggagaagaaaaattggt

SEQ ID NO: 56529 - DNA, 20 bp, Artificial Sequence
  chemically synthesized
aattggtgagtgatgaatga

SEQ ID NO: 56530 - DNA, 20 bp, Artificial Sequence
  chemically synthesized
aatgaaagtgttatgaaaaa

SEQ ID NO: 56531 - DNA, 20 bp, Artificial Sequence
  chemically synthesized
gaaaaatggacaatattctt

SEQ ID NO: 56532 - DNA, 20 bp, Artificial Sequence
  chemically synthesized
aaaaatggacaatattcttc

SEQ ID NO: 56533 - DNA, 20 bp, Artificial Sequence
  chemically synthesized
gacaatattcttcaggtatc

SEQ ID NO: 56534 - DNA, 20 bp, Artificial Sequence
  chemically synthesized
atattcttcaggtatctggt

SEQ ID NO: 56535 - DNA, 20 bp, Artificial Sequence
  chemically synthesized
attcttcaggtatctggtaa

SEQ ID NO: 56536 - DNA, 20 bp, Artificial Sequence
  chemically synthesized
gtatctggtaagagcaaaac

SEQ ID NO: 56537 - DNA, 20 bp, Artificial Sequence
  chemically synthesized
accagctctcaataataatt

SEQ ID NO: 56538 - DNA, 20 bp, Artificial Sequence
  chemically synthesized
ccagctctcaataataattg

SEQ ID NO: 56539 - DNA, 20 bp, Artificial Sequence
  chemically synthesized
agctctcaataataattgag

SEQ ID NO: 56540 - DNA, 20 bp, Artificial Sequence
  chemically synthesized
ctcaataataattgaggagt

SEQ ID NO: 56541 - DNA, 20 bp, Artificial Sequence
  chemically synthesized
ggagtaagtctcacgattcc

SEQ ID NO: 56542 - DNA, 20 bp, Artificial Sequence
  chemically synthesized
cctctccataatttaattac

SEQ ID NO: 56543 - DNA, 20 bp, Artificial Sequence
  chemically synthesized
aatcactctatccaactaac

SEQ ID NO: 56544 - DNA, 20 bp, Artificial Sequence
  chemically synthesized
atcactctatccaactaacc

SEQ ID NO: 56545 - DNA, 20 bp, Artificial Sequence
  chemically synthesized
accctgctatctgtgcctgt

SEQ ID NO: 56546 - DNA, 20 bp, Artificial Sequence
  chemically synthesized
ccctgctatctgtgcctgtc

SEQ ID NO: 56547 - DNA, 20 bp, Artificial Sequence
  chemically synthesized
tgctatctgtgcctgtcagg

SEQ ID NO: 56548 - DNA, 20 bp, Artificial Sequence
  chemically synthesized
gtcaggtagtactcacatgt

SEQ ID NO: 56549 - DNA, 20 bp, Artificial Sequence
  chemically synthesized
gtactcacatgtcagctctt

SEQ ID NO: 56550 - DNA, 20 bp, Artificial Sequence
  chemically synthesized
tcagctctttggtcttgaat

SEQ ID NO: 56551 - DNA, 20 bp, Artificial Sequence
  chemically synthesized
ctctttggtcttgaataagt

SEQ ID NO: 56552 - DNA, 20 bp, Artificial Sequence
  chemically synthesized
agacattgtgattgccatta

SEQ ID NO: 56553 - DNA, 20 bp, Artificial Sequence
  chemically synthesized
gacattgtgattgccattaa

SEQ ID NO: 56554 - DNA, 20 bp, Artificial Sequence
  chemically synthesized
attctaattgtgattatctt

SEQ ID NO: 56555 - DNA, 20 bp, Artificial Sequence
  chemically synthesized
tctaattgtgattatctttg

SEQ ID NO: 56556 - DNA, 20 bp, Artificial Sequence
  chemically synthesized
aattgtgattatctttggag

SEQ ID NO: 56557 - DNA, 20 bp, Artificial Sequence
  chemically synthesized
aagaaaaaatttgcccctat

SEQ ID NO: 56558 - DNA, 20 bp, Artificial Sequence
  chemically synthesized
aaatttgcccctattagaaa

SEQ ID NO: 56559 - DNA, 20 bp, Artificial Sequence
  chemically synthesized
ttgcccctattagaaaaagc

SEQ ID NO: 56560 - DNA, 20 bp, Artificial Sequence
  chemically synthesized
tagaaaaagccagtgactta

SEQ ID NO: 56561 - DNA, 20 bp, Artificial Sequence
  chemically synthesized
aaaagccagtgacttatgga

SEQ ID NO: 56562 - DNA, 20 bp, Artificial Sequence
  chemically synthesized
aaagccagtgacttatggat

SEQ ID NO: 56563 - DNA, 20 bp, Artificial Sequence
  chemically synthesized
agccagtgacttatggatgg

SEQ ID NO: 56564 - DNA, 20 bp, Artificial Sequence
  chemically synthesized
gatgggagtgtcataaaact

SEQ ID NO: 56565 - DNA, 20 bp, Artificial Sequence
  chemically synthesized
agtgtcataaaactaagcat

SEQ ID NO: 56566 - DNA, 20 bp, Artificial Sequence
  chemically synthesized
gtgtcataaaactaagcatt

SEQ ID NO: 56567 - DNA, 20 bp, Artificial Sequence
  chemically synthesized
tgtcataaaactaagcattg

SEQ ID NO: 56568 - DNA, 20 bp, Artificial Sequence
  chemically synthesized
agcattggggatcaaatctg

SEQ ID NO: 56569 - DNA, 20 bp, Artificial Sequence
  chemically synthesized
gatcaaatctgtggaaatca

SEQ ID NO: 56570 - DNA, 20 bp, Artificial Sequence
  chemically synthesized
aaagtatttaattgacctac

SEQ ID NO: 56571 - DNA, 20 bp, Artificial Sequence
  chemically synthesized
ttaattgacctactagttta

SEQ ID NO: 56572 - DNA, 20 bp, Artificial Sequence
  chemically synthesized
agtttacggtaaatgtatgt

SEQ ID NO: 56573 - DNA, 20 bp, Artificial Sequence
  chemically synthesized
taaatgtatgttagctgata

SEQ ID NO: 56574 - DNA, 20 bp, Artificial Sequence
  chemically synthesized
tgaaatgtcctctgctgatt

SEQ ID NO: 56575 - DNA, 20 bp, Artificial Sequence
  chemically synthesized
tgatttggttctttcatttg

SEQ ID NO: 56576 - DNA, 20 bp, Artificial Sequence
  chemically synthesized
tggttctttcatttgaagtt

SEQ ID NO: 56577 - DNA, 20 bp, Artificial Sequence
  chemically synthesized
ttctttcatttgaagtttag

SEQ ID NO: 56578 - DNA, 20 bp, Artificial Sequence
  chemically synthesized
tttcatttgaagtttagcag

SEQ ID NO: 56579 - DNA, 20 bp, Artificial Sequence
  chemically synthesized
acatttgttgttgaatattt

SEQ ID NO: 56580 - DNA, 20 bp, Artificial Sequence
  chemically synthesized
caaaaaaaaaaaaaaaaaaa

SEQ ID NO: 56581 - DNA, 20 bp, Artificial Sequence
  chemically synthesized
aaaagctgctttttctttca

SEQ ID NO: 56582 - DNA, 20 bp, Artificial Sequence
  chemically synthesized
ctgctttttctttcaaagaa

SEQ ID NO: 56583 - DNA, 20 bp, Artificial Sequence
  chemically synthesized
acagctacttcctgaatttc

SEQ ID NO: 56584 - DNA, 20 bp, Artificial Sequence
  chemically synthesized
ttcctgaatttccagcatat

SEQ ID NO: 56585 - DNA, 20 bp, Artificial Sequence
  chemically synthesized
tccagcatattggtgacatg

SEQ ID NO: 56586 - DNA, 20 bp, Artificial Sequence
  chemically synthesized
tattggtgacatgaagcata

SEQ ID NO: 56587 - DNA, 20 bp, Artificial Sequence
  chemically synthesized
ggtgacatgaagcatacggt

SEQ ID NO: 56588 - DNA, 20 bp, Artificial Sequence
  chemically synthesized
catacggttagctgattcat

SEQ ID NO: 56589 - DNA, 20 bp, Artificial Sequence
  chemically synthesized
agctgattcatgagcttact

SEQ ID NO: 56590 - DNA, 20 bp, Artificial Sequence
  chemically synthesized
gagataaaacaactttattg

SEQ ID NO: 56591 - DNA, 20 bp, Artificial Sequence
  chemically synthesized
aacaactttattgaagtgtc

SEQ ID NO: 56592 - DNA, 20 bp, Artificial Sequence
  chemically synthesized
acaactttattgaagtgtct

SEQ ID NO: 56593 - DNA, 20 bp, Artificial Sequence
  chemically synthesized
ctttattgaagtgtctagga

SEQ ID NO: 56594 - DNA, 20 bp, Artificial Sequence
  chemically synthesized
gaagtgtctaggaaagaatg

SEQ ID NO: 56595 - DNA, 20 bp, Artificial Sequence
  chemically synthesized
acaaacatttctctaatgta

SEQ ID NO: 56596 - DNA, 20 bp, Artificial Sequence
  chemically synthesized
gattcaaaatatgtaatttt

SEQ ID NO: 56597 - DNA, 20 bp, Artificial Sequence
  chemically synthesized
tagaaaataactattttgat

SEQ ID NO: 56598 - DNA, 20 bp, Artificial Sequence
  chemically synthesized
gaaaataactattttgatca

SEQ ID NO: 56599 - DNA, 20 bp, Artificial Sequence
  chemically synthesized
gatcagagaacttttatata

SEQ ID NO: 56600 - DNA, 20 bp, Artificial Sequence
  chemically synthesized
agaacttttatataaagcat

SEQ ID NO: 56601 - DNA, 20 bp, Artificial Sequence
  chemically synthesized
aacttttatataaagcataa

SEQ ID NO: 56602 - DNA, 20 bp, Artificial Sequence
  chemically synthesized
ttatataaagcataagagcc

SEQ ID NO: 56603 - DNA, 20 bp, Artificial Sequence
  chemically synthesized
tatataaagcataagagccc

SEQ ID NO: 56604 - DNA, 20 bp, Artificial Sequence
  chemically synthesized
gcataagagcccaggttttt

SEQ ID NO: 56605 - DNA, 20 bp, Artificial Sequence
  chemically synthesized
ttttcagaaaattcaatcat

SEQ ID NO: 56606 - DNA, 20 bp, Artificial Sequence
  chemically synthesized
caatcatcagtgaaattgaa

SEQ ID NO: 56607 - DNA, 20 bp, Artificial Sequence
  chemically synthesized
aaaagtgactaaattttctt

SEQ ID NO: 56608 - DNA, 20 bp, Artificial Sequence
  chemically synthesized
aaattttctttggttattca

SEQ ID NO: 56609 - DNA, 20 bp, Artificial Sequence
  chemically synthesized
catagtgctttcctcaattt

SEQ ID NO: 56610 - DNA, 20 bp, Artificial Sequence
  chemically synthesized
tcctcaattttagtctcccc

SEQ ID NO: 56611 - DNA, 20 bp, Artificial Sequence
  chemically synthesized
tttgtcctgtcttccctgtc

SEQ ID NO: 56612 - DNA, 20 bp, Artificial Sequence
  chemically synthesized
ttctacatttgacttcttct

SEQ ID NO: 56613 - DNA, 20 bp, Artificial Sequence
  chemically synthesized
cttctaagaaatctgtcctt

SEQ ID NO: 56614 - DNA, 20 bp, Artificial Sequence
  chemically synthesized
tttttactaatttcttatgt

SEQ ID NO: 56615 - DNA, 20 bp, Artificial Sequence
  chemically synthesized
tttactaatttcttatgtca

SEQ ID NO: 56616 - DNA, 20 bp, Artificial Sequence
  chemically synthesized
cagagctcacaaaattatat

SEQ ID NO: 56617 - DNA, 20 bp, Artificial Sequence
  chemically synthesized
catctcacctatatttcatt

SEQ ID NO: 56618 - DNA, 20 bp, Artificial Sequence
  chemically synthesized
atatttcattaagaactaat

SEQ ID NO: 56619 - DNA, 20 bp, Artificial Sequence
  chemically synthesized
aagaactaatgagcctttat

SEQ ID NO: 56620 - DNA, 20 bp, Artificial Sequence
  chemically synthesized
agaactaatgagcctttatt

SEQ ID NO: 56621 - DNA, 20 bp, Artificial Sequence
  chemically synthesized
aactctgaacattttaaaac

SEQ ID NO: 56622 - DNA, 20 bp, Artificial Sequence
  chemically synthesized
actctgaacattttaaaacc

SEQ ID NO: 56623 - DNA, 20 bp, Artificial Sequence
  chemically synthesized
acattttaaaaccaggaaac

SEQ ID NO: 56624 - DNA, 20 bp, Artificial Sequence
  chemically synthesized
caggaaactggactctattc

SEQ ID NO: 56625 - DNA, 20 bp, Artificial Sequence
  chemically synthesized
tgattcatttgcccattatt

SEQ ID NO: 56626 - DNA, 20 bp, Artificial Sequence
  chemically synthesized
tgcccattattcagtatctg

SEQ ID NO: 56627 - DNA, 20 bp, Artificial Sequence
  chemically synthesized
attcagtatctgtggtttat

SEQ ID NO: 56628 - DNA, 20 bp, Artificial Sequence
  chemically synthesized
ttcagtatctgtggtttatc

SEQ ID NO: 56629 - DNA, 20 bp, Artificial Sequence
  chemically synthesized
cagtatctgtggtttatcag

SEQ ID NO: 56630 - DNA, 20 bp, Artificial Sequence
  chemically synthesized
atctgtggtttatcaggagc

SEQ ID NO: 56631 - DNA, 20 bp, Artificial Sequence
  chemically synthesized
aggagcaagttctcttgccg

SEQ ID NO: 56632 - DNA, 20 bp, Artificial Sequence
  chemically synthesized
ggagcaagttctcttgccgt

SEQ ID NO: 56633 - DNA, 20 bp, Artificial Sequence
  chemically synthesized
ctgctgctcatcttgtccct

SEQ ID NO: 56634 - DNA, 20 bp, Artificial Sequence
  chemically synthesized
ctgctcatcttgtcccttag

SEQ ID NO: 56635 - DNA, 20 bp, Artificial Sequence
  chemically synthesized
ccttagcagttccttctctc

SEQ ID NO: 56636 - DNA, 20 bp, Artificial Sequence
  chemically synthesized
ttctctctagatattccata

SEQ ID NO: 56637 - DNA, 20 bp, Artificial Sequence
  chemically synthesized
ttttaaactcacaacatttc

SEQ ID NO: 56638 - DNA, 20 bp, Artificial Sequence
  chemically synthesized
ttaaactcacaacatttcaa

SEQ ID NO: 56639 - DNA, 20 bp, Artificial Sequence
  chemically synthesized
tcacaacatttcaagagttt

SEQ ID NO: 56640 - DNA, 20 bp, Artificial Sequence
  chemically synthesized
tttcagctgtttaaaatata

SEQ ID NO: 56641 - DNA, 20 bp, Artificial Sequence
  chemically synthesized
ttcagctgtttaaaatatat

SEQ ID NO: 56642 - DNA, 20 bp, Artificial Sequence
  chemically synthesized
tataattccctttaacttta

SEQ ID NO: 56643 - DNA, 20 bp, Artificial Sequence
  chemically synthesized
taactttaaagaaatataaa

SEQ ID NO: 56644 - DNA, 20 bp, Artificial Sequence
  chemically synthesized
aaagaaatataaaaagcaac

SEQ ID NO: 56645 - DNA, 20 bp, Artificial Sequence
  chemically synthesized
aagaaatataaaaagcaacc

SEQ ID NO: 56646 - DNA, 20 bp, Artificial Sequence
  chemically synthesized
gaaatataaaaagcaaccag

SEQ ID NO: 56647 - DNA, 20 bp, Artificial Sequence
  chemically synthesized
taaaaagcaaccaggagctt

SEQ ID NO: 56648 - DNA, 20 bp, Artificial Sequence
  chemically synthesized
agcaaccaggagctttggct

SEQ ID NO: 56649 - DNA, 20 bp, Artificial Sequence
  chemically synthesized
ctttggctcagatttgtcaa

SEQ ID NO: 56650 - DNA, 20 bp, Artificial Sequence
  chemically synthesized
tcagatttgtcaaaagtata

SEQ ID NO: 56651 - DNA, 20 bp, Artificial Sequence
  chemically synthesized
aaagatttcaattatttcta

SEQ ID NO: 56652 - DNA, 20 bp, Artificial Sequence
  chemically synthesized
tacattattctgaatataaa

SEQ ID NO: 56653 - DNA, 20 bp, Artificial Sequence
  chemically synthesized
aaagaaatatattatgttct

SEQ ID NO: 56654 - DNA, 20 bp, Artificial Sequence
  chemically synthesized
aagaaatatattatgttctt

SEQ ID NO: 56655 - DNA, 20 bp, Artificial Sequence
  chemically synthesized
ctacctctattctctttcat

SEQ ID NO: 56656 - DNA, 20 bp, Artificial Sequence
  chemically synthesized
tacctctattctctttcatt

SEQ ID NO: 56657 - DNA, 20 bp, Artificial Sequence
  chemically synthesized
aatcttttacaccaatgtac

SEQ ID NO: 56658 - DNA, 20 bp, Artificial Sequence
  chemically synthesized
ttttacaccaatgtactggt

SEQ ID NO: 56659 - DNA, 20 bp, Artificial Sequence
  chemically synthesized
ttacaccaatgtactggtca

SEQ ID NO: 56660 - DNA, 20 bp, Artificial Sequence
  chemically synthesized
gcttgtctaaaatgttctta

SEQ ID NO: 56661 - DNA, 20 bp, Artificial Sequence
  chemically synthesized
aaaatgttcttaaagaaaat

SEQ ID NO: 56662 - DNA, 20 bp, Artificial Sequence
  chemically synthesized
ttcttaaagaaaattggaaa

SEQ ID NO: 56663 - DNA, 20 bp, Artificial Sequence
  chemically synthesized
aattggaaatagttaaatac

SEQ ID NO: 56664 - DNA, 20 bp, Artificial Sequence
  chemically synthesized
ttggaaatagttaaatacta

SEQ ID NO: 56665 - DNA, 20 bp, Artificial Sequence
  chemically synthesized
tggaaatagttaaatactag

SEQ ID NO: 56666 - DNA, 20 bp, Artificial Sequence
  chemically synthesized
atagttaaatactagaggaa

SEQ ID NO: 56667 - DNA, 20 bp, Artificial Sequence
  chemically synthesized
aatagctgaaatgtgaaata

SEQ ID NO: 56668 - DNA, 20 bp, Artificial Sequence
  chemically synthesized
tagctgaaatgtgaaatatg

SEQ ID NO: 56669 - DNA, 20 bp, Artificial Sequence
  chemically synthesized
gctgaaatgtgaaatatgga

SEQ ID NO: 56670 - DNA, 20 bp, Artificial Sequence
  chemically synthesized
ctgaaatgtgaaatatggag

SEQ ID NO: 56671 - DNA, 20 bp, Artificial Sequence
  chemically synthesized
cttctttttttttttgtcca

SEQ ID NO: 56672 - DNA, 20 bp, Artificial Sequence
  chemically synthesized
ttctttttttttttgtccac

SEQ ID NO: 56673 - DNA, 20 bp, Artificial Sequence
  chemically synthesized
tttttttttgtccacaggtc

SEQ ID NO: 56674 - DNA, 20 bp, Artificial Sequence
  chemically synthesized
tttttgtccacaggtctgga

SEQ ID NO: 56675 - DNA, 20 bp, Artificial Sequence
  chemically synthesized
acaggtctggaaagaaataa

SEQ ID NO: 56676 - DNA, 20 bp, Artificial Sequence
  chemically synthesized
tctggaaagaaataacagac

SEQ ID NO: 56677 - DNA, 20 bp, Artificial Sequence
  chemically synthesized
gaaagaaataacagactggc

SEQ ID NO: 56678 - DNA, 20 bp, Artificial Sequence
  chemically synthesized
agaaataacagactggccag

SEQ ID NO: 56679 - DNA, 20 bp, Artificial Sequence
  chemically synthesized
cagtagtccaatcccctgtc

SEQ ID NO: 56680 - DNA, 20 bp, Artificial Sequence
  chemically synthesized
agtagtccaatcccctgtcc

SEQ ID NO: 56681 - DNA, 20 bp, Artificial Sequence
  chemically synthesized
ccctgtccaggtgattttgc

SEQ ID NO: 56682 - DNA, 20 bp, Artificial Sequence
  chemically synthesized
tttgctggttctaatgtatt

SEQ ID NO: 56683 - DNA, 20 bp, Artificial Sequence
  chemically synthesized
atgcacataacatcctatta

SEQ ID NO: 56684 - DNA, 20 bp, Artificial Sequence
  chemically synthesized
cataacatcctattatggca

SEQ ID NO: 56685 - DNA, 20 bp, Artificial Sequence
  chemically synthesized
gtgaatgccccacctgaaaa

SEQ ID NO: 56686 - DNA, 20 bp, Artificial Sequence
  chemically synthesized
ttcctttcaaaactgtgaat

SEQ ID NO: 56687 - DNA, 20 bp, Artificial Sequence
  chemically synthesized
tttcaaaactgtgaataaga

SEQ ID NO: 56688 - DNA, 20 bp, Artificial Sequence
  chemically synthesized
gtgaataagatggatgattt

SEQ ID NO: 56689 - DNA, 20 bp, Artificial Sequence
  chemically synthesized
gaataagatggatgatttta

SEQ ID NO: 56690 - DNA, 20 bp, Artificial Sequence
  chemically synthesized
ttttagagttatacccaaat

SEQ ID NO: 56691 - DNA, 20 bp, Artificial Sequence
  chemically synthesized
agagttatacccaaatcaga

SEQ ID NO: 56692 - DNA, 20 bp, Artificial Sequence
  chemically synthesized
tcagacagactcaatataat

SEQ ID NO: 56693 - DNA, 20 bp, Artificial Sequence
  chemically synthesized
cagactcaatataatgagtt

SEQ ID NO: 56694 - DNA, 20 bp, Artificial Sequence
  chemically synthesized
gactcaatataatgagtttg

SEQ ID NO: 56695 - DNA, 20 bp, Artificial Sequence
  chemically synthesized
ataatgagtttggagaaaat

SEQ ID NO: 56696 - DNA, 20 bp, Artificial Sequence
  chemically synthesized
tgagtttggagaaaatcaga

SEQ ID NO: 56697 - DNA, 20 bp, Artificial Sequence
  chemically synthesized
gtttggagaaaatcagaaag

SEQ ID NO: 56698 - DNA, 20 bp, Artificial Sequence
  chemically synthesized
tggagaaaatcagaaagcag

SEQ ID NO: 56699 - DNA, 20 bp, Artificial Sequence
  chemically synthesized
gagaaaatcagaaagcagaa

SEQ ID NO: 56700 - DNA, 20 bp, Artificial Sequence
  chemically synthesized
agaaaatcagaaagcagaag

SEQ ID NO: 56701 - DNA, 20 bp, Artificial Sequence
  chemically synthesized
atcagaaagcagaagaggaa

SEQ ID NO: 56702 - DNA, 20 bp, Artificial Sequence
  chemically synthesized
gaggaacagtaacactgact

SEQ ID NO: 56703 - DNA, 20 bp, Artificial Sequence
  chemically synthesized
gaaacttcttttgtttgcat

SEQ ID NO: 56704 - DNA, 20 bp, Artificial Sequence
  chemically synthesized
aaacttcttttgtttgcatc

SEQ ID NO: 56705 - DNA, 20 bp, Artificial Sequence
  chemically synthesized
acttcttttgtttgcatcag

SEQ ID NO: 56706 - DNA, 20 bp, Artificial Sequence
  chemically synthesized
tatgtccatttccaacatca

SEQ ID NO: 56707 - DNA, 20 bp, Artificial Sequence
  chemically synthesized
catgccctctgtgttgacac

SEQ ID NO: 56708 - DNA, 20 bp, Artificial Sequence
  chemically synthesized
gccctctgtgttgacactag

SEQ ID NO: 56709 - DNA, 20 bp, Artificial Sequence
  chemically synthesized
ccctctgtgttgacactagt

SEQ ID NO: 56710 - DNA, 20 bp, Artificial Sequence
  chemically synthesized
cctctgtgttgacactagta

SEQ ID NO: 56711 - DNA, 20 bp, Artificial Sequence
  chemically synthesized
gttgacactagtagggatcc

SEQ ID NO: 56712 - DNA, 20 bp, Artificial Sequence
  chemically synthesized
ttgacactagtagggatccc

SEQ ID NO: 56713 - DNA, 20 bp, Artificial Sequence
  chemically synthesized
actagtagggatcccaggcc

SEQ ID NO: 56714 - DNA, 20 bp, Artificial Sequence
  chemically synthesized
tcccaggcctagaatctgtg

SEQ ID NO: 56715 - DNA, 20 bp, Artificial Sequence
  chemically synthesized
gcctagaatctgtgcagtgc

SEQ ID NO: 56716 - DNA, 20 bp, Artificial Sequence
  chemically synthesized
gaatctgtgcagtgctggat

SEQ ID NO: 56717 - DNA, 20 bp, Artificial Sequence
  chemically synthesized
aatctgtgcagtgctggatt

SEQ ID NO: 56718 - DNA, 20 bp, Artificial Sequence
  chemically synthesized
atttatctcattgctatgat

SEQ ID NO: 56719 - DNA, 20 bp, Artificial Sequence
  chemically synthesized
attggaaattccttgcttct

SEQ ID NO: 56720 - DNA, 20 bp, Artificial Sequence
  chemically synthesized
ttctgagcatcatcaaatct

SEQ ID NO: 56721 - DNA, 20 bp, Artificial Sequence
  chemically synthesized
agcatcatcaaatctgagcg

SEQ ID NO: 56722 - DNA, 20 bp, Artificial Sequence
  chemically synthesized
aatctgagcgcagtctccat

SEQ ID NO: 56723 - DNA, 20 bp, Artificial Sequence
  chemically synthesized
tgagcccttgtacattttct

SEQ ID NO: 56724 - DNA, 20 bp, Artificial Sequence
  chemically synthesized
gagcccttgtacattttctt

SEQ ID NO: 56725 - DNA, 20 bp, Artificial Sequence
  chemically synthesized
gtacattttcttaggcatgc

SEQ ID NO: 56726 - DNA, 20 bp, Artificial Sequence
  chemically synthesized
tacattttcttaggcatgct

SEQ ID NO: 56727 - DNA, 20 bp, Artificial Sequence
  chemically synthesized
cattttcttaggcatgctag

SEQ ID NO: 56728 - DNA, 20 bp, Artificial Sequence
  chemically synthesized
cttaggcatgctaggagcca

SEQ ID NO: 56729 - DNA, 20 bp, Artificial Sequence
  chemically synthesized
gccacagacattgcacttgc

SEQ ID NO: 56730 - DNA, 20 bp, Artificial Sequence
  chemically synthesized
acagacattgcacttgctag

SEQ ID NO: 56731 - DNA, 20 bp, Artificial Sequence
  chemically synthesized
ttgctagcagcattatgcca

SEQ ID NO: 56732 - DNA, 20 bp, Artificial Sequence
  chemically synthesized
agcattatgccaaagatgct

SEQ ID NO: 56733 - DNA, 20 bp, Artificial Sequence
  chemically synthesized
caaagatgcttggaatattc

SEQ ID NO: 56734 - DNA, 20 bp, Artificial Sequence
  chemically synthesized
attcctgcttgcttcaaatg

SEQ ID NO: 56735 - DNA, 20 bp, Artificial Sequence
  chemically synthesized
tgtggttcatccacacattg

SEQ ID NO: 56736 - DNA, 20 bp, Artificial Sequence
  chemically synthesized
gtggttcatccacacattgc

SEQ ID NO: 56737 - DNA, 20 bp, Artificial Sequence
  chemically synthesized
tggttcatccacacattgca

SEQ ID NO: 56738 - DNA, 20 bp, Artificial Sequence
  chemically synthesized
catccacacattgcagggta

SEQ ID NO: 56739 - DNA, 20 bp, Artificial Sequence
  chemically synthesized
tccacacattgcagggtata

SEQ ID NO: 56740 - DNA, 20 bp, Artificial Sequence
  chemically synthesized
cacattgcagggtatagagt

SEQ ID NO: 56741 - DNA, 20 bp, Artificial Sequence
  chemically synthesized
acattgcagggtatagagtc

SEQ ID NO: 56742 - DNA, 20 bp, Artificial Sequence
  chemically synthesized
tatagagtcaggcatccttg

SEQ ID NO: 56743 - DNA, 20 bp, Artificial Sequence
  chemically synthesized
gtcaggcatccttgtggcca

SEQ ID NO: 56744 - DNA, 20 bp, Artificial Sequence
  chemically synthesized
catccttgtggccatggccc

SEQ ID NO: 56745 - DNA, 20 bp, Artificial Sequence
  chemically synthesized
catggccctggaccgttatg

SEQ ID NO: 56746 - DNA, 20 bp, Artificial Sequence
  chemically synthesized
gtggccatctgttatccact

SEQ ID NO: 56747 - DNA, 20 bp, Artificial Sequence
  chemically synthesized
atgccaacatcttcacccac

SEQ ID NO: 56748 - DNA, 20 bp, Artificial Sequence
  chemically synthesized
tcacccaccagcttgtcatt

SEQ ID NO: 56749 - DNA, 20 bp, Artificial Sequence
  chemically synthesized
ccaccagcttgtcattcaga

SEQ ID NO: 56750 - DNA, 20 bp, Artificial Sequence
  chemically synthesized
caccagcttgtcattcagat

SEQ ID NO: 56751 - DNA, 20 bp, Artificial Sequence
  chemically synthesized
tgtcattcagataggaacta

SEQ ID NO: 56752 - DNA, 20 bp, Artificial Sequence
  chemically synthesized
ataggaactatggtcgtact

SEQ ID NO: 56753 - DNA, 20 bp, Artificial Sequence
  chemically synthesized
taggaactatggtcgtactc

SEQ ID NO: 56754 - DNA, 20 bp, Artificial Sequence
  chemically synthesized
aggaactatggtcgtactca

SEQ ID NO: 56755 - DNA, 20 bp, Artificial Sequence
  chemically synthesized
actcagggctgctattcttg

SEQ ID NO: 56756 - DNA, 20 bp, Artificial Sequence
  chemically synthesized
tattcttgtagccccatgcc

SEQ ID NO: 56757 - DNA, 20 bp, Artificial Sequence
  chemically synthesized
ccccatgcctagtactgata

SEQ ID NO: 56758 - DNA, 20 bp, Artificial Sequence
  chemically synthesized
gcctagtactgataaagtgc

SEQ ID NO: 56759 - DNA, 20 bp, Artificial Sequence
  chemically synthesized
gtttcaattttatcacacaa

SEQ ID NO: 56760 - DNA, 20 bp, Artificial Sequence
  chemically synthesized
tcatctcccactcctactgt

SEQ ID NO: 56761 - DNA, 20 bp, Artificial Sequence
  chemically synthesized
ccactcctactgtgagcata

SEQ ID NO: 56762 - DNA, 20 bp, Artificial Sequence
  chemically synthesized
gcatatggccattgtgaaac

SEQ ID NO: 56763 - DNA, 20 bp, Artificial Sequence
  chemically synthesized
tatggccattgtgaaactag

SEQ ID NO: 56764 - DNA, 20 bp, Artificial Sequence
  chemically synthesized
ggccattgtgaaactagcag

SEQ ID NO: 56765 - DNA, 20 bp, Artificial Sequence
  chemically synthesized
actagcagcagcaaatgttc

SEQ ID NO: 56766 - DNA, 20 bp, Artificial Sequence
  chemically synthesized
gttcaagtcaacaaaatcta

SEQ ID NO: 56767 - DNA, 20 bp, Artificial Sequence
  chemically synthesized
caaaatctatggtttgtttg

SEQ ID NO: 56768 - DNA, 20 bp, Artificial Sequence
  chemically synthesized
tttgtttgtggccttcactg

SEQ ID NO: 56769 - DNA, 20 bp, Artificial Sequence
  chemically synthesized
gtttgtggccttcactgtag

SEQ ID NO: 56770 - DNA, 20 bp, Artificial Sequence
  chemically synthesized
tttgtggccttcactgtagc

SEQ ID NO: 56771 - DNA, 20 bp, Artificial Sequence
  chemically synthesized
tcatcacattgtcctacatc

SEQ ID NO: 56772 - DNA, 20 bp, Artificial Sequence
  chemically synthesized
ctacatccagatatttatca

SEQ ID NO: 56773 - DNA, 20 bp, Artificial Sequence
  chemically synthesized
tcacagtttttcgtttgccc

SEQ ID NO: 56774 - DNA, 20 bp, Artificial Sequence
  chemically synthesized
cagtttttcgtttgccccag

SEQ ID NO: 56775 - DNA, 20 bp, Artificial Sequence
  chemically synthesized
agtttttcgtttgccccaga

SEQ ID NO: 56776 - DNA, 20 bp, Artificial Sequence
  chemically synthesized
tttttcgtttgccccagaag

SEQ ID NO: 56777 - DNA, 20 bp, Artificial Sequence
  chemically synthesized
ttttcgtttgccccagaagg

SEQ ID NO: 56778 - DNA, 20 bp, Artificial Sequence
  chemically synthesized
cgtttgccccagaaggaggc

SEQ ID NO: 56779 - DNA, 20 bp, Artificial Sequence
  chemically synthesized
gtttgccccagaaggaggct

SEQ ID NO: 56780 - DNA, 20 bp, Artificial Sequence
  chemically synthesized
ccagaaggaggctaggttta

SEQ ID NO: 56781 - DNA, 20 bp, Artificial Sequence
  chemically synthesized
ctcacatctgtgtcttcctc

SEQ ID NO: 56782 - DNA, 20 bp, Artificial Sequence
  chemically synthesized
ttcttctccttcttcacaca

SEQ ID NO: 56783 - DNA, 20 bp, Artificial Sequence
  chemically synthesized
tcttctccttcttcacacat

SEQ ID NO: 56784 - DNA, 20 bp, Artificial Sequence
  chemically synthesized
tccttcttcacacataggtt

SEQ ID NO: 56785 - DNA, 20 bp, Artificial Sequence
  chemically synthesized
ccttcttcacacataggttt

SEQ ID NO: 56786 - DNA, 20 bp, Artificial Sequence
  chemically synthesized
tatatccatattctcttttc

SEQ ID NO: 56787 - DNA, 20 bp, Artificial Sequence
  chemically synthesized
cttttctagcatttacttgc

SEQ ID NO: 56788 - DNA, 20 bp, Artificial Sequence
  chemically synthesized
tttctcaatccacttgtcta

SEQ ID NO: 56789 - DNA, 20 bp, Artificial Sequence
  chemically synthesized
atccacttgtctatggtgca

SEQ ID NO: 56790 - DNA, 20 bp, Artificial Sequence
  chemically synthesized
tctatggtgcaaagaccaca

SEQ ID NO: 56791 - DNA, 20 bp, Artificial Sequence
  chemically synthesized
cacacagattcgcattcatg

SEQ ID NO: 56792 - DNA, 20 bp, Artificial Sequence
  chemically synthesized
ctacatgcttttttcttttg

SEQ ID NO: 56793 - DNA, 20 bp, Artificial Sequence
  chemically synthesized
catgcttttttcttttgcag

SEQ ID NO: 56794 - DNA, 20 bp, Artificial Sequence
  chemically synthesized
aaacaaaaaacatattattt

SEQ ID NO: 56795 - DNA, 20 bp, Artificial Sequence
  chemically synthesized
aaacatattatttgagatgc

SEQ ID NO: 56796 - DNA, 20 bp, Artificial Sequence
  chemically synthesized
aacatattatttgagatgct

SEQ ID NO: 56797 - DNA, 20 bp, Artificial Sequence
  chemically synthesized
gctgggtttgtgaaatctgc

SEQ ID NO: 56798 - DNA, 20 bp, Artificial Sequence
  chemically synthesized
tgtgaaatctgccagcacaa

SEQ ID NO: 56799 - DNA, 20 bp, Artificial Sequence
  chemically synthesized
aaatctgccagcacaatagc

SEQ ID NO: 56800 - DNA, 20 bp, Artificial Sequence
  chemically synthesized
gccagcacaatagctggttt

SEQ ID NO: 56801 - DNA, 20 bp, Artificial Sequence
  chemically synthesized
tagctggttttagatcatca

SEQ ID NO: 56802 - DNA, 20 bp, Artificial Sequence
  chemically synthesized
tcatcatggctcatatcaat

SEQ ID NO: 56803 - DNA, 20 bp, Artificial Sequence
  chemically synthesized
tcatggctcatatcaatcag

SEQ ID NO: 56804 - DNA, 20 bp, Artificial Sequence
  chemically synthesized
catggctcatatcaatcagt

SEQ ID NO: 56805 - DNA, 20 bp, Artificial Sequence
  chemically synthesized
gaattctacgtgactaatga

SEQ ID NO: 56806 - DNA, 20 bp, Artificial Sequence
  chemically synthesized
tctacgtgactaatgaaagt

SEQ ID NO: 56807 - DNA, 20 bp, Artificial Sequence
  chemically synthesized
acgtgactaatgaaagtgag

SEQ ID NO: 56808 - DNA, 20 bp, Artificial Sequence
  chemically synthesized
gaaagtgagaagtgtgaaat

SEQ ID NO: 56809 - DNA, 20 bp, Artificial Sequence
  chemically synthesized
tgagaagtgtgaaatgagtg

SEQ ID NO: 56810 - DNA, 20 bp, Artificial Sequence
  chemically synthesized
gaagtgtgaaatgagtgaag

SEQ ID NO: 56811 - DNA, 20 bp, Artificial Sequence
  chemically synthesized
attttttctcttttattctt

SEQ ID NO: 56812 - DNA, 20 bp, Artificial Sequence
  chemically synthesized
ctcttttattctttagcccc

SEQ ID NO: 56813 - DNA, 20 bp, Artificial Sequence
  chemically synthesized
ttattctttagcccctggtt

SEQ ID NO: 56814 - DNA, 20 bp, Artificial Sequence
  chemically synthesized
cctggttgagttattcttct

SEQ ID NO: 56815 - DNA, 20 bp, Artificial Sequence
  chemically synthesized
ttcttctaagaatatttctc

SEQ ID NO: 56816 - DNA, 20 bp, Artificial Sequence
  chemically synthesized
tcttctaagaatatttctcc

SEQ ID NO: 56817 - DNA, 20 bp, Artificial Sequence
  chemically synthesized
ttctaagaatatttctccag

SEQ ID NO: 56818 - DNA, 20 bp, Artificial Sequence
  chemically synthesized
tctaagaatatttctccagg

SEQ ID NO: 56819 - DNA, 20 bp, Artificial Sequence
  chemically synthesized
cactgaatttaaatgcacct

SEQ ID NO: 56820 - DNA, 20 bp, Artificial Sequence
  chemically synthesized
actgaatttaaatgcaccta

SEQ ID NO: 56821 - DNA, 20 bp, Artificial Sequence
  chemically synthesized
gctcgttgttctgaaacatc

SEQ ID NO: 56822 - DNA, 20 bp, Artificial Sequence
  chemically synthesized
ctcgttgttctgaaacatcc

SEQ ID NO: 56823 - DNA, 20 bp, Artificial Sequence
  chemically synthesized
tcgttgttctgaaacatcca

SEQ ID NO: 56824 - DNA, 20 bp, Artificial Sequence
  chemically synthesized
tccagggactcaatgaaaac

SEQ ID NO: 56825 - DNA, 20 bp, Artificial Sequence
  chemically synthesized
tgccttaaaaaaaaaaatca

SEQ ID NO: 56826 - DNA, 20 bp, Artificial Sequence
  chemically synthesized
gccttaaaaaaaaaaatcaa

SEQ ID NO: 56827 - DNA, 20 bp, Artificial Sequence
  chemically synthesized
ttaaaaaaaaaaatcaaagg

SEQ ID NO: 56828 - DNA, 20 bp, Artificial Sequence
  chemically synthesized
tgttaactgtgttcttgtca

SEQ ID NO: 56829 - DNA, 20 bp, Artificial Sequence
  chemically synthesized
aagaaaatcttatgaatatc

SEQ ID NO: 56830 - DNA, 20 bp, Artificial Sequence
  chemically synthesized
gaaaatcttatgaatatcaa

SEQ ID NO: 56831 - DNA, 20 bp, Artificial Sequence
  chemically synthesized
atgaatatcaagagacaata

SEQ ID NO: 56832 - DNA, 20 bp, Artificial Sequence
  chemically synthesized
taaaaatttaaatacatttt

SEQ ID NO: 56833 - DNA, 20 bp, Artificial Sequence
  chemically synthesized
aaaatttaaatacattttca

SEQ ID NO: 56834 - DNA, 20 bp, Artificial Sequence
  chemically synthesized
atacattttcagagtcatac

SEQ ID NO: 56835 - DNA, 20 bp, Artificial Sequence
  chemically synthesized
tacattttcagagtcataca

SEQ ID NO: 56836 - DNA, 20 bp, Artificial Sequence
  chemically synthesized
cagagtcatacaaggaatta

SEQ ID NO: 56837 - DNA, 20 bp, Artificial Sequence
  chemically synthesized
agagtcatacaaggaattac

SEQ ID NO: 56838 - DNA, 20 bp, Artificial Sequence
  chemically synthesized
ggaattacaggcacaaaaat

SEQ ID NO: 56839 - DNA, 20 bp, Artificial Sequence
  chemically synthesized
acaggcacaaaaattagaac

SEQ ID NO: 56840 - DNA, 20 bp, Artificial Sequence
  chemically synthesized
caggcacaaaaattagaacc

SEQ ID NO: 56841 - DNA, 20 bp, Artificial Sequence
  chemically synthesized
atattaaaaatactatacta

SEQ ID NO: 56842 - DNA, 20 bp, Artificial Sequence
  chemically synthesized
actacagaatcgtgacataa

SEQ ID NO: 56843 - DNA, 20 bp, Artificial Sequence
  chemically synthesized
tcgtgacataatagtaaatc

SEQ ID NO: 56844 - DNA, 20 bp, Artificial Sequence
  chemically synthesized
acataatagtaaatctggca

SEQ ID NO: 56845 - DNA, 20 bp, Artificial Sequence
  chemically synthesized
gcacagtgaataattctcat

SEQ ID NO: 56846 - DNA, 20 bp, Artificial Sequence
  chemically synthesized
agtttgtacctatgtaattc

SEQ ID NO: 56847 - DNA, 20 bp, Artificial Sequence
  chemically synthesized
gtacctatgtaattctggaa

SEQ ID NO: 56848 - DNA, 20 bp, Artificial Sequence
  chemically synthesized
acctatgtaattctggaaaa

SEQ ID NO: 56849 - DNA, 20 bp, Artificial Sequence
  chemically synthesized
ctatgtaattctggaaaaga

SEQ ID NO: 56850 - DNA, 20 bp, Artificial Sequence
  chemically synthesized
ttctggaaaagagagactga

SEQ ID NO: 56851 - DNA, 20 bp, Artificial Sequence
  chemically synthesized
tctggaaaagagagactgaa

SEQ ID NO: 56852 - DNA, 20 bp, Artificial Sequence
  chemically synthesized
ggaaaagagagactgaaagg

SEQ ID NO: 56853 - DNA, 20 bp, Artificial Sequence
  chemically synthesized
aaaagagagactgaaaggaa

SEQ ID NO: 56854 - DNA, 20 bp, Artificial Sequence
  chemically synthesized
aagagagactgaaaggaaga

SEQ ID NO: 56855 - DNA, 20 bp, Artificial Sequence
  chemically synthesized
agagagactgaaaggaagag

SEQ ID NO: 56856 - DNA, 20 bp, Artificial Sequence
  chemically synthesized
gagactgaaaggaagagagg

SEQ ID NO: 56857 - DNA, 20 bp, Artificial Sequence
  chemically synthesized
agactgaaaggaagagaggt

SEQ ID NO: 56858 - DNA, 20 bp, Artificial Sequence
  chemically synthesized
gactgaaaggaagagaggtg

SEQ ID NO: 56859 - DNA, 20 bp, Artificial Sequence
  chemically synthesized
aaaggaagagaggtggggaa

SEQ ID NO: 56860 - DNA, 20 bp, Artificial Sequence
  chemically synthesized
aaggaagagaggtggggaat

SEQ ID NO: 56861 - DNA, 20 bp, Artificial Sequence
  chemically synthesized
gaagagaggtggggaatggg

SEQ ID NO: 56862 - DNA, 20 bp, Artificial Sequence
  chemically synthesized
aagagaggtggggaatgggc

SEQ ID NO: 56863 - DNA, 20 bp, Artificial Sequence
  chemically synthesized
gaggtggggaatgggcaggc

SEQ ID NO: 56864 - DNA, 20 bp, Artificial Sequence
  chemically synthesized
aggtggggaatgggcaggca

SEQ ID NO: 56865 - DNA, 20 bp, Artificial Sequence
  chemically synthesized
ggtggggaatgggcaggcaa

SEQ ID NO: 56866 - DNA, 20 bp, Artificial Sequence
  chemically synthesized
gggaatgggcaggcaaggga

SEQ ID NO: 56867 - DNA, 20 bp, Artificial Sequence
  chemically synthesized
aatgggcaggcaagggaaag

SEQ ID NO: 56868 - DNA, 20 bp, Artificial Sequence
  chemically synthesized
tgggcaggcaagggaaagaa

SEQ ID NO: 56869 - DNA, 20 bp, Artificial Sequence
  chemically synthesized
ggcaggcaagggaaagaaga

SEQ ID NO: 56870 - DNA, 20 bp, Artificial Sequence
  chemically synthesized
ggaaagaagagagaaataac

SEQ ID NO: 56871 - DNA, 20 bp, Artificial Sequence
  chemically synthesized
agaaataacaagtgtacaca

SEQ ID NO: 56872 - DNA, 20 bp, Artificial Sequence
  chemically synthesized
gaaataacaagtgtacacat

SEQ ID NO: 56873 - DNA, 20 bp, Artificial Sequence
  chemically synthesized
acaagtgtacacataggatg

SEQ ID NO: 56874 - DNA, 20 bp, Artificial Sequence
  chemically synthesized
aagtgtacacataggatgtg

SEQ ID NO: 56875 - DNA, 20 bp, Artificial Sequence
  chemically synthesized
tacacataggatgtggagtt

SEQ ID NO: 56876 - DNA, 20 bp, Artificial Sequence
  chemically synthesized
cacataggatgtggagttca

SEQ ID NO: 56877 - DNA, 20 bp, Artificial Sequence
  chemically synthesized
cataggatgtggagttcaga

SEQ ID NO: 56878 - DNA, 20 bp, Artificial Sequence
  chemically synthesized
tgtggagttcagagagaatg

SEQ ID NO: 56879 - DNA, 20 bp, Artificial Sequence
  chemically synthesized
gaagcattgaaatctaacca

SEQ ID NO: 56880 - DNA, 20 bp, Artificial Sequence
  chemically synthesized
gcattgaaatctaaccaaag

SEQ ID NO: 56881 - DNA, 20 bp, Artificial Sequence
  chemically synthesized
cattgaaatctaaccaaagc

SEQ ID NO: 56882 - DNA, 20 bp, Artificial Sequence
  chemically synthesized
attgaaatctaaccaaagca

SEQ ID NO: 56883 - DNA, 20 bp, Artificial Sequence
  chemically synthesized
ttgaaatctaaccaaagcag

SEQ ID NO: 56884 - DNA, 20 bp, Artificial Sequence
  chemically synthesized
gaaatctaaccaaagcaggg

SEQ ID NO: 56885 - DNA, 20 bp, Artificial Sequence
  chemically synthesized
atttattgtattttgttttt

SEQ ID NO: 56886 - DNA, 20 bp, Artificial Sequence
  chemically synthesized
attgtattttgttttttggt

SEQ ID NO: 56887 - DNA, 20 bp, Artificial Sequence
  chemically synthesized
ttgtattttgttttttggtt

SEQ ID NO: 56888 - DNA, 20 bp, Artificial Sequence
  chemically synthesized
tattttgttttttggttagg

SEQ ID NO: 56889 - DNA, 20 bp, Artificial Sequence
  chemically synthesized
ggtagttacctctgattctt

SEQ ID NO: 56890 - DNA, 20 bp, Artificial Sequence
  chemically synthesized
gtagttacctctgattcttg

SEQ ID NO: 56891 - DNA, 20 bp, Artificial Sequence
  chemically synthesized
ctctgattcttgaggaatga

SEQ ID NO: 56892 - DNA, 20 bp, Artificial Sequence
  chemically synthesized
attcttgaggaatgatggat

SEQ ID NO: 56893 - DNA, 20 bp, Artificial Sequence
  chemically synthesized
cttgaggaatgatggatgag

SEQ ID NO: 56894 - DNA, 20 bp, Artificial Sequence
  chemically synthesized
ggaatgatggatgagtagcc

SEQ ID NO: 56895 - DNA, 20 bp, Artificial Sequence
  chemically synthesized
gaatgatggatgagtagcca

SEQ ID NO: 56896 - DNA, 20 bp, Artificial Sequence
  chemically synthesized
tgatggatgagtagccaagg

SEQ ID NO: 56897 - DNA, 20 bp, Artificial Sequence
  chemically synthesized
ggatgagtagccaaggaagt

SEQ ID NO: 56898 - DNA, 20 bp, Artificial Sequence
  chemically synthesized
gaagtaagaacacatcatgc

SEQ ID NO: 56899 - DNA, 20 bp, Artificial Sequence
  chemically synthesized
aagtaagaacacatcatgcc

SEQ ID NO: 56900 - DNA, 20 bp, Artificial Sequence
  chemically synthesized
taagaacacatcatgccagg

SEQ ID NO: 56901 - DNA, 20 bp, Artificial Sequence
  chemically synthesized
aacacatcatgccaggtaga

SEQ ID NO: 56902 - DNA, 20 bp, Artificial Sequence
  chemically synthesized
acatcatgccaggtagatag

SEQ ID NO: 56903 - DNA, 20 bp, Artificial Sequence
  chemically synthesized
atcatgccaggtagatagta

SEQ ID NO: 56904 - DNA, 20 bp, Artificial Sequence
  chemically synthesized
tcatgccaggtagatagtag

SEQ ID NO: 56905 - DNA, 20 bp, Artificial Sequence
  chemically synthesized
atgccaggtagatagtagag

SEQ ID NO: 56906 - DNA, 20 bp, Artificial Sequence
  chemically synthesized
atagtagaggagatttaaac

SEQ ID NO: 56907 - DNA, 20 bp, Artificial Sequence
  chemically synthesized
gagatttaaactagataatg

SEQ ID NO: 56908 - DNA, 20 bp, Artificial Sequence
  chemically synthesized
taaactagataatgtagttt

SEQ ID NO: 56909 - DNA, 20 bp, Artificial Sequence
  chemically synthesized
aaactagataatgtagttta

SEQ ID NO: 56910 - DNA, 20 bp, Artificial Sequence
  chemically synthesized
aatgtagtttaaggtaactc

SEQ ID NO: 56911 - DNA, 20 bp, Artificial Sequence
  chemically synthesized
taactctagttttttcaata

SEQ ID NO: 56912 - DNA, 20 bp, Artificial Sequence
  chemically synthesized
tagttttttcaatatggtat

SEQ ID NO: 56913 - DNA, 20 bp, Artificial Sequence
  chemically synthesized
tttcaatatggtatgagtgc

SEQ ID NO: 56914 - DNA, 20 bp, Artificial Sequence
  chemically synthesized
ttcaatatggtatgagtgca

SEQ ID NO: 56915 - DNA, 20 bp, Artificial Sequence
  chemically synthesized
aatatggtatgagtgcaagg

SEQ ID NO: 56916 - DNA, 20 bp, Artificial Sequence
  chemically synthesized
tatgagtgcaaggtagaact

SEQ ID NO: 56917 - DNA, 20 bp, Artificial Sequence
  chemically synthesized
atgagtgcaaggtagaactt

SEQ ID NO: 56918 - DNA, 20 bp, Artificial Sequence
  chemically synthesized
tgagtgcaaggtagaacttg

SEQ ID NO: 56919 - DNA, 20 bp, Artificial Sequence
  chemically synthesized
agtgcaaggtagaacttggg

SEQ ID NO: 56920 - DNA, 20 bp, Artificial Sequence
  chemically synthesized
aaggtagaacttggggagac

SEQ ID NO: 56921 - DNA, 20 bp, Artificial Sequence
  chemically synthesized
aggtagaacttggggagaca

SEQ ID NO: 56922 - DNA, 20 bp, Artificial Sequence
  chemically synthesized
gaaaatatgaatatcaaaaa

SEQ ID NO: 56923 - DNA, 20 bp, Artificial Sequence
  chemically synthesized
aaatggctattaatgttgtg

SEQ ID NO: 56924 - DNA, 20 bp, Artificial Sequence
  chemically synthesized
atggctattaatgttgtgca

SEQ ID NO: 56925 - DNA, 20 bp, Artificial Sequence
  chemically synthesized
ttaatgttgtgcagagttgc

SEQ ID NO: 56926 - DNA, 20 bp, Artificial Sequence
  chemically synthesized
gttgctggactttattccaa

SEQ ID NO: 56927 - DNA, 20 bp, Artificial Sequence
  chemically synthesized
caaaagctataatgtgccat

SEQ ID NO: 56928 - DNA, 20 bp, Artificial Sequence
  chemically synthesized
aaagctataatgtgccattg

SEQ ID NO: 56929 - DNA, 20 bp, Artificial Sequence
  chemically synthesized
agctataatgtgccattgga

SEQ ID NO: 56930 - DNA, 20 bp, Artificial Sequence
  chemically synthesized
tttgtttgcttgtgttctac

SEQ ID NO: 56931 - DNA, 20 bp, Artificial Sequence
  chemically synthesized
tttgcttgtgttctacaagt

SEQ ID NO: 56932 - DNA, 20 bp, Artificial Sequence
  chemically synthesized
tgtgtgtgtgtgtgtctgct

SEQ ID NO: 56933 - DNA, 20 bp, Artificial Sequence
  chemically synthesized
gtgtgtgtgtgtgtctgctt

SEQ ID NO: 56934 - DNA, 20 bp, Artificial Sequence
  chemically synthesized
tgtgtgtctgcttgggcatg

SEQ ID NO: 56935 - DNA, 20 bp, Artificial Sequence
  chemically synthesized
gtgtctgcttgggcatgtgg

SEQ ID NO: 56936 - DNA, 20 bp, Artificial Sequence
  chemically synthesized
gcatgtggcagcataccaca

SEQ ID NO: 56937 - DNA, 20 bp, Artificial Sequence
  chemically synthesized
accacacagcaaatataaat

SEQ ID NO: 56938 - DNA, 20 bp, Artificial Sequence
  chemically synthesized
acagcaaatataaataagtc

SEQ ID NO: 56939 - DNA, 20 bp, Artificial Sequence
  chemically synthesized
cagcaaatataaataagtct

SEQ ID NO: 56940 - DNA, 20 bp, Artificial Sequence
  chemically synthesized
agcaaatataaataagtcta

SEQ ID NO: 56941 - DNA, 20 bp, Artificial Sequence
  chemically synthesized
taagtctagggctattgtgt

SEQ ID NO: 56942 - DNA, 20 bp, Artificial Sequence
  chemically synthesized
ctagggctattgtgttagtg

SEQ ID NO: 56943 - DNA, 20 bp, Artificial Sequence
  chemically synthesized
agggctattgtgttagtgaa

SEQ ID NO: 56944 - DNA, 20 bp, Artificial Sequence
  chemically synthesized
gggctattgtgttagtgaag

SEQ ID NO: 56945 - DNA, 20 bp, Artificial Sequence
  chemically synthesized
gctattgtgttagtgaagag

SEQ ID NO: 56946 - DNA, 20 bp, Artificial Sequence
  chemically synthesized
ctattgtgttagtgaagagg

SEQ ID NO: 56947 - DNA, 20 bp, Artificial Sequence
  chemically synthesized
aggactatattgtctaaaat

SEQ ID NO: 56948 - DNA, 20 bp, Artificial Sequence
  chemically synthesized
actatattgtctaaaattag

SEQ ID NO: 56949 - DNA, 20 bp, Artificial Sequence
  chemically synthesized
ttgtctaaaattagtggcat

SEQ ID NO: 56950 - DNA, 20 bp, Artificial Sequence
  chemically synthesized
attagtggcataagaattta

SEQ ID NO: 56951 - DNA, 20 bp, Artificial Sequence
  chemically synthesized
gtggcataagaatttacggc

SEQ ID NO: 56952 - DNA, 20 bp, Artificial Sequence
  chemically synthesized
caattgttcttgaaaaacct

SEQ ID NO: 56953 - DNA, 20 bp, Artificial Sequence
  chemically synthesized
aattgttcttgaaaaacctc

SEQ ID NO: 56954 - DNA, 20 bp, Artificial Sequence
  chemically synthesized
tcttgaaaaacctcaggtca

SEQ ID NO: 56955 - DNA, 20 bp, Artificial Sequence
  chemically synthesized
ggtcatagatcatttttttc

SEQ ID NO: 56956 - DNA, 20 bp, Artificial Sequence
  chemically synthesized
gtcatagatcatttttttca

SEQ ID NO: 56957 - DNA, 20 bp, Artificial Sequence
  chemically synthesized
gatcatttttttcaaggtta

SEQ ID NO: 56958 - DNA, 20 bp, Artificial Sequence
  chemically synthesized
ttatggaaaatattcacata

SEQ ID NO: 56959 - DNA, 20 bp, Artificial Sequence
  chemically synthesized
tatggaaaatattcacatat

SEQ ID NO: 56960 - DNA, 20 bp, Artificial Sequence
  chemically synthesized
ggaaaatattcacatatggg

SEQ ID NO: 56961 - DNA, 20 bp, Artificial Sequence
  chemically synthesized
atgtccatactttgatttac

SEQ ID NO: 56962 - DNA, 20 bp, Artificial Sequence
  chemically synthesized
gtatggacatctgcccatat

SEQ ID NO: 56963 - DNA, 20 bp, Artificial Sequence
  chemically synthesized
tgtagaacacaagcaaacaa

SEQ ID NO: 56964 - DNA, 20 bp, Artificial Sequence
  chemically synthesized
caatggcacattatagcttt

SEQ ID NO: 56965 - DNA, 20 bp, Artificial Sequence
  chemically synthesized
tcataccatattgaaaaaac

SEQ ID NO: 56966 - DNA, 20 bp, Artificial Sequence
  chemically synthesized
ctactcatccatcattcctc

SEQ ID NO: 56967 - DNA, 20 bp, Artificial Sequence
  chemically synthesized
tcctttcagtctctcttttc

SEQ ID NO: 56968 - DNA, 20 bp, Artificial Sequence
  chemically synthesized
ttacataggtacaaactcat

SEQ ID NO: 56969 - DNA, 20 bp, Artificial Sequence
  chemically synthesized
tgcaggtttttgataaaatg

SEQ ID NO: 56970 - DNA, 20 bp, Artificial Sequence
  chemically synthesized
ttgatttttttttttaaggc

SEQ ID NO: 56971 - DNA, 20 bp, Artificial Sequence
  chemically synthesized
gcagggatgatcaagaaaat

SEQ ID NO: 56972 - DNA, 20 bp, Artificial Sequence
  chemically synthesized
gagtcaacaacttgttttca

SEQ ID NO: 56973 - DNA, 20 bp, Artificial Sequence
  chemically synthesized
aacttgttttcattgagtcc

SEQ ID NO: 56974 - DNA, 20 bp, Artificial Sequence
  chemically synthesized
tcctggagaaatattcttag

SEQ ID NO: 56975 - DNA, 20 bp, Artificial Sequence
  chemically synthesized
aataactcaaccaggggcta

SEQ ID NO: 56976 - DNA, 20 bp, Artificial Sequence
  chemically synthesized
tctcactttcattagtcacg

SEQ ID NO: 56977 - DNA, 20 bp, Artificial Sequence
  chemically synthesized
gcatgtaggcattaattaag

SEQ ID NO: 56978 - DNA, 20 bp, Artificial Sequence
  chemically synthesized
gaacagaacatttttaccac

SEQ ID NO: 56979 - DNA, 20 bp, Artificial Sequence
  chemically synthesized
aacatttttaccacatgaat

SEQ ID NO: 56980 - DNA, 20 bp, Artificial Sequence
  chemically synthesized
ggtctttgcaccatagacaa

SEQ ID NO: 56981 - DNA, 20 bp, Artificial Sequence
  chemically synthesized
agcaagtaaatgctagaaaa

SEQ ID NO: 56982 - DNA, 20 bp, Artificial Sequence
  chemically synthesized
taaatgctagaaaagagaat

SEQ ID NO: 56983 - DNA, 20 bp, Artificial Sequence
  chemically synthesized
agatgtgagcaatgcaggta

SEQ ID NO: 56984 - DNA, 20 bp, Artificial Sequence
  chemically synthesized
cgaaaaactgtgataaatat

SEQ ID NO: 56985 - DNA, 20 bp, Artificial Sequence
  chemically synthesized
tctggatgtaggacaatgtg

SEQ ID NO: 56986 - DNA, 20 bp, Artificial Sequence
  chemically synthesized
aatggccatatgctcacagt

SEQ ID NO: 56987 - DNA, 20 bp, Artificial Sequence
  chemically synthesized
agtactaggcatggggctac

SEQ ID NO: 56988 - DNA, 20 bp, Artificial Sequence
  chemically synthesized
gggctacaagaatagcagcc

SEQ ID NO: 56989 - DNA, 20 bp, Artificial Sequence
  chemically synthesized
agtacgaccatagttcctat

SEQ ID NO: 56990 - DNA, 20 bp, Artificial Sequence
  chemically synthesized
cctatctgaatgacaagctg

SEQ ID NO: 56991 - DNA, 20 bp, Artificial Sequence
  chemically synthesized
gaagatgttggcatgtctta

SEQ ID NO: 56992 - DNA, 20 bp, Artificial Sequence
  chemically synthesized
cggtccagggccatggccac

SEQ ID NO: 56993 - DNA, 20 bp, Artificial Sequence
  chemically synthesized
gactctataccctgcaatgt

SEQ ID NO: 56994 - DNA, 20 bp, Artificial Sequence
  chemically synthesized
gaaccacatttgaagcaagc

SEQ ID NO: 56995 - DNA, 20 bp, Artificial Sequence
  chemically synthesized
agatttcaggcacattaaac

SEQ ID NO: 56996 - DNA, 20 bp, Artificial Sequence
  chemically synthesized
tttgatgatgctcagaagca

SEQ ID NO: 56997 - DNA, 20 bp, Artificial Sequence
  chemically synthesized
tagcaatgagataaatggca

SEQ ID NO: 56998 - DNA, 20 bp, Artificial Sequence
  chemically synthesized
atgagataaatggcacagaa

SEQ ID NO: 56999 - DNA, 20 bp, Artificial Sequence
  chemically synthesized
cactgcacagattctaggcc

SEQ ID NO: 57000 - DNA, 20 bp, Artificial Sequence
  chemically synthesized
tggaaatggacatagtgtcg

SEQ ID NO: 57001 - DNA, 20 bp, Artificial Sequence
  chemically synthesized
ttttctccaaactcattata

SEQ ID NO: 57002 - DNA, 20 bp, Artificial Sequence
  chemically synthesized
ttatattgagtctgtctgat

SEQ ID NO: 57003 - DNA, 20 bp, Artificial Sequence
  chemically synthesized
cacagttttgaaaggaaaag

SEQ ID NO: 57004 - DNA, 20 bp, Artificial Sequence
  chemically synthesized
tcacaggcactgtgccataa

SEQ ID NO: 57005 - DNA, 20 bp, Artificial Sequence
  chemically synthesized
ccagcaaaatcacctggaca

SEQ ID NO: 57006 - DNA, 20 bp, Artificial Sequence
  chemically synthesized
gtaaaagattcccaatgaaa

SEQ ID NO: 57007 - DNA, 20 bp, Artificial Sequence
  chemically synthesized
aatatatttctttttatatt

SEQ ID NO: 57008 - DNA, 20 bp, Artificial Sequence
  chemically synthesized
tatattcagaataatgtaaa

SEQ ID NO: 57009 - DNA, 20 bp, Artificial Sequence
  chemically synthesized
tatatttctttaaagttaaa

SEQ ID NO: 57010 - DNA, 20 bp, Artificial Sequence
  chemically synthesized
gctgaaactcttgaaatgtt

SEQ ID NO: 57011 - DNA, 20 bp, Artificial Sequence
  chemically synthesized
taaaattttaatacacttta

SEQ ID NO: 57012 - DNA, 20 bp, Artificial Sequence
  chemically synthesized
ctcctgataaaccacagata

SEQ ID NO: 57013 - DNA, 20 bp, Artificial Sequence
  chemically synthesized
agatactgaataatgggcaa

SEQ ID NO: 57014 - DNA, 20 bp, Artificial Sequence
  chemically synthesized
gggcaaatgaatcatttagc

SEQ ID NO: 57015 - DNA, 20 bp, Artificial Sequence
  chemically synthesized
aatgaatcatttagccagaa

SEQ ID NO: 57016 - DNA, 20 bp, Artificial Sequence
  chemically synthesized
tttcctggttttaaaatgtt

SEQ ID NO: 57017 - DNA, 20 bp, Artificial Sequence
  chemically synthesized
ctaaaattgaggaaagcact

SEQ ID NO: 57018 - DNA, 20 bp, Artificial Sequence
  chemically synthesized
cttttcaatttcactgatga

SEQ ID NO: 57019 - DNA, 20 bp, Artificial Sequence
  chemically synthesized
ttttctaaaaattacatatt

SEQ ID NO: 57020 - DNA, 20 bp, Artificial Sequence
  chemically synthesized
tgttttatctcagtaagctc

SEQ ID NO: 57021 - DNA, 20 bp, Artificial Sequence
  chemically synthesized
gaagaaagagaaaagaggaa

SEQ ID NO: 57022 - DNA, 20 bp, Artificial Sequence
  chemically synthesized
tctccaaagataatcacaat

SEQ ID NO: 57023 - DNA, 20 bp, Artificial Sequence
  chemically synthesized
aagataatcacaattagaat

SEQ ID NO: 57024 - DNA, 20 bp, Artificial Sequence
  chemically synthesized
caagaccaaagagctgacat

SEQ ID NO: 57025 - DNA, 20 bp, Artificial Sequence
  chemically synthesized
tacctgacaggcacagatag

SEQ ID NO: 57026 - DNA, 20 bp, Artificial Sequence
  chemically synthesized
gtatgtaagttcctggttag

SEQ ID NO: 57027 - DNA, 20 bp, Artificial Sequence
  chemically synthesized
taagttcctggttagttgga

SEQ ID NO: 57028 - DNA, 20 bp, Artificial Sequence
  chemically synthesized
taaattatggagaggaaact

SEQ ID NO: 57029 - DNA, 20 bp, Artificial Sequence
  chemically synthesized
ttgctcttaccagatacctg

SEQ ID NO: 57030 - DNA, 20 bp, Artificial Sequence
  chemically synthesized
ctcaccaatttttcttctcc

SEQ ID NO: 57031 - DNA, 20 bp, Artificial Sequence
  chemically synthesized
cagcttcattcccttaagtt

SEQ ID NO: 57032 - DNA, 20 bp, Artificial Sequence
  chemically synthesized
aattttactctgtttggtgc

SEQ ID NO: 57033 - DNA, 20 bp, Artificial Sequence
  chemically synthesized
gtctgtagcattctgaaaca

SEQ ID NO: 57034 - DNA, 20 bp, Artificial Sequence
  chemically synthesized
gtagcattctgaaacacggg

SEQ ID NO: 57035 - DNA, 20 bp, Artificial Sequence
  chemically synthesized
caccaatttaatattccttt

SEQ ID NO: 57036 - DNA, 20 bp, Artificial Sequence
  chemically synthesized
tgaatgtgtggagaagtagg

SEQ ID NO: 57037 - DNA, 20 bp, Artificial Sequence
  chemically synthesized
ggagttatgagcatgaaatg

SEQ ID NO: 57038 - DNA, 20 bp, Artificial Sequence
  chemically synthesized
caaattttaagtcagccctc

SEQ ID NO: 57039 - DNA, 20 bp, Artificial Sequence
  chemically synthesized
cttttcccacaggctaaatg

SEQ ID NO: 57040 - DNA, 20 bp, Artificial Sequence
  chemically synthesized
ggaagcaagttgttgaacat

SEQ ID NO: 57041 - DNA, 20 bp, Artificial Sequence
  chemically synthesized
tcattatattcctactattt

SEQ ID NO: 57042 - DNA, 20 bp, Artificial Sequence
  chemically synthesized
cctttaaattattagtaaaa

SEQ ID NO: 57043 - DNA, 20 bp, Artificial Sequence
  chemically synthesized
cagctggtttctaggctttc

SEQ ID NO: 57044 - DNA, 20 bp, Artificial Sequence
  chemically synthesized
taggaagcatactaatggtg

SEQ ID NO: 57045 - DNA, 20 bp, Artificial Sequence
  chemically synthesized
aatggtggagaatatttata

SEQ ID NO: 57046 - DNA, 20 bp, Artificial Sequence
  chemically synthesized
aatggatttccaggagaaca

SEQ ID NO: 57047 - DNA, 20 bp, Artificial Sequence
  chemically synthesized
ggaaccccatgtgctctttc

SEQ ID NO: 57048 - DNA, 20 bp, Artificial Sequence
  chemically synthesized
aacaatagtactgttgcatg

SEQ ID NO: 57049 - DNA, 20 bp, Artificial Sequence
  chemically synthesized
gggctctccaaagttctatc

SEQ ID NO: 57050 - DNA, 20 bp, Artificial Sequence
  chemically synthesized
catcctttgaaacattgtca

SEQ ID NO: 57051 - DNA, 20 bp, Artificial Sequence
  chemically synthesized
atatgcatcaataactatct

SEQ ID NO: 57052 - DNA, 20 bp, Artificial Sequence
  chemically synthesized
tttttttcttttttttgaga

SEQ ID NO: 57053 - DNA, 20 bp, Artificial Sequence
  chemically synthesized
tctctctctgtcgcccaggc

SEQ ID NO: 57054 - DNA, 20 bp, Artificial Sequence
  chemically synthesized
ttgtatttttttagtagaga

SEQ ID NO: 57055 - DNA, 20 bp, Artificial Sequence
  chemically synthesized
cggggtttcactgtgttagc

SEQ ID NO: 57056 - DNA, 20 bp, Artificial Sequence
  chemically synthesized
gcctccgcctcccaaagtgc

SEQ ID NO: 57057 - DNA, 20 bp, Artificial Sequence
  chemically synthesized
gagccactgcacccggccta

SEQ ID NO: 57058 - DNA, 20 bp, Artificial Sequence
  chemically synthesized
ctttttttttttccttgaga

SEQ ID NO: 57059 - DNA, 20 bp, Artificial Sequence
  chemically synthesized
tctcgctccgtcatccaggc

SEQ ID NO: 57060 - DNA, 20 bp, Artificial Sequence
  chemically synthesized
tccaggctggagtgcagtgg

SEQ ID NO: 57061 - DNA, 20 bp, Artificial Sequence
  chemically synthesized
gcccaagcctcccaagtagg

SEQ ID NO: 57062 - DNA, 20 bp, Artificial Sequence
  chemically synthesized
ttttgtatttttagtagaga

SEQ ID NO: 57063 - DNA, 20 bp, Artificial Sequence
  chemically synthesized
ccagcccatctttaccattt

SEQ ID NO: 57064 - DNA, 20 bp, Artificial Sequence
  chemically synthesized
tacacacagagggagagaga

SEQ ID NO: 57065 - DNA, 20 bp, Artificial Sequence
  chemically synthesized
gagggagagagagagagtgg

SEQ ID NO: 57066 - DNA, 20 bp, Artificial Sequence
  chemically synthesized
tccacgtttttaacttccac

SEQ ID NO: 57067 - DNA, 20 bp, Artificial Sequence
  chemically synthesized
tatttcattcttttttatgg

SEQ ID NO: 57068 - DNA, 20 bp, Artificial Sequence
  chemically synthesized
ctttatccatttatctgttg

SEQ ID NO: 57069 - DNA, 20 bp, Artificial Sequence
  chemically synthesized
gatttcaaatcttggcgttt

SEQ ID NO: 57070 - DNA, 20 bp, Artificial Sequence
  chemically synthesized
aatagtgctataataaagat

SEQ ID NO: 57071 - DNA, 20 bp, Artificial Sequence
  chemically synthesized
acatactaatttattctttt

SEQ ID NO: 57072 - DNA, 20 bp, Artificial Sequence
  chemically synthesized
tcttttaagggtatatacct

SEQ ID NO: 57073 - DNA, 20 bp, Artificial Sequence
  chemically synthesized
tatacctaggagtgatattg

SEQ ID NO: 57074 - DNA, 20 bp, Artificial Sequence
  chemically synthesized
tactcccaccaacagtgtaa

SEQ ID NO: 57075 - DNA, 20 bp, Artificial Sequence
  chemically synthesized
atttatttatttattttctg

SEQ ID NO: 57076 - DNA, 20 bp, Artificial Sequence
  chemically synthesized
tttattttctgttgagttgc

SEQ ID NO: 57077 - DNA, 20 bp, Artificial Sequence
  chemically synthesized
caaatattttctcccattct

SEQ ID NO: 57078 - DNA, 20 bp, Artificial Sequence
  chemically synthesized
gacagtatttgcccaaatca

SEQ ID NO: 57079 - DNA, 20 bp, Artificial Sequence
  chemically synthesized
ccaaatcaatgaatgccctg

SEQ ID NO: 57080 - DNA, 20 bp, Artificial Sequence
  chemically synthesized
tagtttcataatttcaggta

SEQ ID NO: 57081 - DNA, 20 bp, Artificial Sequence
  chemically synthesized
ttttgtatatagtgagagat

SEQ ID NO: 57082 - DNA, 20 bp, Artificial Sequence
  chemically synthesized
ccgattttactcttttgcaa

SEQ ID NO: 57083 - DNA, 20 bp, Artificial Sequence
  chemically synthesized
ttttttttttttttttgaga

SEQ ID NO: 57084 - DNA, 20 bp, Artificial Sequence
  chemically synthesized
agtctcactgttgcccaggc

SEQ ID NO: 57085 - DNA, 20 bp, Artificial Sequence
  chemically synthesized
agtgcagtggcagcacaatc

SEQ ID NO: 57086 - DNA, 20 bp, Artificial Sequence
  chemically synthesized
gattctcctgcctcagcctc

SEQ ID NO: 57087 - DNA, 20 bp, Artificial Sequence
  chemically synthesized
gcctcagcctcctgagtatc

SEQ ID NO: 57088 - DNA, 20 bp, Artificial Sequence
  chemically synthesized
ttttgtatttttagtagaga

SEQ ID NO: 57089 - DNA, 20 bp, Artificial Sequence
  chemically synthesized
acctcagcctcacaaagtgc

SEQ ID NO: 57090 - DNA, 20 bp, Artificial Sequence
  chemically synthesized
atgacttggttgttaagtgc

SEQ ID NO: 57091 - DNA, 20 bp, Artificial Sequence
  chemically synthesized
ttaagtgcctggatttgcat

SEQ ID NO: 57092 - DNA, 20 bp, Artificial Sequence
  chemically synthesized
ttggttttgttctttttgct

SEQ ID NO: 57093 - DNA, 20 bp, Artificial Sequence
  chemically synthesized
tcaggattgctttagctatt

SEQ ID NO: 57094 - DNA, 20 bp, Artificial Sequence
  chemically synthesized
ttgtggttccatataaatat

SEQ ID NO: 57095 - DNA, 20 bp, Artificial Sequence
  chemically synthesized
aggattgtttttctatttct

SEQ ID NO: 57096 - DNA, 20 bp, Artificial Sequence
  chemically synthesized
gtattttgacagaaattgca

SEQ ID NO: 57097 - DNA, 20 bp, Artificial Sequence
  chemically synthesized
cactgaatctgtacattgct

SEQ ID NO: 57098 - DNA, 20 bp, Artificial Sequence
  chemically synthesized
attcttctagttcatgagca

SEQ ID NO: 57099 - DNA, 20 bp, Artificial Sequence
  chemically synthesized
ccctcttctatttctttcac

SEQ ID NO: 57100 - DNA, 20 bp, Artificial Sequence
  chemically synthesized
ttatagagatcttttacttc

SEQ ID NO: 57101 - DNA, 20 bp, Artificial Sequence
  chemically synthesized
ttcttgggttagattgactc

SEQ ID NO: 57102 - DNA, 20 bp, Artificial Sequence
  chemically synthesized
ttaacttcttcctttccaat

SEQ ID NO: 57103 - DNA, 20 bp, Artificial Sequence
  chemically synthesized
gatgcactttctttctcttc

SEQ ID NO: 57104 - DNA, 20 bp, Artificial Sequence
  chemically synthesized
ttgttgtgtcctggtctggt

SEQ ID NO: 57105 - DNA, 20 bp, Artificial Sequence
  chemically synthesized
ctggtctggtttgggtatat

SEQ ID NO: 57106 - DNA, 20 bp, Artificial Sequence
  chemically synthesized
ttagagtaatgcttgcctca

SEQ ID NO: 57107 - DNA, 20 bp, Artificial Sequence
  chemically synthesized
tttatttgtttgtttgtttg

SEQ ID NO: 57108 - DNA, 20 bp, Artificial Sequence
  chemically synthesized
tgtttgtttgtttgaggaat

SEQ ID NO: 57109 - DNA, 20 bp, Artificial Sequence
  chemically synthesized
ttgaaatgtttggtagccca

SEQ ID NO: 57110 - DNA, 20 bp, Artificial Sequence
  chemically synthesized
ttgctaggctgtatgtgtcc

SEQ ID NO: 57111 - DNA, 20 bp, Artificial Sequence
  chemically synthesized
ttctagattttccaatttgt

SEQ ID NO: 57112 - DNA, 20 bp, Artificial Sequence
  chemically synthesized
gttgttcataatagtatcta

SEQ ID NO: 57113 - DNA, 20 bp, Artificial Sequence
  chemically synthesized
gttgaagcctttctactttt

SEQ ID NO: 57114 - DNA, 20 bp, Artificial Sequence
  chemically synthesized
gcaataaagctttttatcac

SEQ ID NO: 57115 - DNA, 20 bp, Artificial Sequence
  chemically synthesized
atcacctgggtgcaggcggg

SEQ ID NO: 57116 - DNA, 20 bp, Artificial Sequence
  chemically synthesized
aggcgggctgagtccgaaaa

SEQ ID NO: 57117 - DNA, 20 bp, Artificial Sequence
  chemically synthesized
gagagtcagcaaagggagat

SEQ ID NO: 57118 - DNA, 20 bp, Artificial Sequence
  chemically synthesized
gtggggctgttttataagat

SEQ ID NO: 57119 - DNA, 20 bp, Artificial Sequence
  chemically synthesized
aaggaaaattacagtcaaag

SEQ ID NO: 57120 - DNA, 20 bp, Artificial Sequence
  chemically synthesized
ggggttgttctctggcgggc

SEQ ID NO: 57121 - DNA, 20 bp, Artificial Sequence
  chemically synthesized
ttctctggcgggcaggagtg

SEQ ID NO: 57122 - DNA, 20 bp, Artificial Sequence
  chemically synthesized
cagtaggggagcttttgagc

SEQ ID NO: 57123 - DNA, 20 bp, Artificial Sequence
  chemically synthesized
cattttcacttcttttgtgg

SEQ ID NO: 57124 - DNA, 20 bp, Artificial Sequence
  chemically synthesized
ttggggcagcgaaaattttg

SEQ ID NO: 57125 - DNA, 20 bp, Artificial Sequence
  chemically synthesized
tttctcagggctgcttcgag

SEQ ID NO: 57126 - DNA, 20 bp, Artificial Sequence
  chemically synthesized
ttaggggcggcgtgggaacc

SEQ ID NO: 57127 - DNA, 20 bp, Artificial Sequence
  chemically synthesized
tgaaggaagattttgtggta

SEQ ID NO: 57128 - DNA, 20 bp, Artificial Sequence
  chemically synthesized
tgtggtaaggggtgatattg

SEQ ID NO: 57129 - DNA, 20 bp, Artificial Sequence
  chemically synthesized
tagaagaaacatttgtcatg

SEQ ID NO: 57130 - DNA, 20 bp, Artificial Sequence
  chemically synthesized
gtagaattattggtgatggc

SEQ ID NO: 57131 - DNA, 20 bp, Artificial Sequence
  chemically synthesized
tggcctggatacggttttgt

SEQ ID NO: 57132 - DNA, 20 bp, Artificial Sequence
  chemically synthesized
gtatggattgaaaaaccaaa

SEQ ID NO: 57133 - DNA, 20 bp, Artificial Sequence
  chemically synthesized
ggacctaggacatctgatta

SEQ ID NO: 57134 - DNA, 20 bp, Artificial Sequence
  chemically synthesized
aaagattatttatttacttc

SEQ ID NO: 57135 - DNA, 20 bp, Artificial Sequence
  chemically synthesized
atttatttacttcaagagtt

SEQ ID NO: 57136 - DNA, 20 bp, Artificial Sequence
  chemically synthesized
agagttaagagtggcagttt

SEQ ID NO: 57137 - DNA, 20 bp, Artificial Sequence
  chemically synthesized
taaacaagagcagggcatgt

SEQ ID NO: 57138 - DNA, 20 bp, Artificial Sequence
  chemically synthesized
cagggcatgtatgagtagtt

SEQ ID NO: 57139 - DNA, 20 bp, Artificial Sequence
  chemically synthesized
tgtatgagtagttgagaatg

SEQ ID NO: 57140 - DNA, 20 bp, Artificial Sequence
  chemically synthesized
agtagttgagaatggtgaat

SEQ ID NO: 57141 - DNA, 20 bp, Artificial Sequence
  chemically synthesized
atgactagacagaagatagc

SEQ ID NO: 57142 - DNA, 20 bp, Artificial Sequence
  chemically synthesized
ttctaagttggtctggtgtc

SEQ ID NO: 57143 - DNA, 20 bp, Artificial Sequence
  chemically synthesized
cctgaagacggaggaccgta

SEQ ID NO: 57144 - DNA, 20 bp, Artificial Sequence
  chemically synthesized
taagggatataaaggtttta

SEQ ID NO: 57145 - DNA, 20 bp, Artificial Sequence
  chemically synthesized
gaggtaggaaggctaaactg

SEQ ID NO: 57146 - DNA, 20 bp, Artificial Sequence
  chemically synthesized
gttatctgactcagggcatg

SEQ ID NO: 57147 - DNA, 20 bp, Artificial Sequence
  chemically synthesized
gtaaatctaatttgccagtc

SEQ ID NO: 57148 - DNA, 20 bp, Artificial Sequence
  chemically synthesized
gtgtagggaagggagggggc

SEQ ID NO: 57149 - DNA, 20 bp, Artificial Sequence
  chemically synthesized
gggggcctgaataatccctg

SEQ ID NO: 57150 - DNA, 20 bp, Artificial Sequence
  chemically synthesized
gaataatccctgaggagtag

SEQ ID NO: 57151 - DNA, 20 bp, Artificial Sequence
  chemically synthesized
cactgagaagttatttcttt

SEQ ID NO: 57152 - DNA, 20 bp, Artificial Sequence
  chemically synthesized
atcaataaatcaagtgtgat

SEQ ID NO: 57153 - DNA, 20 bp, Artificial Sequence
  chemically synthesized
aagaaggaaatatggggaaa

SEQ ID NO: 57154 - DNA, 20 bp, Artificial Sequence
  chemically synthesized
aggaaatatggggaaatggg

SEQ ID NO: 57155 - DNA, 20 bp, Artificial Sequence
  chemically synthesized
ggaaatggggtgaatgtcag

SEQ ID NO: 57156 - DNA, 20 bp, Artificial Sequence
  chemically synthesized
gatcagagagatacaatcat

SEQ ID NO: 57157 - DNA, 20 bp, Artificial Sequence
  chemically synthesized
tgggggtcaggtgtggtatc

SEQ ID NO: 57158 - DNA, 20 bp, Artificial Sequence
  chemically synthesized
atcaggaataatgtgggagg

SEQ ID NO: 57159 - DNA, 20 bp, Artificial Sequence
  chemically synthesized
ggtaattgtgggacttaaca

SEQ ID NO: 57160 - DNA, 20 bp, Artificial Sequence
  chemically synthesized
attgtgggacttaacaaaga

SEQ ID NO: 57161 - DNA, 20 bp, Artificial Sequence
  chemically synthesized
tgagtacagctgaaggagcc

SEQ ID NO: 57162 - DNA, 20 bp, Artificial Sequence
  chemically synthesized
tagaagttatgagaaatgtg

SEQ ID NO: 57163 - DNA, 20 bp, Artificial Sequence
  chemically synthesized
ttatttggacagaaaggcta

SEQ ID NO: 57164 - DNA, 20 bp, Artificial Sequence
  chemically synthesized
aaaggctacagggtgcagtc

SEQ ID NO: 57165 - DNA, 20 bp, Artificial Sequence
  chemically synthesized
tgcagtcctggatcttgtgt

SEQ ID NO: 57166 - DNA, 20 bp, Artificial Sequence
  chemically synthesized
taactatgcctaggaaggaa

SEQ ID NO: 57167 - DNA, 20 bp, Artificial Sequence
  chemically synthesized
aggagttgttgttttgtaga

SEQ ID NO: 57168 - DNA, 20 bp, Artificial Sequence
  chemically synthesized
gagagcacgtgtgtttttat

SEQ ID NO: 57169 - DNA, 20 bp, Artificial Sequence
  chemically synthesized
tgccgagataggtaacacat

SEQ ID NO: 57170 - DNA, 20 bp, Artificial Sequence
  chemically synthesized
tttgggcttgactgaagtaa

SEQ ID NO: 57171 - DNA, 20 bp, Artificial Sequence
  chemically synthesized
caggtaatttgctgagccta

SEQ ID NO: 57172 - DNA, 20 bp, Artificial Sequence
  chemically synthesized
aagtgaaagcgaagagaggc

SEQ ID NO: 57173 - DNA, 20 bp, Artificial Sequence
  chemically synthesized
agcgaagagaggctggaatg

SEQ ID NO: 57174 - DNA, 20 bp, Artificial Sequence
  chemically synthesized
ggctggaatgaagggtgcaa

SEQ ID NO: 57175 - DNA, 20 bp, Artificial Sequence
  chemically synthesized
agcatgtttgagatccagaa

SEQ ID NO: 57176 - DNA, 20 bp, Artificial Sequence
  chemically synthesized
ttgagatccagaacagaata

SEQ ID NO: 57177 - DNA, 20 bp, Artificial Sequence
  chemically synthesized
gggttatagatggaggtatt

SEQ ID NO: 57178 - DNA, 20 bp, Artificial Sequence
  chemically synthesized
gatggaggtattgaggatag

SEQ ID NO: 57179 - DNA, 20 bp, Artificial Sequence
  chemically synthesized
tattgaggataggagagtat

SEQ ID NO: 57180 - DNA, 20 bp, Artificial Sequence
  chemically synthesized
agtatatgggtttggcacca

SEQ ID NO: 57181 - DNA, 20 bp, Artificial Sequence
  chemically synthesized
tatgggtttggcaccatggg

SEQ ID NO: 57182 - DNA, 20 bp, Artificial Sequence
  chemically synthesized
ttttaggacaggtaaaatgg

SEQ ID NO: 57183 - DNA, 20 bp, Artificial Sequence
  chemically synthesized
taaaatgggggaatggtaag

SEQ ID NO: 57184 - DNA, 20 bp, Artificial Sequence
  chemically synthesized
aatcctttcaaagcatgctg

SEQ ID NO: 57185 - DNA, 20 bp, Artificial Sequence
  chemically synthesized
tttcaaagcatgctgtggga

SEQ ID NO: 57186 - DNA, 20 bp, Artificial Sequence
  chemically synthesized
gatgggatactggcattgag

SEQ ID NO: 57187 - DNA, 20 bp, Artificial Sequence
  chemically synthesized
atactggcattgagcggggt

SEQ ID NO: 57188 - DNA, 20 bp, Artificial Sequence
  chemically synthesized
taagagtgattaggttttaa

SEQ ID NO: 57189 - DNA, 20 bp, Artificial Sequence
  chemically synthesized
agtagaggtgtcttatactt

SEQ ID NO: 57190 - DNA, 20 bp, Artificial Sequence
  chemically synthesized
aaggtggggagatacaaggg

SEQ ID NO: 57191 - DNA, 20 bp, Artificial Sequence
  chemically synthesized
atgaggtatggctgtagccc

SEQ ID NO: 57192 - DNA, 20 bp, Artificial Sequence
  chemically synthesized
taataagggaactggcaggt

SEQ ID NO: 57193 - DNA, 20 bp, Artificial Sequence
  chemically synthesized
gcaggtggggataatgaaaa

SEQ ID NO: 57194 - DNA, 20 bp, Artificial Sequence
  chemically synthesized
aatgaaaaaggagtgcttaa

SEQ ID NO: 57195 - DNA, 20 bp, Artificial Sequence
  chemically synthesized
agtatcgtctcggttagcac

SEQ ID NO: 57196 - DNA, 20 bp, Artificial Sequence
  chemically synthesized
ctcggttagcaccagagttg

SEQ ID NO: 57197 - DNA, 20 bp, Artificial Sequence
  chemically synthesized
cctttgaaaagaaggtaatg

SEQ ID NO: 57198 - DNA, 20 bp, Artificial Sequence
  chemically synthesized
tgaaaagaaggtaatgtgga

SEQ ID NO: 57199 - DNA, 20 bp, Artificial Sequence
  chemically synthesized
tagcctccatactgattaag

SEQ ID NO: 57200 - DNA, 20 bp, Artificial Sequence
  chemically synthesized
acagacttaccctccactgt

SEQ ID NO: 57201 - DNA, 20 bp, Artificial Sequence
  chemically synthesized
aaagccgagaagatctggga

SEQ ID NO: 57202 - DNA, 20 bp, Artificial Sequence
  chemically synthesized
tcagtcagggagccttgggc

SEQ ID NO: 57203 - DNA, 20 bp, Artificial Sequence
  chemically synthesized
gccagagttccaggggctct

SEQ ID NO: 57204 - DNA, 20 bp, Artificial Sequence
  chemically synthesized
gctctaggagtggctgccag

SEQ ID NO: 57205 - DNA, 20 bp, Artificial Sequence
  chemically synthesized
ttgaacagtccgatttctag

SEQ ID NO: 57206 - DNA, 20 bp, Artificial Sequence
  chemically synthesized
cagatgggacacggcttagg

SEQ ID NO: 57207 - DNA, 20 bp, Artificial Sequence
  chemically synthesized
ttgtgtgctggagatgtggc

SEQ ID NO: 57208 - DNA, 20 bp, Artificial Sequence
  chemically synthesized
tttgtctcacagtggaggca

SEQ ID NO: 57209 - DNA, 20 bp, Artificial Sequence
  chemically synthesized
caccttgaaggtgaggttaa

SEQ ID NO: 57210 - DNA, 20 bp, Artificial Sequence
  chemically synthesized
aggttaattgagtcctgttg

SEQ ID NO: 57211 - DNA, 20 bp, Artificial Sequence
  chemically synthesized
ctgttgtggggtttgaggtc

SEQ ID NO: 57212 - DNA, 20 bp, Artificial Sequence
  chemically synthesized
gaggtccagaatttaatttt

SEQ ID NO: 57213 - DNA, 20 bp, Artificial Sequence
  chemically synthesized
tatttaatgtcaggagcaga

SEQ ID NO: 57214 - DNA, 20 bp, Artificial Sequence
  chemically synthesized
tgggtaataaaatgtatatt

SEQ ID NO: 57215 - DNA, 20 bp, Artificial Sequence
  chemically synthesized
aaagtggccttttgtccttt

SEQ ID NO: 57216 - DNA, 20 bp, Artificial Sequence
  chemically synthesized
tctagggctgtaaagcgtct

SEQ ID NO: 57217 - DNA, 20 bp, Artificial Sequence
  chemically synthesized
cgaacgagccatgaactggg

SEQ ID NO: 57218 - DNA, 20 bp, Artificial Sequence
  chemically synthesized
acgctctgattcgggagagg

SEQ ID NO: 57219 - DNA, 20 bp, Artificial Sequence
  chemically synthesized
aggttggggagggctagtca

SEQ ID NO: 57220 - DNA, 20 bp, Artificial Sequence
  chemically synthesized
gaatgaaactgtaaaccgga

SEQ ID NO: 57221 - DNA, 20 bp, Artificial Sequence
  chemically synthesized
gggaggtgataaaaagatta

SEQ ID NO: 57222 - DNA, 20 bp, Artificial Sequence
  chemically synthesized
gggaggaggggagacgtcag

SEQ ID NO: 57223 - DNA, 20 bp, Artificial Sequence
  chemically synthesized
tagaaagactcagcgacgct

SEQ ID NO: 57224 - DNA, 20 bp, Artificial Sequence
  chemically synthesized
agggagggaccaatgtgtaa

SEQ ID NO: 57225 - DNA, 20 bp, Artificial Sequence
  chemically synthesized
caaaaattatttagatcttg

SEQ ID NO: 57226 - DNA, 20 bp, Artificial Sequence
  chemically synthesized
ctggctatttggaaccactg

SEQ ID NO: 57227 - DNA, 20 bp, Artificial Sequence
  chemically synthesized
aaccactgtcgagtttgtat

SEQ ID NO: 57228 - DNA, 20 bp, Artificial Sequence
  chemically synthesized
atttaggttttaggtcaggt

SEQ ID NO: 57229 - DNA, 20 bp, Artificial Sequence
  chemically synthesized
gcacaggctaagggagaggg

SEQ ID NO: 57230 - DNA, 20 bp, Artificial Sequence
  chemically synthesized
ctaagggagagggaggaatg

SEQ ID NO: 57231 - DNA, 20 bp, Artificial Sequence
  chemically synthesized
aggcaagcccagagaaaaga

SEQ ID NO: 57232 - DNA, 20 bp, Artificial Sequence
  chemically synthesized
agagtacagacacggaggga

SEQ ID NO: 57233 - DNA, 20 bp, Artificial Sequence
  chemically synthesized
gacacggagggaaggggttc

SEQ ID NO: 57234 - DNA, 20 bp, Artificial Sequence
  chemically synthesized
actcaccagaaaaatgggca

SEQ ID NO: 57235 - DNA, 20 bp, Artificial Sequence
  chemically synthesized
ggggttggggcacggaaata

SEQ ID NO: 57236 - DNA, 20 bp, Artificial Sequence
  chemically synthesized
ggggcacggaaataaggggt

SEQ ID NO: 57237 - DNA, 20 bp, Artificial Sequence
  chemically synthesized
gaggtcagggcacagaaata

SEQ ID NO: 57238 - DNA, 20 bp, Artificial Sequence
  chemically synthesized
agggcacagaaataaggggt

SEQ ID NO: 57239 - DNA, 20 bp, Artificial Sequence
  chemically synthesized
gaggttggggcacagaaata

SEQ ID NO: 57240 - DNA, 20 bp, Artificial Sequence
  chemically synthesized
ggggcacagaaataagggat

SEQ ID NO: 57241 - DNA, 20 bp, Artificial Sequence
  chemically synthesized
ggggtgcagagataagaggt

SEQ ID NO: 57242 - DNA, 20 bp, Artificial Sequence
  chemically synthesized
gaggttggggtgcagaaata

SEQ ID NO: 57243 - DNA, 20 bp, Artificial Sequence
  chemically synthesized
ggggtgcagaaataagggat

SEQ ID NO: 57244 - DNA, 20 bp, Artificial Sequence
  chemically synthesized
agggtgcagagataagaggt

SEQ ID NO: 57245 - DNA, 20 bp, Artificial Sequence
  chemically synthesized
gaggtcggggtgcagaaata

SEQ ID NO: 57246 - DNA, 20 bp, Artificial Sequence
  chemically synthesized
ggggtgcagaaataagggat

SEQ ID NO: 57247 - DNA, 20 bp, Artificial Sequence
  chemically synthesized
ggattggggtgcagagataa

SEQ ID NO: 57248 - DNA, 20 bp, Artificial Sequence
  chemically synthesized
gaggatggggcgtggaaata

SEQ ID NO: 57249 - DNA, 20 bp, Artificial Sequence
  chemically synthesized
tggggcgtggaaataaggga

SEQ ID NO: 57250 - DNA, 20 bp, Artificial Sequence
  chemically synthesized
gaggttggggcacagaaata

SEQ ID NO: 57251 - DNA, 20 bp, Artificial Sequence
  chemically synthesized
ggggcacagaaataagggat

SEQ ID NO: 57252 - DNA, 20 bp, Artificial Sequence
  chemically synthesized
ggggcagagacatggagaga

SEQ ID NO: 57253 - DNA, 20 bp, Artificial Sequence
  chemically synthesized
gagacatggagagaaggggt

SEQ ID NO: 57254 - DNA, 20 bp, Artificial Sequence
  chemically synthesized
cttacccccctccagaaaag

SEQ ID NO: 57255 - DNA, 20 bp, Artificial Sequence
  chemically synthesized
gaaaagtgggatttgccgct

SEQ ID NO: 57256 - DNA, 20 bp, Artificial Sequence
  chemically synthesized
tcccagtccgtgactggcac

SEQ ID NO: 57257 - DNA, 20 bp, Artificial Sequence
  chemically synthesized
ccgtgactggcaccggagtt

SEQ ID NO: 57258 - DNA, 20 bp, Artificial Sequence
  chemically synthesized
ggcaccggagttttgggtcc

SEQ ID NO: 57259 - DNA, 20 bp, Artificial Sequence
  chemically synthesized
tgtctctactggaaaatgaa

SEQ ID NO: 57260 - DNA, 20 bp, Artificial Sequence
  chemically synthesized
ttgaaaggagaaagaagttg

SEQ ID NO: 57261 - DNA, 20 bp, Artificial Sequence
  chemically synthesized
cagtaaaaagaggccactta

SEQ ID NO: 57262 - DNA, 20 bp, Artificial Sequence
  chemically synthesized
ttgaggacctgaggtcgtag

SEQ ID NO: 57263 - DNA, 20 bp, Artificial Sequence
  chemically synthesized
gagcaaagagcaggaggaca

SEQ ID NO: 57264 - DNA, 20 bp, Artificial Sequence
  chemically synthesized
cccaagggaggtcccccaat

SEQ ID NO: 57265 - DNA, 20 bp, Artificial Sequence
  chemically synthesized
aacaaggctgtttatttcac

SEQ ID NO: 57266 - DNA, 20 bp, Artificial Sequence
  chemically synthesized
ttcacctgggtgcaggcagg

SEQ ID NO: 57267 - DNA, 20 bp, Artificial Sequence
  chemically synthesized
aggcaggctgagtccaaaaa

SEQ ID NO: 57268 - DNA, 20 bp, Artificial Sequence
  chemically synthesized
gagagtcagcaaagggagat

SEQ ID NO: 57269 - DNA, 20 bp, Artificial Sequence
  chemically synthesized
gtggggctgttttataagat

SEQ ID NO: 57270 - DNA, 20 bp, Artificial Sequence
  chemically synthesized
aaggaaaattacagtcaaag

SEQ ID NO: 57271 - DNA, 20 bp, Artificial Sequence
  chemically synthesized
ggggttgttctctggcgggc

SEQ ID NO: 57272 - DNA, 20 bp, Artificial Sequence
  chemically synthesized
gttctctggcgggcaggagt

SEQ ID NO: 57273 - DNA, 20 bp, Artificial Sequence
  chemically synthesized
cagtaggggagcttttgagc

SEQ ID NO: 57274 - DNA, 20 bp, Artificial Sequence
  chemically synthesized
agccaggatgagccaggaga

SEQ ID NO: 57275 - DNA, 20 bp, Artificial Sequence
  chemically synthesized
cattttcacttcttttgtgg

SEQ ID NO: 57276 - DNA, 20 bp, Artificial Sequence
  chemically synthesized
acaagttctgttaatgtcag

SEQ ID NO: 57277 - DNA, 20 bp, Artificial Sequence
  chemically synthesized
agttgggtctattagatata

SEQ ID NO: 57278 - DNA, 20 bp, Artificial Sequence
  chemically synthesized
tatacttgggaactttgatg

SEQ ID NO: 57279 - DNA, 20 bp, Artificial Sequence
  chemically synthesized
tttataattgtatcctcttg

SEQ ID NO: 57280 - DNA, 20 bp, Artificial Sequence
  chemically synthesized
tctttctggtttccagttca

SEQ ID NO: 57281 - DNA, 20 bp, Artificial Sequence
  chemically synthesized
tgtgtgcctttataggtgaa

SEQ ID NO: 57282 - DNA, 20 bp, Artificial Sequence
  chemically synthesized
ttcttgaagatcgcataaag

SEQ ID NO: 57283 - DNA, 20 bp, Artificial Sequence
  chemically synthesized
actcagtgtagttactaagt

SEQ ID NO: 57284 - DNA, 20 bp, Artificial Sequence
  chemically synthesized
aaatatagcaagttatttta

SEQ ID NO: 57285 - DNA, 20 bp, Artificial Sequence
  chemically synthesized
gcaagttattttaaaggatg

SEQ ID NO: 57286 - DNA, 20 bp, Artificial Sequence
  chemically synthesized
ttatcttagatcgcaaataa

SEQ ID NO: 57287 - DNA, 20 bp, Artificial Sequence
  chemically synthesized
gtttttgaaagatttgtttt

SEQ ID NO: 57288 - DNA, 20 bp, Artificial Sequence
  chemically synthesized
ttgttttttgggtttcatac

SEQ ID NO: 57289 - DNA, 20 bp, Artificial Sequence
  chemically synthesized
gtttcatactggagttctgt

SEQ ID NO: 57290 - DNA, 20 bp, Artificial Sequence
  chemically synthesized
cacaccaaaaaatacagtaa

SEQ ID NO: 57291 - DNA, 20 bp, Artificial Sequence
  chemically synthesized
ctatgtacttaattttacca

SEQ ID NO: 57292 - DNA, 20 bp, Artificial Sequence
  chemically synthesized
tgcaagatggtctggtgttg

SEQ ID NO: 57293 - DNA, 20 bp, Artificial Sequence
  chemically synthesized
actttatatattgcttatat

SEQ ID NO: 57294 - DNA, 20 bp, Artificial Sequence
  chemically synthesized
ttttaccctataaaatattc

SEQ ID NO: 57295 - DNA, 20 bp, Artificial Sequence
  chemically synthesized
tattgagatgtttgttgtca

SEQ ID NO: 57296 - DNA, 20 bp, Artificial Sequence
  chemically synthesized
tttctcatctcttctgcttt

SEQ ID NO: 57297 - DNA, 20 bp, Artificial Sequence
  chemically synthesized
actatatctaggactacact

SEQ ID NO: 57298 - DNA, 20 bp, Artificial Sequence
  chemically synthesized
tatctaggactacacttaga

SEQ ID NO: 57299 - DNA, 20 bp, Artificial Sequence
  chemically synthesized
tgttggttgaggaagtagaa

SEQ ID NO: 57300 - DNA, 20 bp, Artificial Sequence
  chemically synthesized
tataattagaggaaacagag

SEQ ID NO: 57301 - DNA, 20 bp, Artificial Sequence
  chemically synthesized
attagaggaaacagaggtga

SEQ ID NO: 57302 - DNA, 20 bp, Artificial Sequence
  chemically synthesized
ggtgagtgaattttgtcctc

SEQ ID NO: 57303 - DNA, 20 bp, Artificial Sequence
  chemically synthesized
tcaaaggagaaaatggttta

SEQ ID NO: 57304 - DNA, 20 bp, Artificial Sequence
  chemically synthesized
ttccaattttaaagtcaaat

SEQ ID NO: 57305 - DNA, 20 bp, Artificial Sequence
  chemically synthesized
actgataatatggtgggcta

SEQ ID NO: 57306 - DNA, 20 bp, Artificial Sequence
  chemically synthesized
ctaaagaatcaggtttttag

SEQ ID NO: 57307 - DNA, 20 bp, Artificial Sequence
  chemically synthesized
tttagttggattgtctggtt

SEQ ID NO: 57308 - DNA, 20 bp, Artificial Sequence
  chemically synthesized
tttcttcatatatttgttcc

SEQ ID NO: 57309 - DNA, 20 bp, Artificial Sequence
  chemically synthesized
tgactttaatttttatgtac

SEQ ID NO: 57310 - DNA, 20 bp, Artificial Sequence
  chemically synthesized
tagcatttagagagactgtc

SEQ ID NO: 57311 - DNA, 20 bp, Artificial Sequence
  chemically synthesized
aatcttcaagatcataaaag

SEQ ID NO: 57312 - DNA, 20 bp, Artificial Sequence
  chemically synthesized
attttcttattcatttataa

SEQ ID NO: 57313 - DNA, 20 bp, Artificial Sequence
  chemically synthesized
tcacactgaggacttggctc

SEQ ID NO: 57314 - DNA, 20 bp, Artificial Sequence
  chemically synthesized
agttttttcatgtataccat

SEQ ID NO: 57315 - DNA, 20 bp, Artificial Sequence
  chemically synthesized
ctaaattactctgaaatttt

SEQ ID NO: 57316 - DNA, 20 bp, Artificial Sequence
  chemically synthesized
ctcaagactgtgtggtttaa

SEQ ID NO: 57317 - DNA, 20 bp, Artificial Sequence
  chemically synthesized
ggctctgcaatccctgtctg

SEQ ID NO: 57318 - DNA, 20 bp, Artificial Sequence
  chemically synthesized
tccctgtctgagggattttc

SEQ ID NO: 57319 - DNA, 20 bp, Artificial Sequence
  chemically synthesized
tgtcagaagcttgtctacta

SEQ ID NO: 57320 - DNA, 20 bp, Artificial Sequence
  chemically synthesized
atgtcaccaaagactattgc

SEQ ID NO: 57321 - DNA, 20 bp, Artificial Sequence
  chemically synthesized
taagatttaacattagcaca

SEQ ID NO: 57322 - DNA, 20 bp, Artificial Sequence
  chemically synthesized
acactgagtataattttttt

SEQ ID NO: 57323 - DNA, 20 bp, Artificial Sequence
  chemically synthesized
tgtaaactacacaaagtaaa

SEQ ID NO: 57324 - DNA, 20 bp, Artificial Sequence
  chemically synthesized
ttatatccatcagaggtaag

SEQ ID NO: 57325 - DNA, 20 bp, Artificial Sequence
  chemically synthesized
attcccagaaccaaatgtca

SEQ ID NO: 57326 - DNA, 20 bp, Artificial Sequence
  chemically synthesized
cagaaccaaatgtcactgaa

SEQ ID NO: 57327 - DNA, 20 bp, Artificial Sequence
  chemically synthesized
tgtcactgaattgagtattc

SEQ ID NO: 57328 - DNA, 20 bp, Artificial Sequence
  chemically synthesized
ctcctcccacaattttattt

SEQ ID NO: 57329 - DNA, 20 bp, Artificial Sequence
  chemically synthesized
taacaagcaataataagcca

SEQ ID NO: 57330 - DNA, 20 bp, Artificial Sequence
  chemically synthesized
gatctaagtgcctgtgctgt

SEQ ID NO: 57331 - DNA, 20 bp, Artificial Sequence
  chemically synthesized
attagaactcacccctcttc

SEQ ID NO: 57332 - DNA, 20 bp, Artificial Sequence
  chemically synthesized
agtgtaagaacaacgctgtt

SEQ ID NO: 57333 - DNA, 20 bp, Artificial Sequence
  chemically synthesized
gattttgatactatagacaa

SEQ ID NO: 57334 - DNA, 20 bp, Artificial Sequence
  chemically synthesized
atatgtgcgacacacatgtg

SEQ ID NO: 57335 - DNA, 20 bp, Artificial Sequence
  chemically synthesized
gctatttccagtactgtatg

SEQ ID NO: 57336 - DNA, 20 bp, Artificial Sequence
  chemically synthesized
aaggtaatgacaaatagagc

SEQ ID NO: 57337 - DNA, 20 bp, Artificial Sequence
  chemically synthesized
acagggcaatttgatcagat

SEQ ID NO: 57338 - DNA, 20 bp, Artificial Sequence
  chemically synthesized
cagatctgagtggaggcaat

SEQ ID NO: 57339 - DNA, 20 bp, Artificial Sequence
  chemically synthesized
tggaggcaataagagtgtgt

SEQ ID NO: 57340 - DNA, 20 bp, Artificial Sequence
  chemically synthesized
ccagaaatgcaggcaattgt

SEQ ID NO: 57341 - DNA, 20 bp, Artificial Sequence
  chemically synthesized
agaaggacacctgactccat

SEQ ID NO: 57342 - DNA, 20 bp, Artificial Sequence
  chemically synthesized
acctgactccataagagtga

SEQ ID NO: 57343 - DNA, 20 bp, Artificial Sequence
  chemically synthesized
tgacatcgttaatgccaaag

SEQ ID NO: 57344 - DNA, 20 bp, Artificial Sequence
  chemically synthesized
gcatggccagaaaatagtac

SEQ ID NO: 57345 - DNA, 20 bp, Artificial Sequence
  chemically synthesized
gtacatgggttggtgcaagg

SEQ ID NO: 57346 - DNA, 20 bp, Artificial Sequence
  chemically synthesized
tggtgcaaggaagagtcaat

SEQ ID NO: 57347 - DNA, 20 bp, Artificial Sequence
  chemically synthesized
gagtcaattcggatgatgtg

SEQ ID NO: 57348 - DNA, 20 bp, Artificial Sequence
  chemically synthesized
atggtgtatatcaggcagaa

SEQ ID NO: 57349 - DNA, 20 bp, Artificial Sequence
  chemically synthesized
tgtatatcaggcagaagggg

SEQ ID NO: 57350 - DNA, 20 bp, Artificial Sequence
  chemically synthesized
taatgttctgcctccagtcc

SEQ ID NO: 57351 - DNA, 20 bp, Artificial Sequence
  chemically synthesized
tccagtcccgggatgccaac

SEQ ID NO: 57352 - DNA, 20 bp, Artificial Sequence
  chemically synthesized
gtcccgggatgccaacgaga

SEQ ID NO: 57353 - DNA, 20 bp, Artificial Sequence
  chemically synthesized
cgagagtgaatgttgtaggt

SEQ ID NO: 57354 - DNA, 20 bp, Artificial Sequence
  chemically synthesized
attgagaagcacatggagac

SEQ ID NO: 57355 - DNA, 20 bp, Artificial Sequence
  chemically synthesized
taagacatttcctcagaaaa

SEQ ID NO: 57356 - DNA, 20 bp, Artificial Sequence
  chemically synthesized
aagggcacaggtaagccaca

SEQ ID NO: 57357 - DNA, 20 bp, Artificial Sequence
  chemically synthesized
gtgagtggaagagaaaccta

SEQ ID NO: 57358 - DNA, 20 bp, Artificial Sequence
  chemically synthesized
gcattaatagaaatctcaag

SEQ ID NO: 57359 - DNA, 20 bp, Artificial Sequence
  chemically synthesized
taacttgtagtgtttataaa

SEQ ID NO: 57360 - DNA, 20 bp, Artificial Sequence
  chemically synthesized
agtgtttataaagagagtag

SEQ ID NO: 57361 - DNA, 20 bp, Artificial Sequence
  chemically synthesized
aaagtaatataacactaata

SEQ ID NO: 57362 - DNA, 20 bp, Artificial Sequence
  chemically synthesized
atttaattgacgtgtaatct

SEQ ID NO: 57363 - DNA, 20 bp, Artificial Sequence
  chemically synthesized
atattgtttatcattatatg

SEQ ID NO: 57364 - DNA, 20 bp, Artificial Sequence
  chemically synthesized
tatagtaaatattaaatgta

SEQ ID NO: 57365 - DNA, 20 bp, Artificial Sequence
  chemically synthesized
aatttaatatattagaacac

SEQ ID NO: 57366 - DNA, 20 bp, Artificial Sequence
  chemically synthesized
aacacaaggatagtttctcc

SEQ ID NO: 57367 - DNA, 20 bp, Artificial Sequence
  chemically synthesized
agctcctctgtattttgcag

SEQ ID NO: 57368 - DNA, 20 bp, Artificial Sequence
  chemically synthesized
gggtcagtcttctgctggaa

SEQ ID NO: 57369 - DNA, 20 bp, Artificial Sequence
  chemically synthesized
gtcacatgtgatggtggggc

SEQ ID NO: 57370 - DNA, 20 bp, Artificial Sequence
  chemically synthesized
ttaacgttggaggccagaaa

SEQ ID NO: 57371 - DNA, 20 bp, Artificial Sequence
  chemically synthesized
tggaggccagaaatggaatt

SEQ ID NO: 57372 - DNA, 20 bp, Artificial Sequence
  chemically synthesized
tcaggatggggctcagaaat

SEQ ID NO: 57373 - DNA, 20 bp, Artificial Sequence
  chemically synthesized
tcttcgttaggcataatcag

SEQ ID NO: 57374 - DNA, 20 bp, Artificial Sequence
  chemically synthesized
ttgactggaggacatagaga

SEQ ID NO: 57375 - DNA, 20 bp, Artificial Sequence
  chemically synthesized
ccctcaagaagcaattaacc

SEQ ID NO: 57376 - DNA, 20 bp, Artificial Sequence
  chemically synthesized
aataattattcccagaaact

SEQ ID NO: 57377 - DNA, 20 bp, Artificial Sequence
  chemically synthesized
ggtgtattagagagaaaggg

SEQ ID NO: 57378 - DNA, 20 bp, Artificial Sequence
  chemically synthesized
ttcctgagaagcatgctgga

SEQ ID NO: 57379 - DNA, 20 bp, Artificial Sequence
  chemically synthesized
aagtaaaaagtggagagatg

SEQ ID NO: 57380 - DNA, 20 bp, Artificial Sequence
  chemically synthesized
aaaagtggagagatgcagag

SEQ ID NO: 57381 - DNA, 20 bp, Artificial Sequence
  chemically synthesized
ctagagacggaactgcagat

SEQ ID NO: 57382 - DNA, 20 bp, Artificial Sequence
  chemically synthesized
tggtgtagatagtaataaag

SEQ ID NO: 57383 - DNA, 20 bp, Artificial Sequence
  chemically synthesized
ctgaaatttgtttgggggac

SEQ ID NO: 57384 - DNA, 20 bp, Artificial Sequence
  chemically synthesized
gtttgggggacttgggtaat

SEQ ID NO: 57385 - DNA, 20 bp, Artificial Sequence
  chemically synthesized
ctaataccaagtataagatc

SEQ ID NO: 57386 - DNA, 20 bp, Artificial Sequence
  chemically synthesized
gttggtctccaagcatgatg

SEQ ID NO: 57387 - DNA, 20 bp, Artificial Sequence
  chemically synthesized
ttttatatttttatataaat

SEQ ID NO: 57388 - DNA, 20 bp, Artificial Sequence
  chemically synthesized
aactttgtattctttcaaat

SEQ ID NO: 57389 - DNA, 20 bp, Artificial Sequence
  chemically synthesized
taacaccctcggaaggaagc

SEQ ID NO: 57390 - DNA, 20 bp, Artificial Sequence
  chemically synthesized
ttagatatgacacaaaaagt

SEQ ID NO: 57391 - DNA, 20 bp, Artificial Sequence
  chemically synthesized
acaaaaaataaatacataaa

SEQ ID NO: 57392 - DNA, 20 bp, Artificial Sequence
  chemically synthesized
tatttcataagtttaatatc

SEQ ID NO: 57393 - DNA, 20 bp, Artificial Sequence
  chemically synthesized
tttaaaaatatgcaaatgat

SEQ ID NO: 57394 - DNA, 20 bp, Artificial Sequence
  chemically synthesized
aaaatatgcaaatgatggga

SEQ ID NO: 57395 - DNA, 20 bp, Artificial Sequence
  chemically synthesized
agacactacttcaaacttac

SEQ ID NO: 57396 - DNA, 20 bp, Artificial Sequence
  chemically synthesized
tgacaaagatataagaaaat

SEQ ID NO: 57397 - DNA, 20 bp, Artificial Sequence
  chemically synthesized
gttcttcaaaaacttaggca

SEQ ID NO: 57398 - DNA, 20 bp, Artificial Sequence
  chemically synthesized
agccaaaaggtggaaacaac

SEQ ID NO: 57399 - DNA, 20 bp, Artificial Sequence
  chemically synthesized
accagaatgtacataaacag

SEQ ID NO: 57400 - DNA, 20 bp, Artificial Sequence
  chemically synthesized
gaatgtacataaacagatga

SEQ ID NO: 57401 - DNA, 20 bp, Artificial Sequence
  chemically synthesized
aatgtgatatatacacacaa

SEQ ID NO: 57402 - DNA, 20 bp, Artificial Sequence
  chemically synthesized
aatattatgtagcaataaaa

SEQ ID NO: 57403 - DNA, 20 bp, Artificial Sequence
  chemically synthesized
gtaagtccttatttaatgtc

SEQ ID NO: 57404 - DNA, 20 bp, Artificial Sequence
  chemically synthesized
actgttagatgagaaaaaaa

SEQ ID NO: 57405 - DNA, 20 bp, Artificial Sequence
  chemically synthesized
ggcttaaagtttcagtttcc

SEQ ID NO: 57406 - DNA, 20 bp, Artificial Sequence
  chemically synthesized
gtttcagtttccaagaatct

SEQ ID NO: 57407 - DNA, 20 bp, Artificial Sequence
  chemically synthesized
accactatacatgttatggc

SEQ ID NO: 57408 - DNA, 20 bp, Artificial Sequence
  chemically synthesized
atggactttgaaaccttatg

SEQ ID NO: 57409 - DNA, 20 bp, Artificial Sequence
  chemically synthesized
cacaaaacaacaaatattgt

SEQ ID NO: 57410 - DNA, 20 bp, Artificial Sequence
  chemically synthesized
tattgtatgaatctatttat

SEQ ID NO: 57411 - DNA, 20 bp, Artificial Sequence
  chemically synthesized
tagaggttactatgggactg

SEQ ID NO: 57412 - DNA, 20 bp, Artificial Sequence
  chemically synthesized
aacaagtatagcatttctgc

SEQ ID NO: 57413 - DNA, 20 bp, Artificial Sequence
  chemically synthesized
agacaaatttttattttgat

SEQ ID NO: 57414 - DNA, 20 bp, Artificial Sequence
  chemically synthesized
aatttttattttgattaggg

SEQ ID NO: 57415 - DNA, 20 bp, Artificial Sequence
  chemically synthesized
ttattttgattagggttgaa

SEQ ID NO: 57416 - DNA, 20 bp, Artificial Sequence
  chemically synthesized
agggttgaattgaatttatt

SEQ ID NO: 57417 - DNA, 20 bp, Artificial Sequence
  chemically synthesized
ttattatgagttgtttctga

SEQ ID NO: 57418 - DNA, 20 bp, Artificial Sequence
  chemically synthesized
tatacagttctattatcatt

SEQ ID NO: 57419 - DNA, 20 bp, Artificial Sequence
  chemically synthesized
tatttttggtttttttgaga

SEQ ID NO: 57420 - DNA, 20 bp, Artificial Sequence
  chemically synthesized
tctctctctgtggtccaggc

SEQ ID NO: 57421 - DNA, 20 bp, Artificial Sequence
  chemically synthesized
ctcactgcaacctccgcctc

SEQ ID NO: 57422 - DNA, 20 bp, Artificial Sequence
  chemically synthesized
gcctcagcctcccatgtagc

SEQ ID NO: 57423 - DNA, 20 bp, Artificial Sequence
  chemically synthesized
gtctggcctctatcatcatt

SEQ ID NO: 57424 - DNA, 20 bp, Artificial Sequence
  chemically synthesized
agtctgtagtggtactggtc

SEQ ID NO: 57425 - DNA, 20 bp, Artificial Sequence
  chemically synthesized
ttccctttcccttcctgctg

SEQ ID NO: 57426 - DNA, 20 bp, Artificial Sequence
  chemically synthesized
agccatttcctaaatccttt

SEQ ID NO: 57427 - DNA, 20 bp, Artificial Sequence
  chemically synthesized
ttcctaaatcctttcagaat

SEQ ID NO: 57428 - DNA, 20 bp, Artificial Sequence
  chemically synthesized
gatatcatgttgcatgcatt

SEQ ID NO: 57429 - DNA, 20 bp, Artificial Sequence
  chemically synthesized
ttttatggagaaatgcaacg

SEQ ID NO: 57430 - DNA, 20 bp, Artificial Sequence
  chemically synthesized
gctgagtgtaaatttcacat

SEQ ID NO: 57431 - DNA, 20 bp, Artificial Sequence
  chemically synthesized
agaatgtccaaaacattgtg

SEQ ID NO: 57432 - DNA, 20 bp, Artificial Sequence
  chemically synthesized
aacaaattaattagattttt

SEQ ID NO: 57433 - DNA, 20 bp, Artificial Sequence
  chemically synthesized
aagctaagcataagccaagc

SEQ ID NO: 57434 - DNA, 20 bp, Artificial Sequence
  chemically synthesized
aaaaatttgtattgatgtga

SEQ ID NO: 57435 - DNA, 20 bp, Artificial Sequence
  chemically synthesized
tcatagataattacttttgc

SEQ ID NO: 57436 - DNA, 20 bp, Artificial Sequence
  chemically synthesized
catgatgctccattgatgac

SEQ ID NO: 57437 - DNA, 20 bp, Artificial Sequence
  chemically synthesized
aattcactattattcacttg

SEQ ID NO: 57438 - DNA, 20 bp, Artificial Sequence
  chemically synthesized
agagactttgtgagatgtca

SEQ ID NO: 57439 - DNA, 20 bp, Artificial Sequence
  chemically synthesized
agtgagttagaaaatattct

SEQ ID NO: 57440 - DNA, 20 bp, Artificial Sequence
  chemically synthesized
gttattggttcaagtctctg

SEQ ID NO: 57441 - DNA, 20 bp, Artificial Sequence
  chemically synthesized
aagtctctgcagagtacagc

SEQ ID NO: 57442 - DNA, 20 bp, Artificial Sequence
  chemically synthesized
gggagtgttgtacatttcag

SEQ ID NO: 57443 - DNA, 20 bp, Artificial Sequence
  chemically synthesized
tctacgtaggaaaagtcaat

SEQ ID NO: 57444 - DNA, 20 bp, Artificial Sequence
  chemically synthesized
atagtatttctgaaaaaatg

SEQ ID NO: 57445 - DNA, 20 bp, Artificial Sequence
  chemically synthesized
tttttcaaaacctttgatct

SEQ ID NO: 57446 - DNA, 20 bp, Artificial Sequence
  chemically synthesized
ccatcattttaagtgtgttt

SEQ ID NO: 57447 - DNA, 20 bp, Artificial Sequence
  chemically synthesized
aagtgtgtttgaggatttct

SEQ ID NO: 57448 - DNA, 20 bp, Artificial Sequence
  chemically synthesized
ggtcttcaccccataaatga

SEQ ID NO: 57449 - DNA, 20 bp, Artificial Sequence
  chemically synthesized
aacacatagagactgcccac

SEQ ID NO: 57450 - DNA, 20 bp, Artificial Sequence
  chemically synthesized
tagagactgcccactaggat

SEQ ID NO: 57451 - DNA, 20 bp, Artificial Sequence
  chemically synthesized
actaggatgtgaatgtggtg

SEQ ID NO: 57452 - DNA, 20 bp, Artificial Sequence
  chemically synthesized
agcgatgggcaagaaatgaa

SEQ ID NO: 57453 - DNA, 20 bp, Artificial Sequence
  chemically synthesized
gcaagaaatgaaaagaatgc

SEQ ID NO: 57454 - DNA, 20 bp, Artificial Sequence
  chemically synthesized
ccaggaagatatctgaaaca

SEQ ID NO: 57455 - DNA, 20 bp, Artificial Sequence
  chemically synthesized
gatatctgaaacactgagtg

SEQ ID NO: 57456 - DNA, 20 bp, Artificial Sequence
  chemically synthesized
ctgagtgaaggatcattgtg

SEQ ID NO: 57457 - DNA, 20 bp, Artificial Sequence
  chemically synthesized
gcactatatccagtcctgta

SEQ ID NO: 57458 - DNA, 20 bp, Artificial Sequence
  chemically synthesized
tctggcaatgtgctcacagt

SEQ ID NO: 57459 - DNA, 20 bp, Artificial Sequence
  chemically synthesized
atgtgctcacagtaggaatg

SEQ ID NO: 57460 - DNA, 20 bp, Artificial Sequence
  chemically synthesized
ggttaaaatggtgtatctca

SEQ ID NO: 57461 - DNA, 20 bp, Artificial Sequence
  chemically synthesized
cggtcaaatgccattgccag

SEQ ID NO: 57462 - DNA, 20 bp, Artificial Sequence
  chemically synthesized
tctgagacacacaactacca

SEQ ID NO: 57463 - DNA, 20 bp, Artificial Sequence
  chemically synthesized
actaccaaaggatatgtcca

SEQ ID NO: 57464 - DNA, 20 bp, Artificial Sequence
  chemically synthesized
atgtccatggagtggaacca

SEQ ID NO: 57465 - DNA, 20 bp, Artificial Sequence
  chemically synthesized
ggaagtcggctgaggccagc

SEQ ID NO: 57466 - DNA, 20 bp, Artificial Sequence
  chemically synthesized
acaatgtacataaaagaaaa

SEQ ID NO: 57467 - DNA, 20 bp, Artificial Sequence
  chemically synthesized
gtatgcaagccttccagccc

SEQ ID NO: 57468 - DNA, 20 bp, Artificial Sequence
  chemically synthesized
caggacataccacacatcct

SEQ ID NO: 57469 - DNA, 20 bp, Artificial Sequence
  chemically synthesized
tagtgaaagactacaaagtt

SEQ ID NO: 57470 - DNA, 20 bp, Artificial Sequence
  chemically synthesized
tttagaaacactaccttagg

SEQ ID NO: 57471 - DNA, 20 bp, Artificial Sequence
  chemically synthesized
tgttttcttctctgggaaag

SEQ ID NO: 57472 - DNA, 20 bp, Artificial Sequence
  chemically synthesized
ctctgggaaaggagagtaaa

SEQ ID NO: 57473 - DNA, 20 bp, Artificial Sequence
  chemically synthesized
gagtaaaatgggttaataga

SEQ ID NO: 57474 - DNA, 20 bp, Artificial Sequence
  chemically synthesized
gcctcttaccctaggcccta

SEQ ID NO: 57475 - DNA, 20 bp, Artificial Sequence
  chemically synthesized
ctactggatttaaagtaagg

SEQ ID NO: 57476 - DNA, 20 bp, Artificial Sequence
  chemically synthesized
tcatatccctaaggaaaata

SEQ ID NO: 57477 - DNA, 20 bp, Artificial Sequence
  chemically synthesized
tgctgcttacagaaatggga

SEQ ID NO: 57478 - DNA, 20 bp, Artificial Sequence
  chemically synthesized
taatctatttctcaaaaata

SEQ ID NO: 57479 - DNA, 20 bp, Artificial Sequence
  chemically synthesized
atttgcaatggcagacggag

SEQ ID NO: 57480 - DNA, 20 bp, Artificial Sequence
  chemically synthesized
cagcactttgagaggctgag

SEQ ID NO: 57481 - DNA, 20 bp, Artificial Sequence
  chemically synthesized
ggcgggtagatcacaaggtc

SEQ ID NO: 57482 - DNA, 20 bp, Artificial Sequence
  chemically synthesized
tactcaagaggctgaggcag

SEQ ID NO: 57483 - DNA, 20 bp, Artificial Sequence
  chemically synthesized
tatatgcctcataggtggta

SEQ ID NO: 57484 - DNA, 20 bp, Artificial Sequence
  chemically synthesized
gtttattatactttaagttc

SEQ ID NO: 57485 - DNA, 20 bp, Artificial Sequence
  chemically synthesized
tcattgttcaactcccacct

SEQ ID NO: 57486 - DNA, 20 bp, Artificial Sequence
  chemically synthesized
ttcaactcccacctatgagt

SEQ ID NO: 57487 - DNA, 20 bp, Artificial Sequence
  chemically synthesized
cgtccttgcgatactttgct

SEQ ID NO: 57488 - DNA, 20 bp, Artificial Sequence
  chemically synthesized
agtctatcattgttggacat

SEQ ID NO: 57489 - DNA, 20 bp, Artificial Sequence
  chemically synthesized
ggttccaagtctttgctatt

SEQ ID NO: 57490 - DNA, 20 bp, Artificial Sequence
  chemically synthesized
gcagcatgatttacattcct

SEQ ID NO: 57491 - DNA, 20 bp, Artificial Sequence
  chemically synthesized
tttgggtatatacccagtaa

SEQ ID NO: 57492 - DNA, 20 bp, Artificial Sequence
  chemically synthesized
tatacccagtaataggatgg

SEQ ID NO: 57493 - DNA, 20 bp, Artificial Sequence
  chemically synthesized
tttctagttctagatccctg

SEQ ID NO: 57494 - DNA, 20 bp, Artificial Sequence
  chemically synthesized
tttttttcttgtaaatttgt

SEQ ID NO: 57495 - DNA, 20 bp, Artificial Sequence
  chemically synthesized
gtttgagttcattgtagatt

SEQ ID NO: 57496 - DNA, 20 bp, Artificial Sequence
  chemically synthesized
ggatattagccctttgtcag

SEQ ID NO: 57497 - DNA, 20 bp, Artificial Sequence
  chemically synthesized
tccttgcccatgcctatgtc

SEQ ID NO: 57498 - DNA, 20 bp, Artificial Sequence
  chemically synthesized
ttttgtataaggtgtaagga

SEQ ID NO: 57499 - DNA, 20 bp, Artificial Sequence
  chemically synthesized
ccagcatcatttattaaata

SEQ ID NO: 57500 - DNA, 20 bp, Artificial Sequence
  chemically synthesized
ttgtcaaagatcagatagtt

SEQ ID NO: 57501 - DNA, 20 bp, Artificial Sequence
  chemically synthesized
ctagctttgttcttttggct

SEQ ID NO: 57502 - DNA, 20 bp, Artificial Sequence
  chemically synthesized
aaagtcattggtagcttgat

SEQ ID NO: 57503 - DNA, 20 bp, Artificial Sequence
  chemically synthesized
gtagcttgatggggatggca

SEQ ID NO: 57504 - DNA, 20 bp, Artificial Sequence
  chemically synthesized
attcttcctatccatgagca

SEQ ID NO: 57505 - DNA, 20 bp, Artificial Sequence
  chemically synthesized
tccttcacatcccttgtaag

SEQ ID NO: 57506 - DNA, 20 bp, Artificial Sequence
  chemically synthesized
ttattctctttgaggcaatt

SEQ ID NO: 57507 - DNA, 20 bp, Artificial Sequence
  chemically synthesized
tctttgaggcaattgtgaat

SEQ ID NO: 57508 - DNA, 20 bp, Artificial Sequence
  chemically synthesized
tttgtctgttattggtgtat

SEQ ID NO: 57509 - DNA, 20 bp, Artificial Sequence
  chemically synthesized
gagattttgggctgagacga

SEQ ID NO: 57510 - DNA, 20 bp, Artificial Sequence
  chemically synthesized
ttcacttcctcttttcctaa

SEQ ID NO: 57511 - DNA, 20 bp, Artificial Sequence
  chemically synthesized
ccagaacttccaacactatg

SEQ ID NO: 57512 - DNA, 20 bp, Artificial Sequence
  chemically synthesized
cttccaacactatgttgaat

SEQ ID NO: 57513 - DNA, 20 bp, Artificial Sequence
  chemically synthesized
gtcttgtgccagttttcaaa

SEQ ID NO: 57514 - DNA, 20 bp, Artificial Sequence
  chemically synthesized
cattcagtatgatattggct

SEQ ID NO: 57515 - DNA, 20 bp, Artificial Sequence
  chemically synthesized
ccatcgatacctaatttatt

SEQ ID NO: 57516 - DNA, 20 bp, Artificial Sequence
  chemically synthesized
gtttttagtatgaagcattg

SEQ ID NO: 57517 - DNA, 20 bp, Artificial Sequence
  chemically synthesized
tctttggttctgtttatatg

SEQ ID NO: 57518 - DNA, 20 bp, Artificial Sequence
  chemically synthesized
ttgaaccagccctgcatccc

SEQ ID NO: 57519 - DNA, 20 bp, Artificial Sequence
  chemically synthesized
atgaagcccacttgatcatg

SEQ ID NO: 57520 - DNA, 20 bp, Artificial Sequence
  chemically synthesized
ataagctttttgatgtgctc

SEQ ID NO: 57521 - DNA, 20 bp, Artificial Sequence
  chemically synthesized
tggtttgccagtattttact

SEQ ID NO: 57522 - DNA, 20 bp, Artificial Sequence
  chemically synthesized
tttttgcatcgatgttcatc

SEQ ID NO: 57523 - DNA, 20 bp, Artificial Sequence
  chemically synthesized
gatgatgctggcctcataaa

SEQ ID NO: 57524 - DNA, 20 bp, Artificial Sequence
  chemically synthesized
gcctcataaaatgagttagg

SEQ ID NO: 57525 - DNA, 20 bp, Artificial Sequence
  chemically synthesized
ttccctctttttctattgat

SEQ ID NO: 57526 - DNA, 20 bp, Artificial Sequence
  chemically synthesized
ttgattggaatagtttcaga

SEQ ID NO: 57527 - DNA, 20 bp, Artificial Sequence
  chemically synthesized
gctcctccttgtacctctgg

SEQ ID NO: 57528 - DNA, 20 bp, Artificial Sequence
  chemically synthesized
acctctggtagaattcggct

SEQ ID NO: 57529 - DNA, 20 bp, Artificial Sequence
  chemically synthesized
accagctaacatcataatga

SEQ ID NO: 57530 - DNA, 20 bp, Artificial Sequence
  chemically synthesized
aaaagacacagactggcaaa

SEQ ID NO: 57531 - DNA, 20 bp, Artificial Sequence
  chemically synthesized
acagactggcaaattggata

SEQ ID NO: 57532 - DNA, 20 bp, Artificial Sequence
  chemically synthesized
cacacataggctcaaaataa

SEQ ID NO: 57533 - DNA, 20 bp, Artificial Sequence
  chemically synthesized
aatggaaaacaaaaaaaagg

SEQ ID NO: 57534 - DNA, 20 bp, Artificial Sequence
  chemically synthesized
aggccattacatactggtaa

SEQ ID NO: 57535 - DNA, 20 bp, Artificial Sequence
  chemically synthesized
caacgagacagaaagttaac

SEQ ID NO: 57536 - DNA, 20 bp, Artificial Sequence
  chemically synthesized
gaaagttaacaaggatatcc

SEQ ID NO: 57537 - DNA, 20 bp, Artificial Sequence
  chemically synthesized
ttaacaaggatatccaggaa

SEQ ID NO: 57538 - DNA, 20 bp, Artificial Sequence
  chemically synthesized
aactctccatcccaaatcaa

SEQ ID NO: 57539 - DNA, 20 bp, Artificial Sequence
  chemically synthesized
agtgcaatcaaactagaact

SEQ ID NO: 57540 - DNA, 20 bp, Artificial Sequence
  chemically synthesized
ggaaactgaacagcctgctc

SEQ ID NO: 57541 - DNA, 20 bp, Artificial Sequence
  chemically synthesized
agcctgctcctgaatgacta

SEQ ID NO: 57542 - DNA, 20 bp, Artificial Sequence
  chemically synthesized
agatgttctttgaaaccaac

SEQ ID NO: 57543 - DNA, 20 bp, Artificial Sequence
  chemically synthesized
agaataaagatacaacaaaa

SEQ ID NO: 57544 - DNA, 20 bp, Artificial Sequence
  chemically synthesized
aaaaacccttaaaaaaatca

SEQ ID NO: 57545 - DNA, 20 bp, Artificial Sequence
  chemically synthesized
atgcaataagaaatgataaa

SEQ ID NO: 57546 - DNA, 20 bp, Artificial Sequence
  chemically synthesized
agacatacaaactaccatca

SEQ ID NO: 57547 - DNA, 20 bp, Artificial Sequence
  chemically synthesized
aactagaaaatctagtagaa

SEQ ID NO: 57548 - DNA, 20 bp, Artificial Sequence
  chemically synthesized
aagactaaaccagggagaaa

SEQ ID NO: 57549 - DNA, 20 bp, Artificial Sequence
  chemically synthesized
atgttttcacattataaaac

SEQ ID NO: 57550 - DNA, 20 bp, Artificial Sequence
  chemically synthesized
aattactagttctaaaaaat

SEQ ID NO: 57551 - DNA, 20 bp, Artificial Sequence
  chemically synthesized
ggatagaagcaagtttaata

SEQ ID NO: 57552 - DNA, 20 bp, Artificial Sequence
  chemically synthesized
aagattaggagatgcaacac

SEQ ID NO: 57553 - DNA, 20 bp, Artificial Sequence
  chemically synthesized
atagatagatagatagatgc

SEQ ID NO: 57554 - DNA, 20 bp, Artificial Sequence
  chemically synthesized
ataaacatagataataatat

SEQ ID NO: 57555 - DNA, 20 bp, Artificial Sequence
  chemically synthesized
attttatatgatggaaatgt

SEQ ID NO: 57556 - DNA, 20 bp, Artificial Sequence
  chemically synthesized
aaatgtttgggtcccatttt

SEQ ID NO: 57557 - DNA, 20 bp, Artificial Sequence
  chemically synthesized
ccattttttgagttacagtt

SEQ ID NO: 57558 - DNA, 20 bp, Artificial Sequence
  chemically synthesized
aatttacccttgctttaagt

SEQ ID NO: 57559 - DNA, 20 bp, Artificial Sequence
  chemically synthesized
atttgaagttatttaactct

SEQ ID NO: 57560 - DNA, 20 bp, Artificial Sequence
  chemically synthesized
taatatatatctcacattgt

SEQ ID NO: 57561 - DNA, 20 bp, Artificial Sequence
  chemically synthesized
ttgatgtttcagagaaagga

SEQ ID NO: 57562 - DNA, 20 bp, Artificial Sequence
  chemically synthesized
tctaggccagagccatgcat

SEQ ID NO: 57563 - DNA, 20 bp, Artificial Sequence
  chemically synthesized
tgaagcgtagttatagaagt

SEQ ID NO: 57564 - DNA, 20 bp, Artificial Sequence
  chemically synthesized
tggggcttcatcaggacatt

SEQ ID NO: 57565 - DNA, 20 bp, Artificial Sequence
  chemically synthesized
ggacattagggatgggagag

SEQ ID NO: 57566 - DNA, 20 bp, Artificial Sequence
  chemically synthesized
tctaagtgaaaaaaaaatac

SEQ ID NO: 57567 - DNA, 20 bp, Artificial Sequence
  chemically synthesized
tgatgacccaaattataggc

SEQ ID NO: 57568 - DNA, 20 bp, Artificial Sequence
  chemically synthesized
ggttccttgtagcattattc

SEQ ID NO: 57569 - DNA, 20 bp, Artificial Sequence
  chemically synthesized
tttctgacagcatattctga

SEQ ID NO: 57570 - DNA, 20 bp, Artificial Sequence
  chemically synthesized
cagcatattctgactgaatc

SEQ ID NO: 57571 - DNA, 20 bp, Artificial Sequence
  chemically synthesized
aataagcataaatttaaaat

SEQ ID NO: 57572 - DNA, 20 bp, Artificial Sequence
  chemically synthesized
agaccaaaattattgtcaac

SEQ ID NO: 57573 - DNA, 20 bp, Artificial Sequence
  chemically synthesized
tattatccatcaaactgaga

SEQ ID NO: 57574 - DNA, 20 bp, Artificial Sequence
  chemically synthesized
aaactgagattgaattgatt

SEQ ID NO: 57575 - DNA, 20 bp, Artificial Sequence
  chemically synthesized
ttagagtatccataaatact

SEQ ID NO: 57576 - DNA, 20 bp, Artificial Sequence
  chemically synthesized
ttcagcatggtgacagacac

SEQ ID NO: 57577 - DNA, 20 bp, Artificial Sequence
  chemically synthesized
cagacacatgaattttgaaa

SEQ ID NO: 57578 - DNA, 20 bp, Artificial Sequence
  chemically synthesized
tatctttgttacatagggaa

SEQ ID NO: 57579 - DNA, 20 bp, Artificial Sequence
  chemically synthesized
gggaagagagttaaaaattt

SEQ ID NO: 57580 - DNA, 20 bp, Artificial Sequence
  chemically synthesized
tgtgcctagactattacctg

SEQ ID NO: 57581 - DNA, 20 bp, Artificial Sequence
  chemically synthesized
ctgagccttgttttaactac

SEQ ID NO: 57582 - DNA, 20 bp, Artificial Sequence
  chemically synthesized
actactagaatataaattca

SEQ ID NO: 57583 - DNA, 20 bp, Artificial Sequence
  chemically synthesized
aaagccaagtctagtattcc

SEQ ID NO: 57584 - DNA, 20 bp, Artificial Sequence
  chemically synthesized
ttagatgattaagttatcgg

SEQ ID NO: 57585 - DNA, 20 bp, Artificial Sequence
  chemically synthesized
gtttacttacttgcattttc

SEQ ID NO: 57586 - DNA, 20 bp, Artificial Sequence
  chemically synthesized
aaggttttcagcttaagagg

SEQ ID NO: 57587 - DNA, 20 bp, Artificial Sequence
  chemically synthesized
ttttcttggtcacatggtaa

SEQ ID NO: 57588 - DNA, 20 bp, Artificial Sequence
  chemically synthesized
tggtcacatggtaaatgggt

SEQ ID NO: 57589 - DNA, 20 bp, Artificial Sequence
  chemically synthesized
gtagatatcccattctcttg

SEQ ID NO: 57590 - DNA, 20 bp, Artificial Sequence
  chemically synthesized
tcttgaaggatactttaatg

SEQ ID NO: 57591 - DNA, 20 bp, Artificial Sequence
  chemically synthesized
aacaaataccatgatattca

SEQ ID NO: 57592 - DNA, 20 bp, Artificial Sequence
  chemically synthesized
tgattttctgatatttttca

SEQ ID NO: 57593 - DNA, 20 bp, Artificial Sequence
  chemically synthesized
ttgacatcagctgaccctga

SEQ ID NO: 57594 - DNA, 20 bp, Artificial Sequence
  chemically synthesized
ccctgactggatgatcttga

SEQ ID NO: 57595 - DNA, 20 bp, Artificial Sequence
  chemically synthesized
tcatattttattacgtaagt

SEQ ID NO: 57596 - DNA, 20 bp, Artificial Sequence
  chemically synthesized
tgctatatggtgggagatat

SEQ ID NO: 57597 - DNA, 20 bp, Artificial Sequence
  chemically synthesized
aaaggtcttgaaaccatagt

SEQ ID NO: 57598 - DNA, 20 bp, Artificial Sequence
  chemically synthesized
gaaaccatagtgagggtaaa

SEQ ID NO: 57599 - DNA, 20 bp, Artificial Sequence
  chemically synthesized
atccttggaaaagaaattaa

SEQ ID NO: 57600 - DNA, 20 bp, Artificial Sequence
  chemically synthesized
aaaagaaattaaaggaatca

SEQ ID NO: 57601 - DNA, 20 bp, Artificial Sequence
  chemically synthesized
agagatggagaaaggacaag

SEQ ID NO: 57602 - DNA, 20 bp, Artificial Sequence
  chemically synthesized
tgatagtgacaggaagaaca

SEQ ID NO: 57603 - DNA, 20 bp, Artificial Sequence
  chemically synthesized
gtgacaggaagaacaaagaa

SEQ ID NO: 57604 - DNA, 20 bp, Artificial Sequence
  chemically synthesized
tctggggactctaaaacttg

SEQ ID NO: 57605 - DNA, 20 bp, Artificial Sequence
  chemically synthesized
aaaataattttccaattttt

SEQ ID NO: 57606 - DNA, 20 bp, Artificial Sequence
  chemically synthesized
acatcaagtaacaatatcat

SEQ ID NO: 57607 - DNA, 20 bp, Artificial Sequence
  chemically synthesized
gggaacatgtaagtattatg

SEQ ID NO: 57608 - DNA, 20 bp, Artificial Sequence
  chemically synthesized
gactcagtttttaaatttct

SEQ ID NO: 57609 - DNA, 20 bp, Artificial Sequence
  chemically synthesized
tttctatggatttcaaggaa

SEQ ID NO: 57610 - DNA, 20 bp, Artificial Sequence
  chemically synthesized
tgatttagtatctgtaaatt

SEQ ID NO: 57611 - DNA, 20 bp, Artificial Sequence
  chemically synthesized
gtatctgtaaattaaggatg

SEQ ID NO: 57612 - DNA, 20 bp, Artificial Sequence
  chemically synthesized
aatatgtaagatacttctaa

SEQ ID NO: 57613 - DNA, 20 bp, Artificial Sequence
  chemically synthesized
tctataggtaaattagtgtc

SEQ ID NO: 57614 - DNA, 20 bp, Artificial Sequence
  chemically synthesized
cctttatcttactatgggac

SEQ ID NO: 57615 - DNA, 20 bp, Artificial Sequence
  chemically synthesized
gagtggaggaaatccaagaa

SEQ ID NO: 57616 - DNA, 20 bp, Artificial Sequence
  chemically synthesized
atttgtaagttagtaaagct

SEQ ID NO: 57617 - DNA, 20 bp, Artificial Sequence
  chemically synthesized
gagttggtgctagtaaagct

SEQ ID NO: 57618 - DNA, 20 bp, Artificial Sequence
  chemically synthesized
gcatgcatcccaagatggct

SEQ ID NO: 57619 - DNA, 20 bp, Artificial Sequence
  chemically synthesized
aagattggacatccctgctg

SEQ ID NO: 57620 - DNA, 20 bp, Artificial Sequence
  chemically synthesized
ctgtagagtttctcagtggt

SEQ ID NO: 57621 - DNA, 20 bp, Artificial Sequence
  chemically synthesized
gtggttggaatcaatatttg

SEQ ID NO: 57622 - DNA, 20 bp, Artificial Sequence
  chemically synthesized
atttttcccctgccacattg

SEQ ID NO: 57623 - DNA, 20 bp, Artificial Sequence
  chemically synthesized
tagccactcttctttccagg

SEQ ID NO: 57624 - DNA, 20 bp, Artificial Sequence
  chemically synthesized
cttctttccaggtggagttt

SEQ ID NO: 57625 - DNA, 20 bp, Artificial Sequence
  chemically synthesized
agagatgatctttatctggg

SEQ ID NO: 57626 - DNA, 20 bp, Artificial Sequence
  chemically synthesized
ttagatacttttctttaagg

SEQ ID NO: 57627 - DNA, 20 bp, Artificial Sequence
  chemically synthesized
cttacattttatgtattttg

SEQ ID NO: 57628 - DNA, 20 bp, Artificial Sequence
  chemically synthesized
gttgaattgtgtttaatcac

SEQ ID NO: 57629 - DNA, 20 bp, Artificial Sequence
  chemically synthesized
taatgcatgcctgatatggt

SEQ ID NO: 57630 - DNA, 20 bp, Artificial Sequence
  chemically synthesized
tggggcctggtgggaagtga

SEQ ID NO: 57631 - DNA, 20 bp, Artificial Sequence
  chemically synthesized
aagtgattggatcataggag

SEQ ID NO: 57632 - DNA, 20 bp, Artificial Sequence
  chemically synthesized
agtcccttttggtacgtata

SEQ ID NO: 57633 - DNA, 20 bp, Artificial Sequence
  chemically synthesized
ccttttggtacgtatagtgg

SEQ ID NO: 57634 - DNA, 20 bp, Artificial Sequence
  chemically synthesized
gtatttccttatagcaagat

SEQ ID NO: 57635 - DNA, 20 bp, Artificial Sequence
  chemically synthesized
cagaaaattggtaccaaaag

SEQ ID NO: 57636 - DNA, 20 bp, Artificial Sequence
  chemically synthesized
atgtggaagcaactttggca

SEQ ID NO: 57637 - DNA, 20 bp, Artificial Sequence
  chemically synthesized
ggataacaggcagaagttgg

SEQ ID NO: 57638 - DNA, 20 bp, Artificial Sequence
  chemically synthesized
aagaagacagggagatgagg

SEQ ID NO: 57639 - DNA, 20 bp, Artificial Sequence
  chemically synthesized
tggaactttctagagacttg

SEQ ID NO: 57640 - DNA, 20 bp, Artificial Sequence
  chemically synthesized
tgaggtggtctcagatggaa

SEQ ID NO: 57641 - DNA, 20 bp, Artificial Sequence
  chemically synthesized
tgcactgtgcctctacctta

SEQ ID NO: 57642 - DNA, 20 bp, Artificial Sequence
  chemically synthesized
tttgcataaatgaagaggag

SEQ ID NO: 57643 - DNA, 20 bp, Artificial Sequence
  chemically synthesized
ctaatagccaaaataaaggg

SEQ ID NO: 57644 - DNA, 20 bp, Artificial Sequence
  chemically synthesized
catcacaggcctggtggcct

SEQ ID NO: 57645 - DNA, 20 bp, Artificial Sequence
  chemically synthesized
ggcctggtggcctaggagta

SEQ ID NO: 57646 - DNA, 20 bp, Artificial Sequence
  chemically synthesized
taggagtactgaatgatttt

SEQ ID NO: 57647 - DNA, 20 bp, Artificial Sequence
  chemically synthesized
cagctaaggccactgcttca

SEQ ID NO: 57648 - DNA, 20 bp, Artificial Sequence
  chemically synthesized
ttccacatggtgataaatct

SEQ ID NO: 57649 - DNA, 20 bp, Artificial Sequence
  chemically synthesized
aagcctccacctagatttca

SEQ ID NO: 57650 - DNA, 20 bp, Artificial Sequence
  chemically synthesized
cagaggatgtgtagaaaagc

SEQ ID NO: 57651 - DNA, 20 bp, Artificial Sequence
  chemically synthesized
atgaggttggaaccccctca

SEQ ID NO: 57652 - DNA, 20 bp, Artificial Sequence
  chemically synthesized
ggccaccgtcctccagaccc

SEQ ID NO: 57653 - DNA, 20 bp, Artificial Sequence
  chemically synthesized
gctaaactgtgcaaagcaat

SEQ ID NO: 57654 - DNA, 20 bp, Artificial Sequence
  chemically synthesized
tgtgtccctgatatgagaca

SEQ ID NO: 57655 - DNA, 20 bp, Artificial Sequence
  chemically synthesized
ggggtcaaaggagattattt

SEQ ID NO: 57656 - DNA, 20 bp, Artificial Sequence
  chemically synthesized
ctatgaagaaatacccgaga

SEQ ID NO: 57657 - DNA, 20 bp, Artificial Sequence
  chemically synthesized
gtgttccttccatgacaggc

SEQ ID NO: 57658 - DNA, 20 bp, Artificial Sequence
  chemically synthesized
cctactattcaagaagaaat

SEQ ID NO: 57659 - DNA, 20 bp, Artificial Sequence
  chemically synthesized
aaggtgtaatgactgccctg

SEQ ID NO: 57660 - DNA, 20 bp, Artificial Sequence
  chemically synthesized
tgctgggttttctactcgtg

SEQ ID NO: 57661 - DNA, 20 bp, Artificial Sequence
  chemically synthesized
tttggtgcatttctctcttt

SEQ ID NO: 57662 - DNA, 20 bp, Artificial Sequence
  chemically synthesized
gcatttctctcttttggaat

SEQ ID NO: 57663 - DNA, 20 bp, Artificial Sequence
  chemically synthesized
ttgaagggacttgccttgtc

SEQ ID NO: 57664 - DNA, 20 bp, Artificial Sequence
  chemically synthesized
agactttggactttggactt

SEQ ID NO: 57665 - DNA, 20 bp, Artificial Sequence
  chemically synthesized
ttggacttttgagttaatgc

SEQ ID NO: 57666 - DNA, 20 bp, Artificial Sequence
  chemically synthesized
acttttgagttaatgctgga

SEQ ID NO: 57667 - DNA, 20 bp, Artificial Sequence
  chemically synthesized
ttggaaggggccagaggtgg

SEQ ID NO: 57668 - DNA, 20 bp, Artificial Sequence
  chemically synthesized
cagaggtggaaggatatggt

SEQ ID NO: 57669 - DNA, 20 bp, Artificial Sequence
  chemically synthesized
aggtaattcaatcatggtgg

SEQ ID NO: 57670 - DNA, 20 bp, Artificial Sequence
  chemically synthesized
atcccccttggtactgtata

SEQ ID NO: 57671 - DNA, 20 bp, Artificial Sequence
  chemically synthesized
actcaatgtgatcaagattt

SEQ ID NO: 57672 - DNA, 20 bp, Artificial Sequence
  chemically synthesized
agctgtctgaaactaagtca

SEQ ID NO: 57673 - DNA, 20 bp, Artificial Sequence
  chemically synthesized
tattcactatttgtctatta

SEQ ID NO: 57674 - DNA, 20 bp, Artificial Sequence
  chemically synthesized
tgaatatctatatttgtttg

SEQ ID NO: 57675 - DNA, 20 bp, Artificial Sequence
  chemically synthesized
aggaataataatcagaacag

SEQ ID NO: 57676 - DNA, 20 bp, Artificial Sequence
  chemically synthesized
agaaggatatgaaagactat

SEQ ID NO: 57677 - DNA, 20 bp, Artificial Sequence
  chemically synthesized
agcaagataaaataggttaa

SEQ ID NO: 57678 - DNA, 20 bp, Artificial Sequence
  chemically synthesized
ggttaatggagtaatatgta

SEQ ID NO: 57679 - DNA, 20 bp, Artificial Sequence
  chemically synthesized
gatgactataattaaagaaa

SEQ ID NO: 57680 - DNA, 20 bp, Artificial Sequence
  chemically synthesized
atagacctttatttatatca

SEQ ID NO: 57681 - DNA, 20 bp, Artificial Sequence
  chemically synthesized
actgaataatattctatcct

SEQ ID NO: 57682 - DNA, 20 bp, Artificial Sequence
  chemically synthesized
actttcaacttttggcaatt

SEQ ID NO: 57683 - DNA, 20 bp, Artificial Sequence
  chemically synthesized
gacataaatttttgactcat

SEQ ID NO: 57684 - DNA, 20 bp, Artificial Sequence
  chemically synthesized
actcatttgggtaaatacat

SEQ ID NO: 57685 - DNA, 20 bp, Artificial Sequence
  chemically synthesized
aatacataggagtgtgattg

SEQ ID NO: 57686 - DNA, 20 bp, Artificial Sequence
  chemically synthesized
catccctacaagcaataagt

SEQ ID NO: 57687 - DNA, 20 bp, Artificial Sequence
  chemically synthesized
cacttcgttgccagtgtttg

SEQ ID NO: 57688 - DNA, 20 bp, Artificial Sequence
  chemically synthesized
tttggtggatgtcagtattt

SEQ ID NO: 57689 - DNA, 20 bp, Artificial Sequence
  chemically synthesized
tttcttaatgacatgtgtta

SEQ ID NO: 57690 - DNA, 20 bp, Artificial Sequence
  chemically synthesized
atcttttgcccactttgcaa

SEQ ID NO: 57691 - DNA, 20 bp, Artificial Sequence
  chemically synthesized
ggattgtttgttttttattg

SEQ ID NO: 57692 - DNA, 20 bp, Artificial Sequence
  chemically synthesized
tttcattctcttaacttacc

SEQ ID NO: 57693 - DNA, 20 bp, Artificial Sequence
  chemically synthesized
ttattttattttattttgtt

SEQ ID NO: 57694 - DNA, 20 bp, Artificial Sequence
  chemically synthesized
tattttgttctgggtatttt

SEQ ID NO: 57695 - DNA, 20 bp, Artificial Sequence
  chemically synthesized
ctgaactccagttaagattt

SEQ ID NO: 57696 - DNA, 20 bp, Artificial Sequence
  chemically synthesized
tactattctgttcaaatatc

SEQ ID NO: 57697 - DNA, 20 bp, Artificial Sequence
  chemically synthesized
tcaaatatcaaggatctaaa

SEQ ID NO: 57698 - DNA, 20 bp, Artificial Sequence
  chemically synthesized
aaatgagtggttatttaatt

SEQ ID NO: 57699 - DNA, 20 bp, Artificial Sequence
  chemically synthesized
attagcttttattttctgcc

SEQ ID NO: 57700 - DNA, 20 bp, Artificial Sequence
  chemically synthesized
tttgtccatccttctgtgtc

SEQ ID NO: 57701 - DNA, 20 bp, Artificial Sequence
  chemically synthesized
tccttctgtgtccggaattg

SEQ ID NO: 57702 - DNA, 20 bp, Artificial Sequence
  chemically synthesized
ttcttggtctcgctgactta

SEQ ID NO: 57703 - DNA, 20 bp, Artificial Sequence
  chemically synthesized
tgaagccgcgaaccctcgtg

SEQ ID NO: 57704 - DNA, 20 bp, Artificial Sequence
  chemically synthesized
tcttaaagatggtgtgttca

SEQ ID NO: 57705 - DNA, 20 bp, Artificial Sequence
  chemically synthesized
tttgttacttcagatgtgtc

SEQ ID NO: 57706 - DNA, 20 bp, Artificial Sequence
  chemically synthesized
ttcacggtcttgctggctcc

SEQ ID NO: 57707 - DNA, 20 bp, Artificial Sequence
  chemically synthesized
tgaagctgcagacccccacg

SEQ ID NO: 57708 - DNA, 20 bp, Artificial Sequence
  chemically synthesized
gctcttaaaggcggagcgta

SEQ ID NO: 57709 - DNA, 20 bp, Artificial Sequence
  chemically synthesized
agttgctcattcctcctgtc

SEQ ID NO: 57710 - DNA, 20 bp, Artificial Sequence
  chemically synthesized
tgggttgttcatcccccatg

SEQ ID NO: 57711 - DNA, 20 bp, Artificial Sequence
  chemically synthesized
tgaagccgcagaccttcgca

SEQ ID NO: 57712 - DNA, 20 bp, Artificial Sequence
  chemically synthesized
ttacagctcataaaggcagc

SEQ ID NO: 57713 - DNA, 20 bp, Artificial Sequence
  chemically synthesized
ataaaggcagcgcggatcca

SEQ ID NO: 57714 - DNA, 20 bp, Artificial Sequence
  chemically synthesized
cagcagtaagatttattgtg

SEQ ID NO: 57715 - DNA, 20 bp, Artificial Sequence
  chemically synthesized
agctggttggtccgttttgg

SEQ ID NO: 57716 - DNA, 20 bp, Artificial Sequence
  chemically synthesized
tacaaaccttgagctagaca

SEQ ID NO: 57717 - DNA, 20 bp, Artificial Sequence
  chemically synthesized
gattggtgcatttacaaacc

SEQ ID NO: 57718 - DNA, 20 bp, Artificial Sequence
  chemically synthesized
atatttcatggtgaggaaca

SEQ ID NO: 57719 - DNA, 20 bp, Artificial Sequence
  chemically synthesized
tgaggaacaaagaatatagt

SEQ ID NO: 57720 - DNA, 20 bp, Artificial Sequence
  chemically synthesized
aaatgtccaacaatgataga

SEQ ID NO: 57721 - DNA, 20 bp, Artificial Sequence
  chemically synthesized
aatgtggcacatacacacca

SEQ ID NO: 57722 - DNA, 20 bp, Artificial Sequence
  chemically synthesized
aatactatgcagccataaaa

SEQ ID NO: 57723 - DNA, 20 bp, Artificial Sequence
  chemically synthesized
ctatgcagccataaaaaagg

SEQ ID NO: 57724 - DNA, 20 bp, Artificial Sequence
  chemically synthesized
ttcatgtcctttgtagggac

SEQ ID NO: 57725 - DNA, 20 bp, Artificial Sequence
  chemically synthesized
gcatgttctcactcataggt

SEQ ID NO: 57726 - DNA, 20 bp, Artificial Sequence
  chemically synthesized
tcacactctggggactgttg

SEQ ID NO: 57727 - DNA, 20 bp, Artificial Sequence
  chemically synthesized
gtggggtggggggagggagg

SEQ ID NO: 57728 - DNA, 20 bp, Artificial Sequence
  chemically synthesized
gatatacctaatgctaaatg

SEQ ID NO: 57729 - DNA, 20 bp, Artificial Sequence
  chemically synthesized
taatgctaaatgatgagtta

SEQ ID NO: 57730 - DNA, 20 bp, Artificial Sequence
  chemically synthesized
taaaataaaataattttaaa

SEQ ID NO: 57731 - DNA, 20 bp, Artificial Sequence
  chemically synthesized
aattttaaaaagagtatagt

SEQ ID NO: 57732 - DNA, 20 bp, Artificial Sequence
  chemically synthesized
aagcctagctaatccagtaa

SEQ ID NO: 57733 - DNA, 20 bp, Artificial Sequence
  chemically synthesized
tagtcctggcatcctttgca

SEQ ID NO: 57734 - DNA, 20 bp, Artificial Sequence
  chemically synthesized
tgcactgaatttcccagtgt

SEQ ID NO: 57735 - DNA, 20 bp, Artificial Sequence
  chemically synthesized
tttgccagaactaaagagaa

SEQ ID NO: 57736 - DNA, 20 bp, Artificial Sequence
  chemically synthesized
catttttagccctacccctc

SEQ ID NO: 57737 - DNA, 20 bp, Artificial Sequence
  chemically synthesized
tgtgtacatctatagcttta

SEQ ID NO: 57738 - DNA, 20 bp, Artificial Sequence
  chemically synthesized
aggacatcgactcctactgc

SEQ ID NO: 57739 - DNA, 20 bp, Artificial Sequence
  chemically synthesized
taatggtaacaaatatccta

SEQ ID NO: 57740 - DNA, 20 bp, Artificial Sequence
  chemically synthesized
ggaacctggtctcacagcag

SEQ ID NO: 57741 - DNA, 20 bp, Artificial Sequence
  chemically synthesized
gattctcatagaggcatgca

SEQ ID NO: 57742 - DNA, 20 bp, Artificial Sequence
  chemically synthesized
tctaggttgcggcttcttat

SEQ ID NO: 57743 - DNA, 20 bp, Artificial Sequence
  chemically synthesized
tgtacagtgaacatctgcct

SEQ ID NO: 57744 - DNA, 20 bp, Artificial Sequence
  chemically synthesized
ctaaaaacacatttctaatc

SEQ ID NO: 57745 - DNA, 20 bp, Artificial Sequence
  chemically synthesized
aatcatgtcctctcacttct

SEQ ID NO: 57746 - DNA, 20 bp, Artificial Sequence
  chemically synthesized
ggaccttagcttttcggtgt

SEQ ID NO: 57747 - DNA, 20 bp, Artificial Sequence
  chemically synthesized
cttttcggtgtaagagttaa

SEQ ID NO: 57748 - DNA, 20 bp, Artificial Sequence
  chemically synthesized
aagagttaaatgaatagcaa

SEQ ID NO: 57749 - DNA, 20 bp, Artificial Sequence
  chemically synthesized
ggactagactttctgatttt

SEQ ID NO: 57750 - DNA, 20 bp, Artificial Sequence
  chemically synthesized
cgtaacgtttctcagtgacg

SEQ ID NO: 57751 - DNA, 20 bp, Artificial Sequence
  chemically synthesized
tagccttgcaggccttacaa

SEQ ID NO: 57752 - DNA, 20 bp, Artificial Sequence
  chemically synthesized
actgattttcctccctttgg

SEQ ID NO: 57753 - DNA, 20 bp, Artificial Sequence
  chemically synthesized
taaaataagcaatgatttct

SEQ ID NO: 57754 - DNA, 20 bp, Artificial Sequence
  chemically synthesized
attcattctgatgcttccct

SEQ ID NO: 57755 - DNA, 20 bp, Artificial Sequence
  chemically synthesized
aaacatattgtcagttgttg

SEQ ID NO: 57756 - DNA, 20 bp, Artificial Sequence
  chemically synthesized
gtcagctctccggcgtatgg

SEQ ID NO: 57757 - DNA, 20 bp, Artificial Sequence
  chemically synthesized
gctctccggcgtatgggagg

SEQ ID NO: 57758 - DNA, 20 bp, Artificial Sequence
  chemically synthesized
tcattataaaactggggcat

SEQ ID NO: 57759 - DNA, 20 bp, Artificial Sequence
  chemically synthesized
ttttttttttttttttgaga

SEQ ID NO: 57760 - DNA, 20 bp, Artificial Sequence
  chemically synthesized
tctctctctgtcgcccaggc

SEQ ID NO: 57761 - DNA, 20 bp, Artificial Sequence
  chemically synthesized
ctcactgcaagctccacctc

SEQ ID NO: 57762 - DNA, 20 bp, Artificial Sequence
  chemically synthesized
cattctcctgtctcagcctc

SEQ ID NO: 57763 - DNA, 20 bp, Artificial Sequence
  chemically synthesized
acaggtgcccgccaccacgc

SEQ ID NO: 57764 - DNA, 20 bp, Artificial Sequence
  chemically synthesized
ttgtgtttttttagtagaga

SEQ ID NO: 57765 - DNA, 20 bp, Artificial Sequence
  chemically synthesized
ggggtttcaccattgctggc

SEQ ID NO: 57766 - DNA, 20 bp, Artificial Sequence
  chemically synthesized
aagacctaatttattgttct

SEQ ID NO: 57767 - DNA, 20 bp, Artificial Sequence
  chemically synthesized
gcctgtatttttgtttccct

SEQ ID NO: 57768 - DNA, 20 bp, Artificial Sequence
  chemically synthesized
agtagacagaggctatgtta

SEQ ID NO: 57769 - DNA, 20 bp, Artificial Sequence
  chemically synthesized
ttaccttcttagatacctaa

SEQ ID NO: 57770 - DNA, 20 bp, Artificial Sequence
  chemically synthesized
tatcttttttcttttaaact

SEQ ID NO: 57771 - DNA, 20 bp, Artificial Sequence
  chemically synthesized
tgcttccagccttgtagcag

SEQ ID NO: 57772 - DNA, 20 bp, Artificial Sequence
  chemically synthesized
acatataaaatctaaaaaat

SEQ ID NO: 57773 - DNA, 20 bp, Artificial Sequence
  chemically synthesized
taaattagacatggtagaag

SEQ ID NO: 57774 - DNA, 20 bp, Artificial Sequence
  chemically synthesized
acagatatcacaacattcct

SEQ ID NO: 57775 - DNA, 20 bp, Artificial Sequence
  chemically synthesized
ggttaattaagtaaacctca

SEQ ID NO: 57776 - DNA, 20 bp, Artificial Sequence
  chemically synthesized
cttaaatatggtcagactga

SEQ ID NO: 57777 - DNA, 20 bp, Artificial Sequence
  chemically synthesized
aaggtcatttgtcatggact

SEQ ID NO: 57778 - DNA, 20 bp, Artificial Sequence
  chemically synthesized
ctcaatatcttttcagagaa

SEQ ID NO: 57779 - DNA, 20 bp, Artificial Sequence
  chemically synthesized
aagagtctaagcattctggt

SEQ ID NO: 57780 - DNA, 20 bp, Artificial Sequence
  chemically synthesized
agcattctggtatgaatctg

SEQ ID NO: 57781 - DNA, 20 bp, Artificial Sequence
  chemically synthesized
ggtcttgacactgtagatga

SEQ ID NO: 57782 - DNA, 20 bp, Artificial Sequence
  chemically synthesized
ggattcattaaaggtgggaa

SEQ ID NO: 57783 - DNA, 20 bp, Artificial Sequence
  chemically synthesized
accattgtgaggctaatgat

SEQ ID NO: 57784 - DNA, 20 bp, Artificial Sequence
  chemically synthesized
gcaactgccaggactgactt

SEQ ID NO: 57785 - DNA, 20 bp, Artificial Sequence
  chemically synthesized
gccaggactgacttaagaat

SEQ ID NO: 57786 - DNA, 20 bp, Artificial Sequence
  chemically synthesized
agaatcaggatgtaggagaa

SEQ ID NO: 57787 - DNA, 20 bp, Artificial Sequence
  chemically synthesized
tcaggatgtaggagaaaagg

SEQ ID NO: 57788 - DNA, 20 bp, Artificial Sequence
  chemically synthesized
gcatcagggcatagtaacta

SEQ ID NO: 57789 - DNA, 20 bp, Artificial Sequence
  chemically synthesized
agggcatagtaactattgaa

SEQ ID NO: 57790 - DNA, 20 bp, Artificial Sequence
  chemically synthesized
aagatcctggtgcaggcaga

SEQ ID NO: 57791 - DNA, 20 bp, Artificial Sequence
  chemically synthesized
tgcaggcagaaagagtgaga

SEQ ID NO: 57792 - DNA, 20 bp, Artificial Sequence
  chemically synthesized
aaaatttcagacagatgatg

SEQ ID NO: 57793 - DNA, 20 bp, Artificial Sequence
  chemically synthesized
gagcccaattttgataattc

SEQ ID NO: 57794 - DNA, 20 bp, Artificial Sequence
  chemically synthesized
ttgataattctggaattagt

SEQ ID NO: 57795 - DNA, 20 bp, Artificial Sequence
  chemically synthesized
tctggaattagtcaggatgg

SEQ ID NO: 57796 - DNA, 20 bp, Artificial Sequence
  chemically synthesized
caggatggaggaataacgta

SEQ ID NO: 57797 - DNA, 20 bp, Artificial Sequence
  chemically synthesized
gactccatgaaggacagacc

SEQ ID NO: 57798 - DNA, 20 bp, Artificial Sequence
  chemically synthesized
gaaataggactgggcaatgc

SEQ ID NO: 57799 - DNA, 20 bp, Artificial Sequence
  chemically synthesized
caggaatccaagctgatctc

SEQ ID NO: 57800 - DNA, 20 bp, Artificial Sequence
  chemically synthesized
atctctcgaatgatccccca

SEQ ID NO: 57801 - DNA, 20 bp, Artificial Sequence
  chemically synthesized
atggcatagattgaggagaa

SEQ ID NO: 57802 - DNA, 20 bp, Artificial Sequence
  chemically synthesized
ggagaaggggatggaaagcc

SEQ ID NO: 57803 - DNA, 20 bp, Artificial Sequence
  chemically synthesized
aaatccagtgagaagaaagg

SEQ ID NO: 57804 - DNA, 20 bp, Artificial Sequence
  chemically synthesized
tctggaactgagaaacatgt

SEQ ID NO: 57805 - DNA, 20 bp, Artificial Sequence
  chemically synthesized
aggaaatgtttcaatttcac

SEQ ID NO: 57806 - DNA, 20 bp, Artificial Sequence
  chemically synthesized
agtcattattttttcactgt

SEQ ID NO: 57807 - DNA, 20 bp, Artificial Sequence
  chemically synthesized
cgttgcttagacattttccc

SEQ ID NO: 57808 - DNA, 20 bp, Artificial Sequence
  chemically synthesized
ttcattaaacattcgaagtg

SEQ ID NO: 57809 - DNA, 20 bp, Artificial Sequence
  chemically synthesized
ttcattggtgataagcagac

SEQ ID NO: 57810 - DNA, 20 bp, Artificial Sequence
  chemically synthesized
gaatatttatgcatgagacc

SEQ ID NO: 57811 - DNA, 20 bp, Artificial Sequence
  chemically synthesized
atttgtgcctttgtgatgta

SEQ ID NO: 57812 - DNA, 20 bp, Artificial Sequence
  chemically synthesized
tttcaaaagcctcatggtag

SEQ ID NO: 57813 - DNA, 20 bp, Artificial Sequence
  chemically synthesized
ctgctttaagttccagacct

SEQ ID NO: 57814 - DNA, 20 bp, Artificial Sequence
  chemically synthesized
gtccatactttcatgtttga

SEQ ID NO: 57815 - DNA, 20 bp, Artificial Sequence
  chemically synthesized
gccctgactccttctcagca

SEQ ID NO: 57816 - DNA, 20 bp, Artificial Sequence
  chemically synthesized
ttttaatacttttttctcca

SEQ ID NO: 57817 - DNA, 20 bp, Artificial Sequence
  chemically synthesized
aagtttcttcgtttcttgca

SEQ ID NO: 57818 - DNA, 20 bp, Artificial Sequence
  chemically synthesized
gcagaggatttttcagtctt

SEQ ID NO: 57819 - DNA, 20 bp, Artificial Sequence
  chemically synthesized
tcttctttcatttctctaaa

SEQ ID NO: 57820 - DNA, 20 bp, Artificial Sequence
  chemically synthesized
actcctgagagctcaaattc

SEQ ID NO: 57821 - DNA, 20 bp, Artificial Sequence
  chemically synthesized
tggctatttaatatattcat

SEQ ID NO: 57822 - DNA, 20 bp, Artificial Sequence
  chemically synthesized
tgagtgtttaatcttaaaat

SEQ ID NO: 57823 - DNA, 20 bp, Artificial Sequence
  chemically synthesized
acaattgcataagacaagtc

SEQ ID NO: 57824 - DNA, 20 bp, Artificial Sequence
  chemically synthesized
agctaagtacatgcatgtct

SEQ ID NO: 57825 - DNA, 20 bp, Artificial Sequence
  chemically synthesized
cccatggtcttctctgtgct

SEQ ID NO: 57826 - DNA, 20 bp, Artificial Sequence
  chemically synthesized
attcctttcaccattaactt

SEQ ID NO: 57827 - DNA, 20 bp, Artificial Sequence
  chemically synthesized
taaaatgattacttcctcag

SEQ ID NO: 57828 - DNA, 20 bp, Artificial Sequence
  chemically synthesized
tttataccacttattataca

SEQ ID NO: 57829 - DNA, 20 bp, Artificial Sequence
  chemically synthesized
accatatctgttttttgctc

SEQ ID NO: 57830 - DNA, 20 bp, Artificial Sequence
  chemically synthesized
tgctcaagaatatgaaaaat

SEQ ID NO: 57831 - DNA, 20 bp, Artificial Sequence
  chemically synthesized
atgaaaaataagggttagca

SEQ ID NO: 57832 - DNA, 20 bp, Artificial Sequence
  chemically synthesized
cacagagatataaagataat

SEQ ID NO: 57833 - DNA, 20 bp, Artificial Sequence
  chemically synthesized
ttctgacctttggccaccaa

SEQ ID NO: 57834 - DNA, 20 bp, Artificial Sequence
  chemically synthesized
tgagtcatcatataccaagt

SEQ ID NO: 57835 - DNA, 20 bp, Artificial Sequence
  chemically synthesized
tataaaacagatgctgctcc

SEQ ID NO: 57836 - DNA, 20 bp, Artificial Sequence
  chemically synthesized
ctccagggatcttgctgacc

SEQ ID NO: 57837 - DNA, 20 bp, Artificial Sequence
  chemically synthesized
cctgactcagacatatcgtc

SEQ ID NO: 57838 - DNA, 20 bp, Artificial Sequence
  chemically synthesized
cagacatatcgtcaaggatc

SEQ ID NO: 57839 - DNA, 20 bp, Artificial Sequence
  chemically synthesized
cacaaaagatttaatattct

SEQ ID NO: 57840 - DNA, 20 bp, Artificial Sequence
  chemically synthesized
actttgggaggccgaggcag

SEQ ID NO: 57841 - DNA, 20 bp, Artificial Sequence
  chemically synthesized
caggtggattggctgagctc

SEQ ID NO: 57842 - DNA, 20 bp, Artificial Sequence
  chemically synthesized
tacttgggagactgaggcag

SEQ ID NO: 57843 - DNA, 20 bp, Artificial Sequence
  chemically synthesized
catagagactatcagccttt

SEQ ID NO: 57844 - DNA, 20 bp, Artificial Sequence
  chemically synthesized
ccagagcaaaatacatgttg

SEQ ID NO: 57845 - DNA, 20 bp, Artificial Sequence
  chemically synthesized
ttaaaatatgttttgaaagg

SEQ ID NO: 57846 - DNA, 20 bp, Artificial Sequence
  chemically synthesized
catgttgtgttatgctatct

SEQ ID NO: 57847 - DNA, 20 bp, Artificial Sequence
  chemically synthesized
tcagtgtatggtatctcagt

SEQ ID NO: 57848 - DNA, 20 bp, Artificial Sequence
  chemically synthesized
aatagagaagacaaatagca

SEQ ID NO: 57849 - DNA, 20 bp, Artificial Sequence
  chemically synthesized
gaagacaaatagcagtgaat

SEQ ID NO: 57850 - DNA, 20 bp, Artificial Sequence
  chemically synthesized
atttgagtctggagaaataa

SEQ ID NO: 57851 - DNA, 20 bp, Artificial Sequence
  chemically synthesized
tatcccctctgagcactgtc

SEQ ID NO: 57852 - DNA, 20 bp, Artificial Sequence
  chemically synthesized
aataaccaggtcattctttc

SEQ ID NO: 57853 - DNA, 20 bp, Artificial Sequence
  chemically synthesized
tttttttttttctgtctttt

SEQ ID NO: 57854 - DNA, 20 bp, Artificial Sequence
  chemically synthesized
attacttgcttactttaaaa

SEQ ID NO: 57855 - DNA, 20 bp, Artificial Sequence
  chemically synthesized
attcctatttgccaaggcag

SEQ ID NO: 57856 - DNA, 20 bp, Artificial Sequence
  chemically synthesized
ggtcttttctggacaccact

SEQ ID NO: 57857 - DNA, 20 bp, Artificial Sequence
  chemically synthesized
gtaagcgaggtcaggccctc

SEQ ID NO: 57858 - DNA, 20 bp, Artificial Sequence
  chemically synthesized
ggtcaggccctcaagagtct

SEQ ID NO: 57859 - DNA, 20 bp, Artificial Sequence
  chemically synthesized
gaactgactgtttaatgatt

SEQ ID NO: 57860 - DNA, 20 bp, Artificial Sequence
  chemically synthesized
tctgaatatgctagttcaga

SEQ ID NO: 57861 - DNA, 20 bp, Artificial Sequence
  chemically synthesized
ggcttaaatttccagtttac

SEQ ID NO: 57862 - DNA, 20 bp, Artificial Sequence
  chemically synthesized
aatggttatgacctaattag

SEQ ID NO: 57863 - DNA, 20 bp, Artificial Sequence
  chemically synthesized
ctataagaaactggtaaaca

SEQ ID NO: 57864 - DNA, 20 bp, Artificial Sequence
  chemically synthesized
aataataagtgcatatatta

SEQ ID NO: 57865 - DNA, 20 bp, Artificial Sequence
  chemically synthesized
ataatatatataatatgtta

SEQ ID NO: 57866 - DNA, 20 bp, Artificial Sequence
  chemically synthesized
atctatatatacattgtaga

SEQ ID NO: 57867 - DNA, 20 bp, Artificial Sequence
  chemically synthesized
tctatcaagctaattagcat

SEQ ID NO: 57868 - DNA, 20 bp, Artificial Sequence
  chemically synthesized
aaatgaacagttaaatttat

SEQ ID NO: 57869 - DNA, 20 bp, Artificial Sequence
  chemically synthesized
aagttgtcctctgaaaattc

SEQ ID NO: 57870 - DNA, 20 bp, Artificial Sequence
  chemically synthesized
tgtaaaggctttctaagaaa

SEQ ID NO: 57871 - DNA, 20 bp, Artificial Sequence
  chemically synthesized
ccaggtccaatttttctcca

SEQ ID NO: 57872 - DNA, 20 bp, Artificial Sequence
  chemically synthesized
actttctcatcaccacacag

SEQ ID NO: 57873 - DNA, 20 bp, Artificial Sequence
  chemically synthesized
tcatcaccacacagtggaat

SEQ ID NO: 57874 - DNA, 20 bp, Artificial Sequence
  chemically synthesized
gtaaagccttcagaaaaagt

SEQ ID NO: 57875 - DNA, 20 bp, Artificial Sequence
  chemically synthesized
atgttattaaagctaaaatt

SEQ ID NO: 57876 - DNA, 20 bp, Artificial Sequence
  chemically synthesized
tctatctttctgttcaagaa

SEQ ID NO: 57877 - DNA, 20 bp, Artificial Sequence
  chemically synthesized
gacctcagaacataggagag

SEQ ID NO: 57878 - DNA, 20 bp, Artificial Sequence
  chemically synthesized
gagatggatattgtacacca

SEQ ID NO: 57879 - DNA, 20 bp, Artificial Sequence
  chemically synthesized
atattgtacaccacagagtc

SEQ ID NO: 57880 - DNA, 20 bp, Artificial Sequence
  chemically synthesized
gtccaggatgactagcagtg

SEQ ID NO: 57881 - DNA, 20 bp, Artificial Sequence
  chemically synthesized
ccaagtccccaaagacaaga

SEQ ID NO: 57882 - DNA, 20 bp, Artificial Sequence
  chemically synthesized
atgagccctcccattgctat

SEQ ID NO: 57883 - DNA, 20 bp, Artificial Sequence
  chemically synthesized
cctcccattgctataaggat

SEQ ID NO: 57884 - DNA, 20 bp, Artificial Sequence
  chemically synthesized
attccaacctcaaccaaatg

SEQ ID NO: 57885 - DNA, 20 bp, Artificial Sequence
  chemically synthesized
caaccaaatgagggatggct

SEQ ID NO: 57886 - DNA, 20 bp, Artificial Sequence
  chemically synthesized
aagatactgtatcttaggag

SEQ ID NO: 57887 - DNA, 20 bp, Artificial Sequence
  chemically synthesized
ttttttttatagaaactcgt

SEQ ID NO: 57888 - DNA, 20 bp, Artificial Sequence
  chemically synthesized
actcgtcaggatattattgc

SEQ ID NO: 57889 - DNA, 20 bp, Artificial Sequence
  chemically synthesized
gttactgggaaaaaagctga

SEQ ID NO: 57890 - DNA, 20 bp, Artificial Sequence
  chemically synthesized
aaaaagctgatggaatacaa

SEQ ID NO: 57891 - DNA, 20 bp, Artificial Sequence
  chemically synthesized
aaaagagtagacatccccac

SEQ ID NO: 57892 - DNA, 20 bp, Artificial Sequence
  chemically synthesized
agatctaaaattgtaatttc

SEQ ID NO: 57893 - DNA, 20 bp, Artificial Sequence
  chemically synthesized
attgtaatttcttggattcc

SEQ ID NO: 57894 - DNA, 20 bp, Artificial Sequence
  chemically synthesized
ttcctagaatttctaaatct

SEQ ID NO: 57895 - DNA, 20 bp, Artificial Sequence
  chemically synthesized
tttctaaatctgtggatttt

SEQ ID NO: 57896 - DNA, 20 bp, Artificial Sequence
  chemically synthesized
gctaccggagctatgtactt

SEQ ID NO: 57897 - DNA, 20 bp, Artificial Sequence
  chemically synthesized
agctatgtacttttggatat

SEQ ID NO: 57898 - DNA, 20 bp, Artificial Sequence
  chemically synthesized
atcagaaggaaccattgtcc

SEQ ID NO: 57899 - DNA, 20 bp, Artificial Sequence
  chemically synthesized
tttggtttgtcatttttcga

SEQ ID NO: 57900 - DNA, 20 bp, Artificial Sequence
  chemically synthesized
tagctcttaatttattattg

SEQ ID NO: 57901 - DNA, 20 bp, Artificial Sequence
  chemically synthesized
agctattaacttatggacct

SEQ ID NO: 57902 - DNA, 20 bp, Artificial Sequence
  chemically synthesized
aaataatagtggtttgaaat

SEQ ID NO: 57903 - DNA, 20 bp, Artificial Sequence
  chemically synthesized
atagtggtttgaaatttgag

SEQ ID NO: 57904 - DNA, 20 bp, Artificial Sequence
  chemically synthesized
ccaagaaaatgcatatttca

SEQ ID NO: 57905 - DNA, 20 bp, Artificial Sequence
  chemically synthesized
gtaattagctccttagctga

SEQ ID NO: 57906 - DNA, 20 bp, Artificial Sequence
  chemically synthesized
ttgattattaaatatatata

SEQ ID NO: 57907 - DNA, 20 bp, Artificial Sequence
  chemically synthesized
aatatatataagggatagaa

SEQ ID NO: 57908 - DNA, 20 bp, Artificial Sequence
  chemically synthesized
ataagggatagaagagagtg

SEQ ID NO: 57909 - DNA, 20 bp, Artificial Sequence
  chemically synthesized
caaaattttgtcttggaaat

SEQ ID NO: 57910 - DNA, 20 bp, Artificial Sequence
  chemically synthesized
agaggaaactgaaagaagtg

SEQ ID NO: 57911 - DNA, 20 bp, Artificial Sequence
  chemically synthesized
tttactatcttttcaactcg

SEQ ID NO: 57912 - DNA, 20 bp, Artificial Sequence
  chemically synthesized
agcaatgaagttctttttag

SEQ ID NO: 57913 - DNA, 20 bp, Artificial Sequence
  chemically synthesized
agtgaagacactgctgactt

SEQ ID NO: 57914 - DNA, 20 bp, Artificial Sequence
  chemically synthesized
actgctgactttggaattga

SEQ ID NO: 57915 - DNA, 20 bp, Artificial Sequence
  chemically synthesized
ttagctcagctacttactag

SEQ ID NO: 57916 - DNA, 20 bp, Artificial Sequence
  chemically synthesized
caagacagtgtgtgtaaaag

SEQ ID NO: 57917 - DNA, 20 bp, Artificial Sequence
  chemically synthesized
taacaacatctcaggaagca

SEQ ID NO: 57918 - DNA, 20 bp, Artificial Sequence
  chemically synthesized
ctaattgactaaagccattt

SEQ ID NO: 57919 - DNA, 20 bp, Artificial Sequence
  chemically synthesized
cacaaattatacatgcacag

SEQ ID NO: 57920 - DNA, 20 bp, Artificial Sequence
  chemically synthesized
actaataagataggaaatta

SEQ ID NO: 57921 - DNA, 20 bp, Artificial Sequence
  chemically synthesized
tttttaaaagtgtgtataca

SEQ ID NO: 57922 - DNA, 20 bp, Artificial Sequence
  chemically synthesized
ctttattcaatattatgttt

SEQ ID NO: 57923 - DNA, 20 bp, Artificial Sequence
  chemically synthesized
ctgtagttgatttttcattt

SEQ ID NO: 57924 - DNA, 20 bp, Artificial Sequence
  chemically synthesized
actccacagttgatagatat

SEQ ID NO: 57925 - DNA, 20 bp, Artificial Sequence
  chemically synthesized
agcctgcatgtgcccagatt

SEQ ID NO: 57926 - DNA, 20 bp, Artificial Sequence
  chemically synthesized
ctttttgcccctacttgact

SEQ ID NO: 57927 - DNA, 20 bp, Artificial Sequence
  chemically synthesized
caagctggcctcaactggaa

SEQ ID NO: 57928 - DNA, 20 bp, Artificial Sequence
  chemically synthesized
gtactttttccttttcccca

SEQ ID NO: 57929 - DNA, 20 bp, Artificial Sequence
  chemically synthesized
taaagcctaatcctgccatc

SEQ ID NO: 57930 - DNA, 20 bp, Artificial Sequence
  chemically synthesized
ctgccatccagaatgagcaa

SEQ ID NO: 57931 - DNA, 20 bp, Artificial Sequence
  chemically synthesized
aaagggaagggaaaaaggag

SEQ ID NO: 57932 - DNA, 20 bp, Artificial Sequence
  chemically synthesized
tgtttctcccacttgctctg

SEQ ID NO: 57933 - DNA, 20 bp, Artificial Sequence
  chemically synthesized
cctaatctcgttagtacctt

SEQ ID NO: 57934 - DNA, 20 bp, Artificial Sequence
  chemically synthesized
attagttttcaagataggac

SEQ ID NO: 57935 - DNA, 20 bp, Artificial Sequence
  chemically synthesized
gataggacttgagttcctcg

SEQ ID NO: 57936 - DNA, 20 bp, Artificial Sequence
  chemically synthesized
agggagaacgatttgagctc

SEQ ID NO: 57937 - DNA, 20 bp, Artificial Sequence
  chemically synthesized
caaaaaattttaaaaagtag

SEQ ID NO: 57938 - DNA, 20 bp, Artificial Sequence
  chemically synthesized
tacttgggaggctgaggtgg

SEQ ID NO: 57939 - DNA, 20 bp, Artificial Sequence
  chemically synthesized
attcaggttgtcagaagtaa

SEQ ID NO: 57940 - DNA, 20 bp, Artificial Sequence
  chemically synthesized
tcaaattacaaagaaggaca

SEQ ID NO: 57941 - DNA, 20 bp, Artificial Sequence
  chemically synthesized
aggtggaaagaggagcaagg

SEQ ID NO: 57942 - DNA, 20 bp, Artificial Sequence
  chemically synthesized
tacatagctaaacacatgtc

SEQ ID NO: 57943 - DNA, 20 bp, Artificial Sequence
  chemically synthesized
tgttcttacattagtttgtt

SEQ ID NO: 57944 - DNA, 20 bp, Artificial Sequence
  chemically synthesized
gtgtgcatgtgtctttgtga

SEQ ID NO: 57945 - DNA, 20 bp, Artificial Sequence
  chemically synthesized
tttaggtatatactcaataa

SEQ ID NO: 57946 - DNA, 20 bp, Artificial Sequence
  chemically synthesized
tatactcaataataggattg

SEQ ID NO: 57947 - DNA, 20 bp, Artificial Sequence
  chemically synthesized
tttctgtttttaggtcttta

SEQ ID NO: 57948 - DNA, 20 bp, Artificial Sequence
  chemically synthesized
atgtgagatagtatctcatt

SEQ ID NO: 57949 - DNA, 20 bp, Artificial Sequence
  chemically synthesized
ggccacatgtatgtcttctt

SEQ ID NO: 57950 - DNA, 20 bp, Artificial Sequence
  chemically synthesized
atttaagttccttatagatt

SEQ ID NO: 57951 - DNA, 20 bp, Artificial Sequence
  chemically synthesized
ttctgaatattaggcctttg

SEQ ID NO: 57952 - DNA, 20 bp, Artificial Sequence
  chemically synthesized
tctttgcccctgcttatgtc

SEQ ID NO: 57953 - DNA, 20 bp, Artificial Sequence
  chemically synthesized
ctttcaagcatttttatagt

SEQ ID NO: 57954 - DNA, 20 bp, Artificial Sequence
  chemically synthesized
atttaagtctctaatccatc

SEQ ID NO: 57955 - DNA, 20 bp, Artificial Sequence
  chemically synthesized
tttgtgtatatgatatagaa

SEQ ID NO: 57956 - DNA, 20 bp, Artificial Sequence
  chemically synthesized
agttatcccaacaccacttg

SEQ ID NO: 57957 - DNA, 20 bp, Artificial Sequence
  chemically synthesized
tcccaacaccacttgttgaa

SEQ ID NO: 57958 - DNA, 20 bp, Artificial Sequence
  chemically synthesized
tcatttttcaattcccacct

SEQ ID NO: 57959 - DNA, 20 bp, Artificial Sequence
  chemically synthesized
caattcccacctgtgagtat

SEQ ID NO: 57960 - DNA, 20 bp, Artificial Sequence
  chemically synthesized
tgtatttttctagttctgtg

SEQ ID NO: 57961 - DNA, 20 bp, Artificial Sequence
  chemically synthesized
aatgtcattggtagtttgat

SEQ ID NO: 57962 - DNA, 20 bp, Artificial Sequence
  chemically synthesized
ctttttgtggcaacggtaaa

SEQ ID NO: 57963 - DNA, 20 bp, Artificial Sequence
  chemically synthesized
cttggctattgttgatgtat

SEQ ID NO: 57964 - DNA, 20 bp, Artificial Sequence
  chemically synthesized
gttttctagatacagaaaac

SEQ ID NO: 57965 - DNA, 20 bp, Artificial Sequence
  chemically synthesized
ttgactttctctcttcctat

SEQ ID NO: 57966 - DNA, 20 bp, Artificial Sequence
  chemically synthesized
ccaggactgccagtactata

SEQ ID NO: 57967 - DNA, 20 bp, Artificial Sequence
  chemically synthesized
gtcttgtgccagttttcaag

SEQ ID NO: 57968 - DNA, 20 bp, Artificial Sequence
  chemically synthesized
cattctgtatgatgttggct

SEQ ID NO: 57969 - DNA, 20 bp, Artificial Sequence
  chemically synthesized
ggttttaacatgaagtgaag

SEQ ID NO: 57970 - DNA, 20 bp, Artificial Sequence
  chemically synthesized
tttttagtgctgtatatatg

SEQ ID NO: 57971 - DNA, 20 bp, Artificial Sequence
  chemically synthesized
ctgaaccaatcttgcttctc

SEQ ID NO: 57972 - DNA, 20 bp, Artificial Sequence
  chemically synthesized
ataaagcctacttgattgag

SEQ ID NO: 57973 - DNA, 20 bp, Artificial Sequence
  chemically synthesized
attagctttgtgatgtgttg

SEQ ID NO: 57974 - DNA, 20 bp, Artificial Sequence
  chemically synthesized
gtatttttgcatcaatgttc

SEQ ID NO: 57975 - DNA, 20 bp, Artificial Sequence
  chemically synthesized
tgtctatcaggttttggtat

SEQ ID NO: 57976 - DNA, 20 bp, Artificial Sequence
  chemically synthesized
cctcataaaatgagctgagg

SEQ ID NO: 57977 - DNA, 20 bp, Artificial Sequence
  chemically synthesized
atccctccccctcaattttt

SEQ ID NO: 57978 - DNA, 20 bp, Artificial Sequence
  chemically synthesized
ttttttggagtagcttcagt

SEQ ID NO: 57979 - DNA, 20 bp, Artificial Sequence
  chemically synthesized
actcttctttgtgcatctga

SEQ ID NO: 57980 - DNA, 20 bp, Artificial Sequence
  chemically synthesized
gcatctgatagaatttggtt

SEQ ID NO: 57981 - DNA, 20 bp, Artificial Sequence
  chemically synthesized
gtttgataggctatttatta

SEQ ID NO: 57982 - DNA, 20 bp, Artificial Sequence
  chemically synthesized
aatcattttcagagctcatc

SEQ ID NO: 57983 - DNA, 20 bp, Artificial Sequence
  chemically synthesized
caatcactctcagaccacag

SEQ ID NO: 57984 - DNA, 20 bp, Artificial Sequence
  chemically synthesized
aaaaatagatttcaagacta

SEQ ID NO: 57985 - DNA, 20 bp, Artificial Sequence
  chemically synthesized
ggaaattaaacaacctgctc

SEQ ID NO: 57986 - DNA, 20 bp, Artificial Sequence
  chemically synthesized
attaaacaacctgctcctga

SEQ ID NO: 57987 - DNA, 20 bp, Artificial Sequence
  chemically synthesized
aacctgctcctgaatgaatt

SEQ ID NO: 57988 - DNA, 20 bp, Artificial Sequence
  chemically synthesized
agaacaaagatacaatatac

SEQ ID NO: 57989 - DNA, 20 bp, Artificial Sequence
  chemically synthesized
aacaagatcaaagctaactg

SEQ ID NO: 57990 - DNA, 20 bp, Artificial Sequence
  chemically synthesized
aaataccattcaaaagatta

SEQ ID NO: 57991 - DNA, 20 bp, Artificial Sequence
  chemically synthesized
gcacagttagaaatgaaaaa

SEQ ID NO: 57992 - DNA, 20 bp, Artificial Sequence
  chemically synthesized
aactagaaaatctaaaagaa

SEQ ID NO: 57993 - DNA, 20 bp, Artificial Sequence
  chemically synthesized
gtactttatttgagggctct

SEQ ID NO: 57994 - DNA, 20 bp, Artificial Sequence
  chemically synthesized
ttatttgagggctctttgag

SEQ ID NO: 57995 - DNA, 20 bp, Artificial Sequence
  chemically synthesized
caactctatgtccccctccc

SEQ ID NO: 57996 - DNA, 20 bp, Artificial Sequence
  chemically synthesized
tggttatatctgtgttatat

SEQ ID NO: 57997 - DNA, 20 bp, Artificial Sequence
  chemically synthesized
tatctgaatatatggctcta

SEQ ID NO: 57998 - DNA, 20 bp, Artificial Sequence
  chemically synthesized
gctagtccaaaatccaagct

SEQ ID NO: 57999 - DNA, 20 bp, Artificial Sequence
  chemically synthesized
gaataagacaggtgagacct

SEQ ID NO: 58000 - DNA, 20 bp, Artificial Sequence
  chemically synthesized
aagacaggtgagacctttgg

SEQ ID NO: 58001 - DNA, 20 bp, Artificial Sequence
  chemically synthesized
tgagaagatgtgaagaaccc

SEQ ID NO: 58002 - DNA, 20 bp, Artificial Sequence
  chemically synthesized
aacagccccgaggcactgca

SEQ ID NO: 58003 - DNA, 20 bp, Artificial Sequence
  chemically synthesized
aggggttcagacctgtgttg

SEQ ID NO: 58004 - DNA, 20 bp, Artificial Sequence
  chemically synthesized
tgtttgtttttcctcagaga

SEQ ID NO: 58005 - DNA, 20 bp, Artificial Sequence
  chemically synthesized
gatcctatcacttcagcctc

SEQ ID NO: 58006 - DNA, 20 bp, Artificial Sequence
  chemically synthesized
atatatggagagactgaggt

SEQ ID NO: 58007 - DNA, 20 bp, Artificial Sequence
  chemically synthesized
gtcacaactaatctagttga

SEQ ID NO: 58008 - DNA, 20 bp, Artificial Sequence
  chemically synthesized
aaagacttgataatggctct

SEQ ID NO: 58009 - DNA, 20 bp, Artificial Sequence
  chemically synthesized
atgtgtgagatcagttttaa

SEQ ID NO: 58010 - DNA, 20 bp, Artificial Sequence
  chemically synthesized
tattattatacttcaagttt

SEQ ID NO: 58011 - DNA, 20 bp, Artificial Sequence
  chemically synthesized
ccccaccccataacagtccc

SEQ ID NO: 58012 - DNA, 20 bp, Artificial Sequence
  chemically synthesized
tcattgttcaattcccacct

SEQ ID NO: 58013 - DNA, 20 bp, Artificial Sequence
  chemically synthesized
tctccttgtgatagtttgct

SEQ ID NO: 58014 - DNA, 20 bp, Artificial Sequence
  chemically synthesized
agtctatcgttgttggacat

SEQ ID NO: 58015 - DNA, 20 bp, Artificial Sequence
  chemically synthesized
ggttccaagtctttgctatt

SEQ ID NO: 58016 - DNA, 20 bp, Artificial Sequence
  chemically synthesized
gcagcatgatttataatcct

SEQ ID NO: 58017 - DNA, 20 bp, Artificial Sequence
  chemically synthesized
tttgggtatgtacccagtaa

SEQ ID NO: 58018 - DNA, 20 bp, Artificial Sequence
  chemically synthesized
tgtacccagtaatgggatgg

SEQ ID NO: 58019 - DNA, 20 bp, Artificial Sequence
  chemically synthesized
tttctagttctagattcctg

SEQ ID NO: 58020 - DNA, 20 bp, Artificial Sequence
  chemically synthesized
atcctttgcccactttttga

SEQ ID NO: 58021 - DNA, 20 bp, Artificial Sequence
  chemically synthesized
gttttttcttgtaaatttgt

SEQ ID NO: 58022 - DNA, 20 bp, Artificial Sequence
  chemically synthesized
gtttgagttcattgtagatt

SEQ ID NO: 58023 - DNA, 20 bp, Artificial Sequence
  chemically synthesized
ggatattagccctttgtcag

SEQ ID NO: 58024 - DNA, 20 bp, Artificial Sequence
  chemically synthesized
tccttgcccatgcctatgtc

SEQ ID NO: 58025 - DNA, 20 bp, Artificial Sequence
  chemically synthesized
gtattgcctaggtttttttc

SEQ ID NO: 58026 - DNA, 20 bp, Artificial Sequence
  chemically synthesized
atgtaagtctttaatccatc

SEQ ID NO: 58027 - DNA, 20 bp, Artificial Sequence
  chemically synthesized
ttttgtataaggtgtaagga

SEQ ID NO: 58028 - DNA, 20 bp, Artificial Sequence
  chemically synthesized
ccagcaccatttattaaata

SEQ ID NO: 58029 - DNA, 20 bp, Artificial Sequence
  chemically synthesized
ccagctttgttcttttggct

SEQ ID NO: 58030 - DNA, 20 bp, Artificial Sequence
  chemically synthesized
aaagtcattggtagcttgat

SEQ ID NO: 58031 - DNA, 20 bp, Artificial Sequence
  chemically synthesized
gtagcttgatggggatggca

SEQ ID NO: 58032 - DNA, 20 bp, Artificial Sequence
  chemically synthesized
attcttcctacccatgagca

SEQ ID NO: 58033 - DNA, 20 bp, Artificial Sequence
  chemically synthesized
tccttcacatcccttgtaag

SEQ ID NO: 58034 - DNA, 20 bp, Artificial Sequence
  chemically synthesized
ttattctctttgaagcaatt

SEQ ID NO: 58035 - DNA, 20 bp, Artificial Sequence
  chemically synthesized
tctttgaagcaattgtgaat

SEQ ID NO: 58036 - DNA, 20 bp, Artificial Sequence
  chemically synthesized
tttgtctgttattggtgcat

SEQ ID NO: 58037 - DNA, 20 bp, Artificial Sequence
  chemically synthesized
gagattttgggctgagacaa

SEQ ID NO: 58038 - DNA, 20 bp, Artificial Sequence
  chemically synthesized
ttcacttcctcttttcctaa

SEQ ID NO: 58039 - DNA, 20 bp, Artificial Sequence
  chemically synthesized
ccagaacttacaacactatg

SEQ ID NO: 58040 - DNA, 20 bp, Artificial Sequence
  chemically synthesized
cttacaacactatgttgaat

SEQ ID NO: 58041 - DNA, 20 bp, Artificial Sequence
  chemically synthesized
gccttgtgccagttttcaaa

SEQ ID NO: 58042 - DNA, 20 bp, Artificial Sequence
  chemically synthesized
cactcagtatgatattggct

SEQ ID NO: 58043 - DNA, 20 bp, Artificial Sequence
  chemically synthesized
ccatcaatacctaatttatt

SEQ ID NO: 58044 - DNA, 20 bp, Artificial Sequence
  chemically synthesized
gtttttagcatgaagcgttg

SEQ ID NO: 58045 - DNA, 20 bp, Artificial Sequence
  chemically synthesized
tctttggttctgtttatatg

SEQ ID NO: 58046 - DNA, 20 bp, Artificial Sequence
  chemically synthesized
ttgaaccagccttgcatggc

SEQ ID NO: 58047 - DNA, 20 bp, Artificial Sequence
  chemically synthesized
atgaagcccacttgatcatg

SEQ ID NO: 58048 - DNA, 20 bp, Artificial Sequence
  chemically synthesized
cagtttgccagtattttatt

SEQ ID NO: 58049 - DNA, 20 bp, Artificial Sequence
  chemically synthesized
tttttgcatcaatgttcatc

SEQ ID NO: 58050 - DNA, 20 bp, Artificial Sequence
  chemically synthesized
tctctgtcaggctttggtat

SEQ ID NO: 58051 - DNA, 20 bp, Artificial Sequence
  chemically synthesized
gatgatgctggcctcataaa

SEQ ID NO: 58052 - DNA, 20 bp, Artificial Sequence
  chemically synthesized
gcctcataaaatgagttagg

SEQ ID NO: 58053 - DNA, 20 bp, Artificial Sequence
  chemically synthesized
ttccctctttttctattgat

SEQ ID NO: 58054 - DNA, 20 bp, Artificial Sequence
  chemically synthesized
ttgattggaatagtttcaga

SEQ ID NO: 58055 - DNA, 20 bp, Artificial Sequence
  chemically synthesized
gctcctccttgtacctctgg

SEQ ID NO: 58056 - DNA, 20 bp, Artificial Sequence
  chemically synthesized
acctctggtagaattcggct

SEQ ID NO: 58057 - DNA, 20 bp, Artificial Sequence
  chemically synthesized
tcttcctggtttagtcttgg

SEQ ID NO: 58058 - DNA, 20 bp, Artificial Sequence
  chemically synthesized
ttggcagagtgtatgtgtcg

SEQ ID NO: 58059 - DNA, 20 bp, Artificial Sequence
  chemically synthesized
gacggtagtttgtatttctg

SEQ ID NO: 58060 - DNA, 20 bp, Artificial Sequence
  chemically synthesized
tcttttcaaaaaaacagctt

SEQ ID NO: 58061 - DNA, 20 bp, Artificial Sequence
  chemically synthesized
tggattcattgatttttttg

SEQ ID NO: 58062 - DNA, 20 bp, Artificial Sequence
  chemically synthesized
ttcttgtcttctgttagctt

SEQ ID NO: 58063 - DNA, 20 bp, Artificial Sequence
  chemically synthesized
tagttttttaattgtgatgt

SEQ ID NO: 58064 - DNA, 20 bp, Artificial Sequence
  chemically synthesized
atttccctctacacactgct

SEQ ID NO: 58065 - DNA, 20 bp, Artificial Sequence
  chemically synthesized
gctgttcagtttccatgtag

SEQ ID NO: 58066 - DNA, 20 bp, Artificial Sequence
  chemically synthesized
ttccatgtagctgagtggtt

SEQ ID NO: 58067 - DNA, 20 bp, Artificial Sequence
  chemically synthesized
atgtagctgagtggttttga

SEQ ID NO: 58068 - DNA, 20 bp, Artificial Sequence
  chemically synthesized
tttgagtgagtttcttaatc

SEQ ID NO: 58069 - DNA, 20 bp, Artificial Sequence
  chemically synthesized
tccaactatgtggtcagttt

SEQ ID NO: 58070 - DNA, 20 bp, Artificial Sequence
  chemically synthesized
aggtgtggtgtggtgctgaa

SEQ ID NO: 58071 - DNA, 20 bp, Artificial Sequence
  chemically synthesized
gaatgtatattctgttgatt

SEQ ID NO: 58072 - DNA, 20 bp, Artificial Sequence
  chemically synthesized
tattctgttgatttggggtg

SEQ ID NO: 58073 - DNA, 20 bp, Artificial Sequence
  chemically synthesized
taggtctgcttggtgcagag

SEQ ID NO: 58074 - DNA, 20 bp, Artificial Sequence
  chemically synthesized
tgcagagctgagtccaattc

SEQ ID NO: 58075 - DNA, 20 bp, Artificial Sequence
  chemically synthesized
gatctgtctaatgttgacag

SEQ ID NO: 58076 - DNA, 20 bp, Artificial Sequence
  chemically synthesized
ggtcactcaggacttgtttt

SEQ ID NO: 58077 - DNA, 20 bp, Artificial Sequence
  chemically synthesized
tcaggacttgttttatgaat

SEQ ID NO: 58078 - DNA, 20 bp, Artificial Sequence
  chemically synthesized
tgaatctgggtgctcctgta

SEQ ID NO: 58079 - DNA, 20 bp, Artificial Sequence
  chemically synthesized
agtatagttagttcttcttc

SEQ ID NO: 58080 - DNA, 20 bp, Artificial Sequence
  chemically synthesized
aaatctgttttatcagagac

SEQ ID NO: 58081 - DNA, 20 bp, Artificial Sequence
  chemically synthesized
tgtgtgtctctgcacgtgag

SEQ ID NO: 58082 - DNA, 20 bp, Artificial Sequence
  chemically synthesized
ctgcacgtgagatgggtttc

SEQ ID NO: 58083 - DNA, 20 bp, Artificial Sequence
  chemically synthesized
ttcctgaatacagaacacag

SEQ ID NO: 58084 - DNA, 20 bp, Artificial Sequence
  chemically synthesized
ttagcctatttacatttaag

SEQ ID NO: 58085 - DNA, 20 bp, Artificial Sequence
  chemically synthesized
taaggtgagtattgttatgt

SEQ ID NO: 58086 - DNA, 20 bp, Artificial Sequence
  chemically synthesized
tcagcatttgcttgtctgta

SEQ ID NO: 58087 - DNA, 20 bp, Artificial Sequence
  chemically synthesized
acttatgaagcttagtttgg

SEQ ID NO: 58088 - DNA, 20 bp, Artificial Sequence
  chemically synthesized
gtttggctggatatgaaatt

SEQ ID NO: 58089 - DNA, 20 bp, Artificial Sequence
  chemically synthesized
aattcttttctttaacaatg

SEQ ID NO: 58090 - DNA, 20 bp, Artificial Sequence
  chemically synthesized
ccccactttcttctggcttg

SEQ ID NO: 58091 - DNA, 20 bp, Artificial Sequence
  chemically synthesized
agtctgatgggcttcccttt

SEQ ID NO: 58092 - DNA, 20 bp, Artificial Sequence
  chemically synthesized
tttccttcatttcaactttg

SEQ ID NO: 58093 - DNA, 20 bp, Artificial Sequence
  chemically synthesized
aatctgacagttatgtgtct

SEQ ID NO: 58094 - DNA, 20 bp, Artificial Sequence
  chemically synthesized
tcttggagttgcttttctct

SEQ ID NO: 58095 - DNA, 20 bp, Artificial Sequence
  chemically synthesized
tgtggcgttctctgtatttc

SEQ ID NO: 58096 - DNA, 20 bp, Artificial Sequence
  chemically synthesized
gttctctgtatttcctgaat

SEQ ID NO: 58097 - DNA, 20 bp, Artificial Sequence
  chemically synthesized
gctagattggggaagttctc

SEQ ID NO: 58098 - DNA, 20 bp, Artificial Sequence
  chemically synthesized
ttctcctggataatatcctg

SEQ ID NO: 58099 - DNA, 20 bp, Artificial Sequence
  chemically synthesized
tcgaacttcctcctttagct

SEQ ID NO: 58100 - DNA, 20 bp, Artificial Sequence
  chemically synthesized
aggagaggcactctcatttt

SEQ ID NO: 58101 - DNA, 20 bp, Artificial Sequence
  chemically synthesized
ttgatgatggcgatgtacag

SEQ ID NO: 58102 - DNA, 20 bp, Artificial Sequence
  chemically synthesized
tgtacagatgggtttttggt

SEQ ID NO: 58103 - DNA, 20 bp, Artificial Sequence
  chemically synthesized
accctcagctgcaggtctgt

SEQ ID NO: 58104 - DNA, 20 bp, Artificial Sequence
  chemically synthesized
ccactccagaagctgttttc

SEQ ID NO: 58105 - DNA, 20 bp, Artificial Sequence
  chemically synthesized
acagcggtggctgcagaaca

SEQ ID NO: 58106 - DNA, 20 bp, Artificial Sequence
  chemically synthesized
ctctggaagttttgtcttag

SEQ ID NO: 58107 - DNA, 20 bp, Artificial Sequence
  chemically synthesized
gtgtcagtctgcccctactg

SEQ ID NO: 58108 - DNA, 20 bp, Artificial Sequence
  chemically synthesized
gcctcccagttaggctactc

SEQ ID NO: 58109 - DNA, 20 bp, Artificial Sequence
  chemically synthesized
aggaccctctgagccaggca

SEQ ID NO: 58110 - DNA, 20 bp, Artificial Sequence
  chemically synthesized
gaagagcgcagtattagggc

SEQ ID NO: 58111 - DNA, 20 bp, Artificial Sequence
  chemically synthesized
ccttttctttgactaggaaa

SEQ ID NO: 58112 - DNA, 20 bp, Artificial Sequence
  chemically synthesized
tccctgaccccttgtgcttc

SEQ ID NO: 58113 - DNA, 20 bp, Artificial Sequence
  chemically synthesized
tttttcttttttttttgtga

SEQ ID NO: 58114 - DNA, 20 bp, Artificial Sequence
  chemically synthesized
tctcatgctgtcacctgggc

SEQ ID NO: 58115 - DNA, 20 bp, Artificial Sequence
  chemically synthesized
tcactgcaacctctgcctcc

SEQ ID NO: 58116 - DNA, 20 bp, Artificial Sequence
  chemically synthesized
gcctcagcctcccaaattgc

SEQ ID NO: 58117 - DNA, 20 bp, Artificial Sequence
  chemically synthesized
gtgagccaccgctcccagcc

SEQ ID NO: 58118 - DNA, 20 bp, Artificial Sequence
  chemically synthesized
ttaaatgcttttattgttga

SEQ ID NO: 58119 - DNA, 20 bp, Artificial Sequence
  chemically synthesized
ctcccttgatagtttctact

SEQ ID NO: 58120 - DNA, 20 bp, Artificial Sequence
  chemically synthesized
ttattctagttttttcgtga

SEQ ID NO: 58121 - DNA, 20 bp, Artificial Sequence
  chemically synthesized
attttagtgagatttagttt

SEQ ID NO: 58122 - DNA, 20 bp, Artificial Sequence
  chemically synthesized
ttccactatcttacttacac

SEQ ID NO: 58123 - DNA, 20 bp, Artificial Sequence
  chemically synthesized
gtattaatttaacatgattt

SEQ ID NO: 58124 - DNA, 20 bp, Artificial Sequence
  chemically synthesized
cagcagaaagagataatatt

SEQ ID NO: 58125 - DNA, 20 bp, Artificial Sequence
  chemically synthesized
taaggataatcagaaaaaaa

SEQ ID NO: 58126 - DNA, 20 bp, Artificial Sequence
  chemically synthesized
aaaaatagaataaacttaga

SEQ ID NO: 58127 - DNA, 20 bp, Artificial Sequence
  chemically synthesized
taataacactagaaaatcta

SEQ ID NO: 58128 - DNA, 20 bp, Artificial Sequence
  chemically synthesized
tttattgtattgttttggaa

SEQ ID NO: 58129 - DNA, 20 bp, Artificial Sequence
  chemically synthesized
ggaaaagagtaaacagtcaa

SEQ ID NO: 58130 - DNA, 20 bp, Artificial Sequence
  chemically synthesized
atatttgtatctgaaaaatc

SEQ ID NO: 58131 - DNA, 20 bp, Artificial Sequence
  chemically synthesized
acgcctgtaatcccagccct

SEQ ID NO: 58132 - DNA, 20 bp, Artificial Sequence
  chemically synthesized
cctttgggtggccgaggcag

SEQ ID NO: 58133 - DNA, 20 bp, Artificial Sequence
  chemically synthesized
gatgctgtacattagatatc

SEQ ID NO: 58134 - DNA, 20 bp, Artificial Sequence
  chemically synthesized
taactgaaattttataccct

SEQ ID NO: 58135 - DNA, 20 bp, Artificial Sequence
  chemically synthesized
cctctactgtctgtttccat

SEQ ID NO: 58136 - DNA, 20 bp, Artificial Sequence
  chemically synthesized
atcaattctgccataaatgg

SEQ ID NO: 58137 - DNA, 20 bp, Artificial Sequence
  chemically synthesized
ttttaattttttgtttgtta

SEQ ID NO: 58138 - DNA, 20 bp, Artificial Sequence
  chemically synthesized
atctgtgtttcttatatatt

SEQ ID NO: 58139 - DNA, 20 bp, Artificial Sequence
  chemically synthesized
attcaaaaaacggctgcaac

SEQ ID NO: 58140 - DNA, 20 bp, Artificial Sequence
  chemically synthesized
aacggctgcaacgtgaatat

SEQ ID NO: 58141 - DNA, 20 bp, Artificial Sequence
  chemically synthesized
ttttgtttatggtgtaagac

SEQ ID NO: 58142 - DNA, 20 bp, Artificial Sequence
  chemically synthesized
gtctgatttcatttcatttt

SEQ ID NO: 58143 - DNA, 20 bp, Artificial Sequence
  chemically synthesized
ctgattatatgccttgattt

SEQ ID NO: 58144 - DNA, 20 bp, Artificial Sequence
  chemically synthesized
agaatcttgccaactagatt

SEQ ID NO: 58145 - DNA, 20 bp, Artificial Sequence
  chemically synthesized
tgagactcatattttatttc

SEQ ID NO: 58146 - DNA, 20 bp, Artificial Sequence
  chemically synthesized
agcatctacctacctaggta

SEQ ID NO: 58147 - DNA, 20 bp, Artificial Sequence
  chemically synthesized
agcagacctctgatctcttc

SEQ ID NO: 58148 - DNA, 20 bp, Artificial Sequence
  chemically synthesized
taatcttaaacatcctgagg

SEQ ID NO: 58149 - DNA, 20 bp, Artificial Sequence
  chemically synthesized
ggaagaatgggacttccatt

SEQ ID NO: 58150 - DNA, 20 bp, Artificial Sequence
  chemically synthesized
catttggggtgggcctatga

SEQ ID NO: 58151 - DNA, 20 bp, Artificial Sequence
  chemically synthesized
gacagggtaataagacagta

SEQ ID NO: 58152 - DNA, 20 bp, Artificial Sequence
  chemically synthesized
ccttccaaagcagactgtga

SEQ ID NO: 58153 - DNA, 20 bp, Artificial Sequence
  chemically synthesized
ggagactagcactgcagatt

SEQ ID NO: 58154 - DNA, 20 bp, Artificial Sequence
  chemically synthesized
actgcagattccgggtcact

SEQ ID NO: 58155 - DNA, 20 bp, Artificial Sequence
  chemically synthesized
gacaacagagacaactaagg

SEQ ID NO: 58156 - DNA, 20 bp, Artificial Sequence
  chemically synthesized
ggtatctctaagcaagagaa

SEQ ID NO: 58157 - DNA, 20 bp, Artificial Sequence
  chemically synthesized
ctctaagcaagagaactgag

SEQ ID NO: 58158 - DNA, 20 bp, Artificial Sequence
  chemically synthesized
ggagtcaaggctgagagatg

SEQ ID NO: 58159 - DNA, 20 bp, Artificial Sequence
  chemically synthesized
gagagatgcaggataagcaa

SEQ ID NO: 58160 - DNA, 20 bp, Artificial Sequence
  chemically synthesized
cctccaaatcaagcctctac

SEQ ID NO: 58161 - DNA, 20 bp, Artificial Sequence
  chemically synthesized
tctacttgaatccttttctg

SEQ ID NO: 58162 - DNA, 20 bp, Artificial Sequence
  chemically synthesized
cttgaatccttttctgaggg

SEQ ID NO: 58163 - DNA, 20 bp, Artificial Sequence
  chemically synthesized
tgcagcctcaccttctttca

SEQ ID NO: 58164 - DNA, 20 bp, Artificial Sequence
  chemically synthesized
aataaatgttttttattagg

SEQ ID NO: 58165 - DNA, 20 bp, Artificial Sequence
  chemically synthesized
tgataggcagcctgcactgg

SEQ ID NO: 58166 - DNA, 20 bp, Artificial Sequence
  chemically synthesized
aggcagcctgcactggtggg

SEQ ID NO: 58167 - DNA, 20 bp, Artificial Sequence
  chemically synthesized
aaaagggcctagcttggact

SEQ ID NO: 58168 - DNA, 20 bp, Artificial Sequence
  chemically synthesized
tcccaaccataaaataaaag

SEQ ID NO: 58169 - DNA, 20 bp, Artificial Sequence
  chemically synthesized
aaataaaagcagaatggtag

SEQ ID NO: 58170 - DNA, 20 bp, Artificial Sequence
  chemically synthesized
aaattatcactgttattctt

SEQ ID NO: 58171 - DNA, 20 bp, Artificial Sequence
  chemically synthesized
gaaaataaagtagggagatt

SEQ ID NO: 58172 - DNA, 20 bp, Artificial Sequence
  chemically synthesized
agaagaaaaaaaaagaaagc

SEQ ID NO: 58173 - DNA, 20 bp, Artificial Sequence
  chemically synthesized
tagactcaccctgaagttct

SEQ ID NO: 58174 - DNA, 20 bp, Artificial Sequence
  chemically synthesized
cttgccatgagccttcacct

SEQ ID NO: 58175 - DNA, 20 bp, Artificial Sequence
  chemically synthesized
gggttgcccataacagcatc

SEQ ID NO: 58176 - DNA, 20 bp, Artificial Sequence
  chemically synthesized
ccaaaggactcaaagaacct

SEQ ID NO: 58177 - DNA, 20 bp, Artificial Sequence
  chemically synthesized
ctcaaagaacctctgggtcc

SEQ ID NO: 58178 - DNA, 20 bp, Artificial Sequence
  chemically synthesized
gggtagaccaccagcagcct

SEQ ID NO: 58179 - DNA, 20 bp, Artificial Sequence
  chemically synthesized
aaaatagaccaataggcaga

SEQ ID NO: 58180 - DNA, 20 bp, Artificial Sequence
  chemically synthesized
tcagtgcctatcagaaaccc

SEQ ID NO: 58181 - DNA, 20 bp, Artificial Sequence
  chemically synthesized
gtaacggcagacttctcctc

SEQ ID NO: 58182 - DNA, 20 bp, Artificial Sequence
  chemically synthesized
ctcctgccctccctgctcct

SEQ ID NO: 58183 - DNA, 20 bp, Artificial Sequence
  chemically synthesized
gggagtagattggccaaccc

SEQ ID NO: 58184 - DNA, 20 bp, Artificial Sequence
  chemically synthesized
aaccctagggtgtggctcca

SEQ ID NO: 58185 - DNA, 20 bp, Artificial Sequence
  chemically synthesized
ggctcttctggcactggctt

SEQ ID NO: 58186 - DNA, 20 bp, Artificial Sequence
  chemically synthesized
aagtgtatttacgtaatatt

SEQ ID NO: 58187 - DNA, 20 bp, Artificial Sequence
  chemically synthesized
agttgatgcactaaaagtgg

SEQ ID NO: 58188 - DNA, 20 bp, Artificial Sequence
  chemically synthesized
tgtctaccataattcagctt

SEQ ID NO: 58189 - DNA, 20 bp, Artificial Sequence
  chemically synthesized
ttcagctttgggatatgtag

SEQ ID NO: 58190 - DNA, 20 bp, Artificial Sequence
  chemically synthesized
tggatctcttcctgcgtctc

SEQ ID NO: 58191 - DNA, 20 bp, Artificial Sequence
  chemically synthesized
tatgcaaaatacttacagga

SEQ ID NO: 58192 - DNA, 20 bp, Artificial Sequence
  chemically synthesized
caaaatacttacaggacaga

SEQ ID NO: 58193 - DNA, 20 bp, Artificial Sequence
  chemically synthesized
taagcatatcttctccttat

SEQ ID NO: 58194 - DNA, 20 bp, Artificial Sequence
  chemically synthesized
taataaattatgtctaaaaa

SEQ ID NO: 58195 - DNA, 20 bp, Artificial Sequence
  chemically synthesized
acccaaagtgtgactatcaa

SEQ ID NO: 58196 - DNA, 20 bp, Artificial Sequence
  chemically synthesized
ttctgcctggactaatctgc

SEQ ID NO: 58197 - DNA, 20 bp, Artificial Sequence
  chemically synthesized
gcctctgtgacttagaaagt

SEQ ID NO: 58198 - DNA, 20 bp, Artificial Sequence
  chemically synthesized
tttttttcctctagtccact

SEQ ID NO: 58199 - DNA, 20 bp, Artificial Sequence
  chemically synthesized
gaggaaaaacttttgaagtg

SEQ ID NO: 58200 - DNA, 20 bp, Artificial Sequence
  chemically synthesized
aagcatttatgaggtcagcg

SEQ ID NO: 58201 - DNA, 20 bp, Artificial Sequence
  chemically synthesized
taagggccctgtcagtcatc

SEQ ID NO: 58202 - DNA, 20 bp, Artificial Sequence
  chemically synthesized
tttaggttaaccaaaagaaa

SEQ ID NO: 58203 - DNA, 20 bp, Artificial Sequence
  chemically synthesized
tgtatgattatagaggtaag

SEQ ID NO: 58204 - DNA, 20 bp, Artificial Sequence
  chemically synthesized
ctgtaaaaaactaaagcaat

SEQ ID NO: 58205 - DNA, 20 bp, Artificial Sequence
  chemically synthesized
ctgagaaaagatttcacatg

SEQ ID NO: 58206 - DNA, 20 bp, Artificial Sequence
  chemically synthesized
tttgacttggctgttagatt

SEQ ID NO: 58207 - DNA, 20 bp, Artificial Sequence
  chemically synthesized
ataaagtgttctgcggaagt

SEQ ID NO: 58208 - DNA, 20 bp, Artificial Sequence
  chemically synthesized
atatgtcttttgcaaatatc

SEQ ID NO: 58209 - DNA, 20 bp, Artificial Sequence
  chemically synthesized
tcttttttaaatgatgaact

SEQ ID NO: 58210 - DNA, 20 bp, Artificial Sequence
  chemically synthesized
catcatcctggcttcaaggc

SEQ ID NO: 58211 - DNA, 20 bp, Artificial Sequence
  chemically synthesized
tggtagttacttagtgtgac

SEQ ID NO: 58212 - DNA, 20 bp, Artificial Sequence
  chemically synthesized
tgtgagcttgcttctactct

SEQ ID NO: 58213 - DNA, 20 bp, Artificial Sequence
  chemically synthesized
agcttgcttctactctgtga

SEQ ID NO: 58214 - DNA, 20 bp, Artificial Sequence
  chemically synthesized
taagtcctaatgttttatat

SEQ ID NO: 58215 - DNA, 20 bp, Artificial Sequence
  chemically synthesized
tatatcagaatggccctagt

SEQ ID NO: 58216 - DNA, 20 bp, Artificial Sequence
  chemically synthesized
ccctagtctgggtatactta

SEQ ID NO: 58217 - DNA, 20 bp, Artificial Sequence
  chemically synthesized
agtctgggtatacttagagg

SEQ ID NO: 58218 - DNA, 20 bp, Artificial Sequence
  chemically synthesized
aaatcatgacactcatctat

SEQ ID NO: 58219 - DNA, 20 bp, Artificial Sequence
  chemically synthesized
tttcaaaagcagcacttgac

SEQ ID NO: 58220 - DNA, 20 bp, Artificial Sequence
  chemically synthesized
aaacacaactcagcagctct

SEQ ID NO: 58221 - DNA, 20 bp, Artificial Sequence
  chemically synthesized
cacacaaaatagtttggaaa

SEQ ID NO: 58222 - DNA, 20 bp, Artificial Sequence
  chemically synthesized
actgggctcagattttcatt

SEQ ID NO: 58223 - DNA, 20 bp, Artificial Sequence
  chemically synthesized
agattgcatctctttagagg

SEQ ID NO: 58224 - DNA, 20 bp, Artificial Sequence
  chemically synthesized
actgctctgaagctcaagag

SEQ ID NO: 58225 - DNA, 20 bp, Artificial Sequence
  chemically synthesized
aaaattaaagccaaatcttg

SEQ ID NO: 58226 - DNA, 20 bp, Artificial Sequence
  chemically synthesized
ttaactttcattttaaattt

SEQ ID NO: 58227 - DNA, 20 bp, Artificial Sequence
  chemically synthesized
tataggtaaattgcatatca

SEQ ID NO: 58228 - DNA, 20 bp, Artificial Sequence
  chemically synthesized
ccctcaaccctcaagtaggc

SEQ ID NO: 58229 - DNA, 20 bp, Artificial Sequence
  chemically synthesized
cccatccaggtgatgttctc

SEQ ID NO: 58230 - DNA, 20 bp, Artificial Sequence
  chemically synthesized
tctcatgaattctctggtat

SEQ ID NO: 58231 - DNA, 20 bp, Artificial Sequence
  chemically synthesized
ctgactacttctaatggtgt

SEQ ID NO: 58232 - DNA, 20 bp, Artificial Sequence
  chemically synthesized
tttttttgacttttggagaa

SEQ ID NO: 58233 - DNA, 20 bp, Artificial Sequence
  chemically synthesized
acaatctctcttactgtctt

SEQ ID NO: 58234 - DNA, 20 bp, Artificial Sequence
  chemically synthesized
atgagaacttccctatgctc

SEQ ID NO: 58235 - DNA, 20 bp, Artificial Sequence
  chemically synthesized
gtgatcttccccaaaatgcc

SEQ ID NO: 58236 - DNA, 20 bp, Artificial Sequence
  chemically synthesized
aaatatcttattcagatata

SEQ ID NO: 58237 - DNA, 20 bp, Artificial Sequence
  chemically synthesized
taatgacttaaggaaaacac

SEQ ID NO: 58238 - DNA, 20 bp, Artificial Sequence
  chemically synthesized
gtatattctggcagtacaga

SEQ ID NO: 58239 - DNA, 20 bp, Artificial Sequence
  chemically synthesized
attccagaagttctaaagca

SEQ ID NO: 58240 - DNA, 20 bp, Artificial Sequence
  chemically synthesized
ttcattcattcactgttttc

SEQ ID NO: 58241 - DNA, 20 bp, Artificial Sequence
  chemically synthesized
tattttctttctgcccattg

SEQ ID NO: 58242 - DNA, 20 bp, Artificial Sequence
  chemically synthesized
agtaggcatgtaagaaggta

SEQ ID NO: 58243 - DNA, 20 bp, Artificial Sequence
  chemically synthesized
gtaagaaggtagagaatagg

SEQ ID NO: 58244 - DNA, 20 bp, Artificial Sequence
  chemically synthesized
gcagaattgcttataaagca

SEQ ID NO: 58245 - DNA, 20 bp, Artificial Sequence
  chemically synthesized
atataaaaaatggtgtgggg

SEQ ID NO: 58246 - DNA, 20 bp, Artificial Sequence
  chemically synthesized
ggagggtttggaaagatttt

SEQ ID NO: 58247 - DNA, 20 bp, Artificial Sequence
  chemically synthesized
atagagaagtttattgtggc

SEQ ID NO: 58248 - DNA, 20 bp, Artificial Sequence
  chemically synthesized
tcacaagtaatacgtgagca

SEQ ID NO: 58249 - DNA, 20 bp, Artificial Sequence
  chemically synthesized
cttggagcaggaacacttga

SEQ ID NO: 58250 - DNA, 20 bp, Artificial Sequence
  chemically synthesized
aaagacaacataacattgtc

SEQ ID NO: 58251 - DNA, 20 bp, Artificial Sequence
  chemically synthesized
attattttctcagtaattgt

SEQ ID NO: 58252 - DNA, 20 bp, Artificial Sequence
  chemically synthesized
ttacccttgaggctatgtct

SEQ ID NO: 58253 - DNA, 20 bp, Artificial Sequence
  chemically synthesized
gccagtattatctttgtatc

SEQ ID NO: 58254 - DNA, 20 bp, Artificial Sequence
  chemically synthesized
gtgttcccaagttcagaaaa

SEQ ID NO: 58255 - DNA, 20 bp, Artificial Sequence
  chemically synthesized
gaaaatagaatctagggaaa

SEQ ID NO: 58256 - DNA, 20 bp, Artificial Sequence
  chemically synthesized
atggttatcaggaaacagtc

SEQ ID NO: 58257 - DNA, 20 bp, Artificial Sequence
  chemically synthesized
tgataggcagcctgcatttg

SEQ ID NO: 58258 - DNA, 20 bp, Artificial Sequence
  chemically synthesized
aggcagcctgcatttgtggg

SEQ ID NO: 58259 - DNA, 20 bp, Artificial Sequence
  chemically synthesized
cagcataaataagtacatat

SEQ ID NO: 58260 - DNA, 20 bp, Artificial Sequence
  chemically synthesized
cctttccattccatttacta

SEQ ID NO: 58261 - DNA, 20 bp, Artificial Sequence
  chemically synthesized
gtattctatgcctctcatct

SEQ ID NO: 58262 - DNA, 20 bp, Artificial Sequence
  chemically synthesized
atacccatgtggagagacaa

SEQ ID NO: 58263 - DNA, 20 bp, Artificial Sequence
  chemically synthesized
caaaaggattattctaagtg

SEQ ID NO: 58264 - DNA, 20 bp, Artificial Sequence
  chemically synthesized
tgagagctggtatgcataat

SEQ ID NO: 58265 - DNA, 20 bp, Artificial Sequence
  chemically synthesized
gagaaggaaaaatgaaggga

SEQ ID NO: 58266 - DNA, 20 bp, Artificial Sequence
  chemically synthesized
agggggttgggagagaaaga

SEQ ID NO: 58267 - DNA, 20 bp, Artificial Sequence
  chemically synthesized
ttgtgaggaaggaaaaaatg

SEQ ID NO: 58268 - DNA, 20 bp, Artificial Sequence
  chemically synthesized
tggactcaccctgaagttct

SEQ ID NO: 58269 - DNA, 20 bp, Artificial Sequence
  chemically synthesized
cttgccatgagccttcacct

SEQ ID NO: 58270 - DNA, 20 bp, Artificial Sequence
  chemically synthesized
ccaaaggactcaaagaacct

SEQ ID NO: 58271 - DNA, 20 bp, Artificial Sequence
  chemically synthesized
ctcaaagaacctctgggtcc

SEQ ID NO: 58272 - DNA, 20 bp, Artificial Sequence
  chemically synthesized
gggtagaccaccagtaatct

SEQ ID NO: 58273 - DNA, 20 bp, Artificial Sequence
  chemically synthesized
ggaaaacagcccaagggaca

SEQ ID NO: 58274 - DNA, 20 bp, Artificial Sequence
  chemically synthesized
tcagtgcctatcagaaaccc

SEQ ID NO: 58275 - DNA, 20 bp, Artificial Sequence
  chemically synthesized
ttgacagcagtcttctcctc

SEQ ID NO: 58276 - DNA, 20 bp, Artificial Sequence
  chemically synthesized
gcaggttggtttaagataag

SEQ ID NO: 58277 - DNA, 20 bp, Artificial Sequence
  chemically synthesized
gcagggtttcattagtttgt

SEQ ID NO: 58278 - DNA, 20 bp, Artificial Sequence
  chemically synthesized
agtgttttaggctaatatag

SEQ ID NO: 58279 - DNA, 20 bp, Artificial Sequence
  chemically synthesized
taatatagtggaatgtatct

SEQ ID NO: 58280 - DNA, 20 bp, Artificial Sequence
  chemically synthesized
ctagagatttttgtctccaa

SEQ ID NO: 58281 - DNA, 20 bp, Artificial Sequence
  chemically synthesized
ccaagggaattttgagaggt

SEQ ID NO: 58282 - DNA, 20 bp, Artificial Sequence
  chemically synthesized
ttgaaataaatatccattaa

SEQ ID NO: 58283 - DNA, 20 bp, Artificial Sequence
  chemically synthesized
attaaaagaatatttaaaaa

SEQ ID NO: 58284 - DNA, 20 bp, Artificial Sequence
  chemically synthesized
ttgaaataggttctggaaac

SEQ ID NO: 58285 - DNA, 20 bp, Artificial Sequence
  chemically synthesized
aaatattatatacaaatatt

SEQ ID NO: 58286 - DNA, 20 bp, Artificial Sequence
  chemically synthesized
aattatggtatgactaaaga

SEQ ID NO: 58287 - DNA, 20 bp, Artificial Sequence
  chemically synthesized
ttaaatttaacgaagttcct

SEQ ID NO: 58288 - DNA, 20 bp, Artificial Sequence
  chemically synthesized
tgtgttcttaaaaaaaaatg

SEQ ID NO: 58289 - DNA, 20 bp, Artificial Sequence
  chemically synthesized
aaaaatgtggaattagaccc

SEQ ID NO: 58290 - DNA, 20 bp, Artificial Sequence
  chemically synthesized
cagtagtttttcactctttt

SEQ ID NO: 58291 - DNA, 20 bp, Artificial Sequence
  chemically synthesized
ccatgagcatatccaaaagg

SEQ ID NO: 58292 - DNA, 20 bp, Artificial Sequence
  chemically synthesized
ggaaggaagaggggaagaga

SEQ ID NO: 58293 - DNA, 20 bp, Artificial Sequence
  chemically synthesized
aggggaagagagaggatgga

SEQ ID NO: 58294 - DNA, 20 bp, Artificial Sequence
  chemically synthesized
ggaggggagaggagaggaga

SEQ ID NO: 58295 - DNA, 20 bp, Artificial Sequence
  chemically synthesized
gttcaaattttggtggtgat

SEQ ID NO: 58296 - DNA, 20 bp, Artificial Sequence
  chemically synthesized
tttaatagtatccacaaatg

SEQ ID NO: 58297 - DNA, 20 bp, Artificial Sequence
  chemically synthesized
acttaaatgcttaccaacag

SEQ ID NO: 58298 - DNA, 20 bp, Artificial Sequence
  chemically synthesized
gataaattacggtatagtca

SEQ ID NO: 58299 - DNA, 20 bp, Artificial Sequence
  chemically synthesized
attacggtatagtcaaagaa

SEQ ID NO: 58300 - DNA, 20 bp, Artificial Sequence
  chemically synthesized
gaatattacacagaaatgaa

SEQ ID NO: 58301 - DNA, 20 bp, Artificial Sequence
  chemically synthesized
ttgattaaaagtaaccagag

SEQ ID NO: 58302 - DNA, 20 bp, Artificial Sequence
  chemically synthesized
ctttatttgtatatagaaag

SEQ ID NO: 58303 - DNA, 20 bp, Artificial Sequence
  chemically synthesized
caaggggaaatgttataaaa

SEQ ID NO: 58304 - DNA, 20 bp, Artificial Sequence
  chemically synthesized
aaatagggtagagaggagcc

SEQ ID NO: 58305 - DNA, 20 bp, Artificial Sequence
  chemically synthesized
ctggaagccaacgaaagata

SEQ ID NO: 58306 - DNA, 20 bp, Artificial Sequence
  chemically synthesized
gtgatgtcagtcgtgaacac

SEQ ID NO: 58307 - DNA, 20 bp, Artificial Sequence
  chemically synthesized
acaagaatagggccacattt

SEQ ID NO: 58308 - DNA, 20 bp, Artificial Sequence
  chemically synthesized
ataaaatcagaaatacagtc

SEQ ID NO: 58309 - DNA, 20 bp, Artificial Sequence
  chemically synthesized
aaaaagatgtacttagatat

SEQ ID NO: 58310 - DNA, 20 bp, Artificial Sequence
  chemically synthesized
atgtggatctggagctcaga

SEQ ID NO: 58311 - DNA, 20 bp, Artificial Sequence
  chemically synthesized
agaaagaatacaaccaggtc

SEQ ID NO: 58312 - DNA, 20 bp, Artificial Sequence
  chemically synthesized
atacaaccaggtcaagaata

SEQ ID NO: 58313 - DNA, 20 bp, Artificial Sequence
  chemically synthesized
aacagatcataatgtgctgt

SEQ ID NO: 58314 - DNA, 20 bp, Artificial Sequence
  chemically synthesized
tcaatatctccttaaaatct

SEQ ID NO: 58315 - DNA, 20 bp, Artificial Sequence
  chemically synthesized
ttagaatgtgtttgtgaggg

SEQ ID NO: 58316 - DNA, 20 bp, Artificial Sequence
  chemically synthesized
tggttacatgtttattctat

SEQ ID NO: 58317 - DNA, 20 bp, Artificial Sequence
  chemically synthesized
ttctatatggattgcattga

SEQ ID NO: 58318 - DNA, 20 bp, Artificial Sequence
  chemically synthesized
cattgagaggatttgtataa

SEQ ID NO: 58319 - DNA, 20 bp, Artificial Sequence
  chemically synthesized
ttttcttttctcttctgaga

SEQ ID NO: 58320 - DNA, 20 bp, Artificial Sequence
  chemically synthesized
ttcatccctattgcccaagc

SEQ ID NO: 58321 - DNA, 20 bp, Artificial Sequence
  chemically synthesized
ctcaccgcaacctctgcctc

SEQ ID NO: 58322 - DNA, 20 bp, Artificial Sequence
  chemically synthesized
aattctcctgcctcagccac

SEQ ID NO: 58323 - DNA, 20 bp, Artificial Sequence
  chemically synthesized
ttttgtatttttagtagaga

SEQ ID NO: 58324 - DNA, 20 bp, Artificial Sequence
  chemically synthesized
tgccttggcctcccaaagtg

SEQ ID NO: 58325 - DNA, 20 bp, Artificial Sequence
  chemically synthesized
cctgagccaccgcatccagc

SEQ ID NO: 58326 - DNA, 20 bp, Artificial Sequence
  chemically synthesized
ggataaggtctaaaagtgga

SEQ ID NO: 58327 - DNA, 20 bp, Artificial Sequence
  chemically synthesized
tgaggacctgactgggcagt

SEQ ID NO: 58328 - DNA, 20 bp, Artificial Sequence
  chemically synthesized
tagatagggacaaattgaag

SEQ ID NO: 58329 - DNA, 20 bp, Artificial Sequence
  chemically synthesized
gattttaatctgtgaccttg

SEQ ID NO: 58330 - DNA, 20 bp, Artificial Sequence
  chemically synthesized
taacaagtgaaatacccatg

SEQ ID NO: 58331 - DNA, 20 bp, Artificial Sequence
  chemically synthesized
cccagtacattgtttgatat

SEQ ID NO: 58332 - DNA, 20 bp, Artificial Sequence
  chemically synthesized
ggaggtcagaggttagaaat

SEQ ID NO: 58333 - DNA, 20 bp, Artificial Sequence
  chemically synthesized
agaggttagaaatcagagtt

SEQ ID NO: 58334 - DNA, 20 bp, Artificial Sequence
  chemically synthesized
tagaaatcagagttgggaat

SEQ ID NO: 58335 - DNA, 20 bp, Artificial Sequence
  chemically synthesized
ggattatacaggctgtattt

SEQ ID NO: 58336 - DNA, 20 bp, Artificial Sequence
  chemically synthesized
ttaagagtttagatataact

SEQ ID NO: 58337 - DNA, 20 bp, Artificial Sequence
  chemically synthesized
ttagatataactgtgaatcc

SEQ ID NO: 58338 - DNA, 20 bp, Artificial Sequence
  chemically synthesized
actgtgaatccaagagtgtg

SEQ ID NO: 58339 - DNA, 20 bp, Artificial Sequence
  chemically synthesized
ttaattagtgtaatgccaat

SEQ ID NO: 58340 - DNA, 20 bp, Artificial Sequence
  chemically synthesized
agtgtaatgccaatgtgggt

SEQ ID NO: 58341 - DNA, 20 bp, Artificial Sequence
  chemically synthesized
ctgaaacaaaaaggaaaagg

SEQ ID NO: 58342 - DNA, 20 bp, Artificial Sequence
  chemically synthesized
agatgggaaatgtatgtaag

SEQ ID NO: 58343 - DNA, 20 bp, Artificial Sequence
  chemically synthesized
gggaggtatactaaggactc

SEQ ID NO: 58344 - DNA, 20 bp, Artificial Sequence
  chemically synthesized
gactctagggtcagagaaat

SEQ ID NO: 58345 - DNA, 20 bp, Artificial Sequence
  chemically synthesized
tacaaaattcacattcttgg

SEQ ID NO: 58346 - DNA, 20 bp, Artificial Sequence
  chemically synthesized
cagcactttcagaggccgag

SEQ ID NO: 58347 - DNA, 20 bp, Artificial Sequence
  chemically synthesized
actttcagaggccgaggagg

SEQ ID NO: 58348 - DNA, 20 bp, Artificial Sequence
  chemically synthesized
agggtggatcacctgatgtt

SEQ ID NO: 58349 - DNA, 20 bp, Artificial Sequence
  chemically synthesized
tacttgggaggctgaggcag

SEQ ID NO: 58350 - DNA, 20 bp, Artificial Sequence
  chemically synthesized
aggcagatgttgcagtgagc

SEQ ID NO: 58351 - DNA, 20 bp, Artificial Sequence
  chemically synthesized
taattcataattttcagata

SEQ ID NO: 58352 - DNA, 20 bp, Artificial Sequence
  chemically synthesized
taatctcagttcactgctgt

SEQ ID NO: 58353 - DNA, 20 bp, Artificial Sequence
  chemically synthesized
tggtctctctctctctctga

SEQ ID NO: 58354 - DNA, 20 bp, Artificial Sequence
  chemically synthesized
aaggagcacccactagctca

SEQ ID NO: 58355 - DNA, 20 bp, Artificial Sequence
  chemically synthesized
tattttagctcttccaatac

SEQ ID NO: 58356 - DNA, 20 bp, Artificial Sequence
  chemically synthesized
gagctgtatttaattctagg

SEQ ID NO: 58357 - DNA, 20 bp, Artificial Sequence
  chemically synthesized
ttagtgtatgaaattctgat

SEQ ID NO: 58358 - DNA, 20 bp, Artificial Sequence
  chemically synthesized
ggtctcaaacaaacttctct

SEQ ID NO: 58359 - DNA, 20 bp, Artificial Sequence
  chemically synthesized
tagaaaagagagatctaatt

SEQ ID NO: 58360 - DNA, 20 bp, Artificial Sequence
  chemically synthesized
tctccaaatactagggaaat

SEQ ID NO: 58361 - DNA, 20 bp, Artificial Sequence
  chemically synthesized
agaggttaaaatttagtggt

SEQ ID NO: 58362 - DNA, 20 bp, Artificial Sequence
  chemically synthesized
gaaagagcccataattgtag

SEQ ID NO: 58363 - DNA, 20 bp, Artificial Sequence
  chemically synthesized
tataagttaggacttaaagt

SEQ ID NO: 58364 - DNA, 20 bp, Artificial Sequence
  chemically synthesized
aatgagggaaagacatcacc

SEQ ID NO: 58365 - DNA, 20 bp, Artificial Sequence
  chemically synthesized
aacagcatgtacaaagctaa

SEQ ID NO: 58366 - DNA, 20 bp, Artificial Sequence
  chemically synthesized
tccaaattctctagattgac

SEQ ID NO: 58367 - DNA, 20 bp, Artificial Sequence
  chemically synthesized
tgtgtgttcttatgtgtgca

SEQ ID NO: 58368 - DNA, 20 bp, Artificial Sequence
  chemically synthesized
acatctgtatgtgtatatca

SEQ ID NO: 58369 - DNA, 20 bp, Artificial Sequence
  chemically synthesized
ttatgtgttttccactaaag

SEQ ID NO: 58370 - DNA, 20 bp, Artificial Sequence
  chemically synthesized
tcatctcttcatttaaaata

SEQ ID NO: 58371 - DNA, 20 bp, Artificial Sequence
  chemically synthesized
gagtgacattcagaagggca

SEQ ID NO: 58372 - DNA, 20 bp, Artificial Sequence
  chemically synthesized
ttggacacagtaattattca

SEQ ID NO: 58373 - DNA, 20 bp, Artificial Sequence
  chemically synthesized
tgtatgctacaagacagcag

SEQ ID NO: 58374 - DNA, 20 bp, Artificial Sequence
  chemically synthesized
actggtatttattctgcttt

SEQ ID NO: 58375 - DNA, 20 bp, Artificial Sequence
  chemically synthesized
gggactcaaaaatatgacaa

SEQ ID NO: 58376 - DNA, 20 bp, Artificial Sequence
  chemically synthesized
atatggtgaggtgagctctt

SEQ ID NO: 58377 - DNA, 20 bp, Artificial Sequence
  chemically synthesized
atactttgagaaagaggttt

SEQ ID NO: 58378 - DNA, 20 bp, Artificial Sequence
  chemically synthesized
attaatgaaactggagaaga

SEQ ID NO: 58379 - DNA, 20 bp, Artificial Sequence
  chemically synthesized
ttctttgaggttttaggttt

SEQ ID NO: 58380 - DNA, 20 bp, Artificial Sequence
  chemically synthesized
gagggtgctacatacttcct

SEQ ID NO: 58381 - DNA, 20 bp, Artificial Sequence
  chemically synthesized
ctacatacttcctaagggtc

SEQ ID NO: 58382 - DNA, 20 bp, Artificial Sequence
  chemically synthesized
ttcctaagggtcttgggtac

SEQ ID NO: 58383 - DNA, 20 bp, Artificial Sequence
  chemically synthesized
ggagtttgaagtgattgcca

SEQ ID NO: 58384 - DNA, 20 bp, Artificial Sequence
  chemically synthesized
ccttcttttcattcacagac

SEQ ID NO: 58385 - DNA, 20 bp, Artificial Sequence
  chemically synthesized
ttctatatatatatatacat

SEQ ID NO: 58386 - DNA, 20 bp, Artificial Sequence
  chemically synthesized
cataaaaattgtatatattt

SEQ ID NO: 58387 - DNA, 20 bp, Artificial Sequence
  chemically synthesized
tgtgtgtatatatatagaaa

SEQ ID NO: 58388 - DNA, 20 bp, Artificial Sequence
  chemically synthesized
acaaagagatttattattta

SEQ ID NO: 58389 - DNA, 20 bp, Artificial Sequence
  chemically synthesized
ctatcatatgcacagcttaa

SEQ ID NO: 58390 - DNA, 20 bp, Artificial Sequence
  chemically synthesized
gtcaccaaatgagctatatc

SEQ ID NO: 58391 - DNA, 20 bp, Artificial Sequence
  chemically synthesized
gcctatacagaacttctaat

SEQ ID NO: 58392 - DNA, 20 bp, Artificial Sequence
  chemically synthesized
acaatcctcttacacctcca

SEQ ID NO: 58393 - DNA, 20 bp, Artificial Sequence
  chemically synthesized
agagacgatttccccttcct

SEQ ID NO: 58394 - DNA, 20 bp, Artificial Sequence
  chemically synthesized
ctaccccactaaatccaccc

SEQ ID NO: 58395 - DNA, 20 bp, Artificial Sequence
  chemically synthesized
acgagttctctcttttcttg

SEQ ID NO: 58396 - DNA, 20 bp, Artificial Sequence
  chemically synthesized
gaaatagtgcgtccttttgg

SEQ ID NO: 58397 - DNA, 20 bp, Artificial Sequence
  chemically synthesized
gtgcgtccttttggctgaat

SEQ ID NO: 58398 - DNA, 20 bp, Artificial Sequence
  chemically synthesized
gtaaaatataaagacagaaa

SEQ ID NO: 58399 - DNA, 20 bp, Artificial Sequence
  chemically synthesized
ctatttttatcatgcaggaa

SEQ ID NO: 58400 - DNA, 20 bp, Artificial Sequence
  chemically synthesized
gcaggaactgaatcagcagg

SEQ ID NO: 58401 - DNA, 20 bp, Artificial Sequence
  chemically synthesized
tgccaagaagcctgtatctg

SEQ ID NO: 58402 - DNA, 20 bp, Artificial Sequence
  chemically synthesized
agggtaaaatcctcgctgaa

SEQ ID NO: 58403 - DNA, 20 bp, Artificial Sequence
  chemically synthesized
cgttgcctaagagctgggga

SEQ ID NO: 58404 - DNA, 20 bp, Artificial Sequence
  chemically synthesized
aaaaaagaaaatggtacata

SEQ ID NO: 58405 - DNA, 20 bp, Artificial Sequence
  chemically synthesized
acacttacatcctttttcac

SEQ ID NO: 58406 - DNA, 20 bp, Artificial Sequence
  chemically synthesized
gacttcgtccttttaaaaag

SEQ ID NO: 58407 - DNA, 20 bp, Artificial Sequence
  chemically synthesized
tagtacttcaaggaacagta

SEQ ID NO: 58408 - DNA, 20 bp, Artificial Sequence
  chemically synthesized
cttcaaggaacagtaatgga

SEQ ID NO: 58409 - DNA, 20 bp, Artificial Sequence
  chemically synthesized
tttcccaaacactcataaca

SEQ ID NO: 58410 - DNA, 20 bp, Artificial Sequence
  chemically synthesized
acactcagtttgattttggc

SEQ ID NO: 58411 - DNA, 20 bp, Artificial Sequence
  chemically synthesized
tacccatagtgcaaatatct

SEQ ID NO: 58412 - DNA, 20 bp, Artificial Sequence
  chemically synthesized
ctaagggtaaagaagaaagc

SEQ ID NO: 58413 - DNA, 20 bp, Artificial Sequence
  chemically synthesized
actactcaccaggaagttct

SEQ ID NO: 58414 - DNA, 20 bp, Artificial Sequence
  chemically synthesized
cttgccatgtgccttgactt

SEQ ID NO: 58415 - DNA, 20 bp, Artificial Sequence
  chemically synthesized
ttcaaagtacctctaggtcc

SEQ ID NO: 58416 - DNA, 20 bp, Artificial Sequence
  chemically synthesized
ggtagacaaccaggagactg

SEQ ID NO: 58417 - DNA, 20 bp, Artificial Sequence
  chemically synthesized
gcttccagtacctacctgcc

SEQ ID NO: 58418 - DNA, 20 bp, Artificial Sequence
  chemically synthesized
tgcactacagtgtcagatct

SEQ ID NO: 58419 - DNA, 20 bp, Artificial Sequence
  chemically synthesized
cctttgcctctcccagtgaa

SEQ ID NO: 58420 - DNA, 20 bp, Artificial Sequence
  chemically synthesized
cctttgcctccctcagtaaa

SEQ ID NO: 58421 - DNA, 20 bp, Artificial Sequence
  chemically synthesized
gtaaaatgaatctattggtc

SEQ ID NO: 58422 - DNA, 20 bp, Artificial Sequence
  chemically synthesized
aatgaatctattggtcaagg

SEQ ID NO: 58423 - DNA, 20 bp, Artificial Sequence
  chemically synthesized
caagggtgggttgtgactcc

SEQ ID NO: 58424 - DNA, 20 bp, Artificial Sequence
  chemically synthesized
gtgggttgtgactccagggg

SEQ ID NO: 58425 - DNA, 20 bp, Artificial Sequence
  chemically synthesized
aagttttgcaagatggacat

SEQ ID NO: 58426 - DNA, 20 bp, Artificial Sequence
  chemically synthesized
atggacattcgagtttctga

SEQ ID NO: 58427 - DNA, 20 bp, Artificial Sequence
  chemically synthesized
cgccagcagccgctaataac

SEQ ID NO: 58428 - DNA, 20 bp, Artificial Sequence
  chemically synthesized
taacctgaatgctgacaaat

SEQ ID NO: 58429 - DNA, 20 bp, Artificial Sequence
  chemically synthesized
aggaataagttacaactgaa

SEQ ID NO: 58430 - DNA, 20 bp, Artificial Sequence
  chemically synthesized
aagttacaactgaaaaggat

SEQ ID NO: 58431 - DNA, 20 bp, Artificial Sequence
  chemically synthesized
aactgaaaaggataagaatt

SEQ ID NO: 58432 - DNA, 20 bp, Artificial Sequence
  chemically synthesized
aatatcttagccatcaattc

SEQ ID NO: 58433 - DNA, 20 bp, Artificial Sequence
  chemically synthesized
tagccatcaattcctggatc

SEQ ID NO: 58434 - DNA, 20 bp, Artificial Sequence
  chemically synthesized
tcaattctcttgagactaca

SEQ ID NO: 58435 - DNA, 20 bp, Artificial Sequence
  chemically synthesized
ttttttttttttttttgaga

SEQ ID NO: 58436 - DNA, 20 bp, Artificial Sequence
  chemically synthesized
tctcgctttgtcacccaggc

SEQ ID NO: 58437 - DNA, 20 bp, Artificial Sequence
  chemically synthesized
cattctcctgcctcagcctc

SEQ ID NO: 58438 - DNA, 20 bp, Artificial Sequence
  chemically synthesized
ttttgtatttttagtagaga

SEQ ID NO: 58439 - DNA, 20 bp, Artificial Sequence
  chemically synthesized
tggggtttcaccatgttagc

SEQ ID NO: 58440 - DNA, 20 bp, Artificial Sequence
  chemically synthesized
acctcagcctcccaaagtgc

SEQ ID NO: 58441 - DNA, 20 bp, Artificial Sequence
  chemically synthesized
cggccaatttcatcactttt

SEQ ID NO: 58442 - DNA, 20 bp, Artificial Sequence
  chemically synthesized
agcatcaacttggaagaaag

SEQ ID NO: 58443 - DNA, 20 bp, Artificial Sequence
  chemically synthesized
ctagggaagtaaggggaaaa

SEQ ID NO: 58444 - DNA, 20 bp, Artificial Sequence
  chemically synthesized
ctgaacaaaggagatttcct

SEQ ID NO: 58445 - DNA, 20 bp, Artificial Sequence
  chemically synthesized
gtgctgctctgttcaagcaa

SEQ ID NO: 58446 - DNA, 20 bp, Artificial Sequence
  chemically synthesized
cgtctcaaacaagcaatttc

SEQ ID NO: 58447 - DNA, 20 bp, Artificial Sequence
  chemically synthesized
tgtcctcatacttagaggtt

SEQ ID NO: 58448 - DNA, 20 bp, Artificial Sequence
  chemically synthesized
caaggagactctaaatttca

SEQ ID NO: 58449 - DNA, 20 bp, Artificial Sequence
  chemically synthesized
ttaaacccaatatattaaag

SEQ ID NO: 58450 - DNA, 20 bp, Artificial Sequence
  chemically synthesized
atgcaggaaacacatttata

SEQ ID NO: 58451 - DNA, 20 bp, Artificial Sequence
  chemically synthesized
gccctaaaactcattcccaa

SEQ ID NO: 58452 - DNA, 20 bp, Artificial Sequence
  chemically synthesized
catctttccatcagccaacc

SEQ ID NO: 58453 - DNA, 20 bp, Artificial Sequence
  chemically synthesized
catccatttttcttaattct

SEQ ID NO: 58454 - DNA, 20 bp, Artificial Sequence
  chemically synthesized
cagcatacatactaaaagaa

SEQ ID NO: 58455 - DNA, 20 bp, Artificial Sequence
  chemically synthesized
acaaaagcaagcaatgggga

SEQ ID NO: 58456 - DNA, 20 bp, Artificial Sequence
  chemically synthesized
ttatccaaaattaactccag

SEQ ID NO: 58457 - DNA, 20 bp, Artificial Sequence
  chemically synthesized
caaaagcaaaaattgaccaa

SEQ ID NO: 58458 - DNA, 20 bp, Artificial Sequence
  chemically synthesized
tcagagcgaaagacaatcta

SEQ ID NO: 58459 - DNA, 20 bp, Artificial Sequence
  chemically synthesized
tctgacaaaggcctaatatc

SEQ ID NO: 58460 - DNA, 20 bp, Artificial Sequence
  chemically synthesized
catatcctgtacgtgtaccc

SEQ ID NO: 58461 - DNA, 20 bp, Artificial Sequence
  chemically synthesized
aaaaaagaaagaaagaaaaa

SEQ ID NO: 58462 - DNA, 20 bp, Artificial Sequence
  chemically synthesized
atgtaaagacattacaaggc

SEQ ID NO: 58463 - DNA, 20 bp, Artificial Sequence
  chemically synthesized
gaagggcgcaggcttattat

SEQ ID NO: 58464 - DNA, 20 bp, Artificial Sequence
  chemically synthesized
attatttgggtcttatagat

SEQ ID NO: 58465 - DNA, 20 bp, Artificial Sequence
  chemically synthesized
ggtcttatagatgagagtag

SEQ ID NO: 58466 - DNA, 20 bp, Artificial Sequence
  chemically synthesized
ctataacaaaatacaaaaga

SEQ ID NO: 58467 - DNA, 20 bp, Artificial Sequence
  chemically synthesized
agactgggtggcttcaacaa

SEQ ID NO: 58468 - DNA, 20 bp, Artificial Sequence
  chemically synthesized
tctgaaggctgactcgtggt

SEQ ID NO: 58469 - DNA, 20 bp, Artificial Sequence
  chemically synthesized
tcgtggtcagggttctcttc

SEQ ID NO: 58470 - DNA, 20 bp, Artificial Sequence
  chemically synthesized
aaggaaaataattttatgat

SEQ ID NO: 58471 - DNA, 20 bp, Artificial Sequence
  chemically synthesized
ccccacagataaggtcagtt

SEQ ID NO: 58472 - DNA, 20 bp, Artificial Sequence
  chemically synthesized
gataaggtcagttgggagtt

SEQ ID NO: 58473 - DNA, 20 bp, Artificial Sequence
  chemically synthesized
gggagttggggattcagcat

SEQ ID NO: 58474 - DNA, 20 bp, Artificial Sequence
  chemically synthesized
acctaagtccccacctcccc

SEQ ID NO: 58475 - DNA, 20 bp, Artificial Sequence
  chemically synthesized
aatctgcacacttgagggca

SEQ ID NO: 58476 - DNA, 20 bp, Artificial Sequence
  chemically synthesized
tagtattcctcctaataaaa

SEQ ID NO: 58477 - DNA, 20 bp, Artificial Sequence
  chemically synthesized
ttgctacacctgactaaacc

SEQ ID NO: 58478 - DNA, 20 bp, Artificial Sequence
  chemically synthesized
tatagaggtctttcttccca

SEQ ID NO: 58479 - DNA, 20 bp, Artificial Sequence
  chemically synthesized
aatcatgtgtgatctctcag

SEQ ID NO: 58480 - DNA, 20 bp, Artificial Sequence
  chemically synthesized
tttattatttgtattgcttg

SEQ ID NO: 58481 - DNA, 20 bp, Artificial Sequence
  chemically synthesized
aaagcctatccttgaaagct

SEQ ID NO: 58482 - DNA, 20 bp, Artificial Sequence
  chemically synthesized
tgccaggaagcctgcacctc

SEQ ID NO: 58483 - DNA, 20 bp, Artificial Sequence
  chemically synthesized
aggaagcctgcacctcaggg

SEQ ID NO: 58484 - DNA, 20 bp, Artificial Sequence
  chemically synthesized
ggggtgaattctttgccgaa

SEQ ID NO: 58485 - DNA, 20 bp, Artificial Sequence
  chemically synthesized
ctacacaccaagcttccacc

SEQ ID NO: 58486 - DNA, 20 bp, Artificial Sequence
  chemically synthesized
ggacatactttgcccccatc

SEQ ID NO: 58487 - DNA, 20 bp, Artificial Sequence
  chemically synthesized
tttgcccccatctggaatta

SEQ ID NO: 58488 - DNA, 20 bp, Artificial Sequence
  chemically synthesized
tatatgtgtccagctgatat

SEQ ID NO: 58489 - DNA, 20 bp, Artificial Sequence
  chemically synthesized
aagatgaaagttctttctac

SEQ ID NO: 58490 - DNA, 20 bp, Artificial Sequence
  chemically synthesized
taggccctaaaacattacca

SEQ ID NO: 58491 - DNA, 20 bp, Artificial Sequence
  chemically synthesized
tggactcaccttgaagttct

SEQ ID NO: 58492 - DNA, 20 bp, Artificial Sequence
  chemically synthesized
cttgccatgtgccttgactt

SEQ ID NO: 58493 - DNA, 20 bp, Artificial Sequence
  chemically synthesized
ccaaagctgtcaaagaacct

SEQ ID NO: 58494 - DNA, 20 bp, Artificial Sequence
  chemically synthesized
gtcaaagaacctctgggtcc

SEQ ID NO: 58495 - DNA, 20 bp, Artificial Sequence
  chemically synthesized
acctggacttttgccaggca

SEQ ID NO: 58496 - DNA, 20 bp, Artificial Sequence
  chemically synthesized
gtcaccagagcctaccttcc

SEQ ID NO: 58497 - DNA, 20 bp, Artificial Sequence
  chemically synthesized
taacctcagacgttccagaa

SEQ ID NO: 58498 - DNA, 20 bp, Artificial Sequence
  chemically synthesized
gcgagtgtgtggaactgctg

SEQ ID NO: 58499 - DNA, 20 bp, Artificial Sequence
  chemically synthesized
gccgccggcccctggcctca

SEQ ID NO: 58500 - DNA, 20 bp, Artificial Sequence
  chemically synthesized
aaggcaaggctggccaaccc

SEQ ID NO: 58501 - DNA, 20 bp, Artificial Sequence
  chemically synthesized
aaggctggccaacccatggg

SEQ ID NO: 58502 - DNA, 20 bp, Artificial Sequence
  chemically synthesized
tgtggggaaggggcccccaa

SEQ ID NO: 58503 - DNA, 20 bp, Artificial Sequence
  chemically synthesized
agtttccttctcccatcata

SEQ ID NO: 58504 - DNA, 20 bp, Artificial Sequence
  chemically synthesized
taccaatttttgaaaagttc

SEQ ID NO: 58505 - DNA, 20 bp, Artificial Sequence
  chemically synthesized
atgtgttttaggcataggtc

SEQ ID NO: 58506 - DNA, 20 bp, Artificial Sequence
  chemically synthesized
aaaaagtgctatacttcttt

SEQ ID NO: 58507 - DNA, 20 bp, Artificial Sequence
  chemically synthesized
cagatgatgtgtatttacca

SEQ ID NO: 58508 - DNA, 20 bp, Artificial Sequence
  chemically synthesized
gtgtgtgctggctgatgacc

SEQ ID NO: 58509 - DNA, 20 bp, Artificial Sequence
  chemically synthesized
atgctcagtaaagatgatgg

SEQ ID NO: 58510 - DNA, 20 bp, Artificial Sequence
  chemically synthesized
aatgttctttggcaggtact

SEQ ID NO: 58511 - DNA, 20 bp, Artificial Sequence
  chemically synthesized
ctttggcaggtactgtggat

SEQ ID NO: 58512 - DNA, 20 bp, Artificial Sequence
  chemically synthesized
aatgctaggttcacttctca

SEQ ID NO: 58513 - DNA, 20 bp, Artificial Sequence
  chemically synthesized
gaaaacaactctaaagaggc

SEQ ID NO: 58514 - DNA, 20 bp, Artificial Sequence
  chemically synthesized
agtccacacactattataac

SEQ ID NO: 58515 - DNA, 20 bp, Artificial Sequence
  chemically synthesized
ctgacatattggaccattaa

SEQ ID NO: 58516 - DNA, 20 bp, Artificial Sequence
  chemically synthesized
gattataatgccagaagctc

SEQ ID NO: 58517 - DNA, 20 bp, Artificial Sequence
  chemically synthesized
aaaggacaaagaaagaaagt

SEQ ID NO: 58518 - DNA, 20 bp, Artificial Sequence
  chemically synthesized
gtgcgaattgtgaaatggta

SEQ ID NO: 58519 - DNA, 20 bp, Artificial Sequence
  chemically synthesized
agtgagtgatggcatttgaa

SEQ ID NO: 58520 - DNA, 20 bp, Artificial Sequence
  chemically synthesized
aaagtacgttgaagaaaaaa

SEQ ID NO: 58521 - DNA, 20 bp, Artificial Sequence
  chemically synthesized
actatttgcatcttacagat

SEQ ID NO: 58522 - DNA, 20 bp, Artificial Sequence
  chemically synthesized
catcttacagatgagagtag

SEQ ID NO: 58523 - DNA, 20 bp, Artificial Sequence
  chemically synthesized
ctataacaaaatagcataga

SEQ ID NO: 58524 - DNA, 20 bp, Artificial Sequence
  chemically synthesized
agactgggtgacttcaacaa

SEQ ID NO: 58525 - DNA, 20 bp, Artificial Sequence
  chemically synthesized
tcctggtcagggctctcttc

SEQ ID NO: 58526 - DNA, 20 bp, Artificial Sequence
  chemically synthesized
gaggaaaataattctatgat

SEQ ID NO: 58527 - DNA, 20 bp, Artificial Sequence
  chemically synthesized
ccccacaaatggagccaatt

SEQ ID NO: 58528 - DNA, 20 bp, Artificial Sequence
  chemically synthesized
aatggagccaattgggagtt

SEQ ID NO: 58529 - DNA, 20 bp, Artificial Sequence
  chemically synthesized
gggagttggggattcagcat

SEQ ID NO: 58530 - DNA, 20 bp, Artificial Sequence
  chemically synthesized
tcaattatataagaactcca

SEQ ID NO: 58531 - DNA, 20 bp, Artificial Sequence
  chemically synthesized
tgtgaccagtctgtagactt

SEQ ID NO: 58532 - DNA, 20 bp, Artificial Sequence
  chemically synthesized
agtctgtagacttaagggta

SEQ ID NO: 58533 - DNA, 20 bp, Artificial Sequence
  chemically synthesized
gaaaagttccttagtaaagt

SEQ ID NO: 58534 - DNA, 20 bp, Artificial Sequence
  chemically synthesized
tagtattgcccctaataaaa

SEQ ID NO: 58535 - DNA, 20 bp, Artificial Sequence
  chemically synthesized
ctgtgctgcaatccagggaa

SEQ ID NO: 58536 - DNA, 20 bp, Artificial Sequence
  chemically synthesized
ttccaaaacatctgtttctg

SEQ ID NO: 58537 - DNA, 20 bp, Artificial Sequence
  chemically synthesized
ctaacgtaaacaaaaaagtg

SEQ ID NO: 58538 - DNA, 20 bp, Artificial Sequence
  chemically synthesized
aaccatgtgtgatctcttag

SEQ ID NO: 58539 - DNA, 20 bp, Artificial Sequence
  chemically synthesized
atttattatttgattgcttg

SEQ ID NO: 58540 - DNA, 20 bp, Artificial Sequence
  chemically synthesized
tgccaggaagcctgcacctc

SEQ ID NO: 58541 - DNA, 20 bp, Artificial Sequence
  chemically synthesized
aggaagcctgcacctcaggg

SEQ ID NO: 58542 - DNA, 20 bp, Artificial Sequence
  chemically synthesized
ggggtgaattctttgccgaa

SEQ ID NO: 58543 - DNA, 20 bp, Artificial Sequence
  chemically synthesized
ctacacaccaagcttccacc

SEQ ID NO: 58544 - DNA, 20 bp, Artificial Sequence
  chemically synthesized
ggacatactttgcccccatc

SEQ ID NO: 58545 - DNA, 20 bp, Artificial Sequence
  chemically synthesized
tttgcccccatctggaatta

SEQ ID NO: 58546 - DNA, 20 bp, Artificial Sequence
  chemically synthesized
tatatgtgtccagctgatat

SEQ ID NO: 58547 - DNA, 20 bp, Artificial Sequence
  chemically synthesized
ctccagatagatgttttaaa

SEQ ID NO: 58548 - DNA, 20 bp, Artificial Sequence
  chemically synthesized
taggccctaaaacattgcca

SEQ ID NO: 58549 - DNA, 20 bp, Artificial Sequence
  chemically synthesized
tggactcaccttgaagttct

SEQ ID NO: 58550 - DNA, 20 bp, Artificial Sequence
  chemically synthesized
cttgccatgtgccttgactt

SEQ ID NO: 58551 - DNA, 20 bp, Artificial Sequence
  chemically synthesized
ccaaagctgtcaaagaacct

SEQ ID NO: 58552 - DNA, 20 bp, Artificial Sequence
  chemically synthesized
gtcaaagaacctctgggtcc

SEQ ID NO: 58553 - DNA, 20 bp, Artificial Sequence
  chemically synthesized
acctggacttttgccaggca

SEQ ID NO: 58554 - DNA, 20 bp, Artificial Sequence
  chemically synthesized
gtcaccagagcctaccttcc

SEQ ID NO: 58555 - DNA, 20 bp, Artificial Sequence
  chemically synthesized
taacctcagacgttccagaa

SEQ ID NO: 58556 - DNA, 20 bp, Artificial Sequence
  chemically synthesized
gcgagtgtgtggaactgctg

SEQ ID NO: 58557 - DNA, 20 bp, Artificial Sequence
  chemically synthesized
gccgccggcccctggcctca

SEQ ID NO: 58558 - DNA, 20 bp, Artificial Sequence
  chemically synthesized
aaggcaaggctggccaaccc

SEQ ID NO: 58559 - DNA, 20 bp, Artificial Sequence
  chemically synthesized
aaggctggccaacccatggg

SEQ ID NO: 58560 - DNA, 20 bp, Artificial Sequence
  chemically synthesized
tgtggggaaggggcccccaa

SEQ ID NO: 58561 - DNA, 20 bp, Artificial Sequence
  chemically synthesized
taccaatttttgaaaagttc

SEQ ID NO: 58562 - DNA, 20 bp, Artificial Sequence
  chemically synthesized
atgtgttttaggcataggtc

SEQ ID NO: 58563 - DNA, 20 bp, Artificial Sequence
  chemically synthesized
aagaagtgctatacttatct

SEQ ID NO: 58564 - DNA, 20 bp, Artificial Sequence
  chemically synthesized
taaagcaacagtttcagtgc

SEQ ID NO: 58565 - DNA, 20 bp, Artificial Sequence
  chemically synthesized
ttatgtaatataatataaga

SEQ ID NO: 58566 - DNA, 20 bp, Artificial Sequence
  chemically synthesized
ccgatgatgtgtatttatca

SEQ ID NO: 58567 - DNA, 20 bp, Artificial Sequence
  chemically synthesized
gtatgtgctggctgatgacc

SEQ ID NO: 58568 - DNA, 20 bp, Artificial Sequence
  chemically synthesized
atgctcggtaaagatgatgg

SEQ ID NO: 58569 - DNA, 20 bp, Artificial Sequence
  chemically synthesized
aatgctctttaccagatact

SEQ ID NO: 58570 - DNA, 20 bp, Artificial Sequence
  chemically synthesized
ctttaccagatactatggat

SEQ ID NO: 58571 - DNA, 20 bp, Artificial Sequence
  chemically synthesized
aatgctaggttcacttctta

SEQ ID NO: 58572 - DNA, 20 bp, Artificial Sequence
  chemically synthesized
agtccacacactgtgacagc

SEQ ID NO: 58573 - DNA, 20 bp, Artificial Sequence
  chemically synthesized
ttttttctttattttttctt

SEQ ID NO: 58574 - DNA, 20 bp, Artificial Sequence
  chemically synthesized
ccctaacctatcaggttgat

SEQ ID NO: 58575 - DNA, 20 bp, Artificial Sequence
  chemically synthesized
aggaattataataatattgg

SEQ ID NO: 58576 - DNA, 20 bp, Artificial Sequence
  chemically synthesized
tttggaagttaaaataaaag

SEQ ID NO: 58577 - DNA, 20 bp, Artificial Sequence
  chemically synthesized
taagtgacttctctcaatct

SEQ ID NO: 58578 - DNA, 20 bp, Artificial Sequence
  chemically synthesized
tgacttctctcaatctaagg

SEQ ID NO: 58579 - DNA, 20 bp, Artificial Sequence
  chemically synthesized
agactgaggtgaacccaaat

SEQ ID NO: 58580 - DNA, 20 bp, Artificial Sequence
  chemically synthesized
attagggtctctttaagata

SEQ ID NO: 58581 - DNA, 20 bp, Artificial Sequence
  chemically synthesized
taagataggggatctgtgag

SEQ ID NO: 58582 - DNA, 20 bp, Artificial Sequence
  chemically synthesized
atagatctttggccatatct

SEQ ID NO: 58583 - DNA, 20 bp, Artificial Sequence
  chemically synthesized
ggccatatctgagagtctgg

SEQ ID NO: 58584 - DNA, 20 bp, Artificial Sequence
  chemically synthesized
atttgtagagcctgaccttt

SEQ ID NO: 58585 - DNA, 20 bp, Artificial Sequence
  chemically synthesized
gcccgctaaggcctaaacaa

SEQ ID NO: 58586 - DNA, 20 bp, Artificial Sequence
  chemically synthesized
ggcctaaacaagtgaatctt

SEQ ID NO: 58587 - DNA, 20 bp, Artificial Sequence
  chemically synthesized
tctcttttttttttttgaga

SEQ ID NO: 58588 - DNA, 20 bp, Artificial Sequence
  chemically synthesized
tcttgttctgtcacccaggc

SEQ ID NO: 58589 - DNA, 20 bp, Artificial Sequence
  chemically synthesized
tcctcagcctcccaagtagc

SEQ ID NO: 58590 - DNA, 20 bp, Artificial Sequence
  chemically synthesized
tttttgtatttttgtagaga

SEQ ID NO: 58591 - DNA, 20 bp, Artificial Sequence
  chemically synthesized
gccttggcctcccaaaattc

SEQ ID NO: 58592 - DNA, 20 bp, Artificial Sequence
  chemically synthesized
cactcccagcctctaaacaa

SEQ ID NO: 58593 - DNA, 20 bp, Artificial Sequence
  chemically synthesized
aattgctcctcctcagacta

SEQ ID NO: 58594 - DNA, 20 bp, Artificial Sequence
  chemically synthesized
tcctcagactaaggaatatc

SEQ ID NO: 58595 - DNA, 20 bp, Artificial Sequence
  chemically synthesized
cttttgaggcaatatctttt

SEQ ID NO: 58596 - DNA, 20 bp, Artificial Sequence
  chemically synthesized
catttaagttaaataagtca

SEQ ID NO: 58597 - DNA, 20 bp, Artificial Sequence
  chemically synthesized
aatttcagatattattaact

SEQ ID NO: 58598 - DNA, 20 bp, Artificial Sequence
  chemically synthesized
aacagaggcaaaatgacaga

SEQ ID NO: 58599 - DNA, 20 bp, Artificial Sequence
  chemically synthesized
aacaaactcctgctgtgcca

SEQ ID NO: 58600 - DNA, 20 bp, Artificial Sequence
  chemically synthesized
tgccgttgatatgtaaagtg

SEQ ID NO: 58601 - DNA, 20 bp, Artificial Sequence
  chemically synthesized
taaacttgtcctcagtggta

SEQ ID NO: 58602 - DNA, 20 bp, Artificial Sequence
  chemically synthesized
tagggagtgagaagccatta

SEQ ID NO: 58603 - DNA, 20 bp, Artificial Sequence
  chemically synthesized
taagcaacctgtactattgg

SEQ ID NO: 58604 - DNA, 20 bp, Artificial Sequence
  chemically synthesized
attggctggattactattct

SEQ ID NO: 58605 - DNA, 20 bp, Artificial Sequence
  chemically synthesized
tgtgtgtgtgtgtattcatt

SEQ ID NO: 58606 - DNA, 20 bp, Artificial Sequence
  chemically synthesized
ttgctttcaattaagttatc

SEQ ID NO: 58607 - DNA, 20 bp, Artificial Sequence
  chemically synthesized
aatctagatatagctcccta

SEQ ID NO: 58608 - DNA, 20 bp, Artificial Sequence
  chemically synthesized
atatagctccctaaggggta

SEQ ID NO: 58609 - DNA, 20 bp, Artificial Sequence
  chemically synthesized
tgcatattaccgacaaatta

SEQ ID NO: 58610 - DNA, 20 bp, Artificial Sequence
  chemically synthesized
aagtacattgcagctcccac

SEQ ID NO: 58611 - DNA, 20 bp, Artificial Sequence
  chemically synthesized
agcatgtgaagtctcccatc

SEQ ID NO: 58612 - DNA, 20 bp, Artificial Sequence
  chemically synthesized
cgggaaacaccccaaatatt

SEQ ID NO: 58613 - DNA, 20 bp, Artificial Sequence
  chemically synthesized
gattctgaccttacctggag

SEQ ID NO: 58614 - DNA, 20 bp, Artificial Sequence
  chemically synthesized
tagagggccaagcaaaatac

SEQ ID NO: 58615 - DNA, 20 bp, Artificial Sequence
  chemically synthesized
ggaaaagccctgtgggctct

SEQ ID NO: 58616 - DNA, 20 bp, Artificial Sequence
  chemically synthesized
ccatttctgccttgcctcac

SEQ ID NO: 58617 - DNA, 20 bp, Artificial Sequence
  chemically synthesized
atctaggggctgggcagtgg

SEQ ID NO: 58618 - DNA, 20 bp, Artificial Sequence
  chemically synthesized
gggggggttggtggggggac

SEQ ID NO: 58619 - DNA, 20 bp, Artificial Sequence
  chemically synthesized
gattcggtgctgttgcgggg

SEQ ID NO: 58620 - DNA, 20 bp, Artificial Sequence
  chemically synthesized
ctggaagtgagaccaacctt

SEQ ID NO: 58621 - DNA, 20 bp, Artificial Sequence
  chemically synthesized
gacaaagggcatatattctt

SEQ ID NO: 58622 - DNA, 20 bp, Artificial Sequence
  chemically synthesized
gcatatattcttgggagttc

SEQ ID NO: 58623 - DNA, 20 bp, Artificial Sequence
  chemically synthesized
accaaaagtaaggaccctca

SEQ ID NO: 58624 - DNA, 20 bp, Artificial Sequence
  chemically synthesized
gacaaaccccagtaccagcc

SEQ ID NO: 58625 - DNA, 20 bp, Artificial Sequence
  chemically synthesized
cctggagtctggtagacctg

SEQ ID NO: 58626 - DNA, 20 bp, Artificial Sequence
  chemically synthesized
attcaaaacttcaggaaaca

SEQ ID NO: 58627 - DNA, 20 bp, Artificial Sequence
  chemically synthesized
aaaacttcaggaaacaatgg

SEQ ID NO: 58628 - DNA, 20 bp, Artificial Sequence
  chemically synthesized
cttcaggaaacaatggatga

SEQ ID NO: 58629 - DNA, 20 bp, Artificial Sequence
  chemically synthesized
gctctagaaagtctcagcaa

SEQ ID NO: 58630 - DNA, 20 bp, Artificial Sequence
  chemically synthesized
agagcttgaagacaaagttt

SEQ ID NO: 58631 - DNA, 20 bp, Artificial Sequence
  chemically synthesized
tccaacaaagacaaagaaaa

SEQ ID NO: 58632 - DNA, 20 bp, Artificial Sequence
  chemically synthesized
aacaaagcctccaagaaatc

SEQ ID NO: 58633 - DNA, 20 bp, Artificial Sequence
  chemically synthesized
tatgttaaacaatcaaacct

SEQ ID NO: 58634 - DNA, 20 bp, Artificial Sequence
  chemically synthesized
ttgcctaggtacattgtcat

SEQ ID NO: 58635 - DNA, 20 bp, Artificial Sequence
  chemically synthesized
caaagttatctaaagacaaa

SEQ ID NO: 58636 - DNA, 20 bp, Artificial Sequence
  chemically synthesized
agaaaccgtaaaagctagaa

SEQ ID NO: 58637 - DNA, 20 bp, Artificial Sequence
  chemically synthesized
aaacaaaacaattatcagcc

SEQ ID NO: 58638 - DNA, 20 bp, Artificial Sequence
  chemically synthesized
ttcagaaaaacaaatgctga

SEQ ID NO: 58639 - DNA, 20 bp, Artificial Sequence
  chemically synthesized
cacaggcaacaaataccacg

SEQ ID NO: 58640 - DNA, 20 bp, Artificial Sequence
  chemically synthesized
gcaacaaataccacgaagaa

SEQ ID NO: 58641 - DNA, 20 bp, Artificial Sequence
  chemically synthesized
ctcacacctcaatactgatg

SEQ ID NO: 58642 - DNA, 20 bp, Artificial Sequence
  chemically synthesized
aatgctccacttaaaagata

SEQ ID NO: 58643 - DNA, 20 bp, Artificial Sequence
  chemically synthesized
acttaaaagatacagaattg

SEQ ID NO: 58644 - DNA, 20 bp, Artificial Sequence
  chemically synthesized
aaaagatacagaattgcaga

SEQ ID NO: 58645 - DNA, 20 bp, Artificial Sequence
  chemically synthesized
tacagaattgcagaatgaat

SEQ ID NO: 58646 - DNA, 20 bp, Artificial Sequence
  chemically synthesized
ctcacataaacttaaggtaa

SEQ ID NO: 58647 - DNA, 20 bp, Artificial Sequence
  chemically synthesized
taaaagcccttgtccaatgg

SEQ ID NO: 58648 - DNA, 20 bp, Artificial Sequence
  chemically synthesized
agacagtctacaaagaaaca

SEQ ID NO: 58649 - DNA, 20 bp, Artificial Sequence
  chemically synthesized
gacattctacccaacaactg

SEQ ID NO: 58650 - DNA, 20 bp, Artificial Sequence
  chemically synthesized
agcactctctcagaccacag

SEQ ID NO: 58651 - DNA, 20 bp, Artificial Sequence
  chemically synthesized
ggaaattaaataacctgctc

SEQ ID NO: 58652 - DNA, 20 bp, Artificial Sequence
  chemically synthesized
aacctgctcctgaatgatca

SEQ ID NO: 58653 - DNA, 20 bp, Artificial Sequence
  chemically synthesized
tttgaaaaccggcacaagac

SEQ ID NO: 58654 - DNA, 20 bp, Artificial Sequence
  chemically synthesized
gacaagcagagagccaaatc

SEQ ID NO: 58655 - DNA, 20 bp, Artificial Sequence
  chemically synthesized
ccattcacaattgctgcaaa

SEQ ID NO: 58656 - DNA, 20 bp, Artificial Sequence
  chemically synthesized
acctagaaatacaacttcta

SEQ ID NO: 58657 - DNA, 20 bp, Artificial Sequence
  chemically synthesized
attccatgctcatagataga

SEQ ID NO: 58658 - DNA, 20 bp, Artificial Sequence
  chemically synthesized
gctaccactgacttttttca

SEQ ID NO: 58659 - DNA, 20 bp, Artificial Sequence
  chemically synthesized
aaactactttaaatgtcata

SEQ ID NO: 58660 - DNA, 20 bp, Artificial Sequence
  chemically synthesized
catcacaaaagcaatggaga

SEQ ID NO: 58661 - DNA, 20 bp, Artificial Sequence
  chemically synthesized
tatacaaaaattaactcaag

SEQ ID NO: 58662 - DNA, 20 bp, Artificial Sequence
  chemically synthesized
caaaggccaaaattgacata

SEQ ID NO: 58663 - DNA, 20 bp, Artificial Sequence
  chemically synthesized
gcacagcaaaagactatcat

SEQ ID NO: 58664 - DNA, 20 bp, Artificial Sequence
  chemically synthesized
cagagtgaacaggcaaccta

SEQ ID NO: 58665 - DNA, 20 bp, Artificial Sequence
  chemically synthesized
accccatcaaaaagtggaca

SEQ ID NO: 58666 - DNA, 20 bp, Artificial Sequence
  chemically synthesized
agataccatctcatgccagt

SEQ ID NO: 58667 - DNA, 20 bp, Artificial Sequence
  chemically synthesized
aggaaacaaaaggtgctgga

SEQ ID NO: 58668 - DNA, 20 bp, Artificial Sequence
  chemically synthesized
aggtgctggagaggatgtgg

SEQ ID NO: 58669 - DNA, 20 bp, Artificial Sequence
  chemically synthesized
ggaaaaattttacactgttg

SEQ ID NO: 58670 - DNA, 20 bp, Artificial Sequence
  chemically synthesized
agacagtgtggcgattcctc

SEQ ID NO: 58671 - DNA, 20 bp, Artificial Sequence
  chemically synthesized
ttgacccagcaatcccatta

SEQ ID NO: 58672 - DNA, 20 bp, Artificial Sequence
  chemically synthesized
cattactgggtatataccca

SEQ ID NO: 58673 - DNA, 20 bp, Artificial Sequence
  chemically synthesized
aaatggccatcagcgatata

SEQ ID NO: 58674 - DNA, 20 bp, Artificial Sequence
  chemically synthesized
aatgtggcacatatacacca

SEQ ID NO: 58675 - DNA, 20 bp, Artificial Sequence
  chemically synthesized
actatgcagccataaaaatg

SEQ ID NO: 58676 - DNA, 20 bp, Artificial Sequence
  chemically synthesized
gttcatgtctttgcagggac

SEQ ID NO: 58677 - DNA, 20 bp, Artificial Sequence
  chemically synthesized
acacgttctcactcataagt

SEQ ID NO: 58678 - DNA, 20 bp, Artificial Sequence
  chemically synthesized
tcacacaccagggcctgtcg

SEQ ID NO: 58679 - DNA, 20 bp, Artificial Sequence
  chemically synthesized
cagggcctgtcggggggtga

SEQ ID NO: 58680 - DNA, 20 bp, Artificial Sequence
  chemically synthesized
gggggtgagggggttaggag

SEQ ID NO: 58681 - DNA, 20 bp, Artificial Sequence
  chemically synthesized
ctaatgtagatgacaggttg

SEQ ID NO: 58682 - DNA, 20 bp, Artificial Sequence
  chemically synthesized
acacaacctatcaaaacctc

SEQ ID NO: 58683 - DNA, 20 bp, Artificial Sequence
  chemically synthesized
agccctaaatgtcgatgtca

SEQ ID NO: 58684 - DNA, 20 bp, Artificial Sequence
  chemically synthesized
ccaaaacccagcaaaagaaa

SEQ ID NO: 58685 - DNA, 20 bp, Artificial Sequence
  chemically synthesized
agaaaacctaaaggagacgt

SEQ ID NO: 58686 - DNA, 20 bp, Artificial Sequence
  chemically synthesized
gggctctagcttaagtcagg

SEQ ID NO: 58687 - DNA, 20 bp, Artificial Sequence
  chemically synthesized
aggaccagatagattcacag

SEQ ID NO: 58688 - DNA, 20 bp, Artificial Sequence
  chemically synthesized
attctaccagacattcaaag

SEQ ID NO: 58689 - DNA, 20 bp, Artificial Sequence
  chemically synthesized
ttctacaagatagagaaaga

SEQ ID NO: 58690 - DNA, 20 bp, Artificial Sequence
  chemically synthesized
atatcaaaacccatgatcaa

SEQ ID NO: 58691 - DNA, 20 bp, Artificial Sequence
  chemically synthesized
gatcaagtgggtttcatgcg

SEQ ID NO: 58692 - DNA, 20 bp, Artificial Sequence
  chemically synthesized
gggtttcatgcgagggatgc

SEQ ID NO: 58693 - DNA, 20 bp, Artificial Sequence
  chemically synthesized
agtgtgatacacaacataaa

SEQ ID NO: 58694 - DNA, 20 bp, Artificial Sequence
  chemically synthesized
aacacacagccaacattata

SEQ ID NO: 58695 - DNA, 20 bp, Artificial Sequence
  chemically synthesized
aaagcattctgtctgaaaac

SEQ ID NO: 58696 - DNA, 20 bp, Artificial Sequence
  chemically synthesized
tctgaaaactggaatgagac

SEQ ID NO: 58697 - DNA, 20 bp, Artificial Sequence
  chemically synthesized
aaaataattcagcaaagttt

SEQ ID NO: 58698 - DNA, 20 bp, Artificial Sequence
  chemically synthesized
tacaaaattaacgtacacca

SEQ ID NO: 58699 - DNA, 20 bp, Artificial Sequence
  chemically synthesized
ataccagcaatgaccaagct

SEQ ID NO: 58700 - DNA, 20 bp, Artificial Sequence
  chemically synthesized
acaaaacaaaacaaaaactt

SEQ ID NO: 58701 - DNA, 20 bp, Artificial Sequence
  chemically synthesized
aacacatgccattctcatag

SEQ ID NO: 58702 - DNA, 20 bp, Artificial Sequence
  chemically synthesized
atgccattctcatagatggg

SEQ ID NO: 58703 - DNA, 20 bp, Artificial Sequence
  chemically synthesized
aggcacatcgaccaatggaa

SEQ ID NO: 58704 - DNA, 20 bp, Artificial Sequence
  chemically synthesized
ccctattcaacaaatggtgc

SEQ ID NO: 58705 - DNA, 20 bp, Artificial Sequence
  chemically synthesized
agctggcaagctacatgtag

SEQ ID NO: 58706 - DNA, 20 bp, Artificial Sequence
  chemically synthesized
ctacatgtaggagaatgaaa

SEQ ID NO: 58707 - DNA, 20 bp, Artificial Sequence
  chemically synthesized
tatacaaaaatcaactcaag

SEQ ID NO: 58708 - DNA, 20 bp, Artificial Sequence
  chemically synthesized
ttctacacattggcttagga

SEQ ID NO: 58709 - DNA, 20 bp, Artificial Sequence
  chemically synthesized
agcttttgcatggcaaaagg

SEQ ID NO: 58710 - DNA, 20 bp, Artificial Sequence
  chemically synthesized
atggcaaaaggaagagtctg

SEQ ID NO: 58711 - DNA, 20 bp, Artificial Sequence
  chemically synthesized
cagaataaacagacaaccca

SEQ ID NO: 58712 - DNA, 20 bp, Artificial Sequence
  chemically synthesized
acaatctatacatctgacaa

SEQ ID NO: 58713 - DNA, 20 bp, Artificial Sequence
  chemically synthesized
aaaaaataacagatccttgt

SEQ ID NO: 58714 - DNA, 20 bp, Artificial Sequence
  chemically synthesized
ctttcttacacactgttggt

SEQ ID NO: 58715 - DNA, 20 bp, Artificial Sequence
  chemically synthesized
tattcacaatagttaaggtt

SEQ ID NO: 58716 - DNA, 20 bp, Artificial Sequence
  chemically synthesized
aagtgtctatcaacagatga

SEQ ID NO: 58717 - DNA, 20 bp, Artificial Sequence
  chemically synthesized
agtactattttgccatgaaa

SEQ ID NO: 58718 - DNA, 20 bp, Artificial Sequence
  chemically synthesized
atcttgtcatttgtagcaac

SEQ ID NO: 58719 - DNA, 20 bp, Artificial Sequence
  chemically synthesized
catctgtgggagctaaaaaa

SEQ ID NO: 58720 - DNA, 20 bp, Artificial Sequence
  chemically synthesized
aagtgggtctcatggtggta

SEQ ID NO: 58721 - DNA, 20 bp, Artificial Sequence
  chemically synthesized
ggtctcatggtggtagagag

SEQ ID NO: 58722 - DNA, 20 bp, Artificial Sequence
  chemically synthesized
tatcagaggctggaaaaagt

SEQ ID NO: 58723 - DNA, 20 bp, Artificial Sequence
  chemically synthesized
aagtgtgagtgtgtatggga

SEQ ID NO: 58724 - DNA, 20 bp, Artificial Sequence
  chemically synthesized
gttaataggtacaaacacag

SEQ ID NO: 58725 - DNA, 20 bp, Artificial Sequence
  chemically synthesized
gtacaaacacagttggatag

SEQ ID NO: 58726 - DNA, 20 bp, Artificial Sequence
  chemically synthesized
taagccataatgtttgatat

SEQ ID NO: 58727 - DNA, 20 bp, Artificial Sequence
  chemically synthesized
cataatgtttgatatttgag

SEQ ID NO: 58728 - DNA, 20 bp, Artificial Sequence
  chemically synthesized
atttcaaaatggctagaaat

SEQ ID NO: 58729 - DNA, 20 bp, Artificial Sequence
  chemically synthesized
aatgataaatgctcaaagca

SEQ ID NO: 58730 - DNA, 20 bp, Artificial Sequence
  chemically synthesized
aggtgaaaatatttagtgcc

SEQ ID NO: 58731 - DNA, 20 bp, Artificial Sequence
  chemically synthesized
atttgtctctctcccatatt

SEQ ID NO: 58732 - DNA, 20 bp, Artificial Sequence
  chemically synthesized
tccctctacccttcacacat

SEQ ID NO: 58733 - DNA, 20 bp, Artificial Sequence
  chemically synthesized
ttctcatctcccacagtcag

SEQ ID NO: 58734 - DNA, 20 bp, Artificial Sequence
  chemically synthesized
ccacagactcactgctcctc

SEQ ID NO: 58735 - DNA, 20 bp, Artificial Sequence
  chemically synthesized
gaaccattgtatctgtcccc

SEQ ID NO: 58736 - DNA, 20 bp, Artificial Sequence
  chemically synthesized
attttattttatctgcaaac

SEQ ID NO: 58737 - DNA, 20 bp, Artificial Sequence
  chemically synthesized
ttttcccaaaatcttatttc

SEQ ID NO: 58738 - DNA, 20 bp, Artificial Sequence
  chemically synthesized
aagccctagcttgctggttt

SEQ ID NO: 58739 - DNA, 20 bp, Artificial Sequence
  chemically synthesized
tcagctaacccatgaaataa

SEQ ID NO: 58740 - DNA, 20 bp, Artificial Sequence
  chemically synthesized
agctacttcaaaatgtaaat

SEQ ID NO: 58741 - DNA, 20 bp, Artificial Sequence
  chemically synthesized
tagtaattctagcctatatc

SEQ ID NO: 58742 - DNA, 20 bp, Artificial Sequence
  chemically synthesized
cggtgcagtaaaaactgcct

SEQ ID NO: 58743 - DNA, 20 bp, Artificial Sequence
  chemically synthesized
ctccatcatatcatcctcct

SEQ ID NO: 58744 - DNA, 20 bp, Artificial Sequence
  chemically synthesized
tatcatcctccttggaatcc

SEQ ID NO: 58745 - DNA, 20 bp, Artificial Sequence
  chemically synthesized
acactttttccttttaacac

SEQ ID NO: 58746 - DNA, 20 bp, Artificial Sequence
  chemically synthesized
ccagtccccatgtgcagaag

SEQ ID NO: 58747 - DNA, 20 bp, Artificial Sequence
  chemically synthesized
catgtgcagaaggagggtgt

SEQ ID NO: 58748 - DNA, 20 bp, Artificial Sequence
  chemically synthesized
tgccaggcagcctgcacttc

SEQ ID NO: 58749 - DNA, 20 bp, Artificial Sequence
  chemically synthesized
ggggtgaactccttgccaaa

SEQ ID NO: 58750 - DNA, 20 bp, Artificial Sequence
  chemically synthesized
tccttgccaaagtgagtagc

SEQ ID NO: 58751 - DNA, 20 bp, Artificial Sequence
  chemically synthesized
caaaataacacacaggcatg

SEQ ID NO: 58752 - DNA, 20 bp, Artificial Sequence
  chemically synthesized
tccccattttaccagtatta

SEQ ID NO: 58753 - DNA, 20 bp, Artificial Sequence
  chemically synthesized
ttgtctaatttttgtaaatg

SEQ ID NO: 58754 - DNA, 20 bp, Artificial Sequence
  chemically synthesized
aatttttgtaaatgtagaat

SEQ ID NO: 58755 - DNA, 20 bp, Artificial Sequence
  chemically synthesized
atgtagaatgtgagtgctgc

SEQ ID NO: 58756 - DNA, 20 bp, Artificial Sequence
  chemically synthesized
gtgctgcaagagttctcagc

SEQ ID NO: 58757 - DNA, 20 bp, Artificial Sequence
  chemically synthesized
aattctataatacaattctc

SEQ ID NO: 58758 - DNA, 20 bp, Artificial Sequence
  chemically synthesized
gtcctttactgtcactagtt

SEQ ID NO: 58759 - DNA, 20 bp, Artificial Sequence
  chemically synthesized
tgaactcaccttgaagttct

SEQ ID NO: 58760 - DNA, 20 bp, Artificial Sequence
  chemically synthesized
cttgccatgggccttgacct

SEQ ID NO: 58761 - DNA, 20 bp, Artificial Sequence
  chemically synthesized
gccttgaccttggggttgcc

SEQ ID NO: 58762 - DNA, 20 bp, Artificial Sequence
  chemically synthesized
ccaaagctgtcaaaaaatct

SEQ ID NO: 58763 - DNA, 20 bp, Artificial Sequence
  chemically synthesized
gtcaaaaaatctctgggtcc

SEQ ID NO: 58764 - DNA, 20 bp, Artificial Sequence
  chemically synthesized
gggtccaggggtaaacaacg

SEQ ID NO: 58765 - DNA, 20 bp, Artificial Sequence
  chemically synthesized
gactttcccaatcaacttgc

SEQ ID NO: 58766 - DNA, 20 bp, Artificial Sequence
  chemically synthesized
aaggctgacctgtgtccctc

SEQ ID NO: 58767 - DNA, 20 bp, Artificial Sequence
  chemically synthesized
tgacctgtgtccctcagggg

SEQ ID NO: 58768 - DNA, 20 bp, Artificial Sequence
  chemically synthesized
ggggtggagtcaggtccgga

SEQ ID NO: 58769 - DNA, 20 bp, Artificial Sequence
  chemically synthesized
tccggagagggtcagcagtg

SEQ ID NO: 58770 - DNA, 20 bp, Artificial Sequence
  chemically synthesized
taagtttgtgataatgtgtg

SEQ ID NO: 58771 - DNA, 20 bp, Artificial Sequence
  chemically synthesized
agaaaataaagctgttaaaa

SEQ ID NO: 58772 - DNA, 20 bp, Artificial Sequence
  chemically synthesized
acccagttctagctctctta

SEQ ID NO: 58773 - DNA, 20 bp, Artificial Sequence
  chemically synthesized
agttccttctagaaactgaa

SEQ ID NO: 58774 - DNA, 20 bp, Artificial Sequence
  chemically synthesized
aatcccaaagtacagtacct

SEQ ID NO: 58775 - DNA, 20 bp, Artificial Sequence
  chemically synthesized
gattacatccagtgcttcca

SEQ ID NO: 58776 - DNA, 20 bp, Artificial Sequence
  chemically synthesized
caggggacattggctacttt

SEQ ID NO: 58777 - DNA, 20 bp, Artificial Sequence
  chemically synthesized
atcctaaaattatttaaagc

SEQ ID NO: 58778 - DNA, 20 bp, Artificial Sequence
  chemically synthesized
gtcatcaaacagagaaaaaa

SEQ ID NO: 58779 - DNA, 20 bp, Artificial Sequence
  chemically synthesized
atcgatatattaatcaggct

SEQ ID NO: 58780 - DNA, 20 bp, Artificial Sequence
  chemically synthesized
atattaatcaggctaggagt

SEQ ID NO: 58781 - DNA, 20 bp, Artificial Sequence
  chemically synthesized
gtagagctgaaactggaagt

SEQ ID NO: 58782 - DNA, 20 bp, Artificial Sequence
  chemically synthesized
caattcgatccatgtgcctg

SEQ ID NO: 58783 - DNA, 20 bp, Artificial Sequence
  chemically synthesized
ttgtcattatcctcatattt

SEQ ID NO: 58784 - DNA, 20 bp, Artificial Sequence
  chemically synthesized
atcctcatattttagaatca

SEQ ID NO: 58785 - DNA, 20 bp, Artificial Sequence
  chemically synthesized
gtgacagaagtaatgattgg

SEQ ID NO: 58786 - DNA, 20 bp, Artificial Sequence
  chemically synthesized
gattgggggaataatagaag

SEQ ID NO: 58787 - DNA, 20 bp, Artificial Sequence
  chemically synthesized
ttttttttttttttttgaga

SEQ ID NO: 58788 - DNA, 20 bp, Artificial Sequence
  chemically synthesized
gtctcactctgttgccagac

SEQ ID NO: 58789 - DNA, 20 bp, Artificial Sequence
  chemically synthesized
ctcactgcaaccttcgcctc

SEQ ID NO: 58790 - DNA, 20 bp, Artificial Sequence
  chemically synthesized
ttttttatttttagtagaga

SEQ ID NO: 58791 - DNA, 20 bp, Artificial Sequence
  chemically synthesized
cgggatttcaccatgtttgc

SEQ ID NO: 58792 - DNA, 20 bp, Artificial Sequence
  chemically synthesized
ccccttgccccaccagatct

SEQ ID NO: 58793 - DNA, 20 bp, Artificial Sequence
  chemically synthesized
ctcccaagtcaagtgccttt

SEQ ID NO: 58794 - DNA, 20 bp, Artificial Sequence
  chemically synthesized
aaaaaacacttgtggcaagt

SEQ ID NO: 58795 - DNA, 20 bp, Artificial Sequence
  chemically synthesized
attgttattattccaggcca

SEQ ID NO: 58796 - DNA, 20 bp, Artificial Sequence
  chemically synthesized
tggctaacacagacaaaacc

SEQ ID NO: 58797 - DNA, 20 bp, Artificial Sequence
  chemically synthesized
ttgcatcaaataatatacat

SEQ ID NO: 58798 - DNA, 20 bp, Artificial Sequence
  chemically synthesized
ctttatgaaagcattagatc

SEQ ID NO: 58799 - DNA, 20 bp, Artificial Sequence
  chemically synthesized
tgaaagcattagatctagga

SEQ ID NO: 58800 - DNA, 20 bp, Artificial Sequence
  chemically synthesized
aagtagtgatgcagataaat

SEQ ID NO: 58801 - DNA, 20 bp, Artificial Sequence
  chemically synthesized
cgggcagatcatctgaggtc

SEQ ID NO: 58802 - DNA, 20 bp, Artificial Sequence
  chemically synthesized
tactcaggaggccaaggcag

SEQ ID NO: 58803 - DNA, 20 bp, Artificial Sequence
  chemically synthesized
ggccaaggcaggagaattgc

SEQ ID NO: 58804 - DNA, 20 bp, Artificial Sequence
  chemically synthesized
taaccaattaagatacagct

SEQ ID NO: 58805 - DNA, 20 bp, Artificial Sequence
  chemically synthesized
tacagctctgggttttcagg

SEQ ID NO: 58806 - DNA, 20 bp, Artificial Sequence
  chemically synthesized
cagtggcccttcctcagaac

SEQ ID NO: 58807 - DNA, 20 bp, Artificial Sequence
  chemically synthesized
cttcctcagaacttgaatgt

SEQ ID NO: 58808 - DNA, 20 bp, Artificial Sequence
  chemically synthesized
tcagacattgccaaagtcca

SEQ ID NO: 58809 - DNA, 20 bp, Artificial Sequence
  chemically synthesized
ggaccaggtatctcaaggcc

SEQ ID NO: 58810 - DNA, 20 bp, Artificial Sequence
  chemically synthesized
ttctccctaaaacaagccct

SEQ ID NO: 58811 - DNA, 20 bp, Artificial Sequence
  chemically synthesized
atcccatcattcttcccatt

SEQ ID NO: 58812 - DNA, 20 bp, Artificial Sequence
  chemically synthesized
caccagtcttctcttagatt

SEQ ID NO: 58813 - DNA, 20 bp, Artificial Sequence
  chemically synthesized
cttctcttagattcagagta

SEQ ID NO: 58814 - DNA, 20 bp, Artificial Sequence
  chemically synthesized
tccagacctggcttgcatcc

SEQ ID NO: 58815 - DNA, 20 bp, Artificial Sequence
  chemically synthesized
catatgagataccatgaaaa

SEQ ID NO: 58816 - DNA, 20 bp, Artificial Sequence
  chemically synthesized
agataagtgttatggccatc

SEQ ID NO: 58817 - DNA, 20 bp, Artificial Sequence
  chemically synthesized
agtcagaaaaagtaatcagt

SEQ ID NO: 58818 - DNA, 20 bp, Artificial Sequence
  chemically synthesized
gaagattaattcctgcctgt

SEQ ID NO: 58819 - DNA, 20 bp, Artificial Sequence
  chemically synthesized
gtaatttcttaagttctatg

SEQ ID NO: 58820 - DNA, 20 bp, Artificial Sequence
  chemically synthesized
tatgacatatgtttaacctg

SEQ ID NO: 58821 - DNA, 20 bp, Artificial Sequence
  chemically synthesized
aaagtaggcccttcacttca

SEQ ID NO: 58822 - DNA, 20 bp, Artificial Sequence
  chemically synthesized
tctaagaaataaatacttta

SEQ ID NO: 58823 - DNA, 20 bp, Artificial Sequence
  chemically synthesized
ctgataggaaaagagctgct

SEQ ID NO: 58824 - DNA, 20 bp, Artificial Sequence
  chemically synthesized
tgttagattttgcattatcc

SEQ ID NO: 58825 - DNA, 20 bp, Artificial Sequence
  chemically synthesized
ttgcattatccaggaatgac

SEQ ID NO: 58826 - DNA, 20 bp, Artificial Sequence
  chemically synthesized
tattttctagtgtaattgta

SEQ ID NO: 58827 - DNA, 20 bp, Artificial Sequence
  chemically synthesized
agtgtaattgtaaagaatga

SEQ ID NO: 58828 - DNA, 20 bp, Artificial Sequence
  chemically synthesized
tcaacttttattttaagttc

SEQ ID NO: 58829 - DNA, 20 bp, Artificial Sequence
  chemically synthesized
taagttcaggggtacatgta

SEQ ID NO: 58830 - DNA, 20 bp, Artificial Sequence
  chemically synthesized
caggtttgttacatagataa

SEQ ID NO: 58831 - DNA, 20 bp, Artificial Sequence
  chemically synthesized
catagataaatgaatgtcaa

SEQ ID NO: 58832 - DNA, 20 bp, Artificial Sequence
  chemically synthesized
agtatgcgttgtttccctct

SEQ ID NO: 58833 - DNA, 20 bp, Artificial Sequence
  chemically synthesized
atctctcacgaagtttgcag

SEQ ID NO: 58834 - DNA, 20 bp, Artificial Sequence
  chemically synthesized
cagggctgaggctcattctc

SEQ ID NO: 58835 - DNA, 20 bp, Artificial Sequence
  chemically synthesized
cactgtgcctaaagtacaac

SEQ ID NO: 58836 - DNA, 20 bp, Artificial Sequence
  chemically synthesized
aagtacaaccagagttactt

SEQ ID NO: 58837 - DNA, 20 bp, Artificial Sequence
  chemically synthesized
gtgaatgttaattaagcagg

SEQ ID NO: 58838 - DNA, 20 bp, Artificial Sequence
  chemically synthesized
agggatctttaatgggaaaa

SEQ ID NO: 58839 - DNA, 20 bp, Artificial Sequence
  chemically synthesized
gggaaaaaggagtagaaagc

SEQ ID NO: 58840 - DNA, 20 bp, Artificial Sequence
  chemically synthesized
tgggcactgaaggttaaaac

SEQ ID NO: 58841 - DNA, 20 bp, Artificial Sequence
  chemically synthesized
ttctttgaccttttgggacc

SEQ ID NO: 58842 - DNA, 20 bp, Artificial Sequence
  chemically synthesized
attaaaattctaagaaattc

SEQ ID NO: 58843 - DNA, 20 bp, Artificial Sequence
  chemically synthesized
aacaatactctgaagtagtt

SEQ ID NO: 58844 - DNA, 20 bp, Artificial Sequence
  chemically synthesized
atgtgctttcaatttatata

SEQ ID NO: 58845 - DNA, 20 bp, Artificial Sequence
  chemically synthesized
actattttaagtgcagggct

SEQ ID NO: 58846 - DNA, 20 bp, Artificial Sequence
  chemically synthesized
actataacatagtatgtttc

SEQ ID NO: 58847 - DNA, 20 bp, Artificial Sequence
  chemically synthesized
ctctggagaaggttaaaact

SEQ ID NO: 58848 - DNA, 20 bp, Artificial Sequence
  chemically synthesized
cccctctgttttgtgtcact

SEQ ID NO: 58849 - DNA, 20 bp, Artificial Sequence
  chemically synthesized
tgttttgtgtcactaagggt

SEQ ID NO: 58850 - DNA, 20 bp, Artificial Sequence
  chemically synthesized
tgtcactaagggtgaggatg

SEQ ID NO: 58851 - DNA, 20 bp, Artificial Sequence
  chemically synthesized
atcaataattctagccccac

SEQ ID NO: 58852 - DNA, 20 bp, Artificial Sequence
  chemically synthesized
attatttttttctttagact

SEQ ID NO: 58853 - DNA, 20 bp, Artificial Sequence
  chemically synthesized
ggcagcgtcagaaactgtgt

SEQ ID NO: 58854 - DNA, 20 bp, Artificial Sequence
  chemically synthesized
ggggcctagctaaaggcagt

SEQ ID NO: 58855 - DNA, 20 bp, Artificial Sequence
  chemically synthesized
tagctaaaggcagtgagagt

SEQ ID NO: 58856 - DNA, 20 bp, Artificial Sequence
  chemically synthesized
aaggctataggttagtgttt

SEQ ID NO: 58857 - DNA, 20 bp, Artificial Sequence
  chemically synthesized
accagataacttgcaagtcc

SEQ ID NO: 58858 - DNA, 20 bp, Artificial Sequence
  chemically synthesized
atcacacactggggcctgtt

SEQ ID NO: 58859 - DNA, 20 bp, Artificial Sequence
  chemically synthesized
tgggggtggggggctagggg

SEQ ID NO: 58860 - DNA, 20 bp, Artificial Sequence
  chemically synthesized
agaaatacctaatgtagatg

SEQ ID NO: 58861 - DNA, 20 bp, Artificial Sequence
  chemically synthesized
ctaatgtagatgacgggttg

SEQ ID NO: 58862 - DNA, 20 bp, Artificial Sequence
  chemically synthesized
tcaaatttaactataagaga

SEQ ID NO: 58863 - DNA, 20 bp, Artificial Sequence
  chemically synthesized
aattcttaactataatctta

SEQ ID NO: 58864 - DNA, 20 bp, Artificial Sequence
  chemically synthesized
aatcttacagaatattctca

SEQ ID NO: 58865 - DNA, 20 bp, Artificial Sequence
  chemically synthesized
aggccatccttcccatgaag

SEQ ID NO: 58866 - DNA, 20 bp, Artificial Sequence
  chemically synthesized
catccttcccatgaagatgg

SEQ ID NO: 58867 - DNA, 20 bp, Artificial Sequence
  chemically synthesized
aattaattgcttacataaac

SEQ ID NO: 58868 - DNA, 20 bp, Artificial Sequence
  chemically synthesized
aatctcagcctacaaaacaa

SEQ ID NO: 58869 - DNA, 20 bp, Artificial Sequence
  chemically synthesized
ttctttgtgtgtgcatagca

SEQ ID NO: 58870 - DNA, 20 bp, Artificial Sequence
  chemically synthesized
ttcaaaattgtaaaattgct

SEQ ID NO: 58871 - DNA, 20 bp, Artificial Sequence
  chemically synthesized
ctaagaatacagcacaaaaa

SEQ ID NO: 58872 - DNA, 20 bp, Artificial Sequence
  chemically synthesized
acagcacaaaaacagaatag

SEQ ID NO: 58873 - DNA, 20 bp, Artificial Sequence
  chemically synthesized
aaaaaaactgaaatgaaggc

SEQ ID NO: 58874 - DNA, 20 bp, Artificial Sequence
  chemically synthesized
aggccagagtgtgattagga

SEQ ID NO: 58875 - DNA, 20 bp, Artificial Sequence
  chemically synthesized
gtgtgattaggacagggtga

SEQ ID NO: 58876 - DNA, 20 bp, Artificial Sequence
  chemically synthesized
actataaagttaacacctga

SEQ ID NO: 58877 - DNA, 20 bp, Artificial Sequence
  chemically synthesized
gattaaatatttagggcata

SEQ ID NO: 58878 - DNA, 20 bp, Artificial Sequence
  chemically synthesized
ccctaaagatgtaagatgct

SEQ ID NO: 58879 - DNA, 20 bp, Artificial Sequence
  chemically synthesized
taagatgcttagaattttca

SEQ ID NO: 58880 - DNA, 20 bp, Artificial Sequence
  chemically synthesized
gaatatcaataaggccaatg

SEQ ID NO: 58881 - DNA, 20 bp, Artificial Sequence
  chemically synthesized
ggatgagattcggtgaaggg

SEQ ID NO: 58882 - DNA, 20 bp, Artificial Sequence
  chemically synthesized
cactaataatacctacatca

SEQ ID NO: 58883 - DNA, 20 bp, Artificial Sequence
  chemically synthesized
atgcatgaacaactattgta

SEQ ID NO: 58884 - DNA, 20 bp, Artificial Sequence
  chemically synthesized
caactattgtagagaattgt

SEQ ID NO: 58885 - DNA, 20 bp, Artificial Sequence
  chemically synthesized
tacattttgaaaagactaat

SEQ ID NO: 58886 - DNA, 20 bp, Artificial Sequence
  chemically synthesized
gtagaagcaggaagattgtt

SEQ ID NO: 58887 - DNA, 20 bp, Artificial Sequence
  chemically synthesized
gtggtgacagtgacttagac

SEQ ID NO: 58888 - DNA, 20 bp, Artificial Sequence
  chemically synthesized
tagcattggaggtgaaggca

SEQ ID NO: 58889 - DNA, 20 bp, Artificial Sequence
  chemically synthesized
atcctttcacgaaaaaccaa

SEQ ID NO: 58890 - DNA, 20 bp, Artificial Sequence
  chemically synthesized
accaacaggattttctgaca

SEQ ID NO: 58891 - DNA, 20 bp, Artificial Sequence
  chemically synthesized
ggattttctgacagagaata

SEQ ID NO: 58892 - DNA, 20 bp, Artificial Sequence
  chemically synthesized
gtgcatgctaatttctggct

SEQ ID NO: 58893 - DNA, 20 bp, Artificial Sequence
  chemically synthesized
ttctggctgtgagtatatgt

SEQ ID NO: 58894 - DNA, 20 bp, Artificial Sequence
  chemically synthesized
ctgtgagtatatgtcagagt

SEQ ID NO: 58895 - DNA, 20 bp, Artificial Sequence
  chemically synthesized
ggattttgaagctaggcaaa

SEQ ID NO: 58896 - DNA, 20 bp, Artificial Sequence
  chemically synthesized
aagctaggcaaagtgagtct

SEQ ID NO: 58897 - DNA, 20 bp, Artificial Sequence
  chemically synthesized
aggcaaagtgagtctttggg

SEQ ID NO: 58898 - DNA, 20 bp, Artificial Sequence
  chemically synthesized
gttcatcacagtctctacct

SEQ ID NO: 58899 - DNA, 20 bp, Artificial Sequence
  chemically synthesized
ttggctttaaaattggaaag

SEQ ID NO: 58900 - DNA, 20 bp, Artificial Sequence
  chemically synthesized
ctttaaaattggaaagctgg

SEQ ID NO: 58901 - DNA, 20 bp, Artificial Sequence
  chemically synthesized
aaaattggaaagctgggtgg

SEQ ID NO: 58902 - DNA, 20 bp, Artificial Sequence
  chemically synthesized
aaagtgacatcaagtatttc

SEQ ID NO: 58903 - DNA, 20 bp, Artificial Sequence
  chemically synthesized
taagtcagagaacaatcaga

SEQ ID NO: 58904 - DNA, 20 bp, Artificial Sequence
  chemically synthesized
gacagaattctgttcggtca

SEQ ID NO: 58905 - DNA, 20 bp, Artificial Sequence
  chemically synthesized
ctgttcggtcagggaatttg

SEQ ID NO: 58906 - DNA, 20 bp, Artificial Sequence
  chemically synthesized
tgttttcgtttttctttaga

SEQ ID NO: 58907 - DNA, 20 bp, Artificial Sequence
  chemically synthesized
cagagtctcgctctggaggc

SEQ ID NO: 58908 - DNA, 20 bp, Artificial Sequence
  chemically synthesized
tgcctcagcctcccaagtag

SEQ ID NO: 58909 - DNA, 20 bp, Artificial Sequence
  chemically synthesized
tcccaaactgctgtgattac

SEQ ID NO: 58910 - DNA, 20 bp, Artificial Sequence
  chemically synthesized
gagtgagccaccgcacctca

SEQ ID NO: 58911 - DNA, 20 bp, Artificial Sequence
  chemically synthesized
taggctgtgacctctgcact

SEQ ID NO: 58912 - DNA, 20 bp, Artificial Sequence
  chemically synthesized
gaggcgtgcctccatccctg

SEQ ID NO: 58913 - DNA, 20 bp, Artificial Sequence
  chemically synthesized
atgagtttttcctccatgtg

SEQ ID NO: 58914 - DNA, 20 bp, Artificial Sequence
  chemically synthesized
tttttcctccatgtgtagaa

SEQ ID NO: 58915 - DNA, 20 bp, Artificial Sequence
  chemically synthesized
catgtgtagaattgaataag

SEQ ID NO: 58916 - DNA, 20 bp, Artificial Sequence
  chemically synthesized
gtagaattgaataagaagga

SEQ ID NO: 58917 - DNA, 20 bp, Artificial Sequence
  chemically synthesized
agaattcaatttaacaagct

SEQ ID NO: 58918 - DNA, 20 bp, Artificial Sequence
  chemically synthesized
aggcccaatataaaatgaaa

SEQ ID NO: 58919 - DNA, 20 bp, Artificial Sequence
  chemically synthesized
tagcccctttgtcaaaaatt

SEQ ID NO: 58920 - DNA, 20 bp, Artificial Sequence
  chemically synthesized
gatttcatgtcaggaacagc

SEQ ID NO: 58921 - DNA, 20 bp, Artificial Sequence
  chemically synthesized
attcatgatacgaaaaaata

SEQ ID NO: 58922 - DNA, 20 bp, Artificial Sequence
  chemically synthesized
agtctttctagacccatcca

SEQ ID NO: 58923 - DNA, 20 bp, Artificial Sequence
  chemically synthesized
atcattcattcacagcgaaa

SEQ ID NO: 58924 - DNA, 20 bp, Artificial Sequence
  chemically synthesized
aagaggtcattcattcacaa

SEQ ID NO: 58925 - DNA, 20 bp, Artificial Sequence
  chemically synthesized
agtatacgtgaggtcctgta

SEQ ID NO: 58926 - DNA, 20 bp, Artificial Sequence
  chemically synthesized
aacccttttagctctcctgg

SEQ ID NO: 58927 - DNA, 20 bp, Artificial Sequence
  chemically synthesized
gaggaatgtttctttcctct

SEQ ID NO: 58928 - DNA, 20 bp, Artificial Sequence
  chemically synthesized
tgtttctttcctctcaggat

SEQ ID NO: 58929 - DNA, 20 bp, Artificial Sequence
  chemically synthesized
cttttgccacctagctgtcc

SEQ ID NO: 58930 - DNA, 20 bp, Artificial Sequence
  chemically synthesized
attcaggaaataatatattc

SEQ ID NO: 58931 - DNA, 20 bp, Artificial Sequence
  chemically synthesized
ctttatgatgccgtttgagg

SEQ ID NO: 58932 - DNA, 20 bp, Artificial Sequence
  chemically synthesized
atcctgctggggacccagat

SEQ ID NO: 58933 - DNA, 20 bp, Artificial Sequence
  chemically synthesized
gttacacagaaccagaaggc

SEQ ID NO: 58934 - DNA, 20 bp, Artificial Sequence
  chemically synthesized
aagcttatttaatcagagat

SEQ ID NO: 58935 - DNA, 20 bp, Artificial Sequence
  chemically synthesized
tcagagatgaggatgctgga

SEQ ID NO: 58936 - DNA, 20 bp, Artificial Sequence
  chemically synthesized
aaatggttttgaagcacctg

SEQ ID NO: 58937 - DNA, 20 bp, Artificial Sequence
  chemically synthesized
ctaaacactattttcagtgc

SEQ ID NO: 58938 - DNA, 20 bp, Artificial Sequence
  chemically synthesized
tcagtgcttgaatcataaat

SEQ ID NO: 58939 - DNA, 20 bp, Artificial Sequence
  chemically synthesized
acatgtatcttattccccac

SEQ ID NO: 58940 - DNA, 20 bp, Artificial Sequence
  chemically synthesized
atgtgctctgtcccccaggc

SEQ ID NO: 58941 - DNA, 20 bp, Artificial Sequence
  chemically synthesized
ctcactgcaacctccgcctc

SEQ ID NO: 58942 - DNA, 20 bp, Artificial Sequence
  chemically synthesized
gcctcagccaccctaatagc

SEQ ID NO: 58943 - DNA, 20 bp, Artificial Sequence
  chemically synthesized
ttttgtactttttgtagagg

SEQ ID NO: 58944 - DNA, 20 bp, Artificial Sequence
  chemically synthesized
acctcagcctcccaaagtgc

SEQ ID NO: 58945 - DNA, 20 bp, Artificial Sequence
  chemically synthesized
atatttaatagaggtattta

SEQ ID NO: 58946 - DNA, 20 bp, Artificial Sequence
  chemically synthesized
gtatttatgggatgggggaa

SEQ ID NO: 58947 - DNA, 20 bp, Artificial Sequence
  chemically synthesized
aaaagaatgtttctctcact

SEQ ID NO: 58948 - DNA, 20 bp, Artificial Sequence
  chemically synthesized
tctcactgtggattatttta

SEQ ID NO: 58949 - DNA, 20 bp, Artificial Sequence
  chemically synthesized
gtggattattttagagagtg

SEQ ID NO: 58950 - DNA, 20 bp, Artificial Sequence
  chemically synthesized
gaaaatttatttttttgttg

SEQ ID NO: 58951 - DNA, 20 bp, Artificial Sequence
  chemically synthesized
ctggctaagacacagtgaga

SEQ ID NO: 58952 - DNA, 20 bp, Artificial Sequence
  chemically synthesized
cagaaatttcataagtctac

SEQ ID NO: 58953 - DNA, 20 bp, Artificial Sequence
  chemically synthesized
aggcagatcacataagaaaa

SEQ ID NO: 58954 - DNA, 20 bp, Artificial Sequence
  chemically synthesized
gatgccagttaaggtctgca

SEQ ID NO: 58955 - DNA, 20 bp, Artificial Sequence
  chemically synthesized
tgagtatgagcccatccctg

SEQ ID NO: 58956 - DNA, 20 bp, Artificial Sequence
  chemically synthesized
ttcttgaagtctctgaaata

SEQ ID NO: 58957 - DNA, 20 bp, Artificial Sequence
  chemically synthesized
tgataatatgtattagctaa

SEQ ID NO: 58958 - DNA, 20 bp, Artificial Sequence
  chemically synthesized
gtattagctaatagaattat

SEQ ID NO: 58959 - DNA, 20 bp, Artificial Sequence
  chemically synthesized
tacagttgcatgctacctta

SEQ ID NO: 58960 - DNA, 20 bp, Artificial Sequence
  chemically synthesized
agcccatcagggaagacata

SEQ ID NO: 58961 - DNA, 20 bp, Artificial Sequence
  chemically synthesized
gaagacatagggagttctgt

SEQ ID NO: 58962 - DNA, 20 bp, Artificial Sequence
  chemically synthesized
acatagggagttctgtagga

SEQ ID NO: 58963 - DNA, 20 bp, Artificial Sequence
  chemically synthesized
acccggcaaagggagatgca

SEQ ID NO: 58964 - DNA, 20 bp, Artificial Sequence
  chemically synthesized
cctcagttcttgacgctagt

SEQ ID NO: 58965 - DNA, 20 bp, Artificial Sequence
  chemically synthesized
ctgaggcactgaggtcactg

SEQ ID NO: 58966 - DNA, 20 bp, Artificial Sequence
  chemically synthesized
gcaggatgaagacggagcca

SEQ ID NO: 58967 - DNA, 20 bp, Artificial Sequence
  chemically synthesized
gagccaatgggttagaccag

SEQ ID NO: 58968 - DNA, 20 bp, Artificial Sequence
  chemically synthesized
ccaaagttgcagcttgacca

SEQ ID NO: 58969 - DNA, 20 bp, Artificial Sequence
  chemically synthesized
gcagcttgaccaaggggtca

SEQ ID NO: 58970 - DNA, 20 bp, Artificial Sequence
  chemically synthesized
agaagcaagggccacagggc

SEQ ID NO: 58971 - DNA, 20 bp, Artificial Sequence
  chemically synthesized
atttctcgcatccacaatat

SEQ ID NO: 58972 - DNA, 20 bp, Artificial Sequence
  chemically synthesized
tgtcttcagaggtagcagaa

SEQ ID NO: 58973 - DNA, 20 bp, Artificial Sequence
  chemically synthesized
ttatttcatgtctttgattt

SEQ ID NO: 58974 - DNA, 20 bp, Artificial Sequence
  chemically synthesized
aatgaggtaataatctactt

SEQ ID NO: 58975 - DNA, 20 bp, Artificial Sequence
  chemically synthesized
atctacttctgagtattggt

SEQ ID NO: 58976 - DNA, 20 bp, Artificial Sequence
  chemically synthesized
ttctttttttttttttgaga

SEQ ID NO: 58977 - DNA, 20 bp, Artificial Sequence
  chemically synthesized
tctcactctgtcgcctaggc

SEQ ID NO: 58978 - DNA, 20 bp, Artificial Sequence
  chemically synthesized
ctcactgcaacctccacctc

SEQ ID NO: 58979 - DNA, 20 bp, Artificial Sequence
  chemically synthesized
gattctcctgcctcagcctc

SEQ ID NO: 58980 - DNA, 20 bp, Artificial Sequence
  chemically synthesized
gcctcagcctcctgagtagc

SEQ ID NO: 58981 - DNA, 20 bp, Artificial Sequence
  chemically synthesized
tttgtattttttagtagaga

SEQ ID NO: 58982 - DNA, 20 bp, Artificial Sequence
  chemically synthesized
gccttggcctcccaaagtgc

SEQ ID NO: 58983 - DNA, 20 bp, Artificial Sequence
  chemically synthesized
gttcaataatacatatctca

SEQ ID NO: 58984 - DNA, 20 bp, Artificial Sequence
  chemically synthesized
gttagaaggttctactggag

SEQ ID NO: 58985 - DNA, 20 bp, Artificial Sequence
  chemically synthesized
actgttaggccactggtcca

SEQ ID NO: 58986 - DNA, 20 bp, Artificial Sequence
  chemically synthesized
gatgatgatcctgaaaacat

SEQ ID NO: 58987 - DNA, 20 bp, Artificial Sequence
  chemically synthesized
caaggcacttgcccctagct

SEQ ID NO: 58988 - DNA, 20 bp, Artificial Sequence
  chemically synthesized
ggagcagtcccatgtagtag

SEQ ID NO: 58989 - DNA, 20 bp, Artificial Sequence
  chemically synthesized
gtctatctctcctggctcct

SEQ ID NO: 58990 - DNA, 20 bp, Artificial Sequence
  chemically synthesized
ccagctcgcaaagtcaccgt

SEQ ID NO: 58991 - DNA, 20 bp, Artificial Sequence
  chemically synthesized
ccgtgagggtcttgtgtttg

SEQ ID NO: 58992 - DNA, 20 bp, Artificial Sequence
  chemically synthesized
atggctgtctcctttatcca

SEQ ID NO: 58993 - DNA, 20 bp, Artificial Sequence
  chemically synthesized
gggcccatgagcagtagctg

SEQ ID NO: 58994 - DNA, 20 bp, Artificial Sequence
  chemically synthesized
ataataatagtgttttttta

SEQ ID NO: 58995 - DNA, 20 bp, Artificial Sequence
  chemically synthesized
tttttttatggagttagcgt

SEQ ID NO: 58996 - DNA, 20 bp, Artificial Sequence
  chemically synthesized
aattttcccttacctataat

SEQ ID NO: 58997 - DNA, 20 bp, Artificial Sequence
  chemically synthesized
atattcttcttatagtgatt

SEQ ID NO: 58998 - DNA, 20 bp, Artificial Sequence
  chemically synthesized
gtgattctggatattaaagt

SEQ ID NO: 58999 - DNA, 20 bp, Artificial Sequence
  chemically synthesized
ccccacatagatcatctcag

SEQ ID NO: 59000 - DNA, 20 bp, Artificial Sequence
  chemically synthesized
cagggttcaggaagataaag

SEQ ID NO: 59001 - DNA, 20 bp, Artificial Sequence
  chemically synthesized
taaggaagaacactgggcaa

SEQ ID NO: 59002 - DNA, 20 bp, Artificial Sequence
  chemically synthesized
ggttgtccaacgctgaaagt

SEQ ID NO: 59003 - DNA, 20 bp, Artificial Sequence
  chemically synthesized
aggaatctaagcactagtct

SEQ ID NO: 59004 - DNA, 20 bp, Artificial Sequence
  chemically synthesized
gatgctaggagggcctctgc

SEQ ID NO: 59005 - DNA, 20 bp, Artificial Sequence
  chemically synthesized
ccagcaggaaacacttaaga

SEQ ID NO: 59006 - DNA, 20 bp, Artificial Sequence
  chemically synthesized
gatttctacatgctggagcc

SEQ ID NO: 59007 - DNA, 20 bp, Artificial Sequence
  chemically synthesized
ataatctgattcatgcaacc

SEQ ID NO: 59008 - DNA, 20 bp, Artificial Sequence
  chemically synthesized
atttattgttgtgcatatga

SEQ ID NO: 59009 - DNA, 20 bp, Artificial Sequence
  chemically synthesized
atagactttctcagagctat

SEQ ID NO: 59010 - DNA, 20 bp, Artificial Sequence
  chemically synthesized
tctcagagctatatgagttt

SEQ ID NO: 59011 - DNA, 20 bp, Artificial Sequence
  chemically synthesized
atcaagaccagccttttgct

SEQ ID NO: 59012 - DNA, 20 bp, Artificial Sequence
  chemically synthesized
tcagggtagaaatcccctat

SEQ ID NO: 59013 - DNA, 20 bp, Artificial Sequence
  chemically synthesized
ctatagggatttattcaatg

SEQ ID NO: 59014 - DNA, 20 bp, Artificial Sequence
  chemically synthesized
tatgaaattcttacacacag

SEQ ID NO: 59015 - DNA, 20 bp, Artificial Sequence
  chemically synthesized
cacagaagaatcttctaatc

SEQ ID NO: 59016 - DNA, 20 bp, Artificial Sequence
  chemically synthesized
gtgtagtctttcctgatgtc

SEQ ID NO: 59017 - DNA, 20 bp, Artificial Sequence
  chemically synthesized
catcccagagcaggacacag

SEQ ID NO: 59018 - DNA, 20 bp, Artificial Sequence
  chemically synthesized
tagtcacttaggaaaaacag

SEQ ID NO: 59019 - DNA, 20 bp, Artificial Sequence
  chemically synthesized
aggaaaaacagtggaatgca

SEQ ID NO: 59020 - DNA, 20 bp, Artificial Sequence
  chemically synthesized
caaagagtaaaaaatgcttt

SEQ ID NO: 59021 - DNA, 20 bp, Artificial Sequence
  chemically synthesized
gagtaaaaaatgctttctga

SEQ ID NO: 59022 - DNA, 20 bp, Artificial Sequence
  chemically synthesized
tacatgtcaataaatattta

SEQ ID NO: 59023 - DNA, 20 bp, Artificial Sequence
  chemically synthesized
tagtttatgtttgtgtgtgt

SEQ ID NO: 59024 - DNA, 20 bp, Artificial Sequence
  chemically synthesized
ttttttaactgtagtaaaat

SEQ ID NO: 59025 - DNA, 20 bp, Artificial Sequence
  chemically synthesized
taataatagtatctacctga

SEQ ID NO: 59026 - DNA, 20 bp, Artificial Sequence
  chemically synthesized
gtatctacctgaaagaatcc

SEQ ID NO: 59027 - DNA, 20 bp, Artificial Sequence
  chemically synthesized
ttttattattacagttaaag

SEQ ID NO: 59028 - DNA, 20 bp, Artificial Sequence
  chemically synthesized
cactagttttcacctgcagc

SEQ ID NO: 59029 - DNA, 20 bp, Artificial Sequence
  chemically synthesized
aaaatactagcaaacatttc

SEQ ID NO: 59030 - DNA, 20 bp, Artificial Sequence
  chemically synthesized
tgggcagattgcttgagctc

SEQ ID NO: 59031 - DNA, 20 bp, Artificial Sequence
  chemically synthesized
tacctgtggttccagctact

SEQ ID NO: 59032 - DNA, 20 bp, Artificial Sequence
  chemically synthesized
ttttgccactacactcccat

SEQ ID NO: 59033 - DNA, 20 bp, Artificial Sequence
  chemically synthesized
ctacactcccatttgggtga

SEQ ID NO: 59034 - DNA, 20 bp, Artificial Sequence
  chemically synthesized
ccattttacagatgaagaaa

SEQ ID NO: 59035 - DNA, 20 bp, Artificial Sequence
  chemically synthesized
catacaactactaagagaaa

SEQ ID NO: 59036 - DNA, 20 bp, Artificial Sequence
  chemically synthesized
cccaagacttttataaagtc

SEQ ID NO: 59037 - DNA, 20 bp, Artificial Sequence
  chemically synthesized
gacttttataaagtcaaggg

SEQ ID NO: 59038 - DNA, 20 bp, Artificial Sequence
  chemically synthesized
tcaagggttgagtcactgaa

SEQ ID NO: 59039 - DNA, 20 bp, Artificial Sequence
  chemically synthesized
gagtcactgaaatgagttat

SEQ ID NO: 59040 - DNA, 20 bp, Artificial Sequence
  chemically synthesized
tattgggatggctgtgtggg

SEQ ID NO: 59041 - DNA, 20 bp, Artificial Sequence
  chemically synthesized
gttctttcctaaaggtatgt

SEQ ID NO: 59042 - DNA, 20 bp, Artificial Sequence
  chemically synthesized
aaatctgacactcagtgggc

SEQ ID NO: 59043 - DNA, 20 bp, Artificial Sequence
  chemically synthesized
cagtgggcctgggtgaaggt

SEQ ID NO: 59044 - DNA, 20 bp, Artificial Sequence
  chemically synthesized
tgaaggtgagaattttattg

SEQ ID NO: 59045 - DNA, 20 bp, Artificial Sequence
  chemically synthesized
tggggacatcttgccagtca

SEQ ID NO: 59046 - DNA, 20 bp, Artificial Sequence
  chemically synthesized
ttcaatttccttctcagtct

SEQ ID NO: 59047 - DNA, 20 bp, Artificial Sequence
  chemically synthesized
agagaaactgaggctcagag

SEQ ID NO: 59048 - DNA, 20 bp, Artificial Sequence
  chemically synthesized
tgacatggaaatgatcaggc

SEQ ID NO: 59049 - DNA, 20 bp, Artificial Sequence
  chemically synthesized
taaataagcaaaccctgctc

SEQ ID NO: 59050 - DNA, 20 bp, Artificial Sequence
  chemically synthesized
ccctgctcgggaatgggagg

SEQ ID NO: 59051 - DNA, 20 bp, Artificial Sequence
  chemically synthesized
ggaatgggagggagagtctc

SEQ ID NO: 59052 - DNA, 20 bp, Artificial Sequence
  chemically synthesized
ccctgcccattgctgggcct

SEQ ID NO: 59053 - DNA, 20 bp, Artificial Sequence
  chemically synthesized
gcccattgctgggccttgga

SEQ ID NO: 59054 - DNA, 20 bp, Artificial Sequence
  chemically synthesized
ggcaagccatctcatagctg

SEQ ID NO: 59055 - DNA, 20 bp, Artificial Sequence
  chemically synthesized
cttattctcacactaagaaa

SEQ ID NO: 59056 - DNA, 20 bp, Artificial Sequence
  chemically synthesized
ctgcgtcccctcttgtgtac

SEQ ID NO: 59057 - DNA, 20 bp, Artificial Sequence
  chemically synthesized
aatttcacatcaatgtctat

SEQ ID NO: 59058 - DNA, 20 bp, Artificial Sequence
  chemically synthesized
tctaagaaagttacaacatg

SEQ ID NO: 59059 - DNA, 20 bp, Artificial Sequence
  chemically synthesized
tcttgaggcctcagctttct

SEQ ID NO: 59060 - DNA, 20 bp, Artificial Sequence
  chemically synthesized
tttcactctgctgtccaggc

SEQ ID NO: 59061 - DNA, 20 bp, Artificial Sequence
  chemically synthesized
gccttgacctcctgagctca

SEQ ID NO: 59062 - DNA, 20 bp, Artificial Sequence
  chemically synthesized
gatcctcccatttcggcctc

SEQ ID NO: 59063 - DNA, 20 bp, Artificial Sequence
  chemically synthesized
cgaggtcttgctatgttgtc

SEQ ID NO: 59064 - DNA, 20 bp, Artificial Sequence
  chemically synthesized
cacttctacctctcaagtgc

SEQ ID NO: 59065 - DNA, 20 bp, Artificial Sequence
  chemically synthesized
ctaattcctgacactacttg

SEQ ID NO: 59066 - DNA, 20 bp, Artificial Sequence
  chemically synthesized
acacatctttaatataccaa

SEQ ID NO: 59067 - DNA, 20 bp, Artificial Sequence
  chemically synthesized
atataccaaatgggtgactg

SEQ ID NO: 59068 - DNA, 20 bp, Artificial Sequence
  chemically synthesized
tgtagggttgagagggagat

SEQ ID NO: 59069 - DNA, 20 bp, Artificial Sequence
  chemically synthesized
gtgcaaaaagggaactacct

SEQ ID NO: 59070 - DNA, 20 bp, Artificial Sequence
  chemically synthesized
cttccaaggtctgttgcatc

SEQ ID NO: 59071 - DNA, 20 bp, Artificial Sequence
  chemically synthesized
aggtctgttgcatcaagagt

SEQ ID NO: 59072 - DNA, 20 bp, Artificial Sequence
  chemically synthesized
gaattgaaggtcttagaagc

SEQ ID NO: 59073 - DNA, 20 bp, Artificial Sequence
  chemically synthesized
gatctagtcatctacaaagc

SEQ ID NO: 59074 - DNA, 20 bp, Artificial Sequence
  chemically synthesized
tcatctacaaagcatgagtt

SEQ ID NO: 59075 - DNA, 20 bp, Artificial Sequence
  chemically synthesized
cttttgacttcctttgacat

SEQ ID NO: 59076 - DNA, 20 bp, Artificial Sequence
  chemically synthesized
ttgacatcagaatataacct

SEQ ID NO: 59077 - DNA, 20 bp, Artificial Sequence
  chemically synthesized
gtgctcagggctgtgtgtgt

SEQ ID NO: 59078 - DNA, 20 bp, Artificial Sequence
  chemically synthesized
gtttgaaatgaaactaaagt

SEQ ID NO: 59079 - DNA, 20 bp, Artificial Sequence
  chemically synthesized
caacatcctcataataactt

SEQ ID NO: 59080 - DNA, 20 bp, Artificial Sequence
  chemically synthesized
aattttataaaatatcacaa

SEQ ID NO: 59081 - DNA, 20 bp, Artificial Sequence
  chemically synthesized
cacaatagggtcatgttcag

SEQ ID NO: 59082 - DNA, 20 bp, Artificial Sequence
  chemically synthesized
aaaattagacaagccatagt

SEQ ID NO: 59083 - DNA, 20 bp, Artificial Sequence
  chemically synthesized
catagtttgagtttaccctt

SEQ ID NO: 59084 - DNA, 20 bp, Artificial Sequence
  chemically synthesized
aaggcaatttaattatcttt

SEQ ID NO: 59085 - DNA, 20 bp, Artificial Sequence
  chemically synthesized
tatagttcctagcacaaagt

SEQ ID NO: 59086 - DNA, 20 bp, Artificial Sequence
  chemically synthesized
tgtatttatctgttattaat

SEQ ID NO: 59087 - DNA, 20 bp, Artificial Sequence
  chemically synthesized
actatgaagcaggtatttat

SEQ ID NO: 59088 - DNA, 20 bp, Artificial Sequence
  chemically synthesized
tatttatttgagttttccaa

SEQ ID NO: 59089 - DNA, 20 bp, Artificial Sequence
  chemically synthesized
accagccttagctgtctgct

SEQ ID NO: 59090 - DNA, 20 bp, Artificial Sequence
  chemically synthesized
aaatgagagagagaaatggg

SEQ ID NO: 59091 - DNA, 20 bp, Artificial Sequence
  chemically synthesized
gagggtagaaggaaggaaga

SEQ ID NO: 59092 - DNA, 20 bp, Artificial Sequence
  chemically synthesized
aaagagctctttccattaca

SEQ ID NO: 59093 - DNA, 20 bp, Artificial Sequence
  chemically synthesized
ttattattagaaatggggaa

SEQ ID NO: 59094 - DNA, 20 bp, Artificial Sequence
  chemically synthesized
gggaaactggagaaactggg

SEQ ID NO: 59095 - DNA, 20 bp, Artificial Sequence
  chemically synthesized
cagcttcagctacctctcta

SEQ ID NO: 59096 - DNA, 20 bp, Artificial Sequence
  chemically synthesized
ctaaactgaaattgctatag

SEQ ID NO: 59097 - DNA, 20 bp, Artificial Sequence
  chemically synthesized
gtttacagatattttccaca

SEQ ID NO: 59098 - DNA, 20 bp, Artificial Sequence
  chemically synthesized
atattttccacaaagagtaa

SEQ ID NO: 59099 - DNA, 20 bp, Artificial Sequence
  chemically synthesized
catattatgacgaacaacat

SEQ ID NO: 59100 - DNA, 20 bp, Artificial Sequence
  chemically synthesized
gaaagaggagccatttgatc

SEQ ID NO: 59101 - DNA, 20 bp, Artificial Sequence
  chemically synthesized
taaaggagaacctaaagagg

SEQ ID NO: 59102 - DNA, 20 bp, Artificial Sequence
  chemically synthesized
aatatccttttgactgtgga

SEQ ID NO: 59103 - DNA, 20 bp, Artificial Sequence
  chemically synthesized
agaggaacattggcttggtg

SEQ ID NO: 59104 - DNA, 20 bp, Artificial Sequence
  chemically synthesized
atatctgtcctgatgttgtc

SEQ ID NO: 59105 - DNA, 20 bp, Artificial Sequence
  chemically synthesized
ataacgtagagaaaacagga

SEQ ID NO: 59106 - DNA, 20 bp, Artificial Sequence
  chemically synthesized
gacaaagaggcatcaaagat

SEQ ID NO: 59107 - DNA, 20 bp, Artificial Sequence
  chemically synthesized
tcaaagatagggatgtttgt

SEQ ID NO: 59108 - DNA, 20 bp, Artificial Sequence
  chemically synthesized
ttttttgcgttagtcaccgt

SEQ ID NO: 59109 - DNA, 20 bp, Artificial Sequence
  chemically synthesized
ataataattgtgtgtattca

SEQ ID NO: 59110 - DNA, 20 bp, Artificial Sequence
  chemically synthesized
agttaaaatgtcatatgtgt

SEQ ID NO: 59111 - DNA, 20 bp, Artificial Sequence
  chemically synthesized
agtaatagatttagaaaaca

SEQ ID NO: 59112 - DNA, 20 bp, Artificial Sequence
  chemically synthesized
tgaatgattccttgcaaatc

SEQ ID NO: 59113 - DNA, 20 bp, Artificial Sequence
  chemically synthesized
cttgatcacttttggaggtc

SEQ ID NO: 59114 - DNA, 20 bp, Artificial Sequence
  chemically synthesized
aacttgaaattgcattatag

SEQ ID NO: 59115 - DNA, 20 bp, Artificial Sequence
  chemically synthesized
attatagcagaatgtaggcc

SEQ ID NO: 59116 - DNA, 20 bp, Artificial Sequence
  chemically synthesized
tagcagaatgtaggccttga

SEQ ID NO: 59117 - DNA, 20 bp, Artificial Sequence
  chemically synthesized
taagcagtttcatatgaaac

SEQ ID NO: 59118 - DNA, 20 bp, Artificial Sequence
  chemically synthesized
acagtcagatgttcatggtc

SEQ ID NO: 59119 - DNA, 20 bp, Artificial Sequence
  chemically synthesized
tctcctccaagcagtgggcc

SEQ ID NO: 59120 - DNA, 20 bp, Artificial Sequence
  chemically synthesized
tgtgattgactttatcattt

SEQ ID NO: 59121 - DNA, 20 bp, Artificial Sequence
  chemically synthesized
gccacatagaggaagggaaa

SEQ ID NO: 59122 - DNA, 20 bp, Artificial Sequence
  chemically synthesized
tagaagggcactctgcctta

SEQ ID NO: 59123 - DNA, 20 bp, Artificial Sequence
  chemically synthesized
tgtttctgacatactgtgtc

SEQ ID NO: 59124 - DNA, 20 bp, Artificial Sequence
  chemically synthesized
acatactgtgtccggaattg

SEQ ID NO: 59125 - DNA, 20 bp, Artificial Sequence
  chemically synthesized
ttcttggtttcactgacttc

SEQ ID NO: 59126 - DNA, 20 bp, Artificial Sequence
  chemically synthesized
tgaagccggggaccctcgtg

SEQ ID NO: 59127 - DNA, 20 bp, Artificial Sequence
  chemically synthesized
gttcttaaaggctgcgtgtg

SEQ ID NO: 59128 - DNA, 20 bp, Artificial Sequence
  chemically synthesized
gagtttgttcgttctgatgt

SEQ ID NO: 59129 - DNA, 20 bp, Artificial Sequence
  chemically synthesized
ttctgatgtttggatgtgtt

SEQ ID NO: 59130 - DNA, 20 bp, Artificial Sequence
  chemically synthesized
ttcggagtttcttccttctg

SEQ ID NO: 59131 - DNA, 20 bp, Artificial Sequence
  chemically synthesized
gttcgtggtctcgctggctc

SEQ ID NO: 59132 - DNA, 20 bp, Artificial Sequence
  chemically synthesized
agctcttaaggcggcgcctc

SEQ ID NO: 59133 - DNA, 20 bp, Artificial Sequence
  chemically synthesized
ggagttgttcgttcctcccg

SEQ ID NO: 59134 - DNA, 20 bp, Artificial Sequence
  chemically synthesized
ttcgtggtctcgctggcttc

SEQ ID NO: 59135 - DNA, 20 bp, Artificial Sequence
  chemically synthesized
cagtgtggaaggggacccga

SEQ ID NO: 59136 - DNA, 20 bp, Artificial Sequence
  chemically synthesized
cccaccagattagctagata

SEQ ID NO: 59137 - DNA, 20 bp, Artificial Sequence
  chemically synthesized
aaggttctccaagtccccac

SEQ ID NO: 59138 - DNA, 20 bp, Artificial Sequence
  chemically synthesized
cccaccagagtagctagata

SEQ ID NO: 59139 - DNA, 20 bp, Artificial Sequence
  chemically synthesized
cacaaaccctgagctagaca

SEQ ID NO: 59140 - DNA, 20 bp, Artificial Sequence
  chemically synthesized
cttgagctagatacagactg

SEQ ID NO: 59141 - DNA, 20 bp, Artificial Sequence
  chemically synthesized
aaggttctccacgtccccac

SEQ ID NO: 59142 - DNA, 20 bp, Artificial Sequence
  chemically synthesized
cccaccagagtagctagata

SEQ ID NO: 59143 - DNA, 20 bp, Artificial Sequence
  chemically synthesized
cacaaaccctgagctagaca

SEQ ID NO: 59144 - DNA, 20 bp, Artificial Sequence
  chemically synthesized
aaggttctccaaggccccac

SEQ ID NO: 59145 - DNA, 20 bp, Artificial Sequence
  chemically synthesized
gccccaccagagtagctaga

SEQ ID NO: 59146 - DNA, 20 bp, Artificial Sequence
  chemically synthesized
cacaaaccctgagctagaca

SEQ ID NO: 59147 - DNA, 20 bp, Artificial Sequence
  chemically synthesized
tacaaaccttgagctagata

SEQ ID NO: 59148 - DNA, 20 bp, Artificial Sequence
  chemically synthesized
acaatcccttatctagacat

SEQ ID NO: 59149 - DNA, 20 bp, Artificial Sequence
  chemically synthesized
agcctagccggcttcaccca

SEQ ID NO: 59150 - DNA, 20 bp, Artificial Sequence
  chemically synthesized
gcgcccgcactcttcagccc

SEQ ID NO: 59151 - DNA, 20 bp, Artificial Sequence
  chemically synthesized
cccttgggtggtcgatggga

SEQ ID NO: 59152 - DNA, 20 bp, Artificial Sequence
  chemically synthesized
aaggcagctaaggcccggcg

SEQ ID NO: 59153 - DNA, 20 bp, Artificial Sequence
  chemically synthesized
ggtggggccggctggcggct

SEQ ID NO: 59154 - DNA, 20 bp, Artificial Sequence
  chemically synthesized
ccggctggcggctccgagtg

SEQ ID NO: 59155 - DNA, 20 bp, Artificial Sequence
  chemically synthesized
cctgtgcttccaaaaataac

SEQ ID NO: 59156 - DNA, 20 bp, Artificial Sequence
  chemically synthesized
taagcagtaaaaataagacc

SEQ ID NO: 59157 - DNA, 20 bp, Artificial Sequence
  chemically synthesized
ccaaatgctgtaatacttca

SEQ ID NO: 59158 - DNA, 20 bp, Artificial Sequence
  chemically synthesized
gctttaaaaaatgtttcctc

SEQ ID NO: 59159 - DNA, 20 bp, Artificial Sequence
  chemically synthesized
gtattctagagccaaatatc

SEQ ID NO: 59160 - DNA, 20 bp, Artificial Sequence
  chemically synthesized
ctagagccaaatatcatgag

SEQ ID NO: 59161 - DNA, 20 bp, Artificial Sequence
  chemically synthesized
agttagtagccacttcatct

SEQ ID NO: 59162 - DNA, 20 bp, Artificial Sequence
  chemically synthesized
gcctcagtttcctcctctta

SEQ ID NO: 59163 - DNA, 20 bp, Artificial Sequence
  chemically synthesized
ttacaatagtacttgaggca

SEQ ID NO: 59164 - DNA, 20 bp, Artificial Sequence
  chemically synthesized
acttgaggcacagagttact

SEQ ID NO: 59165 - DNA, 20 bp, Artificial Sequence
  chemically synthesized
actatcctagtgtgtagatt

SEQ ID NO: 59166 - DNA, 20 bp, Artificial Sequence
  chemically synthesized
caaagacatgaaggtcacat

SEQ ID NO: 59167 - DNA, 20 bp, Artificial Sequence
  chemically synthesized
ggtcacatatgggtagacat

SEQ ID NO: 59168 - DNA, 20 bp, Artificial Sequence
  chemically synthesized
atagatgagatgacattgtc

SEQ ID NO: 59169 - DNA, 20 bp, Artificial Sequence
  chemically synthesized
atgacattgtcaaggattac

SEQ ID NO: 59170 - DNA, 20 bp, Artificial Sequence
  chemically synthesized
tggcagaaacattttttcaa

SEQ ID NO: 59171 - DNA, 20 bp, Artificial Sequence
  chemically synthesized
tgctgctttttgactcagag

SEQ ID NO: 59172 - DNA, 20 bp, Artificial Sequence
  chemically synthesized
gtatttagaaggctttggag

SEQ ID NO: 59173 - DNA, 20 bp, Artificial Sequence
  chemically synthesized
aatgtacatatatttttgac

SEQ ID NO: 59174 - DNA, 20 bp, Artificial Sequence
  chemically synthesized
agatgtttatagtgataagt

SEQ ID NO: 59175 - DNA, 20 bp, Artificial Sequence
  chemically synthesized
ttattttatgtgaagaaact

SEQ ID NO: 59176 - DNA, 20 bp, Artificial Sequence
  chemically synthesized
atgtgaagaaactcagaata

SEQ ID NO: 59177 - DNA, 20 bp, Artificial Sequence
  chemically synthesized
tctcaaattatcacttttat

SEQ ID NO: 59178 - DNA, 20 bp, Artificial Sequence
  chemically synthesized
atctcttctcattttctatc

SEQ ID NO: 59179 - DNA, 20 bp, Artificial Sequence
  chemically synthesized
tttagattaaaacatctaac

SEQ ID NO: 59180 - DNA, 20 bp, Artificial Sequence
  chemically synthesized
acattagttatctcttacat

SEQ ID NO: 59181 - DNA, 20 bp, Artificial Sequence
  chemically synthesized
catttcaacctacacaaatt

SEQ ID NO: 59182 - DNA, 20 bp, Artificial Sequence
  chemically synthesized
gctacacagctgtttaaatt

SEQ ID NO: 59183 - DNA, 20 bp, Artificial Sequence
  chemically synthesized
taggcatttaataaattttg

SEQ ID NO: 59184 - DNA, 20 bp, Artificial Sequence
  chemically synthesized
cactatgatacctacttatt

SEQ ID NO: 59185 - DNA, 20 bp, Artificial Sequence
  chemically synthesized
cctaggcacatgaaacactt

SEQ ID NO: 59186 - DNA, 20 bp, Artificial Sequence
  chemically synthesized
catgcagaaagaagcttaat

SEQ ID NO: 59187 - DNA, 20 bp, Artificial Sequence
  chemically synthesized
aacatcctttccctttctgt

SEQ ID NO: 59188 - DNA, 20 bp, Artificial Sequence
  chemically synthesized
cacctgccttcatccatccc

SEQ ID NO: 59189 - DNA, 20 bp, Artificial Sequence
  chemically synthesized
catcccttggatatgatacc

SEQ ID NO: 59190 - DNA, 20 bp, Artificial Sequence
  chemically synthesized
cacatattgtgtttctatgg

SEQ ID NO: 59191 - DNA, 20 bp, Artificial Sequence
  chemically synthesized
aggttctacattgtgtggtt

SEQ ID NO: 59192 - DNA, 20 bp, Artificial Sequence
  chemically synthesized
cagtctcttcatgtgtagtc

SEQ ID NO: 59193 - DNA, 20 bp, Artificial Sequence
  chemically synthesized
cctcttaagacactagcaac

SEQ ID NO: 59194 - DNA, 20 bp, Artificial Sequence
  chemically synthesized
attatatactgaactcatgt

SEQ ID NO: 59195 - DNA, 20 bp, Artificial Sequence
  chemically synthesized
gtatatcttccttgtaggta

SEQ ID NO: 59196 - DNA, 20 bp, Artificial Sequence
  chemically synthesized
ttccttattggtcaatactt

SEQ ID NO: 59197 - DNA, 20 bp, Artificial Sequence
  chemically synthesized
tgataataatgccaagaggc

SEQ ID NO: 59198 - DNA, 20 bp, Artificial Sequence
  chemically synthesized
aggctggggtgagctataag

SEQ ID NO: 59199 - DNA, 20 bp, Artificial Sequence
  chemically synthesized
aggctaatcagtacagcaag

SEQ ID NO: 59200 - DNA, 20 bp, Artificial Sequence
  chemically synthesized
taatcagtacagcaagagga

SEQ ID NO: 59201 - DNA, 20 bp, Artificial Sequence
  chemically synthesized
agataaagggaacggcgtgg

SEQ ID NO: 59202 - DNA, 20 bp, Artificial Sequence
  chemically synthesized
cgtgggagggtgtttcctga

SEQ ID NO: 59203 - DNA, 20 bp, Artificial Sequence
  chemically synthesized
gaatattcatgagacaaaca

SEQ ID NO: 59204 - DNA, 20 bp, Artificial Sequence
  chemically synthesized
acagagaataaagaaatgaa

SEQ ID NO: 59205 - DNA, 20 bp, Artificial Sequence
  chemically synthesized
aagtgatttctagaaagtgc

SEQ ID NO: 59206 - DNA, 20 bp, Artificial Sequence
  chemically synthesized
aaagacctggcacttaaaat

SEQ ID NO: 59207 - DNA, 20 bp, Artificial Sequence
  chemically synthesized
ctggctgagagaaatatctc

SEQ ID NO: 59208 - DNA, 20 bp, Artificial Sequence
  chemically synthesized
aatggccatgttccaggctt

SEQ ID NO: 59209 - DNA, 20 bp, Artificial Sequence
  chemically synthesized
tgtccctatcattaggaggc

SEQ ID NO: 59210 - DNA, 20 bp, Artificial Sequence
  chemically synthesized
tcattaggaggccagggtgg

SEQ ID NO: 59211 - DNA, 20 bp, Artificial Sequence
  chemically synthesized
tgggaggattgcttgaggtt

SEQ ID NO: 59212 - DNA, 20 bp, Artificial Sequence
  chemically synthesized
tactcaaaaagctgaggaag

SEQ ID NO: 59213 - DNA, 20 bp, Artificial Sequence
  chemically synthesized
gaagaaggattgcttgagcc

SEQ ID NO: 59214 - DNA, 20 bp, Artificial Sequence
  chemically synthesized
aggactgcattaataaattt

SEQ ID NO: 59215 - DNA, 20 bp, Artificial Sequence
  chemically synthesized
ttaataaatttgggggttta

SEQ ID NO: 59216 - DNA, 20 bp, Artificial Sequence
  chemically synthesized
actaaactcacagtatgaca

SEQ ID NO: 59217 - DNA, 20 bp, Artificial Sequence
  chemically synthesized
agtatggcaaacttgtcagt

SEQ ID NO: 59218 - DNA, 20 bp, Artificial Sequence
  chemically synthesized
ttgtcagtcagggtgagact

SEQ ID NO: 59219 - DNA, 20 bp, Artificial Sequence
  chemically synthesized
ataaatgtccttatatatca

SEQ ID NO: 59220 - DNA, 20 bp, Artificial Sequence
  chemically synthesized
atatatcactggatcagcag

SEQ ID NO: 59221 - DNA, 20 bp, Artificial Sequence
  chemically synthesized
gatgctgacttaataattga

SEQ ID NO: 59222 - DNA, 20 bp, Artificial Sequence
  chemically synthesized
taaaatataatatataggtt

SEQ ID NO: 59223 - DNA, 20 bp, Artificial Sequence
  chemically synthesized
atatacatttacttaagaaa

SEQ ID NO: 59224 - DNA, 20 bp, Artificial Sequence
  chemically synthesized
atgtcatcccttgctaacat

SEQ ID NO: 59225 - DNA, 20 bp, Artificial Sequence
  chemically synthesized
cagaaaacgacgtttctaaa

SEQ ID NO: 59226 - DNA, 20 bp, Artificial Sequence
  chemically synthesized
aaataaataaattttacaca

SEQ ID NO: 59227 - DNA, 20 bp, Artificial Sequence
  chemically synthesized
gaataacaactaaaatgaca

SEQ ID NO: 59228 - DNA, 20 bp, Artificial Sequence
  chemically synthesized
acaaacaattcgcacaataa

SEQ ID NO: 59229 - DNA, 20 bp, Artificial Sequence
  chemically synthesized
gcacaataactgaatccttc

SEQ ID NO: 59230 - DNA, 20 bp, Artificial Sequence
  chemically synthesized
gtattttcttatcaaatctc

SEQ ID NO: 59231 - DNA, 20 bp, Artificial Sequence
  chemically synthesized
tcaaatctctggaatatttt

SEQ ID NO: 59232 - DNA, 20 bp, Artificial Sequence
  chemically synthesized
gatttcttaagtgaagcaga

SEQ ID NO: 59233 - DNA, 20 bp, Artificial Sequence
  chemically synthesized
taagtgaagcagagagaatt

SEQ ID NO: 59234 - DNA, 20 bp, Artificial Sequence
  chemically synthesized
gaagcagagagaatttagaa

SEQ ID NO: 59235 - DNA, 20 bp, Artificial Sequence
  chemically synthesized
tagaatggaataattatata

SEQ ID NO: 59236 - DNA, 20 bp, Artificial Sequence
  chemically synthesized
agaaacagcagtcttcagag

SEQ ID NO: 59237 - DNA, 20 bp, Artificial Sequence
  chemically synthesized
acagcagtcttcagagagga

SEQ ID NO: 59238 - DNA, 20 bp, Artificial Sequence
  chemically synthesized
aagcaagaggggaaatagaa

SEQ ID NO: 59239 - DNA, 20 bp, Artificial Sequence
  chemically synthesized
gggaagaaggaaaacggggc

SEQ ID NO: 59240 - DNA, 20 bp, Artificial Sequence
  chemically synthesized
actaagggaaattacatttc

SEQ ID NO: 59241 - DNA, 20 bp, Artificial Sequence
  chemically synthesized
taatcaagcaagatcctttt

SEQ ID NO: 59242 - DNA, 20 bp, Artificial Sequence
  chemically synthesized
aaatcatagttactcttctt

SEQ ID NO: 59243 - DNA, 20 bp, Artificial Sequence
  chemically synthesized
ttttcatgtgataattaaaa

SEQ ID NO: 59244 - DNA, 20 bp, Artificial Sequence
  chemically synthesized
aactctgaggaaaaaaaagt

SEQ ID NO: 59245 - DNA, 20 bp, Artificial Sequence
  chemically synthesized
aaaaagtgtggatataaaac

SEQ ID NO: 59246 - DNA, 20 bp, Artificial Sequence
  chemically synthesized
ctactctgcccagaaaatag

SEQ ID NO: 59247 - DNA, 20 bp, Artificial Sequence
  chemically synthesized
aataggcgaataatgcttct

SEQ ID NO: 59248 - DNA, 20 bp, Artificial Sequence
  chemically synthesized
ggtcttgatgctataaatga

SEQ ID NO: 59249 - DNA, 20 bp, Artificial Sequence
  chemically synthesized
tgctataaatgataggattc

SEQ ID NO: 59250 - DNA, 20 bp, Artificial Sequence
  chemically synthesized
ggtgcatgtttcccaaacct

SEQ ID NO: 59251 - DNA, 20 bp, Artificial Sequence
  chemically synthesized
catgtttcccaaacctgtga

SEQ ID NO: 59252 - DNA, 20 bp, Artificial Sequence
  chemically synthesized
gcaatgcccatcactgtctt

SEQ ID NO: 59253 - DNA, 20 bp, Artificial Sequence
  chemically synthesized
aaaaagacagtcaaagaagt

SEQ ID NO: 59254 - DNA, 20 bp, Artificial Sequence
  chemically synthesized
agtcaaagaagtctgaataa

SEQ ID NO: 59255 - DNA, 20 bp, Artificial Sequence
  chemically synthesized
taaacgtgatatcagcacag

SEQ ID NO: 59256 - DNA, 20 bp, Artificial Sequence
  chemically synthesized
gagggcacgggaaccacaat

SEQ ID NO: 59257 - DNA, 20 bp, Artificial Sequence
  chemically synthesized
aaccacaatatgggtagcag

SEQ ID NO: 59258 - DNA, 20 bp, Artificial Sequence
  chemically synthesized
tatgggtagcagtagagtga

SEQ ID NO: 59259 - DNA, 20 bp, Artificial Sequence
  chemically synthesized
cagtcctatgttcatcactc

SEQ ID NO: 59260 - DNA, 20 bp, Artificial Sequence
  chemically synthesized
ttcatcactcgggaattggt

SEQ ID NO: 59261 - DNA, 20 bp, Artificial Sequence
  chemically synthesized
cagttgtacctcagtggtgt

SEQ ID NO: 59262 - DNA, 20 bp, Artificial Sequence
  chemically synthesized
acctgattctacaatggcca

SEQ ID NO: 59263 - DNA, 20 bp, Artificial Sequence
  chemically synthesized
gattctacaatggccagtga

SEQ ID NO: 59264 - DNA, 20 bp, Artificial Sequence
  chemically synthesized
caatggccagtgaatgaatg

SEQ ID NO: 59265 - DNA, 20 bp, Artificial Sequence
  chemically synthesized
gccagtgaatgaatgaagga

SEQ ID NO: 59266 - DNA, 20 bp, Artificial Sequence
  chemically synthesized
ccaggactgtgggcattgta

SEQ ID NO: 59267 - DNA, 20 bp, Artificial Sequence
  chemically synthesized
tcattccaaatgaggacaag

SEQ ID NO: 59268 - DNA, 20 bp, Artificial Sequence
  chemically synthesized
aggtggagaagatatttttt

SEQ ID NO: 59269 - DNA, 20 bp, Artificial Sequence
  chemically synthesized
ctcaaaacttaaatattttt

SEQ ID NO: 59270 - DNA, 20 bp, Artificial Sequence
  chemically synthesized
gtactcacaaggcctttccc

SEQ ID NO: 59271 - DNA, 20 bp, Artificial Sequence
  chemically synthesized
caaataacaaaaatcatggt

SEQ ID NO: 59272 - DNA, 20 bp, Artificial Sequence
  chemically synthesized
ttactgtgttactatccaag

SEQ ID NO: 59273 - DNA, 20 bp, Artificial Sequence
  chemically synthesized
actaatgggacagctgtatt

SEQ ID NO: 59274 - DNA, 20 bp, Artificial Sequence
  chemically synthesized
gttgctatctcaagtggact

SEQ ID NO: 59275 - DNA, 20 bp, Artificial Sequence
  chemically synthesized
ctgctctccagcctgggcaa

SEQ ID NO: 59276 - DNA, 20 bp, Artificial Sequence
  chemically synthesized
aagaaaataactcatctatt

SEQ ID NO: 59277 - DNA, 20 bp, Artificial Sequence
  chemically synthesized
aaatctgaacacctgaacaa

SEQ ID NO: 59278 - DNA, 20 bp, Artificial Sequence
  chemically synthesized
ttccctatgctgcaaaaagt

SEQ ID NO: 59279 - DNA, 20 bp, Artificial Sequence
  chemically synthesized
cacaaaagcctaatacttgt

SEQ ID NO: 59280 - DNA, 20 bp, Artificial Sequence
  chemically synthesized
gtaatatcggaagttggtaa

SEQ ID NO: 59281 - DNA, 20 bp, Artificial Sequence
  chemically synthesized
ttacagaccctctaatcatt

SEQ ID NO: 59282 - DNA, 20 bp, Artificial Sequence
  chemically synthesized
tcgtattgagaaaaattcac

SEQ ID NO: 59283 - DNA, 20 bp, Artificial Sequence
  chemically synthesized
caattgattctgtatgtgtc

SEQ ID NO: 59284 - DNA, 20 bp, Artificial Sequence
  chemically synthesized
acaataataattatatgttt

SEQ ID NO: 59285 - DNA, 20 bp, Artificial Sequence
  chemically synthesized
gtagcagagactatgttcat

SEQ ID NO: 59286 - DNA, 20 bp, Artificial Sequence
  chemically synthesized
ctgctaactaacttgatcca

SEQ ID NO: 59287 - DNA, 20 bp, Artificial Sequence
  chemically synthesized
cagaacttatctaccgccac

SEQ ID NO: 59288 - DNA, 20 bp, Artificial Sequence
  chemically synthesized
cttccaatgttgccttataa

SEQ ID NO: 59289 - DNA, 20 bp, Artificial Sequence
  chemically synthesized
caatgttgccttataagaga

SEQ ID NO: 59290 - DNA, 20 bp, Artificial Sequence
  chemically synthesized
taatgccaaaatttgttgta

SEQ ID NO: 59291 - DNA, 20 bp, Artificial Sequence
  chemically synthesized
gataagagctaaccacttat

SEQ ID NO: 59292 - DNA, 20 bp, Artificial Sequence
  chemically synthesized
ctgagctgcgtttgggacat

SEQ ID NO: 59293 - DNA, 20 bp, Artificial Sequence
  chemically synthesized
gtttgggacatgcggatgca

SEQ ID NO: 59294 - DNA, 20 bp, Artificial Sequence
  chemically synthesized
acatacccaaatattccagg

SEQ ID NO: 59295 - DNA, 20 bp, Artificial Sequence
  chemically synthesized
atagttgccctaatagttta

SEQ ID NO: 59296 - DNA, 20 bp, Artificial Sequence
  chemically synthesized
taatagtttagggagtctcc

SEQ ID NO: 59297 - DNA, 20 bp, Artificial Sequence
  chemically synthesized
atgtgatacatgacaaaagt

SEQ ID NO: 59298 - DNA, 20 bp, Artificial Sequence
  chemically synthesized
agtgagagtcataactttag

SEQ ID NO: 59299 - DNA, 20 bp, Artificial Sequence
  chemically synthesized
gcaagcatagaggccccctg

SEQ ID NO: 59300 - DNA, 20 bp, Artificial Sequence
  chemically synthesized
cactgttctcttgccccttt

SEQ ID NO: 59301 - DNA, 20 bp, Artificial Sequence
  chemically synthesized
ttctttgacagcaactatcc

SEQ ID NO: 59302 - DNA, 20 bp, Artificial Sequence
  chemically synthesized
gcaactatcccagagtcctc

SEQ ID NO: 59303 - DNA, 20 bp, Artificial Sequence
  chemically synthesized
ctaaaatgagaagacaaaaa

SEQ ID NO: 59304 - DNA, 20 bp, Artificial Sequence
  chemically synthesized
ccctgtacaatcagtgtccc

SEQ ID NO: 59305 - DNA, 20 bp, Artificial Sequence
  chemically synthesized
tagcactttggaaggctgag

SEQ ID NO: 59306 - DNA, 20 bp, Artificial Sequence
  chemically synthesized
actaaaaatacaaaaattag

SEQ ID NO: 59307 - DNA, 20 bp, Artificial Sequence
  chemically synthesized
tactcgggaggctgaggcag

SEQ ID NO: 59308 - DNA, 20 bp, Artificial Sequence
  chemically synthesized
agaagcaggcacagatgtaa

SEQ ID NO: 59309 - DNA, 20 bp, Artificial Sequence
  chemically synthesized
caatgaaaagggaagtttat

SEQ ID NO: 59310 - DNA, 20 bp, Artificial Sequence
  chemically synthesized
gaaaagggaagtttatagga

SEQ ID NO: 59311 - DNA, 20 bp, Artificial Sequence
  chemically synthesized
taggttaatagtgaaaaata

SEQ ID NO: 59312 - DNA, 20 bp, Artificial Sequence
  chemically synthesized
atttcaacataatggcagaa

SEQ ID NO: 59313 - DNA, 20 bp, Artificial Sequence
  chemically synthesized
taatgactgtgagacaaaaa

SEQ ID NO: 59314 - DNA, 20 bp, Artificial Sequence
  chemically synthesized
cagcactttgggaggccgag

SEQ ID NO: 59315 - DNA, 20 bp, Artificial Sequence
  chemically synthesized
actttgggaggccgaggagg

SEQ ID NO: 59316 - DNA, 20 bp, Artificial Sequence
  chemically synthesized
ggccgaggagggtggatcac

SEQ ID NO: 59317 - DNA, 20 bp, Artificial Sequence
  chemically synthesized
agggtggatcacttgagttc

SEQ ID NO: 59318 - DNA, 20 bp, Artificial Sequence
  chemically synthesized
tactctggaggctgaggcat

SEQ ID NO: 59319 - DNA, 20 bp, Artificial Sequence
  chemically synthesized
gagagagagagaaaagaaaa

SEQ ID NO: 59320 - DNA, 20 bp, Artificial Sequence
  chemically synthesized
gcaactaatatgtgtcataa

SEQ ID NO: 59321 - DNA, 20 bp, Artificial Sequence
  chemically synthesized
gttaaacttgcttcccgtat

SEQ ID NO: 59322 - DNA, 20 bp, Artificial Sequence
  chemically synthesized
ttgcggtttctgagcatgac

SEQ ID NO: 59323 - DNA, 20 bp, Artificial Sequence
  chemically synthesized
tgttacacaaacaactctca

SEQ ID NO: 59324 - DNA, 20 bp, Artificial Sequence
  chemically synthesized
tattctagctcatttccaca

SEQ ID NO: 59325 - DNA, 20 bp, Artificial Sequence
  chemically synthesized
catttccacataggatattt

SEQ ID NO: 59326 - DNA, 20 bp, Artificial Sequence
  chemically synthesized
ctttattttttctttggaag

SEQ ID NO: 59327 - DNA, 20 bp, Artificial Sequence
  chemically synthesized
tcagatgaggcatgaccgaa

SEQ ID NO: 59328 - DNA, 20 bp, Artificial Sequence
  chemically synthesized
ctcaagtgttccattggtct

SEQ ID NO: 59329 - DNA, 20 bp, Artificial Sequence
  chemically synthesized
gctatctcattcatatatat

SEQ ID NO: 59330 - DNA, 20 bp, Artificial Sequence
  chemically synthesized
ttatatttaggtctgatctc

SEQ ID NO: 59331 - DNA, 20 bp, Artificial Sequence
  chemically synthesized
accctaagacttctttcctg

SEQ ID NO: 59332 - DNA, 20 bp, Artificial Sequence
  chemically synthesized
ttctgaaatctcttttttca

SEQ ID NO: 59333 - DNA, 20 bp, Artificial Sequence
  chemically synthesized
ttttttcattggattatgtg

SEQ ID NO: 59334 - DNA, 20 bp, Artificial Sequence
  chemically synthesized
atacagcaataaatgcattc

SEQ ID NO: 59335 - DNA, 20 bp, Artificial Sequence
  chemically synthesized
aaacttctgaaagattttaa

SEQ ID NO: 59336 - DNA, 20 bp, Artificial Sequence
  chemically synthesized
aaaatggagcttaacatata

SEQ ID NO: 59337 - DNA, 20 bp, Artificial Sequence
  chemically synthesized
agtaagtactagttaagcaa

SEQ ID NO: 59338 - DNA, 20 bp, Artificial Sequence
  chemically synthesized
tcttgctctgtcacccagga

SEQ ID NO: 59339 - DNA, 20 bp, Artificial Sequence
  chemically synthesized
tcttagtactttggctgcaa

SEQ ID NO: 59340 - DNA, 20 bp, Artificial Sequence
  chemically synthesized
aagtgtctaaatatgtatag

SEQ ID NO: 59341 - DNA, 20 bp, Artificial Sequence
  chemically synthesized
aattgcactttgggcccctg

SEQ ID NO: 59342 - DNA, 20 bp, Artificial Sequence
  chemically synthesized
acagccctgcatattcaaaa

SEQ ID NO: 59343 - DNA, 20 bp, Artificial Sequence
  chemically synthesized
tggtcatcactgaagataga

SEQ ID NO: 59344 - DNA, 20 bp, Artificial Sequence
  chemically synthesized
ctaagcatgagaaaaactaa

SEQ ID NO: 59345 - DNA, 20 bp, Artificial Sequence
  chemically synthesized
caaatcaagatggaaatgat

SEQ ID NO: 59346 - DNA, 20 bp, Artificial Sequence
  chemically synthesized
gggcacattatgagaaacag

SEQ ID NO: 59347 - DNA, 20 bp, Artificial Sequence
  chemically synthesized
gagaaacagaggagtctttg

SEQ ID NO: 59348 - DNA, 20 bp, Artificial Sequence
  chemically synthesized
aattttgcttacagcatgca

SEQ ID NO: 59349 - DNA, 20 bp, Artificial Sequence
  chemically synthesized
ttttttaagcattccataga

SEQ ID NO: 59350 - DNA, 20 bp, Artificial Sequence
  chemically synthesized
cagcactttgggaggccgag

SEQ ID NO: 59351 - DNA, 20 bp, Artificial Sequence
  chemically synthesized
actttgggaggccgaggcgg

SEQ ID NO: 59352 - DNA, 20 bp, Artificial Sequence
  chemically synthesized
tactcgggaggctgaggcag

SEQ ID NO: 59353 - DNA, 20 bp, Artificial Sequence
  chemically synthesized
tgaaaatgtacctgtaaaat

SEQ ID NO: 59354 - DNA, 20 bp, Artificial Sequence
  chemically synthesized
ccacatatttttaggtctgg

SEQ ID NO: 59355 - DNA, 20 bp, Artificial Sequence
  chemically synthesized
cattatcataaaatctctag

SEQ ID NO: 59356 - DNA, 20 bp, Artificial Sequence
  chemically synthesized
tgtctcattttcttcttcca

SEQ ID NO: 59357 - DNA, 20 bp, Artificial Sequence
  chemically synthesized
ttcttccatggaatattcca

SEQ ID NO: 59358 - DNA, 20 bp, Artificial Sequence
  chemically synthesized
aaggaatattctttgaaaag

SEQ ID NO: 59359 - DNA, 20 bp, Artificial Sequence
  chemically synthesized
tctttgaaaagcagaatatt

SEQ ID NO: 59360 - DNA, 20 bp, Artificial Sequence
  chemically synthesized
agtagagagatatatttagg

SEQ ID NO: 59361 - DNA, 20 bp, Artificial Sequence
  chemically synthesized
tcaataattcacagtagcca

SEQ ID NO: 59362 - DNA, 20 bp, Artificial Sequence
  chemically synthesized
aaaatgtcttatatatgtga

SEQ ID NO: 59363 - DNA, 20 bp, Artificial Sequence
  chemically synthesized
ggtctgacacatgctacaac

SEQ ID NO: 59364 - DNA, 20 bp, Artificial Sequence
  chemically synthesized
tttcacttacatgagctatc

SEQ ID NO: 59365 - DNA, 20 bp, Artificial Sequence
  chemically synthesized
aaaagtagattagaagttac

SEQ ID NO: 59366 - DNA, 20 bp, Artificial Sequence
  chemically synthesized
taccagagtgtaggaagaac

SEQ ID NO: 59367 - DNA, 20 bp, Artificial Sequence
  chemically synthesized
tgtaggaagaacatggattg

SEQ ID NO: 59368 - DNA, 20 bp, Artificial Sequence
  chemically synthesized
gagtaactgattaatcaata

SEQ ID NO: 59369 - DNA, 20 bp, Artificial Sequence
  chemically synthesized
attgtgaaaggtttaaaaac

SEQ ID NO: 59370 - DNA, 20 bp, Artificial Sequence
  chemically synthesized
acaactatatatatacatac

SEQ ID NO: 59371 - DNA, 20 bp, Artificial Sequence
  chemically synthesized
atttatttgattttaataaa

SEQ ID NO: 59372 - DNA, 20 bp, Artificial Sequence
  chemically synthesized
tttgattttaataaatagaa

SEQ ID NO: 59373 - DNA, 20 bp, Artificial Sequence
  chemically synthesized
caacaatttcacttgagaga

SEQ ID NO: 59374 - DNA, 20 bp, Artificial Sequence
  chemically synthesized
gtgaaggcatgccgcaaatc

SEQ ID NO: 59375 - DNA, 20 bp, Artificial Sequence
  chemically synthesized
tatttactcatctggtaatt

SEQ ID NO: 59376 - DNA, 20 bp, Artificial Sequence
  chemically synthesized
tttggactgctattttaaaa

SEQ ID NO: 59377 - DNA, 20 bp, Artificial Sequence
  chemically synthesized
ttaaaactgggtctacttca

SEQ ID NO: 59378 - DNA, 20 bp, Artificial Sequence
  chemically synthesized
gaatgacacccaagaaaaac

SEQ ID NO: 59379 - DNA, 20 bp, Artificial Sequence
  chemically synthesized
ggatctatcctgctttctcc

SEQ ID NO: 59380 - DNA, 20 bp, Artificial Sequence
  chemically synthesized
cacttattctctgaccttct

SEQ ID NO: 59381 - DNA, 20 bp, Artificial Sequence
  chemically synthesized
gaaatacatactgaaatgat

SEQ ID NO: 59382 - DNA, 20 bp, Artificial Sequence
  chemically synthesized
tacatactgaaatgatttga

SEQ ID NO: 59383 - DNA, 20 bp, Artificial Sequence
  chemically synthesized
accatttccactttcctaaa

SEQ ID NO: 59384 - DNA, 20 bp, Artificial Sequence
  chemically synthesized
gaagtaattttaaaacatca

SEQ ID NO: 59385 - DNA, 20 bp, Artificial Sequence
  chemically synthesized
ttcagtagctttccatgact

SEQ ID NO: 59386 - DNA, 20 bp, Artificial Sequence
  chemically synthesized
cacacacactccttcagtct

SEQ ID NO: 59387 - DNA, 20 bp, Artificial Sequence
  chemically synthesized
gctgaagggacactttctca

SEQ ID NO: 59388 - DNA, 20 bp, Artificial Sequence
  chemically synthesized
tcacagcacttgttttaaat

SEQ ID NO: 59389 - DNA, 20 bp, Artificial Sequence
  chemically synthesized
atttggatttcttttattct

SEQ ID NO: 59390 - DNA, 20 bp, Artificial Sequence
  chemically synthesized
gcccttaaaaaattaaccaa

SEQ ID NO: 59391 - DNA, 20 bp, Artificial Sequence
  chemically synthesized
tccacgaaaataggcacatg

SEQ ID NO: 59392 - DNA, 20 bp, Artificial Sequence
  chemically synthesized
aacacaaacccttttaaaca

SEQ ID NO: 59393 - DNA, 20 bp, Artificial Sequence
  chemically synthesized
cttcttaaaatcaattataa

SEQ ID NO: 59394 - DNA, 20 bp, Artificial Sequence
  chemically synthesized
tgagatcacttgtgatttat

SEQ ID NO: 59395 - DNA, 20 bp, Artificial Sequence
  chemically synthesized
ttattagaataaaaaataaa

SEQ ID NO: 59396 - DNA, 20 bp, Artificial Sequence
  chemically synthesized
aatgagcaactaggaaattt

SEQ ID NO: 59397 - DNA, 20 bp, Artificial Sequence
  chemically synthesized
ctaggaaatttatgaattta

SEQ ID NO: 59398 - DNA, 20 bp, Artificial Sequence
  chemically synthesized
tgcaaaaaaaaattgacaaa

SEQ ID NO: 59399 - DNA, 20 bp, Artificial Sequence
  chemically synthesized
cagagataacagacaaccta

SEQ ID NO: 59400 - DNA, 20 bp, Artificial Sequence
  chemically synthesized
tctgacaaaagtctaatatc

SEQ ID NO: 59401 - DNA, 20 bp, Artificial Sequence
  chemically synthesized
aacaaccccattaaaaagtg

SEQ ID NO: 59402 - DNA, 20 bp, Artificial Sequence
  chemically synthesized
attaaaaagtggggaatgac

SEQ ID NO: 59403 - DNA, 20 bp, Artificial Sequence
  chemically synthesized
aatgcaaatcaaaaccacaa

SEQ ID NO: 59404 - DNA, 20 bp, Artificial Sequence
  chemically synthesized
ggataccatctcacaccagt

SEQ ID NO: 59405 - DNA, 20 bp, Artificial Sequence
  chemically synthesized
tggcaaggttgcagagagaa

SEQ ID NO: 59406 - DNA, 20 bp, Artificial Sequence
  chemically synthesized
aggttgcagagagaaaggaa

SEQ ID NO: 59407 - DNA, 20 bp, Artificial Sequence
  chemically synthesized
tgcttttacactgttaacgg

SEQ ID NO: 59408 - DNA, 20 bp, Artificial Sequence
  chemically synthesized
ttagttcaaacattgtggaa

SEQ ID NO: 59409 - DNA, 20 bp, Artificial Sequence
  chemically synthesized
ttgactcagcaatctcatta

SEQ ID NO: 59410 - DNA, 20 bp, Artificial Sequence
  chemically synthesized
attactgggtatatacccaa

SEQ ID NO: 59411 - DNA, 20 bp, Artificial Sequence
  chemically synthesized
tattcataatagccaagatg

SEQ ID NO: 59412 - DNA, 20 bp, Artificial Sequence
  chemically synthesized
acccaaatgtccatcaatga

SEQ ID NO: 59413 - DNA, 20 bp, Artificial Sequence
  chemically synthesized
aaatgtccatcaatgataga

SEQ ID NO: 59414 - DNA, 20 bp, Artificial Sequence
  chemically synthesized
aacgtggtacatatatacca

SEQ ID NO: 59415 - DNA, 20 bp, Artificial Sequence
  chemically synthesized
tatacagccataaaaaggaa

SEQ ID NO: 59416 - DNA, 20 bp, Artificial Sequence
  chemically synthesized
attgtgttccttgcagggac

SEQ ID NO: 59417 - DNA, 20 bp, Artificial Sequence
  chemically synthesized
acacaggggcctgtccggta

SEQ ID NO: 59418 - DNA, 20 bp, Artificial Sequence
  chemically synthesized
aggagagggagagcaccagg

SEQ ID NO: 59419 - DNA, 20 bp, Artificial Sequence
  chemically synthesized
agcaccaggaagaatagcta

SEQ ID NO: 59420 - DNA, 20 bp, Artificial Sequence
  chemically synthesized
aaggaaaatctaccctgaaa

SEQ ID NO: 59421 - DNA, 20 bp, Artificial Sequence
  chemically synthesized
gagtagttttgagattatag

SEQ ID NO: 59422 - DNA, 20 bp, Artificial Sequence
  chemically synthesized
aaatggtactttcagttctt

SEQ ID NO: 59423 - DNA, 20 bp, Artificial Sequence
  chemically synthesized
agttcttatgaatacaggtt

SEQ ID NO: 59424 - DNA, 20 bp, Artificial Sequence
  chemically synthesized
accatattttccctgattat

SEQ ID NO: 59425 - DNA, 20 bp, Artificial Sequence
  chemically synthesized
ataaagctttacatctacat

SEQ ID NO: 59426 - DNA, 20 bp, Artificial Sequence
  chemically synthesized
atttatcaattgatcaattg

SEQ ID NO: 59427 - DNA, 20 bp, Artificial Sequence
  chemically synthesized
taacactgatacaagagata

SEQ ID NO: 59428 - DNA, 20 bp, Artificial Sequence
  chemically synthesized
aataggcgaacaatgcttct

SEQ ID NO: 59429 - DNA, 20 bp, Artificial Sequence
  chemically synthesized
tggtttgatgctgtatataa

SEQ ID NO: 59430 - DNA, 20 bp, Artificial Sequence
  chemically synthesized
tgctgtatataatagggttc

SEQ ID NO: 59431 - DNA, 20 bp, Artificial Sequence
  chemically synthesized
catgaatggaggaaaaagaa

SEQ ID NO: 59432 - DNA, 20 bp, Artificial Sequence
  chemically synthesized
ggtgcatgtttcccaaacct

SEQ ID NO: 59433 - DNA, 20 bp, Artificial Sequence
  chemically synthesized
gcaatacctttaactgtttt

SEQ ID NO: 59434 - DNA, 20 bp, Artificial Sequence
  chemically synthesized
cctttaactgttttaaggat

SEQ ID NO: 59435 - DNA, 20 bp, Artificial Sequence
  chemically synthesized
aggaagaaaatcaaagcaac

SEQ ID NO: 59436 - DNA, 20 bp, Artificial Sequence
  chemically synthesized
aatcaaagcaaccagaatag

SEQ ID NO: 59437 - DNA, 20 bp, Artificial Sequence
  chemically synthesized
gaatagctgggtataagtga

SEQ ID NO: 59438 - DNA, 20 bp, Artificial Sequence
  chemically synthesized
aaaggtgtggaagagaacat

SEQ ID NO: 59439 - DNA, 20 bp, Artificial Sequence
  chemically synthesized
aatgacaatatgggaagcaa

SEQ ID NO: 59440 - DNA, 20 bp, Artificial Sequence
  chemically synthesized
tatgggaagcaatggagtgg

SEQ ID NO: 59441 - DNA, 20 bp, Artificial Sequence
  chemically synthesized
gtggcagaattggaggcacg

SEQ ID NO: 59442 - DNA, 20 bp, Artificial Sequence
  chemically synthesized
tagttatacctgagaagcat

SEQ ID NO: 59443 - DNA, 20 bp, Artificial Sequence
  chemically synthesized
cggtcataggccattgacag

SEQ ID NO: 59444 - DNA, 20 bp, Artificial Sequence
  chemically synthesized
gagaatacctgattctgcaa

SEQ ID NO: 59445 - DNA, 20 bp, Artificial Sequence
  chemically synthesized
tgattctgcaagtggataat

SEQ ID NO: 59446 - DNA, 20 bp, Artificial Sequence
  chemically synthesized
tctgcaagtggataatggga

SEQ ID NO: 59447 - DNA, 20 bp, Artificial Sequence
  chemically synthesized
acctgcaagaagcaggcccc

SEQ ID NO: 59448 - DNA, 20 bp, Artificial Sequence
  chemically synthesized
gtgtggcaaggaaacagtac

SEQ ID NO: 59449 - DNA, 20 bp, Artificial Sequence
  chemically synthesized
cacacataaacagcaaagaa

SEQ ID NO: 59450 - DNA, 20 bp, Artificial Sequence
  chemically synthesized
agcaaagaaggggatggaga

SEQ ID NO: 59451 - DNA, 20 bp, Artificial Sequence
  chemically synthesized
aataatttattggtatatgc

SEQ ID NO: 59452 - DNA, 20 bp, Artificial Sequence
  chemically synthesized
tatagactgtgctagagata

SEQ ID NO: 59453 - DNA, 20 bp, Artificial Sequence
  chemically synthesized
tgatgatcatttcttcagtt

SEQ ID NO: 59454 - DNA, 20 bp, Artificial Sequence
  chemically synthesized
tgcttagcttaattgcatat

SEQ ID NO: 59455 - DNA, 20 bp, Artificial Sequence
  chemically synthesized
ttctttgtttagttttgaaa

SEQ ID NO: 59456 - DNA, 20 bp, Artificial Sequence
  chemically synthesized
aatagaatgttaatgtttta

SEQ ID NO: 59457 - DNA, 20 bp, Artificial Sequence
  chemically synthesized
taggtgttggtcatcccaga

SEQ ID NO: 59458 - DNA, 20 bp, Artificial Sequence
  chemically synthesized
catctaacataagaaggaag

SEQ ID NO: 59459 - DNA, 20 bp, Artificial Sequence
  chemically synthesized
ctatgctgtcattttcttgc

SEQ ID NO: 59460 - DNA, 20 bp, Artificial Sequence
  chemically synthesized
ctattcaagaggccaaatta

SEQ ID NO: 59461 - DNA, 20 bp, Artificial Sequence
  chemically synthesized
gtatgtggaaatcacttccc

SEQ ID NO: 59462 - DNA, 20 bp, Artificial Sequence
  chemically synthesized
gaactttcaggtatttctcc

SEQ ID NO: 59463 - DNA, 20 bp, Artificial Sequence
  chemically synthesized
tttcaggtatttctccaagg

SEQ ID NO: 59464 - DNA, 20 bp, Artificial Sequence
  chemically synthesized
ctccaatgccacctctacat

SEQ ID NO: 59465 - DNA, 20 bp, Artificial Sequence
  chemically synthesized
aaagtattgagagatactag

SEQ ID NO: 59466 - DNA, 20 bp, Artificial Sequence
  chemically synthesized
tgagagatactagttgaatg

SEQ ID NO: 59467 - DNA, 20 bp, Artificial Sequence
  chemically synthesized
ggtcacatgtgtctttgtcc

SEQ ID NO: 59468 - DNA, 20 bp, Artificial Sequence
  chemically synthesized
tctgatccacaggaacctca

SEQ ID NO: 59469 - DNA, 20 bp, Artificial Sequence
  chemically synthesized
tgcccatttcataccaggtt

SEQ ID NO: 59470 - DNA, 20 bp, Artificial Sequence
  chemically synthesized
caacatttactttagataca

SEQ ID NO: 59471 - DNA, 20 bp, Artificial Sequence
  chemically synthesized
tacttgtgcaggttttttac

SEQ ID NO: 59472 - DNA, 20 bp, Artificial Sequence
  chemically synthesized
tttagcttccacttataaat

SEQ ID NO: 59473 - DNA, 20 bp, Artificial Sequence
  chemically synthesized
tgttcttgcgttaatttgct

SEQ ID NO: 59474 - DNA, 20 bp, Artificial Sequence
  chemically synthesized
gtctaatgctctgttttcct

SEQ ID NO: 59475 - DNA, 20 bp, Artificial Sequence
  chemically synthesized
tatggatatatacccagtag

SEQ ID NO: 59476 - DNA, 20 bp, Artificial Sequence
  chemically synthesized
ccttttctccatagcctcat

SEQ ID NO: 59477 - DNA, 20 bp, Artificial Sequence
  chemically synthesized
cctgtatgtcttctcttgag

SEQ ID NO: 59478 - DNA, 20 bp, Artificial Sequence
  chemically synthesized
ctcttgagaagagtctgttc

SEQ ID NO: 59479 - DNA, 20 bp, Artificial Sequence
  chemically synthesized
ggattttgcccatttttaaa

SEQ ID NO: 59480 - DNA, 20 bp, Artificial Sequence
  chemically synthesized
ctttttgcttgctgatatgt

SEQ ID NO: 59481 - DNA, 20 bp, Artificial Sequence
  chemically synthesized
gttcgaattccttatagatt

SEQ ID NO: 59482 - DNA, 20 bp, Artificial Sequence
  chemically synthesized
cttttccagatgcacagttt

SEQ ID NO: 59483 - DNA, 20 bp, Artificial Sequence
  chemically synthesized
tattattatactttaagttc

SEQ ID NO: 59484 - DNA, 20 bp, Artificial Sequence
  chemically synthesized
tgtccttgtgatagtttgct

SEQ ID NO: 59485 - DNA, 20 bp, Artificial Sequence
  chemically synthesized
attctatcattgttggacat

SEQ ID NO: 59486 - DNA, 20 bp, Artificial Sequence
  chemically synthesized
ggttccaagtctttgttatt

SEQ ID NO: 59487 - DNA, 20 bp, Artificial Sequence
  chemically synthesized
agtttaattaggttccactt

SEQ ID NO: 59488 - DNA, 20 bp, Artificial Sequence
  chemically synthesized
tgagatcttacatttaagtt

SEQ ID NO: 59489 - DNA, 20 bp, Artificial Sequence
  chemically synthesized
ttctctaaatggtgtaaggt

SEQ ID NO: 59490 - DNA, 20 bp, Artificial Sequence
  chemically synthesized
acgtattccagcacagttta

SEQ ID NO: 59491 - DNA, 20 bp, Artificial Sequence
  chemically synthesized
gtaactatgtagctttattt

SEQ ID NO: 59492 - DNA, 20 bp, Artificial Sequence
  chemically synthesized
tgtaacaatatcatgctgtt

SEQ ID NO: 59493 - DNA, 20 bp, Artificial Sequence
  chemically synthesized
tctttctttttttatttttt

SEQ ID NO: 59494 - DNA, 20 bp, Artificial Sequence
  chemically synthesized
tttcactctgtcacccaggc

SEQ ID NO: 59495 - DNA, 20 bp, Artificial Sequence
  chemically synthesized
ctcactgcaccgtctgcctc

SEQ ID NO: 59496 - DNA, 20 bp, Artificial Sequence
  chemically synthesized
aattctcctgcctcagcctt

SEQ ID NO: 59497 - DNA, 20 bp, Artificial Sequence
  chemically synthesized
gcctcagccttccgagtagc

SEQ ID NO: 59498 - DNA, 20 bp, Artificial Sequence
  chemically synthesized
acctcagccccctaaagtgc

SEQ ID NO: 59499 - DNA, 20 bp, Artificial Sequence
  chemically synthesized
caggctctttttggttccat

SEQ ID NO: 59500 - DNA, 20 bp, Artificial Sequence
  chemically synthesized
ctagtttttctaatactgtg

SEQ ID NO: 59501 - DNA, 20 bp, Artificial Sequence
  chemically synthesized
gtgaagaatgacattggtaa

SEQ ID NO: 59502 - DNA, 20 bp, Artificial Sequence
  chemically synthesized
gtaattggatagaaattgca

SEQ ID NO: 59503 - DNA, 20 bp, Artificial Sequence
  chemically synthesized
atcaaaggaacatacctcaa

SEQ ID NO: 59504 - DNA, 20 bp, Artificial Sequence
  chemically synthesized
aacccataaccaaaaccata

SEQ ID NO: 59505 - DNA, 20 bp, Artificial Sequence
  chemically synthesized
ctcgaaaactgcaacaagac

SEQ ID NO: 59506 - DNA, 20 bp, Artificial Sequence
  chemically synthesized
aaacaattttagcaaggttt

SEQ ID NO: 59507 - DNA, 20 bp, Artificial Sequence
  chemically synthesized
acaccaataaggcccaggct

SEQ ID NO: 59508 - DNA, 20 bp, Artificial Sequence
  chemically synthesized
ctagaaagaaaatatttacc

SEQ ID NO: 59509 - DNA, 20 bp, Artificial Sequence
  chemically synthesized
tacaacactatcattactac

SEQ ID NO: 59510 - DNA, 20 bp, Artificial Sequence
  chemically synthesized
agacacatcaaataaatttc

SEQ ID NO: 59511 - DNA, 20 bp, Artificial Sequence
  chemically synthesized
gaagaaatgctacttaagct

SEQ ID NO: 59512 - DNA, 20 bp, Artificial Sequence
  chemically synthesized
agtagtgtagtagtatttgg

SEQ ID NO: 59513 - DNA, 20 bp, Artificial Sequence
  chemically synthesized
gaaaaaaagcttgagagaaa

SEQ ID NO: 59514 - DNA, 20 bp, Artificial Sequence
  chemically synthesized
acattttgacattaccataa

SEQ ID NO: 59515 - DNA, 20 bp, Artificial Sequence
  chemically synthesized
tttgacattaccataaggga

SEQ ID NO: 59516 - DNA, 20 bp, Artificial Sequence
  chemically synthesized
aatataaaacaagaggtatg

SEQ ID NO: 59517 - DNA, 20 bp, Artificial Sequence
  chemically synthesized
agaacaggtaaaagaagtat

SEQ ID NO: 59518 - DNA, 20 bp, Artificial Sequence
  chemically synthesized
atcagtagcattagaaaggc

SEQ ID NO: 59519 - DNA, 20 bp, Artificial Sequence
  chemically synthesized
agaagagagattctatgact

SEQ ID NO: 59520 - DNA, 20 bp, Artificial Sequence
  chemically synthesized
ttctatgacttagaatagaa

SEQ ID NO: 59521 - DNA, 20 bp, Artificial Sequence
  chemically synthesized
agaagcgtaagtaatgccac

SEQ ID NO: 59522 - DNA, 20 bp, Artificial Sequence
  chemically synthesized
aagtaatgccacctgaattt

SEQ ID NO: 59523 - DNA, 20 bp, Artificial Sequence
  chemically synthesized
acctgaatttctgagttttg

SEQ ID NO: 59524 - DNA, 20 bp, Artificial Sequence
  chemically synthesized
tttctgagttttgctgaatg

SEQ ID NO: 59525 - DNA, 20 bp, Artificial Sequence
  chemically synthesized
tgattggtcattgtacatta

SEQ ID NO: 59526 - DNA, 20 bp, Artificial Sequence
  chemically synthesized
gactttgtagaaaagatgaa

SEQ ID NO: 59527 - DNA, 20 bp, Artificial Sequence
  chemically synthesized
tcaatgaagtgctttgcaca

SEQ ID NO: 59528 - DNA, 20 bp, Artificial Sequence
  chemically synthesized
cattaacatataggtaaaga

SEQ ID NO: 59529 - DNA, 20 bp, Artificial Sequence
  chemically synthesized
catgtggtaaagtgggaagg

SEQ ID NO: 59530 - DNA, 20 bp, Artificial Sequence
  chemically synthesized
gtaaagtgggaaggctgaat

SEQ ID NO: 59531 - DNA, 20 bp, Artificial Sequence
  chemically synthesized
aggatattattttgttttta

SEQ ID NO: 59532 - DNA, 20 bp, Artificial Sequence
  chemically synthesized
ccttattaaaaatatgacag

SEQ ID NO: 59533 - DNA, 20 bp, Artificial Sequence
  chemically synthesized
ctcaatgaaataaaatgcta

SEQ ID NO: 59534 - DNA, 20 bp, Artificial Sequence
  chemically synthesized
gtggattcagatcaccctct

SEQ ID NO: 59535 - DNA, 20 bp, Artificial Sequence
  chemically synthesized
ccatgaaggcaccaagaaca

SEQ ID NO: 59536 - DNA, 20 bp, Artificial Sequence
  chemically synthesized
tggccttggccagttaaact

SEQ ID NO: 59537 - DNA, 20 bp, Artificial Sequence
  chemically synthesized
tcaaaatttagatatcagat

SEQ ID NO: 59538 - DNA, 20 bp, Artificial Sequence
  chemically synthesized
tcaagatagcaaatcaagat

SEQ ID NO: 59539 - DNA, 20 bp, Artificial Sequence
  chemically synthesized
tttggtagataactgacttt

SEQ ID NO: 59540 - DNA, 20 bp, Artificial Sequence
  chemically synthesized
agataactgacttttaggat

SEQ ID NO: 59541 - DNA, 20 bp, Artificial Sequence
  chemically synthesized
gttttccccttttgaaattt

SEQ ID NO: 59542 - DNA, 20 bp, Artificial Sequence
  chemically synthesized
ccaccacaattttttagtca

SEQ ID NO: 59543 - DNA, 20 bp, Artificial Sequence
  chemically synthesized
cacaattttttagtcattgg

SEQ ID NO: 59544 - DNA, 20 bp, Artificial Sequence
  chemically synthesized
ttgttggtcttcctaatata

SEQ ID NO: 59545 - DNA, 20 bp, Artificial Sequence
  chemically synthesized
agagaaagtatttatggcaa

SEQ ID NO: 59546 - DNA, 20 bp, Artificial Sequence
  chemically synthesized
atgtctcatatttttcattc

SEQ ID NO: 59547 - DNA, 20 bp, Artificial Sequence
  chemically synthesized
aatggctatattttctattt

SEQ ID NO: 59548 - DNA, 20 bp, Artificial Sequence
  chemically synthesized
tctaagatttttttgggcaa

SEQ ID NO: 59549 - DNA, 20 bp, Artificial Sequence
  chemically synthesized
gggcaaaagaatatttatag

SEQ ID NO: 59550 - DNA, 20 bp, Artificial Sequence
  chemically synthesized
taaaatccagacatcctgca

SEQ ID NO: 59551 - DNA, 20 bp, Artificial Sequence
  chemically synthesized
aaatgcaaatcatggcccta

SEQ ID NO: 59552 - DNA, 20 bp, Artificial Sequence
  chemically synthesized
ccctagagagtaccctaact

SEQ ID NO: 59553 - DNA, 20 bp, Artificial Sequence
  chemically synthesized
cttatcactatatttgccat

SEQ ID NO: 59554 - DNA, 20 bp, Artificial Sequence
  chemically synthesized
gaataatgaaaattttaaat

SEQ ID NO: 59555 - DNA, 20 bp, Artificial Sequence
  chemically synthesized
taaataagaatttatttcta

SEQ ID NO: 59556 - DNA, 20 bp, Artificial Sequence
  chemically synthesized
atttcaggtgcatttgaaag

SEQ ID NO: 59557 - DNA, 20 bp, Artificial Sequence
  chemically synthesized
ggtaaagtacttaagtcctt

SEQ ID NO: 59558 - DNA, 20 bp, Artificial Sequence
  chemically synthesized
ctgtgtctgattctccagat

SEQ ID NO: 59559 - DNA, 20 bp, Artificial Sequence
  chemically synthesized
aacctatgtttagataaaag

SEQ ID NO: 59560 - DNA, 20 bp, Artificial Sequence
  chemically synthesized
ggttttgatgctgtagatga

SEQ ID NO: 59561 - DNA, 20 bp, Artificial Sequence
  chemically synthesized
cattcttcccaaatctgtaa

SEQ ID NO: 59562 - DNA, 20 bp, Artificial Sequence
  chemically synthesized
gcaatgcctatgacagtatt

SEQ ID NO: 59563 - DNA, 20 bp, Artificial Sequence
  chemically synthesized
cctatgacagtattaagaat

SEQ ID NO: 59564 - DNA, 20 bp, Artificial Sequence
  chemically synthesized
agaattagaatataggagaa

SEQ ID NO: 59565 - DNA, 20 bp, Artificial Sequence
  chemically synthesized
tgttaaagagatcaaaatta

SEQ ID NO: 59566 - DNA, 20 bp, Artificial Sequence
  chemically synthesized
aaaagacgcaaaattacagg

SEQ ID NO: 59567 - DNA, 20 bp, Artificial Sequence
  chemically synthesized
gacgcaaaattacaggcagg

SEQ ID NO: 59568 - DNA, 20 bp, Artificial Sequence
  chemically synthesized
gctatgactctagtattggt

SEQ ID NO: 59569 - DNA, 20 bp, Artificial Sequence
  chemically synthesized
gagaatggaagcatatctca

SEQ ID NO: 59570 - DNA, 20 bp, Artificial Sequence
  chemically synthesized
gaagcatatctcaaaggatt

SEQ ID NO: 59571 - DNA, 20 bp, Artificial Sequence
  chemically synthesized
acctgattccacaacagaaa

SEQ ID NO: 59572 - DNA, 20 bp, Artificial Sequence
  chemically synthesized
gattccacaacagaaaggga

SEQ ID NO: 59573 - DNA, 20 bp, Artificial Sequence
  chemically synthesized
atctccctgtgattcaccca

SEQ ID NO: 59574 - DNA, 20 bp, Artificial Sequence
  chemically synthesized
aggagcatgccattgcccag

SEQ ID NO: 59575 - DNA, 20 bp, Artificial Sequence
  chemically synthesized
cacacataaacagcaaagaa

SEQ ID NO: 59576 - DNA, 20 bp, Artificial Sequence
  chemically synthesized
ctgcaactattttcctgaag

SEQ ID NO: 59577 - DNA, 20 bp, Artificial Sequence
  chemically synthesized
ttccctaattagaaaaaata

SEQ ID NO: 59578 - DNA, 20 bp, Artificial Sequence
  chemically synthesized
atattatccgcaactatttt

SEQ ID NO: 59579 - DNA, 20 bp, Artificial Sequence
  chemically synthesized
cataacataaatatacataa

SEQ ID NO: 59580 - DNA, 20 bp, Artificial Sequence
  chemically synthesized
tttctcattttttttggaaa

SEQ ID NO: 59581 - DNA, 20 bp, Artificial Sequence
  chemically synthesized
agttacttgagcttggccac

SEQ ID NO: 59582 - DNA, 20 bp, Artificial Sequence
  chemically synthesized
tgagcttggccaccagagtt

SEQ ID NO: 59583 - DNA, 20 bp, Artificial Sequence
  chemically synthesized
attctgccccttccaacatt

SEQ ID NO: 59584 - DNA, 20 bp, Artificial Sequence
  chemically synthesized
ttataatgtttccacagcct

SEQ ID NO: 59585 - DNA, 20 bp, Artificial Sequence
  chemically synthesized
cttggttgccacgatccaag

SEQ ID NO: 59586 - DNA, 20 bp, Artificial Sequence
  chemically synthesized
gtcttatttaacgagaaatt

SEQ ID NO: 59587 - DNA, 20 bp, Artificial Sequence
  chemically synthesized
cctcagtatcaaaaataaat

SEQ ID NO: 59588 - DNA, 20 bp, Artificial Sequence
  chemically synthesized
ctacctctgtatcagctcct

SEQ ID NO: 59589 - DNA, 20 bp, Artificial Sequence
  chemically synthesized
ctgtatcagctcctgtgagt

SEQ ID NO: 59590 - DNA, 20 bp, Artificial Sequence
  chemically synthesized
gattgaaatcaccaacacta

SEQ ID NO: 59591 - DNA, 20 bp, Artificial Sequence
  chemically synthesized
atccctaaaattaaatcaca

SEQ ID NO: 59592 - DNA, 20 bp, Artificial Sequence
  chemically synthesized
cattgaattcatatagaaga

SEQ ID NO: 59593 - DNA, 20 bp, Artificial Sequence
  chemically synthesized
atgcttaaaaacacagattg

SEQ ID NO: 59594 - DNA, 20 bp, Artificial Sequence
  chemically synthesized
aaacacagattgaggaataa

SEQ ID NO: 59595 - DNA, 20 bp, Artificial Sequence
  chemically synthesized
ttgaggaataagaggatgta

SEQ ID NO: 59596 - DNA, 20 bp, Artificial Sequence
  chemically synthesized
ggaatgaggtataggaggaa

SEQ ID NO: 59597 - DNA, 20 bp, Artificial Sequence
  chemically synthesized
aattggtgacacatattctg

SEQ ID NO: 59598 - DNA, 20 bp, Artificial Sequence
  chemically synthesized
aaaaagaaagccataaaatc

SEQ ID NO: 59599 - DNA, 20 bp, Artificial Sequence
  chemically synthesized
tcctttaaaaaaaattgtgt

SEQ ID NO: 59600 - DNA, 20 bp, Artificial Sequence
  chemically synthesized
atctccctccatctctaagc

SEQ ID NO: 59601 - DNA, 20 bp, Artificial Sequence
  chemically synthesized
taaatcatgtctgagatttt

SEQ ID NO: 59602 - DNA, 20 bp, Artificial Sequence
  chemically synthesized
ttacccagaggcaggcgtgt

SEQ ID NO: 59603 - DNA, 20 bp, Artificial Sequence
  chemically synthesized
aagcacaagaactagttttt

SEQ ID NO: 59604 - DNA, 20 bp, Artificial Sequence
  chemically synthesized
taaatgtttagtgatttcct

SEQ ID NO: 59605 - DNA, 20 bp, Artificial Sequence
  chemically synthesized
ttagtgatttcctaaggatc

SEQ ID NO: 59606 - DNA, 20 bp, Artificial Sequence
  chemically synthesized
caagttggaaaatgactatt

SEQ ID NO: 59607 - DNA, 20 bp, Artificial Sequence
  chemically synthesized
atgactattttgagtcagca

SEQ ID NO: 59608 - DNA, 20 bp, Artificial Sequence
  chemically synthesized
agaagctctcaatatggcct

SEQ ID NO: 59609 - DNA, 20 bp, Artificial Sequence
  chemically synthesized
attctcccttcaattttatg

SEQ ID NO: 59610 - DNA, 20 bp, Artificial Sequence
  chemically synthesized
ttttatgcagaatattgccc

SEQ ID NO: 59611 - DNA, 20 bp, Artificial Sequence
  chemically synthesized
attgcccttgaatgtctcaa

SEQ ID NO: 59612 - DNA, 20 bp, Artificial Sequence
  chemically synthesized
attctagatgttctattgac

SEQ ID NO: 59613 - DNA, 20 bp, Artificial Sequence
  chemically synthesized
acatgatgatatatttctag

SEQ ID NO: 59614 - DNA, 20 bp, Artificial Sequence
  chemically synthesized
gctcactttgagaacataat

SEQ ID NO: 59615 - DNA, 20 bp, Artificial Sequence
  chemically synthesized
ttgaatgttaccagatacaa

SEQ ID NO: 59616 - DNA, 20 bp, Artificial Sequence
  chemically synthesized
tcaagaaaatgtagtaaata

SEQ ID NO: 59617 - DNA, 20 bp, Artificial Sequence
  chemically synthesized
tttcctactctgccctcctt

SEQ ID NO: 59618 - DNA, 20 bp, Artificial Sequence
  chemically synthesized
tactctgccctccttctgag

SEQ ID NO: 59619 - DNA, 20 bp, Artificial Sequence
  chemically synthesized
aaggagatgggccctgtctc

SEQ ID NO: 59620 - DNA, 20 bp, Artificial Sequence
  chemically synthesized
ctgtctctagaatttttcta

SEQ ID NO: 59621 - DNA, 20 bp, Artificial Sequence
  chemically synthesized
acatgcatgtgtgtgtttca

SEQ ID NO: 59622 - DNA, 20 bp, Artificial Sequence
  chemically synthesized
tgtgtttcaaggggtgttgt

SEQ ID NO: 59623 - DNA, 20 bp, Artificial Sequence
  chemically synthesized
acttttctttctataaattt

SEQ ID NO: 59624 - DNA, 20 bp, Artificial Sequence
  chemically synthesized
tataaatttcaggatcttag

SEQ ID NO: 59625 - DNA, 20 bp, Artificial Sequence
  chemically synthesized
tgtctttaatcttcaaaaaa

SEQ ID NO: 59626 - DNA, 20 bp, Artificial Sequence
  chemically synthesized
ctaagcctttcaactcgatt

SEQ ID NO: 59627 - DNA, 20 bp, Artificial Sequence
  chemically synthesized
aaacgtaaaataagcccttt

SEQ ID NO: 59628 - DNA, 20 bp, Artificial Sequence
  chemically synthesized
cctttctggataaacaaaaa

SEQ ID NO: 59629 - DNA, 20 bp, Artificial Sequence
  chemically synthesized
aaatgaccaaagatgatcat

SEQ ID NO: 59630 - DNA, 20 bp, Artificial Sequence
  chemically synthesized
tctgcttcttattttcaaaa

SEQ ID NO: 59631 - DNA, 20 bp, Artificial Sequence
  chemically synthesized
gaatgtattacaataaaaaa

SEQ ID NO: 59632 - DNA, 20 bp, Artificial Sequence
  chemically synthesized
ccaataactgaacaaaggag

SEQ ID NO: 59633 - DNA, 20 bp, Artificial Sequence
  chemically synthesized
gagtgataacaaagctgttt

SEQ ID NO: 59634 - DNA, 20 bp, Artificial Sequence
  chemically synthesized
ataaacatctacatagaaaa

SEQ ID NO: 59635 - DNA, 20 bp, Artificial Sequence
  chemically synthesized
atctacatagaaaaatgagt

SEQ ID NO: 59636 - DNA, 20 bp, Artificial Sequence
  chemically synthesized
aattatacttatgccaatcc

SEQ ID NO: 59637 - DNA, 20 bp, Artificial Sequence
  chemically synthesized
aaaaaaaaaaatctgtgctg

SEQ ID NO: 59638 - DNA, 20 bp, Artificial Sequence
  chemically synthesized
aaccttcttatatgctttcc

SEQ ID NO: 59639 - DNA, 20 bp, Artificial Sequence
  chemically synthesized
catctcacatcagaagagag

SEQ ID NO: 59640 - DNA, 20 bp, Artificial Sequence
  chemically synthesized
gcatgtggaaatcacctccc

SEQ ID NO: 59641 - DNA, 20 bp, Artificial Sequence
  chemically synthesized
ggccccacaactgatgtcct

SEQ ID NO: 59642 - DNA, 20 bp, Artificial Sequence
  chemically synthesized
ggattttcaggtgtttcctg

SEQ ID NO: 59643 - DNA, 20 bp, Artificial Sequence
  chemically synthesized
ttcaggtgtttcctgaagaa

SEQ ID NO: 59644 - DNA, 20 bp, Artificial Sequence
  chemically synthesized
aaaaccagctgatgtaagat

SEQ ID NO: 59645 - DNA, 20 bp, Artificial Sequence
  chemically synthesized
tcataacttagtttatttga

SEQ ID NO: 59646 - DNA, 20 bp, Artificial Sequence
  chemically synthesized
tagtttatttgaaagggtta

SEQ ID NO: 59647 - DNA, 20 bp, Artificial Sequence
  chemically synthesized
aggggatatcggttgtcttc

SEQ ID NO: 59648 - DNA, 20 bp, Artificial Sequence
  chemically synthesized
cagggatcatatgtacctct

SEQ ID NO: 59649 - DNA, 20 bp, Artificial Sequence
  chemically synthesized
ctctacgggtcctagagctt

SEQ ID NO: 59650 - DNA, 20 bp, Artificial Sequence
  chemically synthesized
tcttatctactggaacttca

SEQ ID NO: 59651 - DNA, 20 bp, Artificial Sequence
  chemically synthesized
tttttttttttttttttaga

SEQ ID NO: 59652 - DNA, 20 bp, Artificial Sequence
  chemically synthesized
gtctcactctgtcgccaggc

SEQ ID NO: 59653 - DNA, 20 bp, Artificial Sequence
  chemically synthesized
ttttgtatttttagtagaca

SEQ ID NO: 59654 - DNA, 20 bp, Artificial Sequence
  chemically synthesized
cggggtttcaccatattggc

SEQ ID NO: 59655 - DNA, 20 bp, Artificial Sequence
  chemically synthesized
tccttggcctcccaaagtgc

SEQ ID NO: 59656 - DNA, 20 bp, Artificial Sequence
  chemically synthesized
aaagtgctgggattgcaggt

SEQ ID NO: 59657 - DNA, 20 bp, Artificial Sequence
  chemically synthesized
aggagcatagtctttattca

SEQ ID NO: 59658 - DNA, 20 bp, Artificial Sequence
  chemically synthesized
aaatatagtgtttgtataag

SEQ ID NO: 59659 - DNA, 20 bp, Artificial Sequence
  chemically synthesized
atatgacaaactcaaatcaa

SEQ ID NO: 59660 - DNA, 20 bp, Artificial Sequence
  chemically synthesized
caagagaattctagcagagc

SEQ ID NO: 59661 - DNA, 20 bp, Artificial Sequence
  chemically synthesized
gtgagaaaattgaacacaaa

SEQ ID NO: 59662 - DNA, 20 bp, Artificial Sequence
  chemically synthesized
tattattatactttaagttt

SEQ ID NO: 59663 - DNA, 20 bp, Artificial Sequence
  chemically synthesized
ccccacctcacaacagtccc

SEQ ID NO: 59664 - DNA, 20 bp, Artificial Sequence
  chemically synthesized
tcattgttcaattcccacct

SEQ ID NO: 59665 - DNA, 20 bp, Artificial Sequence
  chemically synthesized
tgtccttgcgatagtttgct

SEQ ID NO: 59666 - DNA, 20 bp, Artificial Sequence
  chemically synthesized
agtctatcattgttggacat

SEQ ID NO: 59667 - DNA, 20 bp, Artificial Sequence
  chemically synthesized
ggttccaagtctttgctatt

SEQ ID NO: 59668 - DNA, 20 bp, Artificial Sequence
  chemically synthesized
gcagcatgatttataatccg

SEQ ID NO: 59669 - DNA, 20 bp, Artificial Sequence
  chemically synthesized
gttgggtatatacccagtaa

SEQ ID NO: 59670 - DNA, 20 bp, Artificial Sequence
  chemically synthesized
tatacccagtaatgggatgg

SEQ ID NO: 59671 - DNA, 20 bp, Artificial Sequence
  chemically synthesized
tttctagttctagatccctg

SEQ ID NO: 59672 - DNA, 20 bp, Artificial Sequence
  chemically synthesized
aactagtttacagtcccacc

SEQ ID NO: 59673 - DNA, 20 bp, Artificial Sequence
  chemically synthesized
tgatgaagcacagtgtctga

SEQ ID NO: 59674 - DNA, 20 bp, Artificial Sequence
  chemically synthesized
gcaattcccatgaccttctt

SEQ ID NO: 59675 - DNA, 20 bp, Artificial Sequence
  chemically synthesized
cccatgaccttcttaaggat

SEQ ID NO: 59676 - DNA, 20 bp, Artificial Sequence
  chemically synthesized
aggatcagaatgtaagagat

SEQ ID NO: 59677 - DNA, 20 bp, Artificial Sequence
  chemically synthesized
agttgatgagaccaggacta

SEQ ID NO: 59678 - DNA, 20 bp, Artificial Sequence
  chemically synthesized
agaaagcatgggagaggaca

SEQ ID NO: 59679 - DNA, 20 bp, Artificial Sequence
  chemically synthesized
ggacatgggattgacagtag

SEQ ID NO: 59680 - DNA, 20 bp, Artificial Sequence
  chemically synthesized
tgacagtaggggaatccaga

SEQ ID NO: 59681 - DNA, 20 bp, Artificial Sequence
  chemically synthesized
ttcaccaccttagcattggt

SEQ ID NO: 59682 - DNA, 20 bp, Artificial Sequence
  chemically synthesized
gagaatggaggtgtatctca

SEQ ID NO: 59683 - DNA, 20 bp, Artificial Sequence
  chemically synthesized
gaggtgtatctcaggggatt

SEQ ID NO: 59684 - DNA, 20 bp, Artificial Sequence
  chemically synthesized
tctggactccacgatagaga

SEQ ID NO: 59685 - DNA, 20 bp, Artificial Sequence
  chemically synthesized
gactccacgatagagaggga

SEQ ID NO: 59686 - DNA, 20 bp, Artificial Sequence
  chemically synthesized
tatggctgccagtatagtca

SEQ ID NO: 59687 - DNA, 20 bp, Artificial Sequence
  chemically synthesized
gagtagtacacgggctcatg

SEQ ID NO: 59688 - DNA, 20 bp, Artificial Sequence
  chemically synthesized
aaagaaggagatagaactcc

SEQ ID NO: 59689 - DNA, 20 bp, Artificial Sequence
  chemically synthesized
gaaaaggggcagcagtaatg

SEQ ID NO: 59690 - DNA, 20 bp, Artificial Sequence
  chemically synthesized
cagtaatggtgggtgacatg

SEQ ID NO: 59691 - DNA, 20 bp, Artificial Sequence
  chemically synthesized
gttctggtagtcacattaaa

SEQ ID NO: 59692 - DNA, 20 bp, Artificial Sequence
  chemically synthesized
ttggtacaaattcttcaaaa

SEQ ID NO: 59693 - DNA, 20 bp, Artificial Sequence
  chemically synthesized
tgcttcatcaaaaaaatgtt

SEQ ID NO: 59694 - DNA, 20 bp, Artificial Sequence
  chemically synthesized
ctatcctaatttctaggact

SEQ ID NO: 59695 - DNA, 20 bp, Artificial Sequence
  chemically synthesized
atatgatacaatatcatgct

SEQ ID NO: 59696 - DNA, 20 bp, Artificial Sequence
  chemically synthesized
aagttgctgatctattgact

SEQ ID NO: 59697 - DNA, 20 bp, Artificial Sequence
  chemically synthesized
attccatgagcccctaaaag

SEQ ID NO: 59698 - DNA, 20 bp, Artificial Sequence
  chemically synthesized
gagttttcaccaagtagtag

SEQ ID NO: 59699 - DNA, 20 bp, Artificial Sequence
  chemically synthesized
tcaaaatttgagaaaggttc

SEQ ID NO: 59700 - DNA, 20 bp, Artificial Sequence
  chemically synthesized
tataaggaggtcacaaaaga

SEQ ID NO: 59701 - DNA, 20 bp, Artificial Sequence
  chemically synthesized
acaaaaacaaacagggactt

SEQ ID NO: 59702 - DNA, 20 bp, Artificial Sequence
  chemically synthesized
aggaaactgaactctgacag

SEQ ID NO: 59703 - DNA, 20 bp, Artificial Sequence
  chemically synthesized
actttgggaggccaaggcgg

SEQ ID NO: 59704 - DNA, 20 bp, Artificial Sequence
  chemically synthesized
cgggcggatcacctgaggtc

SEQ ID NO: 59705 - DNA, 20 bp, Artificial Sequence
  chemically synthesized
tacttgggaaactgaggcag

SEQ ID NO: 59706 - DNA, 20 bp, Artificial Sequence
  chemically synthesized
ttgtgccactgcactccagg

SEQ ID NO: 59707 - DNA, 20 bp, Artificial Sequence
  chemically synthesized
aactgagctctgactacaat

SEQ ID NO: 59708 - DNA, 20 bp, Artificial Sequence
  chemically synthesized
caatctgaatgaacgtggaa

SEQ ID NO: 59709 - DNA, 20 bp, Artificial Sequence
  chemically synthesized
cgaattcttccccagagcct

SEQ ID NO: 59710 - DNA, 20 bp, Artificial Sequence
  chemically synthesized
agcccagccctcccgatatt

SEQ ID NO: 59711 - DNA, 20 bp, Artificial Sequence
  chemically synthesized
gagaactcagttaagcctat

SEQ ID NO: 59712 - DNA, 20 bp, Artificial Sequence
  chemically synthesized
actattatccatattttatt

SEQ ID NO: 59713 - DNA, 20 bp, Artificial Sequence
  chemically synthesized
catattttattaagagttta

SEQ ID NO: 59714 - DNA, 20 bp, Artificial Sequence
  chemically synthesized
ctataataaactaatattta

SEQ ID NO: 59715 - DNA, 20 bp, Artificial Sequence
  chemically synthesized
gtatcatttatctattatca

SEQ ID NO: 59716 - DNA, 20 bp, Artificial Sequence
  chemically synthesized
gcaccatctgctcaggtaca

SEQ ID NO: 59717 - DNA, 20 bp, Artificial Sequence
  chemically synthesized
aatggccctggaagcaatga

SEQ ID NO: 59718 - DNA, 20 bp, Artificial Sequence
  chemically synthesized
aaggcagaaagggaacatag

SEQ ID NO: 59719 - DNA, 20 bp, Artificial Sequence
  chemically synthesized
ccaccctgcacattcactcc

SEQ ID NO: 59720 - DNA, 20 bp, Artificial Sequence
  chemically synthesized
taaaactactgtttttattt

SEQ ID NO: 59721 - DNA, 20 bp, Artificial Sequence
  chemically synthesized
ttggaggttgatacacccgg

SEQ ID NO: 59722 - DNA, 20 bp, Artificial Sequence
  chemically synthesized
gcaacaactatgtggtggaa

SEQ ID NO: 59723 - DNA, 20 bp, Artificial Sequence
  chemically synthesized
atagtcactagagcctgacc

SEQ ID NO: 59724 - DNA, 20 bp, Artificial Sequence
  chemically synthesized
attaaggggagaggtaattg

SEQ ID NO: 59725 - DNA, 20 bp, Artificial Sequence
  chemically synthesized
gtatctctgaagactgctaa

SEQ ID NO: 59726 - DNA, 20 bp, Artificial Sequence
  chemically synthesized
ccccagtatctgtcttgatg

SEQ ID NO: 59727 - DNA, 20 bp, Artificial Sequence
  chemically synthesized
atgctggataattaggctac

SEQ ID NO: 59728 - DNA, 20 bp, Artificial Sequence
  chemically synthesized
ttttctttgcaaaaagaaaa

SEQ ID NO: 59729 - DNA, 20 bp, Artificial Sequence
  chemically synthesized
tttgttatatatactcacaa

SEQ ID NO: 59730 - DNA, 20 bp, Artificial Sequence
  chemically synthesized
tctcttggtaagtcttgccc

SEQ ID NO: 59731 - DNA, 20 bp, Artificial Sequence
  chemically synthesized
ggtaagtcttgcccaagaat

SEQ ID NO: 59732 - DNA, 20 bp, Artificial Sequence
  chemically synthesized
ctttgtctgacaatttgtac

SEQ ID NO: 59733 - DNA, 20 bp, Artificial Sequence
  chemically synthesized
tcatagtctgtcagagaaat

SEQ ID NO: 59734 - DNA, 20 bp, Artificial Sequence
  chemically synthesized
tgtcagagaaataaggatct

SEQ ID NO: 59735 - DNA, 20 bp, Artificial Sequence
  chemically synthesized
cccaactatgagattttaaa

SEQ ID NO: 59736 - DNA, 20 bp, Artificial Sequence
  chemically synthesized
tatgagattttaaaatgagt

SEQ ID NO: 59737 - DNA, 20 bp, Artificial Sequence
  chemically synthesized
ggtgcaatgtggtgaaccat

SEQ ID NO: 59738 - DNA, 20 bp, Artificial Sequence
  chemically synthesized
taggtcttcctaaatgtaag

SEQ ID NO: 59739 - DNA, 20 bp, Artificial Sequence
  chemically synthesized
tactaagttaaaatttaggt

SEQ ID NO: 59740 - DNA, 20 bp, Artificial Sequence
  chemically synthesized
gaccctctcactggcagtac

SEQ ID NO: 59741 - DNA, 20 bp, Artificial Sequence
  chemically synthesized
taatttcctgcagactgccc

SEQ ID NO: 59742 - DNA, 20 bp, Artificial Sequence
  chemically synthesized
cctgcagactgccccagagt

SEQ ID NO: 59743 - DNA, 20 bp, Artificial Sequence
  chemically synthesized
gtgaagtgacactgttggtg

SEQ ID NO: 59744 - DNA, 20 bp, Artificial Sequence
  chemically synthesized
tggtggaggataagcctcca

SEQ ID NO: 59745 - DNA, 20 bp, Artificial Sequence
  chemically synthesized
ttgatgcagtgtttcctgac

SEQ ID NO: 59746 - DNA, 20 bp, Artificial Sequence
  chemically synthesized
ttcctgacaagggtcatccg

SEQ ID NO: 59747 - DNA, 20 bp, Artificial Sequence
  chemically synthesized
tcacataacacaatatttat

SEQ ID NO: 59748 - DNA, 20 bp, Artificial Sequence
  chemically synthesized
attcaggaaggtctctatcc

SEQ ID NO: 59749 - DNA, 20 bp, Artificial Sequence
  chemically synthesized
cctaggatttttgctgtttg

SEQ ID NO: 59750 - DNA, 20 bp, Artificial Sequence
  chemically synthesized
ttctattatctgtcagcctt

SEQ ID NO: 59751 - DNA, 20 bp, Artificial Sequence
  chemically synthesized
atgccaatttgactgggcca

SEQ ID NO: 59752 - DNA, 20 bp, Artificial Sequence
  chemically synthesized
attattctagatgtttttgt

SEQ ID NO: 59753 - DNA, 20 bp, Artificial Sequence
  chemically synthesized
tcctccaatcagttgaaaac

SEQ ID NO: 59754 - DNA, 20 bp, Artificial Sequence
  chemically synthesized
tgacccttccccaaatcaga

SEQ ID NO: 59755 - DNA, 20 bp, Artificial Sequence
  chemically synthesized
cttattgatggccttcaaac

SEQ ID NO: 59756 - DNA, 20 bp, Artificial Sequence
  chemically synthesized
aactgaaacatcaaaacttc

SEQ ID NO: 59757 - DNA, 20 bp, Artificial Sequence
  chemically synthesized
ggtctgaagcctgatggctt

SEQ ID NO: 59758 - DNA, 20 bp, Artificial Sequence
  chemically synthesized
gactaaactaccaggctctc

SEQ ID NO: 59759 - DNA, 20 bp, Artificial Sequence
  chemically synthesized
cattatttttttttaatgca

SEQ ID NO: 59760 - DNA, 20 bp, Artificial Sequence
  chemically synthesized
taagttctgaggtacatgtg

SEQ ID NO: 59761 - DNA, 20 bp, Artificial Sequence
  chemically synthesized
tgtctatcattgatggccat

SEQ ID NO: 59762 - DNA, 20 bp, Artificial Sequence
  chemically synthesized
gattctatgtctttgctatt

SEQ ID NO: 59763 - DNA, 20 bp, Artificial Sequence
  chemically synthesized
atgtgcatgtatcttagtaa

SEQ ID NO: 59764 - DNA, 20 bp, Artificial Sequence
  chemically synthesized
tttaggtatatacccagtaa

SEQ ID NO: 59765 - DNA, 20 bp, Artificial Sequence
  chemically synthesized
tttctggttctaaatctttg

SEQ ID NO: 59766 - DNA, 20 bp, Artificial Sequence
  chemically synthesized
cacactgtcttccacaatgg

SEQ ID NO: 59767 - DNA, 20 bp, Artificial Sequence
  chemically synthesized
gtcctttgcccactttttaa

SEQ ID NO: 59768 - DNA, 20 bp, Artificial Sequence
  chemically synthesized
gtctaagttcctcatagatt

SEQ ID NO: 59769 - DNA, 20 bp, Artificial Sequence
  chemically synthesized
ggatattagacctttgtcag

SEQ ID NO: 59770 - DNA, 20 bp, Artificial Sequence
  chemically synthesized
tctcactctttcacccatgc

SEQ ID NO: 59771 - DNA, 20 bp, Artificial Sequence
  chemically synthesized
ctcactgcaacctctgcctc

SEQ ID NO: 59772 - DNA, 20 bp, Artificial Sequence
  chemically synthesized
aattctcctgcctcagcctc

SEQ ID NO: 59773 - DNA, 20 bp, Artificial Sequence
  chemically synthesized
ttttgtatttttagtagaga

SEQ ID NO: 59774 - DNA, 20 bp, Artificial Sequence
  chemically synthesized
accttggcctcccaaagtgc

SEQ ID NO: 59775 - DNA, 20 bp, Artificial Sequence
  chemically synthesized
tctttgcctgtgtctatgtc

SEQ ID NO: 59776 - DNA, 20 bp, Artificial Sequence
  chemically synthesized
cttctaaagtttttatagtt

SEQ ID NO: 59777 - DNA, 20 bp, Artificial Sequence
  chemically synthesized
acttaagtctttaatgcatc

SEQ ID NO: 59778 - DNA, 20 bp, Artificial Sequence
  chemically synthesized
ttatgtataagatgtaagga

SEQ ID NO: 59779 - DNA, 20 bp, Artificial Sequence
  chemically synthesized
ccagcacaatttataaaata

SEQ ID NO: 59780 - DNA, 20 bp, Artificial Sequence
  chemically synthesized
tcagatgcgcggtcttactt

SEQ ID NO: 59781 - DNA, 20 bp, Artificial Sequence
  chemically synthesized
ccttgtagtataatttgaag

SEQ ID NO: 59782 - DNA, 20 bp, Artificial Sequence
  chemically synthesized
ccataaaataaattttgtct

SEQ ID NO: 59783 - DNA, 20 bp, Artificial Sequence
  chemically synthesized
taataacaatgactgtgtct

SEQ ID NO: 59784 - DNA, 20 bp, Artificial Sequence
  chemically synthesized
ttaattggacatggagacct

SEQ ID NO: 59785 - DNA, 20 bp, Artificial Sequence
  chemically synthesized
agcaattatttgttaatgag

SEQ ID NO: 59786 - DNA, 20 bp, Artificial Sequence
  chemically synthesized
atattattatttgaaaaaga

SEQ ID NO: 59787 - DNA, 20 bp, Artificial Sequence
  chemically synthesized
gttatattcttctttcagtc

SEQ ID NO: 59788 - DNA, 20 bp, Artificial Sequence
  chemically synthesized
cagtcttgaatgatgaaaag

SEQ ID NO: 59789 - DNA, 20 bp, Artificial Sequence
  chemically synthesized
tgttagtccactggaccact

SEQ ID NO: 59790 - DNA, 20 bp, Artificial Sequence
  chemically synthesized
ctctgaattctactcttctt

SEQ ID NO: 59791 - DNA, 20 bp, Artificial Sequence
  chemically synthesized
ctaacttttattttaggttc

SEQ ID NO: 59792 - DNA, 20 bp, Artificial Sequence
  chemically synthesized
catatttaaacttgtgtcac

SEQ ID NO: 59793 - DNA, 20 bp, Artificial Sequence
  chemically synthesized
tgtttatgttgattgttaca

SEQ ID NO: 59794 - DNA, 20 bp, Artificial Sequence
  chemically synthesized
gttgattgttacaatgggtt

SEQ ID NO: 59795 - DNA, 20 bp, Artificial Sequence
  chemically synthesized
ttttgaatagaaaaacatgt

SEQ ID NO: 59796 - DNA, 20 bp, Artificial Sequence
  chemically synthesized
gaatagaaaaacatgtctga

SEQ ID NO: 59797 - DNA, 20 bp, Artificial Sequence
  chemically synthesized
catcctacagcatcttctca

SEQ ID NO: 59798 - DNA, 20 bp, Artificial Sequence
  chemically synthesized
acaaaacaaattacaagaag

SEQ ID NO: 59799 - DNA, 20 bp, Artificial Sequence
  chemically synthesized
aagaggagtttattaggctg

SEQ ID NO: 59800 - DNA, 20 bp, Artificial Sequence
  chemically synthesized
tcaaactgtcctccttgtca

SEQ ID NO: 59801 - DNA, 20 bp, Artificial Sequence
  chemically synthesized
cactgagtctcaggaaaaca

SEQ ID NO: 59802 - DNA, 20 bp, Artificial Sequence
  chemically synthesized
aaagttcttctactgcggtt

SEQ ID NO: 59803 - DNA, 20 bp, Artificial Sequence
  chemically synthesized
ttcatagggaacaatatttt

SEQ ID NO: 59804 - DNA, 20 bp, Artificial Sequence
  chemically synthesized
agtaggtactacaagcatga

SEQ ID NO: 59805 - DNA, 20 bp, Artificial Sequence
  chemically synthesized
ggcaaaaagtagaagccact

SEQ ID NO: 59806 - DNA, 20 bp, Artificial Sequence
  chemically synthesized
ctaaggatagtctactgtag

SEQ ID NO: 59807 - DNA, 20 bp, Artificial Sequence
  chemically synthesized
tatagttagaagatataaat

SEQ ID NO: 59808 - DNA, 20 bp, Artificial Sequence
  chemically synthesized
aaaaatgttatgcccttgga

SEQ ID NO: 59809 - DNA, 20 bp, Artificial Sequence
  chemically synthesized
atctaccccacaatattttt

SEQ ID NO: 59810 - DNA, 20 bp, Artificial Sequence
  chemically synthesized
ttttatgaataaaataagtt

SEQ ID NO: 59811 - DNA, 20 bp, Artificial Sequence
  chemically synthesized
agggacacatgtttggtttt

SEQ ID NO: 59812 - DNA, 20 bp, Artificial Sequence
  chemically synthesized
ctcaggtgacatggcgtgac

SEQ ID NO: 59813 - DNA, 20 bp, Artificial Sequence
  chemically synthesized
aattacatctcttaatgaaa

SEQ ID NO: 59814 - DNA, 20 bp, Artificial Sequence
  chemically synthesized
taatgaaacagaatataaat

SEQ ID NO: 59815 - DNA, 20 bp, Artificial Sequence
  chemically synthesized
ctatgagcaatacctgagat

SEQ ID NO: 59816 - DNA, 20 bp, Artificial Sequence
  chemically synthesized
caaatgtgtgcaatttatta

SEQ ID NO: 59817 - DNA, 20 bp, Artificial Sequence
  chemically synthesized
agcttagcttcagaaggcaa

SEQ ID NO: 59818 - DNA, 20 bp, Artificial Sequence
  chemically synthesized
tcttcataagacatttcctg

SEQ ID NO: 59819 - DNA, 20 bp, Artificial Sequence
  chemically synthesized
gcacaattctgtaaaatgat

SEQ ID NO: 59820 - DNA, 20 bp, Artificial Sequence
  chemically synthesized
agacataacctccctctttt

SEQ ID NO: 59821 - DNA, 20 bp, Artificial Sequence
  chemically synthesized
tctttttaggatattttaaa

SEQ ID NO: 59822 - DNA, 20 bp, Artificial Sequence
  chemically synthesized
aggatattttaaattgagtt

SEQ ID NO: 59823 - DNA, 20 bp, Artificial Sequence
  chemically synthesized
tcagacaattttaatcaaat

SEQ ID NO: 59824 - DNA, 20 bp, Artificial Sequence
  chemically synthesized
ggaaatttacacttattaca

SEQ ID NO: 59825 - DNA, 20 bp, Artificial Sequence
  chemically synthesized
ttacacttattacatggaat

SEQ ID NO: 59826 - DNA, 20 bp, Artificial Sequence
  chemically synthesized
gacctttttcatagcaaaag

SEQ ID NO: 59827 - DNA, 20 bp, Artificial Sequence
  chemically synthesized
gtcagccagcgtagatatct

SEQ ID NO: 59828 - DNA, 20 bp, Artificial Sequence
  chemically synthesized
tcaacattggagctagcaac

SEQ ID NO: 59829 - DNA, 20 bp, Artificial Sequence
  chemically synthesized
ggagctagcaactagggtag

SEQ ID NO: 59830 - DNA, 20 bp, Artificial Sequence
  chemically synthesized
agcaactagggtagtagaat

SEQ ID NO: 59831 - DNA, 20 bp, Artificial Sequence
  chemically synthesized
tgtcagaaggtactgccttg

SEQ ID NO: 59832 - DNA, 20 bp, Artificial Sequence
  chemically synthesized
tactgccttggggaataaat

SEQ ID NO: 59833 - DNA, 20 bp, Artificial Sequence
  chemically synthesized
acacctgcagagaaattcat

SEQ ID NO: 59834 - DNA, 20 bp, Artificial Sequence
  chemically synthesized
tagagaaatattccgtttac

SEQ ID NO: 59835 - DNA, 20 bp, Artificial Sequence
  chemically synthesized
gtacaaactacatttagcta

SEQ ID NO: 59836 - DNA, 20 bp, Artificial Sequence
  chemically synthesized
tttgctctcctgctaaatat

SEQ ID NO: 59837 - DNA, 20 bp, Artificial Sequence
  chemically synthesized
ttagagtttttacattctgt

SEQ ID NO: 59838 - DNA, 20 bp, Artificial Sequence
  chemically synthesized
ggagatcaggttccaattct

SEQ ID NO: 59839 - DNA, 20 bp, Artificial Sequence
  chemically synthesized
ctatgggtagtaaaaaggtg

SEQ ID NO: 59840 - DNA, 20 bp, Artificial Sequence
  chemically synthesized
aaaaggtgaagaatggcatt

SEQ ID NO: 59841 - DNA, 20 bp, Artificial Sequence
  chemically synthesized
ggtcttgacactatatgtta

SEQ ID NO: 59842 - DNA, 20 bp, Artificial Sequence
  chemically synthesized
ggaacctgctttccaaaacg

SEQ ID NO: 59843 - DNA, 20 bp, Artificial Sequence
  chemically synthesized
aggcaatgctcaggacagtc

SEQ ID NO: 59844 - DNA, 20 bp, Artificial Sequence
  chemically synthesized
tataaagactacaagcacag

SEQ ID NO: 59845 - DNA, 20 bp, Artificial Sequence
  chemically synthesized
tgaaggtggtatcagcacag

SEQ ID NO: 59846 - DNA, 20 bp, Artificial Sequence
  chemically synthesized
taatgacatcctggtgaagg

SEQ ID NO: 59847 - DNA, 20 bp, Artificial Sequence
  chemically synthesized
gaatgcatgtgaaagaacat

SEQ ID NO: 59848 - DNA, 20 bp, Artificial Sequence
  chemically synthesized
ggggcctgattgggggaaca

SEQ ID NO: 59849 - DNA, 20 bp, Artificial Sequence
  chemically synthesized
cccagcccaatcttcactac

SEQ ID NO: 59850 - DNA, 20 bp, Artificial Sequence
  chemically synthesized
aagtacagaggtatatctaa

SEQ ID NO: 59851 - DNA, 20 bp, Artificial Sequence
  chemically synthesized
cggtcataggccatggcaag

SEQ ID NO: 59852 - DNA, 20 bp, Artificial Sequence
  chemically synthesized
gccagactcgagaaaggaaa

SEQ ID NO: 59853 - DNA, 20 bp, Artificial Sequence
  chemically synthesized
tcttccttaatgagaagaag

SEQ ID NO: 59854 - DNA, 20 bp, Artificial Sequence
  chemically synthesized
aggagggtgccattgccaaa

SEQ ID NO: 59855 - DNA, 20 bp, Artificial Sequence
  chemically synthesized
gggtgccattgccaaaaagg

SEQ ID NO: 59856 - DNA, 20 bp, Artificial Sequence
  chemically synthesized
tggaaaaccagtcaatagga

SEQ ID NO: 59857 - DNA, 20 bp, Artificial Sequence
  chemically synthesized
agctgccgctggacgacatc

SEQ ID NO: 59858 - DNA, 20 bp, Artificial Sequence
  chemically synthesized
cacttcgactatatcattct

SEQ ID NO: 59859 - DNA, 20 bp, Artificial Sequence
  chemically synthesized
tgtttctcaaaatacattct

SEQ ID NO: 59860 - DNA, 20 bp, Artificial Sequence
  chemically synthesized
gtattcttaactgcacattc

SEQ ID NO: 59861 - DNA, 20 bp, Artificial Sequence
  chemically synthesized
tacctacgtaatcaaattct

SEQ ID NO: 59862 - DNA, 20 bp, Artificial Sequence
  chemically synthesized
ccttaactatgcagatttta

SEQ ID NO: 59863 - DNA, 20 bp, Artificial Sequence
  chemically synthesized
gtattctatggggcattcaa

SEQ ID NO: 59864 - DNA, 20 bp, Artificial Sequence
  chemically synthesized
tcctgcatgtaaagacttac

SEQ ID NO: 59865 - DNA, 20 bp, Artificial Sequence
  chemically synthesized
aacagacattcacgattagt

SEQ ID NO: 59866 - DNA, 20 bp, Artificial Sequence
  chemically synthesized
tagtgtgaattaccctcttg

SEQ ID NO: 59867 - DNA, 20 bp, Artificial Sequence
  chemically synthesized
tataagttagactttggggc

SEQ ID NO: 59868 - DNA, 20 bp, Artificial Sequence
  chemically synthesized
ggcctactgaagtaattccc

SEQ ID NO: 59869 - DNA, 20 bp, Artificial Sequence
  chemically synthesized
ttatccccagccataggctt

SEQ ID NO: 59870 - DNA, 20 bp, Artificial Sequence
  chemically synthesized
tgaatctgttctccccaata

SEQ ID NO: 59871 - DNA, 20 bp, Artificial Sequence
  chemically synthesized
ccatgatatttaaagctctc

SEQ ID NO: 59872 - DNA, 20 bp, Artificial Sequence
  chemically synthesized
tactacttgatgtagattaa

SEQ ID NO: 59873 - DNA, 20 bp, Artificial Sequence
  chemically synthesized
tagggccttacagaccacca

SEQ ID NO: 59874 - DNA, 20 bp, Artificial Sequence
  chemically synthesized
agcaagagacaagaaaagag

SEQ ID NO: 59875 - DNA, 20 bp, Artificial Sequence
  chemically synthesized
ctattttaaaaatccatatg

SEQ ID NO: 59876 - DNA, 20 bp, Artificial Sequence
  chemically synthesized
tttgctgatatattaaaaat

SEQ ID NO: 59877 - DNA, 20 bp, Artificial Sequence
  chemically synthesized
atttctgtttgaacaaatga

SEQ ID NO: 59878 - DNA, 20 bp, Artificial Sequence
  chemically synthesized
actcaaaatggaagtctgag

SEQ ID NO: 59879 - DNA, 20 bp, Artificial Sequence
  chemically synthesized
tattcacttgtgaggaaatc

SEQ ID NO: 59880 - DNA, 20 bp, Artificial Sequence
  chemically synthesized
agagtcattagtaaatatag

SEQ ID NO: 59881 - DNA, 20 bp, Artificial Sequence
  chemically synthesized
cgtatccaaatatacccctt

SEQ ID NO: 59882 - DNA, 20 bp, Artificial Sequence
  chemically synthesized
gcaacaactcagcactttga

SEQ ID NO: 59883 - DNA, 20 bp, Artificial Sequence
  chemically synthesized
taggactgagagacataaac

SEQ ID NO: 59884 - DNA, 20 bp, Artificial Sequence
  chemically synthesized
cagtgcctactgaacataca

SEQ ID NO: 59885 - DNA, 20 bp, Artificial Sequence
  chemically synthesized
tgaaaaattccttcttatca

SEQ ID NO: 59886 - DNA, 20 bp, Artificial Sequence
  chemically synthesized
gagaatatgcagcacaagtg

SEQ ID NO: 59887 - DNA, 20 bp, Artificial Sequence
  chemically synthesized
tttcctccttctccattccc

SEQ ID NO: 59888 - DNA, 20 bp, Artificial Sequence
  chemically synthesized
gcagctataatagtgatcta

SEQ ID NO: 59889 - DNA, 20 bp, Artificial Sequence
  chemically synthesized
ggaaagagatcataaagact

SEQ ID NO: 59890 - DNA, 20 bp, Artificial Sequence
  chemically synthesized
gtttaaaaagtaaaatgtag

SEQ ID NO: 59891 - DNA, 20 bp, Artificial Sequence
  chemically synthesized
aaaggaaagaagacatatga

SEQ ID NO: 59892 - DNA, 20 bp, Artificial Sequence
  chemically synthesized
ggtcaatcatattcacatca

SEQ ID NO: 59893 - DNA, 20 bp, Artificial Sequence
  chemically synthesized
ggtagttggttggtagcact

SEQ ID NO: 59894 - DNA, 20 bp, Artificial Sequence
  chemically synthesized
tttctctggagagcttatag

SEQ ID NO: 59895 - DNA, 20 bp, Artificial Sequence
  chemically synthesized
agtacactctttatatatct

SEQ ID NO: 59896 - DNA, 20 bp, Artificial Sequence
  chemically synthesized
tgtttgatggtgaggaagag

SEQ ID NO: 59897 - DNA, 20 bp, Artificial Sequence
  chemically synthesized
gtctcccttttatagccaac

SEQ ID NO: 59898 - DNA, 20 bp, Artificial Sequence
  chemically synthesized
tttttcaaataagttactgg

SEQ ID NO: 59899 - DNA, 20 bp, Artificial Sequence
  chemically synthesized
tggtaggacctttatgtgtg

SEQ ID NO: 59900 - DNA, 20 bp, Artificial Sequence
  chemically synthesized
atcttcttggcctatgtaac

SEQ ID NO: 59901 - DNA, 20 bp, Artificial Sequence
  chemically synthesized
aagcagagagctagatagac

SEQ ID NO: 59902 - DNA, 20 bp, Artificial Sequence
  chemically synthesized
tatcactaactattcccttc

SEQ ID NO: 59903 - DNA, 20 bp, Artificial Sequence
  chemically synthesized
cagaagttttctcttttcca

SEQ ID NO: 59904 - DNA, 20 bp, Artificial Sequence
  chemically synthesized
ccaggacagagacagagatc

SEQ ID NO: 59905 - DNA, 20 bp, Artificial Sequence
  chemically synthesized
gaacaataattatctaaatc

SEQ ID NO: 59906 - DNA, 20 bp, Artificial Sequence
  chemically synthesized
gatacatgactatggaactg

SEQ ID NO: 59907 - DNA, 20 bp, Artificial Sequence
  chemically synthesized
gaacaaagtttcaggtcagt

SEQ ID NO: 59908 - DNA, 20 bp, Artificial Sequence
  chemically synthesized
caggtcagtgagggtattta

SEQ ID NO: 59909 - DNA, 20 bp, Artificial Sequence
  chemically synthesized
aagtaatagtgttgtctgct

SEQ ID NO: 59910 - DNA, 20 bp, Artificial Sequence
  chemically synthesized
agtagatatatgtagtaggc

SEQ ID NO: 59911 - DNA, 20 bp, Artificial Sequence
  chemically synthesized
ctctaaaacttggtttcttt

SEQ ID NO: 59912 - DNA, 20 bp, Artificial Sequence
  chemically synthesized
tcttcaaatataaaaaagtg

SEQ ID NO: 59913 - DNA, 20 bp, Artificial Sequence
  chemically synthesized
ttctacgaacaaaccagagc

SEQ ID NO: 59914 - DNA, 20 bp, Artificial Sequence
  chemically synthesized
gcatgggtgttgactcaggc

SEQ ID NO: 59915 - DNA, 20 bp, Artificial Sequence
  chemically synthesized
gttgactcaggcatgaatta

SEQ ID NO: 59916 - DNA, 20 bp, Artificial Sequence
  chemically synthesized
ctggcttccattctaaccct

SEQ ID NO: 59917 - DNA, 20 bp, Artificial Sequence
  chemically synthesized
gtccagataagtgccaaata

SEQ ID NO: 59918 - DNA, 20 bp, Artificial Sequence
  chemically synthesized
aaattaagcttggacggagc

SEQ ID NO: 59919 - DNA, 20 bp, Artificial Sequence
  chemically synthesized
agcttgggttatgtgtgcct

SEQ ID NO: 59920 - DNA, 20 bp, Artificial Sequence
  chemically synthesized
gttatgtgtgcctctggatc

SEQ ID NO: 59921 - DNA, 20 bp, Artificial Sequence
  chemically synthesized
agatagtacccacccagacg

SEQ ID NO: 59922 - DNA, 20 bp, Artificial Sequence
  chemically synthesized
agtacccacccagacggagg

SEQ ID NO: 59923 - DNA, 20 bp, Artificial Sequence
  chemically synthesized
cccacccagacggagggtgg

SEQ ID NO: 59924 - DNA, 20 bp, Artificial Sequence
  chemically synthesized
tcaatattaaccatcacaga

SEQ ID NO: 59925 - DNA, 20 bp, Artificial Sequence
  chemically synthesized
aggataatagccaaaggtaa

SEQ ID NO: 59926 - DNA, 20 bp, Artificial Sequence
  chemically synthesized
caaaggtaagggggtaaaaa

SEQ ID NO: 59927 - DNA, 20 bp, Artificial Sequence
  chemically synthesized
actaagtgcttgagacagaa

SEQ ID NO: 59928 - DNA, 20 bp, Artificial Sequence
  chemically synthesized
aaaagccaaagggaaggtga

SEQ ID NO: 59929 - DNA, 20 bp, Artificial Sequence
  chemically synthesized
gaatatatgaaagttaacat

SEQ ID NO: 59930 - DNA, 20 bp, Artificial Sequence
  chemically synthesized
agagccatcagtttatgcgg

SEQ ID NO: 59931 - DNA, 20 bp, Artificial Sequence
  chemically synthesized
gcggcagagtttgagacttt

SEQ ID NO: 59932 - DNA, 20 bp, Artificial Sequence
  chemically synthesized
ctatgacagagaccctggaa

SEQ ID NO: 59933 - DNA, 20 bp, Artificial Sequence
  chemically synthesized
gacagagaccctggaagagg

SEQ ID NO: 59934 - DNA, 20 bp, Artificial Sequence
  chemically synthesized
ggaagagggtgaatggctgc

SEQ ID NO: 59935 - DNA, 20 bp, Artificial Sequence
  chemically synthesized
ctcatataccacaaaagcaa

SEQ ID NO: 59936 - DNA, 20 bp, Artificial Sequence
  chemically synthesized
tataccacaaaagcaactga

SEQ ID NO: 59937 - DNA, 20 bp, Artificial Sequence
  chemically synthesized
acaagacaaacagctatttt

SEQ ID NO: 59938 - DNA, 20 bp, Artificial Sequence
  chemically synthesized
attatggtaatcatttaaca

SEQ ID NO: 59939 - DNA, 20 bp, Artificial Sequence
  chemically synthesized
cttctttaatcctgcataag

SEQ ID NO: 59940 - DNA, 20 bp, Artificial Sequence
  chemically synthesized
cttttctcactttttgagga

SEQ ID NO: 59941 - DNA, 20 bp, Artificial Sequence
  chemically synthesized
ggaaatcatttgacacacct

SEQ ID NO: 59942 - DNA, 20 bp, Artificial Sequence
  chemically synthesized
atcatttgacacacctctgg

SEQ ID NO: 59943 - DNA, 20 bp, Artificial Sequence
  chemically synthesized
ttccccttactttgtgtcaa

SEQ ID NO: 59944 - DNA, 20 bp, Artificial Sequence
  chemically synthesized
aaaatgaaagtccagtaatc

SEQ ID NO: 59945 - DNA, 20 bp, Artificial Sequence
  chemically synthesized
gcctgcaccagctgaaatct

SEQ ID NO: 59946 - DNA, 20 bp, Artificial Sequence
  chemically synthesized
gctgaaatcttagaattcta

SEQ ID NO: 59947 - DNA, 20 bp, Artificial Sequence
  chemically synthesized
tcaatttatattatgaaaat

SEQ ID NO: 59948 - DNA, 20 bp, Artificial Sequence
  chemically synthesized
tgaagcagtgtatcaataac

SEQ ID NO: 59949 - DNA, 20 bp, Artificial Sequence
  chemically synthesized
ggttataaagctgggcaact

SEQ ID NO: 59950 - DNA, 20 bp, Artificial Sequence
  chemically synthesized
agtctctggagcttcatcaa

SEQ ID NO: 59951 - DNA, 20 bp, Artificial Sequence
  chemically synthesized
atcaattgaattttccctcc

SEQ ID NO: 59952 - DNA, 20 bp, Artificial Sequence
  chemically synthesized
caccctataataccaccagt

SEQ ID NO: 59953 - DNA, 20 bp, Artificial Sequence
  chemically synthesized
tttcattttgtttttatttt

SEQ ID NO: 59954 - DNA, 20 bp, Artificial Sequence
  chemically synthesized
tctgggttatatgatttaca

SEQ ID NO: 59955 - DNA, 20 bp, Artificial Sequence
  chemically synthesized
ttcaacaatgtttattctgc

SEQ ID NO: 59956 - DNA, 20 bp, Artificial Sequence
  chemically synthesized
tagtatccaataatcttaca

SEQ ID NO: 59957 - DNA, 20 bp, Artificial Sequence
  chemically synthesized
acattctattttcccatacc

SEQ ID NO: 59958 - DNA, 20 bp, Artificial Sequence
  chemically synthesized
tcccatacctaggatctccc

SEQ ID NO: 59959 - DNA, 20 bp, Artificial Sequence
  chemically synthesized
gtgaacatcttatgaacagg

SEQ ID NO: 59960 - DNA, 20 bp, Artificial Sequence
  chemically synthesized
ctgattactattgctttacc

SEQ ID NO: 59961 - DNA, 20 bp, Artificial Sequence
  chemically synthesized
ggcatggagaaggcacatca

SEQ ID NO: 59962 - DNA, 20 bp, Artificial Sequence
  chemically synthesized
gcactcttctctttctcatc

SEQ ID NO: 59963 - DNA, 20 bp, Artificial Sequence
  chemically synthesized
atgttggcagctacagacct

SEQ ID NO: 59964 - DNA, 20 bp, Artificial Sequence
  chemically synthesized
tatccatactctttctgtca

SEQ ID NO: 59965 - DNA, 20 bp, Artificial Sequence
  chemically synthesized
caggtaatgaagattggtgt

SEQ ID NO: 59966 - DNA, 20 bp, Artificial Sequence
  chemically synthesized
gcattaaaactaagcagatt

SEQ ID NO: 59967 - DNA, 20 bp, Artificial Sequence
  chemically synthesized
cattgtttcactggtctctg

SEQ ID NO: 59968 - DNA, 20 bp, Artificial Sequence
  chemically synthesized
aataattcaggggacctgga

SEQ ID NO: 59969 - DNA, 20 bp, Artificial Sequence
  chemically synthesized
accaattatatatataattc

SEQ ID NO: 59970 - DNA, 20 bp, Artificial Sequence
  chemically synthesized
ataattcttgggtctatgat

SEQ ID NO: 59971 - DNA, 20 bp, Artificial Sequence
  chemically synthesized
atattagtcctgttatacat

SEQ ID NO: 59972 - DNA, 20 bp, Artificial Sequence
  chemically synthesized
gaaatgagactttcttcaat

SEQ ID NO: 59973 - DNA, 20 bp, Artificial Sequence
  chemically synthesized
cctcaattactttcttcaat

SEQ ID NO: 59974 - DNA, 20 bp, Artificial Sequence
  chemically synthesized
atttccctcaattcaaaatg

SEQ ID NO: 59975 - DNA, 20 bp, Artificial Sequence
  chemically synthesized
catcagagataagactagat

SEQ ID NO: 59976 - DNA, 20 bp, Artificial Sequence
  chemically synthesized
gtctggcatgtgcaaaatag

SEQ ID NO: 59977 - DNA, 20 bp, Artificial Sequence
  chemically synthesized
caaacagttggtcatatgtg

SEQ ID NO: 59978 - DNA, 20 bp, Artificial Sequence
  chemically synthesized
ggagagtggggaggaaggga

SEQ ID NO: 59979 - DNA, 20 bp, Artificial Sequence
  chemically synthesized
caaatacttttgattctttt

SEQ ID NO: 59980 - DNA, 20 bp, Artificial Sequence
  chemically synthesized
agagtctaggcatgagaaga

SEQ ID NO: 59981 - DNA, 20 bp, Artificial Sequence
  chemically synthesized
atattcttttgaccaaaata

SEQ ID NO: 59982 - DNA, 20 bp, Artificial Sequence
  chemically synthesized
gccacccagtgaccagtcag

SEQ ID NO: 59983 - DNA, 20 bp, Artificial Sequence
  chemically synthesized
actcttcatcacagaaaggt

SEQ ID NO: 59984 - DNA, 20 bp, Artificial Sequence
  chemically synthesized
acagaaaggtggggattttt

SEQ ID NO: 59985 - DNA, 20 bp, Artificial Sequence
  chemically synthesized
tggggattttttaggattct

SEQ ID NO: 59986 - DNA, 20 bp, Artificial Sequence
  chemically synthesized
agcttcttgactgtgtgctc

SEQ ID NO: 59987 - DNA, 20 bp, Artificial Sequence
  chemically synthesized
aaatataatttttcattaaa

SEQ ID NO: 59988 - DNA, 20 bp, Artificial Sequence
  chemically synthesized
ctttcttcccttgggctttt

SEQ ID NO: 59989 - DNA, 20 bp, Artificial Sequence
  chemically synthesized
cttcccttgggcttttggga

SEQ ID NO: 59990 - DNA, 20 bp, Artificial Sequence
  chemically synthesized
gcttttgggaatgaattcag

SEQ ID NO: 59991 - DNA, 20 bp, Artificial Sequence
  chemically synthesized
caggctagtataaagataac

SEQ ID NO: 59992 - DNA, 20 bp, Artificial Sequence
  chemically synthesized
gacacatttgactgacaacc

SEQ ID NO: 59993 - DNA, 20 bp, Artificial Sequence
  chemically synthesized
gggacttgcagttctctttg

SEQ ID NO: 59994 - DNA, 20 bp, Artificial Sequence
  chemically synthesized
cctgaacaacatatcaacag

SEQ ID NO: 59995 - DNA, 20 bp, Artificial Sequence
  chemically synthesized
atcaagagggcatctttgcc

SEQ ID NO: 59996 - DNA, 20 bp, Artificial Sequence
  chemically synthesized
gacaaaagacaaacagtttg

SEQ ID NO: 59997 - DNA, 20 bp, Artificial Sequence
  chemically synthesized
acttcaagccacaagaagca

SEQ ID NO: 59998 - DNA, 20 bp, Artificial Sequence
  chemically synthesized
accagacctgagagaactct

SEQ ID NO: 59999 - DNA, 20 bp, Artificial Sequence
  chemically synthesized
ttcaagagaccttgacgaag

SEQ ID NO: 60000 - DNA, 20 bp, Artificial Sequence
  chemically synthesized
cactgtgtgaagtctgtgcg

SEQ ID NO: 60001 - DNA, 20 bp, Artificial Sequence
  chemically synthesized
agaaaggtgatgtgctctgg

SEQ ID NO: 60002 - DNA, 20 bp, Artificial Sequence
  chemically synthesized
aggatatccacaaaaaactc

SEQ ID NO: 60003 - DNA, 20 bp, Artificial Sequence
  chemically synthesized
tggaccaatttcctgacttg

SEQ ID NO: 60004 - DNA, 20 bp, Artificial Sequence
  chemically synthesized
ctcaacagagcttcaggagg

SEQ ID NO: 60005 - DNA, 20 bp, Artificial Sequence
  chemically synthesized
gcctctgtctaaggcagaag

SEQ ID NO: 60006 - DNA, 20 bp, Artificial Sequence
  chemically synthesized
gaaagcatagagaaagtttg

SEQ ID NO: 60007 - DNA, 20 bp, Artificial Sequence
  chemically synthesized
ttaccattattatagtcaag

SEQ ID NO: 60008 - DNA, 20 bp, Artificial Sequence
  chemically synthesized
attattatagtcaagacgaa

SEQ ID NO: 60009 - DNA, 20 bp, Artificial Sequence
  chemically synthesized
agtatgaagtgatgatgaaa

SEQ ID NO: 60010 - DNA, 20 bp, Artificial Sequence
  chemically synthesized
aaagagcaacacccactgat

SEQ ID NO: 60011 - DNA, 20 bp, Artificial Sequence
  chemically synthesized
ttctcctatgccagcatgac

SEQ ID NO: 60012 - DNA, 20 bp, Artificial Sequence
  chemically synthesized
taaaaattaaaaaaaaaaaa

SEQ ID NO: 60013 - DNA, 20 bp, Artificial Sequence
  chemically synthesized
attaaaaaaaaaaaaaagag

SEQ ID NO: 60014 - DNA, 20 bp, Artificial Sequence
  chemically synthesized
aaaaaaaaagagtagggtca

SEQ ID NO: 60015 - DNA, 20 bp, Artificial Sequence
  chemically synthesized
aagagtagggtcaaggggta

SEQ ID NO: 60016 - DNA, 20 bp, Artificial Sequence
  chemically synthesized
agggtagcaaaattttctta

SEQ ID NO: 60017 - DNA, 20 bp, Artificial Sequence
  chemically synthesized
ttaaaaatctgctgcaagct

SEQ ID NO: 60018 - DNA, 20 bp, Artificial Sequence
  chemically synthesized
aaactggaaactctaaaaat

SEQ ID NO: 60019 - DNA, 20 bp, Artificial Sequence
  chemically synthesized
gagtgcctctcctcctccaa

SEQ ID NO: 60020 - DNA, 20 bp, Artificial Sequence
  chemically synthesized
caacggtacaaagctggaca

SEQ ID NO: 60021 - DNA, 20 bp, Artificial Sequence
  chemically synthesized
aaattagactaatggctaac

SEQ ID NO: 60022 - DNA, 20 bp, Artificial Sequence
  chemically synthesized
caaggcatgagaactacatg

SEQ ID NO: 60023 - DNA, 20 bp, Artificial Sequence
  chemically synthesized
tgattcgatcaactggaaga

SEQ ID NO: 60024 - DNA, 20 bp, Artificial Sequence
  chemically synthesized
tatcagtgatggaagatcaa

SEQ ID NO: 60025 - DNA, 20 bp, Artificial Sequence
  chemically synthesized
gaagagaagtttagagaaaa

SEQ ID NO: 60026 - DNA, 20 bp, Artificial Sequence
  chemically synthesized
gtgtacctgaaagtgacggg

SEQ ID NO: 60027 - DNA, 20 bp, Artificial Sequence
  chemically synthesized
ccaagttggaaaacactctg

SEQ ID NO: 60028 - DNA, 20 bp, Artificial Sequence
  chemically synthesized
gaaatgaagggaaaaatgtt

SEQ ID NO: 60029 - DNA, 20 bp, Artificial Sequence
  chemically synthesized
agggtagccagagagaaagg

SEQ ID NO: 60030 - DNA, 20 bp, Artificial Sequence
  chemically synthesized
acccacaaagggaagcccat

SEQ ID NO: 60031 - DNA, 20 bp, Artificial Sequence
  chemically synthesized
agaaactctacaagccagaa

SEQ ID NO: 60032 - DNA, 20 bp, Artificial Sequence
  chemically synthesized
tattcaacatccttaaagga

SEQ ID NO: 60033 - DNA, 20 bp, Artificial Sequence
  chemically synthesized
aaaggaaagaattttcaaca

SEQ ID NO: 60034 - DNA, 20 bp, Artificial Sequence
  chemically synthesized
accagctaacatcataatga

SEQ ID NO: 60035 - DNA, 20 bp, Artificial Sequence
  chemically synthesized
acagacgggcaaattagata

SEQ ID NO: 60036 - DNA, 20 bp, Artificial Sequence
  chemically synthesized
cacacataggctcaaaataa

SEQ ID NO: 60037 - DNA, 20 bp, Artificial Sequence
  chemically synthesized
aatggaaaacaaaaaaaggc

SEQ ID NO: 60038 - DNA, 20 bp, Artificial Sequence
  chemically synthesized
aggccattacataatggtaa

SEQ ID NO: 60039 - DNA, 20 bp, Artificial Sequence
  chemically synthesized
caacgagacagaaagttaac

SEQ ID NO: 60040 - DNA, 20 bp, Artificial Sequence
  chemically synthesized
gaaagttaacaaggatatcc

SEQ ID NO: 60041 - DNA, 20 bp, Artificial Sequence
  chemically synthesized
aactctccaccccaaatcaa

SEQ ID NO: 60042 - DNA, 20 bp, Artificial Sequence
  chemically synthesized
agtgcaatcaaactagaact

SEQ ID NO: 60043 - DNA, 20 bp, Artificial Sequence
  chemically synthesized
ggaaaccgaacaaattgctc

SEQ ID NO: 60044 - DNA, 20 bp, Artificial Sequence
  chemically synthesized
aaattgctcctgaatgacta

SEQ ID NO: 60045 - DNA, 20 bp, Artificial Sequence
  chemically synthesized
agaacaaagacacaacatac

SEQ ID NO: 60046 - DNA, 20 bp, Artificial Sequence
  chemically synthesized
aaaaacccttcaaaaaatca

SEQ ID NO: 60047 - DNA, 20 bp, Artificial Sequence
  chemically synthesized
taataaagaagaaaagagag

SEQ ID NO: 60048 - DNA, 20 bp, Artificial Sequence
  chemically synthesized
agatgcaataaaaaatgata

SEQ ID NO: 60049 - DNA, 20 bp, Artificial Sequence
  chemically synthesized
agaaatacaaaccaccatca

SEQ ID NO: 60050 - DNA, 20 bp, Artificial Sequence
  chemically synthesized
aactagaaaatctagaagaa

SEQ ID NO: 60051 - DNA, 20 bp, Artificial Sequence
  chemically synthesized
aagactaaaccaggaagaag

SEQ ID NO: 60052 - DNA, 20 bp, Artificial Sequence
  chemically synthesized
accaggaagaagttgaatct

SEQ ID NO: 60053 - DNA, 20 bp, Artificial Sequence
  chemically synthesized
atctctgaatagaccaataa

SEQ ID NO: 60054 - DNA, 20 bp, Artificial Sequence
  chemically synthesized
aaaaacagtccaggaccaga

SEQ ID NO: 60055 - DNA, 20 bp, Artificial Sequence
  chemically synthesized
accattccctctgaaactat

SEQ ID NO: 60056 - DNA, 20 bp, Artificial Sequence
  chemically synthesized
ttcgaatcaatagtaaaaga

SEQ ID NO: 60057 - DNA, 20 bp, Artificial Sequence
  chemically synthesized
gcagagacacaacaaaaaaa

SEQ ID NO: 60058 - DNA, 20 bp, Artificial Sequence
  chemically synthesized
gatcaagtgggcttcatccc

SEQ ID NO: 60059 - DNA, 20 bp, Artificial Sequence
  chemically synthesized
aacccacagccaatatcata

SEQ ID NO: 60060 - DNA, 20 bp, Artificial Sequence
  chemically synthesized
tttgaaaactggcacaagac

SEQ ID NO: 60061 - DNA, 20 bp, Artificial Sequence
  chemically synthesized
actcctattcaacatagtgt

SEQ ID NO: 60062 - DNA, 20 bp, Artificial Sequence
  chemically synthesized
aggcaacttcagcaaagtct

SEQ ID NO: 60063 - DNA, 20 bp, Artificial Sequence
  chemically synthesized
ccattcacaattgcttcaaa

SEQ ID NO: 60064 - DNA, 20 bp, Artificial Sequence
  chemically synthesized
tcaaagagaataaaatacct

SEQ ID NO: 60065 - DNA, 20 bp, Artificial Sequence
  chemically synthesized
aggagaactacaaaccactg

SEQ ID NO: 60066 - DNA, 20 bp, Artificial Sequence
  chemically synthesized
tggaagaacattccatgctc

SEQ ID NO: 60067 - DNA, 20 bp, Artificial Sequence
  chemically synthesized
attccatgctcatgggtagg

SEQ ID NO: 60068 - DNA, 20 bp, Artificial Sequence
  chemically synthesized
gctaccaatgactttcttca

SEQ ID NO: 60069 - DNA, 20 bp, Artificial Sequence
  chemically synthesized
acaaaaaaaacaaatgggga

SEQ ID NO: 60070 - DNA, 20 bp, Artificial Sequence
  chemically synthesized
ccatacgcagaaagctgaaa

SEQ ID NO: 60071 - DNA, 20 bp, Artificial Sequence
  chemically synthesized
tatacaaaaattaattcaag

SEQ ID NO: 60072 - DNA, 20 bp, Artificial Sequence
  chemically synthesized
caaaagccaaaatggacaaa

SEQ ID NO: 60073 - DNA, 20 bp, Artificial Sequence
  chemically synthesized
acagcaaaagaaactaccat

SEQ ID NO: 60074 - DNA, 20 bp, Artificial Sequence
  chemically synthesized
cagagtgaacaggcaacata

SEQ ID NO: 60075 - DNA, 20 bp, Artificial Sequence
  chemically synthesized
tccgacaaagggctaatatc

SEQ ID NO: 60076 - DNA, 20 bp, Artificial Sequence
  chemically synthesized
accccatcaaaaagtgggca

SEQ ID NO: 60077 - DNA, 20 bp, Artificial Sequence
  chemically synthesized
agataccatctcacaccagt

SEQ ID NO: 60078 - DNA, 20 bp, Artificial Sequence
  chemically synthesized
aggaaacaacaggtgctgga

SEQ ID NO: 60079 - DNA, 20 bp, Artificial Sequence
  chemically synthesized
agtcagtgtggcgattcctc

SEQ ID NO: 60080 - DNA, 20 bp, Artificial Sequence
  chemically synthesized
ttgacccagccatcccatta

SEQ ID NO: 60081 - DNA, 20 bp, Artificial Sequence
  chemically synthesized
cattactgggtacatactca

SEQ ID NO: 60082 - DNA, 20 bp, Artificial Sequence
  chemically synthesized
aaatgtccaacaatgataga

SEQ ID NO: 60083 - DNA, 20 bp, Artificial Sequence
  chemically synthesized
aacgtggcacatatacacca

SEQ ID NO: 60084 - DNA, 20 bp, Artificial Sequence
  chemically synthesized
ctatgcagccataaaaaatg

SEQ ID NO: 60085 - DNA, 20 bp, Artificial Sequence
  chemically synthesized
ttcatgtcctttgtagggac

SEQ ID NO: 60086 - DNA, 20 bp, Artificial Sequence
  chemically synthesized
gcatgttctcactcataggt

SEQ ID NO: 60087 - DNA, 20 bp, Artificial Sequence
  chemically synthesized
tcacacaccagggcctgcag

SEQ ID NO: 60088 - DNA, 20 bp, Artificial Sequence
  chemically synthesized
accagggcctgcagtggggt

SEQ ID NO: 60089 - DNA, 20 bp, Artificial Sequence
  chemically synthesized
gtggggtgggggtcgggggg

SEQ ID NO: 60090 - DNA, 20 bp, Artificial Sequence
  chemically synthesized
gatatacctaatgctaagtg

SEQ ID NO: 60091 - DNA, 20 bp, Artificial Sequence
  chemically synthesized
taatgctaagtgacgagtta

SEQ ID NO: 60092 - DNA, 20 bp, Artificial Sequence
  chemically synthesized
ttctaaatccctcaggctgg

SEQ ID NO: 60093 - DNA, 20 bp, Artificial Sequence
  chemically synthesized
taaagaaggagggaggagag

SEQ ID NO: 60094 - DNA, 20 bp, Artificial Sequence
  chemically synthesized
gagaggagtgggccgtaggg

SEQ ID NO: 60095 - DNA, 20 bp, Artificial Sequence
  chemically synthesized
ttttctttgcagcttggctt

SEQ ID NO: 60096 - DNA, 20 bp, Artificial Sequence
  chemically synthesized
tatagtctaaaaagttggtg

SEQ ID NO: 60097 - DNA, 20 bp, Artificial Sequence
  chemically synthesized
ccaatatcttgaccaggctt

SEQ ID NO: 60098 - DNA, 20 bp, Artificial Sequence
  chemically synthesized
ttggcctagaggctccgcat

SEQ ID NO: 60099 - DNA, 20 bp, Artificial Sequence
  chemically synthesized
atgtatcagtcaagatgtga

SEQ ID NO: 60100 - DNA, 20 bp, Artificial Sequence
  chemically synthesized
gtcaagatgtgatggggtat

SEQ ID NO: 60101 - DNA, 20 bp, Artificial Sequence
  chemically synthesized
aaatctttagaacttggctt

SEQ ID NO: 60102 - DNA, 20 bp, Artificial Sequence
  chemically synthesized
tctcctttttcattccctag

SEQ ID NO: 60103 - DNA, 20 bp, Artificial Sequence
  chemically synthesized
aaatcaagttgaaaatccac

SEQ ID NO: 60104 - DNA, 20 bp, Artificial Sequence
  chemically synthesized
gttgaaaatccacgggaata

SEQ ID NO: 60105 - DNA, 20 bp, Artificial Sequence
  chemically synthesized
gtgtagttccagactctggt

SEQ ID NO: 60106 - DNA, 20 bp, Artificial Sequence
  chemically synthesized
actcccaaaaaagatgaagt

SEQ ID NO: 60107 - DNA, 20 bp, Artificial Sequence
  chemically synthesized
aaaaaagatgaagttagagt

SEQ ID NO: 60108 - DNA, 20 bp, Artificial Sequence
  chemically synthesized
ataggggacactgtaatgac

SEQ ID NO: 60109 - DNA, 20 bp, Artificial Sequence
  chemically synthesized
ccaaatagattagtgtcaga

SEQ ID NO: 60110 - DNA, 20 bp, Artificial Sequence
  chemically synthesized
atctcaaccacacccagata

SEQ ID NO: 60111 - DNA, 20 bp, Artificial Sequence
  chemically synthesized
cacccagatagagagtgata

SEQ ID NO: 60112 - DNA, 20 bp, Artificial Sequence
  chemically synthesized
tggatcccgtgtttctgtcg

SEQ ID NO: 60113 - DNA, 20 bp, Artificial Sequence
  chemically synthesized
ccgtgtttctgtcgggggat

SEQ ID NO: 60114 - DNA, 20 bp, Artificial Sequence
  chemically synthesized
ctacccagatgaaaatggtg

SEQ ID NO: 60115 - DNA, 20 bp, Artificial Sequence
  chemically synthesized
aatcaactacgaagatggtc

SEQ ID NO: 60116 - DNA, 20 bp, Artificial Sequence
  chemically synthesized
tagttgttgagccttataat

SEQ ID NO: 60117 - DNA, 20 bp, Artificial Sequence
  chemically synthesized
tgatgattaaatcaggtcta

SEQ ID NO: 60118 - DNA, 20 bp, Artificial Sequence
  chemically synthesized
aatcaggtctactggatact

SEQ ID NO: 60119 - DNA, 20 bp, Artificial Sequence
  chemically synthesized
gtctactggatactatgaat

SEQ ID NO: 60120 - DNA, 20 bp, Artificial Sequence
  chemically synthesized
taacagaagtcttctggtgg

SEQ ID NO: 60121 - DNA, 20 bp, Artificial Sequence
  chemically synthesized
gtacacttgtgatatctata

SEQ ID NO: 60122 - DNA, 20 bp, Artificial Sequence
  chemically synthesized
gaagtcctcttcctgatgct

SEQ ID NO: 60123 - DNA, 20 bp, Artificial Sequence
  chemically synthesized
ctctgggttggcatctacat

SEQ ID NO: 60124 - DNA, 20 bp, Artificial Sequence
  chemically synthesized
gcatctacatgtgagtgccc

SEQ ID NO: 60125 - DNA, 20 bp, Artificial Sequence
  chemically synthesized
gtaacaaccaggtggcttca

SEQ ID NO: 60126 - DNA, 20 bp, Artificial Sequence
  chemically synthesized
agaaataatagaagttaggc

SEQ ID NO: 60127 - DNA, 20 bp, Artificial Sequence
  chemically synthesized
aaaatgtgctaagtagatgt

SEQ ID NO: 60128 - DNA, 20 bp, Artificial Sequence
  chemically synthesized
cttaagggaagaaagagacc

SEQ ID NO: 60129 - DNA, 20 bp, Artificial Sequence
  chemically synthesized
aaaactcaaagttttacgaa

SEQ ID NO: 60130 - DNA, 20 bp, Artificial Sequence
  chemically synthesized
gaaatcatttttcatcaata

SEQ ID NO: 60131 - DNA, 20 bp, Artificial Sequence
  chemically synthesized
acacacacacacacacaccg

SEQ ID NO: 60132 - DNA, 20 bp, Artificial Sequence
  chemically synthesized
aagtcatgatgcagcagtat

SEQ ID NO: 60133 - DNA, 20 bp, Artificial Sequence
  chemically synthesized
ttttacttcaagctatggtg

SEQ ID NO: 60134 - DNA, 20 bp, Artificial Sequence
  chemically synthesized
caagcacagataccaagttt

SEQ ID NO: 60135 - DNA, 20 bp, Artificial Sequence
  chemically synthesized
cagataccaagtttttgagt

SEQ ID NO: 60136 - DNA, 20 bp, Artificial Sequence
  chemically synthesized
actactaagattatattgtc

SEQ ID NO: 60137 - DNA, 20 bp, Artificial Sequence
  chemically synthesized
cgggaaagtagcattttcat

SEQ ID NO: 60138 - DNA, 20 bp, Artificial Sequence
  chemically synthesized
aaggaggagaagcttgtgtt

SEQ ID NO: 60139 - DNA, 20 bp, Artificial Sequence
  chemically synthesized
gaagcttgtgttaggaatgg

SEQ ID NO: 60140 - DNA, 20 bp, Artificial Sequence
  chemically synthesized
aggtatctcaacactaaaga

SEQ ID NO: 60141 - DNA, 20 bp, Artificial Sequence
  chemically synthesized
taaagaaagagtaaaatttt

SEQ ID NO: 60142 - DNA, 20 bp, Artificial Sequence
  chemically synthesized
tcttgacttcacaaaaccat

SEQ ID NO: 60143 - DNA, 20 bp, Artificial Sequence
  chemically synthesized
ttcacaaaaccattggaatt

SEQ ID NO: 60144 - DNA, 20 bp, Artificial Sequence
  chemically synthesized
gtgatgtgtcatttctgtga

SEQ ID NO: 60145 - DNA, 20 bp, Artificial Sequence
  chemically synthesized
tttaagcacagtgctttgaa

SEQ ID NO: 60146 - DNA, 20 bp, Artificial Sequence
  chemically synthesized
ctccatcctcatgtgcatct

SEQ ID NO: 60147 - DNA, 20 bp, Artificial Sequence
  chemically synthesized
atgacagaagactcttcaaa

SEQ ID NO: 60148 - DNA, 20 bp, Artificial Sequence
  chemically synthesized
tgatcaaagtcccttgttta

SEQ ID NO: 60149 - DNA, 20 bp, Artificial Sequence
  chemically synthesized
ttccttcctgagcatgtgtt

SEQ ID NO: 60150 - DNA, 20 bp, Artificial Sequence
  chemically synthesized
cctttcctaagtttctattg

SEQ ID NO: 60151 - DNA, 20 bp, Artificial Sequence
  chemically synthesized
taatcattgtagcttctatg

SEQ ID NO: 60152 - DNA, 20 bp, Artificial Sequence
  chemically synthesized
gaagtaacagaaggctacaa

SEQ ID NO: 60153 - DNA, 20 bp, Artificial Sequence
  chemically synthesized
ttgtcattcttgtcacagca

SEQ ID NO: 60154 - DNA, 20 bp, Artificial Sequence
  chemically synthesized
taatcatgcttgtaataacc

SEQ ID NO: 60155 - DNA, 20 bp, Artificial Sequence
  chemically synthesized
taacttttcttctttgtctg

SEQ ID NO: 60156 - DNA, 20 bp, Artificial Sequence
  chemically synthesized
tggtgagttctgtagacatt

SEQ ID NO: 60157 - DNA, 20 bp, Artificial Sequence
  chemically synthesized
ggtggtgagaacagtgttat

SEQ ID NO: 60158 - DNA, 20 bp, Artificial Sequence
  chemically synthesized
gtttgccagctgtggaaaac

SEQ ID NO: 60159 - DNA, 20 bp, Artificial Sequence
  chemically synthesized
tggcaacaagtaaccaaata

SEQ ID NO: 60160 - DNA, 20 bp, Artificial Sequence
  chemically synthesized
accattttcctgtctatgca

SEQ ID NO: 60161 - DNA, 20 bp, Artificial Sequence
  chemically synthesized
tttcctgtctatgcacagga

SEQ ID NO: 60162 - DNA, 20 bp, Artificial Sequence
  chemically synthesized
gccatgacagggctcttggt

SEQ ID NO: 60163 - DNA, 20 bp, Artificial Sequence
  chemically synthesized
agtatgtgctggcttgatga

SEQ ID NO: 60164 - DNA, 20 bp, Artificial Sequence
  chemically synthesized
agaggaactctgcttacctc

SEQ ID NO: 60165 - DNA, 20 bp, Artificial Sequence
  chemically synthesized
tgcttacctcttgggttctg

SEQ ID NO: 60166 - DNA, 20 bp, Artificial Sequence
  chemically synthesized
tgtttgggggctgttaatgg

SEQ ID NO: 60167 - DNA, 20 bp, Artificial Sequence
  chemically synthesized
tgttaatggaagagttgctg

SEQ ID NO: 60168 - DNA, 20 bp, Artificial Sequence
  chemically synthesized
aataagaaacagtatgtgaa

SEQ ID NO: 60169 - DNA, 20 bp, Artificial Sequence
  chemically synthesized
caagccttaagtaggaagtt

SEQ ID NO: 60170 - DNA, 20 bp, Artificial Sequence
  chemically synthesized
agggccagagaaacagaagg

SEQ ID NO: 60171 - DNA, 20 bp, Artificial Sequence
  chemically synthesized
gctcaagggaaggttcctct

SEQ ID NO: 60172 - DNA, 20 bp, Artificial Sequence
  chemically synthesized
atgcctgtaatcccagcact

SEQ ID NO: 60173 - DNA, 20 bp, Artificial Sequence
  chemically synthesized
actttgggtggctgaggcag

SEQ ID NO: 60174 - DNA, 20 bp, Artificial Sequence
  chemically synthesized
caggaggatcacctgagggc

SEQ ID NO: 60175 - DNA, 20 bp, Artificial Sequence
  chemically synthesized
tacacaggaggctgaggtag

SEQ ID NO: 60176 - DNA, 20 bp, Artificial Sequence
  chemically synthesized
aaagaaggaaggaaggaaat

SEQ ID NO: 60177 - DNA, 20 bp, Artificial Sequence
  chemically synthesized
cacttgagattcaaagtctt

SEQ ID NO: 60178 - DNA, 20 bp, Artificial Sequence
  chemically synthesized
gactaattccaatcccaagc

SEQ ID NO: 60179 - DNA, 20 bp, Artificial Sequence
  chemically synthesized
aggactgggaaggtttaggc

SEQ ID NO: 60180 - DNA, 20 bp, Artificial Sequence
  chemically synthesized
tcccgctgcagtccatgaac

SEQ ID NO: 60181 - DNA, 20 bp, Artificial Sequence
  chemically synthesized
aagacattctctcaagtctc

SEQ ID NO: 60182 - DNA, 20 bp, Artificial Sequence
  chemically synthesized
tgcaaagccacttagtgaca

SEQ ID NO: 60183 - DNA, 20 bp, Artificial Sequence
  chemically synthesized
ttagttatttcattgtgaac

SEQ ID NO: 60184 - DNA, 20 bp, Artificial Sequence
  chemically synthesized
agttaaaagcattgccagaa

SEQ ID NO: 60185 - DNA, 20 bp, Artificial Sequence
  chemically synthesized
tcacaatccagaccctaaga

SEQ ID NO: 60186 - DNA, 20 bp, Artificial Sequence
  chemically synthesized
cagaccctaagagagggttc

SEQ ID NO: 60187 - DNA, 20 bp, Artificial Sequence
  chemically synthesized
cttggatttcgtgcccaaga

SEQ ID NO: 60188 - DNA, 20 bp, Artificial Sequence
  chemically synthesized
caagttaattaagaaagtaa

SEQ ID NO: 60189 - DNA, 20 bp, Artificial Sequence
  chemically synthesized
tattgatgatatgctaaaca

SEQ ID NO: 60190 - DNA, 20 bp, Artificial Sequence
  chemically synthesized
gatgatatgctaaacaaggg

SEQ ID NO: 60191 - DNA, 20 bp, Artificial Sequence
  chemically synthesized
aacagtcatagtgctggtgg

SEQ ID NO: 60192 - DNA, 20 bp, Artificial Sequence
  chemically synthesized
ctcatcacaatcttggtttg

SEQ ID NO: 60193 - DNA, 20 bp, Artificial Sequence
  chemically synthesized
tcttatctcatcctgtgact

SEQ ID NO: 60194 - DNA, 20 bp, Artificial Sequence
  chemically synthesized
ctgagaatgcctaactttct

SEQ ID NO: 60195 - DNA, 20 bp, Artificial Sequence
  chemically synthesized
tacccagctcctatttaaga

SEQ ID NO: 60196 - DNA, 20 bp, Artificial Sequence
  chemically synthesized
gtttctggtatgctagcacc

SEQ ID NO: 60197 - DNA, 20 bp, Artificial Sequence
  chemically synthesized
tccttactcagcagtttgtg

SEQ ID NO: 60198 - DNA, 20 bp, Artificial Sequence
  chemically synthesized
cttcaaagtttcacttctac

SEQ ID NO: 60199 - DNA, 20 bp, Artificial Sequence
  chemically synthesized
cagtcttatgcagtagtttt

SEQ ID NO: 60200 - DNA, 20 bp, Artificial Sequence
  chemically synthesized
tggtccactcatctttaagt

SEQ ID NO: 60201 - DNA, 20 bp, Artificial Sequence
  chemically synthesized
taccaatagtacccacatgg

SEQ ID NO: 60202 - DNA, 20 bp, Artificial Sequence
  chemically synthesized
aaatttgaggtttctaaaca

SEQ ID NO: 60203 - DNA, 20 bp, Artificial Sequence
  chemically synthesized
tgttcttaggagcaagatgt

SEQ ID NO: 60204 - DNA, 20 bp, Artificial Sequence
  chemically synthesized
ggaatttacaccattcttat

SEQ ID NO: 60205 - DNA, 20 bp, Artificial Sequence
  chemically synthesized
attaagagaggtttccttct

SEQ ID NO: 60206 - DNA, 20 bp, Artificial Sequence
  chemically synthesized
tgttcaggaactttttcttt

SEQ ID NO: 60207 - DNA, 20 bp, Artificial Sequence
  chemically synthesized
ctagatattcattcaccaag

SEQ ID NO: 60208 - DNA, 20 bp, Artificial Sequence
  chemically synthesized
caagatgagtgcctttgaag

SEQ ID NO: 60209 - DNA, 20 bp, Artificial Sequence
  chemically synthesized
ctttgaagcagaatctgtga

SEQ ID NO: 60210 - DNA, 20 bp, Artificial Sequence
  chemically synthesized
tagagacatatggccatgac

SEQ ID NO: 60211 - DNA, 20 bp, Artificial Sequence
  chemically synthesized
tctaaggttagacatacaga

SEQ ID NO: 60212 - DNA, 20 bp, Artificial Sequence
  chemically synthesized
catccattcacacatataac

SEQ ID NO: 60213 - DNA, 20 bp, Artificial Sequence
  chemically synthesized
actgattttctagtactgta

SEQ ID NO: 60214 - DNA, 20 bp, Artificial Sequence
  chemically synthesized
gatatgtatgcccatgtgtg

SEQ ID NO: 60215 - DNA, 20 bp, Artificial Sequence
  chemically synthesized
aagttattattactagttag

SEQ ID NO: 60216 - DNA, 20 bp, Artificial Sequence
  chemically synthesized
gcaaaatataacacttttag

SEQ ID NO: 60217 - DNA, 20 bp, Artificial Sequence
  chemically synthesized
agactttttatatatttttt

SEQ ID NO: 60218 - DNA, 20 bp, Artificial Sequence
  chemically synthesized
gtctgcatttttgtgttaca

SEQ ID NO: 60219 - DNA, 20 bp, Artificial Sequence
  chemically synthesized
agaaagggaagacattttct

SEQ ID NO: 60220 - DNA, 20 bp, Artificial Sequence
  chemically synthesized
ctccctctgcatggccccag

SEQ ID NO: 60221 - DNA, 20 bp, Artificial Sequence
  chemically synthesized
taaatcctaaagttgaaggt

SEQ ID NO: 60222 - DNA, 20 bp, Artificial Sequence
  chemically synthesized
tatcttttatgctgactgtc

SEQ ID NO: 60223 - DNA, 20 bp, Artificial Sequence
  chemically synthesized
caaagactaaactaaaatag

SEQ ID NO: 60224 - DNA, 20 bp, Artificial Sequence
  chemically synthesized
aaattaaattcaaatcttca

SEQ ID NO: 60225 - DNA, 20 bp, Artificial Sequence
  chemically synthesized
cactctttctgtgtttagaa

SEQ ID NO: 60226 - DNA, 20 bp, Artificial Sequence
  chemically synthesized
ctgtgtttagaaatgaataa

SEQ ID NO: 60227 - DNA, 20 bp, Artificial Sequence
  chemically synthesized
cttctctattttagcaacta

SEQ ID NO: 60228 - DNA, 20 bp, Artificial Sequence
  chemically synthesized
agaaaaaatttgatgcaata

SEQ ID NO: 60229 - DNA, 20 bp, Artificial Sequence
  chemically synthesized
tgtaagctagtgtgacaaat

SEQ ID NO: 60230 - DNA, 20 bp, Artificial Sequence
  chemically synthesized
taatatttcagctgtgacct

SEQ ID NO: 60231 - DNA, 20 bp, Artificial Sequence
  chemically synthesized
tttttccaagagcagataat

SEQ ID NO: 60232 - DNA, 20 bp, Artificial Sequence
  chemically synthesized
agccctagctatggaccacc

SEQ ID NO: 60233 - DNA, 20 bp, Artificial Sequence
  chemically synthesized
ttgaagtaagggctttgttt

SEQ ID NO: 60234 - DNA, 20 bp, Artificial Sequence
  chemically synthesized
aattactctccacacattct

SEQ ID NO: 60235 - DNA, 20 bp, Artificial Sequence
  chemically synthesized
aagccacacagcacctttcc

SEQ ID NO: 60236 - DNA, 20 bp, Artificial Sequence
  chemically synthesized
acagcacctttccccggatc

SEQ ID NO: 60237 - DNA, 20 bp, Artificial Sequence
  chemically synthesized
attgatgaaactgtaaaacc

SEQ ID NO: 60238 - DNA, 20 bp, Artificial Sequence
  chemically synthesized
agatataaaatttcaacata

SEQ ID NO: 60239 - DNA, 20 bp, Artificial Sequence
  chemically synthesized
gacagtgatagctgtatcta

SEQ ID NO: 60240 - DNA, 20 bp, Artificial Sequence
  chemically synthesized
catatatctcattatatcca

SEQ ID NO: 60241 - DNA, 20 bp, Artificial Sequence
  chemically synthesized
caaagggttacataagtttt

SEQ ID NO: 60242 - DNA, 20 bp, Artificial Sequence
  chemically synthesized
gtaagcttgttcaaaaaata

SEQ ID NO: 60243 - DNA, 20 bp, Artificial Sequence
  chemically synthesized
ccccatctccttttttaagg

SEQ ID NO: 60244 - DNA, 20 bp, Artificial Sequence
  chemically synthesized
gtttccatgtcttggctatt

SEQ ID NO: 60245 - DNA, 20 bp, Artificial Sequence
  chemically synthesized
aataatgctgcaattaacat

SEQ ID NO: 60246 - DNA, 20 bp, Artificial Sequence
  chemically synthesized
tgcagatagctctagaaaat

SEQ ID NO: 60247 - DNA, 20 bp, Artificial Sequence
  chemically synthesized
aaatgcggattttatttatt

SEQ ID NO: 60248 - DNA, 20 bp, Artificial Sequence
  chemically synthesized
cattcccaccagctatgcac

SEQ ID NO: 60249 - DNA, 20 bp, Artificial Sequence
  chemically synthesized
taatagccatctcaacaggt

SEQ ID NO: 60250 - DNA, 20 bp, Artificial Sequence
  chemically synthesized
attttttcatatttagttga

SEQ ID NO: 60251 - DNA, 20 bp, Artificial Sequence
  chemically synthesized
gattgagttccttatatatt

SEQ ID NO: 60252 - DNA, 20 bp, Artificial Sequence
  chemically synthesized
gacacatagaccaaattgaa

SEQ ID NO: 60253 - DNA, 20 bp, Artificial Sequence
  chemically synthesized
ggccaccaacacaatagggg

SEQ ID NO: 60254 - DNA, 20 bp, Artificial Sequence
  chemically synthesized
aacaaatagtgttgggaaaa

SEQ ID NO: 60255 - DNA, 20 bp, Artificial Sequence
  chemically synthesized
aactggatatccaaatgcaa

SEQ ID NO: 60256 - DNA, 20 bp, Artificial Sequence
  chemically synthesized
cagcgtgaacaacacagaag

SEQ ID NO: 60257 - DNA, 20 bp, Artificial Sequence
  chemically synthesized
ctgcatttccatctgaggta

SEQ ID NO: 60258 - DNA, 20 bp, Artificial Sequence
  chemically synthesized
gtatggggttcatctcgcta

SEQ ID NO: 60259 - DNA, 20 bp, Artificial Sequence
  chemically synthesized
cagacagtgggcacaggtca

SEQ ID NO: 60260 - DNA, 20 bp, Artificial Sequence
  chemically synthesized
acaccatgcaccagccgaag

SEQ ID NO: 60261 - DNA, 20 bp, Artificial Sequence
  chemically synthesized
tgcctcacttgggaagcaca

SEQ ID NO: 60262 - DNA, 20 bp, Artificial Sequence
  chemically synthesized
ttgggaagcacaaggggtca

SEQ ID NO: 60263 - DNA, 20 bp, Artificial Sequence
  chemically synthesized
tccctttcctggtcaaggaa

SEQ ID NO: 60264 - DNA, 20 bp, Artificial Sequence
  chemically synthesized
gaaaattgggccactcccac

SEQ ID NO: 60265 - DNA, 20 bp, Artificial Sequence
  chemically synthesized
tatatcctgcacatggctcc

SEQ ID NO: 60266 - DNA, 20 bp, Artificial Sequence
  chemically synthesized
ctccgagggtcctacgccca

SEQ ID NO: 60267 - DNA, 20 bp, Artificial Sequence
  chemically synthesized
aagcagccaggaagctcaaa

SEQ ID NO: 60268 - DNA, 20 bp, Artificial Sequence
  chemically synthesized
cgggcagactgcctcctcaa

SEQ ID NO: 60269 - DNA, 20 bp, Artificial Sequence
  chemically synthesized
acgatcagacagcagcattc

SEQ ID NO: 60270 - DNA, 20 bp, Artificial Sequence
  chemically synthesized
gctgctgatacccaggcaaa

SEQ ID NO: 60271 - DNA, 20 bp, Artificial Sequence
  chemically synthesized
atacccaggcaaacagggtc

SEQ ID NO: 60272 - DNA, 20 bp, Artificial Sequence
  chemically synthesized
actccaacagacctgcagct

SEQ ID NO: 60273 - DNA, 20 bp, Artificial Sequence
  chemically synthesized
tcaccagcaacggaacaaag

SEQ ID NO: 60274 - DNA, 20 bp, Artificial Sequence
  chemically synthesized
caacggaacaaagctggatg

SEQ ID NO: 60275 - DNA, 20 bp, Artificial Sequence
  chemically synthesized
aactttgaaaaaaaatttag

SEQ ID NO: 60276 - DNA, 20 bp, Artificial Sequence
  chemically synthesized
aatttagatgaatgtataac

SEQ ID NO: 60277 - DNA, 20 bp, Artificial Sequence
  chemically synthesized
ggagctgaaagccaaggctc

SEQ ID NO: 60278 - DNA, 20 bp, Artificial Sequence
  chemically synthesized
caaggctcgagaatgacgtg

SEQ ID NO: 60279 - DNA, 20 bp, Artificial Sequence
  chemically synthesized
tgatgcgatcaactggaaga

SEQ ID NO: 60280 - DNA, 20 bp, Artificial Sequence
  chemically synthesized
gaagggaagtttagagaaaa

SEQ ID NO: 60281 - DNA, 20 bp, Artificial Sequence
  chemically synthesized
gtgtacctgaaagtgacggg

SEQ ID NO: 60282 - DNA, 20 bp, Artificial Sequence
  chemically synthesized
ccaagttggaaaacactctg

SEQ ID NO: 60283 - DNA, 20 bp, Artificial Sequence
  chemically synthesized
agggcagccagagagaaagg

SEQ ID NO: 60284 - DNA, 20 bp, Artificial Sequence
  chemically synthesized
agaaactctacaagccagaa

SEQ ID NO: 60285 - DNA, 20 bp, Artificial Sequence
  chemically synthesized
tattcaacatccttaaagga

SEQ ID NO: 60286 - DNA, 20 bp, Artificial Sequence
  chemically synthesized
aaaggaaagaattttcaaca

SEQ ID NO: 60287 - DNA, 20 bp, Artificial Sequence
  chemically synthesized
ataaccagctatcataatga

SEQ ID NO: 60288 - DNA, 20 bp, Artificial Sequence
  chemically synthesized
gaaagacacagactggcaaa

SEQ ID NO: 60289 - DNA, 20 bp, Artificial Sequence
  chemically synthesized
acagactggcaaattggata

SEQ ID NO: 60290 - DNA, 20 bp, Artificial Sequence
  chemically synthesized
cacacataggctcaaaataa

SEQ ID NO: 60291 - DNA, 20 bp, Artificial Sequence
  chemically synthesized
aatggaaaacaaaaaaaggc

SEQ ID NO: 60292 - DNA, 20 bp, Artificial Sequence
  chemically synthesized
aggccattacataatggtaa

SEQ ID NO: 60293 - DNA, 20 bp, Artificial Sequence
  chemically synthesized
caacgagacagaaagttaac

SEQ ID NO: 60294 - DNA, 20 bp, Artificial Sequence
  chemically synthesized
gaaagttaacaaggatatcc

SEQ ID NO: 60295 - DNA, 20 bp, Artificial Sequence
  chemically synthesized
aactctccaccccaaatcaa

SEQ ID NO: 60296 - DNA, 20 bp, Artificial Sequence
  chemically synthesized
agtgcaatcaaactagaact

SEQ ID NO: 60297 - DNA, 20 bp, Artificial Sequence
  chemically synthesized
ggaaactgaacaacctgctc

SEQ ID NO: 60298 - DNA, 20 bp, Artificial Sequence
  chemically synthesized
aacctgctcctgaatgacta

SEQ ID NO: 60299 - DNA, 20 bp, Artificial Sequence
  chemically synthesized
agaacaaagacacaacatac

SEQ ID NO: 60300 - DNA, 20 bp, Artificial Sequence
  chemically synthesized
ccagaatctctgggacacat

SEQ ID NO: 60301 - DNA, 20 bp, Artificial Sequence
  chemically synthesized
aaaaacccttcaaaaaatta

SEQ ID NO: 60302 - DNA, 20 bp, Artificial Sequence
  chemically synthesized
tctgggagctggttttttga

SEQ ID NO: 60303 - DNA, 20 bp, Artificial Sequence
  chemically synthesized
agactaataagaaaagagag

SEQ ID NO: 60304 - DNA, 20 bp, Artificial Sequence
  chemically synthesized
cacaataaaaaaatgataaa

SEQ ID NO: 60305 - DNA, 20 bp, Artificial Sequence
  chemically synthesized
agaaatacaaactgccatca

SEQ ID NO: 60306 - DNA, 20 bp, Artificial Sequence
  chemically synthesized
aactagaaaatctagaagaa

SEQ ID NO: 60307 - DNA, 20 bp, Artificial Sequence
  chemically synthesized
aagactaaaccaggaagaag

SEQ ID NO: 60308 - DNA, 20 bp, Artificial Sequence
  chemically synthesized
accaggaagaagttgaatct

SEQ ID NO: 60309 - DNA, 20 bp, Artificial Sequence
  chemically synthesized
atctctgaatagaccaataa

SEQ ID NO: 60310 - DNA, 20 bp, Artificial Sequence
  chemically synthesized
tcaatagcttaccaaccaaa

SEQ ID NO: 60311 - DNA, 20 bp, Artificial Sequence
  chemically synthesized
caaaaagagtccaggaccag

SEQ ID NO: 60312 - DNA, 20 bp, Artificial Sequence
  chemically synthesized
attctaacagaggtacaagg

SEQ ID NO: 60313 - DNA, 20 bp, Artificial Sequence
  chemically synthesized
ttccaatcaacagaaaaaga

SEQ ID NO: 60314 - DNA, 20 bp, Artificial Sequence
  chemically synthesized
aaagagacacaaccaaaaaa

SEQ ID NO: 60315 - DNA, 20 bp, Artificial Sequence
  chemically synthesized
accaaaaaagagaattttag

SEQ ID NO: 60316 - DNA, 20 bp, Artificial Sequence
  chemically synthesized
ctcaataaaatactggcaaa

SEQ ID NO: 60317 - DNA, 20 bp, Artificial Sequence
  chemically synthesized
gatcaagtggacttcatccc

SEQ ID NO: 60318 - DNA, 20 bp, Artificial Sequence
  chemically synthesized
aacccacagccaatatcata

SEQ ID NO: 60319 - DNA, 20 bp, Artificial Sequence
  chemically synthesized
tttgtaaactggcacaagac

SEQ ID NO: 60320 - DNA, 20 bp, Artificial Sequence
  chemically synthesized
ttaggcagaagacaggaaaa

SEQ ID NO: 60321 - DNA, 20 bp, Artificial Sequence
  chemically synthesized
aagcaacttcagcaaagcct

SEQ ID NO: 60322 - DNA, 20 bp, Artificial Sequence
  chemically synthesized
ccattcacaattgcttcaaa

SEQ ID NO: 60323 - DNA, 20 bp, Artificial Sequence
  chemically synthesized
tcaaagagaataaaatacct

SEQ ID NO: 60324 - DNA, 20 bp, Artificial Sequence
  chemically synthesized
acctaggaatccaacttaca

SEQ ID NO: 60325 - DNA, 20 bp, Artificial Sequence
  chemically synthesized
tggaagaacattccatgctt

SEQ ID NO: 60326 - DNA, 20 bp, Artificial Sequence
  chemically synthesized
attccatgcttatgggtagg

SEQ ID NO: 60327 - DNA, 20 bp, Artificial Sequence
  chemically synthesized
gctaccaatgattttcttca

SEQ ID NO: 60328 - DNA, 20 bp, Artificial Sequence
  chemically synthesized
agaaaaacaagaaatgggga

SEQ ID NO: 60329 - DNA, 20 bp, Artificial Sequence
  chemically synthesized
gagaactggctagccatatg

SEQ ID NO: 60330 - DNA, 20 bp, Artificial Sequence
  chemically synthesized
ccatatgtagaatgctgaaa

SEQ ID NO: 60331 - DNA, 20 bp, Artificial Sequence
  chemically synthesized
tatacaaaaattaattcaag

SEQ ID NO: 60332 - DNA, 20 bp, Artificial Sequence
  chemically synthesized
caaaagccaaaattcactaa

SEQ ID NO: 60333 - DNA, 20 bp, Artificial Sequence
  chemically synthesized
acagctaaagaaactaccat

SEQ ID NO: 60334 - DNA, 20 bp, Artificial Sequence
  chemically synthesized
tctgacaaagggctaatatc

SEQ ID NO: 60335 - DNA, 20 bp, Artificial Sequence
  chemically synthesized
gccccatcaacaagtgggca

SEQ ID NO: 60336 - DNA, 20 bp, Artificial Sequence
  chemically synthesized
agataccatctcataccagt

SEQ ID NO: 60337 - DNA, 20 bp, Artificial Sequence
  chemically synthesized
aggaaacaacaggtgctgga

SEQ ID NO: 60338 - DNA, 20 bp, Artificial Sequence
  chemically synthesized
agtcagtgtggcgattcctc

SEQ ID NO: 60339 - DNA, 20 bp, Artificial Sequence
  chemically synthesized
ttgacccagccatcccatta

SEQ ID NO: 60340 - DNA, 20 bp, Artificial Sequence
  chemically synthesized
attactgggtatatacccaa

SEQ ID NO: 60341 - DNA, 20 bp, Artificial Sequence
  chemically synthesized
aaatgtccaacaatgataga

SEQ ID NO: 60342 - DNA, 20 bp, Artificial Sequence
  chemically synthesized
aatgtggcacatatacacca

SEQ ID NO: 60343 - DNA, 20 bp, Artificial Sequence
  chemically synthesized
actatgcagccataaaaatg

SEQ ID NO: 60344 - DNA, 20 bp, Artificial Sequence
  chemically synthesized
ttcatgtcctttgtagggac

SEQ ID NO: 60345 - DNA, 20 bp, Artificial Sequence
  chemically synthesized
tcacactctggggactgttg

SEQ ID NO: 60346 - DNA, 20 bp, Artificial Sequence
  chemically synthesized
tctggggactgttgtggggt

SEQ ID NO: 60347 - DNA, 20 bp, Artificial Sequence
  chemically synthesized
tgtggggtgggggtgcaggg

SEQ ID NO: 60348 - DNA, 20 bp, Artificial Sequence
  chemically synthesized
gatatacctaatgctaaatt

SEQ ID NO: 60349 - DNA, 20 bp, Artificial Sequence
  chemically synthesized
taatgctaaattacgagtta

SEQ ID NO: 60350 - DNA, 20 bp, Artificial Sequence
  chemically synthesized
gctcaaggttagctaaagat

SEQ ID NO: 60351 - DNA, 20 bp, Artificial Sequence
  chemically synthesized
atccattttttgtttccttt

SEQ ID NO: 60352 - DNA, 20 bp, Artificial Sequence
  chemically synthesized
ggacagcttgatactttccc

SEQ ID NO: 60353 - DNA, 20 bp, Artificial Sequence
  chemically synthesized
tttcccatgagtctggcttt

SEQ ID NO: 60354 - DNA, 20 bp, Artificial Sequence
  chemically synthesized
atcttggacttttaagtcac

SEQ ID NO: 60355 - DNA, 20 bp, Artificial Sequence
  chemically synthesized
actaaaactttagcccaact

SEQ ID NO: 60356 - DNA, 20 bp, Artificial Sequence
  chemically synthesized
agaagagatggtttcccaaa

SEQ ID NO: 60357 - DNA, 20 bp, Artificial Sequence
  chemically synthesized
tcataatgactgaagagagg

SEQ ID NO: 60358 - DNA, 20 bp, Artificial Sequence
  chemically synthesized
acgaaagaaggcgtttctga

SEQ ID NO: 60359 - DNA, 20 bp, Artificial Sequence
  chemically synthesized
gcaggtgtccagggaggcag

SEQ ID NO: 60360 - DNA, 20 bp, Artificial Sequence
  chemically synthesized
gaggcagggggatggacaaa

SEQ ID NO: 60361 - DNA, 20 bp, Artificial Sequence
  chemically synthesized
ttttggcaatcctaacttct

SEQ ID NO: 60362 - DNA, 20 bp, Artificial Sequence
  chemically synthesized
atcgatctcacaccacaaaa

SEQ ID NO: 60363 - DNA, 20 bp, Artificial Sequence
  chemically synthesized
ggacttgttctaacaggcct

SEQ ID NO: 60364 - DNA, 20 bp, Artificial Sequence
  chemically synthesized
ctgtgacagagacacctaaa

SEQ ID NO: 60365 - DNA, 20 bp, Artificial Sequence
  chemically synthesized
acacctaaaaagagtctgtt

SEQ ID NO: 60366 - DNA, 20 bp, Artificial Sequence
  chemically synthesized
ctggagacattgagaaccct

SEQ ID NO: 60367 - DNA, 20 bp, Artificial Sequence
  chemically synthesized
acattgagaaccctgtgagt

SEQ ID NO: 60368 - DNA, 20 bp, Artificial Sequence
  chemically synthesized
tatttaggtctgtttctggt

SEQ ID NO: 60369 - DNA, 20 bp, Artificial Sequence
  chemically synthesized
ggtctgtttctggtcagagt

SEQ ID NO: 60370 - DNA, 20 bp, Artificial Sequence
  chemically synthesized
aggaagatcatcctcaaagg

SEQ ID NO: 60371 - DNA, 20 bp, Artificial Sequence
  chemically synthesized
tggcagctttcagctgtgta

SEQ ID NO: 60372 - DNA, 20 bp, Artificial Sequence
  chemically synthesized
gccacattttcttgtgccct

SEQ ID NO: 60373 - DNA, 20 bp, Artificial Sequence
  chemically synthesized
agtagggccttggtgctggt

SEQ ID NO: 60374 - DNA, 20 bp, Artificial Sequence
  chemically synthesized
aatttaagcctatccttggg

SEQ ID NO: 60375 - DNA, 20 bp, Artificial Sequence
  chemically synthesized
acagcatgtgtacagacctt

SEQ ID NO: 60376 - DNA, 20 bp, Artificial Sequence
  chemically synthesized
tggggattcagttctcctga

SEQ ID NO: 60377 - DNA, 20 bp, Artificial Sequence
  chemically synthesized
gggctggctaggtatcaatt

SEQ ID NO: 60378 - DNA, 20 bp, Artificial Sequence
  chemically synthesized
gacacttttcacttttagta

SEQ ID NO: 60379 - DNA, 20 bp, Artificial Sequence
  chemically synthesized
tggatttagattctttaata

SEQ ID NO: 60380 - DNA, 20 bp, Artificial Sequence
  chemically synthesized
aataccttaaaggttaaggc

SEQ ID NO: 60381 - DNA, 20 bp, Artificial Sequence
  chemically synthesized
tctatcttcaagttcttgat

SEQ ID NO: 60382 - DNA, 20 bp, Artificial Sequence
  chemically synthesized
gcacgtcaatgaaaattgat

SEQ ID NO: 60383 - DNA, 20 bp, Artificial Sequence
  chemically synthesized
aaaggtcatttagagcaata

SEQ ID NO: 60384 - DNA, 20 bp, Artificial Sequence
  chemically synthesized
gcaataaagaatcaaaaatg

SEQ ID NO: 60385 - DNA, 20 bp, Artificial Sequence
  chemically synthesized
aattatataattcagagaaa

SEQ ID NO: 60386 - DNA, 20 bp, Artificial Sequence
  chemically synthesized
acatgtcatataaactcatt

SEQ ID NO: 60387 - DNA, 20 bp, Artificial Sequence
  chemically synthesized
cttatgtgtgatagatgccc

SEQ ID NO: 60388 - DNA, 20 bp, Artificial Sequence
  chemically synthesized
gctgttatactgtccttggc

SEQ ID NO: 60389 - DNA, 20 bp, Artificial Sequence
  chemically synthesized
aatcatgttcttaataaatg

SEQ ID NO: 60390 - DNA, 20 bp, Artificial Sequence
  chemically synthesized
taaggtggtgccacttctgt

SEQ ID NO: 60391 - DNA, 20 bp, Artificial Sequence
  chemically synthesized
aatggcatgtcataaacttc

SEQ ID NO: 60392 - DNA, 20 bp, Artificial Sequence
  chemically synthesized
aatcaaccatgccctattta

SEQ ID NO: 60393 - DNA, 20 bp, Artificial Sequence
  chemically synthesized
cttgcttcatgccagtctcc

SEQ ID NO: 60394 - DNA, 20 bp, Artificial Sequence
  chemically synthesized
ttgtggtggagaggttgtgt

SEQ ID NO: 60395 - DNA, 20 bp, Artificial Sequence
  chemically synthesized
cactgacctggacatttgtt

SEQ ID NO: 60396 - DNA, 20 bp, Artificial Sequence
  chemically synthesized
acctggacatttgtttgggg

SEQ ID NO: 60397 - DNA, 20 bp, Artificial Sequence
  chemically synthesized
gacatttgtttggggtagga

SEQ ID NO: 60398 - DNA, 20 bp, Artificial Sequence
  chemically synthesized
atataaaaatagacaggaaa

SEQ ID NO: 60399 - DNA, 20 bp, Artificial Sequence
  chemically synthesized
atagacaggaaaatgagtgc

SEQ ID NO: 60400 - DNA, 20 bp, Artificial Sequence
  chemically synthesized
gaaaatgagtgcaggagtga

SEQ ID NO: 60401 - DNA, 20 bp, Artificial Sequence
  chemically synthesized
aaagccactgtgaacatcac

SEQ ID NO: 60402 - DNA, 20 bp, Artificial Sequence
  chemically synthesized
tccgacctctctggaaaacg

SEQ ID NO: 60403 - DNA, 20 bp, Artificial Sequence
  chemically synthesized
aaacgacgggtccattacta

SEQ ID NO: 60404 - DNA, 20 bp, Artificial Sequence
  chemically synthesized
taaataaaatgataagtgat

SEQ ID NO: 60405 - DNA, 20 bp, Artificial Sequence
  chemically synthesized
gtgtagccaaaacctgggga

SEQ ID NO: 60406 - DNA, 20 bp, Artificial Sequence
  chemically synthesized
gctcttcagcttcaggagac

SEQ ID NO: 60407 - DNA, 20 bp, Artificial Sequence
  chemically synthesized
taaagaaagtttcctgccca

SEQ ID NO: 60408 - DNA, 20 bp, Artificial Sequence
  chemically synthesized
gctggagccatggtctttag

SEQ ID NO: 60409 - DNA, 20 bp, Artificial Sequence
  chemically synthesized
atttttgttattacctgctg

SEQ ID NO: 60410 - DNA, 20 bp, Artificial Sequence
  chemically synthesized
gtctcactactgtcttgtgc

SEQ ID NO: 60411 - DNA, 20 bp, Artificial Sequence
  chemically synthesized
ctgtcttgtgccggggtttc

SEQ ID NO: 60412 - DNA, 20 bp, Artificial Sequence
  chemically synthesized
cttgtgccggggtttcagga

SEQ ID NO: 60413 - DNA, 20 bp, Artificial Sequence
  chemically synthesized
gggagaaaatgagggaaaat

SEQ ID NO: 60414 - DNA, 20 bp, Artificial Sequence
  chemically synthesized
aaggcttttcccccaaatgt

SEQ ID NO: 60415 - DNA, 20 bp, Artificial Sequence
  chemically synthesized
gtttgaatgtccttagccaa

SEQ ID NO: 60416 - DNA, 20 bp, Artificial Sequence
  chemically synthesized
attccctgcactaagcctaa

SEQ ID NO: 60417 - DNA, 20 bp, Artificial Sequence
  chemically synthesized
tagctcactgtaaactcaaa

SEQ ID NO: 60418 - DNA, 20 bp, Artificial Sequence
  chemically synthesized
accttattcttccaagttgc

SEQ ID NO: 60419 - DNA, 20 bp, Artificial Sequence
  chemically synthesized
gaaaatgaagtcttagaaac

SEQ ID NO: 60420 - DNA, 20 bp, Artificial Sequence
  chemically synthesized
cttagaaaccagggttctca

SEQ ID NO: 60421 - DNA, 20 bp, Artificial Sequence
  chemically synthesized
agaatctcttctgatattct

SEQ ID NO: 60422 - DNA, 20 bp, Artificial Sequence
  chemically synthesized
agggctgcctcactcccctg

SEQ ID NO: 60423 - DNA, 20 bp, Artificial Sequence
  chemically synthesized
atggccaggccagcccctcc

SEQ ID NO: 60424 - DNA, 20 bp, Artificial Sequence
  chemically synthesized
cctggatcatgtctagaagt

SEQ ID NO: 60425 - DNA, 20 bp, Artificial Sequence
  chemically synthesized
cttgtaacttccccagtatc

SEQ ID NO: 60426 - DNA, 20 bp, Artificial Sequence
  chemically synthesized
aaaaacaggcatgtttacag

SEQ ID NO: 60427 - DNA, 20 bp, Artificial Sequence
  chemically synthesized
ccactgtggaaatgttctct

SEQ ID NO: 60428 - DNA, 20 bp, Artificial Sequence
  chemically synthesized
tgttctctaggggttcaaaa

SEQ ID NO: 60429 - DNA, 20 bp, Artificial Sequence
  chemically synthesized
ctaatattaaattcaaacaa

SEQ ID NO: 60430 - DNA, 20 bp, Artificial Sequence
  chemically synthesized
tatactgaaaatctcttttc

SEQ ID NO: 60431 - DNA, 20 bp, Artificial Sequence
  chemically synthesized
attttctcctgtgatctaag

SEQ ID NO: 60432 - DNA, 20 bp, Artificial Sequence
  chemically synthesized
taagatgaatctactctgcc

SEQ ID NO: 60433 - DNA, 20 bp, Artificial Sequence
  chemically synthesized
attagatgtaactgactgct

SEQ ID NO: 60434 - DNA, 20 bp, Artificial Sequence
  chemically synthesized
atgactgttgctctcctatc

SEQ ID NO: 60435 - DNA, 20 bp, Artificial Sequence
  chemically synthesized
acaacagaaccccaggcaca

SEQ ID NO: 60436 - DNA, 20 bp, Artificial Sequence
  chemically synthesized
gaaccccaggcacaaagaat

SEQ ID NO: 60437 - DNA, 20 bp, Artificial Sequence
  chemically synthesized
acaaagaatcaggataagag

SEQ ID NO: 60438 - DNA, 20 bp, Artificial Sequence
  chemically synthesized
tcaggctccaggggccttta

SEQ ID NO: 60439 - DNA, 20 bp, Artificial Sequence
  chemically synthesized
cagtctaatcaacttaaaaa

SEQ ID NO: 60440 - DNA, 20 bp, Artificial Sequence
  chemically synthesized
tgttctaaacatgtataata

SEQ ID NO: 60441 - DNA, 20 bp, Artificial Sequence
  chemically synthesized
aaaaatctataaagtatata

SEQ ID NO: 60442 - DNA, 20 bp, Artificial Sequence
  chemically synthesized
gtatattctataaagtattt

SEQ ID NO: 60443 - DNA, 20 bp, Artificial Sequence
  chemically synthesized
ttatacatatgtgtacttat

SEQ ID NO: 60444 - DNA, 20 bp, Artificial Sequence
  chemically synthesized
tatataaatataaaaatata

SEQ ID NO: 60445 - DNA, 20 bp, Artificial Sequence
  chemically synthesized
gatatttgtactaagtctta

SEQ ID NO: 60446 - DNA, 20 bp, Artificial Sequence
  chemically synthesized
tgtttactggttggaaaaac

SEQ ID NO: 60447 - DNA, 20 bp, Artificial Sequence
  chemically synthesized
caagaaagcaataaatatag

SEQ ID NO: 60448 - DNA, 20 bp, Artificial Sequence
  chemically synthesized
aaacaagaaaagtatgtgta

SEQ ID NO: 60449 - DNA, 20 bp, Artificial Sequence
  chemically synthesized
gaattgaagaaaaaaatgat

SEQ ID NO: 60450 - DNA, 20 bp, Artificial Sequence
  chemically synthesized
ggtgtgttgactgggaaaag

SEQ ID NO: 60451 - DNA, 20 bp, Artificial Sequence
  chemically synthesized
ccgggctaaagatggtgtta

SEQ ID NO: 60452 - DNA, 20 bp, Artificial Sequence
  chemically synthesized
tttcgctcactaccaggcct

SEQ ID NO: 60453 - DNA, 20 bp, Artificial Sequence
  chemically synthesized
gaaaacagtgcagtgattca

SEQ ID NO: 60454 - DNA, 20 bp, Artificial Sequence
  chemically synthesized
taatctcggtggctgcagta

SEQ ID NO: 60455 - DNA, 20 bp, Artificial Sequence
  chemically synthesized
gaggagcctggctttgcatg

SEQ ID NO: 60456 - DNA, 20 bp, Artificial Sequence
  chemically synthesized
cattggctacagagatgaag

SEQ ID NO: 60457 - DNA, 20 bp, Artificial Sequence
  chemically synthesized
gatgaagatgaatagattac

SEQ ID NO: 60458 - DNA, 20 bp, Artificial Sequence
  chemically synthesized
attagatacagaaagaggga

SEQ ID NO: 60459 - DNA, 20 bp, Artificial Sequence
  chemically synthesized
atacagaaagagggagaggg

SEQ ID NO: 60460 - DNA, 20 bp, Artificial Sequence
  chemically synthesized
atcagctcaaaaatgttgtc

SEQ ID NO: 60461 - DNA, 20 bp, Artificial Sequence
  chemically synthesized
gtcttgaatggcaggaaatg

SEQ ID NO: 60462 - DNA, 20 bp, Artificial Sequence
  chemically synthesized
aaaaaatgcataaatatgag

SEQ ID NO: 60463 - DNA, 20 bp, Artificial Sequence
  chemically synthesized
gaagaatcaggtgtgaaaag

SEQ ID NO: 60464 - DNA, 20 bp, Artificial Sequence
  chemically synthesized
tgggctcaatattagacgtg

SEQ ID NO: 60465 - DNA, 20 bp, Artificial Sequence
  chemically synthesized
aactcaggcctgatatgtaa

SEQ ID NO: 60466 - DNA, 20 bp, Artificial Sequence
  chemically synthesized
taataataatagataatata

SEQ ID NO: 60467 - DNA, 20 bp, Artificial Sequence
  chemically synthesized
aggtgttcaaggacagtaaa

SEQ ID NO: 60468 - DNA, 20 bp, Artificial Sequence
  chemically synthesized
tatttgagcaatggaaataa

SEQ ID NO: 60469 - DNA, 20 bp, Artificial Sequence
  chemically synthesized
aaccagcagatcttggcatt

SEQ ID NO: 60470 - DNA, 20 bp, Artificial Sequence
  chemically synthesized
ttggcccctagaagtcactg

SEQ ID NO: 60471 - DNA, 20 bp, Artificial Sequence
  chemically synthesized
aggagcattgctttagctaa

SEQ ID NO: 60472 - DNA, 20 bp, Artificial Sequence
  chemically synthesized
gggttttaaaaaaaacatta

SEQ ID NO: 60473 - DNA, 20 bp, Artificial Sequence
  chemically synthesized
aaacattatagggtggttgg

SEQ ID NO: 60474 - DNA, 20 bp, Artificial Sequence
  chemically synthesized
gcatttagctgctacttcaa

SEQ ID NO: 60475 - DNA, 20 bp, Artificial Sequence
  chemically synthesized
tccccaccttgcttcctcca

SEQ ID NO: 60476 - DNA, 20 bp, Artificial Sequence
  chemically synthesized
cacttgttcttcctccttcc

SEQ ID NO: 60477 - DNA, 20 bp, Artificial Sequence
  chemically synthesized
ttacttttgcaccaacctaa

SEQ ID NO: 60478 - DNA, 20 bp, Artificial Sequence
  chemically synthesized
acaatttcaatatgtattta

SEQ ID NO: 60479 - DNA, 20 bp, Artificial Sequence
  chemically synthesized
tgtatttattgaatcaatta

SEQ ID NO: 60480 - DNA, 20 bp, Artificial Sequence
  chemically synthesized
atgaataattattgaaataa

SEQ ID NO: 60481 - DNA, 20 bp, Artificial Sequence
  chemically synthesized
atttattcaaataatattta

SEQ ID NO: 60482 - DNA, 20 bp, Artificial Sequence
  chemically synthesized
agtcatggtttatgtccaca

SEQ ID NO: 60483 - DNA, 20 bp, Artificial Sequence
  chemically synthesized
aactacaggaacacatagga

SEQ ID NO: 60484 - DNA, 20 bp, Artificial Sequence
  chemically synthesized
gggtattcaaactaaacttg

SEQ ID NO: 60485 - DNA, 20 bp, Artificial Sequence
  chemically synthesized
gacatcatatctaagctaag

SEQ ID NO: 60486 - DNA, 20 bp, Artificial Sequence
  chemically synthesized
aaaaatgtttttattccagg

SEQ ID NO: 60487 - DNA, 20 bp, Artificial Sequence
  chemically synthesized
aagcatactagataaactgg

SEQ ID NO: 60488 - DNA, 20 bp, Artificial Sequence
  chemically synthesized
tgtttagtgtcattaacacc

SEQ ID NO: 60489 - DNA, 20 bp, Artificial Sequence
  chemically synthesized
cgtgaatatacagaggaaat

SEQ ID NO: 60490 - DNA, 20 bp, Artificial Sequence
  chemically synthesized
aattaggatagataagaaaa

SEQ ID NO: 60491 - DNA, 20 bp, Artificial Sequence
  chemically synthesized
tacacggagagaaaataagg

SEQ ID NO: 60492 - DNA, 20 bp, Artificial Sequence
  chemically synthesized
agagaaaataaggtagggtc

SEQ ID NO: 60493 - DNA, 20 bp, Artificial Sequence
  chemically synthesized
tcttgctatatagtagtcaa

SEQ ID NO: 60494 - DNA, 20 bp, Artificial Sequence
  chemically synthesized
tgaatacagtagtacaaaag

SEQ ID NO: 60495 - DNA, 20 bp, Artificial Sequence
  chemically synthesized
tagtacaaaagatgagtcac

SEQ ID NO: 60496 - DNA, 20 bp, Artificial Sequence
  chemically synthesized
agtcactggaatagtcctga

SEQ ID NO: 60497 - DNA, 20 bp, Artificial Sequence
  chemically synthesized
aatagtcctgaaagagtgat

SEQ ID NO: 60498 - DNA, 20 bp, Artificial Sequence
  chemically synthesized
cctgaaagagtgatctgaat

SEQ ID NO: 60499 - DNA, 20 bp, Artificial Sequence
  chemically synthesized
tagcatcaatgaaggtgacg

SEQ ID NO: 60500 - DNA, 20 bp, Artificial Sequence
  chemically synthesized
atgaaaagtacagatgttgc

SEQ ID NO: 60501 - DNA, 20 bp, Artificial Sequence
  chemically synthesized
aaagagagaaagacaagttc

SEQ ID NO: 60502 - DNA, 20 bp, Artificial Sequence
  chemically synthesized
tatttgttatttatcaatat

SEQ ID NO: 60503 - DNA, 20 bp, Artificial Sequence
  chemically synthesized
tggtaaatgaaatcatggta

SEQ ID NO: 60504 - DNA, 20 bp, Artificial Sequence
  chemically synthesized
atgacattaagaagaaataa

SEQ ID NO: 60505 - DNA, 20 bp, Artificial Sequence
  chemically synthesized
aatatggccaggaaattgcc

SEQ ID NO: 60506 - DNA, 20 bp, Artificial Sequence
  chemically synthesized
ggatgggaagaactatactt

SEQ ID NO: 60507 - DNA, 20 bp, Artificial Sequence
  chemically synthesized
caataaagtagtgagattgg

SEQ ID NO: 60508 - DNA, 20 bp, Artificial Sequence
  chemically synthesized
gtgagattggcagaattcat

SEQ ID NO: 60509 - DNA, 20 bp, Artificial Sequence
  chemically synthesized
attggcagaattcataaggg

SEQ ID NO: 60510 - DNA, 20 bp, Artificial Sequence
  chemically synthesized
atggtactgcttgtgatgtt

SEQ ID NO: 60511 - DNA, 20 bp, Artificial Sequence
  chemically synthesized
tgtgaatgttagtgaagctg

SEQ ID NO: 60512 - DNA, 20 bp, Artificial Sequence
  chemically synthesized
tattttcagctcaatccccg

SEQ ID NO: 60513 - DNA, 20 bp, Artificial Sequence
  chemically synthesized
attctatctcaccagctttc

SEQ ID NO: 60514 - DNA, 20 bp, Artificial Sequence
  chemically synthesized
ggattggaaggcatcaaaca

SEQ ID NO: 60515 - DNA, 20 bp, Artificial Sequence
  chemically synthesized
tccacgttgcccaccactat

SEQ ID NO: 60516 - DNA, 20 bp, Artificial Sequence
  chemically synthesized
catccactctttttccttca

SEQ ID NO: 60517 - DNA, 20 bp, Artificial Sequence
  chemically synthesized
cctgaaggcttttccctact

SEQ ID NO: 60518 - DNA, 20 bp, Artificial Sequence
  chemically synthesized
ggtcttaaaaaggccagtaa

SEQ ID NO: 60519 - DNA, 20 bp, Artificial Sequence
  chemically synthesized
cccaaattggactgaaaatt

SEQ ID NO: 60520 - DNA, 20 bp, Artificial Sequence
  chemically synthesized
tggactgaaaatttggagta

SEQ ID NO: 60521 - DNA, 20 bp, Artificial Sequence
  chemically synthesized
aatatgggcaaatttatgtc

SEQ ID NO: 60522 - DNA, 20 bp, Artificial Sequence
  chemically synthesized
tggctgatcagcctgtccct

SEQ ID NO: 60523 - DNA, 20 bp, Artificial Sequence
  chemically synthesized
tgactaaatgcaatccttgc

SEQ ID NO: 60524 - DNA, 20 bp, Artificial Sequence
  chemically synthesized
aggtgtgtgcatgtgtccat

SEQ ID NO: 60525 - DNA, 20 bp, Artificial Sequence
  chemically synthesized
gactaaatcaagatccctgg

SEQ ID NO: 60526 - DNA, 20 bp, Artificial Sequence
  chemically synthesized
ggacatatagatacataaag

SEQ ID NO: 60527 - DNA, 20 bp, Artificial Sequence
  chemically synthesized
ttctactttactcaggccct

SEQ ID NO: 60528 - DNA, 20 bp, Artificial Sequence
  chemically synthesized
actttgggagaccaaggtgg

SEQ ID NO: 60529 - DNA, 20 bp, Artificial Sequence
  chemically synthesized
tgggaggattgctgaaggcc

SEQ ID NO: 60530 - DNA, 20 bp, Artificial Sequence
  chemically synthesized
acttcaggcaagaagattac

SEQ ID NO: 60531 - DNA, 20 bp, Artificial Sequence
  chemically synthesized
caagaagattacttgagtcc

SEQ ID NO: 60532 - DNA, 20 bp, Artificial Sequence
  chemically synthesized
acctgggaggctgaggtggg

SEQ ID NO: 60533 - DNA, 20 bp, Artificial Sequence
  chemically synthesized
agccataatcacactactgc

SEQ ID NO: 60534 - DNA, 20 bp, Artificial Sequence
  chemically synthesized
ggtatctcatgtttgtatgt

SEQ ID NO: 60535 - DNA, 20 bp, Artificial Sequence
  chemically synthesized
tcaatagcagttccgagact

SEQ ID NO: 60536 - DNA, 20 bp, Artificial Sequence
  chemically synthesized
attctatagatctcatttgg

SEQ ID NO: 60537 - DNA, 20 bp, Artificial Sequence
  chemically synthesized
atagatctcatttggtagaa

SEQ ID NO: 60538 - DNA, 20 bp, Artificial Sequence
  chemically synthesized
agaatggggtacaaaaaatt

SEQ ID NO: 60539 - DNA, 20 bp, Artificial Sequence
  chemically synthesized
gggtacaaaaaatttaggat

SEQ ID NO: 60540 - DNA, 20 bp, Artificial Sequence
  chemically synthesized
atatcttaatttgttactaa

SEQ ID NO: 60541 - DNA, 20 bp, Artificial Sequence
  chemically synthesized
ttgttactaaacgaatattg

SEQ ID NO: 60542 - DNA, 20 bp, Artificial Sequence
  chemically synthesized
actaaacgaatattgaagaa

SEQ ID NO: 60543 - DNA, 20 bp, Artificial Sequence
  chemically synthesized
cagcactctgggaggccgag

SEQ ID NO: 60544 - DNA, 20 bp, Artificial Sequence
  chemically synthesized
actctgggaggccgaggcgg

SEQ ID NO: 60545 - DNA, 20 bp, Artificial Sequence
  chemically synthesized
tactcaggaggctggggcag

SEQ ID NO: 60546 - DNA, 20 bp, Artificial Sequence
  chemically synthesized
aaagaggtattttcacatac

SEQ ID NO: 60547 - DNA, 20 bp, Artificial Sequence
  chemically synthesized
taaatgataaattaaaaatt

SEQ ID NO: 60548 - DNA, 20 bp, Artificial Sequence
  chemically synthesized
tgtgttgaactatttaataa

SEQ ID NO: 60549 - DNA, 20 bp, Artificial Sequence
  chemically synthesized
gtgttattgttcataatttt

SEQ ID NO: 60550 - DNA, 20 bp, Artificial Sequence
  chemically synthesized
atgtaagcatacaaaatgtc

SEQ ID NO: 60551 - DNA, 20 bp, Artificial Sequence
  chemically synthesized
ttaactcacggtagagaggg

SEQ ID NO: 60552 - DNA, 20 bp, Artificial Sequence
  chemically synthesized
taactttttgttccctttcc

SEQ ID NO: 60553 - DNA, 20 bp, Artificial Sequence
  chemically synthesized
tttttaatagacttgatttt

SEQ ID NO: 60554 - DNA, 20 bp, Artificial Sequence
  chemically synthesized
gaaaaactcagtagaaggta

SEQ ID NO: 60555 - DNA, 20 bp, Artificial Sequence
  chemically synthesized
cttgacaataaccttatgag

SEQ ID NO: 60556 - DNA, 20 bp, Artificial Sequence
  chemically synthesized
gctcatgtaattgaagttca

SEQ ID NO: 60557 - DNA, 20 bp, Artificial Sequence
  chemically synthesized
tatctaaaatgttacctatt

SEQ ID NO: 60558 - DNA, 20 bp, Artificial Sequence
  chemically synthesized
agacaatgctttctgaaaga

SEQ ID NO: 60559 - DNA, 20 bp, Artificial Sequence
  chemically synthesized
gatctttacatacttgctca

SEQ ID NO: 60560 - DNA, 20 bp, Artificial Sequence
  chemically synthesized
tacttgctcagtgaatgaca

SEQ ID NO: 60561 - DNA, 20 bp, Artificial Sequence
  chemically synthesized
aagaaaagaaagacaaaaaa

SEQ ID NO: 60562 - DNA, 20 bp, Artificial Sequence
  chemically synthesized
gctggggagagaagacagtc

SEQ ID NO: 60563 - DNA, 20 bp, Artificial Sequence
  chemically synthesized
tctcaaatgctttggtctag

SEQ ID NO: 60564 - DNA, 20 bp, Artificial Sequence
  chemically synthesized
agcccacgtagaacagcatc

SEQ ID NO: 60565 - DNA, 20 bp, Artificial Sequence
  chemically synthesized
tcaaatggaagatgctggca

SEQ ID NO: 60566 - DNA, 20 bp, Artificial Sequence
  chemically synthesized
tgctgaaggtcctttgtttt

SEQ ID NO: 60567 - DNA, 20 bp, Artificial Sequence
  chemically synthesized
ttgtggataaaggaagtcat

SEQ ID NO: 60568 - DNA, 20 bp, Artificial Sequence
  chemically synthesized
ttatctagcatgactatatg

SEQ ID NO: 60569 - DNA, 20 bp, Artificial Sequence
  chemically synthesized
catgactatatgcagggtta

SEQ ID NO: 60570 - DNA, 20 bp, Artificial Sequence
  chemically synthesized
ttactgggctatgccttgta

SEQ ID NO: 60571 - DNA, 20 bp, Artificial Sequence
  chemically synthesized
atgccttgtagagaatgata

SEQ ID NO: 60572 - DNA, 20 bp, Artificial Sequence
  chemically synthesized
tgatgaagcttctaacattt

SEQ ID NO: 60573 - DNA, 20 bp, Artificial Sequence
  chemically synthesized
actttgccaaagccatatgg

SEQ ID NO: 60574 - DNA, 20 bp, Artificial Sequence
  chemically synthesized
ctcactgcaacattgctcac

SEQ ID NO: 60575 - DNA, 20 bp, Artificial Sequence
  chemically synthesized
caactaataaaatgtgtcta

SEQ ID NO: 60576 - DNA, 20 bp, Artificial Sequence
  chemically synthesized
tactccatttaaaattgcat

SEQ ID NO: 60577 - DNA, 20 bp, Artificial Sequence
  chemically synthesized
atgaatggctctctaatcta

SEQ ID NO: 60578 - DNA, 20 bp, Artificial Sequence
  chemically synthesized
tctctaatctatggagtagg

SEQ ID NO: 60579 - DNA, 20 bp, Artificial Sequence
  chemically synthesized
tcagatactttgcacaatca

SEQ ID NO: 60580 - DNA, 20 bp, Artificial Sequence
  chemically synthesized
atgtgcctaggctgcaagac

SEQ ID NO: 60581 - DNA, 20 bp, Artificial Sequence
  chemically synthesized
aagcaacttcagcaaagtct

SEQ ID NO: 60582 - DNA, 20 bp, Artificial Sequence
  chemically synthesized
acaccaataacagacaaaca

SEQ ID NO: 60583 - DNA, 20 bp, Artificial Sequence
  chemically synthesized
ccattcacaattgcttcaga

SEQ ID NO: 60584 - DNA, 20 bp, Artificial Sequence
  chemically synthesized
tcagagagaatataatacct

SEQ ID NO: 60585 - DNA, 20 bp, Artificial Sequence
  chemically synthesized
acctaggaatccaacttaca

SEQ ID NO: 60586 - DNA, 20 bp, Artificial Sequence
  chemically synthesized
tggaagaacattccatgctc

SEQ ID NO: 60587 - DNA, 20 bp, Artificial Sequence
  chemically synthesized
gctaccaatgactttcttca

SEQ ID NO: 60588 - DNA, 20 bp, Artificial Sequence
  chemically synthesized
agaaaaacaagaaatgggga

SEQ ID NO: 60589 - DNA, 20 bp, Artificial Sequence
  chemically synthesized
ccaaatgtaggaagctgaaa

SEQ ID NO: 60590 - DNA, 20 bp, Artificial Sequence
  chemically synthesized
tatacaaaaattaactcaag

SEQ ID NO: 60591 - DNA, 20 bp, Artificial Sequence
  chemically synthesized
caaaagccaaaattcactaa

SEQ ID NO: 60592 - DNA, 20 bp, Artificial Sequence
  chemically synthesized
acagcaaaagaaactaccat

SEQ ID NO: 60593 - DNA, 20 bp, Artificial Sequence
  chemically synthesized
tctgacaaagggctaatatc

SEQ ID NO: 60594 - DNA, 20 bp, Artificial Sequence
  chemically synthesized
accccatcaaaaagtgggca

SEQ ID NO: 60595 - DNA, 20 bp, Artificial Sequence
  chemically synthesized
agataccatctcacaccagt

SEQ ID NO: 60596 - DNA, 20 bp, Artificial Sequence
  chemically synthesized
aggaaacaacaggtgctgga

SEQ ID NO: 60597 - DNA, 20 bp, Artificial Sequence
  chemically synthesized
agtcagtgtggtgattcctc

SEQ ID NO: 60598 - DNA, 20 bp, Artificial Sequence
  chemically synthesized
ttgacccagccatcccatta

SEQ ID NO: 60599 - DNA, 20 bp, Artificial Sequence
  chemically synthesized
cattactgggtatacaccca

SEQ ID NO: 60600 - DNA, 20 bp, Artificial Sequence
  chemically synthesized
aaatgtccaacaatgataga

SEQ ID NO: 60601 - DNA, 20 bp, Artificial Sequence
  chemically synthesized
aatgtggcacatatacacca

SEQ ID NO: 60602 - DNA, 20 bp, Artificial Sequence
  chemically synthesized
ctatgcagccataaaaaatg

SEQ ID NO: 60603 - DNA, 20 bp, Artificial Sequence
  chemically synthesized
ttcatgtcctttgtagggac

SEQ ID NO: 60604 - DNA, 20 bp, Artificial Sequence
  chemically synthesized
tcacacaccggggcctgttg

SEQ ID NO: 60605 - DNA, 20 bp, Artificial Sequence
  chemically synthesized
gtggggtgggaggagggggc

SEQ ID NO: 60606 - DNA, 20 bp, Artificial Sequence
  chemically synthesized
gatatacctaatgttaaatg

SEQ ID NO: 60607 - DNA, 20 bp, Artificial Sequence
  chemically synthesized
taatgttaaatggtgagtta

SEQ ID NO: 60608 - DNA, 20 bp, Artificial Sequence
  chemically synthesized
atattagttatttaaatatg

SEQ ID NO: 60609 - DNA, 20 bp, Artificial Sequence
  chemically synthesized
gcttgtttcccttaggttct

SEQ ID NO: 60610 - DNA, 20 bp, Artificial Sequence
  chemically synthesized
agagaggctaatgtaattac

SEQ ID NO: 60611 - DNA, 20 bp, Artificial Sequence
  chemically synthesized
agccccaggactaagaagat

SEQ ID NO: 60612 - DNA, 20 bp, Artificial Sequence
  chemically synthesized
agaggccagtttcacttgtg

SEQ ID NO: 60613 - DNA, 20 bp, Artificial Sequence
  chemically synthesized
gtctccacccaaatttcata

SEQ ID NO: 60614 - DNA, 20 bp, Artificial Sequence
  chemically synthesized
agggaccaggtgggagatta

SEQ ID NO: 60615 - DNA, 20 bp, Artificial Sequence
  chemically synthesized
cccatgcagttctcgtgata

SEQ ID NO: 60616 - DNA, 20 bp, Artificial Sequence
  chemically synthesized
tgcagttctcgtgatactga

SEQ ID NO: 60617 - DNA, 20 bp, Artificial Sequence
  chemically synthesized
ctccccagctatgtggaaat

SEQ ID NO: 60618 - DNA, 20 bp, Artificial Sequence
  chemically synthesized
tagtatctttagagcagtgt

SEQ ID NO: 60619 - DNA, 20 bp, Artificial Sequence
  chemically synthesized
aacctgtctggcagaaggag

SEQ ID NO: 60620 - DNA, 20 bp, Artificial Sequence
  chemically synthesized
caaaaacaccagagcacatc

SEQ ID NO: 60621 - DNA, 20 bp, Artificial Sequence
  chemically synthesized
agttttgccatcatattatc

SEQ ID NO: 60622 - DNA, 20 bp, Artificial Sequence
  chemically synthesized
gtttacctcacagatgtggt

SEQ ID NO: 60623 - DNA, 20 bp, Artificial Sequence
  chemically synthesized
gctgactgtgattgactcct

SEQ ID NO: 60624 - DNA, 20 bp, Artificial Sequence
  chemically synthesized
gagaattcctgaaagagata

SEQ ID NO: 60625 - DNA, 20 bp, Artificial Sequence
  chemically synthesized
tgaaagagatatagagtgga

SEQ ID NO: 60626 - DNA, 20 bp, Artificial Sequence
  chemically synthesized
ctccaattctgtccagctcc

SEQ ID NO: 60627 - DNA, 20 bp, Artificial Sequence
  chemically synthesized
caaacaaatcctaaactcag

SEQ ID NO: 60628 - DNA, 20 bp, Artificial Sequence
  chemically synthesized
ctctggagatggaaactgag

SEQ ID NO: 60629 - DNA, 20 bp, Artificial Sequence
  chemically synthesized
gaggtgtggcaggcaagata

SEQ ID NO: 60630 - DNA, 20 bp, Artificial Sequence
  chemically synthesized
aggcaagatacagggtgcag

SEQ ID NO: 60631 - DNA, 20 bp, Artificial Sequence
  chemically synthesized
atacagggtgcagtgggatc

SEQ ID NO: 60632 - DNA, 20 bp, Artificial Sequence
  chemically synthesized
tcttcccgtgtgctgcctta

SEQ ID NO: 60633 - DNA, 20 bp, Artificial Sequence
  chemically synthesized
gcctgccacacctcaaataa

SEQ ID NO: 60634 - DNA, 20 bp, Artificial Sequence
  chemically synthesized
tcttgactgatacttgaaac

SEQ ID NO: 60635 - DNA, 20 bp, Artificial Sequence
  chemically synthesized
tccttctcagtttccatctc

SEQ ID NO: 60636 - DNA, 20 bp, Artificial Sequence
  chemically synthesized
cagagtctctaccgccagat

SEQ ID NO: 60637 - DNA, 20 bp, Artificial Sequence
  chemically synthesized
cttaaaacacaatcattctc

SEQ ID NO: 60638 - DNA, 20 bp, Artificial Sequence
  chemically synthesized
cacaatcattctcctgagtt

SEQ ID NO: 60639 - DNA, 20 bp, Artificial Sequence
  chemically synthesized
ttagcttgaaaggttacaaa

SEQ ID NO: 60640 - DNA, 20 bp, Artificial Sequence
  chemically synthesized
acaacaaatcagaaaaaaag

SEQ ID NO: 60641 - DNA, 20 bp, Artificial Sequence
  chemically synthesized
actgtacccctggagctgga

SEQ ID NO: 60642 - DNA, 20 bp, Artificial Sequence
  chemically synthesized
ggagctggacagaattggag

SEQ ID NO: 60643 - DNA, 20 bp, Artificial Sequence
  chemically synthesized
atgtgagcctttagcaacca

SEQ ID NO: 60644 - DNA, 20 bp, Artificial Sequence
  chemically synthesized
ctccactctatatctctttc

SEQ ID NO: 60645 - DNA, 20 bp, Artificial Sequence
  chemically synthesized
tatctctttcaggaattctc

SEQ ID NO: 60646 - DNA, 20 bp, Artificial Sequence
  chemically synthesized
tgtgaggtaaacaaggagac

SEQ ID NO: 60647 - DNA, 20 bp, Artificial Sequence
  chemically synthesized
aaaccagacataagcatttt

SEQ ID NO: 60648 - DNA, 20 bp, Artificial Sequence
  chemically synthesized
tatgatggcaaaactatttc

SEQ ID NO: 60649 - DNA, 20 bp, Artificial Sequence
  chemically synthesized
ttttccatctgccaccaatt

SEQ ID NO: 60650 - DNA, 20 bp, Artificial Sequence
  chemically synthesized
aagggcttcacactgtgaca

SEQ ID NO: 60651 - DNA, 20 bp, Artificial Sequence
  chemically synthesized
tcacactgtgacatggggtt

SEQ ID NO: 60652 - DNA, 20 bp, Artificial Sequence
  chemically synthesized
gtgacatggggttgggagtc

SEQ ID NO: 60653 - DNA, 20 bp, Artificial Sequence
  chemically synthesized
tgcttcagaaggcagggctt

SEQ ID NO: 60654 - DNA, 20 bp, Artificial Sequence
  chemically synthesized
tctaaagatactacctgaga

SEQ ID NO: 60655 - DNA, 20 bp, Artificial Sequence
  chemically synthesized
ttacttggtggcaggcaaga

SEQ ID NO: 60656 - DNA, 20 bp, Artificial Sequence
  chemically synthesized
tggtccctcccccgacatat

SEQ ID NO: 60657 - DNA, 20 bp, Artificial Sequence
  chemically synthesized
ccccgacatatagggattat

SEQ ID NO: 60658 - DNA, 20 bp, Artificial Sequence
  chemically synthesized
attacaattcaatatgaaat

SEQ ID NO: 60659 - DNA, 20 bp, Artificial Sequence
  chemically synthesized
acacagagccaagccatatc

SEQ ID NO: 60660 - DNA, 20 bp, Artificial Sequence
  chemically synthesized
actggcctctgagcctcagg

SEQ ID NO: 60661 - DNA, 20 bp, Artificial Sequence
  chemically synthesized
tatcttcttagtcctggggc

SEQ ID NO: 60662 - DNA, 20 bp, Artificial Sequence
  chemically synthesized
cattttttgaaaaagctgat

SEQ ID NO: 60663 - DNA, 20 bp, Artificial Sequence
  chemically synthesized
aaaagctgatcagagtctct

SEQ ID NO: 60664 - DNA, 20 bp, Artificial Sequence
  chemically synthesized
ctgatcagagtctctaggag

SEQ ID NO: 60665 - DNA, 20 bp, Artificial Sequence
  chemically synthesized
aagggaaacaagcaaagata

SEQ ID NO: 60666 - DNA, 20 bp, Artificial Sequence
  chemically synthesized
agagtcagtatctttgtgaa

SEQ ID NO: 60667 - DNA, 20 bp, Artificial Sequence
  chemically synthesized
tttgttatacttttaagttt

SEQ ID NO: 60668 - DNA, 20 bp, Artificial Sequence
  chemically synthesized
tcattgttcagttcccacct

SEQ ID NO: 60669 - DNA, 20 bp, Artificial Sequence
  chemically synthesized
tgtccttgtgatagtttgct

SEQ ID NO: 60670 - DNA, 20 bp, Artificial Sequence
  chemically synthesized
agtctatcattgttggacat

SEQ ID NO: 60671 - DNA, 20 bp, Artificial Sequence
  chemically synthesized
ggttccaagtctttgctatt

SEQ ID NO: 60672 - DNA, 20 bp, Artificial Sequence
  chemically synthesized
gcagcatgatttataatcct

SEQ ID NO: 60673 - DNA, 20 bp, Artificial Sequence
  chemically synthesized
tttgggtgtatacccagtaa

SEQ ID NO: 60674 - DNA, 20 bp, Artificial Sequence
  chemically synthesized
tatacccagtaatgggatgg

SEQ ID NO: 60675 - DNA, 20 bp, Artificial Sequence
  chemically synthesized
tttctagttctagatccctg

SEQ ID NO: 60676 - DNA, 20 bp, Artificial Sequence
  chemically synthesized
atcctttgcccactttttga

SEQ ID NO: 60677 - DNA, 20 bp, Artificial Sequence
  chemically synthesized
tttttctcttgtaaatttgt

SEQ ID NO: 60678 - DNA, 20 bp, Artificial Sequence
  chemically synthesized
gtttgagttcattgtagatt

SEQ ID NO: 60679 - DNA, 20 bp, Artificial Sequence
  chemically synthesized
ggatattagccctttgtcag

SEQ ID NO: 60680 - DNA, 20 bp, Artificial Sequence
  chemically synthesized
agtttaattagatcccatta

SEQ ID NO: 60681 - DNA, 20 bp, Artificial Sequence
  chemically synthesized
tccatgcccatgcctatgtc

SEQ ID NO: 60682 - DNA, 20 bp, Artificial Sequence
  chemically synthesized
gtattgcttaggttttcttc

SEQ ID NO: 60683 - DNA, 20 bp, Artificial Sequence
  chemically synthesized
atttaagtctttaatccatc

SEQ ID NO: 60684 - DNA, 20 bp, Artificial Sequence
  chemically synthesized
ttttgtataaggtgtaagga

SEQ ID NO: 60685 - DNA, 20 bp, Artificial Sequence
  chemically synthesized
ccagcaccatttattaaaca

SEQ ID NO: 60686 - DNA, 20 bp, Artificial Sequence
  chemically synthesized
ccagctttgttcttttggct

SEQ ID NO: 60687 - DNA, 20 bp, Artificial Sequence
  chemically synthesized
aaagtcattggtagcttgat

SEQ ID NO: 60688 - DNA, 20 bp, Artificial Sequence
  chemically synthesized
gtagcttgatggggatggca

SEQ ID NO: 60689 - DNA, 20 bp, Artificial Sequence
  chemically synthesized
tttcttcctatccatgagca

SEQ ID NO: 60690 - DNA, 20 bp, Artificial Sequence
  chemically synthesized
tccttcacatcccttgtaag

SEQ ID NO: 60691 - DNA, 20 bp, Artificial Sequence
  chemically synthesized
atattctctctgaagcaatt

SEQ ID NO: 60692 - DNA, 20 bp, Artificial Sequence
  chemically synthesized
tctctgaagcaattgtgaat

SEQ ID NO: 60693 - DNA, 20 bp, Artificial Sequence
  chemically synthesized
tttgtctgttattggtgtat

SEQ ID NO: 60694 - DNA, 20 bp, Artificial Sequence
  chemically synthesized
gaagttgcttatcagcttaa

SEQ ID NO: 60695 - DNA, 20 bp, Artificial Sequence
  chemically synthesized
gggattttgggctgagacaa

SEQ ID NO: 60696 - DNA, 20 bp, Artificial Sequence
  chemically synthesized
ttgactttctctttacataa

SEQ ID NO: 60697 - DNA, 20 bp, Artificial Sequence
  chemically synthesized
ccagaacttccaacactatg

SEQ ID NO: 60698 - DNA, 20 bp, Artificial Sequence
  chemically synthesized
cttccaacactatgttgaat

SEQ ID NO: 60699 - DNA, 20 bp, Artificial Sequence
  chemically synthesized
cattcatatgcaattttaaa

SEQ ID NO: 60700 - DNA, 20 bp, Artificial Sequence
  chemically synthesized
acaatgaagcgtaaggtatt

SEQ ID NO: 60701 - DNA, 20 bp, Artificial Sequence
  chemically synthesized
atatggctttggcaaagtta

SEQ ID NO: 60702 - DNA, 20 bp, Artificial Sequence
  chemically synthesized
gcatatagtcatgctagata

SEQ ID NO: 60703 - DNA, 20 bp, Artificial Sequence
  chemically synthesized
ccagcatcttccatttgact

SEQ ID NO: 60704 - DNA, 20 bp, Artificial Sequence
  chemically synthesized
tataaagctgtctctcttcc

SEQ ID NO: 60705 - DNA, 20 bp, Artificial Sequence
  chemically synthesized
cttgggtctttggccctcaa

SEQ ID NO: 60706 - DNA, 20 bp, Artificial Sequence
  chemically synthesized
cctagatggacgcagacttg

SEQ ID NO: 60707 - DNA, 20 bp, Artificial Sequence
  chemically synthesized
agacttgatgaatgtcaaag

SEQ ID NO: 60708 - DNA, 20 bp, Artificial Sequence
  chemically synthesized
aaatggaaatttagtgaacc

SEQ ID NO: 60709 - DNA, 20 bp, Artificial Sequence
  chemically synthesized
ggaggtatttcagtgagcca

SEQ ID NO: 60710 - DNA, 20 bp, Artificial Sequence
  chemically synthesized
caacttcataagaaaattta

SEQ ID NO: 60711 - DNA, 20 bp, Artificial Sequence
  chemically synthesized
gtatgtaaagatcacaagct

SEQ ID NO: 60712 - DNA, 20 bp, Artificial Sequence
  chemically synthesized
acaagctttgggtcagatat

SEQ ID NO: 60713 - DNA, 20 bp, Artificial Sequence
  chemically synthesized
ggaaaacatgtacaaaggct

SEQ ID NO: 60714 - DNA, 20 bp, Artificial Sequence
  chemically synthesized
tcaaaggcttagagaggctt

SEQ ID NO: 60715 - DNA, 20 bp, Artificial Sequence
  chemically synthesized
ggcttgtggatattaaataa

SEQ ID NO: 60716 - DNA, 20 bp, Artificial Sequence
  chemically synthesized
ttgtaaagatttttgcctgc

SEQ ID NO: 60717 - DNA, 20 bp, Artificial Sequence
  chemically synthesized
aggaatataggcttgtgctg

SEQ ID NO: 60718 - DNA, 20 bp, Artificial Sequence
  chemically synthesized
aagcagatactgtcattagc

SEQ ID NO: 60719 - DNA, 20 bp, Artificial Sequence
  chemically synthesized
tttttggtttgttgttgttg

SEQ ID NO: 60720 - DNA, 20 bp, Artificial Sequence
  chemically synthesized
tcagtgtacttatctgtaaa

SEQ ID NO: 60721 - DNA, 20 bp, Artificial Sequence
  chemically synthesized
cttatagtgtattatgccct

SEQ ID NO: 60722 - DNA, 20 bp, Artificial Sequence
  chemically synthesized
aaggtactcagtaccttcta

SEQ ID NO: 60723 - DNA, 20 bp, Artificial Sequence
  chemically synthesized
accttctactgagtttttct

SEQ ID NO: 60724 - DNA, 20 bp, Artificial Sequence
  chemically synthesized
atggaaaacatggccctgaa

SEQ ID NO: 60725 - DNA, 20 bp, Artificial Sequence
  chemically synthesized
acgagtggtcctgtttggag

SEQ ID NO: 60726 - DNA, 20 bp, Artificial Sequence
  chemically synthesized
aaaatcagatgcgcttgata

SEQ ID NO: 60727 - DNA, 20 bp, Artificial Sequence
  chemically synthesized
agtactcagccctctctacc

SEQ ID NO: 60728 - DNA, 20 bp, Artificial Sequence
  chemically synthesized
ttttaataatagtgtatcaa

SEQ ID NO: 60729 - DNA, 20 bp, Artificial Sequence
  chemically synthesized
attgatcactgacctaggag

SEQ ID NO: 60730 - DNA, 20 bp, Artificial Sequence
  chemically synthesized
gcatttctgagacacagagc

SEQ ID NO: 60731 - DNA, 20 bp, Artificial Sequence
  chemically synthesized
ctttttttttgtttttgaga

SEQ ID NO: 60732 - DNA, 20 bp, Artificial Sequence
  chemically synthesized
tcttgctctgttgcccaggc

SEQ ID NO: 60733 - DNA, 20 bp, Artificial Sequence
  chemically synthesized
ctcactgcaagctccacctc

SEQ ID NO: 60734 - DNA, 20 bp, Artificial Sequence
  chemically synthesized
cattctgctgccccagcctc

SEQ ID NO: 60735 - DNA, 20 bp, Artificial Sequence
  chemically synthesized
ttttgtatttttagtagaga

SEQ ID NO: 60736 - DNA, 20 bp, Artificial Sequence
  chemically synthesized
ctgggttccaccgtgttagc

SEQ ID NO: 60737 - DNA, 20 bp, Artificial Sequence
  chemically synthesized
atccacccgcctcggcctcc

SEQ ID NO: 60738 - DNA, 20 bp, Artificial Sequence
  chemically synthesized
gcctcggcctcccagagtgc

SEQ ID NO: 60739 - DNA, 20 bp, Artificial Sequence
  chemically synthesized
tgttaatttgcattttaaat

SEQ ID NO: 60740 - DNA, 20 bp, Artificial Sequence
  chemically synthesized
attctaccaaatgagatcta

SEQ ID NO: 60741 - DNA, 20 bp, Artificial Sequence
  chemically synthesized
ccaaatgagatctatagaat

SEQ ID NO: 60742 - DNA, 20 bp, Artificial Sequence
  chemically synthesized
aatttcctctcaacatggag

SEQ ID NO: 60743 - DNA, 20 bp, Artificial Sequence
  chemically synthesized
tctaagtctcggaactgcta

SEQ ID NO: 60744 - DNA, 20 bp, Artificial Sequence
  chemically synthesized
tgagtaatgtggcctactat

SEQ ID NO: 60745 - DNA, 20 bp, Artificial Sequence
  chemically synthesized
tgtggatgtaaattaaagtt

SEQ ID NO: 60746 - DNA, 20 bp, Artificial Sequence
  chemically synthesized
tagaatggaacctatgttta

SEQ ID NO: 60747 - DNA, 20 bp, Artificial Sequence
  chemically synthesized
ctgtaaggctgcagaaactg

SEQ ID NO: 60748 - DNA, 20 bp, Artificial Sequence
  chemically synthesized
ccagaggggctcccaagcct

SEQ ID NO: 60749 - DNA, 20 bp, Artificial Sequence
  chemically synthesized
caaacatacatacatatttt

SEQ ID NO: 60750 - DNA, 20 bp, Artificial Sequence
  chemically synthesized
gtttgttttcctttttattt

SEQ ID NO: 60751 - DNA, 20 bp, Artificial Sequence
  chemically synthesized
tttcctttttatttttgaat

SEQ ID NO: 60752 - DNA, 20 bp, Artificial Sequence
  chemically synthesized
tttaattttttttgtagaga

SEQ ID NO: 60753 - DNA, 20 bp, Artificial Sequence
  chemically synthesized
accttggtctcccaaagtgc

SEQ ID NO: 60754 - DNA, 20 bp, Artificial Sequence
  chemically synthesized
atggtaattttaacctgtag

SEQ ID NO: 60755 - DNA, 20 bp, Artificial Sequence
  chemically synthesized
taattttaacctgtaggaga

SEQ ID NO: 60756 - DNA, 20 bp, Artificial Sequence
  chemically synthesized
acctgtaggagaatgggtgg

SEQ ID NO: 60757 - DNA, 20 bp, Artificial Sequence
  chemically synthesized
ggtgggaggatccagagggc

SEQ ID NO: 60758 - DNA, 20 bp, Artificial Sequence
  chemically synthesized
aatgaagatataccaccttg

SEQ ID NO: 60759 - DNA, 20 bp, Artificial Sequence
  chemically synthesized
aaaggtgtcttcttgggctt

SEQ ID NO: 60760 - DNA, 20 bp, Artificial Sequence
  chemically synthesized
ggcttctgaatgtgaagagg

SEQ ID NO: 60761 - DNA, 20 bp, Artificial Sequence
  chemically synthesized
gaagagaacttctgttagct

SEQ ID NO: 60762 - DNA, 20 bp, Artificial Sequence
  chemically synthesized
acgcatacatttaatattta

SEQ ID NO: 60763 - DNA, 20 bp, Artificial Sequence
  chemically synthesized
aagacatgcctaattcctcc

SEQ ID NO: 60764 - DNA, 20 bp, Artificial Sequence
  chemically synthesized
ttcaaagctgagacccctgc

SEQ ID NO: 60765 - DNA, 20 bp, Artificial Sequence
  chemically synthesized
gtttatttcctcctgagcaa

SEQ ID NO: 60766 - DNA, 20 bp, Artificial Sequence
  chemically synthesized
tgtgacttcaatatgtttgt

SEQ ID NO: 60767 - DNA, 20 bp, Artificial Sequence
  chemically synthesized
aaggtaaaatcagagatgag

SEQ ID NO: 60768 - DNA, 20 bp, Artificial Sequence
  chemically synthesized
aatcagagatgagaggagtc

SEQ ID NO: 60769 - DNA, 20 bp, Artificial Sequence
  chemically synthesized
gagatgagaggagtcaagga

SEQ ID NO: 60770 - DNA, 20 bp, Artificial Sequence
  chemically synthesized
atcaaagtctcttcttctag

SEQ ID NO: 60771 - DNA, 20 bp, Artificial Sequence
  chemically synthesized
gcacaaccttagaaatttgg

SEQ ID NO: 60772 - DNA, 20 bp, Artificial Sequence
  chemically synthesized
gcttgaaacaggtgttgagg

SEQ ID NO: 60773 - DNA, 20 bp, Artificial Sequence
  chemically synthesized
caggtgttgaggaagaatgc

SEQ ID NO: 60774 - DNA, 20 bp, Artificial Sequence
  chemically synthesized
tgaggtttctgatgtgactt

SEQ ID NO: 60775 - DNA, 20 bp, Artificial Sequence
  chemically synthesized
gtctgaaagttactgctgac

SEQ ID NO: 60776 - DNA, 20 bp, Artificial Sequence
  chemically synthesized
aaggaggtgtatttccggag

SEQ ID NO: 60777 - DNA, 20 bp, Artificial Sequence
  chemically synthesized
ggtctctgccaggctctcct

SEQ ID NO: 60778 - DNA, 20 bp, Artificial Sequence
  chemically synthesized
accttcaataaagttgcctt

SEQ ID NO: 60779 - DNA, 20 bp, Artificial Sequence
  chemically synthesized
ccttcttataggcctctagg

SEQ ID NO: 60780 - DNA, 20 bp, Artificial Sequence
  chemically synthesized
aggaacttgataatggcacg

SEQ ID NO: 60781 - DNA, 20 bp, Artificial Sequence
  chemically synthesized
ggtcttaatgctgtatatga

SEQ ID NO: 60782 - DNA, 20 bp, Artificial Sequence
  chemically synthesized
tagacattggccataagaag

SEQ ID NO: 60783 - DNA, 20 bp, Artificial Sequence
  chemically synthesized
acagccccatcatgggcaca

SEQ ID NO: 60784 - DNA, 20 bp, Artificial Sequence
  chemically synthesized
gccaggcctgctactgtgtg

SEQ ID NO: 60785 - DNA, 20 bp, Artificial Sequence
  chemically synthesized
ggcctgctactgtgtgcagg

SEQ ID NO: 60786 - DNA, 20 bp, Artificial Sequence
  chemically synthesized
cacttcctggtgcaggcaaa

SEQ ID NO: 60787 - DNA, 20 bp, Artificial Sequence
  chemically synthesized
gccttcaggaggaggacaat

SEQ ID NO: 60788 - DNA, 20 bp, Artificial Sequence
  chemically synthesized
ttgctggccagtgataatga

SEQ ID NO: 60789 - DNA, 20 bp, Artificial Sequence
  chemically synthesized
gataatgaccgaatacctca

SEQ ID NO: 60790 - DNA, 20 bp, Artificial Sequence
  chemically synthesized
tgaggactccatgaaggaaa

SEQ ID NO: 60791 - DNA, 20 bp, Artificial Sequence
  chemically synthesized
gactccatgaaggaaaaaga

SEQ ID NO: 60792 - DNA, 20 bp, Artificial Sequence
  chemically synthesized
aaagagtggatgcagaacat

SEQ ID NO: 60793 - DNA, 20 bp, Artificial Sequence
  chemically synthesized
cgctccaaagtagatactat

SEQ ID NO: 60794 - DNA, 20 bp, Artificial Sequence
  chemically synthesized
ccaggtcagtgagggccagc

SEQ ID NO: 60795 - DNA, 20 bp, Artificial Sequence
  chemically synthesized
gcaaggatagtagatagtac

SEQ ID NO: 60796 - DNA, 20 bp, Artificial Sequence
  chemically synthesized
gtacatgggtgtgtgcagac

SEQ ID NO: 60797 - DNA, 20 bp, Artificial Sequence
  chemically synthesized
gggttggtcttaataatgat

SEQ ID NO: 60798 - DNA, 20 bp, Artificial Sequence
  chemically synthesized
accatgtacataaagaaaaa

SEQ ID NO: 60799 - DNA, 20 bp, Artificial Sequence
  chemically synthesized
atccaggaaagctggtgaga

SEQ ID NO: 60800 - DNA, 20 bp, Artificial Sequence
  chemically synthesized
agatagaatatggggctaaa

SEQ ID NO: 60801 - DNA, 20 bp, Artificial Sequence
  chemically synthesized
tggggctaaactgagtaatg

SEQ ID NO: 60802 - DNA, 20 bp, Artificial Sequence
  chemically synthesized
gagtaatgttggatagcagc

SEQ ID NO: 60803 - DNA, 20 bp, Artificial Sequence
  chemically synthesized
cagcatgaattgaggactga

SEQ ID NO: 60804 - DNA, 20 bp, Artificial Sequence
  chemically synthesized
atattggactgacattcctc

SEQ ID NO: 60805 - DNA, 20 bp, Artificial Sequence
  chemically synthesized
ggggattgagctgaaaataa

SEQ ID NO: 60806 - DNA, 20 bp, Artificial Sequence
  chemically synthesized
gtattatctactccaccctt

SEQ ID NO: 60807 - DNA, 20 bp, Artificial Sequence
  chemically synthesized
atcaaccaatcaccaagtcc

SEQ ID NO: 60808 - DNA, 20 bp, Artificial Sequence
  chemically synthesized
agtcctagggtttctgttta

SEQ ID NO: 60809 - DNA, 20 bp, Artificial Sequence
  chemically synthesized
atttgtattttcattcttcc

SEQ ID NO: 60810 - DNA, 20 bp, Artificial Sequence
  chemically synthesized
ttaaattccccaagtttagt

SEQ ID NO: 60811 - DNA, 20 bp, Artificial Sequence
  chemically synthesized
ttctgtattgcttctataat

SEQ ID NO: 60812 - DNA, 20 bp, Artificial Sequence
  chemically synthesized
ttaattttaatattagctct

SEQ ID NO: 60813 - DNA, 20 bp, Artificial Sequence
  chemically synthesized
ttttttagccaccatatcat

SEQ ID NO: 60814 - DNA, 20 bp, Artificial Sequence
  chemically synthesized
tggaatcctttaaatattat

SEQ ID NO: 60815 - DNA, 20 bp, Artificial Sequence
  chemically synthesized
agggagcaaaggaggaaggt

SEQ ID NO: 60816 - DNA, 20 bp, Artificial Sequence
  chemically synthesized
taagagtgatgcattttata

SEQ ID NO: 60817 - DNA, 20 bp, Artificial Sequence
  chemically synthesized
ggtagtcagagaagacctct

SEQ ID NO: 60818 - DNA, 20 bp, Artificial Sequence
  chemically synthesized
tcaatggaggaagcaaggtg

SEQ ID NO: 60819 - DNA, 20 bp, Artificial Sequence
  chemically synthesized
tgcaggtcacgcaagctact

SEQ ID NO: 60820 - DNA, 20 bp, Artificial Sequence
  chemically synthesized
ttttattatacttgtgagct

SEQ ID NO: 60821 - DNA, 20 bp, Artificial Sequence
  chemically synthesized
gttgagagcagaggtgctgc

SEQ ID NO: 60822 - DNA, 20 bp, Artificial Sequence
  chemically synthesized
aggcttacatcactttggca

SEQ ID NO: 60823 - DNA, 20 bp, Artificial Sequence
  chemically synthesized
tctaggggccaaatgcaatg

SEQ ID NO: 60824 - DNA, 20 bp, Artificial Sequence
  chemically synthesized
aactccgttacatatcaggc

SEQ ID NO: 60825 - DNA, 20 bp, Artificial Sequence
  chemically synthesized
ttctcactaggtgtttccaa

SEQ ID NO: 60826 - DNA, 20 bp, Artificial Sequence
  chemically synthesized
atgcagaaagtactaactct

SEQ ID NO: 60827 - DNA, 20 bp, Artificial Sequence
  chemically synthesized
acttcagtagctcctatcat

SEQ ID NO: 60828 - DNA, 20 bp, Artificial Sequence
  chemically synthesized
gtgaaaagcttgacataatc

SEQ ID NO: 60829 - DNA, 20 bp, Artificial Sequence
  chemically synthesized
gcctggtagtgagcgaaaat

SEQ ID NO: 60830 - DNA, 20 bp, Artificial Sequence
  chemically synthesized
tttccaaccagtaaacactt

SEQ ID NO: 60831 - DNA, 20 bp, Artificial Sequence
  chemically synthesized
atttactcataaatacttta

SEQ ID NO: 60832 - DNA, 20 bp, Artificial Sequence
  chemically synthesized
agattttttatatataagta

SEQ ID NO: 60833 - DNA, 20 bp, Artificial Sequence
  chemically synthesized
attttttaagttgattagac

SEQ ID NO: 60834 - DNA, 20 bp, Artificial Sequence
  chemically synthesized
ttttttgcatgaaaaactaa

SEQ ID NO: 60835 - DNA, 20 bp, Artificial Sequence
  chemically synthesized
ttgcatgaaaaactaaatgg

SEQ ID NO: 60836 - DNA, 20 bp, Artificial Sequence
  chemically synthesized
ttatcctgattctttgtgcc

SEQ ID NO: 60837 - DNA, 20 bp, Artificial Sequence
  chemically synthesized
agctctgtgttcaccaactt

SEQ ID NO: 60838 - DNA, 20 bp, Artificial Sequence
  chemically synthesized
gtgatgagatggacagggag

SEQ ID NO: 60839 - DNA, 20 bp, Artificial Sequence
  chemically synthesized
tacagagacaatgacagggc

SEQ ID NO: 60840 - DNA, 20 bp, Artificial Sequence
  chemically synthesized
ctcttgggaagaaagcttta

SEQ ID NO: 60841 - DNA, 20 bp, Artificial Sequence
  chemically synthesized
tcatgtctactaagcaatgg

SEQ ID NO: 60842 - DNA, 20 bp, Artificial Sequence
  chemically synthesized
cataattaaaatattcaagg

SEQ ID NO: 60843 - DNA, 20 bp, Artificial Sequence
  chemically synthesized
aaagagattttcagtataca

SEQ ID NO: 60844 - DNA, 20 bp, Artificial Sequence
  chemically synthesized
gtgtctaaatattcttttgt

SEQ ID NO: 60845 - DNA, 20 bp, Artificial Sequence
  chemically synthesized
tttaatgaactacattggtg

SEQ ID NO: 60846 - DNA, 20 bp, Artificial Sequence
  chemically synthesized
atactgtttcttgtaaatag

SEQ ID NO: 60847 - DNA, 20 bp, Artificial Sequence
  chemically synthesized
gtaaacatgcctgtttttag

SEQ ID NO: 60848 - DNA, 20 bp, Artificial Sequence
  chemically synthesized
ctgtttttagtaggatagag

SEQ ID NO: 60849 - DNA, 20 bp, Artificial Sequence
  chemically synthesized
tggaaggcgaaggccatatc

SEQ ID NO: 60850 - DNA, 20 bp, Artificial Sequence
  chemically synthesized
gggaagttacaaggtgttgt

SEQ ID NO: 60851 - DNA, 20 bp, Artificial Sequence
  chemically synthesized
tggattaaaataagcagatt

SEQ ID NO: 60852 - DNA, 20 bp, Artificial Sequence
  chemically synthesized
taaaataagcagattgagga

SEQ ID NO: 60853 - DNA, 20 bp, Artificial Sequence
  chemically synthesized
aaaatgcatttaataatttg

SEQ ID NO: 60854 - DNA, 20 bp, Artificial Sequence
  chemically synthesized
tttaataatttgttgaataa

SEQ ID NO: 60855 - DNA, 20 bp, Artificial Sequence
  chemically synthesized
tgaatgactgtttttctgat

SEQ ID NO: 60856 - DNA, 20 bp, Artificial Sequence
  chemically synthesized
ttttctgatgagagtaagga

SEQ ID NO: 60857 - DNA, 20 bp, Artificial Sequence
  chemically synthesized
taccagatggctcggcagga

SEQ ID NO: 60858 - DNA, 20 bp, Artificial Sequence
  chemically synthesized
gccatgcaggcactcatcag

SEQ ID NO: 60859 - DNA, 20 bp, Artificial Sequence
  chemically synthesized
ctgcctcctggccttcctaa

SEQ ID NO: 60860 - DNA, 20 bp, Artificial Sequence
  chemically synthesized
tggttctgtgcatagactct

SEQ ID NO: 60861 - DNA, 20 bp, Artificial Sequence
  chemically synthesized
ttataatcctggcaacttgg

SEQ ID NO: 60862 - DNA, 20 bp, Artificial Sequence
  chemically synthesized
aacttggaagaataaggtgg

SEQ ID NO: 60863 - DNA, 20 bp, Artificial Sequence
  chemically synthesized
gaataaggtgggaggattgc

SEQ ID NO: 60864 - DNA, 20 bp, Artificial Sequence
  chemically synthesized
gaggattgcttgaatccggt

SEQ ID NO: 60865 - DNA, 20 bp, Artificial Sequence
  chemically synthesized
ttacaccactgcactgtagc

SEQ ID NO: 60866 - DNA, 20 bp, Artificial Sequence
  chemically synthesized
atcccattaggcttagtgca

SEQ ID NO: 60867 - DNA, 20 bp, Artificial Sequence
  chemically synthesized
ggcttagtgcagggaatgtg

SEQ ID NO: 60868 - DNA, 20 bp, Artificial Sequence
  chemically synthesized
ataacaaaaatgtgaagcca

SEQ ID NO: 60869 - DNA, 20 bp, Artificial Sequence
  chemically synthesized
taggttccaaaggaagaaag

SEQ ID NO: 60870 - DNA, 20 bp, Artificial Sequence
  chemically synthesized
gaagaaagaagagtatagat

SEQ ID NO: 60871 - DNA, 20 bp, Artificial Sequence
  chemically synthesized
agtatagataaggatgacac

SEQ ID NO: 60872 - DNA, 20 bp, Artificial Sequence
  chemically synthesized
caaggctgtggctgtcacag

SEQ ID NO: 60873 - DNA, 20 bp, Artificial Sequence
  chemically synthesized
ggagaacttaatggtaaaca

SEQ ID NO: 60874 - DNA, 20 bp, Artificial Sequence
  chemically synthesized
aacaaagggtccccagggct

SEQ ID NO: 60875 - DNA, 20 bp, Artificial Sequence
  chemically synthesized
cccgtcgttttccagagagg

SEQ ID NO: 60876 - DNA, 20 bp, Artificial Sequence
  chemically synthesized
ggtcggatgtagtatatgaa

SEQ ID NO: 60877 - DNA, 20 bp, Artificial Sequence
  chemically synthesized
caaagctctctacttcatct

SEQ ID NO: 60878 - DNA, 20 bp, Artificial Sequence
  chemically synthesized
cccagactatgctacagaac

SEQ ID NO: 60879 - DNA, 20 bp, Artificial Sequence
  chemically synthesized
ttaaatagggcatggttgat

SEQ ID NO: 60880 - DNA, 20 bp, Artificial Sequence
  chemically synthesized
atggttgattagagttgtgt

SEQ ID NO: 60881 - DNA, 20 bp, Artificial Sequence
  chemically synthesized
agaagtggcaccaccttaca

SEQ ID NO: 60882 - DNA, 20 bp, Artificial Sequence
  chemically synthesized
aagtaactggttgttagggc

SEQ ID NO: 60883 - DNA, 20 bp, Artificial Sequence
  chemically synthesized
ttgttagggccagagtgtag

SEQ ID NO: 60884 - DNA, 20 bp, Artificial Sequence
  chemically synthesized
gggccagagtgtaggagagt

SEQ ID NO: 60885 - DNA, 20 bp, Artificial Sequence
  chemically synthesized
ataggacaagatgcagagag

SEQ ID NO: 60886 - DNA, 20 bp, Artificial Sequence
  chemically synthesized
atgattttagcctatttcac

SEQ ID NO: 60887 - DNA, 20 bp, Artificial Sequence
  chemically synthesized
tggcaattatattaatattt

SEQ ID NO: 60888 - DNA, 20 bp, Artificial Sequence
  chemically synthesized
ctgagctatgaagactaatt

SEQ ID NO: 60889 - DNA, 20 bp, Artificial Sequence
  chemically synthesized
gaaaggtatttccaaaaagg

SEQ ID NO: 60890 - DNA, 20 bp, Artificial Sequence
  chemically synthesized
tgatcaaatataacatttaa

SEQ ID NO: 60891 - DNA, 20 bp, Artificial Sequence
  chemically synthesized
atttaagagagttaatacct

SEQ ID NO: 60892 - DNA, 20 bp, Artificial Sequence
  chemically synthesized
aggtaggcaggggcaagacc

SEQ ID NO: 60893 - DNA, 20 bp, Artificial Sequence
  chemically synthesized
aggcaggggcaagaccctga

SEQ ID NO: 60894 - DNA, 20 bp, Artificial Sequence
  chemically synthesized
catggtacacattttgatgg

SEQ ID NO: 60895 - DNA, 20 bp, Artificial Sequence
  chemically synthesized
gagataacaatcatattttc

SEQ ID NO: 60896 - DNA, 20 bp, Artificial Sequence
  chemically synthesized
cattgttaacaatatgcagg

SEQ ID NO: 60897 - DNA, 20 bp, Artificial Sequence
  chemically synthesized
tgttattttggtgtatggag

SEQ ID NO: 60898 - DNA, 20 bp, Artificial Sequence
  chemically synthesized
tagataaacaatactgttta

SEQ ID NO: 60899 - DNA, 20 bp, Artificial Sequence
  chemically synthesized
tagctttatattctatttct

SEQ ID NO: 60900 - DNA, 20 bp, Artificial Sequence
  chemically synthesized
ttgcctttatgaagctcaca

SEQ ID NO: 60901 - DNA, 20 bp, Artificial Sequence
  chemically synthesized
gttcaacgaagtttccaaaa

SEQ ID NO: 60902 - DNA, 20 bp, Artificial Sequence
  chemically synthesized
tgaagcctggaggccaagag

SEQ ID NO: 60903 - DNA, 20 bp, Artificial Sequence
  chemically synthesized
tcggacctatctctatcact

SEQ ID NO: 60904 - DNA, 20 bp, Artificial Sequence
  chemically synthesized
ctatcactgtgggtaatcat

SEQ ID NO: 60905 - DNA, 20 bp, Artificial Sequence
  chemically synthesized
tcatgcgaatattaggtgaa

SEQ ID NO: 60906 - DNA, 20 bp, Artificial Sequence
  chemically synthesized
gaatattaggtgaagtgaat

SEQ ID NO: 60907 - DNA, 20 bp, Artificial Sequence
  chemically synthesized
ggccttaacctttaaggtat

SEQ ID NO: 60908 - DNA, 20 bp, Artificial Sequence
  chemically synthesized
ggtattagaattcattatta

SEQ ID NO: 60909 - DNA, 20 bp, Artificial Sequence
  chemically synthesized
gagcgacagagagagagagg

SEQ ID NO: 60910 - DNA, 20 bp, Artificial Sequence
  chemically synthesized
cagagagagagaggtggggt

SEQ ID NO: 60911 - DNA, 20 bp, Artificial Sequence
  chemically synthesized
gaggtggggtgggggtatgg

SEQ ID NO: 60912 - DNA, 20 bp, Artificial Sequence
  chemically synthesized
ttatttaaggaacctctatc

SEQ ID NO: 60913 - DNA, 20 bp, Artificial Sequence
  chemically synthesized
aggagattccttcaggagaa

SEQ ID NO: 60914 - DNA, 20 bp, Artificial Sequence
  chemically synthesized
ccagggggagcattcagccc

SEQ ID NO: 60915 - DNA, 20 bp, Artificial Sequence
  chemically synthesized
aaccagttcattcttccttt

SEQ ID NO: 60916 - DNA, 20 bp, Artificial Sequence
  chemically synthesized
ctaaataaaatccttactca

SEQ ID NO: 60917 - DNA, 20 bp, Artificial Sequence
  chemically synthesized
ttttgtggtgtgagatcgat

SEQ ID NO: 60918 - DNA, 20 bp, Artificial Sequence
  chemically synthesized
ctggagagacccacagaagt

SEQ ID NO: 60919 - DNA, 20 bp, Artificial Sequence
  chemically synthesized
acagaagttaggattgccaa

SEQ ID NO: 60920 - DNA, 20 bp, Artificial Sequence
  chemically synthesized
cctgcatctgtgtgtgcaca

SEQ ID NO: 60921 - DNA, 20 bp, Artificial Sequence
  chemically synthesized
catattttgatttgctataa

SEQ ID NO: 60922 - DNA, 20 bp, Artificial Sequence
  chemically synthesized
gatttgctataacagagtac

SEQ ID NO: 60923 - DNA, 20 bp, Artificial Sequence
  chemically synthesized
ctataacagagtacctgagt

SEQ ID NO: 60924 - DNA, 20 bp, Artificial Sequence
  chemically synthesized
ctgtccaccatatgtgaaat

SEQ ID NO: 60925 - DNA, 20 bp, Artificial Sequence
  chemically synthesized
attctaaaaggaaacaaaaa

SEQ ID NO: 60926 - DNA, 20 bp, Artificial Sequence
  chemically synthesized
aatggattaaacgttttttg

SEQ ID NO: 60927 - DNA, 20 bp, Artificial Sequence
  chemically synthesized
gttttttgaggaattattga

SEQ ID NO: 60928 - DNA, 20 bp, Artificial Sequence
  chemically synthesized
tattattatactttaagatt

SEQ ID NO: 60929 - DNA, 20 bp, Artificial Sequence
  chemically synthesized
ccccaccccacaacagtccc

SEQ ID NO: 60930 - DNA, 20 bp, Artificial Sequence
  chemically synthesized
tcattgttcagttcccatct

SEQ ID NO: 60931 - DNA, 20 bp, Artificial Sequence
  chemically synthesized
ttcagttcccatctatgagt

SEQ ID NO: 60932 - DNA, 20 bp, Artificial Sequence
  chemically synthesized
tgtccttgcgatagtttact

SEQ ID NO: 60933 - DNA, 20 bp, Artificial Sequence
  chemically synthesized
agtctatcattgttggacat

SEQ ID NO: 60934 - DNA, 20 bp, Artificial Sequence
  chemically synthesized
ggttccaagtctttgctatt

SEQ ID NO: 60935 - DNA, 20 bp, Artificial Sequence
  chemically synthesized
gcagcatgatttatattcct

SEQ ID NO: 60936 - DNA, 20 bp, Artificial Sequence
  chemically synthesized
tttgggtatatacccagtaa

SEQ ID NO: 60937 - DNA, 20 bp, Artificial Sequence
  chemically synthesized
tatacccagtaatgggatgg

SEQ ID NO: 60938 - DNA, 20 bp, Artificial Sequence
  chemically synthesized
tttctagttctagatccctg

SEQ ID NO: 60939 - DNA, 20 bp, Artificial Sequence
  chemically synthesized
aactagtttacagtcccacc

SEQ ID NO: 60940 - DNA, 20 bp, Artificial Sequence
  chemically synthesized
tttttttcttgtaaatttgt

SEQ ID NO: 60941 - DNA, 20 bp, Artificial Sequence
  chemically synthesized
gtttgagttcattatagatt

SEQ ID NO: 60942 - DNA, 20 bp, Artificial Sequence
  chemically synthesized
ggatattagccctttgtcag

SEQ ID NO: 60943 - DNA, 20 bp, Artificial Sequence
  chemically synthesized
agtttcattagatcccatta

SEQ ID NO: 60944 - DNA, 20 bp, Artificial Sequence
  chemically synthesized
tccttgcccatgcctatgtc

SEQ ID NO: 60945 - DNA, 20 bp, Artificial Sequence
  chemically synthesized
gtaatgcctgcgttttcttc

SEQ ID NO: 60946 - DNA, 20 bp, Artificial Sequence
  chemically synthesized
gtttaagtctttaatccatc

SEQ ID NO: 60947 - DNA, 20 bp, Artificial Sequence
  chemically synthesized
ttttgtataaggtgtaagga

SEQ ID NO: 60948 - DNA, 20 bp, Artificial Sequence
  chemically synthesized
ccagcaccatttattaaata

SEQ ID NO: 60949 - DNA, 20 bp, Artificial Sequence
  chemically synthesized
ccagctttgttcttttggct

SEQ ID NO: 60950 - DNA, 20 bp, Artificial Sequence
  chemically synthesized
aaaatcattggtagcttgat

SEQ ID NO: 60951 - DNA, 20 bp, Artificial Sequence
  chemically synthesized
gtagcttgatggggatggca

SEQ ID NO: 60952 - DNA, 20 bp, Artificial Sequence
  chemically synthesized
attcttcctacccataagca

SEQ ID NO: 60953 - DNA, 20 bp, Artificial Sequence
  chemically synthesized
tccttcacatcccttgtaag

SEQ ID NO: 60954 - DNA, 20 bp, Artificial Sequence
  chemically synthesized
ttattctctttgaagcaatt

SEQ ID NO: 60955 - DNA, 20 bp, Artificial Sequence
  chemically synthesized
tctttgaagcaattgtgaat

SEQ ID NO: 60956 - DNA, 20 bp, Artificial Sequence
  chemically synthesized
tttgtctgttattggtgtat

SEQ ID NO: 60957 - DNA, 20 bp, Artificial Sequence
  chemically synthesized
gagattttgggctgagacaa

SEQ ID NO: 60958 - DNA, 20 bp, Artificial Sequence
  chemically synthesized
ttgacttcctcttttcttaa

SEQ ID NO: 60959 - DNA, 20 bp, Artificial Sequence
  chemically synthesized
ccagaacttccaacactatg

SEQ ID NO: 60960 - DNA, 20 bp, Artificial Sequence
  chemically synthesized
cttccaacactatgttgaat

SEQ ID NO: 60961 - DNA, 20 bp, Artificial Sequence
  chemically synthesized
gtcttgtgccagtttacaaa

SEQ ID NO: 60962 - DNA, 20 bp, Artificial Sequence
  chemically synthesized
cattcagtatgatattggct

SEQ ID NO: 60963 - DNA, 20 bp, Artificial Sequence
  chemically synthesized
tattgaaagtttttagcatg

SEQ ID NO: 60964 - DNA, 20 bp, Artificial Sequence
  chemically synthesized
gtttttagcatgaagggttg

SEQ ID NO: 60965 - DNA, 20 bp, Artificial Sequence
  chemically synthesized
tctttggttctgtttatatg

SEQ ID NO: 60966 - DNA, 20 bp, Artificial Sequence
  chemically synthesized
ttgaaccagccttgcatccc

SEQ ID NO: 60967 - DNA, 20 bp, Artificial Sequence
  chemically synthesized
atgaagtccacttgatcatc

SEQ ID NO: 60968 - DNA, 20 bp, Artificial Sequence
  chemically synthesized
ataagctttttgatgtgctg

SEQ ID NO: 60969 - DNA, 20 bp, Artificial Sequence
  chemically synthesized
cggtttgccagtattttatt

SEQ ID NO: 60970 - DNA, 20 bp, Artificial Sequence
  chemically synthesized
tttttgcatcgatgttcatc

SEQ ID NO: 60971 - DNA, 20 bp, Artificial Sequence
  chemically synthesized
tctctttctggctttggtat

SEQ ID NO: 60972 - DNA, 20 bp, Artificial Sequence
  chemically synthesized
gatgatgctggcctcataaa

SEQ ID NO: 60973 - DNA, 20 bp, Artificial Sequence
  chemically synthesized
gcctcataaaatgagttagg

SEQ ID NO: 60974 - DNA, 20 bp, Artificial Sequence
  chemically synthesized
ttccttctttttctgttgat

SEQ ID NO: 60975 - DNA, 20 bp, Artificial Sequence
  chemically synthesized
ttgattggaatagtttcaga

SEQ ID NO: 60976 - DNA, 20 bp, Artificial Sequence
  chemically synthesized
attcctccttgtacctctgt

SEQ ID NO: 60977 - DNA, 20 bp, Artificial Sequence
  chemically synthesized
acctctgttagaatttggct

SEQ ID NO: 60978 - DNA, 20 bp, Artificial Sequence
  chemically synthesized
acttcttcctggtttagtct

SEQ ID NO: 60979 - DNA, 20 bp, Artificial Sequence
  chemically synthesized
ttgggatagtgtatgtgtcc

SEQ ID NO: 60980 - DNA, 20 bp, Artificial Sequence
  chemically synthesized
gatggcagtttgtatttctg

SEQ ID NO: 60981 - DNA, 20 bp, Artificial Sequence
  chemically synthesized
ccagattcattaattttttg

SEQ ID NO: 60982 - DNA, 20 bp, Artificial Sequence
  chemically synthesized
ttcttgacttctgctagctt

SEQ ID NO: 60983 - DNA, 20 bp, Artificial Sequence
  chemically synthesized
agttcttttaattgtgatgt

SEQ ID NO: 60984 - DNA, 20 bp, Artificial Sequence
  chemically synthesized
gtgatgttagggtgtcaatt

SEQ ID NO: 60985 - DNA, 20 bp, Artificial Sequence
  chemically synthesized
atttccccctacacactgat

SEQ ID NO: 60986 - DNA, 20 bp, Artificial Sequence
  chemically synthesized
gttgttcagtttccatgtag

SEQ ID NO: 60987 - DNA, 20 bp, Artificial Sequence
  chemically synthesized
ttccatgtagttgagtggtt

SEQ ID NO: 60988 - DNA, 20 bp, Artificial Sequence
  chemically synthesized
atgtagttgagtggttttga

SEQ ID NO: 60989 - DNA, 20 bp, Artificial Sequence
  chemically synthesized
tttgagtgagtttcttaatc

SEQ ID NO: 60990 - DNA, 20 bp, Artificial Sequence
  chemically synthesized
tccaagtatgtggtcaattt

SEQ ID NO: 60991 - DNA, 20 bp, Artificial Sequence
  chemically synthesized
aaatgtatattctgttgatt

SEQ ID NO: 60992 - DNA, 20 bp, Artificial Sequence
  chemically synthesized
tattctgttgatttggggtg

SEQ ID NO: 60993 - DNA, 20 bp, Artificial Sequence
  chemically synthesized
tgcagagctgtgttcaattc

SEQ ID NO: 60994 - DNA, 20 bp, Artificial Sequence
  chemically synthesized
gatctgtctaatgttgacag

SEQ ID NO: 60995 - DNA, 20 bp, Artificial Sequence
  chemically synthesized
gtctcccattattaaagtgt

SEQ ID NO: 60996 - DNA, 20 bp, Artificial Sequence
  chemically synthesized
ggtctctaaggacttgcttt

SEQ ID NO: 60997 - DNA, 20 bp, Artificial Sequence
  chemically synthesized
taaggacttgctttatgaat

SEQ ID NO: 60998 - DNA, 20 bp, Artificial Sequence
  chemically synthesized
tgaatctgggtgctcctgta

SEQ ID NO: 60999 - DNA, 20 bp, Artificial Sequence
  chemically synthesized
gtattgggtgcatatatatt

SEQ ID NO: 61000 - DNA, 20 bp, Artificial Sequence
  chemically synthesized
aggatagttagctcttcttg

SEQ ID NO: 61001 - DNA, 20 bp, Artificial Sequence
  chemically synthesized
aagcctgttttatcagagac

SEQ ID NO: 61002 - DNA, 20 bp, Artificial Sequence
  chemically synthesized
tgtgtgtgtgtgcacatgag

SEQ ID NO: 61003 - DNA, 20 bp, Artificial Sequence
  chemically synthesized
gtgcacatgagatgggtttc

SEQ ID NO: 61004 - DNA, 20 bp, Artificial Sequence
  chemically synthesized
ttaaagttaatattgtatgt

SEQ ID NO: 61005 - DNA, 20 bp, Artificial Sequence
  chemically synthesized
acttatgaagcttagtttgg

SEQ ID NO: 61006 - DNA, 20 bp, Artificial Sequence
  chemically synthesized
tgttgaaaattctttccttt

SEQ ID NO: 61007 - DNA, 20 bp, Artificial Sequence
  chemically synthesized
aattctttcctttaaggatg

SEQ ID NO: 61008 - DNA, 20 bp, Artificial Sequence
  chemically synthesized
ccccactctcttctggcttg

SEQ ID NO: 61009 - DNA, 20 bp, Artificial Sequence
  chemically synthesized
agtctgatgggcttcccttt

SEQ ID NO: 61010 - DNA, 20 bp, Artificial Sequence
  chemically synthesized
tttccttcatttcaactttg

SEQ ID NO: 61011 - DNA, 20 bp, Artificial Sequence
  chemically synthesized
aatctgacaattatgtgtct

SEQ ID NO: 61012 - DNA, 20 bp, Artificial Sequence
  chemically synthesized
tcttggagttgctcttctcg

SEQ ID NO: 61013 - DNA, 20 bp, Artificial Sequence
  chemically synthesized
tgtggcgttctctgtatttc

SEQ ID NO: 61014 - DNA, 20 bp, Artificial Sequence
  chemically synthesized
gttctctgtatttcctgaat

SEQ ID NO: 61015 - DNA, 20 bp, Artificial Sequence
  chemically synthesized
gctagattggggaagttctc

SEQ ID NO: 61016 - DNA, 20 bp, Artificial Sequence
  chemically synthesized
ttctcctggataatatcctg

SEQ ID NO: 61017 - DNA, 20 bp, Artificial Sequence
  chemically synthesized
ttatcttctttgcctttggt

SEQ ID NO: 61018 - DNA, 20 bp, Artificial Sequence
  chemically synthesized
ttgaatttcctcctgtagct

SEQ ID NO: 61019 - DNA, 20 bp, Artificial Sequence
  chemically synthesized
aggaaaggtgctctgctttt

SEQ ID NO: 61020 - DNA, 20 bp, Artificial Sequence
  chemically synthesized
ttgatgatagtgatgtaccg

SEQ ID NO: 61021 - DNA, 20 bp, Artificial Sequence
  chemically synthesized
tgtaccgatgggtttttggt

SEQ ID NO: 61022 - DNA, 20 bp, Artificial Sequence
  chemically synthesized
accctcagctgcaggtctgt

SEQ ID NO: 61023 - DNA, 20 bp, Artificial Sequence
  chemically synthesized
ccactccagaccctgtttgc

SEQ ID NO: 61024 - DNA, 20 bp, Artificial Sequence
  chemically synthesized
accgcagattttcgtgatcc

SEQ ID NO: 61025 - DNA, 20 bp, Artificial Sequence
  chemically synthesized
ctctggaagttttgtctcag

SEQ ID NO: 61026 - DNA, 20 bp, Artificial Sequence
  chemically synthesized
gtgtcagtctgcccttactt

SEQ ID NO: 61027 - DNA, 20 bp, Artificial Sequence
  chemically synthesized
gcctcccagttaggctgctc

SEQ ID NO: 61028 - DNA, 20 bp, Artificial Sequence
  chemically synthesized
agttaggctgctcgggggtc

SEQ ID NO: 61029 - DNA, 20 bp, Artificial Sequence
  chemically synthesized
caggcctccttgagctgtgg

SEQ ID NO: 61030 - DNA, 20 bp, Artificial Sequence
  chemically synthesized
aggaccctcggagccatgtg

SEQ ID NO: 61031 - DNA, 20 bp, Artificial Sequence
  chemically synthesized
ctgtcagaaaagcacagtat

SEQ ID NO: 61032 - DNA, 20 bp, Artificial Sequence
  chemically synthesized
gaaaagcacagtattcgggt

SEQ ID NO: 61033 - DNA, 20 bp, Artificial Sequence
  chemically synthesized
atctctatacatgttcttcc

SEQ ID NO: 61034 - DNA, 20 bp, Artificial Sequence
  chemically synthesized
atttatgtctttaatctatt

SEQ ID NO: 61035 - DNA, 20 bp, Artificial Sequence
  chemically synthesized
ccaattttattcttttgcat

SEQ ID NO: 61036 - DNA, 20 bp, Artificial Sequence
  chemically synthesized
attgtgttggtggccttgtt

SEQ ID NO: 61037 - DNA, 20 bp, Artificial Sequence
  chemically synthesized
caagattgttttggccattt

SEQ ID NO: 61038 - DNA, 20 bp, Artificial Sequence
  chemically synthesized
aacctaagtaaaaatgggca

SEQ ID NO: 61039 - DNA, 20 bp, Artificial Sequence
  chemically synthesized
agtaaaaatgggcaaaggat

SEQ ID NO: 61040 - DNA, 20 bp, Artificial Sequence
  chemically synthesized
tatcaaaaaagacaagagat

SEQ ID NO: 61041 - DNA, 20 bp, Artificial Sequence
  chemically synthesized
aactcttgtgcatagctggt

SEQ ID NO: 61042 - DNA, 20 bp, Artificial Sequence
  chemically synthesized
gtttctcaaacaactaaaaa

SEQ ID NO: 61043 - DNA, 20 bp, Artificial Sequence
  chemically synthesized
gccttaaaaaaggagatggg

SEQ ID NO: 61044 - DNA, 20 bp, Artificial Sequence
  chemically synthesized
atggggggaatgtataaacc

SEQ ID NO: 61045 - DNA, 20 bp, Artificial Sequence
  chemically synthesized
ggcatgatattacttatatg

SEQ ID NO: 61046 - DNA, 20 bp, Artificial Sequence
  chemically synthesized
gttataaacttgcagctgta

SEQ ID NO: 61047 - DNA, 20 bp, Artificial Sequence
  chemically synthesized
ctatggaaggtgttgtattg

SEQ ID NO: 61048 - DNA, 20 bp, Artificial Sequence
  chemically synthesized
atttctgtttcctaattgtt

SEQ ID NO: 61049 - DNA, 20 bp, Artificial Sequence
  chemically synthesized
cttaaaacttatgtaaccct

SEQ ID NO: 61050 - DNA, 20 bp, Artificial Sequence
  chemically synthesized
atacagctatcactgtctct

SEQ ID NO: 61051 - DNA, 20 bp, Artificial Sequence
  chemically synthesized
tatatctccggcctacaact

SEQ ID NO: 61052 - DNA, 20 bp, Artificial Sequence
  chemically synthesized
ttaaatgtttatgagccaca

SEQ ID NO: 61053 - DNA, 20 bp, Artificial Sequence
  chemically synthesized
gtttatgagccacagagaat

SEQ ID NO: 61054 - DNA, 20 bp, Artificial Sequence
  chemically synthesized
atttttttgaacttctgtgt

SEQ ID NO: 61055 - DNA, 20 bp, Artificial Sequence
  chemically synthesized
gggaaaggtgctgtgtggct

SEQ ID NO: 61056 - DNA, 20 bp, Artificial Sequence
  chemically synthesized
gtggcttagagtataaacat

SEQ ID NO: 61057 - DNA, 20 bp, Artificial Sequence
  chemically synthesized
agaatgtgctatggactttc

SEQ ID NO: 61058 - DNA, 20 bp, Artificial Sequence
  chemically synthesized
tcagtgcccttgtatatcct

SEQ ID NO: 61059 - DNA, 20 bp, Artificial Sequence
  chemically synthesized
gtatatcctcagaatgtgtg

SEQ ID NO: 61060 - DNA, 20 bp, Artificial Sequence
  chemically synthesized
tagctagggctagcagaagg

SEQ ID NO: 61061 - DNA, 20 bp, Artificial Sequence
  chemically synthesized
tcttggaaaaaccagtccct

SEQ ID NO: 61062 - DNA, 20 bp, Artificial Sequence
  chemically synthesized
atacaagcttcataggaaca

SEQ ID NO: 61063 - DNA, 20 bp, Artificial Sequence
  chemically synthesized
tattcatttctaaacacaga

SEQ ID NO: 61064 - DNA, 20 bp, Artificial Sequence
  chemically synthesized
aagggagaaagacagaaagt

SEQ ID NO: 61065 - DNA, 20 bp, Artificial Sequence
  chemically synthesized
gaaagtaagaatgaaagaaa

SEQ ID NO: 61066 - DNA, 20 bp, Artificial Sequence
  chemically synthesized
gaaagaaagagagtgagata

SEQ ID NO: 61067 - DNA, 20 bp, Artificial Sequence
  chemically synthesized
acaaatgatcctctgaagat

SEQ ID NO: 61068 - DNA, 20 bp, Artificial Sequence
  chemically synthesized
aacattcaaaccttcaactt

SEQ ID NO: 61069 - DNA, 20 bp, Artificial Sequence
  chemically synthesized
cttgttgatacagattgaca

SEQ ID NO: 61070 - DNA, 20 bp, Artificial Sequence
  chemically synthesized
tctttccccactgcctttcc

SEQ ID NO: 61071 - DNA, 20 bp, Artificial Sequence
  chemically synthesized
ttaacaactgttgacttatt

SEQ ID NO: 61072 - DNA, 20 bp, Artificial Sequence
  chemically synthesized
cagccaataggactatttat

SEQ ID NO: 61073 - DNA, 20 bp, Artificial Sequence
  chemically synthesized
aaagggaaattatctccagg

SEQ ID NO: 61074 - DNA, 20 bp, Artificial Sequence
  chemically synthesized
tccagggaggatagaaaggt

SEQ ID NO: 61075 - DNA, 20 bp, Artificial Sequence
  chemically synthesized
tactttatatttaatataca

SEQ ID NO: 61076 - DNA, 20 bp, Artificial Sequence
  chemically synthesized
aattatatcatagacatatt

SEQ ID NO: 61077 - DNA, 20 bp, Artificial Sequence
  chemically synthesized
tcatagacatatttaggata

SEQ ID NO: 61078 - DNA, 20 bp, Artificial Sequence
  chemically synthesized
tatataaaaagtctgtttca

SEQ ID NO: 61079 - DNA, 20 bp, Artificial Sequence
  chemically synthesized
tagggactcaggttatatgt

SEQ ID NO: 61080 - DNA, 20 bp, Artificial Sequence
  chemically synthesized
gactcaggttatatgtgtga

SEQ ID NO: 61081 - DNA, 20 bp, Artificial Sequence
  chemically synthesized
caggttatatgtgtgaatgg

SEQ ID NO: 61082 - DNA, 20 bp, Artificial Sequence
  chemically synthesized
atgtgtgaatggatgaataa

SEQ ID NO: 61083 - DNA, 20 bp, Artificial Sequence
  chemically synthesized
gtgaatggatgaataaatga

SEQ ID NO: 61084 - DNA, 20 bp, Artificial Sequence
  chemically synthesized
cttcaaaggcactcatcttg

SEQ ID NO: 61085 - DNA, 20 bp, Artificial Sequence
  chemically synthesized
aaaggcactcatcttggtga

SEQ ID NO: 61086 - DNA, 20 bp, Artificial Sequence
  chemically synthesized
tgacacacaatttaggcttc

SEQ ID NO: 61087 - DNA, 20 bp, Artificial Sequence
  chemically synthesized
aaacctctcttaatccacat

SEQ ID NO: 61088 - DNA, 20 bp, Artificial Sequence
  chemically synthesized
cagttttaaagcataatatt

SEQ ID NO: 61089 - DNA, 20 bp, Artificial Sequence
  chemically synthesized
tactatgctctgctttctca

SEQ ID NO: 61090 - DNA, 20 bp, Artificial Sequence
  chemically synthesized
ctttctcacaggatgcatgt

SEQ ID NO: 61091 - DNA, 20 bp, Artificial Sequence
  chemically synthesized
aaaacacaaagtctttatgt

SEQ ID NO: 61092 - DNA, 20 bp, Artificial Sequence
  chemically synthesized
ttttctttgtcagagctaga

SEQ ID NO: 61093 - DNA, 20 bp, Artificial Sequence
  chemically synthesized
cattaaaataattcaaccat

SEQ ID NO: 61094 - DNA, 20 bp, Artificial Sequence
  chemically synthesized
attggtatccccacttaaag

SEQ ID NO: 61095 - DNA, 20 bp, Artificial Sequence
  chemically synthesized
aaagataaattgctttgcta

SEQ ID NO: 61096 - DNA, 20 bp, Artificial Sequence
  chemically synthesized
cgcagccaataagtggaagg

SEQ ID NO: 61097 - DNA, 20 bp, Artificial Sequence
  chemically synthesized
gaagcctacagaacacttaa

SEQ ID NO: 61098 - DNA, 20 bp, Artificial Sequence
  chemically synthesized
tggttgaagatgcaacaaat

SEQ ID NO: 61099 - DNA, 20 bp, Artificial Sequence
  chemically synthesized
cagaggaaaaaacaaagaaa

SEQ ID NO: 61100 - DNA, 20 bp, Artificial Sequence
  chemically synthesized
aaaaacaaagaaagagagtt

SEQ ID NO: 61101 - DNA, 20 bp, Artificial Sequence
  chemically synthesized
aaagagagttctgagtgagc

SEQ ID NO: 61102 - DNA, 20 bp, Artificial Sequence
  chemically synthesized
agcaaagaaccaagtgaagc

SEQ ID NO: 61103 - DNA, 20 bp, Artificial Sequence
  chemically synthesized
agtgaagcttgggttagttg

SEQ ID NO: 61104 - DNA, 20 bp, Artificial Sequence
  chemically synthesized
ctggtagaagtgaaactttg

SEQ ID NO: 61105 - DNA, 20 bp, Artificial Sequence
  chemically synthesized
gtctgattcctcacaaactg

SEQ ID NO: 61106 - DNA, 20 bp, Artificial Sequence
  chemically synthesized
ttcctcacaaactgctgagt

SEQ ID NO: 61107 - DNA, 20 bp, Artificial Sequence
  chemically synthesized
aagtgaaaaaaaatacattt

SEQ ID NO: 61108 - DNA, 20 bp, Artificial Sequence
  chemically synthesized
attgtgcaagtgcctctatt

SEQ ID NO: 61109 - DNA, 20 bp, Artificial Sequence
  chemically synthesized
aactccatcttaaataggag

SEQ ID NO: 61110 - DNA, 20 bp, Artificial Sequence
  chemically synthesized
aagttaggcattctcagtca

SEQ ID NO: 61111 - DNA, 20 bp, Artificial Sequence
  chemically synthesized
caccaaaccaagattgtgat

SEQ ID NO: 61112 - DNA, 20 bp, Artificial Sequence
  chemically synthesized
gcggtctgaaaaggggaggc

SEQ ID NO: 61113 - DNA, 20 bp, Artificial Sequence
  chemically synthesized
cctcaggactgttctgccta

SEQ ID NO: 61114 - DNA, 20 bp, Artificial Sequence
  chemically synthesized
acttgctttcacttttctgt

SEQ ID NO: 61115 - DNA, 20 bp, Artificial Sequence
  chemically synthesized
gaaatccaagaaccctctct

SEQ ID NO: 61116 - DNA, 20 bp, Artificial Sequence
  chemically synthesized
caagaaccctctcttagggt

SEQ ID NO: 61117 - DNA, 20 bp, Artificial Sequence
  chemically synthesized
accacattcctgagacttga

SEQ ID NO: 61118 - DNA, 20 bp, Artificial Sequence
  chemically synthesized
gtctttggtctctgctgcta

SEQ ID NO: 61119 - DNA, 20 bp, Artificial Sequence
  chemically synthesized
gcattttcaaactttgggag

SEQ ID NO: 61120 - DNA, 20 bp, Artificial Sequence
  chemically synthesized
aactttgtgcctgttgtctc

SEQ ID NO: 61121 - DNA, 20 bp, Artificial Sequence
  chemically synthesized
attgcacagagacccgtgct

SEQ ID NO: 61122 - DNA, 20 bp, Artificial Sequence
  chemically synthesized
cagagacccgtgcttgggat

SEQ ID NO: 61123 - DNA, 20 bp, Artificial Sequence
  chemically synthesized
taatttttattctaaagact

SEQ ID NO: 61124 - DNA, 20 bp, Artificial Sequence
  chemically synthesized
ctaaagactttgaatctcaa

SEQ ID NO: 61125 - DNA, 20 bp, Artificial Sequence
  chemically synthesized
gcttttgccttccaggctgc

SEQ ID NO: 61126 - DNA, 20 bp, Artificial Sequence
  chemically synthesized
ttttgtatttttattagaga

SEQ ID NO: 61127 - DNA, 20 bp, Artificial Sequence
  chemically synthesized
gcctcagccacccaaagtgc

SEQ ID NO: 61128 - DNA, 20 bp, Artificial Sequence
  chemically synthesized
aaagtgctgggattacaggc

SEQ ID NO: 61129 - DNA, 20 bp, Artificial Sequence
  chemically synthesized
actgtttcttattttgccca

SEQ ID NO: 61130 - DNA, 20 bp, Artificial Sequence
  chemically synthesized
ctgattacctggctgctcca

SEQ ID NO: 61131 - DNA, 20 bp, Artificial Sequence
  chemically synthesized
ttcagaacccaagaggtaag

SEQ ID NO: 61132 - DNA, 20 bp, Artificial Sequence
  chemically synthesized
gaggtaagcagagttcctct

SEQ ID NO: 61133 - DNA, 20 bp, Artificial Sequence
  chemically synthesized
tctataatgtgctagacaat

SEQ ID NO: 61134 - DNA, 20 bp, Artificial Sequence
  chemically synthesized
gtgggtaatggaggtgatgc

SEQ ID NO: 61135 - DNA, 20 bp, Artificial Sequence
  chemically synthesized
gacaatttaaatgtatcagt

SEQ ID NO: 61136 - DNA, 20 bp, Artificial Sequence
  chemically synthesized
tttaaatgtatcagtttggg

SEQ ID NO: 61137 - DNA, 20 bp, Artificial Sequence
  chemically synthesized
agtttgggttgaataaaatc

SEQ ID NO: 61138 - DNA, 20 bp, Artificial Sequence
  chemically synthesized
atggttgctgactggcagac

SEQ ID NO: 61139 - DNA, 20 bp, Artificial Sequence
  chemically synthesized
tgctgactggcagaccagaa

SEQ ID NO: 61140 - DNA, 20 bp, Artificial Sequence
  chemically synthesized
tggttcactagatgtttcca

SEQ ID NO: 61141 - DNA, 20 bp, Artificial Sequence
  chemically synthesized
cagttgtgataagctaccac

SEQ ID NO: 61142 - DNA, 20 bp, Artificial Sequence
  chemically synthesized
tattgacacatttggtttta

SEQ ID NO: 61143 - DNA, 20 bp, Artificial Sequence
  chemically synthesized
ccaagattcattgctgtgac

SEQ ID NO: 61144 - DNA, 20 bp, Artificial Sequence
  chemically synthesized
aacacatgctcaggaaggaa

SEQ ID NO: 61145 - DNA, 20 bp, Artificial Sequence
  chemically synthesized
gactttgatcattcactttg

SEQ ID NO: 61146 - DNA, 20 bp, Artificial Sequence
  chemically synthesized
gaagagtcttctgtcatatg

SEQ ID NO: 61147 - DNA, 20 bp, Artificial Sequence
  chemically synthesized
aacagcttagagggctgcct

SEQ ID NO: 61148 - DNA, 20 bp, Artificial Sequence
  chemically synthesized
agatattcagagatgcacat

SEQ ID NO: 61149 - DNA, 20 bp, Artificial Sequence
  chemically synthesized
ttcagagatgcacatgagga

SEQ ID NO: 61150 - DNA, 20 bp, Artificial Sequence
  chemically synthesized
gtttattttttcatttaata

SEQ ID NO: 61151 - DNA, 20 bp, Artificial Sequence
  chemically synthesized
tgcttaaagctggcatgtag

SEQ ID NO: 61152 - DNA, 20 bp, Artificial Sequence
  chemically synthesized
cagcaaggagactgaccatt

SEQ ID NO: 61153 - DNA, 20 bp, Artificial Sequence
  chemically synthesized
ttgagaattacaaatatggc

SEQ ID NO: 61154 - DNA, 20 bp, Artificial Sequence
  chemically synthesized
ttgagatacctcttccttta

SEQ ID NO: 61155 - DNA, 20 bp, Artificial Sequence
  chemically synthesized
tcgaccttattgcaaccatg

SEQ ID NO: 61156 - DNA, 20 bp, Artificial Sequence
  chemically synthesized
aggtccacatcacataatat

SEQ ID NO: 61157 - DNA, 20 bp, Artificial Sequence
  chemically synthesized
ccacatcacataatatgtgg

SEQ ID NO: 61158 - DNA, 20 bp, Artificial Sequence
  chemically synthesized
gcttctcctcctttacagaa

SEQ ID NO: 61159 - DNA, 20 bp, Artificial Sequence
  chemically synthesized
cctcctttacagaaatgggt

SEQ ID NO: 61160 - DNA, 20 bp, Artificial Sequence
  chemically synthesized
tttatacctgccatgtcatg

SEQ ID NO: 61161 - DNA, 20 bp, Artificial Sequence
  chemically synthesized
atgtcatgctgagtgggggc

SEQ ID NO: 61162 - DNA, 20 bp, Artificial Sequence
  chemically synthesized
tattgtacactaaatatagt

SEQ ID NO: 61163 - DNA, 20 bp, Artificial Sequence
  chemically synthesized
atatggtccctagtttttaa

SEQ ID NO: 61164 - DNA, 20 bp, Artificial Sequence
  chemically synthesized
actttcccgctttccaataa

SEQ ID NO: 61165 - DNA, 20 bp, Artificial Sequence
  chemically synthesized
acaagcaaatggccaaatgg

SEQ ID NO: 61166 - DNA, 20 bp, Artificial Sequence
  chemically synthesized
tgcttggtttaataaaagta

SEQ ID NO: 61167 - DNA, 20 bp, Artificial Sequence
  chemically synthesized
agtgagtgtacctcatggag

SEQ ID NO: 61168 - DNA, 20 bp, Artificial Sequence
  chemically synthesized
tggcgcttttgtgtgagaga

SEQ ID NO: 61169 - DNA, 20 bp, Artificial Sequence
  chemically synthesized
aggaacaattaattggtgat

SEQ ID NO: 61170 - DNA, 20 bp, Artificial Sequence
  chemically synthesized
tgtgtgtgtgtgtgtgtgtg

SEQ ID NO: 61171 - DNA, 20 bp, Artificial Sequence
  chemically synthesized
gtgtgtgtgtgtgtgagggg

SEQ ID NO: 61172 - DNA, 20 bp, Artificial Sequence
  chemically synthesized
atcattctgttcgtaaaact

SEQ ID NO: 61173 - DNA, 20 bp, Artificial Sequence
  chemically synthesized
ctttgagttttgaagacact

SEQ ID NO: 61174 - DNA, 20 bp, Artificial Sequence
  chemically synthesized
ccttaagctttctctcatgg

SEQ ID NO: 61175 - DNA, 20 bp, Artificial Sequence
  chemically synthesized
aaaacttaatttacaaaagc

SEQ ID NO: 61176 - DNA, 20 bp, Artificial Sequence
  chemically synthesized
agaggacttcaaagcccatg

SEQ ID NO: 61177 - DNA, 20 bp, Artificial Sequence
  chemically synthesized
aatcagatgggggaagacag

SEQ ID NO: 61178 - DNA, 20 bp, Artificial Sequence
  chemically synthesized
cttcgtagttgattatggct

SEQ ID NO: 61179 - DNA, 20 bp, Artificial Sequence
  chemically synthesized
gcatccagcaccattttcat

SEQ ID NO: 61180 - DNA, 20 bp, Artificial Sequence
  chemically synthesized
cccatcccccgacagaaaca

SEQ ID NO: 61181 - DNA, 20 bp, Artificial Sequence
  chemically synthesized
gatccactatcactctctat

SEQ ID NO: 61182 - DNA, 20 bp, Artificial Sequence
  chemically synthesized
gcagtgctgatagctcagca

SEQ ID NO: 61183 - DNA, 20 bp, Artificial Sequence
  chemically synthesized
tctctctgactttggtttat

SEQ ID NO: 61184 - DNA, 20 bp, Artificial Sequence
  chemically synthesized
ggatttgcatacattttctg

SEQ ID NO: 61185 - DNA, 20 bp, Artificial Sequence
  chemically synthesized
tggatactaggctcatttct

SEQ ID NO: 61186 - DNA, 20 bp, Artificial Sequence
  chemically synthesized
actctaacttcatctttttt

SEQ ID NO: 61187 - DNA, 20 bp, Artificial Sequence
  chemically synthesized
aggaaatagataatccaaac

SEQ ID NO: 61188 - DNA, 20 bp, Artificial Sequence
  chemically synthesized
agatatcattctgtattccc

SEQ ID NO: 61189 - DNA, 20 bp, Artificial Sequence
  chemically synthesized
ctaactagatcactctgcta

SEQ ID NO: 61190 - DNA, 20 bp, Artificial Sequence
  chemically synthesized
agggaatgaaaaaggagatc

SEQ ID NO: 61191 - DNA, 20 bp, Artificial Sequence
  chemically synthesized
tctaggattttccctcttct

SEQ ID NO: 61192 - DNA, 20 bp, Artificial Sequence
  chemically synthesized
gccaagttctaaagatttta

SEQ ID NO: 61193 - DNA, 20 bp, Artificial Sequence
  chemically synthesized
taaagattttagggagtctt

SEQ ID NO: 61194 - DNA, 20 bp, Artificial Sequence
  chemically synthesized
gcctctaggccaagacacac

SEQ ID NO: 61195 - DNA, 20 bp, Artificial Sequence
  chemically synthesized
ccctaagcctggtcaagata

SEQ ID NO: 61196 - DNA, 20 bp, Artificial Sequence
  chemically synthesized
ttctttattctcccagcctg

SEQ ID NO: 61197 - DNA, 20 bp, Artificial Sequence
  chemically synthesized
gggatttagaactttggaac

SEQ ID NO: 61198 - DNA, 20 bp, Artificial Sequence
  chemically synthesized
ttcttcctgcatctaggtta

SEQ ID NO: 61199 - DNA, 20 bp, Artificial Sequence
  chemically synthesized
atttattttaagcatcacat

SEQ ID NO: 61200 - DNA, 20 bp, Artificial Sequence
  chemically synthesized
ggtagaaaagaaaatgtagg

SEQ ID NO: 61201 - DNA, 20 bp, Artificial Sequence
  chemically synthesized
tattattatactttaagttt

SEQ ID NO: 61202 - DNA, 20 bp, Artificial Sequence
  chemically synthesized
tcattgttcaattcccacct

SEQ ID NO: 61203 - DNA, 20 bp, Artificial Sequence
  chemically synthesized
tgtccttgcgatagtttgct

SEQ ID NO: 61204 - DNA, 20 bp, Artificial Sequence
  chemically synthesized
agtctatcattgttggacat

SEQ ID NO: 61205 - DNA, 20 bp, Artificial Sequence
  chemically synthesized
ggttccaagtctttgctatt

SEQ ID NO: 61206 - DNA, 20 bp, Artificial Sequence
  chemically synthesized
gcagcatgatttataatcct

SEQ ID NO: 61207 - DNA, 20 bp, Artificial Sequence
  chemically synthesized
tttgagtatgtacccagtaa

SEQ ID NO: 61208 - DNA, 20 bp, Artificial Sequence
  chemically synthesized
tgtacccagtaatgggatgg

SEQ ID NO: 61209 - DNA, 20 bp, Artificial Sequence
  chemically synthesized
tttctagttctagatccctg

SEQ ID NO: 61210 - DNA, 20 bp, Artificial Sequence
  chemically synthesized
atcctttgcccactttttga

SEQ ID NO: 61211 - DNA, 20 bp, Artificial Sequence
  chemically synthesized
tttttttcttgtaaatttgt

SEQ ID NO: 61212 - DNA, 20 bp, Artificial Sequence
  chemically synthesized
gtttgagttcatcatagatt

SEQ ID NO: 61213 - DNA, 20 bp, Artificial Sequence
  chemically synthesized
ttctggatattagccctttg

SEQ ID NO: 61214 - DNA, 20 bp, Artificial Sequence
  chemically synthesized
ggatattagccctttgtcgg

SEQ ID NO: 61215 - DNA, 20 bp, Artificial Sequence
  chemically synthesized
tccttgcccatgcctatgtc

SEQ ID NO: 61216 - DNA, 20 bp, Artificial Sequence
  chemically synthesized
gtattgcctaggttttcttc

SEQ ID NO: 61217 - DNA, 20 bp, Artificial Sequence
  chemically synthesized
atttaagtctgtaatccatc

SEQ ID NO: 61218 - DNA, 20 bp, Artificial Sequence
  chemically synthesized
ttttgtataaggtgtaagaa

SEQ ID NO: 61219 - DNA, 20 bp, Artificial Sequence
  chemically synthesized
ccagcaccatttattaaata

SEQ ID NO: 61220 - DNA, 20 bp, Artificial Sequence
  chemically synthesized
ccagctttgttcttttggct

SEQ ID NO: 61221 - DNA, 20 bp, Artificial Sequence
  chemically synthesized
aaagtcattggtagcttgat

SEQ ID NO: 61222 - DNA, 20 bp, Artificial Sequence
  chemically synthesized
gtagcttgatggggatggca

SEQ ID NO: 61223 - DNA, 20 bp, Artificial Sequence
  chemically synthesized
attcttcctacccatgagca

SEQ ID NO: 61224 - DNA, 20 bp, Artificial Sequence
  chemically synthesized
tccttcacctctcttgtaag

SEQ ID NO: 61225 - DNA, 20 bp, Artificial Sequence
  chemically synthesized
ttattctctttgaagcaatt

SEQ ID NO: 61226 - DNA, 20 bp, Artificial Sequence
  chemically synthesized
tctttgaagcaattgtgaat

SEQ ID NO: 61227 - DNA, 20 bp, Artificial Sequence
  chemically synthesized
tttgtctgttattggtgtat

SEQ ID NO: 61228 - DNA, 20 bp, Artificial Sequence
  chemically synthesized
gacattttgggctgagacag

SEQ ID NO: 61229 - DNA, 20 bp, Artificial Sequence
  chemically synthesized
ttgacttcctcttttcctaa

SEQ ID NO: 61230 - DNA, 20 bp, Artificial Sequence
  chemically synthesized
ccagaaattccaacactatg

SEQ ID NO: 61231 - DNA, 20 bp, Artificial Sequence
  chemically synthesized
attccaacactatgttgaat

SEQ ID NO: 61232 - DNA, 20 bp, Artificial Sequence
  chemically synthesized
gtcttgtgccagttttcaaa

SEQ ID NO: 61233 - DNA, 20 bp, Artificial Sequence
  chemically synthesized
cattcagtatgatattggct

SEQ ID NO: 61234 - DNA, 20 bp, Artificial Sequence
  chemically synthesized
ccatcaatacctaatttatt

SEQ ID NO: 61235 - DNA, 20 bp, Artificial Sequence
  chemically synthesized
tattgagagtttttagcatg

SEQ ID NO: 61236 - DNA, 20 bp, Artificial Sequence
  chemically synthesized
gtttttagcatgaagggttg

SEQ ID NO: 61237 - DNA, 20 bp, Artificial Sequence
  chemically synthesized
tctttggttctgtttatatg

SEQ ID NO: 61238 - DNA, 20 bp, Artificial Sequence
  chemically synthesized
ttgaaccagccttgcatccc

SEQ ID NO: 61239 - DNA, 20 bp, Artificial Sequence
  chemically synthesized
atgaagcccacttgatcatg

SEQ ID NO: 61240 - DNA, 20 bp, Artificial Sequence
  chemically synthesized
tgatcatggtggataagctt

SEQ ID NO: 61241 - DNA, 20 bp, Artificial Sequence
  chemically synthesized
ataagcttttggatgtgctg

SEQ ID NO: 61242 - DNA, 20 bp, Artificial Sequence
  chemically synthesized
tttttgcatcgatgtccatc

SEQ ID NO: 61243 - DNA, 20 bp, Artificial Sequence
  chemically synthesized
tctctgcccggctttggtat

SEQ ID NO: 61244 - DNA, 20 bp, Artificial Sequence
  chemically synthesized
gatgatgctggcctcataaa

SEQ ID NO: 61245 - DNA, 20 bp, Artificial Sequence
  chemically synthesized
gcctcataaaatgagttagg

SEQ ID NO: 61246 - DNA, 20 bp, Artificial Sequence
  chemically synthesized
ttccctcttttactattgat

SEQ ID NO: 61247 - DNA, 20 bp, Artificial Sequence
  chemically synthesized
ttgattcgaatagtttcaga

SEQ ID NO: 61248 - DNA, 20 bp, Artificial Sequence
  chemically synthesized
gctcctccttgtacctctgg

SEQ ID NO: 61249 - DNA, 20 bp, Artificial Sequence
  chemically synthesized
tcttcctggtttagtcttgg

SEQ ID NO: 61250 - DNA, 20 bp, Artificial Sequence
  chemically synthesized
ttgggagggtgtatgtgtca

SEQ ID NO: 61251 - DNA, 20 bp, Artificial Sequence
  chemically synthesized
gatggtggtttgtatttctg

SEQ ID NO: 61252 - DNA, 20 bp, Artificial Sequence
  chemically synthesized
tctttttgaaaaaccagctt

SEQ ID NO: 61253 - DNA, 20 bp, Artificial Sequence
  chemically synthesized
ctggattcattgattttttg

SEQ ID NO: 61254 - DNA, 20 bp, Artificial Sequence
  chemically synthesized
ttcttgccttctgctagcat

SEQ ID NO: 61255 - DNA, 20 bp, Artificial Sequence
  chemically synthesized
agttcttttaattgtgatgt

SEQ ID NO: 61256 - DNA, 20 bp, Artificial Sequence
  chemically synthesized
atttccctctacacactgct

SEQ ID NO: 61257 - DNA, 20 bp, Artificial Sequence
  chemically synthesized
ttccatgtagttgagcggtt

SEQ ID NO: 61258 - DNA, 20 bp, Artificial Sequence
  chemically synthesized
atgtagttgagcggttttga

SEQ ID NO: 61259 - DNA, 20 bp, Artificial Sequence
  chemically synthesized
tttgagtgagtttcttaatc

SEQ ID NO: 61260 - DNA, 20 bp, Artificial Sequence
  chemically synthesized
ctgttcttttacatttgctg

SEQ ID NO: 61261 - DNA, 20 bp, Artificial Sequence
  chemically synthesized
tccaactatgtggtcaattt

SEQ ID NO: 61262 - DNA, 20 bp, Artificial Sequence
  chemically synthesized
aggtgtggtgtggtgctgaa

SEQ ID NO: 61263 - DNA, 20 bp, Artificial Sequence
  chemically synthesized
gaatgtatattctgttgatt

SEQ ID NO: 61264 - DNA, 20 bp, Artificial Sequence
  chemically synthesized
tattctgttgatttggggtg

SEQ ID NO: 61265 - DNA, 20 bp, Artificial Sequence
  chemically synthesized
taggtccgcttggtgcagag

SEQ ID NO: 61266 - DNA, 20 bp, Artificial Sequence
  chemically synthesized
tgcagagctgagttcaattc

SEQ ID NO: 61267 - DNA, 20 bp, Artificial Sequence
  chemically synthesized
gatctgtctaatgttgacag

SEQ ID NO: 61268 - DNA, 20 bp, Artificial Sequence
  chemically synthesized
gtctcccattgttattgtgt

SEQ ID NO: 61269 - DNA, 20 bp, Artificial Sequence
  chemically synthesized
taaggacttgctttatgaac

SEQ ID NO: 61270 - DNA, 20 bp, Artificial Sequence
  chemically synthesized
tgaacctgggtgttcctgta

SEQ ID NO: 61271 - DNA, 20 bp, Artificial Sequence
  chemically synthesized
gtattgggtgcatatatgtt

SEQ ID NO: 61272 - DNA, 20 bp, Artificial Sequence
  chemically synthesized
aggatagttagctcttcttg

SEQ ID NO: 61273 - DNA, 20 bp, Artificial Sequence
  chemically synthesized
aagcctgttttatcagagat

SEQ ID NO: 61274 - DNA, 20 bp, Artificial Sequence
  chemically synthesized
tgtgtgtgtgtgcacatgag

SEQ ID NO: 61275 - DNA, 20 bp, Artificial Sequence
  chemically synthesized
gtgcacatgagatgggtttc

SEQ ID NO: 61276 - DNA, 20 bp, Artificial Sequence
  chemically synthesized
ttcctgaatacagcacactg

SEQ ID NO: 61277 - DNA, 20 bp, Artificial Sequence
  chemically synthesized
taaggttaatattgttatgt

SEQ ID NO: 61278 - DNA, 20 bp, Artificial Sequence
  chemically synthesized
acttatgaagcttagtttgg

SEQ ID NO: 61279 - DNA, 20 bp, Artificial Sequence
  chemically synthesized
tgttgaaaattctttccttt

SEQ ID NO: 61280 - DNA, 20 bp, Artificial Sequence
  chemically synthesized
aattctttcctttaaggatg

SEQ ID NO: 61281 - DNA, 20 bp, Artificial Sequence
  chemically synthesized
ccccactctcttctggcttg

SEQ ID NO: 61282 - DNA, 20 bp, Artificial Sequence
  chemically synthesized
attctgatgggcttcccttt

SEQ ID NO: 61283 - DNA, 20 bp, Artificial Sequence
  chemically synthesized
ttcccttcatttcaactttg

SEQ ID NO: 61284 - DNA, 20 bp, Artificial Sequence
  chemically synthesized
ccttgtagttgctcttctca

SEQ ID NO: 61285 - DNA, 20 bp, Artificial Sequence
  chemically synthesized
tgtggcgttctctgtatttc

SEQ ID NO: 61286 - DNA, 20 bp, Artificial Sequence
  chemically synthesized
gttctctgtatttcctgaat

SEQ ID NO: 61287 - DNA, 20 bp, Artificial Sequence
  chemically synthesized
gctagattggggaagttctc

SEQ ID NO: 61288 - DNA, 20 bp, Artificial Sequence
  chemically synthesized
ttctcctggataatatcctg

SEQ ID NO: 61289 - DNA, 20 bp, Artificial Sequence
  chemically synthesized
ataccctttcttccagttga

SEQ ID NO: 61290 - DNA, 20 bp, Artificial Sequence
  chemically synthesized
ccagttgatcgaatcagcta

SEQ ID NO: 61291 - DNA, 20 bp, Artificial Sequence
  chemically synthesized
aggtttttaacttttttgcc

SEQ ID NO: 61292 - DNA, 20 bp, Artificial Sequence
  chemically synthesized
tcgagcttcctcctttagct

SEQ ID NO: 61293 - DNA, 20 bp, Artificial Sequence
  chemically synthesized
aggagaggcactctgatttt

SEQ ID NO: 61294 - DNA, 20 bp, Artificial Sequence
  chemically synthesized
ttgatgatggtgacgtacag

SEQ ID NO: 61295 - DNA, 20 bp, Artificial Sequence
  chemically synthesized
cgtacagatgggtttttggt

SEQ ID NO: 61296 - DNA, 20 bp, Artificial Sequence
  chemically synthesized
attgacgcctatgtcactac

SEQ ID NO: 61297 - DNA, 20 bp, Artificial Sequence
  chemically synthesized
ataacttttacagatgattt

SEQ ID NO: 61298 - DNA, 20 bp, Artificial Sequence
  chemically synthesized
ttagacagatacaggactgc

SEQ ID NO: 61299 - DNA, 20 bp, Artificial Sequence
  chemically synthesized
acttgaactagttgttgggc

SEQ ID NO: 61300 - DNA, 20 bp, Artificial Sequence
  chemically synthesized
aactagttgttgggctgggg

SEQ ID NO: 61301 - DNA, 20 bp, Artificial Sequence
  chemically synthesized
tgtggagaggacccaaatca

SEQ ID NO: 61302 - DNA, 20 bp, Artificial Sequence
  chemically synthesized
aaatcagtgggtgttgctct

SEQ ID NO: 61303 - DNA, 20 bp, Artificial Sequence
  chemically synthesized
ggtagttttccagtgttagc

SEQ ID NO: 61304 - DNA, 20 bp, Artificial Sequence
  chemically synthesized
gtgttagcaaggatgcatcc

SEQ ID NO: 61305 - DNA, 20 bp, Artificial Sequence
  chemically synthesized
gatgcatccatgagtttttt

SEQ ID NO: 61306 - DNA, 20 bp, Artificial Sequence
  chemically synthesized
ctcagcttcgtcaaggtctc

SEQ ID NO: 61307 - DNA, 20 bp, Artificial Sequence
  chemically synthesized
tgattgcttctaaacatcct

SEQ ID NO: 61308 - DNA, 20 bp, Artificial Sequence
  chemically synthesized
cttctggaggacgttttcct

SEQ ID NO: 61309 - DNA, 20 bp, Artificial Sequence
  chemically synthesized
ggacgttttcctgtgagtgg

SEQ ID NO: 61310 - DNA, 20 bp, Artificial Sequence
  chemically synthesized
gaggggcgggaggaagtggg

SEQ ID NO: 61311 - DNA, 20 bp, Artificial Sequence
  chemically synthesized
aagtggggaggatcatgagg

SEQ ID NO: 61312 - DNA, 20 bp, Artificial Sequence
  chemically synthesized
agaaagggaggagagaaact

SEQ ID NO: 61313 - DNA, 20 bp, Artificial Sequence
  chemically synthesized
cagtcaaatgtgtccattta

SEQ ID NO: 61314 - DNA, 20 bp, Artificial Sequence
  chemically synthesized
tagcctgctatggcaggttt

SEQ ID NO: 61315 - DNA, 20 bp, Artificial Sequence
  chemically synthesized
tttcaggatcactggaccta

SEQ ID NO: 61316 - DNA, 20 bp, Artificial Sequence
  chemically synthesized
aggatcactggacctagagg

SEQ ID NO: 61317 - DNA, 20 bp, Artificial Sequence
  chemically synthesized
ttgatgtggcttagatcccc

SEQ ID NO: 61318 - DNA, 20 bp, Artificial Sequence
  chemically synthesized
aagcccaagggaagaaagaa

SEQ ID NO: 61319 - DNA, 20 bp, Artificial Sequence
  chemically synthesized
tagcagacacacagaaagac

SEQ ID NO: 61320 - DNA, 20 bp, Artificial Sequence
  chemically synthesized
agaagttctgtaatacagta

SEQ ID NO: 61321 - DNA, 20 bp, Artificial Sequence
  chemically synthesized
aaatttcacacacagccaag

SEQ ID NO: 61322 - DNA, 20 bp, Artificial Sequence
  chemically synthesized
ctgtgttatttatacatccc

SEQ ID NO: 61323 - DNA, 20 bp, Artificial Sequence
  chemically synthesized
atccccacctttctgtgatg

SEQ ID NO: 61324 - DNA, 20 bp, Artificial Sequence
  chemically synthesized
aggtgggcagccatagatca

SEQ ID NO: 61325 - DNA, 20 bp, Artificial Sequence
  chemically synthesized
ggcatccagctgactggtca

SEQ ID NO: 61326 - DNA, 20 bp, Artificial Sequence
  chemically synthesized
ataccctgtattttggtcaa

SEQ ID NO: 61327 - DNA, 20 bp, Artificial Sequence
  chemically synthesized
attaatttaaaacttatcat

SEQ ID NO: 61328 - DNA, 20 bp, Artificial Sequence
  chemically synthesized
taaaacttatcatttgagtc

SEQ ID NO: 61329 - DNA, 20 bp, Artificial Sequence
  chemically synthesized
tctcatgcctagactctgaa

SEQ ID NO: 61330 - DNA, 20 bp, Artificial Sequence
  chemically synthesized
tctctctgttcagtagtaac

SEQ ID NO: 61331 - DNA, 20 bp, Artificial Sequence
  chemically synthesized
actatcaagacaatggtcat

SEQ ID NO: 61332 - DNA, 20 bp, Artificial Sequence
  chemically synthesized
ctttccctagactcatcatt

SEQ ID NO: 61333 - DNA, 20 bp, Artificial Sequence
  chemically synthesized
gctccatatatgcaagagaa

SEQ ID NO: 61334 - DNA, 20 bp, Artificial Sequence
  chemically synthesized
gtgacccaaatcatagaccc

SEQ ID NO: 61335 - DNA, 20 bp, Artificial Sequence
  chemically synthesized
ttaaatatatataatagtgt

SEQ ID NO: 61336 - DNA, 20 bp, Artificial Sequence
  chemically synthesized
ccataagctaatcaaacaat

SEQ ID NO: 61337 - DNA, 20 bp, Artificial Sequence
  chemically synthesized
acaaatcagcaatagacagg

SEQ ID NO: 61338 - DNA, 20 bp, Artificial Sequence
  chemically synthesized
aataatgttctaagtagcag

SEQ ID NO: 61339 - DNA, 20 bp, Artificial Sequence
  chemically synthesized
tgatttccactgaaatgctc

SEQ ID NO: 61340 - DNA, 20 bp, Artificial Sequence
  chemically synthesized
tgtcatcctgtccaggtccc

SEQ ID NO: 61341 - DNA, 20 bp, Artificial Sequence
  chemically synthesized
agtgaaacaatgtcatgctc

SEQ ID NO: 61342 - DNA, 20 bp, Artificial Sequence
  chemically synthesized
atgctctagagtgaggcaga

SEQ ID NO: 61343 - DNA, 20 bp, Artificial Sequence
  chemically synthesized
aataaacgaagtatgccact

SEQ ID NO: 61344 - DNA, 20 bp, Artificial Sequence
  chemically synthesized
agttttaatgctatagataa

SEQ ID NO: 61345 - DNA, 20 bp, Artificial Sequence
  chemically synthesized
ataaaaggtgggaaaaggaa

SEQ ID NO: 61346 - DNA, 20 bp, Artificial Sequence
  chemically synthesized
ggaacatgctttccaaacct

SEQ ID NO: 61347 - DNA, 20 bp, Artificial Sequence
  chemically synthesized
actacagtgacatagaagac

SEQ ID NO: 61348 - DNA, 20 bp, Artificial Sequence
  chemically synthesized
ccaatgcccatgacagtctt

SEQ ID NO: 61349 - DNA, 20 bp, Artificial Sequence
  chemically synthesized
cattgcaaataaaactacaa

SEQ ID NO: 61350 - DNA, 20 bp, Artificial Sequence
  chemically synthesized
ggtgtagacagaaagcatgg

SEQ ID NO: 61351 - DNA, 20 bp, Artificial Sequence
  chemically synthesized
agaaagcatgggagagtaca

SEQ ID NO: 61352 - DNA, 20 bp, Artificial Sequence
  chemically synthesized
cgcacaccaatcttcattac

SEQ ID NO: 61353 - DNA, 20 bp, Artificial Sequence
  chemically synthesized
ttcattacctgggtgttggt

SEQ ID NO: 61354 - DNA, 20 bp, Artificial Sequence
  chemically synthesized
gaggtatatcttaaggggct

SEQ ID NO: 61355 - DNA, 20 bp, Artificial Sequence
  chemically synthesized
acacctgactccatgacaga

SEQ ID NO: 61356 - DNA, 20 bp, Artificial Sequence
  chemically synthesized
gactccatgacagaaagagt

SEQ ID NO: 61357 - DNA, 20 bp, Artificial Sequence
  chemically synthesized
tcattcctgatgagaaagag

SEQ ID NO: 61358 - DNA, 20 bp, Artificial Sequence
  chemically synthesized
gagatgtaggctgccaataa

SEQ ID NO: 61359 - DNA, 20 bp, Artificial Sequence
  chemically synthesized
tgtaggctgccaataatggg

SEQ ID NO: 61360 - DNA, 20 bp, Artificial Sequence
  chemically synthesized
ttgtataaaagttgctcctt

SEQ ID NO: 61361 - DNA, 20 bp, Artificial Sequence
  chemically synthesized
tcctgactttcagtgacagc

SEQ ID NO: 61362 - DNA, 20 bp, Artificial Sequence
  chemically synthesized
agatcctaggtatgggaaaa

SEQ ID NO: 61363 - DNA, 20 bp, Artificial Sequence
  chemically synthesized
tgtataaagaagatattatt

SEQ ID NO: 61364 - DNA, 20 bp, Artificial Sequence
  chemically synthesized
gtttactctatgtaagatta

SEQ ID NO: 61365 - DNA, 20 bp, Artificial Sequence
  chemically synthesized
agattattggatactacgtt

SEQ ID NO: 61366 - DNA, 20 bp, Artificial Sequence
  chemically synthesized
tggggatacagctattcatg

SEQ ID NO: 61367 - DNA, 20 bp, Artificial Sequence
  chemically synthesized
ttcatgcagaataaacattg

SEQ ID NO: 61368 - DNA, 20 bp, Artificial Sequence
  chemically synthesized
gaaagaagaaatcactatat

SEQ ID NO: 61369 - DNA, 20 bp, Artificial Sequence
  chemically synthesized
catcctgactggtggtatta

SEQ ID NO: 61370 - DNA, 20 bp, Artificial Sequence
  chemically synthesized
ctgactggtggtattatagg

SEQ ID NO: 61371 - DNA, 20 bp, Artificial Sequence
  chemically synthesized
tgatgaagctccagagactt

SEQ ID NO: 61372 - DNA, 20 bp, Artificial Sequence
  chemically synthesized
gggtagttagaaaatgacgt

SEQ ID NO: 61373 - DNA, 20 bp, Artificial Sequence
  chemically synthesized
gttattgatacactgcttca

SEQ ID NO: 61374 - DNA, 20 bp, Artificial Sequence
  chemically synthesized
aattttcataatataaattg

SEQ ID NO: 61375 - DNA, 20 bp, Artificial Sequence
  chemically synthesized
tgaagaataaacagtaaaat

SEQ ID NO: 61376 - DNA, 20 bp, Artificial Sequence
  chemically synthesized
gtaatttaggcaagatcaag

SEQ ID NO: 61377 - DNA, 20 bp, Artificial Sequence
  chemically synthesized
gaattttttttttaaaacta

SEQ ID NO: 61378 - DNA, 20 bp, Artificial Sequence
  chemically synthesized
tttaaaactatggaatctga

SEQ ID NO: 61379 - DNA, 20 bp, Artificial Sequence
  chemically synthesized
gagaaggctctgtgactcat

SEQ ID NO: 61380 - DNA, 20 bp, Artificial Sequence
  chemically synthesized
ggtgcaggcagccaacctct

SEQ ID NO: 61381 - DNA, 20 bp, Artificial Sequence
  chemically synthesized
gacctctttctgtccatgaa

SEQ ID NO: 61382 - DNA, 20 bp, Artificial Sequence
  chemically synthesized
tactggactttcattttcag

SEQ ID NO: 61383 - DNA, 20 bp, Artificial Sequence
  chemically synthesized
gtaaggggaaatgttttgta

SEQ ID NO: 61384 - DNA, 20 bp, Artificial Sequence
  chemically synthesized
ggggaaatgttttgtaaaga

SEQ ID NO: 61385 - DNA, 20 bp, Artificial Sequence
  chemically synthesized
acctcctttctctttctcta

SEQ ID NO: 61386 - DNA, 20 bp, Artificial Sequence
  chemically synthesized
tttctctagtgagtacatgt

SEQ ID NO: 61387 - DNA, 20 bp, Artificial Sequence
  chemically synthesized
gaacagatataagatgatga

SEQ ID NO: 61388 - DNA, 20 bp, Artificial Sequence
  chemically synthesized
gcagataaaatgtgatatgt

SEQ ID NO: 61389 - DNA, 20 bp, Artificial Sequence
  chemically synthesized
cagacaatactcagcttatg

SEQ ID NO: 61390 - DNA, 20 bp, Artificial Sequence
  chemically synthesized
ttgataaattaaaaaaaaac

SEQ ID NO: 61391 - DNA, 20 bp, Artificial Sequence
  chemically synthesized
aattaaaaaaaaacaggagt

SEQ ID NO: 61392 - DNA, 20 bp, Artificial Sequence
  chemically synthesized
atgtatggaacaaataattg

SEQ ID NO: 61393 - DNA, 20 bp, Artificial Sequence
  chemically synthesized
tatacacctcattttttggg

SEQ ID NO: 61394 - DNA, 20 bp, Artificial Sequence
  chemically synthesized
gtctgttttcatattgaaaa

SEQ ID NO: 61395 - DNA, 20 bp, Artificial Sequence
  chemically synthesized
tgtggtatatgagatgatct

SEQ ID NO: 61396 - DNA, 20 bp, Artificial Sequence
  chemically synthesized
gatgatctgtgagtttcaga

SEQ ID NO: 61397 - DNA, 20 bp, Artificial Sequence
  chemically synthesized
tgcagccattcaccctcttc

SEQ ID NO: 61398 - DNA, 20 bp, Artificial Sequence
  chemically synthesized
ctcttccagggtctctgtca

SEQ ID NO: 61399 - DNA, 20 bp, Artificial Sequence
  chemically synthesized
gtctctgtcatagaatagac

SEQ ID NO: 61400 - DNA, 20 bp, Artificial Sequence
  chemically synthesized
cctttctgtgatggttaata

SEQ ID NO: 61401 - DNA, 20 bp, Artificial Sequence
  chemically synthesized
aatattgagtgcaaacttga

SEQ ID NO: 61402 - DNA, 20 bp, Artificial Sequence
  chemically synthesized
gtgcaaacttgattggattg

SEQ ID NO: 61403 - DNA, 20 bp, Artificial Sequence
  chemically synthesized
aaggatgcaaagtattgttc

SEQ ID NO: 61404 - DNA, 20 bp, Artificial Sequence
  chemically synthesized
attgttcctgggtgtgctgt

SEQ ID NO: 61405 - DNA, 20 bp, Artificial Sequence
  chemically synthesized
ttgccaaaggagattaacat

SEQ ID NO: 61406 - DNA, 20 bp, Artificial Sequence
  chemically synthesized
cagacccacccaccctccgt

SEQ ID NO: 61407 - DNA, 20 bp, Artificial Sequence
  chemically synthesized
cccacccaccctccgtctgg

SEQ ID NO: 61408 - DNA, 20 bp, Artificial Sequence
  chemically synthesized
aagcaggcaaaagaagatgg

SEQ ID NO: 61409 - DNA, 20 bp, Artificial Sequence
  chemically synthesized
caaaagaagatggaagagta

SEQ ID NO: 61410 - DNA, 20 bp, Artificial Sequence
  chemically synthesized
gctaaagtcacacaggctat

SEQ ID NO: 61411 - DNA, 20 bp, Artificial Sequence
  chemically synthesized
agctccgtccaagcttaatt

SEQ ID NO: 61412 - DNA, 20 bp, Artificial Sequence
  chemically synthesized
ttacagaggtatacctcctc

SEQ ID NO: 61413 - DNA, 20 bp, Artificial Sequence
  chemically synthesized
atacctcctcaagaatttgg

SEQ ID NO: 61414 - DNA, 20 bp, Artificial Sequence
  chemically synthesized
gacttctaaggtaaaagaca

SEQ ID NO: 61415 - DNA, 20 bp, Artificial Sequence
  chemically synthesized
gttgggggcagggggactct

SEQ ID NO: 61416 - DNA, 20 bp, Artificial Sequence
  chemically synthesized
ggcagggggactctcagggt

SEQ ID NO: 61417 - DNA, 20 bp, Artificial Sequence
  chemically synthesized
aatggaagccagagagatta

SEQ ID NO: 61418 - DNA, 20 bp, Artificial Sequence
  chemically synthesized
tacaaccccataattcatgc

SEQ ID NO: 61419 - DNA, 20 bp, Artificial Sequence
  chemically synthesized
cccatgctctggtttgttcg

SEQ ID NO: 61420 - DNA, 20 bp, Artificial Sequence
  chemically synthesized
attgtttgccttatgtgttc

SEQ ID NO: 61421 - DNA, 20 bp, Artificial Sequence
  chemically synthesized
accaagttttagagatgtca

SEQ ID NO: 61422 - DNA, 20 bp, Artificial Sequence
  chemically synthesized
agatttgggcatcatctttt

SEQ ID NO: 61423 - DNA, 20 bp, Artificial Sequence
  chemically synthesized
ttatttgtgccctcagcctt

SEQ ID NO: 61424 - DNA, 20 bp, Artificial Sequence
  chemically synthesized
aggttttcctctgttggagg

SEQ ID NO: 61425 - DNA, 20 bp, Artificial Sequence
  chemically synthesized
tggctcttgctgtgctactt

SEQ ID NO: 61426 - DNA, 20 bp, Artificial Sequence
  chemically synthesized
cttggctgaagcaccatgtg

SEQ ID NO: 61427 - DNA, 20 bp, Artificial Sequence
  chemically synthesized
tggtaggctaaactcaagaa

SEQ ID NO: 61428 - DNA, 20 bp, Artificial Sequence
  chemically synthesized
ggaatagttagtgataactg

SEQ ID NO: 61429 - DNA, 20 bp, Artificial Sequence
  chemically synthesized
ctgcagaatgtgcgttcacg

SEQ ID NO: 61430 - DNA, 20 bp, Artificial Sequence
  chemically synthesized
tgggtactagagaaggctgc

SEQ ID NO: 61431 - DNA, 20 bp, Artificial Sequence
  chemically synthesized
tgactgttgaagtaaatgta

SEQ ID NO: 61432 - DNA, 20 bp, Artificial Sequence
  chemically synthesized
ttacctcccagaggtgatac

SEQ ID NO: 61433 - DNA, 20 bp, Artificial Sequence
  chemically synthesized
tgttccagctccctctaagg

SEQ ID NO: 61434 - DNA, 20 bp, Artificial Sequence
  chemically synthesized
cctctaaggaggagttaata

SEQ ID NO: 61435 - DNA, 20 bp, Artificial Sequence
  chemically synthesized
tcaaacaagttatggtacct

SEQ ID NO: 61436 - DNA, 20 bp, Artificial Sequence
  chemically synthesized
gaaatactcctagatatata

SEQ ID NO: 61437 - DNA, 20 bp, Artificial Sequence
  chemically synthesized
aaagatacggagaagaagtg

SEQ ID NO: 61438 - DNA, 20 bp, Artificial Sequence
  chemically synthesized
gatctcaatagtccacagct

SEQ ID NO: 61439 - DNA, 20 bp, Artificial Sequence
  chemically synthesized
gaccttctgtactcagtgat

SEQ ID NO: 61440 - DNA, 20 bp, Artificial Sequence
  chemically synthesized
attttctaggtgttccatta

SEQ ID NO: 61441 - DNA, 20 bp, Artificial Sequence
  chemically synthesized
ccacgactagctgaggacac

SEQ ID NO: 61442 - DNA, 20 bp, Artificial Sequence
  chemically synthesized
agaattttcacaaaacaaag

SEQ ID NO: 61443 - DNA, 20 bp, Artificial Sequence
  chemically synthesized
cattaccaggtatgtctgca

SEQ ID NO: 61444 - DNA, 20 bp, Artificial Sequence
  chemically synthesized
tatgtctgcatggaattctt

SEQ ID NO: 61445 - DNA, 20 bp, Artificial Sequence
  chemically synthesized
ctgcatattctctgataaga

SEQ ID NO: 61446 - DNA, 20 bp, Artificial Sequence
  chemically synthesized
tgctgaaacgtcagagaagt

SEQ ID NO: 61447 - DNA, 20 bp, Artificial Sequence
  chemically synthesized
acagaaggggaggagctaag

SEQ ID NO: 61448 - DNA, 20 bp, Artificial Sequence
  chemically synthesized
atctttgcgtctagtaactg

SEQ ID NO: 61449 - DNA, 20 bp, Artificial Sequence
  chemically synthesized
cattgtatgttcagtaggca

SEQ ID NO: 61450 - DNA, 20 bp, Artificial Sequence
  chemically synthesized
tatgtctctcagtcctagga

SEQ ID NO: 61451 - DNA, 20 bp, Artificial Sequence
  chemically synthesized
tctcagtcctaggacagaat

SEQ ID NO: 61452 - DNA, 20 bp, Artificial Sequence
  chemically synthesized
aaaatgattctttcaaagtg

SEQ ID NO: 61453 - DNA, 20 bp, Artificial Sequence
  chemically synthesized
tacagttagatctcatctct

SEQ ID NO: 61454 - DNA, 20 bp, Artificial Sequence
  chemically synthesized
tctctatgggtggaaggtaa

SEQ ID NO: 61455 - DNA, 20 bp, Artificial Sequence
  chemically synthesized
gtttcctttggtggcatctt

SEQ ID NO: 61456 - DNA, 20 bp, Artificial Sequence
  chemically synthesized
cactgacaaagtaactctga

SEQ ID NO: 61457 - DNA, 20 bp, Artificial Sequence
  chemically synthesized
gtaactctgaaggggtatat

SEQ ID NO: 61458 - DNA, 20 bp, Artificial Sequence
  chemically synthesized
atacgaccatctttttaact

SEQ ID NO: 61459 - DNA, 20 bp, Artificial Sequence
  chemically synthesized
tgtgacaagaaaaaaaagca

SEQ ID NO: 61460 - DNA, 20 bp, Artificial Sequence
  chemically synthesized
gactcttgatttcctcacaa

SEQ ID NO: 61461 - DNA, 20 bp, Artificial Sequence
  chemically synthesized
atccccctcagacttccatt

SEQ ID NO: 61462 - DNA, 20 bp, Artificial Sequence
  chemically synthesized
aggtcaccatgactcttcat

SEQ ID NO: 61463 - DNA, 20 bp, Artificial Sequence
  chemically synthesized
ttcttcacatagcagtctaa

SEQ ID NO: 61464 - DNA, 20 bp, Artificial Sequence
  chemically synthesized
agtaatttaaaaatacaaat

SEQ ID NO: 61465 - DNA, 20 bp, Artificial Sequence
  chemically synthesized
gcccctagtctagtggcaga

SEQ ID NO: 61466 - DNA, 20 bp, Artificial Sequence
  chemically synthesized
agattcagaagcctatggct

SEQ ID NO: 61467 - DNA, 20 bp, Artificial Sequence
  chemically synthesized
aagggaaggaaaccaggaag

SEQ ID NO: 61468 - DNA, 20 bp, Artificial Sequence
  chemically synthesized
atgagagaggtcagattcta

SEQ ID NO: 61469 - DNA, 20 bp, Artificial Sequence
  chemically synthesized
ctgagctattgtcacaagta

SEQ ID NO: 61470 - DNA, 20 bp, Artificial Sequence
  chemically synthesized
acaagtagtgagtagtactg

SEQ ID NO: 61471 - DNA, 20 bp, Artificial Sequence
  chemically synthesized
agtactgaaggattctacaa

SEQ ID NO: 61472 - DNA, 20 bp, Artificial Sequence
  chemically synthesized
gagggtaattcacactaatc

SEQ ID NO: 61473 - DNA, 20 bp, Artificial Sequence
  chemically synthesized
cttagctacagtggtagtgg

SEQ ID NO: 61474 - DNA, 20 bp, Artificial Sequence
  chemically synthesized
gtctttacatgcaggaaaat

SEQ ID NO: 61475 - DNA, 20 bp, Artificial Sequence
  chemically synthesized
catgcaggaaaatgtggatt

SEQ ID NO: 61476 - DNA, 20 bp, Artificial Sequence
  chemically synthesized
ttagctttctggaaatcccc

SEQ ID NO: 61477 - DNA, 20 bp, Artificial Sequence
  chemically synthesized
aaatccccttgaatgcccca

SEQ ID NO: 61478 - DNA, 20 bp, Artificial Sequence
  chemically synthesized
ccttgaatgccccatagaat

SEQ ID NO: 61479 - DNA, 20 bp, Artificial Sequence
  chemically synthesized
tctttaaaatctgcatagtt

SEQ ID NO: 61480 - DNA, 20 bp, Artificial Sequence
  chemically synthesized
tacataattttttttctgaa

SEQ ID NO: 61481 - DNA, 20 bp, Artificial Sequence
  chemically synthesized
atataaacagttgaaactcc

SEQ ID NO: 61482 - DNA, 20 bp, Artificial Sequence
  chemically synthesized
cgtaggtaggagatagatcc

SEQ ID NO: 61483 - DNA, 20 bp, Artificial Sequence
  chemically synthesized
agatcctggaatgtgcagtt

SEQ ID NO: 61484 - DNA, 20 bp, Artificial Sequence
  chemically synthesized
cagttaagaatacaaatagt

SEQ ID NO: 61485 - DNA, 20 bp, Artificial Sequence
  chemically synthesized
caaatagtatgagtaaccct

SEQ ID NO: 61486 - DNA, 20 bp, Artificial Sequence
  chemically synthesized
tatctttaggaaaaaattct

SEQ ID NO: 61487 - DNA, 20 bp, Artificial Sequence
  chemically synthesized
acatttcttctatataaacc

SEQ ID NO: 61488 - DNA, 20 bp, Artificial Sequence
  chemically synthesized
ggcttggaggaagctcatca

SEQ ID NO: 61489 - DNA, 20 bp, Artificial Sequence
  chemically synthesized
accacaatgcccacggtgct

SEQ ID NO: 61490 - DNA, 20 bp, Artificial Sequence
  chemically synthesized
cggtgctgggagtcctctgg

SEQ ID NO: 61491 - DNA, 20 bp, Artificial Sequence
  chemically synthesized
tatacactcactttcctttc

SEQ ID NO: 61492 - DNA, 20 bp, Artificial Sequence
  chemically synthesized
acctctgtacttactaatac

SEQ ID NO: 61493 - DNA, 20 bp, Artificial Sequence
  chemically synthesized
cgagtagtgaagattgggct

SEQ ID NO: 61494 - DNA, 20 bp, Artificial Sequence
  chemically synthesized
tgggctgggagttctgatga

SEQ ID NO: 61495 - DNA, 20 bp, Artificial Sequence
  chemically synthesized
cacatgcattctgccttcac

SEQ ID NO: 61496 - DNA, 20 bp, Artificial Sequence
  chemically synthesized
ttgtagtctttatatttgtg

SEQ ID NO: 61497 - DNA, 20 bp, Artificial Sequence
  chemically synthesized
ggttttttatgtcacagtga

SEQ ID NO: 61498 - DNA, 20 bp, Artificial Sequence
  chemically synthesized
attttctgttccctccacta

SEQ ID NO: 61499 - DNA, 20 bp, Artificial Sequence
  chemically synthesized
gtgtcaagaccaagcagatt

SEQ ID NO: 61500 - DNA, 20 bp, Artificial Sequence
  chemically synthesized
cttcacctttttactaccca

SEQ ID NO: 61501 - DNA, 20 bp, Artificial Sequence
  chemically synthesized
aatcatcacagtcactctca

SEQ ID NO: 61502 - DNA, 20 bp, Artificial Sequence
  chemically synthesized
ttttgttgcattcctgtaaa

SEQ ID NO: 61503 - DNA, 20 bp, Artificial Sequence
  chemically synthesized
ataaagttagcagataggaa

SEQ ID NO: 61504 - DNA, 20 bp, Artificial Sequence
  chemically synthesized
atataaaattattagttggt

SEQ ID NO: 61505 - DNA, 20 bp, Artificial Sequence
  chemically synthesized
attagttggttcgagtgaaa

SEQ ID NO: 61506 - DNA, 20 bp, Artificial Sequence
  chemically synthesized
ttggttcgagtgaaatggaa

SEQ ID NO: 61507 - DNA, 20 bp, Artificial Sequence
  chemically synthesized
aaatctaatttccaactctt

SEQ ID NO: 61508 - DNA, 20 bp, Artificial Sequence
  chemically synthesized
aaatttggtcactgaagtcc

SEQ ID NO: 61509 - DNA, 20 bp, Artificial Sequence
  chemically synthesized
ccaggaattttcctgcaaaa

SEQ ID NO: 61510 - DNA, 20 bp, Artificial Sequence
  chemically synthesized
cctccctccatcaaattata

SEQ ID NO: 61511 - DNA, 20 bp, Artificial Sequence
  chemically synthesized
taacaaaaaaatgtgagaag

SEQ ID NO: 61512 - DNA, 20 bp, Artificial Sequence
  chemically synthesized
aaaatgtgagaagaggaatc

SEQ ID NO: 61513 - DNA, 20 bp, Artificial Sequence
  chemically synthesized
taggtttctgcatttttttg

SEQ ID NO: 61514 - DNA, 20 bp, Artificial Sequence
  chemically synthesized
taataagtgtaaatttccca

SEQ ID NO: 61515 - DNA, 20 bp, Artificial Sequence
  chemically synthesized
catttgattaaaattgtctg

SEQ ID NO: 61516 - DNA, 20 bp, Artificial Sequence
  chemically synthesized
gttttaccccgatcatttta

SEQ ID NO: 61517 - DNA, 20 bp, Artificial Sequence
  chemically synthesized
ttttacagaattgtgcacct

SEQ ID NO: 61518 - DNA, 20 bp, Artificial Sequence
  chemically synthesized
cattaataaattgcacacat

SEQ ID NO: 61519 - DNA, 20 bp, Artificial Sequence
  chemically synthesized
tatctcaggtattgctcata

SEQ ID NO: 61520 - DNA, 20 bp, Artificial Sequence
  chemically synthesized
tgtcacctgagcaacacagt

SEQ ID NO: 61521 - DNA, 20 bp, Artificial Sequence
  chemically synthesized
cacagtctgaatactaaatt

SEQ ID NO: 61522 - DNA, 20 bp, Artificial Sequence
  chemically synthesized
ctgaatactaaattgtgagt

SEQ ID NO: 61523 - DNA, 20 bp, Artificial Sequence
  chemically synthesized
ttttattcataaaaatattg

SEQ ID NO: 61524 - DNA, 20 bp, Artificial Sequence
  chemically synthesized
cttctaactataaggccagt

SEQ ID NO: 61525 - DNA, 20 bp, Artificial Sequence
  chemically synthesized
agtagaagaacttttttaaa

SEQ ID NO: 61526 - DNA, 20 bp, Artificial Sequence
  chemically synthesized
tatgacattgcaaaaaaaaa

SEQ ID NO: 61527 - DNA, 20 bp, Artificial Sequence
  chemically synthesized
aaagagtaatgcttttgttg

SEQ ID NO: 61528 - DNA, 20 bp, Artificial Sequence
  chemically synthesized
aattactaaaatgcaatgct

SEQ ID NO: 61529 - DNA, 20 bp, Artificial Sequence
  chemically synthesized
ttcaaactataataaatatt

SEQ ID NO: 61530 - DNA, 20 bp, Artificial Sequence
  chemically synthesized
aagaaatgataataaataaa

SEQ ID NO: 61531 - DNA, 20 bp, Artificial Sequence
  chemically synthesized
tcagtgacaaggaggacagt

SEQ ID NO: 61532 - DNA, 20 bp, Artificial Sequence
  chemically synthesized
tttgttcagcctagtttcag

SEQ ID NO: 61533 - DNA, 20 bp, Artificial Sequence
  chemically synthesized
atcatctcagttatagatat

SEQ ID NO: 61534 - DNA, 20 bp, Artificial Sequence
  chemically synthesized
gcaggaaagttgaccatttg

SEQ ID NO: 61535 - DNA, 20 bp, Artificial Sequence
  chemically synthesized
aattcactgagaagatgctg

SEQ ID NO: 61536 - DNA, 20 bp, Artificial Sequence
  chemically synthesized
cactgagaagatgctgtagg

SEQ ID NO: 61537 - DNA, 20 bp, Artificial Sequence
  chemically synthesized
aataccacgtgttctcactt

SEQ ID NO: 61538 - DNA, 20 bp, Artificial Sequence
  chemically synthesized
tcacacactggggcctattg

SEQ ID NO: 61539 - DNA, 20 bp, Artificial Sequence
  chemically synthesized
ctggggcctattggaggatg

SEQ ID NO: 61540 - DNA, 20 bp, Artificial Sequence
  chemically synthesized
atggagggtgaaaggaggga

SEQ ID NO: 61541 - DNA, 20 bp, Artificial Sequence
  chemically synthesized
aggatcaggaaaagtaacaa

SEQ ID NO: 61542 - DNA, 20 bp, Artificial Sequence
  chemically synthesized
aagggtactaggcttaatac

SEQ ID NO: 61543 - DNA, 20 bp, Artificial Sequence
  chemically synthesized
gtactaggcttaatacctga

SEQ ID NO: 61544 - DNA, 20 bp, Artificial Sequence
  chemically synthesized
tctcctaggaaacactgcac

SEQ ID NO: 61545 - DNA, 20 bp, Artificial Sequence
  chemically synthesized
catgaatttgtattcataag

SEQ ID NO: 61546 - DNA, 20 bp, Artificial Sequence
  chemically synthesized
atttgtattcataagaagag

SEQ ID NO: 61547 - DNA, 20 bp, Artificial Sequence
  chemically synthesized
ttcataagaagagtagaatt

SEQ ID NO: 61548 - DNA, 20 bp, Artificial Sequence
  chemically synthesized
tcatcattcaagactgaaag

SEQ ID NO: 61549 - DNA, 20 bp, Artificial Sequence
  chemically synthesized
atatagagaaggacctcatg

SEQ ID NO: 61550 - DNA, 20 bp, Artificial Sequence
  chemically synthesized
atgggaaatctaaggtgtaa

SEQ ID NO: 61551 - DNA, 20 bp, Artificial Sequence
  chemically synthesized
cttgtgtagtatgggcttga

SEQ ID NO: 61552 - DNA, 20 bp, Artificial Sequence
  chemically synthesized
ttgaagggataacataccat

SEQ ID NO: 61553 - DNA, 20 bp, Artificial Sequence
  chemically synthesized
ataccataagaatatttaat

SEQ ID NO: 61554 - DNA, 20 bp, Artificial Sequence
  chemically synthesized
aaatgattaagaagacgtgg

SEQ ID NO: 61555 - DNA, 20 bp, Artificial Sequence
  chemically synthesized
gaaaaaatatgtatggtcta

SEQ ID NO: 61556 - DNA, 20 bp, Artificial Sequence
  chemically synthesized
cacttttcctcccatataaa

SEQ ID NO: 61557 - DNA, 20 bp, Artificial Sequence
  chemically synthesized
ctctcattaacaaataattg

SEQ ID NO: 61558 - DNA, 20 bp, Artificial Sequence
  chemically synthesized
accagagatgcagattttta

SEQ ID NO: 61559 - DNA, 20 bp, Artificial Sequence
  chemically synthesized
aaagatacttactagattat

SEQ ID NO: 61560 - DNA, 20 bp, Artificial Sequence
  chemically synthesized
tgagtattaaattgggcagc

SEQ ID NO: 61561 - DNA, 20 bp, Artificial Sequence
  chemically synthesized
gaggtctccatgtccaatta

SEQ ID NO: 61562 - DNA, 20 bp, Artificial Sequence
  chemically synthesized
atttattttatgggaaattt

SEQ ID NO: 61563 - DNA, 20 bp, Artificial Sequence
  chemically synthesized
gtcatggttctccagaaaaa

SEQ ID NO: 61564 - DNA, 20 bp, Artificial Sequence
  chemically synthesized
ctccagaaaaatagaatcaa

SEQ ID NO: 61565 - DNA, 20 bp, Artificial Sequence
  chemically synthesized
agacacactgactaatggaa

SEQ ID NO: 61566 - DNA, 20 bp, Artificial Sequence
  chemically synthesized
gtaaaaacaagtaatgggga

SEQ ID NO: 61567 - DNA, 20 bp, Artificial Sequence
  chemically synthesized
cagcactttgggaggccaag

SEQ ID NO: 61568 - DNA, 20 bp, Artificial Sequence
  chemically synthesized
actttgggaggccaaggtgg

SEQ ID NO: 61569 - DNA, 20 bp, Artificial Sequence
  chemically synthesized
tgggtggatcacttgaggtg

SEQ ID NO: 61570 - DNA, 20 bp, Artificial Sequence
  chemically synthesized
ctaaaaatacaaaaaatgtg

SEQ ID NO: 61571 - DNA, 20 bp, Artificial Sequence
  chemically synthesized
tactcaggaggctgaggcag

SEQ ID NO: 61572 - DNA, 20 bp, Artificial Sequence
  chemically synthesized
tcgcaccactgcactctagc

SEQ ID NO: 61573 - DNA, 20 bp, Artificial Sequence
  chemically synthesized
ctgcactctagcatgggtga

SEQ ID NO: 61574 - DNA, 20 bp, Artificial Sequence
  chemically synthesized
cagagcgaacaggcaaccta

SEQ ID NO: 61575 - DNA, 20 bp, Artificial Sequence
  chemically synthesized
tctgacaaaggtctaatatc

SEQ ID NO: 61576 - DNA, 20 bp, Artificial Sequence
  chemically synthesized
aaataccatctgacaccagt

SEQ ID NO: 61577 - DNA, 20 bp, Artificial Sequence
  chemically synthesized
ttgacctcacaatcccatta

SEQ ID NO: 61578 - DNA, 20 bp, Artificial Sequence
  chemically synthesized
attactgggtatatacctaa

SEQ ID NO: 61579 - DNA, 20 bp, Artificial Sequence
  chemically synthesized
tattcacaatagcaaagaca

SEQ ID NO: 61580 - DNA, 20 bp, Artificial Sequence
  chemically synthesized
aatactatctaaccataaaa

SEQ ID NO: 61581 - DNA, 20 bp, Artificial Sequence
  chemically synthesized
atcatgccctttgctgggac

SEQ ID NO: 61582 - DNA, 20 bp, Artificial Sequence
  chemically synthesized
agaagtgggagctgaacaat

SEQ ID NO: 61583 - DNA, 20 bp, Artificial Sequence
  chemically synthesized
cactggagcctgtcagggca

SEQ ID NO: 61584 - DNA, 20 bp, Artificial Sequence
  chemically synthesized
ctgggcttaacacctaggtg

SEQ ID NO: 61585 - DNA, 20 bp, Artificial Sequence
  chemically synthesized
gaacttaaaaattaaaaaaa

SEQ ID NO: 61586 - DNA, 20 bp, Artificial Sequence
  chemically synthesized
aaggcaagtcccaagatatg

SEQ ID NO: 61587 - DNA, 20 bp, Artificial Sequence
  chemically synthesized
caagtcccaagatatgcaga

SEQ ID NO: 61588 - DNA, 20 bp, Artificial Sequence
  chemically synthesized
tctgaaggcctgggaaacag

SEQ ID NO: 61589 - DNA, 20 bp, Artificial Sequence
  chemically synthesized
cagtttgaaggccatcaata

SEQ ID NO: 61590 - DNA, 20 bp, Artificial Sequence
  chemically synthesized
taattctctctgatttgggg

SEQ ID NO: 61591 - DNA, 20 bp, Artificial Sequence
  chemically synthesized
aacaccctcacaaaaacatc

SEQ ID NO: 61592 - DNA, 20 bp, Artificial Sequence
  chemically synthesized
attaaccatcagagcctgta

SEQ ID NO: 61593 - DNA, 20 bp, Artificial Sequence
  chemically synthesized
accatcagagcctgtagagg

SEQ ID NO: 61594 - DNA, 20 bp, Artificial Sequence
  chemically synthesized
agcctgtagaggatgagtta

SEQ ID NO: 61595 - DNA, 20 bp, Artificial Sequence
  chemically synthesized
gtagaggatgagttaaagga

SEQ ID NO: 61596 - DNA, 20 bp, Artificial Sequence
  chemically synthesized
ggaatcttcggagataattg

SEQ ID NO: 61597 - DNA, 20 bp, Artificial Sequence
  chemically synthesized
tccagaaggctgacagataa

SEQ ID NO: 61598 - DNA, 20 bp, Artificial Sequence
  chemically synthesized
tcaacaaacagcaaaaatcc

SEQ ID NO: 61599 - DNA, 20 bp, Artificial Sequence
  chemically synthesized
atcctaggatagagaccttc

SEQ ID NO: 61600 - DNA, 20 bp, Artificial Sequence
  chemically synthesized
gcgatataagcttattatac

SEQ ID NO: 61601 - DNA, 20 bp, Artificial Sequence
  chemically synthesized
agagctcagaccaagagcca

SEQ ID NO: 61602 - DNA, 20 bp, Artificial Sequence
  chemically synthesized
atttctaataatgtggctgc

SEQ ID NO: 61603 - DNA, 20 bp, Artificial Sequence
  chemically synthesized
tagaaagagacaggcactca

SEQ ID NO: 61604 - DNA, 20 bp, Artificial Sequence
  chemically synthesized
aatacagcaggaaatatgaa

SEQ ID NO: 61605 - DNA, 20 bp, Artificial Sequence
  chemically synthesized
aacaaggtcttagaaaatac

SEQ ID NO: 61606 - DNA, 20 bp, Artificial Sequence
  chemically synthesized
ttaaggaaatagaagatatt

SEQ ID NO: 61607 - DNA, 20 bp, Artificial Sequence
  chemically synthesized
tgcccctaagcttggtgact

SEQ ID NO: 61608 - DNA, 20 bp, Artificial Sequence
  chemically synthesized
ctaagataagtgatgtttcc

SEQ ID NO: 61609 - DNA, 20 bp, Artificial Sequence
  chemically synthesized
ataagtgatgtttccaggaa

SEQ ID NO: 61610 - DNA, 20 bp, Artificial Sequence
  chemically synthesized
gattcgtgtactgccagtga

SEQ ID NO: 61611 - DNA, 20 bp, Artificial Sequence
  chemically synthesized
tgaaattaaatcagttatct

SEQ ID NO: 61612 - DNA, 20 bp, Artificial Sequence
  chemically synthesized
catttaggaagacctatgag

SEQ ID NO: 61613 - DNA, 20 bp, Artificial Sequence
  chemically synthesized
ctcatagttgggctaagttc

SEQ ID NO: 61614 - DNA, 20 bp, Artificial Sequence
  chemically synthesized
gctaagttccaggataaatt

SEQ ID NO: 61615 - DNA, 20 bp, Artificial Sequence
  chemically synthesized
acaaattgtcagacaaagcc

SEQ ID NO: 61616 - DNA, 20 bp, Artificial Sequence
  chemically synthesized
tcagacaaagccagggatta

SEQ ID NO: 61617 - DNA, 20 bp, Artificial Sequence
  chemically synthesized
cttatcagcagcactcattt

SEQ ID NO: 61618 - DNA, 20 bp, Artificial Sequence
  chemically synthesized
ccaagaaaagattaagtgtg

SEQ ID NO: 61619 - DNA, 20 bp, Artificial Sequence
  chemically synthesized
attattaagctttgtctaag

SEQ ID NO: 61620 - DNA, 20 bp, Artificial Sequence
  chemically synthesized
ttgagtgagcttattggcta

SEQ ID NO: 61621 - DNA, 20 bp, Artificial Sequence
  chemically synthesized
gcttattggctacagggtta

SEQ ID NO: 61622 - DNA, 20 bp, Artificial Sequence
  chemically synthesized
ggtatcttctttttgaggtg

SEQ ID NO: 61623 - DNA, 20 bp, Artificial Sequence
  chemically synthesized
gatagcatgacttccatgtg

SEQ ID NO: 61624 - DNA, 20 bp, Artificial Sequence
  chemically synthesized
acagatactggggaacaatt

SEQ ID NO: 61625 - DNA, 20 bp, Artificial Sequence
  chemically synthesized
tcaggctctagtgactatgg

SEQ ID NO: 61626 - DNA, 20 bp, Artificial Sequence
  chemically synthesized
ctctagtgactatgggagaa

SEQ ID NO: 61627 - DNA, 20 bp, Artificial Sequence
  chemically synthesized
gaaaataaagactaatcttc

SEQ ID NO: 61628 - DNA, 20 bp, Artificial Sequence
  chemically synthesized
ccaccacatagttgttgcaa

SEQ ID NO: 61629 - DNA, 20 bp, Artificial Sequence
  chemically synthesized
atctgtatctacagattctg

SEQ ID NO: 61630 - DNA, 20 bp, Artificial Sequence
  chemically synthesized
aaaaacagtagttttatgtg

SEQ ID NO: 61631 - DNA, 20 bp, Artificial Sequence
  chemically synthesized
tttatgtgatgggtgcttac

SEQ ID NO: 61632 - DNA, 20 bp, Artificial Sequence
  chemically synthesized
gggtgcttacatgaataatt

SEQ ID NO: 61633 - DNA, 20 bp, Artificial Sequence
  chemically synthesized
tacatgaataattaagagtt

SEQ ID NO: 61634 - DNA, 20 bp, Artificial Sequence
  chemically synthesized
agaggaaagagactgactct

SEQ ID NO: 61635 - DNA, 20 bp, Artificial Sequence
  chemically synthesized
gaaagagactgactctggga

SEQ ID NO: 61636 - DNA, 20 bp, Artificial Sequence
  chemically synthesized
tgactctgggagtgaatgtg

SEQ ID NO: 61637 - DNA, 20 bp, Artificial Sequence
  chemically synthesized
ctgggagtgaatgtgcaggg

SEQ ID NO: 61638 - DNA, 20 bp, Artificial Sequence
  chemically synthesized
aaagtaagcaatgttagtgt

SEQ ID NO: 61639 - DNA, 20 bp, Artificial Sequence
  chemically synthesized
agcaatgttagtgttggagt

SEQ ID NO: 61640 - DNA, 20 bp, Artificial Sequence
  chemically synthesized
gaaccgtgttttttactaca

SEQ ID NO: 61641 - DNA, 20 bp, Artificial Sequence
  chemically synthesized
taggtctgagagactagtaa

SEQ ID NO: 61642 - DNA, 20 bp, Artificial Sequence
  chemically synthesized
gctaagttttatgctaaagt

SEQ ID NO: 61643 - DNA, 20 bp, Artificial Sequence
  chemically synthesized
ggtgatgcaaaagagacatc

SEQ ID NO: 61644 - DNA, 20 bp, Artificial Sequence
  chemically synthesized
tatagaaatagatacaacaa

SEQ ID NO: 61645 - DNA, 20 bp, Artificial Sequence
  chemically synthesized
atagatacaacaaaagggtg

SEQ ID NO: 61646 - DNA, 20 bp, Artificial Sequence
  chemically synthesized
agaacgacacaggaaaacaa

SEQ ID NO: 61647 - DNA, 20 bp, Artificial Sequence
  chemically synthesized
acacaggaaaacaataggat

SEQ ID NO: 61648 - DNA, 20 bp, Artificial Sequence
  chemically synthesized
aaataagttgaaccatgcat

SEQ ID NO: 61649 - DNA, 20 bp, Artificial Sequence
  chemically synthesized
ctataaactcttaataaaat

SEQ ID NO: 61650 - DNA, 20 bp, Artificial Sequence
  chemically synthesized
ctgcactctcataggcttaa

SEQ ID NO: 61651 - DNA, 20 bp, Artificial Sequence
  chemically synthesized
gcttaactgagttctctgct

SEQ ID NO: 61652 - DNA, 20 bp, Artificial Sequence
  chemically synthesized
cttatccaaaggctctgggg

SEQ ID NO: 61653 - DNA, 20 bp, Artificial Sequence
  chemically synthesized
ttttttttttttttttgaga

SEQ ID NO: 61654 - DNA, 20 bp, Artificial Sequence
  chemically synthesized
tctcgctctgtcacccagcc

SEQ ID NO: 61655 - DNA, 20 bp, Artificial Sequence
  chemically synthesized
ctccctgcaacctgtgcctc

SEQ ID NO: 61656 - DNA, 20 bp, Artificial Sequence
  chemically synthesized
taatttttatattttttggt

SEQ ID NO: 61657 - DNA, 20 bp, Artificial Sequence
  chemically synthesized
tttatattttttggtaggga

SEQ ID NO: 61658 - DNA, 20 bp, Artificial Sequence
  chemically synthesized
gccttggcctcccaaagtgc

SEQ ID NO: 61659 - DNA, 20 bp, Artificial Sequence
  chemically synthesized
aaagtgctgggattacaggc

SEQ ID NO: 61660 - DNA, 20 bp, Artificial Sequence
  chemically synthesized
gagccattgcacccggctgt

SEQ ID NO: 61661 - DNA, 20 bp, Artificial Sequence
  chemically synthesized
tttgtttgcaggctgttagc

SEQ ID NO: 61662 - DNA, 20 bp, Artificial Sequence
  chemically synthesized
ccatgaacctttctcaaatt

SEQ ID NO: 61663 - DNA, 20 bp, Artificial Sequence
  chemically synthesized
actctgcttttaggggctca

SEQ ID NO: 61664 - DNA, 20 bp, Artificial Sequence
  chemically synthesized
tggaattagactaggttccc

SEQ ID NO: 61665 - DNA, 20 bp, Artificial Sequence
  chemically synthesized
atattcacagtcctagaaat

SEQ ID NO: 61666 - DNA, 20 bp, Artificial Sequence
  chemically synthesized
tgatgaagcacaatgtctga

SEQ ID NO: 61667 - DNA, 20 bp, Artificial Sequence
  chemically synthesized
aaagggtggtagaaagcagc

SEQ ID NO: 61668 - DNA, 20 bp, Artificial Sequence
  chemically synthesized
aagcagctggagtcgaaact

SEQ ID NO: 61669 - DNA, 20 bp, Artificial Sequence
  chemically synthesized
aacagtagcatctggttagc

SEQ ID NO: 61670 - DNA, 20 bp, Artificial Sequence
  chemically synthesized
agcatctggttagcttgagt

SEQ ID NO: 61671 - DNA, 20 bp, Artificial Sequence
  chemically synthesized
agtgtaaacactcgattttg

SEQ ID NO: 61672 - DNA, 20 bp, Artificial Sequence
  chemically synthesized
gtctggagagatttcatcct

SEQ ID NO: 61673 - DNA, 20 bp, Artificial Sequence
  chemically synthesized
aatccactccctctctatcg

SEQ ID NO: 61674 - DNA, 20 bp, Artificial Sequence
  chemically synthesized
tccctctctatcgtggagtc

SEQ ID NO: 61675 - DNA, 20 bp, Artificial Sequence
  chemically synthesized
aaggtggtgaagatagatct

SEQ ID NO: 61676 - DNA, 20 bp, Artificial Sequence
  chemically synthesized
agatctgggggttcaaatga

SEQ ID NO: 61677 - DNA, 20 bp, Artificial Sequence
  chemically synthesized
gcccataatcatcaccctct

SEQ ID NO: 61678 - DNA, 20 bp, Artificial Sequence
  chemically synthesized
ctgatccttaagaaggtcat

SEQ ID NO: 61679 - DNA, 20 bp, Artificial Sequence
  chemically synthesized
tgcttcatcaaaaaaatgtt

SEQ ID NO: 61680 - DNA, 20 bp, Artificial Sequence
  chemically synthesized
agataccatctcacaccagt

SEQ ID NO: 61681 - DNA, 20 bp, Artificial Sequence
  chemically synthesized
agggaacaacaggtgctgga

SEQ ID NO: 61682 - DNA, 20 bp, Artificial Sequence
  chemically synthesized
agtcagtgtggcgattcctc

SEQ ID NO: 61683 - DNA, 20 bp, Artificial Sequence
  chemically synthesized
ttgacccagccatcccatta

SEQ ID NO: 61684 - DNA, 20 bp, Artificial Sequence
  chemically synthesized
cattactgggtatataccca

SEQ ID NO: 61685 - DNA, 20 bp, Artificial Sequence
  chemically synthesized
aaatgtccaacaatgataga

SEQ ID NO: 61686 - DNA, 20 bp, Artificial Sequence
  chemically synthesized
aatgtggcacatatacacca

SEQ ID NO: 61687 - DNA, 20 bp, Artificial Sequence
  chemically synthesized
ctatgcagccataaaaaatg

SEQ ID NO: 61688 - DNA, 20 bp, Artificial Sequence
  chemically synthesized
ttcatgtcatttgtagggac

SEQ ID NO: 61689 - DNA, 20 bp, Artificial Sequence
  chemically synthesized
gcatgttctcactcataggt

SEQ ID NO: 61690 - DNA, 20 bp, Artificial Sequence
  chemically synthesized
taatgctaagtgacaagtta

SEQ ID NO: 61691 - DNA, 20 bp, Artificial Sequence
  chemically synthesized
aataataaaaatacattatt

SEQ ID NO: 61692 - DNA, 20 bp, Artificial Sequence
  chemically synthesized
ttttgttattctggctctgc

SEQ ID NO: 61693 - DNA, 20 bp, Artificial Sequence
  chemically synthesized
tctgctagaattctcttgat

SEQ ID NO: 61694 - DNA, 20 bp, Artificial Sequence
  chemically synthesized
ttacacactatttacattct

SEQ ID NO: 61695 - DNA, 20 bp, Artificial Sequence
  chemically synthesized
tataattttaagataaaaag

SEQ ID NO: 61696 - DNA, 20 bp, Artificial Sequence
  chemically synthesized
cagcactttgggaggccaag

SEQ ID NO: 61697 - DNA, 20 bp, Artificial Sequence
  chemically synthesized
actttgggaggccaaggagg

SEQ ID NO: 61698 - DNA, 20 bp, Artificial Sequence
  chemically synthesized
actaaaaatacaaaaattag

SEQ ID NO: 61699 - DNA, 20 bp, Artificial Sequence
  chemically synthesized
ttctcaggaggctgtggcag

SEQ ID NO: 61700 - DNA, 20 bp, Artificial Sequence
  chemically synthesized
aatcacttgaacctgggagg

SEQ ID NO: 61701 - DNA, 20 bp, Artificial Sequence
  chemically synthesized
actgcactccagcctggcga

SEQ ID NO: 61702 - DNA, 20 bp, Artificial Sequence
  chemically synthesized
aaaaaaaaaaaaaaaaaaag

SEQ ID NO: 61703 - DNA, 20 bp, Artificial Sequence
  chemically synthesized
aaaaaaaaaagctgaatgtc

SEQ ID NO: 61704 - DNA, 20 bp, Artificial Sequence
  chemically synthesized
aggaaagacaaaaacgcaat

SEQ ID NO: 61705 - DNA, 20 bp, Artificial Sequence
  chemically synthesized
agttatgatgctgagcctcc

SEQ ID NO: 61706 - DNA, 20 bp, Artificial Sequence
  chemically synthesized
tatcttacatcagctggttt

SEQ ID NO: 61707 - DNA, 20 bp, Artificial Sequence
  chemically synthesized
aagagagggaagggagatca

SEQ ID NO: 61708 - DNA, 20 bp, Artificial Sequence
  chemically synthesized
tgaggcctcatgagaggtct

SEQ ID NO: 61709 - DNA, 20 bp, Artificial Sequence
  chemically synthesized
gcctcatgagaggtctgtga

SEQ ID NO: 61710 - DNA, 20 bp, Artificial Sequence
  chemically synthesized
ctgtgagtgaatgatctgaa

SEQ ID NO: 61711 - DNA, 20 bp, Artificial Sequence
  chemically synthesized
actgagtcctcaaagaggac

SEQ ID NO: 61712 - DNA, 20 bp, Artificial Sequence
  chemically synthesized
cctattttagccacaatact

SEQ ID NO: 61713 - DNA, 20 bp, Artificial Sequence
  chemically synthesized
ttttagccacaatactgtga

SEQ ID NO: 61714 - DNA, 20 bp, Artificial Sequence
  chemically synthesized
agccacaatactgtgagtgg

SEQ ID NO: 61715 - DNA, 20 bp, Artificial Sequence
  chemically synthesized
agtgggtgagtgccaggaac

SEQ ID NO: 61716 - DNA, 20 bp, Artificial Sequence
  chemically synthesized
gagtgccaggaacttgaata

SEQ ID NO: 61717 - DNA, 20 bp, Artificial Sequence
  chemically synthesized
ggtaaagatcacagctgagg

SEQ ID NO: 61718 - DNA, 20 bp, Artificial Sequence
  chemically synthesized
tttttttttttcttttttga

SEQ ID NO: 61719 - DNA, 20 bp, Artificial Sequence
  chemically synthesized
ggttttctaatctgggaccc

SEQ ID NO: 61720 - DNA, 20 bp, Artificial Sequence
  chemically synthesized
tgtttatagcttttttttca

SEQ ID NO: 61721 - DNA, 20 bp, Artificial Sequence
  chemically synthesized
tttgaaaataagaagcagaa

SEQ ID NO: 61722 - DNA, 20 bp, Artificial Sequence
  chemically synthesized
attgataactttcctgttca

SEQ ID NO: 61723 - DNA, 20 bp, Artificial Sequence
  chemically synthesized
ttgttgatagtttttctctg

SEQ ID NO: 61724 - DNA, 20 bp, Artificial Sequence
  chemically synthesized
tgaagagtagacaaaaaatt

SEQ ID NO: 61725 - DNA, 20 bp, Artificial Sequence
  chemically synthesized
agtagacaaaaaattctgaa

SEQ ID NO: 61726 - DNA, 20 bp, Artificial Sequence
  chemically synthesized
ttaagatctaagaaagcaaa

SEQ ID NO: 61727 - DNA, 20 bp, Artificial Sequence
  chemically synthesized
gcagatgataatatattgga

SEQ ID NO: 61728 - DNA, 20 bp, Artificial Sequence
  chemically synthesized
actgggttggagaaggcagg

SEQ ID NO: 61729 - DNA, 20 bp, Artificial Sequence
  chemically synthesized
cttgtggacaatagaaatct

SEQ ID NO: 61730 - DNA, 20 bp, Artificial Sequence
  chemically synthesized
ggacaatagaaatctgagag

SEQ ID NO: 61731 - DNA, 20 bp, Artificial Sequence
  chemically synthesized
aaagacaatgcgtgagagca

SEQ ID NO: 61732 - DNA, 20 bp, Artificial Sequence
  chemically synthesized
gaactgctctaagagatggc

SEQ ID NO: 61733 - DNA, 20 bp, Artificial Sequence
  chemically synthesized
catccaactcagaaggaggg

SEQ ID NO: 61734 - DNA, 20 bp, Artificial Sequence
  chemically synthesized
atgagaagatgagggaaagg

SEQ ID NO: 61735 - DNA, 20 bp, Artificial Sequence
  chemically synthesized
atgtatttatgcatcttggt

SEQ ID NO: 61736 - DNA, 20 bp, Artificial Sequence
  chemically synthesized
gagagtgttgctacaagtat

SEQ ID NO: 61737 - DNA, 20 bp, Artificial Sequence
  chemically synthesized
attcaggtcaatagaacatc

SEQ ID NO: 61738 - DNA, 20 bp, Artificial Sequence
  chemically synthesized
tagaacatctagaatgaagc

SEQ ID NO: 61739 - DNA, 20 bp, Artificial Sequence
  chemically synthesized
tttctcaagttttcagcatt

SEQ ID NO: 61740 - DNA, 20 bp, Artificial Sequence
  chemically synthesized
attctgcataaaattgaagg

SEQ ID NO: 61741 - DNA, 20 bp, Artificial Sequence
  chemically synthesized
acttgtcccagatggtattg

SEQ ID NO: 61742 - DNA, 20 bp, Artificial Sequence
  chemically synthesized
aatcactaaacatttatgtt

SEQ ID NO: 61743 - DNA, 20 bp, Artificial Sequence
  chemically synthesized
cttgttaatagctaagccat

SEQ ID NO: 61744 - DNA, 20 bp, Artificial Sequence
  chemically synthesized
taatagctaagccatctgaa

SEQ ID NO: 61745 - DNA, 20 bp, Artificial Sequence
  chemically synthesized
atgacagtatctagctctcc

SEQ ID NO: 61746 - DNA, 20 bp, Artificial Sequence
  chemically synthesized
gaatccccacacgcctgcct

SEQ ID NO: 61747 - DNA, 20 bp, Artificial Sequence
  chemically synthesized
ccttacacaattttttttaa

SEQ ID NO: 61748 - DNA, 20 bp, Artificial Sequence
  chemically synthesized
tttcttctatgtttaccctt

SEQ ID NO: 61749 - DNA, 20 bp, Artificial Sequence
  chemically synthesized
aatctgtgtttttaagcatg

SEQ ID NO: 61750 - DNA, 20 bp, Artificial Sequence
  chemically synthesized
attataattcagtcttctat

SEQ ID NO: 61751 - DNA, 20 bp, Artificial Sequence
  chemically synthesized
attcaatgtgatttaatttt

SEQ ID NO: 61752 - DNA, 20 bp, Artificial Sequence
  chemically synthesized
aggtgctaaagacttgcctc

SEQ ID NO: 61753 - DNA, 20 bp, Artificial Sequence
  chemically synthesized
aaagacttgcctccaggatt

SEQ ID NO: 61754 - DNA, 20 bp, Artificial Sequence
  chemically synthesized
ttctttctcccatacccctc

SEQ ID NO: 61755 - DNA, 20 bp, Artificial Sequence
  chemically synthesized
cagaactgcaacagttcctc

SEQ ID NO: 61756 - DNA, 20 bp, Artificial Sequence
  chemically synthesized
gcaacagttcctcaggagtt

SEQ ID NO: 61757 - DNA, 20 bp, Artificial Sequence
  chemically synthesized
ggagaaaatgagaaaatcaa

SEQ ID NO: 61758 - DNA, 20 bp, Artificial Sequence
  chemically synthesized
aaaggtttctatctcgaaag

SEQ ID NO: 61759 - DNA, 20 bp, Artificial Sequence
  chemically synthesized
gcccagacattgttttgcac

SEQ ID NO: 61760 - DNA, 20 bp, Artificial Sequence
  chemically synthesized
cacctgaggacctgaaaaaa

SEQ ID NO: 61761 - DNA, 20 bp, Artificial Sequence
  chemically synthesized
tgaaaaaagcgaatttgatt

SEQ ID NO: 61762 - DNA, 20 bp, Artificial Sequence
  chemically synthesized
attcagaatgttggaagggg

SEQ ID NO: 61763 - DNA, 20 bp, Artificial Sequence
  chemically synthesized
ggccaagctcaagtaactgt

SEQ ID NO: 61764 - DNA, 20 bp, Artificial Sequence
  chemically synthesized
taagtaccctcaaaatagtt

SEQ ID NO: 61765 - DNA, 20 bp, Artificial Sequence
  chemically synthesized
ttaaaattaatgaaaaattt

SEQ ID NO: 61766 - DNA, 20 bp, Artificial Sequence
  chemically synthesized
cttcttcaggaaaatagttg

SEQ ID NO: 61767 - DNA, 20 bp, Artificial Sequence
  chemically synthesized
aagaaatctgatctttaccg

SEQ ID NO: 61768 - DNA, 20 bp, Artificial Sequence
  chemically synthesized
gggctggaggcagctcatca

SEQ ID NO: 61769 - DNA, 20 bp, Artificial Sequence
  chemically synthesized
cctactgtaatgggcatcct

SEQ ID NO: 61770 - DNA, 20 bp, Artificial Sequence
  chemically synthesized
ctgtaatgggcatcctatgg

SEQ ID NO: 61771 - DNA, 20 bp, Artificial Sequence
  chemically synthesized
tattcactccctttctgttg

SEQ ID NO: 61772 - DNA, 20 bp, Artificial Sequence
  chemically synthesized
gcttccattctcaccaatac

SEQ ID NO: 61773 - DNA, 20 bp, Artificial Sequence
  chemically synthesized
aatactagagtcatagcgtt

SEQ ID NO: 61774 - DNA, 20 bp, Artificial Sequence
  chemically synthesized
agagtcatagcgttaggagt

SEQ ID NO: 61775 - DNA, 20 bp, Artificial Sequence
  chemically synthesized
taggagtgggagtgtttcta

SEQ ID NO: 61776 - DNA, 20 bp, Artificial Sequence
  chemically synthesized
ttatcttctatgttacagtg

SEQ ID NO: 61777 - DNA, 20 bp, Artificial Sequence
  chemically synthesized
cattcatttacagatttggg

SEQ ID NO: 61778 - DNA, 20 bp, Artificial Sequence
  chemically synthesized
cagaggttgtccacattatc

SEQ ID NO: 61779 - DNA, 20 bp, Artificial Sequence
  chemically synthesized
cataggtttagtagttaaac

SEQ ID NO: 61780 - DNA, 20 bp, Artificial Sequence
  chemically synthesized
agtagttaaactcggatctg

SEQ ID NO: 61781 - DNA, 20 bp, Artificial Sequence
  chemically synthesized
cacagacataaaaatgaagc

SEQ ID NO: 61782 - DNA, 20 bp, Artificial Sequence
  chemically synthesized
cagaatgaaaaatgaaagcc

SEQ ID NO: 61783 - DNA, 20 bp, Artificial Sequence
  chemically synthesized
gttctttcttagcaaagagc

SEQ ID NO: 61784 - DNA, 20 bp, Artificial Sequence
  chemically synthesized
aggacttaagtactttacca

SEQ ID NO: 61785 - DNA, 20 bp, Artificial Sequence
  chemically synthesized
agaagtctggtgacagaaca

SEQ ID NO: 61786 - DNA, 20 bp, Artificial Sequence
  chemically synthesized
tcttttaactgtcctctacc

SEQ ID NO: 61787 - DNA, 20 bp, Artificial Sequence
  chemically synthesized
aactgtcctctaccctgagt

SEQ ID NO: 61788 - DNA, 20 bp, Artificial Sequence
  chemically synthesized
atacagtcgtaagtcactta

SEQ ID NO: 61789 - DNA, 20 bp, Artificial Sequence
  chemically synthesized
aattttcaatacattccttg

SEQ ID NO: 61790 - DNA, 20 bp, Artificial Sequence
  chemically synthesized
atacattccttgcaggatgt

SEQ ID NO: 61791 - DNA, 20 bp, Artificial Sequence
  chemically synthesized
agctcgtaaaaaagtaaaaa

SEQ ID NO: 61792 - DNA, 20 bp, Artificial Sequence
  chemically synthesized
aaagtaaaaagtgagttttt

SEQ ID NO: 61793 - DNA, 20 bp, Artificial Sequence
  chemically synthesized
tcccttggcctaataatagg

SEQ ID NO: 61794 - DNA, 20 bp, Artificial Sequence
  chemically synthesized
aatagaaaatatagccattc

SEQ ID NO: 61795 - DNA, 20 bp, Artificial Sequence
  chemically synthesized
gaccaacaatgttgagagaa

SEQ ID NO: 61796 - DNA, 20 bp, Artificial Sequence
  chemically synthesized
gactaaaaaattgtggtggg

SEQ ID NO: 61797 - DNA, 20 bp, Artificial Sequence
  chemically synthesized
agactgatttaattgtgaaa

SEQ ID NO: 61798 - DNA, 20 bp, Artificial Sequence
  chemically synthesized
caaaaggggaaaacctatct

SEQ ID NO: 61799 - DNA, 20 bp, Artificial Sequence
  chemically synthesized
taatgttcaagttattgatg

SEQ ID NO: 61800 - DNA, 20 bp, Artificial Sequence
  chemically synthesized
cttaatggaaaaatctcatt

SEQ ID NO: 61801 - DNA, 20 bp, Artificial Sequence
  chemically synthesized
ccatctgatatctaaatttt

SEQ ID NO: 61802 - DNA, 20 bp, Artificial Sequence
  chemically synthesized
gcatgccttttgtgtatatg

SEQ ID NO: 61803 - DNA, 20 bp, Artificial Sequence
  chemically synthesized
ttttgtgtatatggtgggtt

SEQ ID NO: 61804 - DNA, 20 bp, Artificial Sequence
  chemically synthesized
atggcaatattgcagcctca

SEQ ID NO: 61805 - DNA, 20 bp, Artificial Sequence
  chemically synthesized
ggtataaggaggtgcttact

SEQ ID NO: 61806 - DNA, 20 bp, Artificial Sequence
  chemically synthesized
tccttaaactggtttagacg

SEQ ID NO: 61807 - DNA, 20 bp, Artificial Sequence
  chemically synthesized
atttttcaaattgattctaa

SEQ ID NO: 61808 - DNA, 20 bp, Artificial Sequence
  chemically synthesized
attgattctaagagggtgat

SEQ ID NO: 61809 - DNA, 20 bp, Artificial Sequence
  chemically synthesized
ctgttagaaaagaaaatgat

SEQ ID NO: 61810 - DNA, 20 bp, Artificial Sequence
  chemically synthesized
atgatatgagtaattttctc

SEQ ID NO: 61811 - DNA, 20 bp, Artificial Sequence
  chemically synthesized
caataaataactgttgatta

SEQ ID NO: 61812 - DNA, 20 bp, Artificial Sequence
  chemically synthesized
ctcagttctattctaagtca

SEQ ID NO: 61813 - DNA, 20 bp, Artificial Sequence
  chemically synthesized
atacttccttaatgtatatt

SEQ ID NO: 61814 - DNA, 20 bp, Artificial Sequence
  chemically synthesized
ttgaataaaattatttttat

SEQ ID NO: 61815 - DNA, 20 bp, Artificial Sequence
  chemically synthesized
cgtagtaatgatagtgttgt

SEQ ID NO: 61816 - DNA, 20 bp, Artificial Sequence
  chemically synthesized
attttctttctagtgcctgc

SEQ ID NO: 61817 - DNA, 20 bp, Artificial Sequence
  chemically synthesized
ttctttgtggctgttcttaa

SEQ ID NO: 61818 - DNA, 20 bp, Artificial Sequence
  chemically synthesized
cagttctagcagccttttgg

SEQ ID NO: 61819 - DNA, 20 bp, Artificial Sequence
  chemically synthesized
cagccttttggaagaatctg

SEQ ID NO: 61820 - DNA, 20 bp, Artificial Sequence
  chemically synthesized
tctgtaggattttctaagta

SEQ ID NO: 61821 - DNA, 20 bp, Artificial Sequence
  chemically synthesized
cttccaattttatgttcact

SEQ ID NO: 61822 - DNA, 20 bp, Artificial Sequence
  chemically synthesized
ttatgttcactaggagtggt

SEQ ID NO: 61823 - DNA, 20 bp, Artificial Sequence
  chemically synthesized
tcactaggagtggtgagaat

SEQ ID NO: 61824 - DNA, 20 bp, Artificial Sequence
  chemically synthesized
gtcttgttgcagttttcgag

SEQ ID NO: 61825 - DNA, 20 bp, Artificial Sequence
  chemically synthesized
cattcagtatggttttggtt

SEQ ID NO: 61826 - DNA, 20 bp, Artificial Sequence
  chemically synthesized
gttggaggtttttatcatga

SEQ ID NO: 61827 - DNA, 20 bp, Artificial Sequence
  chemically synthesized
gtttttatcatgaagggatg

SEQ ID NO: 61828 - DNA, 20 bp, Artificial Sequence
  chemically synthesized
aataaaagctttccaggctc

SEQ ID NO: 61829 - DNA, 20 bp, Artificial Sequence
  chemically synthesized
tttccaggctcatggattgg

SEQ ID NO: 61830 - DNA, 20 bp, Artificial Sequence
  chemically synthesized
catggattggaagaatcaat

SEQ ID NO: 61831 - DNA, 20 bp, Artificial Sequence
  chemically synthesized
tagcactttagggggctgag

SEQ ID NO: 61832 - DNA, 20 bp, Artificial Sequence
  chemically synthesized
tgggtgtatcacctgaggtc

SEQ ID NO: 61833 - DNA, 20 bp, Artificial Sequence
  chemically synthesized
tactcggaaggctgaggcag

SEQ ID NO: 61834 - DNA, 20 bp, Artificial Sequence
  chemically synthesized
tcgcaccactgcactccagc

SEQ ID NO: 61835 - DNA, 20 bp, Artificial Sequence
  chemically synthesized
ctgcactccagcctgggtga

SEQ ID NO: 61836 - DNA, 20 bp, Artificial Sequence
  chemically synthesized
acctatccaataaactgtgc

SEQ ID NO: 61837 - DNA, 20 bp, Artificial Sequence
  chemically synthesized
acgtggctagccatatgcag

SEQ ID NO: 61838 - DNA, 20 bp, Artificial Sequence
  chemically synthesized
tttagagaaatcaactgaaa

SEQ ID NO: 61839 - DNA, 20 bp, Artificial Sequence
  chemically synthesized
acccaaatgtccaacaatga

SEQ ID NO: 61840 - DNA, 20 bp, Artificial Sequence
  chemically synthesized
aaatgtccaacaatgataga

SEQ ID NO: 61841 - DNA, 20 bp, Artificial Sequence
  chemically synthesized
aatgtggcacatatacacca

SEQ ID NO: 61842 - DNA, 20 bp, Artificial Sequence
  chemically synthesized
ctatgcagccataaaaaatg

SEQ ID NO: 61843 - DNA, 20 bp, Artificial Sequence
  chemically synthesized
ttcatgtcctttgtagggac

SEQ ID NO: 61844 - DNA, 20 bp, Artificial Sequence
  chemically synthesized
acatgttctcacttataggt

SEQ ID NO: 61845 - DNA, 20 bp, Artificial Sequence
  chemically synthesized
tcacacaccagggcctgttg

SEQ ID NO: 61846 - DNA, 20 bp, Artificial Sequence
  chemically synthesized
accagggcctgttgtggggt

SEQ ID NO: 61847 - DNA, 20 bp, Artificial Sequence
  chemically synthesized
cctgttgtggggtgggggtg

SEQ ID NO: 61848 - DNA, 20 bp, Artificial Sequence
  chemically synthesized
ggtgggggtggggggtggag

SEQ ID NO: 61849 - DNA, 20 bp, Artificial Sequence
  chemically synthesized
agatatacctaatgtaaatg

SEQ ID NO: 61850 - DNA, 20 bp, Artificial Sequence
  chemically synthesized
ctaatgtaaatgatgagtta

SEQ ID NO: 61851 - DNA, 20 bp, Artificial Sequence
  chemically synthesized
gcagcagaagaaactatcaa

SEQ ID NO: 61852 - DNA, 20 bp, Artificial Sequence
  chemically synthesized
cagagtaaactgacaatcta

SEQ ID NO: 61853 - DNA, 20 bp, Artificial Sequence
  chemically synthesized
tctggaaaaggtctaatatt

SEQ ID NO: 61854 - DNA, 20 bp, Artificial Sequence
  chemically synthesized
tctaatattcagaatctata

SEQ ID NO: 61855 - DNA, 20 bp, Artificial Sequence
  chemically synthesized
agatactatctcataccagt

SEQ ID NO: 61856 - DNA, 20 bp, Artificial Sequence
  chemically synthesized
aacacttatacaatgatgat

SEQ ID NO: 61857 - DNA, 20 bp, Artificial Sequence
  chemically synthesized
ccactgcagaaaacagtttg

SEQ ID NO: 61858 - DNA, 20 bp, Artificial Sequence
  chemically synthesized
ttgacacagcaatcccgcta

SEQ ID NO: 61859 - DNA, 20 bp, Artificial Sequence
  chemically synthesized
atgttcactgtaatgctgtt

SEQ ID NO: 61860 - DNA, 20 bp, Artificial Sequence
  chemically synthesized
aggtgtctatcaaaggcgga

SEQ ID NO: 61861 - DNA, 20 bp, Artificial Sequence
  chemically synthesized
atcatgtccttttcagcaac

SEQ ID NO: 61862 - DNA, 20 bp, Artificial Sequence
  chemically synthesized
ttataagtggaagctaaaca

SEQ ID NO: 61863 - DNA, 20 bp, Artificial Sequence
  chemically synthesized
aagctaaacattgagtacac

SEQ ID NO: 61864 - DNA, 20 bp, Artificial Sequence
  chemically synthesized
gggcagggagagatgcggga

SEQ ID NO: 61865 - DNA, 20 bp, Artificial Sequence
  chemically synthesized
ggagagggttaaaaaatcta

SEQ ID NO: 61866 - DNA, 20 bp, Artificial Sequence
  chemically synthesized
atagatccattgaggttcct

SEQ ID NO: 61867 - DNA, 20 bp, Artificial Sequence
  chemically synthesized
agacaatgcaaagtacacac

SEQ ID NO: 61868 - DNA, 20 bp, Artificial Sequence
  chemically synthesized
atatactgtgtactgatgct

SEQ ID NO: 61869 - DNA, 20 bp, Artificial Sequence
  chemically synthesized
tactgatgcttagggtcctg

SEQ ID NO: 61870 - DNA, 20 bp, Artificial Sequence
  chemically synthesized
tcccaatgtagaggtggcat

SEQ ID NO: 61871 - DNA, 20 bp, Artificial Sequence
  chemically synthesized
cagaggagggaggggagatc

SEQ ID NO: 61872 - DNA, 20 bp, Artificial Sequence
  chemically synthesized
aggggagatcaagggttctt

SEQ ID NO: 61873 - DNA, 20 bp, Artificial Sequence
  chemically synthesized
aaactctctaatttggcctc

SEQ ID NO: 61874 - DNA, 20 bp, Artificial Sequence
  chemically synthesized
tcttgaatagtctttgagaa

SEQ ID NO: 61875 - DNA, 20 bp, Artificial Sequence
  chemically synthesized
ttgagaagtgagtgtctgaa

SEQ ID NO: 61876 - DNA, 20 bp, Artificial Sequence
  chemically synthesized
actgagtcttcaaatagagc

SEQ ID NO: 61877 - DNA, 20 bp, Artificial Sequence
  chemically synthesized
agtcttcaaatagagcagga

SEQ ID NO: 61878 - DNA, 20 bp, Artificial Sequence
  chemically synthesized
gcaagaaaatgacagcatag

SEQ ID NO: 61879 - DNA, 20 bp, Artificial Sequence
  chemically synthesized
cataggtgagtgccaggaac

SEQ ID NO: 61880 - DNA, 20 bp, Artificial Sequence
  chemically synthesized
gagtgccaggaacaggaata

SEQ ID NO: 61881 - DNA, 20 bp, Artificial Sequence
  chemically synthesized
ataggagaacatactccatc

SEQ ID NO: 61882 - DNA, 20 bp, Artificial Sequence
  chemically synthesized
aagtttcaaatgtggtgctc

SEQ ID NO: 61883 - DNA, 20 bp, Artificial Sequence
  chemically synthesized
gattagcttcaggaaaacgt

SEQ ID NO: 61884 - DNA, 20 bp, Artificial Sequence
  chemically synthesized
agagggctcatggcttttgt

SEQ ID NO: 61885 - DNA, 20 bp, Artificial Sequence
  chemically synthesized
taaaatgtgttttttagatt

SEQ ID NO: 61886 - DNA, 20 bp, Artificial Sequence
  chemically synthesized
ccaataaattattgctaaat

SEQ ID NO: 61887 - DNA, 20 bp, Artificial Sequence
  chemically synthesized
ttattgctaaatatgaatat

SEQ ID NO: 61888 - DNA, 20 bp, Artificial Sequence
  chemically synthesized
gtagtaaaaactgataaggc

SEQ ID NO: 61889 - DNA, 20 bp, Artificial Sequence
  chemically synthesized
cccactgtaatgggcgtctt

SEQ ID NO: 61890 - DNA, 20 bp, Artificial Sequence
  chemically synthesized
ctgtaatgggcgtcttgtgg

SEQ ID NO: 61891 - DNA, 20 bp, Artificial Sequence
  chemically synthesized
ccactcccattatccacttg

SEQ ID NO: 61892 - DNA, 20 bp, Artificial Sequence
  chemically synthesized
ataactatttctactaaatc

SEQ ID NO: 61893 - DNA, 20 bp, Artificial Sequence
  chemically synthesized
gttcgcctattttctgggca

SEQ ID NO: 61894 - DNA, 20 bp, Artificial Sequence
  chemically synthesized
aatggcttgagccctttttt

SEQ ID NO: 61895 - DNA, 20 bp, Artificial Sequence
  chemically synthesized
cttcatgatttctgggcctt

SEQ ID NO: 61896 - DNA, 20 bp, Artificial Sequence
  chemically synthesized
ctacatggaacaataataca

SEQ ID NO: 61897 - DNA, 20 bp, Artificial Sequence
  chemically synthesized
attgagagatactaggaaag

SEQ ID NO: 61898 - DNA, 20 bp, Artificial Sequence
  chemically synthesized
actaggaaagtggaatacta

SEQ ID NO: 61899 - DNA, 20 bp, Artificial Sequence
  chemically synthesized
actgaaagtaccattttagg

SEQ ID NO: 61900 - DNA, 20 bp, Artificial Sequence
  chemically synthesized
ctagttttggccatataaag

SEQ ID NO: 61901 - DNA, 20 bp, Artificial Sequence
  chemically synthesized
ataaagatgaattatagcat

SEQ ID NO: 61902 - DNA, 20 bp, Artificial Sequence
  chemically synthesized
atctcaaaactactctattt

SEQ ID NO: 61903 - DNA, 20 bp, Artificial Sequence
  chemically synthesized
taagttccagggcacatgtg

SEQ ID NO: 61904 - DNA, 20 bp, Artificial Sequence
  chemically synthesized
tgttcctgtgttagtttgat

SEQ ID NO: 61905 - DNA, 20 bp, Artificial Sequence
  chemically synthesized
actctatcattgatggacat

SEQ ID NO: 61906 - DNA, 20 bp, Artificial Sequence
  chemically synthesized
gattccacatcttggctatt

SEQ ID NO: 61907 - DNA, 20 bp, Artificial Sequence
  chemically synthesized
atagattgatttatattcct

SEQ ID NO: 61908 - DNA, 20 bp, Artificial Sequence
  chemically synthesized
tatacccagtaatgagattg

SEQ ID NO: 61909 - DNA, 20 bp, Artificial Sequence
  chemically synthesized
ttcatatgtttattagaagc

SEQ ID NO: 61910 - DNA, 20 bp, Artificial Sequence
  chemically synthesized
tgtcattccccactttttaa

SEQ ID NO: 61911 - DNA, 20 bp, Artificial Sequence
  chemically synthesized
ttgcagttgcttttggtgtc

SEQ ID NO: 61912 - DNA, 20 bp, Artificial Sequence
  chemically synthesized
atttcctagttgctcatttc

SEQ ID NO: 61913 - DNA, 20 bp, Artificial Sequence
  chemically synthesized
tcttgtgttctctctaaatg

SEQ ID NO: 61914 - DNA, 20 bp, Artificial Sequence
  chemically synthesized
cagcaacttggaaatctcac

SEQ ID NO: 61915 - DNA, 20 bp, Artificial Sequence
  chemically synthesized
tgtacatatcctatgtttaa

SEQ ID NO: 61916 - DNA, 20 bp, Artificial Sequence
  chemically synthesized
aaaagggtttgtgtttggag

SEQ ID NO: 61917 - DNA, 20 bp, Artificial Sequence
  chemically synthesized
aattttttaagggcactatt

SEQ ID NO: 61918 - DNA, 20 bp, Artificial Sequence
  chemically synthesized
ttcaaataagtggggactca

SEQ ID NO: 61919 - DNA, 20 bp, Artificial Sequence
  chemically synthesized
cataaagcagaaagaagaca

SEQ ID NO: 61920 - DNA, 20 bp, Artificial Sequence
  chemically synthesized
cagaaagaagacactgaatg

SEQ ID NO: 61921 - DNA, 20 bp, Artificial Sequence
  chemically synthesized
gaagacactgaatggagagt

SEQ ID NO: 61922 - DNA, 20 bp, Artificial Sequence
  chemically synthesized
ttgaggttatggcttgaaat

SEQ ID NO: 61923 - DNA, 20 bp, Artificial Sequence
  chemically synthesized
ccttcagctgagacctgaaa

SEQ ID NO: 61924 - DNA, 20 bp, Artificial Sequence
  chemically synthesized
taactggtgaaaatacagac

SEQ ID NO: 61925 - DNA, 20 bp, Artificial Sequence
  chemically synthesized
caagaatattctaagactga

SEQ ID NO: 61926 - DNA, 20 bp, Artificial Sequence
  chemically synthesized
agggaaggtggctactggaa

SEQ ID NO: 61927 - DNA, 20 bp, Artificial Sequence
  chemically synthesized
gagaagaggctgaagaggga

SEQ ID NO: 61928 - DNA, 20 bp, Artificial Sequence
  chemically synthesized
atggccttattggtcatcat

SEQ ID NO: 61929 - DNA, 20 bp, Artificial Sequence
  chemically synthesized
ttattggtcatcataagagt

SEQ ID NO: 61930 - DNA, 20 bp, Artificial Sequence
  chemically synthesized
taagagtttgagtctctact

SEQ ID NO: 61931 - DNA, 20 bp, Artificial Sequence
  chemically synthesized
cttcaatattatttataaaa

SEQ ID NO: 61932 - DNA, 20 bp, Artificial Sequence
  chemically synthesized
tgagggaggcagggaaaggg

SEQ ID NO: 61933 - DNA, 20 bp, Artificial Sequence
  chemically synthesized
gcagggaaagggcagaatat

SEQ ID NO: 61934 - DNA, 20 bp, Artificial Sequence
  chemically synthesized
ttagaaaagcagaggaaaga

SEQ ID NO: 61935 - DNA, 20 bp, Artificial Sequence
  chemically synthesized
atgtattgtctataaataag

SEQ ID NO: 61936 - DNA, 20 bp, Artificial Sequence
  chemically synthesized
ttttaaagttgtgggacact

SEQ ID NO: 61937 - DNA, 20 bp, Artificial Sequence
  chemically synthesized
aaagttgtgggacactgaga

SEQ ID NO: 61938 - DNA, 20 bp, Artificial Sequence
  chemically synthesized
tttctttttgcctgatcatg

SEQ ID NO: 61939 - DNA, 20 bp, Artificial Sequence
  chemically synthesized
gacatatgtcagaaaatgat

SEQ ID NO: 61940 - DNA, 20 bp, Artificial Sequence
  chemically synthesized
atgacacccaaagaaggtca

SEQ ID NO: 61941 - DNA, 20 bp, Artificial Sequence
  chemically synthesized
ctcactatcctaggagaaag

SEQ ID NO: 61942 - DNA, 20 bp, Artificial Sequence
  chemically synthesized
taggagaaagcaggatagat

SEQ ID NO: 61943 - DNA, 20 bp, Artificial Sequence
  chemically synthesized
aggatagatccgggtttttc

SEQ ID NO: 61944 - DNA, 20 bp, Artificial Sequence
  chemically synthesized
atacaaacataaataggaag

SEQ ID NO: 61945 - DNA, 20 bp, Artificial Sequence
  chemically synthesized
gaagatggattaactaaatt

SEQ ID NO: 61946 - DNA, 20 bp, Artificial Sequence
  chemically synthesized
actaaattctgaattaccag

SEQ ID NO: 61947 - DNA, 20 bp, Artificial Sequence
  chemically synthesized
ttaccagatgagtaaataac

SEQ ID NO: 61948 - DNA, 20 bp, Artificial Sequence
  chemically synthesized
ttgaaaaatgaagttttttc

SEQ ID NO: 61949 - DNA, 20 bp, Artificial Sequence
  chemically synthesized
ctttctctcaagtgaaattg

SEQ ID NO: 61950 - DNA, 20 bp, Artificial Sequence
  chemically synthesized
tgtgtggacacctgcacatg

SEQ ID NO: 61951 - DNA, 20 bp, Artificial Sequence
  chemically synthesized
aacctttcacaataaattta

SEQ ID NO: 61952 - DNA, 20 bp, Artificial Sequence
  chemically synthesized
ctaatctactttttgtctct

SEQ ID NO: 61953 - DNA, 20 bp, Artificial Sequence
  chemically synthesized
tgcgtatgacttattgcact

SEQ ID NO: 61954 - DNA, 20 bp, Artificial Sequence
  chemically synthesized
gtttctattccttggctact

SEQ ID NO: 61955 - DNA, 20 bp, Artificial Sequence
  chemically synthesized
tctctctacttcctctcact

SEQ ID NO: 61956 - DNA, 20 bp, Artificial Sequence
  chemically synthesized
tctgaatattctgcttttca

SEQ ID NO: 61957 - DNA, 20 bp, Artificial Sequence
  chemically synthesized
gcttttcaaagaatattcct

SEQ ID NO: 61958 - DNA, 20 bp, Artificial Sequence
  chemically synthesized
ctgactgcaacctctgcctc

SEQ ID NO: 61959 - DNA, 20 bp, Artificial Sequence
  chemically synthesized
aatctttgctctggacttca

SEQ ID NO: 61960 - DNA, 20 bp, Artificial Sequence
  chemically synthesized
gttttgttttgtttttgaga

SEQ ID NO: 61961 - DNA, 20 bp, Artificial Sequence
  chemically synthesized
tctcgctctgtcgcccaggc

SEQ ID NO: 61962 - DNA, 20 bp, Artificial Sequence
  chemically synthesized
ctcactgcaagctctgcctc

SEQ ID NO: 61963 - DNA, 20 bp, Artificial Sequence
  chemically synthesized
cattctcctgcctcagcctc

SEQ ID NO: 61964 - DNA, 20 bp, Artificial Sequence
  chemically synthesized
ttttgtctttttagtagaga

SEQ ID NO: 61965 - DNA, 20 bp, Artificial Sequence
  chemically synthesized
cggggtttcactgtgttagc

SEQ ID NO: 61966 - DNA, 20 bp, Artificial Sequence
  chemically synthesized
gcctcggcctcccaaagtgc

SEQ ID NO: 61967 - DNA, 20 bp, Artificial Sequence
  chemically synthesized
cgtgagccaccgcgcccggc

SEQ ID NO: 61968 - DNA, 20 bp, Artificial Sequence
  chemically synthesized
gagaaatgagatccaatcta

SEQ ID NO: 61969 - DNA, 20 bp, Artificial Sequence
  chemically synthesized
tgtattaaaactttttcata

SEQ ID NO: 61970 - DNA, 20 bp, Artificial Sequence
  chemically synthesized
gtaagcaaaattatatgcta

SEQ ID NO: 61971 - DNA, 20 bp, Artificial Sequence
  chemically synthesized
caatgtttaagctattgata

SEQ ID NO: 61972 - DNA, 20 bp, Artificial Sequence
  chemically synthesized
ttccatcttgatttgctgac

SEQ ID NO: 61973 - DNA, 20 bp, Artificial Sequence
  chemically synthesized
gtctttgtaagttattttgg

SEQ ID NO: 61974 - DNA, 20 bp, Artificial Sequence
  chemically synthesized
aacggttatctgggcctgtt

SEQ ID NO: 61975 - DNA, 20 bp, Artificial Sequence
  chemically synthesized
atctgggcctgttgtggatt

SEQ ID NO: 61976 - DNA, 20 bp, Artificial Sequence
  chemically synthesized
gattgtgaatatgacaatat

SEQ ID NO: 61977 - DNA, 20 bp, Artificial Sequence
  chemically synthesized
taagagagggacactcactt

SEQ ID NO: 61978 - DNA, 20 bp, Artificial Sequence
  chemically synthesized
tgatggaggaaagagattgg

SEQ ID NO: 61979 - DNA, 20 bp, Artificial Sequence
  chemically synthesized
gattggaggaatgtagattt

SEQ ID NO: 61980 - DNA, 20 bp, Artificial Sequence
  chemically synthesized
gaagttgtttggcttggaag

SEQ ID NO: 61981 - DNA, 20 bp, Artificial Sequence
  chemically synthesized
aatgtctgatatattattgt

SEQ ID NO: 61982 - DNA, 20 bp, Artificial Sequence
  chemically synthesized
ttggggtacagttctttatt

SEQ ID NO: 61983 - DNA, 20 bp, Artificial Sequence
  chemically synthesized
tacagttctttattgagaat

SEQ ID NO: 61984 - DNA, 20 bp, Artificial Sequence
  chemically synthesized
tttcaaagtagtcttttcat

SEQ ID NO: 61985 - DNA, 20 bp, Artificial Sequence
  chemically synthesized
tagtcttttcattggaatgg

SEQ ID NO: 61986 - DNA, 20 bp, Artificial Sequence
  chemically synthesized
tctcaccactgcactccctc

SEQ ID NO: 61987 - DNA, 20 bp, Artificial Sequence
  chemically synthesized
agagaggaaagaaaagaaaa

SEQ ID NO: 61988 - DNA, 20 bp, Artificial Sequence
  chemically synthesized
aagaaagaaaaaagaaagga

SEQ ID NO: 61989 - DNA, 20 bp, Artificial Sequence
  chemically synthesized
tctttcttcttgatgttgtt

SEQ ID NO: 61990 - DNA, 20 bp, Artificial Sequence
  chemically synthesized
aaaaccaatggcttgatcac

SEQ ID NO: 61991 - DNA, 20 bp, Artificial Sequence
  chemically synthesized
ttcagaagttttgttttact

SEQ ID NO: 61992 - DNA, 20 bp, Artificial Sequence
  chemically synthesized
tcacttcttagctacaagtc

SEQ ID NO: 61993 - DNA, 20 bp, Artificial Sequence
  chemically synthesized
gaatcaacaggttctgcaaa

SEQ ID NO: 61994 - DNA, 20 bp, Artificial Sequence
  chemically synthesized
aggttctgcaaaatgaattc

SEQ ID NO: 61995 - DNA, 20 bp, Artificial Sequence
  chemically synthesized
acgttttggcaaaatcttac

SEQ ID NO: 61996 - DNA, 20 bp, Artificial Sequence
  chemically synthesized
aatcttacctgaatatatga

SEQ ID NO: 61997 - DNA, 20 bp, Artificial Sequence
  chemically synthesized
tataaacaggtgatagtaaa

SEQ ID NO: 61998 - DNA, 20 bp, Artificial Sequence
  chemically synthesized
agtaaatagagtaacttgct

SEQ ID NO: 61999 - DNA, 20 bp, Artificial Sequence
  chemically synthesized
cgagtgtcacatatattatg

SEQ ID NO: 62000 - DNA, 20 bp, Artificial Sequence
  chemically synthesized
actattttaaatctgaaaga

SEQ ID NO: 62001 - DNA, 20 bp, Artificial Sequence
  chemically synthesized
aatttgacatgttttgagat

SEQ ID NO: 62002 - DNA, 20 bp, Artificial Sequence
  chemically synthesized
catgttttgagataagagtt

SEQ ID NO: 62003 - DNA, 20 bp, Artificial Sequence
  chemically synthesized
tttgagataagagtttaggg

SEQ ID NO: 62004 - DNA, 20 bp, Artificial Sequence
  chemically synthesized
tccaatgaaaaaagagattt

SEQ ID NO: 62005 - DNA, 20 bp, Artificial Sequence
  chemically synthesized
tgggactaatatgacaacat

SEQ ID NO: 62006 - DNA, 20 bp, Artificial Sequence
  chemically synthesized
gagcatcataggaaataaat

SEQ ID NO: 62007 - DNA, 20 bp, Artificial Sequence
  chemically synthesized
ataggaaataaatcaggatt

SEQ ID NO: 62008 - DNA, 20 bp, Artificial Sequence
  chemically synthesized
acccatcaggaaagaagtct

SEQ ID NO: 62009 - DNA, 20 bp, Artificial Sequence
  chemically synthesized
catctagaaaaaaattatgt

SEQ ID NO: 62010 - DNA, 20 bp, Artificial Sequence
  chemically synthesized
ggagatcagacctaaatata

SEQ ID NO: 62011 - DNA, 20 bp, Artificial Sequence
  chemically synthesized
ctctctcactgtctctgtct

SEQ ID NO: 62012 - DNA, 20 bp, Artificial Sequence
  chemically synthesized
taaatgaaacccacatatat

SEQ ID NO: 62013 - DNA, 20 bp, Artificial Sequence
  chemically synthesized
tatatatgaatgagatagct

SEQ ID NO: 62014 - DNA, 20 bp, Artificial Sequence
  chemically synthesized
atgaatgagatagctcaggg

SEQ ID NO: 62015 - DNA, 20 bp, Artificial Sequence
  chemically synthesized
agatagctcagggtagggta

SEQ ID NO: 62016 - DNA, 20 bp, Artificial Sequence
  chemically synthesized
tcagggtagggtagtgagtt

SEQ ID NO: 62017 - DNA, 20 bp, Artificial Sequence
  chemically synthesized
gtgagttttgaatcaataga

SEQ ID NO: 62018 - DNA, 20 bp, Artificial Sequence
  chemically synthesized
aaagaataaataaatgtctg

SEQ ID NO: 62019 - DNA, 20 bp, Artificial Sequence
  chemically synthesized
aaaaggtttggtggtggctc

SEQ ID NO: 62020 - DNA, 20 bp, Artificial Sequence
  chemically synthesized
ggtggctcaaggattttgta

SEQ ID NO: 62021 - DNA, 20 bp, Artificial Sequence
  chemically synthesized
ctcaaggattttgtaaaggg

SEQ ID NO: 62022 - DNA, 20 bp, Artificial Sequence
  chemically synthesized
ttttgtaaagggttgaatta

SEQ ID NO: 62023 - DNA, 20 bp, Artificial Sequence
  chemically synthesized
ctaagaccaatggaacactt

SEQ ID NO: 62024 - DNA, 20 bp, Artificial Sequence
  chemically synthesized
tcccaggttggggaggaaaa

SEQ ID NO: 62025 - DNA, 20 bp, Artificial Sequence
  chemically synthesized
tatcctatgtggaaatgagc

SEQ ID NO: 62026 - DNA, 20 bp, Artificial Sequence
  chemically synthesized
atgagctagaataacccctt

SEQ ID NO: 62027 - DNA, 20 bp, Artificial Sequence
  chemically synthesized
gtaacaaatatatctctcat

SEQ ID NO: 62028 - DNA, 20 bp, Artificial Sequence
  chemically synthesized
atatatctctcatcagaatt

SEQ ID NO: 62029 - DNA, 20 bp, Artificial Sequence
  chemically synthesized
cagaattaagagtaaatact

SEQ ID NO: 62030 - DNA, 20 bp, Artificial Sequence
  chemically synthesized
tggctcaggtaagaaaagcc

SEQ ID NO: 62031 - DNA, 20 bp, Artificial Sequence
  chemically synthesized
ccatttgatggacattggtt

SEQ ID NO: 62032 - DNA, 20 bp, Artificial Sequence
  chemically synthesized
cattggttgagaatatgagc

SEQ ID NO: 62033 - DNA, 20 bp, Artificial Sequence
  chemically synthesized
tgagaatatgagcttgggtt

SEQ ID NO: 62034 - DNA, 20 bp, Artificial Sequence
  chemically synthesized
tgggttagataaacctgtgt

SEQ ID NO: 62035 - DNA, 20 bp, Artificial Sequence
  chemically synthesized
tttttctctgttgcccaggc

SEQ ID NO: 62036 - DNA, 20 bp, Artificial Sequence
  chemically synthesized
ctcactgcgacctcctccac

SEQ ID NO: 62037 - DNA, 20 bp, Artificial Sequence
  chemically synthesized
acctcctccaccagggttca

SEQ ID NO: 62038 - DNA, 20 bp, Artificial Sequence
  chemically synthesized
gattctcatgcctcagcctc

SEQ ID NO: 62039 - DNA, 20 bp, Artificial Sequence
  chemically synthesized
gcctcagcctccagagtagc

SEQ ID NO: 62040 - DNA, 20 bp, Artificial Sequence
  chemically synthesized
tcctcggcctcccaaagtgc

SEQ ID NO: 62041 - DNA, 20 bp, Artificial Sequence
  chemically synthesized
aattctcctgcctcagcctc

SEQ ID NO: 62042 - DNA, 20 bp, Artificial Sequence
  chemically synthesized
gcctcagcctcccgagtagc

SEQ ID NO: 62043 - DNA, 20 bp, Artificial Sequence
  chemically synthesized
ttttgtatttttagtagaga

SEQ ID NO: 62044 - DNA, 20 bp, Artificial Sequence
  chemically synthesized
acctcagccttccaaagtgc

SEQ ID NO: 62045 - DNA, 20 bp, Artificial Sequence
  chemically synthesized
caatatgtggagatgaaaaa

SEQ ID NO: 62046 - DNA, 20 bp, Artificial Sequence
  chemically synthesized
catggcaagttgaagaagct

SEQ ID NO: 62047 - DNA, 20 bp, Artificial Sequence
  chemically synthesized
agttgaagaagctctggatg

SEQ ID NO: 62048 - DNA, 20 bp, Artificial Sequence
  chemically synthesized
tcagaaactcttgaggactc

SEQ ID NO: 62049 - DNA, 20 bp, Artificial Sequence
  chemically synthesized
ctctgggatagttgctgtca

SEQ ID NO: 62050 - DNA, 20 bp, Artificial Sequence
  chemically synthesized
gggggcctctatgcttgcct

SEQ ID NO: 62051 - DNA, 20 bp, Artificial Sequence
  chemically synthesized
attagggcaactattctccc

SEQ ID NO: 62052 - DNA, 20 bp, Artificial Sequence
  chemically synthesized
aactattctccctggaatat

SEQ ID NO: 62053 - DNA, 20 bp, Artificial Sequence
  chemically synthesized
tgaaaacacgactatagttt

SEQ ID NO: 62054 - DNA, 20 bp, Artificial Sequence
  chemically synthesized
tcctccatctggtccattat

SEQ ID NO: 62055 - DNA, 20 bp, Artificial Sequence
  chemically synthesized
actatgcaggtcataattca

SEQ ID NO: 62056 - DNA, 20 bp, Artificial Sequence
  chemically synthesized
ttgttatcacttcattttta

SEQ ID NO: 62057 - DNA, 20 bp, Artificial Sequence
  chemically synthesized
cggtagtaatatttataata

SEQ ID NO: 62058 - DNA, 20 bp, Artificial Sequence
  chemically synthesized
taaaagactctggacacata

SEQ ID NO: 62059 - DNA, 20 bp, Artificial Sequence
  chemically synthesized
ctggacacatacagaatcaa

SEQ ID NO: 62060 - DNA, 20 bp, Artificial Sequence
  chemically synthesized
tcaattgaatttgggagaaa

SEQ ID NO: 62061 - DNA, 20 bp, Artificial Sequence
  chemically synthesized
tagacttcatagttccctat

SEQ ID NO: 62062 - DNA, 20 bp, Artificial Sequence
  chemically synthesized
agttccctatgaggatcctt

SEQ ID NO: 62063 - DNA, 20 bp, Artificial Sequence
  chemically synthesized
ccttgtgaatttttctcaat

SEQ ID NO: 62064 - DNA, 20 bp, Artificial Sequence
  chemically synthesized
ttacagattcataatgatta

SEQ ID NO: 62065 - DNA, 20 bp, Artificial Sequence
  chemically synthesized
agttgccgtattttctctct

SEQ ID NO: 62066 - DNA, 20 bp, Artificial Sequence
  chemically synthesized
cccttcagatcaacatactt

SEQ ID NO: 62067 - DNA, 20 bp, Artificial Sequence
  chemically synthesized
ttccgttatgagcttccaac

SEQ ID NO: 62068 - DNA, 20 bp, Artificial Sequence
  chemically synthesized
tttgcagcatagggaacttg

SEQ ID NO: 62069 - DNA, 20 bp, Artificial Sequence
  chemically synthesized
cttgctgagtcccaagtcca

SEQ ID NO: 62070 - DNA, 20 bp, Artificial Sequence
  chemically synthesized
agtaattacacctttctaaa

SEQ ID NO: 62071 - DNA, 20 bp, Artificial Sequence
  chemically synthesized
tctgtggaaactcacaatag

SEQ ID NO: 62072 - DNA, 20 bp, Artificial Sequence
  chemically synthesized
tattttattttttatagaga

SEQ ID NO: 62073 - DNA, 20 bp, Artificial Sequence
  chemically synthesized
tcttttttttttggtggagg

SEQ ID NO: 62074 - DNA, 20 bp, Artificial Sequence
  chemically synthesized
gtctagctatgttgcccagg

SEQ ID NO: 62075 - DNA, 20 bp, Artificial Sequence
  chemically synthesized
atatttctcagtcatttcta

SEQ ID NO: 62076 - DNA, 20 bp, Artificial Sequence
  chemically synthesized
aaaatttgaactgactcaac

SEQ ID NO: 62077 - DNA, 20 bp, Artificial Sequence
  chemically synthesized
atatgataaataataggagg

SEQ ID NO: 62078 - DNA, 20 bp, Artificial Sequence
  chemically synthesized
aataataggaggaggaataa

SEQ ID NO: 62079 - DNA, 20 bp, Artificial Sequence
  chemically synthesized
aggaggaataaaagagtaaa

SEQ ID NO: 62080 - DNA, 20 bp, Artificial Sequence
  chemically synthesized
aagagaataaaagggaacaa

SEQ ID NO: 62081 - DNA, 20 bp, Artificial Sequence
  chemically synthesized
aaggagtcctatttgggacc

SEQ ID NO: 62082 - DNA, 20 bp, Artificial Sequence
  chemically synthesized
gctatgagcacagacgtaag

SEQ ID NO: 62083 - DNA, 20 bp, Artificial Sequence
  chemically synthesized
taaaggttgtatgcttcata

SEQ ID NO: 62084 - DNA, 20 bp, Artificial Sequence
  chemically synthesized
ttgtatgcttcatagtgaat

SEQ ID NO: 62085 - DNA, 20 bp, Artificial Sequence
  chemically synthesized
ttattctagggaaaggcctt

SEQ ID NO: 62086 - DNA, 20 bp, Artificial Sequence
  chemically synthesized
ggctcagaggcagttcacta

SEQ ID NO: 62087 - DNA, 20 bp, Artificial Sequence
  chemically synthesized
gcactcttcttgtcctcatt

SEQ ID NO: 62088 - DNA, 20 bp, Artificial Sequence
  chemically synthesized
atgctggcagacacggacct

SEQ ID NO: 62089 - DNA, 20 bp, Artificial Sequence
  chemically synthesized
tcactacaatgcccacagtc

SEQ ID NO: 62090 - DNA, 20 bp, Artificial Sequence
  chemically synthesized
cattcattcactggccattg

SEQ ID NO: 62091 - DNA, 20 bp, Artificial Sequence
  chemically synthesized
aactgcattcttaccaattc

SEQ ID NO: 62092 - DNA, 20 bp, Artificial Sequence
  chemically synthesized
cgagtgatgaacataggact

SEQ ID NO: 62093 - DNA, 20 bp, Artificial Sequence
  chemically synthesized
attttctctttcctccattc

SEQ ID NO: 62094 - DNA, 20 bp, Artificial Sequence
  chemically synthesized
ttattcgcctattttctggg

SEQ ID NO: 62095 - DNA, 20 bp, Artificial Sequence
  chemically synthesized
tagggcttgagcccttattt

SEQ ID NO: 62096 - DNA, 20 bp, Artificial Sequence
  chemically synthesized
tttcagaatctcaagatctc

SEQ ID NO: 62097 - DNA, 20 bp, Artificial Sequence
  chemically synthesized
tatccacacttttttttcct

SEQ ID NO: 62098 - DNA, 20 bp, Artificial Sequence
  chemically synthesized
tatatatcacctaataaaga

SEQ ID NO: 62099 - DNA, 20 bp, Artificial Sequence
  chemically synthesized
tgccagtgatgctgaagaaa

SEQ ID NO: 62100 - DNA, 20 bp, Artificial Sequence
  chemically synthesized
gagatataacaatccaaaag

SEQ ID NO: 62101 - DNA, 20 bp, Artificial Sequence
  chemically synthesized
gataagtggactaaagcagc

SEQ ID NO: 62102 - DNA, 20 bp, Artificial Sequence
  chemically synthesized
attttatgtgtcttataaag

SEQ ID NO: 62103 - DNA, 20 bp, Artificial Sequence
  chemically synthesized
tgtgtcttataaaggtgaat

SEQ ID NO: 62104 - DNA, 20 bp, Artificial Sequence
  chemically synthesized
ttgaaactagttactctgaa

SEQ ID NO: 62105 - DNA, 20 bp, Artificial Sequence
  chemically synthesized
ttttagaaatttttcactga

SEQ ID NO: 62106 - DNA, 20 bp, Artificial Sequence
  chemically synthesized
gtaagtctttatgctgttca

SEQ ID NO: 62107 - DNA, 20 bp, Artificial Sequence
  chemically synthesized
cacttgctattagtgtaaca

SEQ ID NO: 62108 - DNA, 20 bp, Artificial Sequence
  chemically synthesized
ctccaaattagaaggcccat

SEQ ID NO: 62109 - DNA, 20 bp, Artificial Sequence
  chemically synthesized
ctaataaatgactactcctg

SEQ ID NO: 62110 - DNA, 20 bp, Artificial Sequence
  chemically synthesized
ctgaaggattcagttattgt

SEQ ID NO: 62111 - DNA, 20 bp, Artificial Sequence
  chemically synthesized
ttattgtgcgaattgtttgt

SEQ ID NO: 62112 - DNA, 20 bp, Artificial Sequence
  chemically synthesized
ttctttgaaagtaggacgtg

SEQ ID NO: 62113 - DNA, 20 bp, Artificial Sequence
  chemically synthesized
gtttttccaaagttggcata

SEQ ID NO: 62114 - DNA, 20 bp, Artificial Sequence
  chemically synthesized
gcatctctattgaccactga

SEQ ID NO: 62115 - DNA, 20 bp, Artificial Sequence
  chemically synthesized
accactgaaaggatgtctgt

SEQ ID NO: 62116 - DNA, 20 bp, Artificial Sequence
  chemically synthesized
agcggtattaaaattttcag

SEQ ID NO: 62117 - DNA, 20 bp, Artificial Sequence
  chemically synthesized
attaaaattttcaggcgaat

SEQ ID NO: 62118 - DNA, 20 bp, Artificial Sequence
  chemically synthesized
ggcaaatgtatttgtcagta

SEQ ID NO: 62119 - DNA, 20 bp, Artificial Sequence
  chemically synthesized
agtttactcatatgttagca

SEQ ID NO: 62120 - DNA, 20 bp, Artificial Sequence
  chemically synthesized
atagtcaaaaatcaattaaa

SEQ ID NO: 62121 - DNA, 20 bp, Artificial Sequence
  chemically synthesized
tctcttagagatctgctctg

SEQ ID NO: 62122 - DNA, 20 bp, Artificial Sequence
  chemically synthesized
agttaattctctgtcatact

SEQ ID NO: 62123 - DNA, 20 bp, Artificial Sequence
  chemically synthesized
catcagcatattgtcttccc

SEQ ID NO: 62124 - DNA, 20 bp, Artificial Sequence
  chemically synthesized
tcttgctctgttgcccaggc

SEQ ID NO: 62125 - DNA, 20 bp, Artificial Sequence
  chemically synthesized
aatccttcttcctcagcttt

SEQ ID NO: 62126 - DNA, 20 bp, Artificial Sequence
  chemically synthesized
gtttttattttttgtaaata

SEQ ID NO: 62127 - DNA, 20 bp, Artificial Sequence
  chemically synthesized
aaattttaggcagaaaaggg

SEQ ID NO: 62128 - DNA, 20 bp, Artificial Sequence
  chemically synthesized
aaaagggcggggtccctggc

SEQ ID NO: 62129 - DNA, 20 bp, Artificial Sequence
  chemically synthesized
ctttattctctgtttgtctc

SEQ ID NO: 62130 - DNA, 20 bp, Artificial Sequence
  chemically synthesized
gtgttaccacagttgaacag

SEQ ID NO: 62131 - DNA, 20 bp, Artificial Sequence
  chemically synthesized
cttgcaatgtaaattataat

SEQ ID NO: 62132 - DNA, 20 bp, Artificial Sequence
  chemically synthesized
gaaaagcctagatatagaaa

SEQ ID NO: 62133 - DNA, 20 bp, Artificial Sequence
  chemically synthesized
tatagaaactggatcctcac

SEQ ID NO: 62134 - DNA, 20 bp, Artificial Sequence
  chemically synthesized
agttcagtatataattgtaa

SEQ ID NO: 62135 - DNA, 20 bp, Artificial Sequence
  chemically synthesized
ctgattatcacaaaaatact

SEQ ID NO: 62136 - DNA, 20 bp, Artificial Sequence
  chemically synthesized
atgtggtataaatgagacag

SEQ ID NO: 62137 - DNA, 20 bp, Artificial Sequence
  chemically synthesized
tctccttcctatgctgtcag

SEQ ID NO: 62138 - DNA, 20 bp, Artificial Sequence
  chemically synthesized
ctgtcagatgaatactgaga

SEQ ID NO: 62139 - DNA, 20 bp, Artificial Sequence
  chemically synthesized
catttctgtctgttgaagat

SEQ ID NO: 62140 - DNA, 20 bp, Artificial Sequence
  chemically synthesized
tctgttgaagatttgggtgt

SEQ ID NO: 62141 - DNA, 20 bp, Artificial Sequence
  chemically synthesized
aactcaaggtatcatatcca

SEQ ID NO: 62142 - DNA, 20 bp, Artificial Sequence
  chemically synthesized
caaggtatcatatccaaggg

SEQ ID NO: 62143 - DNA, 20 bp, Artificial Sequence
  chemically synthesized
gtgactctaacagaaaggga

SEQ ID NO: 62144 - DNA, 20 bp, Artificial Sequence
  chemically synthesized
tgcatgcattggcaatgttt

SEQ ID NO: 62145 - DNA, 20 bp, Artificial Sequence
  chemically synthesized
caaaagtgtttcatgtgcct

SEQ ID NO: 62146 - DNA, 20 bp, Artificial Sequence
  chemically synthesized
gcctaggggtgtcaaatact

SEQ ID NO: 62147 - DNA, 20 bp, Artificial Sequence
  chemically synthesized
tatacttctctgtaatgtgt

SEQ ID NO: 62148 - DNA, 20 bp, Artificial Sequence
  chemically synthesized
aacagctgtgtagcctaatt

SEQ ID NO: 62149 - DNA, 20 bp, Artificial Sequence
  chemically synthesized
gtatatttatcagaagtctt

SEQ ID NO: 62150 - DNA, 20 bp, Artificial Sequence
  chemically synthesized
aagtctttagggtcatgaaa

SEQ ID NO: 62151 - DNA, 20 bp, Artificial Sequence
  chemically synthesized
gttttaatctaaatctatct

SEQ ID NO: 62152 - DNA, 20 bp, Artificial Sequence
  chemically synthesized
gtttacataaagaaaataag

SEQ ID NO: 62153 - DNA, 20 bp, Artificial Sequence
  chemically synthesized
gaaaaaaaatactccatatt

SEQ ID NO: 62154 - DNA, 20 bp, Artificial Sequence
  chemically synthesized
tatataaaagatattttaaa

SEQ ID NO: 62155 - DNA, 20 bp, Artificial Sequence
  chemically synthesized
tcatagcattttaaatagtt

SEQ ID NO: 62156 - DNA, 20 bp, Artificial Sequence
  chemically synthesized
ttctaagtttcccacaaact

SEQ ID NO: 62157 - DNA, 20 bp, Artificial Sequence
  chemically synthesized
gtcaaaaatatatgtacatt

SEQ ID NO: 62158 - DNA, 20 bp, Artificial Sequence
  chemically synthesized
tttagtacatctaagaagaa

SEQ ID NO: 62159 - DNA, 20 bp, Artificial Sequence
  chemically synthesized
gttttgtctcttatccacct

SEQ ID NO: 62160 - DNA, 20 bp, Artificial Sequence
  chemically synthesized
tcccacagccccacttagct

SEQ ID NO: 62161 - DNA, 20 bp, Artificial Sequence
  chemically synthesized
agccccacttagctctggat

SEQ ID NO: 62162 - DNA, 20 bp, Artificial Sequence
  chemically synthesized
actacatggacgtaaaatgc

SEQ ID NO: 62163 - DNA, 20 bp, Artificial Sequence
  chemically synthesized
tacatcctcaatctacacac

SEQ ID NO: 62164 - DNA, 20 bp, Artificial Sequence
  chemically synthesized
caactcatgatatttggctc

SEQ ID NO: 62165 - DNA, 20 bp, Artificial Sequence
  chemically synthesized
ttggctctagaatacatgct

SEQ ID NO: 62166 - DNA, 20 bp, Artificial Sequence
  chemically synthesized
ctctgaaataagacataatt

SEQ ID NO: 62167 - DNA, 20 bp, Artificial Sequence
  chemically synthesized
tcctgttatttttggaagca

SEQ ID NO: 62168 - DNA, 20 bp, Artificial Sequence
  chemically synthesized
atttttggaagcacagggtg

SEQ ID NO: 62169 - DNA, 20 bp, Artificial Sequence
  chemically synthesized
gggctgtgcgccgtgcttga

SEQ ID NO: 62170 - DNA, 20 bp, Artificial Sequence
  chemically synthesized
gcgccgtgcttgagggagtt

SEQ ID NO: 62171 - DNA, 20 bp, Artificial Sequence
  chemically synthesized
catcgaccacccaagggctg

SEQ ID NO: 62172 - DNA, 20 bp, Artificial Sequence
  chemically synthesized
ctccccctgcagcccaggtg

SEQ ID NO: 62173 - DNA, 20 bp, Artificial Sequence
  chemically synthesized
cagcccaggtgcgggatcca

SEQ ID NO: 62174 - DNA, 20 bp, Artificial Sequence
  chemically synthesized
gggtgaagccggctaggctc

SEQ ID NO: 62175 - DNA, 20 bp, Artificial Sequence
  chemically synthesized
gctaggctcctgagtttgct

SEQ ID NO: 62176 - DNA, 20 bp, Artificial Sequence
  chemically synthesized
agaacccttatgtctagata

SEQ ID NO: 62177 - DNA, 20 bp, Artificial Sequence
  chemically synthesized
tcagcaccctgtgtctagct

SEQ ID NO: 62178 - DNA, 20 bp, Artificial Sequence
  chemically synthesized
ctgtgtctagctcagggttt

SEQ ID NO: 62179 - DNA, 20 bp, Artificial Sequence
  chemically synthesized
agaacctttatgtctagctc

SEQ ID NO: 62180 - DNA, 20 bp, Artificial Sequence
  chemically synthesized
tcagcaccctgtgtctagct

SEQ ID NO: 62181 - DNA, 20 bp, Artificial Sequence
  chemically synthesized
ctgtgtctagctcagggttt

SEQ ID NO: 62182 - DNA, 20 bp, Artificial Sequence
  chemically synthesized
agaacctttatgtctagctc

SEQ ID NO: 62183 - DNA, 20 bp, Artificial Sequence
  chemically synthesized
tcagcaccctgtgtctagct

SEQ ID NO: 62184 - DNA, 20 bp, Artificial Sequence
  chemically synthesized
ctgtgtctagctcagggttt

SEQ ID NO: 62185 - DNA, 20 bp, Artificial Sequence
  chemically synthesized
agaacctttgtgtctagctc

SEQ ID NO: 62186 - DNA, 20 bp, Artificial Sequence
  chemically synthesized
cactgggctctaccaatcag

SEQ ID NO: 62187 - DNA, 20 bp, Artificial Sequence
  chemically synthesized
gctctaccaatcagcaggat

SEQ ID NO: 62188 - DNA, 20 bp, Artificial Sequence
  chemically synthesized
atgtgggtggggccagataa

SEQ ID NO: 62189 - DNA, 20 bp, Artificial Sequence
  chemically synthesized
agccagcagtggcaacccgc

SEQ ID NO: 62190 - DNA, 20 bp, Artificial Sequence
  chemically synthesized
atcttgctgctgctcactgt

SEQ ID NO: 62191 - DNA, 20 bp, Artificial Sequence
  chemically synthesized
agaactgtaacactcaccac

SEQ ID NO: 62192 - DNA, 20 bp, Artificial Sequence
  chemically synthesized
cacagtatgtcagaaacaat

SEQ ID NO: 62193 - DNA, 20 bp, Artificial Sequence
  chemically synthesized
taatgtgttactccctaagg

SEQ ID NO: 62194 - DNA, 20 bp, Artificial Sequence
  chemically synthesized
ttctttacaggccgagaaaa

SEQ ID NO: 62195 - DNA, 20 bp, Artificial Sequence
  chemically synthesized
acaggccgagaaaaatgaat

SEQ ID NO: 62196 - DNA, 20 bp, Artificial Sequence
  chemically synthesized
atcattattcatgatttgca

SEQ ID NO: 62197 - DNA, 20 bp, Artificial Sequence
  chemically synthesized
tttaactatgttccagattt

SEQ ID NO: 62198 - DNA, 20 bp, Artificial Sequence
  chemically synthesized
atgttccagatttttgaatg

SEQ ID NO: 62199 - DNA, 20 bp, Artificial Sequence
  chemically synthesized
aaaaataagtatgtgaagtg

SEQ ID NO: 62200 - DNA, 20 bp, Artificial Sequence
  chemically synthesized
aaagcatcatgttgtacccc

SEQ ID NO: 62201 - DNA, 20 bp, Artificial Sequence
  chemically synthesized
gttttctctacgttatttat

SEQ ID NO: 62202 - DNA, 20 bp, Artificial Sequence
  chemically synthesized
accaccctttccacagtcaa

SEQ ID NO: 62203 - DNA, 20 bp, Artificial Sequence
  chemically synthesized
gatattgtagtttaatgcct

SEQ ID NO: 62204 - DNA, 20 bp, Artificial Sequence
  chemically synthesized
cctctttaggttctccttta

SEQ ID NO: 62205 - DNA, 20 bp, Artificial Sequence
  chemically synthesized
tatgcctctacctttattag

SEQ ID NO: 62206 - DNA, 20 bp, Artificial Sequence
  chemically synthesized
cacgtagtctgtgcttatga

SEQ ID NO: 62207 - DNA, 20 bp, Artificial Sequence
  chemically synthesized
ctaatgttgttcgtcataat

SEQ ID NO: 62208 - DNA, 20 bp, Artificial Sequence
  chemically synthesized
cagtttaggctagtaagcat

SEQ ID NO: 62209 - DNA, 20 bp, Artificial Sequence
  chemically synthesized
ttcccacagtctgttggtca

SEQ ID NO: 62210 - DNA, 20 bp, Artificial Sequence
  chemically synthesized
tctgttggtcacagaataac

SEQ ID NO: 62211 - DNA, 20 bp, Artificial Sequence
  chemically synthesized
acctgagtgattactgatga

SEQ ID NO: 62212 - DNA, 20 bp, Artificial Sequence
  chemically synthesized
gtgattactgatgaaagagt

SEQ ID NO: 62213 - DNA, 20 bp, Artificial Sequence
  chemically synthesized
aaatgtttctctttttatta

SEQ ID NO: 62214 - DNA, 20 bp, Artificial Sequence
  chemically synthesized
aggagcccttttgattgaag

SEQ ID NO: 62215 - DNA, 20 bp, Artificial Sequence
  chemically synthesized
accttacagggacaggacat

SEQ ID NO: 62216 - DNA, 20 bp, Artificial Sequence
  chemically synthesized
catcggtctttctttatttc

SEQ ID NO: 62217 - DNA, 20 bp, Artificial Sequence
  chemically synthesized
ctctttcaagagacagagaa

SEQ ID NO: 62218 - DNA, 20 bp, Artificial Sequence
  chemically synthesized
ttctcagaagtatattttga

SEQ ID NO: 62219 - DNA, 20 bp, Artificial Sequence
  chemically synthesized
aagaagtgatattgagaagg

SEQ ID NO: 62220 - DNA, 20 bp, Artificial Sequence
  chemically synthesized
tttatatacatctgtattgt

SEQ ID NO: 62221 - DNA, 20 bp, Artificial Sequence
  chemically synthesized
atatactagctatgtaacct

SEQ ID NO: 62222 - DNA, 20 bp, Artificial Sequence
  chemically synthesized
cctgcttcatagttattaat

SEQ ID NO: 62223 - DNA, 20 bp, Artificial Sequence
  chemically synthesized
tacacacacacacacattga

SEQ ID NO: 62224 - DNA, 20 bp, Artificial Sequence
  chemically synthesized
ggtattatctaaatttcata

SEQ ID NO: 62225 - DNA, 20 bp, Artificial Sequence
  chemically synthesized
tttgtcatatatttattcaa

SEQ ID NO: 62226 - DNA, 20 bp, Artificial Sequence
  chemically synthesized
aattattctcaagttattat

SEQ ID NO: 62227 - DNA, 20 bp, Artificial Sequence
  chemically synthesized
tgaggatgttgaaagacaga

SEQ ID NO: 62228 - DNA, 20 bp, Artificial Sequence
  chemically synthesized
atgttgaaagacagagagga

SEQ ID NO: 62229 - DNA, 20 bp, Artificial Sequence
  chemically synthesized
cacaattaagctaagcagct

SEQ ID NO: 62230 - DNA, 20 bp, Artificial Sequence
  chemically synthesized
ctaagcagctaagagtcttg

SEQ ID NO: 62231 - DNA, 20 bp, Artificial Sequence
  chemically synthesized
gcagggtagtgtagggacca

SEQ ID NO: 62232 - DNA, 20 bp, Artificial Sequence
  chemically synthesized
ccacagggttaagggggcag

SEQ ID NO: 62233 - DNA, 20 bp, Artificial Sequence
  chemically synthesized
ttgtttaaatgtataaataa

SEQ ID NO: 62234 - DNA, 20 bp, Artificial Sequence
  chemically synthesized
atgtataaataagtggatga

SEQ ID NO: 62235 - DNA, 20 bp, Artificial Sequence
  chemically synthesized
atagacagatagatgataga

SEQ ID NO: 62236 - DNA, 20 bp, Artificial Sequence
  chemically synthesized
atttcagccatatcttaaca

SEQ ID NO: 62237 - DNA, 20 bp, Artificial Sequence
  chemically synthesized
ctctaatcttaaaggtaaac

SEQ ID NO: 62238 - DNA, 20 bp, Artificial Sequence
  chemically synthesized
gcctttttggtcataaaaca

SEQ ID NO: 62239 - DNA, 20 bp, Artificial Sequence
  chemically synthesized
agtatccctcaagtagtgtc

SEQ ID NO: 62240 - DNA, 20 bp, Artificial Sequence
  chemically synthesized
atttaaatagtctgcaagcc

SEQ ID NO: 62241 - DNA, 20 bp, Artificial Sequence
  chemically synthesized
tgggaggactgcttgagctc

SEQ ID NO: 62242 - DNA, 20 bp, Artificial Sequence
  chemically synthesized
tactcaggaggccgaaatgg

SEQ ID NO: 62243 - DNA, 20 bp, Artificial Sequence
  chemically synthesized
ctgcactccagcctggacag

SEQ ID NO: 62244 - DNA, 20 bp, Artificial Sequence
  chemically synthesized
tgaaaccttgcctcacgaaa

SEQ ID NO: 62245 - DNA, 20 bp, Artificial Sequence
  chemically synthesized
tgatgctctaccacataggt

SEQ ID NO: 62246 - DNA, 20 bp, Artificial Sequence
  chemically synthesized
tcaccatgttgtaactttct

SEQ ID NO: 62247 - DNA, 20 bp, Artificial Sequence
  chemically synthesized
agtaacaatataaagttatt

SEQ ID NO: 62248 - DNA, 20 bp, Artificial Sequence
  chemically synthesized
ttctactaagccattgaaac

SEQ ID NO: 62249 - DNA, 20 bp, Artificial Sequence
  chemically synthesized
gaataacagaacaagattga

SEQ ID NO: 62250 - DNA, 20 bp, Artificial Sequence
  chemically synthesized
aatacattttccgaaattac

SEQ ID NO: 62251 - DNA, 20 bp, Artificial Sequence
  chemically synthesized
caagcacgtggacctgggag

SEQ ID NO: 62252 - DNA, 20 bp, Artificial Sequence
  chemically synthesized
aaatgcaggtttataataga

SEQ ID NO: 62253 - DNA, 20 bp, Artificial Sequence
  chemically synthesized
ccagtacacaagaggggacg

SEQ ID NO: 62254 - DNA, 20 bp, Artificial Sequence
  chemically synthesized
ctcattctttttcttagtgt

SEQ ID NO: 62255 - DNA, 20 bp, Artificial Sequence
  chemically synthesized
ctttttcttagtgtgagaat

SEQ ID NO: 62256 - DNA, 20 bp, Artificial Sequence
  chemically synthesized
agaataagaatagccatgac

SEQ ID NO: 62257 - DNA, 20 bp, Artificial Sequence
  chemically synthesized
ctgcagagccagggccgaga

SEQ ID NO: 62258 - DNA, 20 bp, Artificial Sequence
  chemically synthesized
ctctccctcccattcccgag

SEQ ID NO: 62259 - DNA, 20 bp, Artificial Sequence
  chemically synthesized
gctgtgacatggaaactatg

SEQ ID NO: 62260 - DNA, 20 bp, Artificial Sequence
  chemically synthesized
tggaaactatgtagaatatt

SEQ ID NO: 62261 - DNA, 20 bp, Artificial Sequence
  chemically synthesized
tagacagaaagtcaggagct

SEQ ID NO: 62262 - DNA, 20 bp, Artificial Sequence
  chemically synthesized
cagtttctctttttataagt

SEQ ID NO: 62263 - DNA, 20 bp, Artificial Sequence
  chemically synthesized
tctttttataagtaggagtc

SEQ ID NO: 62264 - DNA, 20 bp, Artificial Sequence
  chemically synthesized
ctcaccttcacccaggccca

SEQ ID NO: 62265 - DNA, 20 bp, Artificial Sequence
  chemically synthesized
tagttcacgtgtgtaaaaag

SEQ ID NO: 62266 - DNA, 20 bp, Artificial Sequence
  chemically synthesized
ggcagtatagagcagagatt

SEQ ID NO: 62267 - DNA, 20 bp, Artificial Sequence
  chemically synthesized
agatgctggagccagaccac

SEQ ID NO: 62268 - DNA, 20 bp, Artificial Sequence
  chemically synthesized
gtttcttcatctgtaaaatg

SEQ ID NO: 62269 - DNA, 20 bp, Artificial Sequence
  chemically synthesized
taattagtttgtttttgaga

SEQ ID NO: 62270 - DNA, 20 bp, Artificial Sequence
  chemically synthesized
tctcactctgtcacccaaat

SEQ ID NO: 62271 - DNA, 20 bp, Artificial Sequence
  chemically synthesized
ggtcctcccacctcaacatc

SEQ ID NO: 62272 - DNA, 20 bp, Artificial Sequence
  chemically synthesized
ttttgtatttttggtagaga

SEQ ID NO: 62273 - DNA, 20 bp, Artificial Sequence
  chemically synthesized
atggggtttcacatgttaca

SEQ ID NO: 62274 - DNA, 20 bp, Artificial Sequence
  chemically synthesized
acctcagccttccaaagtgc

SEQ ID NO: 62275 - DNA, 20 bp, Artificial Sequence
  chemically synthesized
gggattataagcatgattac

SEQ ID NO: 62276 - DNA, 20 bp, Artificial Sequence
  chemically synthesized
tcataagattgttctgcagc

SEQ ID NO: 62277 - DNA, 20 bp, Artificial Sequence
  chemically synthesized
aagattgttctgcagcccga

SEQ ID NO: 62278 - DNA, 20 bp, Artificial Sequence
  chemically synthesized
cgagtgagttaatacatgca

SEQ ID NO: 62279 - DNA, 20 bp, Artificial Sequence
  chemically synthesized
attaatcatatttaatactc

SEQ ID NO: 62280 - DNA, 20 bp, Artificial Sequence
  chemically synthesized
cataaactactagcaaatag

SEQ ID NO: 62281 - DNA, 20 bp, Artificial Sequence
  chemically synthesized
acttcttggcagtctgtatg

SEQ ID NO: 62282 - DNA, 20 bp, Artificial Sequence
  chemically synthesized
cagtctgtatgctggatgct

SEQ ID NO: 62283 - DNA, 20 bp, Artificial Sequence
  chemically synthesized
tattcgtctgtgtcctgctc

SEQ ID NO: 62284 - DNA, 20 bp, Artificial Sequence
  chemically synthesized
aagactacaccatgtggaga

SEQ ID NO: 62285 - DNA, 20 bp, Artificial Sequence
  chemically synthesized
gtggctctctggttgactgt

SEQ ID NO: 62286 - DNA, 20 bp, Artificial Sequence
  chemically synthesized
gcctattatttaacaaatgc

SEQ ID NO: 62287 - DNA, 20 bp, Artificial Sequence
  chemically synthesized
taacaaatgcatgaatgctt

SEQ ID NO: 62288 - DNA, 20 bp, Artificial Sequence
  chemically synthesized
gcatgaatgcttcagaatat

SEQ ID NO: 62289 - DNA, 20 bp, Artificial Sequence
  chemically synthesized
aatatgggaatattatcttc

SEQ ID NO: 62290 - DNA, 20 bp, Artificial Sequence
  chemically synthesized
gaatattatcttctggaata

SEQ ID NO: 62291 - DNA, 20 bp, Artificial Sequence
  chemically synthesized
tcaagttatattatgtaacc

SEQ ID NO: 62292 - DNA, 20 bp, Artificial Sequence
  chemically synthesized
tagaagattcttctgtgtgt

SEQ ID NO: 62293 - DNA, 20 bp, Artificial Sequence
  chemically synthesized
agaaagcttttaacccatca

SEQ ID NO: 62294 - DNA, 20 bp, Artificial Sequence
  chemically synthesized
tcattgaataaatccctata

SEQ ID NO: 62295 - DNA, 20 bp, Artificial Sequence
  chemically synthesized
ctctcataattcttggttgc

SEQ ID NO: 62296 - DNA, 20 bp, Artificial Sequence
  chemically synthesized
tgagacaaactatggggaag

SEQ ID NO: 62297 - DNA, 20 bp, Artificial Sequence
  chemically synthesized
aagcagggtatgaaagagct

SEQ ID NO: 62298 - DNA, 20 bp, Artificial Sequence
  chemically synthesized
gcttaaaatcagaagcccca

SEQ ID NO: 62299 - DNA, 20 bp, Artificial Sequence
  chemically synthesized
aatcagaagccccattggat

SEQ ID NO: 62300 - DNA, 20 bp, Artificial Sequence
  chemically synthesized
gcctcctgccccgaacttcc

SEQ ID NO: 62301 - DNA, 20 bp, Artificial Sequence
  chemically synthesized
ctctcttaagtgtttcctgc

SEQ ID NO: 62302 - DNA, 20 bp, Artificial Sequence
  chemically synthesized
tccagcccctggctagttga

SEQ ID NO: 62303 - DNA, 20 bp, Artificial Sequence
  chemically synthesized
tactttcagcgttggacaac

SEQ ID NO: 62304 - DNA, 20 bp, Artificial Sequence
  chemically synthesized
gctgagatgatctatgtggg

SEQ ID NO: 62305 - DNA, 20 bp, Artificial Sequence
  chemically synthesized
ctcattcccactttaatatc

SEQ ID NO: 62306 - DNA, 20 bp, Artificial Sequence
  chemically synthesized
atatccagaatcactataag

SEQ ID NO: 62307 - DNA, 20 bp, Artificial Sequence
  chemically synthesized
tataagaagaatataataag

SEQ ID NO: 62308 - DNA, 20 bp, Artificial Sequence
  chemically synthesized
aaattaagaggcatacgtga

SEQ ID NO: 62309 - DNA, 20 bp, Artificial Sequence
  chemically synthesized
taagaggcatacgtgatggg

SEQ ID NO: 62310 - DNA, 20 bp, Artificial Sequence
  chemically synthesized
atgagtaagagaggagaggg

SEQ ID NO: 62311 - DNA, 20 bp, Artificial Sequence
  chemically synthesized
catgacaagactgagctcag

SEQ ID NO: 62312 - DNA, 20 bp, Artificial Sequence
  chemically synthesized
ccctgtgctgcactgatgag

SEQ ID NO: 62313 - DNA, 20 bp, Artificial Sequence
  chemically synthesized
gcactgatgaggaggatcag

SEQ ID NO: 62314 - DNA, 20 bp, Artificial Sequence
  chemically synthesized
tggatggggcaatgaagcaa

SEQ ID NO: 62315 - DNA, 20 bp, Artificial Sequence
  chemically synthesized
tgaagcaaaggaatcattct

SEQ ID NO: 62316 - DNA, 20 bp, Artificial Sequence
  chemically synthesized
atgactgtaaatttgggagc

SEQ ID NO: 62317 - DNA, 20 bp, Artificial Sequence
  chemically synthesized
gagcaggagtctctaaggac

SEQ ID NO: 62318 - DNA, 20 bp, Artificial Sequence
  chemically synthesized
ctctaaggacttggatttca

SEQ ID NO: 62319 - DNA, 20 bp, Artificial Sequence
  chemically synthesized
tgtctatcagaggttccagg

SEQ ID NO: 62320 - DNA, 20 bp, Artificial Sequence
  chemically synthesized
atcagaggttccagggaggg

SEQ ID NO: 62321 - DNA, 20 bp, Artificial Sequence
  chemically synthesized
aggttccagggagggtgggg

SEQ ID NO: 62322 - DNA, 20 bp, Artificial Sequence
  chemically synthesized
caccagctatcagggcccag

SEQ ID NO: 62323 - DNA, 20 bp, Artificial Sequence
  chemically synthesized
gttaggtcaggttggtggtg

SEQ ID NO: 62324 - DNA, 20 bp, Artificial Sequence
  chemically synthesized
gtcaggttggtggtgctggg

SEQ ID NO: 62325 - DNA, 20 bp, Artificial Sequence
  chemically synthesized
ggagccaggagagatagacc

SEQ ID NO: 62326 - DNA, 20 bp, Artificial Sequence
  chemically synthesized
tgccttgactcctatgtttt

SEQ ID NO: 62327 - DNA, 20 bp, Artificial Sequence
  chemically synthesized
aggatcatcatctataaagt

SEQ ID NO: 62328 - DNA, 20 bp, Artificial Sequence
  chemically synthesized
taataattgtgtctatctca

SEQ ID NO: 62329 - DNA, 20 bp, Artificial Sequence
  chemically synthesized
ctatctcatagggttattat

SEQ ID NO: 62330 - DNA, 20 bp, Artificial Sequence
  chemically synthesized
gagctatgggcttcctatgt

SEQ ID NO: 62331 - DNA, 20 bp, Artificial Sequence
  chemically synthesized
accagctgctgcagtcaaag

SEQ ID NO: 62332 - DNA, 20 bp, Artificial Sequence
  chemically synthesized
tctgaacatgagaaattttt

SEQ ID NO: 62333 - DNA, 20 bp, Artificial Sequence
  chemically synthesized
aaatttttaggaatctgcac

SEQ ID NO: 62334 - DNA, 20 bp, Artificial Sequence
  chemically synthesized
gaggtaaatgaaagagaagt

SEQ ID NO: 62335 - DNA, 20 bp, Artificial Sequence
  chemically synthesized
ctaatgataagtaacacctc

SEQ ID NO: 62336 - DNA, 20 bp, Artificial Sequence
  chemically synthesized
cttgagtacttagtatatgc

SEQ ID NO: 62337 - DNA, 20 bp, Artificial Sequence
  chemically synthesized
cgggcacggtggctcatata

SEQ ID NO: 62338 - DNA, 20 bp, Artificial Sequence
  chemically synthesized
actttgggaggccaaggcaa

SEQ ID NO: 62339 - DNA, 20 bp, Artificial Sequence
  chemically synthesized
caattggatcacctgaggtc

SEQ ID NO: 62340 - DNA, 20 bp, Artificial Sequence
  chemically synthesized
tactcaggaggctgaggcag

SEQ ID NO: 62341 - DNA, 20 bp, Artificial Sequence
  chemically synthesized
ctgcactccagcctaggcga

SEQ ID NO: 62342 - DNA, 20 bp, Artificial Sequence
  chemically synthesized
aaaaaaaagaagtttattat

SEQ ID NO: 62343 - DNA, 20 bp, Artificial Sequence
  chemically synthesized
gaaccaccaagtagtaaggc

SEQ ID NO: 62344 - DNA, 20 bp, Artificial Sequence
  chemically synthesized
aaaacacaaactcagatatt

SEQ ID NO: 62345 - DNA, 20 bp, Artificial Sequence
  chemically synthesized
gaaaaatttagaaacaactt

SEQ ID NO: 62346 - DNA, 20 bp, Artificial Sequence
  chemically synthesized
cagaataaagagattttctc

SEQ ID NO: 62347 - DNA, 20 bp, Artificial Sequence
  chemically synthesized
aagctgcaactttggttaaa

SEQ ID NO: 62348 - DNA, 20 bp, Artificial Sequence
  chemically synthesized
tgagggccctaaactatgct

SEQ ID NO: 62349 - DNA, 20 bp, Artificial Sequence
  chemically synthesized
attctctgcatctccctttg

SEQ ID NO: 62350 - DNA, 20 bp, Artificial Sequence
  chemically synthesized
ttgtctttctcatctgtaaa

SEQ ID NO: 62351 - DNA, 20 bp, Artificial Sequence
  chemically synthesized
ctatgtcttccctgatgggc

SEQ ID NO: 62352 - DNA, 20 bp, Artificial Sequence
  chemically synthesized
gtcaaaagtaggctaagtag

SEQ ID NO: 62353 - DNA, 20 bp, Artificial Sequence
  chemically synthesized
aggaacagagagcaaaagag

SEQ ID NO: 62354 - DNA, 20 bp, Artificial Sequence
  chemically synthesized
acagagagcaaaagaggtgg

SEQ ID NO: 62355 - DNA, 20 bp, Artificial Sequence
  chemically synthesized
caaaagaggtgggtgaatga

SEQ ID NO: 62356 - DNA, 20 bp, Artificial Sequence
  chemically synthesized
tgttgtctaaatatctccta

SEQ ID NO: 62357 - DNA, 20 bp, Artificial Sequence
  chemically synthesized
agggaattattgtgagaggt

SEQ ID NO: 62358 - DNA, 20 bp, Artificial Sequence
  chemically synthesized
gaatagtgttgtaaaataag

SEQ ID NO: 62359 - DNA, 20 bp, Artificial Sequence
  chemically synthesized
ttaacagtcaagaaatacct

SEQ ID NO: 62360 - DNA, 20 bp, Artificial Sequence
  chemically synthesized
actgtaacagaaaacactta

SEQ ID NO: 62361 - DNA, 20 bp, Artificial Sequence
  chemically synthesized
gttgattgccttaattcatc

SEQ ID NO: 62362 - DNA, 20 bp, Artificial Sequence
  chemically synthesized
gaaaggcagagctgactgtg

SEQ ID NO: 62363 - DNA, 20 bp, Artificial Sequence
  chemically synthesized
tgatgaaggtgccttctcat

SEQ ID NO: 62364 - DNA, 20 bp, Artificial Sequence
  chemically synthesized
gcttgccctgatgggagata

SEQ ID NO: 62365 - DNA, 20 bp, Artificial Sequence
  chemically synthesized
gccctgatgggagatagaga

SEQ ID NO: 62366 - DNA, 20 bp, Artificial Sequence
  chemically synthesized
cagcactttgggaggctgag

SEQ ID NO: 62367 - DNA, 20 bp, Artificial Sequence
  chemically synthesized
gggtggactgcttggagctc

SEQ ID NO: 62368 - DNA, 20 bp, Artificial Sequence
  chemically synthesized
gcacctgtaatcccagctat

SEQ ID NO: 62369 - DNA, 20 bp, Artificial Sequence
  chemically synthesized
tattagggtggctgaggcag

SEQ ID NO: 62370 - DNA, 20 bp, Artificial Sequence
  chemically synthesized
tttttacttggactcttgtg

SEQ ID NO: 62371 - DNA, 20 bp, Artificial Sequence
  chemically synthesized
aggtgcttcaaaaccatttg

SEQ ID NO: 62372 - DNA, 20 bp, Artificial Sequence
  chemically synthesized
agttctggccaggcccctgt

SEQ ID NO: 62373 - DNA, 20 bp, Artificial Sequence
  chemically synthesized
ctggctcaagcacagcaatg

SEQ ID NO: 62374 - DNA, 20 bp, Artificial Sequence
  chemically synthesized
cacagcaatgctgagtcatg

SEQ ID NO: 62375 - DNA, 20 bp, Artificial Sequence
  chemically synthesized
tgatgagtcatgctgaggct

SEQ ID NO: 62376 - DNA, 20 bp, Artificial Sequence
  chemically synthesized
gtgcccagatgttctcagcc

SEQ ID NO: 62377 - DNA, 20 bp, Artificial Sequence
  chemically synthesized
cctagagtgatgactcctat

SEQ ID NO: 62378 - DNA, 20 bp, Artificial Sequence
  chemically synthesized
actcctatctgggtccccag

SEQ ID NO: 62379 - DNA, 20 bp, Artificial Sequence
  chemically synthesized
caaacggcatcataaagaaa

SEQ ID NO: 62380 - DNA, 20 bp, Artificial Sequence
  chemically synthesized
aagaaaatggatgcctgaga

SEQ ID NO: 62381 - DNA, 20 bp, Artificial Sequence
  chemically synthesized
agacagaatgtgacatattc

SEQ ID NO: 62382 - DNA, 20 bp, Artificial Sequence
  chemically synthesized
attctagaatatattatttc

SEQ ID NO: 62383 - DNA, 20 bp, Artificial Sequence
  chemically synthesized
tttgttgttatcaattgcca

SEQ ID NO: 62384 - DNA, 20 bp, Artificial Sequence
  chemically synthesized
ccatagaatgattagttatt

SEQ ID NO: 62385 - DNA, 20 bp, Artificial Sequence
  chemically synthesized
gcctctatacctagaagcgg

SEQ ID NO: 62386 - DNA, 20 bp, Artificial Sequence
  chemically synthesized
aatacatgtgtatagatttt

SEQ ID NO: 62387 - DNA, 20 bp, Artificial Sequence
  chemically synthesized
cacatgtattaatatgaaac

SEQ ID NO: 62388 - DNA, 20 bp, Artificial Sequence
  chemically synthesized
agaggacacatgctcacata

SEQ ID NO: 62389 - DNA, 20 bp, Artificial Sequence
  chemically synthesized
atacggggtcagatctgact

SEQ ID NO: 62390 - DNA, 20 bp, Artificial Sequence
  chemically synthesized
tactgggaagctctcatctt

SEQ ID NO: 62391 - DNA, 20 bp, Artificial Sequence
  chemically synthesized
cattcctccaggagagctaa

SEQ ID NO: 62392 - DNA, 20 bp, Artificial Sequence
  chemically synthesized
agctaaaagggttcacctgt

SEQ ID NO: 62393 - DNA, 20 bp, Artificial Sequence
  chemically synthesized
gtaactgtgaaggactacaa

SEQ ID NO: 62394 - DNA, 20 bp, Artificial Sequence
  chemically synthesized
gagaaaaaacaggaggtcaa

SEQ ID NO: 62395 - DNA, 20 bp, Artificial Sequence
  chemically synthesized
gggatagagaaggcttccag

SEQ ID NO: 62396 - DNA, 20 bp, Artificial Sequence
  chemically synthesized
gctttgaagctggcttctgt

SEQ ID NO: 62397 - DNA, 20 bp, Artificial Sequence
  chemically synthesized
attagttcaacagacatgca

SEQ ID NO: 62398 - DNA, 20 bp, Artificial Sequence
  chemically synthesized
gacatgcaaggaattttcag

SEQ ID NO: 62399 - DNA, 20 bp, Artificial Sequence
  chemically synthesized
ttcttgaggttagcagctgt

SEQ ID NO: 62400 - DNA, 20 bp, Artificial Sequence
  chemically synthesized
actgttttttgtattcattt

SEQ ID NO: 62401 - DNA, 20 bp, Artificial Sequence
  chemically synthesized
ttttttgtattcatttgtga

SEQ ID NO: 62402 - DNA, 20 bp, Artificial Sequence
  chemically synthesized
tcagtctactcggtttcgct

SEQ ID NO: 62403 - DNA, 20 bp, Artificial Sequence
  chemically synthesized
tctactcggtttcgctgtga

SEQ ID NO: 62404 - DNA, 20 bp, Artificial Sequence
  chemically synthesized
taagaaaggaaatcaacctg

SEQ ID NO: 62405 - DNA, 20 bp, Artificial Sequence
  chemically synthesized
tatacagataacaaaataca

SEQ ID NO: 62406 - DNA, 20 bp, Artificial Sequence
  chemically synthesized
cagataacaaaatacagaga

SEQ ID NO: 62407 - DNA, 20 bp, Artificial Sequence
  chemically synthesized
gtaataactgtggcacaggc

SEQ ID NO: 62408 - DNA, 20 bp, Artificial Sequence
  chemically synthesized
aacagtggggaaaaaattcc

SEQ ID NO: 62409 - DNA, 20 bp, Artificial Sequence
  chemically synthesized
gtggggaaaaaattccatgg

SEQ ID NO: 62410 - DNA, 20 bp, Artificial Sequence
  chemically synthesized
aagactagcattgttttagg

SEQ ID NO: 62411 - DNA, 20 bp, Artificial Sequence
  chemically synthesized
aggttgagtggcagtgttta

SEQ ID NO: 62412 - DNA, 20 bp, Artificial Sequence
  chemically synthesized
gaaatatgtggctaaataac

SEQ ID NO: 62413 - DNA, 20 bp, Artificial Sequence
  chemically synthesized
actctttattttttcgtatc

SEQ ID NO: 62414 - DNA, 20 bp, Artificial Sequence
  chemically synthesized
agtactcaaagcttgttaaa

SEQ ID NO: 62415 - DNA, 20 bp, Artificial Sequence
  chemically synthesized
acatggaggaaaaactcatc

SEQ ID NO: 62416 - DNA, 20 bp, Artificial Sequence
  chemically synthesized
ggtgtggctctgcagtgtga

SEQ ID NO: 62417 - DNA, 20 bp, Artificial Sequence
  chemically synthesized
gattgggtacttgcaggacg

SEQ ID NO: 62418 - DNA, 20 bp, Artificial Sequence
  chemically synthesized
ggtacttgcaggacgaaggg

SEQ ID NO: 62419 - DNA, 20 bp, Artificial Sequence
  chemically synthesized
tgcaggacgaagggtggggt

SEQ ID NO: 62420 - DNA, 20 bp, Artificial Sequence
  chemically synthesized
tgggcagatcacttgaggtc

SEQ ID NO: 62421 - DNA, 20 bp, Artificial Sequence
  chemically synthesized
tacttgggaggctgaggcag

SEQ ID NO: 62422 - DNA, 20 bp, Artificial Sequence
  chemically synthesized
aatcgcttgaaccggggagg

SEQ ID NO: 62423 - DNA, 20 bp, Artificial Sequence
  chemically synthesized
catcaaattccctgaccgaa

SEQ ID NO: 62424 - DNA, 20 bp, Artificial Sequence
  chemically synthesized
agccagaaattagcatgcac

SEQ ID NO: 62425 - DNA, 20 bp, Artificial Sequence
  chemically synthesized
tagcatgcactagagtgtgc

SEQ ID NO: 62426 - DNA, 20 bp, Artificial Sequence
  chemically synthesized
atcctgttggtttttcgtga

SEQ ID NO: 62427 - DNA, 20 bp, Artificial Sequence
  chemically synthesized
tatatttatgtgtatgtgtg

SEQ ID NO: 62428 - DNA, 20 bp, Artificial Sequence
  chemically synthesized
atcttttattctccccttca

SEQ ID NO: 62429 - DNA, 20 bp, Artificial Sequence
  chemically synthesized
ttctaagcatcttacatctt

SEQ ID NO: 62430 - DNA, 20 bp, Artificial Sequence
  chemically synthesized
ttaatcatagtttcatataa

SEQ ID NO: 62431 - DNA, 20 bp, Artificial Sequence
  chemically synthesized
aaatgggttcctcatcatct

SEQ ID NO: 62432 - DNA, 20 bp, Artificial Sequence
  chemically synthesized
ttcttagcaattttacaatt

SEQ ID NO: 62433 - DNA, 20 bp, Artificial Sequence
  chemically synthesized
tagcaattttacaattttga

SEQ ID NO: 62434 - DNA, 20 bp, Artificial Sequence
  chemically synthesized
aattttacaattttgaatga

SEQ ID NO: 62435 - DNA, 20 bp, Artificial Sequence
  chemically synthesized
acatatacaactataattaa

SEQ ID NO: 62436 - DNA, 20 bp, Artificial Sequence
  chemically synthesized
tgcacacacaaagaaatcag

SEQ ID NO: 62437 - DNA, 20 bp, Artificial Sequence
  chemically synthesized
ctccgcaggcagagccttga

SEQ ID NO: 62438 - DNA, 20 bp, Artificial Sequence
  chemically synthesized
gcagagccttgatgggatta

SEQ ID NO: 62439 - DNA, 20 bp, Artificial Sequence
  chemically synthesized
ttgatgggattactgagttc

SEQ ID NO: 62440 - DNA, 20 bp, Artificial Sequence
  chemically synthesized
caaaataaaaggctcaaaag

SEQ ID NO: 62441 - DNA, 20 bp, Artificial Sequence
  chemically synthesized
caaaagatgaatatcgaaac

SEQ ID NO: 62442 - DNA, 20 bp, Artificial Sequence
  chemically synthesized
aaccagggtgttttttacac

SEQ ID NO: 62443 - DNA, 20 bp, Artificial Sequence
  chemically synthesized
tattcatccatcttcatggg

SEQ ID NO: 62444 - DNA, 20 bp, Artificial Sequence
  chemically synthesized
taagcatacttctattcaat

SEQ ID NO: 62445 - DNA, 20 bp, Artificial Sequence
  chemically synthesized
tattctgtaagattatagtt

SEQ ID NO: 62446 - DNA, 20 bp, Artificial Sequence
  chemically synthesized
ttttaatatgctttaagttc

SEQ ID NO: 62447 - DNA, 20 bp, Artificial Sequence
  chemically synthesized
atgttcccctccctgtgtcc

SEQ ID NO: 62448 - DNA, 20 bp, Artificial Sequence
  chemically synthesized
taaagtctcagttaaatttt

SEQ ID NO: 62449 - DNA, 20 bp, Artificial Sequence
  chemically synthesized
caagtctaaagaaaaaaata

SEQ ID NO: 62450 - DNA, 20 bp, Artificial Sequence
  chemically synthesized
gagactggtgacactagtgt

SEQ ID NO: 62451 - DNA, 20 bp, Artificial Sequence
  chemically synthesized
cactagtgtctgaatgaggc

SEQ ID NO: 62452 - DNA, 20 bp, Artificial Sequence
  chemically synthesized
agaacaaactcctgtggggc

SEQ ID NO: 62453 - DNA, 20 bp, Artificial Sequence
  chemically synthesized
gttttccatatttcctcatg

SEQ ID NO: 62454 - DNA, 20 bp, Artificial Sequence
  chemically synthesized
gctttatgttgctgttgttt

SEQ ID NO: 62455 - DNA, 20 bp, Artificial Sequence
  chemically synthesized
ctcagttctagcactagagg

SEQ ID NO: 62456 - DNA, 20 bp, Artificial Sequence
  chemically synthesized
tgcacttaaaatagtctcat

SEQ ID NO: 62457 - DNA, 20 bp, Artificial Sequence
  chemically synthesized
aagcacattctgaactactt

SEQ ID NO: 62458 - DNA, 20 bp, Artificial Sequence
  chemically synthesized
caatttaattaaaaaaaccc

SEQ ID NO: 62459 - DNA, 20 bp, Artificial Sequence
  chemically synthesized
aaaaaaacccaagaatttct

SEQ ID NO: 62460 - DNA, 20 bp, Artificial Sequence
  chemically synthesized
agctatatttcagcggaaaa

SEQ ID NO: 62461 - DNA, 20 bp, Artificial Sequence
  chemically synthesized
cagcggaaaatgggatattt

SEQ ID NO: 62462 - DNA, 20 bp, Artificial Sequence
  chemically synthesized
tcccgaggtcagtcacacaa

SEQ ID NO: 62463 - DNA, 20 bp, Artificial Sequence
  chemically synthesized
cagagagagagattactctt

SEQ ID NO: 62464 - DNA, 20 bp, Artificial Sequence
  chemically synthesized
acgcatactggggcctatca

SEQ ID NO: 62465 - DNA, 20 bp, Artificial Sequence
  chemically synthesized
ctggggcctatcagagggtg

SEQ ID NO: 62466 - DNA, 20 bp, Artificial Sequence
  chemically synthesized
ggtggagggtgagagaagga

SEQ ID NO: 62467 - DNA, 20 bp, Artificial Sequence
  chemically synthesized
aggatcaggaaaaatcacta

SEQ ID NO: 62468 - DNA, 20 bp, Artificial Sequence
  chemically synthesized
atggatgctaagcgtaatac

SEQ ID NO: 62469 - DNA, 20 bp, Artificial Sequence
  chemically synthesized
ggcttcctgcaaggcagcca

SEQ ID NO: 62470 - DNA, 20 bp, Artificial Sequence
  chemically synthesized
ttgtgatatccaagtcattc

SEQ ID NO: 62471 - DNA, 20 bp, Artificial Sequence
  chemically synthesized
aaatctaacacaaaatctag

SEQ ID NO: 62472 - DNA, 20 bp, Artificial Sequence
  chemically synthesized
cttacatctatttttgttct

SEQ ID NO: 62473 - DNA, 20 bp, Artificial Sequence
  chemically synthesized
atttagatacataatggaag

SEQ ID NO: 62474 - DNA, 20 bp, Artificial Sequence
  chemically synthesized
aatttaaaatctggctaatt

SEQ ID NO: 62475 - DNA, 20 bp, Artificial Sequence
  chemically synthesized
aaagtaagttatttgtggta

SEQ ID NO: 62476 - DNA, 20 bp, Artificial Sequence
  chemically synthesized
aagggcctactttacttaac

SEQ ID NO: 62477 - DNA, 20 bp, Artificial Sequence
  chemically synthesized
cagaaagatttaagaaaata

SEQ ID NO: 62478 - DNA, 20 bp, Artificial Sequence
  chemically synthesized
attaggcatcttacagtttt

SEQ ID NO: 62479 - DNA, 20 bp, Artificial Sequence
  chemically synthesized
taaagcaaacccaaacaggc

SEQ ID NO: 62480 - DNA, 20 bp, Artificial Sequence
  chemically synthesized
caggcaggaattaatcttca

SEQ ID NO: 62481 - DNA, 20 bp, Artificial Sequence
  chemically synthesized
ggaattaatcttcatcgaat

SEQ ID NO: 62482 - DNA, 20 bp, Artificial Sequence
  chemically synthesized
tttaattatatagacaataa

SEQ ID NO: 62483 - DNA, 20 bp, Artificial Sequence
  chemically synthesized
tctaatctttctgatctatc

SEQ ID NO: 62484 - DNA, 20 bp, Artificial Sequence
  chemically synthesized
gcccgcagcctacctgactt

SEQ ID NO: 62485 - DNA, 20 bp, Artificial Sequence
  chemically synthesized
agcctacctgacttctgagt

SEQ ID NO: 62486 - DNA, 20 bp, Artificial Sequence
  chemically synthesized
cctttagccataaggaaaca

SEQ ID NO: 62487 - DNA, 20 bp, Artificial Sequence
  chemically synthesized
tagccataaggaaacatgga

SEQ ID NO: 62488 - DNA, 20 bp, Artificial Sequence
  chemically synthesized
acatggaatgggtcagatcc

SEQ ID NO: 62489 - DNA, 20 bp, Artificial Sequence
  chemically synthesized
ctggctccgagggagcagga

SEQ ID NO: 62490 - DNA, 20 bp, Artificial Sequence
  chemically synthesized
gagaggatcaaccccatact

SEQ ID NO: 62491 - DNA, 20 bp, Artificial Sequence
  chemically synthesized
agaagactggtgtccatact

SEQ ID NO: 62492 - DNA, 20 bp, Artificial Sequence
  chemically synthesized
gtgtccatactctgaatggg

SEQ ID NO: 62493 - DNA, 20 bp, Artificial Sequence
  chemically synthesized
actctgaatgggaagaatga

SEQ ID NO: 62494 - DNA, 20 bp, Artificial Sequence
  chemically synthesized
agggccactgccttcatact

SEQ ID NO: 62495 - DNA, 20 bp, Artificial Sequence
  chemically synthesized
atctcaacgactgttcttct

SEQ ID NO: 62496 - DNA, 20 bp, Artificial Sequence
  chemically synthesized
gtcattgttcttttatttca

SEQ ID NO: 62497 - DNA, 20 bp, Artificial Sequence
  chemically synthesized
aaatacgttctttccaaacc

SEQ ID NO: 62498 - DNA, 20 bp, Artificial Sequence
  chemically synthesized
tgtcccaggaagtcttaatc

SEQ ID NO: 62499 - DNA, 20 bp, Artificial Sequence
  chemically synthesized
atttagcattttcttctact

SEQ ID NO: 62500 - DNA, 20 bp, Artificial Sequence
  chemically synthesized
tttgaatgcaaaggacaaac

SEQ ID NO: 62501 - DNA, 20 bp, Artificial Sequence
  chemically synthesized
gtttttgtttttgtttgaga

SEQ ID NO: 62502 - DNA, 20 bp, Artificial Sequence
  chemically synthesized
ttcgctcttattgcccaggc

SEQ ID NO: 62503 - DNA, 20 bp, Artificial Sequence
  chemically synthesized
aattctcctgccttggcctc

SEQ ID NO: 62504 - DNA, 20 bp, Artificial Sequence
  chemically synthesized
ccttggcctcctgagtagct

SEQ ID NO: 62505 - DNA, 20 bp, Artificial Sequence
  chemically synthesized
ttttgtatttttagtagaga

SEQ ID NO: 62506 - DNA, 20 bp, Artificial Sequence
  chemically synthesized
gccttggcctcctgaagtgc

SEQ ID NO: 62507 - DNA, 20 bp, Artificial Sequence
  chemically synthesized
acatttatctgcatcactac

SEQ ID NO: 62508 - DNA, 20 bp, Artificial Sequence
  chemically synthesized
ctgtgacacaaaaaaagttt

SEQ ID NO: 62509 - DNA, 20 bp, Artificial Sequence
  chemically synthesized
tgtctgtgttagccaatggt

SEQ ID NO: 62510 - DNA, 20 bp, Artificial Sequence
  chemically synthesized
ggttaatagctaaaagaaaa

SEQ ID NO: 62511 - DNA, 20 bp, Artificial Sequence
  chemically synthesized
ggagtagaaattcagtggcc

SEQ ID NO: 62512 - DNA, 20 bp, Artificial Sequence
  chemically synthesized
ttaagtcaggtgaagacttc

SEQ ID NO: 62513 - DNA, 20 bp, Artificial Sequence
  chemically synthesized
agaaacgctcttagtaaact

SEQ ID NO: 62514 - DNA, 20 bp, Artificial Sequence
  chemically synthesized
ctcttagtaaacttggaata

SEQ ID NO: 62515 - DNA, 20 bp, Artificial Sequence
  chemically synthesized
aggagaaagaaatggtagaa

SEQ ID NO: 62516 - DNA, 20 bp, Artificial Sequence
  chemically synthesized
tgctcgggaggctgaggcag

SEQ ID NO: 62517 - DNA, 20 bp, Artificial Sequence
  chemically synthesized
attgcactccagtctggcaa

SEQ ID NO: 62518 - DNA, 20 bp, Artificial Sequence
  chemically synthesized
aaagaaaaaagaaaaaataa

SEQ ID NO: 62519 - DNA, 20 bp, Artificial Sequence
  chemically synthesized
ggtgatgtaagggactttta

SEQ ID NO: 62520 - DNA, 20 bp, Artificial Sequence
  chemically synthesized
ttttatagaattaacaatgc

SEQ ID NO: 62521 - DNA, 20 bp, Artificial Sequence
  chemically synthesized
ttgatagttaaataatttct

SEQ ID NO: 62522 - DNA, 20 bp, Artificial Sequence
  chemically synthesized
attccttgattctaaaatat

SEQ ID NO: 62523 - DNA, 20 bp, Artificial Sequence
  chemically synthesized
gagcaatattcttcaggcac

SEQ ID NO: 62524 - DNA, 20 bp, Artificial Sequence
  chemically synthesized
atattcttcaggcacatgga

SEQ ID NO: 62525 - DNA, 20 bp, Artificial Sequence
  chemically synthesized
cttcaggcacatggatcgaa

SEQ ID NO: 62526 - DNA, 20 bp, Artificial Sequence
  chemically synthesized
gaaaaaaaaaaggacactag

SEQ ID NO: 62527 - DNA, 20 bp, Artificial Sequence
  chemically synthesized
attctggctttaaataattt

SEQ ID NO: 62528 - DNA, 20 bp, Artificial Sequence
  chemically synthesized
catagagaaatgaaaagaga

SEQ ID NO: 62529 - DNA, 20 bp, Artificial Sequence
  chemically synthesized
gagaggattctctggaagca

SEQ ID NO: 62530 - DNA, 20 bp, Artificial Sequence
  chemically synthesized
ttttctgtctgtcctctcta

SEQ ID NO: 62531 - DNA, 20 bp, Artificial Sequence
  chemically synthesized
caccccaaggtactgtactt

SEQ ID NO: 62532 - DNA, 20 bp, Artificial Sequence
  chemically synthesized
actccttaagagagctagaa

SEQ ID NO: 62533 - DNA, 20 bp, Artificial Sequence
  chemically synthesized
atgaggctttcttggaaaag

SEQ ID NO: 62534 - DNA, 20 bp, Artificial Sequence
  chemically synthesized
ggaaaaggagaatgggagag

SEQ ID NO: 62535 - DNA, 20 bp, Artificial Sequence
  chemically synthesized
tcattttggaagatgatgaa

SEQ ID NO: 62536 - DNA, 20 bp, Artificial Sequence
  chemically synthesized
gagccaacaaaaaagagcct

SEQ ID NO: 62537 - DNA, 20 bp, Artificial Sequence
  chemically synthesized
gggccagaacttcggcagta

SEQ ID NO: 62538 - DNA, 20 bp, Artificial Sequence
  chemically synthesized
tcactagcctgtggagcaag

SEQ ID NO: 62539 - DNA, 20 bp, Artificial Sequence
  chemically synthesized
agcattggttctcaatgcat

SEQ ID NO: 62540 - DNA, 20 bp, Artificial Sequence
  chemically synthesized
gttctcaatgcatgggaatg

SEQ ID NO: 62541 - DNA, 20 bp, Artificial Sequence
  chemically synthesized
tcaatgcatgggaatgaagg

SEQ ID NO: 62542 - DNA, 20 bp, Artificial Sequence
  chemically synthesized
tcaagcccgcctttgctaag

SEQ ID NO: 62543 - DNA, 20 bp, Artificial Sequence
  chemically synthesized
tgcactgtgacaagctgcat

SEQ ID NO: 62544 - DNA, 20 bp, Artificial Sequence
  chemically synthesized
tggatcctgagaacttcaag

SEQ ID NO: 62545 - DNA, 20 bp, Artificial Sequence
  chemically synthesized
caacaaagatctcagaaatc

SEQ ID NO: 62546 - DNA, 20 bp, Artificial Sequence
  chemically synthesized
agtaaaggactactaacagc

SEQ ID NO: 62547 - DNA, 20 bp, Artificial Sequence
  chemically synthesized
aacttgatgtgtttatccca

SEQ ID NO: 62548 - DNA, 20 bp, Artificial Sequence
  chemically synthesized
tatcccagagaattgtatta

SEQ ID NO: 62549 - DNA, 20 bp, Artificial Sequence
  chemically synthesized
gaattgtagacttgtgaaag

SEQ ID NO: 62550 - DNA, 20 bp, Artificial Sequence
  chemically synthesized
atagaaatgccttattttat

SEQ ID NO: 62551 - DNA, 20 bp, Artificial Sequence
  chemically synthesized
gaccaagtgaaggcttgttt

SEQ ID NO: 62552 - DNA, 20 bp, Artificial Sequence
  chemically synthesized
ggcttgtttccgaatttgtt

SEQ ID NO: 62553 - DNA, 20 bp, Artificial Sequence
  chemically synthesized
aatactggtaaaatggggaa

SEQ ID NO: 62554 - DNA, 20 bp, Artificial Sequence
  chemically synthesized
ggtaaaatggggaagggggt

SEQ ID NO: 62555 - DNA, 20 bp, Artificial Sequence
  chemically synthesized
ggggtgagggtgtaggtagg

SEQ ID NO: 62556 - DNA, 20 bp, Artificial Sequence
  chemically synthesized
gggtgtaggtaggtagaatg

SEQ ID NO: 62557 - DNA, 20 bp, Artificial Sequence
  chemically synthesized
aatgttgaatgtagggctca

SEQ ID NO: 62558 - DNA, 20 bp, Artificial Sequence
  chemically synthesized
aaaattgaacctaagctcat

SEQ ID NO: 62559 - DNA, 20 bp, Artificial Sequence
  chemically synthesized
cctaagctcatctgaatttt

SEQ ID NO: 62560 - DNA, 20 bp, Artificial Sequence
  chemically synthesized
accttggaacagtttgaggt

SEQ ID NO: 62561 - DNA, 20 bp, Artificial Sequence
  chemically synthesized
gtttgaggtcagggttgtct

SEQ ID NO: 62562 - DNA, 20 bp, Artificial Sequence
  chemically synthesized
tgtcttttgcctaacagctc

SEQ ID NO: 62563 - DNA, 20 bp, Artificial Sequence
  chemically synthesized
tctggctactcactttggca

SEQ ID NO: 62564 - DNA, 20 bp, Artificial Sequence
  chemically synthesized
gccctggcccataagtacca

SEQ ID NO: 62565 - DNA, 20 bp, Artificial Sequence
  chemically synthesized
gaaaaagtgttcatgggctg

SEQ ID NO: 62566 - DNA, 20 bp, Artificial Sequence
  chemically synthesized
tgggggcttgtaaaattaat

SEQ ID NO: 62567 - DNA, 20 bp, Artificial Sequence
  chemically synthesized
aattaatgtggatgttatgg

SEQ ID NO: 62568 - DNA, 20 bp, Artificial Sequence
  chemically synthesized
tggatgttatgggagaattc

SEQ ID NO: 62569 - DNA, 20 bp, Artificial Sequence
  chemically synthesized
gagaattccaggattccaag

SEQ ID NO: 62570 - DNA, 20 bp, Artificial Sequence
  chemically synthesized
tgatggagaaaaatctttat

SEQ ID NO: 62571 - DNA, 20 bp, Artificial Sequence
  chemically synthesized
tagatatccaagatataggc

SEQ ID NO: 62572 - DNA, 20 bp, Artificial Sequence
  chemically synthesized
gaaattgatttggagataag

SEQ ID NO: 62573 - DNA, 20 bp, Artificial Sequence
  chemically synthesized
aatagcctgctctttccatg

SEQ ID NO: 62574 - DNA, 20 bp, Artificial Sequence
  chemically synthesized
atgaaggattccattatttc

SEQ ID NO: 62575 - DNA, 20 bp, Artificial Sequence
  chemically synthesized
cattgtgcattatcttctga

SEQ ID NO: 62576 - DNA, 20 bp, Artificial Sequence
  chemically synthesized
aacatgcactaaaataaagt

SEQ ID NO: 62577 - DNA, 20 bp, Artificial Sequence
  chemically synthesized
aataaagttagagttaggac

SEQ ID NO: 62578 - DNA, 20 bp, Artificial Sequence
  chemically synthesized
cctgagtgggaaagtttttg

SEQ ID NO: 62579 - DNA, 20 bp, Artificial Sequence
  chemically synthesized
tgaagactttccgtgggaga

SEQ ID NO: 62580 - DNA, 20 bp, Artificial Sequence
  chemically synthesized
ggctctctggaagtagaagg

SEQ ID NO: 62581 - DNA, 20 bp, Artificial Sequence
  chemically synthesized
caatactaaacgataagcat

SEQ ID NO: 62582 - DNA, 20 bp, Artificial Sequence
  chemically synthesized
aatctgcttatgtgcacaaa

SEQ ID NO: 62583 - DNA, 20 bp, Artificial Sequence
  chemically synthesized
gtttgcagataaaataaaat

SEQ ID NO: 62584 - DNA, 20 bp, Artificial Sequence
  chemically synthesized
gttcaaacccaagaggagca

SEQ ID NO: 62585 - DNA, 20 bp, Artificial Sequence
  chemically synthesized
caagaggagcagtgagtctg

SEQ ID NO: 62586 - DNA, 20 bp, Artificial Sequence
  chemically synthesized
cagtgagtctgtggaatttg

SEQ ID NO: 62587 - DNA, 20 bp, Artificial Sequence
  chemically synthesized
atttgaaggatggacaaagg

SEQ ID NO: 62588 - DNA, 20 bp, Artificial Sequence
  chemically synthesized
cctggtgactctcatgtgtg

SEQ ID NO: 62589 - DNA, 20 bp, Artificial Sequence
  chemically synthesized
ctctcatgtgtgaagggtag

SEQ ID NO: 62590 - DNA, 20 bp, Artificial Sequence
  chemically synthesized
aggaagtgctagattggtca

SEQ ID NO: 62591 - DNA, 20 bp, Artificial Sequence
  chemically synthesized
aacctttgcattttccaagt

SEQ ID NO: 62592 - DNA, 20 bp, Artificial Sequence
  chemically synthesized
cattgatcagactttttcct

SEQ ID NO: 62593 - DNA, 20 bp, Artificial Sequence
  chemically synthesized
ctttttcctgtgaattactt

SEQ ID NO: 62594 - DNA, 20 bp, Artificial Sequence
  chemically synthesized
tgaatttggctgtatatatc

SEQ ID NO: 62595 - DNA, 20 bp, Artificial Sequence
  chemically synthesized
cctttcaatatgcccataaa

SEQ ID NO: 62596 - DNA, 20 bp, Artificial Sequence
  chemically synthesized
tgcccataaacagagtaaac

SEQ ID NO: 62597 - DNA, 20 bp, Artificial Sequence
  chemically synthesized
tacatatttttatatattta

SEQ ID NO: 62598 - DNA, 20 bp, Artificial Sequence
  chemically synthesized
gatgattaagtctagatatt

SEQ ID NO: 62599 - DNA, 20 bp, Artificial Sequence
  chemically synthesized
cacttttttagctcccacag

SEQ ID NO: 62600 - DNA, 20 bp, Artificial Sequence
  chemically synthesized
atctatctctttggcatacc

SEQ ID NO: 62601 - DNA, 20 bp, Artificial Sequence
  chemically synthesized
gatcccaaaccttaactatt

SEQ ID NO: 62602 - DNA, 20 bp, Artificial Sequence
  chemically synthesized
tgaatagtgcttcaataaac

SEQ ID NO: 62603 - DNA, 20 bp, Artificial Sequence
  chemically synthesized
acatgagtgtaatgtgtcca

SEQ ID NO: 62604 - DNA, 20 bp, Artificial Sequence
  chemically synthesized
atatactgatttcctttctt

SEQ ID NO: 62605 - DNA, 20 bp, Artificial Sequence
  chemically synthesized
aataaccactagtgagattg

SEQ ID NO: 62606 - DNA, 20 bp, Artificial Sequence
  chemically synthesized
cccaccaacagtgtgtaaga

SEQ ID NO: 62607 - DNA, 20 bp, Artificial Sequence
  chemically synthesized
ccttttctccatatcctcac

SEQ ID NO: 62608 - DNA, 20 bp, Artificial Sequence
  chemically synthesized
ttgttaatagccgttttaac

SEQ ID NO: 62609 - DNA, 20 bp, Artificial Sequence
  chemically synthesized
ccctgatcattagtgatgtt

SEQ ID NO: 62610 - DNA, 20 bp, Artificial Sequence
  chemically synthesized
tcatttgtatatctttttct

SEQ ID NO: 62611 - DNA, 20 bp, Artificial Sequence
  chemically synthesized
gtccttagcctactttttat

SEQ ID NO: 62612 - DNA, 20 bp, Artificial Sequence
  chemically synthesized
atttgtgttcattttagagc

SEQ ID NO: 62613 - DNA, 20 bp, Artificial Sequence
  chemically synthesized
tgaagattttctcccactct

SEQ ID NO: 62614 - DNA, 20 bp, Artificial Sequence
  chemically synthesized
tttcctaagccaatgtgtag

SEQ ID NO: 62615 - DNA, 20 bp, Artificial Sequence
  chemically synthesized
gtttttccgatgttattttc

SEQ ID NO: 62616 - DNA, 20 bp, Artificial Sequence
  chemically synthesized
atttaagtccttgatccatc

SEQ ID NO: 62617 - DNA, 20 bp, Artificial Sequence
  chemically synthesized
agctatccccgcaccatttg

SEQ ID NO: 62618 - DNA, 20 bp, Artificial Sequence
  chemically synthesized
tccccgcaccatttgttgaa

SEQ ID NO: 62619 - DNA, 20 bp, Artificial Sequence
  chemically synthesized
tttgctttgtcaaagatcag

SEQ ID NO: 62620 - DNA, 20 bp, Artificial Sequence
  chemically synthesized
gatcagttggatgtaagtat

SEQ ID NO: 62621 - DNA, 20 bp, Artificial Sequence
  chemically synthesized
gtaagtatttgagtttattt

SEQ ID NO: 62622 - DNA, 20 bp, Artificial Sequence
  chemically synthesized
gggctcttttttggttccat

SEQ ID NO: 62623 - DNA, 20 bp, Artificial Sequence
  chemically synthesized
ttttggttccataagaattt

SEQ ID NO: 62624 - DNA, 20 bp, Artificial Sequence
  chemically synthesized
actaatggtggtattttgat

SEQ ID NO: 62625 - DNA, 20 bp, Artificial Sequence
  chemically synthesized
gtattttgatgggaattgca

SEQ ID NO: 62626 - DNA, 20 bp, Artificial Sequence
  chemically synthesized
tattgattctacccatctat

SEQ ID NO: 62627 - DNA, 20 bp, Artificial Sequence
  chemically synthesized
ttttttgcagctattgtaaa

SEQ ID NO: 62628 - DNA, 20 bp, Artificial Sequence
  chemically synthesized
tgcagctattgtaaaagggg

SEQ ID NO: 62629 - DNA, 20 bp, Artificial Sequence
  chemically synthesized
ttttgtatccagaaactttg

SEQ ID NO: 62630 - DNA, 20 bp, Artificial Sequence
  chemically synthesized
gaattattttatcagttcta

SEQ ID NO: 62631 - DNA, 20 bp, Artificial Sequence
  chemically synthesized
tcagttctagggggttttgg

SEQ ID NO: 62632 - DNA, 20 bp, Artificial Sequence
  chemically synthesized
gggggttttggaggagtctt

SEQ ID NO: 62633 - DNA, 20 bp, Artificial Sequence
  chemically synthesized
ttgactttctctttaacaat

SEQ ID NO: 62634 - DNA, 20 bp, Artificial Sequence
  chemically synthesized
atatgttaaagagaagtggt

SEQ ID NO: 62635 - DNA, 20 bp, Artificial Sequence
  chemically synthesized
gttaaagagaagtggtgaga

SEQ ID NO: 62636 - DNA, 20 bp, Artificial Sequence
  chemically synthesized
gtctcattccagttttcaga

SEQ ID NO: 62637 - DNA, 20 bp, Artificial Sequence
  chemically synthesized
tcctttgtaaaccgattttg

SEQ ID NO: 62638 - DNA, 20 bp, Artificial Sequence
  chemically synthesized
gttttagtcataaagtgatg

SEQ ID NO: 62639 - DNA, 20 bp, Artificial Sequence
  chemically synthesized
taaagtgatgttgaattttg

SEQ ID NO: 62640 - DNA, 20 bp, Artificial Sequence
  chemically synthesized
cgcatgaaacccacttgatc

SEQ ID NO: 62641 - DNA, 20 bp, Artificial Sequence
  chemically synthesized
tcatgggttttgatatgctg

SEQ ID NO: 62642 - DNA, 20 bp, Artificial Sequence
  chemically synthesized
ctattagctagtattttgtc

SEQ ID NO: 62643 - DNA, 20 bp, Artificial Sequence
  chemically synthesized
tgttggcatctatgttcatc

SEQ ID NO: 62644 - DNA, 20 bp, Artificial Sequence
  chemically synthesized
ttaaggtgatactggcttca

SEQ ID NO: 62645 - DNA, 20 bp, Artificial Sequence
  chemically synthesized
gcttcatagaatgatttagg

SEQ ID NO: 62646 - DNA, 20 bp, Artificial Sequence
  chemically synthesized
ttctctctttctctatcttg

SEQ ID NO: 62647 - DNA, 20 bp, Artificial Sequence
  chemically synthesized
atcttgtagaatactgtcaa

SEQ ID NO: 62648 - DNA, 20 bp, Artificial Sequence
  chemically synthesized
ggattggtatcaattcttct

SEQ ID NO: 62649 - DNA, 20 bp, Artificial Sequence
  chemically synthesized
attcttctttgaatgtctgg

SEQ ID NO: 62650 - DNA, 20 bp, Artificial Sequence
  chemically synthesized
atgtctggtagaattcagct

SEQ ID NO: 62651 - DNA, 20 bp, Artificial Sequence
  chemically synthesized
ctgcttattactggtctgtt

SEQ ID NO: 62652 - DNA, 20 bp, Artificial Sequence
  chemically synthesized
ctagagccctgtatctttcc

SEQ ID NO: 62653 - DNA, 20 bp, Artificial Sequence
  chemically synthesized
taaaggtgttcatagtagcc

SEQ ID NO: 62654 - DNA, 20 bp, Artificial Sequence
  chemically synthesized
atctcctgttttgtttctaa

SEQ ID NO: 62655 - DNA, 20 bp, Artificial Sequence
  chemically synthesized
tagttattccctttcttttg

SEQ ID NO: 62656 - DNA, 20 bp, Artificial Sequence
  chemically synthesized
tcttattatactttaagttc

SEQ ID NO: 62657 - DNA, 20 bp, Artificial Sequence
  chemically synthesized
taagttctgggatacatgtg

SEQ ID NO: 62658 - DNA, 20 bp, Artificial Sequence
  chemically synthesized
tcattgttcaactcccactt

SEQ ID NO: 62659 - DNA, 20 bp, Artificial Sequence
  chemically synthesized
tgttcctgtgttagtttgct

SEQ ID NO: 62660 - DNA, 20 bp, Artificial Sequence
  chemically synthesized
attatatcgctgatggccat

SEQ ID NO: 62661 - DNA, 20 bp, Artificial Sequence
  chemically synthesized
ggttccaagtctttgctatt

SEQ ID NO: 62662 - DNA, 20 bp, Artificial Sequence
  chemically synthesized
gtgtgcacgtgtctttatag

SEQ ID NO: 62663 - DNA, 20 bp, Artificial Sequence
  chemically synthesized
gtagaatgatttctaattct

SEQ ID NO: 62664 - DNA, 20 bp, Artificial Sequence
  chemically synthesized
tttgggtatatacccagtaa

SEQ ID NO: 62665 - DNA, 20 bp, Artificial Sequence
  chemically synthesized
tatacccagtaatgggattg

SEQ ID NO: 62666 - DNA, 20 bp, Artificial Sequence
  chemically synthesized
tttctggttctagatccttg

SEQ ID NO: 62667 - DNA, 20 bp, Artificial Sequence
  chemically synthesized
atcctttgtccactttttga

SEQ ID NO: 62668 - DNA, 20 bp, Artificial Sequence
  chemically synthesized
gttgaagttctttgtagatt

SEQ ID NO: 62669 - DNA, 20 bp, Artificial Sequence
  chemically synthesized
ggatgttagccctttgtcag

SEQ ID NO: 62670 - DNA, 20 bp, Artificial Sequence
  chemically synthesized
ttgcttttgatgttttagtc

SEQ ID NO: 62671 - DNA, 20 bp, Artificial Sequence
  chemically synthesized
tttttgcccatgcctatgtc

SEQ ID NO: 62672 - DNA, 20 bp, Artificial Sequence
  chemically synthesized
gtattgcctaggttatcttc

SEQ ID NO: 62673 - DNA, 20 bp, Artificial Sequence
  chemically synthesized
atttaagtctttaatccacc

SEQ ID NO: 62674 - DNA, 20 bp, Artificial Sequence
  chemically synthesized
ttttgtataaggtgtaagga

SEQ ID NO: 62675 - DNA, 20 bp, Artificial Sequence
  chemically synthesized
ccagcaccatttattaaata

SEQ ID NO: 62676 - DNA, 20 bp, Artificial Sequence
  chemically synthesized
ccagctttgttctttttgtt

SEQ ID NO: 62677 - DNA, 20 bp, Artificial Sequence
  chemically synthesized
aaagtcagtggtagcttgat

SEQ ID NO: 62678 - DNA, 20 bp, Artificial Sequence
  chemically synthesized
gtagcttgatggggatagca

SEQ ID NO: 62679 - DNA, 20 bp, Artificial Sequence
  chemically synthesized
attctttctatctatgagca

SEQ ID NO: 62680 - DNA, 20 bp, Artificial Sequence
  chemically synthesized
ctctcttatttccttgagca

SEQ ID NO: 62681 - DNA, 20 bp, Artificial Sequence
  chemically synthesized
ttattctctttgcagcaatt

SEQ ID NO: 62682 - DNA, 20 bp, Artificial Sequence
  chemically synthesized
tctttgcagcaattgtgaat

SEQ ID NO: 62683 - DNA, 20 bp, Artificial Sequence
  chemically synthesized
aagattttgggctgagatga

SEQ ID NO: 62684 - DNA, 20 bp, Artificial Sequence
  chemically synthesized
ttgacttcctctcttcctat

SEQ ID NO: 62685 - DNA, 20 bp, Artificial Sequence
  chemically synthesized
cgagaacttccaatactatg

SEQ ID NO: 62686 - DNA, 20 bp, Artificial Sequence
  chemically synthesized
cttccaatactatgttgagt

SEQ ID NO: 62687 - DNA, 20 bp, Artificial Sequence
  chemically synthesized
tttattctactgtggtctga

SEQ ID NO: 62688 - DNA, 20 bp, Artificial Sequence
  chemically synthesized
ggagaaagttccatgtgctg

SEQ ID NO: 62689 - DNA, 20 bp, Artificial Sequence
  chemically synthesized
aagttccatgtgctgatgaa

SEQ ID NO: 62690 - DNA, 20 bp, Artificial Sequence
  chemically synthesized
gaatgtgtattctgcagttg

SEQ ID NO: 62691 - DNA, 20 bp, Artificial Sequence
  chemically synthesized
tgtattctgcagttgttggg

SEQ ID NO: 62692 - DNA, 20 bp, Artificial Sequence
  chemically synthesized
gacctgcctagtgcagtcag

SEQ ID NO: 62693 - DNA, 20 bp, Artificial Sequence
  chemically synthesized
tagtaattgttttataaatt

SEQ ID NO: 62694 - DNA, 20 bp, Artificial Sequence
  chemically synthesized
gtattagatgcatatatatt

SEQ ID NO: 62695 - DNA, 20 bp, Artificial Sequence
  chemically synthesized
aagtttgttttgtctgacat

SEQ ID NO: 62696 - DNA, 20 bp, Artificial Sequence
  chemically synthesized
gcttttggtgtccatttgtg

SEQ ID NO: 62697 - DNA, 20 bp, Artificial Sequence
  chemically synthesized
cccctttaccttaagtttat

SEQ ID NO: 62698 - DNA, 20 bp, Artificial Sequence
  chemically synthesized
tgtgagtccttatgtgttag

SEQ ID NO: 62699 - DNA, 20 bp, Artificial Sequence
  chemically synthesized
aggcggcagataactggttg

SEQ ID NO: 62700 - DNA, 20 bp, Artificial Sequence
  chemically synthesized
tttttgttgtatatgtccta

SEQ ID NO: 62701 - DNA, 20 bp, Artificial Sequence
  chemically synthesized
gttctgttttgatgtgcttc

SEQ ID NO: 62702 - DNA, 20 bp, Artificial Sequence
  chemically synthesized
gtagtgttggcttggtagtg

SEQ ID NO: 62703 - DNA, 20 bp, Artificial Sequence
  chemically synthesized
atttgtgaagcttagtttca

SEQ ID NO: 62704 - DNA, 20 bp, Artificial Sequence
  chemically synthesized
ctctttgtctttagataact

SEQ ID NO: 62705 - DNA, 20 bp, Artificial Sequence
  chemically synthesized
taggcaatgatatttttgca

SEQ ID NO: 62706 - DNA, 20 bp, Artificial Sequence
  chemically synthesized
gtttattgagcttcttgtat

SEQ ID NO: 62707 - DNA, 20 bp, Artificial Sequence
  chemically synthesized
agttttccttgattatttcc

SEQ ID NO: 62708 - DNA, 20 bp, Artificial Sequence
  chemically synthesized
ttagatttctcttctttctc

SEQ ID NO: 62709 - DNA, 20 bp, Artificial Sequence
  chemically synthesized
ttcttttttctttgtctttg

SEQ ID NO: 62710 - DNA, 20 bp, Artificial Sequence
  chemically synthesized
ttttctttgtctttgttgga

SEQ ID NO: 62711 - DNA, 20 bp, Artificial Sequence
  chemically synthesized
aaaaactttgtcttcaagct

SEQ ID NO: 62712 - DNA, 20 bp, Artificial Sequence
  chemically synthesized
aagctctgaatttcttctgc

SEQ ID NO: 62713 - DNA, 20 bp, Artificial Sequence
  chemically synthesized
atccattgtttcctgaagtt

SEQ ID NO: 62714 - DNA, 20 bp, Artificial Sequence
  chemically synthesized
aaaattggacttcaccttcc

SEQ ID NO: 62715 - DNA, 20 bp, Artificial Sequence
  chemically synthesized
ttagcttaataactgacctt

SEQ ID NO: 62716 - DNA, 20 bp, Artificial Sequence
  chemically synthesized
aattatttttcaggtaaatc

SEQ ID NO: 62717 - DNA, 20 bp, Artificial Sequence
  chemically synthesized
atcagggatttcttcttggt

SEQ ID NO: 62718 - DNA, 20 bp, Artificial Sequence
  chemically synthesized
tgagctagtatgattttttg

SEQ ID NO: 62719 - DNA, 20 bp, Artificial Sequence
  chemically synthesized
aaccttgtttttcatattac

SEQ ID NO: 62720 - DNA, 20 bp, Artificial Sequence
  chemically synthesized
gttttctggttccttctcac

SEQ ID NO: 62721 - DNA, 20 bp, Artificial Sequence
  chemically synthesized
tagtgattgttatctctctt

SEQ ID NO: 62722 - DNA, 20 bp, Artificial Sequence
  chemically synthesized
accagactccaggctggtac

SEQ ID NO: 62723 - DNA, 20 bp, Artificial Sequence
  chemically synthesized
ggtactggggtttgtctgca

SEQ ID NO: 62724 - DNA, 20 bp, Artificial Sequence
  chemically synthesized
tcttgtgacgtgaaccatct

SEQ ID NO: 62725 - DNA, 20 bp, Artificial Sequence
  chemically synthesized
ctgctccaatggaggtggca

SEQ ID NO: 62726 - DNA, 20 bp, Artificial Sequence
  chemically synthesized
gaggatgaaatggactctgt

SEQ ID NO: 62727 - DNA, 20 bp, Artificial Sequence
  chemically synthesized
tggggcaccctagaactccc

SEQ ID NO: 62728 - DNA, 20 bp, Artificial Sequence
  chemically synthesized
tgccctttgtcttcagctac

SEQ ID NO: 62729 - DNA, 20 bp, Artificial Sequence
  chemically synthesized
ctttgtcttcagctaccagg

SEQ ID NO: 62730 - DNA, 20 bp, Artificial Sequence
  chemically synthesized
ggactagtcgtgtctgagct

SEQ ID NO: 62731 - DNA, 20 bp, Artificial Sequence
  chemically synthesized
tctttctgtggctactgtgg

SEQ ID NO: 62732 - DNA, 20 bp, Artificial Sequence
  chemically synthesized
tgtggctactgtgggaggat

SEQ ID NO: 62733 - DNA, 20 bp, Artificial Sequence
  chemically synthesized
ggggtgtagtttccaggtca

SEQ ID NO: 62734 - DNA, 20 bp, Artificial Sequence
  chemically synthesized
caccctcccccgcaacagca

SEQ ID NO: 62735 - DNA, 20 bp, Artificial Sequence
  chemically synthesized
ctgtcctacttccctgccag

SEQ ID NO: 62736 - DNA, 20 bp, Artificial Sequence
  chemically synthesized
gactcagctccaggtaaggt

SEQ ID NO: 62737 - DNA, 20 bp, Artificial Sequence
  chemically synthesized
agatcttcaggttccccagt

SEQ ID NO: 62738 - DNA, 20 bp, Artificial Sequence
  chemically synthesized
cccagtgaggatgtgtgttt

SEQ ID NO: 62739 - DNA, 20 bp, Artificial Sequence
  chemically synthesized
gtttgggcactcacaatatt

SEQ ID NO: 62740 - DNA, 20 bp, Artificial Sequence
  chemically synthesized
cacaatatttggggtgtttc

SEQ ID NO: 62741 - DNA, 20 bp, Artificial Sequence
  chemically synthesized
ggagcaatctgcttctttca

SEQ ID NO: 62742 - DNA, 20 bp, Artificial Sequence
  chemically synthesized
tcacatgctgctctgtgcat

SEQ ID NO: 62743 - DNA, 20 bp, Artificial Sequence
  chemically synthesized
tatactgccctttgatatca

SEQ ID NO: 62744 - DNA, 20 bp, Artificial Sequence
  chemically synthesized
gaatcaaggacgtgatgttg

SEQ ID NO: 62745 - DNA, 20 bp, Artificial Sequence
  chemically synthesized
gtgatgttgaggggtgggca

SEQ ID NO: 62746 - DNA, 20 bp, Artificial Sequence
  chemically synthesized
taattgaaagcaaattcata

SEQ ID NO: 62747 - DNA, 20 bp, Artificial Sequence
  chemically synthesized
acaagatttttaatagttga

SEQ ID NO: 62748 - DNA, 20 bp, Artificial Sequence
  chemically synthesized
tgtgataaacaggtcattct

SEQ ID NO: 62749 - DNA, 20 bp, Artificial Sequence
  chemically synthesized
cttagagattatgtcattac

SEQ ID NO: 62750 - DNA, 20 bp, Artificial Sequence
  chemically synthesized
atctaactctctggcacagc

SEQ ID NO: 62751 - DNA, 20 bp, Artificial Sequence
  chemically synthesized
ttttcttctgcttcagagct

SEQ ID NO: 62752 - DNA, 20 bp, Artificial Sequence
  chemically synthesized
ttctgtcattttgcctctgt

SEQ ID NO: 62753 - DNA, 20 bp, Artificial Sequence
  chemically synthesized
atgtttgaaaatacatggga

SEQ ID NO: 62754 - DNA, 20 bp, Artificial Sequence
  chemically synthesized
aaagaaacagttttatcagt

SEQ ID NO: 62755 - DNA, 20 bp, Artificial Sequence
  chemically synthesized
caatgatataggaaaaatcg

SEQ ID NO: 62756 - DNA, 20 bp, Artificial Sequence
  chemically synthesized
aatcgaggaataagacagtt

SEQ ID NO: 62757 - DNA, 20 bp, Artificial Sequence
  chemically synthesized
tcaaaagcataagaggaaat

SEQ ID NO: 62758 - DNA, 20 bp, Artificial Sequence
  chemically synthesized
ttagaacactgccttggttt

SEQ ID NO: 62759 - DNA, 20 bp, Artificial Sequence
  chemically synthesized
ggaagttgtttgaaaacagg

SEQ ID NO: 62760 - DNA, 20 bp, Artificial Sequence
  chemically synthesized
gattcacttgtttagaggct

SEQ ID NO: 62761 - DNA, 20 bp, Artificial Sequence
  chemically synthesized
gtggctcacgcctgtaatcc

SEQ ID NO: 62762 - DNA, 20 bp, Artificial Sequence
  chemically synthesized
caggcagatcacctgaggtc

SEQ ID NO: 62763 - DNA, 20 bp, Artificial Sequence
  chemically synthesized
tacttgggaggctgaggaag

SEQ ID NO: 62764 - DNA, 20 bp, Artificial Sequence
  chemically synthesized
attgcttgaacctggaaggc

SEQ ID NO: 62765 - DNA, 20 bp, Artificial Sequence
  chemically synthesized
tcataccactgcactccagc

SEQ ID NO: 62766 - DNA, 20 bp, Artificial Sequence
  chemically synthesized
tatcttaaagagaccctaat

SEQ ID NO: 62767 - DNA, 20 bp, Artificial Sequence
  chemically synthesized
gagaagtcacttattattat

SEQ ID NO: 62768 - DNA, 20 bp, Artificial Sequence
  chemically synthesized
gagcagatataagccttaca

SEQ ID NO: 62769 - DNA, 20 bp, Artificial Sequence
  chemically synthesized
cacaggattatgaagtctga

SEQ ID NO: 62770 - DNA, 20 bp, Artificial Sequence
  chemically synthesized
cctccaataagccagatttc

SEQ ID NO: 62771 - DNA, 20 bp, Artificial Sequence
  chemically synthesized
cgtcataatctaccaaggtc

SEQ ID NO: 62772 - DNA, 20 bp, Artificial Sequence
  chemically synthesized
taatctaccaaggtcatgga

SEQ ID NO: 62773 - DNA, 20 bp, Artificial Sequence
  chemically synthesized
aaaataaagaaaaaaacagc

SEQ ID NO: 62774 - DNA, 20 bp, Artificial Sequence
  chemically synthesized
ccaatatgtcagaaacagca

SEQ ID NO: 62775 - DNA, 20 bp, Artificial Sequence
  chemically synthesized
taaaacagtccctgcctctt

SEQ ID NO: 62776 - DNA, 20 bp, Artificial Sequence
  chemically synthesized
caaatacatgtcttatgtct

SEQ ID NO: 62777 - DNA, 20 bp, Artificial Sequence
  chemically synthesized
agaagagctacaccaaaacc

SEQ ID NO: 62778 - DNA, 20 bp, Artificial Sequence
  chemically synthesized
ccagtgataaatacacatca

SEQ ID NO: 62779 - DNA, 20 bp, Artificial Sequence
  chemically synthesized
tcgggtgcctacatacatac

SEQ ID NO: 62780 - DNA, 20 bp, Artificial Sequence
  chemically synthesized
gtgatttatttcaaataggt

SEQ ID NO: 62781 - DNA, 20 bp, Artificial Sequence
  chemically synthesized
ggataagtagatattgaagt

SEQ ID NO: 62782 - DNA, 20 bp, Artificial Sequence
  chemically synthesized
gcactgaaactgttgcttta

SEQ ID NO: 62783 - DNA, 20 bp, Artificial Sequence
  chemically synthesized
gataatggcctaaaaccaca

SEQ ID NO: 62784 - DNA, 20 bp, Artificial Sequence
  chemically synthesized
gaagaaaactagctaaaggg

SEQ ID NO: 62785 - DNA, 20 bp, Artificial Sequence
  chemically synthesized
agaataaattagagaaaaat

SEQ ID NO: 62786 - DNA, 20 bp, Artificial Sequence
  chemically synthesized
ttagagaaaaattggaatga

SEQ ID NO: 62787 - DNA, 20 bp, Artificial Sequence
  chemically synthesized
tccctggctaaactccaccc

SEQ ID NO: 62788 - DNA, 20 bp, Artificial Sequence
  chemically synthesized
gcaaacttgaccaatagtct

SEQ ID NO: 62789 - DNA, 20 bp, Artificial Sequence
  chemically synthesized
ccaggggccggcggctggct

SEQ ID NO: 62790 - DNA, 20 bp, Artificial Sequence
  chemically synthesized
ccggcggctggctagggatg

SEQ ID NO: 62791 - DNA, 20 bp, Artificial Sequence
  chemically synthesized
aagctcctagtccagacgcc

SEQ ID NO: 62792 - DNA, 20 bp, Artificial Sequence
  chemically synthesized
tcacaagcctgtggggcaag

SEQ ID NO: 62793 - DNA, 20 bp, Artificial Sequence
  chemically synthesized
caaaagtccaggtcgcttct

SEQ ID NO: 62794 - DNA, 20 bp, Artificial Sequence
  chemically synthesized
tgggagatgccataaagcac

SEQ ID NO: 62795 - DNA, 20 bp, Artificial Sequence
  chemically synthesized
tcaagggcacctttgcccag

SEQ ID NO: 62796 - DNA, 20 bp, Artificial Sequence
  chemically synthesized
tgcactgtgacaagctgcat

SEQ ID NO: 62797 - DNA, 20 bp, Artificial Sequence
  chemically synthesized
tggatcctgagaacttcaag

SEQ ID NO: 62798 - DNA, 20 bp, Artificial Sequence
  chemically synthesized
tctcgaggcaacttagacaa

SEQ ID NO: 62799 - DNA, 20 bp, Artificial Sequence
  chemically synthesized
gagtattgatctgagcacag

SEQ ID NO: 62800 - DNA, 20 bp, Artificial Sequence
  chemically synthesized
tgtgagctgtttgaagatac

SEQ ID NO: 62801 - DNA, 20 bp, Artificial Sequence
  chemically synthesized
tgtttgaagatactggggtt

SEQ ID NO: 62802 - DNA, 20 bp, Artificial Sequence
  chemically synthesized
tggcaatgttttagggccta

SEQ ID NO: 62803 - DNA, 20 bp, Artificial Sequence
  chemically synthesized
gatgggggcaaagtatgtcc

SEQ ID NO: 62804 - DNA, 20 bp, Artificial Sequence
  chemically synthesized
aacaattgaaacatttgggc

SEQ ID NO: 62805 - DNA, 20 bp, Artificial Sequence
  chemically synthesized
cgttttcagcctacagcata

SEQ ID NO: 62806 - DNA, 20 bp, Artificial Sequence
  chemically synthesized
aagttaacataggcttgatt

SEQ ID NO: 62807 - DNA, 20 bp, Artificial Sequence
  chemically synthesized
gctggagctctcagctcact

SEQ ID NO: 62808 - DNA, 20 bp, Artificial Sequence
  chemically synthesized
tttggcaatccatttcggca

SEQ ID NO: 62809 - DNA, 20 bp, Artificial Sequence
  chemically synthesized
tcctggcagaagatggtgac

SEQ ID NO: 62810 - DNA, 20 bp, Artificial Sequence
  chemically synthesized
gcccatgatgcagagctttc

SEQ ID NO: 62811 - DNA, 20 bp, Artificial Sequence
  chemically synthesized
ttttaaatatatgagccaca

SEQ ID NO: 62812 - DNA, 20 bp, Artificial Sequence
  chemically synthesized
ccacaaagggttttatgttg

SEQ ID NO: 62813 - DNA, 20 bp, Artificial Sequence
  chemically synthesized
cttttttgtttacgttagat

SEQ ID NO: 62814 - DNA, 20 bp, Artificial Sequence
  chemically synthesized
caataaagaaacttgtacat

SEQ ID NO: 62815 - DNA, 20 bp, Artificial Sequence
  chemically synthesized
tacatgggagttctgcaagt

SEQ ID NO: 62816 - DNA, 20 bp, Artificial Sequence
  chemically synthesized
agggggctgaacccccttcc

SEQ ID NO: 62817 - DNA, 20 bp, Artificial Sequence
  chemically synthesized
taggaagtcaaggtttaggc

SEQ ID NO: 62818 - DNA, 20 bp, Artificial Sequence
  chemically synthesized
tcagatgaaaatatagtgtg

SEQ ID NO: 62819 - DNA, 20 bp, Artificial Sequence
  chemically synthesized
aattgagaaggcagattcac

SEQ ID NO: 62820 - DNA, 20 bp, Artificial Sequence
  chemically synthesized
gttaatgcacgttaataagc

SEQ ID NO: 62821 - DNA, 20 bp, Artificial Sequence
  chemically synthesized
gtctccagaaaattcacatg

SEQ ID NO: 62822 - DNA, 20 bp, Artificial Sequence
  chemically synthesized
atgagagcagatccccatca

SEQ ID NO: 62823 - DNA, 20 bp, Artificial Sequence
  chemically synthesized
aaaataagcttcggtgttca

SEQ ID NO: 62824 - DNA, 20 bp, Artificial Sequence
  chemically synthesized
tccacttgtcctctgtgttt

SEQ ID NO: 62825 - DNA, 20 bp, Artificial Sequence
  chemically synthesized
ctgagcccttctgtctaact

SEQ ID NO: 62826 - DNA, 20 bp, Artificial Sequence
  chemically synthesized
ttcttttttttcctcagcct

SEQ ID NO: 62827 - DNA, 20 bp, Artificial Sequence
  chemically synthesized
acaagtttataaaaaattga

SEQ ID NO: 62828 - DNA, 20 bp, Artificial Sequence
  chemically synthesized
ataaaaaattgaaggaataa

SEQ ID NO: 62829 - DNA, 20 bp, Artificial Sequence
  chemically synthesized
atgaatggctacttcatagg

SEQ ID NO: 62830 - DNA, 20 bp, Artificial Sequence
  chemically synthesized
tttcaatagtatgctaaaca

SEQ ID NO: 62831 - DNA, 20 bp, Artificial Sequence
  chemically synthesized
taatttcgaaggtacatgtg

SEQ ID NO: 62832 - DNA, 20 bp, Artificial Sequence
  chemically synthesized
aggatgtgcaggcttgttac

SEQ ID NO: 62833 - DNA, 20 bp, Artificial Sequence
  chemically synthesized
gagcagatataagctttaca

SEQ ID NO: 62834 - DNA, 20 bp, Artificial Sequence
  chemically synthesized
aagctttacacaggatcatg

SEQ ID NO: 62835 - DNA, 20 bp, Artificial Sequence
  chemically synthesized
cacaggatcatgaaggatga

SEQ ID NO: 62836 - DNA, 20 bp, Artificial Sequence
  chemically synthesized
tcaatcaacctgatagctta

SEQ ID NO: 62837 - DNA, 20 bp, Artificial Sequence
  chemically synthesized
acagcttgcctccgataagc

SEQ ID NO: 62838 - DNA, 20 bp, Artificial Sequence
  chemically synthesized
atctagcaaggttagagatc

SEQ ID NO: 62839 - DNA, 20 bp, Artificial Sequence
  chemically synthesized
tgtctaaagtacactaatat

SEQ ID NO: 62840 - DNA, 20 bp, Artificial Sequence
  chemically synthesized
aaaaacaacccttgcctctt

SEQ ID NO: 62841 - DNA, 20 bp, Artificial Sequence
  chemically synthesized
tacacgcacatcttatgtct

SEQ ID NO: 62842 - DNA, 20 bp, Artificial Sequence
  chemically synthesized
agaagagctacgccaaaacc

SEQ ID NO: 62843 - DNA, 20 bp, Artificial Sequence
  chemically synthesized
tctggtgtatacatacatac

SEQ ID NO: 62844 - DNA, 20 bp, Artificial Sequence
  chemically synthesized
tatacatacatacctgaata

SEQ ID NO: 62845 - DNA, 20 bp, Artificial Sequence
  chemically synthesized
atgatttatttcaaataggt

SEQ ID NO: 62846 - DNA, 20 bp, Artificial Sequence
  chemically synthesized
agataatggcaaaagtcaca

SEQ ID NO: 62847 - DNA, 20 bp, Artificial Sequence
  chemically synthesized
gaaggaaactagctaaaggg

SEQ ID NO: 62848 - DNA, 20 bp, Artificial Sequence
  chemically synthesized
agaataaattagagaaaaac

SEQ ID NO: 62849 - DNA, 20 bp, Artificial Sequence
  chemically synthesized
ttagagaaaaactggaatga

SEQ ID NO: 62850 - DNA, 20 bp, Artificial Sequence
  chemically synthesized
tccctggctaaactccaccc

SEQ ID NO: 62851 - DNA, 20 bp, Artificial Sequence
  chemically synthesized
gcaaacttgaccaatagtct

SEQ ID NO: 62852 - DNA, 20 bp, Artificial Sequence
  chemically synthesized
ccaggggccggcggctggct

SEQ ID NO: 62853 - DNA, 20 bp, Artificial Sequence
  chemically synthesized
ccggcggctggctagggatg

SEQ ID NO: 62854 - DNA, 20 bp, Artificial Sequence
  chemically synthesized
aagctcctagtccagacgcc

SEQ ID NO: 62855 - DNA, 20 bp, Artificial Sequence
  chemically synthesized
tcacaagcctgtggggcaag

SEQ ID NO: 62856 - DNA, 20 bp, Artificial Sequence
  chemically synthesized
caaaagtccaggtcgcttct

SEQ ID NO: 62857 - DNA, 20 bp, Artificial Sequence
  chemically synthesized
tgggagatgccacaaagcac

SEQ ID NO: 62858 - DNA, 20 bp, Artificial Sequence
  chemically synthesized
tcaagggcacctttgcccag

SEQ ID NO: 62859 - DNA, 20 bp, Artificial Sequence
  chemically synthesized
tgcactgtgacaagctgcat

SEQ ID NO: 62860 - DNA, 20 bp, Artificial Sequence
  chemically synthesized
tggatcctgagaacttcaag

SEQ ID NO: 62861 - DNA, 20 bp, Artificial Sequence
  chemically synthesized
tctcgaggcaacttagacaa

SEQ ID NO: 62862 - DNA, 20 bp, Artificial Sequence
  chemically synthesized
gagtattgatctgagcacag

SEQ ID NO: 62863 - DNA, 20 bp, Artificial Sequence
  chemically synthesized
tgtgagctgtttgaagatac

SEQ ID NO: 62864 - DNA, 20 bp, Artificial Sequence
  chemically synthesized
tgtttgaagatactggggtt

SEQ ID NO: 62865 - DNA, 20 bp, Artificial Sequence
  chemically synthesized
tggtaatgttttagggccta

SEQ ID NO: 62866 - DNA, 20 bp, Artificial Sequence
  chemically synthesized
gatgggggcaaagtatgtcc

SEQ ID NO: 62867 - DNA, 20 bp, Artificial Sequence
  chemically synthesized
aacaattgaaacatttgggc

SEQ ID NO: 62868 - DNA, 20 bp, Artificial Sequence
  chemically synthesized
cgtcttcagcctacaacata

SEQ ID NO: 62869 - DNA, 20 bp, Artificial Sequence
  chemically synthesized
aagttaacataggcttgatt

SEQ ID NO: 62870 - DNA, 20 bp, Artificial Sequence
  chemically synthesized
gctggagctctcagctcact

SEQ ID NO: 62871 - DNA, 20 bp, Artificial Sequence
  chemically synthesized
tttggcaatccatttcggca

SEQ ID NO: 62872 - DNA, 20 bp, Artificial Sequence
  chemically synthesized
gcccatgattcagagctttc

SEQ ID NO: 62873 - DNA, 20 bp, Artificial Sequence
  chemically synthesized
ttttaaatatatgagccaca

SEQ ID NO: 62874 - DNA, 20 bp, Artificial Sequence
  chemically synthesized
cagtaaagacacttgtacac

SEQ ID NO: 62875 - DNA, 20 bp, Artificial Sequence
  chemically synthesized
tacacgggagttctgcaagt

SEQ ID NO: 62876 - DNA, 20 bp, Artificial Sequence
  chemically synthesized
gttcagtgaagacctggggg

SEQ ID NO: 62877 - DNA, 20 bp, Artificial Sequence
  chemically synthesized
gggggctggattgattgcag

SEQ ID NO: 62878 - DNA, 20 bp, Artificial Sequence
  chemically synthesized
attgattgcagctgagtagc

SEQ ID NO: 62879 - DNA, 20 bp, Artificial Sequence
  chemically synthesized
gggaaagtgttccaagcttt

SEQ ID NO: 62880 - DNA, 20 bp, Artificial Sequence
  chemically synthesized
agcaattctattttattagg

SEQ ID NO: 62881 - DNA, 20 bp, Artificial Sequence
  chemically synthesized
cttagcttttcacagccctt

SEQ ID NO: 62882 - DNA, 20 bp, Artificial Sequence
  chemically synthesized
tggggacttaggtgtaagaa

SEQ ID NO: 62883 - DNA, 20 bp, Artificial Sequence
  chemically synthesized
tgagatcaaaatgtagtggg

SEQ ID NO: 62884 - DNA, 20 bp, Artificial Sequence
  chemically synthesized
taattggaaggcttacttaa

SEQ ID NO: 62885 - DNA, 20 bp, Artificial Sequence
  chemically synthesized
ttaatggaatttttgtatag

SEQ ID NO: 62886 - DNA, 20 bp, Artificial Sequence
  chemically synthesized
gttagtgcatctctataagt

SEQ ID NO: 62887 - DNA, 20 bp, Artificial Sequence
  chemically synthesized
gtctcctcaaaattcacatg

SEQ ID NO: 62888 - DNA, 20 bp, Artificial Sequence
  chemically synthesized
ccaggaagagaaccctgacc

SEQ ID NO: 62889 - DNA, 20 bp, Artificial Sequence
  chemically synthesized
ttttgttatagcaccttgca

SEQ ID NO: 62890 - DNA, 20 bp, Artificial Sequence
  chemically synthesized
agaaggagaaaaaaataagc

SEQ ID NO: 62891 - DNA, 20 bp, Artificial Sequence
  chemically synthesized
gaaaaaaataagcttgggtt

SEQ ID NO: 62892 - DNA, 20 bp, Artificial Sequence
  chemically synthesized
ttcttttttctcctcagcct

SEQ ID NO: 62893 - DNA, 20 bp, Artificial Sequence
  chemically synthesized
aaatgcagtcactaccgttt

SEQ ID NO: 62894 - DNA, 20 bp, Artificial Sequence
  chemically synthesized
agtcaaagcaaatttcttga

SEQ ID NO: 62895 - DNA, 20 bp, Artificial Sequence
  chemically synthesized
ttgagagagtaaagaaataa

SEQ ID NO: 62896 - DNA, 20 bp, Artificial Sequence
  chemically synthesized
gatgatatgttaaacaagtt

SEQ ID NO: 62897 - DNA, 20 bp, Artificial Sequence
  chemically synthesized
ccttctctttttaggccata

SEQ ID NO: 62898 - DNA, 20 bp, Artificial Sequence
  chemically synthesized
tttactgttaccttaaattc

SEQ ID NO: 62899 - DNA, 20 bp, Artificial Sequence
  chemically synthesized
taaattcaggggtacacgta

SEQ ID NO: 62900 - DNA, 20 bp, Artificial Sequence
  chemically synthesized
aaaagtgtgccatggtttta

SEQ ID NO: 62901 - DNA, 20 bp, Artificial Sequence
  chemically synthesized
gtttaagtttcttgtttact

SEQ ID NO: 62902 - DNA, 20 bp, Artificial Sequence
  chemically synthesized
ggatattaggcctttgtcag

SEQ ID NO: 62903 - DNA, 20 bp, Artificial Sequence
  chemically synthesized
tctgtgcccgtgtttatatc

SEQ ID NO: 62904 - DNA, 20 bp, Artificial Sequence
  chemically synthesized
tttctaggctttttatagtt

SEQ ID NO: 62905 - DNA, 20 bp, Artificial Sequence
  chemically synthesized
atttaagtctctaatccatc

SEQ ID NO: 62906 - DNA, 20 bp, Artificial Sequence
  chemically synthesized
taatccatctggagttaatt

SEQ ID NO: 62907 - DNA, 20 bp, Artificial Sequence
  chemically synthesized
ttttggataaggtataagga

SEQ ID NO: 62908 - DNA, 20 bp, Artificial Sequence
  chemically synthesized
agtgagggcaccattagcca

SEQ ID NO: 62909 - DNA, 20 bp, Artificial Sequence
  chemically synthesized
tctagttcatgtaagattct

SEQ ID NO: 62910 - DNA, 20 bp, Artificial Sequence
  chemically synthesized
gattctcagaattaagaaaa

SEQ ID NO: 62911 - DNA, 20 bp, Artificial Sequence
  chemically synthesized
ttaagaaaaatggatggcat

SEQ ID NO: 62912 - DNA, 20 bp, Artificial Sequence
  chemically synthesized
tggcatatgaatgaaacttc

SEQ ID NO: 62913 - DNA, 20 bp, Artificial Sequence
  chemically synthesized
gaaacttcatggatgacata

SEQ ID NO: 62914 - DNA, 20 bp, Artificial Sequence
  chemically synthesized
tggaatctaatatgtatttg

SEQ ID NO: 62915 - DNA, 20 bp, Artificial Sequence
  chemically synthesized
taacctggtattgatgatat

SEQ ID NO: 62916 - DNA, 20 bp, Artificial Sequence
  chemically synthesized
gggaacagccacaaacaaga

SEQ ID NO: 62917 - DNA, 20 bp, Artificial Sequence
  chemically synthesized
tgcaggtcacttttcctgga

SEQ ID NO: 62918 - DNA, 20 bp, Artificial Sequence
  chemically synthesized
gtggaagttagcagtaactg

SEQ ID NO: 62919 - DNA, 20 bp, Artificial Sequence
  chemically synthesized
ggcagctgttcactggtacg

SEQ ID NO: 62920 - DNA, 20 bp, Artificial Sequence
  chemically synthesized
ggttttagatgtatgtacct

SEQ ID NO: 62921 - DNA, 20 bp, Artificial Sequence
  chemically synthesized
caatgaacagaaattctttt

SEQ ID NO: 62922 - DNA, 20 bp, Artificial Sequence
  chemically synthesized
gaacagaaattcttttggga

SEQ ID NO: 62923 - DNA, 20 bp, Artificial Sequence
  chemically synthesized
agaaattcagctttaatata

SEQ ID NO: 62924 - DNA, 20 bp, Artificial Sequence
  chemically synthesized
gggtttaactctttgaaatt

SEQ ID NO: 62925 - DNA, 20 bp, Artificial Sequence
  chemically synthesized
agtctccttgaaatacacat

SEQ ID NO: 62926 - DNA, 20 bp, Artificial Sequence
  chemically synthesized
tcctaaactttatttcttgt

SEQ ID NO: 62927 - DNA, 20 bp, Artificial Sequence
  chemically synthesized
ttcttgtaaggatttatctc

SEQ ID NO: 62928 - DNA, 20 bp, Artificial Sequence
  chemically synthesized
gtatgaggacagtaagcctt

SEQ ID NO: 62929 - DNA, 20 bp, Artificial Sequence
  chemically synthesized
gagacacgtgcagcagcctg

SEQ ID NO: 62930 - DNA, 20 bp, Artificial Sequence
  chemically synthesized
cctgtggaatattgtcagtg

SEQ ID NO: 62931 - DNA, 20 bp, Artificial Sequence
  chemically synthesized
ctaatgcccagcacgggcca

SEQ ID NO: 62932 - DNA, 20 bp, Artificial Sequence
  chemically synthesized
ggcataattttgtagatatg

SEQ ID NO: 62933 - DNA, 20 bp, Artificial Sequence
  chemically synthesized
ataagtacactgactactaa

SEQ ID NO: 62934 - DNA, 20 bp, Artificial Sequence
  chemically synthesized
tgctttcttccaagttgatg

SEQ ID NO: 62935 - DNA, 20 bp, Artificial Sequence
  chemically synthesized
actttgggaggctgaggtgg

SEQ ID NO: 62936 - DNA, 20 bp, Artificial Sequence
  chemically synthesized
aaaattagccagagacagtg

SEQ ID NO: 62937 - DNA, 20 bp, Artificial Sequence
  chemically synthesized
tactcgggaggctgaggcag

SEQ ID NO: 62938 - DNA, 20 bp, Artificial Sequence
  chemically synthesized
gcgccactgcacactccagc

SEQ ID NO: 62939 - DNA, 20 bp, Artificial Sequence
  chemically synthesized
tgtattcaatgtagtctcaa

SEQ ID NO: 62940 - DNA, 20 bp, Artificial Sequence
  chemically synthesized
tggcttcttccacataaagc

SEQ ID NO: 62941 - DNA, 20 bp, Artificial Sequence
  chemically synthesized
ttcttccacataaagcctgg

SEQ ID NO: 62942 - DNA, 20 bp, Artificial Sequence
  chemically synthesized
cataaagcctggatgaataa

SEQ ID NO: 62943 - DNA, 20 bp, Artificial Sequence
  chemically synthesized
attgtcacaactcctgatcc

SEQ ID NO: 62944 - DNA, 20 bp, Artificial Sequence
  chemically synthesized
cttgagaaataaactgcaca

SEQ ID NO: 62945 - DNA, 20 bp, Artificial Sequence
  chemically synthesized
taaactgcacactggatggt

SEQ ID NO: 62946 - DNA, 20 bp, Artificial Sequence
  chemically synthesized
agttcccctgagaaggccac

SEQ ID NO: 62947 - DNA, 20 bp, Artificial Sequence
  chemically synthesized
acctggattctatcagaaac

SEQ ID NO: 62948 - DNA, 20 bp, Artificial Sequence
  chemically synthesized
ccttgcccaaaccccacccc

SEQ ID NO: 62949 - DNA, 20 bp, Artificial Sequence
  chemically synthesized
gcagaaagtgtttctgaaag

SEQ ID NO: 62950 - DNA, 20 bp, Artificial Sequence
  chemically synthesized
ctagaggtactttgaaagtt

SEQ ID NO: 62951 - DNA, 20 bp, Artificial Sequence
  chemically synthesized
tcggaaaagctgttatgctc

SEQ ID NO: 62952 - DNA, 20 bp, Artificial Sequence
  chemically synthesized
tcaaaggcacctttgctaca

SEQ ID NO: 62953 - DNA, 20 bp, Artificial Sequence
  chemically synthesized
tggaccctgagaacttcctg

SEQ ID NO: 62954 - DNA, 20 bp, Artificial Sequence
  chemically synthesized
tacccttagatatttgcact

SEQ ID NO: 62955 - DNA, 20 bp, Artificial Sequence
  chemically synthesized
aggtggctttctcttgtgtt

SEQ ID NO: 62956 - DNA, 20 bp, Artificial Sequence
  chemically synthesized
cttgtgttatgagtcagcta

SEQ ID NO: 62957 - DNA, 20 bp, Artificial Sequence
  chemically synthesized
gggatatgatatttcagcag

SEQ ID NO: 62958 - DNA, 20 bp, Artificial Sequence
  chemically synthesized
tatttcagcagtgggatttt

SEQ ID NO: 62959 - DNA, 20 bp, Artificial Sequence
  chemically synthesized
aatttggtagagcaaggact

SEQ ID NO: 62960 - DNA, 20 bp, Artificial Sequence
  chemically synthesized
aaattctggccaaaatcaaa

SEQ ID NO: 62961 - DNA, 20 bp, Artificial Sequence
  chemically synthesized
caaaatcaaactgagtgttt

SEQ ID NO: 62962 - DNA, 20 bp, Artificial Sequence
  chemically synthesized
tagtgggaagctgttaaaaa

SEQ ID NO: 62963 - DNA, 20 bp, Artificial Sequence
  chemically synthesized
aaaaagaggattgtttccct

SEQ ID NO: 62964 - DNA, 20 bp, Artificial Sequence
  chemically synthesized
atacttttgtacgcatggta

SEQ ID NO: 62965 - DNA, 20 bp, Artificial Sequence
  chemically synthesized
atggtacaggattctttgtt

SEQ ID NO: 62966 - DNA, 20 bp, Artificial Sequence
  chemically synthesized
atgaaacaatcacaatatgt

SEQ ID NO: 62967 - DNA, 20 bp, Artificial Sequence
  chemically synthesized
aatcacaatatgttggggta

SEQ ID NO: 62968 - DNA, 20 bp, Artificial Sequence
  chemically synthesized
gttggcatagcaagtaagag

SEQ ID NO: 62969 - DNA, 20 bp, Artificial Sequence
  chemically synthesized
gatatctagcccataatggt

SEQ ID NO: 62970 - DNA, 20 bp, Artificial Sequence
  chemically synthesized
ttgctcaaactctggtgaaa

SEQ ID NO: 62971 - DNA, 20 bp, Artificial Sequence
  chemically synthesized
ttttggcaacccacttcagc

SEQ ID NO: 62972 - DNA, 20 bp, Artificial Sequence
  chemically synthesized
tgctgtagcccacaagacca

SEQ ID NO: 62973 - DNA, 20 bp, Artificial Sequence
  chemically synthesized
cagttcctgcatgataaaaa

SEQ ID NO: 62974 - DNA, 20 bp, Artificial Sequence
  chemically synthesized
gcactatttctgatggaaat

SEQ ID NO: 62975 - DNA, 20 bp, Artificial Sequence
  chemically synthesized
tgatggaaatgagaatgttg

SEQ ID NO: 62976 - DNA, 20 bp, Artificial Sequence
  chemically synthesized
aaatgagaatgttggagaat

SEQ ID NO: 62977 - DNA, 20 bp, Artificial Sequence
  chemically synthesized
tgcaagaaaagagagaactc

SEQ ID NO: 62978 - DNA, 20 bp, Artificial Sequence
  chemically synthesized
agaaaagagagaactcgtgg

SEQ ID NO: 62979 - DNA, 20 bp, Artificial Sequence
  chemically synthesized
gaactcgtgggtggatttag

SEQ ID NO: 62980 - DNA, 20 bp, Artificial Sequence
  chemically synthesized
taggaaggggaaatcgtctc

SEQ ID NO: 62981 - DNA, 20 bp, Artificial Sequence
  chemically synthesized
ggtactctttggaggtgtaa

SEQ ID NO: 62982 - DNA, 20 bp, Artificial Sequence
  chemically synthesized
gctattatttgtatgaaact

SEQ ID NO: 62983 - DNA, 20 bp, Artificial Sequence
  chemically synthesized
tttattatttataatgaagt

SEQ ID NO: 62984 - DNA, 20 bp, Artificial Sequence
  chemically synthesized
cgtcttcaatggtattaata

SEQ ID NO: 62985 - DNA, 20 bp, Artificial Sequence
  chemically synthesized
tatcatatgtattttcctta

SEQ ID NO: 62986 - DNA, 20 bp, Artificial Sequence
  chemically synthesized
aggatttttgtaagaactaa

SEQ ID NO: 62987 - DNA, 20 bp, Artificial Sequence
  chemically synthesized
cataaatatatacaattttt

SEQ ID NO: 62988 - DNA, 20 bp, Artificial Sequence
  chemically synthesized
gttaagtcaagttgatagag

SEQ ID NO: 62989 - DNA, 20 bp, Artificial Sequence
  chemically synthesized
atatggacatttaaaagagg

SEQ ID NO: 62990 - DNA, 20 bp, Artificial Sequence
  chemically synthesized
atgatataaaattagggaaa

SEQ ID NO: 62991 - DNA, 20 bp, Artificial Sequence
  chemically synthesized
cactgaagtttcttgcatat

SEQ ID NO: 62992 - DNA, 20 bp, Artificial Sequence
  chemically synthesized
ctgattagacaaagtctaac

SEQ ID NO: 62993 - DNA, 20 bp, Artificial Sequence
  chemically synthesized
gctgtaattatattgaggtg

SEQ ID NO: 62994 - DNA, 20 bp, Artificial Sequence
  chemically synthesized
aatgaagttaagaaaaaaaa

SEQ ID NO: 62995 - DNA, 20 bp, Artificial Sequence
  chemically synthesized
ctggaaaacattgtgaaaca

SEQ ID NO: 62996 - DNA, 20 bp, Artificial Sequence
  chemically synthesized
gacagctaaaatccctgtct

SEQ ID NO: 62997 - DNA, 20 bp, Artificial Sequence
  chemically synthesized
aatgcctacaagccccctgt

SEQ ID NO: 62998 - DNA, 20 bp, Artificial Sequence
  chemically synthesized
agctcacctcaccatatctc

SEQ ID NO: 62999 - DNA, 20 bp, Artificial Sequence
  chemically synthesized
gaaattcctttgtcatattt

SEQ ID NO: 63000 - DNA, 20 bp, Artificial Sequence
  chemically synthesized
cccactaataacccacaaag

SEQ ID NO: 63001 - DNA, 20 bp, Artificial Sequence
  chemically synthesized
acattaattaagcacattct

SEQ ID NO: 63002 - DNA, 20 bp, Artificial Sequence
  chemically synthesized
ttgtgctatcccttgccctt

SEQ ID NO: 63003 - DNA, 20 bp, Artificial Sequence
  chemically synthesized
tgtattttaaatgaagagat

SEQ ID NO: 63004 - DNA, 20 bp, Artificial Sequence
  chemically synthesized
tttaaatgaagagatgaggg

SEQ ID NO: 63005 - DNA, 20 bp, Artificial Sequence
  chemically synthesized
ttattgttcatttctcgatg

SEQ ID NO: 63006 - DNA, 20 bp, Artificial Sequence
  chemically synthesized
ataccaaactgacatgtagc

SEQ ID NO: 63007 - DNA, 20 bp, Artificial Sequence
  chemically synthesized
acactgttacagatgcatac

SEQ ID NO: 63008 - DNA, 20 bp, Artificial Sequence
  chemically synthesized
aaattaccccagtcaatcta

SEQ ID NO: 63009 - DNA, 20 bp, Artificial Sequence
  chemically synthesized
ccccagtcaatctagagaat

SEQ ID NO: 63010 - DNA, 20 bp, Artificial Sequence
  chemically synthesized
gtacatgctgttcatttact

SEQ ID NO: 63011 - DNA, 20 bp, Artificial Sequence
  chemically synthesized
agatctctcttttctacatt

SEQ ID NO: 63012 - DNA, 20 bp, Artificial Sequence
  chemically synthesized
tgtcatgcatttattcacat

SEQ ID NO: 63013 - DNA, 20 bp, Artificial Sequence
  chemically synthesized
agtttattagttatatcagt

SEQ ID NO: 63014 - DNA, 20 bp, Artificial Sequence
  chemically synthesized
ccattatcagttactcaacc

SEQ ID NO: 63015 - DNA, 20 bp, Artificial Sequence
  chemically synthesized
ggagaaaatgtttataccac

SEQ ID NO: 63016 - DNA, 20 bp, Artificial Sequence
  chemically synthesized
agcccataaccagaggtcca

SEQ ID NO: 63017 - DNA, 20 bp, Artificial Sequence
  chemically synthesized
ccactggattcagtgagcta

SEQ ID NO: 63018 - DNA, 20 bp, Artificial Sequence
  chemically synthesized
tcagccagtgtttaccattg

SEQ ID NO: 63019 - DNA, 20 bp, Artificial Sequence
  chemically synthesized
cagaatgtacatgcgactga

SEQ ID NO: 63020 - DNA, 20 bp, Artificial Sequence
  chemically synthesized
aatacagagaacactgaggg

SEQ ID NO: 63021 - DNA, 20 bp, Artificial Sequence
  chemically synthesized
aaataaatgtgaaagcagac

SEQ ID NO: 63022 - DNA, 20 bp, Artificial Sequence
  chemically synthesized
ggtaattgacagaaggaaac

SEQ ID NO: 63023 - DNA, 20 bp, Artificial Sequence
  chemically synthesized
aactaggatgtgtccagtaa

SEQ ID NO: 63024 - DNA, 20 bp, Artificial Sequence
  chemically synthesized
gataagataatatgaaaaca

SEQ ID NO: 63025 - DNA, 20 bp, Artificial Sequence
  chemically synthesized
aaacagcagtgaactgagat

SEQ ID NO: 63026 - DNA, 20 bp, Artificial Sequence
  chemically synthesized
tgtggagagcactggcattt

SEQ ID NO: 63027 - DNA, 20 bp, Artificial Sequence
  chemically synthesized
gcatttaagaatgtcacact

SEQ ID NO: 63028 - DNA, 20 bp, Artificial Sequence
  chemically synthesized
atattcattatctgaaaatt

SEQ ID NO: 63029 - DNA, 20 bp, Artificial Sequence
  chemically synthesized
attgctatggttgcccaggc

SEQ ID NO: 63030 - DNA, 20 bp, Artificial Sequence
  chemically synthesized
ttttctatttttagtagata

SEQ ID NO: 63031 - DNA, 20 bp, Artificial Sequence
  chemically synthesized
tcctcggcctctgaaagtgc

SEQ ID NO: 63032 - DNA, 20 bp, Artificial Sequence
  chemically synthesized
gtgagccaccacacccagcc

SEQ ID NO: 63033 - DNA, 20 bp, Artificial Sequence
  chemically synthesized
caccacacccagccaagaat

SEQ ID NO: 63034 - DNA, 20 bp, Artificial Sequence
  chemically synthesized
caagaatgtgaattttgtag

SEQ ID NO: 63035 - DNA, 20 bp, Artificial Sequence
  chemically synthesized
aacccatatttctctgaccc

SEQ ID NO: 63036 - DNA, 20 bp, Artificial Sequence
  chemically synthesized
tacactaattaaaatcgata

SEQ ID NO: 63037 - DNA, 20 bp, Artificial Sequence
  chemically synthesized
tactgagttctaaaatcatc

SEQ ID NO: 63038 - DNA, 20 bp, Artificial Sequence
  chemically synthesized
actttgtattcatcacactc

SEQ ID NO: 63039 - DNA, 20 bp, Artificial Sequence
  chemically synthesized
ataggcacctcagactcagc

SEQ ID NO: 63040 - DNA, 20 bp, Artificial Sequence
  chemically synthesized
gtcctcattgtttcctgaac

SEQ ID NO: 63041 - DNA, 20 bp, Artificial Sequence
  chemically synthesized
acttttagaccttatcctgg

SEQ ID NO: 63042 - DNA, 20 bp, Artificial Sequence
  chemically synthesized
caggcagatcacttgaggtc

SEQ ID NO: 63043 - DNA, 20 bp, Artificial Sequence
  chemically synthesized
tattcaggtggctgaggcag

SEQ ID NO: 63044 - DNA, 20 bp, Artificial Sequence
  chemically synthesized
tgcactctagcttgggcaat

SEQ ID NO: 63045 - DNA, 20 bp, Artificial Sequence
  chemically synthesized
tcctctcaatgcaatccata

SEQ ID NO: 63046 - DNA, 20 bp, Artificial Sequence
  chemically synthesized
taaaatcatttcaggtagaa

SEQ ID NO: 63047 - DNA, 20 bp, Artificial Sequence
  chemically synthesized
aaagtgaaaagccaagtctt

SEQ ID NO: 63048 - DNA, 20 bp, Artificial Sequence
  chemically synthesized
ataacagtcctcatggcctt

SEQ ID NO: 63049 - DNA, 20 bp, Artificial Sequence
  chemically synthesized
aatttacctaacattttttt

SEQ ID NO: 63050 - DNA, 20 bp, Artificial Sequence
  chemically synthesized
tagaatcaattttcttatat

SEQ ID NO: 63051 - DNA, 20 bp, Artificial Sequence
  chemically synthesized
tacatctttttgcattttac

SEQ ID NO: 63052 - DNA, 20 bp, Artificial Sequence
  chemically synthesized
aatacatttcttcactaagt

SEQ ID NO: 63053 - DNA, 20 bp, Artificial Sequence
  chemically synthesized
aaaccatgccaccacctttc

SEQ ID NO: 63054 - DNA, 20 bp, Artificial Sequence
  chemically synthesized
ataacatttccccttgtgat

SEQ ID NO: 63055 - DNA, 20 bp, Artificial Sequence
  chemically synthesized
aagcatttctatacatgtct

SEQ ID NO: 63056 - DNA, 20 bp, Artificial Sequence
  chemically synthesized
atacacacatgcatgtgttt

SEQ ID NO: 63057 - DNA, 20 bp, Artificial Sequence
  chemically synthesized
ttatcaagcatccagcattt

SEQ ID NO: 63058 - DNA, 20 bp, Artificial Sequence
  chemically synthesized
tactattaaaggttttccaa

SEQ ID NO: 63059 - DNA, 20 bp, Artificial Sequence
  chemically synthesized
ctattgtacagtgtcaccaa

SEQ ID NO: 63060 - DNA, 20 bp, Artificial Sequence
  chemically synthesized
tacagtgtcaccaacagagt

SEQ ID NO: 63061 - DNA, 20 bp, Artificial Sequence
  chemically synthesized
ctttccttcaatccttcctt

SEQ ID NO: 63062 - DNA, 20 bp, Artificial Sequence
  chemically synthesized
ccttccttttggatatgctc

SEQ ID NO: 63063 - DNA, 20 bp, Artificial Sequence
  chemically synthesized
gtctgccattgtggcattat

SEQ ID NO: 63064 - DNA, 20 bp, Artificial Sequence
  chemically synthesized
ggcattatttgaattcagaa

SEQ ID NO: 63065 - DNA, 20 bp, Artificial Sequence
  chemically synthesized
agaaaagagtgaaaaactac

SEQ ID NO: 63066 - DNA, 20 bp, Artificial Sequence
  chemically synthesized
aactactgggatcttcattc

SEQ ID NO: 63067 - DNA, 20 bp, Artificial Sequence
  chemically synthesized
cttcgttaaatttaatctgg

SEQ ID NO: 63068 - DNA, 20 bp, Artificial Sequence
  chemically synthesized
attttttaaatattctttta

SEQ ID NO: 63069 - DNA, 20 bp, Artificial Sequence
  chemically synthesized
atttcaatataataaaaaat

SEQ ID NO: 63070 - DNA, 20 bp, Artificial Sequence
  chemically synthesized
aattagagttttattatagg

SEQ ID NO: 63071 - DNA, 20 bp, Artificial Sequence
  chemically synthesized
aggcaaagaagaactttata

SEQ ID NO: 63072 - DNA, 20 bp, Artificial Sequence
  chemically synthesized
ttctgcaaaaatgaaactag

SEQ ID NO: 63073 - DNA, 20 bp, Artificial Sequence
  chemically synthesized
gggagatatgtagaggagaa

SEQ ID NO: 63074 - DNA, 20 bp, Artificial Sequence
  chemically synthesized
tgtagaggagaacagggttt

SEQ ID NO: 63075 - DNA, 20 bp, Artificial Sequence
  chemically synthesized
ccaatctcagggcaagttaa

SEQ ID NO: 63076 - DNA, 20 bp, Artificial Sequence
  chemically synthesized
agggcaagttaagggaatag

SEQ ID NO: 63077 - DNA, 20 bp, Artificial Sequence
  chemically synthesized
gaccagcataaaaggcaggg

SEQ ID NO: 63078 - DNA, 20 bp, Artificial Sequence
  chemically synthesized
ccctgtggggcaaagtgaac

SEQ ID NO: 63079 - DNA, 20 bp, Artificial Sequence
  chemically synthesized
tgtgtagacagagaagactc

SEQ ID NO: 63080 - DNA, 20 bp, Artificial Sequence
  chemically synthesized
cccttggacccagaggttct

SEQ ID NO: 63081 - DNA, 20 bp, Artificial Sequence
  chemically synthesized
agaggttctttgagtccttt

SEQ ID NO: 63082 - DNA, 20 bp, Artificial Sequence
  chemically synthesized
tcaagggcactttttctcag

SEQ ID NO: 63083 - DNA, 20 bp, Artificial Sequence
  chemically synthesized
tgcactgtgacaagctgcac

SEQ ID NO: 63084 - DNA, 20 bp, Artificial Sequence
  chemically synthesized
cacgtggatcctgagaactt

SEQ ID NO: 63085 - DNA, 20 bp, Artificial Sequence
  chemically synthesized
tggatcctgagaacttcagg

SEQ ID NO: 63086 - DNA, 20 bp, Artificial Sequence
  chemically synthesized
tcacctgctaattctgcact

SEQ ID NO: 63087 - DNA, 20 bp, Artificial Sequence
  chemically synthesized
taatccttttgtctctccac

SEQ ID NO: 63088 - DNA, 20 bp, Artificial Sequence
  chemically synthesized
caactcaaagatgagaggca

SEQ ID NO: 63089 - DNA, 20 bp, Artificial Sequence
  chemically synthesized
ctataaatcattttacaata

SEQ ID NO: 63090 - DNA, 20 bp, Artificial Sequence
  chemically synthesized
attttacaataaggaataat

SEQ ID NO: 63091 - DNA, 20 bp, Artificial Sequence
  chemically synthesized
tttataaattctgtagtaaa

SEQ ID NO: 63092 - DNA, 20 bp, Artificial Sequence
  chemically synthesized
taaatggaatggaaaggaaa

SEQ ID NO: 63093 - DNA, 20 bp, Artificial Sequence
  chemically synthesized
atacaaaattaaaactaatt

SEQ ID NO: 63094 - DNA, 20 bp, Artificial Sequence
  chemically synthesized
acatgctagttaagtacata

SEQ ID NO: 63095 - DNA, 20 bp, Artificial Sequence
  chemically synthesized
atgtacttatttatgctgat

SEQ ID NO: 63096 - DNA, 20 bp, Artificial Sequence
  chemically synthesized
tatgctgatgggaataacct

SEQ ID NO: 63097 - DNA, 20 bp, Artificial Sequence
  chemically synthesized
taagatttgggcagaaaaaa

SEQ ID NO: 63098 - DNA, 20 bp, Artificial Sequence
  chemically synthesized
gctggcccgcaactttggca

SEQ ID NO: 63099 - DNA, 20 bp, Artificial Sequence
  chemically synthesized
gggaacacaatgcctacttc

SEQ ID NO: 63100 - DNA, 20 bp, Artificial Sequence
  chemically synthesized
ggtatggcttctgcctaata

SEQ ID NO: 63101 - DNA, 20 bp, Artificial Sequence
  chemically synthesized
gagcacttgtttattttaca

SEQ ID NO: 63102 - DNA, 20 bp, Artificial Sequence
  chemically synthesized
gggaaccgtacaaggcatta

SEQ ID NO: 63103 - DNA, 20 bp, Artificial Sequence
  chemically synthesized
caaccctaagacatagcctc

SEQ ID NO: 63104 - DNA, 20 bp, Artificial Sequence
  chemically synthesized
tgccccagaacatctctgta

SEQ ID NO: 63105 - DNA, 20 bp, Artificial Sequence
  chemically synthesized
aatatttattcaagaaaaca

SEQ ID NO: 63106 - DNA, 20 bp, Artificial Sequence
  chemically synthesized
tttattcaagaaaacagtga

SEQ ID NO: 63107 - DNA, 20 bp, Artificial Sequence
  chemically synthesized
agaaaacagtgaatgaatga

SEQ ID NO: 63108 - DNA, 20 bp, Artificial Sequence
  chemically synthesized
aacagtgaatgaatgaacga

SEQ ID NO: 63109 - DNA, 20 bp, Artificial Sequence
  chemically synthesized
atgaatgaacgaatgagtaa

SEQ ID NO: 63110 - DNA, 20 bp, Artificial Sequence
  chemically synthesized
atgagtaaatgagtaaatga

SEQ ID NO: 63111 - DNA, 20 bp, Artificial Sequence
  chemically synthesized
attccttgctttagaacttc

SEQ ID NO: 63112 - DNA, 20 bp, Artificial Sequence
  chemically synthesized
gttatttcctttctgatcat

SEQ ID NO: 63113 - DNA, 20 bp, Artificial Sequence
  chemically synthesized
tttgccataggtaaaattag

SEQ ID NO: 63114 - DNA, 20 bp, Artificial Sequence
  chemically synthesized
ttgattaattttaaacttac

SEQ ID NO: 63115 - DNA, 20 bp, Artificial Sequence
  chemically synthesized
aacttacttgaatacctaaa

SEQ ID NO: 63116 - DNA, 20 bp, Artificial Sequence
  chemically synthesized
agtaactctgtctgtactgc

SEQ ID NO: 63117 - DNA, 20 bp, Artificial Sequence
  chemically synthesized
actgttttgatcacaacatt

SEQ ID NO: 63118 - DNA, 20 bp, Artificial Sequence
  chemically synthesized
gcactgagaactctttatat

SEQ ID NO: 63119 - DNA, 20 bp, Artificial Sequence
  chemically synthesized
gagcatagggaagttctcat

SEQ ID NO: 63120 - DNA, 20 bp, Artificial Sequence
  chemically synthesized
tacaccattagaagtagtca

SEQ ID NO: 63121 - DNA, 20 bp, Artificial Sequence
  chemically synthesized
ccctaaaaatccaaatacca

SEQ ID NO: 63122 - DNA, 20 bp, Artificial Sequence
  chemically synthesized
agaattcatgagaacatcac

SEQ ID NO: 63123 - DNA, 20 bp, Artificial Sequence
  chemically synthesized
gttatattaaaattatttgt

SEQ ID NO: 63124 - DNA, 20 bp, Artificial Sequence
  chemically synthesized
tgttagagtagagcttttgt

SEQ ID NO: 63125 - DNA, 20 bp, Artificial Sequence
  chemically synthesized
tagagcttttgtaagagtct

SEQ ID NO: 63126 - DNA, 20 bp, Artificial Sequence
  chemically synthesized
acagacacccaggcctactt

SEQ ID NO: 63127 - DNA, 20 bp, Artificial Sequence
  chemically synthesized
cccaggcctacttgagggtt

SEQ ID NO: 63128 - DNA, 20 bp, Artificial Sequence
  chemically synthesized
agacgatgaaaaagaaccta

SEQ ID NO: 63129 - DNA, 20 bp, Artificial Sequence
  chemically synthesized
attgggtattaagttcatca

SEQ ID NO: 63130 - DNA, 20 bp, Artificial Sequence
  chemically synthesized
tgaaagttaaaacaaagtat

SEQ ID NO: 63131 - DNA, 20 bp, Artificial Sequence
  chemically synthesized
gttaaaacaaagtataggaa

SEQ ID NO: 63132 - DNA, 20 bp, Artificial Sequence
  chemically synthesized
ataaactatgttcagtatgt

SEQ ID NO: 63133 - DNA, 20 bp, Artificial Sequence
  chemically synthesized
tgttcagtatgtctgaatga

SEQ ID NO: 63134 - DNA, 20 bp, Artificial Sequence
  chemically synthesized
ggaagagaggacgtaataat

SEQ ID NO: 63135 - DNA, 20 bp, Artificial Sequence
  chemically synthesized
gaggacgtaataatgtgaat

SEQ ID NO: 63136 - DNA, 20 bp, Artificial Sequence
  chemically synthesized
ataaaataatttaatgtcag

SEQ ID NO: 63137 - DNA, 20 bp, Artificial Sequence
  chemically synthesized
ttgagcttcagagcagtcct

SEQ ID NO: 63138 - DNA, 20 bp, Artificial Sequence
  chemically synthesized
ttaatgcctacatgtttgta

SEQ ID NO: 63139 - DNA, 20 bp, Artificial Sequence
  chemically synthesized
aggttaaaaaaaagctaatt

SEQ ID NO: 63140 - DNA, 20 bp, Artificial Sequence
  chemically synthesized
tgtgtgtgcggtttgtttct

SEQ ID NO: 63141 - DNA, 20 bp, Artificial Sequence
  chemically synthesized
ttaattaattctgagagctg

SEQ ID NO: 63142 - DNA, 20 bp, Artificial Sequence
  chemically synthesized
ttgctaaaatgtctcacttg

SEQ ID NO: 63143 - DNA, 20 bp, Artificial Sequence
  chemically synthesized
ataaaaccacactcccatag

SEQ ID NO: 63144 - DNA, 20 bp, Artificial Sequence
  chemically synthesized
cttaagaaagattaatagac

SEQ ID NO: 63145 - DNA, 20 bp, Artificial Sequence
  chemically synthesized
tgtgttgtggtcagtggggc

SEQ ID NO: 63146 - DNA, 20 bp, Artificial Sequence
  chemically synthesized
cagtggggctggaataaaag

SEQ ID NO: 63147 - DNA, 20 bp, Artificial Sequence
  chemically synthesized
cctgctgtggcatccattca

SEQ ID NO: 63148 - DNA, 20 bp, Artificial Sequence
  chemically synthesized
tagtgaagatgtcagtaagc

SEQ ID NO: 63149 - DNA, 20 bp, Artificial Sequence
  chemically synthesized
tgaatagtttttcaggaact

SEQ ID NO: 63150 - DNA, 20 bp, Artificial Sequence
  chemically synthesized
agcttgcagccttgtccctg

SEQ ID NO: 63151 - DNA, 20 bp, Artificial Sequence
  chemically synthesized
ccttgtccctgcagggtatt

SEQ ID NO: 63152 - DNA, 20 bp, Artificial Sequence
  chemically synthesized
agcaacccctgccttgaagc

SEQ ID NO: 63153 - DNA, 20 bp, Artificial Sequence
  chemically synthesized
agcagttgccaacacaagag

SEQ ID NO: 63154 - DNA, 20 bp, Artificial Sequence
  chemically synthesized
tttctgagcataagaagttg

SEQ ID NO: 63155 - DNA, 20 bp, Artificial Sequence
  chemically synthesized
aggtgacaatttctgccaat

SEQ ID NO: 63156 - DNA, 20 bp, Artificial Sequence
  chemically synthesized
ctttgacaattttggtcttt

SEQ ID NO: 63157 - DNA, 20 bp, Artificial Sequence
  chemically synthesized
tctgtgcattttctttgacc

SEQ ID NO: 63158 - DNA, 20 bp, Artificial Sequence
  chemically synthesized
atatacatgcctcttatatc

SEQ ID NO: 63159 - DNA, 20 bp, Artificial Sequence
  chemically synthesized
cttatatcagggatgtgaaa

SEQ ID NO: 63160 - DNA, 20 bp, Artificial Sequence
  chemically synthesized
attttaaagacgtcttttcc

SEQ ID NO: 63161 - DNA, 20 bp, Artificial Sequence
  chemically synthesized
aacatgtgaaatcttttctc

SEQ ID NO: 63162 - DNA, 20 bp, Artificial Sequence
  chemically synthesized
attgctttagttttttacag

SEQ ID NO: 63163 - DNA, 20 bp, Artificial Sequence
  chemically synthesized
ctttagttttttacagagga

SEQ ID NO: 63164 - DNA, 20 bp, Artificial Sequence
  chemically synthesized
caaacactttctgcgtgtgt

SEQ ID NO: 63165 - DNA, 20 bp, Artificial Sequence
  chemically synthesized
tctgcgtgtgtgagaataat

SEQ ID NO: 63166 - DNA, 20 bp, Artificial Sequence
  chemically synthesized
ttttttcacaagtacctgat

SEQ ID NO: 63167 - DNA, 20 bp, Artificial Sequence
  chemically synthesized
ataatagagaaagcatttaa

SEQ ID NO: 63168 - DNA, 20 bp, Artificial Sequence
  chemically synthesized
ccttctgataactagaaata

SEQ ID NO: 63169 - DNA, 20 bp, Artificial Sequence
  chemically synthesized
attttgtgtaatcgtagttt

SEQ ID NO: 63170 - DNA, 20 bp, Artificial Sequence
  chemically synthesized
actttccttactaaaccgac

SEQ ID NO: 63171 - DNA, 20 bp, Artificial Sequence
  chemically synthesized
catgggtttccaggtagggg

SEQ ID NO: 63172 - DNA, 20 bp, Artificial Sequence
  chemically synthesized
ttccaggtaggggcaggatt

SEQ ID NO: 63173 - DNA, 20 bp, Artificial Sequence
  chemically synthesized
caaaagtttttcctcacctg

SEQ ID NO: 63174 - DNA, 20 bp, Artificial Sequence
  chemically synthesized
tacaaggggaaaaagtacag

SEQ ID NO: 63175 - DNA, 20 bp, Artificial Sequence
  chemically synthesized
ttgggaagctatagagaaag

SEQ ID NO: 63176 - DNA, 20 bp, Artificial Sequence
  chemically synthesized
atataaagagaaataggaac

SEQ ID NO: 63177 - DNA, 20 bp, Artificial Sequence
  chemically synthesized
accccattgatagtcacact

SEQ ID NO: 63178 - DNA, 20 bp, Artificial Sequence
  chemically synthesized
attaagaaaaacaacaacaa

SEQ ID NO: 63179 - DNA, 20 bp, Artificial Sequence
  chemically synthesized
agatatgcttagaaccgagg

SEQ ID NO: 63180 - DNA, 20 bp, Artificial Sequence
  chemically synthesized
tccatctacatatcccaaag

SEQ ID NO: 63181 - DNA, 20 bp, Artificial Sequence
  chemically synthesized
acgtaaatacacttgcaaag

SEQ ID NO: 63182 - DNA, 20 bp, Artificial Sequence
  chemically synthesized
tatatcttagagggagggct

SEQ ID NO: 63183 - DNA, 20 bp, Artificial Sequence
  chemically synthesized
caccctgtggagccacaccc

SEQ ID NO: 63184 - DNA, 20 bp, Artificial Sequence
  chemically synthesized
ccctgtggggcaaggtgaac

SEQ ID NO: 63185 - DNA, 20 bp, Artificial Sequence
  chemically synthesized
tgtggagacagagaagactc

SEQ ID NO: 63186 - DNA, 20 bp, Artificial Sequence
  chemically synthesized
cccttggacccagaggttct

SEQ ID NO: 63187 - DNA, 20 bp, Artificial Sequence
  chemically synthesized
agaggttctttgagtccttt

SEQ ID NO: 63188 - DNA, 20 bp, Artificial Sequence
  chemically synthesized
tcaagggcacctttgccaca

SEQ ID NO: 63189 - DNA, 20 bp, Artificial Sequence
  chemically synthesized
tgcactgtgacaagctgcac

SEQ ID NO: 63190 - DNA, 20 bp, Artificial Sequence
  chemically synthesized
cacgtggatcctgagaactt

SEQ ID NO: 63191 - DNA, 20 bp, Artificial Sequence
  chemically synthesized
tggatcctgagaacttcagg

SEQ ID NO: 63192 - DNA, 20 bp, Artificial Sequence
  chemically synthesized
ttaagttcatgtcataggaa

SEQ ID NO: 63193 - DNA, 20 bp, Artificial Sequence
  chemically synthesized
cataggaaggggataagtaa

SEQ ID NO: 63194 - DNA, 20 bp, Artificial Sequence
  chemically synthesized
ataagtaacagggtacagtt

SEQ ID NO: 63195 - DNA, 20 bp, Artificial Sequence
  chemically synthesized
cagtttagaatgggaaacag

SEQ ID NO: 63196 - DNA, 20 bp, Artificial Sequence
  chemically synthesized
ttgcatcagtgtggaagtct

SEQ ID NO: 63197 - DNA, 20 bp, Artificial Sequence
  chemically synthesized
ctgcctagtacattactatt

SEQ ID NO: 63198 - DNA, 20 bp, Artificial Sequence
  chemically synthesized
cataatcattatacatattt

SEQ ID NO: 63199 - DNA, 20 bp, Artificial Sequence
  chemically synthesized
tgtacacatattgaccaaat

SEQ ID NO: 63200 - DNA, 20 bp, Artificial Sequence
  chemically synthesized
tgcctctttgcaccattcta

SEQ ID NO: 63201 - DNA, 20 bp, Artificial Sequence
  chemically synthesized
aagaataacagtgataattt

SEQ ID NO: 63202 - DNA, 20 bp, Artificial Sequence
  chemically synthesized
ttctgcttttattttatggt

SEQ ID NO: 63203 - DNA, 20 bp, Artificial Sequence
  chemically synthesized
attttatggttgggataagg

SEQ ID NO: 63204 - DNA, 20 bp, Artificial Sequence
  chemically synthesized
tgggataaggctggattatt

SEQ ID NO: 63205 - DNA, 20 bp, Artificial Sequence
  chemically synthesized
gctggcccatcactttggca

SEQ ID NO: 63206 - DNA, 20 bp, Artificial Sequence
  chemically synthesized
taagtccaactactaaactg

SEQ ID NO: 63207 - DNA, 20 bp, Artificial Sequence
  chemically synthesized
ttatgaagggccttgagcat

SEQ ID NO: 63208 - DNA, 20 bp, Artificial Sequence
  chemically synthesized
atgatgtatttaaattattt

SEQ ID NO: 63209 - DNA, 20 bp, Artificial Sequence
  chemically synthesized
tctgaatattttactaaaaa

SEQ ID NO: 63210 - DNA, 20 bp, Artificial Sequence
  chemically synthesized
gccttattcatccctcagaa

SEQ ID NO: 63211 - DNA, 20 bp, Artificial Sequence
  chemically synthesized
ttattgttttagctgtcctc

SEQ ID NO: 63212 - DNA, 20 bp, Artificial Sequence
  chemically synthesized
ctacttgaagaaggaaaaac

SEQ ID NO: 63213 - DNA, 20 bp, Artificial Sequence
  chemically synthesized
ctcccccactcacagtgacc

SEQ ID NO: 63214 - DNA, 20 bp, Artificial Sequence
  chemically synthesized
tatgaaaagttaggactgag

SEQ ID NO: 63215 - DNA, 20 bp, Artificial Sequence
  chemically synthesized
atggaagtcccattcttcct

SEQ ID NO: 63216 - DNA, 20 bp, Artificial Sequence
  chemically synthesized
ctagattctggaaataaaat

SEQ ID NO: 63217 - DNA, 20 bp, Artificial Sequence
  chemically synthesized
tcctctctcccagtcaaatt

SEQ ID NO: 63218 - DNA, 20 bp, Artificial Sequence
  chemically synthesized
tcagtaataagtgatgatag

SEQ ID NO: 63219 - DNA, 20 bp, Artificial Sequence
  chemically synthesized
gatgatagaagggtatatag

SEQ ID NO: 63220 - DNA, 20 bp, Artificial Sequence
  chemically synthesized
agaagaattttattatatga

SEQ ID NO: 63221 - DNA, 20 bp, Artificial Sequence
  chemically synthesized
caccataaacaaaaataaat

SEQ ID NO: 63222 - DNA, 20 bp, Artificial Sequence
  chemically synthesized
ataaacaaaaataaatttga

SEQ ID NO: 63223 - DNA, 20 bp, Artificial Sequence
  chemically synthesized
aaataaatttgaatgggtta

SEQ ID NO: 63224 - DNA, 20 bp, Artificial Sequence
  chemically synthesized
attcacgttgcagccgtttt

SEQ ID NO: 63225 - DNA, 20 bp, Artificial Sequence
  chemically synthesized
gaaaatcctgccatttatgg

SEQ ID NO: 63226 - DNA, 20 bp, Artificial Sequence
  chemically synthesized
tggcagaattgatgaacctg

SEQ ID NO: 63227 - DNA, 20 bp, Artificial Sequence
  chemically synthesized
acagtagaggtatggtttcc

SEQ ID NO: 63228 - DNA, 20 bp, Artificial Sequence
  chemically synthesized
aggtatggtttccaggggtt

SEQ ID NO: 63229 - DNA, 20 bp, Artificial Sequence
  chemically synthesized
tttccaggggttgggggtgg

SEQ ID NO: 63230 - DNA, 20 bp, Artificial Sequence
  chemically synthesized
aatcaggaaactattactca

SEQ ID NO: 63231 - DNA, 20 bp, Artificial Sequence
  chemically synthesized
ggtataaaatttcagttatg

SEQ ID NO: 63232 - DNA, 20 bp, Artificial Sequence
  chemically synthesized
taaaatttcagttatgtggg

SEQ ID NO: 63233 - DNA, 20 bp, Artificial Sequence
  chemically synthesized
gtatatttaaaatttgcaaa

SEQ ID NO: 63234 - DNA, 20 bp, Artificial Sequence
  chemically synthesized
gatttttttttttttttaga

SEQ ID NO: 63235 - DNA, 20 bp, Artificial Sequence
  chemically synthesized
tttgctcttgttgtccaggc

SEQ ID NO: 63236 - DNA, 20 bp, Artificial Sequence
  chemically synthesized
ctcactgcaacctccgcctc

SEQ ID NO: 63237 - DNA, 20 bp, Artificial Sequence
  chemically synthesized
aaatctcctgcctcagcctc

SEQ ID NO: 63238 - DNA, 20 bp, Artificial Sequence
  chemically synthesized
gcctcagcctcccgagtagc

SEQ ID NO: 63239 - DNA, 20 bp, Artificial Sequence
  chemically synthesized
ttttgtatttttagtagaga

SEQ ID NO: 63240 - DNA, 20 bp, Artificial Sequence
  chemically synthesized
gcctcggccacccaaagggc

SEQ ID NO: 63241 - DNA, 20 bp, Artificial Sequence
  chemically synthesized
gtgagccaccgggcctggcc

SEQ ID NO: 63242 - DNA, 20 bp, Artificial Sequence
  chemically synthesized
aaaggtaactatgtgagata

SEQ ID NO: 63243 - DNA, 20 bp, Artificial Sequence
  chemically synthesized
aatatatacaatttttattt

SEQ ID NO: 63244 - DNA, 20 bp, Artificial Sequence
  chemically synthesized
atgatacctcaataaagttg

SEQ ID NO: 63245 - DNA, 20 bp, Artificial Sequence
  chemically synthesized
aaagttgaagaataataaaa

SEQ ID NO: 63246 - DNA, 20 bp, Artificial Sequence
  chemically synthesized
taaaaaagaatagacatcac

SEQ ID NO: 63247 - DNA, 20 bp, Artificial Sequence
  chemically synthesized
aaaaaatgcatcttgatgat

SEQ ID NO: 63248 - DNA, 20 bp, Artificial Sequence
  chemically synthesized
ctcatgtgtaagtaagatag

SEQ ID NO: 63249 - DNA, 20 bp, Artificial Sequence
  chemically synthesized
gaacaactatactttttgaa

SEQ ID NO: 63250 - DNA, 20 bp, Artificial Sequence
  chemically synthesized
aaattcagtcacgaaaaaac

SEQ ID NO: 63251 - DNA, 20 bp, Artificial Sequence
  chemically synthesized
actttgggaggcctagacag

SEQ ID NO: 63252 - DNA, 20 bp, Artificial Sequence
  chemically synthesized
gacaggcggatcacgacgtc

SEQ ID NO: 63253 - DNA, 20 bp, Artificial Sequence
  chemically synthesized
aatttgggaggctgaggcag

SEQ ID NO: 63254 - DNA, 20 bp, Artificial Sequence
  chemically synthesized
gagcggtggagccaagatga

SEQ ID NO: 63255 - DNA, 20 bp, Artificial Sequence
  chemically synthesized
tccagtctatagctcccatc

SEQ ID NO: 63256 - DNA, 20 bp, Artificial Sequence
  chemically synthesized
catcgtgagtgacgcagaag

SEQ ID NO: 63257 - DNA, 20 bp, Artificial Sequence
  chemically synthesized
tcacagggaagtgccaggca

SEQ ID NO: 63258 - DNA, 20 bp, Artificial Sequence
  chemically synthesized
cacctcacccgggaagcaca

SEQ ID NO: 63259 - DNA, 20 bp, Artificial Sequence
  chemically synthesized
ccgggaagcacaaggggtca

SEQ ID NO: 63260 - DNA, 20 bp, Artificial Sequence
  chemically synthesized
tccctttcctagtcaaagaa

SEQ ID NO: 63261 - DNA, 20 bp, Artificial Sequence
  chemically synthesized
gacagatggcacctggaaaa

SEQ ID NO: 63262 - DNA, 20 bp, Artificial Sequence
  chemically synthesized
tatatcccatgcctggctca

SEQ ID NO: 63263 - DNA, 20 bp, Artificial Sequence
  chemically synthesized
ggtggcagtgaggctggggg

SEQ ID NO: 63264 - DNA, 20 bp, Artificial Sequence
  chemically synthesized
aagccgcctggaagctcgaa

SEQ ID NO: 63265 - DNA, 20 bp, Artificial Sequence
  chemically synthesized
ccctgtctgacagctttgaa

SEQ ID NO: 63266 - DNA, 20 bp, Artificial Sequence
  chemically synthesized
caggcagactgcctcctcaa

SEQ ID NO: 63267 - DNA, 20 bp, Artificial Sequence
  chemically synthesized
ctcaagtgggtccctgaccc

SEQ ID NO: 63268 - DNA, 20 bp, Artificial Sequence
  chemically synthesized
ctctaagacaaaacttccag

SEQ ID NO: 63269 - DNA, 20 bp, Artificial Sequence
  chemically synthesized
atacccaggaaaacagcttc

SEQ ID NO: 63270 - DNA, 20 bp, Artificial Sequence
  chemically synthesized
actccaacagacctgcagct

SEQ ID NO: 63271 - DNA, 20 bp, Artificial Sequence
  chemically synthesized
aaactggacactctaaaaat

SEQ ID NO: 63272 - DNA, 20 bp, Artificial Sequence
  chemically synthesized
caatggaacaaagctgggca

SEQ ID NO: 63273 - DNA, 20 bp, Artificial Sequence
  chemically synthesized
ctgggcagagaatgactttg

SEQ ID NO: 63274 - DNA, 20 bp, Artificial Sequence
  chemically synthesized
aaactttgaaaaaaaattag

SEQ ID NO: 63275 - DNA, 20 bp, Artificial Sequence
  chemically synthesized
tttgaaaaaaaattagatga

SEQ ID NO: 63276 - DNA, 20 bp, Artificial Sequence
  chemically synthesized
aaattagatgaatggataac

SEQ ID NO: 63277 - DNA, 20 bp, Artificial Sequence
  chemically synthesized
cgatgagatcaactggaaga

SEQ ID NO: 63278 - DNA, 20 bp, Artificial Sequence
  chemically synthesized
tatcaatgacgaaagatgaa

SEQ ID NO: 63279 - DNA, 20 bp, Artificial Sequence
  chemically synthesized
gaagagaagtttagagaaaa

SEQ ID NO: 63280 - DNA, 20 bp, Artificial Sequence
  chemically synthesized
gtgtagctgaaagtgatggg

SEQ ID NO: 63281 - DNA, 20 bp, Artificial Sequence
  chemically synthesized
ccaagttggaaaacactctg

SEQ ID NO: 63282 - DNA, 20 bp, Artificial Sequence
  chemically synthesized
agggcagccagagagaaagg

SEQ ID NO: 63283 - DNA, 20 bp, Artificial Sequence
  chemically synthesized
tattcaacattgttaaagaa

SEQ ID NO: 63284 - DNA, 20 bp, Artificial Sequence
  chemically synthesized
aaagaaaagaattttcaacc

SEQ ID NO: 63285 - DNA, 20 bp, Artificial Sequence
  chemically synthesized
accagctaacatcataatga

SEQ ID NO: 63286 - DNA, 20 bp, Artificial Sequence
  chemically synthesized
aaaagacacagactggcaaa

SEQ ID NO: 63287 - DNA, 20 bp, Artificial Sequence
  chemically synthesized
acagactggcaaattggata

SEQ ID NO: 63288 - DNA, 20 bp, Artificial Sequence
  chemically synthesized
cacacataggctcgaaataa

SEQ ID NO: 63289 - DNA, 20 bp, Artificial Sequence
  chemically synthesized
ggctcgaaataaaaggatgg

SEQ ID NO: 63290 - DNA, 20 bp, Artificial Sequence
  chemically synthesized
aatggaaaacaaaaaaaggc

SEQ ID NO: 63291 - DNA, 20 bp, Artificial Sequence
  chemically synthesized
aggccattacataatggcaa

SEQ ID NO: 63292 - DNA, 20 bp, Artificial Sequence
  chemically synthesized
ccagattcataaaacaagtc

SEQ ID NO: 63293 - DNA, 20 bp, Artificial Sequence
  chemically synthesized
caacgagacagaaagttaac

SEQ ID NO: 63294 - DNA, 20 bp, Artificial Sequence
  chemically synthesized
gaaagttaacaaggatatcc

SEQ ID NO: 63295 - DNA, 20 bp, Artificial Sequence
  chemically synthesized
aactctccaccccaaatcaa

SEQ ID NO: 63296 - DNA, 20 bp, Artificial Sequence
  chemically synthesized
agtgcaatcaaactagaact

SEQ ID NO: 63297 - DNA, 20 bp, Artificial Sequence
  chemically synthesized
ggaaactgaacagcctgctc

SEQ ID NO: 63298 - DNA, 20 bp, Artificial Sequence
  chemically synthesized
agcctgctcctgaatgacta

SEQ ID NO: 63299 - DNA, 20 bp, Artificial Sequence
  chemically synthesized
agaacaaagacacaacacac

SEQ ID NO: 63300 - DNA, 20 bp, Artificial Sequence
  chemically synthesized
aaaacccttcaaaaaaatca

SEQ ID NO: 63301 - DNA, 20 bp, Artificial Sequence
  chemically synthesized
taataaagaagaaaagagag

SEQ ID NO: 63302 - DNA, 20 bp, Artificial Sequence
  chemically synthesized
agacgcaataaaaaatgaca

SEQ ID NO: 63303 - DNA, 20 bp, Artificial Sequence
  chemically synthesized
agaaatacaaactaccgtca

SEQ ID NO: 63304 - DNA, 20 bp, Artificial Sequence
  chemically synthesized
aactagaaaatctagaagaa

SEQ ID NO: 63305 - DNA, 20 bp, Artificial Sequence
  chemically synthesized
accaggaagaagttgtatct

SEQ ID NO: 63306 - DNA, 20 bp, Artificial Sequence
  chemically synthesized
caaaaaaagtccgggaccag

SEQ ID NO: 63307 - DNA, 20 bp, Artificial Sequence
  chemically synthesized
gggaccagtaggattcatag

SEQ ID NO: 63308 - DNA, 20 bp, Artificial Sequence
  chemically synthesized
ttccaatcaatagaaaaaga

SEQ ID NO: 63309 - DNA, 20 bp, Artificial Sequence
  chemically synthesized
acagagacacaacaaaaaaa

SEQ ID NO: 63310 - DNA, 20 bp, Artificial Sequence
  chemically synthesized
aacccacagccaatatcata

SEQ ID NO: 63311 - DNA, 20 bp, Artificial Sequence
  chemically synthesized
tttgaaaactggcacaaggc

SEQ ID NO: 63312 - DNA, 20 bp, Artificial Sequence
  chemically synthesized
aagcaacttcagcaaagtct

SEQ ID NO: 63313 - DNA, 20 bp, Artificial Sequence
  chemically synthesized
gacaaacagagagccaaatc

SEQ ID NO: 63314 - DNA, 20 bp, Artificial Sequence
  chemically synthesized
ccattcacaattgcttcaaa

SEQ ID NO: 63315 - DNA, 20 bp, Artificial Sequence
  chemically synthesized
tcaaagagaataaaatacct

SEQ ID NO: 63316 - DNA, 20 bp, Artificial Sequence
  chemically synthesized
acctaggaatccaacttaca

SEQ ID NO: 63317 - DNA, 20 bp, Artificial Sequence
  chemically synthesized
cactgctcaatgaaataaaa

SEQ ID NO: 63318 - DNA, 20 bp, Artificial Sequence
  chemically synthesized
tggaagaacattccatgctc

SEQ ID NO: 63319 - DNA, 20 bp, Artificial Sequence
  chemically synthesized
attccatgctcatgggtagg

SEQ ID NO: 63320 - DNA, 20 bp, Artificial Sequence
  chemically synthesized
agagaaacaagcaatgggga

SEQ ID NO: 63321 - DNA, 20 bp, Artificial Sequence
  chemically synthesized
ccatatgtagaaagctgaaa

SEQ ID NO: 63322 - DNA, 20 bp, Artificial Sequence
  chemically synthesized
tatacaaaaattaattcaag

SEQ ID NO: 63323 - DNA, 20 bp, Artificial Sequence
  chemically synthesized
caaaagacaaaatggacaaa

SEQ ID NO: 63324 - DNA, 20 bp, Artificial Sequence
  chemically synthesized
acagctaaagaaactaccat

SEQ ID NO: 63325 - DNA, 20 bp, Artificial Sequence
  chemically synthesized
tctgacaaagggctaatatc

SEQ ID NO: 63326 - DNA, 20 bp, Artificial Sequence
  chemically synthesized
accccatcaaaaagtgggca

SEQ ID NO: 63327 - DNA, 20 bp, Artificial Sequence
  chemically synthesized
agataccatctcacaccagt

SEQ ID NO: 63328 - DNA, 20 bp, Artificial Sequence
  chemically synthesized
aggaaacaacaggtgctgga

SEQ ID NO: 63329 - DNA, 20 bp, Artificial Sequence
  chemically synthesized
agtcagtgtggcaattcctc

SEQ ID NO: 63330 - DNA, 20 bp, Artificial Sequence
  chemically synthesized
ttgacccagccatcccatta

SEQ ID NO: 63331 - DNA, 20 bp, Artificial Sequence
  chemically synthesized
cattactgggtacataccca

SEQ ID NO: 63332 - DNA, 20 bp, Artificial Sequence
  chemically synthesized
aaatgtccaacaacgataga

SEQ ID NO: 63333 - DNA, 20 bp, Artificial Sequence
  chemically synthesized
aatgtggcacatatacacca

SEQ ID NO: 63334 - DNA, 20 bp, Artificial Sequence
  chemically synthesized
ctatgcagccataaaaaatg

SEQ ID NO: 63335 - DNA, 20 bp, Artificial Sequence
  chemically synthesized
ttcatgtcctttgtagggac

SEQ ID NO: 63336 - DNA, 20 bp, Artificial Sequence
  chemically synthesized
tctcagcaaactatcacaag

SEQ ID NO: 63337 - DNA, 20 bp, Artificial Sequence
  chemically synthesized
gcatgttctcactcataggt

SEQ ID NO: 63338 - DNA, 20 bp, Artificial Sequence
  chemically synthesized
tcacactctggggactgtta

SEQ ID NO: 63339 - DNA, 20 bp, Artificial Sequence
  chemically synthesized
atggggtggggggcaggggc

SEQ ID NO: 63340 - DNA, 20 bp, Artificial Sequence
  chemically synthesized
gatatacctaatgctaaatg

SEQ ID NO: 63341 - DNA, 20 bp, Artificial Sequence
  chemically synthesized
taatgctaaatgacgagtta

SEQ ID NO: 63342 - DNA, 20 bp, Artificial Sequence
  chemically synthesized
cagtctctccatatatttct

SEQ ID NO: 63343 - DNA, 20 bp, Artificial Sequence
  chemically synthesized
cttccttcttatttgtttat

SEQ ID NO: 63344 - DNA, 20 bp, Artificial Sequence
  chemically synthesized
tactaaacaggagccaagcc

SEQ ID NO: 63345 - DNA, 20 bp, Artificial Sequence
  chemically synthesized
gagccaagcctagaataaag

SEQ ID NO: 63346 - DNA, 20 bp, Artificial Sequence
  chemically synthesized
ctagaataaagttgaatttc

SEQ ID NO: 63347 - DNA, 20 bp, Artificial Sequence
  chemically synthesized
aacccaggaggctgaagtga

SEQ ID NO: 63348 - DNA, 20 bp, Artificial Sequence
  chemically synthesized
gtgataggatcacttgagcc

SEQ ID NO: 63349 - DNA, 20 bp, Artificial Sequence
  chemically synthesized
atcacttgagcccaggattt

SEQ ID NO: 63350 - DNA, 20 bp, Artificial Sequence
  chemically synthesized
gcctcggggctgtttctcca

SEQ ID NO: 63351 - DNA, 20 bp, Artificial Sequence
  chemically synthesized
gctgtttctccagtggattc

SEQ ID NO: 63352 - DNA, 20 bp, Artificial Sequence
  chemically synthesized
tcacctgtcttattcagagc

SEQ ID NO: 63353 - DNA, 20 bp, Artificial Sequence
  chemically synthesized
gactagctttttctatttct

SEQ ID NO: 63354 - DNA, 20 bp, Artificial Sequence
  chemically synthesized
gtattctggggagggggaca

SEQ ID NO: 63355 - DNA, 20 bp, Artificial Sequence
  chemically synthesized
catagagttgagagaaatac

SEQ ID NO: 63356 - DNA, 20 bp, Artificial Sequence
  chemically synthesized
gatgattatttgtatttctg

SEQ ID NO: 63357 - DNA, 20 bp, Artificial Sequence
  chemically synthesized
attatttgtatttctgtggg

SEQ ID NO: 63358 - DNA, 20 bp, Artificial Sequence
  chemically synthesized
tcatttctaactgtgcttat

SEQ ID NO: 63359 - DNA, 20 bp, Artificial Sequence
  chemically synthesized
ctcttggactcattaatctt

SEQ ID NO: 63360 - DNA, 20 bp, Artificial Sequence
  chemically synthesized
ttcttgtcttctgctagatt

SEQ ID NO: 63361 - DNA, 20 bp, Artificial Sequence
  chemically synthesized
tttttattcctctgtggtct

SEQ ID NO: 63362 - DNA, 20 bp, Artificial Sequence
  chemically synthesized
attttttttttgcatttgct

SEQ ID NO: 63363 - DNA, 20 bp, Artificial Sequence
  chemically synthesized
attctatcagatgcacaaag

SEQ ID NO: 63364 - DNA, 20 bp, Artificial Sequence
  chemically synthesized
actccaaaaaattgaggggg

SEQ ID NO: 63365 - DNA, 20 bp, Artificial Sequence
  chemically synthesized
aacccacagccaacatcata

SEQ ID NO: 63366 - DNA, 20 bp, Artificial Sequence
  chemically synthesized
cttgaaaactggcacaagac

SEQ ID NO: 63367 - DNA, 20 bp, Artificial Sequence
  chemically synthesized
agagcaatcaggcaagagaa

SEQ ID NO: 63368 - DNA, 20 bp, Artificial Sequence
  chemically synthesized
tgataacttcagcaaagttt

SEQ ID NO: 63369 - DNA, 20 bp, Artificial Sequence
  chemically synthesized
ccatttaccgttgccacaaa

SEQ ID NO: 63370 - DNA, 20 bp, Artificial Sequence
  chemically synthesized
acaaaaagaataaaatacct

SEQ ID NO: 63371 - DNA, 20 bp, Artificial Sequence
  chemically synthesized
tggaaaaactttccatgctc

SEQ ID NO: 63372 - DNA, 20 bp, Artificial Sequence
  chemically synthesized
tttccatgctcatggataaa

SEQ ID NO: 63373 - DNA, 20 bp, Artificial Sequence
  chemically synthesized
aaatcctaatactcacaggt

SEQ ID NO: 63374 - DNA, 20 bp, Artificial Sequence
  chemically synthesized
aaaatgagaacacttggaca

SEQ ID NO: 63375 - DNA, 20 bp, Artificial Sequence
  chemically synthesized
tcacacaccggggcctgtcg

SEQ ID NO: 63376 - DNA, 20 bp, Artificial Sequence
  chemically synthesized
gtggggtggtaggagagagg

SEQ ID NO: 63377 - DNA, 20 bp, Artificial Sequence
  chemically synthesized
agatatatctaatgtaaatg

SEQ ID NO: 63378 - DNA, 20 bp, Artificial Sequence
  chemically synthesized
ctaatgtaaatgacgagtta

SEQ ID NO: 63379 - DNA, 20 bp, Artificial Sequence
  chemically synthesized
tgcacaggtaccgtagaact

SEQ ID NO: 63380 - DNA, 20 bp, Artificial Sequence
  chemically synthesized
agacacacagacaaatggaa

SEQ ID NO: 63381 - DNA, 20 bp, Artificial Sequence
  chemically synthesized
ccctattcaacaagtggtgt

SEQ ID NO: 63382 - DNA, 20 bp, Artificial Sequence
  chemically synthesized
tatacacaaataaactcaag

SEQ ID NO: 63383 - DNA, 20 bp, Artificial Sequence
  chemically synthesized
caaaagcaaaaattgacaaa

SEQ ID NO: 63384 - DNA, 20 bp, Artificial Sequence
  chemically synthesized
acagcaaaagaaactatcaa

SEQ ID NO: 63385 - DNA, 20 bp, Artificial Sequence
  chemically synthesized
tcaactgagtaaacaaccta

SEQ ID NO: 63386 - DNA, 20 bp, Artificial Sequence
  chemically synthesized
tccaacaaaggcctaatatt

SEQ ID NO: 63387 - DNA, 20 bp, Artificial Sequence
  chemically synthesized
agaatctataaggaacttaa

SEQ ID NO: 63388 - DNA, 20 bp, Artificial Sequence
  chemically synthesized
aacaaacaatgccacaaaaa

SEQ ID NO: 63389 - DNA, 20 bp, Artificial Sequence
  chemically synthesized
atagtcaaaaaataacagat

SEQ ID NO: 63390 - DNA, 20 bp, Artificial Sequence
  chemically synthesized
gggtaaggttgtggagaaaa

SEQ ID NO: 63391 - DNA, 20 bp, Artificial Sequence
  chemically synthesized
ttaacccaacaatcctatta

SEQ ID NO: 63392 - DNA, 20 bp, Artificial Sequence
  chemically synthesized
taatcacaatagcaaagaca

SEQ ID NO: 63393 - DNA, 20 bp, Artificial Sequence
  chemically synthesized
gaacatgtacatatacacca

SEQ ID NO: 63394 - DNA, 20 bp, Artificial Sequence
  chemically synthesized
aatactatgtggccataaaa

SEQ ID NO: 63395 - DNA, 20 bp, Artificial Sequence
  chemically synthesized
atcatgtcctttgcaggaac

SEQ ID NO: 63396 - DNA, 20 bp, Artificial Sequence
  chemically synthesized
caaaagacactgcagcctaa

SEQ ID NO: 63397 - DNA, 20 bp, Artificial Sequence
  chemically synthesized
ctgcagcctaattgagtttg

SEQ ID NO: 63398 - DNA, 20 bp, Artificial Sequence
  chemically synthesized
aagagcagaaaaagtaacta

SEQ ID NO: 63399 - DNA, 20 bp, Artificial Sequence
  chemically synthesized
tagctatgtaacaaaccatc

SEQ ID NO: 63400 - DNA, 20 bp, Artificial Sequence
  chemically synthesized
attcagttacttctgacaac

SEQ ID NO: 63401 - DNA, 20 bp, Artificial Sequence
  chemically synthesized
tctcttttttttttttttga

SEQ ID NO: 63402 - DNA, 20 bp, Artificial Sequence
  chemically synthesized
tctcgctgtgttgcccaggt

SEQ ID NO: 63403 - DNA, 20 bp, Artificial Sequence
  chemically synthesized
ttttaaaattttttgtagag

SEQ ID NO: 63404 - DNA, 20 bp, Artificial Sequence
  chemically synthesized
gagattaggaagtgccccga

SEQ ID NO: 63405 - DNA, 20 bp, Artificial Sequence
  chemically synthesized
ccgagagagtgcatagagga

SEQ ID NO: 63406 - DNA, 20 bp, Artificial Sequence
  chemically synthesized
aggagagggtagaagtaaag

SEQ ID NO: 63407 - DNA, 20 bp, Artificial Sequence
  chemically synthesized
tgggtttgctttgttagtga

SEQ ID NO: 63408 - DNA, 20 bp, Artificial Sequence
  chemically synthesized
tccccatccacttgctcatt

SEQ ID NO: 63409 - DNA, 20 bp, Artificial Sequence
  chemically synthesized
cacttgctcattctggatgg

SEQ ID NO: 63410 - DNA, 20 bp, Artificial Sequence
  chemically synthesized
aaaggaaaaagtacatttag

SEQ ID NO: 63411 - DNA, 20 bp, Artificial Sequence
  chemically synthesized
tttagtggggtgtgggactg

SEQ ID NO: 63412 - DNA, 20 bp, Artificial Sequence
  chemically synthesized
gccagcttgcttcccactag

SEQ ID NO: 63413 - DNA, 20 bp, Artificial Sequence
  chemically synthesized
ttcatttattattgtttttc

SEQ ID NO: 63414 - DNA, 20 bp, Artificial Sequence
  chemically synthesized
caggagcaatttaaacttgc

SEQ ID NO: 63415 - DNA, 20 bp, Artificial Sequence
  chemically synthesized
caatttcttcaactacaaat

SEQ ID NO: 63416 - DNA, 20 bp, Artificial Sequence
  chemically synthesized
gaactaaatgtaaatataca

SEQ ID NO: 63417 - DNA, 20 bp, Artificial Sequence
  chemically synthesized
ttttatgacctagcaattta

SEQ ID NO: 63418 - DNA, 20 bp, Artificial Sequence
  chemically synthesized
atatatatacaaaaatatat

SEQ ID NO: 63419 - DNA, 20 bp, Artificial Sequence
  chemically synthesized
actcaaatatctatcaactg

SEQ ID NO: 63420 - DNA, 20 bp, Artificial Sequence
  chemically synthesized
attgtggtatatacataaaa

SEQ ID NO: 63421 - DNA, 20 bp, Artificial Sequence
  chemically synthesized
aactacagtcatacactagt

SEQ ID NO: 63422 - DNA, 20 bp, Artificial Sequence
  chemically synthesized
tgcaattcacaaacataata

SEQ ID NO: 63423 - DNA, 20 bp, Artificial Sequence
  chemically synthesized
acacttttaaaaaaagggac

SEQ ID NO: 63424 - DNA, 20 bp, Artificial Sequence
  chemically synthesized
atgagtcaatcgtgataaaa

SEQ ID NO: 63425 - DNA, 20 bp, Artificial Sequence
  chemically synthesized
gtgataaaaatgaattatat

SEQ ID NO: 63426 - DNA, 20 bp, Artificial Sequence
  chemically synthesized
ttaactttggagacaattag

SEQ ID NO: 63427 - DNA, 20 bp, Artificial Sequence
  chemically synthesized
agacaattagtggaatgata

SEQ ID NO: 63428 - DNA, 20 bp, Artificial Sequence
  chemically synthesized
cctatcttattagttgttac

SEQ ID NO: 63429 - DNA, 20 bp, Artificial Sequence
  chemically synthesized
gtcttttacacacactgtct

SEQ ID NO: 63430 - DNA, 20 bp, Artificial Sequence
  chemically synthesized
gaacttcattgctctctgtt

SEQ ID NO: 63431 - DNA, 20 bp, Artificial Sequence
  chemically synthesized
ctatggacctcttaaactca

SEQ ID NO: 63432 - DNA, 20 bp, Artificial Sequence
  chemically synthesized
ctctaatgcttccaaacttg

SEQ ID NO: 63433 - DNA, 20 bp, Artificial Sequence
  chemically synthesized
aataatcaatttctcacaac

SEQ ID NO: 63434 - DNA, 20 bp, Artificial Sequence
  chemically synthesized
atcataaatactgatagctt

SEQ ID NO: 63435 - DNA, 20 bp, Artificial Sequence
  chemically synthesized
cctatttgtgtcttgcaaca

SEQ ID NO: 63436 - DNA, 20 bp, Artificial Sequence
  chemically synthesized
taagttaatagctttgtttt

SEQ ID NO: 63437 - DNA, 20 bp, Artificial Sequence
  chemically synthesized
taataaattaagagctataa

SEQ ID NO: 63438 - DNA, 20 bp, Artificial Sequence
  chemically synthesized
tactttataaatttcttata

SEQ ID NO: 63439 - DNA, 20 bp, Artificial Sequence
  chemically synthesized
aacagaaaaaaaacgataca

SEQ ID NO: 63440 - DNA, 20 bp, Artificial Sequence
  chemically synthesized
aaaacgatacaaagggtatg

SEQ ID NO: 63441 - DNA, 20 bp, Artificial Sequence
  chemically synthesized
gatacaaagggtatgaagga

SEQ ID NO: 63442 - DNA, 20 bp, Artificial Sequence
  chemically synthesized
caaagggtatgaaggattga

SEQ ID NO: 63443 - DNA, 20 bp, Artificial Sequence
  chemically synthesized
ctacggcaccagtggtcttt

SEQ ID NO: 63444 - DNA, 20 bp, Artificial Sequence
  chemically synthesized
ataaacctttgtcacctcta

SEQ ID NO: 63445 - DNA, 20 bp, Artificial Sequence
  chemically synthesized
tccacagatttagaaattct

SEQ ID NO: 63446 - DNA, 20 bp, Artificial Sequence
  chemically synthesized
tttatttacataaataaaag

SEQ ID NO: 63447 - DNA, 20 bp, Artificial Sequence
  chemically synthesized
tgtcacacaatttaaaaatc

SEQ ID NO: 63448 - DNA, 20 bp, Artificial Sequence
  chemically synthesized
ttgcctcaaataatccctgt

SEQ ID NO: 63449 - DNA, 20 bp, Artificial Sequence
  chemically synthesized
atcctagcaataatatcctg

SEQ ID NO: 63450 - DNA, 20 bp, Artificial Sequence
  chemically synthesized
atccctcatttggttgaggt

SEQ ID NO: 63451 - DNA, 20 bp, Artificial Sequence
  chemically synthesized
tggttgaggttggaatttca

SEQ ID NO: 63452 - DNA, 20 bp, Artificial Sequence
  chemically synthesized
tgaggttggaatttcaatgg

SEQ ID NO: 63453 - DNA, 20 bp, Artificial Sequence
  chemically synthesized
ttggaatttcaatgggtggg

SEQ ID NO: 63454 - DNA, 20 bp, Artificial Sequence
  chemically synthesized
cccttcttgtctttggggac

SEQ ID NO: 63455 - DNA, 20 bp, Artificial Sequence
  chemically synthesized
taggagatttcgccaggcat

SEQ ID NO: 63456 - DNA, 20 bp, Artificial Sequence
  chemically synthesized
tctctcctatgttctgaggt

SEQ ID NO: 63457 - DNA, 20 bp, Artificial Sequence
  chemically synthesized
tagtcatgatctcctctgtt

SEQ ID NO: 63458 - DNA, 20 bp, Artificial Sequence
  chemically synthesized
acataaataattatggtaat

SEQ ID NO: 63459 - DNA, 20 bp, Artificial Sequence
  chemically synthesized
ccctggagaaaaattggacc

SEQ ID NO: 63460 - DNA, 20 bp, Artificial Sequence
  chemically synthesized
tggagtctagcagcctaggt

SEQ ID NO: 63461 - DNA, 20 bp, Artificial Sequence
  chemically synthesized
atttcctttatcttaaaaat

SEQ ID NO: 63462 - DNA, 20 bp, Artificial Sequence
  chemically synthesized
taaaaataagggtattgaag

SEQ ID NO: 63463 - DNA, 20 bp, Artificial Sequence
  chemically synthesized
agggtattgaagtagaattc

SEQ ID NO: 63464 - DNA, 20 bp, Artificial Sequence
  chemically synthesized
ctgttcattttaatatattt

SEQ ID NO: 63465 - DNA, 20 bp, Artificial Sequence
  chemically synthesized
tcattttaatatatttaagg

SEQ ID NO: 63466 - DNA, 20 bp, Artificial Sequence
  chemically synthesized
aaagttgatttcataaaaac

SEQ ID NO: 63467 - DNA, 20 bp, Artificial Sequence
  chemically synthesized
gatggttccataggctgact

SEQ ID NO: 63468 - DNA, 20 bp, Artificial Sequence
  chemically synthesized
gctgactgagagtgtagagg

SEQ ID NO: 63469 - DNA, 20 bp, Artificial Sequence
  chemically synthesized
ttgatcttcagttagactag

SEQ ID NO: 63470 - DNA, 20 bp, Artificial Sequence
  chemically synthesized
aaaaatattttagtaatgat

SEQ ID NO: 63471 - DNA, 20 bp, Artificial Sequence
  chemically synthesized
tctctctgaactagcatatt

SEQ ID NO: 63472 - DNA, 20 bp, Artificial Sequence
  chemically synthesized
agttctttggacaagtctta

SEQ ID NO: 63473 - DNA, 20 bp, Artificial Sequence
  chemically synthesized
tgtccagaaaagaccattaa

SEQ ID NO: 63474 - DNA, 20 bp, Artificial Sequence
  chemically synthesized
cattaaaggaatgaccttta

SEQ ID NO: 63475 - DNA, 20 bp, Artificial Sequence
  chemically synthesized
ttgtccaaggcaggacatgt

SEQ ID NO: 63476 - DNA, 20 bp, Artificial Sequence
  chemically synthesized
actccactgccttggcaaat

SEQ ID NO: 63477 - DNA, 20 bp, Artificial Sequence
  chemically synthesized
ataggaatgttttagttcta

SEQ ID NO: 63478 - DNA, 20 bp, Artificial Sequence
  chemically synthesized
agtaagcaagtaatcacaca

SEQ ID NO: 63479 - DNA, 20 bp, Artificial Sequence
  chemically synthesized
gcatcagaaaagactcctga

SEQ ID NO: 63480 - DNA, 20 bp, Artificial Sequence
  chemically synthesized
cattccagacagtgctcaga

SEQ ID NO: 63481 - DNA, 20 bp, Artificial Sequence
  chemically synthesized
atagtctctatggtggcaac

SEQ ID NO: 63482 - DNA, 20 bp, Artificial Sequence
  chemically synthesized
tgtatctagtctgaagaagc

SEQ ID NO: 63483 - DNA, 20 bp, Artificial Sequence
  chemically synthesized
attttttttttcctttggga

SEQ ID NO: 63484 - DNA, 20 bp, Artificial Sequence
  chemically synthesized
tcttgctctgtcgcccagac

SEQ ID NO: 63485 - DNA, 20 bp, Artificial Sequence
  chemically synthesized
tcactgcaacttccacctcc

SEQ ID NO: 63486 - DNA, 20 bp, Artificial Sequence
  chemically synthesized
gcctcagtctcccaagtaac

SEQ ID NO: 63487 - DNA, 20 bp, Artificial Sequence
  chemically synthesized
tttttgtgttttagtagaga

SEQ ID NO: 63488 - DNA, 20 bp, Artificial Sequence
  chemically synthesized
gcctcggcctcccaaagtgc

SEQ ID NO: 63489 - DNA, 20 bp, Artificial Sequence
  chemically synthesized
ttaacacatacctacattca

SEQ ID NO: 63490 - DNA, 20 bp, Artificial Sequence
  chemically synthesized
ccagatccttgacgatatgt

SEQ ID NO: 63491 - DNA, 20 bp, Artificial Sequence
  chemically synthesized
agagaaatcatgtttgaaat

SEQ ID NO: 63492 - DNA, 20 bp, Artificial Sequence
  chemically synthesized
gattttacacacactttgat

SEQ ID NO: 63493 - DNA, 20 bp, Artificial Sequence
  chemically synthesized
attgtctagctcttatttca

SEQ ID NO: 63494 - DNA, 20 bp, Artificial Sequence
  chemically synthesized
ctaatcttctacagcctcta

SEQ ID NO: 63495 - DNA, 20 bp, Artificial Sequence
  chemically synthesized
ataaactagtatactgtgat

SEQ ID NO: 63496 - DNA, 20 bp, Artificial Sequence
  chemically synthesized
gatgagagtaagttagttaa

SEQ ID NO: 63497 - DNA, 20 bp, Artificial Sequence
  chemically synthesized
actcaaaagttaatggtgaa

SEQ ID NO: 63498 - DNA, 20 bp, Artificial Sequence
  chemically synthesized
ggaattgctgtgcaaatact

SEQ ID NO: 63499 - DNA, 20 bp, Artificial Sequence
  chemically synthesized
ataaagatacctaaatatta

SEQ ID NO: 63500 - DNA, 20 bp, Artificial Sequence
  chemically synthesized
aaggctttttgactatgata

SEQ ID NO: 63501 - DNA, 20 bp, Artificial Sequence
  chemically synthesized
tgtattttacattacgagca

SEQ ID NO: 63502 - DNA, 20 bp, Artificial Sequence
  chemically synthesized
caatgggtaagtgaccatca

SEQ ID NO: 63503 - DNA, 20 bp, Artificial Sequence
  chemically synthesized
tgtgtaaaagtgggcctatc

SEQ ID NO: 63504 - DNA, 20 bp, Artificial Sequence
  chemically synthesized
ttatgcaattgtgttattgg

SEQ ID NO: 63505 - DNA, 20 bp, Artificial Sequence
  chemically synthesized
ttttaagattaaacactcag

SEQ ID NO: 63506 - DNA, 20 bp, Artificial Sequence
  chemically synthesized
ttaaatagccagttgtattc

SEQ ID NO: 63507 - DNA, 20 bp, Artificial Sequence
  chemically synthesized
attcatgaatttgagctctc

SEQ ID NO: 63508 - DNA, 20 bp, Artificial Sequence
  chemically synthesized
ttgagctctcaggagtggtc

SEQ ID NO: 63509 - DNA, 20 bp, Artificial Sequence
  chemically synthesized
agtctgcacattaaggaact

SEQ ID NO: 63510 - DNA, 20 bp, Artificial Sequence
  chemically synthesized
gataccaaaataatagatat

SEQ ID NO: 63511 - DNA, 20 bp, Artificial Sequence
  chemically synthesized
aacttcttgaaaagtgattg

SEQ ID NO: 63512 - DNA, 20 bp, Artificial Sequence
  chemically synthesized
agttgcaagatcgttttaaa

SEQ ID NO: 63513 - DNA, 20 bp, Artificial Sequence
  chemically synthesized
aagaaattgaggaaaagatg

SEQ ID NO: 63514 - DNA, 20 bp, Artificial Sequence
  chemically synthesized
taagttattcaatgctgaga

SEQ ID NO: 63515 - DNA, 20 bp, Artificial Sequence
  chemically synthesized
gaagacgtcagtgtagtata

SEQ ID NO: 63516 - DNA, 20 bp, Artificial Sequence
  chemically synthesized
aaacacaattggccaataca

SEQ ID NO: 63517 - DNA, 20 bp, Artificial Sequence
  chemically synthesized
atacattgaataaatgtata

SEQ ID NO: 63518 - DNA, 20 bp, Artificial Sequence
  chemically synthesized
atagttaatcagctcattaa

SEQ ID NO: 63519 - DNA, 20 bp, Artificial Sequence
  chemically synthesized
ctcattaactgaataaataa

SEQ ID NO: 63520 - DNA, 20 bp, Artificial Sequence
  chemically synthesized
tctacatcacaaaggcacaa

SEQ ID NO: 63521 - DNA, 20 bp, Artificial Sequence
  chemically synthesized
catctggagggggagaaaac

SEQ ID NO: 63522 - DNA, 20 bp, Artificial Sequence
  chemically synthesized
cccaaagattactcttcact

SEQ ID NO: 63523 - DNA, 20 bp, Artificial Sequence
  chemically synthesized
ctcttcacttcgaatgttta

SEQ ID NO: 63524 - DNA, 20 bp, Artificial Sequence
  chemically synthesized
tgtttttgcttatggcttct

SEQ ID NO: 63525 - DNA, 20 bp, Artificial Sequence
  chemically synthesized
agaccattttctcaaaggca

SEQ ID NO: 63526 - DNA, 20 bp, Artificial Sequence
  chemically synthesized
gatactatgtctcaaagaaa

SEQ ID NO: 63527 - DNA, 20 bp, Artificial Sequence
  chemically synthesized
ttttttaagtcagtaagttt

SEQ ID NO: 63528 - DNA, 20 bp, Artificial Sequence
  chemically synthesized
tctcacatgtttctcagttc

SEQ ID NO: 63529 - DNA, 20 bp, Artificial Sequence
  chemically synthesized
cagtaagccctagcaccagc

SEQ ID NO: 63530 - DNA, 20 bp, Artificial Sequence
  chemically synthesized
gaattcttcctttcttctca

SEQ ID NO: 63531 - DNA, 20 bp, Artificial Sequence
  chemically synthesized
tccactgtgtacacagtgct

SEQ ID NO: 63532 - DNA, 20 bp, Artificial Sequence
  chemically synthesized
acagtgctggggatcctgtg

SEQ ID NO: 63533 - DNA, 20 bp, Artificial Sequence
  chemically synthesized
ggatcattcgagagatcagc

SEQ ID NO: 63534 - DNA, 20 bp, Artificial Sequence
  chemically synthesized
catccatggtctgtccttca

SEQ ID NO: 63535 - DNA, 20 bp, Artificial Sequence
  chemically synthesized
tcctccatcctgactaattc

SEQ ID NO: 63536 - DNA, 20 bp, Artificial Sequence
  chemically synthesized
ttgggctcactataataggt

SEQ ID NO: 63537 - DNA, 20 bp, Artificial Sequence
  chemically synthesized
ctcactctttctgcctgcac

SEQ ID NO: 63538 - DNA, 20 bp, Artificial Sequence
  chemically synthesized
tggttatttgcatactgttg

SEQ ID NO: 63539 - DNA, 20 bp, Artificial Sequence
  chemically synthesized
acatccttttcccaccttta

SEQ ID NO: 63540 - DNA, 20 bp, Artificial Sequence
  chemically synthesized
aagacccaacagattcatac

SEQ ID NO: 63541 - DNA, 20 bp, Artificial Sequence
  chemically synthesized
attaaaattgtagatttact

SEQ ID NO: 63542 - DNA, 20 bp, Artificial Sequence
  chemically synthesized
aaaatatttaaatatagtca

SEQ ID NO: 63543 - DNA, 20 bp, Artificial Sequence
  chemically synthesized
tcctttgctgtaaaacaaag

SEQ ID NO: 63544 - DNA, 20 bp, Artificial Sequence
  chemically synthesized
ggagactatagccaactcac

SEQ ID NO: 63545 - DNA, 20 bp, Artificial Sequence
  chemically synthesized
gttgtgatatctgtatggac

SEQ ID NO: 63546 - DNA, 20 bp, Artificial Sequence
  chemically synthesized
ataccataaaatggctaaag

SEQ ID NO: 63547 - DNA, 20 bp, Artificial Sequence
  chemically synthesized
ggacacaaagaaatatgact

SEQ ID NO: 63548 - DNA, 20 bp, Artificial Sequence
  chemically synthesized
ctaccatgtctaatttaaat

SEQ ID NO: 63549 - DNA, 20 bp, Artificial Sequence
  chemically synthesized
tttgcttttatatctaagtg

SEQ ID NO: 63550 - DNA, 20 bp, Artificial Sequence
  chemically synthesized
ctgtccgctaccgacttatt

SEQ ID NO: 63551 - DNA, 20 bp, Artificial Sequence
  chemically synthesized
aatcaggtacaaaactatgc

SEQ ID NO: 63552 - DNA, 20 bp, Artificial Sequence
  chemically synthesized
aattggacaaattaatgcat

SEQ ID NO: 63553 - DNA, 20 bp, Artificial Sequence
  chemically synthesized
gtgaggaaattgtttctgga

SEQ ID NO: 63554 - DNA, 20 bp, Artificial Sequence
  chemically synthesized
agaacaataaattaggtctt

SEQ ID NO: 63555 - DNA, 20 bp, Artificial Sequence
  chemically synthesized
tacagtataaggttaatttg

SEQ ID NO: 63556 - DNA, 20 bp, Artificial Sequence
  chemically synthesized
aaggttaatttgaaggataa

SEQ ID NO: 63557 - DNA, 20 bp, Artificial Sequence
  chemically synthesized
ttaatttgaaggataaagga

SEQ ID NO: 63558 - DNA, 20 bp, Artificial Sequence
  chemically synthesized
gtgaatttcctgatgtcaaa

SEQ ID NO: 63559 - DNA, 20 bp, Artificial Sequence
  chemically synthesized
catagtagctgccgaggcgg

SEQ ID NO: 63560 - DNA, 20 bp, Artificial Sequence
  chemically synthesized
tactcgggaggctgagacag

SEQ ID NO: 63561 - DNA, 20 bp, Artificial Sequence
  chemically synthesized
cccgggaggtggagcttgca

SEQ ID NO: 63562 - DNA, 20 bp, Artificial Sequence
  chemically synthesized
aaaaaaaaagaaaagttgat

SEQ ID NO: 63563 - DNA, 20 bp, Artificial Sequence
  chemically synthesized
catggtccctcctggccgac

SEQ ID NO: 63564 - DNA, 20 bp, Artificial Sequence
  chemically synthesized
atgaaaagagaagttagctg

SEQ ID NO: 63565 - DNA, 20 bp, Artificial Sequence
  chemically synthesized
gctgaatctgtagaggtcat

SEQ ID NO: 63566 - DNA, 20 bp, Artificial Sequence
  chemically synthesized
ttccttctaatgctttgaaa

SEQ ID NO: 63567 - DNA, 20 bp, Artificial Sequence
  chemically synthesized
gacacaacactggggaagca

SEQ ID NO: 63568 - DNA, 20 bp, Artificial Sequence
  chemically synthesized
agccactcatagggaagcat

SEQ ID NO: 63569 - DNA, 20 bp, Artificial Sequence
  chemically synthesized
actcatagggaagcatcaga

SEQ ID NO: 63570 - DNA, 20 bp, Artificial Sequence
  chemically synthesized
atattacatgtctgacacaa

SEQ ID NO: 63571 - DNA, 20 bp, Artificial Sequence
  chemically synthesized
cacaactgagttgttggttt

SEQ ID NO: 63572 - DNA, 20 bp, Artificial Sequence
  chemically synthesized
tgagagttatgtttaacagg

SEQ ID NO: 63573 - DNA, 20 bp, Artificial Sequence
  chemically synthesized
tcatctgaagacttcatact

SEQ ID NO: 63574 - DNA, 20 bp, Artificial Sequence
  chemically synthesized
gcttcagattaggcaaccta

SEQ ID NO: 63575 - DNA, 20 bp, Artificial Sequence
  chemically synthesized
acagttaataaaaaatacct

SEQ ID NO: 63576 - DNA, 20 bp, Artificial Sequence
  chemically synthesized
ataagatttatgaagaactt

SEQ ID NO: 63577 - DNA, 20 bp, Artificial Sequence
  chemically synthesized
tctaaggaaacttgttttcc

SEQ ID NO: 63578 - DNA, 20 bp, Artificial Sequence
  chemically synthesized
agaagtgagaggacatgatt

SEQ ID NO: 63579 - DNA, 20 bp, Artificial Sequence
  chemically synthesized
ggtgcaggagggcatggttt

SEQ ID NO: 63580 - DNA, 20 bp, Artificial Sequence
  chemically synthesized
gatcccttgcatgcctctat

SEQ ID NO: 63581 - DNA, 20 bp, Artificial Sequence
  chemically synthesized
gaggttgtgtctccattccc

SEQ ID NO: 63582 - DNA, 20 bp, Artificial Sequence
  chemically synthesized
tacttgcagaagataattgc

SEQ ID NO: 63583 - DNA, 20 bp, Artificial Sequence
  chemically synthesized
agaagataattgctagagta

SEQ ID NO: 63584 - DNA, 20 bp, Artificial Sequence
  chemically synthesized
gccaagaacacccctgcagt

SEQ ID NO: 63585 - DNA, 20 bp, Artificial Sequence
  chemically synthesized
tcaggttgcagccagaactg

SEQ ID NO: 63586 - DNA, 20 bp, Artificial Sequence
  chemically synthesized
gtaatgttctctttcttggt

SEQ ID NO: 63587 - DNA, 20 bp, Artificial Sequence
  chemically synthesized
tatttatgtatttttctgta

SEQ ID NO: 63588 - DNA, 20 bp, Artificial Sequence
  chemically synthesized
aaaatataaatttaagaaat

SEQ ID NO: 63589 - DNA, 20 bp, Artificial Sequence
  chemically synthesized
ttacatataaacctggcaga

SEQ ID NO: 63590 - DNA, 20 bp, Artificial Sequence
  chemically synthesized
tgattttttaaaaaacagaa

SEQ ID NO: 63591 - DNA, 20 bp, Artificial Sequence
  chemically synthesized
aaatctatatgtctacagaa

SEQ ID NO: 63592 - DNA, 20 bp, Artificial Sequence
  chemically synthesized
ttacttataaagcattcgtg

SEQ ID NO: 63593 - DNA, 20 bp, Artificial Sequence
  chemically synthesized
ggctaaaaatggtagaaaag

SEQ ID NO: 63594 - DNA, 20 bp, Artificial Sequence
  chemically synthesized
acactgggaaattcagtgca

SEQ ID NO: 63595 - DNA, 20 bp, Artificial Sequence
  chemically synthesized
gaaacagagagattatgcaa

SEQ ID NO: 63596 - DNA, 20 bp, Artificial Sequence
  chemically synthesized
attatgcaaaagaatacata

SEQ ID NO: 63597 - DNA, 20 bp, Artificial Sequence
  chemically synthesized
ggactaatagatattggcat

SEQ ID NO: 63598 - DNA, 20 bp, Artificial Sequence
  chemically synthesized
ggcatttgagtattcgctta

SEQ ID NO: 63599 - DNA, 20 bp, Artificial Sequence
  chemically synthesized
tattattatactttaagttt

SEQ ID NO: 63600 - DNA, 20 bp, Artificial Sequence
  chemically synthesized
ccccaccccacaacagtccc

SEQ ID NO: 63601 - DNA, 20 bp, Artificial Sequence
  chemically synthesized
tcattgttcaattcccacct

SEQ ID NO: 63602 - DNA, 20 bp, Artificial Sequence
  chemically synthesized
cgtccttgcgatagtttact

SEQ ID NO: 63603 - DNA, 20 bp, Artificial Sequence
  chemically synthesized
agtctatcattgttggacat

SEQ ID NO: 63604 - DNA, 20 bp, Artificial Sequence
  chemically synthesized
ggttccaagtctttgctatt

SEQ ID NO: 63605 - DNA, 20 bp, Artificial Sequence
  chemically synthesized
atatttcatggtgaggaaca

SEQ ID NO: 63606 - DNA, 20 bp, Artificial Sequence
  chemically synthesized
tgaggaacaaagaatatggt

SEQ ID NO: 63607 - DNA, 20 bp, Artificial Sequence
  chemically synthesized
agaacttttgtgtctagcta

SEQ ID NO: 63608 - DNA, 20 bp, Artificial Sequence
  chemically synthesized
ctgtaaaatggaccaatcag

SEQ ID NO: 63609 - DNA, 20 bp, Artificial Sequence
  chemically synthesized
aatggaccaatcagcaggat

SEQ ID NO: 63610 - DNA, 20 bp, Artificial Sequence
  chemically synthesized
accaatcagcaggatgtggg

SEQ ID NO: 63611 - DNA, 20 bp, Artificial Sequence
  chemically synthesized
agccagctgtgacaactgac

SEQ ID NO: 63612 - DNA, 20 bp, Artificial Sequence
  chemically synthesized
atcttactgctgctcactct

SEQ ID NO: 63613 - DNA, 20 bp, Artificial Sequence
  chemically synthesized
aagaccacgaacccagcatg

SEQ ID NO: 63614 - DNA, 20 bp, Artificial Sequence
  chemically synthesized
gatgaacaacccaagacagg

SEQ ID NO: 63615 - DNA, 20 bp, Artificial Sequence
  chemically synthesized
agagctgtaacactccccgt

SEQ ID NO: 63616 - DNA, 20 bp, Artificial Sequence
  chemically synthesized
cctttgaacacaccatcttt

SEQ ID NO: 63617 - DNA, 20 bp, Artificial Sequence
  chemically synthesized
agaattgtaacactcaccac

SEQ ID NO: 63618 - DNA, 20 bp, Artificial Sequence
  chemically synthesized
cccaccaattccggacacag

SEQ ID NO: 63619 - DNA, 20 bp, Artificial Sequence
  chemically synthesized
aaggatggacaaagattatc

SEQ ID NO: 63620 - DNA, 20 bp, Artificial Sequence
  chemically synthesized
caacacaaaaattacatacc

SEQ ID NO: 63621 - DNA, 20 bp, Artificial Sequence
  chemically synthesized
ttagatccttgatatttgaa

SEQ ID NO: 63622 - DNA, 20 bp, Artificial Sequence
  chemically synthesized
gggggacaggaagtagattt

SEQ ID NO: 63623 - DNA, 20 bp, Artificial Sequence
  chemically synthesized
agtgcagaaaaaaaggacaa

SEQ ID NO: 63624 - DNA, 20 bp, Artificial Sequence
  chemically synthesized
ggggggcatggaggaaaaaa

SEQ ID NO: 63625 - DNA, 20 bp, Artificial Sequence
  chemically synthesized
aggaactccaaaatcttaac

SEQ ID NO: 63626 - DNA, 20 bp, Artificial Sequence
  chemically synthesized
atcttaactggagttcagga

SEQ ID NO: 63627 - DNA, 20 bp, Artificial Sequence
  chemically synthesized
agaacacagcagttgaaatt

SEQ ID NO: 63628 - DNA, 20 bp, Artificial Sequence
  chemically synthesized
aaaaattcatggtaagttaa

SEQ ID NO: 63629 - DNA, 20 bp, Artificial Sequence
  chemically synthesized
aactctcacttattgcttgt

SEQ ID NO: 63630 - DNA, 20 bp, Artificial Sequence
  chemically synthesized
actcctatgtatttacccaa

SEQ ID NO: 63631 - DNA, 20 bp, Artificial Sequence
  chemically synthesized
aaaagttgaaagtaaccaag

SEQ ID NO: 63632 - DNA, 20 bp, Artificial Sequence
  chemically synthesized
gttgaaagtaaccaagatga

SEQ ID NO: 63633 - DNA, 20 bp, Artificial Sequence
  chemically synthesized
gataaactgtggaacatcca

SEQ ID NO: 63634 - DNA, 20 bp, Artificial Sequence
  chemically synthesized
actgtggaacatccatagga

SEQ ID NO: 63635 - DNA, 20 bp, Artificial Sequence
  chemically synthesized
tattcaataatagacaaata

SEQ ID NO: 63636 - DNA, 20 bp, Artificial Sequence
  chemically synthesized
agtttcagacagctattgca

SEQ ID NO: 63637 - DNA, 20 bp, Artificial Sequence
  chemically synthesized
ggtttcatgtcactttggac

SEQ ID NO: 63638 - DNA, 20 bp, Artificial Sequence
  chemically synthesized
cactttggacatgagtaaag

SEQ ID NO: 63639 - DNA, 20 bp, Artificial Sequence
  chemically synthesized
actcccaaatcttgatcaca

SEQ ID NO: 63640 - DNA, 20 bp, Artificial Sequence
  chemically synthesized
gcattaaatatcatttatta

SEQ ID NO: 63641 - DNA, 20 bp, Artificial Sequence
  chemically synthesized
ctgtaaaaaaatacctgaga

SEQ ID NO: 63642 - DNA, 20 bp, Artificial Sequence
  chemically synthesized
atggccaggacagggagaag

SEQ ID NO: 63643 - DNA, 20 bp, Artificial Sequence
  chemically synthesized
actcactatacagtaccaag

SEQ ID NO: 63644 - DNA, 20 bp, Artificial Sequence
  chemically synthesized
tgagaactctgccaccatga

SEQ ID NO: 63645 - DNA, 20 bp, Artificial Sequence
  chemically synthesized
attataatttaacatgatat

SEQ ID NO: 63646 - DNA, 20 bp, Artificial Sequence
  chemically synthesized
acataatggaggtactggca

SEQ ID NO: 63647 - DNA, 20 bp, Artificial Sequence
  chemically synthesized
aaaggggctaaagatcccac

SEQ ID NO: 63648 - DNA, 20 bp, Artificial Sequence
  chemically synthesized
tttcccacccaaatttcttc

SEQ ID NO: 63649 - DNA, 20 bp, Artificial Sequence
  chemically synthesized
ctgtcatggaaggaacacac

SEQ ID NO: 63650 - DNA, 20 bp, Artificial Sequence
  chemically synthesized
aggaacacactgggatgtaa

SEQ ID NO: 63651 - DNA, 20 bp, Artificial Sequence
  chemically synthesized
ctgggatgtaattgaatcat

SEQ ID NO: 63652 - DNA, 20 bp, Artificial Sequence
  chemically synthesized
cacatgctgttctcatgata

SEQ ID NO: 63653 - DNA, 20 bp, Artificial Sequence
  chemically synthesized
tgtaaggcctccccagcaat

SEQ ID NO: 63654 - DNA, 20 bp, Artificial Sequence
  chemically synthesized
ctccccagcaatgtggatct

SEQ ID NO: 63655 - DNA, 20 bp, Artificial Sequence
  chemically synthesized
tctttataaattacccagtc

SEQ ID NO: 63656 - DNA, 20 bp, Artificial Sequence
  chemically synthesized
gctgctcttaagagattgta

SEQ ID NO: 63657 - DNA, 20 bp, Artificial Sequence
  chemically synthesized
gtgcacggtgcaaactgtca

SEQ ID NO: 63658 - DNA, 20 bp, Artificial Sequence
  chemically synthesized
tgtcagtggatctaccattc

SEQ ID NO: 63659 - DNA, 20 bp, Artificial Sequence
  chemically synthesized
ccccagtggagactctgtga

SEQ ID NO: 63660 - DNA, 20 bp, Artificial Sequence
  chemically synthesized
ccctattagaggttcttcat

SEQ ID NO: 63661 - DNA, 20 bp, Artificial Sequence
  chemically synthesized
acagctggtgctggagcagc

SEQ ID NO: 63662 - DNA, 20 bp, Artificial Sequence
  chemically synthesized
cctgaagctgctcaaggcag

SEQ ID NO: 63663 - DNA, 20 bp, Artificial Sequence
  chemically synthesized
ctgctcaaggcagcagggtc

SEQ ID NO: 63664 - DNA, 20 bp, Artificial Sequence
  chemically synthesized
gtgatgtgaggggctgctac

SEQ ID NO: 63665 - DNA, 20 bp, Artificial Sequence
  chemically synthesized
tgcaaatttctacagcctgc

SEQ ID NO: 63666 - DNA, 20 bp, Artificial Sequence
  chemically synthesized
cttaaataatattatcaact

SEQ ID NO: 63667 - DNA, 20 bp, Artificial Sequence
  chemically synthesized
ttcattgtccatatcactat

SEQ ID NO: 63668 - DNA, 20 bp, Artificial Sequence
  chemically synthesized
ctataaggaaatacctgaga

SEQ ID NO: 63669 - DNA, 20 bp, Artificial Sequence
  chemically synthesized
caggccccatcttcaacact

SEQ ID NO: 63670 - DNA, 20 bp, Artificial Sequence
  chemically synthesized
attacagctgaacatgagat

SEQ ID NO: 63671 - DNA, 20 bp, Artificial Sequence
  chemically synthesized
caaaacacaacaacaaaacg

SEQ ID NO: 63672 - DNA, 20 bp, Artificial Sequence
  chemically synthesized
cacaaactccacctggaaag

SEQ ID NO: 63673 - DNA, 20 bp, Artificial Sequence
  chemically synthesized
ccactgagaaactctacagc

SEQ ID NO: 63674 - DNA, 20 bp, Artificial Sequence
  chemically synthesized
aatgttttaagaaagttgtg

SEQ ID NO: 63675 - DNA, 20 bp, Artificial Sequence
  chemically synthesized
gatagcattcaaagccatct

SEQ ID NO: 63676 - DNA, 20 bp, Artificial Sequence
  chemically synthesized
ccaaattacttgttcgaaga

SEQ ID NO: 63677 - DNA, 20 bp, Artificial Sequence
  chemically synthesized
tgttcgaagaaaggatcatc

SEQ ID NO: 63678 - DNA, 20 bp, Artificial Sequence
  chemically synthesized
gatcatctggaattcttttc

SEQ ID NO: 63679 - DNA, 20 bp, Artificial Sequence
  chemically synthesized
aagtatcttacatattgaag

SEQ ID NO: 63680 - DNA, 20 bp, Artificial Sequence
  chemically synthesized
aatccatagaaatttaaaaa

SEQ ID NO: 63681 - DNA, 20 bp, Artificial Sequence
  chemically synthesized
tttctgacatgaacttatgt

SEQ ID NO: 63682 - DNA, 20 bp, Artificial Sequence
  chemically synthesized
taactattatttcatctgca

SEQ ID NO: 63683 - DNA, 20 bp, Artificial Sequence
  chemically synthesized
tgtatcacagcagccgtagt

SEQ ID NO: 63684 - DNA, 20 bp, Artificial Sequence
  chemically synthesized
aaaaaaaattcttcaagttt

SEQ ID NO: 63685 - DNA, 20 bp, Artificial Sequence
  chemically synthesized
acattataataagttatcag

SEQ ID NO: 63686 - DNA, 20 bp, Artificial Sequence
  chemically synthesized
ttatcagcagagtatacctc

SEQ ID NO: 63687 - DNA, 20 bp, Artificial Sequence
  chemically synthesized
attcctttaatttcttttcc

SEQ ID NO: 63688 - DNA, 20 bp, Artificial Sequence
  chemically synthesized
tcactatggtttcaagacct

SEQ ID NO: 63689 - DNA, 20 bp, Artificial Sequence
  chemically synthesized
tccaatcaagatcatccagt

SEQ ID NO: 63690 - DNA, 20 bp, Artificial Sequence
  chemically synthesized
tataggtgaaaaaagcttct

SEQ ID NO: 63691 - DNA, 20 bp, Artificial Sequence
  chemically synthesized
atatggaaggctccacttga

SEQ ID NO: 63692 - DNA, 20 bp, Artificial Sequence
  chemically synthesized
tgaagccagtttttaattcc

SEQ ID NO: 63693 - DNA, 20 bp, Artificial Sequence
  chemically synthesized
ctcattaaagtatccttcaa

SEQ ID NO: 63694 - DNA, 20 bp, Artificial Sequence
  chemically synthesized
taaagtatccttcaagagaa

SEQ ID NO: 63695 - DNA, 20 bp, Artificial Sequence
  chemically synthesized
attaaagggaaataaaatga

SEQ ID NO: 63696 - DNA, 20 bp, Artificial Sequence
  chemically synthesized
atgtattaacttaggtgtca

SEQ ID NO: 63697 - DNA, 20 bp, Artificial Sequence
  chemically synthesized
atgcacaaattataatgaaa

SEQ ID NO: 63698 - DNA, 20 bp, Artificial Sequence
  chemically synthesized
gtgtcatctccttccatggg

SEQ ID NO: 63699 - DNA, 20 bp, Artificial Sequence
  chemically synthesized
ctcaacctgctaaatatctt

SEQ ID NO: 63700 - DNA, 20 bp, Artificial Sequence
  chemically synthesized
agaaaatgcaagtaagtaaa

SEQ ID NO: 63701 - DNA, 20 bp, Artificial Sequence
  chemically synthesized
tttccttgatttttgaccca

SEQ ID NO: 63702 - DNA, 20 bp, Artificial Sequence
  chemically synthesized
atactagacttggctttagc

SEQ ID NO: 63703 - DNA, 20 bp, Artificial Sequence
  chemically synthesized
ttaagtaagtcattttcaaa

SEQ ID NO: 63704 - DNA, 20 bp, Artificial Sequence
  chemically synthesized
agaatattttagttttctct

SEQ ID NO: 63705 - DNA, 20 bp, Artificial Sequence
  chemically synthesized
attttctttgatatgcagat

SEQ ID NO: 63706 - DNA, 20 bp, Artificial Sequence
  chemically synthesized
gaatgttgtacaaagattca

SEQ ID NO: 63707 - DNA, 20 bp, Artificial Sequence
  chemically synthesized
ataaaagtaaatgacagata

SEQ ID NO: 63708 - DNA, 20 bp, Artificial Sequence
  chemically synthesized
aaaatttattcctagtattt

SEQ ID NO: 63709 - DNA, 20 bp, Artificial Sequence
  chemically synthesized
atcaattcaatctcagtttg

SEQ ID NO: 63710 - DNA, 20 bp, Artificial Sequence
  chemically synthesized
gtcctgatgtcatctattgt

SEQ ID NO: 63711 - DNA, 20 bp, Artificial Sequence
  chemically synthesized
tttaaattaaatgacgtgtc

SEQ ID NO: 63712 - DNA, 20 bp, Artificial Sequence
  chemically synthesized
aaatgacgtgtccagggtca

SEQ ID NO: 63713 - DNA, 20 bp, Artificial Sequence
  chemically synthesized
cgtgtccagggtcatagagt

SEQ ID NO: 63714 - DNA, 20 bp, Artificial Sequence
  chemically synthesized
caccacactatctttgctcc

SEQ ID NO: 63715 - DNA, 20 bp, Artificial Sequence
  chemically synthesized
ggatacattcatgattcagt

SEQ ID NO: 63716 - DNA, 20 bp, Artificial Sequence
  chemically synthesized
atatgctgtcagaaatatcc

SEQ ID NO: 63717 - DNA, 20 bp, Artificial Sequence
  chemically synthesized
aaggaacccaggcctataat

SEQ ID NO: 63718 - DNA, 20 bp, Artificial Sequence
  chemically synthesized
ctctggcctagaactgtgtc

SEQ ID NO: 63719 - DNA, 20 bp, Artificial Sequence
  chemically synthesized
atgtaaataaagtagatcca

SEQ ID NO: 63720 - DNA, 20 bp, Artificial Sequence
  chemically synthesized
acctcattccaacttaaagc

SEQ ID NO: 63721 - DNA, 20 bp, Artificial Sequence
  chemically synthesized
agggtaaattgctcagctgt

SEQ ID NO: 63722 - DNA, 20 bp, Artificial Sequence
  chemically synthesized
catcatataaaatttgagac

SEQ ID NO: 63723 - DNA, 20 bp, Artificial Sequence
  chemically synthesized
atcagtatattgaactgtaa

SEQ ID NO: 63724 - DNA, 20 bp, Artificial Sequence
  chemically synthesized
tacttgagaaagggaactta

SEQ ID NO: 63725 - DNA, 20 bp, Artificial Sequence
  chemically synthesized
tctccctggtttagtcttgg

SEQ ID NO: 63726 - DNA, 20 bp, Artificial Sequence
  chemically synthesized
ttgggagggtgtatgtgtcg

SEQ ID NO: 63727 - DNA, 20 bp, Artificial Sequence
  chemically synthesized
gatggtagtttgtatgtctg

SEQ ID NO: 63728 - DNA, 20 bp, Artificial Sequence
  chemically synthesized
tcatttcttattgcatctat

SEQ ID NO: 63729 - DNA, 20 bp, Artificial Sequence
  chemically synthesized
tcttttcaaaaaaccagctc

SEQ ID NO: 63730 - DNA, 20 bp, Artificial Sequence
  chemically synthesized
ctggattcattgattttttt

SEQ ID NO: 63731 - DNA, 20 bp, Artificial Sequence
  chemically synthesized
agttcttttaattgtgatgt

SEQ ID NO: 63732 - DNA, 20 bp, Artificial Sequence
  chemically synthesized
gctgttcagtttccatgtag

SEQ ID NO: 63733 - DNA, 20 bp, Artificial Sequence
  chemically synthesized
ttccatgtagttgagtggtt

SEQ ID NO: 63734 - DNA, 20 bp, Artificial Sequence
  chemically synthesized
atgtagttgagtggttttga

SEQ ID NO: 63735 - DNA, 20 bp, Artificial Sequence
  chemically synthesized
tttgagtgagtttcttaatc

SEQ ID NO: 63736 - DNA, 20 bp, Artificial Sequence
  chemically synthesized
ctgttcttttacgtttgctg

SEQ ID NO: 63737 - DNA, 20 bp, Artificial Sequence
  chemically synthesized
cttccaactatgtggtcaac

SEQ ID NO: 63738 - DNA, 20 bp, Artificial Sequence
  chemically synthesized
aggtgtggtgtggtgctgag

SEQ ID NO: 63739 - DNA, 20 bp, Artificial Sequence
  chemically synthesized
gaatgtatattctattgatt

SEQ ID NO: 63740 - DNA, 20 bp, Artificial Sequence
  chemically synthesized
tattctattgatttgggatg

SEQ ID NO: 63741 - DNA, 20 bp, Artificial Sequence
  chemically synthesized
taggtctgcttggtgcagag

SEQ ID NO: 63742 - DNA, 20 bp, Artificial Sequence
  chemically synthesized
tgcagagctgaattcaattc

SEQ ID NO: 63743 - DNA, 20 bp, Artificial Sequence
  chemically synthesized
gatctgtctaatgttgacag

SEQ ID NO: 63744 - DNA, 20 bp, Artificial Sequence
  chemically synthesized
gtctcccattattattgtgt

SEQ ID NO: 63745 - DNA, 20 bp, Artificial Sequence
  chemically synthesized
ggtctctaaggacttgcttt

SEQ ID NO: 63746 - DNA, 20 bp, Artificial Sequence
  chemically synthesized
taaggacttgctttatgaat

SEQ ID NO: 63747 - DNA, 20 bp, Artificial Sequence
  chemically synthesized
tgaatctgggtgctgctgta

SEQ ID NO: 63748 - DNA, 20 bp, Artificial Sequence
  chemically synthesized
gtattgggtgcatatatatt

SEQ ID NO: 63749 - DNA, 20 bp, Artificial Sequence
  chemically synthesized
aggatagttagctcttcttg

SEQ ID NO: 63750 - DNA, 20 bp, Artificial Sequence
  chemically synthesized
ctccacatgagattggtttc

SEQ ID NO: 63751 - DNA, 20 bp, Artificial Sequence
  chemically synthesized
taaggttaatattgttatgt

SEQ ID NO: 63752 - DNA, 20 bp, Artificial Sequence
  chemically synthesized
caaaaaaagtccaggaccag

SEQ ID NO: 63753 - DNA, 20 bp, Artificial Sequence
  chemically synthesized
aggaccagatggattcacag

SEQ ID NO: 63754 - DNA, 20 bp, Artificial Sequence
  chemically synthesized
ttccaatcaatagaaaaaga

SEQ ID NO: 63755 - DNA, 20 bp, Artificial Sequence
  chemically synthesized
gcagacacacaacaaaaaaa

SEQ ID NO: 63756 - DNA, 20 bp, Artificial Sequence
  chemically synthesized
gatcaagtgggcttcatccc

SEQ ID NO: 63757 - DNA, 20 bp, Artificial Sequence
  chemically synthesized
aacccacagccaatatcata

SEQ ID NO: 63758 - DNA, 20 bp, Artificial Sequence
  chemically synthesized
tttgaaaactggcacaagac

SEQ ID NO: 63759 - DNA, 20 bp, Artificial Sequence
  chemically synthesized
gacaaacagagagccaaatc

SEQ ID NO: 63760 - DNA, 20 bp, Artificial Sequence
  chemically synthesized
ccattcacaattgcctcaaa

SEQ ID NO: 63761 - DNA, 20 bp, Artificial Sequence
  chemically synthesized
tcaaagagaataaaatacct

SEQ ID NO: 63762 - DNA, 20 bp, Artificial Sequence
  chemically synthesized
acctaggaatccaacttaca

SEQ ID NO: 63763 - DNA, 20 bp, Artificial Sequence
  chemically synthesized
cactgctcaacgaaataaaa

SEQ ID NO: 63764 - DNA, 20 bp, Artificial Sequence
  chemically synthesized
tggaagaacattccatgctc

SEQ ID NO: 63765 - DNA, 20 bp, Artificial Sequence
  chemically synthesized
attccatgctcatggatagg

SEQ ID NO: 63766 - DNA, 20 bp, Artificial Sequence
  chemically synthesized
gctaccaatgactttcttca

SEQ ID NO: 63767 - DNA, 20 bp, Artificial Sequence
  chemically synthesized
acaaaaacaagcaatgggga

SEQ ID NO: 63768 - DNA, 20 bp, Artificial Sequence
  chemically synthesized
ccatatgtagaaagctgaaa

SEQ ID NO: 63769 - DNA, 20 bp, Artificial Sequence
  chemically synthesized
tatacaaaaattatttcaag

SEQ ID NO: 63770 - DNA, 20 bp, Artificial Sequence
  chemically synthesized
caaaagacaaaatggacaaa

SEQ ID NO: 63771 - DNA, 20 bp, Artificial Sequence
  chemically synthesized
acagcaaaagaaactaccat

SEQ ID NO: 63772 - DNA, 20 bp, Artificial Sequence
  chemically synthesized
tctgacaaagggctaatatc

SEQ ID NO: 63773 - DNA, 20 bp, Artificial Sequence
  chemically synthesized
acaaacaactgcatcaacaa

SEQ ID NO: 63774 - DNA, 20 bp, Artificial Sequence
  chemically synthesized
actgcatcaacaagggggtg

SEQ ID NO: 63775 - DNA, 20 bp, Artificial Sequence
  chemically synthesized
agatatcatctcacaccagt

SEQ ID NO: 63776 - DNA, 20 bp, Artificial Sequence
  chemically synthesized
aggaaaccacaggtgctgga

SEQ ID NO: 63777 - DNA, 20 bp, Artificial Sequence
  chemically synthesized
agtcagtgtggcaattcctc

SEQ ID NO: 63778 - DNA, 20 bp, Artificial Sequence
  chemically synthesized
ttgacccagccatcctatta

SEQ ID NO: 63779 - DNA, 20 bp, Artificial Sequence
  chemically synthesized
attactgggtatatacccaa

SEQ ID NO: 63780 - DNA, 20 bp, Artificial Sequence
  chemically synthesized
aaatgtccaacaatgataga

SEQ ID NO: 63781 - DNA, 20 bp, Artificial Sequence
  chemically synthesized
aatgtggcacatatacatca

SEQ ID NO: 63782 - DNA, 20 bp, Artificial Sequence
  chemically synthesized
ctatgcagccataaaaaatg

SEQ ID NO: 63783 - DNA, 20 bp, Artificial Sequence
  chemically synthesized
ttcatgtcctttgtagggac

SEQ ID NO: 63784 - DNA, 20 bp, Artificial Sequence
  chemically synthesized
acatattctcactcataggt

SEQ ID NO: 63785 - DNA, 20 bp, Artificial Sequence
  chemically synthesized
tcacacaccggggcctgttg

SEQ ID NO: 63786 - DNA, 20 bp, Artificial Sequence
  chemically synthesized
gtggggtgggggccgggggg

SEQ ID NO: 63787 - DNA, 20 bp, Artificial Sequence
  chemically synthesized
agatatacctaatgtaaatg

SEQ ID NO: 63788 - DNA, 20 bp, Artificial Sequence
  chemically synthesized
ctaatgtaaatgacgagtta

SEQ ID NO: 63789 - DNA, 20 bp, Artificial Sequence
  chemically synthesized
atatacttttttttttgaga

SEQ ID NO: 63790 - DNA, 20 bp, Artificial Sequence
  chemically synthesized
tctcgctctgtcacctaggc

SEQ ID NO: 63791 - DNA, 20 bp, Artificial Sequence
  chemically synthesized
gattctcctgcctcagcctc

SEQ ID NO: 63792 - DNA, 20 bp, Artificial Sequence
  chemically synthesized
gcctcagcctcttgagtagc

SEQ ID NO: 63793 - DNA, 20 bp, Artificial Sequence
  chemically synthesized
ttttgtatttttagtagaga

SEQ ID NO: 63794 - DNA, 20 bp, Artificial Sequence
  chemically synthesized
gcctcagcctctcaaagtgc

SEQ ID NO: 63795 - DNA, 20 bp, Artificial Sequence
  chemically synthesized
cataactctctattttcctt

SEQ ID NO: 63796 - DNA, 20 bp, Artificial Sequence
  chemically synthesized
ttttaccttgataggcagca

SEQ ID NO: 63797 - DNA, 20 bp, Artificial Sequence
  chemically synthesized
actttaaatccagtagggcc

SEQ ID NO: 63798 - DNA, 20 bp, Artificial Sequence
  chemically synthesized
gggtaagaggctgaaagtct

SEQ ID NO: 63799 - DNA, 20 bp, Artificial Sequence
  chemically synthesized
ttcactaatggcactaggcc

SEQ ID NO: 63800 - DNA, 20 bp, Artificial Sequence
  chemically synthesized
ttcgcaatcacactaattcc

SEQ ID NO: 63801 - DNA, 20 bp, Artificial Sequence
  chemically synthesized
gatgtgtggtatgtcctgat

SEQ ID NO: 63802 - DNA, 20 bp, Artificial Sequence
  chemically synthesized
gggctggaaggcttgcatac

SEQ ID NO: 63803 - DNA, 20 bp, Artificial Sequence
  chemically synthesized
catacatttcatctttgtgg

SEQ ID NO: 63804 - DNA, 20 bp, Artificial Sequence
  chemically synthesized
tggccctactctctacagga

SEQ ID NO: 63805 - DNA, 20 bp, Artificial Sequence
  chemically synthesized
atgctaaaccccatcattta

SEQ ID NO: 63806 - DNA, 20 bp, Artificial Sequence
  chemically synthesized
aagaccaaacaaattaaaga

SEQ ID NO: 63807 - DNA, 20 bp, Artificial Sequence
  chemically synthesized
agattaaaaagtctgtttta

SEQ ID NO: 63808 - DNA, 20 bp, Artificial Sequence
  chemically synthesized
aaaaagtctgttttagggaa

SEQ ID NO: 63809 - DNA, 20 bp, Artificial Sequence
  chemically synthesized
ggtgtctatcaaagtgtcca

SEQ ID NO: 63810 - DNA, 20 bp, Artificial Sequence
  chemically synthesized
ttttcagaaatactattttc

SEQ ID NO: 63811 - DNA, 20 bp, Artificial Sequence
  chemically synthesized
gagaaaagagaaatatattt

SEQ ID NO: 63812 - DNA, 20 bp, Artificial Sequence
  chemically synthesized
tcctacgtagagctaggaag

SEQ ID NO: 63813 - DNA, 20 bp, Artificial Sequence
  chemically synthesized
tagagctaggaagtggggtt

SEQ ID NO: 63814 - DNA, 20 bp, Artificial Sequence
  chemically synthesized
ttaagttaaaatgttatccc

SEQ ID NO: 63815 - DNA, 20 bp, Artificial Sequence
  chemically synthesized
atctcacaaagtctcttgta

SEQ ID NO: 63816 - DNA, 20 bp, Artificial Sequence
  chemically synthesized
aatacatatgtattcaacaa

SEQ ID NO: 63817 - DNA, 20 bp, Artificial Sequence
  chemically synthesized
tattcaacaagtgaataata

SEQ ID NO: 63818 - DNA, 20 bp, Artificial Sequence
  chemically synthesized
attaacaaatatgagattgc

SEQ ID NO: 63819 - DNA, 20 bp, Artificial Sequence
  chemically synthesized
atgattgaaaatttctatac

SEQ ID NO: 63820 - DNA, 20 bp, Artificial Sequence
  chemically synthesized
aaaagctagagaagattaag

SEQ ID NO: 63821 - DNA, 20 bp, Artificial Sequence
  chemically synthesized
tccaagaaacttaaataaaa

SEQ ID NO: 63822 - DNA, 20 bp, Artificial Sequence
  chemically synthesized
aaagcctagaacaatgccat

SEQ ID NO: 63823 - DNA, 20 bp, Artificial Sequence
  chemically synthesized
taatttatctacatttatat

SEQ ID NO: 63824 - DNA, 20 bp, Artificial Sequence
  chemically synthesized
acacacacgtttgtgcacca

SEQ ID NO: 63825 - DNA, 20 bp, Artificial Sequence
  chemically synthesized
tatttccattattgggaagg

SEQ ID NO: 63826 - DNA, 20 bp, Artificial Sequence
  chemically synthesized
ctaaatatttaagtgctatt

SEQ ID NO: 63827 - DNA, 20 bp, Artificial Sequence
  chemically synthesized
aataatatgatggaaaatga

SEQ ID NO: 63828 - DNA, 20 bp, Artificial Sequence
  chemically synthesized
tagattgcagtatgatgaca

SEQ ID NO: 63829 - DNA, 20 bp, Artificial Sequence
  chemically synthesized
atgatatcttaaataggtat

SEQ ID NO: 63830 - DNA, 20 bp, Artificial Sequence
  chemically synthesized
aatggtagaagtaaaaatga

SEQ ID NO: 63831 - DNA, 20 bp, Artificial Sequence
  chemically synthesized
gttgagcactcagattctga

SEQ ID NO: 63832 - DNA, 20 bp, Artificial Sequence
  chemically synthesized
tggctgttgctatgcagctg

SEQ ID NO: 63833 - DNA, 20 bp, Artificial Sequence
  chemically synthesized
aaccaaacaattttaaagca

SEQ ID NO: 63834 - DNA, 20 bp, Artificial Sequence
  chemically synthesized
aactgatatggtgttctaga

SEQ ID NO: 63835 - DNA, 20 bp, Artificial Sequence
  chemically synthesized
aaaacaaaaaacaaaaggta

SEQ ID NO: 63836 - DNA, 20 bp, Artificial Sequence
  chemically synthesized
tgctaagtgattgataaggt

SEQ ID NO: 63837 - DNA, 20 bp, Artificial Sequence
  chemically synthesized
aaaaagaccaaattgtaatc

SEQ ID NO: 63838 - DNA, 20 bp, Artificial Sequence
  chemically synthesized
ataagtcacctgaaagtaaa

SEQ ID NO: 63839 - DNA, 20 bp, Artificial Sequence
  chemically synthesized
tgcaagaaccaataggaaaa

SEQ ID NO: 63840 - DNA, 20 bp, Artificial Sequence
  chemically synthesized
tacatgggaggctgaggcag

SEQ ID NO: 63841 - DNA, 20 bp, Artificial Sequence
  chemically synthesized
ggctgaggcaggagaatgat

SEQ ID NO: 63842 - DNA, 20 bp, Artificial Sequence
  chemically synthesized
tggctaaaacagtgttattt

SEQ ID NO: 63843 - DNA, 20 bp, Artificial Sequence
  chemically synthesized
gtttccaccttttggctatt

SEQ ID NO: 63844 - DNA, 20 bp, Artificial Sequence
  chemically synthesized
ttttaatatatacctaggag

SEQ ID NO: 63845 - DNA, 20 bp, Artificial Sequence
  chemically synthesized
tatacctaggagaggaattt

SEQ ID NO: 63846 - DNA, 20 bp, Artificial Sequence
  chemically synthesized
catttttagcagcaatatat

SEQ ID NO: 63847 - DNA, 20 bp, Artificial Sequence
  chemically synthesized
atcatttgcatatttttaaa

SEQ ID NO: 63848 - DNA, 20 bp, Artificial Sequence
  chemically synthesized
agttgtttgtctttttgttt

SEQ ID NO: 63849 - DNA, 20 bp, Artificial Sequence
  chemically synthesized
gtaggactttttcatacatt

SEQ ID NO: 63850 - DNA, 20 bp, Artificial Sequence
  chemically synthesized
atactttttgtgtcatatct

SEQ ID NO: 63851 - DNA, 20 bp, Artificial Sequence
  chemically synthesized
atttacccatgcttccttcc

SEQ ID NO: 63852 - DNA, 20 bp, Artificial Sequence
  chemically synthesized
ggcttttaatccttatttga

SEQ ID NO: 63853 - DNA, 20 bp, Artificial Sequence
  chemically synthesized
caaaaatatagcttgaccaa

SEQ ID NO: 63854 - DNA, 20 bp, Artificial Sequence
  chemically synthesized
tatgaagttgtatataaaaa

SEQ ID NO: 63855 - DNA, 20 bp, Artificial Sequence
  chemically synthesized
tcaaacaacagaaaacagtc

SEQ ID NO: 63856 - DNA, 20 bp, Artificial Sequence
  chemically synthesized
gaaaaattgtttatatgttt

SEQ ID NO: 63857 - DNA, 20 bp, Artificial Sequence
  chemically synthesized
tcccccaaacaaatttcagg

SEQ ID NO: 63858 - DNA, 20 bp, Artificial Sequence
  chemically synthesized
aacaaatttcaggtggaatc

SEQ ID NO: 63859 - DNA, 20 bp, Artificial Sequence
  chemically synthesized
tccactttttactttgtata

SEQ ID NO: 63860 - DNA, 20 bp, Artificial Sequence
  chemically synthesized
tgtatatggaatagcttctt

SEQ ID NO: 63861 - DNA, 20 bp, Artificial Sequence
  chemically synthesized
tgtaactattttatgtttat

SEQ ID NO: 63862 - DNA, 20 bp, Artificial Sequence
  chemically synthesized
ctaatacacccgaagtttct

SEQ ID NO: 63863 - DNA, 20 bp, Artificial Sequence
  chemically synthesized
tcttggttaattgcttcttg

SEQ ID NO: 63864 - DNA, 20 bp, Artificial Sequence
  chemically synthesized
taattgcttcttgagggata

SEQ ID NO: 63865 - DNA, 20 bp, Artificial Sequence
  chemically synthesized
aacagtaacaaatagtatgc

SEQ ID NO: 63866 - DNA, 20 bp, Artificial Sequence
  chemically synthesized
ctaggtaagtatctgaggtc

SEQ ID NO: 63867 - DNA, 20 bp, Artificial Sequence
  chemically synthesized
agtctgaaattgatcatggt

SEQ ID NO: 63868 - DNA, 20 bp, Artificial Sequence
  chemically synthesized
ccctggcccaacacgggaag

SEQ ID NO: 63869 - DNA, 20 bp, Artificial Sequence
  chemically synthesized
tcttatttctgagccccatc

SEQ ID NO: 63870 - DNA, 20 bp, Artificial Sequence
  chemically synthesized
cagaggagcttttctaatct

SEQ ID NO: 63871 - DNA, 20 bp, Artificial Sequence
  chemically synthesized
ctatggatagcaggtggaga

SEQ ID NO: 63872 - DNA, 20 bp, Artificial Sequence
  chemically synthesized
attgtctttatagcaaatat

SEQ ID NO: 63873 - DNA, 20 bp, Artificial Sequence
  chemically synthesized
tcttcagtcataatttccat

SEQ ID NO: 63874 - DNA, 20 bp, Artificial Sequence
  chemically synthesized
atctggcatataggctatgt

SEQ ID NO: 63875 - DNA, 20 bp, Artificial Sequence
  chemically synthesized
cagaacttgatgtgcaataa

SEQ ID NO: 63876 - DNA, 20 bp, Artificial Sequence
  chemically synthesized
gactggaggcagaacattat

SEQ ID NO: 63877 - DNA, 20 bp, Artificial Sequence
  chemically synthesized
ggcatcattcttcacatcat

SEQ ID NO: 63878 - DNA, 20 bp, Artificial Sequence
  chemically synthesized
tatgcactctttcactctta

SEQ ID NO: 63879 - DNA, 20 bp, Artificial Sequence
  chemically synthesized
caattgcctgcatttctggg

SEQ ID NO: 63880 - DNA, 20 bp, Artificial Sequence
  chemically synthesized
ttcttacactatccaggaag

SEQ ID NO: 63881 - DNA, 20 bp, Artificial Sequence
  chemically synthesized
tacactatccaggaagaggg

SEQ ID NO: 63882 - DNA, 20 bp, Artificial Sequence
  chemically synthesized
cttagatcaggctttattac

SEQ ID NO: 63883 - DNA, 20 bp, Artificial Sequence
  chemically synthesized
acagttttatatatttccct

SEQ ID NO: 63884 - DNA, 20 bp, Artificial Sequence
  chemically synthesized
gtgatgacacactttgtgtg

SEQ ID NO: 63885 - DNA, 20 bp, Artificial Sequence
  chemically synthesized
acactttgtgtgctgaatcc

SEQ ID NO: 63886 - DNA, 20 bp, Artificial Sequence
  chemically synthesized
attcagtgacatttggttct

SEQ ID NO: 63887 - DNA, 20 bp, Artificial Sequence
  chemically synthesized
tggttctgggaatatgtaga

SEQ ID NO: 63888 - DNA, 20 bp, Artificial Sequence
  chemically synthesized
ggaaaataatcaggacacaa

SEQ ID NO: 63889 - DNA, 20 bp, Artificial Sequence
  chemically synthesized
cagaaccctgcttacctctg

SEQ ID NO: 63890 - DNA, 20 bp, Artificial Sequence
  chemically synthesized
tctgatggatataaagatgg

SEQ ID NO: 63891 - DNA, 20 bp, Artificial Sequence
  chemically synthesized
tggaaatattttgttgtgtt

SEQ ID NO: 63892 - DNA, 20 bp, Artificial Sequence
  chemically synthesized
tcaattttacatcaaaactt

SEQ ID NO: 63893 - DNA, 20 bp, Artificial Sequence
  chemically synthesized
acagatgattagatttcata

SEQ ID NO: 63894 - DNA, 20 bp, Artificial Sequence
  chemically synthesized
aatacaagtgtggaaaatac

SEQ ID NO: 63895 - DNA, 20 bp, Artificial Sequence
  chemically synthesized
ataattgttgaagttgtgtc

SEQ ID NO: 63896 - DNA, 20 bp, Artificial Sequence
  chemically synthesized
gtgctaatgttaaatcttaa

SEQ ID NO: 63897 - DNA, 20 bp, Artificial Sequence
  chemically synthesized
agaaagctattttattttta

SEQ ID NO: 63898 - DNA, 20 bp, Artificial Sequence
  chemically synthesized
aaaaaggtagggaggaccag

SEQ ID NO: 63899 - DNA, 20 bp, Artificial Sequence
  chemically synthesized
ttctagaaaatccctcagac

SEQ ID NO: 63900 - DNA, 20 bp, Artificial Sequence
  chemically synthesized
tttgttttcttcagataatt

SEQ ID NO: 63901 - DNA, 20 bp, Artificial Sequence
  chemically synthesized
ttgaatttccatgaaccaca

SEQ ID NO: 63902 - DNA, 20 bp, Artificial Sequence
  chemically synthesized
tcctattaaaccacacagtc

SEQ ID NO: 63903 - DNA, 20 bp, Artificial Sequence
  chemically synthesized
ataaaaatatgtatcaagta

SEQ ID NO: 63904 - DNA, 20 bp, Artificial Sequence
  chemically synthesized
gtgaagtcataaaaacaaca

SEQ ID NO: 63905 - DNA, 20 bp, Artificial Sequence
  chemically synthesized
aaaaaaaattctcaaaattt

SEQ ID NO: 63906 - DNA, 20 bp, Artificial Sequence
  chemically synthesized
tatcttgctattagtaattg

SEQ ID NO: 63907 - DNA, 20 bp, Artificial Sequence
  chemically synthesized
ttgctagtagtatgacctgt

SEQ ID NO: 63908 - DNA, 20 bp, Artificial Sequence
  chemically synthesized
tataatttattcatttataa

SEQ ID NO: 63909 - DNA, 20 bp, Artificial Sequence
  chemically synthesized
accaaatctgactacaatac

SEQ ID NO: 63910 - DNA, 20 bp, Artificial Sequence
  chemically synthesized
agtcatcatgccccaagtca

SEQ ID NO: 63911 - DNA, 20 bp, Artificial Sequence
  chemically synthesized
gtcaaagagttaataagtgg

SEQ ID NO: 63912 - DNA, 20 bp, Artificial Sequence
  chemically synthesized
ttcagatttgactttaaaat

SEQ ID NO: 63913 - DNA, 20 bp, Artificial Sequence
  chemically synthesized
atgtataaaggttttctcaa

SEQ ID NO: 63914 - DNA, 20 bp, Artificial Sequence
  chemically synthesized
aagtgtagtcctagatatag

SEQ ID NO: 63915 - DNA, 20 bp, Artificial Sequence
  chemically synthesized
agaaatcacacagtccaaga

SEQ ID NO: 63916 - DNA, 20 bp, Artificial Sequence
  chemically synthesized
tcacacagtccaagagagag

SEQ ID NO: 63917 - DNA, 20 bp, Artificial Sequence
  chemically synthesized
atgaaattttcaaagcgctc

SEQ ID NO: 63918 - DNA, 20 bp, Artificial Sequence
  chemically synthesized
ataaaagaaaactgatattc

SEQ ID NO: 63919 - DNA, 20 bp, Artificial Sequence
  chemically synthesized
tgatattcaagaatatttta

SEQ ID NO: 63920 - DNA, 20 bp, Artificial Sequence
  chemically synthesized
cccagacaaacaaaagttga

SEQ ID NO: 63921 - DNA, 20 bp, Artificial Sequence
  chemically synthesized
atcttgcaaaaaatgctaaa

SEQ ID NO: 63922 - DNA, 20 bp, Artificial Sequence
  chemically synthesized
attaagtacatagacaaacc

SEQ ID NO: 63923 - DNA, 20 bp, Artificial Sequence
  chemically synthesized
tgagacaaaagtcaaaatgt

SEQ ID NO: 63924 - DNA, 20 bp, Artificial Sequence
  chemically synthesized
caaaagtcaaaatgtggggg

SEQ ID NO: 63925 - DNA, 20 bp, Artificial Sequence
  chemically synthesized
gtcaaaatgtgggggtggag

SEQ ID NO: 63926 - DNA, 20 bp, Artificial Sequence
  chemically synthesized
ggtggagtggagttaaagtg

SEQ ID NO: 63927 - DNA, 20 bp, Artificial Sequence
  chemically synthesized
gaaggaaaaaaaaggaagag

SEQ ID NO: 63928 - DNA, 20 bp, Artificial Sequence
  chemically synthesized
atccttacttagtaactaca

SEQ ID NO: 63929 - DNA, 20 bp, Artificial Sequence
  chemically synthesized
agttccccaattaaaagtaa

SEQ ID NO: 63930 - DNA, 20 bp, Artificial Sequence
  chemically synthesized
taaaagtaatagaatggtaa

SEQ ID NO: 63931 - DNA, 20 bp, Artificial Sequence
  chemically synthesized
ggcacacataaatgaaagtg

SEQ ID NO: 63932 - DNA, 20 bp, Artificial Sequence
  chemically synthesized
aaactgtaagaaaagataag

SEQ ID NO: 63933 - DNA, 20 bp, Artificial Sequence
  chemically synthesized
gggtcactgtataataataa

SEQ ID NO: 63934 - DNA, 20 bp, Artificial Sequence
  chemically synthesized
taaaggggtcaattcagcaa

SEQ ID NO: 63935 - DNA, 20 bp, Artificial Sequence
  chemically synthesized
agtatattttctgaccacag

SEQ ID NO: 63936 - DNA, 20 bp, Artificial Sequence
  chemically synthesized
acagtggaataaaactagaa

SEQ ID NO: 63937 - DNA, 20 bp, Artificial Sequence
  chemically synthesized
ggaaatcaaacagtatgctc

SEQ ID NO: 63938 - DNA, 20 bp, Artificial Sequence
  chemically synthesized
tcagaggtgtcagaccacgc

SEQ ID NO: 63939 - DNA, 20 bp, Artificial Sequence
  chemically synthesized
caaatcccacttttctggag

SEQ ID NO: 63940 - DNA, 20 bp, Artificial Sequence
  chemically synthesized
accccttgcccatttttctg

SEQ ID NO: 63941 - DNA, 20 bp, Artificial Sequence
  chemically synthesized
agtcccaactccaagcgtcg

SEQ ID NO: 63942 - DNA, 20 bp, Artificial Sequence
  chemically synthesized
ttttctttatccgacctctc

SEQ ID NO: 63943 - DNA, 20 bp, Artificial Sequence
  chemically synthesized
accttcaaggtgtacaataa

SEQ ID NO: 63944 - DNA, 20 bp, Artificial Sequence
  chemically synthesized
agccaagtagcaacatattt

SEQ ID NO: 63945 - DNA, 20 bp, Artificial Sequence
  chemically synthesized
gaaatctggccaccaggcca

SEQ ID NO: 63946 - DNA, 20 bp, Artificial Sequence
  chemically synthesized
gccaaggaatgcccgcagcc

SEQ ID NO: 63947 - DNA, 20 bp, Artificial Sequence
  chemically synthesized
tttaggtaattctcacagtg

SEQ ID NO: 63948 - DNA, 20 bp, Artificial Sequence
  chemically synthesized
catcccacagcatgctttga

SEQ ID NO: 63949 - DNA, 20 bp, Artificial Sequence
  chemically synthesized
acaagccttacaggttagtt

SEQ ID NO: 63950 - DNA, 20 bp, Artificial Sequence
  chemically synthesized
ctataacccattattctgtt

SEQ ID NO: 63951 - DNA, 20 bp, Artificial Sequence
  chemically synthesized
ctaggcatagttagtgcggt

SEQ ID NO: 63952 - DNA, 20 bp, Artificial Sequence
  chemically synthesized
ctgctattctgctactcctc

SEQ ID NO: 63953 - DNA, 20 bp, Artificial Sequence
  chemically synthesized
cttccctacacatcaagctc

SEQ ID NO: 63954 - DNA, 20 bp, Artificial Sequence
  chemically synthesized
ttagatttactcaacatgcc

SEQ ID NO: 63955 - DNA, 20 bp, Artificial Sequence
  chemically synthesized
agtctaggtagacactttca

SEQ ID NO: 63956 - DNA, 20 bp, Artificial Sequence
  chemically synthesized
ataagtagaggtctttccta

SEQ ID NO: 63957 - DNA, 20 bp, Artificial Sequence
  chemically synthesized
tcagaagtcagacctgtcct

SEQ ID NO: 63958 - DNA, 20 bp, Artificial Sequence
  chemically synthesized
gacctgtcctcagaatgcta

SEQ ID NO: 63959 - DNA, 20 bp, Artificial Sequence
  chemically synthesized
ttccagacaccagaccaact

SEQ ID NO: 63960 - DNA, 20 bp, Artificial Sequence
  chemically synthesized
tctttgctggcaggactatg

SEQ ID NO: 63961 - DNA, 20 bp, Artificial Sequence
  chemically synthesized
tcttattaatataagaagac

SEQ ID NO: 63962 - DNA, 20 bp, Artificial Sequence
  chemically synthesized
ctgtttggtagtctcctcac

SEQ ID NO: 63963 - DNA, 20 bp, Artificial Sequence
  chemically synthesized
tcacagggatgcgcatgaaa

SEQ ID NO: 63964 - DNA, 20 bp, Artificial Sequence
  chemically synthesized
cgcatgaaactgaataacca

SEQ ID NO: 63965 - DNA, 20 bp, Artificial Sequence
  chemically synthesized
atacaacataccaaaaccta

SEQ ID NO: 63966 - DNA, 20 bp, Artificial Sequence
  chemically synthesized
tcaacaaaactttaagaaaa

SEQ ID NO: 63967 - DNA, 20 bp, Artificial Sequence
  chemically synthesized
taaaattagaaaatgaaaaa

SEQ ID NO: 63968 - DNA, 20 bp, Artificial Sequence
  chemically synthesized
ttccaacaaattggaaaatc

SEQ ID NO: 63969 - DNA, 20 bp, Artificial Sequence
  chemically synthesized
aattggaaaatctagaataa

SEQ ID NO: 63970 - DNA, 20 bp, Artificial Sequence
  chemically synthesized
aaaacctcaatagaacaata

SEQ ID NO: 63971 - DNA, 20 bp, Artificial Sequence
  chemically synthesized
tctaaggactgaaataaggc

SEQ ID NO: 63972 - DNA, 20 bp, Artificial Sequence
  chemically synthesized
taaaaaaatcaataaagtta

SEQ ID NO: 63973 - DNA, 20 bp, Artificial Sequence
  chemically synthesized
aataaaaatataaaataccc

SEQ ID NO: 63974 - DNA, 20 bp, Artificial Sequence
  chemically synthesized
attccatgctcatgaactag

SEQ ID NO: 63975 - DNA, 20 bp, Artificial Sequence
  chemically synthesized
actttgtgaggctgaggtgg

SEQ ID NO: 63976 - DNA, 20 bp, Artificial Sequence
  chemically synthesized
ggtggggggatcacgaggtc

SEQ ID NO: 63977 - DNA, 20 bp, Artificial Sequence
  chemically synthesized
tactcaggaggctgaggcag

SEQ ID NO: 63978 - DNA, 20 bp, Artificial Sequence
  chemically synthesized
aagaaacagtgctaggaaaa

SEQ ID NO: 63979 - DNA, 20 bp, Artificial Sequence
  chemically synthesized
aactggatatccatttgcaa

SEQ ID NO: 63980 - DNA, 20 bp, Artificial Sequence
  chemically synthesized
tatacaaaaatcaaatcaag

SEQ ID NO: 63981 - DNA, 20 bp, Artificial Sequence
  chemically synthesized
aatcaagatggattaaagac

SEQ ID NO: 63982 - DNA, 20 bp, Artificial Sequence
  chemically synthesized
ccaaaacaaaaatagacaat

SEQ ID NO: 63983 - DNA, 20 bp, Artificial Sequence
  chemically synthesized
taaagtgaagagacaaccca

SEQ ID NO: 63984 - DNA, 20 bp, Artificial Sequence
  chemically synthesized
tgcaaactatatattttaca

SEQ ID NO: 63985 - DNA, 20 bp, Artificial Sequence
  chemically synthesized
ttttacaaggaattgataac

SEQ ID NO: 63986 - DNA, 20 bp, Artificial Sequence
  chemically synthesized
ataaataatggccaaaagac

SEQ ID NO: 63987 - DNA, 20 bp, Artificial Sequence
  chemically synthesized
aggaaataacagatgcttgt

SEQ ID NO: 63988 - DNA, 20 bp, Artificial Sequence
  chemically synthesized
aaccctcttacactgttggt

SEQ ID NO: 63989 - DNA, 20 bp, Artificial Sequence
  chemically synthesized
tcctaggtatatacccttaa

SEQ ID NO: 63990 - DNA, 20 bp, Artificial Sequence
  chemically synthesized
atgtattcgtcaacagataa

SEQ ID NO: 63991 - DNA, 20 bp, Artificial Sequence
  chemically synthesized
acacacacacacacacacaa

SEQ ID NO: 63992 - DNA, 20 bp, Artificial Sequence
  chemically synthesized
aatattattcaaccataaaa

SEQ ID NO: 63993 - DNA, 20 bp, Artificial Sequence
  chemically synthesized
ctcgtgtggaagttaaaaac

SEQ ID NO: 63994 - DNA, 20 bp, Artificial Sequence
  chemically synthesized
acgtggatcttatgaagaca

SEQ ID NO: 63995 - DNA, 20 bp, Artificial Sequence
  chemically synthesized
ccggcggcgggagggaagaa

SEQ ID NO: 63996 - DNA, 20 bp, Artificial Sequence
  chemically synthesized
gtgtatatatatataaaaat

SEQ ID NO: 63997 - DNA, 20 bp, Artificial Sequence
  chemically synthesized
tcaaaaatggtaaagatggg

SEQ ID NO: 63998 - DNA, 20 bp, Artificial Sequence
  chemically synthesized
actttgggaggccaaggcag

SEQ ID NO: 63999 - DNA, 20 bp, Artificial Sequence
  chemically synthesized
ggcaggtggatcatgaggtc

SEQ ID NO: 64000 - DNA, 20 bp, Artificial Sequence
  chemically synthesized
tacttgggaggcttgggcag

SEQ ID NO: 64001 - DNA, 20 bp, Artificial Sequence
  chemically synthesized
tcctaccactgcactccagc

SEQ ID NO: 64002 - DNA, 20 bp, Artificial Sequence
  chemically synthesized
tttaaaaaatattcagtagg

SEQ ID NO: 64003 - DNA, 20 bp, Artificial Sequence
  chemically synthesized
cagcactttgggaggcggag

SEQ ID NO: 64004 - DNA, 20 bp, Artificial Sequence
  chemically synthesized
actttgggaggcggaggcgg

SEQ ID NO: 64005 - DNA, 20 bp, Artificial Sequence
  chemically synthesized
aaaattagccgggcttggtg

SEQ ID NO: 64006 - DNA, 20 bp, Artificial Sequence
  chemically synthesized
tactatggaggctgaggcgg

SEQ ID NO: 64007 - DNA, 20 bp, Artificial Sequence
  chemically synthesized
acaatgaaaaaaaaataacc

SEQ ID NO: 64008 - DNA, 20 bp, Artificial Sequence
  chemically synthesized
aactcattgacaatgtttca

SEQ ID NO: 64009 - DNA, 20 bp, Artificial Sequence
  chemically synthesized
acaatgtttcaaaggatgtg

SEQ ID NO: 64010 - DNA, 20 bp, Artificial Sequence
  chemically synthesized
tgggctggaaatattgttat

SEQ ID NO: 64011 - DNA, 20 bp, Artificial Sequence
  chemically synthesized
aaggtgacaactaaattatt

SEQ ID NO: 64012 - DNA, 20 bp, Artificial Sequence
  chemically synthesized
actaaattatttggagtaga

SEQ ID NO: 64013 - DNA, 20 bp, Artificial Sequence
  chemically synthesized
agatggagtcaccagcacat

SEQ ID NO: 64014 - DNA, 20 bp, Artificial Sequence
  chemically synthesized
ccagcacatgtgaatagttt

SEQ ID NO: 64015 - DNA, 20 bp, Artificial Sequence
  chemically synthesized
aaattgtttcttagtgacaa

SEQ ID NO: 64016 - DNA, 20 bp, Artificial Sequence
  chemically synthesized
cttagtgacaaaagaataac

SEQ ID NO: 64017 - DNA, 20 bp, Artificial Sequence
  chemically synthesized
attagctgcctatatgctct

SEQ ID NO: 64018 - DNA, 20 bp, Artificial Sequence
  chemically synthesized
gaaattctggaaagagcaca

SEQ ID NO: 64019 - DNA, 20 bp, Artificial Sequence
  chemically synthesized
accagctgtaaaatgtcaag

SEQ ID NO: 64020 - DNA, 20 bp, Artificial Sequence
  chemically synthesized
tcatatgcataagtcttgct

SEQ ID NO: 64021 - DNA, 20 bp, Artificial Sequence
  chemically synthesized
ataatttttttcatttcatt

SEQ ID NO: 64022 - DNA, 20 bp, Artificial Sequence
  chemically synthesized
acatctcactcataaatagt

SEQ ID NO: 64023 - DNA, 20 bp, Artificial Sequence
  chemically synthesized
agaaagagagaaaagaggaa

SEQ ID NO: 64024 - DNA, 20 bp, Artificial Sequence
  chemically synthesized
ccattataatttgtcactat

SEQ ID NO: 64025 - DNA, 20 bp, Artificial Sequence
  chemically synthesized
cttcaataaaataaaatggg

SEQ ID NO: 64026 - DNA, 20 bp, Artificial Sequence
  chemically synthesized
ttgtgtggtaaaaagtagtt

SEQ ID NO: 64027 - DNA, 20 bp, Artificial Sequence
  chemically synthesized
tgaatacagatttttctttt

SEQ ID NO: 64028 - DNA, 20 bp, Artificial Sequence
  chemically synthesized
accaagatatttatttaaat

SEQ ID NO: 64029 - DNA, 20 bp, Artificial Sequence
  chemically synthesized
tgtttgcattaaatgggctt

SEQ ID NO: 64030 - DNA, 20 bp, Artificial Sequence
  chemically synthesized
tgtaaaaaaattttttgcat

SEQ ID NO: 64031 - DNA, 20 bp, Artificial Sequence
  chemically synthesized
gcaagtgtagaaataattac

SEQ ID NO: 64032 - DNA, 20 bp, Artificial Sequence
  chemically synthesized
gagggctgacttaaaatttg

SEQ ID NO: 64033 - DNA, 20 bp, Artificial Sequence
  chemically synthesized
acttctccacacattcataa

SEQ ID NO: 64034 - DNA, 20 bp, Artificial Sequence
  chemically synthesized
cataaaggaatattaaattg

SEQ ID NO: 64035 - DNA, 20 bp, Artificial Sequence
  chemically synthesized
aataaattcatcccgtgttt

SEQ ID NO: 64036 - DNA, 20 bp, Artificial Sequence
  chemically synthesized
agaatgctacagacctcact

SEQ ID NO: 64037 - DNA, 20 bp, Artificial Sequence
  chemically synthesized
cctcactatgagttttactg

SEQ ID NO: 64038 - DNA, 20 bp, Artificial Sequence
  chemically synthesized
gcacatatcctggcaccaaa

SEQ ID NO: 64039 - DNA, 20 bp, Artificial Sequence
  chemically synthesized
agtaaaatttatgacattag

SEQ ID NO: 64040 - DNA, 20 bp, Artificial Sequence
  chemically synthesized
attagctggatgctgttaca

SEQ ID NO: 64041 - DNA, 20 bp, Artificial Sequence
  chemically synthesized
tcacagaacccacaacttaa

SEQ ID NO: 64042 - DNA, 20 bp, Artificial Sequence
  chemically synthesized
acaacttaagggaatgaagc

SEQ ID NO: 64043 - DNA, 20 bp, Artificial Sequence
  chemically synthesized
tccttggagaagaaaaattg

SEQ ID NO: 64044 - DNA, 20 bp, Artificial Sequence
  chemically synthesized
agaagaaaaattggtgagtg

SEQ ID NO: 64045 - DNA, 20 bp, Artificial Sequence
  chemically synthesized
ccagctctcaataataattg

SEQ ID NO: 64046 - DNA, 20 bp, Artificial Sequence
  chemically synthesized
cacatgtcagctctttggtc

SEQ ID NO: 64047 - DNA, 20 bp, Artificial Sequence
  chemically synthesized
agacattgtgattgccatta

SEQ ID NO: 64048 - DNA, 20 bp, Artificial Sequence
  chemically synthesized
ttagaaaaagccagtgactt

SEQ ID NO: 64049 - DNA, 20 bp, Artificial Sequence
  chemically synthesized
aaagccagtgacttatggat

SEQ ID NO: 64050 - DNA, 20 bp, Artificial Sequence
  chemically synthesized
gtgtcataaaactaagcatt

SEQ ID NO: 64051 - DNA, 20 bp, Artificial Sequence
  chemically synthesized
cagcagttgaacatttgttg

SEQ ID NO: 64052 - DNA, 20 bp, Artificial Sequence
  chemically synthesized
gaacatttgttgttgaatat

SEQ ID NO: 64053 - DNA, 20 bp, Artificial Sequence
  chemically synthesized
tttcaaagaacagctacttc

SEQ ID NO: 64054 - DNA, 20 bp, Artificial Sequence
  chemically synthesized
ctttattgaagtgtctagga

SEQ ID NO: 64055 - DNA, 20 bp, Artificial Sequence
  chemically synthesized
ttttaaactcacaacatttc

SEQ ID NO: 64056 - DNA, 20 bp, Artificial Sequence
  chemically synthesized
agcattctctttacattatt

SEQ ID NO: 64057 - DNA, 20 bp, Artificial Sequence
  chemically synthesized
aaaagaaatatattatgttc

SEQ ID NO: 64058 - DNA, 20 bp, Artificial Sequence
  chemically synthesized
tacctctattctctttcatt

SEQ ID NO: 64059 - DNA, 20 bp, Artificial Sequence
  chemically synthesized
ttttacaccaatgtactggt

SEQ ID NO: 64060 - DNA, 20 bp, Artificial Sequence
  chemically synthesized
tggaaatagttaaatactag

SEQ ID NO: 64061 - DNA, 20 bp, Artificial Sequence
  chemically synthesized
ttttgctggttctaatgtat

SEQ ID NO: 64062 - DNA, 20 bp, Artificial Sequence
  chemically synthesized
cctattatggcacagtgcct

SEQ ID NO: 64063 - DNA, 20 bp, Artificial Sequence
  chemically synthesized
gaaaacagtgatgtatctcc

SEQ ID NO: 64064 - DNA, 20 bp, Artificial Sequence
  chemically synthesized
catcttttcctttcaaaact

SEQ ID NO: 64065 - DNA, 20 bp, Artificial Sequence
  chemically synthesized
ctttcaaaactgtgaataag

SEQ ID NO: 64066 - DNA, 20 bp, Artificial Sequence
  chemically synthesized
gtgaataagatggatgattt

SEQ ID NO: 64067 - DNA, 20 bp, Artificial Sequence
  chemically synthesized
aatcagacagactcaatata

SEQ ID NO: 64068 - DNA, 20 bp, Artificial Sequence
  chemically synthesized
ccctctgtgttgacactagt

SEQ ID NO: 64069 - DNA, 20 bp, Artificial Sequence
  chemically synthesized
actagtagggatcccaggcc

SEQ ID NO: 64070 - DNA, 20 bp, Artificial Sequence
  chemically synthesized
ggcctagaatctgtgcagtg

SEQ ID NO: 64071 - DNA, 20 bp, Artificial Sequence
  chemically synthesized
gaatctgtgcagtgctggat

SEQ ID NO: 64072 - DNA, 20 bp, Artificial Sequence
  chemically synthesized
agcattatgccaaagatgct

SEQ ID NO: 64073 - DNA, 20 bp, Artificial Sequence
  chemically synthesized
tgtggttcatccacacattg

SEQ ID NO: 64074 - DNA, 20 bp, Artificial Sequence
  chemically synthesized
catccacacattgcagggta

SEQ ID NO: 64075 - DNA, 20 bp, Artificial Sequence
  chemically synthesized
gtttgtggccttcactgtag

SEQ ID NO: 64076 - DNA, 20 bp, Artificial Sequence
  chemically synthesized
ctccttcttcacacataggt

SEQ ID NO: 64077 - DNA, 20 bp, Artificial Sequence
  chemically synthesized
aaaacatattatttgagatg

SEQ ID NO: 64078 - DNA, 20 bp, Artificial Sequence
  chemically synthesized
tcatggctcatatcaatcag

SEQ ID NO: 64079 - DNA, 20 bp, Artificial Sequence
  chemically synthesized
tcatatcaatcagtgggatt

SEQ ID NO: 64080 - DNA, 20 bp, Artificial Sequence
  chemically synthesized
atgaaagtgagaagtgtgaa

SEQ ID NO: 64081 - DNA, 20 bp, Artificial Sequence
  chemically synthesized
agtgtgaaatgagtgaagta

SEQ ID NO: 64082 - DNA, 20 bp, Artificial Sequence
  chemically synthesized
ttttattctttagcccctgg

SEQ ID NO: 64083 - DNA, 20 bp, Artificial Sequence
  chemically synthesized
cctggttgagttattcttct

SEQ ID NO: 64084 - DNA, 20 bp, Artificial Sequence
  chemically synthesized
ttctaagaatatttctccag

SEQ ID NO: 64085 - DNA, 20 bp, Artificial Sequence
  chemically synthesized
tataaattatgcctttgtca

SEQ ID NO: 64086 - DNA, 20 bp, Artificial Sequence
  chemically synthesized
ttcttgtcaaagaaaatctt

SEQ ID NO: 64087 - DNA, 20 bp, Artificial Sequence
  chemically synthesized
taaaaatttaaatacatttt

SEQ ID NO: 64088 - DNA, 20 bp, Artificial Sequence
  chemically synthesized
tacattttcagagtcataca

SEQ ID NO: 64089 - DNA, 20 bp, Artificial Sequence
  chemically synthesized
atattaaaaatactatacta

SEQ ID NO: 64090 - DNA, 20 bp, Artificial Sequence
  chemically synthesized
ataatagtaaatctggcaca

SEQ ID NO: 64091 - DNA, 20 bp, Artificial Sequence
  chemically synthesized
tggcacagtgaataattctc

SEQ ID NO: 64092 - DNA, 20 bp, Artificial Sequence
  chemically synthesized
gactgaaaggaagagaggtg

SEQ ID NO: 64093 - DNA, 20 bp, Artificial Sequence
  chemically synthesized
agaaataacaagtgtacaca

SEQ ID NO: 64094 - DNA, 20 bp, Artificial Sequence
  chemically synthesized
acaagtgtacacataggatg

SEQ ID NO: 64095 - DNA, 20 bp, Artificial Sequence
  chemically synthesized
cataggatgtggagttcaga

SEQ ID NO: 64096 - DNA, 20 bp, Artificial Sequence
  chemically synthesized
ttgaaatctaaccaaagcag

SEQ ID NO: 64097 - DNA, 20 bp, Artificial Sequence
  chemically synthesized
gtagttacctctgattcttg

SEQ ID NO: 64098 - DNA, 20 bp, Artificial Sequence
  chemically synthesized
cctctgattcttgaggaatg

SEQ ID NO: 64099 - DNA, 20 bp, Artificial Sequence
  chemically synthesized
tgattcttgaggaatgatgg

SEQ ID NO: 64100 - DNA, 20 bp, Artificial Sequence
  chemically synthesized
tctagttttttcaatatggt

SEQ ID NO: 64101 - DNA, 20 bp, Artificial Sequence
  chemically synthesized
cttggggagacaaggaaaat

SEQ ID NO: 64102 - DNA, 20 bp, Artificial Sequence
  chemically synthesized
aaatggctattaatgttgtg

SEQ ID NO: 64103 - DNA, 20 bp, Artificial Sequence
  chemically synthesized
aaagctataatgtgccattg

SEQ ID NO: 64104 - DNA, 20 bp, Artificial Sequence
  chemically synthesized
ttgtctaaaattagtggcat

SEQ ID NO: 64105 - DNA, 20 bp, Artificial Sequence
  chemically synthesized
gctactcatccatcattcct

SEQ ID NO: 64106 - DNA, 20 bp, Artificial Sequence
  chemically synthesized
ttcctttcagtctctctttt

SEQ ID NO: 64107 - DNA, 20 bp, Artificial Sequence
  chemically synthesized
attacataggtacaaactca

SEQ ID NO: 64108 - DNA, 20 bp, Artificial Sequence
  chemically synthesized
ttttttaaggcagggatgat

SEQ ID NO: 64109 - DNA, 20 bp, Artificial Sequence
  chemically synthesized
cataatttataaatcctcct

SEQ ID NO: 64110 - DNA, 20 bp, Artificial Sequence
  chemically synthesized
ctcctggagaaatattctta

SEQ ID NO: 64111 - DNA, 20 bp, Artificial Sequence
  chemically synthesized
gaataactcaaccaggggct

SEQ ID NO: 64112 - DNA, 20 bp, Artificial Sequence
  chemically synthesized
accaggggctaaagaataaa

SEQ ID NO: 64113 - DNA, 20 bp, Artificial Sequence
  chemically synthesized
ttctcactttcattagtcac

SEQ ID NO: 64114 - DNA, 20 bp, Artificial Sequence
  chemically synthesized
ttgatatggttactactgca

SEQ ID NO: 64115 - DNA, 20 bp, Artificial Sequence
  chemically synthesized
tgcaccatagacaagtggat

SEQ ID NO: 64116 - DNA, 20 bp, Artificial Sequence
  chemically synthesized
gagggaccagcaagtaaatg

SEQ ID NO: 64117 - DNA, 20 bp, Artificial Sequence
  chemically synthesized
cagcaagtaaatgctagaaa

SEQ ID NO: 64118 - DNA, 20 bp, Artificial Sequence
  chemically synthesized
cagtactaggcatggggcta

SEQ ID NO: 64119 - DNA, 20 bp, Artificial Sequence
  chemically synthesized
tagatttcaggcacattaaa

SEQ ID NO: 64120 - DNA, 20 bp, Artificial Sequence
  chemically synthesized
tctgtggctcctagcatgcc

SEQ ID NO: 64121 - DNA, 20 bp, Artificial Sequence
  chemically synthesized
atagcaatgagataaatggc

SEQ ID NO: 64122 - DNA, 20 bp, Artificial Sequence
  chemically synthesized
tgtaaaagattcccaatgaa

SEQ ID NO: 64123 - DNA, 20 bp, Artificial Sequence
  chemically synthesized
cccaatgaaagagaatagag

SEQ ID NO: 64124 - DNA, 20 bp, Artificial Sequence
  chemically synthesized
taatatatttctttttatat

SEQ ID NO: 64125 - DNA, 20 bp, Artificial Sequence
  chemically synthesized
ttatattcagaataatgtaa

SEQ ID NO: 64126 - DNA, 20 bp, Artificial Sequence
  chemically synthesized
aataatgtaaagagaatgct

SEQ ID NO: 64127 - DNA, 20 bp, Artificial Sequence
  chemically synthesized
tgggcaaatgaatcatttag

SEQ ID NO: 64128 - DNA, 20 bp, Artificial Sequence
  chemically synthesized
taattttgtgagctctgaca

SEQ ID NO: 64129 - DNA, 20 bp, Artificial Sequence
  chemically synthesized
ggaaagcactatgaataacc

SEQ ID NO: 64130 - DNA, 20 bp, Artificial Sequence
  chemically synthesized
tacattttaagctatacatt

SEQ ID NO: 64131 - DNA, 20 bp, Artificial Sequence
  chemically synthesized
caggaagtagctgttctttg

SEQ ID NO: 64132 - DNA, 20 bp, Artificial Sequence
  chemically synthesized
tttttttttttttttttttg

SEQ ID NO: 64133 - DNA, 20 bp, Artificial Sequence
  chemically synthesized
aaaggaaggtaagtaacaag

SEQ ID NO: 64134 - DNA, 20 bp, Artificial Sequence
  chemically synthesized
aggtaagtaacaaggaagaa

SEQ ID NO: 64135 - DNA, 20 bp, Artificial Sequence
  chemically synthesized
ttctccaaagataatcacaa

SEQ ID NO: 64136 - DNA, 20 bp, Artificial Sequence
  chemically synthesized
aaagataatcacaattagaa

SEQ ID NO: 64137 - DNA, 20 bp, Artificial Sequence
  chemically synthesized
tttgctcttaccagatacct

SEQ ID NO: 64138 - DNA, 20 bp, Artificial Sequence
  chemically synthesized
gaatttattgagctcaaatt

SEQ ID NO: 64139 - DNA, 20 bp, Artificial Sequence
  chemically synthesized
ccgtaattatttctacactt

SEQ ID NO: 64140 - DNA, 20 bp, Artificial Sequence
  chemically synthesized
tcttttcccacaggctaaat

SEQ ID NO: 64141 - DNA, 20 bp, Artificial Sequence
  chemically synthesized
caaggtttttctctttttat

SEQ ID NO: 64142 - DNA, 20 bp, Artificial Sequence
  chemically synthesized
tttttctctttttattcaga

SEQ ID NO: 64143 - DNA, 20 bp, Artificial Sequence
  chemically synthesized
ttaggaagcatactaatggt

SEQ ID NO: 64144 - DNA, 20 bp, Artificial Sequence
  chemically synthesized
aggaaccccatgtgctcttt

SEQ ID NO: 64145 - DNA, 20 bp, Artificial Sequence
  chemically synthesized
tcaggttattcttttgtcac

SEQ ID NO: 64146 - DNA, 20 bp, Artificial Sequence
  chemically synthesized
gccatttgtatggcttcttt

SEQ ID NO: 64147 - DNA, 20 bp, Artificial Sequence
  chemically synthesized
tgaatgccattggtattttg

SEQ ID NO: 64148 - DNA, 20 bp, Artificial Sequence
  chemically synthesized
attagagtaatgcttgcctc

SEQ ID NO: 64149 - DNA, 20 bp, Artificial Sequence
  chemically synthesized
gttgattttgtttacctttc

SEQ ID NO: 64150 - DNA, 20 bp, Artificial Sequence
  chemically synthesized
ttcctgtcttcttatattaa

SEQ ID NO: 64151 - DNA, 20 bp, Artificial Sequence
  chemically synthesized
gtgatattgtggggttgtta

SEQ ID NO: 64152 - DNA, 20 bp, Artificial Sequence
  chemically synthesized
ttagaagaaacatttgtcat

SEQ ID NO: 64153 - DNA, 20 bp, Artificial Sequence
  chemically synthesized
aaccaaatggaataagagaa

SEQ ID NO: 64154 - DNA, 20 bp, Artificial Sequence
  chemically synthesized
gcagggcatgtatgagtagt

SEQ ID NO: 64155 - DNA, 20 bp, Artificial Sequence
  chemically synthesized
ctgaggacaggtctgacttc

SEQ ID NO: 64156 - DNA, 20 bp, Artificial Sequence
  chemically synthesized
ggacaggtctgacttctgag

SEQ ID NO: 64157 - DNA, 20 bp, Artificial Sequence
  chemically synthesized
gaattatgtctgacagaagg

SEQ ID NO: 64158 - DNA, 20 bp, Artificial Sequence
  chemically synthesized
tgaataatccctgaggagta

SEQ ID NO: 64159 - DNA, 20 bp, Artificial Sequence
  chemically synthesized
acagctgaaggagccgggga

SEQ ID NO: 64160 - DNA, 20 bp, Artificial Sequence
  chemically synthesized
gtatatgcatcaggtatgag

SEQ ID NO: 64161 - DNA, 20 bp, Artificial Sequence
  chemically synthesized
aaaatagattttagaagtta

SEQ ID NO: 64162 - DNA, 20 bp, Artificial Sequence
  chemically synthesized
agtaaggtcaagttatttgg

SEQ ID NO: 64163 - DNA, 20 bp, Artificial Sequence
  chemically synthesized
gtgcagtcctggatcttgtg

SEQ ID NO: 64164 - DNA, 20 bp, Artificial Sequence
  chemically synthesized
ggagagcacgtgtgttttta

SEQ ID NO: 64165 - DNA, 20 bp, Artificial Sequence
  chemically synthesized
gaagggtgcaaaggaatagt

SEQ ID NO: 64166 - DNA, 20 bp, Artificial Sequence
  chemically synthesized
aagcatgtttgagatccaga

SEQ ID NO: 64167 - DNA, 20 bp, Artificial Sequence
  chemically synthesized
tacagacttaccctccactg

SEQ ID NO: 64168 - DNA, 20 bp, Artificial Sequence
  chemically synthesized
cctgttgtggggtttgaggt

SEQ ID NO: 64169 - DNA, 20 bp, Artificial Sequence
  chemically synthesized
ttgggtaataaaatgtatat

SEQ ID NO: 64170 - DNA, 20 bp, Artificial Sequence
  chemically synthesized
tgattcgggagaggtcggat

SEQ ID NO: 64171 - DNA, 20 bp, Artificial Sequence
  chemically synthesized
gggagacgtcagatgggtct

SEQ ID NO: 64172 - DNA, 20 bp, Artificial Sequence
  chemically synthesized
gggtctgtagaaaaggaaga

SEQ ID NO: 64173 - DNA, 20 bp, Artificial Sequence
  chemically synthesized
tagggagggaccaatgtgta

SEQ ID NO: 64174 - DNA, 20 bp, Artificial Sequence
  chemically synthesized
acaaaaattatttagatctt

SEQ ID NO: 64175 - DNA, 20 bp, Artificial Sequence
  chemically synthesized
tggagtcaagcggccttgca

SEQ ID NO: 64176 - DNA, 20 bp, Artificial Sequence
  chemically synthesized
ctagtgaaggaggcaagccc

SEQ ID NO: 64177 - DNA, 20 bp, Artificial Sequence
  chemically synthesized
gaaggaggcaagcccagaga

SEQ ID NO: 64178 - DNA, 20 bp, Artificial Sequence
  chemically synthesized
ggttcgggggttcttactca

SEQ ID NO: 64179 - DNA, 20 bp, Artificial Sequence
  chemically synthesized
cagagataagaggtcagggc

SEQ ID NO: 64180 - DNA, 20 bp, Artificial Sequence
  chemically synthesized
cagagataagaggttggggc

SEQ ID NO: 64181 - DNA, 20 bp, Artificial Sequence
  chemically synthesized
cagagataagaggttggggt

SEQ ID NO: 64182 - DNA, 20 bp, Artificial Sequence
  chemically synthesized
cagagataagaggtcggggt

SEQ ID NO: 64183 - DNA, 20 bp, Artificial Sequence
  chemically synthesized
ctgagataagaggttggggc

SEQ ID NO: 64184 - DNA, 20 bp, Artificial Sequence
  chemically synthesized
agggattggggttcttgccc

SEQ ID NO: 64185 - DNA, 20 bp, Artificial Sequence
  chemically synthesized
gttggggtacttacccccct

SEQ ID NO: 64186 - DNA, 20 bp, Artificial Sequence
  chemically synthesized
ggaattgaaattaagagaag

SEQ ID NO: 64187 - DNA, 20 bp, Artificial Sequence
  chemically synthesized
gtgtggtgccaagattgaaa

SEQ ID NO: 64188 - DNA, 20 bp, Artificial Sequence
  chemically synthesized
gtggaatgtcatcagttaag

SEQ ID NO: 64189 - DNA, 20 bp, Artificial Sequence
  chemically synthesized
ctagttttattccactgtgg

SEQ ID NO: 64190 - DNA, 20 bp, Artificial Sequence
  chemically synthesized
aatgttgtacatgctgcttt

SEQ ID NO: 64191 - DNA, 20 bp, Artificial Sequence
  chemically synthesized
tgtggttaccatggggctta

SEQ ID NO: 64192 - DNA, 20 bp, Artificial Sequence
  chemically synthesized
tactatatctaggactacac

SEQ ID NO: 64193 - DNA, 20 bp, Artificial Sequence
  chemically synthesized
gtatttatttattgtaagca

SEQ ID NO: 64194 - DNA, 20 bp, Artificial Sequence
  chemically synthesized
gtgttggttgaggaagtaga

SEQ ID NO: 64195 - DNA, 20 bp, Artificial Sequence
  chemically synthesized
cccttttataaagatcctct

SEQ ID NO: 64196 - DNA, 20 bp, Artificial Sequence
  chemically synthesized
ttgtcctcatgaatctcaaa

SEQ ID NO: 64197 - DNA, 20 bp, Artificial Sequence
  chemically synthesized
ctcaaaggagaaaatggttt

SEQ ID NO: 64198 - DNA, 20 bp, Artificial Sequence
  chemically synthesized
cactgataatatggtgggct

SEQ ID NO: 64199 - DNA, 20 bp, Artificial Sequence
  chemically synthesized
ggtacactatagctcgtgac

SEQ ID NO: 64200 - DNA, 20 bp, Artificial Sequence
  chemically synthesized
tagttttttcatgtatacca

SEQ ID NO: 64201 - DNA, 20 bp, Artificial Sequence
  chemically synthesized
tctaaattactctgaaattt

SEQ ID NO: 64202 - DNA, 20 bp, Artificial Sequence
  chemically synthesized
ataaattaatttcgaggaaa

SEQ ID NO: 64203 - DNA, 20 bp, Artificial Sequence
  chemically synthesized
atggaaattcaaaattatct

SEQ ID NO: 64204 - DNA, 20 bp, Artificial Sequence
  chemically synthesized
atccctgtctgagggatttt

SEQ ID NO: 64205 - DNA, 20 bp, Artificial Sequence
  chemically synthesized
cacactgagtataatttttt

SEQ ID NO: 64206 - DNA, 20 bp, Artificial Sequence
  chemically synthesized
tttttaagaatctttttatt

SEQ ID NO: 64207 - DNA, 20 bp, Artificial Sequence
  chemically synthesized
ttgtaaactacacaaagtaa

SEQ ID NO: 64208 - DNA, 20 bp, Artificial Sequence
  chemically synthesized
ttgatgtaaaattgatgtac

SEQ ID NO: 64209 - DNA, 20 bp, Artificial Sequence
  chemically synthesized
aacaaaatatttccatctcc

SEQ ID NO: 64210 - DNA, 20 bp, Artificial Sequence
  chemically synthesized
tatcactaattttaatataa

SEQ ID NO: 64211 - DNA, 20 bp, Artificial Sequence
  chemically synthesized
agctatttccagtactgtat

SEQ ID NO: 64212 - DNA, 20 bp, Artificial Sequence
  chemically synthesized
ctgtatgaagaatcagcaca

SEQ ID NO: 64213 - DNA, 20 bp, Artificial Sequence
  chemically synthesized
tgtgtgagggtattgtggcc

SEQ ID NO: 64214 - DNA, 20 bp, Artificial Sequence
  chemically synthesized
acagaaaggcagacgcctca

SEQ ID NO: 64215 - DNA, 20 bp, Artificial Sequence
  chemically synthesized
aggcaatggcggcacccgtc

SEQ ID NO: 64216 - DNA, 20 bp, Artificial Sequence
  chemically synthesized
cccagaaatgcaggcaattg

SEQ ID NO: 64217 - DNA, 20 bp, Artificial Sequence
  chemically synthesized
ccataagagtgaaagagtgc

SEQ ID NO: 64218 - DNA, 20 bp, Artificial Sequence
  chemically synthesized
ttcaacaaaggccggcatgg

SEQ ID NO: 64219 - DNA, 20 bp, Artificial Sequence
  chemically synthesized
agagtcaattcggatgatgt

SEQ ID NO: 64220 - DNA, 20 bp, Artificial Sequence
  chemically synthesized
gtcatatctaagacatttcc

SEQ ID NO: 64221 - DNA, 20 bp, Artificial Sequence
  chemically synthesized
ggtaagccacagtgagtgga

SEQ ID NO: 64222 - DNA, 20 bp, Artificial Sequence
  chemically synthesized
agagaaacctaatgggtcat

SEQ ID NO: 64223 - DNA, 20 bp, Artificial Sequence
  chemically synthesized
atatgccagataaggcatta

SEQ ID NO: 64224 - DNA, 20 bp, Artificial Sequence
  chemically synthesized
ttcacatggaaattatgact

SEQ ID NO: 64225 - DNA, 20 bp, Artificial Sequence
  chemically synthesized
atatagtaaatattaaatgt

SEQ ID NO: 64226 - DNA, 20 bp, Artificial Sequence
  chemically synthesized
gaacacaaggatagtttctc

SEQ ID NO: 64227 - DNA, 20 bp, Artificial Sequence
  chemically synthesized
ctccacctgctatccataga

SEQ ID NO: 64228 - DNA, 20 bp, Artificial Sequence
  chemically synthesized
ttaggtattaacgttggagg

SEQ ID NO: 64229 - DNA, 20 bp, Artificial Sequence
  chemically synthesized
aatggaattcaggatggggc

SEQ ID NO: 64230 - DNA, 20 bp, Artificial Sequence
  chemically synthesized
ttcaggatggggctcagaaa

SEQ ID NO: 64231 - DNA, 20 bp, Artificial Sequence
  chemically synthesized
gttgactggaggacatagag

SEQ ID NO: 64232 - DNA, 20 bp, Artificial Sequence
  chemically synthesized
tccctcaagaagcaattaac

SEQ ID NO: 64233 - DNA, 20 bp, Artificial Sequence
  chemically synthesized
ttaaccaagaataattattc

SEQ ID NO: 64234 - DNA, 20 bp, Artificial Sequence
  chemically synthesized
agaaacttcgggtgtattag

SEQ ID NO: 64235 - DNA, 20 bp, Artificial Sequence
  chemically synthesized
tgtttgggggacttgggtaa

SEQ ID NO: 64236 - DNA, 20 bp, Artificial Sequence
  chemically synthesized
gttcatgcaacaaacgactt

SEQ ID NO: 64237 - DNA, 20 bp, Artificial Sequence
  chemically synthesized
gtatttcataagtttaatat

SEQ ID NO: 64238 - DNA, 20 bp, Artificial Sequence
  chemically synthesized
atgatgggaatgagtaattt

SEQ ID NO: 64239 - DNA, 20 bp, Artificial Sequence
  chemically synthesized
aagacactacttcaaactta

SEQ ID NO: 64240 - DNA, 20 bp, Artificial Sequence
  chemically synthesized
actagaatgtctatacttta

SEQ ID NO: 64241 - DNA, 20 bp, Artificial Sequence
  chemically synthesized
aacaagtgttgacaaagata

SEQ ID NO: 64242 - DNA, 20 bp, Artificial Sequence
  chemically synthesized
tgttaagtggtgcaacttct

SEQ ID NO: 64243 - DNA, 20 bp, Artificial Sequence
  chemically synthesized
tagccaaaaggtggaaacaa

SEQ ID NO: 64244 - DNA, 20 bp, Artificial Sequence
  chemically synthesized
gaatattatgtagcaataaa

SEQ ID NO: 64245 - DNA, 20 bp, Artificial Sequence
  chemically synthesized
ttttagccaacactgttaga

SEQ ID NO: 64246 - DNA, 20 bp, Artificial Sequence
  chemically synthesized
tggcttaaagtttcagtttc

SEQ ID NO: 64247 - DNA, 20 bp, Artificial Sequence
  chemically synthesized
tatctaaaatagactgattt

SEQ ID NO: 64248 - DNA, 20 bp, Artificial Sequence
  chemically synthesized
ctttatcacaataaaaatgg

SEQ ID NO: 64249 - DNA, 20 bp, Artificial Sequence
  chemically synthesized
tttattatgagttgtttctg

SEQ ID NO: 64250 - DNA, 20 bp, Artificial Sequence
  chemically synthesized
gctcactgcaacctccgcct

SEQ ID NO: 64251 - DNA, 20 bp, Artificial Sequence
  chemically synthesized
aaatgatcatatcatataca

SEQ ID NO: 64252 - DNA, 20 bp, Artificial Sequence
  chemically synthesized
ataaaggcaaagatgtaaat

SEQ ID NO: 64253 - DNA, 20 bp, Artificial Sequence
  chemically synthesized
cagccatttcctaaatcctt

SEQ ID NO: 64254 - DNA, 20 bp, Artificial Sequence
  chemically synthesized
catcatattattacttttat

SEQ ID NO: 64255 - DNA, 20 bp, Artificial Sequence
  chemically synthesized
cgctgagtgtaaatttcaca

SEQ ID NO: 64256 - DNA, 20 bp, Artificial Sequence
  chemically synthesized
tgtccaaaacattgtgtaga

SEQ ID NO: 64257 - DNA, 20 bp, Artificial Sequence
  chemically synthesized
atgaagtttaacagatgtac

SEQ ID NO: 64258 - DNA, 20 bp, Artificial Sequence
  chemically synthesized
aaatatttagtgtagtacta

SEQ ID NO: 64259 - DNA, 20 bp, Artificial Sequence
  chemically synthesized
aaacaaattaattagatttt

SEQ ID NO: 64260 - DNA, 20 bp, Artificial Sequence
  chemically synthesized
tataaatttctataaaaatc

SEQ ID NO: 64261 - DNA, 20 bp, Artificial Sequence
  chemically synthesized
aatttatttatcacccaggt

SEQ ID NO: 64262 - DNA, 20 bp, Artificial Sequence
  chemically synthesized
ctttgtgagatgtcagtgag

SEQ ID NO: 64263 - DNA, 20 bp, Artificial Sequence
  chemically synthesized
cgggagtgttgtacatttca

SEQ ID NO: 64264 - DNA, 20 bp, Artificial Sequence
  chemically synthesized
aatagtatttctgaaaaaat

SEQ ID NO: 64265 - DNA, 20 bp, Artificial Sequence
  chemically synthesized
taacagcatacactgatagg

SEQ ID NO: 64266 - DNA, 20 bp, Artificial Sequence
  chemically synthesized
tttacctccaaagcgatggg

SEQ ID NO: 64267 - DNA, 20 bp, Artificial Sequence
  chemically synthesized
aagcgatgggcaagaaatga

SEQ ID NO: 64268 - DNA, 20 bp, Artificial Sequence
  chemically synthesized
gcggtcaaatgccattgcca

SEQ ID NO: 64269 - DNA, 20 bp, Artificial Sequence
  chemically synthesized
caacagccacaatgtacata

SEQ ID NO: 64270 - DNA, 20 bp, Artificial Sequence
  chemically synthesized
tgggaattagtgtgattgcg

SEQ ID NO: 64271 - DNA, 20 bp, Artificial Sequence
  chemically synthesized
aagactacaaagttgaggat

SEQ ID NO: 64272 - DNA, 20 bp, Artificial Sequence
  chemically synthesized
gaaatttagttgtgctgctt

SEQ ID NO: 64273 - DNA, 20 bp, Artificial Sequence
  chemically synthesized
ctactcaagaggctgaggca

SEQ ID NO: 64274 - DNA, 20 bp, Artificial Sequence
  chemically synthesized
gtatatgcctcataggtggt

SEQ ID NO: 64275 - DNA, 20 bp, Artificial Sequence
  chemically synthesized
gttcaactcccacctatgag

SEQ ID NO: 64276 - DNA, 20 bp, Artificial Sequence
  chemically synthesized
tcgtccttgcgatactttgc

SEQ ID NO: 64277 - DNA, 20 bp, Artificial Sequence
  chemically synthesized
gtagttttttccaattctgt

SEQ ID NO: 64278 - DNA, 20 bp, Artificial Sequence
  chemically synthesized
agctcctccttgtacctctg

SEQ ID NO: 64279 - DNA, 20 bp, Artificial Sequence
  chemically synthesized
tggtaagcttcataagtgaa

SEQ ID NO: 64280 - DNA, 20 bp, Artificial Sequence
  chemically synthesized
gaaggaagcagtaaacatgg

SEQ ID NO: 64281 - DNA, 20 bp, Artificial Sequence
  chemically synthesized
gtaaagaccatcaaggctag

SEQ ID NO: 64282 - DNA, 20 bp, Artificial Sequence
  chemically synthesized
acattagacagatcaacgag

SEQ ID NO: 64283 - DNA, 20 bp, Artificial Sequence
  chemically synthesized
gaactctccatcccaaatca

SEQ ID NO: 64284 - DNA, 20 bp, Artificial Sequence
  chemically synthesized
tcctcagcaaacgtaaaaga

SEQ ID NO: 64285 - DNA, 20 bp, Artificial Sequence
  chemically synthesized
atcaaactagaactcaggat

SEQ ID NO: 64286 - DNA, 20 bp, Artificial Sequence
  chemically synthesized
gggtacataacaaaatgaag

SEQ ID NO: 64287 - DNA, 20 bp, Artificial Sequence
  chemically synthesized
aagatgttctttgaaaccaa

SEQ ID NO: 64288 - DNA, 20 bp, Artificial Sequence
  chemically synthesized
gagaataaagatacaacaaa

SEQ ID NO: 64289 - DNA, 20 bp, Artificial Sequence
  chemically synthesized
tatagcactaaatgcccaca

SEQ ID NO: 64290 - DNA, 20 bp, Artificial Sequence
  chemically synthesized
tttcaaaagctagcggaagg

SEQ ID NO: 64291 - DNA, 20 bp, Artificial Sequence
  chemically synthesized
ctgctagcaagactaataaa

SEQ ID NO: 64292 - DNA, 20 bp, Artificial Sequence
  chemically synthesized
gaagactcaaatagatgcaa

SEQ ID NO: 64293 - DNA, 20 bp, Artificial Sequence
  chemically synthesized
cagacatacaaactaccatc

SEQ ID NO: 64294 - DNA, 20 bp, Artificial Sequence
  chemically synthesized
aacacctctacgcaaataaa

SEQ ID NO: 64295 - DNA, 20 bp, Artificial Sequence
  chemically synthesized
caaataaactagaaaatcta

SEQ ID NO: 64296 - DNA, 20 bp, Artificial Sequence
  chemically synthesized
ccctcccaagactaaaccag

SEQ ID NO: 64297 - DNA, 20 bp, Artificial Sequence
  chemically synthesized
ctagctagctagctagctag

SEQ ID NO: 64298 - DNA, 20 bp, Artificial Sequence
  chemically synthesized
tttgaggtggcacaggggct

SEQ ID NO: 64299 - DNA, 20 bp, Artificial Sequence
  chemically synthesized
cccattttttgagttacagt

SEQ ID NO: 64300 - DNA, 20 bp, Artificial Sequence
  chemically synthesized
ttaatatatatctcacattg

SEQ ID NO: 64301 - DNA, 20 bp, Artificial Sequence
  chemically synthesized
aagtaaactgttgatgtttc

SEQ ID NO: 64302 - DNA, 20 bp, Artificial Sequence
  chemically synthesized
gttgatgtttcagagaaagg

SEQ ID NO: 64303 - DNA, 20 bp, Artificial Sequence
  chemically synthesized
aggacattagggatgggaga

SEQ ID NO: 64304 - DNA, 20 bp, Artificial Sequence
  chemically synthesized
caggaatgaagataaggggg

SEQ ID NO: 64305 - DNA, 20 bp, Artificial Sequence
  chemically synthesized
agcaaagatagtgtggtgta

SEQ ID NO: 64306 - DNA, 20 bp, Artificial Sequence
  chemically synthesized
actgagccttgttttaacta

SEQ ID NO: 64307 - DNA, 20 bp, Artificial Sequence
  chemically synthesized
aacattcaaatctgcatatc

SEQ ID NO: 64308 - DNA, 20 bp, Artificial Sequence
  chemically synthesized
cattatttaaacatattcta

SEQ ID NO: 64309 - DNA, 20 bp, Artificial Sequence
  chemically synthesized
gttagatgattaagttatcg

SEQ ID NO: 64310 - DNA, 20 bp, Artificial Sequence
  chemically synthesized
agtttacttacttgcatttt

SEQ ID NO: 64311 - DNA, 20 bp, Artificial Sequence
  chemically synthesized
ttctggtacatagtccacag

SEQ ID NO: 64312 - DNA, 20 bp, Artificial Sequence
  chemically synthesized
ttggtcacatggtaaatggg

SEQ ID NO: 64313 - DNA, 20 bp, Artificial Sequence
  chemically synthesized
tgggtcagaatctgaagggc

SEQ ID NO: 64314 - DNA, 20 bp, Artificial Sequence
  chemically synthesized
atacagatgaagataaaaag

SEQ ID NO: 64315 - DNA, 20 bp, Artificial Sequence
  chemically synthesized
gtgattttctgatatttttc

SEQ ID NO: 64316 - DNA, 20 bp, Artificial Sequence
  chemically synthesized
gtgctatatggtgggagata

SEQ ID NO: 64317 - DNA, 20 bp, Artificial Sequence
  chemically synthesized
accttgcttttttagacatt

SEQ ID NO: 64318 - DNA, 20 bp, Artificial Sequence
  chemically synthesized
tcttcccacctatccttgga

SEQ ID NO: 64319 - DNA, 20 bp, Artificial Sequence
  chemically synthesized
taaaggaatcaaaggatatt

SEQ ID NO: 64320 - DNA, 20 bp, Artificial Sequence
  chemically synthesized
gatattatagaaaaagagat

SEQ ID NO: 64321 - DNA, 20 bp, Artificial Sequence
  chemically synthesized
aagagatggagaaaggacaa

SEQ ID NO: 64322 - DNA, 20 bp, Artificial Sequence
  chemically synthesized
caaggagaatttaggggaca

SEQ ID NO: 64323 - DNA, 20 bp, Artificial Sequence
  chemically synthesized
ctgatagtgacaggaagaac

SEQ ID NO: 64324 - DNA, 20 bp, Artificial Sequence
  chemically synthesized
agtgacaggaagaacaaaga

SEQ ID NO: 64325 - DNA, 20 bp, Artificial Sequence
  chemically synthesized
atctggggactctaaaactt

SEQ ID NO: 64326 - DNA, 20 bp, Artificial Sequence
  chemically synthesized
cagtctttgagccacatgct

SEQ ID NO: 64327 - DNA, 20 bp, Artificial Sequence
  chemically synthesized
agggaacatgtaagtattat

SEQ ID NO: 64328 - DNA, 20 bp, Artificial Sequence
  chemically synthesized
aattctcacataagttcatg

SEQ ID NO: 64329 - DNA, 20 bp, Artificial Sequence
  chemically synthesized
ggacttgagtggaggaaatc

SEQ ID NO: 64330 - DNA, 20 bp, Artificial Sequence
  chemically synthesized
tgagtggaggaaatccaaga

SEQ ID NO: 64331 - DNA, 20 bp, Artificial Sequence
  chemically synthesized
agtaaagctgggagttggtg

SEQ ID NO: 64332 - DNA, 20 bp, Artificial Sequence
  chemically synthesized
agttggtgccagaaaagaga

SEQ ID NO: 64333 - DNA, 20 bp, Artificial Sequence
  chemically synthesized
gatttttcccctgccacatt

SEQ ID NO: 64334 - DNA, 20 bp, Artificial Sequence
  chemically synthesized
tagagatgatctttatctgg

SEQ ID NO: 64335 - DNA, 20 bp, Artificial Sequence
  chemically synthesized
ccaatacgactgcttgtatt

SEQ ID NO: 64336 - DNA, 20 bp, Artificial Sequence
  chemically synthesized
ggtatttccttatagcaaga

SEQ ID NO: 64337 - DNA, 20 bp, Artificial Sequence
  chemically synthesized
caagatgagaatggaccagt

SEQ ID NO: 64338 - DNA, 20 bp, Artificial Sequence
  chemically synthesized
gaagaagacagggagatgag

SEQ ID NO: 64339 - DNA, 20 bp, Artificial Sequence
  chemically synthesized
ctgcactgtgcctctacctt

SEQ ID NO: 64340 - DNA, 20 bp, Artificial Sequence
  chemically synthesized
ctatgctcatatgtgtgagc

SEQ ID NO: 64341 - DNA, 20 bp, Artificial Sequence
  chemically synthesized
attatctgctcggccatgtg

SEQ ID NO: 64342 - DNA, 20 bp, Artificial Sequence
  chemically synthesized
aggagcaattcaagcaggct

SEQ ID NO: 64343 - DNA, 20 bp, Artificial Sequence
  chemically synthesized
tctaatagccaaaataaagg

SEQ ID NO: 64344 - DNA, 20 bp, Artificial Sequence
  chemically synthesized
acctagatttcagaggatgt

SEQ ID NO: 64345 - DNA, 20 bp, Artificial Sequence
  chemically synthesized
ggcactgcctagcagagcta

SEQ ID NO: 64346 - DNA, 20 bp, Artificial Sequence
  chemically synthesized
gggccaccgtcctccagacc

SEQ ID NO: 64347 - DNA, 20 bp, Artificial Sequence
  chemically synthesized
tgacagtttgcaccgtgcac

SEQ ID NO: 64348 - DNA, 20 bp, Artificial Sequence
  chemically synthesized
tgtccgttttaaactgctat

SEQ ID NO: 64349 - DNA, 20 bp, Artificial Sequence
  chemically synthesized
cccgagactgggtaatttat

SEQ ID NO: 64350 - DNA, 20 bp, Artificial Sequence
  chemically synthesized
ttatgggacctactattcaa

SEQ ID NO: 64351 - DNA, 20 bp, Artificial Sequence
  chemically synthesized
tagctgtctgaaactaagtc

SEQ ID NO: 64352 - DNA, 20 bp, Artificial Sequence
  chemically synthesized
aggttaatggagtaatatgt

SEQ ID NO: 64353 - DNA, 20 bp, Artificial Sequence
  chemically synthesized
agagaatgatgactataatt

SEQ ID NO: 64354 - DNA, 20 bp, Artificial Sequence
  chemically synthesized
acatgaaaagactagttttg

SEQ ID NO: 64355 - DNA, 20 bp, Artificial Sequence
  chemically synthesized
tggattgtttgttttttatt

SEQ ID NO: 64356 - DNA, 20 bp, Artificial Sequence
  chemically synthesized
caactgctgtgttcttttgt

SEQ ID NO: 64357 - DNA, 20 bp, Artificial Sequence
  chemically synthesized
aaaatgagtggttatttaat

SEQ ID NO: 64358 - DNA, 20 bp, Artificial Sequence
  chemically synthesized
gttcttggtctcgctgactt

SEQ ID NO: 64359 - DNA, 20 bp, Artificial Sequence
  chemically synthesized
gcagcagtaagatttattgt

SEQ ID NO: 64360 - DNA, 20 bp, Artificial Sequence
  chemically synthesized
catatttcatggtgaggaac

SEQ ID NO: 64361 - DNA, 20 bp, Artificial Sequence
  chemically synthesized
ccaacaatgatagactggat

SEQ ID NO: 64362 - DNA, 20 bp, Artificial Sequence
  chemically synthesized
ccagttactttgaaggctga

SEQ ID NO: 64363 - DNA, 20 bp, Artificial Sequence
  chemically synthesized
aatcattttgccagaactaa

SEQ ID NO: 64364 - DNA, 20 bp, Artificial Sequence
  chemically synthesized
taagtaatttctgtgttttt

SEQ ID NO: 64365 - DNA, 20 bp, Artificial Sequence
  chemically synthesized
atctatagctttagtggatt

SEQ ID NO: 64366 - DNA, 20 bp, Artificial Sequence
  chemically synthesized
ttagtggattagagaaagta

SEQ ID NO: 64367 - DNA, 20 bp, Artificial Sequence
  chemically synthesized
tttatattttattattcagt

SEQ ID NO: 64368 - DNA, 20 bp, Artificial Sequence
  chemically synthesized
cttttaacaaacactcagac

SEQ ID NO: 64369 - DNA, 20 bp, Artificial Sequence
  chemically synthesized
atggtgccaagactgcaggg

SEQ ID NO: 64370 - DNA, 20 bp, Artificial Sequence
  chemically synthesized
atctaggttgcggcttctta

SEQ ID NO: 64371 - DNA, 20 bp, Artificial Sequence
  chemically synthesized
gaatcatgtcctctcacttc

SEQ ID NO: 64372 - DNA, 20 bp, Artificial Sequence
  chemically synthesized
aaaacatattgtcagttgtt

SEQ ID NO: 64373 - DNA, 20 bp, Artificial Sequence
  chemically synthesized
aaggaagcttctttggccat

SEQ ID NO: 64374 - DNA, 20 bp, Artificial Sequence
  chemically synthesized
aaccagatactttactctgt

SEQ ID NO: 64375 - DNA, 20 bp, Artificial Sequence
  chemically synthesized
tcactttgaggcttaagcta

SEQ ID NO: 64376 - DNA, 20 bp, Artificial Sequence
  chemically synthesized
cttaccttcttagataccta

SEQ ID NO: 64377 - DNA, 20 bp, Artificial Sequence
  chemically synthesized
ggaaagctgcactagcttac

SEQ ID NO: 64378 - DNA, 20 bp, Artificial Sequence
  chemically synthesized
ttatcttttttcttttaaac

SEQ ID NO: 64379 - DNA, 20 bp, Artificial Sequence
  chemically synthesized
tatagaacatcgccatcagt

SEQ ID NO: 64380 - DNA, 20 bp, Artificial Sequence
  chemically synthesized
aggttaattaagtaaacctc

SEQ ID NO: 64381 - DNA, 20 bp, Artificial Sequence
  chemically synthesized
taagtaaacctcagagaatg

SEQ ID NO: 64382 - DNA, 20 bp, Artificial Sequence
  chemically synthesized
atatctctcaatatcttttc

SEQ ID NO: 64383 - DNA, 20 bp, Artificial Sequence
  chemically synthesized
ggcaactgccaggactgact

SEQ ID NO: 64384 - DNA, 20 bp, Artificial Sequence
  chemically synthesized
gacttaagaatcaggatgta

SEQ ID NO: 64385 - DNA, 20 bp, Artificial Sequence
  chemically synthesized
cggagaagatcctggtgcag

SEQ ID NO: 64386 - DNA, 20 bp, Artificial Sequence
  chemically synthesized
cctggtgcaggcagaaagag

SEQ ID NO: 64387 - DNA, 20 bp, Artificial Sequence
  chemically synthesized
cagatgatggggggtgtaat

SEQ ID NO: 64388 - DNA, 20 bp, Artificial Sequence
  chemically synthesized
aggggtattgctgctccatg

SEQ ID NO: 64389 - DNA, 20 bp, Artificial Sequence
  chemically synthesized
catgccagaaaatccagtga

SEQ ID NO: 64390 - DNA, 20 bp, Artificial Sequence
  chemically synthesized
aaaatccagtgagaagaaag

SEQ ID NO: 64391 - DNA, 20 bp, Artificial Sequence
  chemically synthesized
tgaagtaatcattctggaac

SEQ ID NO: 64392 - DNA, 20 bp, Artificial Sequence
  chemically synthesized
actgacttaaaaaaaacagc

SEQ ID NO: 64393 - DNA, 20 bp, Artificial Sequence
  chemically synthesized
gacatagtatccattgcctt

SEQ ID NO: 64394 - DNA, 20 bp, Artificial Sequence
  chemically synthesized
catttgtgcctttgtgatgt

SEQ ID NO: 64395 - DNA, 20 bp, Artificial Sequence
  chemically synthesized
atttcaaaagcctcatggta

SEQ ID NO: 64396 - DNA, 20 bp, Artificial Sequence
  chemically synthesized
cctgctttaagttccagacc

SEQ ID NO: 64397 - DNA, 20 bp, Artificial Sequence
  chemically synthesized
tttttaatacttttttctcc

SEQ ID NO: 64398 - DNA, 20 bp, Artificial Sequence
  chemically synthesized
ctgagtgtttaatcttaaaa

SEQ ID NO: 64399 - DNA, 20 bp, Artificial Sequence
  chemically synthesized
atcaatttctaccatttcta

SEQ ID NO: 64400 - DNA, 20 bp, Artificial Sequence
  chemically synthesized
aaccatatctgttttttgct

SEQ ID NO: 64401 - DNA, 20 bp, Artificial Sequence
  chemically synthesized
tatgaaaaataagggttagc

SEQ ID NO: 64402 - DNA, 20 bp, Artificial Sequence
  chemically synthesized
ttacttgggagactgaggca

SEQ ID NO: 64403 - DNA, 20 bp, Artificial Sequence
  chemically synthesized
gcttcttcagactagataca

SEQ ID NO: 64404 - DNA, 20 bp, Artificial Sequence
  chemically synthesized
aggtaaataaatgaagattt

SEQ ID NO: 64405 - DNA, 20 bp, Artificial Sequence
  chemically synthesized
atagcagtgaatttgagtct

SEQ ID NO: 64406 - DNA, 20 bp, Artificial Sequence
  chemically synthesized
attaaaactgacctacatat

SEQ ID NO: 64407 - DNA, 20 bp, Artificial Sequence
  chemically synthesized
ttttttttttttctgtcttt

SEQ ID NO: 64408 - DNA, 20 bp, Artificial Sequence
  chemically synthesized
agtcattgttccaaagacat

SEQ ID NO: 64409 - DNA, 20 bp, Artificial Sequence
  chemically synthesized
ttctgaatatgctagttcag

SEQ ID NO: 64410 - DNA, 20 bp, Artificial Sequence
  chemically synthesized
tttaatatgttcccttttct

SEQ ID NO: 64411 - DNA, 20 bp, Artificial Sequence
  chemically synthesized
gcttaaaataaaattaacta

SEQ ID NO: 64412 - DNA, 20 bp, Artificial Sequence
  chemically synthesized
ctggtaaacactgaatgaaa

SEQ ID NO: 64413 - DNA, 20 bp, Artificial Sequence
  chemically synthesized
gaatgaaagaagaaaaccaa

SEQ ID NO: 64414 - DNA, 20 bp, Artificial Sequence
  chemically synthesized
taagttgtcctctgaaaatt

SEQ ID NO: 64415 - DNA, 20 bp, Artificial Sequence
  chemically synthesized
aggaaattgtaaaggctttc

SEQ ID NO: 64416 - DNA, 20 bp, Artificial Sequence
  chemically synthesized
ctcatcaccacacagtggaa

SEQ ID NO: 64417 - DNA, 20 bp, Artificial Sequence
  chemically synthesized
atatcaaattagtaaagcct

SEQ ID NO: 64418 - DNA, 20 bp, Artificial Sequence
  chemically synthesized
tccagttctatctttctgtt

SEQ ID NO: 64419 - DNA, 20 bp, Artificial Sequence
  chemically synthesized
ttctatctttctgttcaaga

SEQ ID NO: 64420 - DNA, 20 bp, Artificial Sequence
  chemically synthesized
gaggggagtttttttttttt

SEQ ID NO: 64421 - DNA, 20 bp, Artificial Sequence
  chemically synthesized
aattgtaatttcttggattc

SEQ ID NO: 64422 - DNA, 20 bp, Artificial Sequence
  chemically synthesized
atttctaaatctgtggattt

SEQ ID NO: 64423 - DNA, 20 bp, Artificial Sequence
  chemically synthesized
aatcagaaggaaccattgtc

SEQ ID NO: 64424 - DNA, 20 bp, Artificial Sequence
  chemically synthesized
atggggcaagtgtacaatac

SEQ ID NO: 64425 - DNA, 20 bp, Artificial Sequence
  chemically synthesized
tctgtggtaaacgtcagcgt

SEQ ID NO: 64426 - DNA, 20 bp, Artificial Sequence
  chemically synthesized
agctgactgtggctataggt

SEQ ID NO: 64427 - DNA, 20 bp, Artificial Sequence
  chemically synthesized
ttatgttaatttactcacta

SEQ ID NO: 64428 - DNA, 20 bp, Artificial Sequence
  chemically synthesized
aaatttgagtagagtaggac

SEQ ID NO: 64429 - DNA, 20 bp, Artificial Sequence
  chemically synthesized
agtaattagctccttagctg

SEQ ID NO: 64430 - DNA, 20 bp, Artificial Sequence
  chemically synthesized
tatgataataattctagttg

SEQ ID NO: 64431 - DNA, 20 bp, Artificial Sequence
  chemically synthesized
cactgctgactttggaattg

SEQ ID NO: 64432 - DNA, 20 bp, Artificial Sequence
  chemically synthesized
cctaattgactaaagccatt

SEQ ID NO: 64433 - DNA, 20 bp, Artificial Sequence
  chemically synthesized
gtatgcacttcttgaaatgc

SEQ ID NO: 64434 - DNA, 20 bp, Artificial Sequence
  chemically synthesized
tattattctcatttgtagtt

SEQ ID NO: 64435 - DNA, 20 bp, Artificial Sequence
  chemically synthesized
aaattgctcctggctacatc

SEQ ID NO: 64436 - DNA, 20 bp, Artificial Sequence
  chemically synthesized
gcaagctggcctcaactgga

SEQ ID NO: 64437 - DNA, 20 bp, Artificial Sequence
  chemically synthesized
gcctcaactggaacagaatg

SEQ ID NO: 64438 - DNA, 20 bp, Artificial Sequence
  chemically synthesized
ataaagcctaatcctgccat

SEQ ID NO: 64439 - DNA, 20 bp, Artificial Sequence
  chemically synthesized
aaaagggaagggaaaaagga

SEQ ID NO: 64440 - DNA, 20 bp, Artificial Sequence
  chemically synthesized
gacttgagttcctcgaagga

SEQ ID NO: 64441 - DNA, 20 bp, Artificial Sequence
  chemically synthesized
gagaccagcttgggcaacat

SEQ ID NO: 64442 - DNA, 20 bp, Artificial Sequence
  chemically synthesized
caaaaaaaaaaaaaagagag

SEQ ID NO: 64443 - DNA, 20 bp, Artificial Sequence
  chemically synthesized
aaaaaaaaaaagagagctag

SEQ ID NO: 64444 - DNA, 20 bp, Artificial Sequence
  chemically synthesized
aaaaaaagagagctagaaag

SEQ ID NO: 64445 - DNA, 20 bp, Artificial Sequence
  chemically synthesized
atcaaattacaaagaaggac

SEQ ID NO: 64446 - DNA, 20 bp, Artificial Sequence
  chemically synthesized
taggtggaaagaggagcaag

SEQ ID NO: 64447 - DNA, 20 bp, Artificial Sequence
  chemically synthesized
ggtgtgcatgtgtctttgtg

SEQ ID NO: 64448 - DNA, 20 bp, Artificial Sequence
  chemically synthesized
ttgatagtttcttttgctgt

SEQ ID NO: 64449 - DNA, 20 bp, Artificial Sequence
  chemically synthesized
gtgtatttttctagttctgt

SEQ ID NO: 64450 - DNA, 20 bp, Artificial Sequence
  chemically synthesized
gactatggtgttttctagat

SEQ ID NO: 64451 - DNA, 20 bp, Artificial Sequence
  chemically synthesized
tgtcttgtgccagttttcaa

SEQ ID NO: 64452 - DNA, 20 bp, Artificial Sequence
  chemically synthesized
aactcttctttgtgcatctg

SEQ ID NO: 64453 - DNA, 20 bp, Artificial Sequence
  chemically synthesized
acagcttagacagtgttaag

SEQ ID NO: 64454 - DNA, 20 bp, Artificial Sequence
  chemically synthesized
accctaaatctagcagaaga

SEQ ID NO: 64455 - DNA, 20 bp, Artificial Sequence
  chemically synthesized
gaagatccaaataagcacag

SEQ ID NO: 64456 - DNA, 20 bp, Artificial Sequence
  chemically synthesized
ggaatattatcactcacccc

SEQ ID NO: 64457 - DNA, 20 bp, Artificial Sequence
  chemically synthesized
aacatctctatgtacataaa

SEQ ID NO: 64458 - DNA, 20 bp, Artificial Sequence
  chemically synthesized
tacataaactagaaaatcta

SEQ ID NO: 64459 - DNA, 20 bp, Artificial Sequence
  chemically synthesized
tcaactctatgtccccctcc

SEQ ID NO: 64460 - DNA, 20 bp, Artificial Sequence
  chemically synthesized
atatctgaatatatggctct

SEQ ID NO: 64461 - DNA, 20 bp, Artificial Sequence
  chemically synthesized
tatatggctctagagaatcc

SEQ ID NO: 64462 - DNA, 20 bp, Artificial Sequence
  chemically synthesized
gctctagagaatcccaagaa

SEQ ID NO: 64463 - DNA, 20 bp, Artificial Sequence
  chemically synthesized
ttgagaagatgtgaagaacc

SEQ ID NO: 64464 - DNA, 20 bp, Artificial Sequence
  chemically synthesized
gaagaacccaagaatccact

SEQ ID NO: 64465 - DNA, 20 bp, Artificial Sequence
  chemically synthesized
aaggggttcagacctgtgtt

SEQ ID NO: 64466 - DNA, 20 bp, Artificial Sequence
  chemically synthesized
tttcccctagcttgttgatt

SEQ ID NO: 64467 - DNA, 20 bp, Artificial Sequence
  chemically synthesized
acaaataagaaggaagactc

SEQ ID NO: 64468 - DNA, 20 bp, Artificial Sequence
  chemically synthesized
ttgaaggaatgttaactgac

SEQ ID NO: 64469 - DNA, 20 bp, Artificial Sequence
  chemically synthesized
taaatttctgtctatttcaa

SEQ ID NO: 64470 - DNA, 20 bp, Artificial Sequence
  chemically synthesized
ttctccttgtgatagtttgc

SEQ ID NO: 64471 - DNA, 20 bp, Artificial Sequence
  chemically synthesized
gtagttttttccagttctgt

SEQ ID NO: 64472 - DNA, 20 bp, Artificial Sequence
  chemically synthesized
agctcctccttgtacctctg

SEQ ID NO: 64473 - DNA, 20 bp, Artificial Sequence
  chemically synthesized
taggtgtggtgtggtgctga

SEQ ID NO: 64474 - DNA, 20 bp, Artificial Sequence
  chemically synthesized
ctggtacctcagttggaaat

SEQ ID NO: 64475 - DNA, 20 bp, Artificial Sequence
  chemically synthesized
tgtgagccaccgctcccagc

SEQ ID NO: 64476 - DNA, 20 bp, Artificial Sequence
  chemically synthesized
ggtattaatttaacatgatt

SEQ ID NO: 64477 - DNA, 20 bp, Artificial Sequence
  chemically synthesized
atttaacatgattttagaat

SEQ ID NO: 64478 - DNA, 20 bp, Artificial Sequence
  chemically synthesized
aaagtaacaatgtatttcca

SEQ ID NO: 64479 - DNA, 20 bp, Artificial Sequence
  chemically synthesized
agagataatattaaggataa

SEQ ID NO: 64480 - DNA, 20 bp, Artificial Sequence
  chemically synthesized
ttaaggataatcagaaaaaa

SEQ ID NO: 64481 - DNA, 20 bp, Artificial Sequence
  chemically synthesized
aaaaaatagaataaacttag

SEQ ID NO: 64482 - DNA, 20 bp, Artificial Sequence
  chemically synthesized
gaataaacttagagagaatg

SEQ ID NO: 64483 - DNA, 20 bp, Artificial Sequence
  chemically synthesized
ttagagagaatgttagaaat

SEQ ID NO: 64484 - DNA, 20 bp, Artificial Sequence
  chemically synthesized
ttcactatttaataataaca

SEQ ID NO: 64485 - DNA, 20 bp, Artificial Sequence
  chemically synthesized
gatatttgtatctgaaaaat

SEQ ID NO: 64486 - DNA, 20 bp, Artificial Sequence
  chemically synthesized
cggatcagcctgaccaacat

SEQ ID NO: 64487 - DNA, 20 bp, Artificial Sequence
  chemically synthesized
cgatgctgtacattagatat

SEQ ID NO: 64488 - DNA, 20 bp, Artificial Sequence
  chemically synthesized
tggatattaaccaaaatatt

SEQ ID NO: 64489 - DNA, 20 bp, Artificial Sequence
  chemically synthesized
aaacggctgcaacgtgaata

SEQ ID NO: 64490 - DNA, 20 bp, Artificial Sequence
  chemically synthesized
actgattatatgccttgatt

SEQ ID NO: 64491 - DNA, 20 bp, Artificial Sequence
  chemically synthesized
cagaatcttgccaactagat

SEQ ID NO: 64492 - DNA, 20 bp, Artificial Sequence
  chemically synthesized
ttgagactcatattttattt

SEQ ID NO: 64493 - DNA, 20 bp, Artificial Sequence
  chemically synthesized
ctacctacctaggtattgaa

SEQ ID NO: 64494 - DNA, 20 bp, Artificial Sequence
  chemically synthesized
ctaatcttaaacatcctgag

SEQ ID NO: 64495 - DNA, 20 bp, Artificial Sequence
  chemically synthesized
aaggctgagtggccaggcga

SEQ ID NO: 64496 - DNA, 20 bp, Artificial Sequence
  chemically synthesized
ttccctttttagtaaaatat

SEQ ID NO: 64497 - DNA, 20 bp, Artificial Sequence
  chemically synthesized
aaataaatgttttttattag

SEQ ID NO: 64498 - DNA, 20 bp, Artificial Sequence
  chemically synthesized
agggaacaaaggaaccttta

SEQ ID NO: 64499 - DNA, 20 bp, Artificial Sequence
  chemically synthesized
ctttaatagaaattggacag

SEQ ID NO: 64500 - DNA, 20 bp, Artificial Sequence
  chemically synthesized
caaaagggcctagcttggac

SEQ ID NO: 64501 - DNA, 20 bp, Artificial Sequence
  chemically synthesized
atcccaaccataaaataaaa

SEQ ID NO: 64502 - DNA, 20 bp, Artificial Sequence
  chemically synthesized
acatcagttacaatttatat

SEQ ID NO: 64503 - DNA, 20 bp, Artificial Sequence
  chemically synthesized
gatattgctattgccttaac

SEQ ID NO: 64504 - DNA, 20 bp, Artificial Sequence
  chemically synthesized
gaaattatcactgttattct

SEQ ID NO: 64505 - DNA, 20 bp, Artificial Sequence
  chemically synthesized
attgtatcattattgccctg

SEQ ID NO: 64506 - DNA, 20 bp, Artificial Sequence
  chemically synthesized
gaaagagattagggaaagta

SEQ ID NO: 64507 - DNA, 20 bp, Artificial Sequence
  chemically synthesized
aacaaaaaagtatattaaaa

SEQ ID NO: 64508 - DNA, 20 bp, Artificial Sequence
  chemically synthesized
ttatgtatcaattaaaaata

SEQ ID NO: 64509 - DNA, 20 bp, Artificial Sequence
  chemically synthesized
ataatagtaaaaattgcgga

SEQ ID NO: 64510 - DNA, 20 bp, Artificial Sequence
  chemically synthesized
aaattgcggagaagaaaaaa

SEQ ID NO: 64511 - DNA, 20 bp, Artificial Sequence
  chemically synthesized
gagaagaaaaaaaaagaaag

SEQ ID NO: 64512 - DNA, 20 bp, Artificial Sequence
  chemically synthesized
aagaaagcaagaattaaaca

SEQ ID NO: 64513 - DNA, 20 bp, Artificial Sequence
  chemically synthesized
attgttatgaacagcaaata

SEQ ID NO: 64514 - DNA, 20 bp, Artificial Sequence
  chemically synthesized
cctatgacatgaacttaacc

SEQ ID NO: 64515 - DNA, 20 bp, Artificial Sequence
  chemically synthesized
taaccatagaaaagaagggg

SEQ ID NO: 64516 - DNA, 20 bp, Artificial Sequence
  chemically synthesized
gcagagagagtcagtgccta

SEQ ID NO: 64517 - DNA, 20 bp, Artificial Sequence
  chemically synthesized
atggatctcttcctgcgtct

SEQ ID NO: 64518 - DNA, 20 bp, Artificial Sequence
  chemically synthesized
atatgcaaaatacttacagg

SEQ ID NO: 64519 - DNA, 20 bp, Artificial Sequence
  chemically synthesized
tttggattaaaaccttctgg

SEQ ID NO: 64520 - DNA, 20 bp, Artificial Sequence
  chemically synthesized
attaaaaccttctggtaaga

SEQ ID NO: 64521 - DNA, 20 bp, Artificial Sequence
  chemically synthesized
ctaataaattatgtctaaaa

SEQ ID NO: 64522 - DNA, 20 bp, Artificial Sequence
  chemically synthesized
gaacaaaaagcctctgtgac

SEQ ID NO: 64523 - DNA, 20 bp, Artificial Sequence
  chemically synthesized
atttttttcctctagtccac

SEQ ID NO: 64524 - DNA, 20 bp, Artificial Sequence
  chemically synthesized
aataaaatttaggttaacca

SEQ ID NO: 64525 - DNA, 20 bp, Artificial Sequence
  chemically synthesized
ctctgattattctcacacac

SEQ ID NO: 64526 - DNA, 20 bp, Artificial Sequence
  chemically synthesized
tctaggcacacgtgtatccc

SEQ ID NO: 64527 - DNA, 20 bp, Artificial Sequence
  chemically synthesized
ttttgcaaatatcctgggtc

SEQ ID NO: 64528 - DNA, 20 bp, Artificial Sequence
  chemically synthesized
gagctttgaaatcctgattg

SEQ ID NO: 64529 - DNA, 20 bp, Artificial Sequence
  chemically synthesized
taccctacaacttcttatgc

SEQ ID NO: 64530 - DNA, 20 bp, Artificial Sequence
  chemically synthesized
ttaagtcctaatgttttata

SEQ ID NO: 64531 - DNA, 20 bp, Artificial Sequence
  chemically synthesized
taaacacaactcagcagctc

SEQ ID NO: 64532 - DNA, 20 bp, Artificial Sequence
  chemically synthesized
aaaatgaaataaaaatgctc

SEQ ID NO: 64533 - DNA, 20 bp, Artificial Sequence
  chemically synthesized
ctccaagaaaaccagaaccc

SEQ ID NO: 64534 - DNA, 20 bp, Artificial Sequence
  chemically synthesized
aaagtatatgcataattatt

SEQ ID NO: 64535 - DNA, 20 bp, Artificial Sequence
  chemically synthesized
cactgggctcagattttcat

SEQ ID NO: 64536 - DNA, 20 bp, Artificial Sequence
  chemically synthesized
gagattgcatctctttagag

SEQ ID NO: 64537 - DNA, 20 bp, Artificial Sequence
  chemically synthesized
tttataaagcaacgccatag

SEQ ID NO: 64538 - DNA, 20 bp, Artificial Sequence
  chemically synthesized
aaagcaacgccatagtgaga

SEQ ID NO: 64539 - DNA, 20 bp, Artificial Sequence
  chemically synthesized
gctctttttttttgactttt

SEQ ID NO: 64540 - DNA, 20 bp, Artificial Sequence
  chemically synthesized
tttttaaaaatgtatacaac

SEQ ID NO: 64541 - DNA, 20 bp, Artificial Sequence
  chemically synthesized
aaaaaatattactcctatga

SEQ ID NO: 64542 - DNA, 20 bp, Artificial Sequence
  chemically synthesized
tatgttgtagcattaacaac

SEQ ID NO: 64543 - DNA, 20 bp, Artificial Sequence
  chemically synthesized
cagtaggcatgtaagaaggt

SEQ ID NO: 64544 - DNA, 20 bp, Artificial Sequence
  chemically synthesized
tgtaagaaggtagagaatag

SEQ ID NO: 64545 - DNA, 20 bp, Artificial Sequence
  chemically synthesized
gtgtgtgtgcatgaaataaa

SEQ ID NO: 64546 - DNA, 20 bp, Artificial Sequence
  chemically synthesized
tgtgcaggcaaaggaaggag

SEQ ID NO: 64547 - DNA, 20 bp, Artificial Sequence
  chemically synthesized
taggcattgtgttcccaagt

SEQ ID NO: 64548 - DNA, 20 bp, Artificial Sequence
  chemically synthesized
tgtgttcccaagttcagaaa

SEQ ID NO: 64549 - DNA, 20 bp, Artificial Sequence
  chemically synthesized
gatacatgcatatggttaac

SEQ ID NO: 64550 - DNA, 20 bp, Artificial Sequence
  chemically synthesized
gagaaataaagactggcttc

SEQ ID NO: 64551 - DNA, 20 bp, Artificial Sequence
  chemically synthesized
tcctttccattccatttact

SEQ ID NO: 64552 - DNA, 20 bp, Artificial Sequence
  chemically synthesized
acaaaaggattattctaagt

SEQ ID NO: 64553 - DNA, 20 bp, Artificial Sequence
  chemically synthesized
aatgaagggagggggttggg

SEQ ID NO: 64554 - DNA, 20 bp, Artificial Sequence
  chemically synthesized
attgtgaggaaggaaaaaat

SEQ ID NO: 64555 - DNA, 20 bp, Artificial Sequence
  chemically synthesized
aaaagaaccaaaatgtaaga

SEQ ID NO: 64556 - DNA, 20 bp, Artificial Sequence
  chemically synthesized
tgtaagattagaaagtaaaa

SEQ ID NO: 64557 - DNA, 20 bp, Artificial Sequence
  chemically synthesized
cacagtgcagctcactcagc

SEQ ID NO: 64558 - DNA, 20 bp, Artificial Sequence
  chemically synthesized
ggacagagagtcagtgccta

SEQ ID NO: 64559 - DNA, 20 bp, Artificial Sequence
  chemically synthesized
tagtgaacactgttatgtca

SEQ ID NO: 64560 - DNA, 20 bp, Artificial Sequence
  chemically synthesized
agcagggtttcattagtttg

SEQ ID NO: 64561 - DNA, 20 bp, Artificial Sequence
  chemically synthesized
tctgtcatgtgtgtcttgac

SEQ ID NO: 64562 - DNA, 20 bp, Artificial Sequence
  chemically synthesized
ttgtttctgtcactttatac

SEQ ID NO: 64563 - DNA, 20 bp, Artificial Sequence
  chemically synthesized
attgaaataaatatccatta

SEQ ID NO: 64564 - DNA, 20 bp, Artificial Sequence
  chemically synthesized
tttaaaattatggtatgact

SEQ ID NO: 64565 - DNA, 20 bp, Artificial Sequence
  chemically synthesized
aaattatggtatgactaaag

SEQ ID NO: 64566 - DNA, 20 bp, Artificial Sequence
  chemically synthesized
aggattgaaggaaagaggag

SEQ ID NO: 64567 - DNA, 20 bp, Artificial Sequence
  chemically synthesized
aggaaagaggaggaagaaat

SEQ ID NO: 64568 - DNA, 20 bp, Artificial Sequence
  chemically synthesized
aataaataatggagaggaga

SEQ ID NO: 64569 - DNA, 20 bp, Artificial Sequence
  chemically synthesized
gagaggagaagggataggga

SEQ ID NO: 64570 - DNA, 20 bp, Artificial Sequence
  chemically synthesized
agaagggatagggaagagaa

SEQ ID NO: 64571 - DNA, 20 bp, Artificial Sequence
  chemically synthesized
agaggaaagaagagaagagg

SEQ ID NO: 64572 - DNA, 20 bp, Artificial Sequence
  chemically synthesized
aaagaagagaagaggagaga

SEQ ID NO: 64573 - DNA, 20 bp, Artificial Sequence
  chemically synthesized
tttggtggtgatatggatca

SEQ ID NO: 64574 - DNA, 20 bp, Artificial Sequence
  chemically synthesized
gcaattacatttttagatat

SEQ ID NO: 64575 - DNA, 20 bp, Artificial Sequence
  chemically synthesized
gtgtgtatccaaagacatgt

SEQ ID NO: 64576 - DNA, 20 bp, Artificial Sequence
  chemically synthesized
cacttaaatgcttaccaaca

SEQ ID NO: 64577 - DNA, 20 bp, Artificial Sequence
  chemically synthesized
tgataaattacggtatagtc

SEQ ID NO: 64578 - DNA, 20 bp, Artificial Sequence
  chemically synthesized
aattacggtatagtcaaaga

SEQ ID NO: 64579 - DNA, 20 bp, Artificial Sequence
  chemically synthesized
gtcaaagaatagaatattac

SEQ ID NO: 64580 - DNA, 20 bp, Artificial Sequence
  chemically synthesized
agaatattacacagaaatga

SEQ ID NO: 64581 - DNA, 20 bp, Artificial Sequence
  chemically synthesized
ctatatgactttatttgtat

SEQ ID NO: 64582 - DNA, 20 bp, Artificial Sequence
  chemically synthesized
acgaaagatattgaataatt

SEQ ID NO: 64583 - DNA, 20 bp, Artificial Sequence
  chemically synthesized
aaagattattctcacttagt

SEQ ID NO: 64584 - DNA, 20 bp, Artificial Sequence
  chemically synthesized
aagaaatgtattttagaagt

SEQ ID NO: 64585 - DNA, 20 bp, Artificial Sequence
  chemically synthesized
tgggcttctgttgcagtagg

SEQ ID NO: 64586 - DNA, 20 bp, Artificial Sequence
  chemically synthesized
ggtgatgtcagtcgtgaaca

SEQ ID NO: 64587 - DNA, 20 bp, Artificial Sequence
  chemically synthesized
agtttagtggtacgataaaa

SEQ ID NO: 64588 - DNA, 20 bp, Artificial Sequence
  chemically synthesized
tagatatgtggatctggagc

SEQ ID NO: 64589 - DNA, 20 bp, Artificial Sequence
  chemically synthesized
tatgtggatctggagctcag

SEQ ID NO: 64590 - DNA, 20 bp, Artificial Sequence
  chemically synthesized
cagaaagaatacaaccaggt

SEQ ID NO: 64591 - DNA, 20 bp, Artificial Sequence
  chemically synthesized
aatacaaccaggtcaagaat

SEQ ID NO: 64592 - DNA, 20 bp, Artificial Sequence
  chemically synthesized
atcaatatctccttaaaatc

SEQ ID NO: 64593 - DNA, 20 bp, Artificial Sequence
  chemically synthesized
ttatgtttccaattcatata

SEQ ID NO: 64594 - DNA, 20 bp, Artificial Sequence
  chemically synthesized
gcattgagaggatttgtata

SEQ ID NO: 64595 - DNA, 20 bp, Artificial Sequence
  chemically synthesized
aggataaggtctaaaagtgg

SEQ ID NO: 64596 - DNA, 20 bp, Artificial Sequence
  chemically synthesized
atagatagggacaaattgaa

SEQ ID NO: 64597 - DNA, 20 bp, Artificial Sequence
  chemically synthesized
ctaaaatggaaaacactgga

SEQ ID NO: 64598 - DNA, 20 bp, Artificial Sequence
  chemically synthesized
ctgaggttggaggtcagagg

SEQ ID NO: 64599 - DNA, 20 bp, Artificial Sequence
  chemically synthesized
tagtgtaatgccaatgtggg

SEQ ID NO: 64600 - DNA, 20 bp, Artificial Sequence
  chemically synthesized
atactaaggactctagggtc

SEQ ID NO: 64601 - DNA, 20 bp, Artificial Sequence
  chemically synthesized
aaaccccctatctactaaaa

SEQ ID NO: 64602 - DNA, 20 bp, Artificial Sequence
  chemically synthesized
ctacttgggaggctgaggca

SEQ ID NO: 64603 - DNA, 20 bp, Artificial Sequence
  chemically synthesized
aaccatagcaatgctctatc

SEQ ID NO: 64604 - DNA, 20 bp, Artificial Sequence
  chemically synthesized
gatagtgtaatactcataat

SEQ ID NO: 64605 - DNA, 20 bp, Artificial Sequence
  chemically synthesized
aggaaaaacactaaatatta

SEQ ID NO: 64606 - DNA, 20 bp, Artificial Sequence
  chemically synthesized
caaagctaacagagtcaaat

SEQ ID NO: 64607 - DNA, 20 bp, Artificial Sequence
  chemically synthesized
gaatgtttgttcatggagca

SEQ ID NO: 64608 - DNA, 20 bp, Artificial Sequence
  chemically synthesized
cacatctgtatgtgtatatc

SEQ ID NO: 64609 - DNA, 20 bp, Artificial Sequence
  chemically synthesized
tgaatgtgaaaactcctcat

SEQ ID NO: 64610 - DNA, 20 bp, Artificial Sequence
  chemically synthesized
tttggacacagtaattattc

SEQ ID NO: 64611 - DNA, 20 bp, Artificial Sequence
  chemically synthesized
gacacatagaggaaatactt

SEQ ID NO: 64612 - DNA, 20 bp, Artificial Sequence
  chemically synthesized
ttgggattaatgaaactgga

SEQ ID NO: 64613 - DNA, 20 bp, Artificial Sequence
  chemically synthesized
aggagtttgaagtgattgcc

SEQ ID NO: 64614 - DNA, 20 bp, Artificial Sequence
  chemically synthesized
tattatgtcactctcatatg

SEQ ID NO: 64615 - DNA, 20 bp, Artificial Sequence
  chemically synthesized
acacatgtgtgtgtatatat

SEQ ID NO: 64616 - DNA, 20 bp, Artificial Sequence
  chemically synthesized
gtgtgtgtatatatatagaa

SEQ ID NO: 64617 - DNA, 20 bp, Artificial Sequence
  chemically synthesized
aataaaacttgtacatattt

SEQ ID NO: 64618 - DNA, 20 bp, Artificial Sequence
  chemically synthesized
taataccattgaagacgtta

SEQ ID NO: 64619 - DNA, 20 bp, Artificial Sequence
  chemically synthesized
tctcttttcttgcaggattg

SEQ ID NO: 64620 - DNA, 20 bp, Artificial Sequence
  chemically synthesized
ctccaacattctcatttcca

SEQ ID NO: 64621 - DNA, 20 bp, Artificial Sequence
  chemically synthesized
aatcagggtaaaatataaag

SEQ ID NO: 64622 - DNA, 20 bp, Artificial Sequence
  chemically synthesized
ggggagggagtgaagataaa

SEQ ID NO: 64623 - DNA, 20 bp, Artificial Sequence
  chemically synthesized
ttttcccaaacactcataac

SEQ ID NO: 64624 - DNA, 20 bp, Artificial Sequence
  chemically synthesized
tttctaacctccaggactat

SEQ ID NO: 64625 - DNA, 20 bp, Artificial Sequence
  chemically synthesized
aaaagtgactattaattttt

SEQ ID NO: 64626 - DNA, 20 bp, Artificial Sequence
  chemically synthesized
aacactcagtttgattttgg

SEQ ID NO: 64627 - DNA, 20 bp, Artificial Sequence
  chemically synthesized
catagctgactcataacaca

SEQ ID NO: 64628 - DNA, 20 bp, Artificial Sequence
  chemically synthesized
tgcaaatatctaagggtaaa

SEQ ID NO: 64629 - DNA, 20 bp, Artificial Sequence
  chemically synthesized
acaacgggctaatccctctt

SEQ ID NO: 64630 - DNA, 20 bp, Artificial Sequence
  chemically synthesized
ggcttccagtacctacctgc

SEQ ID NO: 64631 - DNA, 20 bp, Artificial Sequence
  chemically synthesized
gatggacattcgagtttctg

SEQ ID NO: 64632 - DNA, 20 bp, Artificial Sequence
  chemically synthesized
taagttacaactgaaaagga

SEQ ID NO: 64633 - DNA, 20 bp, Artificial Sequence
  chemically synthesized
ccggccaatttcatcacttt

SEQ ID NO: 64634 - DNA, 20 bp, Artificial Sequence
  chemically synthesized
caatttcatcactttttaga

SEQ ID NO: 64635 - DNA, 20 bp, Artificial Sequence
  chemically synthesized
ctctatccagcatcaacttg

SEQ ID NO: 64636 - DNA, 20 bp, Artificial Sequence
  chemically synthesized
cagcatcaacttggaagaaa

SEQ ID NO: 64637 - DNA, 20 bp, Artificial Sequence
  chemically synthesized
caacttggaagaaagcagaa

SEQ ID NO: 64638 - DNA, 20 bp, Artificial Sequence
  chemically synthesized
acccctgagataaatcctta

SEQ ID NO: 64639 - DNA, 20 bp, Artificial Sequence
  chemically synthesized
agagcagagatcgatgatat

SEQ ID NO: 64640 - DNA, 20 bp, Artificial Sequence
  chemically synthesized
ggccctaaaactcattccca

SEQ ID NO: 64641 - DNA, 20 bp, Artificial Sequence
  chemically synthesized
ccatccatttttcttaattc

SEQ ID NO: 64642 - DNA, 20 bp, Artificial Sequence
  chemically synthesized
ggagaccagcatacatacta

SEQ ID NO: 64643 - DNA, 20 bp, Artificial Sequence
  chemically synthesized
cagatggtattatatgactt

SEQ ID NO: 64644 - DNA, 20 bp, Artificial Sequence
  chemically synthesized
acctacaaccatctggtctt

SEQ ID NO: 64645 - DNA, 20 bp, Artificial Sequence
  chemically synthesized
aaccccaaactataaaaagc

SEQ ID NO: 64646 - DNA, 20 bp, Artificial Sequence
  chemically synthesized
taaagagctcctgctcagca

SEQ ID NO: 64647 - DNA, 20 bp, Artificial Sequence
  chemically synthesized
atcagagcgaaagacaatct

SEQ ID NO: 64648 - DNA, 20 bp, Artificial Sequence
  chemically synthesized
ggcctaatatccagagtaaa

SEQ ID NO: 64649 - DNA, 20 bp, Artificial Sequence
  chemically synthesized
aagaaacttaaacaacttta

SEQ ID NO: 64650 - DNA, 20 bp, Artificial Sequence
  chemically synthesized
ggtaacagtaaattaaatta

SEQ ID NO: 64651 - DNA, 20 bp, Artificial Sequence
  chemically synthesized
agaaaaatgccatggcaatg

SEQ ID NO: 64652 - DNA, 20 bp, Artificial Sequence
  chemically synthesized
aaacttgtttaacatatcat

SEQ ID NO: 64653 - DNA, 20 bp, Artificial Sequence
  chemically synthesized
cgtttatttctttactctct

SEQ ID NO: 64654 - DNA, 20 bp, Artificial Sequence
  chemically synthesized
taaaaaaaacaaaaaacaaa

SEQ ID NO: 64655 - DNA, 20 bp, Artificial Sequence
  chemically synthesized
aaaaacaaaaaacaaaaaag

SEQ ID NO: 64656 - DNA, 20 bp, Artificial Sequence
  chemically synthesized
gtgccaaattctgaggctga

SEQ ID NO: 64657 - DNA, 20 bp, Artificial Sequence
  chemically synthesized
attctgaggctgaggagaaa

SEQ ID NO: 64658 - DNA, 20 bp, Artificial Sequence
  chemically synthesized
tgaggctgaggagaaaaaag

SEQ ID NO: 64659 - DNA, 20 bp, Artificial Sequence
  chemically synthesized
gctgaggagaaaaaagaaag

SEQ ID NO: 64660 - DNA, 20 bp, Artificial Sequence
  chemically synthesized
gaaaaaagaaagaaagaaaa

SEQ ID NO: 64661 - DNA, 20 bp, Artificial Sequence
  chemically synthesized
agcatgttgaagtaaaaata

SEQ ID NO: 64662 - DNA, 20 bp, Artificial Sequence
  chemically synthesized
tgtgtcctcaccgggaggaa

SEQ ID NO: 64663 - DNA, 20 bp, Artificial Sequence
  chemically synthesized
ctgtgaaaagctaagtgcca

SEQ ID NO: 64664 - DNA, 20 bp, Artificial Sequence
  chemically synthesized
atagtattcctcctaataaa

SEQ ID NO: 64665 - DNA, 20 bp, Artificial Sequence
  chemically synthesized
ccacaaacacaaacaggcat

SEQ ID NO: 64666 - DNA, 20 bp, Artificial Sequence
  chemically synthesized
aagatgtaaaaaaaagagct

SEQ ID NO: 64667 - DNA, 20 bp, Artificial Sequence
  chemically synthesized
aaatcatgtgtgatctctca

SEQ ID NO: 64668 - DNA, 20 bp, Artificial Sequence
  chemically synthesized
atttattatttgtattgctt

SEQ ID NO: 64669 - DNA, 20 bp, Artificial Sequence
  chemically synthesized
actacacaccaagcttccac

SEQ ID NO: 64670 - DNA, 20 bp, Artificial Sequence
  chemically synthesized
gttgtaggctgaagacgtta

SEQ ID NO: 64671 - DNA, 20 bp, Artificial Sequence
  chemically synthesized
tctttctactggaatctaat

SEQ ID NO: 64672 - DNA, 20 bp, Artificial Sequence
  chemically synthesized
taaatcatgactgtttcatc

SEQ ID NO: 64673 - DNA, 20 bp, Artificial Sequence
  chemically synthesized
tatgctcagtaaagatgatg

SEQ ID NO: 64674 - DNA, 20 bp, Artificial Sequence
  chemically synthesized
tctttggcaggtactgtgga

SEQ ID NO: 64675 - DNA, 20 bp, Artificial Sequence
  chemically synthesized
tgatacagatggctaaaagg

SEQ ID NO: 64676 - DNA, 20 bp, Artificial Sequence
  chemically synthesized
ttactaaaaaaaaaaaggac

SEQ ID NO: 64677 - DNA, 20 bp, Artificial Sequence
  chemically synthesized
taaaaaaaaaaaggacaaag

SEQ ID NO: 64678 - DNA, 20 bp, Artificial Sequence
  chemically synthesized
gagccaggcagaagacgttt

SEQ ID NO: 64679 - DNA, 20 bp, Artificial Sequence
  chemically synthesized
actctgaggctgaggaaaaa

SEQ ID NO: 64680 - DNA, 20 bp, Artificial Sequence
  chemically synthesized
tgaggctgaggaaaaaaaag

SEQ ID NO: 64681 - DNA, 20 bp, Artificial Sequence
  chemically synthesized
gctgaggaaaaaaaagaaag

SEQ ID NO: 64682 - DNA, 20 bp, Artificial Sequence
  chemically synthesized
aaaaagaaagaaagaaatat

SEQ ID NO: 64683 - DNA, 20 bp, Artificial Sequence
  chemically synthesized
ttacaagcctaaagtacgtt

SEQ ID NO: 64684 - DNA, 20 bp, Artificial Sequence
  chemically synthesized
taaagtacgttgaagaaaaa

SEQ ID NO: 64685 - DNA, 20 bp, Artificial Sequence
  chemically synthesized
ctgtgtcctcaccagaagga

SEQ ID NO: 64686 - DNA, 20 bp, Artificial Sequence
  chemically synthesized
cttcattgtagttaccgtgg

SEQ ID NO: 64687 - DNA, 20 bp, Artificial Sequence
  chemically synthesized
ctgtagagcctcacaagggc

SEQ ID NO: 64688 - DNA, 20 bp, Artificial Sequence
  chemically synthesized
atagtattgcccctaataaa

SEQ ID NO: 64689 - DNA, 20 bp, Artificial Sequence
  chemically synthesized
caaccatgtgtgatctctta

SEQ ID NO: 64690 - DNA, 20 bp, Artificial Sequence
  chemically synthesized
gatttattatttgattgctt

SEQ ID NO: 64691 - DNA, 20 bp, Artificial Sequence
  chemically synthesized
actacacaccaagcttccac

SEQ ID NO: 64692 - DNA, 20 bp, Artificial Sequence
  chemically synthesized
gctgtaggctgaaaacgtta

SEQ ID NO: 64693 - DNA, 20 bp, Artificial Sequence
  chemically synthesized
tctttctaccgaaatctaat

SEQ ID NO: 64694 - DNA, 20 bp, Artificial Sequence
  chemically synthesized
tatgctcggtaaagatgatg

SEQ ID NO: 64695 - DNA, 20 bp, Artificial Sequence
  chemically synthesized
tctttaccagatactatgga

SEQ ID NO: 64696 - DNA, 20 bp, Artificial Sequence
  chemically synthesized
gaccttggtagattatgacg

SEQ ID NO: 64697 - DNA, 20 bp, Artificial Sequence
  chemically synthesized
agtgttaggcggctaaaaga

SEQ ID NO: 64698 - DNA, 20 bp, Artificial Sequence
  chemically synthesized
aagttaaaataaaagttgaa

SEQ ID NO: 64699 - DNA, 20 bp, Artificial Sequence
  chemically synthesized
taaaagttgaataagaaagg

SEQ ID NO: 64700 - DNA, 20 bp, Artificial Sequence
  chemically synthesized
tctctcaatctaaggatggg

SEQ ID NO: 64701 - DNA, 20 bp, Artificial Sequence
  chemically synthesized
catttgtagagcctgacctt

SEQ ID NO: 64702 - DNA, 20 bp, Artificial Sequence
  chemically synthesized
gcatttaagttaaataagtc

SEQ ID NO: 64703 - DNA, 20 bp, Artificial Sequence
  chemically synthesized
taatttcagatattattaac

SEQ ID NO: 64704 - DNA, 20 bp, Artificial Sequence
  chemically synthesized
ttaactaagaatgaaattaa

SEQ ID NO: 64705 - DNA, 20 bp, Artificial Sequence
  chemically synthesized
aaattcaaagctctgaagca

SEQ ID NO: 64706 - DNA, 20 bp, Artificial Sequence
  chemically synthesized
gtgccgttgatatgtaaagt

SEQ ID NO: 64707 - DNA, 20 bp, Artificial Sequence
  chemically synthesized
gtagggagtgagaagccatt

SEQ ID NO: 64708 - DNA, 20 bp, Artificial Sequence
  chemically synthesized
tattggctggattactattc

SEQ ID NO: 64709 - DNA, 20 bp, Artificial Sequence
  chemically synthesized
ggcagtatagttttggggga

SEQ ID NO: 64710 - DNA, 20 bp, Artificial Sequence
  chemically synthesized
gggagaagaaaaagagagag

SEQ ID NO: 64711 - DNA, 20 bp, Artificial Sequence
  chemically synthesized
ttttttttgcagaaccacct

SEQ ID NO: 64712 - DNA, 20 bp, Artificial Sequence
  chemically synthesized
aaccacctgcagaaataaat

SEQ ID NO: 64713 - DNA, 20 bp, Artificial Sequence
  chemically synthesized
ctgggaaaagatgacaggaa

SEQ ID NO: 64714 - DNA, 20 bp, Artificial Sequence
  chemically synthesized
cccatcctcccacagtagcc

SEQ ID NO: 64715 - DNA, 20 bp, Artificial Sequence
  chemically synthesized
actgcctctgctgatgcttt

SEQ ID NO: 64716 - DNA, 20 bp, Artificial Sequence
  chemically synthesized
cctacccaagtgagaaggaa

SEQ ID NO: 64717 - DNA, 20 bp, Artificial Sequence
  chemically synthesized
cagcaatgcatccaaaccaa

SEQ ID NO: 64718 - DNA, 20 bp, Artificial Sequence
  chemically synthesized
aaaaaaccaaaaatatgata

SEQ ID NO: 64719 - DNA, 20 bp, Artificial Sequence
  chemically synthesized
atatgatacaagaaatgagg

SEQ ID NO: 64720 - DNA, 20 bp, Artificial Sequence
  chemically synthesized
atggatgaatggatgcactt

SEQ ID NO: 64721 - DNA, 20 bp, Artificial Sequence
  chemically synthesized
ttatagaaatgcaaaatgct

SEQ ID NO: 64722 - DNA, 20 bp, Artificial Sequence
  chemically synthesized
tgctctagaaagtctcagca

SEQ ID NO: 64723 - DNA, 20 bp, Artificial Sequence
  chemically synthesized
tcagcaatagaatccaagca

SEQ ID NO: 64724 - DNA, 20 bp, Artificial Sequence
  chemically synthesized
taacccaatccaacaaagac

SEQ ID NO: 64725 - DNA, 20 bp, Artificial Sequence
  chemically synthesized
atccaacaaagacaaagaaa

SEQ ID NO: 64726 - DNA, 20 bp, Artificial Sequence
  chemically synthesized
caaagacaaagaaaaaagaa

SEQ ID NO: 64727 - DNA, 20 bp, Artificial Sequence
  chemically synthesized
gaaaatatgaacaaagcctc

SEQ ID NO: 64728 - DNA, 20 bp, Artificial Sequence
  chemically synthesized
ttatgttaaacaatcaaacc

SEQ ID NO: 64729 - DNA, 20 bp, Artificial Sequence
  chemically synthesized
ctaagaataatcagcattcc

SEQ ID NO: 64730 - DNA, 20 bp, Artificial Sequence
  chemically synthesized
atcagcattcctgagaaaga

SEQ ID NO: 64731 - DNA, 20 bp, Artificial Sequence
  chemically synthesized
ccaaagttatctaaagacaa

SEQ ID NO: 64732 - DNA, 20 bp, Artificial Sequence
  chemically synthesized
aaactaccaggtaacctatg

SEQ ID NO: 64733 - DNA, 20 bp, Artificial Sequence
  chemically synthesized
gattaacagcagatttctca

SEQ ID NO: 64734 - DNA, 20 bp, Artificial Sequence
  chemically synthesized
taaacaaaacaattatcagc

SEQ ID NO: 64735 - DNA, 20 bp, Artificial Sequence
  chemically synthesized
tgaaactaagcttcacaaat

SEQ ID NO: 64736 - DNA, 20 bp, Artificial Sequence
  chemically synthesized
aagaaaatacacagtgtttt

SEQ ID NO: 64737 - DNA, 20 bp, Artificial Sequence
  chemically synthesized
tttcagaaaaacaaatgctg

SEQ ID NO: 64738 - DNA, 20 bp, Artificial Sequence
  chemically synthesized
acacaggcaacaaataccac

SEQ ID NO: 64739 - DNA, 20 bp, Artificial Sequence
  chemically synthesized
aaatgctccacttaaaagat

SEQ ID NO: 64740 - DNA, 20 bp, Artificial Sequence
  chemically synthesized
cacttaaaagatacagaatt

SEQ ID NO: 64741 - DNA, 20 bp, Artificial Sequence
  chemically synthesized
atacagaattgcagaatgaa

SEQ ID NO: 64742 - DNA, 20 bp, Artificial Sequence
  chemically synthesized
tgtcagacaaaacaaacttt

SEQ ID NO: 64743 - DNA, 20 bp, Artificial Sequence
  chemically synthesized
ataaaagcccttgtccaatg

SEQ ID NO: 64744 - DNA, 20 bp, Artificial Sequence
  chemically synthesized
aggtcatcaagacagtctac

SEQ ID NO: 64745 - DNA, 20 bp, Artificial Sequence
  chemically synthesized
ggacattctacccaacaact

SEQ ID NO: 64746 - DNA, 20 bp, Artificial Sequence
  chemically synthesized
aagcactctctcagaccaca

SEQ ID NO: 64747 - DNA, 20 bp, Artificial Sequence
  chemically synthesized
ctcgccaggacaatcaggca

SEQ ID NO: 64748 - DNA, 20 bp, Artificial Sequence
  chemically synthesized
ccaggacaatcaggcaagag

SEQ ID NO: 64749 - DNA, 20 bp, Artificial Sequence
  chemically synthesized
tcaagatacaaaatcagtgt

SEQ ID NO: 64750 - DNA, 20 bp, Artificial Sequence
  chemically synthesized
cccattcacaattgctgcaa

SEQ ID NO: 64751 - DNA, 20 bp, Artificial Sequence
  chemically synthesized
aagagaataaaataaaatac

SEQ ID NO: 64752 - DNA, 20 bp, Artificial Sequence
  chemically synthesized
aaaacattccatgctcatag

SEQ ID NO: 64753 - DNA, 20 bp, Artificial Sequence
  chemically synthesized
cattccatgctcatagatag

SEQ ID NO: 64754 - DNA, 20 bp, Artificial Sequence
  chemically synthesized
agctaccactgacttttttc

SEQ ID NO: 64755 - DNA, 20 bp, Artificial Sequence
  chemically synthesized
cactgacttttttcaaagaa

SEQ ID NO: 64756 - DNA, 20 bp, Artificial Sequence
  chemically synthesized
agtggaacagaacagaagcc

SEQ ID NO: 64757 - DNA, 20 bp, Artificial Sequence
  chemically synthesized
acaaacatcacaaaagcaat

SEQ ID NO: 64758 - DNA, 20 bp, Artificial Sequence
  chemically synthesized
acatcacaaaagcaatggag

SEQ ID NO: 64759 - DNA, 20 bp, Artificial Sequence
  chemically synthesized
tcagagtgaacaggcaacct

SEQ ID NO: 64760 - DNA, 20 bp, Artificial Sequence
  chemically synthesized
aacaggcaacctacagaatg

SEQ ID NO: 64761 - DNA, 20 bp, Artificial Sequence
  chemically synthesized
aaagaacttcaacaaattta

SEQ ID NO: 64762 - DNA, 20 bp, Artificial Sequence
  chemically synthesized
aaagaagtcatttatgtggc

SEQ ID NO: 64763 - DNA, 20 bp, Artificial Sequence
  chemically synthesized
gctcatcatcactggtcatt

SEQ ID NO: 64764 - DNA, 20 bp, Artificial Sequence
  chemically synthesized
gagataccatctcatgccag

SEQ ID NO: 64765 - DNA, 20 bp, Artificial Sequence
  chemically synthesized
aaggtgctggagaggatgtg

SEQ ID NO: 64766 - DNA, 20 bp, Artificial Sequence
  chemically synthesized
gattcctcaaggatctagaa

SEQ ID NO: 64767 - DNA, 20 bp, Artificial Sequence
  chemically synthesized
ccattactgggtatataccc

SEQ ID NO: 64768 - DNA, 20 bp, Artificial Sequence
  chemically synthesized
ctgggtatatacccaaagaa

SEQ ID NO: 64769 - DNA, 20 bp, Artificial Sequence
  chemically synthesized
ccatcagcgatataatggat

SEQ ID NO: 64770 - DNA, 20 bp, Artificial Sequence
  chemically synthesized
gagcaaactaacacaggaac

SEQ ID NO: 64771 - DNA, 20 bp, Artificial Sequence
  chemically synthesized
ttaggagagggataacatta

SEQ ID NO: 64772 - DNA, 20 bp, Artificial Sequence
  chemically synthesized
gacaatataaggtcacacca

SEQ ID NO: 64773 - DNA, 20 bp, Artificial Sequence
  chemically synthesized
aggtcacaccacaagaaact

SEQ ID NO: 64774 - DNA, 20 bp, Artificial Sequence
  chemically synthesized
aacagaaccaaaacccagca

SEQ ID NO: 64775 - DNA, 20 bp, Artificial Sequence
  chemically synthesized
agaccattagcaagattaac

SEQ ID NO: 64776 - DNA, 20 bp, Artificial Sequence
  chemically synthesized
agaagtgcaaataaactcaa

SEQ ID NO: 64777 - DNA, 20 bp, Artificial Sequence
  chemically synthesized
gagatactattactgatacc

SEQ ID NO: 64778 - DNA, 20 bp, Artificial Sequence
  chemically synthesized
aacacctttacatgcataaa

SEQ ID NO: 64779 - DNA, 20 bp, Artificial Sequence
  chemically synthesized
agggctctagcttaagtcag

SEQ ID NO: 64780 - DNA, 20 bp, Artificial Sequence
  chemically synthesized
aattctaccagacattcaaa

SEQ ID NO: 64781 - DNA, 20 bp, Artificial Sequence
  chemically synthesized
ttgacagtattctacaagat

SEQ ID NO: 64782 - DNA, 20 bp, Artificial Sequence
  chemically synthesized
attctacaagatagagaaag

SEQ ID NO: 64783 - DNA, 20 bp, Artificial Sequence
  chemically synthesized
aagtgtgatacacaacataa

SEQ ID NO: 64784 - DNA, 20 bp, Artificial Sequence
  chemically synthesized
atgtgattatctcaatagcc

SEQ ID NO: 64785 - DNA, 20 bp, Artificial Sequence
  chemically synthesized
ctagcaagagcaatcagaca

SEQ ID NO: 64786 - DNA, 20 bp, Artificial Sequence
  chemically synthesized
aagcacatccaaattgttaa

SEQ ID NO: 64787 - DNA, 20 bp, Artificial Sequence
  chemically synthesized
ctgatgatatgattgtgtat

SEQ ID NO: 64788 - DNA, 20 bp, Artificial Sequence
  chemically synthesized
cataccagcaatgaccaagc

SEQ ID NO: 64789 - DNA, 20 bp, Artificial Sequence
  chemically synthesized
catgccattctcatagatgg

SEQ ID NO: 64790 - DNA, 20 bp, Artificial Sequence
  chemically synthesized
caccattagtcttcacagaa

SEQ ID NO: 64791 - DNA, 20 bp, Artificial Sequence
  chemically synthesized
taggcacatcgaccaatgga

SEQ ID NO: 64792 - DNA, 20 bp, Artificial Sequence
  chemically synthesized
aatggaacagaatagagaac

SEQ ID NO: 64793 - DNA, 20 bp, Artificial Sequence
  chemically synthesized
tagctggcaagctacatgta

SEQ ID NO: 64794 - DNA, 20 bp, Artificial Sequence
  chemically synthesized
gccctgaaactgtaacaatt

SEQ ID NO: 64795 - DNA, 20 bp, Artificial Sequence
  chemically synthesized
aaatgcaaatacataaaaac

SEQ ID NO: 64796 - DNA, 20 bp, Artificial Sequence
  chemically synthesized
catggcaaaaggaagagtct

SEQ ID NO: 64797 - DNA, 20 bp, Artificial Sequence
  chemically synthesized
aacagacaacccacagagtg

SEQ ID NO: 64798 - DNA, 20 bp, Artificial Sequence
  chemically synthesized
cacaatctatacatctgaca

SEQ ID NO: 64799 - DNA, 20 bp, Artificial Sequence
  chemically synthesized
aatgaacacaaatagattat

SEQ ID NO: 64800 - DNA, 20 bp, Artificial Sequence
  chemically synthesized
aggacatgaacagacaattc

SEQ ID NO: 64801 - DNA, 20 bp, Artificial Sequence
  chemically synthesized
acagatccttgtgaggatat

SEQ ID NO: 64802 - DNA, 20 bp, Artificial Sequence
  chemically synthesized
cactagtggttatttatcca

SEQ ID NO: 64803 - DNA, 20 bp, Artificial Sequence
  chemically synthesized
cagtactattttgccatgaa

SEQ ID NO: 64804 - DNA, 20 bp, Artificial Sequence
  chemically synthesized
gataataaaataagccagat

SEQ ID NO: 64805 - DNA, 20 bp, Artificial Sequence
  chemically synthesized
gggtctcatggtggtagaga

SEQ ID NO: 64806 - DNA, 20 bp, Artificial Sequence
  chemically synthesized
tattatatatttcaaaatgg

SEQ ID NO: 64807 - DNA, 20 bp, Artificial Sequence
  chemically synthesized
atttgaaattttctcaatac

SEQ ID NO: 64808 - DNA, 20 bp, Artificial Sequence
  chemically synthesized
gaagccctagcttgctggtt

SEQ ID NO: 64809 - DNA, 20 bp, Artificial Sequence
  chemically synthesized
aattgcaatttttgattact

SEQ ID NO: 64810 - DNA, 20 bp, Artificial Sequence
  chemically synthesized
ctccttgccaaagtgagtag

SEQ ID NO: 64811 - DNA, 20 bp, Artificial Sequence
  chemically synthesized
attgtctaatttttgtaaat

SEQ ID NO: 64812 - DNA, 20 bp, Artificial Sequence
  chemically synthesized
gatgggaaatttaacatatt

SEQ ID NO: 64813 - DNA, 20 bp, Artificial Sequence
  chemically synthesized
tctctcccattctccttttc

SEQ ID NO: 64814 - DNA, 20 bp, Artificial Sequence
  chemically synthesized
gacaaaaacagggccaagga

SEQ ID NO: 64815 - DNA, 20 bp, Artificial Sequence
  chemically synthesized
aagaaaataaagctgttaaa

SEQ ID NO: 64816 - DNA, 20 bp, Artificial Sequence
  chemically synthesized
aaaaccgtacatagttcctt

SEQ ID NO: 64817 - DNA, 20 bp, Artificial Sequence
  chemically synthesized
tagttccttctagaaactga

SEQ ID NO: 64818 - DNA, 20 bp, Artificial Sequence
  chemically synthesized
tgattccctagagaggacag

SEQ ID NO: 64819 - DNA, 20 bp, Artificial Sequence
  chemically synthesized
agattacatccagtgcttcc

SEQ ID NO: 64820 - DNA, 20 bp, Artificial Sequence
  chemically synthesized
aatcctaaaattatttaaag

SEQ ID NO: 64821 - DNA, 20 bp, Artificial Sequence
  chemically synthesized
gccagaatttgtcatcaaac

SEQ ID NO: 64822 - DNA, 20 bp, Artificial Sequence
  chemically synthesized
tcaattcgatccatgtgcct

SEQ ID NO: 64823 - DNA, 20 bp, Artificial Sequence
  chemically synthesized
attgtcattatcctcatatt

SEQ ID NO: 64824 - DNA, 20 bp, Artificial Sequence
  chemically synthesized
tagaatcaaggaataaattc

SEQ ID NO: 64825 - DNA, 20 bp, Artificial Sequence
  chemically synthesized
aaaaaaacacttgtggcaag

SEQ ID NO: 64826 - DNA, 20 bp, Artificial Sequence
  chemically synthesized
ctactcaggaggccaaggca

SEQ ID NO: 64827 - DNA, 20 bp, Artificial Sequence
  chemically synthesized
tgtcctttgcattcaaagta

SEQ ID NO: 64828 - DNA, 20 bp, Artificial Sequence
  chemically synthesized
aaggtggtagggaggagctt

SEQ ID NO: 64829 - DNA, 20 bp, Artificial Sequence
  chemically synthesized
ttatggccatccaggataga

SEQ ID NO: 64830 - DNA, 20 bp, Artificial Sequence
  chemically synthesized
agatcagaaagattagacag

SEQ ID NO: 64831 - DNA, 20 bp, Artificial Sequence
  chemically synthesized
cagtcagaaaaagtaatcag

SEQ ID NO: 64832 - DNA, 20 bp, Artificial Sequence
  chemically synthesized
catttaagtataaaggactt

SEQ ID NO: 64833 - DNA, 20 bp, Artificial Sequence
  chemically synthesized
taagtataaaggacttttag

SEQ ID NO: 64834 - DNA, 20 bp, Artificial Sequence
  chemically synthesized
atgtttttcatggtattatc

SEQ ID NO: 64835 - DNA, 20 bp, Artificial Sequence
  chemically synthesized
ctattttctagtgtaattgt

SEQ ID NO: 64836 - DNA, 20 bp, Artificial Sequence
  chemically synthesized
tagtgtaattgtaaagaatg

SEQ ID NO: 64837 - DNA, 20 bp, Artificial Sequence
  chemically synthesized
atctttaatgggaaaaagga

SEQ ID NO: 64838 - DNA, 20 bp, Artificial Sequence
  chemically synthesized
tgggaaaaaggagtagaaag

SEQ ID NO: 64839 - DNA, 20 bp, Artificial Sequence
  chemically synthesized
taaaacttgagtctgtcaac

SEQ ID NO: 64840 - DNA, 20 bp, Artificial Sequence
  chemically synthesized
tattttcatgattaaaattc

SEQ ID NO: 64841 - DNA, 20 bp, Artificial Sequence
  chemically synthesized
tgtatttatgaactaagaac

SEQ ID NO: 64842 - DNA, 20 bp, Artificial Sequence
  chemically synthesized
aaacaatactctgaagtagt

SEQ ID NO: 64843 - DNA, 20 bp, Artificial Sequence
  chemically synthesized
cagggctttgaatcttatgt

SEQ ID NO: 64844 - DNA, 20 bp, Artificial Sequence
  chemically synthesized
ggctaaggcatctgtgaagg

SEQ ID NO: 64845 - DNA, 20 bp, Artificial Sequence
  chemically synthesized
atggtgatagctgggcagcg

SEQ ID NO: 64846 - DNA, 20 bp, Artificial Sequence
  chemically synthesized
ctagctaaaggcagtgagag

SEQ ID NO: 64847 - DNA, 20 bp, Artificial Sequence
  chemically synthesized
gtttctacacaagtagatac

SEQ ID NO: 64848 - DNA, 20 bp, Artificial Sequence
  chemically synthesized
agtcctgcatgattagttgc

SEQ ID NO: 64849 - DNA, 20 bp, Artificial Sequence
  chemically synthesized
ctaggggaaggatagcatta

SEQ ID NO: 64850 - DNA, 20 bp, Artificial Sequence
  chemically synthesized
caattcttaactataatctt

SEQ ID NO: 64851 - DNA, 20 bp, Artificial Sequence
  chemically synthesized
atttggacagccaggaaagc

SEQ ID NO: 64852 - DNA, 20 bp, Artificial Sequence
  chemically synthesized
attcaaaattgtaaaattgc

SEQ ID NO: 64853 - DNA, 20 bp, Artificial Sequence
  chemically synthesized
gctaagaatacagcacaaaa

SEQ ID NO: 64854 - DNA, 20 bp, Artificial Sequence
  chemically synthesized
ccaatgagattaggtgctat

SEQ ID NO: 64855 - DNA, 20 bp, Artificial Sequence
  chemically synthesized
accctaaagatgtaagatgc

SEQ ID NO: 64856 - DNA, 20 bp, Artificial Sequence
  chemically synthesized
aggatgagattcggtgaagg

SEQ ID NO: 64857 - DNA, 20 bp, Artificial Sequence
  chemically synthesized
atacctacatcatagagttg

SEQ ID NO: 64858 - DNA, 20 bp, Artificial Sequence
  chemically synthesized
tatgcatgaacaactattgt

SEQ ID NO: 64859 - DNA, 20 bp, Artificial Sequence
  chemically synthesized
taatttggatagtatattgg

SEQ ID NO: 64860 - DNA, 20 bp, Artificial Sequence
  chemically synthesized
aaccaacaggattttctgac

SEQ ID NO: 64861 - DNA, 20 bp, Artificial Sequence
  chemically synthesized
tgttcatcacagtctctacc

SEQ ID NO: 64862 - DNA, 20 bp, Artificial Sequence
  chemically synthesized
tgggtgggtggatatggaaa

SEQ ID NO: 64863 - DNA, 20 bp, Artificial Sequence
  chemically synthesized
ataagtcagagaacaatcag

SEQ ID NO: 64864 - DNA, 20 bp, Artificial Sequence
  chemically synthesized
gatgagtttttcctccatgt

SEQ ID NO: 64865 - DNA, 20 bp, Artificial Sequence
  chemically synthesized
tgtagaattgaataagaagg

SEQ ID NO: 64866 - DNA, 20 bp, Artificial Sequence
  chemically synthesized
tgctgacaactatgttagag

SEQ ID NO: 64867 - DNA, 20 bp, Artificial Sequence
  chemically synthesized
tattcaggaaataatatatt

SEQ ID NO: 64868 - DNA, 20 bp, Artificial Sequence
  chemically synthesized
gaggtcactaatggagacac

SEQ ID NO: 64869 - DNA, 20 bp, Artificial Sequence
  chemically synthesized
ttcagtgcttgaatcataaa

SEQ ID NO: 64870 - DNA, 20 bp, Artificial Sequence
  chemically synthesized
ggtatttatgggatggggga

SEQ ID NO: 64871 - DNA, 20 bp, Artificial Sequence
  chemically synthesized
tgtggattattttagagagt

SEQ ID NO: 64872 - DNA, 20 bp, Artificial Sequence
  chemically synthesized
gtcaagatttttttaaaaat

SEQ ID NO: 64873 - DNA, 20 bp, Artificial Sequence
  chemically synthesized
agaaaacataagttggacct

SEQ ID NO: 64874 - DNA, 20 bp, Artificial Sequence
  chemically synthesized
ttctcctctctcctttctca

SEQ ID NO: 64875 - DNA, 20 bp, Artificial Sequence
  chemically synthesized
ctagggtcaggcagatcaca

SEQ ID NO: 64876 - DNA, 20 bp, Artificial Sequence
  chemically synthesized
ttaggaggggccaaatgagc

SEQ ID NO: 64877 - DNA, 20 bp, Artificial Sequence
  chemically synthesized
atgataatatgtattagcta

SEQ ID NO: 64878 - DNA, 20 bp, Artificial Sequence
  chemically synthesized
ttacagttgcatgctacctt

SEQ ID NO: 64879 - DNA, 20 bp, Artificial Sequence
  chemically synthesized
atacaataatggctaatttt

SEQ ID NO: 64880 - DNA, 20 bp, Artificial Sequence
  chemically synthesized
tcttccattctttttacaga

SEQ ID NO: 64881 - DNA, 20 bp, Artificial Sequence
  chemically synthesized
ttttaaagtagttagcatat

SEQ ID NO: 64882 - DNA, 20 bp, Artificial Sequence
  chemically synthesized
gacccggcaaagggagatgc

SEQ ID NO: 64883 - DNA, 20 bp, Artificial Sequence
  chemically synthesized
ccctcagttcttgacgctag

SEQ ID NO: 64884 - DNA, 20 bp, Artificial Sequence
  chemically synthesized
atgacaatctctgtaaccca

SEQ ID NO: 64885 - DNA, 20 bp, Artificial Sequence
  chemically synthesized
tttctccctcaaactttcct

SEQ ID NO: 64886 - DNA, 20 bp, Artificial Sequence
  chemically synthesized
tgttcaataatacatatctc

SEQ ID NO: 64887 - DNA, 20 bp, Artificial Sequence
  chemically synthesized
cataaaatggcacctgacat

SEQ ID NO: 64888 - DNA, 20 bp, Artificial Sequence
  chemically synthesized
gggagcagtcccatgtagta

SEQ ID NO: 64889 - DNA, 20 bp, Artificial Sequence
  chemically synthesized
catggctgtctcctttatcc

SEQ ID NO: 64890 - DNA, 20 bp, Artificial Sequence
  chemically synthesized
ctagccaggggctggactgt

SEQ ID NO: 64891 - DNA, 20 bp, Artificial Sequence
  chemically synthesized
gataatctgattcatgcaac

SEQ ID NO: 64892 - DNA, 20 bp, Artificial Sequence
  chemically synthesized
gcatatgatggggtagcaga

SEQ ID NO: 64893 - DNA, 20 bp, Artificial Sequence
  chemically synthesized
agaccagccttttgctcagg

SEQ ID NO: 64894 - DNA, 20 bp, Artificial Sequence
  chemically synthesized
ttatgaaattcttacacaca

SEQ ID NO: 64895 - DNA, 20 bp, Artificial Sequence
  chemically synthesized
ataataatagtatctacctg

SEQ ID NO: 64896 - DNA, 20 bp, Artificial Sequence
  chemically synthesized
acactagttttcacctgcag

SEQ ID NO: 64897 - DNA, 20 bp, Artificial Sequence
  chemically synthesized
aaaccctccattttacagat

SEQ ID NO: 64898 - DNA, 20 bp, Artificial Sequence
  chemically synthesized
actgagtcatacaactacta

SEQ ID NO: 64899 - DNA, 20 bp, Artificial Sequence
  chemically synthesized
agttctttcctaaaggtatg

SEQ ID NO: 64900 - DNA, 20 bp, Artificial Sequence
  chemically synthesized
tcagtgggcctgggtgaagg

SEQ ID NO: 64901 - DNA, 20 bp, Artificial Sequence
  chemically synthesized
ccagactcctacttataaaa

SEQ ID NO: 64902 - DNA, 20 bp, Artificial Sequence
  chemically synthesized
tcatagctgctgagtgggag

SEQ ID NO: 64903 - DNA, 20 bp, Artificial Sequence
  chemically synthesized
ggctattcttattctcacac

SEQ ID NO: 64904 - DNA, 20 bp, Artificial Sequence
  chemically synthesized
tcttattctcacactaagaa

SEQ ID NO: 64905 - DNA, 20 bp, Artificial Sequence
  chemically synthesized
attcctgtttcaatggctta

SEQ ID NO: 64906 - DNA, 20 bp, Artificial Sequence
  chemically synthesized
actttatattgttactactc

SEQ ID NO: 64907 - DNA, 20 bp, Artificial Sequence
  chemically synthesized
gttacaacatggtgaataca

SEQ ID NO: 64908 - DNA, 20 bp, Artificial Sequence
  chemically synthesized
aagagaaagctattacaagt

SEQ ID NO: 64909 - DNA, 20 bp, Artificial Sequence
  chemically synthesized
ctgtagggttgagagggaga

SEQ ID NO: 64910 - DNA, 20 bp, Artificial Sequence
  chemically synthesized
cctggggataaatatttcct

SEQ ID NO: 64911 - DNA, 20 bp, Artificial Sequence
  chemically synthesized
ctattttccctgaagttctc

SEQ ID NO: 64912 - DNA, 20 bp, Artificial Sequence
  chemically synthesized
aaggtctgttgcatcaagag

SEQ ID NO: 64913 - DNA, 20 bp, Artificial Sequence
  chemically synthesized
tacaaagcatgagttgtggg

SEQ ID NO: 64914 - DNA, 20 bp, Artificial Sequence
  chemically synthesized
tcttttgacttcctttgaca

SEQ ID NO: 64915 - DNA, 20 bp, Artificial Sequence
  chemically synthesized
tcaacatcctcataataact

SEQ ID NO: 64916 - DNA, 20 bp, Artificial Sequence
  chemically synthesized
ttatagttcctagcacaaag

SEQ ID NO: 64917 - DNA, 20 bp, Artificial Sequence
  chemically synthesized
ttacatagctagtatataac

SEQ ID NO: 64918 - DNA, 20 bp, Artificial Sequence
  chemically synthesized
tctcaatatcacttcttcac

SEQ ID NO: 64919 - DNA, 20 bp, Artificial Sequence
  chemically synthesized
atcctttcaaaatatacttc

SEQ ID NO: 64920 - DNA, 20 bp, Artificial Sequence
  chemically synthesized
atacttctgagaaatgagag

SEQ ID NO: 64921 - DNA, 20 bp, Artificial Sequence
  chemically synthesized
acagggaaggaggtgtgggg

SEQ ID NO: 64922 - DNA, 20 bp, Artificial Sequence
  chemically synthesized
catttctggactcttgaaat

SEQ ID NO: 64923 - DNA, 20 bp, Artificial Sequence
  chemically synthesized
aactagcctttgctttatta

SEQ ID NO: 64924 - DNA, 20 bp, Artificial Sequence
  chemically synthesized
tattaggaaaaagggaaact

SEQ ID NO: 64925 - DNA, 20 bp, Artificial Sequence
  chemically synthesized
aatataatccactaataaaa

SEQ ID NO: 64926 - DNA, 20 bp, Artificial Sequence
  chemically synthesized
agcacgtccaagtgaaggca

SEQ ID NO: 64927 - DNA, 20 bp, Artificial Sequence
  chemically synthesized
ggcaggagaaatgagaggag

SEQ ID NO: 64928 - DNA, 20 bp, Artificial Sequence
  chemically synthesized
agaaagaggagccatttgat

SEQ ID NO: 64929 - DNA, 20 bp, Artificial Sequence
  chemically synthesized
gagccatttgatcaagaata

SEQ ID NO: 64930 - DNA, 20 bp, Artificial Sequence
  chemically synthesized
ataaaggagaacctaaagag

SEQ ID NO: 64931 - DNA, 20 bp, Artificial Sequence
  chemically synthesized
gatacccatataaataacgt

SEQ ID NO: 64932 - DNA, 20 bp, Artificial Sequence
  chemically synthesized
gtcaggatgcagtaatagat

SEQ ID NO: 64933 - DNA, 20 bp, Artificial Sequence
  chemically synthesized
tcgaggaaaacctatgaaaa

SEQ ID NO: 64934 - DNA, 20 bp, Artificial Sequence
  chemically synthesized
gaacttgaaattgcattata

SEQ ID NO: 64935 - DNA, 20 bp, Artificial Sequence
  chemically synthesized
ctgtgattgactttatcatt

SEQ ID NO: 64936 - DNA, 20 bp, Artificial Sequence
  chemically synthesized
tgccacatagaggaagggaa

SEQ ID NO: 64937 - DNA, 20 bp, Artificial Sequence
  chemically synthesized
gttcttggtttcactgactt

SEQ ID NO: 64938 - DNA, 20 bp, Artificial Sequence
  chemically synthesized
cggctctggccttggccagc

SEQ ID NO: 64939 - DNA, 20 bp, Artificial Sequence
  chemically synthesized
ctctttcagagaacatcatg

SEQ ID NO: 64940 - DNA, 20 bp, Artificial Sequence
  chemically synthesized
atggcagaaacattttttca

SEQ ID NO: 64941 - DNA, 20 bp, Artificial Sequence
  chemically synthesized
caactagaaccaagttacac

SEQ ID NO: 64942 - DNA, 20 bp, Artificial Sequence
  chemically synthesized
gagatgtttatagtgataag

SEQ ID NO: 64943 - DNA, 20 bp, Artificial Sequence
  chemically synthesized
agatttgtattattttatgt

SEQ ID NO: 64944 - DNA, 20 bp, Artificial Sequence
  chemically synthesized
attattttatgtgaagaaac

SEQ ID NO: 64945 - DNA, 20 bp, Artificial Sequence
  chemically synthesized
aacatgatgaggagacatgg

SEQ ID NO: 64946 - DNA, 20 bp, Artificial Sequence
  chemically synthesized
tcactatgatacctacttat

SEQ ID NO: 64947 - DNA, 20 bp, Artificial Sequence
  chemically synthesized
cataaacattgccaatgcat

SEQ ID NO: 64948 - DNA, 20 bp, Artificial Sequence
  chemically synthesized
cacacccaaatcttcaacag

SEQ ID NO: 64949 - DNA, 20 bp, Artificial Sequence
  chemically synthesized
catctgacagcataggaagg

SEQ ID NO: 64950 - DNA, 20 bp, Artificial Sequence
  chemically synthesized
taggcttttcaaactacctt

SEQ ID NO: 64951 - DNA, 20 bp, Artificial Sequence
  chemically synthesized
ggaatattcatgagacaaac

SEQ ID NO: 64952 - DNA, 20 bp, Artificial Sequence
  chemically synthesized
tcatgagacaaacagagaat

SEQ ID NO: 64953 - DNA, 20 bp, Artificial Sequence
  chemically synthesized
tgttaatatacaagtgattt

SEQ ID NO: 64954 - DNA, 20 bp, Artificial Sequence
  chemically synthesized
aaagtgcatgaataagacag

SEQ ID NO: 64955 - DNA, 20 bp, Artificial Sequence
  chemically synthesized
tgaataagacagctagaaag

SEQ ID NO: 64956 - DNA, 20 bp, Artificial Sequence
  chemically synthesized
atgtgaaacagttctggctg

SEQ ID NO: 64957 - DNA, 20 bp, Artificial Sequence
  chemically synthesized
attaataaatttgggggttt

SEQ ID NO: 64958 - DNA, 20 bp, Artificial Sequence
  chemically synthesized
gactaaactcacagtatgac

SEQ ID NO: 64959 - DNA, 20 bp, Artificial Sequence
  chemically synthesized
cgcataaatatacatttact

SEQ ID NO: 64960 - DNA, 20 bp, Artificial Sequence
  chemically synthesized
ggctgtcttcttataacaat

SEQ ID NO: 64961 - DNA, 20 bp, Artificial Sequence
  chemically synthesized
agaccaaacaacaaaggcaa

SEQ ID NO: 64962 - DNA, 20 bp, Artificial Sequence
  chemically synthesized
ccagaaaacgacgtttctaa

SEQ ID NO: 64963 - DNA, 20 bp, Artificial Sequence
  chemically synthesized
caaataaataaattttacac

SEQ ID NO: 64964 - DNA, 20 bp, Artificial Sequence
  chemically synthesized
ccaaatgggccttctaattt

SEQ ID NO: 64965 - DNA, 20 bp, Artificial Sequence
  chemically synthesized
agatttcttaagtgaagcag

SEQ ID NO: 64966 - DNA, 20 bp, Artificial Sequence
  chemically synthesized
ttaagtgaagcagagagaat

SEQ ID NO: 64967 - DNA, 20 bp, Artificial Sequence
  chemically synthesized
ttctgaacatggactttcaa

SEQ ID NO: 64968 - DNA, 20 bp, Artificial Sequence
  chemically synthesized
aacatggactttcaatcaga

SEQ ID NO: 64969 - DNA, 20 bp, Artificial Sequence
  chemically synthesized
caacgagaacttaaaaattg

SEQ ID NO: 64970 - DNA, 20 bp, Artificial Sequence
  chemically synthesized
gcgcagaactagcagtagat

SEQ ID NO: 64971 - DNA, 20 bp, Artificial Sequence
  chemically synthesized
cactttgaagaagattgaag

SEQ ID NO: 64972 - DNA, 20 bp, Artificial Sequence
  chemically synthesized
tgtgagaagcaagaggggaa

SEQ ID NO: 64973 - DNA, 20 bp, Artificial Sequence
  chemically synthesized
atagttggttatttttttca

SEQ ID NO: 64974 - DNA, 20 bp, Artificial Sequence
  chemically synthesized
gaaaaatgtcaggagacaaa

SEQ ID NO: 64975 - DNA, 20 bp, Artificial Sequence
  chemically synthesized
acaaaatagaaagctggaaa

SEQ ID NO: 64976 - DNA, 20 bp, Artificial Sequence
  chemically synthesized
atctggcttccacgagatga

SEQ ID NO: 64977 - DNA, 20 bp, Artificial Sequence
  chemically synthesized
ttttcagtaatgggagaggc

SEQ ID NO: 64978 - DNA, 20 bp, Artificial Sequence
  chemically synthesized
gggctcaagccctactctgc

SEQ ID NO: 64979 - DNA, 20 bp, Artificial Sequence
  chemically synthesized
aggattcacgaatggaggaa

SEQ ID NO: 64980 - DNA, 20 bp, Artificial Sequence
  chemically synthesized
ctgtcttgaggattagtata

SEQ ID NO: 64981 - DNA, 20 bp, Artificial Sequence
  chemically synthesized
atatgggtagcagtagagtg

SEQ ID NO: 64982 - DNA, 20 bp, Artificial Sequence
  chemically synthesized
gttcatcactcgggaattgg

SEQ ID NO: 64983 - DNA, 20 bp, Artificial Sequence
  chemically synthesized
tgtactcacaaggcctttcc

SEQ ID NO: 64984 - DNA, 20 bp, Artificial Sequence
  chemically synthesized
acaaataacaaaaatcatgg

SEQ ID NO: 64985 - DNA, 20 bp, Artificial Sequence
  chemically synthesized
ctgaggaaaatgcttattca

SEQ ID NO: 64986 - DNA, 20 bp, Artificial Sequence
  chemically synthesized
gcttattcaatagaaatgac

SEQ ID NO: 64987 - DNA, 20 bp, Artificial Sequence
  chemically synthesized
ccctgcctccaccaaaaaaa

SEQ ID NO: 64988 - DNA, 20 bp, Artificial Sequence
  chemically synthesized
aaataaaataaaataaaacg

SEQ ID NO: 64989 - DNA, 20 bp, Artificial Sequence
  chemically synthesized
ctcatctattgtgagtttcc

SEQ ID NO: 64990 - DNA, 20 bp, Artificial Sequence
  chemically synthesized
gtaaagttagtaaactcatt

SEQ ID NO: 64991 - DNA, 20 bp, Artificial Sequence
  chemically synthesized
gaaaagataagcactcccag

SEQ ID NO: 64992 - DNA, 20 bp, Artificial Sequence
  chemically synthesized
tgaatctgtaagactcgtat

SEQ ID NO: 64993 - DNA, 20 bp, Artificial Sequence
  chemically synthesized
gatttttgttgttgtgatac

SEQ ID NO: 64994 - DNA, 20 bp, Artificial Sequence
  chemically synthesized
tttttattttataaaaacct

SEQ ID NO: 64995 - DNA, 20 bp, Artificial Sequence
  chemically synthesized
aacaataataattatatgtt

SEQ ID NO: 64996 - DNA, 20 bp, Artificial Sequence
  chemically synthesized
ccttccaatgttgccttata

SEQ ID NO: 64997 - DNA, 20 bp, Artificial Sequence
  chemically synthesized
ttgtggcaaatttggtagta

SEQ ID NO: 64998 - DNA, 20 bp, Artificial Sequence
  chemically synthesized
cacatacccaaatattccag

SEQ ID NO: 64999 - DNA, 20 bp, Artificial Sequence
  chemically synthesized
ctaatagtttagggagtctc

SEQ ID NO: 65000 - DNA, 20 bp, Artificial Sequence
  chemically synthesized
actaaaatgagaagacaaaa

SEQ ID NO: 65001 - DNA, 20 bp, Artificial Sequence
  chemically synthesized
cccaaaattgtgttcctata

SEQ ID NO: 65002 - DNA, 20 bp, Artificial Sequence
  chemically synthesized
ctactcgggaggctgaggca

SEQ ID NO: 65003 - DNA, 20 bp, Artificial Sequence
  chemically synthesized
aaaaaaaaaaaaaggtttgg

SEQ ID NO: 65004 - DNA, 20 bp, Artificial Sequence
  chemically synthesized
acaaattttgctctcagtaa

SEQ ID NO: 65005 - DNA, 20 bp, Artificial Sequence
  chemically synthesized
gtaggttaatagtgaaaaat

SEQ ID NO: 65006 - DNA, 20 bp, Artificial Sequence
  chemically synthesized
ttgacaatttcaacataatg

SEQ ID NO: 65007 - DNA, 20 bp, Artificial Sequence
  chemically synthesized
ctactctggaggctgaggca

SEQ ID NO: 65008 - DNA, 20 bp, Artificial Sequence
  chemically synthesized
tgcactctagcctgggcaac

SEQ ID NO: 65009 - DNA, 20 bp, Artificial Sequence
  chemically synthesized
aaaatctgttaaagagagag

SEQ ID NO: 65010 - DNA, 20 bp, Artificial Sequence
  chemically synthesized
ctgttaaagagagagagaga

SEQ ID NO: 65011 - DNA, 20 bp, Artificial Sequence
  chemically synthesized
aaagaaaagtgagtaaaaaa

SEQ ID NO: 65012 - DNA, 20 bp, Artificial Sequence
  chemically synthesized
cttatatttaggtctgatct

SEQ ID NO: 65013 - DNA, 20 bp, Artificial Sequence
  chemically synthesized
catacagcaataaatgcatt

SEQ ID NO: 65014 - DNA, 20 bp, Artificial Sequence
  chemically synthesized
ttttacatcaatcatggttc

SEQ ID NO: 65015 - DNA, 20 bp, Artificial Sequence
  chemically synthesized
aaaatccataacaacatcaa

SEQ ID NO: 65016 - DNA, 20 bp, Artificial Sequence
  chemically synthesized
atagctagaccaatacatga

SEQ ID NO: 65017 - DNA, 20 bp, Artificial Sequence
  chemically synthesized
agttatgttaccatatagga

SEQ ID NO: 65018 - DNA, 20 bp, Artificial Sequence
  chemically synthesized
atgttaccatataggaagag

SEQ ID NO: 65019 - DNA, 20 bp, Artificial Sequence
  chemically synthesized
ctataacttgaagtttcata

SEQ ID NO: 65020 - DNA, 20 bp, Artificial Sequence
  chemically synthesized
ggcatctttctcactaagca

SEQ ID NO: 65021 - DNA, 20 bp, Artificial Sequence
  chemically synthesized
ggaacttactgggcacatta

SEQ ID NO: 65022 - DNA, 20 bp, Artificial Sequence
  chemically synthesized
aagttttaatacaaggacat

SEQ ID NO: 65023 - DNA, 20 bp, Artificial Sequence
  chemically synthesized
ctactcgggaggctgaggca

SEQ ID NO: 65024 - DNA, 20 bp, Artificial Sequence
  chemically synthesized
gcactgaaaacttcctttct

SEQ ID NO: 65025 - DNA, 20 bp, Artificial Sequence
  chemically synthesized
caaggaatattctttgaaaa

SEQ ID NO: 65026 - DNA, 20 bp, Artificial Sequence
  chemically synthesized
aagtagagagatatatttag

SEQ ID NO: 65027 - DNA, 20 bp, Artificial Sequence
  chemically synthesized
taattcacagtagccaagga

SEQ ID NO: 65028 - DNA, 20 bp, Artificial Sequence
  chemically synthesized
caaaatgtcttatatatgtg

SEQ ID NO: 65029 - DNA, 20 bp, Artificial Sequence
  chemically synthesized
atttcacttacatgagctat

SEQ ID NO: 65030 - DNA, 20 bp, Artificial Sequence
  chemically synthesized
atttggtgtaatacaaaatt

SEQ ID NO: 65031 - DNA, 20 bp, Artificial Sequence
  chemically synthesized
catttatttgattttaataa

SEQ ID NO: 65032 - DNA, 20 bp, Artificial Sequence
  chemically synthesized
tgactcaacaatttcacttg

SEQ ID NO: 65033 - DNA, 20 bp, Artificial Sequence
  chemically synthesized
tcaacaatttcacttgagag

SEQ ID NO: 65034 - DNA, 20 bp, Artificial Sequence
  chemically synthesized
ttatttactcatctggtaat

SEQ ID NO: 65035 - DNA, 20 bp, Artificial Sequence
  chemically synthesized
ctacttcagtgaatgacacc

SEQ ID NO: 65036 - DNA, 20 bp, Artificial Sequence
  chemically synthesized
gactcttcatgatcaggcaa

SEQ ID NO: 65037 - DNA, 20 bp, Artificial Sequence
  chemically synthesized
gcctttcttccaagaacatg

SEQ ID NO: 65038 - DNA, 20 bp, Artificial Sequence
  chemically synthesized
ccacacacactccttcagtc

SEQ ID NO: 65039 - DNA, 20 bp, Artificial Sequence
  chemically synthesized
cacttatttgaagactttaa

SEQ ID NO: 65040 - DNA, 20 bp, Artificial Sequence
  chemically synthesized
aaataaattaggcaaaagta

SEQ ID NO: 65041 - DNA, 20 bp, Artificial Sequence
  chemically synthesized
ttgtgtatatagcaagacaa

SEQ ID NO: 65042 - DNA, 20 bp, Artificial Sequence
  chemically synthesized
ttgagatcacttgtgattta

SEQ ID NO: 65043 - DNA, 20 bp, Artificial Sequence
  chemically synthesized
tatttcatctattggacata

SEQ ID NO: 65044 - DNA, 20 bp, Artificial Sequence
  chemically synthesized
ttagagagaacacaagatca

SEQ ID NO: 65045 - DNA, 20 bp, Artificial Sequence
  chemically synthesized
gatgacattgtatcattttg

SEQ ID NO: 65046 - DNA, 20 bp, Artificial Sequence
  chemically synthesized
taaagagcttctgcacagca

SEQ ID NO: 65047 - DNA, 20 bp, Artificial Sequence
  chemically synthesized
tcagagataacagacaacct

SEQ ID NO: 65048 - DNA, 20 bp, Artificial Sequence
  chemically synthesized
aacagacaacctacagaata

SEQ ID NO: 65049 - DNA, 20 bp, Artificial Sequence
  chemically synthesized
gaggaactaaaacaaattta

SEQ ID NO: 65050 - DNA, 20 bp, Artificial Sequence
  chemically synthesized
aagctcaaccttactggtca

SEQ ID NO: 65051 - DNA, 20 bp, Artificial Sequence
  chemically synthesized
gggataccatctcacaccag

SEQ ID NO: 65052 - DNA, 20 bp, Artificial Sequence
  chemically synthesized
aatggcaattattaaaaagt

SEQ ID NO: 65053 - DNA, 20 bp, Artificial Sequence
  chemically synthesized
agttgctggcaaggttgcag

SEQ ID NO: 65054 - DNA, 20 bp, Artificial Sequence
  chemically synthesized
ctttcctcaaagatgtagaa

SEQ ID NO: 65055 - DNA, 20 bp, Artificial Sequence
  chemically synthesized
ccatcaatgatagagtggat

SEQ ID NO: 65056 - DNA, 20 bp, Artificial Sequence
  chemically synthesized
ctcatcaaactaacacagga

SEQ ID NO: 65057 - DNA, 20 bp, Artificial Sequence
  chemically synthesized
ccaaacacacatgttctcac

SEQ ID NO: 65058 - DNA, 20 bp, Artificial Sequence
  chemically synthesized
gaggagagggagagcaccag

SEQ ID NO: 65059 - DNA, 20 bp, Artificial Sequence
  chemically synthesized
tttccaattactcaaaaggc

SEQ ID NO: 65060 - DNA, 20 bp, Artificial Sequence
  chemically synthesized
gggctcaagccattctgtgc

SEQ ID NO: 65061 - DNA, 20 bp, Artificial Sequence
  chemically synthesized
agggttcatgaatggaggaa

SEQ ID NO: 65062 - DNA, 20 bp, Artificial Sequence
  chemically synthesized
ctgttttaaggatcaggata

SEQ ID NO: 65063 - DNA, 20 bp, Artificial Sequence
  chemically synthesized
acaatgatcagagcgtctag

SEQ ID NO: 65064 - DNA, 20 bp, Artificial Sequence
  chemically synthesized
taggaagaaaatcaaagcaa

SEQ ID NO: 65065 - DNA, 20 bp, Artificial Sequence
  chemically synthesized
aagtttcaggacatcttgat

SEQ ID NO: 65066 - DNA, 20 bp, Artificial Sequence
  chemically synthesized
atatgggaagcaatggagtg

SEQ ID NO: 65067 - DNA, 20 bp, Artificial Sequence
  chemically synthesized
ctatcttcacccaagattta

SEQ ID NO: 65068 - DNA, 20 bp, Artificial Sequence
  chemically synthesized
acggtcataggccattgaca

SEQ ID NO: 65069 - DNA, 20 bp, Artificial Sequence
  chemically synthesized
cacaagtggcaagtagcttt

SEQ ID NO: 65070 - DNA, 20 bp, Artificial Sequence
  chemically synthesized
gatatagacatagtgttttg

SEQ ID NO: 65071 - DNA, 20 bp, Artificial Sequence
  chemically synthesized
tttctttgtttagttttgaa

SEQ ID NO: 65072 - DNA, 20 bp, Artificial Sequence
  chemically synthesized
aaaagccatgagccctctgt

SEQ ID NO: 65073 - DNA, 20 bp, Artificial Sequence
  chemically synthesized
ggtatttctccaaggatgga

SEQ ID NO: 65074 - DNA, 20 bp, Artificial Sequence
  chemically synthesized
gtttagcttccacttataaa

SEQ ID NO: 65075 - DNA, 20 bp, Artificial Sequence
  chemically synthesized
cccttttctccatagcctca

SEQ ID NO: 65076 - DNA, 20 bp, Artificial Sequence
  chemically synthesized
ttgtccttgtgatagtttgc

SEQ ID NO: 65077 - DNA, 20 bp, Artificial Sequence
  chemically synthesized
actagtttttctaatactgt

SEQ ID NO: 65078 - DNA, 20 bp, Artificial Sequence
  chemically synthesized
agaatgacattggtaattgg

SEQ ID NO: 65079 - DNA, 20 bp, Artificial Sequence
  chemically synthesized
atatgatcatctcaatagac

SEQ ID NO: 65080 - DNA, 20 bp, Artificial Sequence
  chemically synthesized
catcaaaggaacatacctca

SEQ ID NO: 65081 - DNA, 20 bp, Artificial Sequence
  chemically synthesized
ctaaccagggcaatcaggcg

SEQ ID NO: 65082 - DNA, 20 bp, Artificial Sequence
  chemically synthesized
ccagggcaatcaggcgagag

SEQ ID NO: 65083 - DNA, 20 bp, Artificial Sequence
  chemically synthesized
ggcaatcaggcgagagaaag

SEQ ID NO: 65084 - DNA, 20 bp, Artificial Sequence
  chemically synthesized
ctgatgatatgactctatac

SEQ ID NO: 65085 - DNA, 20 bp, Artificial Sequence
  chemically synthesized
atcccattaagaacagccac

SEQ ID NO: 65086 - DNA, 20 bp, Artificial Sequence
  chemically synthesized
atttaaaacccaagcaggca

SEQ ID NO: 65087 - DNA, 20 bp, Artificial Sequence
  chemically synthesized
aaaacccaagcaggcactag

SEQ ID NO: 65088 - DNA, 20 bp, Artificial Sequence
  chemically synthesized
ggatcagggaacattttcca

SEQ ID NO: 65089 - DNA, 20 bp, Artificial Sequence
  chemically synthesized
agaagaaatgctacttaagc

SEQ ID NO: 65090 - DNA, 20 bp, Artificial Sequence
  chemically synthesized
aatacatgaaaaaaagcttg

SEQ ID NO: 65091 - DNA, 20 bp, Artificial Sequence
  chemically synthesized
aagttactatggctacagta

SEQ ID NO: 65092 - DNA, 20 bp, Artificial Sequence
  chemically synthesized
actagttgttatcagtagca

SEQ ID NO: 65093 - DNA, 20 bp, Artificial Sequence
  chemically synthesized
tagaagagagattctatgac

SEQ ID NO: 65094 - DNA, 20 bp, Artificial Sequence
  chemically synthesized
gattgaaggtagtagattaa

SEQ ID NO: 65095 - DNA, 20 bp, Artificial Sequence
  chemically synthesized
gtgttttacatgctgacttt

SEQ ID NO: 65096 - DNA, 20 bp, Artificial Sequence
  chemically synthesized
tgactttgtagaaaagatga

SEQ ID NO: 65097 - DNA, 20 bp, Artificial Sequence
  chemically synthesized
ctttgcacaaaggataccct

SEQ ID NO: 65098 - DNA, 20 bp, Artificial Sequence
  chemically synthesized
aaggatattattttgttttt

SEQ ID NO: 65099 - DNA, 20 bp, Artificial Sequence
  chemically synthesized
agtggattcagatcaccctc

SEQ ID NO: 65100 - DNA, 20 bp, Artificial Sequence
  chemically synthesized
accatgaaggcaccaagaac

SEQ ID NO: 65101 - DNA, 20 bp, Artificial Sequence
  chemically synthesized
catggtcacatataaggaac

SEQ ID NO: 65102 - DNA, 20 bp, Artificial Sequence
  chemically synthesized
gagagtttacagtagatgtc

SEQ ID NO: 65103 - DNA, 20 bp, Artificial Sequence
  chemically synthesized
cagagaaagtatttatggca

SEQ ID NO: 65104 - DNA, 20 bp, Artificial Sequence
  chemically synthesized
gatgtctcatatttttcatt

SEQ ID NO: 65105 - DNA, 20 bp, Artificial Sequence
  chemically synthesized
ttctaagatttttttgggca

SEQ ID NO: 65106 - DNA, 20 bp, Artificial Sequence
  chemically synthesized
tgggcaaaagaatatttata

SEQ ID NO: 65107 - DNA, 20 bp, Artificial Sequence
  chemically synthesized
tatttatagaagaatgaggt

SEQ ID NO: 65108 - DNA, 20 bp, Artificial Sequence
  chemically synthesized
taagtgacttacgactgtat

SEQ ID NO: 65109 - DNA, 20 bp, Artificial Sequence
  chemically synthesized
tcttatcactatatttgcca

SEQ ID NO: 65110 - DNA, 20 bp, Artificial Sequence
  chemically synthesized
agaataatgaaaattttaaa

SEQ ID NO: 65111 - DNA, 20 bp, Artificial Sequence
  chemically synthesized
ttaaataagaatttatttct

SEQ ID NO: 65112 - DNA, 20 bp, Artificial Sequence
  chemically synthesized
aatttcaggtgcatttgaaa

SEQ ID NO: 65113 - DNA, 20 bp, Artificial Sequence
  chemically synthesized
agtatacccttgctctttgc

SEQ ID NO: 65114 - DNA, 20 bp, Artificial Sequence
  chemically synthesized
agcaatgcctatgacagtat

SEQ ID NO: 65115 - DNA, 20 bp, Artificial Sequence
  chemically synthesized
gcctatgacagtattaagaa

SEQ ID NO: 65116 - DNA, 20 bp, Artificial Sequence
  chemically synthesized
ctcatgatttcttggtggag

SEQ ID NO: 65117 - DNA, 20 bp, Artificial Sequence
  chemically synthesized
caggatggatacaaaacccc

SEQ ID NO: 65118 - DNA, 20 bp, Artificial Sequence
  chemically synthesized
cgctatgactctagtattgg

SEQ ID NO: 65119 - DNA, 20 bp, Artificial Sequence
  chemically synthesized
ggagggaacctgattccaca

SEQ ID NO: 65120 - DNA, 20 bp, Artificial Sequence
  chemically synthesized
tctgcaactattttcctgaa

SEQ ID NO: 65121 - DNA, 20 bp, Artificial Sequence
  chemically synthesized
gactatggttttttccctaa

SEQ ID NO: 65122 - DNA, 20 bp, Artificial Sequence
  chemically synthesized
tacctaatccatctttcgag

SEQ ID NO: 65123 - DNA, 20 bp, Artificial Sequence
  chemically synthesized
cacgatccaagaggggtatg

SEQ ID NO: 65124 - DNA, 20 bp, Artificial Sequence
  chemically synthesized
tctgctgcagtcttatttaa

SEQ ID NO: 65125 - DNA, 20 bp, Artificial Sequence
  chemically synthesized
agtcttatttaacgagaaat

SEQ ID NO: 65126 - DNA, 20 bp, Artificial Sequence
  chemically synthesized
gcctcagtatcaaaaataaa

SEQ ID NO: 65127 - DNA, 20 bp, Artificial Sequence
  chemically synthesized
tcaaaaataaatcagaatca

SEQ ID NO: 65128 - DNA, 20 bp, Artificial Sequence
  chemically synthesized
cggaatgaggtataggagga

SEQ ID NO: 65129 - DNA, 20 bp, Artificial Sequence
  chemically synthesized
gaggaagagaatggcagatt

SEQ ID NO: 65130 - DNA, 20 bp, Artificial Sequence
  chemically synthesized
tattctgaagggtaaacata

SEQ ID NO: 65131 - DNA, 20 bp, Artificial Sequence
  chemically synthesized
taaaaataaaaaatttttaa

SEQ ID NO: 65132 - DNA, 20 bp, Artificial Sequence
  chemically synthesized
taaaaaacaataacgtcttt

SEQ ID NO: 65133 - DNA, 20 bp, Artificial Sequence
  chemically synthesized
ataaaacacttgaaaccaaa

SEQ ID NO: 65134 - DNA, 20 bp, Artificial Sequence
  chemically synthesized
gttttttattatatttatga

SEQ ID NO: 65135 - DNA, 20 bp, Artificial Sequence
  chemically synthesized
agggaaggttatggtacctc

SEQ ID NO: 65136 - DNA, 20 bp, Artificial Sequence
  chemically synthesized
gtctgagattttgggaataa

SEQ ID NO: 65137 - DNA, 20 bp, Artificial Sequence
  chemically synthesized
gcttagctattaacaagtgt

SEQ ID NO: 65138 - DNA, 20 bp, Artificial Sequence
  chemically synthesized
aatgactattttgagtcagc

SEQ ID NO: 65139 - DNA, 20 bp, Artificial Sequence
  chemically synthesized
tattctcccttcaattttat

SEQ ID NO: 65140 - DNA, 20 bp, Artificial Sequence
  chemically synthesized
gatccataatgctgaaaact

SEQ ID NO: 65141 - DNA, 20 bp, Artificial Sequence
  chemically synthesized
caggaaagatctgttagcct

SEQ ID NO: 65142 - DNA, 20 bp, Artificial Sequence
  chemically synthesized
taaggagatgggccctgtct

SEQ ID NO: 65143 - DNA, 20 bp, Artificial Sequence
  chemically synthesized
tctaagcctttcaactcgat

SEQ ID NO: 65144 - DNA, 20 bp, Artificial Sequence
  chemically synthesized
gaattttttgtctactcttc

SEQ ID NO: 65145 - DNA, 20 bp, Artificial Sequence
  chemically synthesized
tgaatgtattacaataaaaa

SEQ ID NO: 65146 - DNA, 20 bp, Artificial Sequence
  chemically synthesized
taacaaagctgttttggaat

SEQ ID NO: 65147 - DNA, 20 bp, Artificial Sequence
  chemically synthesized
aaaaagctataaacatctac

SEQ ID NO: 65148 - DNA, 20 bp, Artificial Sequence
  chemically synthesized
catctacatagaaaaatgag

SEQ ID NO: 65149 - DNA, 20 bp, Artificial Sequence
  chemically synthesized
gccaatccaagggtcccaga

SEQ ID NO: 65150 - DNA, 20 bp, Artificial Sequence
  chemically synthesized
tccttaaatactctttcaaa

SEQ ID NO: 65151 - DNA, 20 bp, Artificial Sequence
  chemically synthesized
gggattttcaggtgtttcct

SEQ ID NO: 65152 - DNA, 20 bp, Artificial Sequence
  chemically synthesized
gaggagcatagtctttattc

SEQ ID NO: 65153 - DNA, 20 bp, Artificial Sequence
  chemically synthesized
atgtaaatagtgtgtaatat

SEQ ID NO: 65154 - DNA, 20 bp, Artificial Sequence
  chemically synthesized
tagcatgctaaagggagccc

SEQ ID NO: 65155 - DNA, 20 bp, Artificial Sequence
  chemically synthesized
gggcaggggaaaatttctca

SEQ ID NO: 65156 - DNA, 20 bp, Artificial Sequence
  chemically synthesized
gtggggtacagtttataaag

SEQ ID NO: 65157 - DNA, 20 bp, Artificial Sequence
  chemically synthesized
aatacacaggctatggggaa

SEQ ID NO: 65158 - DNA, 20 bp, Artificial Sequence
  chemically synthesized
aatatgacaaactcaaatca

SEQ ID NO: 65159 - DNA, 20 bp, Artificial Sequence
  chemically synthesized
tcaagagaattctagcagag

SEQ ID NO: 65160 - DNA, 20 bp, Artificial Sequence
  chemically synthesized
agccagaataacaaaacatg

SEQ ID NO: 65161 - DNA, 20 bp, Artificial Sequence
  chemically synthesized
tgtgagaaaattgaacacaa

SEQ ID NO: 65162 - DNA, 20 bp, Artificial Sequence
  chemically synthesized
ttgtccttgcgatagtttgc

SEQ ID NO: 65163 - DNA, 20 bp, Artificial Sequence
  chemically synthesized
aaaccagaacacagctaatg

SEQ ID NO: 65164 - DNA, 20 bp, Artificial Sequence
  chemically synthesized
tcccatgaccttcttaagga

SEQ ID NO: 65165 - DNA, 20 bp, Artificial Sequence
  chemically synthesized
ataaggataagcacaaagtc

SEQ ID NO: 65166 - DNA, 20 bp, Artificial Sequence
  chemically synthesized
tttgatcacatctggtgcag

SEQ ID NO: 65167 - DNA, 20 bp, Artificial Sequence
  chemically synthesized
cttcaccaccttagcattgg

SEQ ID NO: 65168 - DNA, 20 bp, Artificial Sequence
  chemically synthesized
cagacctggaaagccagtga

SEQ ID NO: 65169 - DNA, 20 bp, Artificial Sequence
  chemically synthesized
gtgacatggtggatacctga

SEQ ID NO: 65170 - DNA, 20 bp, Artificial Sequence
  chemically synthesized
agtcacattaaaaggagtaa

SEQ ID NO: 65171 - DNA, 20 bp, Artificial Sequence
  chemically synthesized
aaaatcgagtgtttacactt

SEQ ID NO: 65172 - DNA, 20 bp, Artificial Sequence
  chemically synthesized
gtgcttcatcaaaaaaatgt

SEQ ID NO: 65173 - DNA, 20 bp, Artificial Sequence
  chemically synthesized
aaactaacacatatattgga

SEQ ID NO: 65174 - DNA, 20 bp, Artificial Sequence
  chemically synthesized
agagttttcaccaagtagta

SEQ ID NO: 65175 - DNA, 20 bp, Artificial Sequence
  chemically synthesized
agccagacatattcaaaatt

SEQ ID NO: 65176 - DNA, 20 bp, Artificial Sequence
  chemically synthesized
ctacttgggaaactgaggca

SEQ ID NO: 65177 - DNA, 20 bp, Artificial Sequence
  chemically synthesized
ctcaaaaaaaaaaaaaaaaa

SEQ ID NO: 65178 - DNA, 20 bp, Artificial Sequence
  chemically synthesized
aaaaaaaaaaaaagaaaaaa

SEQ ID NO: 65179 - DNA, 20 bp, Artificial Sequence
  chemically synthesized
gcctatgagagtgcagacct

SEQ ID NO: 65180 - DNA, 20 bp, Artificial Sequence
  chemically synthesized
gcagtaatttatgtataaca

SEQ ID NO: 65181 - DNA, 20 bp, Artificial Sequence
  chemically synthesized
tgtatcatttatctattatc

SEQ ID NO: 65182 - DNA, 20 bp, Artificial Sequence
  chemically synthesized
caaagtagaggaggaagaag

SEQ ID NO: 65183 - DNA, 20 bp, Artificial Sequence
  chemically synthesized
aacataggtggatgtaagat

SEQ ID NO: 65184 - DNA, 20 bp, Artificial Sequence
  chemically synthesized
tttcctctcctgcctcttcc

SEQ ID NO: 65185 - DNA, 20 bp, Artificial Sequence
  chemically synthesized
gttggaggttgatacacccg

SEQ ID NO: 65186 - DNA, 20 bp, Artificial Sequence
  chemically synthesized
tgcaacaactatgtggtgga

SEQ ID NO: 65187 - DNA, 20 bp, Artificial Sequence
  chemically synthesized
ctagagcctgacctggggta

SEQ ID NO: 65188 - DNA, 20 bp, Artificial Sequence
  chemically synthesized
ggtaattgctgagtcctggt

SEQ ID NO: 65189 - DNA, 20 bp, Artificial Sequence
  chemically synthesized
gccccatattttctttgcaa

SEQ ID NO: 65190 - DNA, 20 bp, Artificial Sequence
  chemically synthesized
attttctttgcaaaaagaaa

SEQ ID NO: 65191 - DNA, 20 bp, Artificial Sequence
  chemically synthesized
gtctcttggtaagtcttgcc

SEQ ID NO: 65192 - DNA, 20 bp, Artificial Sequence
  chemically synthesized
caatcatctcatagtctgtc

SEQ ID NO: 65193 - DNA, 20 bp, Artificial Sequence
  chemically synthesized
ctgtcagagaaataaggatc

SEQ ID NO: 65194 - DNA, 20 bp, Artificial Sequence
  chemically synthesized
ataggtcttcctaaatgtaa

SEQ ID NO: 65195 - DNA, 20 bp, Artificial Sequence
  chemically synthesized
ttggtggaggataagcctcc

SEQ ID NO: 65196 - DNA, 20 bp, Artificial Sequence
  chemically synthesized
atcacataacacaatattta

SEQ ID NO: 65197 - DNA, 20 bp, Artificial Sequence
  chemically synthesized
atactcaggcagccacatta

SEQ ID NO: 65198 - DNA, 20 bp, Artificial Sequence
  chemically synthesized
ctgacccttccccaaatcag

SEQ ID NO: 65199 - DNA, 20 bp, Artificial Sequence
  chemically synthesized
catgtgcatgtatcttagta

SEQ ID NO: 65200 - DNA, 20 bp, Artificial Sequence
  chemically synthesized
ctttgtcagatgggtagatt

SEQ ID NO: 65201 - DNA, 20 bp, Artificial Sequence
  chemically synthesized
ttctaagattggcttagtct

SEQ ID NO: 65202 - DNA, 20 bp, Artificial Sequence
  chemically synthesized
caagtatattattatttgaa

SEQ ID NO: 65203 - DNA, 20 bp, Artificial Sequence
  chemically synthesized
aggaagacttgtaggagatc

SEQ ID NO: 65204 - DNA, 20 bp, Artificial Sequence
  chemically synthesized
attgttacaatgggttttga

SEQ ID NO: 65205 - DNA, 20 bp, Artificial Sequence
  chemically synthesized
gtttcacacttactttcaag

SEQ ID NO: 65206 - DNA, 20 bp, Artificial Sequence
  chemically synthesized
taggttccatttcctgtatt

SEQ ID NO: 65207 - DNA, 20 bp, Artificial Sequence
  chemically synthesized
atatttttggagtagaagga

SEQ ID NO: 65208 - DNA, 20 bp, Artificial Sequence
  chemically synthesized
agtagaaggaggagaaattt

SEQ ID NO: 65209 - DNA, 20 bp, Artificial Sequence
  chemically synthesized
aggaggagaaattttcagaa

SEQ ID NO: 65210 - DNA, 20 bp, Artificial Sequence
  chemically synthesized
tttatattaaatttccccat

SEQ ID NO: 65211 - DNA, 20 bp, Artificial Sequence
  chemically synthesized
caattacatctcttaatgaa

SEQ ID NO: 65212 - DNA, 20 bp, Artificial Sequence
  chemically synthesized
tgagttgagaacaacaacct

SEQ ID NO: 65213 - DNA, 20 bp, Artificial Sequence
  chemically synthesized
agaacaacaacctgcagaaa

SEQ ID NO: 65214 - DNA, 20 bp, Artificial Sequence
  chemically synthesized
atcagacaattttaatcaaa

SEQ ID NO: 65215 - DNA, 20 bp, Artificial Sequence
  chemically synthesized
tttacacttattacatggaa

SEQ ID NO: 65216 - DNA, 20 bp, Artificial Sequence
  chemically synthesized
catggaatcagaatgtatgt

SEQ ID NO: 65217 - DNA, 20 bp, Artificial Sequence
  chemically synthesized
caatcattcttcaaaaaaat

SEQ ID NO: 65218 - DNA, 20 bp, Artificial Sequence
  chemically synthesized
tggagctagcaactagggta

SEQ ID NO: 65219 - DNA, 20 bp, Artificial Sequence
  chemically synthesized
tagcaactagggtagtagaa

SEQ ID NO: 65220 - DNA, 20 bp, Artificial Sequence
  chemically synthesized
ttgtttgtatggacacctgc

SEQ ID NO: 65221 - DNA, 20 bp, Artificial Sequence
  chemically synthesized
aataatttagtggaaagctt

SEQ ID NO: 65222 - DNA, 20 bp, Artificial Sequence
  chemically synthesized
tctatgggtagtaaaaaggt

SEQ ID NO: 65223 - DNA, 20 bp, Artificial Sequence
  chemically synthesized
aggattcattagtggaggga

SEQ ID NO: 65224 - DNA, 20 bp, Artificial Sequence
  chemically synthesized
ttaatgacatcctggtgaag

SEQ ID NO: 65225 - DNA, 20 bp, Artificial Sequence
  chemically synthesized
aagaacatgggagtgacaat

SEQ ID NO: 65226 - DNA, 20 bp, Artificial Sequence
  chemically synthesized
acggtcataggccatggcaa

SEQ ID NO: 65227 - DNA, 20 bp, Artificial Sequence
  chemically synthesized
ggcaagcagaatgccagact

SEQ ID NO: 65228 - DNA, 20 bp, Artificial Sequence
  chemically synthesized
gtctgtggcagccagcatgg

SEQ ID NO: 65229 - DNA, 20 bp, Artificial Sequence
  chemically synthesized
aggatggatatatacatgaa

SEQ ID NO: 65230 - DNA, 20 bp, Artificial Sequence
  chemically synthesized
cgacatcctgggtttatata

SEQ ID NO: 65231 - DNA, 20 bp, Artificial Sequence
  chemically synthesized
tcacttcgactatatcattc

SEQ ID NO: 65232 - DNA, 20 bp, Artificial Sequence
  chemically synthesized
tatgcatttaagcattctct

SEQ ID NO: 65233 - DNA, 20 bp, Artificial Sequence
  chemically synthesized
cccttaactatgcagatttt

SEQ ID NO: 65234 - DNA, 20 bp, Artificial Sequence
  chemically synthesized
tggggcattcaaggggattt

SEQ ID NO: 65235 - DNA, 20 bp, Artificial Sequence
  chemically synthesized
cagctaaagtctcaacagcc

SEQ ID NO: 65236 - DNA, 20 bp, Artificial Sequence
  chemically synthesized
taaagtctcaacagcctaag

SEQ ID NO: 65237 - DNA, 20 bp, Artificial Sequence
  chemically synthesized
taagaaagaaaagtgtggga

SEQ ID NO: 65238 - DNA, 20 bp, Artificial Sequence
  chemically synthesized
tagctaaggagcagtcagat

SEQ ID NO: 65239 - DNA, 20 bp, Artificial Sequence
  chemically synthesized
ttagtgtgaattaccctctt

SEQ ID NO: 65240 - DNA, 20 bp, Artificial Sequence
  chemically synthesized
aggcctactgaagtaattcc

SEQ ID NO: 65241 - DNA, 20 bp, Artificial Sequence
  chemically synthesized
tgaactgagacctcaataca

SEQ ID NO: 65242 - DNA, 20 bp, Artificial Sequence
  chemically synthesized
tcagcatgactggcatttga

SEQ ID NO: 65243 - DNA, 20 bp, Artificial Sequence
  chemically synthesized
gaagaagactaagcaagaga

SEQ ID NO: 65244 - DNA, 20 bp, Artificial Sequence
  chemically synthesized
gagacaagaaaagagatgag

SEQ ID NO: 65245 - DNA, 20 bp, Artificial Sequence
  chemically synthesized
aagcaggggaaatgaaaaaa

SEQ ID NO: 65246 - DNA, 20 bp, Artificial Sequence
  chemically synthesized
gaaatgaaaaaaagagaaaa

SEQ ID NO: 65247 - DNA, 20 bp, Artificial Sequence
  chemically synthesized
gatttctgtttgaacaaatg

SEQ ID NO: 65248 - DNA, 20 bp, Artificial Sequence
  chemically synthesized
ggcaacaactcagcactttg

SEQ ID NO: 65249 - DNA, 20 bp, Artificial Sequence
  chemically synthesized
ctaggactgagagacataaa

SEQ ID NO: 65250 - DNA, 20 bp, Artificial Sequence
  chemically synthesized
gtgaaaaattccttcttatc

SEQ ID NO: 65251 - DNA, 20 bp, Artificial Sequence
  chemically synthesized
gtttcctccttctccattcc

SEQ ID NO: 65252 - DNA, 20 bp, Artificial Sequence
  chemically synthesized
tcgtggctcttggtttctga

SEQ ID NO: 65253 - DNA, 20 bp, Artificial Sequence
  chemically synthesized
aagattctataatggaacac

SEQ ID NO: 65254 - DNA, 20 bp, Artificial Sequence
  chemically synthesized
tgtttaaaaagtaaaatgta

SEQ ID NO: 65255 - DNA, 20 bp, Artificial Sequence
  chemically synthesized
ggtgccttcctgttcatctt

SEQ ID NO: 65256 - DNA, 20 bp, Artificial Sequence
  chemically synthesized
tttatagccaacttggatct

SEQ ID NO: 65257 - DNA, 20 bp, Artificial Sequence
  chemically synthesized
atctttcccagtttatctca

SEQ ID NO: 65258 - DNA, 20 bp, Artificial Sequence
  chemically synthesized
tttcctgcttggtttagatc

SEQ ID NO: 65259 - DNA, 20 bp, Artificial Sequence
  chemically synthesized
aggctgagggcacaaataat

SEQ ID NO: 65260 - DNA, 20 bp, Artificial Sequence
  chemically synthesized
agatacatgactatggaact

SEQ ID NO: 65261 - DNA, 20 bp, Artificial Sequence
  chemically synthesized
tcgaagctgatttcttagca

SEQ ID NO: 65262 - DNA, 20 bp, Artificial Sequence
  chemically synthesized
agtccagataagtgccaaat

SEQ ID NO: 65263 - DNA, 20 bp, Artificial Sequence
  chemically synthesized
atcagaggttcaaatacttt

SEQ ID NO: 65264 - DNA, 20 bp, Artificial Sequence
  chemically synthesized
tgcactcaatattaaccatc

SEQ ID NO: 65265 - DNA, 20 bp, Artificial Sequence
  chemically synthesized
ggagatactaagtgcttgag

SEQ ID NO: 65266 - DNA, 20 bp, Artificial Sequence
  chemically synthesized
aaaaagccaaagggaaggtg

SEQ ID NO: 65267 - DNA, 20 bp, Artificial Sequence
  chemically synthesized
tgcggcagagtttgagactt

SEQ ID NO: 65268 - DNA, 20 bp, Artificial Sequence
  chemically synthesized
agtccaatacttgacacacg

SEQ ID NO: 65269 - DNA, 20 bp, Artificial Sequence
  chemically synthesized
taggtatatttaaaatttgc

SEQ ID NO: 65270 - DNA, 20 bp, Artificial Sequence
  chemically synthesized
tcacattttatctgctgatt

SEQ ID NO: 65271 - DNA, 20 bp, Artificial Sequence
  chemically synthesized
tatctgttcccaaggcttcc

SEQ ID NO: 65272 - DNA, 20 bp, Artificial Sequence
  chemically synthesized
aatcctgacatgtactcact

SEQ ID NO: 65273 - DNA, 20 bp, Artificial Sequence
  chemically synthesized
gacatgtactcactagagaa

SEQ ID NO: 65274 - DNA, 20 bp, Artificial Sequence
  chemically synthesized
tttccccttactttgtgtca

SEQ ID NO: 65275 - DNA, 20 bp, Artificial Sequence
  chemically synthesized
tcaagagaatgactgagaag

SEQ ID NO: 65276 - DNA, 20 bp, Artificial Sequence
  chemically synthesized
ctttcccaagatcattattg

SEQ ID NO: 65277 - DNA, 20 bp, Artificial Sequence
  chemically synthesized
tggatgcattcttttcatgg

SEQ ID NO: 65278 - DNA, 20 bp, Artificial Sequence
  chemically synthesized
tgcctgcaccagctgaaatc

SEQ ID NO: 65279 - DNA, 20 bp, Artificial Sequence
  chemically synthesized
attttccctccaggaatatt

SEQ ID NO: 65280 - DNA, 20 bp, Artificial Sequence
  chemically synthesized
ggtgaacatcttatgaacag

SEQ ID NO: 65281 - DNA, 20 bp, Artificial Sequence
  chemically synthesized
tcatgggcattggttctgga

SEQ ID NO: 65282 - DNA, 20 bp, Artificial Sequence
  chemically synthesized
tatggagctggctgctgttt

SEQ ID NO: 65283 - DNA, 20 bp, Artificial Sequence
  chemically synthesized
gtttctagaaaattgcacgt

SEQ ID NO: 65284 - DNA, 20 bp, Artificial Sequence
  chemically synthesized
gtctagggaaagtatctcta

SEQ ID NO: 65285 - DNA, 20 bp, Artificial Sequence
  chemically synthesized
taagttttaaattaatttta

SEQ ID NO: 65286 - DNA, 20 bp, Artificial Sequence
  chemically synthesized
ctgcccacctactcttcatc

SEQ ID NO: 65287 - DNA, 20 bp, Artificial Sequence
  chemically synthesized
ttgggatgtataaataacac

SEQ ID NO: 65288 - DNA, 20 bp, Artificial Sequence
  chemically synthesized
agggggatctaagccacatc

SEQ ID NO: 65289 - DNA, 20 bp, Artificial Sequence
  chemically synthesized
catcaagagggcatctttgc

SEQ ID NO: 65290 - DNA, 20 bp, Artificial Sequence
  chemically synthesized
agacaaaagacaaacagttt

SEQ ID NO: 65291 - DNA, 20 bp, Artificial Sequence
  chemically synthesized
gaaggtgtgaaaatggttgg

SEQ ID NO: 65292 - DNA, 20 bp, Artificial Sequence
  chemically synthesized
ctggaccaatttcctgactt

SEQ ID NO: 65293 - DNA, 20 bp, Artificial Sequence
  chemically synthesized
agcctctgtctaaggcagaa

SEQ ID NO: 65294 - DNA, 20 bp, Artificial Sequence
  chemically synthesized
tctaaggcagaagtagaatt

SEQ ID NO: 65295 - DNA, 20 bp, Artificial Sequence
  chemically synthesized
agtagaatttcagaaagcat

SEQ ID NO: 65296 - DNA, 20 bp, Artificial Sequence
  chemically synthesized
aagagtttaatggtgactta

SEQ ID NO: 65297 - DNA, 20 bp, Artificial Sequence
  chemically synthesized
gttagaaggaaaactaacaa

SEQ ID NO: 65298 - DNA, 20 bp, Artificial Sequence
  chemically synthesized
caaagatggggaaaaacaga

SEQ ID NO: 65299 - DNA, 20 bp, Artificial Sequence
  chemically synthesized
gcaacggtacaaagctggac

SEQ ID NO: 65300 - DNA, 20 bp, Artificial Sequence
  chemically synthesized
taaattagactaatggctaa

SEQ ID NO: 65301 - DNA, 20 bp, Artificial Sequence
  chemically synthesized
gtagctgattcgatcaactg

SEQ ID NO: 65302 - DNA, 20 bp, Artificial Sequence
  chemically synthesized
tgaagcaagaagagaagttt

SEQ ID NO: 65303 - DNA, 20 bp, Artificial Sequence
  chemically synthesized
agaagagaagtttagagaaa

SEQ ID NO: 65304 - DNA, 20 bp, Artificial Sequence
  chemically synthesized
gtttagagaaaaaagaataa

SEQ ID NO: 65305 - DNA, 20 bp, Artificial Sequence
  chemically synthesized
aaagaaatgaacaaagcctc

SEQ ID NO: 65306 - DNA, 20 bp, Artificial Sequence
  chemically synthesized
ggtgtacctgaaagtgacgg

SEQ ID NO: 65307 - DNA, 20 bp, Artificial Sequence
  chemically synthesized
aaaatgttaagggtagccag

SEQ ID NO: 65308 - DNA, 20 bp, Artificial Sequence
  chemically synthesized
tacccacaaagggaagccca

SEQ ID NO: 65309 - DNA, 20 bp, Artificial Sequence
  chemically synthesized
gaataacagcagatctctca

SEQ ID NO: 65310 - DNA, 20 bp, Artificial Sequence
  chemically synthesized
atattcaacatccttaaagg

SEQ ID NO: 65311 - DNA, 20 bp, Artificial Sequence
  chemically synthesized
taaaggaaagaattttcaac

SEQ ID NO: 65312 - DNA, 20 bp, Artificial Sequence
  chemically synthesized
aactaagcttcataagtgaa

SEQ ID NO: 65313 - DNA, 20 bp, Artificial Sequence
  chemically synthesized
gtaaagaccattgaggctag

SEQ ID NO: 65314 - DNA, 20 bp, Artificial Sequence
  chemically synthesized
agggatggaggaagatctac

SEQ ID NO: 65315 - DNA, 20 bp, Artificial Sequence
  chemically synthesized
acattagacagatcaacgag

SEQ ID NO: 65316 - DNA, 20 bp, Artificial Sequence
  chemically synthesized
gaactctccaccccaaatca

SEQ ID NO: 65317 - DNA, 20 bp, Artificial Sequence
  chemically synthesized
tcctcagcaaatgtaaaaga

SEQ ID NO: 65318 - DNA, 20 bp, Artificial Sequence
  chemically synthesized
atcaaactagaactcaggat

SEQ ID NO: 65319 - DNA, 20 bp, Artificial Sequence
  chemically synthesized
gggttcataacaaaatgaag

SEQ ID NO: 65320 - DNA, 20 bp, Artificial Sequence
  chemically synthesized
gagaacaaagacacaacata

SEQ ID NO: 65321 - DNA, 20 bp, Artificial Sequence
  chemically synthesized
tatagcactaaacgcccaga

SEQ ID NO: 65322 - DNA, 20 bp, Artificial Sequence
  chemically synthesized
attcaaatgctagcagaagg

SEQ ID NO: 65323 - DNA, 20 bp, Artificial Sequence
  chemically synthesized
ctgctagcaagactaataaa

SEQ ID NO: 65324 - DNA, 20 bp, Artificial Sequence
  chemically synthesized
ctaataaagaagaaaagaga

SEQ ID NO: 65325 - DNA, 20 bp, Artificial Sequence
  chemically synthesized
ggtatatcaccaccgatccc

SEQ ID NO: 65326 - DNA, 20 bp, Artificial Sequence
  chemically synthesized
cagaaatacaaaccaccatc

SEQ ID NO: 65327 - DNA, 20 bp, Artificial Sequence
  chemically synthesized
aacacctctacacaaataaa

SEQ ID NO: 65328 - DNA, 20 bp, Artificial Sequence
  chemically synthesized
caaataaactagaaaatcta

SEQ ID NO: 65329 - DNA, 20 bp, Artificial Sequence
  chemically synthesized
ggcagagacacaacaaaaaa

SEQ ID NO: 65330 - DNA, 20 bp, Artificial Sequence
  chemically synthesized
acatgattatctcaatagat

SEQ ID NO: 65331 - DNA, 20 bp, Artificial Sequence
  chemically synthesized
cagatgacacgattgtatat

SEQ ID NO: 65332 - DNA, 20 bp, Artificial Sequence
  chemically synthesized
cccattcacaattgcttcaa

SEQ ID NO: 65333 - DNA, 20 bp, Artificial Sequence
  chemically synthesized
cattccatgctcatgggtag

SEQ ID NO: 65334 - DNA, 20 bp, Artificial Sequence
  chemically synthesized
agctaccaatgactttcttc

SEQ ID NO: 65335 - DNA, 20 bp, Artificial Sequence
  chemically synthesized
aatggaacagaacagaggcc

SEQ ID NO: 65336 - DNA, 20 bp, Artificial Sequence
  chemically synthesized
ggaaaactggctaaccatac

SEQ ID NO: 65337 - DNA, 20 bp, Artificial Sequence
  chemically synthesized
tgaaaaccataaaaactctg

SEQ ID NO: 65338 - DNA, 20 bp, Artificial Sequence
  chemically synthesized
taaagagcttctgcacagca

SEQ ID NO: 65339 - DNA, 20 bp, Artificial Sequence
  chemically synthesized
tcagagtgaacaggcaacat

SEQ ID NO: 65340 - DNA, 20 bp, Artificial Sequence
  chemically synthesized
aacaggcaacatacagaatg

SEQ ID NO: 65341 - DNA, 20 bp, Artificial Sequence
  chemically synthesized
atccgacaaagggctaatat

SEQ ID NO: 65342 - DNA, 20 bp, Artificial Sequence
  chemically synthesized
gatgaactcaaacaaattta

SEQ ID NO: 65343 - DNA, 20 bp, Artificial Sequence
  chemically synthesized
gctcatcatcactggccatc

SEQ ID NO: 65344 - DNA, 20 bp, Artificial Sequence
  chemically synthesized
gagataccatctcacaccag

SEQ ID NO: 65345 - DNA, 20 bp, Artificial Sequence
  chemically synthesized
gattcctcagggatctagaa

SEQ ID NO: 65346 - DNA, 20 bp, Artificial Sequence
  chemically synthesized
ccaacaatgatagactggat

SEQ ID NO: 65347 - DNA, 20 bp, Artificial Sequence
  chemically synthesized
aaacttaaagtataataata

SEQ ID NO: 65348 - DNA, 20 bp, Artificial Sequence
  chemically synthesized
ttaaagtataataataaaag

SEQ ID NO: 65349 - DNA, 20 bp, Artificial Sequence
  chemically synthesized
agtataataataaaagaaag

SEQ ID NO: 65350 - DNA, 20 bp, Artificial Sequence
  chemically synthesized
taataataaaagaaagaaag

SEQ ID NO: 65351 - DNA, 20 bp, Artificial Sequence
  chemically synthesized
attccctaacctagatgcag

SEQ ID NO: 65352 - DNA, 20 bp, Artificial Sequence
  chemically synthesized
gttctaaatccctcaggctg

SEQ ID NO: 65353 - DNA, 20 bp, Artificial Sequence
  chemically synthesized
agtcaagatgtgatggggta

SEQ ID NO: 65354 - DNA, 20 bp, Artificial Sequence
  chemically synthesized
agttgaaaatccacgggaat

SEQ ID NO: 65355 - DNA, 20 bp, Artificial Sequence
  chemically synthesized
aatgacaagggtatagacta

SEQ ID NO: 65356 - DNA, 20 bp, Artificial Sequence
  chemically synthesized
acaagggtatagactaacag

SEQ ID NO: 65357 - DNA, 20 bp, Artificial Sequence
  chemically synthesized
ctttaaattgctgcatattc

SEQ ID NO: 65358 - DNA, 20 bp, Artificial Sequence
  chemically synthesized
agaaatgagcctagtatcca

SEQ ID NO: 65359 - DNA, 20 bp, Artificial Sequence
  chemically synthesized
ttagttgttgagccttataa

SEQ ID NO: 65360 - DNA, 20 bp, Artificial Sequence
  chemically synthesized
ggtctactggatactatgaa

SEQ ID NO: 65361 - DNA, 20 bp, Artificial Sequence
  chemically synthesized
gaagtcaggaaagcaaaaga

SEQ ID NO: 65362 - DNA, 20 bp, Artificial Sequence
  chemically synthesized
tgtatggcattaaaaaaaaa

SEQ ID NO: 65363 - DNA, 20 bp, Artificial Sequence
  chemically synthesized
ctgagtggcattcctccatg

SEQ ID NO: 65364 - DNA, 20 bp, Artificial Sequence
  chemically synthesized
ccatgagagaaagcttaagg

SEQ ID NO: 65365 - DNA, 20 bp, Artificial Sequence
  chemically synthesized
caaaactcaaagttttacga

SEQ ID NO: 65366 - DNA, 20 bp, Artificial Sequence
  chemically synthesized
acgaacagaatgattagtct

SEQ ID NO: 65367 - DNA, 20 bp, Artificial Sequence
  chemically synthesized
ccaagtttttgagtgtgaat

SEQ ID NO: 65368 - DNA, 20 bp, Artificial Sequence
  chemically synthesized
tgtctggaatcttatgtgac

SEQ ID NO: 65369 - DNA, 20 bp, Artificial Sequence
  chemically synthesized
cagactatatttagtgtaca

SEQ ID NO: 65370 - DNA, 20 bp, Artificial Sequence
  chemically synthesized
agaagcttgtgttaggaatg

SEQ ID NO: 65371 - DNA, 20 bp, Artificial Sequence
  chemically synthesized
ggaagaggtatctcaacact

SEQ ID NO: 65372 - DNA, 20 bp, Artificial Sequence
  chemically synthesized
gatatggaggcaagccaaat

SEQ ID NO: 65373 - DNA, 20 bp, Artificial Sequence
  chemically synthesized
agagctgcacatctttctgt

SEQ ID NO: 65374 - DNA, 20 bp, Artificial Sequence
  chemically synthesized
tggtggtgagaacagtgtta

SEQ ID NO: 65375 - DNA, 20 bp, Artificial Sequence
  chemically synthesized
gagacaagatcaagcatact

SEQ ID NO: 65376 - DNA, 20 bp, Artificial Sequence
  chemically synthesized
caaatgtgttgaggccctaa

SEQ ID NO: 65377 - DNA, 20 bp, Artificial Sequence
  chemically synthesized
ggtgaacccagtgggcaaaa

SEQ ID NO: 65378 - DNA, 20 bp, Artificial Sequence
  chemically synthesized
aggaaagtatagaagacaaa

SEQ ID NO: 65379 - DNA, 20 bp, Artificial Sequence
  chemically synthesized
aagacaaaggagaaagggcc

SEQ ID NO: 65380 - DNA, 20 bp, Artificial Sequence
  chemically synthesized
aagggccagagaaacagaag

SEQ ID NO: 65381 - DNA, 20 bp, Artificial Sequence
  chemically synthesized
tcctctgtgggtagcctgtt

SEQ ID NO: 65382 - DNA, 20 bp, Artificial Sequence
  chemically synthesized
ctacacaggaggctgaggta

SEQ ID NO: 65383 - DNA, 20 bp, Artificial Sequence
  chemically synthesized
cctggaaggcaaaagcaaga

SEQ ID NO: 65384 - DNA, 20 bp, Artificial Sequence
  chemically synthesized
gaaggcaaaagcaagatgag

SEQ ID NO: 65385 - DNA, 20 bp, Artificial Sequence
  chemically synthesized
aagcaagatgagaaagaaat

SEQ ID NO: 65386 - DNA, 20 bp, Artificial Sequence
  chemically synthesized
aagaagaagaaggagaagga

SEQ ID NO: 65387 - DNA, 20 bp, Artificial Sequence
  chemically synthesized
tcacttgagattcaaagtct

SEQ ID NO: 65388 - DNA, 20 bp, Artificial Sequence
  chemically synthesized
ttttgaagttaaaagcattg

SEQ ID NO: 65389 - DNA, 20 bp, Artificial Sequence
  chemically synthesized
gggttcttggatttcgtgcc

SEQ ID NO: 65390 - DNA, 20 bp, Artificial Sequence
  chemically synthesized
tcttggatttcgtgcccaag

SEQ ID NO: 65391 - DNA, 20 bp, Artificial Sequence
  chemically synthesized
agaatttggggcaaatccat

SEQ ID NO: 65392 - DNA, 20 bp, Artificial Sequence
  chemically synthesized
aaaagtgaaagcaagttaat

SEQ ID NO: 65393 - DNA, 20 bp, Artificial Sequence
  chemically synthesized
ctcttatctcatcctgtgac

SEQ ID NO: 65394 - DNA, 20 bp, Artificial Sequence
  chemically synthesized
tgtttctggtatgctagcac

SEQ ID NO: 65395 - DNA, 20 bp, Artificial Sequence
  chemically synthesized
cctggtccattgtaagtatt

SEQ ID NO: 65396 - DNA, 20 bp, Artificial Sequence
  chemically synthesized
atactctgtctagctctgac

SEQ ID NO: 65397 - DNA, 20 bp, Artificial Sequence
  chemically synthesized
ttattctcacatgcatcctg

SEQ ID NO: 65398 - DNA, 20 bp, Artificial Sequence
  chemically synthesized
ccaagatgagtgcctttgaa

SEQ ID NO: 65399 - DNA, 20 bp, Artificial Sequence
  chemically synthesized
ctagagacatatggccatga

SEQ ID NO: 65400 - DNA, 20 bp, Artificial Sequence
  chemically synthesized
tagaatctaaggttagacat

SEQ ID NO: 65401 - DNA, 20 bp, Artificial Sequence
  chemically synthesized
atgcccatgtgtgtggggta

SEQ ID NO: 65402 - DNA, 20 bp, Artificial Sequence
  chemically synthesized
tgcaaaatataacactttta

SEQ ID NO: 65403 - DNA, 20 bp, Artificial Sequence
  chemically synthesized
tcattggttttgctatcaac

SEQ ID NO: 65404 - DNA, 20 bp, Artificial Sequence
  chemically synthesized
tggttttgctatcaacatag

SEQ ID NO: 65405 - DNA, 20 bp, Artificial Sequence
  chemically synthesized
agcatgtgcaagctgcttct

SEQ ID NO: 65406 - DNA, 20 bp, Artificial Sequence
  chemically synthesized
ctgcttctatagaaatgcat

SEQ ID NO: 65407 - DNA, 20 bp, Artificial Sequence
  chemically synthesized
ttgagggcaataatttaatg

SEQ ID NO: 65408 - DNA, 20 bp, Artificial Sequence
  chemically synthesized
ctttctcactctttctgtgt

SEQ ID NO: 65409 - DNA, 20 bp, Artificial Sequence
  chemically synthesized
tctgtgtttagaaatgaata

SEQ ID NO: 65410 - DNA, 20 bp, Artificial Sequence
  chemically synthesized
aacctcatatagctgctatg

SEQ ID NO: 65411 - DNA, 20 bp, Artificial Sequence
  chemically synthesized
tcatatagctgctatgaaag

SEQ ID NO: 65412 - DNA, 20 bp, Artificial Sequence
  chemically synthesized
aagaaaaaatttgatgcaat

SEQ ID NO: 65413 - DNA, 20 bp, Artificial Sequence
  chemically synthesized
tacaagggcactgaaatatt

SEQ ID NO: 65414 - DNA, 20 bp, Artificial Sequence
  chemically synthesized
gagatataaaatttcaacat

SEQ ID NO: 65415 - DNA, 20 bp, Artificial Sequence
  chemically synthesized
agagtactgatattaaaaat

SEQ ID NO: 65416 - DNA, 20 bp, Artificial Sequence
  chemically synthesized
ggaccctaaacaattaggaa

SEQ ID NO: 65417 - DNA, 20 bp, Artificial Sequence
  chemically synthesized
acatgagagtgcagatagct

SEQ ID NO: 65418 - DNA, 20 bp, Artificial Sequence
  chemically synthesized
attttggatacatatacagc

SEQ ID NO: 65419 - DNA, 20 bp, Artificial Sequence
  chemically synthesized
taactctatttttagttgtt

SEQ ID NO: 65420 - DNA, 20 bp, Artificial Sequence
  chemically synthesized
ctgaccatttgcatgtcttc

SEQ ID NO: 65421 - DNA, 20 bp, Artificial Sequence
  chemically synthesized
atgattgttttctttgctgt

SEQ ID NO: 65422 - DNA, 20 bp, Artificial Sequence
  chemically synthesized
cctgagctctggcacatttt

SEQ ID NO: 65423 - DNA, 20 bp, Artificial Sequence
  chemically synthesized
ccaaatggccaaaacaatct

SEQ ID NO: 65424 - DNA, 20 bp, Artificial Sequence
  chemically synthesized
atggccaaaacaatcttgag

SEQ ID NO: 65425 - DNA, 20 bp, Artificial Sequence
  chemically synthesized
agacacatagaccaaattga

SEQ ID NO: 65426 - DNA, 20 bp, Artificial Sequence
  chemically synthesized
aattgaacagaataaagagc

SEQ ID NO: 65427 - DNA, 20 bp, Artificial Sequence
  chemically synthesized
aaactggatatccaaatgca

SEQ ID NO: 65428 - DNA, 20 bp, Artificial Sequence
  chemically synthesized
tttagatattgtcttgattt

SEQ ID NO: 65429 - DNA, 20 bp, Artificial Sequence
  chemically synthesized
gttagaaggaaaactaacaa

SEQ ID NO: 65430 - DNA, 20 bp, Artificial Sequence
  chemically synthesized
aaagttggggaaaaaacaga

SEQ ID NO: 65431 - DNA, 20 bp, Artificial Sequence
  chemically synthesized
gcaacggaacaaagctggat

SEQ ID NO: 65432 - DNA, 20 bp, Artificial Sequence
  chemically synthesized
aaatttagatgaatgtataa

SEQ ID NO: 65433 - DNA, 20 bp, Artificial Sequence
  chemically synthesized
tggagctgaaagccaaggct

SEQ ID NO: 65434 - DNA, 20 bp, Artificial Sequence
  chemically synthesized
ccaaggctcgagaatgacgt

SEQ ID NO: 65435 - DNA, 20 bp, Artificial Sequence
  chemically synthesized
ggagctgatgcgatcaactg

SEQ ID NO: 65436 - DNA, 20 bp, Artificial Sequence
  chemically synthesized
tgaagcgagaagggaagttt

SEQ ID NO: 65437 - DNA, 20 bp, Artificial Sequence
  chemically synthesized
agaagggaagtttagagaaa

SEQ ID NO: 65438 - DNA, 20 bp, Artificial Sequence
  chemically synthesized
gtttagagaaaaaagaataa

SEQ ID NO: 65439 - DNA, 20 bp, Artificial Sequence
  chemically synthesized
aaagaaatgaacaaagcctc

SEQ ID NO: 65440 - DNA, 20 bp, Artificial Sequence
  chemically synthesized
ggtgtacctgaaagtgacgg

SEQ ID NO: 65441 - DNA, 20 bp, Artificial Sequence
  chemically synthesized
aaaatgttaagggcagccag

SEQ ID NO: 65442 - DNA, 20 bp, Artificial Sequence
  chemically synthesized
gactaacagcagctctcttg

SEQ ID NO: 65443 - DNA, 20 bp, Artificial Sequence
  chemically synthesized
atattcaacatccttaaagg

SEQ ID NO: 65444 - DNA, 20 bp, Artificial Sequence
  chemically synthesized
taaaggaaagaattttcaac

SEQ ID NO: 65445 - DNA, 20 bp, Artificial Sequence
  chemically synthesized
aactaagcttcataagtgaa

SEQ ID NO: 65446 - DNA, 20 bp, Artificial Sequence
  chemically synthesized
gtgaagaccatcaagactag

SEQ ID NO: 65447 - DNA, 20 bp, Artificial Sequence
  chemically synthesized
acattagacagatcaacgag

SEQ ID NO: 65448 - DNA, 20 bp, Artificial Sequence
  chemically synthesized
gaactctccaccccaaatca

SEQ ID NO: 65449 - DNA, 20 bp, Artificial Sequence
  chemically synthesized
tcctcagcaaatataaaaga

SEQ ID NO: 65450 - DNA, 20 bp, Artificial Sequence
  chemically synthesized
atcaaactagaactcaggat

SEQ ID NO: 65451 - DNA, 20 bp, Artificial Sequence
  chemically synthesized
gggtacataacgaaatgaag

SEQ ID NO: 65452 - DNA, 20 bp, Artificial Sequence
  chemically synthesized
gagaacaaagacacaacata

SEQ ID NO: 65453 - DNA, 20 bp, Artificial Sequence
  chemically synthesized
tatagcactaaacgcccaca

SEQ ID NO: 65454 - DNA, 20 bp, Artificial Sequence
  chemically synthesized
taaacgcccacaagagaaag

SEQ ID NO: 65455 - DNA, 20 bp, Artificial Sequence
  chemically synthesized
attcaaaagctagcagaagt

SEQ ID NO: 65456 - DNA, 20 bp, Artificial Sequence
  chemically synthesized
tagaccgctagcaagactaa

SEQ ID NO: 65457 - DNA, 20 bp, Artificial Sequence
  chemically synthesized
aagactaataagaaaagaga

SEQ ID NO: 65458 - DNA, 20 bp, Artificial Sequence
  chemically synthesized
gggatatcaccaccgatccc

SEQ ID NO: 65459 - DNA, 20 bp, Artificial Sequence
  chemically synthesized
cagaaatacaaactgccatc

SEQ ID NO: 65460 - DNA, 20 bp, Artificial Sequence
  chemically synthesized
aacacctctacgcaaataaa

SEQ ID NO: 65461 - DNA, 20 bp, Artificial Sequence
  chemically synthesized
caaataaactagaaaatcta

SEQ ID NO: 65462 - DNA, 20 bp, Artificial Sequence
  chemically synthesized
ttctgaaactattccaatca

SEQ ID NO: 65463 - DNA, 20 bp, Artificial Sequence
  chemically synthesized
gcatcatcctaataccaaag

SEQ ID NO: 65464 - DNA, 20 bp, Artificial Sequence
  chemically synthesized
gaaagagacacaaccaaaaa

SEQ ID NO: 65465 - DNA, 20 bp, Artificial Sequence
  chemically synthesized
acatgattatctcaatagat

SEQ ID NO: 65466 - DNA, 20 bp, Artificial Sequence
  chemically synthesized
aggaaaaaagggtattcaat

SEQ ID NO: 65467 - DNA, 20 bp, Artificial Sequence
  chemically synthesized
cagacgacatgattgtatat

SEQ ID NO: 65468 - DNA, 20 bp, Artificial Sequence
  chemically synthesized
cccattcacaattgcttcaa

SEQ ID NO: 65469 - DNA, 20 bp, Artificial Sequence
  chemically synthesized
cattccatgcttatgggtag

SEQ ID NO: 65470 - DNA, 20 bp, Artificial Sequence
  chemically synthesized
agctaccaatgattttcttc

SEQ ID NO: 65471 - DNA, 20 bp, Artificial Sequence
  chemically synthesized
aatggaacagaacagagccc

SEQ ID NO: 65472 - DNA, 20 bp, Artificial Sequence
  chemically synthesized
tatctgatctttgaaaaacc

SEQ ID NO: 65473 - DNA, 20 bp, Artificial Sequence
  chemically synthesized
tttgaaaaacctgagaaaaa

SEQ ID NO: 65474 - DNA, 20 bp, Artificial Sequence
  chemically synthesized
ggagaactggctagccatat

SEQ ID NO: 65475 - DNA, 20 bp, Artificial Sequence
  chemically synthesized
ctaaaaccataaaaacccta

SEQ ID NO: 65476 - DNA, 20 bp, Artificial Sequence
  chemically synthesized
taaagagcttctgcacagct

SEQ ID NO: 65477 - DNA, 20 bp, Artificial Sequence
  chemically synthesized
aacaggcaacctacacaatg

SEQ ID NO: 65478 - DNA, 20 bp, Artificial Sequence
  chemically synthesized
atctgacaaagggctaatat

SEQ ID NO: 65479 - DNA, 20 bp, Artificial Sequence
  chemically synthesized
aatgaactcaaacaaattta

SEQ ID NO: 65480 - DNA, 20 bp, Artificial Sequence
  chemically synthesized
atatgaacagacacttctca

SEQ ID NO: 65481 - DNA, 20 bp, Artificial Sequence
  chemically synthesized
gctcatcatcactggccatc

SEQ ID NO: 65482 - DNA, 20 bp, Artificial Sequence
  chemically synthesized
gagataccatctcataccag

SEQ ID NO: 65483 - DNA, 20 bp, Artificial Sequence
  chemically synthesized
acaggtgctggagaggatgt

SEQ ID NO: 65484 - DNA, 20 bp, Artificial Sequence
  chemically synthesized
gattcctcagggatctagaa

SEQ ID NO: 65485 - DNA, 20 bp, Artificial Sequence
  chemically synthesized
ccaacaatgatagactggat

SEQ ID NO: 65486 - DNA, 20 bp, Artificial Sequence
  chemically synthesized
aatccattttttgtttcctt

SEQ ID NO: 65487 - DNA, 20 bp, Artificial Sequence
  chemically synthesized
gatcttggacttttaagtca

SEQ ID NO: 65488 - DNA, 20 bp, Artificial Sequence
  chemically synthesized
ctgtaaaaatctgaaaaagc

SEQ ID NO: 65489 - DNA, 20 bp, Artificial Sequence
  chemically synthesized
gaggaagatcatcctcaaag

SEQ ID NO: 65490 - DNA, 20 bp, Artificial Sequence
  chemically synthesized
gacacgggaaggtggtgctg

SEQ ID NO: 65491 - DNA, 20 bp, Artificial Sequence
  chemically synthesized
tagtagggccttggtgctgg

SEQ ID NO: 65492 - DNA, 20 bp, Artificial Sequence
  chemically synthesized
ctcctcttggcctccaggct

SEQ ID NO: 65493 - DNA, 20 bp, Artificial Sequence
  chemically synthesized
tgcacgtcaatgaaaattga

SEQ ID NO: 65494 - DNA, 20 bp, Artificial Sequence
  chemically synthesized
taaaggtcatttagagcaat

SEQ ID NO: 65495 - DNA, 20 bp, Artificial Sequence
  chemically synthesized
gtccttcaattatataattc

SEQ ID NO: 65496 - DNA, 20 bp, Artificial Sequence
  chemically synthesized
caattatataattcagagaa

SEQ ID NO: 65497 - DNA, 20 bp, Artificial Sequence
  chemically synthesized
gaggttgtgtgtgagttttg

SEQ ID NO: 65498 - DNA, 20 bp, Artificial Sequence
  chemically synthesized
tgtgtgagttttgaaagaaa

SEQ ID NO: 65499 - DNA, 20 bp, Artificial Sequence
  chemically synthesized
aatgttgatggcatttgcta

SEQ ID NO: 65500 - DNA, 20 bp, Artificial Sequence
  chemically synthesized
ggaaaatgagtgcaggagtg

SEQ ID NO: 65501 - DNA, 20 bp, Artificial Sequence
  chemically synthesized
caggagacaggggtggagat

SEQ ID NO: 65502 - DNA, 20 bp, Artificial Sequence
  chemically synthesized
ggggacatgggagagaggag

SEQ ID NO: 65503 - DNA, 20 bp, Artificial Sequence
  chemically synthesized
tgtttctttgtttgttgttt

SEQ ID NO: 65504 - DNA, 20 bp, Artificial Sequence
  chemically synthesized
ttcacttggaaaatgaagtc

SEQ ID NO: 65505 - DNA, 20 bp, Artificial Sequence
  chemically synthesized
tcttagaaaccagggttctc

SEQ ID NO: 65506 - DNA, 20 bp, Artificial Sequence
  chemically synthesized
ctatgcacagaaccagagcc

SEQ ID NO: 65507 - DNA, 20 bp, Artificial Sequence
  chemically synthesized
gaaccagagccagagaaaga

SEQ ID NO: 65508 - DNA, 20 bp, Artificial Sequence
  chemically synthesized
acaccctctccttactctca

SEQ ID NO: 65509 - DNA, 20 bp, Artificial Sequence
  chemically synthesized
tatatgctggtccagttaac

SEQ ID NO: 65510 - DNA, 20 bp, Artificial Sequence
  chemically synthesized
tttgcatattctcctattta

SEQ ID NO: 65511 - DNA, 20 bp, Artificial Sequence
  chemically synthesized
actaatattaaattcaaaca

SEQ ID NO: 65512 - DNA, 20 bp, Artificial Sequence
  chemically synthesized
gataattatctctcttgcta

SEQ ID NO: 65513 - DNA, 20 bp, Artificial Sequence
  chemically synthesized
aagaggaagtatactttcca

SEQ ID NO: 65514 - DNA, 20 bp, Artificial Sequence
  chemically synthesized
gacaacagaaccccaggcac

SEQ ID NO: 65515 - DNA, 20 bp, Artificial Sequence
  chemically synthesized
gtcaggctccaggggccttt

SEQ ID NO: 65516 - DNA, 20 bp, Artificial Sequence
  chemically synthesized
atgttctaaacatgtataat

SEQ ID NO: 65517 - DNA, 20 bp, Artificial Sequence
  chemically synthesized
aaaaaatctataaagtatat

SEQ ID NO: 65518 - DNA, 20 bp, Artificial Sequence
  chemically synthesized
atatataaatataaaaatat

SEQ ID NO: 65519 - DNA, 20 bp, Artificial Sequence
  chemically synthesized
tacaggtactacgtgagaac

SEQ ID NO: 65520 - DNA, 20 bp, Artificial Sequence
  chemically synthesized
aaaacaggggtggtttttgc

SEQ ID NO: 65521 - DNA, 20 bp, Artificial Sequence
  chemically synthesized
ccaagaaagcaataaatata

SEQ ID NO: 65522 - DNA, 20 bp, Artificial Sequence
  chemically synthesized
taaatatagaagaataaaaa

SEQ ID NO: 65523 - DNA, 20 bp, Artificial Sequence
  chemically synthesized
aaaagtatgtgtagggaatt

SEQ ID NO: 65524 - DNA, 20 bp, Artificial Sequence
  chemically synthesized
aacttagttaaaaattagat

SEQ ID NO: 65525 - DNA, 20 bp, Artificial Sequence
  chemically synthesized
taaaaaatgcataaatatga

SEQ ID NO: 65526 - DNA, 20 bp, Artificial Sequence
  chemically synthesized
tggaaacacctagtgagaag

SEQ ID NO: 65527 - DNA, 20 bp, Artificial Sequence
  chemically synthesized
gaaccagcagatcttggcat

SEQ ID NO: 65528 - DNA, 20 bp, Artificial Sequence
  chemically synthesized
tgagtagtaaactgagaagt

SEQ ID NO: 65529 - DNA, 20 bp, Artificial Sequence
  chemically synthesized
attacttttgcaccaaccta

SEQ ID NO: 65530 - DNA, 20 bp, Artificial Sequence
  chemically synthesized
attcacattatagaagcaat

SEQ ID NO: 65531 - DNA, 20 bp, Artificial Sequence
  chemically synthesized
aaaaaatgtttttattccag

SEQ ID NO: 65532 - DNA, 20 bp, Artificial Sequence
  chemically synthesized
caagcatactagataaactg

SEQ ID NO: 65533 - DNA, 20 bp, Artificial Sequence
  chemically synthesized
acagaggaaattaggataga

SEQ ID NO: 65534 - DNA, 20 bp, Artificial Sequence
  chemically synthesized
agaaaataggatatacacgg

SEQ ID NO: 65535 - DNA, 20 bp, Artificial Sequence
  chemically synthesized
tcctgaaagagtgatctgaa

SEQ ID NO: 65536 - DNA, 20 bp, Artificial Sequence
  chemically synthesized
agacttgaggtattcagtaa

SEQ ID NO: 65537 - DNA, 20 bp, Artificial Sequence
  chemically synthesized
tagagtctggaaatcaaaag

SEQ ID NO: 65538 - DNA, 20 bp, Artificial Sequence
  chemically synthesized
atggtagtggatgacattaa

SEQ ID NO: 65539 - DNA, 20 bp, Artificial Sequence
  chemically synthesized
gatgacattaagaagaaata

SEQ ID NO: 65540 - DNA, 20 bp, Artificial Sequence
  chemically synthesized
ctggtgagggcgaggttatc

SEQ ID NO: 65541 - DNA, 20 bp, Artificial Sequence
  chemically synthesized
tcaataaagtagtgagattg

SEQ ID NO: 65542 - DNA, 20 bp, Artificial Sequence
  chemically synthesized
ttgtgaatgttagtgaagct

SEQ ID NO: 65543 - DNA, 20 bp, Artificial Sequence
  chemically synthesized
tgaagctgaagaattaataa

SEQ ID NO: 65544 - DNA, 20 bp, Artificial Sequence
  chemically synthesized
tttcagacccccaagtcaca

SEQ ID NO: 65545 - DNA, 20 bp, Artificial Sequence
  chemically synthesized
ttgaacaatgacatgtaacg

SEQ ID NO: 65546 - DNA, 20 bp, Artificial Sequence
  chemically synthesized
aaggtgtgtgcatgtgtcca

SEQ ID NO: 65547 - DNA, 20 bp, Artificial Sequence
  chemically synthesized
tacctgggaggctgaggtgg

SEQ ID NO: 65548 - DNA, 20 bp, Artificial Sequence
  chemically synthesized
ctcaatagcagttccgagac

SEQ ID NO: 65549 - DNA, 20 bp, Artificial Sequence
  chemically synthesized
tattctatagatctcatttg

SEQ ID NO: 65550 - DNA, 20 bp, Artificial Sequence
  chemically synthesized
tttgttactaaacgaatatt

SEQ ID NO: 65551 - DNA, 20 bp, Artificial Sequence
  chemically synthesized
ctactcaggaggctggggca

SEQ ID NO: 65552 - DNA, 20 bp, Artificial Sequence
  chemically synthesized
tccttctcaaaaacaaaaaa

SEQ ID NO: 65553 - DNA, 20 bp, Artificial Sequence
  chemically synthesized
aaaagaggtattttcacata

SEQ ID NO: 65554 - DNA, 20 bp, Artificial Sequence
  chemically synthesized
aaatattcatgctctgtgtc

SEQ ID NO: 65555 - DNA, 20 bp, Artificial Sequence
  chemically synthesized
tgtgttattgttcataattt

SEQ ID NO: 65556 - DNA, 20 bp, Artificial Sequence
  chemically synthesized
aatgtaagcatacaaaatgt

SEQ ID NO: 65557 - DNA, 20 bp, Artificial Sequence
  chemically synthesized
ggctataaatatttgtatca

SEQ ID NO: 65558 - DNA, 20 bp, Artificial Sequence
  chemically synthesized
ctaactttttgttccctttc

SEQ ID NO: 65559 - DNA, 20 bp, Artificial Sequence
  chemically synthesized
agtatcaggaaaagatagca

SEQ ID NO: 65560 - DNA, 20 bp, Artificial Sequence
  chemically synthesized
attttaagagttatagattc

SEQ ID NO: 65561 - DNA, 20 bp, Artificial Sequence
  chemically synthesized
ggctcatgtaattgaagttc

SEQ ID NO: 65562 - DNA, 20 bp, Artificial Sequence
  chemically synthesized
aaggggacttttgtctggga

SEQ ID NO: 65563 - DNA, 20 bp, Artificial Sequence
  chemically synthesized
gacttttgtctgggaaaaga

SEQ ID NO: 65564 - DNA, 20 bp, Artificial Sequence
  chemically synthesized
catggagtggaagggctgca

SEQ ID NO: 65565 - DNA, 20 bp, Artificial Sequence
  chemically synthesized
catgagaaagaagctacaga

SEQ ID NO: 65566 - DNA, 20 bp, Artificial Sequence
  chemically synthesized
gttactgggctatgccttgt

SEQ ID NO: 65567 - DNA, 20 bp, Artificial Sequence
  chemically synthesized
catagtaaaaaagctaaggt

SEQ ID NO: 65568 - DNA, 20 bp, Artificial Sequence
  chemically synthesized
ctctctaatctatggagtag

SEQ ID NO: 65569 - DNA, 20 bp, Artificial Sequence
  chemically synthesized
attgtctcaatttttcagat

SEQ ID NO: 65570 - DNA, 20 bp, Artificial Sequence
  chemically synthesized
aaaggcattcaattatgtaa

SEQ ID NO: 65571 - DNA, 20 bp, Artificial Sequence
  chemically synthesized
cagatgacgtgattgcatat

SEQ ID NO: 65572 - DNA, 20 bp, Artificial Sequence
  chemically synthesized
cccattcacaattgcttcag

SEQ ID NO: 65573 - DNA, 20 bp, Artificial Sequence
  chemically synthesized
cattccatgctcatggatag

SEQ ID NO: 65574 - DNA, 20 bp, Artificial Sequence
  chemically synthesized
agctaccaatgactttcttc

SEQ ID NO: 65575 - DNA, 20 bp, Artificial Sequence
  chemically synthesized
aatggaacaaaacagagccc

SEQ ID NO: 65576 - DNA, 20 bp, Artificial Sequence
  chemically synthesized
tatctgatctttgacaaacc

SEQ ID NO: 65577 - DNA, 20 bp, Artificial Sequence
  chemically synthesized
tttgacaaacctgagaaaaa

SEQ ID NO: 65578 - DNA, 20 bp, Artificial Sequence
  chemically synthesized
ctaaaaccataaaaactcta

SEQ ID NO: 65579 - DNA, 20 bp, Artificial Sequence
  chemically synthesized
taaagatcttctgcacagca

SEQ ID NO: 65580 - DNA, 20 bp, Artificial Sequence
  chemically synthesized
aacaggcaacctacacaatg

SEQ ID NO: 65581 - DNA, 20 bp, Artificial Sequence
  chemically synthesized
atctgacaaagggctaatat

SEQ ID NO: 65582 - DNA, 20 bp, Artificial Sequence
  chemically synthesized
tgaactcaaacaaatttaca

SEQ ID NO: 65583 - DNA, 20 bp, Artificial Sequence
  chemically synthesized
gctcatcatcactggccatc

SEQ ID NO: 65584 - DNA, 20 bp, Artificial Sequence
  chemically synthesized
gagataccatctcacaccag

SEQ ID NO: 65585 - DNA, 20 bp, Artificial Sequence
  chemically synthesized
acaggtgctggagaggatgt

SEQ ID NO: 65586 - DNA, 20 bp, Artificial Sequence
  chemically synthesized
gattcctcagggatctagaa

SEQ ID NO: 65587 - DNA, 20 bp, Artificial Sequence
  chemically synthesized
ccaacaatgatagactggat

SEQ ID NO: 65588 - DNA, 20 bp, Artificial Sequence
  chemically synthesized
aaagtataacaaaaaataag

SEQ ID NO: 65589 - DNA, 20 bp, Artificial Sequence
  chemically synthesized
aacaaaaaataagttagaaa

SEQ ID NO: 65590 - DNA, 20 bp, Artificial Sequence
  chemically synthesized
gtagtatctttagagcagtg

SEQ ID NO: 65591 - DNA, 20 bp, Artificial Sequence
  chemically synthesized
agctgactgtgattgactcc

SEQ ID NO: 65592 - DNA, 20 bp, Artificial Sequence
  chemically synthesized
ctgaaagagatatagagtgg

SEQ ID NO: 65593 - DNA, 20 bp, Artificial Sequence
  chemically synthesized
tcaaacaaatcctaaactca

SEQ ID NO: 65594 - DNA, 20 bp, Artificial Sequence
  chemically synthesized
gatgcaaaaaaaaaaaaatg

SEQ ID NO: 65595 - DNA, 20 bp, Artificial Sequence
  chemically synthesized
caaaaaaaaaaaaatgcaag

SEQ ID NO: 65596 - DNA, 20 bp, Artificial Sequence
  chemically synthesized
tgcaagaaagaaaaaaaaag

SEQ ID NO: 65597 - DNA, 20 bp, Artificial Sequence
  chemically synthesized
cctcaaataaccggatattg

SEQ ID NO: 65598 - DNA, 20 bp, Artificial Sequence
  chemically synthesized
gtataataggacacaacaaa

SEQ ID NO: 65599 - DNA, 20 bp, Artificial Sequence
  chemically synthesized
cacaacaaatcagaaaaaaa

SEQ ID NO: 65600 - DNA, 20 bp, Artificial Sequence
  chemically synthesized
gactgtacccctggagctgg

SEQ ID NO: 65601 - DNA, 20 bp, Artificial Sequence
  chemically synthesized
ctgtgaggtaaacaaggaga

SEQ ID NO: 65602 - DNA, 20 bp, Artificial Sequence
  chemically synthesized
atatgatggcaaaactattt

SEQ ID NO: 65603 - DNA, 20 bp, Artificial Sequence
  chemically synthesized
ctctaggagtagagtaatgg

SEQ ID NO: 65604 - DNA, 20 bp, Artificial Sequence
  chemically synthesized
ttgtccttgtgatagtttgc

SEQ ID NO: 65605 - DNA, 20 bp, Artificial Sequence
  chemically synthesized
gtagttttttccaattctgt

SEQ ID NO: 65606 - DNA, 20 bp, Artificial Sequence
  chemically synthesized
gtttgtctgttattggtgta

SEQ ID NO: 65607 - DNA, 20 bp, Artificial Sequence
  chemically synthesized
agcaatgttgcagtgagctc

SEQ ID NO: 65608 - DNA, 20 bp, Artificial Sequence
  chemically synthesized
atgggccctgcctcttttcg

SEQ ID NO: 65609 - DNA, 20 bp, Artificial Sequence
  chemically synthesized
ctccccagctgccaacttca

SEQ ID NO: 65610 - DNA, 20 bp, Artificial Sequence
  chemically synthesized
taagacacaaactctgtctt

SEQ ID NO: 65611 - DNA, 20 bp, Artificial Sequence
  chemically synthesized
acttatagtgtattatgccc

SEQ ID NO: 65612 - DNA, 20 bp, Artificial Sequence
  chemically synthesized
aggagtccagcataatggtt

SEQ ID NO: 65613 - DNA, 20 bp, Artificial Sequence
  chemically synthesized
tccctacttcacaggtttgg

SEQ ID NO: 65614 - DNA, 20 bp, Artificial Sequence
  chemically synthesized
ataaaaccgaaatgtcttct

SEQ ID NO: 65615 - DNA, 20 bp, Artificial Sequence
  chemically synthesized
aatttgtatacggcaaagat

SEQ ID NO: 65616 - DNA, 20 bp, Artificial Sequence
  chemically synthesized
gcaaagatagagaaatctat

SEQ ID NO: 65617 - DNA, 20 bp, Artificial Sequence
  chemically synthesized
cattctaccaaatgagatct

SEQ ID NO: 65618 - DNA, 20 bp, Artificial Sequence
  chemically synthesized
gaatttcctctcaacatgga

SEQ ID NO: 65619 - DNA, 20 bp, Artificial Sequence
  chemically synthesized
atgtggatgtaaattaaagt

SEQ ID NO: 65620 - DNA, 20 bp, Artificial Sequence
  chemically synthesized
gagtgccagcctgtaaggct

SEQ ID NO: 65621 - DNA, 20 bp, Artificial Sequence
  chemically synthesized
agataccacacaaacataca

SEQ ID NO: 65622 - DNA, 20 bp, Artificial Sequence
  chemically synthesized
catggtaattttaacctgta

SEQ ID NO: 65623 - DNA, 20 bp, Artificial Sequence
  chemically synthesized
taccaccttgatggatgcca

SEQ ID NO: 65624 - DNA, 20 bp, Artificial Sequence
  chemically synthesized
ggtcaggagagagcacaacc

SEQ ID NO: 65625 - DNA, 20 bp, Artificial Sequence
  chemically synthesized
tgcttgaaacaggtgttgag

SEQ ID NO: 65626 - DNA, 20 bp, Artificial Sequence
  chemically synthesized
gaaagttactgctgaccagg

SEQ ID NO: 65627 - DNA, 20 bp, Artificial Sequence
  chemically synthesized
accaggatagaaaaagatga

SEQ ID NO: 65628 - DNA, 20 bp, Artificial Sequence
  chemically synthesized
gacagccccatcatgggcac

SEQ ID NO: 65629 - DNA, 20 bp, Artificial Sequence
  chemically synthesized
agggttggtcttaataatga

SEQ ID NO: 65630 - DNA, 20 bp, Artificial Sequence
  chemically synthesized
gagatggcaaccatgtacat

SEQ ID NO: 65631 - DNA, 20 bp, Artificial Sequence
  chemically synthesized
aatccaggaaagctggtgag

SEQ ID NO: 65632 - DNA, 20 bp, Artificial Sequence
  chemically synthesized
aggtactgaaaatacaatga

SEQ ID NO: 65633 - DNA, 20 bp, Artificial Sequence
  chemically synthesized
tctgagtaggtaattttaga

SEQ ID NO: 65634 - DNA, 20 bp, Artificial Sequence
  chemically synthesized
cttcctttttagagctctct

SEQ ID NO: 65635 - DNA, 20 bp, Artificial Sequence
  chemically synthesized
actgcagccaccgagattat

SEQ ID NO: 65636 - DNA, 20 bp, Artificial Sequence
  chemically synthesized
tacttcagtagctcctatca

SEQ ID NO: 65637 - DNA, 20 bp, Artificial Sequence
  chemically synthesized
attttattactacttcacaa

SEQ ID NO: 65638 - DNA, 20 bp, Artificial Sequence
  chemically synthesized
gatttactcataaatacttt

SEQ ID NO: 65639 - DNA, 20 bp, Artificial Sequence
  chemically synthesized
tggacagggagaaggatctg

SEQ ID NO: 65640 - DNA, 20 bp, Artificial Sequence
  chemically synthesized
gaaagtatacttcctcttgg

SEQ ID NO: 65641 - DNA, 20 bp, Artificial Sequence
  chemically synthesized
tagattcatcttagatcaca

SEQ ID NO: 65642 - DNA, 20 bp, Artificial Sequence
  chemically synthesized
gatactgtttcttgtaaata

SEQ ID NO: 65643 - DNA, 20 bp, Artificial Sequence
  chemically synthesized
cctgcctcctggccttccta

SEQ ID NO: 65644 - DNA, 20 bp, Artificial Sequence
  chemically synthesized
ctggttctgtgcatagactc

SEQ ID NO: 65645 - DNA, 20 bp, Artificial Sequence
  chemically synthesized
cttataatcctggcaacttg

SEQ ID NO: 65646 - DNA, 20 bp, Artificial Sequence
  chemically synthesized
catttctaaaaacaacaaac

SEQ ID NO: 65647 - DNA, 20 bp, Artificial Sequence
  chemically synthesized
caaacaaagaaacaacaaca

SEQ ID NO: 65648 - DNA, 20 bp, Artificial Sequence
  chemically synthesized
aaacaacaacaaaagaaaac

SEQ ID NO: 65649 - DNA, 20 bp, Artificial Sequence
  chemically synthesized
ccaatgagtaggttccaaag

SEQ ID NO: 65650 - DNA, 20 bp, Artificial Sequence
  chemically synthesized
gtagcaaatgccatcaacat

SEQ ID NO: 65651 - DNA, 20 bp, Artificial Sequence
  chemically synthesized
tgtaggagagggcaccacta

SEQ ID NO: 65652 - DNA, 20 bp, Artificial Sequence
  chemically synthesized
gcaccactaccagaaaaatt

SEQ ID NO: 65653 - DNA, 20 bp, Artificial Sequence
  chemically synthesized
cctgagctatgaagactaat

SEQ ID NO: 65654 - DNA, 20 bp, Artificial Sequence
  chemically synthesized
tcaaccacagatagggcttt

SEQ ID NO: 65655 - DNA, 20 bp, Artificial Sequence
  chemically synthesized
cgtgcattaagtgcgtcctg

SEQ ID NO: 65656 - DNA, 20 bp, Artificial Sequence
  chemically synthesized
aggccttaacctttaaggta

SEQ ID NO: 65657 - DNA, 20 bp, Artificial Sequence
  chemically synthesized
aggtattagaattcattatt

SEQ ID NO: 65658 - DNA, 20 bp, Artificial Sequence
  chemically synthesized
tgtgtgtgtgagagagagag

SEQ ID NO: 65659 - DNA, 20 bp, Artificial Sequence
  chemically synthesized
tttatttaaggaacctctat

SEQ ID NO: 65660 - DNA, 20 bp, Artificial Sequence
  chemically synthesized
gccctactatccccagggca

SEQ ID NO: 65661 - DNA, 20 bp, Artificial Sequence
  chemically synthesized
gccttaaatccccactctga

SEQ ID NO: 65662 - DNA, 20 bp, Artificial Sequence
  chemically synthesized
tctttttaggtgtctctgtc

SEQ ID NO: 65663 - DNA, 20 bp, Artificial Sequence
  chemically synthesized
ctggactggtccacagcccc

SEQ ID NO: 65664 - DNA, 20 bp, Artificial Sequence
  chemically synthesized
atcttcccacagcaactctt

SEQ ID NO: 65665 - DNA, 20 bp, Artificial Sequence
  chemically synthesized
tcatgctggttccaaacatg

SEQ ID NO: 65666 - DNA, 20 bp, Artificial Sequence
  chemically synthesized
gatgagagaggacgccaggg

SEQ ID NO: 65667 - DNA, 20 bp, Artificial Sequence
  chemically synthesized
aggacgccagggagagaaac

SEQ ID NO: 65668 - DNA, 20 bp, Artificial Sequence
  chemically synthesized
gctgtccaccatatgtgaaa

SEQ ID NO: 65669 - DNA, 20 bp, Artificial Sequence
  chemically synthesized
tgccaatcttaaaagcagac

SEQ ID NO: 65670 - DNA, 20 bp, Artificial Sequence
  chemically synthesized
agaaaaagacacattgcata

SEQ ID NO: 65671 - DNA, 20 bp, Artificial Sequence
  chemically synthesized
gttcagttcccatctatgag

SEQ ID NO: 65672 - DNA, 20 bp, Artificial Sequence
  chemically synthesized
ttgtccttgcgatagtttac

SEQ ID NO: 65673 - DNA, 20 bp, Artificial Sequence
  chemically synthesized
agtcgtttttccaattctgt

SEQ ID NO: 65674 - DNA, 20 bp, Artificial Sequence
  chemically synthesized
gtttgtctgttattggtgta

SEQ ID NO: 65675 - DNA, 20 bp, Artificial Sequence
  chemically synthesized
aattcctccttgtacctctg

SEQ ID NO: 65676 - DNA, 20 bp, Artificial Sequence
  chemically synthesized
tgcgccatttcctaagcctg

SEQ ID NO: 65677 - DNA, 20 bp, Artificial Sequence
  chemically synthesized
cccatacctcagatggaaat

SEQ ID NO: 65678 - DNA, 20 bp, Artificial Sequence
  chemically synthesized
aaactggaactttatttgtg

SEQ ID NO: 65679 - DNA, 20 bp, Artificial Sequence
  chemically synthesized
tattgtgttggtggccttgt

SEQ ID NO: 65680 - DNA, 20 bp, Artificial Sequence
  chemically synthesized
ctaaatattttctgcacagc

SEQ ID NO: 65681 - DNA, 20 bp, Artificial Sequence
  chemically synthesized
tcatcaaaaggaacagtttg

SEQ ID NO: 65682 - DNA, 20 bp, Artificial Sequence
  chemically synthesized
ataggggttggagaggctgt

SEQ ID NO: 65683 - DNA, 20 bp, Artificial Sequence
  chemically synthesized
tgtaagttaacatagccatt

SEQ ID NO: 65684 - DNA, 20 bp, Artificial Sequence
  chemically synthesized
aaatagagttattgtatgat

SEQ ID NO: 65685 - DNA, 20 bp, Artificial Sequence
  chemically synthesized
ctaagtgaaataaaccagac

SEQ ID NO: 65686 - DNA, 20 bp, Artificial Sequence
  chemically synthesized
tacttatatgtggaatctca

SEQ ID NO: 65687 - DNA, 20 bp, Artificial Sequence
  chemically synthesized
agaaaaataaggtcaaatgc

SEQ ID NO: 65688 - DNA, 20 bp, Artificial Sequence
  chemically synthesized
tagaaacagtgtaaaaaggg

SEQ ID NO: 65689 - DNA, 20 bp, Artificial Sequence
  chemically synthesized
aacagtgtaaaaaggggaag

SEQ ID NO: 65690 - DNA, 20 bp, Artificial Sequence
  chemically synthesized
gtaaaaaggggaagaaagaa

SEQ ID NO: 65691 - DNA, 20 bp, Artificial Sequence
  chemically synthesized
gatgttagatgcccttacac

SEQ ID NO: 65692 - DNA, 20 bp, Artificial Sequence
  chemically synthesized
attaaatgtttatgagccac

SEQ ID NO: 65693 - DNA, 20 bp, Artificial Sequence
  chemically synthesized
tgtttatgagccacagagaa

SEQ ID NO: 65694 - DNA, 20 bp, Artificial Sequence
  chemically synthesized
tgtggcttagagtataaaca

SEQ ID NO: 65695 - DNA, 20 bp, Artificial Sequence
  chemically synthesized
cagaatgtgctatggacttt

SEQ ID NO: 65696 - DNA, 20 bp, Artificial Sequence
  chemically synthesized
ttcagtgcccttgtatatcc

SEQ ID NO: 65697 - DNA, 20 bp, Artificial Sequence
  chemically synthesized
aatacaagcttcataggaac

SEQ ID NO: 65698 - DNA, 20 bp, Artificial Sequence
  chemically synthesized
tctattattcatttctaaac

SEQ ID NO: 65699 - DNA, 20 bp, Artificial Sequence
  chemically synthesized
atttctaaacacagaaagag

SEQ ID NO: 65700 - DNA, 20 bp, Artificial Sequence
  chemically synthesized
acacagaaagagtgagaaag

SEQ ID NO: 65701 - DNA, 20 bp, Artificial Sequence
  chemically synthesized
agagtgagaaagggagaaag

SEQ ID NO: 65702 - DNA, 20 bp, Artificial Sequence
  chemically synthesized
aaagggagaaagacagaaag

SEQ ID NO: 65703 - DNA, 20 bp, Artificial Sequence
  chemically synthesized
aaagacagaaagtaagaatg

SEQ ID NO: 65704 - DNA, 20 bp, Artificial Sequence
  chemically synthesized
tgaaagaaagagagtgagat

SEQ ID NO: 65705 - DNA, 20 bp, Artificial Sequence
  chemically synthesized
tcttgttgatacagattgac

SEQ ID NO: 65706 - DNA, 20 bp, Artificial Sequence
  chemically synthesized
ctttccttgagtaaaaatcc

SEQ ID NO: 65707 - DNA, 20 bp, Artificial Sequence
  chemically synthesized
atatatgtatatataaatgt

SEQ ID NO: 65708 - DNA, 20 bp, Artificial Sequence
  chemically synthesized
taaatgtgtagaaaagttgc

SEQ ID NO: 65709 - DNA, 20 bp, Artificial Sequence
  chemically synthesized
ggaaattatctccagggagg

SEQ ID NO: 65710 - DNA, 20 bp, Artificial Sequence
  chemically synthesized
tatcagattttattttttat

SEQ ID NO: 65711 - DNA, 20 bp, Artificial Sequence
  chemically synthesized
tggcctcattcagtacagta

SEQ ID NO: 65712 - DNA, 20 bp, Artificial Sequence
  chemically synthesized
gatctgtaagcatgatccgg

SEQ ID NO: 65713 - DNA, 20 bp, Artificial Sequence
  chemically synthesized
gaaacctctcttaatccaca

SEQ ID NO: 65714 - DNA, 20 bp, Artificial Sequence
  chemically synthesized
cactttgccctgggggaaaa

SEQ ID NO: 65715 - DNA, 20 bp, Artificial Sequence
  chemically synthesized
tattttgagtaactcaatgt

SEQ ID NO: 65716 - DNA, 20 bp, Artificial Sequence
  chemically synthesized
gctttctcacaggatgcatg

SEQ ID NO: 65717 - DNA, 20 bp, Artificial Sequence
  chemically synthesized
taaaacacaaagtctttatg

SEQ ID NO: 65718 - DNA, 20 bp, Artificial Sequence
  chemically synthesized
aaagatgagtggaccaaaac

SEQ ID NO: 65719 - DNA, 20 bp, Artificial Sequence
  chemically synthesized
tgaatggcagaggaaaaaac

SEQ ID NO: 65720 - DNA, 20 bp, Artificial Sequence
  chemically synthesized
tctggtagaagtgaaacttt

SEQ ID NO: 65721 - DNA, 20 bp, Artificial Sequence
  chemically synthesized
ggacataaaaatagatatag

SEQ ID NO: 65722 - DNA, 20 bp, Artificial Sequence
  chemically synthesized
ctattctgggtgctagcata

SEQ ID NO: 65723 - DNA, 20 bp, Artificial Sequence
  chemically synthesized
agacctactgggctgtattc

SEQ ID NO: 65724 - DNA, 20 bp, Artificial Sequence
  chemically synthesized
cccaccagcactatgactgt

SEQ ID NO: 65725 - DNA, 20 bp, Artificial Sequence
  chemically synthesized
aaccacattcctgagacttg

SEQ ID NO: 65726 - DNA, 20 bp, Artificial Sequence
  chemically synthesized
tgtctttggtctctgctgct

SEQ ID NO: 65727 - DNA, 20 bp, Artificial Sequence
  chemically synthesized
agaggtaagcagagttcctc

SEQ ID NO: 65728 - DNA, 20 bp, Artificial Sequence
  chemically synthesized
aatggttgctgactggcaga

SEQ ID NO: 65729 - DNA, 20 bp, Artificial Sequence
  chemically synthesized
tacagaactcaccagacaaa

SEQ ID NO: 65730 - DNA, 20 bp, Artificial Sequence
  chemically synthesized
cccaagattcattgctgtga

SEQ ID NO: 65731 - DNA, 20 bp, Artificial Sequence
  chemically synthesized
gacaagaagaagcagttact

SEQ ID NO: 65732 - DNA, 20 bp, Artificial Sequence
  chemically synthesized
tattaaatggaaattcacca

SEQ ID NO: 65733 - DNA, 20 bp, Artificial Sequence
  chemically synthesized
agtttattttttcatttaat

SEQ ID NO: 65734 - DNA, 20 bp, Artificial Sequence
  chemically synthesized
ccagcaaggagactgaccat

SEQ ID NO: 65735 - DNA, 20 bp, Artificial Sequence
  chemically synthesized
aatatggcaggaatttctaa

SEQ ID NO: 65736 - DNA, 20 bp, Artificial Sequence
  chemically synthesized
tgcagctctcatatcctgtc

SEQ ID NO: 65737 - DNA, 20 bp, Artificial Sequence
  chemically synthesized
atcgaccttattgcaaccat

SEQ ID NO: 65738 - DNA, 20 bp, Artificial Sequence
  chemically synthesized
acacaagcttctcctccttt

SEQ ID NO: 65739 - DNA, 20 bp, Artificial Sequence
  chemically synthesized
catatggtccctagttttta

SEQ ID NO: 65740 - DNA, 20 bp, Artificial Sequence
  chemically synthesized
tactttcccgctttccaata

SEQ ID NO: 65741 - DNA, 20 bp, Artificial Sequence
  chemically synthesized
tataatcttagtagtatcta

SEQ ID NO: 65742 - DNA, 20 bp, Artificial Sequence
  chemically synthesized
caggcgggacacttccagca

SEQ ID NO: 65743 - DNA, 20 bp, Artificial Sequence
  chemically synthesized
cgggacacttccagcaatag

SEQ ID NO: 65744 - DNA, 20 bp, Artificial Sequence
  chemically synthesized
ttatctactcccatcccccg

SEQ ID NO: 65745 - DNA, 20 bp, Artificial Sequence
  chemically synthesized
atactcagaagccaagctgc

SEQ ID NO: 65746 - DNA, 20 bp, Artificial Sequence
  chemically synthesized
agctgcaaagaaaattagtt

SEQ ID NO: 65747 - DNA, 20 bp, Artificial Sequence
  chemically synthesized
ttagggaattagccacatct

SEQ ID NO: 65748 - DNA, 20 bp, Artificial Sequence
  chemically synthesized
attttaagcatcacataggg

SEQ ID NO: 65749 - DNA, 20 bp, Artificial Sequence
  chemically synthesized
aagcatcacataggggtaga

SEQ ID NO: 65750 - DNA, 20 bp, Artificial Sequence
  chemically synthesized
ttgtccttgcgatagtttgc

SEQ ID NO: 65751 - DNA, 20 bp, Artificial Sequence
  chemically synthesized
attaatttttgtataaggtg

SEQ ID NO: 65752 - DNA, 20 bp, Artificial Sequence
  chemically synthesized
gtagttttttccaattctgt

SEQ ID NO: 65753 - DNA, 20 bp, Artificial Sequence
  chemically synthesized
gtttgtctgttattggtgta

SEQ ID NO: 65754 - DNA, 20 bp, Artificial Sequence
  chemically synthesized
ctcctgcctaattgccctgg

SEQ ID NO: 65755 - DNA, 20 bp, Artificial Sequence
  chemically synthesized
agctcctccttgtacctctg

SEQ ID NO: 65756 - DNA, 20 bp, Artificial Sequence
  chemically synthesized
taggtgtggtgtggtgctga

SEQ ID NO: 65757 - DNA, 20 bp, Artificial Sequence
  chemically synthesized
agggcattacattgatcctt

SEQ ID NO: 65758 - DNA, 20 bp, Artificial Sequence
  chemically synthesized
ttaatttttaaaggtaattg

SEQ ID NO: 65759 - DNA, 20 bp, Artificial Sequence
  chemically synthesized
tctcttcagtataaggaaga

SEQ ID NO: 65760 - DNA, 20 bp, Artificial Sequence
  chemically synthesized
aggaagaacagaaagggagg

SEQ ID NO: 65761 - DNA, 20 bp, Artificial Sequence
  chemically synthesized
tcagtcaaatgtgtccattt

SEQ ID NO: 65762 - DNA, 20 bp, Artificial Sequence
  chemically synthesized
actggacctagagggtgagt

SEQ ID NO: 65763 - DNA, 20 bp, Artificial Sequence
  chemically synthesized
tcattcccaaaagcccaagg

SEQ ID NO: 65764 - DNA, 20 bp, Artificial Sequence
  chemically synthesized
acagaagaactagcagacac

SEQ ID NO: 65765 - DNA, 20 bp, Artificial Sequence
  chemically synthesized
cacagtcaagaagctacaaa

SEQ ID NO: 65766 - DNA, 20 bp, Artificial Sequence
  chemically synthesized
tctgtgttatttatacatcc

SEQ ID NO: 65767 - DNA, 20 bp, Artificial Sequence
  chemically synthesized
cataccctgtattttggtca

SEQ ID NO: 65768 - DNA, 20 bp, Artificial Sequence
  chemically synthesized
ttctcatgcctagactctga

SEQ ID NO: 65769 - DNA, 20 bp, Artificial Sequence
  chemically synthesized
agaatcaaaagtatttggag

SEQ ID NO: 65770 - DNA, 20 bp, Artificial Sequence
  chemically synthesized
caagacaatggtcatctgaa

SEQ ID NO: 65771 - DNA, 20 bp, Artificial Sequence
  chemically synthesized
ggaaatggtttaccctcatt

SEQ ID NO: 65772 - DNA, 20 bp, Artificial Sequence
  chemically synthesized
ggaaatggcttactctcatt

SEQ ID NO: 65773 - DNA, 20 bp, Artificial Sequence
  chemically synthesized
atttcttcacgtgcaatttt

SEQ ID NO: 65774 - DNA, 20 bp, Artificial Sequence
  chemically synthesized
ggtgacccaaatcatagacc

SEQ ID NO: 65775 - DNA, 20 bp, Artificial Sequence
  chemically synthesized
acaatgtgagttaaattacc

SEQ ID NO: 65776 - DNA, 20 bp, Artificial Sequence
  chemically synthesized
catgctctagagtgaggcag

SEQ ID NO: 65777 - DNA, 20 bp, Artificial Sequence
  chemically synthesized
accaatgcccatgacagtct

SEQ ID NO: 65778 - DNA, 20 bp, Artificial Sequence
  chemically synthesized
gtcttgagaatcaaaatgta

SEQ ID NO: 65779 - DNA, 20 bp, Artificial Sequence
  chemically synthesized
aatgtaggagaaaaagatga

SEQ ID NO: 65780 - DNA, 20 bp, Artificial Sequence
  chemically synthesized
ttgatgacatcttggtgtag

SEQ ID NO: 65781 - DNA, 20 bp, Artificial Sequence
  chemically synthesized
gcaagacacctgactccatg

SEQ ID NO: 65782 - DNA, 20 bp, Artificial Sequence
  chemically synthesized
tctgtagctgccaacatagc

SEQ ID NO: 65783 - DNA, 20 bp, Artificial Sequence
  chemically synthesized
gaggttatgatcattcctga

SEQ ID NO: 65784 - DNA, 20 bp, Artificial Sequence
  chemically synthesized
gttgtataaaagttgctcct

SEQ ID NO: 65785 - DNA, 20 bp, Artificial Sequence
  chemically synthesized
gagatcctaggtatgggaaa

SEQ ID NO: 65786 - DNA, 20 bp, Artificial Sequence
  chemically synthesized
ttggggatacagctattcat

SEQ ID NO: 65787 - DNA, 20 bp, Artificial Sequence
  chemically synthesized
ttcattgtaaatcatataac

SEQ ID NO: 65788 - DNA, 20 bp, Artificial Sequence
  chemically synthesized
aaaataaaaacaaaatgaaa

SEQ ID NO: 65789 - DNA, 20 bp, Artificial Sequence
  chemically synthesized
atgtgagacctaaaagatca

SEQ ID NO: 65790 - DNA, 20 bp, Artificial Sequence
  chemically synthesized
tggaaaaacaaatacacaag

SEQ ID NO: 65791 - DNA, 20 bp, Artificial Sequence
  chemically synthesized
ctccagagacttttgggtag

SEQ ID NO: 65792 - DNA, 20 bp, Artificial Sequence
  chemically synthesized
agttattgatacactgcttc

SEQ ID NO: 65793 - DNA, 20 bp, Artificial Sequence
  chemically synthesized
aaattttcataatataaatt

SEQ ID NO: 65794 - DNA, 20 bp, Artificial Sequence
  chemically synthesized
ggtaatttaggcaagatcaa

SEQ ID NO: 65795 - DNA, 20 bp, Artificial Sequence
  chemically synthesized
tgagaaggctctgtgactca

SEQ ID NO: 65796 - DNA, 20 bp, Artificial Sequence
  chemically synthesized
tggtgcaggcagccaacctc

SEQ ID NO: 65797 - DNA, 20 bp, Artificial Sequence
  chemically synthesized
gtgtgttggtggcatgagcc

SEQ ID NO: 65798 - DNA, 20 bp, Artificial Sequence
  chemically synthesized
agacctctttctgtccatga

SEQ ID NO: 65799 - DNA, 20 bp, Artificial Sequence
  chemically synthesized
ttactggactttcattttca

SEQ ID NO: 65800 - DNA, 20 bp, Artificial Sequence
  chemically synthesized
gtctgggtgggaaagggaaa

SEQ ID NO: 65801 - DNA, 20 bp, Artificial Sequence
  chemically synthesized
gcaactctgtcctcaaaaag

SEQ ID NO: 65802 - DNA, 20 bp, Artificial Sequence
  chemically synthesized
ccagatagggaaaataaagc

SEQ ID NO: 65803 - DNA, 20 bp, Artificial Sequence
  chemically synthesized
atatacacctcattttttgg

SEQ ID NO: 65804 - DNA, 20 bp, Artificial Sequence
  chemically synthesized
cctcttccagggtctctgtc

SEQ ID NO: 65805 - DNA, 20 bp, Artificial Sequence
  chemically synthesized
tagacttgagtttttattaa

SEQ ID NO: 65806 - DNA, 20 bp, Artificial Sequence
  chemically synthesized
atcagctgccagggcggcta

SEQ ID NO: 65807 - DNA, 20 bp, Artificial Sequence
  chemically synthesized
gtcagatagtgacttttttt

SEQ ID NO: 65808 - DNA, 20 bp, Artificial Sequence
  chemically synthesized
attacagaggtatacctcct

SEQ ID NO: 65809 - DNA, 20 bp, Artificial Sequence
  chemically synthesized
gggcagggggactctcaggg

SEQ ID NO: 65810 - DNA, 20 bp, Artificial Sequence
  chemically synthesized
gaatggaagccagagagatt

SEQ ID NO: 65811 - DNA, 20 bp, Artificial Sequence
  chemically synthesized
ttaaagaatcagtcaggtgg

SEQ ID NO: 65812 - DNA, 20 bp, Artificial Sequence
  chemically synthesized
acccatgctctggtttgttc

SEQ ID NO: 65813 - DNA, 20 bp, Artificial Sequence
  chemically synthesized
aattgtttgccttatgtgtt

SEQ ID NO: 65814 - DNA, 20 bp, Artificial Sequence
  chemically synthesized
tatttgaagaggtaactctc

SEQ ID NO: 65815 - DNA, 20 bp, Artificial Sequence
  chemically synthesized
cactattacttttctcttgc

SEQ ID NO: 65816 - DNA, 20 bp, Artificial Sequence
  chemically synthesized
aagatttgggcatcatcttt

SEQ ID NO: 65817 - DNA, 20 bp, Artificial Sequence
  chemically synthesized
cctgctgcatcccctggaaa

SEQ ID NO: 65818 - DNA, 20 bp, Artificial Sequence
  chemically synthesized
gggaatagttagtgataact

SEQ ID NO: 65819 - DNA, 20 bp, Artificial Sequence
  chemically synthesized
taaaccaagcaggaaatata

SEQ ID NO: 65820 - DNA, 20 bp, Artificial Sequence
  chemically synthesized
agccagtaacttatttgaaa

SEQ ID NO: 65821 - DNA, 20 bp, Artificial Sequence
  chemically synthesized
gactcctctataagctctcc

SEQ ID NO: 65822 - DNA, 20 bp, Artificial Sequence
  chemically synthesized
ttttactttttaaacaaagc

SEQ ID NO: 65823 - DNA, 20 bp, Artificial Sequence
  chemically synthesized
gattttctaggtgttccatt

SEQ ID NO: 65824 - DNA, 20 bp, Artificial Sequence
  chemically synthesized
ttctctcattgtctttcttc

SEQ ID NO: 65825 - DNA, 20 bp, Artificial Sequence
  chemically synthesized
gccacgactagctgaggaca

SEQ ID NO: 65826 - DNA, 20 bp, Artificial Sequence
  chemically synthesized
agagaagtaagagtgttgac

SEQ ID NO: 65827 - DNA, 20 bp, Artificial Sequence
  chemically synthesized
tatctttgcgtctagtaact

SEQ ID NO: 65828 - DNA, 20 bp, Artificial Sequence
  chemically synthesized
ttatgtctctcagtcctagg

SEQ ID NO: 65829 - DNA, 20 bp, Artificial Sequence
  chemically synthesized
gaagttgttctggcatgtga

SEQ ID NO: 65830 - DNA, 20 bp, Artificial Sequence
  chemically synthesized
ccattctttcatttgttcaa

SEQ ID NO: 65831 - DNA, 20 bp, Artificial Sequence
  chemically synthesized
gagtaatttaaaaatacaaa

SEQ ID NO: 65832 - DNA, 20 bp, Artificial Sequence
  chemically synthesized
ctttactacatttatagtaa

SEQ ID NO: 65833 - DNA, 20 bp, Artificial Sequence
  chemically synthesized
ttcacaaatattaggtgaac

SEQ ID NO: 65834 - DNA, 20 bp, Artificial Sequence
  chemically synthesized
ggaattacttcagtaggcct

SEQ ID NO: 65835 - DNA, 20 bp, Artificial Sequence
  chemically synthesized
cctatagaaaaataatttaa

SEQ ID NO: 65836 - DNA, 20 bp, Artificial Sequence
  chemically synthesized
aaaaagacactacttgtaaa

SEQ ID NO: 65837 - DNA, 20 bp, Artificial Sequence
  chemically synthesized
ttacaggtttaggtggtaga

SEQ ID NO: 65838 - DNA, 20 bp, Artificial Sequence
  chemically synthesized
gaaatccccttgaatgcccc

SEQ ID NO: 65839 - DNA, 20 bp, Artificial Sequence
  chemically synthesized
ttacataattttttttctga

SEQ ID NO: 65840 - DNA, 20 bp, Artificial Sequence
  chemically synthesized
catataaacagttgaaactc

SEQ ID NO: 65841 - DNA, 20 bp, Artificial Sequence
  chemically synthesized
tagatcctggaatgtgcagt

SEQ ID NO: 65842 - DNA, 20 bp, Artificial Sequence
  chemically synthesized
acaaatagtatgagtaaccc

SEQ ID NO: 65843 - DNA, 20 bp, Artificial Sequence
  chemically synthesized
gtaaccctgagaatgtattt

SEQ ID NO: 65844 - DNA, 20 bp, Artificial Sequence
  chemically synthesized
ttatctttaggaaaaaattc

SEQ ID NO: 65845 - DNA, 20 bp, Artificial Sequence
  chemically synthesized
aactgtgcactgtggtaata

SEQ ID NO: 65846 - DNA, 20 bp, Artificial Sequence
  chemically synthesized
gcactgtggtaataacagaa

SEQ ID NO: 65847 - DNA, 20 bp, Artificial Sequence
  chemically synthesized
agtgtcaagaccaagcagat

SEQ ID NO: 65848 - DNA, 20 bp, Artificial Sequence
  chemically synthesized
tcttcacctttttactaccc

SEQ ID NO: 65849 - DNA, 20 bp, Artificial Sequence
  chemically synthesized
caatcatcacagtcactctc

SEQ ID NO: 65850 - DNA, 20 bp, Artificial Sequence
  chemically synthesized
tataaagttagcagatagga

SEQ ID NO: 65851 - DNA, 20 bp, Artificial Sequence
  chemically synthesized
tccaggaattttcctgcaaa

SEQ ID NO: 65852 - DNA, 20 bp, Artificial Sequence
  chemically synthesized
ataggtttctgcattttttt

SEQ ID NO: 65853 - DNA, 20 bp, Artificial Sequence
  chemically synthesized
gtaataagtgtaaatttccc

SEQ ID NO: 65854 - DNA, 20 bp, Artificial Sequence
  chemically synthesized
tgttttaccccgatcatttt

SEQ ID NO: 65855 - DNA, 20 bp, Artificial Sequence
  chemically synthesized
ctcagcaggaaatgtcttat

SEQ ID NO: 65856 - DNA, 20 bp, Artificial Sequence
  chemically synthesized
tgctcatagagagtccaact

SEQ ID NO: 65857 - DNA, 20 bp, Artificial Sequence
  chemically synthesized
cagtagaagaacttttttaa

SEQ ID NO: 65858 - DNA, 20 bp, Artificial Sequence
  chemically synthesized
aaaagagtaatgcttttgtt

SEQ ID NO: 65859 - DNA, 20 bp, Artificial Sequence
  chemically synthesized
gaattactaaaatgcaatgc

SEQ ID NO: 65860 - DNA, 20 bp, Artificial Sequence
  chemically synthesized
atttagagtaaattatagat

SEQ ID NO: 65861 - DNA, 20 bp, Artificial Sequence
  chemically synthesized
aaagaaatgataataaataa

SEQ ID NO: 65862 - DNA, 20 bp, Artificial Sequence
  chemically synthesized
cttagcaaattaatacagga

SEQ ID NO: 65863 - DNA, 20 bp, Artificial Sequence
  chemically synthesized
aatttgtattcataagaaga

SEQ ID NO: 65864 - DNA, 20 bp, Artificial Sequence
  chemically synthesized
ttcatcattcaagactgaaa

SEQ ID NO: 65865 - DNA, 20 bp, Artificial Sequence
  chemically synthesized
tatgggaaatctaaggtgta

SEQ ID NO: 65866 - DNA, 20 bp, Artificial Sequence
  chemically synthesized
cttgaagggataacatacca

SEQ ID NO: 65867 - DNA, 20 bp, Artificial Sequence
  chemically synthesized
ttctgtagactaagccaatc

SEQ ID NO: 65868 - DNA, 20 bp, Artificial Sequence
  chemically synthesized
gaaatgattaagaagacgtg

SEQ ID NO: 65869 - DNA, 20 bp, Artificial Sequence
  chemically synthesized
aaattgggcagcaaggatga

SEQ ID NO: 65870 - DNA, 20 bp, Artificial Sequence
  chemically synthesized
agaggtctccatgtccaatt

SEQ ID NO: 65871 - DNA, 20 bp, Artificial Sequence
  chemically synthesized
cctatgttagtcatggttct

SEQ ID NO: 65872 - DNA, 20 bp, Artificial Sequence
  chemically synthesized
agtcatggttctccagaaaa

SEQ ID NO: 65873 - DNA, 20 bp, Artificial Sequence
  chemically synthesized
cagacacactgactaatgga

SEQ ID NO: 65874 - DNA, 20 bp, Artificial Sequence
  chemically synthesized
ggagaactggctagccatat

SEQ ID NO: 65875 - DNA, 20 bp, Artificial Sequence
  chemically synthesized
ccaaaactataaaaacttta

SEQ ID NO: 65876 - DNA, 20 bp, Artificial Sequence
  chemically synthesized
ctactcaggaggctgaggca

SEQ ID NO: 65877 - DNA, 20 bp, Artificial Sequence
  chemically synthesized
gtgagacttcatctcaaaat

SEQ ID NO: 65878 - DNA, 20 bp, Artificial Sequence
  chemically synthesized
tcagagcgaacaggcaacct

SEQ ID NO: 65879 - DNA, 20 bp, Artificial Sequence
  chemically synthesized
aacaggcaacctacagaatg

SEQ ID NO: 65880 - DNA, 20 bp, Artificial Sequence
  chemically synthesized
atctgacaaaggtctaatat

SEQ ID NO: 65881 - DNA, 20 bp, Artificial Sequence
  chemically synthesized
ggaacttagacatatttaca

SEQ ID NO: 65882 - DNA, 20 bp, Artificial Sequence
  chemically synthesized
aaagaagacatttatgtggc

SEQ ID NO: 65883 - DNA, 20 bp, Artificial Sequence
  chemically synthesized
tctcaatgtcactgatcatt

SEQ ID NO: 65884 - DNA, 20 bp, Artificial Sequence
  chemically synthesized
gaaataccatctgacaccag

SEQ ID NO: 65885 - DNA, 20 bp, Artificial Sequence
  chemically synthesized
agaatggtggtttttaaagt

SEQ ID NO: 65886 - DNA, 20 bp, Artificial Sequence
  chemically synthesized
acagatgctagcaaggttgc

SEQ ID NO: 65887 - DNA, 20 bp, Artificial Sequence
  chemically synthesized
aattcctcaaagatttagaa

SEQ ID NO: 65888 - DNA, 20 bp, Artificial Sequence
  chemically synthesized
ctattcacaatagcaaagac

SEQ ID NO: 65889 - DNA, 20 bp, Artificial Sequence
  chemically synthesized
ttcagtaaactaatgcagga

SEQ ID NO: 65890 - DNA, 20 bp, Artificial Sequence
  chemically synthesized
tagaagtgggagctgaacaa

SEQ ID NO: 65891 - DNA, 20 bp, Artificial Sequence
  chemically synthesized
gggtgtggtgaaggggagca

SEQ ID NO: 65892 - DNA, 20 bp, Artificial Sequence
  chemically synthesized
tgtttcagttcaatctaaag

SEQ ID NO: 65893 - DNA, 20 bp, Artificial Sequence
  chemically synthesized
aaacaccctcacaaaaacat

SEQ ID NO: 65894 - DNA, 20 bp, Artificial Sequence
  chemically synthesized
atccagaaggctgacagata

SEQ ID NO: 65895 - DNA, 20 bp, Artificial Sequence
  chemically synthesized
agataatagaatcaaactac

SEQ ID NO: 65896 - DNA, 20 bp, Artificial Sequence
  chemically synthesized
agagccaaggaataggaaga

SEQ ID NO: 65897 - DNA, 20 bp, Artificial Sequence
  chemically synthesized
taaatattgtgttatgtgat

SEQ ID NO: 65898 - DNA, 20 bp, Artificial Sequence
  chemically synthesized
caatacagcaggaaatatga

SEQ ID NO: 65899 - DNA, 20 bp, Artificial Sequence
  chemically synthesized
tgaaaagaatgaacaaggtc

SEQ ID NO: 65900 - DNA, 20 bp, Artificial Sequence
  chemically synthesized
acatttaggaagacctatga

SEQ ID NO: 65901 - DNA, 20 bp, Artificial Sequence
  chemically synthesized
gatttaagactgatgagaca

SEQ ID NO: 65902 - DNA, 20 bp, Artificial Sequence
  chemically synthesized
gtcagacaaagccagggatt

SEQ ID NO: 65903 - DNA, 20 bp, Artificial Sequence
  chemically synthesized
tgggcaagacttaccaagag

SEQ ID NO: 65904 - DNA, 20 bp, Artificial Sequence
  chemically synthesized
caaacaatcttatttgaaac

SEQ ID NO: 65905 - DNA, 20 bp, Artificial Sequence
  chemically synthesized
caattctgttttctttttgc

SEQ ID NO: 65906 - DNA, 20 bp, Artificial Sequence
  chemically synthesized
gtcaggctctagtgactatg

SEQ ID NO: 65907 - DNA, 20 bp, Artificial Sequence
  chemically synthesized
gttgttgcaagagggtaaat

SEQ ID NO: 65908 - DNA, 20 bp, Artificial Sequence
  chemically synthesized
ttaagaacacttttcctaca

SEQ ID NO: 65909 - DNA, 20 bp, Artificial Sequence
  chemically synthesized
ctaggtctgagagactagta

SEQ ID NO: 65910 - DNA, 20 bp, Artificial Sequence
  chemically synthesized
agggcaaaataagagacaat

SEQ ID NO: 65911 - DNA, 20 bp, Artificial Sequence
  chemically synthesized
tatgtacctgagcagatggt

SEQ ID NO: 65912 - DNA, 20 bp, Artificial Sequence
  chemically synthesized
tcttatccaaaggctctggg

SEQ ID NO: 65913 - DNA, 20 bp, Artificial Sequence
  chemically synthesized
attgtatcatattcacagtc

SEQ ID NO: 65914 - DNA, 20 bp, Artificial Sequence
  chemically synthesized
ttaggataggaaatcttgtg

SEQ ID NO: 65915 - DNA, 20 bp, Artificial Sequence
  chemically synthesized
gcacaatgtctgaaagggtg

SEQ ID NO: 65916 - DNA, 20 bp, Artificial Sequence
  chemically synthesized
tagcatctggttagcttgag

SEQ ID NO: 65917 - DNA, 20 bp, Artificial Sequence
  chemically synthesized
aagtgtaaacactcgatttt

SEQ ID NO: 65918 - DNA, 20 bp, Artificial Sequence
  chemically synthesized
gtgcttcatcaaaaaaatgt

SEQ ID NO: 65919 - DNA, 20 bp, Artificial Sequence
  chemically synthesized
gagataccatctcacaccag

SEQ ID NO: 65920 - DNA, 20 bp, Artificial Sequence
  chemically synthesized
acaggtgctggagaggatgt

SEQ ID NO: 65921 - DNA, 20 bp, Artificial Sequence
  chemically synthesized
gattcctcagggatctagaa

SEQ ID NO: 65922 - DNA, 20 bp, Artificial Sequence
  chemically synthesized
ccaacaatgatagactgaat

SEQ ID NO: 65923 - DNA, 20 bp, Artificial Sequence
  chemically synthesized
gttttgttattctggctctg

SEQ ID NO: 65924 - DNA, 20 bp, Artificial Sequence
  chemically synthesized
agcttaaataatatttcttt

SEQ ID NO: 65925 - DNA, 20 bp, Artificial Sequence
  chemically synthesized
cttctcaggaggctgtggca

SEQ ID NO: 65926 - DNA, 20 bp, Artificial Sequence
  chemically synthesized
tcaaggggtctcctgagatg

SEQ ID NO: 65927 - DNA, 20 bp, Artificial Sequence
  chemically synthesized
atgtttatagcttttttttc

SEQ ID NO: 65928 - DNA, 20 bp, Artificial Sequence
  chemically synthesized
ttcatttttgaaaataagaa

SEQ ID NO: 65929 - DNA, 20 bp, Artificial Sequence
  chemically synthesized
tcaactcagtttttgtttat

SEQ ID NO: 65930 - DNA, 20 bp, Artificial Sequence
  chemically synthesized
tctgaatcgagttgaaaggc

SEQ ID NO: 65931 - DNA, 20 bp, Artificial Sequence
  chemically synthesized
agggcagccaaattaagatc

SEQ ID NO: 65932 - DNA, 20 bp, Artificial Sequence
  chemically synthesized
aggaatttaacttgtggaca

SEQ ID NO: 65933 - DNA, 20 bp, Artificial Sequence
  chemically synthesized
ctgctaagatcctgaaattt

SEQ ID NO: 65934 - DNA, 20 bp, Artificial Sequence
  chemically synthesized
taagatcctgaaatttatag

SEQ ID NO: 65935 - DNA, 20 bp, Artificial Sequence
  chemically synthesized
tgagtagtcagtgggactca

SEQ ID NO: 65936 - DNA, 20 bp, Artificial Sequence
  chemically synthesized
agtataggaatcttattcat

SEQ ID NO: 65937 - DNA, 20 bp, Artificial Sequence
  chemically synthesized
aattcaggtcaatagaacat

SEQ ID NO: 65938 - DNA, 20 bp, Artificial Sequence
  chemically synthesized
atagaacatctagaatgaag

SEQ ID NO: 65939 - DNA, 20 bp, Artificial Sequence
  chemically synthesized
tattctgcataaaattgaag

SEQ ID NO: 65940 - DNA, 20 bp, Artificial Sequence
  chemically synthesized
catagctgctccacctttat

SEQ ID NO: 65941 - DNA, 20 bp, Artificial Sequence
  chemically synthesized
gatgacagtatctagctctc

SEQ ID NO: 65942 - DNA, 20 bp, Artificial Sequence
  chemically synthesized
ctttcttctatgtttaccct

SEQ ID NO: 65943 - DNA, 20 bp, Artificial Sequence
  chemically synthesized
tgatactgaggccattttat

SEQ ID NO: 65944 - DNA, 20 bp, Artificial Sequence
  chemically synthesized
ccctcttggatcgtggcaac

SEQ ID NO: 65945 - DNA, 20 bp, Artificial Sequence
  chemically synthesized
ggatcgtggcaaccaagaaa

SEQ ID NO: 65946 - DNA, 20 bp, Artificial Sequence
  chemically synthesized
agcagagagaggtaagaagg

SEQ ID NO: 65947 - DNA, 20 bp, Artificial Sequence
  chemically synthesized
aatgttggaaagggcaagtg

SEQ ID NO: 65948 - DNA, 20 bp, Artificial Sequence
  chemically synthesized
ttggaaagggcaagtggcag

SEQ ID NO: 65949 - DNA, 20 bp, Artificial Sequence
  chemically synthesized
aagaaagccagtaaatggtg

SEQ ID NO: 65950 - DNA, 20 bp, Artificial Sequence
  chemically synthesized
ataattgtatgaagatattt

SEQ ID NO: 65951 - DNA, 20 bp, Artificial Sequence
  chemically synthesized
atgaagatatttggagaaaa

SEQ ID NO: 65952 - DNA, 20 bp, Artificial Sequence
  chemically synthesized
ctgaaaaaagcgaatttgat

SEQ ID NO: 65953 - DNA, 20 bp, Artificial Sequence
  chemically synthesized
gattcagaatgttggaaggg

SEQ ID NO: 65954 - DNA, 20 bp, Artificial Sequence
  chemically synthesized
cattcaatttccaaaaaaaa

SEQ ID NO: 65955 - DNA, 20 bp, Artificial Sequence
  chemically synthesized
taatgaaaaatttttgaatt

SEQ ID NO: 65956 - DNA, 20 bp, Artificial Sequence
  chemically synthesized
ggctcctggtttcaaggttt

SEQ ID NO: 65957 - DNA, 20 bp, Artificial Sequence
  chemically synthesized
cacgtgctttctgcctccac

SEQ ID NO: 65958 - DNA, 20 bp, Artificial Sequence
  chemically synthesized
acattcatttacagatttgg

SEQ ID NO: 65959 - DNA, 20 bp, Artificial Sequence
  chemically synthesized
tagtagttaaactcggatct

SEQ ID NO: 65960 - DNA, 20 bp, Artificial Sequence
  chemically synthesized
acacagacataaaaatgaag

SEQ ID NO: 65961 - DNA, 20 bp, Artificial Sequence
  chemically synthesized
aaaaagttgatcatcattct

SEQ ID NO: 65962 - DNA, 20 bp, Artificial Sequence
  chemically synthesized
tctcatggcaaatatagtga

SEQ ID NO: 65963 - DNA, 20 bp, Artificial Sequence
  chemically synthesized
ggtcaaggctctattcaaaa

SEQ ID NO: 65964 - DNA, 20 bp, Artificial Sequence
  chemically synthesized
aaatagaaaatatagccatt

SEQ ID NO: 65965 - DNA, 20 bp, Artificial Sequence
  chemically synthesized
tatatgttcagagggaaaaa

SEQ ID NO: 65966 - DNA, 20 bp, Artificial Sequence
  chemically synthesized
taggaagaccaacaatgttg

SEQ ID NO: 65967 - DNA, 20 bp, Artificial Sequence
  chemically synthesized
ttaattacctgccacatgtg

SEQ ID NO: 65968 - DNA, 20 bp, Artificial Sequence
  chemically synthesized
tggtgccttcatggttgttt

SEQ ID NO: 65969 - DNA, 20 bp, Artificial Sequence
  chemically synthesized
cctatatgttaatgaaactg

SEQ ID NO: 65970 - DNA, 20 bp, Artificial Sequence
  chemically synthesized
atgttaatgaaactgttaga

SEQ ID NO: 65971 - DNA, 20 bp, Artificial Sequence
  chemically synthesized
tactctccattcagcaaaac

SEQ ID NO: 65972 - DNA, 20 bp, Artificial Sequence
  chemically synthesized
actcagttctattctaagtc

SEQ ID NO: 65973 - DNA, 20 bp, Artificial Sequence
  chemically synthesized
ctggaaaatgttccctgatc

SEQ ID NO: 65974 - DNA, 20 bp, Artificial Sequence
  chemically synthesized
tcagttctagcagccttttg

SEQ ID NO: 65975 - DNA, 20 bp, Artificial Sequence
  chemically synthesized
tttatgttcactaggagtgg

SEQ ID NO: 65976 - DNA, 20 bp, Artificial Sequence
  chemically synthesized
tgtcttgttgcagttttcga

SEQ ID NO: 65977 - DNA, 20 bp, Artificial Sequence
  chemically synthesized
agaactacaaaacactgctg

SEQ ID NO: 65978 - DNA, 20 bp, Artificial Sequence
  chemically synthesized
caaaacactgctgaaagaaa

SEQ ID NO: 65979 - DNA, 20 bp, Artificial Sequence
  chemically synthesized
ctttccaggctcatggattg

SEQ ID NO: 65980 - DNA, 20 bp, Artificial Sequence
  chemically synthesized
caatgtcattcttcacagta

SEQ ID NO: 65981 - DNA, 20 bp, Artificial Sequence
  chemically synthesized
aacaggcaaagcaatcttaa

SEQ ID NO: 65982 - DNA, 20 bp, Artificial Sequence
  chemically synthesized
ctactcggaaggctgaggca

SEQ ID NO: 65983 - DNA, 20 bp, Artificial Sequence
  chemically synthesized
gaaactctgaaaaaataaaa

SEQ ID NO: 65984 - DNA, 20 bp, Artificial Sequence
  chemically synthesized
ctctgaaaaaataaaaaaag

SEQ ID NO: 65985 - DNA, 20 bp, Artificial Sequence
  chemically synthesized
aaaaaataaaaaaagaaaga

SEQ ID NO: 65986 - DNA, 20 bp, Artificial Sequence
  chemically synthesized
aataaaaaaagaaagaaaag

SEQ ID NO: 65987 - DNA, 20 bp, Artificial Sequence
  chemically synthesized
agaaaagaaagaaagagagg

SEQ ID NO: 65988 - DNA, 20 bp, Artificial Sequence
  chemically synthesized
agaaagagagggaagaaagg

SEQ ID NO: 65989 - DNA, 20 bp, Artificial Sequence
  chemically synthesized
acattgactaaggaaacaca

SEQ ID NO: 65990 - DNA, 20 bp, Artificial Sequence
  chemically synthesized
tacgtggctagccatatgca

SEQ ID NO: 65991 - DNA, 20 bp, Artificial Sequence
  chemically synthesized
acccttaccttacaccattt

SEQ ID NO: 65992 - DNA, 20 bp, Artificial Sequence
  chemically synthesized
cccaaaagcaattgcaatgc

SEQ ID NO: 65993 - DNA, 20 bp, Artificial Sequence
  chemically synthesized
aacccaaatgtccaacaatg

SEQ ID NO: 65994 - DNA, 20 bp, Artificial Sequence
  chemically synthesized
ccaacaatgatagaatggat

SEQ ID NO: 65995 - DNA, 20 bp, Artificial Sequence
  chemically synthesized
aaaagagcttctgtgcagca

SEQ ID NO: 65996 - DNA, 20 bp, Artificial Sequence
  chemically synthesized
aactgacaatctacaggata

SEQ ID NO: 65997 - DNA, 20 bp, Artificial Sequence
  chemically synthesized
atctggaaaaggtctaatat

SEQ ID NO: 65998 - DNA, 20 bp, Artificial Sequence
  chemically synthesized
aatgatcatcatcactaatg

SEQ ID NO: 65999 - DNA, 20 bp, Artificial Sequence
  chemically synthesized
gagatactatctcataccag

SEQ ID NO: 66000 - DNA, 20 bp, Artificial Sequence
  chemically synthesized
acagattctcatgaggctat

SEQ ID NO: 66001 - DNA, 20 bp, Artificial Sequence
  chemically synthesized
tgtaaattagttcaaccact

SEQ ID NO: 66002 - DNA, 20 bp, Artificial Sequence
  chemically synthesized
catgttcactgtaatgctgt

SEQ ID NO: 66003 - DNA, 20 bp, Artificial Sequence
  chemically synthesized
ctatcaaaggcggacgggat

SEQ ID NO: 66004 - DNA, 20 bp, Artificial Sequence
  chemically synthesized
aagtaaatgttgaaaattta

SEQ ID NO: 66005 - DNA, 20 bp, Artificial Sequence
  chemically synthesized
gaactgattttcccaaagta

SEQ ID NO: 66006 - DNA, 20 bp, Artificial Sequence
  chemically synthesized
agcttttctcatccatcctt

SEQ ID NO: 66007 - DNA, 20 bp, Artificial Sequence
  chemically synthesized
ggaatgggtccttattccag

SEQ ID NO: 66008 - DNA, 20 bp, Artificial Sequence
  chemically synthesized
cagagggctcatggcttttg

SEQ ID NO: 66009 - DNA, 20 bp, Artificial Sequence
  chemically synthesized
attctatttcaaaactaaac

SEQ ID NO: 66010 - DNA, 20 bp, Artificial Sequence
  chemically synthesized
ttaaaatgtgttttttagat

SEQ ID NO: 66011 - DNA, 20 bp, Artificial Sequence
  chemically synthesized
ctacttaattattcataact

SEQ ID NO: 66012 - DNA, 20 bp, Artificial Sequence
  chemically synthesized
ataaatgtattgctcttcta

SEQ ID NO: 66013 - DNA, 20 bp, Artificial Sequence
  chemically synthesized
tgaatattaggattgaggct

SEQ ID NO: 66014 - DNA, 20 bp, Artificial Sequence
  chemically synthesized
tccactcccattatccactt

SEQ ID NO: 66015 - DNA, 20 bp, Artificial Sequence
  chemically synthesized
aacagttaaaggtattgcct

SEQ ID NO: 66016 - DNA, 20 bp, Artificial Sequence
  chemically synthesized
tgttcgcctattttctgggc

SEQ ID NO: 66017 - DNA, 20 bp, Artificial Sequence
  chemically synthesized
gaatggcttgagcccttttt

SEQ ID NO: 66018 - DNA, 20 bp, Artificial Sequence
  chemically synthesized
tgcaaaggtaattgcagttc

SEQ ID NO: 66019 - DNA, 20 bp, Artificial Sequence
  chemically synthesized
atattagacttttgtcagat

SEQ ID NO: 66020 - DNA, 20 bp, Artificial Sequence
  chemically synthesized
gtgttctctctaaatgctgg

SEQ ID NO: 66021 - DNA, 20 bp, Artificial Sequence
  chemically synthesized
cttcaaataagtggggactc

SEQ ID NO: 66022 - DNA, 20 bp, Artificial Sequence
  chemically synthesized
aagtggggactcaaagaata

SEQ ID NO: 66023 - DNA, 20 bp, Artificial Sequence
  chemically synthesized
gtgctgtgattaatcataaa

SEQ ID NO: 66024 - DNA, 20 bp, Artificial Sequence
  chemically synthesized
gaaataagggtaagattccc

SEQ ID NO: 66025 - DNA, 20 bp, Artificial Sequence
  chemically synthesized
agctgagacctgaaaatgga

SEQ ID NO: 66026 - DNA, 20 bp, Artificial Sequence
  chemically synthesized
ctaactggtgaaaatacaga

SEQ ID NO: 66027 - DNA, 20 bp, Artificial Sequence
  chemically synthesized
ttgagggaggcagggaaagg

SEQ ID NO: 66028 - DNA, 20 bp, Artificial Sequence
  chemically synthesized
gcagaatattagagtaattt

SEQ ID NO: 66029 - DNA, 20 bp, Artificial Sequence
  chemically synthesized
taataaggtttacaggttat

SEQ ID NO: 66030 - DNA, 20 bp, Artificial Sequence
  chemically synthesized
gttatttagaaaagcagagg

SEQ ID NO: 66031 - DNA, 20 bp, Artificial Sequence
  chemically synthesized
caatttctgacatgttcttg

SEQ ID NO: 66032 - DNA, 20 bp, Artificial Sequence
  chemically synthesized
ttggaagaaaggcagtgcca

SEQ ID NO: 66033 - DNA, 20 bp, Artificial Sequence
  chemically synthesized
tatgtattgtctataaataa

SEQ ID NO: 66034 - DNA, 20 bp, Artificial Sequence
  chemically synthesized
tttttaaagttgtgggacac

SEQ ID NO: 66035 - DNA, 20 bp, Artificial Sequence
  chemically synthesized
aaaataataaacatgtgatt

SEQ ID NO: 66036 - DNA, 20 bp, Artificial Sequence
  chemically synthesized
tagtaaaggcaagacatatg

SEQ ID NO: 66037 - DNA, 20 bp, Artificial Sequence
  chemically synthesized
agacatatgtcagaaaatga

SEQ ID NO: 66038 - DNA, 20 bp, Artificial Sequence
  chemically synthesized
gaatttacagatgcaagaca

SEQ ID NO: 66039 - DNA, 20 bp, Artificial Sequence
  chemically synthesized
gatgacacccaaagaaggtc

SEQ ID NO: 66040 - DNA, 20 bp, Artificial Sequence
  chemically synthesized
aacagtggctcactatccta

SEQ ID NO: 66041 - DNA, 20 bp, Artificial Sequence
  chemically synthesized
attaccagatgagtaaataa

SEQ ID NO: 66042 - DNA, 20 bp, Artificial Sequence
  chemically synthesized
ctctgaatattctgcttttc

SEQ ID NO: 66043 - DNA, 20 bp, Artificial Sequence
  chemically synthesized
ccttggaatattccatggaa

SEQ ID NO: 66044 - DNA, 20 bp, Artificial Sequence
  chemically synthesized
gaaaatgagacaagctttct

SEQ ID NO: 66045 - DNA, 20 bp, Artificial Sequence
  chemically synthesized
cctgggttcagttttcagtt

SEQ ID NO: 66046 - DNA, 20 bp, Artificial Sequence
  chemically synthesized
ttttacaggtacattttcac

SEQ ID NO: 66047 - DNA, 20 bp, Artificial Sequence
  chemically synthesized
gggaagacataaaaatgtgg

SEQ ID NO: 66048 - DNA, 20 bp, Artificial Sequence
  chemically synthesized
tgtctttgtaagttattttg

SEQ ID NO: 66049 - DNA, 20 bp, Artificial Sequence
  chemically synthesized
ttgtaagttattttggaaga

SEQ ID NO: 66050 - DNA, 20 bp, Artificial Sequence
  chemically synthesized
ttagtttttctcatgcttag

SEQ ID NO: 66051 - DNA, 20 bp, Artificial Sequence
  chemically synthesized
aacctgcaatttacgtccaa

SEQ ID NO: 66052 - DNA, 20 bp, Artificial Sequence
  chemically synthesized
aacttctttcaacgtaatct

SEQ ID NO: 66053 - DNA, 20 bp, Artificial Sequence
  chemically synthesized
gttggggtacagttctttat

SEQ ID NO: 66054 - DNA, 20 bp, Artificial Sequence
  chemically synthesized
gtagtcttttcattggaatg

SEQ ID NO: 66055 - DNA, 20 bp, Artificial Sequence
  chemically synthesized
acactgtctcaaaagagagg

SEQ ID NO: 66056 - DNA, 20 bp, Artificial Sequence
  chemically synthesized
gtctcaaaagagaggaaaga

SEQ ID NO: 66057 - DNA, 20 bp, Artificial Sequence
  chemically synthesized
aagagaggaaagaaaagaaa

SEQ ID NO: 66058 - DNA, 20 bp, Artificial Sequence
  chemically synthesized
aaaaggaaaggaaaggaaag

SEQ ID NO: 66059 - DNA, 20 bp, Artificial Sequence
  chemically synthesized
ggaaaggaaaggaaagggag

SEQ ID NO: 66060 - DNA, 20 bp, Artificial Sequence
  chemically synthesized
ggagaaagaaaggaaggaag

SEQ ID NO: 66061 - DNA, 20 bp, Artificial Sequence
  chemically synthesized
aggaaggaagaaaaagagag

SEQ ID NO: 66062 - DNA, 20 bp, Artificial Sequence
  chemically synthesized
aaagagagagagaaataagg

SEQ ID NO: 66063 - DNA, 20 bp, Artificial Sequence
  chemically synthesized
agagagagaaataaggaaag

SEQ ID NO: 66064 - DNA, 20 bp, Artificial Sequence
  chemically synthesized
gaaataaggaaagaaagaaa

SEQ ID NO: 66065 - DNA, 20 bp, Artificial Sequence
  chemically synthesized
acatcgaagtactaaacaat

SEQ ID NO: 66066 - DNA, 20 bp, Artificial Sequence
  chemically synthesized
caaaaccaatggcttgatca

SEQ ID NO: 66067 - DNA, 20 bp, Artificial Sequence
  chemically synthesized
gtcacttcttagctacaagt

SEQ ID NO: 66068 - DNA, 20 bp, Artificial Sequence
  chemically synthesized
gcgagtgtcacatatattat

SEQ ID NO: 66069 - DNA, 20 bp, Artificial Sequence
  chemically synthesized
cacgatcttagactacttaa

SEQ ID NO: 66070 - DNA, 20 bp, Artificial Sequence
  chemically synthesized
atccaatgaaaaaagagatt

SEQ ID NO: 66071 - DNA, 20 bp, Artificial Sequence
  chemically synthesized
atgcagatatctttatacat

SEQ ID NO: 66072 - DNA, 20 bp, Artificial Sequence
  chemically synthesized
gggtagtgagttttgaatca

SEQ ID NO: 66073 - DNA, 20 bp, Artificial Sequence
  chemically synthesized
agtgagttttgaatcaatag

SEQ ID NO: 66074 - DNA, 20 bp, Artificial Sequence
  chemically synthesized
attttgtaaagggttgaatt

SEQ ID NO: 66075 - DNA, 20 bp, Artificial Sequence
  chemically synthesized
ctcttagagactctccttcc

SEQ ID NO: 66076 - DNA, 20 bp, Artificial Sequence
  chemically synthesized
ttcccaggttggggaggaaa

SEQ ID NO: 66077 - DNA, 20 bp, Artificial Sequence
  chemically synthesized
atatcctatgtggaaatgag

SEQ ID NO: 66078 - DNA, 20 bp, Artificial Sequence
  chemically synthesized
tgtaacaaatatatctctca

SEQ ID NO: 66079 - DNA, 20 bp, Artificial Sequence
  chemically synthesized
aaccaatattcaggtcatgc

SEQ ID NO: 66080 - DNA, 20 bp, Artificial Sequence
  chemically synthesized
gtcatgctcagaaaccgcaa

SEQ ID NO: 66081 - DNA, 20 bp, Artificial Sequence
  chemically synthesized
agagaaaactgtggctcagg

SEQ ID NO: 66082 - DNA, 20 bp, Artificial Sequence
  chemically synthesized
tccatttgatggacattggt

SEQ ID NO: 66083 - DNA, 20 bp, Artificial Sequence
  chemically synthesized
atgatggatctatgttacct

SEQ ID NO: 66084 - DNA, 20 bp, Artificial Sequence
  chemically synthesized
actctgggatagttgctgtc

SEQ ID NO: 66085 - DNA, 20 bp, Artificial Sequence
  chemically synthesized
aagaatcagtccaaaggcac

SEQ ID NO: 66086 - DNA, 20 bp, Artificial Sequence
  chemically synthesized
ttgaaaacacgactatagtt

SEQ ID NO: 66087 - DNA, 20 bp, Artificial Sequence
  chemically synthesized
ttaaaagactctggacacat

SEQ ID NO: 66088 - DNA, 20 bp, Artificial Sequence
  chemically synthesized
tacagaatcaattgaatttg

SEQ ID NO: 66089 - DNA, 20 bp, Artificial Sequence
  chemically synthesized
cagctgtcccattagtttca

SEQ ID NO: 66090 - DNA, 20 bp, Artificial Sequence
  chemically synthesized
gaggaggaataaaagagtaa

SEQ ID NO: 66091 - DNA, 20 bp, Artificial Sequence
  chemically synthesized
ttaattaagtatgagacaat

SEQ ID NO: 66092 - DNA, 20 bp, Artificial Sequence
  chemically synthesized
tgtgctacaagaagattgtg

SEQ ID NO: 66093 - DNA, 20 bp, Artificial Sequence
  chemically synthesized
caagaagattgtgagagaaa

SEQ ID NO: 66094 - DNA, 20 bp, Artificial Sequence
  chemically synthesized
tcattcattcactggccatt

SEQ ID NO: 66095 - DNA, 20 bp, Artificial Sequence
  chemically synthesized
gtagggcttgagcccttatt

SEQ ID NO: 66096 - DNA, 20 bp, Artificial Sequence
  chemically synthesized
catgaaaaagctgatgtgag

SEQ ID NO: 66097 - DNA, 20 bp, Artificial Sequence
  chemically synthesized
gagggaatgccagtgatgct

SEQ ID NO: 66098 - DNA, 20 bp, Artificial Sequence
  chemically synthesized
atgccagtgatgctgaagaa

SEQ ID NO: 66099 - DNA, 20 bp, Artificial Sequence
  chemically synthesized
aaagaagagtaactatgatt

SEQ ID NO: 66100 - DNA, 20 bp, Artificial Sequence
  chemically synthesized
gggtcaaatacagttcatct

SEQ ID NO: 66101 - DNA, 20 bp, Artificial Sequence
  chemically synthesized
ggcaaaggtaatgttatatt

SEQ ID NO: 66102 - DNA, 20 bp, Artificial Sequence
  chemically synthesized
taaattctctctgcttcact

SEQ ID NO: 66103 - DNA, 20 bp, Artificial Sequence
  chemically synthesized
aaaatattccagagatttga

SEQ ID NO: 66104 - DNA, 20 bp, Artificial Sequence
  chemically synthesized
gcatacagagtttattctat

SEQ ID NO: 66105 - DNA, 20 bp, Artificial Sequence
  chemically synthesized
taaggtatgatagcgaagtc

SEQ ID NO: 66106 - DNA, 20 bp, Artificial Sequence
  chemically synthesized
taatgatagggacaggaggc

SEQ ID NO: 66107 - DNA, 20 bp, Artificial Sequence
  chemically synthesized
aggaggcagagaaattttag

SEQ ID NO: 66108 - DNA, 20 bp, Artificial Sequence
  chemically synthesized
ctgtcttattcatgcacttt

SEQ ID NO: 66109 - DNA, 20 bp, Artificial Sequence
  chemically synthesized
aaagtattgaccaataagga

SEQ ID NO: 66110 - DNA, 20 bp, Artificial Sequence
  chemically synthesized
gtagtttgaaaagcctagat

SEQ ID NO: 66111 - DNA, 20 bp, Artificial Sequence
  chemically synthesized
gagttcagtatataattgta

SEQ ID NO: 66112 - DNA, 20 bp, Artificial Sequence
  chemically synthesized
gaacctaagctgattcggcc

SEQ ID NO: 66113 - DNA, 20 bp, Artificial Sequence
  chemically synthesized
gctgtcagatgaatactgag

SEQ ID NO: 66114 - DNA, 20 bp, Artificial Sequence
  chemically synthesized
gatgaaggcaggtgactcta

SEQ ID NO: 66115 - DNA, 20 bp, Artificial Sequence
  chemically synthesized
tgtgtaggttgaaatgagct

SEQ ID NO: 66116 - DNA, 20 bp, Artificial Sequence
  chemically synthesized
taatgtgaagtgactttaaa

SEQ ID NO: 66117 - DNA, 20 bp, Artificial Sequence
  chemically synthesized
acctgtagatacaaaaagtt

SEQ ID NO: 66118 - DNA, 20 bp, Artificial Sequence
  chemically synthesized
caaaaatctattaatccttg

SEQ ID NO: 66119 - DNA, 20 bp, Artificial Sequence
  chemically synthesized
gataaaacactggtttacat

SEQ ID NO: 66120 - DNA, 20 bp, Artificial Sequence
  chemically synthesized
tccttataaaagtgataatt

SEQ ID NO: 66121 - DNA, 20 bp, Artificial Sequence
  chemically synthesized
cacttatcactataaacatc

SEQ ID NO: 66122 - DNA, 20 bp, Artificial Sequence
  chemically synthesized
tttaaatagttaggaataat

SEQ ID NO: 66123 - DNA, 20 bp, Artificial Sequence
  chemically synthesized
cttggttctagttgcttctt

SEQ ID NO: 66124 - DNA, 20 bp, Artificial Sequence
  chemically synthesized
ctactttttagtacatctaa

SEQ ID NO: 66125 - DNA, 20 bp, Artificial Sequence
  chemically synthesized
ctaaccttccctcgctttgc

SEQ ID NO: 66126 - DNA, 20 bp, Artificial Sequence
  chemically synthesized
tcaactcatgatatttggct

SEQ ID NO: 66127 - DNA, 20 bp, Artificial Sequence
  chemically synthesized
aaataagacataatttgggg

SEQ ID NO: 66128 - DNA, 20 bp, Artificial Sequence
  chemically synthesized
gatgtgggtggggccagata

SEQ ID NO: 66129 - DNA, 20 bp, Artificial Sequence
  chemically synthesized
gaccacgaacccatcagaag

SEQ ID NO: 66130 - DNA, 20 bp, Artificial Sequence
  chemically synthesized
ccaattccggacacagtatg

SEQ ID NO: 66131 - DNA, 20 bp, Artificial Sequence
  chemically synthesized
tctttcccttcctctatgtg

SEQ ID NO: 66132 - DNA, 20 bp, Artificial Sequence
  chemically synthesized
tctgactgtgacgtagcaat

SEQ ID NO: 66133 - DNA, 20 bp, Artificial Sequence
  chemically synthesized
atttcaagttctttacaggc

SEQ ID NO: 66134 - DNA, 20 bp, Artificial Sequence
  chemically synthesized
tttcccacagtctgttggtc

SEQ ID NO: 66135 - DNA, 20 bp, Artificial Sequence
  chemically synthesized
agtgattactgatgaaagag

SEQ ID NO: 66136 - DNA, 20 bp, Artificial Sequence
  chemically synthesized
tctttctttatttcaagagt

SEQ ID NO: 66137 - DNA, 20 bp, Artificial Sequence
  chemically synthesized
aaagagctctttcaagagac

SEQ ID NO: 66138 - DNA, 20 bp, Artificial Sequence
  chemically synthesized
gctctttcaagagacagaga

SEQ ID NO: 66139 - DNA, 20 bp, Artificial Sequence
  chemically synthesized
gtttatatacatctgtattg

SEQ ID NO: 66140 - DNA, 20 bp, Artificial Sequence
  chemically synthesized
accacagggttaagggggca

SEQ ID NO: 66141 - DNA, 20 bp, Artificial Sequence
  chemically synthesized
aatgtataaataagtggatg

SEQ ID NO: 66142 - DNA, 20 bp, Artificial Sequence
  chemically synthesized
gatagacagatagatgatag

SEQ ID NO: 66143 - DNA, 20 bp, Artificial Sequence
  chemically synthesized
agctgaacttggtcaacaaa

SEQ ID NO: 66144 - DNA, 20 bp, Artificial Sequence
  chemically synthesized
gtgaaaccttgcctcacgaa

SEQ ID NO: 66145 - DNA, 20 bp, Artificial Sequence
  chemically synthesized
ttgtaatattgatattattc

SEQ ID NO: 66146 - DNA, 20 bp, Artificial Sequence
  chemically synthesized
ggaataacagaacaagattg

SEQ ID NO: 66147 - DNA, 20 bp, Artificial Sequence
  chemically synthesized
tctcattctttttcttagtg

SEQ ID NO: 66148 - DNA, 20 bp, Artificial Sequence
  chemically synthesized
tctttttcttagtgtgagaa

SEQ ID NO: 66149 - DNA, 20 bp, Artificial Sequence
  chemically synthesized
taaatgatatatttatttta

SEQ ID NO: 66150 - DNA, 20 bp, Artificial Sequence
  chemically synthesized
ggctgtgacatggaaactat

SEQ ID NO: 66151 - DNA, 20 bp, Artificial Sequence
  chemically synthesized
gctcactgcacatacactag

SEQ ID NO: 66152 - DNA, 20 bp, Artificial Sequence
  chemically synthesized
tgatcatttccatgtcatac

SEQ ID NO: 66153 - DNA, 20 bp, Artificial Sequence
  chemically synthesized
ttttttaattagtttgtttt

SEQ ID NO: 66154 - DNA, 20 bp, Artificial Sequence
  chemically synthesized
acttataaatgctaactact

SEQ ID NO: 66155 - DNA, 20 bp, Artificial Sequence
  chemically synthesized
acataaactactagcaaata

SEQ ID NO: 66156 - DNA, 20 bp, Artificial Sequence
  chemically synthesized
tcccaggccaagttatccat

SEQ ID NO: 66157 - DNA, 20 bp, Artificial Sequence
  chemically synthesized
ttaacaaatgcatgaatgct

SEQ ID NO: 66158 - DNA, 20 bp, Artificial Sequence
  chemically synthesized
ttagaagattcttctgtgtg

SEQ ID NO: 66159 - DNA, 20 bp, Artificial Sequence
  chemically synthesized
atctgtgagctcctcaccat

SEQ ID NO: 66160 - DNA, 20 bp, Artificial Sequence
  chemically synthesized
ttcccaaactcatatagctc

SEQ ID NO: 66161 - DNA, 20 bp, Artificial Sequence
  chemically synthesized
ttgcatgaatcagattatca

SEQ ID NO: 66162 - DNA, 20 bp, Artificial Sequence
  chemically synthesized
cccattcagggctccagcat

SEQ ID NO: 66163 - DNA, 20 bp, Artificial Sequence
  chemically synthesized
tgctgagatgatctatgtgg

SEQ ID NO: 66164 - DNA, 20 bp, Artificial Sequence
  chemically synthesized
tgtggggagaatggcttctt

SEQ ID NO: 66165 - DNA, 20 bp, Artificial Sequence
  chemically synthesized
cctcattcccactttaatat

SEQ ID NO: 66166 - DNA, 20 bp, Artificial Sequence
  chemically synthesized
aatatccagaatcactataa

SEQ ID NO: 66167 - DNA, 20 bp, Artificial Sequence
  chemically synthesized
gaagcccaaggttctgaaca

SEQ ID NO: 66168 - DNA, 20 bp, Artificial Sequence
  chemically synthesized
gaaacaagatggtgaaggga

SEQ ID NO: 66169 - DNA, 20 bp, Artificial Sequence
  chemically synthesized
tcttgagtacttagtatatg

SEQ ID NO: 66170 - DNA, 20 bp, Artificial Sequence
  chemically synthesized
ctactcaggaggctgaggca

SEQ ID NO: 66171 - DNA, 20 bp, Artificial Sequence
  chemically synthesized
aaactcagatattgtggatg

SEQ ID NO: 66172 - DNA, 20 bp, Artificial Sequence
  chemically synthesized
tttcttcaggaaagtttgag

SEQ ID NO: 66173 - DNA, 20 bp, Artificial Sequence
  chemically synthesized
agtttgagggagaaaaaggt

SEQ ID NO: 66174 - DNA, 20 bp, Artificial Sequence
  chemically synthesized
agaaaaaggtaaagaaaaat

SEQ ID NO: 66175 - DNA, 20 bp, Artificial Sequence
  chemically synthesized
agaaaaatttagaaacaact

SEQ ID NO: 66176 - DNA, 20 bp, Artificial Sequence
  chemically synthesized
acaaattataagcagacact

SEQ ID NO: 66177 - DNA, 20 bp, Artificial Sequence
  chemically synthesized
cctgcagtgacctcagtgcc

SEQ ID NO: 66178 - DNA, 20 bp, Artificial Sequence
  chemically synthesized
gtggtgctgtgataggtaca

SEQ ID NO: 66179 - DNA, 20 bp, Artificial Sequence
  chemically synthesized
gataggtacacaagaaatga

SEQ ID NO: 66180 - DNA, 20 bp, Artificial Sequence
  chemically synthesized
attgtctttctcatctgtaa

SEQ ID NO: 66181 - DNA, 20 bp, Artificial Sequence
  chemically synthesized
tgggtgaatgagagggtaag

SEQ ID NO: 66182 - DNA, 20 bp, Artificial Sequence
  chemically synthesized
ctgctgccaacattaacagt

SEQ ID NO: 66183 - DNA, 20 bp, Artificial Sequence
  chemically synthesized
atatttatcataatactgta

SEQ ID NO: 66184 - DNA, 20 bp, Artificial Sequence
  chemically synthesized
tagacttatgaaatttctga

SEQ ID NO: 66185 - DNA, 20 bp, Artificial Sequence
  chemically synthesized
ttctgatgagaaaggagaga

SEQ ID NO: 66186 - DNA, 20 bp, Artificial Sequence
  chemically synthesized
agcttgccctgatgggagat

SEQ ID NO: 66187 - DNA, 20 bp, Artificial Sequence
  chemically synthesized
ctctaaaataatccacagtg

SEQ ID NO: 66188 - DNA, 20 bp, Artificial Sequence
  chemically synthesized
ctattagggtggctgaggca

SEQ ID NO: 66189 - DNA, 20 bp, Artificial Sequence
  chemically synthesized
tccacctcaaacggcatcat

SEQ ID NO: 66190 - DNA, 20 bp, Artificial Sequence
  chemically synthesized
aaagaaaatggatgcctgag

SEQ ID NO: 66191 - DNA, 20 bp, Artificial Sequence
  chemically synthesized
gagacagaatgtgacatatt

SEQ ID NO: 66192 - DNA, 20 bp, Artificial Sequence
  chemically synthesized
atttgttgttatcaattgcc

SEQ ID NO: 66193 - DNA, 20 bp, Artificial Sequence
  chemically synthesized
ggcctctatacctagaagcg

SEQ ID NO: 66194 - DNA, 20 bp, Artificial Sequence
  chemically synthesized
aggaaggcatgaaaacagga

SEQ ID NO: 66195 - DNA, 20 bp, Artificial Sequence
  chemically synthesized
gcaactctgatcctgagagg

SEQ ID NO: 66196 - DNA, 20 bp, Artificial Sequence
  chemically synthesized
agacagacataatgcttgtg

SEQ ID NO: 66197 - DNA, 20 bp, Artificial Sequence
  chemically synthesized
ggggatagagaaggcttcca

SEQ ID NO: 66198 - DNA, 20 bp, Artificial Sequence
  chemically synthesized
ttcacagtggcaaagatgtt

SEQ ID NO: 66199 - DNA, 20 bp, Artificial Sequence
  chemically synthesized
ggttcaagtgtatgtttgtg

SEQ ID NO: 66200 - DNA, 20 bp, Artificial Sequence
  chemically synthesized
tctaacataaacacaaacat

SEQ ID NO: 66201 - DNA, 20 bp, Artificial Sequence
  chemically synthesized
ccatttaaatcacaaattaa

SEQ ID NO: 66202 - DNA, 20 bp, Artificial Sequence
  chemically synthesized
aaaaaattccatggatgggt

SEQ ID NO: 66203 - DNA, 20 bp, Artificial Sequence
  chemically synthesized
tgaaatatgtggctaaataa

SEQ ID NO: 66204 - DNA, 20 bp, Artificial Sequence
  chemically synthesized
attttcattttatattgggc

SEQ ID NO: 66205 - DNA, 20 bp, Artificial Sequence
  chemically synthesized
ctacttgggaggctgaggca

SEQ ID NO: 66206 - DNA, 20 bp, Artificial Sequence
  chemically synthesized
tccagagcgagactctgtct

SEQ ID NO: 66207 - DNA, 20 bp, Artificial Sequence
  chemically synthesized
ccatcaaattccctgaccga

SEQ ID NO: 66208 - DNA, 20 bp, Artificial Sequence
  chemically synthesized
atctaccattttccctcctt

SEQ ID NO: 66209 - DNA, 20 bp, Artificial Sequence
  chemically synthesized
agaagcctctggtcagcatc

SEQ ID NO: 66210 - DNA, 20 bp, Artificial Sequence
  chemically synthesized
actctgacatatactcacag

SEQ ID NO: 66211 - DNA, 20 bp, Artificial Sequence
  chemically synthesized
caccaattccatattctctg

SEQ ID NO: 66212 - DNA, 20 bp, Artificial Sequence
  chemically synthesized
atccactgctatgcacacac

SEQ ID NO: 66213 - DNA, 20 bp, Artificial Sequence
  chemically synthesized
cttgatgggattactgagtt

SEQ ID NO: 66214 - DNA, 20 bp, Artificial Sequence
  chemically synthesized
ttcatcagtcaggtaaaagt

SEQ ID NO: 66215 - DNA, 20 bp, Artificial Sequence
  chemically synthesized
ataagcatacttctattcaa

SEQ ID NO: 66216 - DNA, 20 bp, Artificial Sequence
  chemically synthesized
atattctgtaagattatagt

SEQ ID NO: 66217 - DNA, 20 bp, Artificial Sequence
  chemically synthesized
ttttctatgtatctacttgt

SEQ ID NO: 66218 - DNA, 20 bp, Artificial Sequence
  chemically synthesized
gctatcaccatcccaagtct

SEQ ID NO: 66219 - DNA, 20 bp, Artificial Sequence
  chemically synthesized
ggtttgcccatctctgttga

SEQ ID NO: 66220 - DNA, 20 bp, Artificial Sequence
  chemically synthesized
taaaataagcccctaagctc

SEQ ID NO: 66221 - DNA, 20 bp, Artificial Sequence
  chemically synthesized
catgactaaaccagcaagaa

SEQ ID NO: 66222 - DNA, 20 bp, Artificial Sequence
  chemically synthesized
tgtctgaatgaggcttgagt

SEQ ID NO: 66223 - DNA, 20 bp, Artificial Sequence
  chemically synthesized
cagaacaaactcctgtgggg

SEQ ID NO: 66224 - DNA, 20 bp, Artificial Sequence
  chemically synthesized
cctcagttttaaccttctcc

SEQ ID NO: 66225 - DNA, 20 bp, Artificial Sequence
  chemically synthesized
ctgaagatagcatgcatagg

SEQ ID NO: 66226 - DNA, 20 bp, Artificial Sequence
  chemically synthesized
agctttatgttgctgttgtt

SEQ ID NO: 66227 - DNA, 20 bp, Artificial Sequence
  chemically synthesized
gcaatttaattaaaaaaacc

SEQ ID NO: 66228 - DNA, 20 bp, Artificial Sequence
  chemically synthesized
taaaaaaacccaagaatttc

SEQ ID NO: 66229 - DNA, 20 bp, Artificial Sequence
  chemically synthesized
actcaaggtcccaaaaggtc

SEQ ID NO: 66230 - DNA, 20 bp, Artificial Sequence
  chemically synthesized
ccagagagagagattactct

SEQ ID NO: 66231 - DNA, 20 bp, Artificial Sequence
  chemically synthesized
cttaaaataaaagttgaaaa

SEQ ID NO: 66232 - DNA, 20 bp, Artificial Sequence
  chemically synthesized
tctcattctttacaattaca

SEQ ID NO: 66233 - DNA, 20 bp, Artificial Sequence
  chemically synthesized
aggcttcctgcaaggcagcc

SEQ ID NO: 66234 - DNA, 20 bp, Artificial Sequence
  chemically synthesized
aaaatctaacacaaaatcta

SEQ ID NO: 66235 - DNA, 20 bp, Artificial Sequence
  chemically synthesized
gcttacatctatttttgttc

SEQ ID NO: 66236 - DNA, 20 bp, Artificial Sequence
  chemically synthesized
gatttagatacataatggaa

SEQ ID NO: 66237 - DNA, 20 bp, Artificial Sequence
  chemically synthesized
taatttaaaatctggctaat

SEQ ID NO: 66238 - DNA, 20 bp, Artificial Sequence
  chemically synthesized
taaagtaagttatttgtggt

SEQ ID NO: 66239 - DNA, 20 bp, Artificial Sequence
  chemically synthesized
gaagggcctactttacttaa

SEQ ID NO: 66240 - DNA, 20 bp, Artificial Sequence
  chemically synthesized
aaacatatgtcataaattag

SEQ ID NO: 66241 - DNA, 20 bp, Artificial Sequence
  chemically synthesized
ataaattagccagaaagatt

SEQ ID NO: 66242 - DNA, 20 bp, Artificial Sequence
  chemically synthesized
aattaggcatcttacagttt

SEQ ID NO: 66243 - DNA, 20 bp, Artificial Sequence
  chemically synthesized
ttagaatcctgcatagaact

SEQ ID NO: 66244 - DNA, 20 bp, Artificial Sequence
  chemically synthesized
ctttgggcttttaatatagg

SEQ ID NO: 66245 - DNA, 20 bp, Artificial Sequence
  chemically synthesized
aaccataggcagtaaggaga

SEQ ID NO: 66246 - DNA, 20 bp, Artificial Sequence
  chemically synthesized
ggtgtccatactctgaatgg

SEQ ID NO: 66247 - DNA, 20 bp, Artificial Sequence
  chemically synthesized
acccatagggcttgttttag

SEQ ID NO: 66248 - DNA, 20 bp, Artificial Sequence
  chemically synthesized
ctagggggctggtgaagttt

SEQ ID NO: 66249 - DNA, 20 bp, Artificial Sequence
  chemically synthesized
ctttgaatgcaaaggacaaa

SEQ ID NO: 66250 - DNA, 20 bp, Artificial Sequence
  chemically synthesized
tacctattgcatagttataa

SEQ ID NO: 66251 - DNA, 20 bp, Artificial Sequence
  chemically synthesized
ttgtctgtgttagccaatgg

SEQ ID NO: 66252 - DNA, 20 bp, Artificial Sequence
  chemically synthesized
ccaatggttagaatatatgc

SEQ ID NO: 66253 - DNA, 20 bp, Artificial Sequence
  chemically synthesized
ataccattggttaatagcta

SEQ ID NO: 66254 - DNA, 20 bp, Artificial Sequence
  chemically synthesized
aatagctaaaagaaaatgga

SEQ ID NO: 66255 - DNA, 20 bp, Artificial Sequence
  chemically synthesized
tgaagacttctggaatcatg

SEQ ID NO: 66256 - DNA, 20 bp, Artificial Sequence
  chemically synthesized
ttttttttttatcacaaaca

SEQ ID NO: 66257 - DNA, 20 bp, Artificial Sequence
  chemically synthesized
acaaagtcaggttatagaag

SEQ ID NO: 66258 - DNA, 20 bp, Artificial Sequence
  chemically synthesized
acatacaggaaattgtagga

SEQ ID NO: 66259 - DNA, 20 bp, Artificial Sequence
  chemically synthesized
gtggggcaaggggagccata

SEQ ID NO: 66260 - DNA, 20 bp, Artificial Sequence
  chemically synthesized
ggcaaggggagccataggag

SEQ ID NO: 66261 - DNA, 20 bp, Artificial Sequence
  chemically synthesized
agccataggagaaagaaatg

SEQ ID NO: 66262 - DNA, 20 bp, Artificial Sequence
  chemically synthesized
ctgctcgggaggctgaggca

SEQ ID NO: 66263 - DNA, 20 bp, Artificial Sequence
  chemically synthesized
ccgtctcaaaaaaaaaaaaa

SEQ ID NO: 66264 - DNA, 20 bp, Artificial Sequence
  chemically synthesized
ctcaaaaaaaaaaaaaaaag

SEQ ID NO: 66265 - DNA, 20 bp, Artificial Sequence
  chemically synthesized
aaaaaaaaaaaaaaagaaag

SEQ ID NO: 66266 - DNA, 20 bp, Artificial Sequence
  chemically synthesized
aaaaaaaaaagaaagaaaga

SEQ ID NO: 66267 - DNA, 20 bp, Artificial Sequence
  chemically synthesized
aaaagaaagaaagaaaagaa

SEQ ID NO: 66268 - DNA, 20 bp, Artificial Sequence
  chemically synthesized
agaaagaaaagaaaaagaaa

SEQ ID NO: 66269 - DNA, 20 bp, Artificial Sequence
  chemically synthesized
tggtgatgtaagggactttt

SEQ ID NO: 66270 - DNA, 20 bp, Artificial Sequence
  chemically synthesized
agtcatcaaaatggggacat

SEQ ID NO: 66271 - DNA, 20 bp, Artificial Sequence
  chemically synthesized
ccaatgtcccctgtggtcat

SEQ ID NO: 66272 - DNA, 20 bp, Artificial Sequence
  chemically synthesized
tgtacggtttttgtctccct

SEQ ID NO: 66273 - DNA, 20 bp, Artificial Sequence
  chemically synthesized
tatgaggctttcttggaaaa

SEQ ID NO: 66274 - DNA, 20 bp, Artificial Sequence
  chemically synthesized
ggggccagaacttcggcagt

SEQ ID NO: 66275 - DNA, 20 bp, Artificial Sequence
  chemically synthesized
tggaaagaccaacaaagatc

SEQ ID NO: 66276 - DNA, 20 bp, Artificial Sequence
  chemically synthesized
gaacttgatgtgtttatccc

SEQ ID NO: 66277 - DNA, 20 bp, Artificial Sequence
  chemically synthesized
ttatcccagagaattgtatt

SEQ ID NO: 66278 - DNA, 20 bp, Artificial Sequence
  chemically synthesized
agaattgtagacttgtgaaa

SEQ ID NO: 66279 - DNA, 20 bp, Artificial Sequence
  chemically synthesized
tgaaagtccatttcaaggaa

SEQ ID NO: 66280 - DNA, 20 bp, Artificial Sequence
  chemically synthesized
tgggtcatgataattgaggt

SEQ ID NO: 66281 - DNA, 20 bp, Artificial Sequence
  chemically synthesized
aaaaaataaaagatttgctc

SEQ ID NO: 66282 - DNA, 20 bp, Artificial Sequence
  chemically synthesized
caaaaattagacaattgctt

SEQ ID NO: 66283 - DNA, 20 bp, Artificial Sequence
  chemically synthesized
gggggtgagggtgtaggtag

SEQ ID NO: 66284 - DNA, 20 bp, Artificial Sequence
  chemically synthesized
gaatgttgaatgtagggctc

SEQ ID NO: 66285 - DNA, 20 bp, Artificial Sequence
  chemically synthesized
ggggactgggcttggccttg

SEQ ID NO: 66286 - DNA, 20 bp, Artificial Sequence
  chemically synthesized
gttcatgggctgagggatgg

SEQ ID NO: 66287 - DNA, 20 bp, Artificial Sequence
  chemically synthesized
ggaagaaccaagagcttcct

SEQ ID NO: 66288 - DNA, 20 bp, Artificial Sequence
  chemically synthesized
aaattaatgtggatgttatg

SEQ ID NO: 66289 - DNA, 20 bp, Artificial Sequence
  chemically synthesized
tccaaggaggatgatatgat

SEQ ID NO: 66290 - DNA, 20 bp, Artificial Sequence
  chemically synthesized
aaggagctgttagtggtacc

SEQ ID NO: 66291 - DNA, 20 bp, Artificial Sequence
  chemically synthesized
atagatatccaagatatagg

SEQ ID NO: 66292 - DNA, 20 bp, Artificial Sequence
  chemically synthesized
tcattgtgcattatcttctg

SEQ ID NO: 66293 - DNA, 20 bp, Artificial Sequence
  chemically synthesized
atgaagactttccgtgggag

SEQ ID NO: 66294 - DNA, 20 bp, Artificial Sequence
  chemically synthesized
aaggatggacaaaggtgggg

SEQ ID NO: 66295 - DNA, 20 bp, Artificial Sequence
  chemically synthesized
ttgaatttggctgtatatat

SEQ ID NO: 66296 - DNA, 20 bp, Artificial Sequence
  chemically synthesized
catttatcatttctatgtat

SEQ ID NO: 66297 - DNA, 20 bp, Artificial Sequence
  chemically synthesized
tagttctgtttttagtttac

SEQ ID NO: 66298 - DNA, 20 bp, Artificial Sequence
  chemically synthesized
acattcccaccaacagtgtg

SEQ ID NO: 66299 - DNA, 20 bp, Artificial Sequence
  chemically synthesized
tccctgatcattagtgatgt

SEQ ID NO: 66300 - DNA, 20 bp, Artificial Sequence
  chemically synthesized
gtcatttgtatatctttttc

SEQ ID NO: 66301 - DNA, 20 bp, Artificial Sequence
  chemically synthesized
ggtttttccgatgttatttt

SEQ ID NO: 66302 - DNA, 20 bp, Artificial Sequence
  chemically synthesized
tgggctcttttttggttcca

SEQ ID NO: 66303 - DNA, 20 bp, Artificial Sequence
  chemically synthesized
atattgattctacccatcta

SEQ ID NO: 66304 - DNA, 20 bp, Artificial Sequence
  chemically synthesized
gcttggtcattgctggtatg

SEQ ID NO: 66305 - DNA, 20 bp, Artificial Sequence
  chemically synthesized
ggtgtacgttaattttgtat

SEQ ID NO: 66306 - DNA, 20 bp, Artificial Sequence
  chemically synthesized
tgtctcattccagttttcag

SEQ ID NO: 66307 - DNA, 20 bp, Artificial Sequence
  chemically synthesized
attaaggtgatactggcttc

SEQ ID NO: 66308 - DNA, 20 bp, Artificial Sequence
  chemically synthesized
attctctctttctctatctt

SEQ ID NO: 66309 - DNA, 20 bp, Artificial Sequence
  chemically synthesized
aattcttctttgaatgtctg

SEQ ID NO: 66310 - DNA, 20 bp, Artificial Sequence
  chemically synthesized
ttaagttctgggatacatgt

SEQ ID NO: 66311 - DNA, 20 bp, Artificial Sequence
  chemically synthesized
ctgttcctgtgttagtttgc

SEQ ID NO: 66312 - DNA, 20 bp, Artificial Sequence
  chemically synthesized
cgtgtgcacgtgtctttata

SEQ ID NO: 66313 - DNA, 20 bp, Artificial Sequence
  chemically synthesized
catatcatatggcctatctt

SEQ ID NO: 66314 - DNA, 20 bp, Artificial Sequence
  chemically synthesized
aaagttccatgtgctgatga

SEQ ID NO: 66315 - DNA, 20 bp, Artificial Sequence
  chemically synthesized
gtgtattctgcagttgttgg

SEQ ID NO: 66316 - DNA, 20 bp, Artificial Sequence
  chemically synthesized
agtattagatgcatatatat

SEQ ID NO: 66317 - DNA, 20 bp, Artificial Sequence
  chemically synthesized
aaagtttgttttgtctgaca

SEQ ID NO: 66318 - DNA, 20 bp, Artificial Sequence
  chemically synthesized
ctagcttttacggtttctgc

SEQ ID NO: 66319 - DNA, 20 bp, Artificial Sequence
  chemically synthesized
ctgccaggaggtggcacttt

SEQ ID NO: 66320 - DNA, 20 bp, Artificial Sequence
  chemically synthesized
ctggggcaccctagaactcc

SEQ ID NO: 66321 - DNA, 20 bp, Artificial Sequence
  chemically synthesized
aatgacccctgtgaggcaag

SEQ ID NO: 66322 - DNA, 20 bp, Artificial Sequence
  chemically synthesized
tgactcagctccaggtaagg

SEQ ID NO: 66323 - DNA, 20 bp, Artificial Sequence
  chemically synthesized
gacaagatttttaatagttg

SEQ ID NO: 66324 - DNA, 20 bp, Artificial Sequence
  chemically synthesized
ttgtgataaacaggtcattc

SEQ ID NO: 66325 - DNA, 20 bp, Artificial Sequence
  chemically synthesized
aatgtttgaaaatacatggg

SEQ ID NO: 66326 - DNA, 20 bp, Artificial Sequence
  chemically synthesized
acacttgaaattgcttgtgt

SEQ ID NO: 66327 - DNA, 20 bp, Artificial Sequence
  chemically synthesized
aataagacagttatggataa

SEQ ID NO: 66328 - DNA, 20 bp, Artificial Sequence
  chemically synthesized
ggtggctcacgcctgtaatc

SEQ ID NO: 66329 - DNA, 20 bp, Artificial Sequence
  chemically synthesized
ctacttgggaggctgaggaa

SEQ ID NO: 66330 - DNA, 20 bp, Artificial Sequence
  chemically synthesized
caaggtcatggatcgagttc

SEQ ID NO: 66331 - DNA, 20 bp, Artificial Sequence
  chemically synthesized
taccaaaaaataaaaatccc

SEQ ID NO: 66332 - DNA, 20 bp, Artificial Sequence
  chemically synthesized
aaaaatcccaaagaaaaaat

SEQ ID NO: 66333 - DNA, 20 bp, Artificial Sequence
  chemically synthesized
catgttaagtggccaatatg

SEQ ID NO: 66334 - DNA, 20 bp, Artificial Sequence
  chemically synthesized
gcaaatacatgtcttatgtc

SEQ ID NO: 66335 - DNA, 20 bp, Artificial Sequence
  chemically synthesized
tggtatcttctatggtggga

SEQ ID NO: 66336 - DNA, 20 bp, Artificial Sequence
  chemically synthesized
agaagaaaactagctaaagg

SEQ ID NO: 66337 - DNA, 20 bp, Artificial Sequence
  chemically synthesized
gctaaagggaagaataaatt

SEQ ID NO: 66338 - DNA, 20 bp, Artificial Sequence
  chemically synthesized
gccggcggctggctagggat

SEQ ID NO: 66339 - DNA, 20 bp, Artificial Sequence
  chemically synthesized
tgaatgtggaagatgctgga

SEQ ID NO: 66340 - DNA, 20 bp, Artificial Sequence
  chemically synthesized
aagatactggggttgggagt

SEQ ID NO: 66341 - DNA, 20 bp, Artificial Sequence
  chemically synthesized
tagatggacaactttgactt

SEQ ID NO: 66342 - DNA, 20 bp, Artificial Sequence
  chemically synthesized
cttttctttattagatttcg

SEQ ID NO: 66343 - DNA, 20 bp, Artificial Sequence
  chemically synthesized
ttttggcaatccatttcggc

SEQ ID NO: 66344 - DNA, 20 bp, Artificial Sequence
  chemically synthesized
aaataaaagaactaggcaat

SEQ ID NO: 66345 - DNA, 20 bp, Artificial Sequence
  chemically synthesized
aagtgggagtaaaaggtgca

SEQ ID NO: 66346 - DNA, 20 bp, Artificial Sequence
  chemically synthesized
gtgcaggagaaatctggttg

SEQ ID NO: 66347 - DNA, 20 bp, Artificial Sequence
  chemically synthesized
cctctataggacaggactcc

SEQ ID NO: 66348 - DNA, 20 bp, Artificial Sequence
  chemically synthesized
cagcgaggaaggggctcaac

SEQ ID NO: 66349 - DNA, 20 bp, Artificial Sequence
  chemically synthesized
gtcagatgaaaatatagtgt

SEQ ID NO: 66350 - DNA, 20 bp, Artificial Sequence
  chemically synthesized
tgaacttaacgcttgtgtct

SEQ ID NO: 66351 - DNA, 20 bp, Artificial Sequence
  chemically synthesized
catgagagcagatccccatc

SEQ ID NO: 66352 - DNA, 20 bp, Artificial Sequence
  chemically synthesized
agagccctgaccaggaacca

SEQ ID NO: 66353 - DNA, 20 bp, Artificial Sequence
  chemically synthesized
accaggaaccagcagaaaag

SEQ ID NO: 66354 - DNA, 20 bp, Artificial Sequence
  chemically synthesized
ttgcactaagtaaggcagat

SEQ ID NO: 66355 - DNA, 20 bp, Artificial Sequence
  chemically synthesized
taagtaaggcagatgaagaa

SEQ ID NO: 66356 - DNA, 20 bp, Artificial Sequence
  chemically synthesized
aagcttcggtgttcagtgga

SEQ ID NO: 66357 - DNA, 20 bp, Artificial Sequence
  chemically synthesized
ctccacttgtcctctgtgtt

SEQ ID NO: 66358 - DNA, 20 bp, Artificial Sequence
  chemically synthesized
acacaggatcatgaaggatg

SEQ ID NO: 66359 - DNA, 20 bp, Artificial Sequence
  chemically synthesized
tacagcttgcctccgataag

SEQ ID NO: 66360 - DNA, 20 bp, Artificial Sequence
  chemically synthesized
agagatcatggatcactttc

SEQ ID NO: 66361 - DNA, 20 bp, Artificial Sequence
  chemically synthesized
cctgttaatggtccaatatg

SEQ ID NO: 66362 - DNA, 20 bp, Artificial Sequence
  chemically synthesized
atgtcagaaacagcactgtg

SEQ ID NO: 66363 - DNA, 20 bp, Artificial Sequence
  chemically synthesized
tgcgctgaaactgtggcttt

SEQ ID NO: 66364 - DNA, 20 bp, Artificial Sequence
  chemically synthesized
aattgttttcactgcactat

SEQ ID NO: 66365 - DNA, 20 bp, Artificial Sequence
  chemically synthesized
agaagtatagcactttttcc

SEQ ID NO: 66366 - DNA, 20 bp, Artificial Sequence
  chemically synthesized
agaaggaaactagctaaagg

SEQ ID NO: 66367 - DNA, 20 bp, Artificial Sequence
  chemically synthesized
gctaaagggaagaataaatt

SEQ ID NO: 66368 - DNA, 20 bp, Artificial Sequence
  chemically synthesized
gccggcggctggctagggat

SEQ ID NO: 66369 - DNA, 20 bp, Artificial Sequence
  chemically synthesized
tgaatgtggaagatgctgga

SEQ ID NO: 66370 - DNA, 20 bp, Artificial Sequence
  chemically synthesized
aagatactggggttgggggt

SEQ ID NO: 66371 - DNA, 20 bp, Artificial Sequence
  chemically synthesized
tagatggacaattttgactt

SEQ ID NO: 66372 - DNA, 20 bp, Artificial Sequence
  chemically synthesized
cttttctttattagattcca

SEQ ID NO: 66373 - DNA, 20 bp, Artificial Sequence
  chemically synthesized
ttttggcaatccatttcggc

SEQ ID NO: 66374 - DNA, 20 bp, Artificial Sequence
  chemically synthesized
aagtgggagtaaatggtgta

SEQ ID NO: 66375 - DNA, 20 bp, Artificial Sequence
  chemically synthesized
gtgtaggagaaatccggtgg

SEQ ID NO: 66376 - DNA, 20 bp, Artificial Sequence
  chemically synthesized
cctctataggacaggacttc

SEQ ID NO: 66377 - DNA, 20 bp, Artificial Sequence
  chemically synthesized
tcacagcccttgtggatgcc

SEQ ID NO: 66378 - DNA, 20 bp, Artificial Sequence
  chemically synthesized
gggaggtggggacttaggtg

SEQ ID NO: 66379 - DNA, 20 bp, Artificial Sequence
  chemically synthesized
cagcatgagcatgttatgtc

SEQ ID NO: 66380 - DNA, 20 bp, Artificial Sequence
  chemically synthesized
gtgagatcaaaatgtagtgg

SEQ ID NO: 66381 - DNA, 20 bp, Artificial Sequence
  chemically synthesized
ccctgaccacgagtcagcct

SEQ ID NO: 66382 - DNA, 20 bp, Artificial Sequence
  chemically synthesized
cgagtcagccttcagaaatg

SEQ ID NO: 66383 - DNA, 20 bp, Artificial Sequence
  chemically synthesized
tgagtaaggcagatgaagaa

SEQ ID NO: 66384 - DNA, 20 bp, Artificial Sequence
  chemically synthesized
tttcttttttctcctcagcc

SEQ ID NO: 66385 - DNA, 20 bp, Artificial Sequence
  chemically synthesized
caaatgcagtcactaccgtt

SEQ ID NO: 66386 - DNA, 20 bp, Artificial Sequence
  chemically synthesized
agcaaatttcttgagagagt

SEQ ID NO: 66387 - DNA, 20 bp, Artificial Sequence
  chemically synthesized
tggatattaggcctttgtca

SEQ ID NO: 66388 - DNA, 20 bp, Artificial Sequence
  chemically synthesized
tagtgagggcaccattagcc

SEQ ID NO: 66389 - DNA, 20 bp, Artificial Sequence
  chemically synthesized
gtctagttcatgtaagattc

SEQ ID NO: 66390 - DNA, 20 bp, Artificial Sequence
  chemically synthesized
tcatgtaagattctcagaat

SEQ ID NO: 66391 - DNA, 20 bp, Artificial Sequence
  chemically synthesized
aaatggggaacagccacaaa

SEQ ID NO: 66392 - DNA, 20 bp, Artificial Sequence
  chemically synthesized
ggggaacagccacaaacaag

SEQ ID NO: 66393 - DNA, 20 bp, Artificial Sequence
  chemically synthesized
cacttttcctggagcgggtg

SEQ ID NO: 66394 - DNA, 20 bp, Artificial Sequence
  chemically synthesized
gatatgaggtatggcaatga

SEQ ID NO: 66395 - DNA, 20 bp, Artificial Sequence
  chemically synthesized
aaaatattgtgtctctaata

SEQ ID NO: 66396 - DNA, 20 bp, Artificial Sequence
  chemically synthesized
agtatgaggacagtaagcct

SEQ ID NO: 66397 - DNA, 20 bp, Artificial Sequence
  chemically synthesized
gcctgtggaatattgtcagt

SEQ ID NO: 66398 - DNA, 20 bp, Artificial Sequence
  chemically synthesized
ctactcgggaggctgaggca

SEQ ID NO: 66399 - DNA, 20 bp, Artificial Sequence
  chemically synthesized
ctcaaaaaaaaaaaaaaaaa

SEQ ID NO: 66400 - DNA, 20 bp, Artificial Sequence
  chemically synthesized
aaaaaaaaaaaaaaaaagaa

SEQ ID NO: 66401 - DNA, 20 bp, Artificial Sequence
  chemically synthesized
aaaaaaaaaaaaagaaaaag

SEQ ID NO: 66402 - DNA, 20 bp, Artificial Sequence
  chemically synthesized
aaaaaaaaagaaaaagaaag

SEQ ID NO: 66403 - DNA, 20 bp, Artificial Sequence
  chemically synthesized
aaaaagaaaaagaaagaaag

SEQ ID NO: 66404 - DNA, 20 bp, Artificial Sequence
  chemically synthesized
gtgtattcaatgtagtctca

SEQ ID NO: 66405 - DNA, 20 bp, Artificial Sequence
  chemically synthesized
gtctcaagagaattgaaaac

SEQ ID NO: 66406 - DNA, 20 bp, Artificial Sequence
  chemically synthesized
gcggctgctggcgaagtcct

SEQ ID NO: 66407 - DNA, 20 bp, Artificial Sequence
  chemically synthesized
agaaggccacctggattcta

SEQ ID NO: 66408 - DNA, 20 bp, Artificial Sequence
  chemically synthesized
actggaagccgggacaaggt

SEQ ID NO: 66409 - DNA, 20 bp, Artificial Sequence
  chemically synthesized
ccgggacaaggtgcagaaag

SEQ ID NO: 66410 - DNA, 20 bp, Artificial Sequence
  chemically synthesized
gagggaacagaagttgagat

SEQ ID NO: 66411 - DNA, 20 bp, Artificial Sequence
  chemically synthesized
tttctgcatagtcctggagg

SEQ ID NO: 66412 - DNA, 20 bp, Artificial Sequence
  chemically synthesized
tcagttcctgcatgataaaa

SEQ ID NO: 66413 - DNA, 20 bp, Artificial Sequence
  chemically synthesized
ctgcatgataaaaatagaat

SEQ ID NO: 66414 - DNA, 20 bp, Artificial Sequence
  chemically synthesized
gaataaagaaatatgctctc

SEQ ID NO: 66415 - DNA, 20 bp, Artificial Sequence
  chemically synthesized
cgcactatttctgatggaaa

SEQ ID NO: 66416 - DNA, 20 bp, Artificial Sequence
  chemically synthesized
ctgatggaaatgagaatgtt

SEQ ID NO: 66417 - DNA, 20 bp, Artificial Sequence
  chemically synthesized
gatactttcttgcaatcctg

SEQ ID NO: 66418 - DNA, 20 bp, Artificial Sequence
  chemically synthesized
ctaggaaggggaaatcgtct

SEQ ID NO: 66419 - DNA, 20 bp, Artificial Sequence
  chemically synthesized
tagaataagacaatgttttt

SEQ ID NO: 66420 - DNA, 20 bp, Artificial Sequence
  chemically synthesized
acgtcttcaatggtattaat

SEQ ID NO: 66421 - DNA, 20 bp, Artificial Sequence
  chemically synthesized
cgttaagtcaagttgataga

SEQ ID NO: 66422 - DNA, 20 bp, Artificial Sequence
  chemically synthesized
gatgcagagaccagatgaag

SEQ ID NO: 66423 - DNA, 20 bp, Artificial Sequence
  chemically synthesized
gacataataaatagggaaac

SEQ ID NO: 66424 - DNA, 20 bp, Artificial Sequence
  chemically synthesized
gttgatggaaacaatgaagt

SEQ ID NO: 66425 - DNA, 20 bp, Artificial Sequence
  chemically synthesized
accctcaaacctaaaacctc

SEQ ID NO: 66426 - DNA, 20 bp, Artificial Sequence
  chemically synthesized
ccccactaataacccacaaa

SEQ ID NO: 66427 - DNA, 20 bp, Artificial Sequence
  chemically synthesized
aaaattaccccagtcaatct

SEQ ID NO: 66428 - DNA, 20 bp, Artificial Sequence
  chemically synthesized
gtgtcatgcatttattcaca

SEQ ID NO: 66429 - DNA, 20 bp, Artificial Sequence
  chemically synthesized
accattatcagttactcaac

SEQ ID NO: 66430 - DNA, 20 bp, Artificial Sequence
  chemically synthesized
aatatcaaataaaggacagt

SEQ ID NO: 66431 - DNA, 20 bp, Artificial Sequence
  chemically synthesized
aaatctagatgttagtaaca

SEQ ID NO: 66432 - DNA, 20 bp, Artificial Sequence
  chemically synthesized
ttaggcctagaagggcagaa

SEQ ID NO: 66433 - DNA, 20 bp, Artificial Sequence
  chemically synthesized
cgttcagagagagagagaga

SEQ ID NO: 66434 - DNA, 20 bp, Artificial Sequence
  chemically synthesized
ctcagccagtgtttaccatt

SEQ ID NO: 66435 - DNA, 20 bp, Artificial Sequence
  chemically synthesized
agagaacactgagggaagga

SEQ ID NO: 66436 - DNA, 20 bp, Artificial Sequence
  chemically synthesized
tgataagataatatgaaaac

SEQ ID NO: 66437 - DNA, 20 bp, Artificial Sequence
  chemically synthesized
caaacagcagtgaactgaga

SEQ ID NO: 66438 - DNA, 20 bp, Artificial Sequence
  chemically synthesized
ttgtggagagcactggcatt

SEQ ID NO: 66439 - DNA, 20 bp, Artificial Sequence
  chemically synthesized
ggcatttaagaatgtcacac

SEQ ID NO: 66440 - DNA, 20 bp, Artificial Sequence
  chemically synthesized
cgtgagccaccacacccagc

SEQ ID NO: 66441 - DNA, 20 bp, Artificial Sequence
  chemically synthesized
ctattcaggtggctgaggca

SEQ ID NO: 66442 - DNA, 20 bp, Artificial Sequence
  chemically synthesized
ggatgaaactccatctcaga

SEQ ID NO: 66443 - DNA, 20 bp, Artificial Sequence
  chemically synthesized
aaactccatctcagaagaga

SEQ ID NO: 66444 - DNA, 20 bp, Artificial Sequence
  chemically synthesized
atcctctcaatgcaatccat

SEQ ID NO: 66445 - DNA, 20 bp, Artificial Sequence
  chemically synthesized
gtaaaatcatttcaggtaga

SEQ ID NO: 66446 - DNA, 20 bp, Artificial Sequence
  chemically synthesized
aataacagtcctcatggcct

SEQ ID NO: 66447 - DNA, 20 bp, Artificial Sequence
  chemically synthesized
gaatttacctaacatttttt

SEQ ID NO: 66448 - DNA, 20 bp, Artificial Sequence
  chemically synthesized
gtcatggtccaagtctgata

SEQ ID NO: 66449 - DNA, 20 bp, Artificial Sequence
  chemically synthesized
aaatacatttcttcactaag

SEQ ID NO: 66450 - DNA, 20 bp, Artificial Sequence
  chemically synthesized
ctttcgttggcttccaggtt

SEQ ID NO: 66451 - DNA, 20 bp, Artificial Sequence
  chemically synthesized
tataacatttccccttgtga

SEQ ID NO: 66452 - DNA, 20 bp, Artificial Sequence
  chemically synthesized
cattgtggcattatttgaat

SEQ ID NO: 66453 - DNA, 20 bp, Artificial Sequence
  chemically synthesized
aaattagagttttattatag

SEQ ID NO: 66454 - DNA, 20 bp, Artificial Sequence
  chemically synthesized
agttttcttagtataaagtg

SEQ ID NO: 66455 - DNA, 20 bp, Artificial Sequence
  chemically synthesized
atgaaactaggaggatattt

SEQ ID NO: 66456 - DNA, 20 bp, Artificial Sequence
  chemically synthesized
ctcacctgctaattctgcac

SEQ ID NO: 66457 - DNA, 20 bp, Artificial Sequence
  chemically synthesized
ccaactcaaagatgagaggc

SEQ ID NO: 66458 - DNA, 20 bp, Artificial Sequence
  chemically synthesized
cagttttgtctaagatttgg

SEQ ID NO: 66459 - DNA, 20 bp, Artificial Sequence
  chemically synthesized
gggtatggcttctgcctaat

SEQ ID NO: 66460 - DNA, 20 bp, Artificial Sequence
  chemically synthesized
tacaaagagtacatgggaaa

SEQ ID NO: 66461 - DNA, 20 bp, Artificial Sequence
  chemically synthesized
gacacttctacctccaaaga

SEQ ID NO: 66462 - DNA, 20 bp, Artificial Sequence
  chemically synthesized
gattaaactccaacaattac

SEQ ID NO: 66463 - DNA, 20 bp, Artificial Sequence
  chemically synthesized
cccatcaagtgttcctgctc

SEQ ID NO: 66464 - DNA, 20 bp, Artificial Sequence
  chemically synthesized
ttgccccagaacatctctgt

SEQ ID NO: 66465 - DNA, 20 bp, Artificial Sequence
  chemically synthesized
catattaaattcatcaatgg

SEQ ID NO: 66466 - DNA, 20 bp, Artificial Sequence
  chemically synthesized
ttaaattcatcaatgggcag

SEQ ID NO: 66467 - DNA, 20 bp, Artificial Sequence
  chemically synthesized
gcagaaagaaaatatttatt

SEQ ID NO: 66468 - DNA, 20 bp, Artificial Sequence
  chemically synthesized
aaacttacttgaatacctaa

SEQ ID NO: 66469 - DNA, 20 bp, Artificial Sequence
  chemically synthesized
cagtaactctgtctgtactg

SEQ ID NO: 66470 - DNA, 20 bp, Artificial Sequence
  chemically synthesized
gccctaaaaatccaaatacc

SEQ ID NO: 66471 - DNA, 20 bp, Artificial Sequence
  chemically synthesized
aataaaataatttaatgtca

SEQ ID NO: 66472 - DNA, 20 bp, Artificial Sequence
  chemically synthesized
ttgactttattgctttttgg

SEQ ID NO: 66473 - DNA, 20 bp, Artificial Sequence
  chemically synthesized
tgatataaaacattaggact

SEQ ID NO: 66474 - DNA, 20 bp, Artificial Sequence
  chemically synthesized
tcagtggggctggaataaaa

SEQ ID NO: 66475 - DNA, 20 bp, Artificial Sequence
  chemically synthesized
cctgcagggtattatgggta

SEQ ID NO: 66476 - DNA, 20 bp, Artificial Sequence
  chemically synthesized
cagggtattatgggtaatag

SEQ ID NO: 66477 - DNA, 20 bp, Artificial Sequence
  chemically synthesized
tccatagttcatcatttaaa

SEQ ID NO: 66478 - DNA, 20 bp, Artificial Sequence
  chemically synthesized
catttaaaaaagaaaacaaa

SEQ ID NO: 66479 - DNA, 20 bp, Artificial Sequence
  chemically synthesized
gctttgacaattttggtctt

SEQ ID NO: 66480 - DNA, 20 bp, Artificial Sequence
  chemically synthesized
ttacagaggaatgaatataa

SEQ ID NO: 66481 - DNA, 20 bp, Artificial Sequence
  chemically synthesized
ccaaacactttctgcgtgtg

SEQ ID NO: 66482 - DNA, 20 bp, Artificial Sequence
  chemically synthesized
cctgatgagggttgagacag

SEQ ID NO: 66483 - DNA, 20 bp, Artificial Sequence
  chemically synthesized
tctatttatttagcaataat

SEQ ID NO: 66484 - DNA, 20 bp, Artificial Sequence
  chemically synthesized
aataatagagaaagcattta

SEQ ID NO: 66485 - DNA, 20 bp, Artificial Sequence
  chemically synthesized
agagaataaagcaatggaaa

SEQ ID NO: 66486 - DNA, 20 bp, Artificial Sequence
  chemically synthesized
tgtaaatttccttctgataa

SEQ ID NO: 66487 - DNA, 20 bp, Artificial Sequence
  chemically synthesized
agagctgaaaggaagaagta

SEQ ID NO: 66488 - DNA, 20 bp, Artificial Sequence
  chemically synthesized
ggaaaaagtacagggggatg

SEQ ID NO: 66489 - DNA, 20 bp, Artificial Sequence
  chemically synthesized
cgatcacgttgggaagctat

SEQ ID NO: 66490 - DNA, 20 bp, Artificial Sequence
  chemically synthesized
tttaaacaaacaaaatataa

SEQ ID NO: 66491 - DNA, 20 bp, Artificial Sequence
  chemically synthesized
actcttgcagattagtccag

SEQ ID NO: 66492 - DNA, 20 bp, Artificial Sequence
  chemically synthesized
attagcatgcatgagcaaat

SEQ ID NO: 66493 - DNA, 20 bp, Artificial Sequence
  chemically synthesized
tcaacttcttatttgtgtaa

SEQ ID NO: 66494 - DNA, 20 bp, Artificial Sequence
  chemically synthesized
agacaggtttaaggagacca

SEQ ID NO: 66495 - DNA, 20 bp, Artificial Sequence
  chemically synthesized
cctaaggtgaaggctcatgg

SEQ ID NO: 66496 - DNA, 20 bp, Artificial Sequence
  chemically synthesized
gataagtaacagggtacagt

SEQ ID NO: 66497 - DNA, 20 bp, Artificial Sequence
  chemically synthesized
atgcctctttgcaccattct

SEQ ID NO: 66498 - DNA, 20 bp, Artificial Sequence
  chemically synthesized
tgctggcccatcactttggc

SEQ ID NO: 66499 - DNA, 20 bp, Artificial Sequence
  chemically synthesized
ccaccagtgcaggctgccta

SEQ ID NO: 66500 - DNA, 20 bp, Artificial Sequence
  chemically synthesized
ggtcagtgcatttaaaacat

SEQ ID NO: 66501 - DNA, 20 bp, Artificial Sequence
  chemically synthesized
gcatatgccttattcatccc

SEQ ID NO: 66502 - DNA, 20 bp, Artificial Sequence
  chemically synthesized
gtatgaaaagttaggactga

SEQ ID NO: 66503 - DNA, 20 bp, Artificial Sequence
  chemically synthesized
tgatgatagaagggtatata

SEQ ID NO: 66504 - DNA, 20 bp, Artificial Sequence
  chemically synthesized
aaaataaatttgaatgggtt

SEQ ID NO: 66505 - DNA, 20 bp, Artificial Sequence
  chemically synthesized
ctaaaaccataaaaattttt

SEQ ID NO: 66506 - DNA, 20 bp, Artificial Sequence
  chemically synthesized
aatttttaaagaaatcaaaa

SEQ ID NO: 66507 - DNA, 20 bp, Artificial Sequence
  chemically synthesized
tggttaatatccaaaatata

SEQ ID NO: 66508 - DNA, 20 bp, Artificial Sequence
  chemically synthesized
gaaaataaaaaaattaaaaa

SEQ ID NO: 66509 - DNA, 20 bp, Artificial Sequence
  chemically synthesized
agaaaatcctgccatttatg

SEQ ID NO: 66510 - DNA, 20 bp, Artificial Sequence
  chemically synthesized
gaacctggaggatgtaaaac

SEQ ID NO: 66511 - DNA, 20 bp, Artificial Sequence
  chemically synthesized
gtttccaggggttgggggtg

SEQ ID NO: 66512 - DNA, 20 bp, Artificial Sequence
  chemically synthesized
gatcttaaaagcatttacca

SEQ ID NO: 66513 - DNA, 20 bp, Artificial Sequence
  chemically synthesized
aatgatacctcaataaagtt

SEQ ID NO: 66514 - DNA, 20 bp, Artificial Sequence
  chemically synthesized
taaagttgaagaataataaa

SEQ ID NO: 66515 - DNA, 20 bp, Artificial Sequence
  chemically synthesized
aaaaaaatgcatcttgatga

SEQ ID NO: 66516 - DNA, 20 bp, Artificial Sequence
  chemically synthesized
tagtgttattattaaatagt

SEQ ID NO: 66517 - DNA, 20 bp, Artificial Sequence
  chemically synthesized
taagtaagatagtggaataa

SEQ ID NO: 66518 - DNA, 20 bp, Artificial Sequence
  chemically synthesized
aaaattcagtcacgaaaaaa

SEQ ID NO: 66519 - DNA, 20 bp, Artificial Sequence
  chemically synthesized
tatttaattatcaacccaaa

SEQ ID NO: 66520 - DNA, 20 bp, Artificial Sequence
  chemically synthesized
ccaaagtagaaactatcaag

SEQ ID NO: 66521 - DNA, 20 bp, Artificial Sequence
  chemically synthesized
caatttgggaggctgaggca

SEQ ID NO: 66522 - DNA, 20 bp, Artificial Sequence
  chemically synthesized
gagactccgtcacaaaaaaa

SEQ ID NO: 66523 - DNA, 20 bp, Artificial Sequence
  chemically synthesized
gggaattccctttcctagtc

SEQ ID NO: 66524 - DNA, 20 bp, Artificial Sequence
  chemically synthesized
gttagaaggaaaactaacaa

SEQ ID NO: 66525 - DNA, 20 bp, Artificial Sequence
  chemically synthesized
aaagatggggaaaaagcaga

SEQ ID NO: 66526 - DNA, 20 bp, Artificial Sequence
  chemically synthesized
gcaatggaacaaagctgggc

SEQ ID NO: 66527 - DNA, 20 bp, Artificial Sequence
  chemically synthesized
aaaattagatgaatggataa

SEQ ID NO: 66528 - DNA, 20 bp, Artificial Sequence
  chemically synthesized
gtaaccgatgagatcaactg

SEQ ID NO: 66529 - DNA, 20 bp, Artificial Sequence
  chemically synthesized
tgaagcatgaagagaagttt

SEQ ID NO: 66530 - DNA, 20 bp, Artificial Sequence
  chemically synthesized
tgaagagaagtttagagaaa

SEQ ID NO: 66531 - DNA, 20 bp, Artificial Sequence
  chemically synthesized
gtttagagaaaaaagaataa

SEQ ID NO: 66532 - DNA, 20 bp, Artificial Sequence
  chemically synthesized
aaagaaacgaacaaagcctc

SEQ ID NO: 66533 - DNA, 20 bp, Artificial Sequence
  chemically synthesized
ggtgtagctgaaagtgatgg

SEQ ID NO: 66534 - DNA, 20 bp, Artificial Sequence
  chemically synthesized
aacgccacaaagatactcct

SEQ ID NO: 66535 - DNA, 20 bp, Artificial Sequence
  chemically synthesized
aaaatgttaagggcagccag

SEQ ID NO: 66536 - DNA, 20 bp, Artificial Sequence
  chemically synthesized
gactaacagctgatctatcg

SEQ ID NO: 66537 - DNA, 20 bp, Artificial Sequence
  chemically synthesized
ggcagaaactctacaagcca

SEQ ID NO: 66538 - DNA, 20 bp, Artificial Sequence
  chemically synthesized
ggccaatattcaacattgtt

SEQ ID NO: 66539 - DNA, 20 bp, Artificial Sequence
  chemically synthesized
atattcaacattgttaaaga

SEQ ID NO: 66540 - DNA, 20 bp, Artificial Sequence
  chemically synthesized
taaagaaaagaattttcaac

SEQ ID NO: 66541 - DNA, 20 bp, Artificial Sequence
  chemically synthesized
aactaagcttcataagtgaa

SEQ ID NO: 66542 - DNA, 20 bp, Artificial Sequence
  chemically synthesized
gtaaagaccatcaaggctag

SEQ ID NO: 66543 - DNA, 20 bp, Artificial Sequence
  chemically synthesized
acattagacagatcaacgag

SEQ ID NO: 66544 - DNA, 20 bp, Artificial Sequence
  chemically synthesized
gaactctccaccccaaatca

SEQ ID NO: 66545 - DNA, 20 bp, Artificial Sequence
  chemically synthesized
tcctcagcaaatgtaaaaga

SEQ ID NO: 66546 - DNA, 20 bp, Artificial Sequence
  chemically synthesized
atcaaactagaactcaggat

SEQ ID NO: 66547 - DNA, 20 bp, Artificial Sequence
  chemically synthesized
gggtacataacaaaatgaag

SEQ ID NO: 66548 - DNA, 20 bp, Artificial Sequence
  chemically synthesized
gagaacaaagacacaacaca

SEQ ID NO: 66549 - DNA, 20 bp, Artificial Sequence
  chemically synthesized
attcaaaagctaacagaaga

SEQ ID NO: 66550 - DNA, 20 bp, Artificial Sequence
  chemically synthesized
ctgctagcaagactaataaa

SEQ ID NO: 66551 - DNA, 20 bp, Artificial Sequence
  chemically synthesized
ctaataaagaagaaaagaga

SEQ ID NO: 66552 - DNA, 20 bp, Artificial Sequence
  chemically synthesized
ggggtatcaccactgatccc

SEQ ID NO: 66553 - DNA, 20 bp, Artificial Sequence
  chemically synthesized
cagaaatacaaactaccgtc

SEQ ID NO: 66554 - DNA, 20 bp, Artificial Sequence
  chemically synthesized
aacacctctacgcaaataaa

SEQ ID NO: 66555 - DNA, 20 bp, Artificial Sequence
  chemically synthesized
caaataaactagaaaatcta

SEQ ID NO: 66556 - DNA, 20 bp, Artificial Sequence
  chemically synthesized
ttctgaaactattccaatca

SEQ ID NO: 66557 - DNA, 20 bp, Artificial Sequence
  chemically synthesized
gacagagacacaacaaaaaa

SEQ ID NO: 66558 - DNA, 20 bp, Artificial Sequence
  chemically synthesized
atatgattatctcaatagat

SEQ ID NO: 66559 - DNA, 20 bp, Artificial Sequence
  chemically synthesized
cagatgacatgattgtatat

SEQ ID NO: 66560 - DNA, 20 bp, Artificial Sequence
  chemically synthesized
cccattcacaattgcttcaa

SEQ ID NO: 66561 - DNA, 20 bp, Artificial Sequence
  chemically synthesized
cattccatgctcatgggtag

SEQ ID NO: 66562 - DNA, 20 bp, Artificial Sequence
  chemically synthesized
aatggaacagaacagagccc

SEQ ID NO: 66563 - DNA, 20 bp, Artificial Sequence
  chemically synthesized
tctgatctttgacaaacctg

SEQ ID NO: 66564 - DNA, 20 bp, Artificial Sequence
  chemically synthesized
ggaaaactggctagccatat

SEQ ID NO: 66565 - DNA, 20 bp, Artificial Sequence
  chemically synthesized
gacctaaaaccataaaaacc

SEQ ID NO: 66566 - DNA, 20 bp, Artificial Sequence
  chemically synthesized
taaagagcttctgcacagct

SEQ ID NO: 66567 - DNA, 20 bp, Artificial Sequence
  chemically synthesized
aacaggcaacctacaaaatg

SEQ ID NO: 66568 - DNA, 20 bp, Artificial Sequence
  chemically synthesized
atctgacaaagggctaatat

SEQ ID NO: 66569 - DNA, 20 bp, Artificial Sequence
  chemically synthesized
aatgaactcaaacaaattta

SEQ ID NO: 66570 - DNA, 20 bp, Artificial Sequence
  chemically synthesized
gctcatcatcactagccatc

SEQ ID NO: 66571 - DNA, 20 bp, Artificial Sequence
  chemically synthesized
gagataccatctcacaccag

SEQ ID NO: 66572 - DNA, 20 bp, Artificial Sequence
  chemically synthesized
acaggtgctggagaggatgt

SEQ ID NO: 66573 - DNA, 20 bp, Artificial Sequence
  chemically synthesized
aattcctcaggaatctagaa

SEQ ID NO: 66574 - DNA, 20 bp, Artificial Sequence
  chemically synthesized
ccaacaacgatagactggat

SEQ ID NO: 66575 - DNA, 20 bp, Artificial Sequence
  chemically synthesized
ttctcagcaaactatcacaa

SEQ ID NO: 66576 - DNA, 20 bp, Artificial Sequence
  chemically synthesized
agtctttctctttgaaatag

SEQ ID NO: 66577 - DNA, 20 bp, Artificial Sequence
  chemically synthesized
tcttccttcttatttgttta

SEQ ID NO: 66578 - DNA, 20 bp, Artificial Sequence
  chemically synthesized
gtaaatggcaatattgagaa

SEQ ID NO: 66579 - DNA, 20 bp, Artificial Sequence
  chemically synthesized
atactaaacaggagccaagc

SEQ ID NO: 66580 - DNA, 20 bp, Artificial Sequence
  chemically synthesized
aaagtgaccaattaaaataa

SEQ ID NO: 66581 - DNA, 20 bp, Artificial Sequence
  chemically synthesized
gggagggggacatagagttg

SEQ ID NO: 66582 - DNA, 20 bp, Artificial Sequence
  chemically synthesized
tcctcccaaggctgaaccag

SEQ ID NO: 66583 - DNA, 20 bp, Artificial Sequence
  chemically synthesized
atagacacacaacaacaaaa

SEQ ID NO: 66584 - DNA, 20 bp, Artificial Sequence
  chemically synthesized
tcatatatacagcactaaaa

SEQ ID NO: 66585 - DNA, 20 bp, Artificial Sequence
  chemically synthesized
aaacccacagccaacatcat

SEQ ID NO: 66586 - DNA, 20 bp, Artificial Sequence
  chemically synthesized
aagggcatccaaataggaag

SEQ ID NO: 66587 - DNA, 20 bp, Artificial Sequence
  chemically synthesized
agtatccctgttttctgtat

SEQ ID NO: 66588 - DNA, 20 bp, Artificial Sequence
  chemically synthesized
cccatttaccgttgccacaa

SEQ ID NO: 66589 - DNA, 20 bp, Artificial Sequence
  chemically synthesized
agatttacaaaacactgctc

SEQ ID NO: 66590 - DNA, 20 bp, Artificial Sequence
  chemically synthesized
gctcaaagaaatcagagctg

SEQ ID NO: 66591 - DNA, 20 bp, Artificial Sequence
  chemically synthesized
ctttccatgctcatggataa

SEQ ID NO: 66592 - DNA, 20 bp, Artificial Sequence
  chemically synthesized
caatgacattcttcacagaa

SEQ ID NO: 66593 - DNA, 20 bp, Artificial Sequence
  chemically synthesized
tagagtacaaaaaaaaaaaa

SEQ ID NO: 66594 - DNA, 20 bp, Artificial Sequence
  chemically synthesized
acaaaaaaaaaaaaagagaa

SEQ ID NO: 66595 - DNA, 20 bp, Artificial Sequence
  chemically synthesized
caaaacagtgtggtactgtt

SEQ ID NO: 66596 - DNA, 20 bp, Artificial Sequence
  chemically synthesized
aagacacacagacaaatgga

SEQ ID NO: 66597 - DNA, 20 bp, Artificial Sequence
  chemically synthesized
aatggaacagaatagagagc

SEQ ID NO: 66598 - DNA, 20 bp, Artificial Sequence
  chemically synthesized
aataaagtttctgcacagca

SEQ ID NO: 66599 - DNA, 20 bp, Artificial Sequence
  chemically synthesized
atcaactgagtaaacaacct

SEQ ID NO: 66600 - DNA, 20 bp, Artificial Sequence
  chemically synthesized
agtaaacaacctatagaatg

SEQ ID NO: 66601 - DNA, 20 bp, Artificial Sequence
  chemically synthesized
atccaacaaaggcctaatat

SEQ ID NO: 66602 - DNA, 20 bp, Artificial Sequence
  chemically synthesized
gctcagtgtcactgatcatt

SEQ ID NO: 66603 - DNA, 20 bp, Artificial Sequence
  chemically synthesized
acagatgtgggtaaggttgt

SEQ ID NO: 66604 - DNA, 20 bp, Artificial Sequence
  chemically synthesized
aattccctaaagacctaaaa

SEQ ID NO: 66605 - DNA, 20 bp, Artificial Sequence
  chemically synthesized
ataatcacaatagcaaagac

SEQ ID NO: 66606 - DNA, 20 bp, Artificial Sequence
  chemically synthesized
gaatactatgtggccataaa

SEQ ID NO: 66607 - DNA, 20 bp, Artificial Sequence
  chemically synthesized
cttaacaaactaatgtaaga

SEQ ID NO: 66608 - DNA, 20 bp, Artificial Sequence
  chemically synthesized
tacaagtaggaactaaatga

SEQ ID NO: 66609 - DNA, 20 bp, Artificial Sequence
  chemically synthesized
gggtgggaacggggagaaga

SEQ ID NO: 66610 - DNA, 20 bp, Artificial Sequence
  chemically synthesized
gccatcctgcagagcaagtg

SEQ ID NO: 66611 - DNA, 20 bp, Artificial Sequence
  chemically synthesized
ggccagcttgcttcccacta

SEQ ID NO: 66612 - DNA, 20 bp, Artificial Sequence
  chemically synthesized
gcaatttcttcaactacaaa

SEQ ID NO: 66613 - DNA, 20 bp, Artificial Sequence
  chemically synthesized
ggcacatgcaggctgctata

SEQ ID NO: 66614 - DNA, 20 bp, Artificial Sequence
  chemically synthesized
attttatgacctagcaattt

SEQ ID NO: 66615 - DNA, 20 bp, Artificial Sequence
  chemically synthesized
aatatatatacaaaaatata

SEQ ID NO: 66616 - DNA, 20 bp, Artificial Sequence
  chemically synthesized
tattgtggtatatacataaa

SEQ ID NO: 66617 - DNA, 20 bp, Artificial Sequence
  chemically synthesized
tacataaaatagaatgacat

SEQ ID NO: 66618 - DNA, 20 bp, Artificial Sequence
  chemically synthesized
tattaaaataaaaactaaat

SEQ ID NO: 66619 - DNA, 20 bp, Artificial Sequence
  chemically synthesized
ttaacttcctgaagaagagg

SEQ ID NO: 66620 - DNA, 20 bp, Artificial Sequence
  chemically synthesized
ataatgaaaaaaggaaaata

SEQ ID NO: 66621 - DNA, 20 bp, Artificial Sequence
  chemically synthesized
ttcactacatggtactatgt

SEQ ID NO: 66622 - DNA, 20 bp, Artificial Sequence
  chemically synthesized
acatggtactatgtcaagaa

SEQ ID NO: 66623 - DNA, 20 bp, Artificial Sequence
  chemically synthesized
taataatcaatttctcacaa

SEQ ID NO: 66624 - DNA, 20 bp, Artificial Sequence
  chemically synthesized
tgagctaaaaattatatacc

SEQ ID NO: 66625 - DNA, 20 bp, Artificial Sequence
  chemically synthesized
aaataaataaaataaataaa

SEQ ID NO: 66626 - DNA, 20 bp, Artificial Sequence
  chemically synthesized
aataaacctttgtcacctct

SEQ ID NO: 66627 - DNA, 20 bp, Artificial Sequence
  chemically synthesized
aattctaaaaatccacagat

SEQ ID NO: 66628 - DNA, 20 bp, Artificial Sequence
  chemically synthesized
atttagaaattctaggaatc

SEQ ID NO: 66629 - DNA, 20 bp, Artificial Sequence
  chemically synthesized
acaatagatgacacctgcat

SEQ ID NO: 66630 - DNA, 20 bp, Artificial Sequence
  chemically synthesized
atctctcctatgttctgagg

SEQ ID NO: 66631 - DNA, 20 bp, Artificial Sequence
  chemically synthesized
ttctcacattcttttcttga

SEQ ID NO: 66632 - DNA, 20 bp, Artificial Sequence
  chemically synthesized
cttattccactgtgtggtga

SEQ ID NO: 66633 - DNA, 20 bp, Artificial Sequence
  chemically synthesized
tgaagccatagtaaccccct

SEQ ID NO: 66634 - DNA, 20 bp, Artificial Sequence
  chemically synthesized
aggtatgggtactcgatttc

SEQ ID NO: 66635 - DNA, 20 bp, Artificial Sequence
  chemically synthesized
ttaaaaataagggtattgaa

SEQ ID NO: 66636 - DNA, 20 bp, Artificial Sequence
  chemically synthesized
aagggtattgaagtagaatt

SEQ ID NO: 66637 - DNA, 20 bp, Artificial Sequence
  chemically synthesized
ttgatttcataaaaacggga

SEQ ID NO: 66638 - DNA, 20 bp, Artificial Sequence
  chemically synthesized
taagctgtctcacattttct

SEQ ID NO: 66639 - DNA, 20 bp, Artificial Sequence
  chemically synthesized
taatgatgggaatattattt

SEQ ID NO: 66640 - DNA, 20 bp, Artificial Sequence
  chemically synthesized
ttctctctgaactagcatat

SEQ ID NO: 66641 - DNA, 20 bp, Artificial Sequence
  chemically synthesized
cagttctttggacaagtctt

SEQ ID NO: 66642 - DNA, 20 bp, Artificial Sequence
  chemically synthesized
gcatcactgaagtagggagg

SEQ ID NO: 66643 - DNA, 20 bp, Artificial Sequence
  chemically synthesized
cttctgacccctagtggtgt

SEQ ID NO: 66644 - DNA, 20 bp, Artificial Sequence
  chemically synthesized
aataggaatgttttagttct

SEQ ID NO: 66645 - DNA, 20 bp, Artificial Sequence
  chemically synthesized
cagggaattattctgaaaag

SEQ ID NO: 66646 - DNA, 20 bp, Artificial Sequence
  chemically synthesized
tcagttttaatcagagggca

SEQ ID NO: 66647 - DNA, 20 bp, Artificial Sequence
  chemically synthesized
ggcatcagaaaagactcctg

SEQ ID NO: 66648 - DNA, 20 bp, Artificial Sequence
  chemically synthesized
gaagcctttgtagtcagtct

SEQ ID NO: 66649 - DNA, 20 bp, Artificial Sequence
  chemically synthesized
tttaacacatacctacattc

SEQ ID NO: 66650 - DNA, 20 bp, Artificial Sequence
  chemically synthesized
tctgagtcaggctggaaatg

SEQ ID NO: 66651 - DNA, 20 bp, Artificial Sequence
  chemically synthesized
actcaattggtggccaaagg

SEQ ID NO: 66652 - DNA, 20 bp, Artificial Sequence
  chemically synthesized
gattgtctagctcttatttc

SEQ ID NO: 66653 - DNA, 20 bp, Artificial Sequence
  chemically synthesized
gtaagttagttaagggggtt

SEQ ID NO: 66654 - DNA, 20 bp, Artificial Sequence
  chemically synthesized
aatctaggtggggagcagta

SEQ ID NO: 66655 - DNA, 20 bp, Artificial Sequence
  chemically synthesized
caaggctttttgactatgat

SEQ ID NO: 66656 - DNA, 20 bp, Artificial Sequence
  chemically synthesized
gtgtgatttagtagatgttt

SEQ ID NO: 66657 - DNA, 20 bp, Artificial Sequence
  chemically synthesized
ctatctgggatgtgtttctg

SEQ ID NO: 66658 - DNA, 20 bp, Artificial Sequence
  chemically synthesized
atgtgtttctggtagaaatg

SEQ ID NO: 66659 - DNA, 20 bp, Artificial Sequence
  chemically synthesized
gagaggaaagggaaggaaag

SEQ ID NO: 66660 - DNA, 20 bp, Artificial Sequence
  chemically synthesized
ggagtcactttataatatta

SEQ ID NO: 66661 - DNA, 20 bp, Artificial Sequence
  chemically synthesized
ataatattaggagaaaaggg

SEQ ID NO: 66662 - DNA, 20 bp, Artificial Sequence
  chemically synthesized
caaatgttagtttcaaataa

SEQ ID NO: 66663 - DNA, 20 bp, Artificial Sequence
  chemically synthesized
tagtctgcacattaaggaac

SEQ ID NO: 66664 - DNA, 20 bp, Artificial Sequence
  chemically synthesized
atatatggataaatttgtct

SEQ ID NO: 66665 - DNA, 20 bp, Artificial Sequence
  chemically synthesized
gatcgttttaaaaagggtag

SEQ ID NO: 66666 - DNA, 20 bp, Artificial Sequence
  chemically synthesized
tttaggcagatagaacattt

SEQ ID NO: 66667 - DNA, 20 bp, Artificial Sequence
  chemically synthesized
gagaaaaattttacgaaaga

SEQ ID NO: 66668 - DNA, 20 bp, Artificial Sequence
  chemically synthesized
aaagaagagaaattcgattt

SEQ ID NO: 66669 - DNA, 20 bp, Artificial Sequence
  chemically synthesized
aaagactgaaaaatcctctg

SEQ ID NO: 66670 - DNA, 20 bp, Artificial Sequence
  chemically synthesized
aaaaatcctctgcaagaaac

SEQ ID NO: 66671 - DNA, 20 bp, Artificial Sequence
  chemically synthesized
agaaacttcaagcattctat

SEQ ID NO: 66672 - DNA, 20 bp, Artificial Sequence
  chemically synthesized
atgctgagaaggagtcaggg

SEQ ID NO: 66673 - DNA, 20 bp, Artificial Sequence
  chemically synthesized
tagtatagagagtacattga

SEQ ID NO: 66674 - DNA, 20 bp, Artificial Sequence
  chemically synthesized
atctgtagaactgcaggttc

SEQ ID NO: 66675 - DNA, 20 bp, Artificial Sequence
  chemically synthesized
gtagaactgcaggttctaag

SEQ ID NO: 66676 - DNA, 20 bp, Artificial Sequence
  chemically synthesized
tcaagaggccagagctccag

SEQ ID NO: 66677 - DNA, 20 bp, Artificial Sequence
  chemically synthesized
cctgtctgcttatcaccaat

SEQ ID NO: 66678 - DNA, 20 bp, Artificial Sequence
  chemically synthesized
tggctacgtcatctggaggg

SEQ ID NO: 66679 - DNA, 20 bp, Artificial Sequence
  chemically synthesized
atcttcattaaatagtattt

SEQ ID NO: 66680 - DNA, 20 bp, Artificial Sequence
  chemically synthesized
aatgtttaatgaattggaga

SEQ ID NO: 66681 - DNA, 20 bp, Artificial Sequence
  chemically synthesized
ggcaatggatactatgtctc

SEQ ID NO: 66682 - DNA, 20 bp, Artificial Sequence
  chemically synthesized
ggatactatgtctcaaagaa

SEQ ID NO: 66683 - DNA, 20 bp, Artificial Sequence
  chemically synthesized
ttttagggtatttcatttac

SEQ ID NO: 66684 - DNA, 20 bp, Artificial Sequence
  chemically synthesized
ctctcacatgtttctcagtt

SEQ ID NO: 66685 - DNA, 20 bp, Artificial Sequence
  chemically synthesized
ttcctccatcctgactaatt

SEQ ID NO: 66686 - DNA, 20 bp, Artificial Sequence
  chemically synthesized
caagacccaacagattcata

SEQ ID NO: 66687 - DNA, 20 bp, Artificial Sequence
  chemically synthesized
tgagatgtattgcctaaaaa

SEQ ID NO: 66688 - DNA, 20 bp, Artificial Sequence
  chemically synthesized
atgtattgcctaaaaaaaag

SEQ ID NO: 66689 - DNA, 20 bp, Artificial Sequence
  chemically synthesized
acaaaaatcagtgccataaa

SEQ ID NO: 66690 - DNA, 20 bp, Artificial Sequence
  chemically synthesized
aaaaatatttaaatatagtc

SEQ ID NO: 66691 - DNA, 20 bp, Artificial Sequence
  chemically synthesized
tctatcagtctgaccatatt

SEQ ID NO: 66692 - DNA, 20 bp, Artificial Sequence
  chemically synthesized
ctaggttttcaagtttcaaa

SEQ ID NO: 66693 - DNA, 20 bp, Artificial Sequence
  chemically synthesized
tgttgtgatatctgtatgga

SEQ ID NO: 66694 - DNA, 20 bp, Artificial Sequence
  chemically synthesized
acagttcataaagaggacac

SEQ ID NO: 66695 - DNA, 20 bp, Artificial Sequence
  chemically synthesized
tctaccatgtctaatttaaa

SEQ ID NO: 66696 - DNA, 20 bp, Artificial Sequence
  chemically synthesized
accgacttattctgagttta

SEQ ID NO: 66697 - DNA, 20 bp, Artificial Sequence
  chemically synthesized
gtgcagctttccaaagaagg

SEQ ID NO: 66698 - DNA, 20 bp, Artificial Sequence
  chemically synthesized
acaaaactatgcatggataa

SEQ ID NO: 66699 - DNA, 20 bp, Artificial Sequence
  chemically synthesized
ggacagagtaaagtatctgg

SEQ ID NO: 66700 - DNA, 20 bp, Artificial Sequence
  chemically synthesized
ccgtctctactaaaaaaaca

SEQ ID NO: 66701 - DNA, 20 bp, Artificial Sequence
  chemically synthesized
gtactcgggaggctgagaca

SEQ ID NO: 66702 - DNA, 20 bp, Artificial Sequence
  chemically synthesized
tctcaaaaaaaaaaaaaaaa

SEQ ID NO: 66703 - DNA, 20 bp, Artificial Sequence
  chemically synthesized
aaaaaaaaaaagagaaaaaa

SEQ ID NO: 66704 - DNA, 20 bp, Artificial Sequence
  chemically synthesized
tgacacaacactggggaagc

SEQ ID NO: 66705 - DNA, 20 bp, Artificial Sequence
  chemically synthesized
cagccactcatagggaagca

SEQ ID NO: 66706 - DNA, 20 bp, Artificial Sequence
  chemically synthesized
tgcttcagattaggcaacct

SEQ ID NO: 66707 - DNA, 20 bp, Artificial Sequence
  chemically synthesized
aaaaatacctaagagtatcc

SEQ ID NO: 66708 - DNA, 20 bp, Artificial Sequence
  chemically synthesized
gataagatttatgaagaact

SEQ ID NO: 66709 - DNA, 20 bp, Artificial Sequence
  chemically synthesized
atatgattactgggctttat

SEQ ID NO: 66710 - DNA, 20 bp, Artificial Sequence
  chemically synthesized
gattactgggctttatacag

SEQ ID NO: 66711 - DNA, 20 bp, Artificial Sequence
  chemically synthesized
ataactaaacctctcctgag

SEQ ID NO: 66712 - DNA, 20 bp, Artificial Sequence
  chemically synthesized
aggctactatccagcgtcac

SEQ ID NO: 66713 - DNA, 20 bp, Artificial Sequence
  chemically synthesized
agtcacggttattataataa

SEQ ID NO: 66714 - DNA, 20 bp, Artificial Sequence
  chemically synthesized
caaggtgacaaaagtaagat

SEQ ID NO: 66715 - DNA, 20 bp, Artificial Sequence
  chemically synthesized
caaaagtaagattcagaaaa

SEQ ID NO: 66716 - DNA, 20 bp, Artificial Sequence
  chemically synthesized
cgaaaagctaaggtccagtg

SEQ ID NO: 66717 - DNA, 20 bp, Artificial Sequence
  chemically synthesized
tgagaggacatgattcagga

SEQ ID NO: 66718 - DNA, 20 bp, Artificial Sequence
  chemically synthesized
agatcccttgcatgcctcta

SEQ ID NO: 66719 - DNA, 20 bp, Artificial Sequence
  chemically synthesized
cattttcccagaagtctctt

SEQ ID NO: 66720 - DNA, 20 bp, Artificial Sequence
  chemically synthesized
ttggcaccatgtaatggcac

SEQ ID NO: 66721 - DNA, 20 bp, Artificial Sequence
  chemically synthesized
tgaataataaaatataaatt

SEQ ID NO: 66722 - DNA, 20 bp, Artificial Sequence
  chemically synthesized
gatgtacacagagacactgt

SEQ ID NO: 66723 - DNA, 20 bp, Artificial Sequence
  chemically synthesized
aatctgaaatctatatgtct

SEQ ID NO: 66724 - DNA, 20 bp, Artificial Sequence
  chemically synthesized
tctacagaaaaggataccaa

SEQ ID NO: 66725 - DNA, 20 bp, Artificial Sequence
  chemically synthesized
agagcattttctggaaaaac

SEQ ID NO: 66726 - DNA, 20 bp, Artificial Sequence
  chemically synthesized
gaggggtagggctaaaaatg

SEQ ID NO: 66727 - DNA, 20 bp, Artificial Sequence
  chemically synthesized
tgaaacagagagattatgca

SEQ ID NO: 66728 - DNA, 20 bp, Artificial Sequence
  chemically synthesized
aatgatgataaactgtctca

SEQ ID NO: 66729 - DNA, 20 bp, Artificial Sequence
  chemically synthesized
taactaattgtaccgtgttc

SEQ ID NO: 66730 - DNA, 20 bp, Artificial Sequence
  chemically synthesized
tcgtccttgcgatagtttac

SEQ ID NO: 66731 - DNA, 20 bp, Artificial Sequence
  chemically synthesized
catatttcatggtgaggaac

SEQ ID NO: 66732 - DNA, 20 bp, Artificial Sequence
  chemically synthesized
gaccgtgaacacaccagaag

SEQ ID NO: 66733 - DNA, 20 bp, Artificial Sequence
  chemically synthesized
tcctttgaacacaccatctt

SEQ ID NO: 66734 - DNA, 20 bp, Artificial Sequence
  chemically synthesized
ccaacacaaaaattacatac

SEQ ID NO: 66735 - DNA, 20 bp, Artificial Sequence
  chemically synthesized
tacctagaatcaattttaat

SEQ ID NO: 66736 - DNA, 20 bp, Artificial Sequence
  chemically synthesized
tggagcacagcttattcagg

SEQ ID NO: 66737 - DNA, 20 bp, Artificial Sequence
  chemically synthesized
tttagatccttgatatttga

SEQ ID NO: 66738 - DNA, 20 bp, Artificial Sequence
  chemically synthesized
caggaagtagatttaagagt

SEQ ID NO: 66739 - DNA, 20 bp, Artificial Sequence
  chemically synthesized
taaaaattcatggtaagtta

SEQ ID NO: 66740 - DNA, 20 bp, Artificial Sequence
  chemically synthesized
tactcagtaacacatgtcat

SEQ ID NO: 66741 - DNA, 20 bp, Artificial Sequence
  chemically synthesized
tcacttattgcttgtaggga

SEQ ID NO: 66742 - DNA, 20 bp, Artificial Sequence
  chemically synthesized
aactgtggaacatccatagg

SEQ ID NO: 66743 - DNA, 20 bp, Artificial Sequence
  chemically synthesized
aacctattttatcttgctgt

SEQ ID NO: 66744 - DNA, 20 bp, Artificial Sequence
  chemically synthesized
tagtttcagacagctattgc

SEQ ID NO: 66745 - DNA, 20 bp, Artificial Sequence
  chemically synthesized
ttgagtatcaaaggaaggaa

SEQ ID NO: 66746 - DNA, 20 bp, Artificial Sequence
  chemically synthesized
ctcagcttctagggagacct

SEQ ID NO: 66747 - DNA, 20 bp, Artificial Sequence
  chemically synthesized
acaaattcccattccaaaag

SEQ ID NO: 66748 - DNA, 20 bp, Artificial Sequence
  chemically synthesized
caaaagagagaaatgcacca

SEQ ID NO: 66749 - DNA, 20 bp, Artificial Sequence
  chemically synthesized
gggctaaagatcccacacga

SEQ ID NO: 66750 - DNA, 20 bp, Artificial Sequence
  chemically synthesized
catcttgaacaccttgctgc

SEQ ID NO: 66751 - DNA, 20 bp, Artificial Sequence
  chemically synthesized
cttcattgtccatatcacta

SEQ ID NO: 66752 - DNA, 20 bp, Artificial Sequence
  chemically synthesized
cacaaccattccacaagtct

SEQ ID NO: 66753 - DNA, 20 bp, Artificial Sequence
  chemically synthesized
gaaacttataatcatggcag

SEQ ID NO: 66754 - DNA, 20 bp, Artificial Sequence
  chemically synthesized
gtcctggtgtatccttcctt

SEQ ID NO: 66755 - DNA, 20 bp, Artificial Sequence
  chemically synthesized
caaatattgattccaaccac

SEQ ID NO: 66756 - DNA, 20 bp, Artificial Sequence
  chemically synthesized
cataaaatctcataatgttt

SEQ ID NO: 66757 - DNA, 20 bp, Artificial Sequence
  chemically synthesized
ctctacagcctacaaacaag

SEQ ID NO: 66758 - DNA, 20 bp, Artificial Sequence
  chemically synthesized
ctttactaacttacaaatga

SEQ ID NO: 66759 - DNA, 20 bp, Artificial Sequence
  chemically synthesized
ttatgccaaattacttgttc

SEQ ID NO: 66760 - DNA, 20 bp, Artificial Sequence
  chemically synthesized
tatccatttccttgaaatcc

SEQ ID NO: 66761 - DNA, 20 bp, Artificial Sequence
  chemically synthesized
atttctgacatgaacttatg

SEQ ID NO: 66762 - DNA, 20 bp, Artificial Sequence
  chemically synthesized
tcaaagactgtagacttcta

SEQ ID NO: 66763 - DNA, 20 bp, Artificial Sequence
  chemically synthesized
ataactattatttcatctgc

SEQ ID NO: 66764 - DNA, 20 bp, Artificial Sequence
  chemically synthesized
cctcttgcatattatattta

SEQ ID NO: 66765 - DNA, 20 bp, Artificial Sequence
  chemically synthesized
tagggattctttgaaaaata

SEQ ID NO: 66766 - DNA, 20 bp, Artificial Sequence
  chemically synthesized
tatatggaaggctccacttg

SEQ ID NO: 66767 - DNA, 20 bp, Artificial Sequence
  chemically synthesized
cctcattaaagtatccttca

SEQ ID NO: 66768 - DNA, 20 bp, Artificial Sequence
  chemically synthesized
tgacccatttaccatgtgac

SEQ ID NO: 66769 - DNA, 20 bp, Artificial Sequence
  chemically synthesized
aattaaagggaaataaaatg

SEQ ID NO: 66770 - DNA, 20 bp, Artificial Sequence
  chemically synthesized
ggtgtcagagagtggtggct

SEQ ID NO: 66771 - DNA, 20 bp, Artificial Sequence
  chemically synthesized
aatgcacaaattataatgaa

SEQ ID NO: 66772 - DNA, 20 bp, Artificial Sequence
  chemically synthesized
tgctaaatatcttcaggatt

SEQ ID NO: 66773 - DNA, 20 bp, Artificial Sequence
  chemically synthesized
gttatgctcaatgaaaactt

SEQ ID NO: 66774 - DNA, 20 bp, Artificial Sequence
  chemically synthesized
aaaacttgtagaaaataaca

SEQ ID NO: 66775 - DNA, 20 bp, Artificial Sequence
  chemically synthesized
aacaccagaaaaaaaaaagg

SEQ ID NO: 66776 - DNA, 20 bp, Artificial Sequence
  chemically synthesized
attaagtaagtcattttcaa

SEQ ID NO: 66777 - DNA, 20 bp, Artificial Sequence
  chemically synthesized
aagaatattttagttttctc

SEQ ID NO: 66778 - DNA, 20 bp, Artificial Sequence
  chemically synthesized
ttgataccatgtgcccagta

SEQ ID NO: 66779 - DNA, 20 bp, Artificial Sequence
  chemically synthesized
accttcctaagacactgact

SEQ ID NO: 66780 - DNA, 20 bp, Artificial Sequence
  chemically synthesized
acgtgtccagggtcatagag

SEQ ID NO: 66781 - DNA, 20 bp, Artificial Sequence
  chemically synthesized
tggatacattcatgattcag

SEQ ID NO: 66782 - DNA, 20 bp, Artificial Sequence
  chemically synthesized
gattcagtcagaatatgctg

SEQ ID NO: 66783 - DNA, 20 bp, Artificial Sequence
  chemically synthesized
aatatgctgtcagaaatatc

SEQ ID NO: 66784 - DNA, 20 bp, Artificial Sequence
  chemically synthesized
ataggtatcacaaaagatca

SEQ ID NO: 66785 - DNA, 20 bp, Artificial Sequence
  chemically synthesized
caccagaaaaaatttaaagg

SEQ ID NO: 66786 - DNA, 20 bp, Artificial Sequence
  chemically synthesized
ccatcatataaaatttgaga

SEQ ID NO: 66787 - DNA, 20 bp, Artificial Sequence
  chemically synthesized
aactttagccagcttttact

SEQ ID NO: 66788 - DNA, 20 bp, Artificial Sequence
  chemically synthesized
taggtgtggtgtggtgctga

SEQ ID NO: 66789 - DNA, 20 bp, Artificial Sequence
  chemically synthesized
ttaaggttaatattgttatg

SEQ ID NO: 66790 - DNA, 20 bp, Artificial Sequence
  chemically synthesized
ttctgaaactattccaatca

SEQ ID NO: 66791 - DNA, 20 bp, Artificial Sequence
  chemically synthesized
agcagacacacaacaaaaaa

SEQ ID NO: 66792 - DNA, 20 bp, Artificial Sequence
  chemically synthesized
acatgattatctcaatagat

SEQ ID NO: 66793 - DNA, 20 bp, Artificial Sequence
  chemically synthesized
ctggccagggcaatcaggca

SEQ ID NO: 66794 - DNA, 20 bp, Artificial Sequence
  chemically synthesized
ccagggcaatcaggcaagag

SEQ ID NO: 66795 - DNA, 20 bp, Artificial Sequence
  chemically synthesized
cagatgacgtgattgtatat

SEQ ID NO: 66796 - DNA, 20 bp, Artificial Sequence
  chemically synthesized
ccttaagctgataagcaact

SEQ ID NO: 66797 - DNA, 20 bp, Artificial Sequence
  chemically synthesized
cccattcacaattgcctcaa

SEQ ID NO: 66798 - DNA, 20 bp, Artificial Sequence
  chemically synthesized
cattccatgctcatggatag

SEQ ID NO: 66799 - DNA, 20 bp, Artificial Sequence
  chemically synthesized
agctaccaatgactttcttc

SEQ ID NO: 66800 - DNA, 20 bp, Artificial Sequence
  chemically synthesized
aatggagcagaacagagctc

SEQ ID NO: 66801 - DNA, 20 bp, Artificial Sequence
  chemically synthesized
ggaaaactggctagccatat

SEQ ID NO: 66802 - DNA, 20 bp, Artificial Sequence
  chemically synthesized
ctaaaaccataaaaacctta

SEQ ID NO: 66803 - DNA, 20 bp, Artificial Sequence
  chemically synthesized
taaagagcttctgcacagca

SEQ ID NO: 66804 - DNA, 20 bp, Artificial Sequence
  chemically synthesized
aacaggcaacctacacaatg

SEQ ID NO: 66805 - DNA, 20 bp, Artificial Sequence
  chemically synthesized
atctgacaaagggctaatat

SEQ ID NO: 66806 - DNA, 20 bp, Artificial Sequence
  chemically synthesized
aatgaactcaaacaaattta

SEQ ID NO: 66807 - DNA, 20 bp, Artificial Sequence
  chemically synthesized
gctcatcatcactggccatc

SEQ ID NO: 66808 - DNA, 20 bp, Artificial Sequence
  chemically synthesized
gagatatcatctcacaccag

SEQ ID NO: 66809 - DNA, 20 bp, Artificial Sequence
  chemically synthesized
acaggtgctggagaggatgt

SEQ ID NO: 66810 - DNA, 20 bp, Artificial Sequence
  chemically synthesized
aattcctcagggatctagaa

SEQ ID NO: 66811 - DNA, 20 bp, Artificial Sequence
  chemically synthesized
ccaacaatgatagactggat

SEQ ID NO: 66812 - DNA, 20 bp, Artificial Sequence
  chemically synthesized
tcaatcagtgactgaagtgg

SEQ ID NO: 66813 - DNA, 20 bp, Artificial Sequence
  chemically synthesized
aatgttttatcctatatttt

SEQ ID NO: 66814 - DNA, 20 bp, Artificial Sequence
  chemically synthesized
tgtgggttttttttacatct

SEQ ID NO: 66815 - DNA, 20 bp, Artificial Sequence
  chemically synthesized
ttttactctcctttcccaga

SEQ ID NO: 66816 - DNA, 20 bp, Artificial Sequence
  chemically synthesized
cccagagaagaaaacattgg

SEQ ID NO: 66817 - DNA, 20 bp, Artificial Sequence
  chemically synthesized
tcatacatttcatctttgtg

SEQ ID NO: 66818 - DNA, 20 bp, Artificial Sequence
  chemically synthesized
ataccgacttacatattgtg

SEQ ID NO: 66819 - DNA, 20 bp, Artificial Sequence
  chemically synthesized
taaaaagtctgttttaggga

SEQ ID NO: 66820 - DNA, 20 bp, Artificial Sequence
  chemically synthesized
gaatagaataaatacaatcc

SEQ ID NO: 66821 - DNA, 20 bp, Artificial Sequence
  chemically synthesized
taatgaaattctccattttt

SEQ ID NO: 66822 - DNA, 20 bp, Artificial Sequence
  chemically synthesized
taaaaatatataaagataat

SEQ ID NO: 66823 - DNA, 20 bp, Artificial Sequence
  chemically synthesized
atataaagataatcgagaaa

SEQ ID NO: 66824 - DNA, 20 bp, Artificial Sequence
  chemically synthesized
cttaagttaaaatgttatcc

SEQ ID NO: 66825 - DNA, 20 bp, Artificial Sequence
  chemically synthesized
aatggagcatcatggcatca
